United States Patent 7,250,289 (METHODS OF GENETIC ANALYSIS OF MOUSE) - sequence listing, part 12

SEQ ID NO: 442891 - DNA, 25 bp, Mus musculus
gaatttgtgagcgagttctacaggg

SEQ ID NO: 442892 - DNA, 25 bp, Mus musculus
gaatttgtgcacctgagagttcctg

SEQ ID NO: 442893 - DNA, 25 bp, Mus musculus
gaatttgtgcacgtgagagttcctg

SEQ ID NO: 442894 - DNA, 25 bp, Mus musculus
gaatttgtgcatatgtggagatcag

SEQ ID NO: 442895 - DNA, 25 bp, Mus musculus
gaatttgtgcatttgtggagatcag

SEQ ID NO: 442896 - DNA, 25 bp, Mus musculus
gaatttgtgcctccacactaggaag

SEQ ID NO: 442897 - DNA, 25 bp, Mus musculus
gaatttgtgcctgcacactaggaag

SEQ ID NO: 442898 - DNA, 25 bp, Mus musculus
gaatttgtgcttctgaagacccgga

SEQ ID NO: 442899 - DNA, 25 bp, Mus musculus
gaatttgtgcttgtgaagacccgga

SEQ ID NO: 442900 - DNA, 25 bp, Mus musculus
gaatttgtggcaatgtgggcttggg

SEQ ID NO: 442901 - DNA, 25 bp, Mus musculus
gaatttgtggcattgtgggcttggg

SEQ ID NO: 442902 - DNA, 25 bp, Mus musculus
gaatttgtggttcttactgagacag

SEQ ID NO: 442903 - DNA, 25 bp, Mus musculus
gaatttgtggttgttactgagacag

SEQ ID NO: 442904 - DNA, 25 bp, Mus musculus
gaatttgtgtatctgctttgtaata

SEQ ID NO: 442905 - DNA, 25 bp, Mus musculus
gaatttgtgtatgtgctttgtaata

SEQ ID NO: 442906 - DNA, 25 bp, Mus musculus
gaatttgtgtgaacctttgaaacta

SEQ ID NO: 442907 - DNA, 25 bp, Mus musculus
gaatttgtgtgatcctttgaaacta

SEQ ID NO: 442908 - DNA, 25 bp, Mus musculus
gaatttgtgtgtcctgccattaaaa

SEQ ID NO: 442909 - DNA, 25 bp, Mus musculus
gaatttgtgtgtgctgccattaaaa

SEQ ID NO: 442910 - DNA, 25 bp, Mus musculus
gaatttgtgttaattgtaccctcta

SEQ ID NO: 442911 - DNA, 25 bp, Mus musculus
gaatttgtgttatttgtaccctcta

SEQ ID NO: 442912 - DNA, 25 bp, Mus musculus
gaatttgtgttgatcaatgctcagg

SEQ ID NO: 442913 - DNA, 25 bp, Mus musculus
gaatttgtgttgttcaatgctcagg

SEQ ID NO: 442914 - DNA, 25 bp, Mus musculus
gaatttgttatacactcggtcagtt

SEQ ID NO: 442915 - DNA, 25 bp, Mus musculus
gaatttgttatagactcggtcagtt

SEQ ID NO: 442916 - DNA, 25 bp, Mus musculus
gaatttgttcaactcactcatcaca

SEQ ID NO: 442917 - DNA, 25 bp, Mus musculus
gaatttgttcaagtcactcatcaca

SEQ ID NO: 442918 - DNA, 25 bp, Mus musculus
gaatttgttcctcatgtgtgtttgt

SEQ ID NO: 442919 - DNA, 25 bp, Mus musculus
gaatttgttcctgatgtgtgtttgt

SEQ ID NO: 442920 - DNA, 25 bp, Mus musculus
gaatttgttcgccactgtatccaga

SEQ ID NO: 442921 - DNA, 25 bp, Mus musculus
gaatttgttcgcgactgtatccaga

SEQ ID NO: 442922 - DNA, 25 bp, Mus musculus
gaatttgttgcgcacgtcattgagc

SEQ ID NO: 442923 - DNA, 25 bp, Mus musculus
gaatttgttgcggacgtcattgagc

SEQ ID NO: 442924 - DNA, 25 bp, Mus musculus
gaatttgttggcaggaaacactata

SEQ ID NO: 442925 - DNA, 25 bp, Mus musculus
gaatttgttggctggaaacactata

SEQ ID NO: 442926 - DNA, 25 bp, Mus musculus
gaatttgtttgacggcattttcttc

SEQ ID NO: 442927 - DNA, 25 bp, Mus musculus
gaatttgtttgagggcattttcttc

SEQ ID NO: 442928 - DNA, 25 bp, Mus musculus
gaatttgttttgatggagtgtataa

SEQ ID NO: 442929 - DNA, 25 bp, Mus musculus
gaatttgttttgttggagtgtataa

SEQ ID NO: 442930 - DNA, 25 bp, Mus musculus
gaattttaaacactactcacagagt

SEQ ID NO: 442931 - DNA, 25 bp, Mus musculus
gaattttaaacagtactcacagagt

SEQ ID NO: 442932 - DNA, 25 bp, Mus musculus
gaattttaacccaccaggcttcaca

SEQ ID NO: 442933 - DNA, 25 bp, Mus musculus
gaattttaaccctccaggcttcaca

SEQ ID NO: 442934 - DNA, 25 bp, Mus musculus
gaattttaatgcactgaagggacca

SEQ ID NO: 442935 - DNA, 25 bp, Mus musculus
gaattttaatgctctgaagggacca

SEQ ID NO: 442936 - DNA, 25 bp, Mus musculus
gaattttacaccagctgaaggctta

SEQ ID NO: 442937 - DNA, 25 bp, Mus musculus
gaattttacacctgctgaaggctta

SEQ ID NO: 442938 - DNA, 25 bp, Mus musculus
gaattttacagactctagctctata

SEQ ID NO: 442939 - DNA, 25 bp, Mus musculus
gaattttacagagtctagctctata

SEQ ID NO: 442940 - DNA, 25 bp, Mus musculus
gaattttacatcaacctactggtta

SEQ ID NO: 442941 - DNA, 25 bp, Mus musculus
gaattttacatctacctactggtta

SEQ ID NO: 442942 - DNA, 25 bp, Mus musculus
gaattttaccagacttcaagagcat

SEQ ID NO: 442943 - DNA, 25 bp, Mus musculus
gaattttaccagtcttcaagagcat

SEQ ID NO: 442944 - DNA, 25 bp, Mus musculus
gaattttagcttctaatactagtgg

SEQ ID NO: 442945 - DNA, 25 bp, Mus musculus
gaattttagcttgtaatactagtgg

SEQ ID NO: 442946 - DNA, 25 bp, Mus musculus
gaattttatacacaaccaacccagg

SEQ ID NO: 442947 - DNA, 25 bp, Mus musculus
gaattttatacagaaccaacccagg

SEQ ID NO: 442948 - DNA, 25 bp, Mus musculus
gaattttataccctgatgttacaga

SEQ ID NO: 442949 - DNA, 25 bp, Mus musculus
gaattttataccgtgatgttacaga

SEQ ID NO: 442950 - DNA, 25 bp, Mus musculus
gaattttatcatagtcagaagcagg

SEQ ID NO: 442951 - DNA, 25 bp, Mus musculus
gaattttatcattgtcagaagcagg

SEQ ID NO: 442952 - DNA, 25 bp, Mus musculus
gaattttatccaacacaacctacag

SEQ ID NO: 442953 - DNA, 25 bp, Mus musculus
gaattttatccatcacaacctacag

SEQ ID NO: 442954 - DNA, 25 bp, Mus musculus
gaattttatgcacctacttcaaatg

SEQ ID NO: 442955 - DNA, 25 bp, Mus musculus
gaattttatgcagctacttcaaatg

SEQ ID NO: 442956 - DNA, 25 bp, Mus musculus
gaattttatgtgagtctctacctgt

SEQ ID NO: 442957 - DNA, 25 bp, Mus musculus
gaattttatgtgtgtctctacctgt

SEQ ID NO: 442958 - DNA, 25 bp, Mus musculus
gaattttattcacgctcgttcccta

SEQ ID NO: 442959 - DNA, 25 bp, Mus musculus
gaattttattcaggctcgttcccta

SEQ ID NO: 442960 - DNA, 25 bp, Mus musculus
gaattttcaactcctagcaaagcca

SEQ ID NO: 442961 - DNA, 25 bp, Mus musculus
gaattttcaactgctagcaaagcca

SEQ ID NO: 442962 - DNA, 25 bp, Mus musculus
gaattttcacacactttacatgtta

SEQ ID NO: 442963 - DNA, 25 bp, Mus musculus
gaattttcacactctttacatgtta

SEQ ID NO: 442964 - DNA, 25 bp, Mus musculus
gaattttcacatcctgggcggcgtt

SEQ ID NO: 442965 - DNA, 25 bp, Mus musculus
gaattttcacatgctgggcggcgtt

SEQ ID NO: 442966 - DNA, 25 bp, Mus musculus
gaattttcactaatgagcctcgata

SEQ ID NO: 442967 - DNA, 25 bp, Mus musculus
gaattttcactattgagcctcgata

SEQ ID NO: 442968 - DNA, 25 bp, Mus musculus
gaattttcagaccacttcttctttg

SEQ ID NO: 442969 - DNA, 25 bp, Mus musculus
gaattttcagacgacttcttctttg

SEQ ID NO: 442970 - DNA, 25 bp, Mus musculus
gaattttcagccctatcttaatcac

SEQ ID NO: 442971 - DNA, 25 bp, Mus musculus
gaattttcagccgtatcttaatcac

SEQ ID NO: 442972 - DNA, 25 bp, Mus musculus
gaattttcagctagtttcgtataaa

SEQ ID NO: 442973 - DNA, 25 bp, Mus musculus
gaattttcagcttgtttcgtataaa

SEQ ID NO: 442974 - DNA, 25 bp, Mus musculus
gaattttcagtgcacctggatcagt

SEQ ID NO: 442975 - DNA, 25 bp, Mus musculus
gaattttcagtggacctggatcagt

SEQ ID NO: 442976 - DNA, 25 bp, Mus musculus
gaattttcatcccaaggctcagctg

SEQ ID NO: 442977 - DNA, 25 bp, Mus musculus
gaattttcatccgaaggctcagctg

SEQ ID NO: 442978 - DNA, 25 bp, Mus musculus
gaattttcatctctatgtctgcctc

SEQ ID NO: 442979 - DNA, 25 bp, Mus musculus
gaattttcatctgtatgtctgcctc

SEQ ID NO: 442980 - DNA, 25 bp, Mus musculus
gaattttccaaacatcagtccatcc

SEQ ID NO: 442981 - DNA, 25 bp, Mus musculus
gaattttccaaagatcagtccatcc

SEQ ID NO: 442982 - DNA, 25 bp, Mus musculus
gaattttccagtagtcattctctac

SEQ ID NO: 442983 - DNA, 25 bp, Mus musculus
gaattttccagttgtcattctctac

SEQ ID NO: 442984 - DNA, 25 bp, Mus musculus
gaattttccctcagtacaagcaaag

SEQ ID NO: 442985 - DNA, 25 bp, Mus musculus
gaattttccctctgtacaagcaaag

SEQ ID NO: 442986 - DNA, 25 bp, Mus musculus
gaattttcccttccaaataaatagc

SEQ ID NO: 442987 - DNA, 25 bp, Mus musculus
gaattttcccttgcaaataaatagc

SEQ ID NO: 442988 - DNA, 25 bp, Mus musculus
gaattttccggcaacaaggttctcg

SEQ ID NO: 442989 - DNA, 25 bp, Mus musculus
gaattttccggctacaaggttctcg

SEQ ID NO: 442990 - DNA, 25 bp, Mus musculus
gaattttcctacctttgctggcttg

SEQ ID NO: 442991 - DNA, 25 bp, Mus musculus
gaattttcctacgtttgctggcttg

SEQ ID NO: 442992 - DNA, 25 bp, Mus musculus
gaattttcctgacatgtgtgtcttt

SEQ ID NO: 442993 - DNA, 25 bp, Mus musculus
gaattttcctgagatgtgtgtcttt

SEQ ID NO: 442994 - DNA, 25 bp, Mus musculus
gaattttcctttcccaagatccact

SEQ ID NO: 442995 - DNA, 25 bp, Mus musculus
gaattttcctttgccaagatccact

SEQ ID NO: 442996 - DNA, 25 bp, Mus musculus
gaattttcgttcaggtctctgtgct

SEQ ID NO: 442997 - DNA, 25 bp, Mus musculus
gaattttcgttctggtctctgtgct

SEQ ID NO: 442998 - DNA, 25 bp, Mus musculus
gaattttctactcgtctcaaactct

SEQ ID NO: 442999 - DNA, 25 bp, Mus musculus
gaattttctactggtctcaaactct

SEQ ID NO: 443000 - DNA, 25 bp, Mus musculus
gaattttctcagatatacctcatag

SEQ ID NO: 443001 - DNA, 25 bp, Mus musculus
gaattttctcagttatacctcatag

SEQ ID NO: 443002 - DNA, 25 bp, Mus musculus
gaattttctcatatgtataatggag

SEQ ID NO: 443003 - DNA, 25 bp, Mus musculus
gaattttctcatcctcagtcagatt

SEQ ID NO: 443004 - DNA, 25 bp, Mus musculus
gaattttctcatgctcagtcagatt

SEQ ID NO: 443005 - DNA, 25 bp, Mus musculus
gaattttctcatttgtataatggag

SEQ ID NO: 443006 - DNA, 25 bp, Mus musculus
gaattttctccccccagagttggtg

SEQ ID NO: 443007 - DNA, 25 bp, Mus musculus
gaattttctcccgccagagttggtg

SEQ ID NO: 443008 - DNA, 25 bp, Mus musculus
gaattttctctaatcctggtcaggg

SEQ ID NO: 443009 - DNA, 25 bp, Mus musculus
gaattttctctattcctggtcaggg

SEQ ID NO: 443010 - DNA, 25 bp, Mus musculus
gaattttctgcacttaacagtaccg

SEQ ID NO: 443011 - DNA, 25 bp, Mus musculus
gaattttctgcagttaacagtaccg

SEQ ID NO: 443012 - DNA, 25 bp, Mus musculus
gaattttctgccatcttcaccagtg

SEQ ID NO: 443013 - DNA, 25 bp, Mus musculus
gaattttctgccttcttcaccagtg

SEQ ID NO: 443014 - DNA, 25 bp, Mus musculus
gaattttctgtgatcattcactctt

SEQ ID NO: 443015 - DNA, 25 bp, Mus musculus
gaattttctgtgttcattcactctt

SEQ ID NO: 443016 - DNA, 25 bp, Mus musculus
gaattttcttaacacacatttgtcg

SEQ ID NO: 443017 - DNA, 25 bp, Mus musculus
gaattttcttaagacacatttgtcg

SEQ ID NO: 443018 - DNA, 25 bp, Mus musculus
gaattttcttacactgccctttcat

SEQ ID NO: 443019 - DNA, 25 bp, Mus musculus
gaattttcttactctgccctttcat

SEQ ID NO: 443020 - DNA, 25 bp, Mus musculus
gaattttcttggattgtctctcaca

SEQ ID NO: 443021 - DNA, 25 bp, Mus musculus
gaattttcttggctcctatgacgca

SEQ ID NO: 443022 - DNA, 25 bp, Mus musculus
gaattttcttgggtcctatgacgca

SEQ ID NO: 443023 - DNA, 25 bp, Mus musculus
gaattttcttggtttgtctctcaca

SEQ ID NO: 443024 - DNA, 25 bp, Mus musculus
gaattttcttttccccacattcaga

SEQ ID NO: 443025 - DNA, 25 bp, Mus musculus
gaattttcttttgcccacattcaga

SEQ ID NO: 443026 - DNA, 25 bp, Mus musculus
gaattttgaccgaccactgtgaact

SEQ ID NO: 443027 - DNA, 25 bp, Mus musculus
gaattttgaccgtccactgtgaact

SEQ ID NO: 443028 - DNA, 25 bp, Mus musculus
gaattttgatcccatctgaagcccc

SEQ ID NO: 443029 - DNA, 25 bp, Mus musculus
gaattttgatccgatctgaagcccc

SEQ ID NO: 443030 - DNA, 25 bp, Mus musculus
gaattttgcagccagttctctcttt

SEQ ID NO: 443031 - DNA, 25 bp, Mus musculus
gaattttgcagcgagttctctcttt

SEQ ID NO: 443032 - DNA, 25 bp, Mus musculus
gaattttgcatgcttcttgtgaata

SEQ ID NO: 443033 - DNA, 25 bp, Mus musculus
gaattttgcatggttcttgtgaata

SEQ ID NO: 443034 - DNA, 25 bp, Mus musculus
gaattttgcattcctgactcttgca

SEQ ID NO: 443035 - DNA, 25 bp, Mus musculus
gaattttgcattgctgactcttgca

SEQ ID NO: 443036 - DNA, 25 bp, Mus musculus
gaattttgccaaaaatctgttaatg

SEQ ID NO: 443037 - DNA, 25 bp, Mus musculus
gaattttgccaataatctgttaatg

SEQ ID NO: 443038 - DNA, 25 bp, Mus musculus
gaattttgcctaattccatgcattt

SEQ ID NO: 443039 - DNA, 25 bp, Mus musculus
gaattttgcctatttccatgcattt

SEQ ID NO: 443040 - DNA, 25 bp, Mus musculus
gaattttgccttatatcttttcact

SEQ ID NO: 443041 - DNA, 25 bp, Mus musculus
gaattttgccttttatcttttcact

SEQ ID NO: 443042 - DNA, 25 bp, Mus musculus
gaattttgctggcacagctctgtgt

SEQ ID NO: 443043 - DNA, 25 bp, Mus musculus
gaattttgctgggacagctctgtgt

SEQ ID NO: 443044 - DNA, 25 bp, Mus musculus
gaattttgcttgagattgccaacat

SEQ ID NO: 443045 - DNA, 25 bp, Mus musculus
gaattttgcttgtgattgccaacat

SEQ ID NO: 443046 - DNA, 25 bp, Mus musculus
gaattttggaaactccggcatcaga

SEQ ID NO: 443047 - DNA, 25 bp, Mus musculus
gaattttggaaagtccggcatcaga

SEQ ID NO: 443048 - DNA, 25 bp, Mus musculus
gaattttggctgacaccggtagaaa

SEQ ID NO: 443049 - DNA, 25 bp, Mus musculus
gaattttggctgctgtaacaaagac

SEQ ID NO: 443050 - DNA, 25 bp, Mus musculus
gaattttggctggtgtaacaaagac

SEQ ID NO: 443051 - DNA, 25 bp, Mus musculus
gaattttggctgtcaccggtagaaa

SEQ ID NO: 443052 - DNA, 25 bp, Mus musculus
gaattttggcttcctctattttcgg

SEQ ID NO: 443053 - DNA, 25 bp, Mus musculus
gaattttggcttgctctattttcgg

SEQ ID NO: 443054 - DNA, 25 bp, Mus musculus
gaattttggtagactgattgctgct

SEQ ID NO: 443055 - DNA, 25 bp, Mus musculus
gaattttggtagtctgattgctgct

SEQ ID NO: 443056 - DNA, 25 bp, Mus musculus
gaattttgtaacacttccacggaca

SEQ ID NO: 443057 - DNA, 25 bp, Mus musculus
gaattttgtaactcttccacggaca

SEQ ID NO: 443058 - DNA, 25 bp, Mus musculus
gaattttgtactaatcttcccatca

SEQ ID NO: 443059 - DNA, 25 bp, Mus musculus
gaattttgtacttatcttcccatca

SEQ ID NO: 443060 - DNA, 25 bp, Mus musculus
gaattttgtccaacattacggagag

SEQ ID NO: 443061 - DNA, 25 bp, Mus musculus
gaattttgtccatcattacggagag

SEQ ID NO: 443062 - DNA, 25 bp, Mus musculus
gaattttgtgagcttctatactgat

SEQ ID NO: 443063 - DNA, 25 bp, Mus musculus
gaattttgtgaggttctatactgat

SEQ ID NO: 443064 - DNA, 25 bp, Mus musculus
gaattttgtgctcccgtaactatgg

SEQ ID NO: 443065 - DNA, 25 bp, Mus musculus
gaattttgtgctgccgtaactatgg

SEQ ID NO: 443066 - DNA, 25 bp, Mus musculus
gaattttgtgtaagttgatctgaac

SEQ ID NO: 443067 - DNA, 25 bp, Mus musculus
gaattttgtgtatgttgatctgaac

SEQ ID NO: 443068 - DNA, 25 bp, Mus musculus
gaattttgttgtagttttgctgatt

SEQ ID NO: 443069 - DNA, 25 bp, Mus musculus
gaattttgttgttgttttgctgatt

SEQ ID NO: 443070 - DNA, 25 bp, Mus musculus
gaattttgtttgactgtaacctgct

SEQ ID NO: 443071 - DNA, 25 bp, Mus musculus
gaattttgtttgtctgtaacctgct

SEQ ID NO: 443072 - DNA, 25 bp, Mus musculus
gaatttttattcatagcatgttagg

SEQ ID NO: 443073 - DNA, 25 bp, Mus musculus
gaatttttattcttagcatgttagg

SEQ ID NO: 443074 - DNA, 25 bp, Mus musculus
gaatttttcaacctcagtctcagtg

SEQ ID NO: 443075 - DNA, 25 bp, Mus musculus
gaatttttcaacgtcagtctcagtg

SEQ ID NO: 443076 - DNA, 25 bp, Mus musculus
gaatttttcagaaagtgtcccacag

SEQ ID NO: 443077 - DNA, 25 bp, Mus musculus
gaatttttcagatagtgtcccacag

SEQ ID NO: 443078 - DNA, 25 bp, Mus musculus
gaatttttcagtcagcctggtcagc

SEQ ID NO: 443079 - DNA, 25 bp, Mus musculus
gaatttttcagtgagcctggtcagc

SEQ ID NO: 443080 - DNA, 25 bp, Mus musculus
gaatttttcatgaaccagagactat

SEQ ID NO: 443081 - DNA, 25 bp, Mus musculus
gaatttttcatgtaccagagactat

SEQ ID NO: 443082 - DNA, 25 bp, Mus musculus
gaatttttccagactattgagatag

SEQ ID NO: 443083 - DNA, 25 bp, Mus musculus
gaatttttccagtctattgagatag

SEQ ID NO: 443084 - DNA, 25 bp, Mus musculus
gaatttttccttctcaagagctctt

SEQ ID NO: 443085 - DNA, 25 bp, Mus musculus
gaatttttccttgtcaagagctctt

SEQ ID NO: 443086 - DNA, 25 bp, Mus musculus
gaatttttcttaagttcccttctat

SEQ ID NO: 443087 - DNA, 25 bp, Mus musculus
gaatttttcttatgttcccttctat

SEQ ID NO: 443088 - DNA, 25 bp, Mus musculus
gaatttttgcacattgtatagccag

SEQ ID NO: 443089 - DNA, 25 bp, Mus musculus
gaatttttgcactttgtatagccag

SEQ ID NO: 443090 - DNA, 25 bp, Mus musculus
gaatttttgtatacatacttctcaa

SEQ ID NO: 443091 - DNA, 25 bp, Mus musculus
gaatttttgtattcatacttctcaa

SEQ ID NO: 443092 - DNA, 25 bp, Mus musculus
gaatttttgtccaatggctctcatt

SEQ ID NO: 443093 - DNA, 25 bp, Mus musculus
gaatttttgtcctatggctctcatt

SEQ ID NO: 443094 - DNA, 25 bp, Mus musculus
gaatttttgttcattacatactatt

SEQ ID NO: 443095 - DNA, 25 bp, Mus musculus
gaatttttgttctttacatactatt

SEQ ID NO: 443096 - DNA, 25 bp, Mus musculus
gaatttttgtttaggcactcaggat

SEQ ID NO: 443097 - DNA, 25 bp, Mus musculus
gaatttttgtttcctgaatgactgg

SEQ ID NO: 443098 - DNA, 25 bp, Mus musculus
gaatttttgtttgctgaatgactgg

SEQ ID NO: 443099 - DNA, 25 bp, Mus musculus
gaatttttgttttggcactcaggat

SEQ ID NO: 443100 - DNA, 25 bp, Mus musculus
gaattttttcagaagcatttttgtg

SEQ ID NO: 443101 - DNA, 25 bp, Mus musculus
gaattttttcagtagcatttttgtg

SEQ ID NO: 443102 - DNA, 25 bp, Mus musculus
gaattttttcctcatgtcttggaat

SEQ ID NO: 443103 - DNA, 25 bp, Mus musculus
gaattttttcctgatgtcttggaat

SEQ ID NO: 443104 - DNA, 25 bp, Mus musculus
gaattttttctgagcacaatcctgg

SEQ ID NO: 443105 - DNA, 25 bp, Mus musculus
gaattttttctgtgcacaatcctgg

SEQ ID NO: 443106 - DNA, 25 bp, Mus musculus
gaattttttgaccttgatgactact

SEQ ID NO: 443107 - DNA, 25 bp, Mus musculus
gaattttttgacgttgatgactact

SEQ ID NO: 443108 - DNA, 25 bp, Mus musculus
gacaaaaagagaacaggttcccaga

SEQ ID NO: 443109 - DNA, 25 bp, Mus musculus
gacaaaaagagatcaggttcccaga

SEQ ID NO: 443110 - DNA, 25 bp, Mus musculus
gacaaaaaggtgctgactctcggtt

SEQ ID NO: 443111 - DNA, 25 bp, Mus musculus
gacaaaaaggtggtgactctcggtt

SEQ ID NO: 443112 - DNA, 25 bp, Mus musculus
gacaaaaccctcaggaagttctgga

SEQ ID NO: 443113 - DNA, 25 bp, Mus musculus
gacaaaaccctctggaagttctgga

SEQ ID NO: 443114 - DNA, 25 bp, Mus musculus
gacaaaacccttactcttggagtct

SEQ ID NO: 443115 - DNA, 25 bp, Mus musculus
gacaaaaccctttctcttggagtct

SEQ ID NO: 443116 - DNA, 25 bp, Mus musculus
gacaaaacctcccaacacacagtga

SEQ ID NO: 443117 - DNA, 25 bp, Mus musculus
gacaaaacctccgaacacacagtga

SEQ ID NO: 443118 - DNA, 25 bp, Mus musculus
gacaaaacgccccacgtatttgctc

SEQ ID NO: 443119 - DNA, 25 bp, Mus musculus
gacaaaacgcccgacgtatttgctc

SEQ ID NO: 443120 - DNA, 25 bp, Mus musculus
gacaaaacggtactgggtctttcag

SEQ ID NO: 443121 - DNA, 25 bp, Mus musculus
gacaaaacggtagtgggtctttcag

SEQ ID NO: 443122 - DNA, 25 bp, Mus musculus
gacaaaactacaactttgatcactg

SEQ ID NO: 443123 - DNA, 25 bp, Mus musculus
gacaaaactacatctttgatcactg

SEQ ID NO: 443124 - DNA, 25 bp, Mus musculus
gacaaaactagacgcctggagagat

SEQ ID NO: 443125 - DNA, 25 bp, Mus musculus
gacaaaactagaggcctggagagat

SEQ ID NO: 443126 - DNA, 25 bp, Mus musculus
gacaaaactctcaagtgacctctgc

SEQ ID NO: 443127 - DNA, 25 bp, Mus musculus
gacaaaactctctagtgacctctgc

SEQ ID NO: 443128 - DNA, 25 bp, Mus musculus
gacaaaactggaaactctgagtcaa

SEQ ID NO: 443129 - DNA, 25 bp, Mus musculus
gacaaaactggatactctgagtcaa

SEQ ID NO: 443130 - DNA, 25 bp, Mus musculus
gacaaaacttgtctgcaaagtctca

SEQ ID NO: 443131 - DNA, 25 bp, Mus musculus
gacaaaacttgtgtgcaaagtctca

SEQ ID NO: 443132 - DNA, 25 bp, Mus musculus
gacaaaactttgcttcccaatctgc

SEQ ID NO: 443133 - DNA, 25 bp, Mus musculus
gacaaaactttggttcccaatctgc

SEQ ID NO: 443134 - DNA, 25 bp, Mus musculus
gacaaaagaacactctgtgactcag

SEQ ID NO: 443135 - DNA, 25 bp, Mus musculus
gacaaaagaacagtctgtgactcag

SEQ ID NO: 443136 - DNA, 25 bp, Mus musculus
gacaaaagacagcagtaccaggtta

SEQ ID NO: 443137 - DNA, 25 bp, Mus musculus
gacaaaagacaggagtaccaggtta

SEQ ID NO: 443138 - DNA, 25 bp, Mus musculus
gacaaaagagtgatcccacaacctt

SEQ ID NO: 443139 - DNA, 25 bp, Mus musculus
gacaaaagagtgttcccacaacctt

SEQ ID NO: 443140 - DNA, 25 bp, Mus musculus
gacaaaagatctctgccctgtgttt

SEQ ID NO: 443141 - DNA, 25 bp, Mus musculus
gacaaaagatctgtgccctgtgttt

SEQ ID NO: 443142 - DNA, 25 bp, Mus musculus
gacaaaagatgcctgagagaccaca

SEQ ID NO: 443143 - DNA, 25 bp, Mus musculus
gacaaaagatgcgtgagagaccaca

SEQ ID NO: 443144 - DNA, 25 bp, Mus musculus
gacaaaagcgaactacccaaggact

SEQ ID NO: 443145 - DNA, 25 bp, Mus musculus
gacaaaagcgaagtacccaaggact

SEQ ID NO: 443146 - DNA, 25 bp, Mus musculus
gacaaaagcgatattataaccttcg

SEQ ID NO: 443147 - DNA, 25 bp, Mus musculus
gacaaaagcgattttataaccttcg

SEQ ID NO: 443148 - DNA, 25 bp, Mus musculus
gacaaaaggaaaaggccacacatca

SEQ ID NO: 443149 - DNA, 25 bp, Mus musculus
gacaaaaggaaatggccacacatca

SEQ ID NO: 443150 - DNA, 25 bp, Mus musculus
gacaaaaggcttcccagccatggaa

SEQ ID NO: 443151 - DNA, 25 bp, Mus musculus
gacaaaaggcttccttgctttggat

SEQ ID NO: 443152 - DNA, 25 bp, Mus musculus
gacaaaaggcttgccagccatggaa

SEQ ID NO: 443153 - DNA, 25 bp, Mus musculus
gacaaaaggcttgcttgctttggat

SEQ ID NO: 443154 - DNA, 25 bp, Mus musculus
gacaaaagtcaacagtgcttcagat

SEQ ID NO: 443155 - DNA, 25 bp, Mus musculus
gacaaaagtcaagagtgcttcagat

SEQ ID NO: 443156 - DNA, 25 bp, Mus musculus
gacaaaagtcctagggctgaagttt

SEQ ID NO: 443157 - DNA, 25 bp, Mus musculus
gacaaaagtccttgggctgaagttt

SEQ ID NO: 443158 - DNA, 25 bp, Mus musculus
gacaaaagtgttccctttcacagat

SEQ ID NO: 443159 - DNA, 25 bp, Mus musculus
gacaaaagtgttgcctttcacagat

SEQ ID NO: 443160 - DNA, 25 bp, Mus musculus
gacaaaagttagcactgtttcctta

SEQ ID NO: 443161 - DNA, 25 bp, Mus musculus
gacaaaagttaggactgtttcctta

SEQ ID NO: 443162 - DNA, 25 bp, Mus musculus
gacaaaagttcgagtgtgctcacct

SEQ ID NO: 443163 - DNA, 25 bp, Mus musculus
gacaaaagttcgtgtgtgctcacct

SEQ ID NO: 443164 - DNA, 25 bp, Mus musculus
gacaaaataagacaccttgcttttt

SEQ ID NO: 443165 - DNA, 25 bp, Mus musculus
gacaaaataagagaccttgcttttt

SEQ ID NO: 443166 - DNA, 25 bp, Mus musculus
gacaaaatagacaaattagcctcaa

SEQ ID NO: 443167 - DNA, 25 bp, Mus musculus
gacaaaatagactaattagcctcaa

SEQ ID NO: 443168 - DNA, 25 bp, Mus musculus
gacaaaatcaccacttttgcaagct

SEQ ID NO: 443169 - DNA, 25 bp, Mus musculus
gacaaaatcacctcttttgcaagct

SEQ ID NO: 443170 - DNA, 25 bp, Mus musculus
gacaaaatgaccatccaacctgagg

SEQ ID NO: 443171 - DNA, 25 bp, Mus musculus
gacaaaatgaccttccaacctgagg

SEQ ID NO: 443172 - DNA, 25 bp, Mus musculus
gacaaaatgcccaaaatgaagtaca

SEQ ID NO: 443173 - DNA, 25 bp, Mus musculus
gacaaaatgccctaaatgaagtaca

SEQ ID NO: 443174 - DNA, 25 bp, Mus musculus
gacaaaatgtaaccagttctaagag

SEQ ID NO: 443175 - DNA, 25 bp, Mus musculus
gacaaaatgtaagcagttctaagag

SEQ ID NO: 443176 - DNA, 25 bp, Mus musculus
gacaaaattatgagtattcctcaga

SEQ ID NO: 443177 - DNA, 25 bp, Mus musculus
gacaaaattatgtgtattcctcaga

SEQ ID NO: 443178 - DNA, 25 bp, Mus musculus
gacaaaattcttatacgatttggca

SEQ ID NO: 443179 - DNA, 25 bp, Mus musculus
gacaaaattcttcatgattccttca

SEQ ID NO: 443180 - DNA, 25 bp, Mus musculus
gacaaaattcttgatgattccttca

SEQ ID NO: 443181 - DNA, 25 bp, Mus musculus
gacaaaattcttttacgatttggca

SEQ ID NO: 443182 - DNA, 25 bp, Mus musculus
gacaaaattgatctgcttctacagc

SEQ ID NO: 443183 - DNA, 25 bp, Mus musculus
gacaaaattgatgtgcttctacagc

SEQ ID NO: 443184 - DNA, 25 bp, Mus musculus
gacaaaattggccagtttcagaaaa

SEQ ID NO: 443185 - DNA, 25 bp, Mus musculus
gacaaaattggcgagtttcagaaaa

SEQ ID NO: 443186 - DNA, 25 bp, Mus musculus
gacaaaatttccctgtttacttgcg

SEQ ID NO: 443187 - DNA, 25 bp, Mus musculus
gacaaaatttccgtgtttacttgcg

SEQ ID NO: 443188 - DNA, 25 bp, Mus musculus
gacaaacaacatactaaaatttctg

SEQ ID NO: 443189 - DNA, 25 bp, Mus musculus
gacaaacaacattctaaaatttctg

SEQ ID NO: 443190 - DNA, 25 bp, Mus musculus
gacaaacaagacacggcgggacagt

SEQ ID NO: 443191 - DNA, 25 bp, Mus musculus
gacaaacaagactcggcgggacagt

SEQ ID NO: 443192 - DNA, 25 bp, Mus musculus
gacaaacaagggatttcaaccagat

SEQ ID NO: 443193 - DNA, 25 bp, Mus musculus
gacaaacaagggttttcaaccagat

SEQ ID NO: 443194 - DNA, 25 bp, Mus musculus
gacaaacacagccagcttcttgtat

SEQ ID NO: 443195 - DNA, 25 bp, Mus musculus
gacaaacacagcgagcttcttgtat

SEQ ID NO: 443196 - DNA, 25 bp, Mus musculus
gacaaacaccagagtgcttgacctg

SEQ ID NO: 443197 - DNA, 25 bp, Mus musculus
gacaaacaccagtgtgcttgacctg

SEQ ID NO: 443198 - DNA, 25 bp, Mus musculus
gacaaacaccgtattctgtacctct

SEQ ID NO: 443199 - DNA, 25 bp, Mus musculus
gacaaacaccgttttctgtacctct

SEQ ID NO: 443200 - DNA, 25 bp, Mus musculus
gacaaacaccttagccagtttcttt

SEQ ID NO: 443201 - DNA, 25 bp, Mus musculus
gacaaacacctttgccagtttcttt

SEQ ID NO: 443202 - DNA, 25 bp, Mus musculus
gacaaacacgctaacgctgggctgg

SEQ ID NO: 443203 - DNA, 25 bp, Mus musculus
gacaaacacgcttacgctgggctgg

SEQ ID NO: 443204 - DNA, 25 bp, Mus musculus
gacaaacactcaaaaaacatctgaa

SEQ ID NO: 443205 - DNA, 25 bp, Mus musculus
gacaaacactcataaaacatctgaa

SEQ ID NO: 443206 - DNA, 25 bp, Mus musculus
gacaaacagaacaattccttccctc

SEQ ID NO: 443207 - DNA, 25 bp, Mus musculus
gacaaacagaactattccttccctc

SEQ ID NO: 443208 - DNA, 25 bp, Mus musculus
gacaaacaggtcatagcactattat

SEQ ID NO: 443209 - DNA, 25 bp, Mus musculus
gacaaacaggtcttagcactattat

SEQ ID NO: 443210 - DNA, 25 bp, Mus musculus
gacaaacatctaactttctcatcta

SEQ ID NO: 443211 - DNA, 25 bp, Mus musculus
gacaaacatctatctttctcatcta

SEQ ID NO: 443212 - DNA, 25 bp, Mus musculus
gacaaacattaccttcagctgacaa

SEQ ID NO: 443213 - DNA, 25 bp, Mus musculus
gacaaacattacgttcagctgacaa

SEQ ID NO: 443214 - DNA, 25 bp, Mus musculus
gacaaacattgtagccttgagttct

SEQ ID NO: 443215 - DNA, 25 bp, Mus musculus
gacaaacattgttgccttgagttct

SEQ ID NO: 443216 - DNA, 25 bp, Mus musculus
gacaaaccatgaacttcctgtagaa

SEQ ID NO: 443217 - DNA, 25 bp, Mus musculus
gacaaaccatgatcttcctgtagaa

SEQ ID NO: 443218 - DNA, 25 bp, Mus musculus
gacaaaccatggactctctttaaag

SEQ ID NO: 443219 - DNA, 25 bp, Mus musculus
gacaaaccatggtctctctttaaag

SEQ ID NO: 443220 - DNA, 25 bp, Mus musculus
gacaaaccattcaggagaaagccat

SEQ ID NO: 443221 - DNA, 25 bp, Mus musculus
gacaaaccattctggagaaagccat

SEQ ID NO: 443222 - DNA, 25 bp, Mus musculus
gacaaacccagacaagtgactgtaa

SEQ ID NO: 443223 - DNA, 25 bp, Mus musculus
gacaaacccagagaagtgactgtaa

SEQ ID NO: 443224 - DNA, 25 bp, Mus musculus
gacaaacccagcaatcagttgaagt

SEQ ID NO: 443225 - DNA, 25 bp, Mus musculus
gacaaacccagcaggctaactgaga

SEQ ID NO: 443226 - DNA, 25 bp, Mus musculus
gacaaacccagctatcagttgaagt

SEQ ID NO: 443227 - DNA, 25 bp, Mus musculus
gacaaacccagctggctaactgaga

SEQ ID NO: 443228 - DNA, 25 bp, Mus musculus
gacaaaccctcaaggatgctcgttc

SEQ ID NO: 443229 - DNA, 25 bp, Mus musculus
gacaaaccctcatggatgctcgttc

SEQ ID NO: 443230 - DNA, 25 bp, Mus musculus
gacaaaccgaatcctcaccagtggg

SEQ ID NO: 443231 - DNA, 25 bp, Mus musculus
gacaaaccgaatgctcaccagtggg

SEQ ID NO: 443232 - DNA, 25 bp, Mus musculus
gacaaaccgttcacttttgatatgg

SEQ ID NO: 443233 - DNA, 25 bp, Mus musculus
gacaaaccgttctcttttgatatgg

SEQ ID NO: 443234 - DNA, 25 bp, Mus musculus
gacaaacctataatgcagtgattca

SEQ ID NO: 443235 - DNA, 25 bp, Mus musculus
gacaaacctatattgcagtgattca

SEQ ID NO: 443236 - DNA, 25 bp, Mus musculus
gacaaacctggtattctgtgtacgc

SEQ ID NO: 443237 - DNA, 25 bp, Mus musculus
gacaaacctggttttctgtgtacgc

SEQ ID NO: 443238 - DNA, 25 bp, Mus musculus
gacaaaccttatcctggaacgaatg

SEQ ID NO: 443239 - DNA, 25 bp, Mus musculus
gacaaaccttatgctggaacgaatg

SEQ ID NO: 443240 - DNA, 25 bp, Mus musculus
gacaaacgccaacctggtgtaccaa

SEQ ID NO: 443241 - DNA, 25 bp, Mus musculus
gacaaacgccaagctggtgtaccaa

SEQ ID NO: 443242 - DNA, 25 bp, Mus musculus
gacaaacgctaactccccatttatt

SEQ ID NO: 443243 - DNA, 25 bp, Mus musculus
gacaaacgctaagtccccatttatt

SEQ ID NO: 443244 - DNA, 25 bp, Mus musculus
gacaaacgctctcacaacccattag

SEQ ID NO: 443245 - DNA, 25 bp, Mus musculus
gacaaacgctctgacaacccattag

SEQ ID NO: 443246 - DNA, 25 bp, Mus musculus
gacaaacggcagacggaggcccagc

SEQ ID NO: 443247 - DNA, 25 bp, Mus musculus
gacaaacggcagagaggtagcttta

SEQ ID NO: 443248 - DNA, 25 bp, Mus musculus
gacaaacggcagtcggaggcccagc

SEQ ID NO: 443249 - DNA, 25 bp, Mus musculus
gacaaacggcagtgaggtagcttta

SEQ ID NO: 443250 - DNA, 25 bp, Mus musculus
gacaaactatggctattttaactgc

SEQ ID NO: 443251 - DNA, 25 bp, Mus musculus
gacaaactatgggtattttaactgc

SEQ ID NO: 443252 - DNA, 25 bp, Mus musculus
gacaaactccatatacaccttttct

SEQ ID NO: 443253 - DNA, 25 bp, Mus musculus
gacaaactccatatttgcgactccc

SEQ ID NO: 443254 - DNA, 25 bp, Mus musculus
gacaaactccatttacaccttttct

SEQ ID NO: 443255 - DNA, 25 bp, Mus musculus
gacaaactccatttttgcgactccc

SEQ ID NO: 443256 - DNA, 25 bp, Mus musculus
gacaaactccggactagcacggcag

SEQ ID NO: 443257 - DNA, 25 bp, Mus musculus
gacaaactccggtctagcacggcag

SEQ ID NO: 443258 - DNA, 25 bp, Mus musculus
gacaaactcggcagcttcagtgatg

SEQ ID NO: 443259 - DNA, 25 bp, Mus musculus
gacaaactcggctgcttcagtgatg

SEQ ID NO: 443260 - DNA, 25 bp, Mus musculus
gacaaactcttgcaaacggacattt

SEQ ID NO: 443261 - DNA, 25 bp, Mus musculus
gacaaactcttggaaacggacattt

SEQ ID NO: 443262 - DNA, 25 bp, Mus musculus
gacaaactgaccactgtgagccata

SEQ ID NO: 443263 - DNA, 25 bp, Mus musculus
gacaaactgacctctgtgagccata

SEQ ID NO: 443264 - DNA, 25 bp, Mus musculus
gacaaactgcctatcacctatgtga

SEQ ID NO: 443265 - DNA, 25 bp, Mus musculus
gacaaactgcctttcacctatgtga

SEQ ID NO: 443266 - DNA, 25 bp, Mus musculus
gacaaactggtaatagcgactttta

SEQ ID NO: 443267 - DNA, 25 bp, Mus musculus
gacaaactggtattagcgactttta

SEQ ID NO: 443268 - DNA, 25 bp, Mus musculus
gacaaactggtcatcgggcgcatct

SEQ ID NO: 443269 - DNA, 25 bp, Mus musculus
gacaaactggtcttcgggcgcatct

SEQ ID NO: 443270 - DNA, 25 bp, Mus musculus
gacaaactgtacatagcggacgcct

SEQ ID NO: 443271 - DNA, 25 bp, Mus musculus
gacaaactgtacttagcggacgcct

SEQ ID NO: 443272 - DNA, 25 bp, Mus musculus
gacaaactgtagctggccgtcttga

SEQ ID NO: 443273 - DNA, 25 bp, Mus musculus
gacaaactgtaggtggccgtcttga

SEQ ID NO: 443274 - DNA, 25 bp, Mus musculus
gacaaacttagcagggtatattcat

SEQ ID NO: 443275 - DNA, 25 bp, Mus musculus
gacaaacttagctgggtatattcat

SEQ ID NO: 443276 - DNA, 25 bp, Mus musculus
gacaaacttagtacgcatgacctgg

SEQ ID NO: 443277 - DNA, 25 bp, Mus musculus
gacaaacttagttcgcatgacctgg

SEQ ID NO: 443278 - DNA, 25 bp, Mus musculus
gacaaacttgccaaagctactagag

SEQ ID NO: 443279 - DNA, 25 bp, Mus musculus
gacaaacttgcctaagctactagag

SEQ ID NO: 443280 - DNA, 25 bp, Mus musculus
gacaaactttgcagtaagcggacag

SEQ ID NO: 443281 - DNA, 25 bp, Mus musculus
gacaaactttgctgtaagcggacag

SEQ ID NO: 443282 - DNA, 25 bp, Mus musculus
gacaaagaacacctattatcgaatt

SEQ ID NO: 443283 - DNA, 25 bp, Mus musculus
gacaaagaacacgtattatcgaatt

SEQ ID NO: 443284 - DNA, 25 bp, Mus musculus
gacaaagaacgtactctggagattc

SEQ ID NO: 443285 - DNA, 25 bp, Mus musculus
gacaaagaacgttctctggagattc

SEQ ID NO: 443286 - DNA, 25 bp, Mus musculus
gacaaagaatgtcgtgcttcccgaa

SEQ ID NO: 443287 - DNA, 25 bp, Mus musculus
gacaaagaatgtggtgcttcccgaa

SEQ ID NO: 443288 - DNA, 25 bp, Mus musculus
gacaaagacaccagtacctagatgg

SEQ ID NO: 443289 - DNA, 25 bp, Mus musculus
gacaaagacacctgtacctagatgg

SEQ ID NO: 443290 - DNA, 25 bp, Mus musculus
gacaaagacccactgaacaaatccg

SEQ ID NO: 443291 - DNA, 25 bp, Mus musculus
gacaaagacccacttggaaggagta

SEQ ID NO: 443292 - DNA, 25 bp, Mus musculus
gacaaagacccagtgaacaaatccg

SEQ ID NO: 443293 - DNA, 25 bp, Mus musculus
gacaaagacccagttggaaggagta

SEQ ID NO: 443294 - DNA, 25 bp, Mus musculus
gacaaagaccccaggagaagcagca

SEQ ID NO: 443295 - DNA, 25 bp, Mus musculus
gacaaagacccctggagaagcagca

SEQ ID NO: 443296 - DNA, 25 bp, Mus musculus
gacaaagactgcagaattttattcc

SEQ ID NO: 443297 - DNA, 25 bp, Mus musculus
gacaaagactgctgaattttattcc

SEQ ID NO: 443298 - DNA, 25 bp, Mus musculus
gacaaagagaatctcatcctggaga

SEQ ID NO: 443299 - DNA, 25 bp, Mus musculus
gacaaagagaatgtcatcctggaga

SEQ ID NO: 443300 - DNA, 25 bp, Mus musculus
gacaaagatcccatgctaatcgtga

SEQ ID NO: 443301 - DNA, 25 bp, Mus musculus
gacaaagatcccttgctaatcgtga

SEQ ID NO: 443302 - DNA, 25 bp, Mus musculus
gacaaagatgaactccctattatat

SEQ ID NO: 443303 - DNA, 25 bp, Mus musculus
gacaaagatgaagtccctattatat

SEQ ID NO: 443304 - DNA, 25 bp, Mus musculus
gacaaagatgctaagcctggcgcct

SEQ ID NO: 443305 - DNA, 25 bp, Mus musculus
gacaaagatgcttagcctggcgcct

SEQ ID NO: 443306 - DNA, 25 bp, Mus musculus
gacaaagattcccaggccacagtat

SEQ ID NO: 443307 - DNA, 25 bp, Mus musculus
gacaaagattccgaggccacagtat

SEQ ID NO: 443308 - DNA, 25 bp, Mus musculus
gacaaagatttcagcagaggtcaag

SEQ ID NO: 443309 - DNA, 25 bp, Mus musculus
gacaaagatttctgcagaggtcaag

SEQ ID NO: 443310 - DNA, 25 bp, Mus musculus
gacaaagattttcctcgaggattca

SEQ ID NO: 443311 - DNA, 25 bp, Mus musculus
gacaaagattttgctcgaggattca

SEQ ID NO: 443312 - DNA, 25 bp, Mus musculus
gacaaagcaaaactagtgcccaaaa

SEQ ID NO: 443313 - DNA, 25 bp, Mus musculus
gacaaagcaaaagtagtgcccaaaa

SEQ ID NO: 443314 - DNA, 25 bp, Mus musculus
gacaaagcacggagtactgtttaga

SEQ ID NO: 443315 - DNA, 25 bp, Mus musculus
gacaaagcacggtgtactgtttaga

SEQ ID NO: 443316 - DNA, 25 bp, Mus musculus
gacaaagcacttcgatttctgggat

SEQ ID NO: 443317 - DNA, 25 bp, Mus musculus
gacaaagcacttggatttctgggat

SEQ ID NO: 443318 - DNA, 25 bp, Mus musculus
gacaaagcaggaaccctaggaccct

SEQ ID NO: 443319 - DNA, 25 bp, Mus musculus
gacaaagcaggatccctaggaccct

SEQ ID NO: 443320 - DNA, 25 bp, Mus musculus
gacaaagccaccagattggtctgaa

SEQ ID NO: 443321 - DNA, 25 bp, Mus musculus
gacaaagccacctgattggtctgaa

SEQ ID NO: 443322 - DNA, 25 bp, Mus musculus
gacaaagccaggaaggaaaatgcct

SEQ ID NO: 443323 - DNA, 25 bp, Mus musculus
gacaaagccaggtaggaaaatgcct

SEQ ID NO: 443324 - DNA, 25 bp, Mus musculus
gacaaagccagtaaaccttaggttg

SEQ ID NO: 443325 - DNA, 25 bp, Mus musculus
gacaaagccagttaaccttaggttg

SEQ ID NO: 443326 - DNA, 25 bp, Mus musculus
gacaaagccattctggttccattcc

SEQ ID NO: 443327 - DNA, 25 bp, Mus musculus
gacaaagccattgtggttccattcc

SEQ ID NO: 443328 - DNA, 25 bp, Mus musculus
gacaaagcccaaaggcgcgctggaa

SEQ ID NO: 443329 - DNA, 25 bp, Mus musculus
gacaaagcccaatggcgcgctggaa

SEQ ID NO: 443330 - DNA, 25 bp, Mus musculus
gacaaagcccatcgccggcagggct

SEQ ID NO: 443331 - DNA, 25 bp, Mus musculus
gacaaagcccatggccggcagggct

SEQ ID NO: 443332 - DNA, 25 bp, Mus musculus
gacaaagccggtatttactctccag

SEQ ID NO: 443333 - DNA, 25 bp, Mus musculus
gacaaagccggtttttactctccag

SEQ ID NO: 443334 - DNA, 25 bp, Mus musculus
gacaaagcctcgaatgtggcctggg

SEQ ID NO: 443335 - DNA, 25 bp, Mus musculus
gacaaagcctcgtatgtggcctggg

SEQ ID NO: 443336 - DNA, 25 bp, Mus musculus
gacaaagcctctatgattatgctga

SEQ ID NO: 443337 - DNA, 25 bp, Mus musculus
gacaaagcctctttgattatgctga

SEQ ID NO: 443338 - DNA, 25 bp, Mus musculus
gacaaagctagcacaccctagggaa

SEQ ID NO: 443339 - DNA, 25 bp, Mus musculus
gacaaagctagctcaccctagggaa

SEQ ID NO: 443340 - DNA, 25 bp, Mus musculus
gacaaagctcaaaggttactcaaag

SEQ ID NO: 443341 - DNA, 25 bp, Mus musculus
gacaaagctcaatggttactcaaag

SEQ ID NO: 443342 - DNA, 25 bp, Mus musculus
gacaaagctctcacaaaggcttcct

SEQ ID NO: 443343 - DNA, 25 bp, Mus musculus
gacaaagctctctcaaaggcttcct

SEQ ID NO: 443344 - DNA, 25 bp, Mus musculus
gacaaagctgcacaactgttacaca

SEQ ID NO: 443345 - DNA, 25 bp, Mus musculus
gacaaagctgcagaactgttacaca

SEQ ID NO: 443346 - DNA, 25 bp, Mus musculus
gacaaagctgtcatcaggagctggt

SEQ ID NO: 443347 - DNA, 25 bp, Mus musculus
gacaaagctgtcttcaggagctggt

SEQ ID NO: 443348 - DNA, 25 bp, Mus musculus
gacaaagctttcattcactcatcag

SEQ ID NO: 443349 - DNA, 25 bp, Mus musculus
gacaaagctttctttcactcatcag

SEQ ID NO: 443350 - DNA, 25 bp, Mus musculus
gacaaaggacagcatctccacaatg

SEQ ID NO: 443351 - DNA, 25 bp, Mus musculus
gacaaaggacaggatctccacaatg

SEQ ID NO: 443352 - DNA, 25 bp, Mus musculus
gacaaaggacatatctcagccaaga

SEQ ID NO: 443353 - DNA, 25 bp, Mus musculus
gacaaaggacatttctcagccaaga

SEQ ID NO: 443354 - DNA, 25 bp, Mus musculus
gacaaaggactgcactgagggccct

SEQ ID NO: 443355 - DNA, 25 bp, Mus musculus
gacaaaggactggactgagggccct

SEQ ID NO: 443356 - DNA, 25 bp, Mus musculus
gacaaaggcaacagactccctgtgt

SEQ ID NO: 443357 - DNA, 25 bp, Mus musculus
gacaaaggcaactgactccctgtgt

SEQ ID NO: 443358 - DNA, 25 bp, Mus musculus
gacaaaggcaggagctacagaccag

SEQ ID NO: 443359 - DNA, 25 bp, Mus musculus
gacaaaggcaggtgctacagaccag

SEQ ID NO: 443360 - DNA, 25 bp, Mus musculus
gacaaaggcagtagccctcgactta

SEQ ID NO: 443361 - DNA, 25 bp, Mus musculus
gacaaaggcagttgccctcgactta

SEQ ID NO: 443362 - DNA, 25 bp, Mus musculus
gacaaaggccacagaagggttccat

SEQ ID NO: 443363 - DNA, 25 bp, Mus musculus
gacaaaggccacagctggagactga

SEQ ID NO: 443364 - DNA, 25 bp, Mus musculus
gacaaaggccactgaagggttccat

SEQ ID NO: 443365 - DNA, 25 bp, Mus musculus
gacaaaggccactgctggagactga

SEQ ID NO: 443366 - DNA, 25 bp, Mus musculus
gacaaaggcctcatgtagtgcagaa

SEQ ID NO: 443367 - DNA, 25 bp, Mus musculus
gacaaaggcctcttgtagtgcagaa

SEQ ID NO: 443368 - DNA, 25 bp, Mus musculus
gacaaaggccttctgcatcaagaat

SEQ ID NO: 443369 - DNA, 25 bp, Mus musculus
gacaaaggccttgtgcatcaagaat

SEQ ID NO: 443370 - DNA, 25 bp, Mus musculus
gacaaaggctgacagtatctcccat

SEQ ID NO: 443371 - DNA, 25 bp, Mus musculus
gacaaaggctgagagtatctcccat

SEQ ID NO: 443372 - DNA, 25 bp, Mus musculus
gacaaaggctgcatctgtggcctgg

SEQ ID NO: 443373 - DNA, 25 bp, Mus musculus
gacaaaggctgcttctgtggcctgg

SEQ ID NO: 443374 - DNA, 25 bp, Mus musculus
gacaaaggctggctgacactggcac

SEQ ID NO: 443375 - DNA, 25 bp, Mus musculus
gacaaaggctgggtgacactggcac

SEQ ID NO: 443376 - DNA, 25 bp, Mus musculus
gacaaagggataactcacaccacgg

SEQ ID NO: 443377 - DNA, 25 bp, Mus musculus
gacaaagggatatctcacaccacgg

SEQ ID NO: 443378 - DNA, 25 bp, Mus musculus
gacaaagggcaaattggcaacctct

SEQ ID NO: 443379 - DNA, 25 bp, Mus musculus
gacaaagggcaatttggcaacctct

SEQ ID NO: 443380 - DNA, 25 bp, Mus musculus
gacaaagggctgaatcctgcataac

SEQ ID NO: 443381 - DNA, 25 bp, Mus musculus
gacaaagggctgtatcctgcataac

SEQ ID NO: 443382 - DNA, 25 bp, Mus musculus
gacaaaggtcatcgatctcaaaaaa

SEQ ID NO: 443383 - DNA, 25 bp, Mus musculus
gacaaaggtcatggatctcaaaaaa

SEQ ID NO: 443384 - DNA, 25 bp, Mus musculus
gacaaaggtcgcacttccaaaaggt

SEQ ID NO: 443385 - DNA, 25 bp, Mus musculus
gacaaaggtcgctcttccaaaaggt

SEQ ID NO: 443386 - DNA, 25 bp, Mus musculus
gacaaaggtgaaatctggagacaga

SEQ ID NO: 443387 - DNA, 25 bp, Mus musculus
gacaaaggtgaactgatcaaaggag

SEQ ID NO: 443388 - DNA, 25 bp, Mus musculus
gacaaaggtgaagtgatcaaaggag

SEQ ID NO: 443389 - DNA, 25 bp, Mus musculus
gacaaaggtgaattctggagacaga

SEQ ID NO: 443390 - DNA, 25 bp, Mus musculus
gacaaaggtggcctccacgttatca

SEQ ID NO: 443391 - DNA, 25 bp, Mus musculus
gacaaaggtggcgtccacgttatca

SEQ ID NO: 443392 - DNA, 25 bp, Mus musculus
gacaaaggtggtaactagaccaatt

SEQ ID NO: 443393 - DNA, 25 bp, Mus musculus
gacaaaggtggttactagaccaatt

SEQ ID NO: 443394 - DNA, 25 bp, Mus musculus
gacaaagtacacatctggccgagtt

SEQ ID NO: 443395 - DNA, 25 bp, Mus musculus
gacaaagtacacttctggccgagtt

SEQ ID NO: 443396 - DNA, 25 bp, Mus musculus
gacaaagtagacatccttgtgttca

SEQ ID NO: 443397 - DNA, 25 bp, Mus musculus
gacaaagtagacttccttgtgttca

SEQ ID NO: 443398 - DNA, 25 bp, Mus musculus
gacaaagtatttcgctcactgagca

SEQ ID NO: 443399 - DNA, 25 bp, Mus musculus
gacaaagtatttcggcaagagtctt

SEQ ID NO: 443400 - DNA, 25 bp, Mus musculus
gacaaagtatttggctcactgagca

SEQ ID NO: 443401 - DNA, 25 bp, Mus musculus
gacaaagtatttgggcaagagtctt

SEQ ID NO: 443402 - DNA, 25 bp, Mus musculus
gacaaagtcactcttgaacaggctg

SEQ ID NO: 443403 - DNA, 25 bp, Mus musculus
gacaaagtcactgttgaacaggctg

SEQ ID NO: 443404 - DNA, 25 bp, Mus musculus
gacaaagtcagaagatagagggctt

SEQ ID NO: 443405 - DNA, 25 bp, Mus musculus
gacaaagtcagatgatagagggctt

SEQ ID NO: 443406 - DNA, 25 bp, Mus musculus
gacaaagtccaacgatccagaagaa

SEQ ID NO: 443407 - DNA, 25 bp, Mus musculus
gacaaagtccaaggatccagaagaa

SEQ ID NO: 443408 - DNA, 25 bp, Mus musculus
gacaaagtcctaccctacgcctaag

SEQ ID NO: 443409 - DNA, 25 bp, Mus musculus
gacaaagtcctagcctacgcctaag

SEQ ID NO: 443410 - DNA, 25 bp, Mus musculus
gacaaagtcggtactggtgggaggt

SEQ ID NO: 443411 - DNA, 25 bp, Mus musculus
gacaaagtcggttctggtgggaggt

SEQ ID NO: 443412 - DNA, 25 bp, Mus musculus
gacaaagtctgtagttttctaacaa

SEQ ID NO: 443413 - DNA, 25 bp, Mus musculus
gacaaagtctgtatgctccaacaca

SEQ ID NO: 443414 - DNA, 25 bp, Mus musculus
gacaaagtctgttgttttctaacaa

SEQ ID NO: 443415 - DNA, 25 bp, Mus musculus
gacaaagtctgtttgctccaacaca

SEQ ID NO: 443416 - DNA, 25 bp, Mus musculus
gacaaagtgaccacaccaggcctat

SEQ ID NO: 443417 - DNA, 25 bp, Mus musculus
gacaaagtgacctcaccaggcctat

SEQ ID NO: 443418 - DNA, 25 bp, Mus musculus
gacaaagtgagaaggttgcccttca

SEQ ID NO: 443419 - DNA, 25 bp, Mus musculus
gacaaagtgagatggttgcccttca

SEQ ID NO: 443420 - DNA, 25 bp, Mus musculus
gacaaagtgaggatctgatcccctg

SEQ ID NO: 443421 - DNA, 25 bp, Mus musculus
gacaaagtgaggttctgatcccctg

SEQ ID NO: 443422 - DNA, 25 bp, Mus musculus
gacaaagtgtctctctgtataaccc

SEQ ID NO: 443423 - DNA, 25 bp, Mus musculus
gacaaagtgtctgtctgtataaccc

SEQ ID NO: 443424 - DNA, 25 bp, Mus musculus
gacaaagttaccacagatagctaaa

SEQ ID NO: 443425 - DNA, 25 bp, Mus musculus
gacaaagttacctcagatagctaaa

SEQ ID NO: 443426 - DNA, 25 bp, Mus musculus
gacaaagttggccttgcactcagag

SEQ ID NO: 443427 - DNA, 25 bp, Mus musculus
gacaaagttggcgttgcactcagag

SEQ ID NO: 443428 - DNA, 25 bp, Mus musculus
gacaaagttgttatatctctattta

SEQ ID NO: 443429 - DNA, 25 bp, Mus musculus
gacaaagttgttttatctctattta

SEQ ID NO: 443430 - DNA, 25 bp, Mus musculus
gacaaagtttacattaacccatgtg

SEQ ID NO: 443431 - DNA, 25 bp, Mus musculus
gacaaagtttactttaacccatgtg

SEQ ID NO: 443432 - DNA, 25 bp, Mus musculus
gacaaagtttcaccatgtagccctt

SEQ ID NO: 443433 - DNA, 25 bp, Mus musculus
gacaaagtttcagcatgtagccctt

SEQ ID NO: 443434 - DNA, 25 bp, Mus musculus
gacaaagttttaacccttgtgatca

SEQ ID NO: 443435 - DNA, 25 bp, Mus musculus
gacaaagttttatcccttgtgatca

SEQ ID NO: 443436 - DNA, 25 bp, Mus musculus
gacaaataaagtctggcactgcttg

SEQ ID NO: 443437 - DNA, 25 bp, Mus musculus
gacaaataaagtgtggcactgcttg

SEQ ID NO: 443438 - DNA, 25 bp, Mus musculus
gacaaatacaccatgcattcttctg

SEQ ID NO: 443439 - DNA, 25 bp, Mus musculus
gacaaatacaccttgcattcttctg

SEQ ID NO: 443440 - DNA, 25 bp, Mus musculus
gacaaataccagatgcatcttcatg

SEQ ID NO: 443441 - DNA, 25 bp, Mus musculus
gacaaataccagttgcatcttcatg

SEQ ID NO: 443442 - DNA, 25 bp, Mus musculus
gacaaatacctgcaagacaaggccc

SEQ ID NO: 443443 - DNA, 25 bp, Mus musculus
gacaaatacctggaagacaaggccc

SEQ ID NO: 443444 - DNA, 25 bp, Mus musculus
gacaaatacgagctctgcatccgcc

SEQ ID NO: 443445 - DNA, 25 bp, Mus musculus
gacaaatacgaggtctgcatccgcc

SEQ ID NO: 443446 - DNA, 25 bp, Mus musculus
gacaaatactatagggtctaccccg

SEQ ID NO: 443447 - DNA, 25 bp, Mus musculus
gacaaatactattgggtctaccccg

SEQ ID NO: 443448 - DNA, 25 bp, Mus musculus
gacaaatagaccatgagccgggcgt

SEQ ID NO: 443449 - DNA, 25 bp, Mus musculus
gacaaatagaccttgagccgggcgt

SEQ ID NO: 443450 - DNA, 25 bp, Mus musculus
gacaaatatgcacttatttcaagga

SEQ ID NO: 443451 - DNA, 25 bp, Mus musculus
gacaaatatgcagttatttcaagga

SEQ ID NO: 443452 - DNA, 25 bp, Mus musculus
gacaaatatgtcagtgctctgcccc

SEQ ID NO: 443453 - DNA, 25 bp, Mus musculus
gacaaatatgtctgtgctctgcccc

SEQ ID NO: 443454 - DNA, 25 bp, Mus musculus
gacaaatcaaaaacacctcttaatc

SEQ ID NO: 443455 - DNA, 25 bp, Mus musculus
gacaaatcaaaatcacctcttaatc

SEQ ID NO: 443456 - DNA, 25 bp, Mus musculus
gacaaatcatacacagctgctgttg

SEQ ID NO: 443457 - DNA, 25 bp, Mus musculus
gacaaatcatactcagctgctgttg

SEQ ID NO: 443458 - DNA, 25 bp, Mus musculus
gacaaatcatgtattctgccttcat

SEQ ID NO: 443459 - DNA, 25 bp, Mus musculus
gacaaatcatgttttctgccttcat

SEQ ID NO: 443460 - DNA, 25 bp, Mus musculus
gacaaatccaagcacaatagtggtg

SEQ ID NO: 443461 - DNA, 25 bp, Mus musculus
gacaaatccaaggacaatagtggtg

SEQ ID NO: 443462 - DNA, 25 bp, Mus musculus
gacaaatccaccagcgagttggcgc

SEQ ID NO: 443463 - DNA, 25 bp, Mus musculus
gacaaatccacctgcgagttggcgc

SEQ ID NO: 443464 - DNA, 25 bp, Mus musculus
gacaaatccagactctcggcagtgg

SEQ ID NO: 443465 - DNA, 25 bp, Mus musculus
gacaaatccagagtctcggcagtgg

SEQ ID NO: 443466 - DNA, 25 bp, Mus musculus
gacaaatcccacactctaaagtgag

SEQ ID NO: 443467 - DNA, 25 bp, Mus musculus
gacaaatcccactctctaaagtgag

SEQ ID NO: 443468 - DNA, 25 bp, Mus musculus
gacaaatcgtagatgcatgtggaca

SEQ ID NO: 443469 - DNA, 25 bp, Mus musculus
gacaaatcgtagttgcatgtggaca

SEQ ID NO: 443470 - DNA, 25 bp, Mus musculus
gacaaatctactcaggtgaatgggc

SEQ ID NO: 443471 - DNA, 25 bp, Mus musculus
gacaaatctactgaggtgaatgggc

SEQ ID NO: 443472 - DNA, 25 bp, Mus musculus
gacaaatctcaacggtcctccagag

SEQ ID NO: 443473 - DNA, 25 bp, Mus musculus
gacaaatctcaagggtcctccagag

SEQ ID NO: 443474 - DNA, 25 bp, Mus musculus
gacaaatctcctcagttcaatatag

SEQ ID NO: 443475 - DNA, 25 bp, Mus musculus
gacaaatctcctgagttcaatatag

SEQ ID NO: 443476 - DNA, 25 bp, Mus musculus
gacaaatctgcgatttccgaggaat

SEQ ID NO: 443477 - DNA, 25 bp, Mus musculus
gacaaatctgcgttttccgaggaat

SEQ ID NO: 443478 - DNA, 25 bp, Mus musculus
gacaaatctggtattctcaggacaa

SEQ ID NO: 443479 - DNA, 25 bp, Mus musculus
gacaaatctggttttctcaggacaa

SEQ ID NO: 443480 - DNA, 25 bp, Mus musculus
gacaaatctgtaactagccccacac

SEQ ID NO: 443481 - DNA, 25 bp, Mus musculus
gacaaatctgtatctagccccacac

SEQ ID NO: 443482 - DNA, 25 bp, Mus musculus
gacaaatcttttatcaggtactcac

SEQ ID NO: 443483 - DNA, 25 bp, Mus musculus
gacaaatcttttttcaggtactcac

SEQ ID NO: 443484 - DNA, 25 bp, Mus musculus
gacaaatgcatcattgcgggcctcg

SEQ ID NO: 443485 - DNA, 25 bp, Mus musculus
gacaaatgcatctttgcgggcctcg

SEQ ID NO: 443486 - DNA, 25 bp, Mus musculus
gacaaatgccctctgttccttgagg

SEQ ID NO: 443487 - DNA, 25 bp, Mus musculus
gacaaatgccctgtgttccttgagg

SEQ ID NO: 443488 - DNA, 25 bp, Mus musculus
gacaaatgcctgcatgactcactac

SEQ ID NO: 443489 - DNA, 25 bp, Mus musculus
gacaaatgcctggatgactcactac

SEQ ID NO: 443490 - DNA, 25 bp, Mus musculus
gacaaatgctctcattcctagtgcc

SEQ ID NO: 443491 - DNA, 25 bp, Mus musculus
gacaaatgctctgattcctagtgcc

SEQ ID NO: 443492 - DNA, 25 bp, Mus musculus
gacaaatgctgtctgacgactctga

SEQ ID NO: 443493 - DNA, 25 bp, Mus musculus
gacaaatgctgtgtgacgactctga

SEQ ID NO: 443494 - DNA, 25 bp, Mus musculus
gacaaatgctttactcttaaaggtg

SEQ ID NO: 443495 - DNA, 25 bp, Mus musculus
gacaaatgctttagccaaaaacaat

SEQ ID NO: 443496 - DNA, 25 bp, Mus musculus
gacaaatgcttttctcttaaaggtg

SEQ ID NO: 443497 - DNA, 25 bp, Mus musculus
gacaaatgcttttgccaaaaacaat

SEQ ID NO: 443498 - DNA, 25 bp, Mus musculus
gacaaatggatacaatgtacattgt

SEQ ID NO: 443499 - DNA, 25 bp, Mus musculus
gacaaatggatagaatgtacattgt

SEQ ID NO: 443500 - DNA, 25 bp, Mus musculus
gacaaatggcatcacaggacagatt

SEQ ID NO: 443501 - DNA, 25 bp, Mus musculus
gacaaatggcatgacaggacagatt

SEQ ID NO: 443502 - DNA, 25 bp, Mus musculus
gacaaatggcgcacaactacacaat

SEQ ID NO: 443503 - DNA, 25 bp, Mus musculus
gacaaatggcgctcaactacacaat

SEQ ID NO: 443504 - DNA, 25 bp, Mus musculus
gacaaatggtcacgcttagcatggt

SEQ ID NO: 443505 - DNA, 25 bp, Mus musculus
gacaaatggtcaggcttagcatggt

SEQ ID NO: 443506 - DNA, 25 bp, Mus musculus
gacaaatgtcagaagctgtcaagat

SEQ ID NO: 443507 - DNA, 25 bp, Mus musculus
gacaaatgtcagtagctgtcaagat

SEQ ID NO: 443508 - DNA, 25 bp, Mus musculus
gacaaatgtggtcgttccttggtta

SEQ ID NO: 443509 - DNA, 25 bp, Mus musculus
gacaaatgtggtggttccttggtta

SEQ ID NO: 443510 - DNA, 25 bp, Mus musculus
gacaaatgttggcagttgcccctta

SEQ ID NO: 443511 - DNA, 25 bp, Mus musculus
gacaaatgttgggagttgcccctta

SEQ ID NO: 443512 - DNA, 25 bp, Mus musculus
gacaaatgtttgatcttaattccct

SEQ ID NO: 443513 - DNA, 25 bp, Mus musculus
gacaaatgtttgttcttaattccct

SEQ ID NO: 443514 - DNA, 25 bp, Mus musculus
gacaaattctcaattcctaggatcg

SEQ ID NO: 443515 - DNA, 25 bp, Mus musculus
gacaaattctcatttcctaggatcg

SEQ ID NO: 443516 - DNA, 25 bp, Mus musculus
gacaaattctgccttggatagcttt

SEQ ID NO: 443517 - DNA, 25 bp, Mus musculus
gacaaattctgcgttggatagcttt

SEQ ID NO: 443518 - DNA, 25 bp, Mus musculus
gacaaattcttaattattgcacctt

SEQ ID NO: 443519 - DNA, 25 bp, Mus musculus
gacaaattcttaattgcacccatct

SEQ ID NO: 443520 - DNA, 25 bp, Mus musculus
gacaaattcttatttattgcacctt

SEQ ID NO: 443521 - DNA, 25 bp, Mus musculus
gacaaattcttatttgcacccatct

SEQ ID NO: 443522 - DNA, 25 bp, Mus musculus
gacaaattgaccatgactttcaacc

SEQ ID NO: 443523 - DNA, 25 bp, Mus musculus
gacaaattgaccttgactttcaacc

SEQ ID NO: 443524 - DNA, 25 bp, Mus musculus
gacaaattgctaaggaaactcactg

SEQ ID NO: 443525 - DNA, 25 bp, Mus musculus
gacaaattgctatggaaactcactg

SEQ ID NO: 443526 - DNA, 25 bp, Mus musculus
gacaaattggtaagcttgctgttta

SEQ ID NO: 443527 - DNA, 25 bp, Mus musculus
gacaaattggtatgcttgctgttta

SEQ ID NO: 443528 - DNA, 25 bp, Mus musculus
gacaaattgtggctacagcaactct

SEQ ID NO: 443529 - DNA, 25 bp, Mus musculus
gacaaattgtgggtacagcaactct

SEQ ID NO: 443530 - DNA, 25 bp, Mus musculus
gacaaatttcacacattaactctag

SEQ ID NO: 443531 - DNA, 25 bp, Mus musculus
gacaaatttcactcattaactctag

SEQ ID NO: 443532 - DNA, 25 bp, Mus musculus
gacaaattttaacaacccatatcaa

SEQ ID NO: 443533 - DNA, 25 bp, Mus musculus
gacaaattttaagaacccatatcaa

SEQ ID NO: 443534 - DNA, 25 bp, Mus musculus
gacaaattttcacatcgctccttgc

SEQ ID NO: 443535 - DNA, 25 bp, Mus musculus
gacaaattttcactggccaagagtt

SEQ ID NO: 443536 - DNA, 25 bp, Mus musculus
gacaaattttcagatcgctccttgc

SEQ ID NO: 443537 - DNA, 25 bp, Mus musculus
gacaaattttcagtggccaagagtt

SEQ ID NO: 443538 - DNA, 25 bp, Mus musculus
gacaaatttttgctagatattttag

SEQ ID NO: 443539 - DNA, 25 bp, Mus musculus
gacaaatttttggtagatattttag

SEQ ID NO: 443540 - DNA, 25 bp, Mus musculus
gacaacaaagttctgcaaagctgct

SEQ ID NO: 443541 - DNA, 25 bp, Mus musculus
gacaacaaagttgtgcaaagctgct

SEQ ID NO: 443542 - DNA, 25 bp, Mus musculus
gacaacaaatcactgcgtagacgga

SEQ ID NO: 443543 - DNA, 25 bp, Mus musculus
gacaacaaatcagtgcgtagacgga

SEQ ID NO: 443544 - DNA, 25 bp, Mus musculus
gacaacaaatgtatctccaaagaag

SEQ ID NO: 443545 - DNA, 25 bp, Mus musculus
gacaacaaatgtcactttgcatatg

SEQ ID NO: 443546 - DNA, 25 bp, Mus musculus
gacaacaaatgtgactttgcatatg

SEQ ID NO: 443547 - DNA, 25 bp, Mus musculus
gacaacaaatgtttctccaaagaag

SEQ ID NO: 443548 - DNA, 25 bp, Mus musculus
gacaacaacaggctatcagtgagga

SEQ ID NO: 443549 - DNA, 25 bp, Mus musculus
gacaacaacagggtatcagtgagga

SEQ ID NO: 443550 - DNA, 25 bp, Mus musculus
gacaacaaccccattatgatgcagt

SEQ ID NO: 443551 - DNA, 25 bp, Mus musculus
gacaacaacccctttatgatgcagt

SEQ ID NO: 443552 - DNA, 25 bp, Mus musculus
gacaacaacgatcagctgtggccca

SEQ ID NO: 443553 - DNA, 25 bp, Mus musculus
gacaacaacgatgagctgtggccca

SEQ ID NO: 443554 - DNA, 25 bp, Mus musculus
gacaacaactgtcacattcctgtac

SEQ ID NO: 443555 - DNA, 25 bp, Mus musculus
gacaacaactgtgacattcctgtac

SEQ ID NO: 443556 - DNA, 25 bp, Mus musculus
gacaacaaggtcaagttcccattcc

SEQ ID NO: 443557 - DNA, 25 bp, Mus musculus
gacaacaaggtctagttcccattcc

SEQ ID NO: 443558 - DNA, 25 bp, Mus musculus
gacaacaagtggaggcgcatcccgt

SEQ ID NO: 443559 - DNA, 25 bp, Mus musculus
gacaacaagtggctggacctgttcg

SEQ ID NO: 443560 - DNA, 25 bp, Mus musculus
gacaacaagtgggtggacctgttcg

SEQ ID NO: 443561 - DNA, 25 bp, Mus musculus
gacaacaagtggtggcgcatcccgt

SEQ ID NO: 443562 - DNA, 25 bp, Mus musculus
gacaacaataccagtctctgcagaa

SEQ ID NO: 443563 - DNA, 25 bp, Mus musculus
gacaacaatacctgtctctgcagaa

SEQ ID NO: 443564 - DNA, 25 bp, Mus musculus
gacaacaatctccaaactgaagtgc

SEQ ID NO: 443565 - DNA, 25 bp, Mus musculus
gacaacaatctcgaaactgaagtgc

SEQ ID NO: 443566 - DNA, 25 bp, Mus musculus
gacaacaattcacaccccagatgga

SEQ ID NO: 443567 - DNA, 25 bp, Mus musculus
gacaacaattcagaccccagatgga

SEQ ID NO: 443568 - DNA, 25 bp, Mus musculus
gacaacacaaatccgtgtccactta

SEQ ID NO: 443569 - DNA, 25 bp, Mus musculus
gacaacacaaatgcgtgtccactta

SEQ ID NO: 443570 - DNA, 25 bp, Mus musculus
gacaacacacctaaaagctatagag

SEQ ID NO: 443571 - DNA, 25 bp, Mus musculus
gacaacacaccttaaagctatagag

SEQ ID NO: 443572 - DNA, 25 bp, Mus musculus
gacaacacagttagtactgaaggta

SEQ ID NO: 443573 - DNA, 25 bp, Mus musculus
gacaacacagtttgtactgaaggta

SEQ ID NO: 443574 - DNA, 25 bp, Mus musculus
gacaacaccatcataggcctcaagt

SEQ ID NO: 443575 - DNA, 25 bp, Mus musculus
gacaacaccatcttaggcctcaagt

SEQ ID NO: 443576 - DNA, 25 bp, Mus musculus
gacaacaccatgatcttcaacttta

SEQ ID NO: 443577 - DNA, 25 bp, Mus musculus
gacaacaccatgttcttcaacttta

SEQ ID NO: 443578 - DNA, 25 bp, Mus musculus
gacaacaccattaaaccagagccat

SEQ ID NO: 443579 - DNA, 25 bp, Mus musculus
gacaacaccatttaaccagagccat

SEQ ID NO: 443580 - DNA, 25 bp, Mus musculus
gacaacaccgtaaccgtttgtatgg

SEQ ID NO: 443581 - DNA, 25 bp, Mus musculus
gacaacaccgtatccgtttgtatgg

SEQ ID NO: 443582 - DNA, 25 bp, Mus musculus
gacaacacctacctttcagggtggt

SEQ ID NO: 443583 - DNA, 25 bp, Mus musculus
gacaacacctacgtttcagggtggt

SEQ ID NO: 443584 - DNA, 25 bp, Mus musculus
gacaacacgaggagccatggctgca

SEQ ID NO: 443585 - DNA, 25 bp, Mus musculus
gacaacacgaggtgccatggctgca

SEQ ID NO: 443586 - DNA, 25 bp, Mus musculus
gacaacactaaaactgccctgagct

SEQ ID NO: 443587 - DNA, 25 bp, Mus musculus
gacaacactaaatctgccctgagct

SEQ ID NO: 443588 - DNA, 25 bp, Mus musculus
gacaacactaacagctctgggatcc

SEQ ID NO: 443589 - DNA, 25 bp, Mus musculus
gacaacactaactgctctgggatcc

SEQ ID NO: 443590 - DNA, 25 bp, Mus musculus
gacaacactaatcagcatatcctat

SEQ ID NO: 443591 - DNA, 25 bp, Mus musculus
gacaacactaatgagcatatcctat

SEQ ID NO: 443592 - DNA, 25 bp, Mus musculus
gacaacactaggcatctcaactgac

SEQ ID NO: 443593 - DNA, 25 bp, Mus musculus
gacaacactagggatctcaactgac

SEQ ID NO: 443594 - DNA, 25 bp, Mus musculus
gacaacactcgacaatacaattttt

SEQ ID NO: 443595 - DNA, 25 bp, Mus musculus
gacaacactcgagaatacaattttt

SEQ ID NO: 443596 - DNA, 25 bp, Mus musculus
gacaacactgagaatacacaatgca

SEQ ID NO: 443597 - DNA, 25 bp, Mus musculus
gacaacactgagtatacacaatgca

SEQ ID NO: 443598 - DNA, 25 bp, Mus musculus
gacaacacttacatctagctcagcg

SEQ ID NO: 443599 - DNA, 25 bp, Mus musculus
gacaacacttacttctagctcagcg

SEQ ID NO: 443600 - DNA, 25 bp, Mus musculus
gacaacacttctatttatgactctc

SEQ ID NO: 443601 - DNA, 25 bp, Mus musculus
gacaacacttctttttatgactctc

SEQ ID NO: 443602 - DNA, 25 bp, Mus musculus
gacaacacttgaagggatccctcac

SEQ ID NO: 443603 - DNA, 25 bp, Mus musculus
gacaacacttgatgggatccctcac

SEQ ID NO: 443604 - DNA, 25 bp, Mus musculus
gacaacacttggacatgtgctgtac

SEQ ID NO: 443605 - DNA, 25 bp, Mus musculus
gacaacacttggtcatgtgctgtac

SEQ ID NO: 443606 - DNA, 25 bp, Mus musculus
gacaacagaccactcattttacatg

SEQ ID NO: 443607 - DNA, 25 bp, Mus musculus
gacaacagaccagtcattttacatg

SEQ ID NO: 443608 - DNA, 25 bp, Mus musculus
gacaacagagccaaccgatacagca

SEQ ID NO: 443609 - DNA, 25 bp, Mus musculus
gacaacagagcctaccgatacagca

SEQ ID NO: 443610 - DNA, 25 bp, Mus musculus
gacaacagcttgcaccttactatag

SEQ ID NO: 443611 - DNA, 25 bp, Mus musculus
gacaacagcttggaccttactatag

SEQ ID NO: 443612 - DNA, 25 bp, Mus musculus
gacaacaggatacctaggactgcat

SEQ ID NO: 443613 - DNA, 25 bp, Mus musculus
gacaacaggatagctaggactgcat

SEQ ID NO: 443614 - DNA, 25 bp, Mus musculus
gacaacaggccccacggcctaaagg

SEQ ID NO: 443615 - DNA, 25 bp, Mus musculus
gacaacaggcccgacggcctaaagg

SEQ ID NO: 443616 - DNA, 25 bp, Mus musculus
gacaacaggtatcagctctatggaa

SEQ ID NO: 443617 - DNA, 25 bp, Mus musculus
gacaacaggtatgagctctatggaa

SEQ ID NO: 443618 - DNA, 25 bp, Mus musculus
gacaacaggtgtccaccgtcatcgt

SEQ ID NO: 443619 - DNA, 25 bp, Mus musculus
gacaacaggtgtgcaccgtcatcgt

SEQ ID NO: 443620 - DNA, 25 bp, Mus musculus
gacaacagtattccataagttcggg

SEQ ID NO: 443621 - DNA, 25 bp, Mus musculus
gacaacagtattgcataagttcggg

SEQ ID NO: 443622 - DNA, 25 bp, Mus musculus
gacaacagtcacatacctgccaggc

SEQ ID NO: 443623 - DNA, 25 bp, Mus musculus
gacaacagtcacttacctgccaggc

SEQ ID NO: 443624 - DNA, 25 bp, Mus musculus
gacaacagtttgctcctcacagtga

SEQ ID NO: 443625 - DNA, 25 bp, Mus musculus
gacaacagtttggtcctcacagtga

SEQ ID NO: 443626 - DNA, 25 bp, Mus musculus
gacaacatacaacatatctaacctt

SEQ ID NO: 443627 - DNA, 25 bp, Mus musculus
gacaacatacaagatatctaacctt

SEQ ID NO: 443628 - DNA, 25 bp, Mus musculus
gacaacataccaatttattctgctt

SEQ ID NO: 443629 - DNA, 25 bp, Mus musculus
gacaacataccattttattctgctt

SEQ ID NO: 443630 - DNA, 25 bp, Mus musculus
gacaacatagcaaggccctcaatat

SEQ ID NO: 443631 - DNA, 25 bp, Mus musculus
gacaacatagcatggccctcaatat

SEQ ID NO: 443632 - DNA, 25 bp, Mus musculus
gacaacatagttacctgcggatctc

SEQ ID NO: 443633 - DNA, 25 bp, Mus musculus
gacaacatagtttcctgcggatctc

SEQ ID NO: 443634 - DNA, 25 bp, Mus musculus
gacaacatatgcaaaaagcgctcgg

SEQ ID NO: 443635 - DNA, 25 bp, Mus musculus
gacaacatatgctaaaagcgctcgg

SEQ ID NO: 443636 - DNA, 25 bp, Mus musculus
gacaacatcaacatttggctctctg

SEQ ID NO: 443637 - DNA, 25 bp, Mus musculus
gacaacatcaacttttggctctctg

SEQ ID NO: 443638 - DNA, 25 bp, Mus musculus
gacaacatccatagtataacctgct

SEQ ID NO: 443639 - DNA, 25 bp, Mus musculus
gacaacatccattgtataacctgct

SEQ ID NO: 443640 - DNA, 25 bp, Mus musculus
gacaacatcctcaagggctttgcca

SEQ ID NO: 443641 - DNA, 25 bp, Mus musculus
gacaacatcctctagggctttgcca

SEQ ID NO: 443642 - DNA, 25 bp, Mus musculus
gacaacatcgtgcttcatttggccc

SEQ ID NO: 443643 - DNA, 25 bp, Mus musculus
gacaacatcgtggttcatttggccc

SEQ ID NO: 443644 - DNA, 25 bp, Mus musculus
gacaacatctgaagacatgaccaag

SEQ ID NO: 443645 - DNA, 25 bp, Mus musculus
gacaacatctgatgacatgaccaag

SEQ ID NO: 443646 - DNA, 25 bp, Mus musculus
gacaacatctttcgtgtacacagcc

SEQ ID NO: 443647 - DNA, 25 bp, Mus musculus
gacaacatctttggtgtacacagcc

SEQ ID NO: 443648 - DNA, 25 bp, Mus musculus
gacaacatgatcaactgtgcattta

SEQ ID NO: 443649 - DNA, 25 bp, Mus musculus
gacaacatgatctactgtgcattta

SEQ ID NO: 443650 - DNA, 25 bp, Mus musculus
gacaacatggcccaattctttcgac

SEQ ID NO: 443651 - DNA, 25 bp, Mus musculus
gacaacatggccgaattctttcgac

SEQ ID NO: 443652 - DNA, 25 bp, Mus musculus
gacaacattaccagtctgtttggat

SEQ ID NO: 443653 - DNA, 25 bp, Mus musculus
gacaacattacctgtctgtttggat

SEQ ID NO: 443654 - DNA, 25 bp, Mus musculus
gacaacattgtcatcggcgctggat

SEQ ID NO: 443655 - DNA, 25 bp, Mus musculus
gacaacattgtccagggaagccttt

SEQ ID NO: 443656 - DNA, 25 bp, Mus musculus
gacaacattgtcgagggaagccttt

SEQ ID NO: 443657 - DNA, 25 bp, Mus musculus
gacaacattgtcttcggcgctggat

SEQ ID NO: 443658 - DNA, 25 bp, Mus musculus
gacaacatttacaaggtctttcaat

SEQ ID NO: 443659 - DNA, 25 bp, Mus musculus
gacaacatttactaggtctttcaat

SEQ ID NO: 443660 - DNA, 25 bp, Mus musculus
gacaacatttctcagtgaagcgagg

SEQ ID NO: 443661 - DNA, 25 bp, Mus musculus
gacaacatttctgagtgaagcgagg

SEQ ID NO: 443662 - DNA, 25 bp, Mus musculus
gacaacatttgacaggacacaccac

SEQ ID NO: 443663 - DNA, 25 bp, Mus musculus
gacaacatttgagaggacacaccac

SEQ ID NO: 443664 - DNA, 25 bp, Mus musculus
gacaacatttttcccaggagtctaa

SEQ ID NO: 443665 - DNA, 25 bp, Mus musculus
gacaacatttttgccaggagtctaa

SEQ ID NO: 443666 - DNA, 25 bp, Mus musculus
gacaaccaaagaactgaccattcat

SEQ ID NO: 443667 - DNA, 25 bp, Mus musculus
gacaaccaaagatctgaccattcat

SEQ ID NO: 443668 - DNA, 25 bp, Mus musculus
gacaaccaacacacttgggtccttg

SEQ ID NO: 443669 - DNA, 25 bp, Mus musculus
gacaaccaacactcttgggtccttg

SEQ ID NO: 443670 - DNA, 25 bp, Mus musculus
gacaaccaagttagttctaggtact

SEQ ID NO: 443671 - DNA, 25 bp, Mus musculus
gacaaccaagtttgttctaggtact

SEQ ID NO: 443672 - DNA, 25 bp, Mus musculus
gacaaccacagaacatttagcgaca

SEQ ID NO: 443673 - DNA, 25 bp, Mus musculus
gacaaccacagatcatttagcgaca

SEQ ID NO: 443674 - DNA, 25 bp, Mus musculus
gacaaccacctgctgtctgcactaa

SEQ ID NO: 443675 - DNA, 25 bp, Mus musculus
gacaaccacctggtgtctgcactaa

SEQ ID NO: 443676 - DNA, 25 bp, Mus musculus
gacaaccaccttcttccttttctgg

SEQ ID NO: 443677 - DNA, 25 bp, Mus musculus
gacaaccaccttgttccttttctgg

SEQ ID NO: 443678 - DNA, 25 bp, Mus musculus
gacaaccacgataagttaacaggta

SEQ ID NO: 443679 - DNA, 25 bp, Mus musculus
gacaaccacgattagttaacaggta

SEQ ID NO: 443680 - DNA, 25 bp, Mus musculus
gacaaccacgtcagcatgttactgc

SEQ ID NO: 443681 - DNA, 25 bp, Mus musculus
gacaaccacgtctgcatgttactgc

SEQ ID NO: 443682 - DNA, 25 bp, Mus musculus
gacaaccagacccataagccttttc

SEQ ID NO: 443683 - DNA, 25 bp, Mus musculus
gacaaccagaccgataagccttttc

SEQ ID NO: 443684 - DNA, 25 bp, Mus musculus
gacaaccagagacagctacatagtg

SEQ ID NO: 443685 - DNA, 25 bp, Mus musculus
gacaaccagagagagctacatagtg

SEQ ID NO: 443686 - DNA, 25 bp, Mus musculus
gacaaccagatcctatccatggtgg

SEQ ID NO: 443687 - DNA, 25 bp, Mus musculus
gacaaccagatcgtatccatggtgg

SEQ ID NO: 443688 - DNA, 25 bp, Mus musculus
gacaaccaggtacagggtccatagc

SEQ ID NO: 443689 - DNA, 25 bp, Mus musculus
gacaaccaggtagagggtccatagc

SEQ ID NO: 443690 - DNA, 25 bp, Mus musculus
gacaaccaggttctacagcttgaga

SEQ ID NO: 443691 - DNA, 25 bp, Mus musculus
gacaaccaggttgtacagcttgaga

SEQ ID NO: 443692 - DNA, 25 bp, Mus musculus
gacaaccagtgtacagcagcctaaa

SEQ ID NO: 443693 - DNA, 25 bp, Mus musculus
gacaaccagtgtctgctgagagtca

SEQ ID NO: 443694 - DNA, 25 bp, Mus musculus
gacaaccagtgtgtgctgagagtca

SEQ ID NO: 443695 - DNA, 25 bp, Mus musculus
gacaaccagtgttcagcagcctaaa

SEQ ID NO: 443696 - DNA, 25 bp, Mus musculus
gacaaccatcttatatacaatcaca

SEQ ID NO: 443697 - DNA, 25 bp, Mus musculus
gacaaccatcttttatacaatcaca

SEQ ID NO: 443698 - DNA, 25 bp, Mus musculus
gacaaccatgccaggtgcaggcagg

SEQ ID NO: 443699 - DNA, 25 bp, Mus musculus
gacaaccatgcctggtgcaggcagg

SEQ ID NO: 443700 - DNA, 25 bp, Mus musculus
gacaaccatgctcagctcagggaga

SEQ ID NO: 443701 - DNA, 25 bp, Mus musculus
gacaaccatgctgagctcagggaga

SEQ ID NO: 443702 - DNA, 25 bp, Mus musculus
gacaaccatggtcactaagccaatt

SEQ ID NO: 443703 - DNA, 25 bp, Mus musculus
gacaaccatggtgactaagccaatt

SEQ ID NO: 443704 - DNA, 25 bp, Mus musculus
gacaaccatttcctctctgaaagag

SEQ ID NO: 443705 - DNA, 25 bp, Mus musculus
gacaaccatttcgtctctgaaagag

SEQ ID NO: 443706 - DNA, 25 bp, Mus musculus
gacaacccaaccaggtgcaaacata

SEQ ID NO: 443707 - DNA, 25 bp, Mus musculus
gacaacccaacctggtgcaaacata

SEQ ID NO: 443708 - DNA, 25 bp, Mus musculus
gacaacccaccaagaaggagctttt

SEQ ID NO: 443709 - DNA, 25 bp, Mus musculus
gacaacccaccatgaaggagctttt

SEQ ID NO: 443710 - DNA, 25 bp, Mus musculus
gacaacccagatcaaccgcaaagct

SEQ ID NO: 443711 - DNA, 25 bp, Mus musculus
gacaacccagatgaaccgcaaagct

SEQ ID NO: 443712 - DNA, 25 bp, Mus musculus
gacaacccagtgcacagacgcgaat

SEQ ID NO: 443713 - DNA, 25 bp, Mus musculus
gacaacccagtggacagacgcgaat

SEQ ID NO: 443714 - DNA, 25 bp, Mus musculus
gacaaccccatgaaactgtatcaaa

SEQ ID NO: 443715 - DNA, 25 bp, Mus musculus
gacaaccccatgtaactgtatcaaa

SEQ ID NO: 443716 - DNA, 25 bp, Mus musculus
gacaacccctttagatgtggtccaa

SEQ ID NO: 443717 - DNA, 25 bp, Mus musculus
gacaaccccttttgatgtggtccaa

SEQ ID NO: 443718 - DNA, 25 bp, Mus musculus
gacaaccctcagattaaaaagtatg

SEQ ID NO: 443719 - DNA, 25 bp, Mus musculus
gacaaccctcagtttaaaaagtatg

SEQ ID NO: 443720 - DNA, 25 bp, Mus musculus
gacaaccctgtaactattcacagct

SEQ ID NO: 443721 - DNA, 25 bp, Mus musculus
gacaaccctgtatctattcacagct

SEQ ID NO: 443722 - DNA, 25 bp, Mus musculus
gacaaccgaaatctggtccccagga

SEQ ID NO: 443723 - DNA, 25 bp, Mus musculus
gacaaccgaaatgtggtccccagga

SEQ ID NO: 443724 - DNA, 25 bp, Mus musculus
gacaaccgagagcatttcaagcagt

SEQ ID NO: 443725 - DNA, 25 bp, Mus musculus
gacaaccgagaggatttcaagcagt

SEQ ID NO: 443726 - DNA, 25 bp, Mus musculus
gacaacctacttatccaactacaga

SEQ ID NO: 443727 - DNA, 25 bp, Mus musculus
gacaacctacttttccaactacaga

SEQ ID NO: 443728 - DNA, 25 bp, Mus musculus
gacaacctataaaaaccacccgcag

SEQ ID NO: 443729 - DNA, 25 bp, Mus musculus
gacaacctataataaccacccgcag

SEQ ID NO: 443730 - DNA, 25 bp, Mus musculus
gacaacctatataagatcccagtag

SEQ ID NO: 443731 - DNA, 25 bp, Mus musculus
gacaacctatattagatcccagtag

SEQ ID NO: 443732 - DNA, 25 bp, Mus musculus
gacaacctcaggagttcctcaaaag

SEQ ID NO: 443733 - DNA, 25 bp, Mus musculus
gacaacctcaggtgttcctcaaaag

SEQ ID NO: 443734 - DNA, 25 bp, Mus musculus
gacaacctcgttccagaattctgcc

SEQ ID NO: 443735 - DNA, 25 bp, Mus musculus
gacaacctcgttgcagaattctgcc

SEQ ID NO: 443736 - DNA, 25 bp, Mus musculus
gacaacctctttaatatttctcgat

SEQ ID NO: 443737 - DNA, 25 bp, Mus musculus
gacaacctcttttatatttctcgat

SEQ ID NO: 443738 - DNA, 25 bp, Mus musculus
gacaacctgactaggagagcctcta

SEQ ID NO: 443739 - DNA, 25 bp, Mus musculus
gacaacctgacttggagagcctcta

SEQ ID NO: 443740 - DNA, 25 bp, Mus musculus
gacaacctgagcacattccctagga

SEQ ID NO: 443741 - DNA, 25 bp, Mus musculus
gacaacctgagcatgatgctaggaa

SEQ ID NO: 443742 - DNA, 25 bp, Mus musculus
gacaacctgagctcattccctagga

SEQ ID NO: 443743 - DNA, 25 bp, Mus musculus
gacaacctgagcttgatgctaggaa

SEQ ID NO: 443744 - DNA, 25 bp, Mus musculus
gacaacctgcacagaagacctgggt

SEQ ID NO: 443745 - DNA, 25 bp, Mus musculus
gacaacctgcactgaagacctgggt

SEQ ID NO: 443746 - DNA, 25 bp, Mus musculus
gacaacctgcatatggtcttctctg

SEQ ID NO: 443747 - DNA, 25 bp, Mus musculus
gacaacctgcatttggtcttctctg

SEQ ID NO: 443748 - DNA, 25 bp, Mus musculus
gacaacctggaacagacttttatct

SEQ ID NO: 443749 - DNA, 25 bp, Mus musculus
gacaacctggaagagacttttatct

SEQ ID NO: 443750 - DNA, 25 bp, Mus musculus
gacaacctggacaagctgcaggcgt

SEQ ID NO: 443751 - DNA, 25 bp, Mus musculus
gacaacctggactagctgcaggcgt

SEQ ID NO: 443752 - DNA, 25 bp, Mus musculus
gacaacctggagagacatggcagaa

SEQ ID NO: 443753 - DNA, 25 bp, Mus musculus
gacaacctggagtgacatggcagaa

SEQ ID NO: 443754 - DNA, 25 bp, Mus musculus
gacaacctggcaagtgactttctgt

SEQ ID NO: 443755 - DNA, 25 bp, Mus musculus
gacaacctggcatgtgactttctgt

SEQ ID NO: 443756 - DNA, 25 bp, Mus musculus
gacaacctgggtaggagtccaagaa

SEQ ID NO: 443757 - DNA, 25 bp, Mus musculus
gacaacctgggttggagtccaagaa

SEQ ID NO: 443758 - DNA, 25 bp, Mus musculus
gacaacctgtcaccccatcaggagt

SEQ ID NO: 443759 - DNA, 25 bp, Mus musculus
gacaacctgtcagcccatcaggagt

SEQ ID NO: 443760 - DNA, 25 bp, Mus musculus
gacaacctgtctctattctgttaca

SEQ ID NO: 443761 - DNA, 25 bp, Mus musculus
gacaacctgtctgtattctgttaca

SEQ ID NO: 443762 - DNA, 25 bp, Mus musculus
gacaacctgtgtataatctcaggga

SEQ ID NO: 443763 - DNA, 25 bp, Mus musculus
gacaacctgtgtttaatctcaggga

SEQ ID NO: 443764 - DNA, 25 bp, Mus musculus
gacaaccttctgataccccattgtt

SEQ ID NO: 443765 - DNA, 25 bp, Mus musculus
gacaaccttctgttaccccattgtt

SEQ ID NO: 443766 - DNA, 25 bp, Mus musculus
gacaaccttgaaattctcagcccac

SEQ ID NO: 443767 - DNA, 25 bp, Mus musculus
gacaaccttgaatttctcagcccac

SEQ ID NO: 443768 - DNA, 25 bp, Mus musculus
gacaacgaagagaggaatcacccta

SEQ ID NO: 443769 - DNA, 25 bp, Mus musculus
gacaacgaagagtggaatcacccta

SEQ ID NO: 443770 - DNA, 25 bp, Mus musculus
gacaacgacaaccagtacaccacag

SEQ ID NO: 443771 - DNA, 25 bp, Mus musculus
gacaacgacaacgagtacaccacag

SEQ ID NO: 443772 - DNA, 25 bp, Mus musculus
gacaacgacaagaacattgccctgg

SEQ ID NO: 443773 - DNA, 25 bp, Mus musculus
gacaacgacaagtacattgccctgg

SEQ ID NO: 443774 - DNA, 25 bp, Mus musculus
gacaacgacaataaagtgcgagact

SEQ ID NO: 443775 - DNA, 25 bp, Mus musculus
gacaacgacaattaagtgcgagact

SEQ ID NO: 443776 - DNA, 25 bp, Mus musculus
gacaacgactctaggtagagaactg

SEQ ID NO: 443777 - DNA, 25 bp, Mus musculus
gacaacgactcttggtagagaactg

SEQ ID NO: 443778 - DNA, 25 bp, Mus musculus
gacaacgagtacaccacagagctgg

SEQ ID NO: 443779 - DNA, 25 bp, Mus musculus
gacaacgagtactccacagagctgg

SEQ ID NO: 443780 - DNA, 25 bp, Mus musculus
gacaacgatgacagccattatgccc

SEQ ID NO: 443781 - DNA, 25 bp, Mus musculus
gacaacgatgaccaccatgatgttt

SEQ ID NO: 443782 - DNA, 25 bp, Mus musculus
gacaacgatgacgaccatgatgttt

SEQ ID NO: 443783 - DNA, 25 bp, Mus musculus
gacaacgatgactgccattatgccc

SEQ ID NO: 443784 - DNA, 25 bp, Mus musculus
gacaacgatgctagatgcttgcgag

SEQ ID NO: 443785 - DNA, 25 bp, Mus musculus
gacaacgatgcttgatgcttgcgag

SEQ ID NO: 443786 - DNA, 25 bp, Mus musculus
gacaacgatttcactgtggatggtg

SEQ ID NO: 443787 - DNA, 25 bp, Mus musculus
gacaacgatttctctgtggatggtg

SEQ ID NO: 443788 - DNA, 25 bp, Mus musculus
gacaacgcactgatgaggccaggaa

SEQ ID NO: 443789 - DNA, 25 bp, Mus musculus
gacaacgcactgttgaggccaggaa

SEQ ID NO: 443790 - DNA, 25 bp, Mus musculus
gacaacggaatgatcacgaccgata

SEQ ID NO: 443791 - DNA, 25 bp, Mus musculus
gacaacggaatgttcacgaccgata

SEQ ID NO: 443792 - DNA, 25 bp, Mus musculus
gacaacggatgaaatggttcccttt

SEQ ID NO: 443793 - DNA, 25 bp, Mus musculus
gacaacggatgatatggttcccttt

SEQ ID NO: 443794 - DNA, 25 bp, Mus musculus
gacaacggctggcactgacctagct

SEQ ID NO: 443795 - DNA, 25 bp, Mus musculus
gacaacggctgggactgacctagct

SEQ ID NO: 443796 - DNA, 25 bp, Mus musculus
gacaacgggctgagtggcaaaatct

SEQ ID NO: 443797 - DNA, 25 bp, Mus musculus
gacaacgggctgtgtggcaaaatct

SEQ ID NO: 443798 - DNA, 25 bp, Mus musculus
gacaacgtaaagaactatgagaact

SEQ ID NO: 443799 - DNA, 25 bp, Mus musculus
gacaacgtaaagtactatgagaact

SEQ ID NO: 443800 - DNA, 25 bp, Mus musculus
gacaacgtggatctggtattttctt

SEQ ID NO: 443801 - DNA, 25 bp, Mus musculus
gacaacgtggatgtggtattttctt

SEQ ID NO: 443802 - DNA, 25 bp, Mus musculus
gacaacgtggctatgtgcaatggag

SEQ ID NO: 443803 - DNA, 25 bp, Mus musculus
gacaacgtggctttgtgcaatggag

SEQ ID NO: 443804 - DNA, 25 bp, Mus musculus
gacaacgtgggccatgtcatcattg

SEQ ID NO: 443805 - DNA, 25 bp, Mus musculus
gacaacgtgggcgatgtcatcattg

SEQ ID NO: 443806 - DNA, 25 bp, Mus musculus
gacaacgttaatcagtaattcccct

SEQ ID NO: 443807 - DNA, 25 bp, Mus musculus
gacaacgttaatgagtaattcccct

SEQ ID NO: 443808 - DNA, 25 bp, Mus musculus
gacaacgttcagctgtgtgcttttg

SEQ ID NO: 443809 - DNA, 25 bp, Mus musculus
gacaacgttcaggtgtgtgcttttg

SEQ ID NO: 443810 - DNA, 25 bp, Mus musculus
gacaacgttttgatggtaactcatg

SEQ ID NO: 443811 - DNA, 25 bp, Mus musculus
gacaacgttttgttggtaactcatg

SEQ ID NO: 443812 - DNA, 25 bp, Mus musculus
gacaactaacttcttgctgctgtat

SEQ ID NO: 443813 - DNA, 25 bp, Mus musculus
gacaactaacttgttgctgctgtat

SEQ ID NO: 443814 - DNA, 25 bp, Mus musculus
gacaactaagcaactggaagtcata

SEQ ID NO: 443815 - DNA, 25 bp, Mus musculus
gacaactaagcatctggaagtcata

SEQ ID NO: 443816 - DNA, 25 bp, Mus musculus
gacaactacatcaaactccttacgg

SEQ ID NO: 443817 - DNA, 25 bp, Mus musculus
gacaactacatctaactccttacgg

SEQ ID NO: 443818 - DNA, 25 bp, Mus musculus
gacaactacccgaaagatcgtggat

SEQ ID NO: 443819 - DNA, 25 bp, Mus musculus
gacaactacccgtaagatcgtggat

SEQ ID NO: 443820 - DNA, 25 bp, Mus musculus
gacaactactgtattctaaaggaat

SEQ ID NO: 443821 - DNA, 25 bp, Mus musculus
gacaactactgttttctaaaggaat

SEQ ID NO: 443822 - DNA, 25 bp, Mus musculus
gacaactactttaaagagagatctg

SEQ ID NO: 443823 - DNA, 25 bp, Mus musculus
gacaactacttttaagagagatctg

SEQ ID NO: 443824 - DNA, 25 bp, Mus musculus
gacaactagcgccacacaggaaacc

SEQ ID NO: 443825 - DNA, 25 bp, Mus musculus
gacaactagcgcgacacaggaaacc

SEQ ID NO: 443826 - DNA, 25 bp, Mus musculus
gacaactagggacaatggatactta

SEQ ID NO: 443827 - DNA, 25 bp, Mus musculus
gacaactagggagaatggatactta

SEQ ID NO: 443828 - DNA, 25 bp, Mus musculus
gacaactatgagcaggcccggaagt

SEQ ID NO: 443829 - DNA, 25 bp, Mus musculus
gacaactatgaggaggcccggaagt

SEQ ID NO: 443830 - DNA, 25 bp, Mus musculus
gacaactattctatctgctagtgta

SEQ ID NO: 443831 - DNA, 25 bp, Mus musculus
gacaactattctttctgctagtgta

SEQ ID NO: 443832 - DNA, 25 bp, Mus musculus
gacaactcacatatatgctgttaac

SEQ ID NO: 443833 - DNA, 25 bp, Mus musculus
gacaactcacatttatgctgttaac

SEQ ID NO: 443834 - DNA, 25 bp, Mus musculus
gacaactcagataggactccacagt

SEQ ID NO: 443835 - DNA, 25 bp, Mus musculus
gacaactcagattggactccacagt

SEQ ID NO: 443836 - DNA, 25 bp, Mus musculus
gacaactcagttccttctaaaagtg

SEQ ID NO: 443837 - DNA, 25 bp, Mus musculus
gacaactcagttgcttctaaaagtg

SEQ ID NO: 443838 - DNA, 25 bp, Mus musculus
gacaactcatggctttggacaccta

SEQ ID NO: 443839 - DNA, 25 bp, Mus musculus
gacaactcatgggtttggacaccta

SEQ ID NO: 443840 - DNA, 25 bp, Mus musculus
gacaactccaacaccatagcaagat

SEQ ID NO: 443841 - DNA, 25 bp, Mus musculus
gacaactccaactccatagcaagat

SEQ ID NO: 443842 - DNA, 25 bp, Mus musculus
gacaactccaatactctacaaatga

SEQ ID NO: 443843 - DNA, 25 bp, Mus musculus
gacaactccaattctctacaaatga

SEQ ID NO: 443844 - DNA, 25 bp, Mus musculus
gacaactcccctaaagtgcacaggg

SEQ ID NO: 443845 - DNA, 25 bp, Mus musculus
gacaactccccttaagtgcacaggg

SEQ ID NO: 443846 - DNA, 25 bp, Mus musculus
gacaactcctgcaggatatggcgtt

SEQ ID NO: 443847 - DNA, 25 bp, Mus musculus
gacaactcctgctggatatggcgtt

SEQ ID NO: 443848 - DNA, 25 bp, Mus musculus
gacaactccttgctcttggaacagg

SEQ ID NO: 443849 - DNA, 25 bp, Mus musculus
gacaactccttggtcttggaacagg

SEQ ID NO: 443850 - DNA, 25 bp, Mus musculus
gacaactcggacaacaatcatcact

SEQ ID NO: 443851 - DNA, 25 bp, Mus musculus
gacaactcggacagatttgaggaac

SEQ ID NO: 443852 - DNA, 25 bp, Mus musculus
gacaactcggactacaatcatcact

SEQ ID NO: 443853 - DNA, 25 bp, Mus musculus
gacaactcggactgatttgaggaac

SEQ ID NO: 443854 - DNA, 25 bp, Mus musculus
gacaactctacaatgggctacatga

SEQ ID NO: 443855 - DNA, 25 bp, Mus musculus
gacaactctacattgggctacatga

SEQ ID NO: 443856 - DNA, 25 bp, Mus musculus
gacaactctatcatattgcctaatg

SEQ ID NO: 443857 - DNA, 25 bp, Mus musculus
gacaactctatcttattgcctaatg

SEQ ID NO: 443858 - DNA, 25 bp, Mus musculus
gacaactctgaaacgtgttaactct

SEQ ID NO: 443859 - DNA, 25 bp, Mus musculus
gacaactctgaatcgtgttaactct

SEQ ID NO: 443860 - DNA, 25 bp, Mus musculus
gacaactctgctcaggactttggag

SEQ ID NO: 443861 - DNA, 25 bp, Mus musculus
gacaactctgctgaggactttggag

SEQ ID NO: 443862 - DNA, 25 bp, Mus musculus
gacaactctggtctagctgagacat

SEQ ID NO: 443863 - DNA, 25 bp, Mus musculus
gacaactctggtgtagctgagacat

SEQ ID NO: 443864 - DNA, 25 bp, Mus musculus
gacaactcttctcaagtgtgtgtgc

SEQ ID NO: 443865 - DNA, 25 bp, Mus musculus
gacaactcttctgaagtgtgtgtgc

SEQ ID NO: 443866 - DNA, 25 bp, Mus musculus
gacaactctttcattgctaattcac

SEQ ID NO: 443867 - DNA, 25 bp, Mus musculus
gacaactctttctttgctaattcac

SEQ ID NO: 443868 - DNA, 25 bp, Mus musculus
gacaactgacagactgaaaccacca

SEQ ID NO: 443869 - DNA, 25 bp, Mus musculus
gacaactgacagtctgaaaccacca

SEQ ID NO: 443870 - DNA, 25 bp, Mus musculus
gacaactgaccactgtcaactgtga

SEQ ID NO: 443871 - DNA, 25 bp, Mus musculus
gacaactgaccagtgtcaactgtga

SEQ ID NO: 443872 - DNA, 25 bp, Mus musculus
gacaactgagttattactcaaacac

SEQ ID NO: 443873 - DNA, 25 bp, Mus musculus
gacaactgagttccccattacacaa

SEQ ID NO: 443874 - DNA, 25 bp, Mus musculus
gacaactgagttgcccattacacaa

SEQ ID NO: 443875 - DNA, 25 bp, Mus musculus
gacaactgagtttttactcaaacac

SEQ ID NO: 443876 - DNA, 25 bp, Mus musculus
gacaactgcggaacattgccaggaa

SEQ ID NO: 443877 - DNA, 25 bp, Mus musculus
gacaactgcggatcattgccaggaa

SEQ ID NO: 443878 - DNA, 25 bp, Mus musculus
gacaactgcttgcattttgcttttg

SEQ ID NO: 443879 - DNA, 25 bp, Mus musculus
gacaactgcttggattttgcttttg

SEQ ID NO: 443880 - DNA, 25 bp, Mus musculus
gacaactggcacaagcgccgcaaga

SEQ ID NO: 443881 - DNA, 25 bp, Mus musculus
gacaactggcactagcgccgcaaga

SEQ ID NO: 443882 - DNA, 25 bp, Mus musculus
gacaactgggccactaggaggacac

SEQ ID NO: 443883 - DNA, 25 bp, Mus musculus
gacaactgggcctctaggaggacac

SEQ ID NO: 443884 - DNA, 25 bp, Mus musculus
gacaactggtcaacaggttcgcacc

SEQ ID NO: 443885 - DNA, 25 bp, Mus musculus
gacaactggtcatcaggttcgcacc

SEQ ID NO: 443886 - DNA, 25 bp, Mus musculus
gacaactgtattactttgctcaaca

SEQ ID NO: 443887 - DNA, 25 bp, Mus musculus
gacaactgtatttctttgctcaaca

SEQ ID NO: 443888 - DNA, 25 bp, Mus musculus
gacaactgtctgatttactgaaatc

SEQ ID NO: 443889 - DNA, 25 bp, Mus musculus
gacaactgtctgttttactgaaatc

SEQ ID NO: 443890 - DNA, 25 bp, Mus musculus
gacaactgtgagagctgctcctgta

SEQ ID NO: 443891 - DNA, 25 bp, Mus musculus
gacaactgtgagtgctgctcctgta

SEQ ID NO: 443892 - DNA, 25 bp, Mus musculus
gacaactgtgttacatttgctgtaa

SEQ ID NO: 443893 - DNA, 25 bp, Mus musculus
gacaactgtgtttcatttgctgtaa

SEQ ID NO: 443894 - DNA, 25 bp, Mus musculus
gacaactgttcaaatctccatcttc

SEQ ID NO: 443895 - DNA, 25 bp, Mus musculus
gacaactgttcaccaagcttataaa

SEQ ID NO: 443896 - DNA, 25 bp, Mus musculus
gacaactgttcagcaagcttataaa

SEQ ID NO: 443897 - DNA, 25 bp, Mus musculus
gacaactgttcatatctccatcttc

SEQ ID NO: 443898 - DNA, 25 bp, Mus musculus
gacaactgtttcacagatcctcttt

SEQ ID NO: 443899 - DNA, 25 bp, Mus musculus
gacaactgtttctcagatcctcttt

SEQ ID NO: 443900 - DNA, 25 bp, Mus musculus
gacaacttagacatctgtagtgtaa

SEQ ID NO: 443901 - DNA, 25 bp, Mus musculus
gacaacttagacttctgtagtgtaa

SEQ ID NO: 443902 - DNA, 25 bp, Mus musculus
gacaacttagagaccatgatcttta

SEQ ID NO: 443903 - DNA, 25 bp, Mus musculus
gacaacttagagtccatgatcttta

SEQ ID NO: 443904 - DNA, 25 bp, Mus musculus
gacaacttagccatgacatcaaccg

SEQ ID NO: 443905 - DNA, 25 bp, Mus musculus
gacaacttagccttgacatcaaccg

SEQ ID NO: 443906 - DNA, 25 bp, Mus musculus
gacaacttagtccttatgaagatac

SEQ ID NO: 443907 - DNA, 25 bp, Mus musculus
gacaacttagtcgttatgaagatac

SEQ ID NO: 443908 - DNA, 25 bp, Mus musculus
gacaacttatttaattcgaatccca

SEQ ID NO: 443909 - DNA, 25 bp, Mus musculus
gacaacttattttattcgaatccca

SEQ ID NO: 443910 - DNA, 25 bp, Mus musculus
gacaacttccaaatgattctgcagg

SEQ ID NO: 443911 - DNA, 25 bp, Mus musculus
gacaacttccaattgattctgcagg

SEQ ID NO: 443912 - DNA, 25 bp, Mus musculus
gacaacttcctcaaagattgctgaa

SEQ ID NO: 443913 - DNA, 25 bp, Mus musculus
gacaacttcctctaagattgctgaa

SEQ ID NO: 443914 - DNA, 25 bp, Mus musculus
gacaacttcgagacagatgccacat

SEQ ID NO: 443915 - DNA, 25 bp, Mus musculus
gacaacttcgagtcagatgccacat

SEQ ID NO: 443916 - DNA, 25 bp, Mus musculus
gacaacttctaaatcataaccttaa

SEQ ID NO: 443917 - DNA, 25 bp, Mus musculus
gacaacttctaattcataaccttaa

SEQ ID NO: 443918 - DNA, 25 bp, Mus musculus
gacaacttctccaagtttggtcttt

SEQ ID NO: 443919 - DNA, 25 bp, Mus musculus
gacaacttctcctagtttggtcttt

SEQ ID NO: 443920 - DNA, 25 bp, Mus musculus
gacaacttctgcattccatagttaa

SEQ ID NO: 443921 - DNA, 25 bp, Mus musculus
gacaacttctgctttccatagttaa

SEQ ID NO: 443922 - DNA, 25 bp, Mus musculus
gacaacttgacaaacctcaaccaac

SEQ ID NO: 443923 - DNA, 25 bp, Mus musculus
gacaacttgacatacctcaaccaac

SEQ ID NO: 443924 - DNA, 25 bp, Mus musculus
gacaacttgagtacactccctgtga

SEQ ID NO: 443925 - DNA, 25 bp, Mus musculus
gacaacttgagttcactccctgtga

SEQ ID NO: 443926 - DNA, 25 bp, Mus musculus
gacaacttgcagaggaggaacccat

SEQ ID NO: 443927 - DNA, 25 bp, Mus musculus
gacaacttgcagtggaggaacccat

SEQ ID NO: 443928 - DNA, 25 bp, Mus musculus
gacaacttgctgcactacaatcgaa

SEQ ID NO: 443929 - DNA, 25 bp, Mus musculus
gacaacttgctggactacaatcgaa

SEQ ID NO: 443930 - DNA, 25 bp, Mus musculus
gacaacttgggaatgagtcactcca

SEQ ID NO: 443931 - DNA, 25 bp, Mus musculus
gacaacttgggattgagtcactcca

SEQ ID NO: 443932 - DNA, 25 bp, Mus musculus
gacaacttgtggcttgatgacccag

SEQ ID NO: 443933 - DNA, 25 bp, Mus musculus
gacaacttgtgggttgatgacccag

SEQ ID NO: 443934 - DNA, 25 bp, Mus musculus
gacaactttacacaatgcagccttt

SEQ ID NO: 443935 - DNA, 25 bp, Mus musculus
gacaactttacagaatgcagccttt

SEQ ID NO: 443936 - DNA, 25 bp, Mus musculus
gacaactttcctcagtttatcttac

SEQ ID NO: 443937 - DNA, 25 bp, Mus musculus
gacaactttcctgagtttatcttac

SEQ ID NO: 443938 - DNA, 25 bp, Mus musculus
gacaactttgaacaccaggactcca

SEQ ID NO: 443939 - DNA, 25 bp, Mus musculus
gacaactttgaagaccaggactcca

SEQ ID NO: 443940 - DNA, 25 bp, Mus musculus
gacaactttggcatcgggactgaca

SEQ ID NO: 443941 - DNA, 25 bp, Mus musculus
gacaactttggcttcgggactgaca

SEQ ID NO: 443942 - DNA, 25 bp, Mus musculus
gacaactttgttctgcctttttagg

SEQ ID NO: 443943 - DNA, 25 bp, Mus musculus
gacaactttgttgtgcctttttagg

SEQ ID NO: 443944 - DNA, 25 bp, Mus musculus
gacaacttttacattccactctaga

SEQ ID NO: 443945 - DNA, 25 bp, Mus musculus
gacaacttttactttccactctaga

SEQ ID NO: 443946 - DNA, 25 bp, Mus musculus
gacaacttttggagctatgcagtga

SEQ ID NO: 443947 - DNA, 25 bp, Mus musculus
gacaacttttggtgctatgcagtga

SEQ ID NO: 443948 - DNA, 25 bp, Mus musculus
gacaagaaaattctgcccagggatt

SEQ ID NO: 443949 - DNA, 25 bp, Mus musculus
gacaagaaaattgtgcccagggatt

SEQ ID NO: 443950 - DNA, 25 bp, Mus musculus
gacaagaaaccgaggctctggaggt

SEQ ID NO: 443951 - DNA, 25 bp, Mus musculus
gacaagaaaccgtggctctggaggt

SEQ ID NO: 443952 - DNA, 25 bp, Mus musculus
gacaagaaacttccacgatcgcgcc

SEQ ID NO: 443953 - DNA, 25 bp, Mus musculus
gacaagaaacttgcacgatcgcgcc

SEQ ID NO: 443954 - DNA, 25 bp, Mus musculus
gacaagaacaggctcgtctcctcca

SEQ ID NO: 443955 - DNA, 25 bp, Mus musculus
gacaagaacagggtcgtctcctcca

SEQ ID NO: 443956 - DNA, 25 bp, Mus musculus
gacaagaacattcaatcccgggaga

SEQ ID NO: 443957 - DNA, 25 bp, Mus musculus
gacaagaacattgaatcccgggaga

SEQ ID NO: 443958 - DNA, 25 bp, Mus musculus
gacaagaactacattaccccagagg

SEQ ID NO: 443959 - DNA, 25 bp, Mus musculus
gacaagaactactttaccccagagg

SEQ ID NO: 443960 - DNA, 25 bp, Mus musculus
gacaagaactccaggagccggaccc

SEQ ID NO: 443961 - DNA, 25 bp, Mus musculus
gacaagaactcctggagccggaccc

SEQ ID NO: 443962 - DNA, 25 bp, Mus musculus
gacaagaacttactgtactcaagct

SEQ ID NO: 443963 - DNA, 25 bp, Mus musculus
gacaagaacttagtgtactcaagct

SEQ ID NO: 443964 - DNA, 25 bp, Mus musculus
gacaagaagctcctggccaccaatg

SEQ ID NO: 443965 - DNA, 25 bp, Mus musculus
gacaagaagctcgtggccaccaatg

SEQ ID NO: 443966 - DNA, 25 bp, Mus musculus
gacaagaaggatctgttggccacac

SEQ ID NO: 443967 - DNA, 25 bp, Mus musculus
gacaagaaggatgtgttggccacac

SEQ ID NO: 443968 - DNA, 25 bp, Mus musculus
gacaagaagtggagcgtccagccta

SEQ ID NO: 443969 - DNA, 25 bp, Mus musculus
gacaagaagtggtgcgtccagccta

SEQ ID NO: 443970 - DNA, 25 bp, Mus musculus
gacaagaatatgctgcaggcccaca

SEQ ID NO: 443971 - DNA, 25 bp, Mus musculus
gacaagaatatggtgcaggcccaca

SEQ ID NO: 443972 - DNA, 25 bp, Mus musculus
gacaagaatgggaccatccatggac

SEQ ID NO: 443973 - DNA, 25 bp, Mus musculus
gacaagaatgggtccatccatggac

SEQ ID NO: 443974 - DNA, 25 bp, Mus musculus
gacaagaattacacaggctgcatgt

SEQ ID NO: 443975 - DNA, 25 bp, Mus musculus
gacaagaattactcaggctgcatgt

SEQ ID NO: 443976 - DNA, 25 bp, Mus musculus
gacaagaattagagcagtgcggctt

SEQ ID NO: 443977 - DNA, 25 bp, Mus musculus
gacaagaattagtgcagtgcggctt

SEQ ID NO: 443978 - DNA, 25 bp, Mus musculus
gacaagacaaagattccctctctca

SEQ ID NO: 443979 - DNA, 25 bp, Mus musculus
gacaagacaaagtttccctctctca

SEQ ID NO: 443980 - DNA, 25 bp, Mus musculus
gacaagacaacacaacccggaagca

SEQ ID NO: 443981 - DNA, 25 bp, Mus musculus
gacaagacaacagaacccggaagca

SEQ ID NO: 443982 - DNA, 25 bp, Mus musculus
gacaagacaagcatccaggtagcta

SEQ ID NO: 443983 - DNA, 25 bp, Mus musculus
gacaagacaagcttccaggtagcta

SEQ ID NO: 443984 - DNA, 25 bp, Mus musculus
gacaagacacctactgtatctgaca

SEQ ID NO: 443985 - DNA, 25 bp, Mus musculus
gacaagacaccttctgtatctgaca

SEQ ID NO: 443986 - DNA, 25 bp, Mus musculus
gacaagacagacattcttccatcta

SEQ ID NO: 443987 - DNA, 25 bp, Mus musculus
gacaagacagactttcttccatcta

SEQ ID NO: 443988 - DNA, 25 bp, Mus musculus
gacaagacagagaccccaggaatat

SEQ ID NO: 443989 - DNA, 25 bp, Mus musculus
gacaagacagagtccccaggaatat

SEQ ID NO: 443990 - DNA, 25 bp, Mus musculus
gacaagacatggacagctgcctggt

SEQ ID NO: 443991 - DNA, 25 bp, Mus musculus
gacaagacatggtcagctgcctggt

SEQ ID NO: 443992 - DNA, 25 bp, Mus musculus
gacaagaccactagaacgaacccag

SEQ ID NO: 443993 - DNA, 25 bp, Mus musculus
gacaagaccacttgaacgaacccag

SEQ ID NO: 443994 - DNA, 25 bp, Mus musculus
gacaagaccagtatctctaattttt

SEQ ID NO: 443995 - DNA, 25 bp, Mus musculus
gacaagaccagtttctctaattttt

SEQ ID NO: 443996 - DNA, 25 bp, Mus musculus
gacaagaccatgatctgcgcaggtg

SEQ ID NO: 443997 - DNA, 25 bp, Mus musculus
gacaagaccatgttctgcgcaggtg

SEQ ID NO: 443998 - DNA, 25 bp, Mus musculus
gacaagacctacacatgtagcctag

SEQ ID NO: 443999 - DNA, 25 bp, Mus musculus
gacaagacctactcatgtagcctag

SEQ ID NO: 444000 - DNA, 25 bp, Mus musculus
gacaagaccttacatcagagccctt

SEQ ID NO: 444001 - DNA, 25 bp, Mus musculus
gacaagaccttagatcagagccctt

SEQ ID NO: 444002 - DNA, 25 bp, Mus musculus
gacaagacgcagctgctttcttagt

SEQ ID NO: 444003 - DNA, 25 bp, Mus musculus
gacaagacgcaggtgctttcttagt

SEQ ID NO: 444004 - DNA, 25 bp, Mus musculus
gacaagactacaaatgctgcaactg

SEQ ID NO: 444005 - DNA, 25 bp, Mus musculus
gacaagactacatatgctgcaactg

SEQ ID NO: 444006 - DNA, 25 bp, Mus musculus
gacaagactaccatgtgggcaacag

SEQ ID NO: 444007 - DNA, 25 bp, Mus musculus
gacaagactaccttgtgggcaacag

SEQ ID NO: 444008 - DNA, 25 bp, Mus musculus
gacaagacttacaaggcacctacca

SEQ ID NO: 444009 - DNA, 25 bp, Mus musculus
gacaagacttactaggcacctacca

SEQ ID NO: 444010 - DNA, 25 bp, Mus musculus
gacaagacttcacatagtaaccaga

SEQ ID NO: 444011 - DNA, 25 bp, Mus musculus
gacaagacttcagatagtaaccaga

SEQ ID NO: 444012 - DNA, 25 bp, Mus musculus
gacaagagactcatcccctaaggtg

SEQ ID NO: 444013 - DNA, 25 bp, Mus musculus
gacaagagactcttcccctaaggtg

SEQ ID NO: 444014 - DNA, 25 bp, Mus musculus
gacaagagactgctcctatcaagga

SEQ ID NO: 444015 - DNA, 25 bp, Mus musculus
gacaagagactggtcctatcaagga

SEQ ID NO: 444016 - DNA, 25 bp, Mus musculus
gacaagagaggtaaggcactgccat

SEQ ID NO: 444017 - DNA, 25 bp, Mus musculus
gacaagagaggttaggcactgccat

SEQ ID NO: 444018 - DNA, 25 bp, Mus musculus
gacaagagatttaaccatgggttcc

SEQ ID NO: 444019 - DNA, 25 bp, Mus musculus
gacaagagattttaccatgggttcc

SEQ ID NO: 444020 - DNA, 25 bp, Mus musculus
gacaagagcatcctgcactcacttc

SEQ ID NO: 444021 - DNA, 25 bp, Mus musculus
gacaagagcatcgtgcactcacttc

SEQ ID NO: 444022 - DNA, 25 bp, Mus musculus
gacaagagcgagagaccgagacttt

SEQ ID NO: 444023 - DNA, 25 bp, Mus musculus
gacaagagcgagtgaccgagacttt

SEQ ID NO: 444024 - DNA, 25 bp, Mus musculus
gacaagagctgcattggttcaggtt

SEQ ID NO: 444025 - DNA, 25 bp, Mus musculus
gacaagagctgctttggttcaggtt

SEQ ID NO: 444026 - DNA, 25 bp, Mus musculus
gacaagagctgtagatttatgttaa

SEQ ID NO: 444027 - DNA, 25 bp, Mus musculus
gacaagagctgttgatttatgttaa

SEQ ID NO: 444028 - DNA, 25 bp, Mus musculus
gacaagagctttcctgcctaagcta

SEQ ID NO: 444029 - DNA, 25 bp, Mus musculus
gacaagagctttgctgcctaagcta

SEQ ID NO: 444030 - DNA, 25 bp, Mus musculus
gacaagaggcttacgagagattcag

SEQ ID NO: 444031 - DNA, 25 bp, Mus musculus
gacaagaggctttcgagagattcag

SEQ ID NO: 444032 - DNA, 25 bp, Mus musculus
gacaagagtggaatactggtgctta

SEQ ID NO: 444033 - DNA, 25 bp, Mus musculus
gacaagagtggattactggtgctta

SEQ ID NO: 444034 - DNA, 25 bp, Mus musculus
gacaagagttttctacatctggatt

SEQ ID NO: 444035 - DNA, 25 bp, Mus musculus
gacaagagttttgtacatctggatt

SEQ ID NO: 444036 - DNA, 25 bp, Mus musculus
gacaagataggaccccagcttcgag

SEQ ID NO: 444037 - DNA, 25 bp, Mus musculus
gacaagataggagcccagcttcgag

SEQ ID NO: 444038 - DNA, 25 bp, Mus musculus
gacaagatcacactcaggcacctat

SEQ ID NO: 444039 - DNA, 25 bp, Mus musculus
gacaagatcacagtcaggcacctat

SEQ ID NO: 444040 - DNA, 25 bp, Mus musculus
gacaagatcaccaccaggacgctga

SEQ ID NO: 444041 - DNA, 25 bp, Mus musculus
gacaagatcacctccaggacgctga

SEQ ID NO: 444042 - DNA, 25 bp, Mus musculus
gacaagatcatcaccacgaggaagt

SEQ ID NO: 444043 - DNA, 25 bp, Mus musculus
gacaagatcatctccacgaggaagt

SEQ ID NO: 444044 - DNA, 25 bp, Mus musculus
gacaagatccaaagtacgttgcatt

SEQ ID NO: 444045 - DNA, 25 bp, Mus musculus
gacaagatccaatgtacgttgcatt

SEQ ID NO: 444046 - DNA, 25 bp, Mus musculus
gacaagatccttccagatcgccaaa

SEQ ID NO: 444047 - DNA, 25 bp, Mus musculus
gacaagatccttctgtttcacagag

SEQ ID NO: 444048 - DNA, 25 bp, Mus musculus
gacaagatccttgcagatcgccaaa

SEQ ID NO: 444049 - DNA, 25 bp, Mus musculus
gacaagatccttgtgtttcacagag

SEQ ID NO: 444050 - DNA, 25 bp, Mus musculus
gacaagatcgatccagctctcttct

SEQ ID NO: 444051 - DNA, 25 bp, Mus musculus
gacaagatcgatgcagctctcttct

SEQ ID NO: 444052 - DNA, 25 bp, Mus musculus
gacaagatcgtgagcaaggtccaca

SEQ ID NO: 444053 - DNA, 25 bp, Mus musculus
gacaagatcgtgtgcaaggtccaca

SEQ ID NO: 444054 - DNA, 25 bp, Mus musculus
gacaagatctttagggctcccgaac

SEQ ID NO: 444055 - DNA, 25 bp, Mus musculus
gacaagatctttatgctgtccctgc

SEQ ID NO: 444056 - DNA, 25 bp, Mus musculus
gacaagatcttttgggctcccgaac

SEQ ID NO: 444057 - DNA, 25 bp, Mus musculus
gacaagatctttttgctgtccctgc

SEQ ID NO: 444058 - DNA, 25 bp, Mus musculus
gacaagatgaccatgagtactgagg

SEQ ID NO: 444059 - DNA, 25 bp, Mus musculus
gacaagatgaccttgagtactgagg

SEQ ID NO: 444060 - DNA, 25 bp, Mus musculus
gacaagatgatacctaaggcaccca

SEQ ID NO: 444061 - DNA, 25 bp, Mus musculus
gacaagatgatagctaaggcaccca

SEQ ID NO: 444062 - DNA, 25 bp, Mus musculus
gacaagatgatcagccgcaagtgct

SEQ ID NO: 444063 - DNA, 25 bp, Mus musculus
gacaagatgatctgccgcaagtgct

SEQ ID NO: 444064 - DNA, 25 bp, Mus musculus
gacaagatgcctcacaaacagctgt

SEQ ID NO: 444065 - DNA, 25 bp, Mus musculus
gacaagatgcctgacaaacagctgt

SEQ ID NO: 444066 - DNA, 25 bp, Mus musculus
gacaagatgtgacatactttctttt

SEQ ID NO: 444067 - DNA, 25 bp, Mus musculus
gacaagatgtgagatactttctttt

SEQ ID NO: 444068 - DNA, 25 bp, Mus musculus
gacaagattccaaaagagcctagtt

SEQ ID NO: 444069 - DNA, 25 bp, Mus musculus
gacaagattccataagagcctagtt

SEQ ID NO: 444070 - DNA, 25 bp, Mus musculus
gacaagattgtcaaattaaccattt

SEQ ID NO: 444071 - DNA, 25 bp, Mus musculus
gacaagattgtctaattaaccattt

SEQ ID NO: 444072 - DNA, 25 bp, Mus musculus
gacaagatttcaagccaacgtaggt

SEQ ID NO: 444073 - DNA, 25 bp, Mus musculus
gacaagatttcacctctggctgctt

SEQ ID NO: 444074 - DNA, 25 bp, Mus musculus
gacaagatttcagctctggctgctt

SEQ ID NO: 444075 - DNA, 25 bp, Mus musculus
gacaagatttcatgccaacgtaggt

SEQ ID NO: 444076 - DNA, 25 bp, Mus musculus
gacaagattttgagcatttgtacaa

SEQ ID NO: 444077 - DNA, 25 bp, Mus musculus
gacaagattttgtgcatttgtacaa

SEQ ID NO: 444078 - DNA, 25 bp, Mus musculus
gacaagcacaacctagagcgcaagt

SEQ ID NO: 444079 - DNA, 25 bp, Mus musculus
gacaagcacaacgtagagcgcaagt

SEQ ID NO: 444080 - DNA, 25 bp, Mus musculus
gacaagcacaagaaaggcgagggca

SEQ ID NO: 444081 - DNA, 25 bp, Mus musculus
gacaagcacaagtaaggcgagggca

SEQ ID NO: 444082 - DNA, 25 bp, Mus musculus
gacaagcacacaatgtttttctccc

SEQ ID NO: 444083 - DNA, 25 bp, Mus musculus
gacaagcacacattgtttttctccc

SEQ ID NO: 444084 - DNA, 25 bp, Mus musculus
gacaagcacgctatggtcaaggcca

SEQ ID NO: 444085 - DNA, 25 bp, Mus musculus
gacaagcacgctttggtcaaggcca

SEQ ID NO: 444086 - DNA, 25 bp, Mus musculus
gacaagcactgacaagacctcgact

SEQ ID NO: 444087 - DNA, 25 bp, Mus musculus
gacaagcactgagaagacctcgact

SEQ ID NO: 444088 - DNA, 25 bp, Mus musculus
gacaagcactggacttaggatggtt

SEQ ID NO: 444089 - DNA, 25 bp, Mus musculus
gacaagcactggtcttaggatggtt

SEQ ID NO: 444090 - DNA, 25 bp, Mus musculus
gacaagcactttaacatatcagaca

SEQ ID NO: 444091 - DNA, 25 bp, Mus musculus
gacaagcactttcaagccagagcat

SEQ ID NO: 444092 - DNA, 25 bp, Mus musculus
gacaagcactttgaagccagagcat

SEQ ID NO: 444093 - DNA, 25 bp, Mus musculus
gacaagcacttttacatatcagaca

SEQ ID NO: 444094 - DNA, 25 bp, Mus musculus
gacaagcagcaacgaaagcgcctaa

SEQ ID NO: 444095 - DNA, 25 bp, Mus musculus
gacaagcagcaaggaaagcgcctaa

SEQ ID NO: 444096 - DNA, 25 bp, Mus musculus
gacaagcaggatcctgggcttactg

SEQ ID NO: 444097 - DNA, 25 bp, Mus musculus
gacaagcaggatgctgggcttactg

SEQ ID NO: 444098 - DNA, 25 bp, Mus musculus
gacaagcagggcatctctaaacagg

SEQ ID NO: 444099 - DNA, 25 bp, Mus musculus
gacaagcagggcttctctaaacagg

SEQ ID NO: 444100 - DNA, 25 bp, Mus musculus
gacaagcagttacccagcataatct

SEQ ID NO: 444101 - DNA, 25 bp, Mus musculus
gacaagcagttagccagcataatct

SEQ ID NO: 444102 - DNA, 25 bp, Mus musculus
gacaagcatcaacttactgttaatg

SEQ ID NO: 444103 - DNA, 25 bp, Mus musculus
gacaagcatcaagttactgttaatg

SEQ ID NO: 444104 - DNA, 25 bp, Mus musculus
gacaagcatccaacctgagcatcca

SEQ ID NO: 444105 - DNA, 25 bp, Mus musculus
gacaagcatccatcctgagcatcca

SEQ ID NO: 444106 - DNA, 25 bp, Mus musculus
gacaagcattgtctcaagggctcat

SEQ ID NO: 444107 - DNA, 25 bp, Mus musculus
gacaagcattgtgtcaagggctcat

SEQ ID NO: 444108 - DNA, 25 bp, Mus musculus
gacaagcatttgatgactatgaaga

SEQ ID NO: 444109 - DNA, 25 bp, Mus musculus
gacaagcatttgttgactatgaaga

SEQ ID NO: 444110 - DNA, 25 bp, Mus musculus
gacaagccaacaccctgcgtaggtg

SEQ ID NO: 444111 - DNA, 25 bp, Mus musculus
gacaagccaacagcctgcgtaggtg

SEQ ID NO: 444112 - DNA, 25 bp, Mus musculus
gacaagccaacccttctgggtgaat

SEQ ID NO: 444113 - DNA, 25 bp, Mus musculus
gacaagccaaccgttctgggtgaat

SEQ ID NO: 444114 - DNA, 25 bp, Mus musculus
gacaagccaaggaggcctcagtgat

SEQ ID NO: 444115 - DNA, 25 bp, Mus musculus
gacaagccaaggtggcctcagtgat

SEQ ID NO: 444116 - DNA, 25 bp, Mus musculus
gacaagccacataaaagcatcctaa

SEQ ID NO: 444117 - DNA, 25 bp, Mus musculus
gacaagccacattaaagcatcctaa

SEQ ID NO: 444118 - DNA, 25 bp, Mus musculus
gacaagccacctagtgtttgtcacc

SEQ ID NO: 444119 - DNA, 25 bp, Mus musculus
gacaagccaccttgtgtttgtcacc

SEQ ID NO: 444120 - DNA, 25 bp, Mus musculus
gacaagccatctccgtggtcataga

SEQ ID NO: 444121 - DNA, 25 bp, Mus musculus
gacaagccatctctatcctaaagaa

SEQ ID NO: 444122 - DNA, 25 bp, Mus musculus
gacaagccatctgcgtggtcataga

SEQ ID NO: 444123 - DNA, 25 bp, Mus musculus
gacaagccatctgtatcctaaagaa

SEQ ID NO: 444124 - DNA, 25 bp, Mus musculus
gacaagccattaccccagcaagaag

SEQ ID NO: 444125 - DNA, 25 bp, Mus musculus
gacaagccattagcccagcaagaag

SEQ ID NO: 444126 - DNA, 25 bp, Mus musculus
gacaagccattgacagcttccaagc

SEQ ID NO: 444127 - DNA, 25 bp, Mus musculus
gacaagccattgtcagcttccaagc

SEQ ID NO: 444128 - DNA, 25 bp, Mus musculus
gacaagcccagtaagctctttggaa

SEQ ID NO: 444129 - DNA, 25 bp, Mus musculus
gacaagcccagttagctctttggaa

SEQ ID NO: 444130 - DNA, 25 bp, Mus musculus
gacaagcccattaacttatgaccaa

SEQ ID NO: 444131 - DNA, 25 bp, Mus musculus
gacaagcccatttacttatgaccaa

SEQ ID NO: 444132 - DNA, 25 bp, Mus musculus
gacaagcccctgaatgtttttatag

SEQ ID NO: 444133 - DNA, 25 bp, Mus musculus
gacaagcccctgtatgtttttatag

SEQ ID NO: 444134 - DNA, 25 bp, Mus musculus
gacaagccccttataggcagactgg

SEQ ID NO: 444135 - DNA, 25 bp, Mus musculus
gacaagccccttttaggcagactgg

SEQ ID NO: 444136 - DNA, 25 bp, Mus musculus
gacaagccctgacggtgggcccttc

SEQ ID NO: 444137 - DNA, 25 bp, Mus musculus
gacaagccctgagggtgggcccttc

SEQ ID NO: 444138 - DNA, 25 bp, Mus musculus
gacaagccctggacaagactgtcag

SEQ ID NO: 444139 - DNA, 25 bp, Mus musculus
gacaagccctggtcaagactgtcag

SEQ ID NO: 444140 - DNA, 25 bp, Mus musculus
gacaagcctaccattaagtgccagc

SEQ ID NO: 444141 - DNA, 25 bp, Mus musculus
gacaagcctacctttaagtgccagc

SEQ ID NO: 444142 - DNA, 25 bp, Mus musculus
gacaagcctcctctatagttttata

SEQ ID NO: 444143 - DNA, 25 bp, Mus musculus
gacaagcctcctgtatagttttata

SEQ ID NO: 444144 - DNA, 25 bp, Mus musculus
gacaagcctgaaaggcagcagcatt

SEQ ID NO: 444145 - DNA, 25 bp, Mus musculus
gacaagcctgaatggcagcagcatt

SEQ ID NO: 444146 - DNA, 25 bp, Mus musculus
gacaagcctgtgcttagttgttgtt

SEQ ID NO: 444147 - DNA, 25 bp, Mus musculus
gacaagcctgtggttagttgttgtt

SEQ ID NO: 444148 - DNA, 25 bp, Mus musculus
gacaagcctttcagacactttggat

SEQ ID NO: 444149 - DNA, 25 bp, Mus musculus
gacaagcctttctgacactttggat

SEQ ID NO: 444150 - DNA, 25 bp, Mus musculus
gacaagcgaaaaaagctgcgggaaa

SEQ ID NO: 444151 - DNA, 25 bp, Mus musculus
gacaagcgaaaatagctgcgggaaa

SEQ ID NO: 444152 - DNA, 25 bp, Mus musculus
gacaagcgaattctaatgccacact

SEQ ID NO: 444153 - DNA, 25 bp, Mus musculus
gacaagcgaattgtaatgccacact

SEQ ID NO: 444154 - DNA, 25 bp, Mus musculus
gacaagcgccttagtgtggtatgta

SEQ ID NO: 444155 - DNA, 25 bp, Mus musculus
gacaagcgcctttgtgtggtatgta

SEQ ID NO: 444156 - DNA, 25 bp, Mus musculus
gacaagcgcgtcaccacataaatgg

SEQ ID NO: 444157 - DNA, 25 bp, Mus musculus
gacaagcgcgtctccacataaatgg

SEQ ID NO: 444158 - DNA, 25 bp, Mus musculus
gacaagcgctgaaccaaagaagaca

SEQ ID NO: 444159 - DNA, 25 bp, Mus musculus
gacaagcgctgatccaaagaagaca

SEQ ID NO: 444160 - DNA, 25 bp, Mus musculus
gacaagcgttaacgccacattggca

SEQ ID NO: 444161 - DNA, 25 bp, Mus musculus
gacaagcgttaaggccacattggca

SEQ ID NO: 444162 - DNA, 25 bp, Mus musculus
gacaagctaaacagaaaagtacttc

SEQ ID NO: 444163 - DNA, 25 bp, Mus musculus
gacaagctaaactgaaaagtacttc

SEQ ID NO: 444164 - DNA, 25 bp, Mus musculus
gacaagctacacaaacctggacggt

SEQ ID NO: 444165 - DNA, 25 bp, Mus musculus
gacaagctacacattcttctctttt

SEQ ID NO: 444166 - DNA, 25 bp, Mus musculus
gacaagctacactaacctggacggt

SEQ ID NO: 444167 - DNA, 25 bp, Mus musculus
gacaagctacactttcttctctttt

SEQ ID NO: 444168 - DNA, 25 bp, Mus musculus
gacaagctatacaatctgagggacc

SEQ ID NO: 444169 - DNA, 25 bp, Mus musculus
gacaagctatactatctgagggacc

SEQ ID NO: 444170 - DNA, 25 bp, Mus musculus
gacaagctattgcagattcctctcc

SEQ ID NO: 444171 - DNA, 25 bp, Mus musculus
gacaagctattggagattcctctcc

SEQ ID NO: 444172 - DNA, 25 bp, Mus musculus
gacaagctcaaccataaatttccag

SEQ ID NO: 444173 - DNA, 25 bp, Mus musculus
gacaagctcaacgataaatttccag

SEQ ID NO: 444174 - DNA, 25 bp, Mus musculus
gacaagctcatcaccttattttatg

SEQ ID NO: 444175 - DNA, 25 bp, Mus musculus
gacaagctcatctccttattttatg

SEQ ID NO: 444176 - DNA, 25 bp, Mus musculus
gacaagctctctctgacttcaggaa

SEQ ID NO: 444177 - DNA, 25 bp, Mus musculus
gacaagctctctgtgacttcaggaa

SEQ ID NO: 444178 - DNA, 25 bp, Mus musculus
gacaagctctgacggcaaaacccat

SEQ ID NO: 444179 - DNA, 25 bp, Mus musculus
gacaagctctgagggcaaaacccat

SEQ ID NO: 444180 - DNA, 25 bp, Mus musculus
gacaagctctgcaattcccagggcc

SEQ ID NO: 444181 - DNA, 25 bp, Mus musculus
gacaagctctgctattcccagggcc

SEQ ID NO: 444182 - DNA, 25 bp, Mus musculus
gacaagctctggagtcccgagacta

SEQ ID NO: 444183 - DNA, 25 bp, Mus musculus
gacaagctctggtgtcccgagacta

SEQ ID NO: 444184 - DNA, 25 bp, Mus musculus
gacaagctcttcatgaaggaccctt

SEQ ID NO: 444185 - DNA, 25 bp, Mus musculus
gacaagctcttcttgaaggaccctt

SEQ ID NO: 444186 - DNA, 25 bp, Mus musculus
gacaagctgaagaatgaagcatatt

SEQ ID NO: 444187 - DNA, 25 bp, Mus musculus
gacaagctgaagtatgaagcatatt

SEQ ID NO: 444188 - DNA, 25 bp, Mus musculus
gacaagctgaggctaagagctaaat

SEQ ID NO: 444189 - DNA, 25 bp, Mus musculus
gacaagctgagggtaagagctaaat

SEQ ID NO: 444190 - DNA, 25 bp, Mus musculus
gacaagctgattacaggtccctcgt

SEQ ID NO: 444191 - DNA, 25 bp, Mus musculus
gacaagctgatttcaggtccctcgt

SEQ ID NO: 444192 - DNA, 25 bp, Mus musculus
gacaagctgctcacaatgtgactgg

SEQ ID NO: 444193 - DNA, 25 bp, Mus musculus
gacaagctgctctcaatgtgactgg

SEQ ID NO: 444194 - DNA, 25 bp, Mus musculus
gacaagctgctgcacataggaagaa

SEQ ID NO: 444195 - DNA, 25 bp, Mus musculus
gacaagctgctggacataggaagaa

SEQ ID NO: 444196 - DNA, 25 bp, Mus musculus
gacaagctggatagtgttcacacca

SEQ ID NO: 444197 - DNA, 25 bp, Mus musculus
gacaagctggattgtgttcacacca

SEQ ID NO: 444198 - DNA, 25 bp, Mus musculus
gacaagctggctagacctctgagaa

SEQ ID NO: 444199 - DNA, 25 bp, Mus musculus
gacaagctggcttgacctctgagaa

SEQ ID NO: 444200 - DNA, 25 bp, Mus musculus
gacaagctgtaacgacactgcccta

SEQ ID NO: 444201 - DNA, 25 bp, Mus musculus
gacaagctgtaaggacactgcccta

SEQ ID NO: 444202 - DNA, 25 bp, Mus musculus
gacaagctgtggaatatgttacact

SEQ ID NO: 444203 - DNA, 25 bp, Mus musculus
gacaagctgtggtatatgttacact

SEQ ID NO: 444204 - DNA, 25 bp, Mus musculus
gacaagctgttacggctgacgcatt

SEQ ID NO: 444205 - DNA, 25 bp, Mus musculus
gacaagctgttagggctgacgcatt

SEQ ID NO: 444206 - DNA, 25 bp, Mus musculus
gacaagcttcacctgccaagatatc

SEQ ID NO: 444207 - DNA, 25 bp, Mus musculus
gacaagcttcacgtgccaagatatc

SEQ ID NO: 444208 - DNA, 25 bp, Mus musculus
gacaagcttgaacacatctggccaa

SEQ ID NO: 444209 - DNA, 25 bp, Mus musculus
gacaagcttgaagacatctggccaa

SEQ ID NO: 444210 - DNA, 25 bp, Mus musculus
gacaagctttcaacatagtgtgtga

SEQ ID NO: 444211 - DNA, 25 bp, Mus musculus
gacaagctttcaactgtagttccgt

SEQ ID NO: 444212 - DNA, 25 bp, Mus musculus
gacaagctttcatcatagtgtgtga

SEQ ID NO: 444213 - DNA, 25 bp, Mus musculus
gacaagctttcatctgtagttccgt

SEQ ID NO: 444214 - DNA, 25 bp, Mus musculus
gacaagcttttgatggacttccaaa

SEQ ID NO: 444215 - DNA, 25 bp, Mus musculus
gacaagcttttgttggacttccaaa

SEQ ID NO: 444216 - DNA, 25 bp, Mus musculus
gacaaggaaaagactgcctccttca

SEQ ID NO: 444217 - DNA, 25 bp, Mus musculus
gacaaggaaaagtctgcctccttca

SEQ ID NO: 444218 - DNA, 25 bp, Mus musculus
gacaaggaagtcactatcgatggaa

SEQ ID NO: 444219 - DNA, 25 bp, Mus musculus
gacaaggaagtcataagttcaaggc

SEQ ID NO: 444220 - DNA, 25 bp, Mus musculus
gacaaggaagtctctatcgatggaa

SEQ ID NO: 444221 - DNA, 25 bp, Mus musculus
gacaaggaagtcttaagttcaaggc

SEQ ID NO: 444222 - DNA, 25 bp, Mus musculus
gacaaggacaaaccactgcccagct

SEQ ID NO: 444223 - DNA, 25 bp, Mus musculus
gacaaggacaaagcactgcccagct

SEQ ID NO: 444224 - DNA, 25 bp, Mus musculus
gacaaggacaaccacgtgacaacat

SEQ ID NO: 444225 - DNA, 25 bp, Mus musculus
gacaaggacaacgacgtgacaacat

SEQ ID NO: 444226 - DNA, 25 bp, Mus musculus
gacaaggacacgcatactctacagt

SEQ ID NO: 444227 - DNA, 25 bp, Mus musculus
gacaaggacacggatactctacagt

SEQ ID NO: 444228 - DNA, 25 bp, Mus musculus
gacaaggacatgcacgactggctgt

SEQ ID NO: 444229 - DNA, 25 bp, Mus musculus
gacaaggacatggacgactggctgt

SEQ ID NO: 444230 - DNA, 25 bp, Mus musculus
gacaaggaccacactacagcgaaga

SEQ ID NO: 444231 - DNA, 25 bp, Mus musculus
gacaaggaccactctacagcgaaga

SEQ ID NO: 444232 - DNA, 25 bp, Mus musculus
gacaaggacccaagaggttaactta

SEQ ID NO: 444233 - DNA, 25 bp, Mus musculus
gacaaggacccatgaggttaactta

SEQ ID NO: 444234 - DNA, 25 bp, Mus musculus
gacaaggaccccaagtacagtgctc

SEQ ID NO: 444235 - DNA, 25 bp, Mus musculus
gacaaggacccctagtacagtgctc

SEQ ID NO: 444236 - DNA, 25 bp, Mus musculus
gacaaggacctcaccagagagcata

SEQ ID NO: 444237 - DNA, 25 bp, Mus musculus
gacaaggacctctccagagagcata

SEQ ID NO: 444238 - DNA, 25 bp, Mus musculus
gacaaggaccttctcagcgacagtg

SEQ ID NO: 444239 - DNA, 25 bp, Mus musculus
gacaaggaccttgtcagcgacagtg

SEQ ID NO: 444240 - DNA, 25 bp, Mus musculus
gacaaggacgacaaagctgttctta

SEQ ID NO: 444241 - DNA, 25 bp, Mus musculus
gacaaggacgactaagctgttctta

SEQ ID NO: 444242 - DNA, 25 bp, Mus musculus
gacaaggacttgaacctgacctgag

SEQ ID NO: 444243 - DNA, 25 bp, Mus musculus
gacaaggacttgtacctgacctgag

SEQ ID NO: 444244 - DNA, 25 bp, Mus musculus
gacaaggagactaacgaacttcgtt

SEQ ID NO: 444245 - DNA, 25 bp, Mus musculus
gacaaggagacttacgaacttcgtt

SEQ ID NO: 444246 - DNA, 25 bp, Mus musculus
gacaaggagagaccgcggctctcac

SEQ ID NO: 444247 - DNA, 25 bp, Mus musculus
gacaaggagagagcgcggctctcac

SEQ ID NO: 444248 - DNA, 25 bp, Mus musculus
gacaaggaggcccatcttcgcaaag

SEQ ID NO: 444249 - DNA, 25 bp, Mus musculus
gacaaggaggccgatcttcgcaaag

SEQ ID NO: 444250 - DNA, 25 bp, Mus musculus
gacaaggagtagaccagctgcaaaa

SEQ ID NO: 444251 - DNA, 25 bp, Mus musculus
gacaaggagtagacgctccatctct

SEQ ID NO: 444252 - DNA, 25 bp, Mus musculus
gacaaggagtagtccagctgcaaaa

SEQ ID NO: 444253 - DNA, 25 bp, Mus musculus
gacaaggagtagtcgctccatctct

SEQ ID NO: 444254 - DNA, 25 bp, Mus musculus
gacaaggagtgtctgtgcccatcgc

SEQ ID NO: 444255 - DNA, 25 bp, Mus musculus
gacaaggagtgtgtgtgcccatcgc

SEQ ID NO: 444256 - DNA, 25 bp, Mus musculus
gacaaggagttcaagagcacgtgct

SEQ ID NO: 444257 - DNA, 25 bp, Mus musculus
gacaaggagttctagagcacgtgct

SEQ ID NO: 444258 - DNA, 25 bp, Mus musculus
gacaaggatgcaagataccgtaaat

SEQ ID NO: 444259 - DNA, 25 bp, Mus musculus
gacaaggatgcatgataccgtaaat

SEQ ID NO: 444260 - DNA, 25 bp, Mus musculus
gacaaggcacatccttcaaaggcat

SEQ ID NO: 444261 - DNA, 25 bp, Mus musculus
gacaaggcacatgcttcaaaggcat

SEQ ID NO: 444262 - DNA, 25 bp, Mus musculus
gacaaggcacgcactggcagtagtc

SEQ ID NO: 444263 - DNA, 25 bp, Mus musculus
gacaaggcacgctctggcagtagtc

SEQ ID NO: 444264 - DNA, 25 bp, Mus musculus
gacaaggcacttcatgattctctgg

SEQ ID NO: 444265 - DNA, 25 bp, Mus musculus
gacaaggcacttgatgattctctgg

SEQ ID NO: 444266 - DNA, 25 bp, Mus musculus
gacaaggcagatacgtcccgctgga

SEQ ID NO: 444267 - DNA, 25 bp, Mus musculus
gacaaggcagattcgtcccgctgga

SEQ ID NO: 444268 - DNA, 25 bp, Mus musculus
gacaaggcagccatcgtgatgccac

SEQ ID NO: 444269 - DNA, 25 bp, Mus musculus
gacaaggcagccttcgtgatgccac

SEQ ID NO: 444270 - DNA, 25 bp, Mus musculus
gacaaggcatccatacatataaagg

SEQ ID NO: 444271 - DNA, 25 bp, Mus musculus
gacaaggcatccttacatataaagg

SEQ ID NO: 444272 - DNA, 25 bp, Mus musculus
gacaaggcattcaggagagaggata

SEQ ID NO: 444273 - DNA, 25 bp, Mus musculus
gacaaggcattctggagagaggata

SEQ ID NO: 444274 - DNA, 25 bp, Mus musculus
gacaaggcccaaacttacagctgtt

SEQ ID NO: 444275 - DNA, 25 bp, Mus musculus
gacaaggcccaatcttacagctgtt

SEQ ID NO: 444276 - DNA, 25 bp, Mus musculus
gacaaggcccagatgccatacacag

SEQ ID NO: 444277 - DNA, 25 bp, Mus musculus
gacaaggcccagttgccatacacag

SEQ ID NO: 444278 - DNA, 25 bp, Mus musculus
gacaaggccgagaagaagcacttct

SEQ ID NO: 444279 - DNA, 25 bp, Mus musculus
gacaaggccgagtagaagcacttct

SEQ ID NO: 444280 - DNA, 25 bp, Mus musculus
gacaaggcctcaacaagtaggcaat

SEQ ID NO: 444281 - DNA, 25 bp, Mus musculus
gacaaggcctcacagtccagagaat

SEQ ID NO: 444282 - DNA, 25 bp, Mus musculus
gacaaggcctcagagtccagagaat

SEQ ID NO: 444283 - DNA, 25 bp, Mus musculus
gacaaggcctcatcaagtaggcaat

SEQ ID NO: 444284 - DNA, 25 bp, Mus musculus
gacaaggcgaggagattgacatccg

SEQ ID NO: 444285 - DNA, 25 bp, Mus musculus
gacaaggcgaggtgattgacatccg

SEQ ID NO: 444286 - DNA, 25 bp, Mus musculus
gacaaggctatcatgccacatgtgc

SEQ ID NO: 444287 - DNA, 25 bp, Mus musculus
gacaaggctatcttgccacatgtgc

SEQ ID NO: 444288 - DNA, 25 bp, Mus musculus
gacaaggctgcaactgtctctgagt

SEQ ID NO: 444289 - DNA, 25 bp, Mus musculus
gacaaggctgcatctgtctctgagt

SEQ ID NO: 444290 - DNA, 25 bp, Mus musculus
gacaaggctgccactgaaaagaata

SEQ ID NO: 444291 - DNA, 25 bp, Mus musculus
gacaaggctgcctctgaaaagaata

SEQ ID NO: 444292 - DNA, 25 bp, Mus musculus
gacaaggctgttcacctggctggcc

SEQ ID NO: 444293 - DNA, 25 bp, Mus musculus
gacaaggctgttgacctggctggcc

SEQ ID NO: 444294 - DNA, 25 bp, Mus musculus
gacaaggcttgacgagcagggcagc

SEQ ID NO: 444295 - DNA, 25 bp, Mus musculus
gacaaggcttgaggagcagggcagc

SEQ ID NO: 444296 - DNA, 25 bp, Mus musculus
gacaaggctttcagtgggcacactt

SEQ ID NO: 444297 - DNA, 25 bp, Mus musculus
gacaaggctttctgtgggcacactt

SEQ ID NO: 444298 - DNA, 25 bp, Mus musculus
gacaagggaagaagcaggattagat

SEQ ID NO: 444299 - DNA, 25 bp, Mus musculus
gacaagggaagatgcaggattagat

SEQ ID NO: 444300 - DNA, 25 bp, Mus musculus
gacaagggatcccaggtgtccccat

SEQ ID NO: 444301 - DNA, 25 bp, Mus musculus
gacaagggatccgaggtgtccccat

SEQ ID NO: 444302 - DNA, 25 bp, Mus musculus
gacaagggcaaccttcgtgtcaagc

SEQ ID NO: 444303 - DNA, 25 bp, Mus musculus
gacaagggcaacgttcgtgtcaagc

SEQ ID NO: 444304 - DNA, 25 bp, Mus musculus
gacaagggcaagaccatccaagact

SEQ ID NO: 444305 - DNA, 25 bp, Mus musculus
gacaagggcaagcataaaacagcag

SEQ ID NO: 444306 - DNA, 25 bp, Mus musculus
gacaagggcaaggataaaacagcag

SEQ ID NO: 444307 - DNA, 25 bp, Mus musculus
gacaagggcaagtccatccaagact

SEQ ID NO: 444308 - DNA, 25 bp, Mus musculus
gacaagggcattagatcttcttact

SEQ ID NO: 444309 - DNA, 25 bp, Mus musculus
gacaagggcatttgatcttcttact

SEQ ID NO: 444310 - DNA, 25 bp, Mus musculus
gacaagggtctgaagttagtctaga

SEQ ID NO: 444311 - DNA, 25 bp, Mus musculus
gacaagggtctgtagttagtctaga

SEQ ID NO: 444312 - DNA, 25 bp, Mus musculus
gacaagggttaacgcagcaggcttc

SEQ ID NO: 444313 - DNA, 25 bp, Mus musculus
gacaagggttaaggcagcaggcttc

SEQ ID NO: 444314 - DNA, 25 bp, Mus musculus
gacaaggtaaccctttgtcatggga

SEQ ID NO: 444315 - DNA, 25 bp, Mus musculus
gacaaggtaaccgtttgtcatggga

SEQ ID NO: 444316 - DNA, 25 bp, Mus musculus
gacaaggtcatgagattggtcccta

SEQ ID NO: 444317 - DNA, 25 bp, Mus musculus
gacaaggtcatgtgattggtcccta

SEQ ID NO: 444318 - DNA, 25 bp, Mus musculus
gacaaggtccctctgtgtaactctg

SEQ ID NO: 444319 - DNA, 25 bp, Mus musculus
gacaaggtccctgtgtgtaactctg

SEQ ID NO: 444320 - DNA, 25 bp, Mus musculus
gacaaggtcctaatgcactttttaa

SEQ ID NO: 444321 - DNA, 25 bp, Mus musculus
gacaaggtcctattgcactttttaa

SEQ ID NO: 444322 - DNA, 25 bp, Mus musculus
gacaaggtcctcaagcatgtttgca

SEQ ID NO: 444323 - DNA, 25 bp, Mus musculus
gacaaggtcctctagcatgtttgca

SEQ ID NO: 444324 - DNA, 25 bp, Mus musculus
gacaaggtctcacatatcctggatt

SEQ ID NO: 444325 - DNA, 25 bp, Mus musculus
gacaaggtctcagatatcctggatt

SEQ ID NO: 444326 - DNA, 25 bp, Mus musculus
gacaaggtcttaatggctgccgtgt

SEQ ID NO: 444327 - DNA, 25 bp, Mus musculus
gacaaggtcttattggctgccgtgt

SEQ ID NO: 444328 - DNA, 25 bp, Mus musculus
gacaaggtgacaacaggactctcta

SEQ ID NO: 444329 - DNA, 25 bp, Mus musculus
gacaaggtgacacagtgcttctgac

SEQ ID NO: 444330 - DNA, 25 bp, Mus musculus
gacaaggtgacagagtgcttctgac

SEQ ID NO: 444331 - DNA, 25 bp, Mus musculus
gacaaggtgacatcaggactctcta

SEQ ID NO: 444332 - DNA, 25 bp, Mus musculus
gacaaggtgaccagtacagactcaa

SEQ ID NO: 444333 - DNA, 25 bp, Mus musculus
gacaaggtgacctgtacagactcaa

SEQ ID NO: 444334 - DNA, 25 bp, Mus musculus
gacaaggtgcccaaggtcacaagaa

SEQ ID NO: 444335 - DNA, 25 bp, Mus musculus
gacaaggtgccctaggtcacaagaa

SEQ ID NO: 444336 - DNA, 25 bp, Mus musculus
gacaaggtggatcggctcatcatct

SEQ ID NO: 444337 - DNA, 25 bp, Mus musculus
gacaaggtggatctctatcttttaa

SEQ ID NO: 444338 - DNA, 25 bp, Mus musculus
gacaaggtggatgggctcatcatct

SEQ ID NO: 444339 - DNA, 25 bp, Mus musculus
gacaaggtggatgtctatcttttaa

SEQ ID NO: 444340 - DNA, 25 bp, Mus musculus
gacaaggtgtcaacatgggcttcgg

SEQ ID NO: 444341 - DNA, 25 bp, Mus musculus
gacaaggtgtcaagtggcccaagct

SEQ ID NO: 444342 - DNA, 25 bp, Mus musculus
gacaaggtgtcatcatgggcttcgg

SEQ ID NO: 444343 - DNA, 25 bp, Mus musculus
gacaaggtgtcatgtggcccaagct

SEQ ID NO: 444344 - DNA, 25 bp, Mus musculus
gacaaggtgtttactgatccagaga

SEQ ID NO: 444345 - DNA, 25 bp, Mus musculus
gacaaggtgttttctgatccagaga

SEQ ID NO: 444346 - DNA, 25 bp, Mus musculus
gacaaggttaccactcaactcaaga

SEQ ID NO: 444347 - DNA, 25 bp, Mus musculus
gacaaggttacctctcaactcaaga

SEQ ID NO: 444348 - DNA, 25 bp, Mus musculus
gacaaggttccactgtgtagaccag

SEQ ID NO: 444349 - DNA, 25 bp, Mus musculus
gacaaggttccagtgtgtagaccag

SEQ ID NO: 444350 - DNA, 25 bp, Mus musculus
gacaaggttctcaaccagctgatgt

SEQ ID NO: 444351 - DNA, 25 bp, Mus musculus
gacaaggttctctaccagctgatgt

SEQ ID NO: 444352 - DNA, 25 bp, Mus musculus
gacaaggttgctagatcatttcacc

SEQ ID NO: 444353 - DNA, 25 bp, Mus musculus
gacaaggttgcttgatcatttcacc

SEQ ID NO: 444354 - DNA, 25 bp, Mus musculus
gacaaggttgttctgatccctggga

SEQ ID NO: 444355 - DNA, 25 bp, Mus musculus
gacaaggttgttgtgatccctggga

SEQ ID NO: 444356 - DNA, 25 bp, Mus musculus
gacaagtaacgtcgcatgctcatct

SEQ ID NO: 444357 - DNA, 25 bp, Mus musculus
gacaagtaacgtggcatgctcatct

SEQ ID NO: 444358 - DNA, 25 bp, Mus musculus
gacaagtacaacacttttctattca

SEQ ID NO: 444359 - DNA, 25 bp, Mus musculus
gacaagtacaactcttttctattca

SEQ ID NO: 444360 - DNA, 25 bp, Mus musculus
gacaagtacctgaagaagctccaca

SEQ ID NO: 444361 - DNA, 25 bp, Mus musculus
gacaagtacctgtagaagctccaca

SEQ ID NO: 444362 - DNA, 25 bp, Mus musculus
gacaagtactagcaatttcccagac

SEQ ID NO: 444363 - DNA, 25 bp, Mus musculus
gacaagtactaggaatttcccagac

SEQ ID NO: 444364 - DNA, 25 bp, Mus musculus
gacaagtacttcaagctgcctcatg

SEQ ID NO: 444365 - DNA, 25 bp, Mus musculus
gacaagtacttccatgagcactacg

SEQ ID NO: 444366 - DNA, 25 bp, Mus musculus
gacaagtacttcgatgagcactacg

SEQ ID NO: 444367 - DNA, 25 bp, Mus musculus
gacaagtacttctagctgcctcatg

SEQ ID NO: 444368 - DNA, 25 bp, Mus musculus
gacaagtactttcagttcctggcct

SEQ ID NO: 444369 - DNA, 25 bp, Mus musculus
gacaagtactttgagttcctggcct

SEQ ID NO: 444370 - DNA, 25 bp, Mus musculus
gacaagtagaccatcgagctagcga

SEQ ID NO: 444371 - DNA, 25 bp, Mus musculus
gacaagtagaccttcgagctagcga

SEQ ID NO: 444372 - DNA, 25 bp, Mus musculus
gacaagtagttgagtatgcgttaat

SEQ ID NO: 444373 - DNA, 25 bp, Mus musculus
gacaagtagttgtgtatgcgttaat

SEQ ID NO: 444374 - DNA, 25 bp, Mus musculus
gacaagtatcgaaaccagctccagc

SEQ ID NO: 444375 - DNA, 25 bp, Mus musculus
gacaagtatcgataccagctccagc

SEQ ID NO: 444376 - DNA, 25 bp, Mus musculus
gacaagtattctcagttacacccca

SEQ ID NO: 444377 - DNA, 25 bp, Mus musculus
gacaagtattctgagttacacccca

SEQ ID NO: 444378 - DNA, 25 bp, Mus musculus
gacaagtatttccaagtcccgtgtt

SEQ ID NO: 444379 - DNA, 25 bp, Mus musculus
gacaagtatttcgaagtcccgtgtt

SEQ ID NO: 444380 - DNA, 25 bp, Mus musculus
gacaagtcaacaactagacccttgg

SEQ ID NO: 444381 - DNA, 25 bp, Mus musculus
gacaagtcaacatctagacccttgg

SEQ ID NO: 444382 - DNA, 25 bp, Mus musculus
gacaagtcagccatcgtgggagaac

SEQ ID NO: 444383 - DNA, 25 bp, Mus musculus
gacaagtcagccttcgtgggagaac

SEQ ID NO: 444384 - DNA, 25 bp, Mus musculus
gacaagtcccgacccaggactgtgt

SEQ ID NO: 444385 - DNA, 25 bp, Mus musculus
gacaagtcccgagccaggactgtgt

SEQ ID NO: 444386 - DNA, 25 bp, Mus musculus
gacaagtccctacactcagtgacca

SEQ ID NO: 444387 - DNA, 25 bp, Mus musculus
gacaagtccctagactcagtgacca

SEQ ID NO: 444388 - DNA, 25 bp, Mus musculus
gacaagtcctggcatgtgacaattt

SEQ ID NO: 444389 - DNA, 25 bp, Mus musculus
gacaagtcctgggatgtgacaattt

SEQ ID NO: 444390 - DNA, 25 bp, Mus musculus
gacaagtcctttactcataactcaa

SEQ ID NO: 444391 - DNA, 25 bp, Mus musculus
gacaagtccttttctcataactcaa

SEQ ID NO: 444392 - DNA, 25 bp, Mus musculus
gacaagtcgggtacattttcaaatc

SEQ ID NO: 444393 - DNA, 25 bp, Mus musculus
gacaagtcgggttcattttcaaatc

SEQ ID NO: 444394 - DNA, 25 bp, Mus musculus
gacaagtctactcaataccctcatc

SEQ ID NO: 444395 - DNA, 25 bp, Mus musculus
gacaagtctactgaataccctcatc

SEQ ID NO: 444396 - DNA, 25 bp, Mus musculus
gacaagtctccactccagtaaggga

SEQ ID NO: 444397 - DNA, 25 bp, Mus musculus
gacaagtctccagtccagtaaggga

SEQ ID NO: 444398 - DNA, 25 bp, Mus musculus
gacaagtcttgtcctatatcactgg

SEQ ID NO: 444399 - DNA, 25 bp, Mus musculus
gacaagtcttgtcggaatgaacatc

SEQ ID NO: 444400 - DNA, 25 bp, Mus musculus
gacaagtcttgtgctatatcactgg

SEQ ID NO: 444401 - DNA, 25 bp, Mus musculus
gacaagtcttgtgggaatgaacatc

SEQ ID NO: 444402 - DNA, 25 bp, Mus musculus
gacaagtctttaatgagacatggca

SEQ ID NO: 444403 - DNA, 25 bp, Mus musculus
gacaagtctttattgagacatggca

SEQ ID NO: 444404 - DNA, 25 bp, Mus musculus
gacaagtgaaagcacccaggcctgg

SEQ ID NO: 444405 - DNA, 25 bp, Mus musculus
gacaagtgaaaggacccaggcctgg

SEQ ID NO: 444406 - DNA, 25 bp, Mus musculus
gacaagtgacaacctgtttgtttca

SEQ ID NO: 444407 - DNA, 25 bp, Mus musculus
gacaagtgacaagctgtttgtttca

SEQ ID NO: 444408 - DNA, 25 bp, Mus musculus
gacaagtgaggcaaagcaccccaag

SEQ ID NO: 444409 - DNA, 25 bp, Mus musculus
gacaagtgaggctaagcaccccaag

SEQ ID NO: 444410 - DNA, 25 bp, Mus musculus
gacaagtgagtcatcctaggaacaa

SEQ ID NO: 444411 - DNA, 25 bp, Mus musculus
gacaagtgagtcttcctaggaacaa

SEQ ID NO: 444412 - DNA, 25 bp, Mus musculus
gacaagtgagtgacaaacagctcta

SEQ ID NO: 444413 - DNA, 25 bp, Mus musculus
gacaagtgagtgtcaaacagctcta

SEQ ID NO: 444414 - DNA, 25 bp, Mus musculus
gacaagtgatccaaaaatctttata

SEQ ID NO: 444415 - DNA, 25 bp, Mus musculus
gacaagtgatcccatcaagccagtg

SEQ ID NO: 444416 - DNA, 25 bp, Mus musculus
gacaagtgatccgatcaagccagtg

SEQ ID NO: 444417 - DNA, 25 bp, Mus musculus
gacaagtgatcctaaaatctttata

SEQ ID NO: 444418 - DNA, 25 bp, Mus musculus
gacaagtgcaccatgcatttttcag

SEQ ID NO: 444419 - DNA, 25 bp, Mus musculus
gacaagtgcaccttgcatttttcag

SEQ ID NO: 444420 - DNA, 25 bp, Mus musculus
gacaagtgcccaactttggaacagt

SEQ ID NO: 444421 - DNA, 25 bp, Mus musculus
gacaagtgcccatctttggaacagt

SEQ ID NO: 444422 - DNA, 25 bp, Mus musculus
gacaagtggaccaaagtggccgaga

SEQ ID NO: 444423 - DNA, 25 bp, Mus musculus
gacaagtggacctaagtggccgaga

SEQ ID NO: 444424 - DNA, 25 bp, Mus musculus
gacaagtgggcacagcatgctataa

SEQ ID NO: 444425 - DNA, 25 bp, Mus musculus
gacaagtgggcagagcatgctataa

SEQ ID NO: 444426 - DNA, 25 bp, Mus musculus
gacaagtgggtactccttactggtt

SEQ ID NO: 444427 - DNA, 25 bp, Mus musculus
gacaagtgggtagtccttactggtt

SEQ ID NO: 444428 - DNA, 25 bp, Mus musculus
gacaagtggtatctacccctgaacc

SEQ ID NO: 444429 - DNA, 25 bp, Mus musculus
gacaagtggtatgtacccctgaacc

SEQ ID NO: 444430 - DNA, 25 bp, Mus musculus
gacaagtgtacacccaatgatgacc

SEQ ID NO: 444431 - DNA, 25 bp, Mus musculus
gacaagtgtacagccaatgatgacc

SEQ ID NO: 444432 - DNA, 25 bp, Mus musculus
gacaagtgtccaatactggcttctt

SEQ ID NO: 444433 - DNA, 25 bp, Mus musculus
gacaagtgtccattactggcttctt

SEQ ID NO: 444434 - DNA, 25 bp, Mus musculus
gacaagttacctattgacaatctgt

SEQ ID NO: 444435 - DNA, 25 bp, Mus musculus
gacaagttaccttttgacaatctgt

SEQ ID NO: 444436 - DNA, 25 bp, Mus musculus
gacaagttatctaccaactccagtt

SEQ ID NO: 444437 - DNA, 25 bp, Mus musculus
gacaagttatcttccaactccagtt

SEQ ID NO: 444438 - DNA, 25 bp, Mus musculus
gacaagttcacacgaacggcttctg

SEQ ID NO: 444439 - DNA, 25 bp, Mus musculus
gacaagttcacaggaacggcttctg

SEQ ID NO: 444440 - DNA, 25 bp, Mus musculus
gacaagttccgcacagagctggact

SEQ ID NO: 444441 - DNA, 25 bp, Mus musculus
gacaagttccgctcagagctggact

SEQ ID NO: 444442 - DNA, 25 bp, Mus musculus
gacaagttcctcagggacagggcct

SEQ ID NO: 444443 - DNA, 25 bp, Mus musculus
gacaagttcctcagtggcttagatt

SEQ ID NO: 444444 - DNA, 25 bp, Mus musculus
gacaagttcctctgggacagggcct

SEQ ID NO: 444445 - DNA, 25 bp, Mus musculus
gacaagttcctctgtggcttagatt

SEQ ID NO: 444446 - DNA, 25 bp, Mus musculus
gacaagttcgatcggcgacctacca

SEQ ID NO: 444447 - DNA, 25 bp, Mus musculus
gacaagttcgatgggcgacctacca

SEQ ID NO: 444448 - DNA, 25 bp, Mus musculus
gacaagttctcacctagagtgcatg

SEQ ID NO: 444449 - DNA, 25 bp, Mus musculus
gacaagttctcagctagagtgcatg

SEQ ID NO: 444450 - DNA, 25 bp, Mus musculus
gacaagttctccaagtgtggcgtga

SEQ ID NO: 444451 - DNA, 25 bp, Mus musculus
gacaagttctcctagtgtggcgtga

SEQ ID NO: 444452 - DNA, 25 bp, Mus musculus
gacaagttgctccttccttctagag

SEQ ID NO: 444453 - DNA, 25 bp, Mus musculus
gacaagttgctcgttccttctagag

SEQ ID NO: 444454 - DNA, 25 bp, Mus musculus
gacaagttgggaaaacaacagcgac

SEQ ID NO: 444455 - DNA, 25 bp, Mus musculus
gacaagttgggataacaacagcgac

SEQ ID NO: 444456 - DNA, 25 bp, Mus musculus
gacaagttgggtcttgccttacccg

SEQ ID NO: 444457 - DNA, 25 bp, Mus musculus
gacaagttgggtgttgccttacccg

SEQ ID NO: 444458 - DNA, 25 bp, Mus musculus
gacaagttgtagctcccgcatacat

SEQ ID NO: 444459 - DNA, 25 bp, Mus musculus
gacaagttgtaggtcccgcatacat

SEQ ID NO: 444460 - DNA, 25 bp, Mus musculus
gacaagttgtccaagttctttaact

SEQ ID NO: 444461 - DNA, 25 bp, Mus musculus
gacaagttgtcctagttctttaact

SEQ ID NO: 444462 - DNA, 25 bp, Mus musculus
gacaagttgttcaatctcagtgcct

SEQ ID NO: 444463 - DNA, 25 bp, Mus musculus
gacaagttgttctatctcagtgcct

SEQ ID NO: 444464 - DNA, 25 bp, Mus musculus
gacaagtttagcacttcgtgtttta

SEQ ID NO: 444465 - DNA, 25 bp, Mus musculus
gacaagtttagctcttcgtgtttta

SEQ ID NO: 444466 - DNA, 25 bp, Mus musculus
gacaagtttatccagcatccaaaaa

SEQ ID NO: 444467 - DNA, 25 bp, Mus musculus
gacaagtttatcgagcatccaaaaa

SEQ ID NO: 444468 - DNA, 25 bp, Mus musculus
gacaagtttttaacctaacagtctt

SEQ ID NO: 444469 - DNA, 25 bp, Mus musculus
gacaagtttttatcctaacagtctt

SEQ ID NO: 444470 - DNA, 25 bp, Mus musculus
gacaataaacaaccctgtccttcac

SEQ ID NO: 444471 - DNA, 25 bp, Mus musculus
gacaataaacaagcctgtccttcac

SEQ ID NO: 444472 - DNA, 25 bp, Mus musculus
gacaataacggacttcagaaaggaa

SEQ ID NO: 444473 - DNA, 25 bp, Mus musculus
gacaataacggagttcagaaaggaa

SEQ ID NO: 444474 - DNA, 25 bp, Mus musculus
gacaataacttgattacagaagcca

SEQ ID NO: 444475 - DNA, 25 bp, Mus musculus
gacaataacttgtttacagaagcca

SEQ ID NO: 444476 - DNA, 25 bp, Mus musculus
gacaataagctgagctctgaggtct

SEQ ID NO: 444477 - DNA, 25 bp, Mus musculus
gacaataagctgtgctctgaggtct

SEQ ID NO: 444478 - DNA, 25 bp, Mus musculus
gacaataatgtcagctttctccgga

SEQ ID NO: 444479 - DNA, 25 bp, Mus musculus
gacaataatgtctgctttctccgga

SEQ ID NO: 444480 - DNA, 25 bp, Mus musculus
gacaatacaatgcaactgctatgga

SEQ ID NO: 444481 - DNA, 25 bp, Mus musculus
gacaatacaatggaactgctatgga

SEQ ID NO: 444482 - DNA, 25 bp, Mus musculus
gacaatacacacagtctttgtagtt

SEQ ID NO: 444483 - DNA, 25 bp, Mus musculus
gacaatacacactgtctttgtagtt

SEQ ID NO: 444484 - DNA, 25 bp, Mus musculus
gacaatacacggcttgatatacaac

SEQ ID NO: 444485 - DNA, 25 bp, Mus musculus
gacaatacacgggttgatatacaac

SEQ ID NO: 444486 - DNA, 25 bp, Mus musculus
gacaatacagtccatctgctggaga

SEQ ID NO: 444487 - DNA, 25 bp, Mus musculus
gacaatacagtcgatctgctggaga

SEQ ID NO: 444488 - DNA, 25 bp, Mus musculus
gacaatacatgacgctaatcccagc

SEQ ID NO: 444489 - DNA, 25 bp, Mus musculus
gacaatacatgaggctaatcccagc

SEQ ID NO: 444490 - DNA, 25 bp, Mus musculus
gacaatactgcactaaacctctgaa

SEQ ID NO: 444491 - DNA, 25 bp, Mus musculus
gacaatactgcagtaaacctctgaa

SEQ ID NO: 444492 - DNA, 25 bp, Mus musculus
gacaatactgtaaatcctttgattt

SEQ ID NO: 444493 - DNA, 25 bp, Mus musculus
gacaatactgtatatcctttgattt

SEQ ID NO: 444494 - DNA, 25 bp, Mus musculus
gacaatacttttaccatgttgtggt

SEQ ID NO: 444495 - DNA, 25 bp, Mus musculus
gacaatactttttccatgttgtggt

SEQ ID NO: 444496 - DNA, 25 bp, Mus musculus
gacaatagaagcagccctgctattg

SEQ ID NO: 444497 - DNA, 25 bp, Mus musculus
gacaatagaagctgccctgctattg

SEQ ID NO: 444498 - DNA, 25 bp, Mus musculus
gacaatagaccaacactgctgtgac

SEQ ID NO: 444499 - DNA, 25 bp, Mus musculus
gacaatagaccatcactgctgtgac

SEQ ID NO: 444500 - DNA, 25 bp, Mus musculus
gacaatagctccattcacggcagcc

SEQ ID NO: 444501 - DNA, 25 bp, Mus musculus
gacaatagctcctttcacggcagcc

SEQ ID NO: 444502 - DNA, 25 bp, Mus musculus
gacaatagtgtcacacctgtgaatg

SEQ ID NO: 444503 - DNA, 25 bp, Mus musculus
gacaatagtgtctcacctgtgaatg

SEQ ID NO: 444504 - DNA, 25 bp, Mus musculus
gacaatagtgttctccctagggaat

SEQ ID NO: 444505 - DNA, 25 bp, Mus musculus
gacaatagtgttgtccctagggaat

SEQ ID NO: 444506 - DNA, 25 bp, Mus musculus
gacaatataccaccttttgccgcag

SEQ ID NO: 444507 - DNA, 25 bp, Mus musculus
gacaatataccagcttttgccgcag

SEQ ID NO: 444508 - DNA, 25 bp, Mus musculus
gacaatatactcatttcgactcaga

SEQ ID NO: 444509 - DNA, 25 bp, Mus musculus
gacaatatactcttttcgactcaga

SEQ ID NO: 444510 - DNA, 25 bp, Mus musculus
gacaatatcaggcttctgtaaatag

SEQ ID NO: 444511 - DNA, 25 bp, Mus musculus
gacaatatcagggttctgtaaatag

SEQ ID NO: 444512 - DNA, 25 bp, Mus musculus
gacaatatcatcactgtgttctata

SEQ ID NO: 444513 - DNA, 25 bp, Mus musculus
gacaatatcatctctgtgttctata

SEQ ID NO: 444514 - DNA, 25 bp, Mus musculus
gacaatatctccaaaaagccttcaa

SEQ ID NO: 444515 - DNA, 25 bp, Mus musculus
gacaatatctcctaaaagccttcaa

SEQ ID NO: 444516 - DNA, 25 bp, Mus musculus
gacaatatctgtacctttcatctaa

SEQ ID NO: 444517 - DNA, 25 bp, Mus musculus
gacaatatctgttcctttcatctaa

SEQ ID NO: 444518 - DNA, 25 bp, Mus musculus
gacaatattccaacttgcagacagc

SEQ ID NO: 444519 - DNA, 25 bp, Mus musculus
gacaatattccatcttgcagacagc

SEQ ID NO: 444520 - DNA, 25 bp, Mus musculus
gacaatattctcagggttccttcac

SEQ ID NO: 444521 - DNA, 25 bp, Mus musculus
gacaatattctcctgcaggtttatc

SEQ ID NO: 444522 - DNA, 25 bp, Mus musculus
gacaatattctcgtgcaggtttatc

SEQ ID NO: 444523 - DNA, 25 bp, Mus musculus
gacaatattctctgggttccttcac

SEQ ID NO: 444524 - DNA, 25 bp, Mus musculus
gacaatattgtcatcaacatggctg

SEQ ID NO: 444525 - DNA, 25 bp, Mus musculus
gacaatattgtcttcaacatggctg

SEQ ID NO: 444526 - DNA, 25 bp, Mus musculus
gacaatcaagaaactgttcccttcc

SEQ ID NO: 444527 - DNA, 25 bp, Mus musculus
gacaatcaagaatctgttcccttcc

SEQ ID NO: 444528 - DNA, 25 bp, Mus musculus
gacaatcaagccctattttcctaat

SEQ ID NO: 444529 - DNA, 25 bp, Mus musculus
gacaatcaagccgtattttcctaat

SEQ ID NO: 444530 - DNA, 25 bp, Mus musculus
gacaatcaagggaattggaattcct

SEQ ID NO: 444531 - DNA, 25 bp, Mus musculus
gacaatcaagggtattggaattcct

SEQ ID NO: 444532 - DNA, 25 bp, Mus musculus
gacaatcaagttcctttaatcctgt

SEQ ID NO: 444533 - DNA, 25 bp, Mus musculus
gacaatcaagttgctttaatcctgt

SEQ ID NO: 444534 - DNA, 25 bp, Mus musculus
gacaatcacaatacttagttcccta

SEQ ID NO: 444535 - DNA, 25 bp, Mus musculus
gacaatcacaattcttagttcccta

SEQ ID NO: 444536 - DNA, 25 bp, Mus musculus
gacaatcacaccacagaatgctcca

SEQ ID NO: 444537 - DNA, 25 bp, Mus musculus
gacaatcacacctcagaatgctcca

SEQ ID NO: 444538 - DNA, 25 bp, Mus musculus
gacaatcacccaactaagcttgcct

SEQ ID NO: 444539 - DNA, 25 bp, Mus musculus
gacaatcacccatctaagcttgcct

SEQ ID NO: 444540 - DNA, 25 bp, Mus musculus
gacaatcacggtatgctgatctcaa

SEQ ID NO: 444541 - DNA, 25 bp, Mus musculus
gacaatcacggtttgctgatctcaa

SEQ ID NO: 444542 - DNA, 25 bp, Mus musculus
gacaatcacgtcatagctaccagta

SEQ ID NO: 444543 - DNA, 25 bp, Mus musculus
gacaatcacgtcttagctaccagta

SEQ ID NO: 444544 - DNA, 25 bp, Mus musculus
gacaatcacttgcttctggagttag

SEQ ID NO: 444545 - DNA, 25 bp, Mus musculus
gacaatcacttggttctggagttag

SEQ ID NO: 444546 - DNA, 25 bp, Mus musculus
gacaatcagaaaccaagcctgccgt

SEQ ID NO: 444547 - DNA, 25 bp, Mus musculus
gacaatcagaaagcaagcctgccgt

SEQ ID NO: 444548 - DNA, 25 bp, Mus musculus
gacaatcagggcatccttcatcact

SEQ ID NO: 444549 - DNA, 25 bp, Mus musculus
gacaatcagggcttccttcatcact

SEQ ID NO: 444550 - DNA, 25 bp, Mus musculus
gacaatcagtcaacctggattggac

SEQ ID NO: 444551 - DNA, 25 bp, Mus musculus
gacaatcagtcatcctggattggac

SEQ ID NO: 444552 - DNA, 25 bp, Mus musculus
gacaatcagttcattaaggttacta

SEQ ID NO: 444553 - DNA, 25 bp, Mus musculus
gacaatcagttctttaaggttacta

SEQ ID NO: 444554 - DNA, 25 bp, Mus musculus
gacaatcagttgactattcaacaga

SEQ ID NO: 444555 - DNA, 25 bp, Mus musculus
gacaatcagttgtctattcaacaga

SEQ ID NO: 444556 - DNA, 25 bp, Mus musculus
gacaatcataataaaccaccttgct

SEQ ID NO: 444557 - DNA, 25 bp, Mus musculus
gacaatcataattaaccaccttgct

SEQ ID NO: 444558 - DNA, 25 bp, Mus musculus
gacaatcatgtccacctagggtcat

SEQ ID NO: 444559 - DNA, 25 bp, Mus musculus
gacaatcatgtcgacctagggtcat

SEQ ID NO: 444560 - DNA, 25 bp, Mus musculus
gacaatcatgtgagttagccccata

SEQ ID NO: 444561 - DNA, 25 bp, Mus musculus
gacaatcatgtgtgttagccccata

SEQ ID NO: 444562 - DNA, 25 bp, Mus musculus
gacaatccaaccacttgccaggaaa

SEQ ID NO: 444563 - DNA, 25 bp, Mus musculus
gacaatccaacctcttgccaggaaa

SEQ ID NO: 444564 - DNA, 25 bp, Mus musculus
gacaatccacttagctatctgaaac

SEQ ID NO: 444565 - DNA, 25 bp, Mus musculus
gacaatccactttgctatctgaaac

SEQ ID NO: 444566 - DNA, 25 bp, Mus musculus
gacaatccagaacacgggttgcaga

SEQ ID NO: 444567 - DNA, 25 bp, Mus musculus
gacaatccagaagacgggttgcaga

SEQ ID NO: 444568 - DNA, 25 bp, Mus musculus
gacaatcccaagcccaactcctgag

SEQ ID NO: 444569 - DNA, 25 bp, Mus musculus
gacaatcccaaggccaactcctgag

SEQ ID NO: 444570 - DNA, 25 bp, Mus musculus
gacaatcccaccactacacagtatg

SEQ ID NO: 444571 - DNA, 25 bp, Mus musculus
gacaatcccacctctacacagtatg

SEQ ID NO: 444572 - DNA, 25 bp, Mus musculus
gacaatcccctaatgagtcacttgg

SEQ ID NO: 444573 - DNA, 25 bp, Mus musculus
gacaatcccctattgagtcacttgg

SEQ ID NO: 444574 - DNA, 25 bp, Mus musculus
gacaatcccgctcaagactggtgga

SEQ ID NO: 444575 - DNA, 25 bp, Mus musculus
gacaatcccgctgaagactggtgga

SEQ ID NO: 444576 - DNA, 25 bp, Mus musculus
gacaatccctctaaaaatgttgtta

SEQ ID NO: 444577 - DNA, 25 bp, Mus musculus
gacaatccctcttaaaatgttgtta

SEQ ID NO: 444578 - DNA, 25 bp, Mus musculus
gacaatccggagctcatcagcaagt

SEQ ID NO: 444579 - DNA, 25 bp, Mus musculus
gacaatccggaggtcatcagcaagt

SEQ ID NO: 444580 - DNA, 25 bp, Mus musculus
gacaatcctccaaaaaagggacggg

SEQ ID NO: 444581 - DNA, 25 bp, Mus musculus
gacaatcctccataaaagggacggg

SEQ ID NO: 444582 - DNA, 25 bp, Mus musculus
gacaatcctgaactgctgcagcgca

SEQ ID NO: 444583 - DNA, 25 bp, Mus musculus
gacaatcctgaagtgctgcagcgca

SEQ ID NO: 444584 - DNA, 25 bp, Mus musculus
gacaatccttccattaatggctttt

SEQ ID NO: 444585 - DNA, 25 bp, Mus musculus
gacaatccttcctttaatggctttt

SEQ ID NO: 444586 - DNA, 25 bp, Mus musculus
gacaatccttggcaataggccttga

SEQ ID NO: 444587 - DNA, 25 bp, Mus musculus
gacaatccttgggaataggccttga

SEQ ID NO: 444588 - DNA, 25 bp, Mus musculus
gacaatcggtacacacgcaggtgtg

SEQ ID NO: 444589 - DNA, 25 bp, Mus musculus
gacaatcggtactcacgcaggtgtg

SEQ ID NO: 444590 - DNA, 25 bp, Mus musculus
gacaatcgttgtcccagacggcaga

SEQ ID NO: 444591 - DNA, 25 bp, Mus musculus
gacaatcgttgtgccagacggcaga

SEQ ID NO: 444592 - DNA, 25 bp, Mus musculus
gacaatctacttatcattcagggct

SEQ ID NO: 444593 - DNA, 25 bp, Mus musculus
gacaatctacttttcattcagggct

SEQ ID NO: 444594 - DNA, 25 bp, Mus musculus
gacaatctcatgcatatgctggtca

SEQ ID NO: 444595 - DNA, 25 bp, Mus musculus
gacaatctcatggatatgctggtca

SEQ ID NO: 444596 - DNA, 25 bp, Mus musculus
gacaatctccctatgatgacagttt

SEQ ID NO: 444597 - DNA, 25 bp, Mus musculus
gacaatctccctttgatgacagttt

SEQ ID NO: 444598 - DNA, 25 bp, Mus musculus
gacaatctctcactaatcttctatt

SEQ ID NO: 444599 - DNA, 25 bp, Mus musculus
gacaatctctcagtaatcttctatt

SEQ ID NO: 444600 - DNA, 25 bp, Mus musculus
gacaatctcttcaggagtcttcact

SEQ ID NO: 444601 - DNA, 25 bp, Mus musculus
gacaatctcttctggagtcttcact

SEQ ID NO: 444602 - DNA, 25 bp, Mus musculus
gacaatctgactatgatacacatct

SEQ ID NO: 444603 - DNA, 25 bp, Mus musculus
gacaatctgactttgatacacatct

SEQ ID NO: 444604 - DNA, 25 bp, Mus musculus
gacaatctgggcacagcttaggcta

SEQ ID NO: 444605 - DNA, 25 bp, Mus musculus
gacaatctgggctcagcttaggcta

SEQ ID NO: 444606 - DNA, 25 bp, Mus musculus
gacaatctgtcgaattggcgaccta

SEQ ID NO: 444607 - DNA, 25 bp, Mus musculus
gacaatctgtcgtattggcgaccta

SEQ ID NO: 444608 - DNA, 25 bp, Mus musculus
gacaatcttaagaaacctcctttat

SEQ ID NO: 444609 - DNA, 25 bp, Mus musculus
gacaatcttaagtaacctcctttat

SEQ ID NO: 444610 - DNA, 25 bp, Mus musculus
gacaatcttatactccactcacggc

SEQ ID NO: 444611 - DNA, 25 bp, Mus musculus
gacaatcttatagtccactcacggc

SEQ ID NO: 444612 - DNA, 25 bp, Mus musculus
gacaatctttaaatgactccaactt

SEQ ID NO: 444613 - DNA, 25 bp, Mus musculus
gacaatctttaattgactccaactt

SEQ ID NO: 444614 - DNA, 25 bp, Mus musculus
gacaatctttttacaaacatgctat

SEQ ID NO: 444615 - DNA, 25 bp, Mus musculus
gacaatcttttttcaaacatgctat

SEQ ID NO: 444616 - DNA, 25 bp, Mus musculus
gacaatgaagagagctcatcctttt

SEQ ID NO: 444617 - DNA, 25 bp, Mus musculus
gacaatgaagagtgctcatcctttt

SEQ ID NO: 444618 - DNA, 25 bp, Mus musculus
gacaatgaagcgagactctccttat

SEQ ID NO: 444619 - DNA, 25 bp, Mus musculus
gacaatgaagcgtgactctccttat

SEQ ID NO: 444620 - DNA, 25 bp, Mus musculus
gacaatgaagtgaagtcctccacat

SEQ ID NO: 444621 - DNA, 25 bp, Mus musculus
gacaatgaagtgctgcgtccatgct

SEQ ID NO: 444622 - DNA, 25 bp, Mus musculus
gacaatgaagtggtgcgtccatgct

SEQ ID NO: 444623 - DNA, 25 bp, Mus musculus
gacaatgaagtgtagtcctccacat

SEQ ID NO: 444624 - DNA, 25 bp, Mus musculus
gacaatgaataacctcccttttctc

SEQ ID NO: 444625 - DNA, 25 bp, Mus musculus
gacaatgaataagctcccttttctc

SEQ ID NO: 444626 - DNA, 25 bp, Mus musculus
gacaatgaatgcaatcgactcccca

SEQ ID NO: 444627 - DNA, 25 bp, Mus musculus
gacaatgaatgctatcgactcccca

SEQ ID NO: 444628 - DNA, 25 bp, Mus musculus
gacaatgaattcacttcgattaaac

SEQ ID NO: 444629 - DNA, 25 bp, Mus musculus
gacaatgaattctcttcgattaaac

SEQ ID NO: 444630 - DNA, 25 bp, Mus musculus
gacaatgacaaactgctgccctgcc

SEQ ID NO: 444631 - DNA, 25 bp, Mus musculus
gacaatgacaaagtgctgccctgcc

SEQ ID NO: 444632 - DNA, 25 bp, Mus musculus
gacaatgacaagacgccgggatgac

SEQ ID NO: 444633 - DNA, 25 bp, Mus musculus
gacaatgacaagtcgccgggatgac

SEQ ID NO: 444634 - DNA, 25 bp, Mus musculus
gacaatgacaatcactcggagatgg

SEQ ID NO: 444635 - DNA, 25 bp, Mus musculus
gacaatgacaatgactcggagatgg

SEQ ID NO: 444636 - DNA, 25 bp, Mus musculus
gacaatgacactcacccgaacagca

SEQ ID NO: 444637 - DNA, 25 bp, Mus musculus
gacaatgacactgacccgaacagca

SEQ ID NO: 444638 - DNA, 25 bp, Mus musculus
gacaatgacagaaactgtacctctt

SEQ ID NO: 444639 - DNA, 25 bp, Mus musculus
gacaatgacagatactgtacctctt

SEQ ID NO: 444640 - DNA, 25 bp, Mus musculus
gacaatgaccagactttcctcatag

SEQ ID NO: 444641 - DNA, 25 bp, Mus musculus
gacaatgaccagtctttcctcatag

SEQ ID NO: 444642 - DNA, 25 bp, Mus musculus
gacaatgaccatattaccctttgtt

SEQ ID NO: 444643 - DNA, 25 bp, Mus musculus
gacaatgaccattttaccctttgtt

SEQ ID NO: 444644 - DNA, 25 bp, Mus musculus
gacaatgaccttcctatggacagcc

SEQ ID NO: 444645 - DNA, 25 bp, Mus musculus
gacaatgaccttgctatggacagcc

SEQ ID NO: 444646 - DNA, 25 bp, Mus musculus
gacaatgacgcacagttccatcgac

SEQ ID NO: 444647 - DNA, 25 bp, Mus musculus
gacaatgacgcagagttccatcgac

SEQ ID NO: 444648 - DNA, 25 bp, Mus musculus
gacaatgactacaggcctcaggcag

SEQ ID NO: 444649 - DNA, 25 bp, Mus musculus
gacaatgactactggcctcaggcag

SEQ ID NO: 444650 - DNA, 25 bp, Mus musculus
gacaatgactcgcacagcggcagtg

SEQ ID NO: 444651 - DNA, 25 bp, Mus musculus
gacaatgactcggacagcggcagtg

SEQ ID NO: 444652 - DNA, 25 bp, Mus musculus
gacaatgagaccatctatggccaag

SEQ ID NO: 444653 - DNA, 25 bp, Mus musculus
gacaatgagaccttctatggccaag

SEQ ID NO: 444654 - DNA, 25 bp, Mus musculus
gacaatgagactatctctccaggct

SEQ ID NO: 444655 - DNA, 25 bp, Mus musculus
gacaatgagactttctctccaggct

SEQ ID NO: 444656 - DNA, 25 bp, Mus musculus
gacaatgagattccttttaagtgga

SEQ ID NO: 444657 - DNA, 25 bp, Mus musculus
gacaatgagattgcttttaagtgga

SEQ ID NO: 444658 - DNA, 25 bp, Mus musculus
gacaatgaggtgctttaccttttaa

SEQ ID NO: 444659 - DNA, 25 bp, Mus musculus
gacaatgaggtggtttaccttttaa

SEQ ID NO: 444660 - DNA, 25 bp, Mus musculus
gacaatgagtctcagctactgatag

SEQ ID NO: 444661 - DNA, 25 bp, Mus musculus
gacaatgagtctgagctactgatag

SEQ ID NO: 444662 - DNA, 25 bp, Mus musculus
gacaatgagtggcatgggcccaata

SEQ ID NO: 444663 - DNA, 25 bp, Mus musculus
gacaatgagtgggatgggcccaata

SEQ ID NO: 444664 - DNA, 25 bp, Mus musculus
gacaatgatagcatctcctacgacg

SEQ ID NO: 444665 - DNA, 25 bp, Mus musculus
gacaatgatagcttctcctacgacg

SEQ ID NO: 444666 - DNA, 25 bp, Mus musculus
gacaatgatgatcttcaccagaggg

SEQ ID NO: 444667 - DNA, 25 bp, Mus musculus
gacaatgatgatgttcaccagaggg

SEQ ID NO: 444668 - DNA, 25 bp, Mus musculus
gacaatgatgtcacctgatggcttt

SEQ ID NO: 444669 - DNA, 25 bp, Mus musculus
gacaatgatgtctcctgatggcttt

SEQ ID NO: 444670 - DNA, 25 bp, Mus musculus
gacaatgcagcaattaaatcccgtg

SEQ ID NO: 444671 - DNA, 25 bp, Mus musculus
gacaatgcagcatttaaatcccgtg

SEQ ID NO: 444672 - DNA, 25 bp, Mus musculus
gacaatgcccagatcaggttgctga

SEQ ID NO: 444673 - DNA, 25 bp, Mus musculus
gacaatgcccagttcaggttgctga

SEQ ID NO: 444674 - DNA, 25 bp, Mus musculus
gacaatgcccatatgcctctttgtt

SEQ ID NO: 444675 - DNA, 25 bp, Mus musculus
gacaatgcccatttgcctctttgtt

SEQ ID NO: 444676 - DNA, 25 bp, Mus musculus
gacaatgcgggcaatgacagtgcag

SEQ ID NO: 444677 - DNA, 25 bp, Mus musculus
gacaatgcgggctatgacagtgcag

SEQ ID NO: 444678 - DNA, 25 bp, Mus musculus
gacaatgcgtaacacattttccctt

SEQ ID NO: 444679 - DNA, 25 bp, Mus musculus
gacaatgcgtaagacattttccctt

SEQ ID NO: 444680 - DNA, 25 bp, Mus musculus
gacaatgctaaacagctacagagga

SEQ ID NO: 444681 - DNA, 25 bp, Mus musculus
gacaatgctaaagagctacagagga

SEQ ID NO: 444682 - DNA, 25 bp, Mus musculus
gacaatgctattcagtattacagtg

SEQ ID NO: 444683 - DNA, 25 bp, Mus musculus
gacaatgctattgagtattacagtg

SEQ ID NO: 444684 - DNA, 25 bp, Mus musculus
gacaatgctcacataggcctacaag

SEQ ID NO: 444685 - DNA, 25 bp, Mus musculus
gacaatgctcacttaggcctacaag

SEQ ID NO: 444686 - DNA, 25 bp, Mus musculus
gacaatgctcatcgaacataaagaa

SEQ ID NO: 444687 - DNA, 25 bp, Mus musculus
gacaatgctcatggaacataaagaa

SEQ ID NO: 444688 - DNA, 25 bp, Mus musculus
gacaatgctttgctactagtcttaa

SEQ ID NO: 444689 - DNA, 25 bp, Mus musculus
gacaatgctttggtactagtcttaa

SEQ ID NO: 444690 - DNA, 25 bp, Mus musculus
gacaatggaaaaccgtgttggcaat

SEQ ID NO: 444691 - DNA, 25 bp, Mus musculus
gacaatggaaaagcgtgttggcaat

SEQ ID NO: 444692 - DNA, 25 bp, Mus musculus
gacaatggaaccctagcagtggcct

SEQ ID NO: 444693 - DNA, 25 bp, Mus musculus
gacaatggaaccgtagcagtggcct

SEQ ID NO: 444694 - DNA, 25 bp, Mus musculus
gacaatggagaccatgccccacaga

SEQ ID NO: 444695 - DNA, 25 bp, Mus musculus
gacaatggagacgatgccccacaga

SEQ ID NO: 444696 - DNA, 25 bp, Mus musculus
gacaatggatgtcccatacctttaa

SEQ ID NO: 444697 - DNA, 25 bp, Mus musculus
gacaatggatgtgccatacctttaa

SEQ ID NO: 444698 - DNA, 25 bp, Mus musculus
gacaatggccatagtactgggacct

SEQ ID NO: 444699 - DNA, 25 bp, Mus musculus
gacaatggccattgtactgggacct

SEQ ID NO: 444700 - DNA, 25 bp, Mus musculus
gacaatggctcacttttgctggtta

SEQ ID NO: 444701 - DNA, 25 bp, Mus musculus
gacaatggctcagttttgctggtta

SEQ ID NO: 444702 - DNA, 25 bp, Mus musculus
gacaatggctgaccgcaacctggac

SEQ ID NO: 444703 - DNA, 25 bp, Mus musculus
gacaatggctgagcgcaacctggac

SEQ ID NO: 444704 - DNA, 25 bp, Mus musculus
gacaatgggtctcaaattcttgctt

SEQ ID NO: 444705 - DNA, 25 bp, Mus musculus
gacaatgggtctgaaattcttgctt

SEQ ID NO: 444706 - DNA, 25 bp, Mus musculus
gacaatgggtgtacccattttcaca

SEQ ID NO: 444707 - DNA, 25 bp, Mus musculus
gacaatgggtgttcccattttcaca

SEQ ID NO: 444708 - DNA, 25 bp, Mus musculus
gacaatggtcagacgcaggccctgg

SEQ ID NO: 444709 - DNA, 25 bp, Mus musculus
gacaatggtcagtcgcaggccctgg

SEQ ID NO: 444710 - DNA, 25 bp, Mus musculus
gacaatggtgctcgatttctagtta

SEQ ID NO: 444711 - DNA, 25 bp, Mus musculus
gacaatggtgctggatttctagtta

SEQ ID NO: 444712 - DNA, 25 bp, Mus musculus
gacaatggtggaagccagcaagact

SEQ ID NO: 444713 - DNA, 25 bp, Mus musculus
gacaatggtggatgccagcaagact

SEQ ID NO: 444714 - DNA, 25 bp, Mus musculus
gacaatggtgtaaacctgccgccac

SEQ ID NO: 444715 - DNA, 25 bp, Mus musculus
gacaatggtgtatacctgccgccac

SEQ ID NO: 444716 - DNA, 25 bp, Mus musculus
gacaatggttagctctcaccttgag

SEQ ID NO: 444717 - DNA, 25 bp, Mus musculus
gacaatggttaggtctcaccttgag

SEQ ID NO: 444718 - DNA, 25 bp, Mus musculus
gacaatgtagagatcactgaatgca

SEQ ID NO: 444719 - DNA, 25 bp, Mus musculus
gacaatgtagagttcactgaatgca

SEQ ID NO: 444720 - DNA, 25 bp, Mus musculus
gacaatgtagccctctgaccatgcg

SEQ ID NO: 444721 - DNA, 25 bp, Mus musculus
gacaatgtagccgtctgaccatgcg

SEQ ID NO: 444722 - DNA, 25 bp, Mus musculus
gacaatgtatgaccttgcagttcca

SEQ ID NO: 444723 - DNA, 25 bp, Mus musculus
gacaatgtatgagcttgcagttcca

SEQ ID NO: 444724 - DNA, 25 bp, Mus musculus
gacaatgtcaagcaaagaacctctt

SEQ ID NO: 444725 - DNA, 25 bp, Mus musculus
gacaatgtcaaggaaagaacctctt

SEQ ID NO: 444726 - DNA, 25 bp, Mus musculus
gacaatgtcaccagctatggaggct

SEQ ID NO: 444727 - DNA, 25 bp, Mus musculus
gacaatgtcacctgctatggaggct

SEQ ID NO: 444728 - DNA, 25 bp, Mus musculus
gacaatgtctgtatttgggcagctt

SEQ ID NO: 444729 - DNA, 25 bp, Mus musculus
gacaatgtctgtttttgggcagctt

SEQ ID NO: 444730 - DNA, 25 bp, Mus musculus
gacaatgtcttgatacttctactgc

SEQ ID NO: 444731 - DNA, 25 bp, Mus musculus
gacaatgtcttgttacttctactgc

SEQ ID NO: 444732 - DNA, 25 bp, Mus musculus
gacaatgtgaccatactttacctcg

SEQ ID NO: 444733 - DNA, 25 bp, Mus musculus
gacaatgtgaccttactttacctcg

SEQ ID NO: 444734 - DNA, 25 bp, Mus musculus
gacaatgtggagctcttttcacact

SEQ ID NO: 444735 - DNA, 25 bp, Mus musculus
gacaatgtggaggtcttttcacact

SEQ ID NO: 444736 - DNA, 25 bp, Mus musculus
gacaatgtggcaaatcctgttcaaa

SEQ ID NO: 444737 - DNA, 25 bp, Mus musculus
gacaatgtggcatatcctgttcaaa

SEQ ID NO: 444738 - DNA, 25 bp, Mus musculus
gacaatgtggcgatgtagggctcca

SEQ ID NO: 444739 - DNA, 25 bp, Mus musculus
gacaatgtggcgttgtagggctcca

SEQ ID NO: 444740 - DNA, 25 bp, Mus musculus
gacaatgtgtctccaacagattgag

SEQ ID NO: 444741 - DNA, 25 bp, Mus musculus
gacaatgtgtctgcaacagattgag

SEQ ID NO: 444742 - DNA, 25 bp, Mus musculus
gacaatgttacgaggagttcctaat

SEQ ID NO: 444743 - DNA, 25 bp, Mus musculus
gacaatgttacgtggagttcctaat

SEQ ID NO: 444744 - DNA, 25 bp, Mus musculus
gacaatgttactactctgtgatgtg

SEQ ID NO: 444745 - DNA, 25 bp, Mus musculus
gacaatgttacttctctgtgatgtg

SEQ ID NO: 444746 - DNA, 25 bp, Mus musculus
gacaatgttggacgtgacatcagca

SEQ ID NO: 444747 - DNA, 25 bp, Mus musculus
gacaatgttggaggtgacatcagca

SEQ ID NO: 444748 - DNA, 25 bp, Mus musculus
gacaatgttgtaatgacccatactt

SEQ ID NO: 444749 - DNA, 25 bp, Mus musculus
gacaatgttgtattgacccatactt

SEQ ID NO: 444750 - DNA, 25 bp, Mus musculus
gacaatgttgtgcatggccttcacc

SEQ ID NO: 444751 - DNA, 25 bp, Mus musculus
gacaatgttgtggatggccttcacc

SEQ ID NO: 444752 - DNA, 25 bp, Mus musculus
gacaatgtttgcagttctgctttgg

SEQ ID NO: 444753 - DNA, 25 bp, Mus musculus
gacaatgtttgccaagtcatctgta

SEQ ID NO: 444754 - DNA, 25 bp, Mus musculus
gacaatgtttgcgaagtcatctgta

SEQ ID NO: 444755 - DNA, 25 bp, Mus musculus
gacaatgtttgctgttctgctttgg

SEQ ID NO: 444756 - DNA, 25 bp, Mus musculus
gacaattactttcaggctctatctt

SEQ ID NO: 444757 - DNA, 25 bp, Mus musculus
gacaattactttgaggctctatctt

SEQ ID NO: 444758 - DNA, 25 bp, Mus musculus
gacaattattccctttagtgtttga

SEQ ID NO: 444759 - DNA, 25 bp, Mus musculus
gacaattattccgtttagtgtttga

SEQ ID NO: 444760 - DNA, 25 bp, Mus musculus
gacaattcactcaggctgtttgaac

SEQ ID NO: 444761 - DNA, 25 bp, Mus musculus
gacaattcactctggctgtttgaac

SEQ ID NO: 444762 - DNA, 25 bp, Mus musculus
gacaattccagacagcgcacatata

SEQ ID NO: 444763 - DNA, 25 bp, Mus musculus
gacaattccagagagcgcacatata

SEQ ID NO: 444764 - DNA, 25 bp, Mus musculus
gacaattccagcacaaaggttacct

SEQ ID NO: 444765 - DNA, 25 bp, Mus musculus
gacaattccagctcaaaggttacct

SEQ ID NO: 444766 - DNA, 25 bp, Mus musculus
gacaattcccaaacttatgttgcat

SEQ ID NO: 444767 - DNA, 25 bp, Mus musculus
gacaattcccaatcttatgttgcat

SEQ ID NO: 444768 - DNA, 25 bp, Mus musculus
gacaattcctggcactctgggtact

SEQ ID NO: 444769 - DNA, 25 bp, Mus musculus
gacaattcctgggactctgggtact

SEQ ID NO: 444770 - DNA, 25 bp, Mus musculus
gacaattctagcagaaatgtgccaa

SEQ ID NO: 444771 - DNA, 25 bp, Mus musculus
gacaattctagctgaaatgtgccaa

SEQ ID NO: 444772 - DNA, 25 bp, Mus musculus
gacaattctcatactcagagtacca

SEQ ID NO: 444773 - DNA, 25 bp, Mus musculus
gacaattctcattctcagagtacca

SEQ ID NO: 444774 - DNA, 25 bp, Mus musculus
gacaattcttaacagagcttactag

SEQ ID NO: 444775 - DNA, 25 bp, Mus musculus
gacaattcttaagagagcttactag

SEQ ID NO: 444776 - DNA, 25 bp, Mus musculus
gacaattcttgtcattctaaggaaa

SEQ ID NO: 444777 - DNA, 25 bp, Mus musculus
gacaattcttgtgattctaaggaaa

SEQ ID NO: 444778 - DNA, 25 bp, Mus musculus
gacaattgacaaagcgtgcctgtgt

SEQ ID NO: 444779 - DNA, 25 bp, Mus musculus
gacaattgacaatgcgtgcctgtgt

SEQ ID NO: 444780 - DNA, 25 bp, Mus musculus
gacaattgccgcaggtctgagagaa

SEQ ID NO: 444781 - DNA, 25 bp, Mus musculus
gacaattgccgctggtctgagagaa

SEQ ID NO: 444782 - DNA, 25 bp, Mus musculus
gacaattgcctaagagagccatttt

SEQ ID NO: 444783 - DNA, 25 bp, Mus musculus
gacaattgcctatgagagccatttt

SEQ ID NO: 444784 - DNA, 25 bp, Mus musculus
gacaattgcctcatctgactataac

SEQ ID NO: 444785 - DNA, 25 bp, Mus musculus
gacaattgcctcttctgactataac

SEQ ID NO: 444786 - DNA, 25 bp, Mus musculus
gacaattgctttacttgccatctgt

SEQ ID NO: 444787 - DNA, 25 bp, Mus musculus
gacaattgcttttcttgccatctgt

SEQ ID NO: 444788 - DNA, 25 bp, Mus musculus
gacaattggctccacacatgaggtt

SEQ ID NO: 444789 - DNA, 25 bp, Mus musculus
gacaattggctcgacacatgaggtt

SEQ ID NO: 444790 - DNA, 25 bp, Mus musculus
gacaattgggcacctctagtccagc

SEQ ID NO: 444791 - DNA, 25 bp, Mus musculus
gacaattgggcagctctagtccagc

SEQ ID NO: 444792 - DNA, 25 bp, Mus musculus
gacaattgtccccattttactaatg

SEQ ID NO: 444793 - DNA, 25 bp, Mus musculus
gacaattgtcccgattttactaatg

SEQ ID NO: 444794 - DNA, 25 bp, Mus musculus
gacaattgtcttattcttgggtagt

SEQ ID NO: 444795 - DNA, 25 bp, Mus musculus
gacaattgtctttttcttgggtagt

SEQ ID NO: 444796 - DNA, 25 bp, Mus musculus
gacaattgtggcagctgtcactggg

SEQ ID NO: 444797 - DNA, 25 bp, Mus musculus
gacaattgtggctgctgtcactggg

SEQ ID NO: 444798 - DNA, 25 bp, Mus musculus
gacaattgtgtgacacaggcagtaa

SEQ ID NO: 444799 - DNA, 25 bp, Mus musculus
gacaattgtgtgtcacaggcagtaa

SEQ ID NO: 444800 - DNA, 25 bp, Mus musculus
gacaatttaagccacaagatccgta

SEQ ID NO: 444801 - DNA, 25 bp, Mus musculus
gacaatttaagccttgctgctcttg

SEQ ID NO: 444802 - DNA, 25 bp, Mus musculus
gacaatttaagcgacaagatccgta

SEQ ID NO: 444803 - DNA, 25 bp, Mus musculus
gacaatttaagcgttgctgctcttg

SEQ ID NO: 444804 - DNA, 25 bp, Mus musculus
gacaatttacagcaaaccgcatatg

SEQ ID NO: 444805 - DNA, 25 bp, Mus musculus
gacaatttacaggaaaccgcatatg

SEQ ID NO: 444806 - DNA, 25 bp, Mus musculus
gacaatttagctaagaggtggtatt

SEQ ID NO: 444807 - DNA, 25 bp, Mus musculus
gacaatttagcttagaggtggtatt

SEQ ID NO: 444808 - DNA, 25 bp, Mus musculus
gacaatttataacccattaggctgg

SEQ ID NO: 444809 - DNA, 25 bp, Mus musculus
gacaatttataagccattaggctgg

SEQ ID NO: 444810 - DNA, 25 bp, Mus musculus
gacaatttcaacaaacacattccct

SEQ ID NO: 444811 - DNA, 25 bp, Mus musculus
gacaatttcaactaacacattccct

SEQ ID NO: 444812 - DNA, 25 bp, Mus musculus
gacaatttcacgatcctggttgttg

SEQ ID NO: 444813 - DNA, 25 bp, Mus musculus
gacaatttcacgttcctggttgttg

SEQ ID NO: 444814 - DNA, 25 bp, Mus musculus
gacaatttccttacagctataattg

SEQ ID NO: 444815 - DNA, 25 bp, Mus musculus
gacaatttcctttcagctataattg

SEQ ID NO: 444816 - DNA, 25 bp, Mus musculus
gacaatttcttgagaatggcttttg

SEQ ID NO: 444817 - DNA, 25 bp, Mus musculus
gacaatttcttgtgaatggcttttg

SEQ ID NO: 444818 - DNA, 25 bp, Mus musculus
gacaatttgatcattactaactagc

SEQ ID NO: 444819 - DNA, 25 bp, Mus musculus
gacaatttgatctttactaactagc

SEQ ID NO: 444820 - DNA, 25 bp, Mus musculus
gacaatttgcacagaggacggcact

SEQ ID NO: 444821 - DNA, 25 bp, Mus musculus
gacaatttgcactgaggacggcact

SEQ ID NO: 444822 - DNA, 25 bp, Mus musculus
gacaatttggacactacaaaggtct

SEQ ID NO: 444823 - DNA, 25 bp, Mus musculus
gacaatttggactctacaaaggtct

SEQ ID NO: 444824 - DNA, 25 bp, Mus musculus
gacaatttgggcatcttagcgtatg

SEQ ID NO: 444825 - DNA, 25 bp, Mus musculus
gacaatttgggcttcttagcgtatg

SEQ ID NO: 444826 - DNA, 25 bp, Mus musculus
gacaattttcatctctgctggtggt

SEQ ID NO: 444827 - DNA, 25 bp, Mus musculus
gacaattttcatgtctgctggtggt

SEQ ID NO: 444828 - DNA, 25 bp, Mus musculus
gacaattttccacagccagaacata

SEQ ID NO: 444829 - DNA, 25 bp, Mus musculus
gacaattttccagagccagaacata

SEQ ID NO: 444830 - DNA, 25 bp, Mus musculus
gacaattttcttattcccttaccat

SEQ ID NO: 444831 - DNA, 25 bp, Mus musculus
gacaattttctttttcccttaccat

SEQ ID NO: 444832 - DNA, 25 bp, Mus musculus
gacaattttgaccagatggacacct

SEQ ID NO: 444833 - DNA, 25 bp, Mus musculus
gacaattttgacgagatggacacct

SEQ ID NO: 444834 - DNA, 25 bp, Mus musculus
gacaattttgggaccctccgtctca

SEQ ID NO: 444835 - DNA, 25 bp, Mus musculus
gacaattttgggtccctccgtctca

SEQ ID NO: 444836 - DNA, 25 bp, Mus musculus
gacaattttttgaggctgtatttga

SEQ ID NO: 444837 - DNA, 25 bp, Mus musculus
gacaattttttgtggctgtatttga

SEQ ID NO: 444838 - DNA, 25 bp, Mus musculus
gacacaaaactgatagtgacacaac

SEQ ID NO: 444839 - DNA, 25 bp, Mus musculus
gacacaaaactgttagtgacacaac

SEQ ID NO: 444840 - DNA, 25 bp, Mus musculus
gacacaaaagcaaactcagaagttt

SEQ ID NO: 444841 - DNA, 25 bp, Mus musculus
gacacaaaagcatactcagaagttt

SEQ ID NO: 444842 - DNA, 25 bp, Mus musculus
gacacaaaatcaccctccagttcta

SEQ ID NO: 444843 - DNA, 25 bp, Mus musculus
gacacaaaatcagcctccagttcta

SEQ ID NO: 444844 - DNA, 25 bp, Mus musculus
gacacaaacacaactcggcaaagca

SEQ ID NO: 444845 - DNA, 25 bp, Mus musculus
gacacaaacacatctcggcaaagca

SEQ ID NO: 444846 - DNA, 25 bp, Mus musculus
gacacaaacaccctgtggatgcacg

SEQ ID NO: 444847 - DNA, 25 bp, Mus musculus
gacacaaacaccgtgtggatgcacg

SEQ ID NO: 444848 - DNA, 25 bp, Mus musculus
gacacaaacactaatgcaccttctc

SEQ ID NO: 444849 - DNA, 25 bp, Mus musculus
gacacaaacacttatgcaccttctc

SEQ ID NO: 444850 - DNA, 25 bp, Mus musculus
gacacaaacagaatcattatctcca

SEQ ID NO: 444851 - DNA, 25 bp, Mus musculus
gacacaaacagattcattatctcca

SEQ ID NO: 444852 - DNA, 25 bp, Mus musculus
gacacaaactatatccagtacccaa

SEQ ID NO: 444853 - DNA, 25 bp, Mus musculus
gacacaaactatttccagtacccaa

SEQ ID NO: 444854 - DNA, 25 bp, Mus musculus
gacacaaagaacactcggactgcaa

SEQ ID NO: 444855 - DNA, 25 bp, Mus musculus
gacacaaagaactctcggactgcaa

SEQ ID NO: 444856 - DNA, 25 bp, Mus musculus
gacacaaagagaaggcccagaagct

SEQ ID NO: 444857 - DNA, 25 bp, Mus musculus
gacacaaagagatggcccagaagct

SEQ ID NO: 444858 - DNA, 25 bp, Mus musculus
gacacaaagcataacacctgctcag

SEQ ID NO: 444859 - DNA, 25 bp, Mus musculus
gacacaaagcattacacctgctcag

SEQ ID NO: 444860 - DNA, 25 bp, Mus musculus
gacacaaagcggactatctgtttat

SEQ ID NO: 444861 - DNA, 25 bp, Mus musculus
gacacaaagcggtctatctgtttat

SEQ ID NO: 444862 - DNA, 25 bp, Mus musculus
gacacaaagcttaaaactcagatga

SEQ ID NO: 444863 - DNA, 25 bp, Mus musculus
gacacaaagctttaaactcagatga

SEQ ID NO: 444864 - DNA, 25 bp, Mus musculus
gacacaaaggtgactcacctcagac

SEQ ID NO: 444865 - DNA, 25 bp, Mus musculus
gacacaaaggtgtctcacctcagac

SEQ ID NO: 444866 - DNA, 25 bp, Mus musculus
gacacaaatgagacactgagccctc

SEQ ID NO: 444867 - DNA, 25 bp, Mus musculus
gacacaaatgagtcactgagccctc

SEQ ID NO: 444868 - DNA, 25 bp, Mus musculus
gacacaacaactataataccaacat

SEQ ID NO: 444869 - DNA, 25 bp, Mus musculus
gacacaacaactttaataccaacat

SEQ ID NO: 444870 - DNA, 25 bp, Mus musculus
gacacaacagatacctatggcaaca

SEQ ID NO: 444871 - DNA, 25 bp, Mus musculus
gacacaacagattcctatggcaaca

SEQ ID NO: 444872 - DNA, 25 bp, Mus musculus
gacacaacagccaggattgcacagt

SEQ ID NO: 444873 - DNA, 25 bp, Mus musculus
gacacaacagcctggattgcacagt

SEQ ID NO: 444874 - DNA, 25 bp, Mus musculus
gacacaacatcccacatagcttagg

SEQ ID NO: 444875 - DNA, 25 bp, Mus musculus
gacacaacatccgacatagcttagg

SEQ ID NO: 444876 - DNA, 25 bp, Mus musculus
gacacaaccactcaaacttattcct

SEQ ID NO: 444877 - DNA, 25 bp, Mus musculus
gacacaaccactgaaacttattcct

SEQ ID NO: 444878 - DNA, 25 bp, Mus musculus
gacacaaccgtgaaaagcttgacta

SEQ ID NO: 444879 - DNA, 25 bp, Mus musculus
gacacaaccgtgtaaagcttgacta

SEQ ID NO: 444880 - DNA, 25 bp, Mus musculus
gacacaaccttgctgacttcacagg

SEQ ID NO: 444881 - DNA, 25 bp, Mus musculus
gacacaaccttggtgacttcacagg

SEQ ID NO: 444882 - DNA, 25 bp, Mus musculus
gacacaactaagcttgctgtggtat

SEQ ID NO: 444883 - DNA, 25 bp, Mus musculus
gacacaactaaggttgctgtggtat

SEQ ID NO: 444884 - DNA, 25 bp, Mus musculus
gacacaactcataactctggcctga

SEQ ID NO: 444885 - DNA, 25 bp, Mus musculus
gacacaactcattactctggcctga

SEQ ID NO: 444886 - DNA, 25 bp, Mus musculus
gacacaactcctattgttgccggat

SEQ ID NO: 444887 - DNA, 25 bp, Mus musculus
gacacaactccttttgttgccggat

SEQ ID NO: 444888 - DNA, 25 bp, Mus musculus
gacacaacttggaatcatctgagaa

SEQ ID NO: 444889 - DNA, 25 bp, Mus musculus
gacacaacttggtatcatctgagaa

SEQ ID NO: 444890 - DNA, 25 bp, Mus musculus
gacacaacttttatcacctagactg

SEQ ID NO: 444891 - DNA, 25 bp, Mus musculus
gacacaacttttttcacctagactg

SEQ ID NO: 444892 - DNA, 25 bp, Mus musculus
gacacaagatgaaaccctgccaaaa

SEQ ID NO: 444893 - DNA, 25 bp, Mus musculus
gacacaagatgataccctgccaaaa

SEQ ID NO: 444894 - DNA, 25 bp, Mus musculus
gacacaagcgacattgacccagagt

SEQ ID NO: 444895 - DNA, 25 bp, Mus musculus
gacacaagcgactttgacccagagt

SEQ ID NO: 444896 - DNA, 25 bp, Mus musculus
gacacaagcgtcaaaggataggcca

SEQ ID NO: 444897 - DNA, 25 bp, Mus musculus
gacacaagcgtctaaggataggcca

SEQ ID NO: 444898 - DNA, 25 bp, Mus musculus
gacacaagctctcctgatctgtaaa

SEQ ID NO: 444899 - DNA, 25 bp, Mus musculus
gacacaagctctgctgatctgtaaa

SEQ ID NO: 444900 - DNA, 25 bp, Mus musculus
gacacaaggattaagagctgacaaa

SEQ ID NO: 444901 - DNA, 25 bp, Mus musculus
gacacaaggatttagagctgacaaa

SEQ ID NO: 444902 - DNA, 25 bp, Mus musculus
gacacaaggctcacataaggcttct

SEQ ID NO: 444903 - DNA, 25 bp, Mus musculus
gacacaaggctctcataaggcttct

SEQ ID NO: 444904 - DNA, 25 bp, Mus musculus
gacacaagggttaccaaggtcctgc

SEQ ID NO: 444905 - DNA, 25 bp, Mus musculus
gacacaagggtttccaaggtcctgc

SEQ ID NO: 444906 - DNA, 25 bp, Mus musculus
gacacaaggttgcagttaacgttcg

SEQ ID NO: 444907 - DNA, 25 bp, Mus musculus
gacacaaggttggagttaacgttcg

SEQ ID NO: 444908 - DNA, 25 bp, Mus musculus
gacacaagtcctctcgcagtaatag

SEQ ID NO: 444909 - DNA, 25 bp, Mus musculus
gacacaagtcctgtcgcagtaatag

SEQ ID NO: 444910 - DNA, 25 bp, Mus musculus
gacacaagtcttcctcttctgaagg

SEQ ID NO: 444911 - DNA, 25 bp, Mus musculus
gacacaagtcttgctcttctgaagg

SEQ ID NO: 444912 - DNA, 25 bp, Mus musculus
gacacaagttgaacaccacaagttt

SEQ ID NO: 444913 - DNA, 25 bp, Mus musculus
gacacaagttgatcaccacaagttt

SEQ ID NO: 444914 - DNA, 25 bp, Mus musculus
gacacaatcactactgttccaaggg

SEQ ID NO: 444915 - DNA, 25 bp, Mus musculus
gacacaatcacttctgttccaaggg

SEQ ID NO: 444916 - DNA, 25 bp, Mus musculus
gacacaatccacaattctataaggg

SEQ ID NO: 444917 - DNA, 25 bp, Mus musculus
gacacaatccactattctataaggg

SEQ ID NO: 444918 - DNA, 25 bp, Mus musculus
gacacaatcgcacaccaatcagcag

SEQ ID NO: 444919 - DNA, 25 bp, Mus musculus
gacacaatcgcagaccaatcagcag

SEQ ID NO: 444920 - DNA, 25 bp, Mus musculus
gacacaatcttgaaacctgttgcaa

SEQ ID NO: 444921 - DNA, 25 bp, Mus musculus
gacacaatcttgtaacctgttgcaa

SEQ ID NO: 444922 - DNA, 25 bp, Mus musculus
gacacaattagacaaacctttccct

SEQ ID NO: 444923 - DNA, 25 bp, Mus musculus
gacacaattagagaaacctttccct

SEQ ID NO: 444924 - DNA, 25 bp, Mus musculus
gacacaattctgaagtatttccagg

SEQ ID NO: 444925 - DNA, 25 bp, Mus musculus
gacacaattctgtagtatttccagg

SEQ ID NO: 444926 - DNA, 25 bp, Mus musculus
gacacaattgacaatcagaaacagc

SEQ ID NO: 444927 - DNA, 25 bp, Mus musculus
gacacaattgactatcagaaacagc

SEQ ID NO: 444928 - DNA, 25 bp, Mus musculus
gacacaattttaacaacgagctagg

SEQ ID NO: 444929 - DNA, 25 bp, Mus musculus
gacacaattttatcaacgagctagg

SEQ ID NO: 444930 - DNA, 25 bp, Mus musculus
gacacaatttttcactgctgctaat

SEQ ID NO: 444931 - DNA, 25 bp, Mus musculus
gacacaatttttgactgctgctaat

SEQ ID NO: 444932 - DNA, 25 bp, Mus musculus
gacacacaacctatttgagctgctg

SEQ ID NO: 444933 - DNA, 25 bp, Mus musculus
gacacacaacctttttgagctgctg

SEQ ID NO: 444934 - DNA, 25 bp, Mus musculus
gacacacaatgtactttgctgattt

SEQ ID NO: 444935 - DNA, 25 bp, Mus musculus
gacacacaatgttctttgctgattt

SEQ ID NO: 444936 - DNA, 25 bp, Mus musculus
gacacacacaagaccacaacatttt

SEQ ID NO: 444937 - DNA, 25 bp, Mus musculus
gacacacacaagtccacaacatttt

SEQ ID NO: 444938 - DNA, 25 bp, Mus musculus
gacacacacacgaaactttaaaggg

SEQ ID NO: 444939 - DNA, 25 bp, Mus musculus
gacacacacacgtaactttaaaggg

SEQ ID NO: 444940 - DNA, 25 bp, Mus musculus
gacacacacctcagcattgcatata

SEQ ID NO: 444941 - DNA, 25 bp, Mus musculus
gacacacacctctgcattgcatata

SEQ ID NO: 444942 - DNA, 25 bp, Mus musculus
gacacacacctgcagtgatgaccag

SEQ ID NO: 444943 - DNA, 25 bp, Mus musculus
gacacacacctggagtgatgaccag

SEQ ID NO: 444944 - DNA, 25 bp, Mus musculus
gacacacactacaatcagcagggag

SEQ ID NO: 444945 - DNA, 25 bp, Mus musculus
gacacacactactatcagcagggag

SEQ ID NO: 444946 - DNA, 25 bp, Mus musculus
gacacacactgtacaatccaattgt

SEQ ID NO: 444947 - DNA, 25 bp, Mus musculus
gacacacactgttcaatccaattgt

SEQ ID NO: 444948 - DNA, 25 bp, Mus musculus
gacacacagagaatcaggtgaactt

SEQ ID NO: 444949 - DNA, 25 bp, Mus musculus
gacacacagagattcaggtgaactt

SEQ ID NO: 444950 - DNA, 25 bp, Mus musculus
gacacacagatgagcacacttgcat

SEQ ID NO: 444951 - DNA, 25 bp, Mus musculus
gacacacagatgtgcacacttgcat

SEQ ID NO: 444952 - DNA, 25 bp, Mus musculus
gacacacagcatattttccacaagc

SEQ ID NO: 444953 - DNA, 25 bp, Mus musculus
gacacacagcattttttccacaagc

SEQ ID NO: 444954 - DNA, 25 bp, Mus musculus
gacacacagggaaccacatcatttt

SEQ ID NO: 444955 - DNA, 25 bp, Mus musculus
gacacacagggaactgatgatcaca

SEQ ID NO: 444956 - DNA, 25 bp, Mus musculus
gacacacagggatccacatcatttt

SEQ ID NO: 444957 - DNA, 25 bp, Mus musculus
gacacacagggatctgatgatcaca

SEQ ID NO: 444958 - DNA, 25 bp, Mus musculus
gacacacagtgtagatcaaaggagc

SEQ ID NO: 444959 - DNA, 25 bp, Mus musculus
gacacacagtgttgatcaaaggagc

SEQ ID NO: 444960 - DNA, 25 bp, Mus musculus
gacacacatagccatagctgggaca

SEQ ID NO: 444961 - DNA, 25 bp, Mus musculus
gacacacatagcgatagctgggaca

SEQ ID NO: 444962 - DNA, 25 bp, Mus musculus
gacacacatgcaccccgtatggaat

SEQ ID NO: 444963 - DNA, 25 bp, Mus musculus
gacacacatgcagcccgtatggaat

SEQ ID NO: 444964 - DNA, 25 bp, Mus musculus
gacacacatggcaaaattactctgg

SEQ ID NO: 444965 - DNA, 25 bp, Mus musculus
gacacacatggcagcaagcaaccta

SEQ ID NO: 444966 - DNA, 25 bp, Mus musculus
gacacacatggctaaattactctgg

SEQ ID NO: 444967 - DNA, 25 bp, Mus musculus
gacacacatggctgcaagcaaccta

SEQ ID NO: 444968 - DNA, 25 bp, Mus musculus
gacacacattggaaaggcaagatct

SEQ ID NO: 444969 - DNA, 25 bp, Mus musculus
gacacacattggtaaggcaagatct

SEQ ID NO: 444970 - DNA, 25 bp, Mus musculus
gacacaccaattcacaacactgagc

SEQ ID NO: 444971 - DNA, 25 bp, Mus musculus
gacacaccaattgacaacactgagc

SEQ ID NO: 444972 - DNA, 25 bp, Mus musculus
gacacaccaccaatcaatgcttatt

SEQ ID NO: 444973 - DNA, 25 bp, Mus musculus
gacacaccaccattcaatgcttatt

SEQ ID NO: 444974 - DNA, 25 bp, Mus musculus
gacacaccaggcctgccttagttaa

SEQ ID NO: 444975 - DNA, 25 bp, Mus musculus
gacacaccaggcgtgccttagttaa

SEQ ID NO: 444976 - DNA, 25 bp, Mus musculus
gacacaccattcatagctgtctgct

SEQ ID NO: 444977 - DNA, 25 bp, Mus musculus
gacacaccattcttagctgtctgct

SEQ ID NO: 444978 - DNA, 25 bp, Mus musculus
gacacaccattgactccagtgggaa

SEQ ID NO: 444979 - DNA, 25 bp, Mus musculus
gacacaccattgtctccagtgggaa

SEQ ID NO: 444980 - DNA, 25 bp, Mus musculus
gacacacccacaactgctaggatgt

SEQ ID NO: 444981 - DNA, 25 bp, Mus musculus
gacacacccacatctgctaggatgt

SEQ ID NO: 444982 - DNA, 25 bp, Mus musculus
gacacacccaggaaataggcccaca

SEQ ID NO: 444983 - DNA, 25 bp, Mus musculus
gacacacccaggtaataggcccaca

SEQ ID NO: 444984 - DNA, 25 bp, Mus musculus
gacacacccatactgaagggctata

SEQ ID NO: 444985 - DNA, 25 bp, Mus musculus
gacacacccatactgtgaaggagaa

SEQ ID NO: 444986 - DNA, 25 bp, Mus musculus
gacacacccatagtgaagggctata

SEQ ID NO: 444987 - DNA, 25 bp, Mus musculus
gacacacccatagtgtgaaggagaa

SEQ ID NO: 444988 - DNA, 25 bp, Mus musculus
gacacaccccttctagcatagagtt

SEQ ID NO: 444989 - DNA, 25 bp, Mus musculus
gacacaccccttgtagcatagagtt

SEQ ID NO: 444990 - DNA, 25 bp, Mus musculus
gacacaccctgcaatgtccttcaga

SEQ ID NO: 444991 - DNA, 25 bp, Mus musculus
gacacaccctgcatttaaagcctgg

SEQ ID NO: 444992 - DNA, 25 bp, Mus musculus
gacacaccctgctatgtccttcaga

SEQ ID NO: 444993 - DNA, 25 bp, Mus musculus
gacacaccctgcttttaaagcctgg

SEQ ID NO: 444994 - DNA, 25 bp, Mus musculus
gacacaccctggatttactagagaa

SEQ ID NO: 444995 - DNA, 25 bp, Mus musculus
gacacaccctggttttactagagaa

SEQ ID NO: 444996 - DNA, 25 bp, Mus musculus
gacacaccgaagagcagcatcgaga

SEQ ID NO: 444997 - DNA, 25 bp, Mus musculus
gacacaccgaagtgcagcatcgaga

SEQ ID NO: 444998 - DNA, 25 bp, Mus musculus
gacacaccgaccaggcatgttacat

SEQ ID NO: 444999 - DNA, 25 bp, Mus musculus
gacacaccgacctggcatgttacat

SEQ ID NO: 445000 - DNA, 25 bp, Mus musculus
gacacaccgagaaggtgctgctaga

SEQ ID NO: 445001 - DNA, 25 bp, Mus musculus
gacacaccgagatggtgctgctaga

SEQ ID NO: 445002 - DNA, 25 bp, Mus musculus
gacacacctaatccttgagagactt

SEQ ID NO: 445003 - DNA, 25 bp, Mus musculus
gacacacctaatgcttgagagactt

SEQ ID NO: 445004 - DNA, 25 bp, Mus musculus
gacacacctcctaattgttcctaaa

SEQ ID NO: 445005 - DNA, 25 bp, Mus musculus
gacacacctcctactatttattgaa

SEQ ID NO: 445006 - DNA, 25 bp, Mus musculus
gacacacctccttattgttcctaaa

SEQ ID NO: 445007 - DNA, 25 bp, Mus musculus
gacacacctccttctatttattgaa

SEQ ID NO: 445008 - DNA, 25 bp, Mus musculus
gacacacctgcaacatgaatagtaa

SEQ ID NO: 445009 - DNA, 25 bp, Mus musculus
gacacacctgcatcatgaatagtaa

SEQ ID NO: 445010 - DNA, 25 bp, Mus musculus
gacacacctggacttctctgaggat

SEQ ID NO: 445011 - DNA, 25 bp, Mus musculus
gacacacctggagttctctgaggat

SEQ ID NO: 445012 - DNA, 25 bp, Mus musculus
gacacacctgtcaagaaacaaaccc

SEQ ID NO: 445013 - DNA, 25 bp, Mus musculus
gacacacctgtctagaaacaaaccc

SEQ ID NO: 445014 - DNA, 25 bp, Mus musculus
gacacacctgtgattacttatagac

SEQ ID NO: 445015 - DNA, 25 bp, Mus musculus
gacacacctgtgtttacttatagac

SEQ ID NO: 445016 - DNA, 25 bp, Mus musculus
gacacacctttcattgtggtccaga

SEQ ID NO: 445017 - DNA, 25 bp, Mus musculus
gacacacctttctttgtggtccaga

SEQ ID NO: 445018 - DNA, 25 bp, Mus musculus
gacacacgaaaaagacaggcttgga

SEQ ID NO: 445019 - DNA, 25 bp, Mus musculus
gacacacgaaaatgacaggcttgga

SEQ ID NO: 445020 - DNA, 25 bp, Mus musculus
gacacacgaactccagacctgaaaa

SEQ ID NO: 445021 - DNA, 25 bp, Mus musculus
gacacacgaactgcagacctgaaaa

SEQ ID NO: 445022 - DNA, 25 bp, Mus musculus
gacacacgaaggatccagatcccgg

SEQ ID NO: 445023 - DNA, 25 bp, Mus musculus
gacacacgaaggttccagatcccgg

SEQ ID NO: 445024 - DNA, 25 bp, Mus musculus
gacacacgatggcatcgtggccgac

SEQ ID NO: 445025 - DNA, 25 bp, Mus musculus
gacacacgatgggatcgtggccgac

SEQ ID NO: 445026 - DNA, 25 bp, Mus musculus
gacacacgcacaacacaggatgatg

SEQ ID NO: 445027 - DNA, 25 bp, Mus musculus
gacacacgcacatcacaggatgatg

SEQ ID NO: 445028 - DNA, 25 bp, Mus musculus
gacacacggtgtatgtccactgcaa

SEQ ID NO: 445029 - DNA, 25 bp, Mus musculus
gacacacggtgtttgtccactgcaa

SEQ ID NO: 445030 - DNA, 25 bp, Mus musculus
gacacacgtgtaattcctgcagcag

SEQ ID NO: 445031 - DNA, 25 bp, Mus musculus
gacacacgtgtatttcctgcagcag

SEQ ID NO: 445032 - DNA, 25 bp, Mus musculus
gacacacgtgtcattaatacttgat

SEQ ID NO: 445033 - DNA, 25 bp, Mus musculus
gacacacgtgtctttaatacttgat

SEQ ID NO: 445034 - DNA, 25 bp, Mus musculus
gacacacgttatccggtttttccat

SEQ ID NO: 445035 - DNA, 25 bp, Mus musculus
gacacacgttatgcggtttttccat

SEQ ID NO: 445036 - DNA, 25 bp, Mus musculus
gacacactaagaaccaccctaaagg

SEQ ID NO: 445037 - DNA, 25 bp, Mus musculus
gacacactaagatccaccctaaagg

SEQ ID NO: 445038 - DNA, 25 bp, Mus musculus
gacacactaagtcttcacacgatat

SEQ ID NO: 445039 - DNA, 25 bp, Mus musculus
gacacactaagtgttcacacgatat

SEQ ID NO: 445040 - DNA, 25 bp, Mus musculus
gacacactacatagtgaatcactta

SEQ ID NO: 445041 - DNA, 25 bp, Mus musculus
gacacactacatcgacttaattgca

SEQ ID NO: 445042 - DNA, 25 bp, Mus musculus
gacacactacatggacttaattgca

SEQ ID NO: 445043 - DNA, 25 bp, Mus musculus
gacacactacattgtgaatcactta

SEQ ID NO: 445044 - DNA, 25 bp, Mus musculus
gacacactacttaaggttcatactc

SEQ ID NO: 445045 - DNA, 25 bp, Mus musculus
gacacactactttaggttcatactc

SEQ ID NO: 445046 - DNA, 25 bp, Mus musculus
gacacactatgtagtgcattcttta

SEQ ID NO: 445047 - DNA, 25 bp, Mus musculus
gacacactatgttgtgcattcttta

SEQ ID NO: 445048 - DNA, 25 bp, Mus musculus
gacacactcaagaggtggtgctgga

SEQ ID NO: 445049 - DNA, 25 bp, Mus musculus
gacacactcaagtggtggtgctgga

SEQ ID NO: 445050 - DNA, 25 bp, Mus musculus
gacacactcaccctttctgagatag

SEQ ID NO: 445051 - DNA, 25 bp, Mus musculus
gacacactcaccgtttctgagatag

SEQ ID NO: 445052 - DNA, 25 bp, Mus musculus
gacacactcaggacaaaagccatat

SEQ ID NO: 445053 - DNA, 25 bp, Mus musculus
gacacactcaggtcaaaagccatat

SEQ ID NO: 445054 - DNA, 25 bp, Mus musculus
gacacactcatgagccaaacactta

SEQ ID NO: 445055 - DNA, 25 bp, Mus musculus
gacacactcatgcataacctataat

SEQ ID NO: 445056 - DNA, 25 bp, Mus musculus
gacacactcatggataacctataat

SEQ ID NO: 445057 - DNA, 25 bp, Mus musculus
gacacactcatgtgccaaacactta

SEQ ID NO: 445058 - DNA, 25 bp, Mus musculus
gacacactccacagaaatgcgtctt

SEQ ID NO: 445059 - DNA, 25 bp, Mus musculus
gacacactccactgaaatgcgtctt

SEQ ID NO: 445060 - DNA, 25 bp, Mus musculus
gacacactccggctggaggtagaca

SEQ ID NO: 445061 - DNA, 25 bp, Mus musculus
gacacactccgggtggaggtagaca

SEQ ID NO: 445062 - DNA, 25 bp, Mus musculus
gacacactgaaccttgttgctgaaa

SEQ ID NO: 445063 - DNA, 25 bp, Mus musculus
gacacactgaacgttgttgctgaaa

SEQ ID NO: 445064 - DNA, 25 bp, Mus musculus
gacacactgcagatcgaggagtttc

SEQ ID NO: 445065 - DNA, 25 bp, Mus musculus
gacacactgcagttcgaggagtttc

SEQ ID NO: 445066 - DNA, 25 bp, Mus musculus
gacacactgcccctcaaaaagagac

SEQ ID NO: 445067 - DNA, 25 bp, Mus musculus
gacacactgcccgtcaaaaagagac

SEQ ID NO: 445068 - DNA, 25 bp, Mus musculus
gacacactggagctacagaaactgt

SEQ ID NO: 445069 - DNA, 25 bp, Mus musculus
gacacactggaggtacagaaactgt

SEQ ID NO: 445070 - DNA, 25 bp, Mus musculus
gacacactgggcacttacccagtga

SEQ ID NO: 445071 - DNA, 25 bp, Mus musculus
gacacactgggcatcaagggtagtt

SEQ ID NO: 445072 - DNA, 25 bp, Mus musculus
gacacactgggctcttacccagtga

SEQ ID NO: 445073 - DNA, 25 bp, Mus musculus
gacacactgggcttcaagggtagtt

SEQ ID NO: 445074 - DNA, 25 bp, Mus musculus
gacacactgggtccaaccctgagaa

SEQ ID NO: 445075 - DNA, 25 bp, Mus musculus
gacacactgggtgcaaccctgagaa

SEQ ID NO: 445076 - DNA, 25 bp, Mus musculus
gacacactggtactgaagatcttgc

SEQ ID NO: 445077 - DNA, 25 bp, Mus musculus
gacacactggtagtgaagatcttgc

SEQ ID NO: 445078 - DNA, 25 bp, Mus musculus
gacacactgtagaccttttctagac

SEQ ID NO: 445079 - DNA, 25 bp, Mus musculus
gacacactgtagtccttttctagac

SEQ ID NO: 445080 - DNA, 25 bp, Mus musculus
gacacactgtggacccaggttctag

SEQ ID NO: 445081 - DNA, 25 bp, Mus musculus
gacacactgtggtcccaggttctag

SEQ ID NO: 445082 - DNA, 25 bp, Mus musculus
gacacactgttcacacagactacat

SEQ ID NO: 445083 - DNA, 25 bp, Mus musculus
gacacactgttctcacagactacat

SEQ ID NO: 445084 - DNA, 25 bp, Mus musculus
gacacactgtttagaccactatggc

SEQ ID NO: 445085 - DNA, 25 bp, Mus musculus
gacacactgttttgaccactatggc

SEQ ID NO: 445086 - DNA, 25 bp, Mus musculus
gacacacttacccaggtggacctgg

SEQ ID NO: 445087 - DNA, 25 bp, Mus musculus
gacacacttaccgaggtggacctgg

SEQ ID NO: 445088 - DNA, 25 bp, Mus musculus
gacacacttagtatttcgctgagta

SEQ ID NO: 445089 - DNA, 25 bp, Mus musculus
gacacacttagtttttcgctgagta

SEQ ID NO: 445090 - DNA, 25 bp, Mus musculus
gacacacttataaacaaggcagggt

SEQ ID NO: 445091 - DNA, 25 bp, Mus musculus
gacacacttatatacaaggcagggt

SEQ ID NO: 445092 - DNA, 25 bp, Mus musculus
gacacacttcagaagtccttcaagg

SEQ ID NO: 445093 - DNA, 25 bp, Mus musculus
gacacacttcagtagtccttcaagg

SEQ ID NO: 445094 - DNA, 25 bp, Mus musculus
gacacacttcatagacctttactgg

SEQ ID NO: 445095 - DNA, 25 bp, Mus musculus
gacacacttcattgacctttactgg

SEQ ID NO: 445096 - DNA, 25 bp, Mus musculus
gacacacttgaacttggctacatag

SEQ ID NO: 445097 - DNA, 25 bp, Mus musculus
gacacacttgaagttggctacatag

SEQ ID NO: 445098 - DNA, 25 bp, Mus musculus
gacacacttgggatgggagcaccga

SEQ ID NO: 445099 - DNA, 25 bp, Mus musculus
gacacacttgggttgggagcaccga

SEQ ID NO: 445100 - DNA, 25 bp, Mus musculus
gacacacttggtactgactctttta

SEQ ID NO: 445101 - DNA, 25 bp, Mus musculus
gacacacttggttctgactctttta

SEQ ID NO: 445102 - DNA, 25 bp, Mus musculus
gacacactttagacatctcttggga

SEQ ID NO: 445103 - DNA, 25 bp, Mus musculus
gacacactttagtcatctcttggga

SEQ ID NO: 445104 - DNA, 25 bp, Mus musculus
gacacactttttcacgagactgctg

SEQ ID NO: 445105 - DNA, 25 bp, Mus musculus
gacacactttttctacggttttcat

SEQ ID NO: 445106 - DNA, 25 bp, Mus musculus
gacacactttttgacgagactgctg

SEQ ID NO: 445107 - DNA, 25 bp, Mus musculus
gacacactttttgtacggttttcat

SEQ ID NO: 445108 - DNA, 25 bp, Mus musculus
gacacagaaggacaaggtgatctca

SEQ ID NO: 445109 - DNA, 25 bp, Mus musculus
gacacagaaggagaaggtgatctca

SEQ ID NO: 445110 - DNA, 25 bp, Mus musculus
gacacagacagacaccagagctagc

SEQ ID NO: 445111 - DNA, 25 bp, Mus musculus
gacacagacagagaccagagctagc

SEQ ID NO: 445112 - DNA, 25 bp, Mus musculus
gacacagacccacagttttggatat

SEQ ID NO: 445113 - DNA, 25 bp, Mus musculus
gacacagacccagagttttggatat

SEQ ID NO: 445114 - DNA, 25 bp, Mus musculus
gacacagaccctcacattgggacta

SEQ ID NO: 445115 - DNA, 25 bp, Mus musculus
gacacagaccctgacattgggacta

SEQ ID NO: 445116 - DNA, 25 bp, Mus musculus
gacacagacgccatatacatctcta

SEQ ID NO: 445117 - DNA, 25 bp, Mus musculus
gacacagacgccttatacatctcta

SEQ ID NO: 445118 - DNA, 25 bp, Mus musculus
gacacagacgtgatttccagggagc

SEQ ID NO: 445119 - DNA, 25 bp, Mus musculus
gacacagacgtgttttccagggagc

SEQ ID NO: 445120 - DNA, 25 bp, Mus musculus
gacacagactagaacatccttgatt

SEQ ID NO: 445121 - DNA, 25 bp, Mus musculus
gacacagactagtacatccttgatt

SEQ ID NO: 445122 - DNA, 25 bp, Mus musculus
gacacagactccaagcaaacatata

SEQ ID NO: 445123 - DNA, 25 bp, Mus musculus
gacacagactcctagcaaacatata

SEQ ID NO: 445124 - DNA, 25 bp, Mus musculus
gacacagactgcacagattcccaaa

SEQ ID NO: 445125 - DNA, 25 bp, Mus musculus
gacacagactgctcagattcccaaa

SEQ ID NO: 445126 - DNA, 25 bp, Mus musculus
gacacagactggatacttgaaagta

SEQ ID NO: 445127 - DNA, 25 bp, Mus musculus
gacacagactggttacttgaaagta

SEQ ID NO: 445128 - DNA, 25 bp, Mus musculus
gacacagacttcacccaatgggtca

SEQ ID NO: 445129 - DNA, 25 bp, Mus musculus
gacacagacttctcccaatgggtca

SEQ ID NO: 445130 - DNA, 25 bp, Mus musculus
gacacagagaataacctatatgcac

SEQ ID NO: 445131 - DNA, 25 bp, Mus musculus
gacacagagaattacctatatgcac

SEQ ID NO: 445132 - DNA, 25 bp, Mus musculus
gacacagaggatatccgtgagattt

SEQ ID NO: 445133 - DNA, 25 bp, Mus musculus
gacacagaggatttccgtgagattt

SEQ ID NO: 445134 - DNA, 25 bp, Mus musculus
gacacagaggccaatttagtgcctt

SEQ ID NO: 445135 - DNA, 25 bp, Mus musculus
gacacagaggcctatttagtgcctt

SEQ ID NO: 445136 - DNA, 25 bp, Mus musculus
gacacagaggcgatctttcgggatg

SEQ ID NO: 445137 - DNA, 25 bp, Mus musculus
gacacagaggcgttctttcgggatg

SEQ ID NO: 445138 - DNA, 25 bp, Mus musculus
gacacagagtcacgcatccttagca

SEQ ID NO: 445139 - DNA, 25 bp, Mus musculus
gacacagagtcaggcatccttagca

SEQ ID NO: 445140 - DNA, 25 bp, Mus musculus
gacacagatcttatcacggtgactg

SEQ ID NO: 445141 - DNA, 25 bp, Mus musculus
gacacagatcttttcacggtgactg

SEQ ID NO: 445142 - DNA, 25 bp, Mus musculus
gacacagatgctccgggtcaccatt

SEQ ID NO: 445143 - DNA, 25 bp, Mus musculus
gacacagatgctgcgggtcaccatt

SEQ ID NO: 445144 - DNA, 25 bp, Mus musculus
gacacagatgtccatgaggacttct

SEQ ID NO: 445145 - DNA, 25 bp, Mus musculus
gacacagatgtcgatgaggacttct

SEQ ID NO: 445146 - DNA, 25 bp, Mus musculus
gacacagatgtgaacttcatcatca

SEQ ID NO: 445147 - DNA, 25 bp, Mus musculus
gacacagatgtgtacttcatcatca

SEQ ID NO: 445148 - DNA, 25 bp, Mus musculus
gacacagattcaagtttttgcactt

SEQ ID NO: 445149 - DNA, 25 bp, Mus musculus
gacacagattcatgtttttgcactt

SEQ ID NO: 445150 - DNA, 25 bp, Mus musculus
gacacagatttcaggtcctctgtca

SEQ ID NO: 445151 - DNA, 25 bp, Mus musculus
gacacagatttctggtcctctgtca

SEQ ID NO: 445152 - DNA, 25 bp, Mus musculus
gacacagcaaaacctcttttcgggt

SEQ ID NO: 445153 - DNA, 25 bp, Mus musculus
gacacagcaaaagctcttttcgggt

SEQ ID NO: 445154 - DNA, 25 bp, Mus musculus
gacacagcaaacaccaggcattagg

SEQ ID NO: 445155 - DNA, 25 bp, Mus musculus
gacacagcaaactccaggcattagg

SEQ ID NO: 445156 - DNA, 25 bp, Mus musculus
gacacagcaacacatccagtattta

SEQ ID NO: 445157 - DNA, 25 bp, Mus musculus
gacacagcaacagatccagtattta

SEQ ID NO: 445158 - DNA, 25 bp, Mus musculus
gacacagcaaggactcactgtatgg

SEQ ID NO: 445159 - DNA, 25 bp, Mus musculus
gacacagcaaggtctcactgtatgg

SEQ ID NO: 445160 - DNA, 25 bp, Mus musculus
gacacagcacagaaggtgagtcctt

SEQ ID NO: 445161 - DNA, 25 bp, Mus musculus
gacacagcacagtaggtgagtcctt

SEQ ID NO: 445162 - DNA, 25 bp, Mus musculus
gacacagcactgatgtggatccttg

SEQ ID NO: 445163 - DNA, 25 bp, Mus musculus
gacacagcactgttgtggatccttg

SEQ ID NO: 445164 - DNA, 25 bp, Mus musculus
gacacagcagaacgctctaccagca

SEQ ID NO: 445165 - DNA, 25 bp, Mus musculus
gacacagcagaaggctctaccagca

SEQ ID NO: 445166 - DNA, 25 bp, Mus musculus
gacacagcagatccacagcttcatg

SEQ ID NO: 445167 - DNA, 25 bp, Mus musculus
gacacagcagatgcacagcttcatg

SEQ ID NO: 445168 - DNA, 25 bp, Mus musculus
gacacagcaggccaaagttccctcc

SEQ ID NO: 445169 - DNA, 25 bp, Mus musculus
gacacagcaggcgaaagttccctcc

SEQ ID NO: 445170 - DNA, 25 bp, Mus musculus
gacacagcagggagtcttcggactt

SEQ ID NO: 445171 - DNA, 25 bp, Mus musculus
gacacagcagggtgtcttcggactt

SEQ ID NO: 445172 - DNA, 25 bp, Mus musculus
gacacagcaggtaccgagcgctacg

SEQ ID NO: 445173 - DNA, 25 bp, Mus musculus
gacacagcaggttccgagcgctacg

SEQ ID NO: 445174 - DNA, 25 bp, Mus musculus
gacacagcataaatattcccctctt

SEQ ID NO: 445175 - DNA, 25 bp, Mus musculus
gacacagcataattattcccctctt

SEQ ID NO: 445176 - DNA, 25 bp, Mus musculus
gacacagcatcaccttcacaaagag

SEQ ID NO: 445177 - DNA, 25 bp, Mus musculus
gacacagcatcagcttcacaaagag

SEQ ID NO: 445178 - DNA, 25 bp, Mus musculus
gacacagcatctacatggaaccaac

SEQ ID NO: 445179 - DNA, 25 bp, Mus musculus
gacacagcatcttcatggaaccaac

SEQ ID NO: 445180 - DNA, 25 bp, Mus musculus
gacacagcatgactgaccctggagt

SEQ ID NO: 445181 - DNA, 25 bp, Mus musculus
gacacagcatgagtgaccctggagt

SEQ ID NO: 445182 - DNA, 25 bp, Mus musculus
gacacagcatgtaagtccctcctgg

SEQ ID NO: 445183 - DNA, 25 bp, Mus musculus
gacacagcatgttagtccctcctgg

SEQ ID NO: 445184 - DNA, 25 bp, Mus musculus
gacacagccaggataccgggatcta

SEQ ID NO: 445185 - DNA, 25 bp, Mus musculus
gacacagccaggttaccgggatcta

SEQ ID NO: 445186 - DNA, 25 bp, Mus musculus
gacacagccataaatcctgagtgaa

SEQ ID NO: 445187 - DNA, 25 bp, Mus musculus
gacacagccatatatcctgagtgaa

SEQ ID NO: 445188 - DNA, 25 bp, Mus musculus
gacacagccattccctttattgtat

SEQ ID NO: 445189 - DNA, 25 bp, Mus musculus
gacacagccattgcctttattgtat

SEQ ID NO: 445190 - DNA, 25 bp, Mus musculus
gacacagcccagaacaggttgttaa

SEQ ID NO: 445191 - DNA, 25 bp, Mus musculus
gacacagcccagtacaggttgttaa

SEQ ID NO: 445192 - DNA, 25 bp, Mus musculus
gacacagccctactcagcttatgga

SEQ ID NO: 445193 - DNA, 25 bp, Mus musculus
gacacagccctagtcagcttatgga

SEQ ID NO: 445194 - DNA, 25 bp, Mus musculus
gacacagccgcactgttggccataa

SEQ ID NO: 445195 - DNA, 25 bp, Mus musculus
gacacagccgcagtgttggccataa

SEQ ID NO: 445196 - DNA, 25 bp, Mus musculus
gacacagccggcattcatggaagat

SEQ ID NO: 445197 - DNA, 25 bp, Mus musculus
gacacagccggctttcatggaagat

SEQ ID NO: 445198 - DNA, 25 bp, Mus musculus
gacacagcctagaggtccccaagat

SEQ ID NO: 445199 - DNA, 25 bp, Mus musculus
gacacagcctagtggtccccaagat

SEQ ID NO: 445200 - DNA, 25 bp, Mus musculus
gacacagcctatatggtagcccagt

SEQ ID NO: 445201 - DNA, 25 bp, Mus musculus
gacacagcctatttggtagcccagt

SEQ ID NO: 445202 - DNA, 25 bp, Mus musculus
gacacagcctttatgatcatttctt

SEQ ID NO: 445203 - DNA, 25 bp, Mus musculus
gacacagcctttttgatcatttctt

SEQ ID NO: 445204 - DNA, 25 bp, Mus musculus
gacacagcgctgatggagtagttct

SEQ ID NO: 445205 - DNA, 25 bp, Mus musculus
gacacagcgctgttggagtagttct

SEQ ID NO: 445206 - DNA, 25 bp, Mus musculus
gacacagctattaaatctcttgcca

SEQ ID NO: 445207 - DNA, 25 bp, Mus musculus
gacacagctatttaatctcttgcca

SEQ ID NO: 445208 - DNA, 25 bp, Mus musculus
gacacagctcctctcacaaaagtga

SEQ ID NO: 445209 - DNA, 25 bp, Mus musculus
gacacagctcctgtcacaaaagtga

SEQ ID NO: 445210 - DNA, 25 bp, Mus musculus
gacacagctctgattgccaatgatg

SEQ ID NO: 445211 - DNA, 25 bp, Mus musculus
gacacagctctgtttgccaatgatg

SEQ ID NO: 445212 - DNA, 25 bp, Mus musculus
gacacagctgaaatccccactaaag

SEQ ID NO: 445213 - DNA, 25 bp, Mus musculus
gacacagctgaattccccactaaag

SEQ ID NO: 445214 - DNA, 25 bp, Mus musculus
gacacagctgagaagctctgagcat

SEQ ID NO: 445215 - DNA, 25 bp, Mus musculus
gacacagctgagacttgagtcactg

SEQ ID NO: 445216 - DNA, 25 bp, Mus musculus
gacacagctgagtagctctgagcat

SEQ ID NO: 445217 - DNA, 25 bp, Mus musculus
gacacagctgagtcttgagtcactg

SEQ ID NO: 445218 - DNA, 25 bp, Mus musculus
gacacagctgctacgagccatagaa

SEQ ID NO: 445219 - DNA, 25 bp, Mus musculus
gacacagctgctacgggccttggag

SEQ ID NO: 445220 - DNA, 25 bp, Mus musculus
gacacagctgcttcgagccatagaa

SEQ ID NO: 445221 - DNA, 25 bp, Mus musculus
gacacagctgcttcgggccttggag

SEQ ID NO: 445222 - DNA, 25 bp, Mus musculus
gacacagctgggaaagggcagccct

SEQ ID NO: 445223 - DNA, 25 bp, Mus musculus
gacacagctgggtaagggcagccct

SEQ ID NO: 445224 - DNA, 25 bp, Mus musculus
gacacagctgtacctgtatctctcc

SEQ ID NO: 445225 - DNA, 25 bp, Mus musculus
gacacagctgtagctgtatctctcc

SEQ ID NO: 445226 - DNA, 25 bp, Mus musculus
gacacagcttggcacacagtctcac

SEQ ID NO: 445227 - DNA, 25 bp, Mus musculus
gacacagcttggctctaagtattag

SEQ ID NO: 445228 - DNA, 25 bp, Mus musculus
gacacagcttgggacacagtctcac

SEQ ID NO: 445229 - DNA, 25 bp, Mus musculus
gacacagcttgggtctaagtattag

SEQ ID NO: 445230 - DNA, 25 bp, Mus musculus
gacacagcttgtactcaaacacatg

SEQ ID NO: 445231 - DNA, 25 bp, Mus musculus
gacacagcttgttctcaaacacatg

SEQ ID NO: 445232 - DNA, 25 bp, Mus musculus
gacacaggaaatccagctctcctca

SEQ ID NO: 445233 - DNA, 25 bp, Mus musculus
gacacaggaaatgcagctctcctca

SEQ ID NO: 445234 - DNA, 25 bp, Mus musculus
gacacaggaactagactgatgttta

SEQ ID NO: 445235 - DNA, 25 bp, Mus musculus
gacacaggaacttgactgatgttta

SEQ ID NO: 445236 - DNA, 25 bp, Mus musculus
gacacaggacacagtgtgacatcca

SEQ ID NO: 445237 - DNA, 25 bp, Mus musculus
gacacaggacactgtgtgacatcca

SEQ ID NO: 445238 - DNA, 25 bp, Mus musculus
gacacaggacctcacagacaagcat

SEQ ID NO: 445239 - DNA, 25 bp, Mus musculus
gacacaggacctgacagacaagcat

SEQ ID NO: 445240 - DNA, 25 bp, Mus musculus
gacacaggagggaccaagacccctc

SEQ ID NO: 445241 - DNA, 25 bp, Mus musculus
gacacaggagggtccaagacccctc

SEQ ID NO: 445242 - DNA, 25 bp, Mus musculus
gacacaggataccagaaatttcccc

SEQ ID NO: 445243 - DNA, 25 bp, Mus musculus
gacacaggatacgagaaatttcccc

SEQ ID NO: 445244 - DNA, 25 bp, Mus musculus
gacacaggatccaaaactccaaggg

SEQ ID NO: 445245 - DNA, 25 bp, Mus musculus
gacacaggatcctaaactccaaggg

SEQ ID NO: 445246 - DNA, 25 bp, Mus musculus
gacacaggcagtccaacaatccagc

SEQ ID NO: 445247 - DNA, 25 bp, Mus musculus
gacacaggcagtgcaacaatccagc

SEQ ID NO: 445248 - DNA, 25 bp, Mus musculus
gacacaggccagaatattgcagatt

SEQ ID NO: 445249 - DNA, 25 bp, Mus musculus
gacacaggccagtatattgcagatt

SEQ ID NO: 445250 - DNA, 25 bp, Mus musculus
gacacaggcctgatgttgacttgca

SEQ ID NO: 445251 - DNA, 25 bp, Mus musculus
gacacaggcctgttgttgacttgca

SEQ ID NO: 445252 - DNA, 25 bp, Mus musculus
gacacaggcgctcctgctacaatgg

SEQ ID NO: 445253 - DNA, 25 bp, Mus musculus
gacacaggcgctgctgctacaatgg

SEQ ID NO: 445254 - DNA, 25 bp, Mus musculus
gacacaggcggaatggcatttcaca

SEQ ID NO: 445255 - DNA, 25 bp, Mus musculus
gacacaggcggattggcatttcaca

SEQ ID NO: 445256 - DNA, 25 bp, Mus musculus
gacacaggcggcacctgctattgac

SEQ ID NO: 445257 - DNA, 25 bp, Mus musculus
gacacaggcggctcctgctattgac

SEQ ID NO: 445258 - DNA, 25 bp, Mus musculus
gacacaggctacaacctgttgctag

SEQ ID NO: 445259 - DNA, 25 bp, Mus musculus
gacacaggctaccataccagagatt

SEQ ID NO: 445260 - DNA, 25 bp, Mus musculus
gacacaggctacgataccagagatt

SEQ ID NO: 445261 - DNA, 25 bp, Mus musculus
gacacaggctactacctgttgctag

SEQ ID NO: 445262 - DNA, 25 bp, Mus musculus
gacacaggctgcaaggtctcagctg

SEQ ID NO: 445263 - DNA, 25 bp, Mus musculus
gacacaggctgctaggtctcagctg

SEQ ID NO: 445264 - DNA, 25 bp, Mus musculus
gacacaggcttacctgtatttacat

SEQ ID NO: 445265 - DNA, 25 bp, Mus musculus
gacacaggcttacgcaatccagagt

SEQ ID NO: 445266 - DNA, 25 bp, Mus musculus
gacacaggcttagctgtatttacat

SEQ ID NO: 445267 - DNA, 25 bp, Mus musculus
gacacaggcttaggcaatccagagt

SEQ ID NO: 445268 - DNA, 25 bp, Mus musculus
gacacagggaccacttggttaccat

SEQ ID NO: 445269 - DNA, 25 bp, Mus musculus
gacacagggacctcttggttaccat

SEQ ID NO: 445270 - DNA, 25 bp, Mus musculus
gacacagggcttagtgacgggaaca

SEQ ID NO: 445271 - DNA, 25 bp, Mus musculus
gacacagggctttgtgacgggaaca

SEQ ID NO: 445272 - DNA, 25 bp, Mus musculus
gacacagggtcactgcttttgtttt

SEQ ID NO: 445273 - DNA, 25 bp, Mus musculus
gacacagggtcagtgcttttgtttt

SEQ ID NO: 445274 - DNA, 25 bp, Mus musculus
gacacagggtgcaatttattgacat

SEQ ID NO: 445275 - DNA, 25 bp, Mus musculus
gacacagggtgctatttattgacat

SEQ ID NO: 445276 - DNA, 25 bp, Mus musculus
gacacagggttgattgtgtttcttg

SEQ ID NO: 445277 - DNA, 25 bp, Mus musculus
gacacagggttgtttgtgtttcttg

SEQ ID NO: 445278 - DNA, 25 bp, Mus musculus
gacacagggtttcttgatgtagttc

SEQ ID NO: 445279 - DNA, 25 bp, Mus musculus
gacacagggtttgttgatgtagttc

SEQ ID NO: 445280 - DNA, 25 bp, Mus musculus
gacacaggtcaacttccagctctgg

SEQ ID NO: 445281 - DNA, 25 bp, Mus musculus
gacacaggtcaagttccagctctgg

SEQ ID NO: 445282 - DNA, 25 bp, Mus musculus
gacacaggtcagcatcagggccaga

SEQ ID NO: 445283 - DNA, 25 bp, Mus musculus
gacacaggtcaggatcagggccaga

SEQ ID NO: 445284 - DNA, 25 bp, Mus musculus
gacacaggtggacgccgctgtttat

SEQ ID NO: 445285 - DNA, 25 bp, Mus musculus
gacacaggtggaggccgctgtttat

SEQ ID NO: 445286 - DNA, 25 bp, Mus musculus
gacacaggttgcaactgttctttgt

SEQ ID NO: 445287 - DNA, 25 bp, Mus musculus
gacacaggttgcaggcagaactgac

SEQ ID NO: 445288 - DNA, 25 bp, Mus musculus
gacacaggttgctactgttctttgt

SEQ ID NO: 445289 - DNA, 25 bp, Mus musculus
gacacaggttgctggcagaactgac

SEQ ID NO: 445290 - DNA, 25 bp, Mus musculus
gacacaggttttactgttcatctaa

SEQ ID NO: 445291 - DNA, 25 bp, Mus musculus
gacacaggtttttctgttcatctaa

SEQ ID NO: 445292 - DNA, 25 bp, Mus musculus
gacacagtacagatagggactttaa

SEQ ID NO: 445293 - DNA, 25 bp, Mus musculus
gacacagtacagttagggactttaa

SEQ ID NO: 445294 - DNA, 25 bp, Mus musculus
gacacagtagccatgggaccgtagc

SEQ ID NO: 445295 - DNA, 25 bp, Mus musculus
gacacagtagccattgtgtataaag

SEQ ID NO: 445296 - DNA, 25 bp, Mus musculus
gacacagtagccttgggaccgtagc

SEQ ID NO: 445297 - DNA, 25 bp, Mus musculus
gacacagtagcctttgtgtataaag

SEQ ID NO: 445298 - DNA, 25 bp, Mus musculus
gacacagtatcacaacgaaacaaat

SEQ ID NO: 445299 - DNA, 25 bp, Mus musculus
gacacagtatcagaacgaaacaaat

SEQ ID NO: 445300 - DNA, 25 bp, Mus musculus
gacacagtatctccgctagtatcag

SEQ ID NO: 445301 - DNA, 25 bp, Mus musculus
gacacagtatctgcgctagtatcag

SEQ ID NO: 445302 - DNA, 25 bp, Mus musculus
gacacagtatggacctgtccagaga

SEQ ID NO: 445303 - DNA, 25 bp, Mus musculus
gacacagtatggtcctgtccagaga

SEQ ID NO: 445304 - DNA, 25 bp, Mus musculus
gacacagtcacaattcccattaggt

SEQ ID NO: 445305 - DNA, 25 bp, Mus musculus
gacacagtcacatttcccattaggt

SEQ ID NO: 445306 - DNA, 25 bp, Mus musculus
gacacagtcactctgaggtagcctt

SEQ ID NO: 445307 - DNA, 25 bp, Mus musculus
gacacagtcactgtgaggtagcctt

SEQ ID NO: 445308 - DNA, 25 bp, Mus musculus
gacacagtcatgatcaacttttggt

SEQ ID NO: 445309 - DNA, 25 bp, Mus musculus
gacacagtcatgttcaacttttggt

SEQ ID NO: 445310 - DNA, 25 bp, Mus musculus
gacacagtccacattgtgcgagata

SEQ ID NO: 445311 - DNA, 25 bp, Mus musculus
gacacagtccactttgtgcgagata

SEQ ID NO: 445312 - DNA, 25 bp, Mus musculus
gacacagtccctagccaagaaacaa

SEQ ID NO: 445313 - DNA, 25 bp, Mus musculus
gacacagtcccttgccaagaaacaa

SEQ ID NO: 445314 - DNA, 25 bp, Mus musculus
gacacagtcgtgaacattattggat

SEQ ID NO: 445315 - DNA, 25 bp, Mus musculus
gacacagtcgtgtacattattggat

SEQ ID NO: 445316 - DNA, 25 bp, Mus musculus
gacacagtgacaagggttgcccctt

SEQ ID NO: 445317 - DNA, 25 bp, Mus musculus
gacacagtgacatgggttgcccctt

SEQ ID NO: 445318 - DNA, 25 bp, Mus musculus
gacacagtgaccaggacaataatag

SEQ ID NO: 445319 - DNA, 25 bp, Mus musculus
gacacagtgacctggacaataatag

SEQ ID NO: 445320 - DNA, 25 bp, Mus musculus
gacacagtgactcaatccgttcaaa

SEQ ID NO: 445321 - DNA, 25 bp, Mus musculus
gacacagtgactgaatccgttcaaa

SEQ ID NO: 445322 - DNA, 25 bp, Mus musculus
gacacagtgatacgttgttctactt

SEQ ID NO: 445323 - DNA, 25 bp, Mus musculus
gacacagtgataggttgttctactt

SEQ ID NO: 445324 - DNA, 25 bp, Mus musculus
gacacagtgatcctgggctctgtaa

SEQ ID NO: 445325 - DNA, 25 bp, Mus musculus
gacacagtgatcgtgggctctgtaa

SEQ ID NO: 445326 - DNA, 25 bp, Mus musculus
gacacagtgatgaggcagtctgcca

SEQ ID NO: 445327 - DNA, 25 bp, Mus musculus
gacacagtgatgtggcagtctgcca

SEQ ID NO: 445328 - DNA, 25 bp, Mus musculus
gacacagtgcccagtgagaccatat

SEQ ID NO: 445329 - DNA, 25 bp, Mus musculus
gacacagtgccctgtgagaccatat

SEQ ID NO: 445330 - DNA, 25 bp, Mus musculus
gacacagtggaaagccaatcctatg

SEQ ID NO: 445331 - DNA, 25 bp, Mus musculus
gacacagtggaatgccaatcctatg

SEQ ID NO: 445332 - DNA, 25 bp, Mus musculus
gacacagtggctagcctcacaggga

SEQ ID NO: 445333 - DNA, 25 bp, Mus musculus
gacacagtggcttgcctcacaggga

SEQ ID NO: 445334 - DNA, 25 bp, Mus musculus
gacacagtggtaaagtttttactta

SEQ ID NO: 445335 - DNA, 25 bp, Mus musculus
gacacagtggtatagtttttactta

SEQ ID NO: 445336 - DNA, 25 bp, Mus musculus
gacacagtggtcacttatgtgcact

SEQ ID NO: 445337 - DNA, 25 bp, Mus musculus
gacacagtggtctcttatgtgcact

SEQ ID NO: 445338 - DNA, 25 bp, Mus musculus
gacacagtgtaactggaggagacac

SEQ ID NO: 445339 - DNA, 25 bp, Mus musculus
gacacagtgtaagtggaggagacac

SEQ ID NO: 445340 - DNA, 25 bp, Mus musculus
gacacagtgttgcacgcacacatgt

SEQ ID NO: 445341 - DNA, 25 bp, Mus musculus
gacacagtgttggacgcacacatgt

SEQ ID NO: 445342 - DNA, 25 bp, Mus musculus
gacacagttactaggtctgccaaac

SEQ ID NO: 445343 - DNA, 25 bp, Mus musculus
gacacagttacttggtctgccaaac

SEQ ID NO: 445344 - DNA, 25 bp, Mus musculus
gacacagttattatccaagcaaggc

SEQ ID NO: 445345 - DNA, 25 bp, Mus musculus
gacacagttattttccaagcaaggc

SEQ ID NO: 445346 - DNA, 25 bp, Mus musculus
gacacagttcttcataaagcattat

SEQ ID NO: 445347 - DNA, 25 bp, Mus musculus
gacacagttcttgataaagcattat

SEQ ID NO: 445348 - DNA, 25 bp, Mus musculus
gacacagttgagagttttttgctag

SEQ ID NO: 445349 - DNA, 25 bp, Mus musculus
gacacagttgagtgttttttgctag

SEQ ID NO: 445350 - DNA, 25 bp, Mus musculus
gacacagttgcgactgcttcagaca

SEQ ID NO: 445351 - DNA, 25 bp, Mus musculus
gacacagttgcgtctgcttcagaca

SEQ ID NO: 445352 - DNA, 25 bp, Mus musculus
gacacagtttaacgaaaacgccgat

SEQ ID NO: 445353 - DNA, 25 bp, Mus musculus
gacacagtttaaggaaaacgccgat

SEQ ID NO: 445354 - DNA, 25 bp, Mus musculus
gacacagtttccagcaagttgcaaa

SEQ ID NO: 445355 - DNA, 25 bp, Mus musculus
gacacagtttcctgcaagttgcaaa

SEQ ID NO: 445356 - DNA, 25 bp, Mus musculus
gacacagtttgaacttctggttcca

SEQ ID NO: 445357 - DNA, 25 bp, Mus musculus
gacacagtttgatcttctggttcca

SEQ ID NO: 445358 - DNA, 25 bp, Mus musculus
gacacagtttgtatcacactgcagg

SEQ ID NO: 445359 - DNA, 25 bp, Mus musculus
gacacagtttgtttcacactgcagg

SEQ ID NO: 445360 - DNA, 25 bp, Mus musculus
gacacatacactacagagtctctta

SEQ ID NO: 445361 - DNA, 25 bp, Mus musculus
gacacatacacttcagagtctctta

SEQ ID NO: 445362 - DNA, 25 bp, Mus musculus
gacacatacagtagagtacagccct

SEQ ID NO: 445363 - DNA, 25 bp, Mus musculus
gacacatacagttgagtacagccct

SEQ ID NO: 445364 - DNA, 25 bp, Mus musculus
gacacataccgtcaatcctgggctt

SEQ ID NO: 445365 - DNA, 25 bp, Mus musculus
gacacataccgtgaatcctgggctt

SEQ ID NO: 445366 - DNA, 25 bp, Mus musculus
gacacatacctgaccataatggctt

SEQ ID NO: 445367 - DNA, 25 bp, Mus musculus
gacacatacctgacctatctgaagt

SEQ ID NO: 445368 - DNA, 25 bp, Mus musculus
gacacatacctgtccataatggctt

SEQ ID NO: 445369 - DNA, 25 bp, Mus musculus
gacacatacctgtcctatctgaagt

SEQ ID NO: 445370 - DNA, 25 bp, Mus musculus
gacacatagacgaaggaccttgtat

SEQ ID NO: 445371 - DNA, 25 bp, Mus musculus
gacacatagacgtaggaccttgtat

SEQ ID NO: 445372 - DNA, 25 bp, Mus musculus
gacacatagctaaccttcaacaaat

SEQ ID NO: 445373 - DNA, 25 bp, Mus musculus
gacacatagctatccttcaacaaat

SEQ ID NO: 445374 - DNA, 25 bp, Mus musculus
gacacatatatcctctcagttctat

SEQ ID NO: 445375 - DNA, 25 bp, Mus musculus
gacacatatatcgtctcagttctat

SEQ ID NO: 445376 - DNA, 25 bp, Mus musculus
gacacatatccaatgtgatcgtgga

SEQ ID NO: 445377 - DNA, 25 bp, Mus musculus
gacacatatccattgtgatcgtgga

SEQ ID NO: 445378 - DNA, 25 bp, Mus musculus
gacacatatctgctggacaaaccca

SEQ ID NO: 445379 - DNA, 25 bp, Mus musculus
gacacatatctggtggacaaaccca

SEQ ID NO: 445380 - DNA, 25 bp, Mus musculus
gacacatatgtcattggcctgctgg

SEQ ID NO: 445381 - DNA, 25 bp, Mus musculus
gacacatatgtctttggcctgctgg

SEQ ID NO: 445382 - DNA, 25 bp, Mus musculus
gacacatatttgcaggacagatttc

SEQ ID NO: 445383 - DNA, 25 bp, Mus musculus
gacacatatttggaggacagatttc

SEQ ID NO: 445384 - DNA, 25 bp, Mus musculus
gacacatcagcaaagggtgttatgt

SEQ ID NO: 445385 - DNA, 25 bp, Mus musculus
gacacatcagcatagggtgttatgt

SEQ ID NO: 445386 - DNA, 25 bp, Mus musculus
gacacatcatcaatatcccttggat

SEQ ID NO: 445387 - DNA, 25 bp, Mus musculus
gacacatcatcaccaaaacaatttt

SEQ ID NO: 445388 - DNA, 25 bp, Mus musculus
gacacatcatcagcaaaacaatttt

SEQ ID NO: 445389 - DNA, 25 bp, Mus musculus
gacacatcatcattatcccttggat

SEQ ID NO: 445390 - DNA, 25 bp, Mus musculus
gacacatccattaaagagtttgacc

SEQ ID NO: 445391 - DNA, 25 bp, Mus musculus
gacacatccatttaagagtttgacc

SEQ ID NO: 445392 - DNA, 25 bp, Mus musculus
gacacatcctgtcgccagtggtttg

SEQ ID NO: 445393 - DNA, 25 bp, Mus musculus
gacacatcctgtggccagtggtttg

SEQ ID NO: 445394 - DNA, 25 bp, Mus musculus
gacacatccttcatggaaataccgt

SEQ ID NO: 445395 - DNA, 25 bp, Mus musculus
gacacatccttcttggaaataccgt

SEQ ID NO: 445396 - DNA, 25 bp, Mus musculus
gacacatcctttatagagcatcact

SEQ ID NO: 445397 - DNA, 25 bp, Mus musculus
gacacatcctttttagagcatcact

SEQ ID NO: 445398 - DNA, 25 bp, Mus musculus
gacacatcgaggcacagactggatg

SEQ ID NO: 445399 - DNA, 25 bp, Mus musculus
gacacatcgagggacagactggatg

SEQ ID NO: 445400 - DNA, 25 bp, Mus musculus
gacacatctactctggtgaacgaga

SEQ ID NO: 445401 - DNA, 25 bp, Mus musculus
gacacatctactgtggtgaacgaga

SEQ ID NO: 445402 - DNA, 25 bp, Mus musculus
gacacatctcggaaatgctcgcaga

SEQ ID NO: 445403 - DNA, 25 bp, Mus musculus
gacacatctcggtaatgctcgcaga

SEQ ID NO: 445404 - DNA, 25 bp, Mus musculus
gacacatctgatatccagttcctgg

SEQ ID NO: 445405 - DNA, 25 bp, Mus musculus
gacacatctgatttccagttcctgg

SEQ ID NO: 445406 - DNA, 25 bp, Mus musculus
gacacatctgctatctagtaggcaa

SEQ ID NO: 445407 - DNA, 25 bp, Mus musculus
gacacatctgctttctagtaggcaa

SEQ ID NO: 445408 - DNA, 25 bp, Mus musculus
gacacatctggccacttcagaagga

SEQ ID NO: 445409 - DNA, 25 bp, Mus musculus
gacacatctggcgacttcagaagga

SEQ ID NO: 445410 - DNA, 25 bp, Mus musculus
gacacatctgtcacatacattttgt

SEQ ID NO: 445411 - DNA, 25 bp, Mus musculus
gacacatctgtctcatacattttgt

SEQ ID NO: 445412 - DNA, 25 bp, Mus musculus
gacacatcttaaattattctcccac

SEQ ID NO: 445413 - DNA, 25 bp, Mus musculus
gacacatcttaatttattctcccac

SEQ ID NO: 445414 - DNA, 25 bp, Mus musculus
gacacatcttacataatccatctca

SEQ ID NO: 445415 - DNA, 25 bp, Mus musculus
gacacatcttacttaatccatctca

SEQ ID NO: 445416 - DNA, 25 bp, Mus musculus
gacacatctttcatttactaactgg

SEQ ID NO: 445417 - DNA, 25 bp, Mus musculus
gacacatctttcttttactaactgg

SEQ ID NO: 445418 - DNA, 25 bp, Mus musculus
gacacatgaagaagcagtagctgcc

SEQ ID NO: 445419 - DNA, 25 bp, Mus musculus
gacacatgaagaagtttcctcacct

SEQ ID NO: 445420 - DNA, 25 bp, Mus musculus
gacacatgaagaatagcctccctcc

SEQ ID NO: 445421 - DNA, 25 bp, Mus musculus
gacacatgaagatgcagtagctgcc

SEQ ID NO: 445422 - DNA, 25 bp, Mus musculus
gacacatgaagatgtttcctcacct

SEQ ID NO: 445423 - DNA, 25 bp, Mus musculus
gacacatgaagattagcctccctcc

SEQ ID NO: 445424 - DNA, 25 bp, Mus musculus
gacacatgacaactgctatgaccag

SEQ ID NO: 445425 - DNA, 25 bp, Mus musculus
gacacatgacaagtgctatgaccag

SEQ ID NO: 445426 - DNA, 25 bp, Mus musculus
gacacatgacacagcaactttaaag

SEQ ID NO: 445427 - DNA, 25 bp, Mus musculus
gacacatgacactgcaactttaaag

SEQ ID NO: 445428 - DNA, 25 bp, Mus musculus
gacacatgatgtacagggcaaagct

SEQ ID NO: 445429 - DNA, 25 bp, Mus musculus
gacacatgatgttcagggcaaagct

SEQ ID NO: 445430 - DNA, 25 bp, Mus musculus
gacacatgcattatctttgcacatg

SEQ ID NO: 445431 - DNA, 25 bp, Mus musculus
gacacatgcattttctttgcacatg

SEQ ID NO: 445432 - DNA, 25 bp, Mus musculus
gacacatgctttatcttcagttcat

SEQ ID NO: 445433 - DNA, 25 bp, Mus musculus
gacacatgctttttcttcagttcat

SEQ ID NO: 445434 - DNA, 25 bp, Mus musculus
gacacatggaaaactgccacagcag

SEQ ID NO: 445435 - DNA, 25 bp, Mus musculus
gacacatggaaatctgccacagcag

SEQ ID NO: 445436 - DNA, 25 bp, Mus musculus
gacacatggaacagcatcaccactg

SEQ ID NO: 445437 - DNA, 25 bp, Mus musculus
gacacatggaactgcatcaccactg

SEQ ID NO: 445438 - DNA, 25 bp, Mus musculus
gacacatggcgaattacatagtcag

SEQ ID NO: 445439 - DNA, 25 bp, Mus musculus
gacacatggcgatttacatagtcag

SEQ ID NO: 445440 - DNA, 25 bp, Mus musculus
gacacatggcttagaatgattacta

SEQ ID NO: 445441 - DNA, 25 bp, Mus musculus
gacacatggctttgaatgattacta

SEQ ID NO: 445442 - DNA, 25 bp, Mus musculus
gacacatgggccagaccgtgaagca

SEQ ID NO: 445443 - DNA, 25 bp, Mus musculus
gacacatgggcctgaccgtgaagca

SEQ ID NO: 445444 - DNA, 25 bp, Mus musculus
gacacatgggttccgcctgttcaga

SEQ ID NO: 445445 - DNA, 25 bp, Mus musculus
gacacatgggttgcgcctgttcaga

SEQ ID NO: 445446 - DNA, 25 bp, Mus musculus
gacacatggtttactttcaagtggc

SEQ ID NO: 445447 - DNA, 25 bp, Mus musculus
gacacatggttttctttcaagtggc

SEQ ID NO: 445448 - DNA, 25 bp, Mus musculus
gacacatgtaccatgtgaaaaccat

SEQ ID NO: 445449 - DNA, 25 bp, Mus musculus
gacacatgtaccattgtaattggct

SEQ ID NO: 445450 - DNA, 25 bp, Mus musculus
gacacatgtaccttgtgaaaaccat

SEQ ID NO: 445451 - DNA, 25 bp, Mus musculus
gacacatgtacctttgtaattggct

SEQ ID NO: 445452 - DNA, 25 bp, Mus musculus
gacacatgtatgaactcatttttaa

SEQ ID NO: 445453 - DNA, 25 bp, Mus musculus
gacacatgtatgtactcatttttaa

SEQ ID NO: 445454 - DNA, 25 bp, Mus musculus
gacacatgtcacataacacgtccaa

SEQ ID NO: 445455 - DNA, 25 bp, Mus musculus
gacacatgtcacttaacacgtccaa

SEQ ID NO: 445456 - DNA, 25 bp, Mus musculus
gacacatgtcccagagtgacgtgag

SEQ ID NO: 445457 - DNA, 25 bp, Mus musculus
gacacatgtccctgagtgacgtgag

SEQ ID NO: 445458 - DNA, 25 bp, Mus musculus
gacacatgtgagaatatcatctgca

SEQ ID NO: 445459 - DNA, 25 bp, Mus musculus
gacacatgtgagtatatcatctgca

SEQ ID NO: 445460 - DNA, 25 bp, Mus musculus
gacacatgttagctcatttcccaat

SEQ ID NO: 445461 - DNA, 25 bp, Mus musculus
gacacatgttaggtcatttcccaat

SEQ ID NO: 445462 - DNA, 25 bp, Mus musculus
gacacatgttccagtgcatacacag

SEQ ID NO: 445463 - DNA, 25 bp, Mus musculus
gacacatgttcctgtgcatacacag

SEQ ID NO: 445464 - DNA, 25 bp, Mus musculus
gacacatgttttcacgtggagcacg

SEQ ID NO: 445465 - DNA, 25 bp, Mus musculus
gacacatgttttgacgtggagcacg

SEQ ID NO: 445466 - DNA, 25 bp, Mus musculus
gacacattagacatccagtttctgg

SEQ ID NO: 445467 - DNA, 25 bp, Mus musculus
gacacattagacttccagtttctgg

SEQ ID NO: 445468 - DNA, 25 bp, Mus musculus
gacacattagtcaggccaggttctc

SEQ ID NO: 445469 - DNA, 25 bp, Mus musculus
gacacattagtctggccaggttctc

SEQ ID NO: 445470 - DNA, 25 bp, Mus musculus
gacacattagtgagctttcacaaga

SEQ ID NO: 445471 - DNA, 25 bp, Mus musculus
gacacattagtgtgctttcacaaga

SEQ ID NO: 445472 - DNA, 25 bp, Mus musculus
gacacattatgcacagtggccactt

SEQ ID NO: 445473 - DNA, 25 bp, Mus musculus
gacacattatgctcagtggccactt

SEQ ID NO: 445474 - DNA, 25 bp, Mus musculus
gacacattcatgattacggagagat

SEQ ID NO: 445475 - DNA, 25 bp, Mus musculus
gacacattcatgtttacggagagat

SEQ ID NO: 445476 - DNA, 25 bp, Mus musculus
gacacattcccactgtgaaatgatg

SEQ ID NO: 445477 - DNA, 25 bp, Mus musculus
gacacattcccagtgtgaaatgatg

SEQ ID NO: 445478 - DNA, 25 bp, Mus musculus
gacacattcctcacaattgacaaat

SEQ ID NO: 445479 - DNA, 25 bp, Mus musculus
gacacattcctctcaattgacaaat

SEQ ID NO: 445480 - DNA, 25 bp, Mus musculus
gacacattccttagtctgttgaaat

SEQ ID NO: 445481 - DNA, 25 bp, Mus musculus
gacacattcctttgtctgttgaaat

SEQ ID NO: 445482 - DNA, 25 bp, Mus musculus
gacacattctcaaaacaaccctaaa

SEQ ID NO: 445483 - DNA, 25 bp, Mus musculus
gacacattctcataacaaccctaaa

SEQ ID NO: 445484 - DNA, 25 bp, Mus musculus
gacacattgagacttgataaagcga

SEQ ID NO: 445485 - DNA, 25 bp, Mus musculus
gacacattgagagttgataaagcga

SEQ ID NO: 445486 - DNA, 25 bp, Mus musculus
gacacattgagcatcttttactgtt

SEQ ID NO: 445487 - DNA, 25 bp, Mus musculus
gacacattgagcttcttttactgtt

SEQ ID NO: 445488 - DNA, 25 bp, Mus musculus
gacacattgataacctagtccacgg

SEQ ID NO: 445489 - DNA, 25 bp, Mus musculus
gacacattgatatcctagtccacgg

SEQ ID NO: 445490 - DNA, 25 bp, Mus musculus
gacacattgctgaaattagtacctt

SEQ ID NO: 445491 - DNA, 25 bp, Mus musculus
gacacattgctgtaattagtacctt

SEQ ID NO: 445492 - DNA, 25 bp, Mus musculus
gacacattggagaatacaggctgaa

SEQ ID NO: 445493 - DNA, 25 bp, Mus musculus
gacacattggagtatacaggctgaa

SEQ ID NO: 445494 - DNA, 25 bp, Mus musculus
gacacattggcaaatgtatcccagt

SEQ ID NO: 445495 - DNA, 25 bp, Mus musculus
gacacattggcatatgtatcccagt

SEQ ID NO: 445496 - DNA, 25 bp, Mus musculus
gacacattgtataactgacttacgt

SEQ ID NO: 445497 - DNA, 25 bp, Mus musculus
gacacattgtattactgacttacgt

SEQ ID NO: 445498 - DNA, 25 bp, Mus musculus
gacacattgtgaatcccatatatgg

SEQ ID NO: 445499 - DNA, 25 bp, Mus musculus
gacacattgtgattcccatatatgg

SEQ ID NO: 445500 - DNA, 25 bp, Mus musculus
gacacattgttcctgtctagcccag

SEQ ID NO: 445501 - DNA, 25 bp, Mus musculus
gacacattgttcgtgtctagcccag

SEQ ID NO: 445502 - DNA, 25 bp, Mus musculus
gacacatttaacaagtttccctcaa

SEQ ID NO: 445503 - DNA, 25 bp, Mus musculus
gacacatttaactagtttccctcaa

SEQ ID NO: 445504 - DNA, 25 bp, Mus musculus
gacacatttcaaactggtgcaaaca

SEQ ID NO: 445505 - DNA, 25 bp, Mus musculus
gacacatttcaatctggtgcaaaca

SEQ ID NO: 445506 - DNA, 25 bp, Mus musculus
gacacatttcggagagcaggagagt

SEQ ID NO: 445507 - DNA, 25 bp, Mus musculus
gacacatttcggtgagcaggagagt

SEQ ID NO: 445508 - DNA, 25 bp, Mus musculus
gacacatttctactgtggccactag

SEQ ID NO: 445509 - DNA, 25 bp, Mus musculus
gacacatttctagtgtggccactag

SEQ ID NO: 445510 - DNA, 25 bp, Mus musculus
gacacatttctccatctgatcagta

SEQ ID NO: 445511 - DNA, 25 bp, Mus musculus
gacacatttctcgatctgatcagta

SEQ ID NO: 445512 - DNA, 25 bp, Mus musculus
gacacatttgaaatagccggcagtt

SEQ ID NO: 445513 - DNA, 25 bp, Mus musculus
gacacatttgaattagccggcagtt

SEQ ID NO: 445514 - DNA, 25 bp, Mus musculus
gacacatttggaattcatggtatca

SEQ ID NO: 445515 - DNA, 25 bp, Mus musculus
gacacatttggatttcatggtatca

SEQ ID NO: 445516 - DNA, 25 bp, Mus musculus
gacacatttgtaaacttggcacctg

SEQ ID NO: 445517 - DNA, 25 bp, Mus musculus
gacacatttgtacagttttctccct

SEQ ID NO: 445518 - DNA, 25 bp, Mus musculus
gacacatttgtagagttttctccct

SEQ ID NO: 445519 - DNA, 25 bp, Mus musculus
gacacatttgtatacttggcacctg

SEQ ID NO: 445520 - DNA, 25 bp, Mus musculus
gacacatttgtgctcactgacacca

SEQ ID NO: 445521 - DNA, 25 bp, Mus musculus
gacacatttgtggtcactgacacca

SEQ ID NO: 445522 - DNA, 25 bp, Mus musculus
gacacattttggacttaatccatgt

SEQ ID NO: 445523 - DNA, 25 bp, Mus musculus
gacacattttggtcttaatccatgt

SEQ ID NO: 445524 - DNA, 25 bp, Mus musculus
gacacattttgtattctttcatagc

SEQ ID NO: 445525 - DNA, 25 bp, Mus musculus
gacacattttgttttctttcatagc

SEQ ID NO: 445526 - DNA, 25 bp, Mus musculus
gacaccaaaacaatggcctgccatt

SEQ ID NO: 445527 - DNA, 25 bp, Mus musculus
gacaccaaaacattggcctgccatt

SEQ ID NO: 445528 - DNA, 25 bp, Mus musculus
gacaccaaaattctgggttcacttt

SEQ ID NO: 445529 - DNA, 25 bp, Mus musculus
gacaccaaaattgtgggttcacttt

SEQ ID NO: 445530 - DNA, 25 bp, Mus musculus
gacaccaaagatcattccactcata

SEQ ID NO: 445531 - DNA, 25 bp, Mus musculus
gacaccaaagatgattccactcata

SEQ ID NO: 445532 - DNA, 25 bp, Mus musculus
gacaccaaagtcatcgatgcaaaat

SEQ ID NO: 445533 - DNA, 25 bp, Mus musculus
gacaccaaagtcatggctgtaatgt

SEQ ID NO: 445534 - DNA, 25 bp, Mus musculus
gacaccaaagtcttcgatgcaaaat

SEQ ID NO: 445535 - DNA, 25 bp, Mus musculus
gacaccaaagtcttggctgtaatgt

SEQ ID NO: 445536 - DNA, 25 bp, Mus musculus
gacaccaaagttcccagacgctatg

SEQ ID NO: 445537 - DNA, 25 bp, Mus musculus
gacaccaaagttgccagacgctatg

SEQ ID NO: 445538 - DNA, 25 bp, Mus musculus
gacaccaaatccatcagaaatgttc

SEQ ID NO: 445539 - DNA, 25 bp, Mus musculus
gacaccaaatccttcagaaatgttc

SEQ ID NO: 445540 - DNA, 25 bp, Mus musculus
gacaccaaattcaatatgccttcgt

SEQ ID NO: 445541 - DNA, 25 bp, Mus musculus
gacaccaaattctatatgccttcgt

SEQ ID NO: 445542 - DNA, 25 bp, Mus musculus
gacaccaaatttatggcacattttt

SEQ ID NO: 445543 - DNA, 25 bp, Mus musculus
gacaccaaatttttggcacattttt

SEQ ID NO: 445544 - DNA, 25 bp, Mus musculus
gacaccaacctacaattcgctgaag

SEQ ID NO: 445545 - DNA, 25 bp, Mus musculus
gacaccaacctagaattcgctgaag

SEQ ID NO: 445546 - DNA, 25 bp, Mus musculus
gacaccaaggatcacagctccatgt

SEQ ID NO: 445547 - DNA, 25 bp, Mus musculus
gacaccaaggatgacagctccatgt

SEQ ID NO: 445548 - DNA, 25 bp, Mus musculus
gacaccaaggcccaatcctggaatt

SEQ ID NO: 445549 - DNA, 25 bp, Mus musculus
gacaccaaggccgaatcctggaatt

SEQ ID NO: 445550 - DNA, 25 bp, Mus musculus
gacaccaagtttcgagatttcctcc

SEQ ID NO: 445551 - DNA, 25 bp, Mus musculus
gacaccaagtttggagatttcctcc

SEQ ID NO: 445552 - DNA, 25 bp, Mus musculus
gacaccaatacccaaaagtggcgtt

SEQ ID NO: 445553 - DNA, 25 bp, Mus musculus
gacaccaataccgaaaagtggcgtt

SEQ ID NO: 445554 - DNA, 25 bp, Mus musculus
gacaccaatagactcaacagcttcc

SEQ ID NO: 445555 - DNA, 25 bp, Mus musculus
gacaccaatagagtcaacagcttcc

SEQ ID NO: 445556 - DNA, 25 bp, Mus musculus
gacaccaatagtaccaagactccct

SEQ ID NO: 445557 - DNA, 25 bp, Mus musculus
gacaccaatagttccaagactccct

SEQ ID NO: 445558 - DNA, 25 bp, Mus musculus
gacaccaatcaaaactttcatctaa

SEQ ID NO: 445559 - DNA, 25 bp, Mus musculus
gacaccaatcaaattgctgggaaga

SEQ ID NO: 445560 - DNA, 25 bp, Mus musculus
gacaccaatcaatactttcatctaa

SEQ ID NO: 445561 - DNA, 25 bp, Mus musculus
gacaccaatcaatttgctgggaaga

SEQ ID NO: 445562 - DNA, 25 bp, Mus musculus
gacaccaatctcaagaagctgctga

SEQ ID NO: 445563 - DNA, 25 bp, Mus musculus
gacaccaatctctagaagctgctga

SEQ ID NO: 445564 - DNA, 25 bp, Mus musculus
gacaccaatctgctcttcaaatcga

SEQ ID NO: 445565 - DNA, 25 bp, Mus musculus
gacaccaatctggtcttcaaatcga

SEQ ID NO: 445566 - DNA, 25 bp, Mus musculus
gacaccaatgccatagtagcagccg

SEQ ID NO: 445567 - DNA, 25 bp, Mus musculus
gacaccaatgccttagtagcagccg

SEQ ID NO: 445568 - DNA, 25 bp, Mus musculus
gacaccaatgtgcatcgagctacag

SEQ ID NO: 445569 - DNA, 25 bp, Mus musculus
gacaccaatgtggatcgagctacag

SEQ ID NO: 445570 - DNA, 25 bp, Mus musculus
gacaccacaaccaacacgaaagcaa

SEQ ID NO: 445571 - DNA, 25 bp, Mus musculus
gacaccacaacctacacgaaagcaa

SEQ ID NO: 445572 - DNA, 25 bp, Mus musculus
gacaccacagagctcacttgaacca

SEQ ID NO: 445573 - DNA, 25 bp, Mus musculus
gacaccacagaggtcacttgaacca

SEQ ID NO: 445574 - DNA, 25 bp, Mus musculus
gacaccacatgacctttctacgaag

SEQ ID NO: 445575 - DNA, 25 bp, Mus musculus
gacaccacatgagctttctacgaag

SEQ ID NO: 445576 - DNA, 25 bp, Mus musculus
gacaccaccattactgtacagagct

SEQ ID NO: 445577 - DNA, 25 bp, Mus musculus
gacaccaccatttctgtacagagct

SEQ ID NO: 445578 - DNA, 25 bp, Mus musculus
gacaccacccaacttggtttctttg

SEQ ID NO: 445579 - DNA, 25 bp, Mus musculus
gacaccacccaagttggtttctttg

SEQ ID NO: 445580 - DNA, 25 bp, Mus musculus
gacaccacgtggcagccagagcctt

SEQ ID NO: 445581 - DNA, 25 bp, Mus musculus
gacaccacgtgggagccagagcctt

SEQ ID NO: 445582 - DNA, 25 bp, Mus musculus
gacaccactcatactgaactaaaat

SEQ ID NO: 445583 - DNA, 25 bp, Mus musculus
gacaccactcattctgaactaaaat

SEQ ID NO: 445584 - DNA, 25 bp, Mus musculus
gacaccactggacaccgcgaaagag

SEQ ID NO: 445585 - DNA, 25 bp, Mus musculus
gacaccactggagaccgcgaaagag

SEQ ID NO: 445586 - DNA, 25 bp, Mus musculus
gacaccactgtgatcttgagacatt

SEQ ID NO: 445587 - DNA, 25 bp, Mus musculus
gacaccactgtgttcttgagacatt

SEQ ID NO: 445588 - DNA, 25 bp, Mus musculus
gacaccactttgacacagttcctaa

SEQ ID NO: 445589 - DNA, 25 bp, Mus musculus
gacaccactttgtcacagttcctaa

SEQ ID NO: 445590 - DNA, 25 bp, Mus musculus
gacaccagaaatccttgttggagaa

SEQ ID NO: 445591 - DNA, 25 bp, Mus musculus
gacaccagaaatgcttgttggagaa

SEQ ID NO: 445592 - DNA, 25 bp, Mus musculus
gacaccagaataccttcagaggcct

SEQ ID NO: 445593 - DNA, 25 bp, Mus musculus
gacaccagaatagcttcagaggcct

SEQ ID NO: 445594 - DNA, 25 bp, Mus musculus
gacaccagacagcacatttcagtat

SEQ ID NO: 445595 - DNA, 25 bp, Mus musculus
gacaccagacaggacatttcagtat

SEQ ID NO: 445596 - DNA, 25 bp, Mus musculus
gacaccagagaaaaagacgctcaag

SEQ ID NO: 445597 - DNA, 25 bp, Mus musculus
gacaccagagaactaccggctgctt

SEQ ID NO: 445598 - DNA, 25 bp, Mus musculus
gacaccagagaagtaccggctgctt

SEQ ID NO: 445599 - DNA, 25 bp, Mus musculus
gacaccagagaataagacgctcaag

SEQ ID NO: 445600 - DNA, 25 bp, Mus musculus
gacaccagaggcaaatgcttaccct

SEQ ID NO: 445601 - DNA, 25 bp, Mus musculus
gacaccagaggctaatgcttaccct

SEQ ID NO: 445602 - DNA, 25 bp, Mus musculus
gacaccagaggtactatcttgtagt

SEQ ID NO: 445603 - DNA, 25 bp, Mus musculus
gacaccagaggttctatcttgtagt

SEQ ID NO: 445604 - DNA, 25 bp, Mus musculus
gacaccagagtccttcttaaaaata

SEQ ID NO: 445605 - DNA, 25 bp, Mus musculus
gacaccagagtcgttcttaaaaata

SEQ ID NO: 445606 - DNA, 25 bp, Mus musculus
gacaccagagtgctttatctttatg

SEQ ID NO: 445607 - DNA, 25 bp, Mus musculus
gacaccagagtggtttatctttatg

SEQ ID NO: 445608 - DNA, 25 bp, Mus musculus
gacaccagatgtagaaagtctccct

SEQ ID NO: 445609 - DNA, 25 bp, Mus musculus
gacaccagatgttgaaagtctccct

SEQ ID NO: 445610 - DNA, 25 bp, Mus musculus
gacaccagcaagaacttggccacca

SEQ ID NO: 445611 - DNA, 25 bp, Mus musculus
gacaccagcaagaattccggcattt

SEQ ID NO: 445612 - DNA, 25 bp, Mus musculus
gacaccagcaagcaactagttttac

SEQ ID NO: 445613 - DNA, 25 bp, Mus musculus
gacaccagcaaggaactagttttac

SEQ ID NO: 445614 - DNA, 25 bp, Mus musculus
gacaccagcaagtacttggccacca

SEQ ID NO: 445615 - DNA, 25 bp, Mus musculus
gacaccagcaagtattccggcattt

SEQ ID NO: 445616 - DNA, 25 bp, Mus musculus
gacaccagcaccatgagatgttatt

SEQ ID NO: 445617 - DNA, 25 bp, Mus musculus
gacaccagcaccttgagatgttatt

SEQ ID NO: 445618 - DNA, 25 bp, Mus musculus
gacaccagcaggatatagggcagct

SEQ ID NO: 445619 - DNA, 25 bp, Mus musculus
gacaccagcaggttatagggcagct

SEQ ID NO: 445620 - DNA, 25 bp, Mus musculus
gacaccagcatacttggaactgcaa

SEQ ID NO: 445621 - DNA, 25 bp, Mus musculus
gacaccagcatagttggaactgcaa

SEQ ID NO: 445622 - DNA, 25 bp, Mus musculus
gacaccagcatcctgtactgctatg

SEQ ID NO: 445623 - DNA, 25 bp, Mus musculus
gacaccagcatcgtgtactgctatg

SEQ ID NO: 445624 - DNA, 25 bp, Mus musculus
gacaccagccatacagcagagtttg

SEQ ID NO: 445625 - DNA, 25 bp, Mus musculus
gacaccagccattcagcagagtttg

SEQ ID NO: 445626 - DNA, 25 bp, Mus musculus
gacaccagccttctgctgagataga

SEQ ID NO: 445627 - DNA, 25 bp, Mus musculus
gacaccagccttgtgctgagataga

SEQ ID NO: 445628 - DNA, 25 bp, Mus musculus
gacaccagctgtaactgcattgcac

SEQ ID NO: 445629 - DNA, 25 bp, Mus musculus
gacaccagctgttactgcattgcac

SEQ ID NO: 445630 - DNA, 25 bp, Mus musculus
gacaccaggcgcaaattcaaagaat

SEQ ID NO: 445631 - DNA, 25 bp, Mus musculus
gacaccaggcgctaattcaaagaat

SEQ ID NO: 445632 - DNA, 25 bp, Mus musculus
gacaccaggcttctatatggcacac

SEQ ID NO: 445633 - DNA, 25 bp, Mus musculus
gacaccaggcttgtatatggcacac

SEQ ID NO: 445634 - DNA, 25 bp, Mus musculus
gacaccaggtatatcgatgaggagt

SEQ ID NO: 445635 - DNA, 25 bp, Mus musculus
gacaccaggtatttcgatgaggagt

SEQ ID NO: 445636 - DNA, 25 bp, Mus musculus
gacaccaggtcaatcatgttgctct

SEQ ID NO: 445637 - DNA, 25 bp, Mus musculus
gacaccaggtcattcatgttgctct

SEQ ID NO: 445638 - DNA, 25 bp, Mus musculus
gacaccaggtgacccactgagggcc

SEQ ID NO: 445639 - DNA, 25 bp, Mus musculus
gacaccaggtgacgtttactaagta

SEQ ID NO: 445640 - DNA, 25 bp, Mus musculus
gacaccaggtgagccactgagggcc

SEQ ID NO: 445641 - DNA, 25 bp, Mus musculus
gacaccaggtgaggtttactaagta

SEQ ID NO: 445642 - DNA, 25 bp, Mus musculus
gacaccagtccgcaaaggctgtact

SEQ ID NO: 445643 - DNA, 25 bp, Mus musculus
gacaccagtccggaaaggctgtact

SEQ ID NO: 445644 - DNA, 25 bp, Mus musculus
gacaccagtgcccacagcacaagaa

SEQ ID NO: 445645 - DNA, 25 bp, Mus musculus
gacaccagtgccgacagcacaagaa

SEQ ID NO: 445646 - DNA, 25 bp, Mus musculus
gacaccagtgcgcattgctgagaac

SEQ ID NO: 445647 - DNA, 25 bp, Mus musculus
gacaccagtgcggattgctgagaac

SEQ ID NO: 445648 - DNA, 25 bp, Mus musculus
gacaccagtgtgacaacagaagcga

SEQ ID NO: 445649 - DNA, 25 bp, Mus musculus
gacaccagtgtgatcatttattcat

SEQ ID NO: 445650 - DNA, 25 bp, Mus musculus
gacaccagtgtgtcaacagaagcga

SEQ ID NO: 445651 - DNA, 25 bp, Mus musculus
gacaccagtgtgttcatttattcat

SEQ ID NO: 445652 - DNA, 25 bp, Mus musculus
gacaccagttaaatccttcaaccaa

SEQ ID NO: 445653 - DNA, 25 bp, Mus musculus
gacaccagttaattccttcaaccaa

SEQ ID NO: 445654 - DNA, 25 bp, Mus musculus
gacaccatacatacaacttcatcta

SEQ ID NO: 445655 - DNA, 25 bp, Mus musculus
gacaccatacattcaacttcatcta

SEQ ID NO: 445656 - DNA, 25 bp, Mus musculus
gacaccatagttatgatccctagaa

SEQ ID NO: 445657 - DNA, 25 bp, Mus musculus
gacaccatagttttgatccctagaa

SEQ ID NO: 445658 - DNA, 25 bp, Mus musculus
gacaccatatgaataaagacaccca

SEQ ID NO: 445659 - DNA, 25 bp, Mus musculus
gacaccatatgattaaagacaccca

SEQ ID NO: 445660 - DNA, 25 bp, Mus musculus
gacaccatcaaaaatccagcatcca

SEQ ID NO: 445661 - DNA, 25 bp, Mus musculus
gacaccatcaaatatccagcatcca

SEQ ID NO: 445662 - DNA, 25 bp, Mus musculus
gacaccatcaaccagcttcaggagg

SEQ ID NO: 445663 - DNA, 25 bp, Mus musculus
gacaccatcaacgagcttcaggagg

SEQ ID NO: 445664 - DNA, 25 bp, Mus musculus
gacaccatcaggattggattgcatg

SEQ ID NO: 445665 - DNA, 25 bp, Mus musculus
gacaccatcaggtttggattgcatg

SEQ ID NO: 445666 - DNA, 25 bp, Mus musculus
gacaccatcatcaattaaacggagt

SEQ ID NO: 445667 - DNA, 25 bp, Mus musculus
gacaccatcatctattaaacggagt

SEQ ID NO: 445668 - DNA, 25 bp, Mus musculus
gacaccatcctacagctcattaaga

SEQ ID NO: 445669 - DNA, 25 bp, Mus musculus
gacaccatcctagagctcattaaga

SEQ ID NO: 445670 - DNA, 25 bp, Mus musculus
gacaccatctaacctcagagacaga

SEQ ID NO: 445671 - DNA, 25 bp, Mus musculus
gacaccatctaagctcagagacaga

SEQ ID NO: 445672 - DNA, 25 bp, Mus musculus
gacaccatcttcagatttccagaga

SEQ ID NO: 445673 - DNA, 25 bp, Mus musculus
gacaccatcttctgatttccagaga

SEQ ID NO: 445674 - DNA, 25 bp, Mus musculus
gacaccatgactctggcaaatctta

SEQ ID NO: 445675 - DNA, 25 bp, Mus musculus
gacaccatgactgtggcaaatctta

SEQ ID NO: 445676 - DNA, 25 bp, Mus musculus
gacaccatgagcacgggccagcagc

SEQ ID NO: 445677 - DNA, 25 bp, Mus musculus
gacaccatgagctcgggccagcagc

SEQ ID NO: 445678 - DNA, 25 bp, Mus musculus
gacaccatgagtaggttcagcagct

SEQ ID NO: 445679 - DNA, 25 bp, Mus musculus
gacaccatgagttggttcagcagct

SEQ ID NO: 445680 - DNA, 25 bp, Mus musculus
gacaccatggcaagactgtcagtgg

SEQ ID NO: 445681 - DNA, 25 bp, Mus musculus
gacaccatggcatgactgtcagtgg

SEQ ID NO: 445682 - DNA, 25 bp, Mus musculus
gacaccatggccagtattagcaagt

SEQ ID NO: 445683 - DNA, 25 bp, Mus musculus
gacaccatggcctgtattagcaagt

SEQ ID NO: 445684 - DNA, 25 bp, Mus musculus
gacaccatgtctcaggtagggttgt

SEQ ID NO: 445685 - DNA, 25 bp, Mus musculus
gacaccatgtctgaggtagggttgt

SEQ ID NO: 445686 - DNA, 25 bp, Mus musculus
gacaccattgaacttctgtagggaa

SEQ ID NO: 445687 - DNA, 25 bp, Mus musculus
gacaccattgaagttctgtagggaa

SEQ ID NO: 445688 - DNA, 25 bp, Mus musculus
gacaccattgagaataacccgaggc

SEQ ID NO: 445689 - DNA, 25 bp, Mus musculus
gacaccattgagctagtgtggctta

SEQ ID NO: 445690 - DNA, 25 bp, Mus musculus
gacaccattgaggtagtgtggctta

SEQ ID NO: 445691 - DNA, 25 bp, Mus musculus
gacaccattgagtataacccgaggc

SEQ ID NO: 445692 - DNA, 25 bp, Mus musculus
gacaccattgatcaatctttctctc

SEQ ID NO: 445693 - DNA, 25 bp, Mus musculus
gacaccattgatgaatctttctctc

SEQ ID NO: 445694 - DNA, 25 bp, Mus musculus
gacacccaaaggagtctttgtattt

SEQ ID NO: 445695 - DNA, 25 bp, Mus musculus
gacacccaaaggtgtctttgtattt

SEQ ID NO: 445696 - DNA, 25 bp, Mus musculus
gacacccaaggccaaatctattttt

SEQ ID NO: 445697 - DNA, 25 bp, Mus musculus
gacacccaaggcgaaatctattttt

SEQ ID NO: 445698 - DNA, 25 bp, Mus musculus
gacacccaagtcacatatcaaaatg

SEQ ID NO: 445699 - DNA, 25 bp, Mus musculus
gacacccaagtctcatatcaaaatg

SEQ ID NO: 445700 - DNA, 25 bp, Mus musculus
gacacccacactagaaaaagccaat

SEQ ID NO: 445701 - DNA, 25 bp, Mus musculus
gacacccacacttgaaaaagccaat

SEQ ID NO: 445702 - DNA, 25 bp, Mus musculus
gacacccagaatcttacatcatttg

SEQ ID NO: 445703 - DNA, 25 bp, Mus musculus
gacacccagaatgttacatcatttg

SEQ ID NO: 445704 - DNA, 25 bp, Mus musculus
gacacccagagcaaccatctggtat

SEQ ID NO: 445705 - DNA, 25 bp, Mus musculus
gacacccagagccacagatgactag

SEQ ID NO: 445706 - DNA, 25 bp, Mus musculus
gacacccagagcgacagatgactag

SEQ ID NO: 445707 - DNA, 25 bp, Mus musculus
gacacccagagctaccatctggtat

SEQ ID NO: 445708 - DNA, 25 bp, Mus musculus
gacacccagcaccaggactcatggt

SEQ ID NO: 445709 - DNA, 25 bp, Mus musculus
gacacccagcacgaggactcatggt

SEQ ID NO: 445710 - DNA, 25 bp, Mus musculus
gacacccaggagagtgttcccacga

SEQ ID NO: 445711 - DNA, 25 bp, Mus musculus
gacacccaggagtgtgttcccacga

SEQ ID NO: 445712 - DNA, 25 bp, Mus musculus
gacacccagttcatcgatgagaacc

SEQ ID NO: 445713 - DNA, 25 bp, Mus musculus
gacacccagttcttcgatgagaacc

SEQ ID NO: 445714 - DNA, 25 bp, Mus musculus
gacacccagtttagccacatggata

SEQ ID NO: 445715 - DNA, 25 bp, Mus musculus
gacacccagttttgccacatggata

SEQ ID NO: 445716 - DNA, 25 bp, Mus musculus
gacacccatcagattggagctggtt

SEQ ID NO: 445717 - DNA, 25 bp, Mus musculus
gacacccatcagattttgctggctc

SEQ ID NO: 445718 - DNA, 25 bp, Mus musculus
gacacccatcagtttggagctggtt

SEQ ID NO: 445719 - DNA, 25 bp, Mus musculus
gacacccatcagtttttgctggctc

SEQ ID NO: 445720 - DNA, 25 bp, Mus musculus
gacacccatgctctgctgtttccgg

SEQ ID NO: 445721 - DNA, 25 bp, Mus musculus
gacacccatgctgtgctgtttccgg

SEQ ID NO: 445722 - DNA, 25 bp, Mus musculus
gacacccatgtgaaaaatcctgatt

SEQ ID NO: 445723 - DNA, 25 bp, Mus musculus
gacacccatgtgtaaaatcctgatt

SEQ ID NO: 445724 - DNA, 25 bp, Mus musculus
gacaccccaagtaacactggatacc

SEQ ID NO: 445725 - DNA, 25 bp, Mus musculus
gacaccccaagttacactggatacc

SEQ ID NO: 445726 - DNA, 25 bp, Mus musculus
gacaccccacgtcactgatgaggat

SEQ ID NO: 445727 - DNA, 25 bp, Mus musculus
gacaccccacgtgactgatgaggat

SEQ ID NO: 445728 - DNA, 25 bp, Mus musculus
gacaccccatctctgcaagaaagaa

SEQ ID NO: 445729 - DNA, 25 bp, Mus musculus
gacaccccatctgtgcaagaaagaa

SEQ ID NO: 445730 - DNA, 25 bp, Mus musculus
gacacccctaaaatacacatgacct

SEQ ID NO: 445731 - DNA, 25 bp, Mus musculus
gacacccctaaattacacatgacct

SEQ ID NO: 445732 - DNA, 25 bp, Mus musculus
gacacccctatcaggttggaagaga

SEQ ID NO: 445733 - DNA, 25 bp, Mus musculus
gacacccctatctggttggaagaga

SEQ ID NO: 445734 - DNA, 25 bp, Mus musculus
gacacccctccaagggtatggagtt

SEQ ID NO: 445735 - DNA, 25 bp, Mus musculus
gacacccctccaataaaggatgttt

SEQ ID NO: 445736 - DNA, 25 bp, Mus musculus
gacacccctccactaaagattgagt

SEQ ID NO: 445737 - DNA, 25 bp, Mus musculus
gacacccctccagtaaagattgagt

SEQ ID NO: 445738 - DNA, 25 bp, Mus musculus
gacacccctccatgggtatggagtt

SEQ ID NO: 445739 - DNA, 25 bp, Mus musculus
gacacccctccattaaaggatgttt

SEQ ID NO: 445740 - DNA, 25 bp, Mus musculus
gacacccctggtcgactgtaacaat

SEQ ID NO: 445741 - DNA, 25 bp, Mus musculus
gacacccctggtggactgtaacaat

SEQ ID NO: 445742 - DNA, 25 bp, Mus musculus
gacacccgattcaaagtgcaccata

SEQ ID NO: 445743 - DNA, 25 bp, Mus musculus
gacacccgattctaagtgcaccata

SEQ ID NO: 445744 - DNA, 25 bp, Mus musculus
gacacccgctgaattgccacagaaa

SEQ ID NO: 445745 - DNA, 25 bp, Mus musculus
gacacccgctgatttgccacagaaa

SEQ ID NO: 445746 - DNA, 25 bp, Mus musculus
gacaccctacttagctgctaaagga

SEQ ID NO: 445747 - DNA, 25 bp, Mus musculus
gacaccctactttgctgctaaagga

SEQ ID NO: 445748 - DNA, 25 bp, Mus musculus
gacaccctatcaagacccctattat

SEQ ID NO: 445749 - DNA, 25 bp, Mus musculus
gacaccctatcatgacccctattat

SEQ ID NO: 445750 - DNA, 25 bp, Mus musculus
gacaccctcacgcatacaggagaac

SEQ ID NO: 445751 - DNA, 25 bp, Mus musculus
gacaccctcacggatacaggagaac

SEQ ID NO: 445752 - DNA, 25 bp, Mus musculus
gacaccctctgtacagcacacagga

SEQ ID NO: 445753 - DNA, 25 bp, Mus musculus
gacaccctctgttcagcacacagga

SEQ ID NO: 445754 - DNA, 25 bp, Mus musculus
gacaccctcttgacctctgagggtt

SEQ ID NO: 445755 - DNA, 25 bp, Mus musculus
gacaccctcttgtcctctgagggtt

SEQ ID NO: 445756 - DNA, 25 bp, Mus musculus
gacaccctgattctgataacccaag

SEQ ID NO: 445757 - DNA, 25 bp, Mus musculus
gacaccctgattgtgataacccaag

SEQ ID NO: 445758 - DNA, 25 bp, Mus musculus
gacaccctggaaattgagatgcgga

SEQ ID NO: 445759 - DNA, 25 bp, Mus musculus
gacaccctggaatttgagatgcgga

SEQ ID NO: 445760 - DNA, 25 bp, Mus musculus
gacaccctgtggctaattttattac

SEQ ID NO: 445761 - DNA, 25 bp, Mus musculus
gacaccctgtgggtaattttattac

SEQ ID NO: 445762 - DNA, 25 bp, Mus musculus
gacacccttagtattgttcttcgag

SEQ ID NO: 445763 - DNA, 25 bp, Mus musculus
gacacccttagttttgttcttcgag

SEQ ID NO: 445764 - DNA, 25 bp, Mus musculus
gacacccttcacctggagagtgagg

SEQ ID NO: 445765 - DNA, 25 bp, Mus musculus
gacacccttcacgtggagagtgagg

SEQ ID NO: 445766 - DNA, 25 bp, Mus musculus
gacacccttcatcggactttcttgg

SEQ ID NO: 445767 - DNA, 25 bp, Mus musculus
gacacccttcatgggactttcttgg

SEQ ID NO: 445768 - DNA, 25 bp, Mus musculus
gacacccttcccagaaggtatggtt

SEQ ID NO: 445769 - DNA, 25 bp, Mus musculus
gacacccttccctgaaggtatggtt

SEQ ID NO: 445770 - DNA, 25 bp, Mus musculus
gacacccttggaagcatcttttatc

SEQ ID NO: 445771 - DNA, 25 bp, Mus musculus
gacacccttggatgcatcttttatc

SEQ ID NO: 445772 - DNA, 25 bp, Mus musculus
gacacccttgtgcagctttgcatag

SEQ ID NO: 445773 - DNA, 25 bp, Mus musculus
gacacccttgtgcataacatctctg

SEQ ID NO: 445774 - DNA, 25 bp, Mus musculus
gacacccttgtggagctttgcatag

SEQ ID NO: 445775 - DNA, 25 bp, Mus musculus
gacacccttgtggataacatctctg

SEQ ID NO: 445776 - DNA, 25 bp, Mus musculus
gacaccgaactaagtggactccaac

SEQ ID NO: 445777 - DNA, 25 bp, Mus musculus
gacaccgaactatgtggactccaac

SEQ ID NO: 445778 - DNA, 25 bp, Mus musculus
gacaccgaatcaccatcaagaaacg

SEQ ID NO: 445779 - DNA, 25 bp, Mus musculus
gacaccgaatcagcatcaagaaacg

SEQ ID NO: 445780 - DNA, 25 bp, Mus musculus
gacaccgagttaaattctctgtttg

SEQ ID NO: 445781 - DNA, 25 bp, Mus musculus
gacaccgagttatattctctgtttg

SEQ ID NO: 445782 - DNA, 25 bp, Mus musculus
gacaccgatcggaaacagcaggccc

SEQ ID NO: 445783 - DNA, 25 bp, Mus musculus
gacaccgatcggtaacagcaggccc

SEQ ID NO: 445784 - DNA, 25 bp, Mus musculus
gacaccgctggtctgtagtaccaga

SEQ ID NO: 445785 - DNA, 25 bp, Mus musculus
gacaccgctggtgtgtagtaccaga

SEQ ID NO: 445786 - DNA, 25 bp, Mus musculus
gacaccggcatcacacatttctatt

SEQ ID NO: 445787 - DNA, 25 bp, Mus musculus
gacaccggcatctcacatttctatt

SEQ ID NO: 445788 - DNA, 25 bp, Mus musculus
gacaccggcattaccgatcgtaaaa

SEQ ID NO: 445789 - DNA, 25 bp, Mus musculus
gacaccggcatttccgatcgtaaaa

SEQ ID NO: 445790 - DNA, 25 bp, Mus musculus
gacaccggccacaggtgtgcccgag

SEQ ID NO: 445791 - DNA, 25 bp, Mus musculus
gacaccggccactggtgtgcccgag

SEQ ID NO: 445792 - DNA, 25 bp, Mus musculus
gacaccgggaagatgactgactaat

SEQ ID NO: 445793 - DNA, 25 bp, Mus musculus
gacaccgggaagttgactgactaat

SEQ ID NO: 445794 - DNA, 25 bp, Mus musculus
gacaccgggacaccttttcctctag

SEQ ID NO: 445795 - DNA, 25 bp, Mus musculus
gacaccgggacagcttttcctctag

SEQ ID NO: 445796 - DNA, 25 bp, Mus musculus
gacaccgggctgacgtcagacctgg

SEQ ID NO: 445797 - DNA, 25 bp, Mus musculus
gacaccgggctgtcgtcagacctgg

SEQ ID NO: 445798 - DNA, 25 bp, Mus musculus
gacaccggttacatctcctagccaa

SEQ ID NO: 445799 - DNA, 25 bp, Mus musculus
gacaccggttacttctcctagccaa

SEQ ID NO: 445800 - DNA, 25 bp, Mus musculus
gacaccgtacatcagtcagccgagc

SEQ ID NO: 445801 - DNA, 25 bp, Mus musculus
gacaccgtacatgagtcagccgagc

SEQ ID NO: 445802 - DNA, 25 bp, Mus musculus
gacaccgtagaacgagtccagtctg

SEQ ID NO: 445803 - DNA, 25 bp, Mus musculus
gacaccgtagaaggagtccagtctg

SEQ ID NO: 445804 - DNA, 25 bp, Mus musculus
gacaccgtatatcgtgctcagtggc

SEQ ID NO: 445805 - DNA, 25 bp, Mus musculus
gacaccgtatatggtgctcagtggc

SEQ ID NO: 445806 - DNA, 25 bp, Mus musculus
gacaccgtatctagtttacatgctt

SEQ ID NO: 445807 - DNA, 25 bp, Mus musculus
gacaccgtatcttgtttacatgctt

SEQ ID NO: 445808 - DNA, 25 bp, Mus musculus
gacaccgtcaataagtctctgtttg

SEQ ID NO: 445809 - DNA, 25 bp, Mus musculus
gacaccgtcaattagtctctgtttg

SEQ ID NO: 445810 - DNA, 25 bp, Mus musculus
gacaccgtgaccatttagcttataa

SEQ ID NO: 445811 - DNA, 25 bp, Mus musculus
gacaccgtgaccttttagcttataa

SEQ ID NO: 445812 - DNA, 25 bp, Mus musculus
gacaccgtgcagatctcgctagaca

SEQ ID NO: 445813 - DNA, 25 bp, Mus musculus
gacaccgtgcagttctcgctagaca

SEQ ID NO: 445814 - DNA, 25 bp, Mus musculus
gacaccgtggacagctgacgtctgc

SEQ ID NO: 445815 - DNA, 25 bp, Mus musculus
gacaccgtggactgctgacgtctgc

SEQ ID NO: 445816 - DNA, 25 bp, Mus musculus
gacaccgtgtacatggagtaccact

SEQ ID NO: 445817 - DNA, 25 bp, Mus musculus
gacaccgtgtacttggagtaccact

SEQ ID NO: 445818 - DNA, 25 bp, Mus musculus
gacaccgtgtcacttattttatgct

SEQ ID NO: 445819 - DNA, 25 bp, Mus musculus
gacaccgtgtcagttattttatgct

SEQ ID NO: 445820 - DNA, 25 bp, Mus musculus
gacaccgtgttgatatcactagaaa

SEQ ID NO: 445821 - DNA, 25 bp, Mus musculus
gacaccgtgttgttatcactagaaa

SEQ ID NO: 445822 - DNA, 25 bp, Mus musculus
gacaccgttaaaagcgtcgctgcct

SEQ ID NO: 445823 - DNA, 25 bp, Mus musculus
gacaccgttaaatgcgtcgctgcct

SEQ ID NO: 445824 - DNA, 25 bp, Mus musculus
gacaccgtttacatcaggagcctgt

SEQ ID NO: 445825 - DNA, 25 bp, Mus musculus
gacaccgtttacttcaggagcctgt

SEQ ID NO: 445826 - DNA, 25 bp, Mus musculus
gacaccgtttccaacggcactaatg

SEQ ID NO: 445827 - DNA, 25 bp, Mus musculus
gacaccgtttcctacggcactaatg

SEQ ID NO: 445828 - DNA, 25 bp, Mus musculus
gacacctaaatgatcatgacttgag

SEQ ID NO: 445829 - DNA, 25 bp, Mus musculus
gacacctaaatgttcatgacttgag

SEQ ID NO: 445830 - DNA, 25 bp, Mus musculus
gacacctaacacacgatatgtggca

SEQ ID NO: 445831 - DNA, 25 bp, Mus musculus
gacacctaacactcgatatgtggca

SEQ ID NO: 445832 - DNA, 25 bp, Mus musculus
gacacctaatatatacggtctttgt

SEQ ID NO: 445833 - DNA, 25 bp, Mus musculus
gacacctaatatttacggtctttgt

SEQ ID NO: 445834 - DNA, 25 bp, Mus musculus
gacacctaatgccaccctgtgtgta

SEQ ID NO: 445835 - DNA, 25 bp, Mus musculus
gacacctaatgcgaccctgtgtgta

SEQ ID NO: 445836 - DNA, 25 bp, Mus musculus
gacacctaccggcatgacatcgatt

SEQ ID NO: 445837 - DNA, 25 bp, Mus musculus
gacacctaccgggatgacatcgatt

SEQ ID NO: 445838 - DNA, 25 bp, Mus musculus
gacacctacgtgctctttggcgagg

SEQ ID NO: 445839 - DNA, 25 bp, Mus musculus
gacacctacgtggtctttggcgagg

SEQ ID NO: 445840 - DNA, 25 bp, Mus musculus
gacacctactggcagcttcgaaagg

SEQ ID NO: 445841 - DNA, 25 bp, Mus musculus
gacacctactgggagcttcgaaagg

SEQ ID NO: 445842 - DNA, 25 bp, Mus musculus
gacacctagaatatcctccgtaaaa

SEQ ID NO: 445843 - DNA, 25 bp, Mus musculus
gacacctagaatttcctccgtaaaa

SEQ ID NO: 445844 - DNA, 25 bp, Mus musculus
gacacctagatgaggttcagctact

SEQ ID NO: 445845 - DNA, 25 bp, Mus musculus
gacacctagatgtggttcagctact

SEQ ID NO: 445846 - DNA, 25 bp, Mus musculus
gacacctagcaacagcaggttccat

SEQ ID NO: 445847 - DNA, 25 bp, Mus musculus
gacacctagcaagagcaggttccat

SEQ ID NO: 445848 - DNA, 25 bp, Mus musculus
gacacctaggtgactggcgaaggtt

SEQ ID NO: 445849 - DNA, 25 bp, Mus musculus
gacacctaggtgtctggcgaaggtt

SEQ ID NO: 445850 - DNA, 25 bp, Mus musculus
gacacctagtcacctctttggagaa

SEQ ID NO: 445851 - DNA, 25 bp, Mus musculus
gacacctagtcagctctttggagaa

SEQ ID NO: 445852 - DNA, 25 bp, Mus musculus
gacacctatagacatgcctcctcaa

SEQ ID NO: 445853 - DNA, 25 bp, Mus musculus
gacacctatagagatgcctcctcaa

SEQ ID NO: 445854 - DNA, 25 bp, Mus musculus
gacacctatgtgcaggtggttccag

SEQ ID NO: 445855 - DNA, 25 bp, Mus musculus
gacacctatgtggaggtggttccag

SEQ ID NO: 445856 - DNA, 25 bp, Mus musculus
gacacctattcaaattatactgtaa

SEQ ID NO: 445857 - DNA, 25 bp, Mus musculus
gacacctattcacttcagtcacagt

SEQ ID NO: 445858 - DNA, 25 bp, Mus musculus
gacacctattcagttcagtcacagt

SEQ ID NO: 445859 - DNA, 25 bp, Mus musculus
gacacctattcatattatactgtaa

SEQ ID NO: 445860 - DNA, 25 bp, Mus musculus
gacacctcaagaagacctacagact

SEQ ID NO: 445861 - DNA, 25 bp, Mus musculus
gacacctcaagatgacctacagact

SEQ ID NO: 445862 - DNA, 25 bp, Mus musculus
gacacctcagacaggaagtccacca

SEQ ID NO: 445863 - DNA, 25 bp, Mus musculus
gacacctcagactggaagtccacca

SEQ ID NO: 445864 - DNA, 25 bp, Mus musculus
gacacctcagtgaagttattgttat

SEQ ID NO: 445865 - DNA, 25 bp, Mus musculus
gacacctcagtgtagttattgttat

SEQ ID NO: 445866 - DNA, 25 bp, Mus musculus
gacacctcagttagccaagtagagt

SEQ ID NO: 445867 - DNA, 25 bp, Mus musculus
gacacctcagtttgccaagtagagt

SEQ ID NO: 445868 - DNA, 25 bp, Mus musculus
gacacctcatttctctcaaatcctt

SEQ ID NO: 445869 - DNA, 25 bp, Mus musculus
gacacctcatttgtctcaaatcctt

SEQ ID NO: 445870 - DNA, 25 bp, Mus musculus
gacacctccaatattgatgaaccag

SEQ ID NO: 445871 - DNA, 25 bp, Mus musculus
gacacctccaattttgatgaaccag

SEQ ID NO: 445872 - DNA, 25 bp, Mus musculus
gacacctccagaattccatatttta

SEQ ID NO: 445873 - DNA, 25 bp, Mus musculus
gacacctccagatttccatatttta

SEQ ID NO: 445874 - DNA, 25 bp, Mus musculus
gacacctccagcattctaagacagg

SEQ ID NO: 445875 - DNA, 25 bp, Mus musculus
gacacctccagctttctaagacagg

SEQ ID NO: 445876 - DNA, 25 bp, Mus musculus
gacacctcccagagtagtgtgtttt

SEQ ID NO: 445877 - DNA, 25 bp, Mus musculus
gacacctcccagtgtagtgtgtttt

SEQ ID NO: 445878 - DNA, 25 bp, Mus musculus
gacacctcccatatcaaattcattg

SEQ ID NO: 445879 - DNA, 25 bp, Mus musculus
gacacctcccatttcaaattcattg

SEQ ID NO: 445880 - DNA, 25 bp, Mus musculus
gacacctcctagacctattgtgaga

SEQ ID NO: 445881 - DNA, 25 bp, Mus musculus
gacacctcctagtcctattgtgaga

SEQ ID NO: 445882 - DNA, 25 bp, Mus musculus
gacacctcctttatgtagaaagcca

SEQ ID NO: 445883 - DNA, 25 bp, Mus musculus
gacacctcctttttgtagaaagcca

SEQ ID NO: 445884 - DNA, 25 bp, Mus musculus
gacacctctactatgcaattggaga

SEQ ID NO: 445885 - DNA, 25 bp, Mus musculus
gacacctctactttgcaattggaga

SEQ ID NO: 445886 - DNA, 25 bp, Mus musculus
gacacctctgagaatgttcctcaca

SEQ ID NO: 445887 - DNA, 25 bp, Mus musculus
gacacctctgagtatgttcctcaca

SEQ ID NO: 445888 - DNA, 25 bp, Mus musculus
gacacctctgcccaagctatgaaag

SEQ ID NO: 445889 - DNA, 25 bp, Mus musculus
gacacctctgccgaagctatgaaag

SEQ ID NO: 445890 - DNA, 25 bp, Mus musculus
gacacctctgctccaccttggaaag

SEQ ID NO: 445891 - DNA, 25 bp, Mus musculus
gacacctctgctgcaccttggaaag

SEQ ID NO: 445892 - DNA, 25 bp, Mus musculus
gacacctctgtaattttgaagctct

SEQ ID NO: 445893 - DNA, 25 bp, Mus musculus
gacacctctgtatttttgaagctct

SEQ ID NO: 445894 - DNA, 25 bp, Mus musculus
gacacctctgtcattgatgagcagg

SEQ ID NO: 445895 - DNA, 25 bp, Mus musculus
gacacctctgtctttgatgagcagg

SEQ ID NO: 445896 - DNA, 25 bp, Mus musculus
gacacctgaacacctggcaataaag

SEQ ID NO: 445897 - DNA, 25 bp, Mus musculus
gacacctgaacagctggcaataaag

SEQ ID NO: 445898 - DNA, 25 bp, Mus musculus
gacacctgaagaatggcccagctct

SEQ ID NO: 445899 - DNA, 25 bp, Mus musculus
gacacctgaagattggcccagctct

SEQ ID NO: 445900 - DNA, 25 bp, Mus musculus
gacacctgacatccagcaagcattg

SEQ ID NO: 445901 - DNA, 25 bp, Mus musculus
gacacctgacatgcagcaagcattg

SEQ ID NO: 445902 - DNA, 25 bp, Mus musculus
gacacctgactgcaaatatcttttc

SEQ ID NO: 445903 - DNA, 25 bp, Mus musculus
gacacctgactggaaatatcttttc

SEQ ID NO: 445904 - DNA, 25 bp, Mus musculus
gacacctgaggtagcaaacttggcc

SEQ ID NO: 445905 - DNA, 25 bp, Mus musculus
gacacctgaggtagctagtagccca

SEQ ID NO: 445906 - DNA, 25 bp, Mus musculus
gacacctgaggttgcaaacttggcc

SEQ ID NO: 445907 - DNA, 25 bp, Mus musculus
gacacctgaggttgctagtagccca

SEQ ID NO: 445908 - DNA, 25 bp, Mus musculus
gacacctgatatcaacctctgtggg

SEQ ID NO: 445909 - DNA, 25 bp, Mus musculus
gacacctgatatgaacctctgtggg

SEQ ID NO: 445910 - DNA, 25 bp, Mus musculus
gacacctgatgcacttattttttaa

SEQ ID NO: 445911 - DNA, 25 bp, Mus musculus
gacacctgatgctcttattttttaa

SEQ ID NO: 445912 - DNA, 25 bp, Mus musculus
gacacctgcaacacctgcgaggctg

SEQ ID NO: 445913 - DNA, 25 bp, Mus musculus
gacacctgcaactcctgcgaggctg

SEQ ID NO: 445914 - DNA, 25 bp, Mus musculus
gacacctgcactcgggctgaaacat

SEQ ID NO: 445915 - DNA, 25 bp, Mus musculus
gacacctgcactggggctgaaacat

SEQ ID NO: 445916 - DNA, 25 bp, Mus musculus
gacacctgctagcagcctgctggag

SEQ ID NO: 445917 - DNA, 25 bp, Mus musculus
gacacctgctaggagcctgctggag

SEQ ID NO: 445918 - DNA, 25 bp, Mus musculus
gacacctgctcacaccttaaagtat

SEQ ID NO: 445919 - DNA, 25 bp, Mus musculus
gacacctgctcagaccttaaagtat

SEQ ID NO: 445920 - DNA, 25 bp, Mus musculus
gacacctgctgccaagctttcaacc

SEQ ID NO: 445921 - DNA, 25 bp, Mus musculus
gacacctgctgcgaagctttcaacc

SEQ ID NO: 445922 - DNA, 25 bp, Mus musculus
gacacctggattacagtcttggttt

SEQ ID NO: 445923 - DNA, 25 bp, Mus musculus
gacacctggatttcagtcttggttt

SEQ ID NO: 445924 - DNA, 25 bp, Mus musculus
gacacctggcggacggtcagaagcc

SEQ ID NO: 445925 - DNA, 25 bp, Mus musculus
gacacctggcggtcggtcagaagcc

SEQ ID NO: 445926 - DNA, 25 bp, Mus musculus
gacacctgtactaagcaaaccaatt

SEQ ID NO: 445927 - DNA, 25 bp, Mus musculus
gacacctgtacttagcaaaccaatt

SEQ ID NO: 445928 - DNA, 25 bp, Mus musculus
gacacctgtattaaatgacacctgc

SEQ ID NO: 445929 - DNA, 25 bp, Mus musculus
gacacctgtatttaatgacacctgc

SEQ ID NO: 445930 - DNA, 25 bp, Mus musculus
gacacctgtcaaagctctgcaaagc

SEQ ID NO: 445931 - DNA, 25 bp, Mus musculus
gacacctgtcaatgctctgcaaagc

SEQ ID NO: 445932 - DNA, 25 bp, Mus musculus
gacacctgtcgaagtgatcacatgg

SEQ ID NO: 445933 - DNA, 25 bp, Mus musculus
gacacctgtcgatgtgatcacatgg

SEQ ID NO: 445934 - DNA, 25 bp, Mus musculus
gacacctgtctgctcagtttggagt

SEQ ID NO: 445935 - DNA, 25 bp, Mus musculus
gacacctgtctggtcagtttggagt

SEQ ID NO: 445936 - DNA, 25 bp, Mus musculus
gacacctgtggtcaccggaaccgga

SEQ ID NO: 445937 - DNA, 25 bp, Mus musculus
gacacctgtggtgaccggaaccgga

SEQ ID NO: 445938 - DNA, 25 bp, Mus musculus
gacacctgtgttcatttaaattttg

SEQ ID NO: 445939 - DNA, 25 bp, Mus musculus
gacacctgtgttcccctataatcaa

SEQ ID NO: 445940 - DNA, 25 bp, Mus musculus
gacacctgtgttgatttaaattttg

SEQ ID NO: 445941 - DNA, 25 bp, Mus musculus
gacacctgtgttgccctataatcaa

SEQ ID NO: 445942 - DNA, 25 bp, Mus musculus
gacacctgttgtaattgcctcataa

SEQ ID NO: 445943 - DNA, 25 bp, Mus musculus
gacacctgttgttattgcctcataa

SEQ ID NO: 445944 - DNA, 25 bp, Mus musculus
gacaccttaataagcttgataactc

SEQ ID NO: 445945 - DNA, 25 bp, Mus musculus
gacaccttaatatgcttgataactc

SEQ ID NO: 445946 - DNA, 25 bp, Mus musculus
gacaccttacaactgaccgcagtga

SEQ ID NO: 445947 - DNA, 25 bp, Mus musculus
gacaccttacaagtgaccgcagtga

SEQ ID NO: 445948 - DNA, 25 bp, Mus musculus
gacaccttaggtcccattcctgggt

SEQ ID NO: 445949 - DNA, 25 bp, Mus musculus
gacaccttaggtgccattcctgggt

SEQ ID NO: 445950 - DNA, 25 bp, Mus musculus
gacaccttattgaaccttactatga

SEQ ID NO: 445951 - DNA, 25 bp, Mus musculus
gacaccttattgtaccttactatga

SEQ ID NO: 445952 - DNA, 25 bp, Mus musculus
gacaccttcaaactcatttattccc

SEQ ID NO: 445953 - DNA, 25 bp, Mus musculus
gacaccttcaaagtcatttattccc

SEQ ID NO: 445954 - DNA, 25 bp, Mus musculus
gacaccttcaagatgttctgtgaca

SEQ ID NO: 445955 - DNA, 25 bp, Mus musculus
gacaccttcaagttgttctgtgaca

SEQ ID NO: 445956 - DNA, 25 bp, Mus musculus
gacaccttcagaatgtaagctttga

SEQ ID NO: 445957 - DNA, 25 bp, Mus musculus
gacaccttcagaattcagcgctggc

SEQ ID NO: 445958 - DNA, 25 bp, Mus musculus
gacaccttcagattgtaagctttga

SEQ ID NO: 445959 - DNA, 25 bp, Mus musculus
gacaccttcagatttcagcgctggc

SEQ ID NO: 445960 - DNA, 25 bp, Mus musculus
gacaccttcagcacggtgatcagac

SEQ ID NO: 445961 - DNA, 25 bp, Mus musculus
gacaccttcagctcggtgatcagac

SEQ ID NO: 445962 - DNA, 25 bp, Mus musculus
gacaccttcaggaactgctgtgcag

SEQ ID NO: 445963 - DNA, 25 bp, Mus musculus
gacaccttcaggtactgctgtgcag

SEQ ID NO: 445964 - DNA, 25 bp, Mus musculus
gacaccttcatcaaaacatcttcaa

SEQ ID NO: 445965 - DNA, 25 bp, Mus musculus
gacaccttcatctaaacatcttcaa

SEQ ID NO: 445966 - DNA, 25 bp, Mus musculus
gacaccttccatcaatactctagga

SEQ ID NO: 445967 - DNA, 25 bp, Mus musculus
gacaccttccatgaatactctagga

SEQ ID NO: 445968 - DNA, 25 bp, Mus musculus
gacaccttccctattagagcaggag

SEQ ID NO: 445969 - DNA, 25 bp, Mus musculus
gacaccttcccttttagagcaggag

SEQ ID NO: 445970 - DNA, 25 bp, Mus musculus
gacaccttcgtgcacctgcagaagg

SEQ ID NO: 445971 - DNA, 25 bp, Mus musculus
gacaccttcgtggacctgcagaagg

SEQ ID NO: 445972 - DNA, 25 bp, Mus musculus
gacaccttctacctgagcaacgtag

SEQ ID NO: 445973 - DNA, 25 bp, Mus musculus
gacaccttctacgtgagcaacgtag

SEQ ID NO: 445974 - DNA, 25 bp, Mus musculus
gacaccttctcacgtcacttttgaa

SEQ ID NO: 445975 - DNA, 25 bp, Mus musculus
gacaccttctcaggtcacttttgaa

SEQ ID NO: 445976 - DNA, 25 bp, Mus musculus
gacaccttgaaacatctaacactag

SEQ ID NO: 445977 - DNA, 25 bp, Mus musculus
gacaccttgaaagatctaacactag

SEQ ID NO: 445978 - DNA, 25 bp, Mus musculus
gacaccttgcagaaacctgtatgct

SEQ ID NO: 445979 - DNA, 25 bp, Mus musculus
gacaccttgcagtaacctgtatgct

SEQ ID NO: 445980 - DNA, 25 bp, Mus musculus
gacaccttgcatattgttgccagaa

SEQ ID NO: 445981 - DNA, 25 bp, Mus musculus
gacaccttgcattttgttgccagaa

SEQ ID NO: 445982 - DNA, 25 bp, Mus musculus
gacaccttggaactttcattcggaa

SEQ ID NO: 445983 - DNA, 25 bp, Mus musculus
gacaccttggaagtttcattcggaa

SEQ ID NO: 445984 - DNA, 25 bp, Mus musculus
gacaccttggagatatcctatggta

SEQ ID NO: 445985 - DNA, 25 bp, Mus musculus
gacaccttggagttatcctatggta

SEQ ID NO: 445986 - DNA, 25 bp, Mus musculus
gacaccttgggaaccatgagagcct

SEQ ID NO: 445987 - DNA, 25 bp, Mus musculus
gacaccttgggatccatgagagcct

SEQ ID NO: 445988 - DNA, 25 bp, Mus musculus
gacaccttggtgctccgtgatttct

SEQ ID NO: 445989 - DNA, 25 bp, Mus musculus
gacaccttggtggtccgtgatttct

SEQ ID NO: 445990 - DNA, 25 bp, Mus musculus
gacaccttgtataaagtgcactgac

SEQ ID NO: 445991 - DNA, 25 bp, Mus musculus
gacaccttgtattaagtgcactgac

SEQ ID NO: 445992 - DNA, 25 bp, Mus musculus
gacacctttactcacatgcacatat

SEQ ID NO: 445993 - DNA, 25 bp, Mus musculus
gacacctttactgacatgcacatat

SEQ ID NO: 445994 - DNA, 25 bp, Mus musculus
gacacctttattaatgttccgtggt

SEQ ID NO: 445995 - DNA, 25 bp, Mus musculus
gacacctttatttatgttccgtggt

SEQ ID NO: 445996 - DNA, 25 bp, Mus musculus
gacacctttccacccagggtaataa

SEQ ID NO: 445997 - DNA, 25 bp, Mus musculus
gacacctttccagccagggtaataa

SEQ ID NO: 445998 - DNA, 25 bp, Mus musculus
gacacctttctaatataccctgttg

SEQ ID NO: 445999 - DNA, 25 bp, Mus musculus
gacacctttctactagctataccac

SEQ ID NO: 446000 - DNA, 25 bp, Mus musculus
gacacctttctagtagctataccac

SEQ ID NO: 446001 - DNA, 25 bp, Mus musculus
gacacctttctattataccctgttg

SEQ ID NO: 446002 - DNA, 25 bp, Mus musculus
gacacctttcttaatgcaactcttc

SEQ ID NO: 446003 - DNA, 25 bp, Mus musculus
gacacctttctttatgcaactcttc

SEQ ID NO: 446004 - DNA, 25 bp, Mus musculus
gacacctttgaaatagacctgctgg

SEQ ID NO: 446005 - DNA, 25 bp, Mus musculus
gacacctttgaattagacctgctgg

SEQ ID NO: 446006 - DNA, 25 bp, Mus musculus
gacacctttgccatattccttattt

SEQ ID NO: 446007 - DNA, 25 bp, Mus musculus
gacacctttgccttattccttattt

SEQ ID NO: 446008 - DNA, 25 bp, Mus musculus
gacaccttttacctattgaactcca

SEQ ID NO: 446009 - DNA, 25 bp, Mus musculus
gacaccttttacgtattgaactcca

SEQ ID NO: 446010 - DNA, 25 bp, Mus musculus
gacaccttttatcgagattctgaac

SEQ ID NO: 446011 - DNA, 25 bp, Mus musculus
gacaccttttatggagattctgaac

SEQ ID NO: 446012 - DNA, 25 bp, Mus musculus
gacaccttttgaaaacacctgggaa

SEQ ID NO: 446013 - DNA, 25 bp, Mus musculus
gacaccttttgataacacctgggaa

SEQ ID NO: 446014 - DNA, 25 bp, Mus musculus
gacacctttttcagaaatgccccag

SEQ ID NO: 446015 - DNA, 25 bp, Mus musculus
gacacctttttctgaaatgccccag

SEQ ID NO: 446016 - DNA, 25 bp, Mus musculus
gacacgaaaccaactcaggtacctg

SEQ ID NO: 446017 - DNA, 25 bp, Mus musculus
gacacgaaaccatctcaggtacctg

SEQ ID NO: 446018 - DNA, 25 bp, Mus musculus
gacacgacagtgagacagacacatt

SEQ ID NO: 446019 - DNA, 25 bp, Mus musculus
gacacgacagtgtgacagacacatt

SEQ ID NO: 446020 - DNA, 25 bp, Mus musculus
gacacgaccagcagattgtagacac

SEQ ID NO: 446021 - DNA, 25 bp, Mus musculus
gacacgaccagctgattgtagacac

SEQ ID NO: 446022 - DNA, 25 bp, Mus musculus
gacacgacttacactttgagatcca

SEQ ID NO: 446023 - DNA, 25 bp, Mus musculus
gacacgacttactctttgagatcca

SEQ ID NO: 446024 - DNA, 25 bp, Mus musculus
gacacgagaggtcccctttgctgac

SEQ ID NO: 446025 - DNA, 25 bp, Mus musculus
gacacgagaggtgccctttgctgac

SEQ ID NO: 446026 - DNA, 25 bp, Mus musculus
gacacgaggggaaacttttgtgact

SEQ ID NO: 446027 - DNA, 25 bp, Mus musculus
gacacgaggggatacttttgtgact

SEQ ID NO: 446028 - DNA, 25 bp, Mus musculus
gacacgagggtcagaaaaattacta

SEQ ID NO: 446029 - DNA, 25 bp, Mus musculus
gacacgagggtctgaaaaattacta

SEQ ID NO: 446030 - DNA, 25 bp, Mus musculus
gacacgatatttcctattcctaggt

SEQ ID NO: 446031 - DNA, 25 bp, Mus musculus
gacacgatatttgctattcctaggt

SEQ ID NO: 446032 - DNA, 25 bp, Mus musculus
gacacgatccgtcgacagtcttcac

SEQ ID NO: 446033 - DNA, 25 bp, Mus musculus
gacacgatccgtggacagtcttcac

SEQ ID NO: 446034 - DNA, 25 bp, Mus musculus
gacacgatgaggaacctcctctcta

SEQ ID NO: 446035 - DNA, 25 bp, Mus musculus
gacacgatgaggtacctcctctcta

SEQ ID NO: 446036 - DNA, 25 bp, Mus musculus
gacacgcagagcagaaggccgcaat

SEQ ID NO: 446037 - DNA, 25 bp, Mus musculus
gacacgcagagctgaaggccgcaat

SEQ ID NO: 446038 - DNA, 25 bp, Mus musculus
gacacgcagagtctacctacttaga

SEQ ID NO: 446039 - DNA, 25 bp, Mus musculus
gacacgcagagtgtacctacttaga

SEQ ID NO: 446040 - DNA, 25 bp, Mus musculus
gacacgcagattcatagctccgatt

SEQ ID NO: 446041 - DNA, 25 bp, Mus musculus
gacacgcagattgatagctccgatt

SEQ ID NO: 446042 - DNA, 25 bp, Mus musculus
gacacgcagcgtattaggtcggtgc

SEQ ID NO: 446043 - DNA, 25 bp, Mus musculus
gacacgcagcgttttaggtcggtgc

SEQ ID NO: 446044 - DNA, 25 bp, Mus musculus
gacacgcagtcgagatctttcttga

SEQ ID NO: 446045 - DNA, 25 bp, Mus musculus
gacacgcagtcgtgatctttcttga

SEQ ID NO: 446046 - DNA, 25 bp, Mus musculus
gacacgcattgacgtctccctaaga

SEQ ID NO: 446047 - DNA, 25 bp, Mus musculus
gacacgcattgaggtctccctaaga

SEQ ID NO: 446048 - DNA, 25 bp, Mus musculus
gacacgcatttgaaattaagcacac

SEQ ID NO: 446049 - DNA, 25 bp, Mus musculus
gacacgcatttgtaattaagcacac

SEQ ID NO: 446050 - DNA, 25 bp, Mus musculus
gacacgccccaactgtacagagaga

SEQ ID NO: 446051 - DNA, 25 bp, Mus musculus
gacacgccccaagtgtacagagaga

SEQ ID NO: 446052 - DNA, 25 bp, Mus musculus
gacacgcccgtccttggactttctg

SEQ ID NO: 446053 - DNA, 25 bp, Mus musculus
gacacgcccgtcgttggactttctg

SEQ ID NO: 446054 - DNA, 25 bp, Mus musculus
gacacgcgcgtcatcttgcaagtga

SEQ ID NO: 446055 - DNA, 25 bp, Mus musculus
gacacgcgcgtcttcttgcaagtga

SEQ ID NO: 446056 - DNA, 25 bp, Mus musculus
gacacgctatgacatcgacatgacc

SEQ ID NO: 446057 - DNA, 25 bp, Mus musculus
gacacgctatgagatcgacatgacc

SEQ ID NO: 446058 - DNA, 25 bp, Mus musculus
gacacgctcagcaatcagatacaat

SEQ ID NO: 446059 - DNA, 25 bp, Mus musculus
gacacgctcagctatcagatacaat

SEQ ID NO: 446060 - DNA, 25 bp, Mus musculus
gacacgctctctcagggaaactttg

SEQ ID NO: 446061 - DNA, 25 bp, Mus musculus
gacacgctctctgagggaaactttg

SEQ ID NO: 446062 - DNA, 25 bp, Mus musculus
gacacgctgcagatgccgccgatga

SEQ ID NO: 446063 - DNA, 25 bp, Mus musculus
gacacgctgcagttgccgccgatga

SEQ ID NO: 446064 - DNA, 25 bp, Mus musculus
gacacgctgcctactatggactaga

SEQ ID NO: 446065 - DNA, 25 bp, Mus musculus
gacacgctgccttctatggactaga

SEQ ID NO: 446066 - DNA, 25 bp, Mus musculus
gacacgcttcgacgcagagacaaat

SEQ ID NO: 446067 - DNA, 25 bp, Mus musculus
gacacgcttcgaggcagagacaaat

SEQ ID NO: 446068 - DNA, 25 bp, Mus musculus
gacacgcttgcgatgtacttgtatg

SEQ ID NO: 446069 - DNA, 25 bp, Mus musculus
gacacgcttgcgttgtacttgtatg

SEQ ID NO: 446070 - DNA, 25 bp, Mus musculus
gacacggaatagaacacatgtgact

SEQ ID NO: 446071 - DNA, 25 bp, Mus musculus
gacacggaatagtacacatgtgact

SEQ ID NO: 446072 - DNA, 25 bp, Mus musculus
gacacggacatcatcttcatttact

SEQ ID NO: 446073 - DNA, 25 bp, Mus musculus
gacacggacatcttcttcatttact

SEQ ID NO: 446074 - DNA, 25 bp, Mus musculus
gacacggacctcagccgtgaggaca

SEQ ID NO: 446075 - DNA, 25 bp, Mus musculus
gacacggacctctgccgtgaggaca

SEQ ID NO: 446076 - DNA, 25 bp, Mus musculus
gacacggactatcagcgctacacca

SEQ ID NO: 446077 - DNA, 25 bp, Mus musculus
gacacggactatgagcgctacacca

SEQ ID NO: 446078 - DNA, 25 bp, Mus musculus
gacacggagatcatgacgctggtag

SEQ ID NO: 446079 - DNA, 25 bp, Mus musculus
gacacggagatcttgacgctggtag

SEQ ID NO: 446080 - DNA, 25 bp, Mus musculus
gacacggatgttactggctacttaa

SEQ ID NO: 446081 - DNA, 25 bp, Mus musculus
gacacggatgtttctggctacttaa

SEQ ID NO: 446082 - DNA, 25 bp, Mus musculus
gacacggattttacgtcccaacagt

SEQ ID NO: 446083 - DNA, 25 bp, Mus musculus
gacacggatttttcgtcccaacagt

SEQ ID NO: 446084 - DNA, 25 bp, Mus musculus
gacacggcagatccttaagcagcac

SEQ ID NO: 446085 - DNA, 25 bp, Mus musculus
gacacggcagatgcttaagcagcac

SEQ ID NO: 446086 - DNA, 25 bp, Mus musculus
gacacggccttgagattcttcagga

SEQ ID NO: 446087 - DNA, 25 bp, Mus musculus
gacacggccttgtgattcttcagga

SEQ ID NO: 446088 - DNA, 25 bp, Mus musculus
gacacggcgaggacttggcctgcct

SEQ ID NO: 446089 - DNA, 25 bp, Mus musculus
gacacggcgaggtcttggcctgcct

SEQ ID NO: 446090 - DNA, 25 bp, Mus musculus
gacacggctacaaaatttcccagga

SEQ ID NO: 446091 - DNA, 25 bp, Mus musculus
gacacggctacataatttcccagga

SEQ ID NO: 446092 - DNA, 25 bp, Mus musculus
gacacggctgcacatttccaagtaa

SEQ ID NO: 446093 - DNA, 25 bp, Mus musculus
gacacggctgcagatttccaagtaa

SEQ ID NO: 446094 - DNA, 25 bp, Mus musculus
gacacggcttctcaggcaggcacac

SEQ ID NO: 446095 - DNA, 25 bp, Mus musculus
gacacggcttctgaggcaggcacac

SEQ ID NO: 446096 - DNA, 25 bp, Mus musculus
gacacgggaacacaactccaggtat

SEQ ID NO: 446097 - DNA, 25 bp, Mus musculus
gacacgggaacagaactccaggtat

SEQ ID NO: 446098 - DNA, 25 bp, Mus musculus
gacacgggaagaagatctctgggaa

SEQ ID NO: 446099 - DNA, 25 bp, Mus musculus
gacacgggaagatgatctctgggaa

SEQ ID NO: 446100 - DNA, 25 bp, Mus musculus
gacacgggacacagaagcatcactt

SEQ ID NO: 446101 - DNA, 25 bp, Mus musculus
gacacgggacactgaagcatcactt

SEQ ID NO: 446102 - DNA, 25 bp, Mus musculus
gacacgggtcagaacctaatacaga

SEQ ID NO: 446103 - DNA, 25 bp, Mus musculus
gacacgggtcagtacctaatacaga

SEQ ID NO: 446104 - DNA, 25 bp, Mus musculus
gacacggtaaacactgcaatgtgta

SEQ ID NO: 446105 - DNA, 25 bp, Mus musculus
gacacggtaaactctgcaatgtgta

SEQ ID NO: 446106 - DNA, 25 bp, Mus musculus
gacacggtacaaccatcaggccaat

SEQ ID NO: 446107 - DNA, 25 bp, Mus musculus
gacacggtacaagcatcaggccaat

SEQ ID NO: 446108 - DNA, 25 bp, Mus musculus
gacacggtcacccacagggttgaga

SEQ ID NO: 446109 - DNA, 25 bp, Mus musculus
gacacggtcaccgacagggttgaga

SEQ ID NO: 446110 - DNA, 25 bp, Mus musculus
gacacggtctctcatggtagaaatg

SEQ ID NO: 446111 - DNA, 25 bp, Mus musculus
gacacggtctctgatggtagaaatg

SEQ ID NO: 446112 - DNA, 25 bp, Mus musculus
gacacggtgactactgagatgacta

SEQ ID NO: 446113 - DNA, 25 bp, Mus musculus
gacacggtgacttctgagatgacta

SEQ ID NO: 446114 - DNA, 25 bp, Mus musculus
gacacggtgttgaagagtgcatcct

SEQ ID NO: 446115 - DNA, 25 bp, Mus musculus
gacacggtgttgtagagtgcatcct

SEQ ID NO: 446116 - DNA, 25 bp, Mus musculus
gacacggttcagcaggagacacccc

SEQ ID NO: 446117 - DNA, 25 bp, Mus musculus
gacacggttcaggaggagacacccc

SEQ ID NO: 446118 - DNA, 25 bp, Mus musculus
gacacggtttaaattgaaatccttg

SEQ ID NO: 446119 - DNA, 25 bp, Mus musculus
gacacggtttaatttgaaatccttg

SEQ ID NO: 446120 - DNA, 25 bp, Mus musculus
gacacgtacttcaagagtgcaccca

SEQ ID NO: 446121 - DNA, 25 bp, Mus musculus
gacacgtacttctagagtgcaccca

SEQ ID NO: 446122 - DNA, 25 bp, Mus musculus
gacacgtagtccaaaatatactcaa

SEQ ID NO: 446123 - DNA, 25 bp, Mus musculus
gacacgtagtcctaaatatactcaa

SEQ ID NO: 446124 - DNA, 25 bp, Mus musculus
gacacgtcaaaaaatcttcttaaaa

SEQ ID NO: 446125 - DNA, 25 bp, Mus musculus
gacacgtcaaaatatcttcttaaaa

SEQ ID NO: 446126 - DNA, 25 bp, Mus musculus
gacacgtcacagaatagtcccttgt

SEQ ID NO: 446127 - DNA, 25 bp, Mus musculus
gacacgtcacagtatagtcccttgt

SEQ ID NO: 446128 - DNA, 25 bp, Mus musculus
gacacgtcaccaaaagtatttaagc

SEQ ID NO: 446129 - DNA, 25 bp, Mus musculus
gacacgtcaccataagtatttaagc

SEQ ID NO: 446130 - DNA, 25 bp, Mus musculus
gacacgtcagtcaacgcgggcagtt

SEQ ID NO: 446131 - DNA, 25 bp, Mus musculus
gacacgtcagtctacgcgggcagtt

SEQ ID NO: 446132 - DNA, 25 bp, Mus musculus
gacacgtccctaagttattgacccg

SEQ ID NO: 446133 - DNA, 25 bp, Mus musculus
gacacgtccctatgttattgacccg

SEQ ID NO: 446134 - DNA, 25 bp, Mus musculus
gacacgtcgaaaagccaagtggctg

SEQ ID NO: 446135 - DNA, 25 bp, Mus musculus
gacacgtcgaaatgccaagtggctg

SEQ ID NO: 446136 - DNA, 25 bp, Mus musculus
gacacgtcggtacctttgaacctga

SEQ ID NO: 446137 - DNA, 25 bp, Mus musculus
gacacgtcggtagctttgaacctga

SEQ ID NO: 446138 - DNA, 25 bp, Mus musculus
gacacgtctatacacaggccatcag

SEQ ID NO: 446139 - DNA, 25 bp, Mus musculus
gacacgtctatagacaggccatcag

SEQ ID NO: 446140 - DNA, 25 bp, Mus musculus
gacacgtctttactgccagaactct

SEQ ID NO: 446141 - DNA, 25 bp, Mus musculus
gacacgtctttagtgccagaactct

SEQ ID NO: 446142 - DNA, 25 bp, Mus musculus
gacacgtgcattaaatggtcacttt

SEQ ID NO: 446143 - DNA, 25 bp, Mus musculus
gacacgtgcatttaatggtcacttt

SEQ ID NO: 446144 - DNA, 25 bp, Mus musculus
gacacgtgcttcagcgagttcagct

SEQ ID NO: 446145 - DNA, 25 bp, Mus musculus
gacacgtgcttctgcgagttcagct

SEQ ID NO: 446146 - DNA, 25 bp, Mus musculus
gacacgtggaagactgtgctctctt

SEQ ID NO: 446147 - DNA, 25 bp, Mus musculus
gacacgtggaagtctgtgctctctt

SEQ ID NO: 446148 - DNA, 25 bp, Mus musculus
gacacgtggtagatattgtggcttt

SEQ ID NO: 446149 - DNA, 25 bp, Mus musculus
gacacgtggtagttattgtggcttt

SEQ ID NO: 446150 - DNA, 25 bp, Mus musculus
gacacgtggtgaatgcaagactctg

SEQ ID NO: 446151 - DNA, 25 bp, Mus musculus
gacacgtggtgattgcaagactctg

SEQ ID NO: 446152 - DNA, 25 bp, Mus musculus
gacacgtgtgatcggcttttgtcca

SEQ ID NO: 446153 - DNA, 25 bp, Mus musculus
gacacgtgtgatgggcttttgtcca

SEQ ID NO: 446154 - DNA, 25 bp, Mus musculus
gacacgtgtggcaggaagatccttt

SEQ ID NO: 446155 - DNA, 25 bp, Mus musculus
gacacgtgtggctggaagatccttt

SEQ ID NO: 446156 - DNA, 25 bp, Mus musculus
gacacgttaaccagtctctgtgaat

SEQ ID NO: 446157 - DNA, 25 bp, Mus musculus
gacacgttaacctgtctctgtgaat

SEQ ID NO: 446158 - DNA, 25 bp, Mus musculus
gacacgttagccagtgcagggcaca

SEQ ID NO: 446159 - DNA, 25 bp, Mus musculus
gacacgttagcctgtgcagggcaca

SEQ ID NO: 446160 - DNA, 25 bp, Mus musculus
gacacgttccggcacttcgctgtct

SEQ ID NO: 446161 - DNA, 25 bp, Mus musculus
gacacgttccgggacttcgctgtct

SEQ ID NO: 446162 - DNA, 25 bp, Mus musculus
gacacgttctagctctgttgtttat

SEQ ID NO: 446163 - DNA, 25 bp, Mus musculus
gacacgttctaggtctgttgtttat

SEQ ID NO: 446164 - DNA, 25 bp, Mus musculus
gacacgttgacccatccaacaaaat

SEQ ID NO: 446165 - DNA, 25 bp, Mus musculus
gacacgttgaccgatccaacaaaat

SEQ ID NO: 446166 - DNA, 25 bp, Mus musculus
gacacgttgtccacaaatggcatta

SEQ ID NO: 446167 - DNA, 25 bp, Mus musculus
gacacgttgtcctcaaatggcatta

SEQ ID NO: 446168 - DNA, 25 bp, Mus musculus
gacacgtttcacaatattcactaca

SEQ ID NO: 446169 - DNA, 25 bp, Mus musculus
gacacgtttcactatattcactaca

SEQ ID NO: 446170 - DNA, 25 bp, Mus musculus
gacacgtttgaaatacgagttattc

SEQ ID NO: 446171 - DNA, 25 bp, Mus musculus
gacacgtttgaattacgagttattc

SEQ ID NO: 446172 - DNA, 25 bp, Mus musculus
gacacgtttgacagtgaagacaatg

SEQ ID NO: 446173 - DNA, 25 bp, Mus musculus
gacacgtttgactgtgaagacaatg

SEQ ID NO: 446174 - DNA, 25 bp, Mus musculus
gacactaaaggccacacgcaggaag

SEQ ID NO: 446175 - DNA, 25 bp, Mus musculus
gacactaaaggcgacacgcaggaag

SEQ ID NO: 446176 - DNA, 25 bp, Mus musculus
gacactaaattactaagatgcctta

SEQ ID NO: 446177 - DNA, 25 bp, Mus musculus
gacactaaattagtaagatgcctta

SEQ ID NO: 446178 - DNA, 25 bp, Mus musculus
gacactaacagaccccggatgaaag

SEQ ID NO: 446179 - DNA, 25 bp, Mus musculus
gacactaacagagcccggatgaaag

SEQ ID NO: 446180 - DNA, 25 bp, Mus musculus
gacactaactctacccagatgatga

SEQ ID NO: 446181 - DNA, 25 bp, Mus musculus
gacactaactcttcccagatgatga

SEQ ID NO: 446182 - DNA, 25 bp, Mus musculus
gacactaagaacaaccttggaagct

SEQ ID NO: 446183 - DNA, 25 bp, Mus musculus
gacactaagaacagcatccagagag

SEQ ID NO: 446184 - DNA, 25 bp, Mus musculus
gacactaagaactaccttggaagct

SEQ ID NO: 446185 - DNA, 25 bp, Mus musculus
gacactaagaactgcatccagagag

SEQ ID NO: 446186 - DNA, 25 bp, Mus musculus
gacactaagctgctgacgccactga

SEQ ID NO: 446187 - DNA, 25 bp, Mus musculus
gacactaagctggtgacgccactga

SEQ ID NO: 446188 - DNA, 25 bp, Mus musculus
gacactaaggaccactctgagttta

SEQ ID NO: 446189 - DNA, 25 bp, Mus musculus
gacactaaggacgactctgagttta

SEQ ID NO: 446190 - DNA, 25 bp, Mus musculus
gacactaatctaaaaatctaatcat

SEQ ID NO: 446191 - DNA, 25 bp, Mus musculus
gacactaatctataaatctaatcat

SEQ ID NO: 446192 - DNA, 25 bp, Mus musculus
gacactaattccatacaggctctgc

SEQ ID NO: 446193 - DNA, 25 bp, Mus musculus
gacactaattccttacaggctctgc

SEQ ID NO: 446194 - DNA, 25 bp, Mus musculus
gacactacacagatttctaatatgt

SEQ ID NO: 446195 - DNA, 25 bp, Mus musculus
gacactacacagttttctaatatgt

SEQ ID NO: 446196 - DNA, 25 bp, Mus musculus
gacactacagaccctggacagaagg

SEQ ID NO: 446197 - DNA, 25 bp, Mus musculus
gacactacagacgctggacagaagg

SEQ ID NO: 446198 - DNA, 25 bp, Mus musculus
gacactacagagctttaagcactac

SEQ ID NO: 446199 - DNA, 25 bp, Mus musculus
gacactacagaggtttaagcactac

SEQ ID NO: 446200 - DNA, 25 bp, Mus musculus
gacactacagggattgttttcaacg

SEQ ID NO: 446201 - DNA, 25 bp, Mus musculus
gacactacagggtttgttttcaacg

SEQ ID NO: 446202 - DNA, 25 bp, Mus musculus
gacactacagtaactgtccctgggt

SEQ ID NO: 446203 - DNA, 25 bp, Mus musculus
gacactacagtatctgtccctgggt

SEQ ID NO: 446204 - DNA, 25 bp, Mus musculus
gacactaccgtgagtggcctgcaga

SEQ ID NO: 446205 - DNA, 25 bp, Mus musculus
gacactaccgtgtgtggcctgcaga

SEQ ID NO: 446206 - DNA, 25 bp, Mus musculus
gacactacgcttacacaagaggcca

SEQ ID NO: 446207 - DNA, 25 bp, Mus musculus
gacactacgctttcacaagaggcca

SEQ ID NO: 446208 - DNA, 25 bp, Mus musculus
gacactacggccaaggtgttgccat

SEQ ID NO: 446209 - DNA, 25 bp, Mus musculus
gacactacggcctaggtgttgccat

SEQ ID NO: 446210 - DNA, 25 bp, Mus musculus
gacactactaaaattattctcacgc

SEQ ID NO: 446211 - DNA, 25 bp, Mus musculus
gacactactaaatttattctcacgc

SEQ ID NO: 446212 - DNA, 25 bp, Mus musculus
gacactactacaacttccaaggagc

SEQ ID NO: 446213 - DNA, 25 bp, Mus musculus
gacactactacatcttccaaggagc

SEQ ID NO: 446214 - DNA, 25 bp, Mus musculus
gacactactattaatcactatgctg

SEQ ID NO: 446215 - DNA, 25 bp, Mus musculus
gacactactatttatcactatgctg

SEQ ID NO: 446216 - DNA, 25 bp, Mus musculus
gacactactgtgatctgagtgttaa

SEQ ID NO: 446217 - DNA, 25 bp, Mus musculus
gacactactgtgttctgagtgttaa

SEQ ID NO: 446218 - DNA, 25 bp, Mus musculus
gacactacttgaaaggactaggagg

SEQ ID NO: 446219 - DNA, 25 bp, Mus musculus
gacactacttgataggactaggagg

SEQ ID NO: 446220 - DNA, 25 bp, Mus musculus
gacactagactcaaccaaggagaaa

SEQ ID NO: 446221 - DNA, 25 bp, Mus musculus
gacactagactcaagttactagagg

SEQ ID NO: 446222 - DNA, 25 bp, Mus musculus
gacactagactctaccaaggagaaa

SEQ ID NO: 446223 - DNA, 25 bp, Mus musculus
gacactagactctagttactagagg

SEQ ID NO: 446224 - DNA, 25 bp, Mus musculus
gacactagactgaaggctcgcacat

SEQ ID NO: 446225 - DNA, 25 bp, Mus musculus
gacactagactgacttttggcatga

SEQ ID NO: 446226 - DNA, 25 bp, Mus musculus
gacactagactgtaggctcgcacat

SEQ ID NO: 446227 - DNA, 25 bp, Mus musculus
gacactagactgtcttttggcatga

SEQ ID NO: 446228 - DNA, 25 bp, Mus musculus
gacactagagcacggcgagcttcct

SEQ ID NO: 446229 - DNA, 25 bp, Mus musculus
gacactagagcagggcgagcttcct

SEQ ID NO: 446230 - DNA, 25 bp, Mus musculus
gacactagcaaaccatggtgacaca

SEQ ID NO: 446231 - DNA, 25 bp, Mus musculus
gacactagcaaagcatggtgacaca

SEQ ID NO: 446232 - DNA, 25 bp, Mus musculus
gacactagccaaccacatgatcatg

SEQ ID NO: 446233 - DNA, 25 bp, Mus musculus
gacactagccaagcacatgatcatg

SEQ ID NO: 446234 - DNA, 25 bp, Mus musculus
gacactagctataggatccacacgg

SEQ ID NO: 446235 - DNA, 25 bp, Mus musculus
gacactagctattggatccacacgg

SEQ ID NO: 446236 - DNA, 25 bp, Mus musculus
gacactagctcgctggaaccctcag

SEQ ID NO: 446237 - DNA, 25 bp, Mus musculus
gacactagctcggtggaaccctcag

SEQ ID NO: 446238 - DNA, 25 bp, Mus musculus
gacactaggattcactgtgcccaga

SEQ ID NO: 446239 - DNA, 25 bp, Mus musculus
gacactaggattgactgtgcccaga

SEQ ID NO: 446240 - DNA, 25 bp, Mus musculus
gacactaggctgattccaatttctg

SEQ ID NO: 446241 - DNA, 25 bp, Mus musculus
gacactaggctgtttccaatttctg

SEQ ID NO: 446242 - DNA, 25 bp, Mus musculus
gacactagtgacagtgtgctctctt

SEQ ID NO: 446243 - DNA, 25 bp, Mus musculus
gacactagtgactgtgtgctctctt

SEQ ID NO: 446244 - DNA, 25 bp, Mus musculus
gacactagttctcgagtagaaaata

SEQ ID NO: 446245 - DNA, 25 bp, Mus musculus
gacactagttctggagtagaaaata

SEQ ID NO: 446246 - DNA, 25 bp, Mus musculus
gacactatagagctctaagcaccta

SEQ ID NO: 446247 - DNA, 25 bp, Mus musculus
gacactatagaggtctaagcaccta

SEQ ID NO: 446248 - DNA, 25 bp, Mus musculus
gacactatccaccacactttgctga

SEQ ID NO: 446249 - DNA, 25 bp, Mus musculus
gacactatccacgacactttgctga

SEQ ID NO: 446250 - DNA, 25 bp, Mus musculus
gacactatgtatcgaattctcagta

SEQ ID NO: 446251 - DNA, 25 bp, Mus musculus
gacactatgtatggaattctcagta

SEQ ID NO: 446252 - DNA, 25 bp, Mus musculus
gacactattatcagtgacactgtaa

SEQ ID NO: 446253 - DNA, 25 bp, Mus musculus
gacactattatctgtgacactgtaa

SEQ ID NO: 446254 - DNA, 25 bp, Mus musculus
gacactattgaactggactctcaag

SEQ ID NO: 446255 - DNA, 25 bp, Mus musculus
gacactattgaagtggactctcaag

SEQ ID NO: 446256 - DNA, 25 bp, Mus musculus
gacactcaaagacatacctcctggg

SEQ ID NO: 446257 - DNA, 25 bp, Mus musculus
gacactcaaagagatacctcctggg

SEQ ID NO: 446258 - DNA, 25 bp, Mus musculus
gacactcaaaggagtacttttccaa

SEQ ID NO: 446259 - DNA, 25 bp, Mus musculus
gacactcaaaggtgtacttttccaa

SEQ ID NO: 446260 - DNA, 25 bp, Mus musculus
gacactcaacagcttatgataagac

SEQ ID NO: 446261 - DNA, 25 bp, Mus musculus
gacactcaacaggttatgataagac

SEQ ID NO: 446262 - DNA, 25 bp, Mus musculus
gacactcaactgagctggctagtat

SEQ ID NO: 446263 - DNA, 25 bp, Mus musculus
gacactcaactgtgctggctagtat

SEQ ID NO: 446264 - DNA, 25 bp, Mus musculus
gacactcaagggatggctgaatata

SEQ ID NO: 446265 - DNA, 25 bp, Mus musculus
gacactcaagggttggctgaatata

SEQ ID NO: 446266 - DNA, 25 bp, Mus musculus
gacactcaatgtcaacttttaaaag

SEQ ID NO: 446267 - DNA, 25 bp, Mus musculus
gacactcaatgtgaacttttaaaag

SEQ ID NO: 446268 - DNA, 25 bp, Mus musculus
gacactcaccaccatttaatgcttt

SEQ ID NO: 446269 - DNA, 25 bp, Mus musculus
gacactcaccacgatttaatgcttt

SEQ ID NO: 446270 - DNA, 25 bp, Mus musculus
gacactcaccagatagaaaccctgc

SEQ ID NO: 446271 - DNA, 25 bp, Mus musculus
gacactcaccagttagaaaccctgc

SEQ ID NO: 446272 - DNA, 25 bp, Mus musculus
gacactcactctcgaggaatctatt

SEQ ID NO: 446273 - DNA, 25 bp, Mus musculus
gacactcactctggaggaatctatt

SEQ ID NO: 446274 - DNA, 25 bp, Mus musculus
gacactcactgactgctcagaaata

SEQ ID NO: 446275 - DNA, 25 bp, Mus musculus
gacactcactgagtgctcagaaata

SEQ ID NO: 446276 - DNA, 25 bp, Mus musculus
gacactcactggagtttgcatcatg

SEQ ID NO: 446277 - DNA, 25 bp, Mus musculus
gacactcactggtgtttgcatcatg

SEQ ID NO: 446278 - DNA, 25 bp, Mus musculus
gacactcagaacctggacgctgttg

SEQ ID NO: 446279 - DNA, 25 bp, Mus musculus
gacactcagaacgtggacgctgttg

SEQ ID NO: 446280 - DNA, 25 bp, Mus musculus
gacactcagcaaagatgaccctgtt

SEQ ID NO: 446281 - DNA, 25 bp, Mus musculus
gacactcagcaatgatgaccctgtt

SEQ ID NO: 446282 - DNA, 25 bp, Mus musculus
gacactcaggaactgcctctggaaa

SEQ ID NO: 446283 - DNA, 25 bp, Mus musculus
gacactcaggaagtgcctctggaaa

SEQ ID NO: 446284 - DNA, 25 bp, Mus musculus
gacactcaggagaacttacattcag

SEQ ID NO: 446285 - DNA, 25 bp, Mus musculus
gacactcaggagtacttacattcag

SEQ ID NO: 446286 - DNA, 25 bp, Mus musculus
gacactcaggtacattccgaggccc

SEQ ID NO: 446287 - DNA, 25 bp, Mus musculus
gacactcaggtagattccgaggccc

SEQ ID NO: 446288 - DNA, 25 bp, Mus musculus
gacactcaggtcaaaggatccccaa

SEQ ID NO: 446289 - DNA, 25 bp, Mus musculus
gacactcaggtctaaggatccccaa

SEQ ID NO: 446290 - DNA, 25 bp, Mus musculus
gacactcagtcacacaggatcagct

SEQ ID NO: 446291 - DNA, 25 bp, Mus musculus
gacactcagtcagacaggatcagct

SEQ ID NO: 446292 - DNA, 25 bp, Mus musculus
gacactcagtggataccacctttca

SEQ ID NO: 446293 - DNA, 25 bp, Mus musculus
gacactcagtggttaccacctttca

SEQ ID NO: 446294 - DNA, 25 bp, Mus musculus
gacactcagttcataaaagcactaa

SEQ ID NO: 446295 - DNA, 25 bp, Mus musculus
gacactcagttcttaaaagcactaa

SEQ ID NO: 446296 - DNA, 25 bp, Mus musculus
gacactcatattcttccccagagag

SEQ ID NO: 446297 - DNA, 25 bp, Mus musculus
gacactcatattgttccccagagag

SEQ ID NO: 446298 - DNA, 25 bp, Mus musculus
gacactcatcagacatatcctaaag

SEQ ID NO: 446299 - DNA, 25 bp, Mus musculus
gacactcatcagtcatatcctaaag

SEQ ID NO: 446300 - DNA, 25 bp, Mus musculus
gacactcatctgaccacacttgatt

SEQ ID NO: 446301 - DNA, 25 bp, Mus musculus
gacactcatctgagaatatcgctgg

SEQ ID NO: 446302 - DNA, 25 bp, Mus musculus
gacactcatctgtccacacttgatt

SEQ ID NO: 446303 - DNA, 25 bp, Mus musculus
gacactcatctgtgaatatcgctgg

SEQ ID NO: 446304 - DNA, 25 bp, Mus musculus
gacactcatgaaacaagcttgcttt

SEQ ID NO: 446305 - DNA, 25 bp, Mus musculus
gacactcatgaaaggcacagtttat

SEQ ID NO: 446306 - DNA, 25 bp, Mus musculus
gacactcatgaatcaagcttgcttt

SEQ ID NO: 446307 - DNA, 25 bp, Mus musculus
gacactcatgaatggcacagtttat

SEQ ID NO: 446308 - DNA, 25 bp, Mus musculus
gacactcatgcgactacagggagga

SEQ ID NO: 446309 - DNA, 25 bp, Mus musculus
gacactcatgcgtctacagggagga

SEQ ID NO: 446310 - DNA, 25 bp, Mus musculus
gacactcatggaaggtttttgttgt

SEQ ID NO: 446311 - DNA, 25 bp, Mus musculus
gacactcatggatggtttttgttgt

SEQ ID NO: 446312 - DNA, 25 bp, Mus musculus
gacactcattaacaacttggctggt

SEQ ID NO: 446313 - DNA, 25 bp, Mus musculus
gacactcattaagaacttggctggt

SEQ ID NO: 446314 - DNA, 25 bp, Mus musculus
gacactcattcacagtcatggactt

SEQ ID NO: 446315 - DNA, 25 bp, Mus musculus
gacactcattcagagtcatggactt

SEQ ID NO: 446316 - DNA, 25 bp, Mus musculus
gacactccaaacagacacatgacta

SEQ ID NO: 446317 - DNA, 25 bp, Mus musculus
gacactccaaactgacacatgacta

SEQ ID NO: 446318 - DNA, 25 bp, Mus musculus
gacactccaaatcaaggccaggctg

SEQ ID NO: 446319 - DNA, 25 bp, Mus musculus
gacactccaaatgaaggccaggctg

SEQ ID NO: 446320 - DNA, 25 bp, Mus musculus
gacactccacatcggcactgaaata

SEQ ID NO: 446321 - DNA, 25 bp, Mus musculus
gacactccacatgggcactgaaata

SEQ ID NO: 446322 - DNA, 25 bp, Mus musculus
gacactcccaacagttatgatgaca

SEQ ID NO: 446323 - DNA, 25 bp, Mus musculus
gacactcccaactgttatgatgaca

SEQ ID NO: 446324 - DNA, 25 bp, Mus musculus
gacactcccagcctcagatgatgat

SEQ ID NO: 446325 - DNA, 25 bp, Mus musculus
gacactcccagcgtcagatgatgat

SEQ ID NO: 446326 - DNA, 25 bp, Mus musculus
gacactccctctcacaatgacagtg

SEQ ID NO: 446327 - DNA, 25 bp, Mus musculus
gacactccctctgacaatgacagtg

SEQ ID NO: 446328 - DNA, 25 bp, Mus musculus
gacactccgaggacctagatcatat

SEQ ID NO: 446329 - DNA, 25 bp, Mus musculus
gacactccgaggtcctagatcatat

SEQ ID NO: 446330 - DNA, 25 bp, Mus musculus
gacactccgtaaacattttcagcaa

SEQ ID NO: 446331 - DNA, 25 bp, Mus musculus
gacactccgtaatcattttcagcaa

SEQ ID NO: 446332 - DNA, 25 bp, Mus musculus
gacactcctagcctagagcagggaa

SEQ ID NO: 446333 - DNA, 25 bp, Mus musculus
gacactcctagcgtagagcagggaa

SEQ ID NO: 446334 - DNA, 25 bp, Mus musculus
gacactccttcactgacatgtggga

SEQ ID NO: 446335 - DNA, 25 bp, Mus musculus
gacactccttcagtgacatgtggga

SEQ ID NO: 446336 - DNA, 25 bp, Mus musculus
gacactccttccagaaaagaccttt

SEQ ID NO: 446337 - DNA, 25 bp, Mus musculus
gacactccttcctgaaaagaccttt

SEQ ID NO: 446338 - DNA, 25 bp, Mus musculus
gacactcgaagtaacaaagcatcct

SEQ ID NO: 446339 - DNA, 25 bp, Mus musculus
gacactcgaagttacaaagcatcct

SEQ ID NO: 446340 - DNA, 25 bp, Mus musculus
gacactcgaggcattgaatgggaca

SEQ ID NO: 446341 - DNA, 25 bp, Mus musculus
gacactcgaggctttgaatgggaca

SEQ ID NO: 446342 - DNA, 25 bp, Mus musculus
gacactcgagttatggtccattctg

SEQ ID NO: 446343 - DNA, 25 bp, Mus musculus
gacactcgagttttggtccattctg

SEQ ID NO: 446344 - DNA, 25 bp, Mus musculus
gacactcgccatagaattttatgtt

SEQ ID NO: 446345 - DNA, 25 bp, Mus musculus
gacactcgccattgaattttatgtt

SEQ ID NO: 446346 - DNA, 25 bp, Mus musculus
gacactcggaggagtgcagatccat

SEQ ID NO: 446347 - DNA, 25 bp, Mus musculus
gacactcggaggtgtgcagatccat

SEQ ID NO: 446348 - DNA, 25 bp, Mus musculus
gacactcgtcgtaggacaaccttaa

SEQ ID NO: 446349 - DNA, 25 bp, Mus musculus
gacactcgtcgttggacaaccttaa

SEQ ID NO: 446350 - DNA, 25 bp, Mus musculus
gacactcgtgagactgacttgcagg

SEQ ID NO: 446351 - DNA, 25 bp, Mus musculus
gacactcgtgagtctgacttgcagg

SEQ ID NO: 446352 - DNA, 25 bp, Mus musculus
gacactcgtggcctctttgtgcagg

SEQ ID NO: 446353 - DNA, 25 bp, Mus musculus
gacactcgtggcgtctttgtgcagg

SEQ ID NO: 446354 - DNA, 25 bp, Mus musculus
gacactcgttacattcgggagcgaa

SEQ ID NO: 446355 - DNA, 25 bp, Mus musculus
gacactcgttactttcgggagcgaa

SEQ ID NO: 446356 - DNA, 25 bp, Mus musculus
gacactctactgatagtcgatccta

SEQ ID NO: 446357 - DNA, 25 bp, Mus musculus
gacactctactgttagtcgatccta

SEQ ID NO: 446358 - DNA, 25 bp, Mus musculus
gacactctagccctgtggttctgca

SEQ ID NO: 446359 - DNA, 25 bp, Mus musculus
gacactctagccgtgtggttctgca

SEQ ID NO: 446360 - DNA, 25 bp, Mus musculus
gacactctattcactgagcgttaag

SEQ ID NO: 446361 - DNA, 25 bp, Mus musculus
gacactctattctctgagcgttaag

SEQ ID NO: 446362 - DNA, 25 bp, Mus musculus
gacactctcacccagacatgtaggc

SEQ ID NO: 446363 - DNA, 25 bp, Mus musculus
gacactctcaccgagacatgtaggc

SEQ ID NO: 446364 - DNA, 25 bp, Mus musculus
gacactctcactcgctaggtctagg

SEQ ID NO: 446365 - DNA, 25 bp, Mus musculus
gacactctcactggctaggtctagg

SEQ ID NO: 446366 - DNA, 25 bp, Mus musculus
gacactctcctcaggtgatgtttta

SEQ ID NO: 446367 - DNA, 25 bp, Mus musculus
gacactctcctctggtgatgtttta

SEQ ID NO: 446368 - DNA, 25 bp, Mus musculus
gacactctctagatttgtgcagcta

SEQ ID NO: 446369 - DNA, 25 bp, Mus musculus
gacactctctagttttgtgcagcta

SEQ ID NO: 446370 - DNA, 25 bp, Mus musculus
gacactctgaaccaggactcctaca

SEQ ID NO: 446371 - DNA, 25 bp, Mus musculus
gacactctgaacgaggactcctaca

SEQ ID NO: 446372 - DNA, 25 bp, Mus musculus
gacactctgcagaggaacttgccat

SEQ ID NO: 446373 - DNA, 25 bp, Mus musculus
gacactctgcagtggaacttgccat

SEQ ID NO: 446374 - DNA, 25 bp, Mus musculus
gacactctggagcaagcatttgaac

SEQ ID NO: 446375 - DNA, 25 bp, Mus musculus
gacactctggaggaagcatttgaac

SEQ ID NO: 446376 - DNA, 25 bp, Mus musculus
gacactctggatccgattaaggaca

SEQ ID NO: 446377 - DNA, 25 bp, Mus musculus
gacactctggatgcgattaaggaca

SEQ ID NO: 446378 - DNA, 25 bp, Mus musculus
gacactctgggcctgtggagtctca

SEQ ID NO: 446379 - DNA, 25 bp, Mus musculus
gacactctgggcgtgtggagtctca

SEQ ID NO: 446380 - DNA, 25 bp, Mus musculus
gacactctgtagcttctgaaggcca

SEQ ID NO: 446381 - DNA, 25 bp, Mus musculus
gacactctgtaggttctgaaggcca

SEQ ID NO: 446382 - DNA, 25 bp, Mus musculus
gacactctgtccctaagccttgagc

SEQ ID NO: 446383 - DNA, 25 bp, Mus musculus
gacactctgtccgtaagccttgagc

SEQ ID NO: 446384 - DNA, 25 bp, Mus musculus
gacactctgtgtcatgctttggtcc

SEQ ID NO: 446385 - DNA, 25 bp, Mus musculus
gacactctgtgtgatgctttggtcc

SEQ ID NO: 446386 - DNA, 25 bp, Mus musculus
gacactcttaaacctgtttcatact

SEQ ID NO: 446387 - DNA, 25 bp, Mus musculus
gacactcttaaagctgtttcatact

SEQ ID NO: 446388 - DNA, 25 bp, Mus musculus
gacactcttaatcctacttacagag

SEQ ID NO: 446389 - DNA, 25 bp, Mus musculus
gacactcttaatgctacttacagag

SEQ ID NO: 446390 - DNA, 25 bp, Mus musculus
gacactcttcagagacatggacaat

SEQ ID NO: 446391 - DNA, 25 bp, Mus musculus
gacactcttcagtgacatggacaat

SEQ ID NO: 446392 - DNA, 25 bp, Mus musculus
gacactcttcttaaacactgctgtt

SEQ ID NO: 446393 - DNA, 25 bp, Mus musculus
gacactcttcttctgtgacataaat

SEQ ID NO: 446394 - DNA, 25 bp, Mus musculus
gacactcttcttgtgtgacataaat

SEQ ID NO: 446395 - DNA, 25 bp, Mus musculus
gacactcttctttaacactgctgtt

SEQ ID NO: 446396 - DNA, 25 bp, Mus musculus
gacactgaacgactaaagtcacatg

SEQ ID NO: 446397 - DNA, 25 bp, Mus musculus
gacactgaacgagtaaagtcacatg

SEQ ID NO: 446398 - DNA, 25 bp, Mus musculus
gacactgaacttaacaattgacact

SEQ ID NO: 446399 - DNA, 25 bp, Mus musculus
gacactgaacttagcaattaatctt

SEQ ID NO: 446400 - DNA, 25 bp, Mus musculus
gacactgaactttacaattgacact

SEQ ID NO: 446401 - DNA, 25 bp, Mus musculus
gacactgaactttgcaattaatctt

SEQ ID NO: 446402 - DNA, 25 bp, Mus musculus
gacactgaagtcagctccttgaaca

SEQ ID NO: 446403 - DNA, 25 bp, Mus musculus
gacactgaagtctgctccttgaaca

SEQ ID NO: 446404 - DNA, 25 bp, Mus musculus
gacactgaagtgaggccgcccggca

SEQ ID NO: 446405 - DNA, 25 bp, Mus musculus
gacactgaagtgtggccgcccggca

SEQ ID NO: 446406 - DNA, 25 bp, Mus musculus
gacactgaagttcgtttgaataaag

SEQ ID NO: 446407 - DNA, 25 bp, Mus musculus
gacactgaagttggtttgaataaag

SEQ ID NO: 446408 - DNA, 25 bp, Mus musculus
gacactgaatctctgtgcctagaaa

SEQ ID NO: 446409 - DNA, 25 bp, Mus musculus
gacactgaatctgtgtgcctagaaa

SEQ ID NO: 446410 - DNA, 25 bp, Mus musculus
gacactgaattgaatgcctggcccc

SEQ ID NO: 446411 - DNA, 25 bp, Mus musculus
gacactgaattgatttccctactga

SEQ ID NO: 446412 - DNA, 25 bp, Mus musculus
gacactgaattgtatgcctggcccc

SEQ ID NO: 446413 - DNA, 25 bp, Mus musculus
gacactgaattgttttccctactga

SEQ ID NO: 446414 - DNA, 25 bp, Mus musculus
gacactgaatttatgacgttttaca

SEQ ID NO: 446415 - DNA, 25 bp, Mus musculus
gacactgaatttttgacgttttaca

SEQ ID NO: 446416 - DNA, 25 bp, Mus musculus
gacactgacaagcatctgtgcagat

SEQ ID NO: 446417 - DNA, 25 bp, Mus musculus
gacactgacaaggatctgtgcagat

SEQ ID NO: 446418 - DNA, 25 bp, Mus musculus
gacactgaccgcaagtacaaaggat

SEQ ID NO: 446419 - DNA, 25 bp, Mus musculus
gacactgaccgctagtacaaaggat

SEQ ID NO: 446420 - DNA, 25 bp, Mus musculus
gacactgacctgatacaaggagttt

SEQ ID NO: 446421 - DNA, 25 bp, Mus musculus
gacactgacctgttacaaggagttt

SEQ ID NO: 446422 - DNA, 25 bp, Mus musculus
gacactgacgtgatctactgtgcaa

SEQ ID NO: 446423 - DNA, 25 bp, Mus musculus
gacactgacgtgttctactgtgcaa

SEQ ID NO: 446424 - DNA, 25 bp, Mus musculus
gacactgactaccagatgaccaaga

SEQ ID NO: 446425 - DNA, 25 bp, Mus musculus
gacactgactacgagatgaccaaga

SEQ ID NO: 446426 - DNA, 25 bp, Mus musculus
gacactgactgtaactttagctgtt

SEQ ID NO: 446427 - DNA, 25 bp, Mus musculus
gacactgactgttactttagctgtt

SEQ ID NO: 446428 - DNA, 25 bp, Mus musculus
gacactgacttgatggacagaccag

SEQ ID NO: 446429 - DNA, 25 bp, Mus musculus
gacactgacttgttggacagaccag

SEQ ID NO: 446430 - DNA, 25 bp, Mus musculus
gacactgagacaagacagcatcgtt

SEQ ID NO: 446431 - DNA, 25 bp, Mus musculus
gacactgagacatgacagcatcgtt

SEQ ID NO: 446432 - DNA, 25 bp, Mus musculus
gacactgaggaacttcctttgggta

SEQ ID NO: 446433 - DNA, 25 bp, Mus musculus
gacactgaggaagttcctttgggta

SEQ ID NO: 446434 - DNA, 25 bp, Mus musculus
gacactgaggagctgcccaaggctt

SEQ ID NO: 446435 - DNA, 25 bp, Mus musculus
gacactgaggaggtgcccaaggctt

SEQ ID NO: 446436 - DNA, 25 bp, Mus musculus
gacactgaggatcagtttcttctct

SEQ ID NO: 446437 - DNA, 25 bp, Mus musculus
gacactgaggatgagtttcttctct

SEQ ID NO: 446438 - DNA, 25 bp, Mus musculus
gacactgaggccagtgcagtaggca

SEQ ID NO: 446439 - DNA, 25 bp, Mus musculus
gacactgaggcctgtgcagtaggca

SEQ ID NO: 446440 - DNA, 25 bp, Mus musculus
gacactgagtccagcatgtggctaa

SEQ ID NO: 446441 - DNA, 25 bp, Mus musculus
gacactgagtcctgcatgtggctaa

SEQ ID NO: 446442 - DNA, 25 bp, Mus musculus
gacactgatattaggtagactttgg

SEQ ID NO: 446443 - DNA, 25 bp, Mus musculus
gacactgatatttggtagactttgg

SEQ ID NO: 446444 - DNA, 25 bp, Mus musculus
gacactgatctaattcttggacatg

SEQ ID NO: 446445 - DNA, 25 bp, Mus musculus
gacactgatctatttcttggacatg

SEQ ID NO: 446446 - DNA, 25 bp, Mus musculus
gacactgatgtgacacttagcacaa

SEQ ID NO: 446447 - DNA, 25 bp, Mus musculus
gacactgatgtgtcacttagcacaa

SEQ ID NO: 446448 - DNA, 25 bp, Mus musculus
gacactgatgttaatcttgggataa

SEQ ID NO: 446449 - DNA, 25 bp, Mus musculus
gacactgatgtttatcttgggataa

SEQ ID NO: 446450 - DNA, 25 bp, Mus musculus
gacactgattcaccatgcactcgat

SEQ ID NO: 446451 - DNA, 25 bp, Mus musculus
gacactgattcagcatgcactcgat

SEQ ID NO: 446452 - DNA, 25 bp, Mus musculus
gacactgcaccactgaatcagtgca

SEQ ID NO: 446453 - DNA, 25 bp, Mus musculus
gacactgcaccagtgaatcagtgca

SEQ ID NO: 446454 - DNA, 25 bp, Mus musculus
gacactgcactcagctggacagtta

SEQ ID NO: 446455 - DNA, 25 bp, Mus musculus
gacactgcactctgctggacagtta

SEQ ID NO: 446456 - DNA, 25 bp, Mus musculus
gacactgcagacaagggctactcgt

SEQ ID NO: 446457 - DNA, 25 bp, Mus musculus
gacactgcagactagggctactcgt

SEQ ID NO: 446458 - DNA, 25 bp, Mus musculus
gacactgcagagaggtctcagttca

SEQ ID NO: 446459 - DNA, 25 bp, Mus musculus
gacactgcagagatcagccgagaat

SEQ ID NO: 446460 - DNA, 25 bp, Mus musculus
gacactgcagagtggtctcagttca

SEQ ID NO: 446461 - DNA, 25 bp, Mus musculus
gacactgcagagttcagccgagaat

SEQ ID NO: 446462 - DNA, 25 bp, Mus musculus
gacactgcagcaacgtgactactgt

SEQ ID NO: 446463 - DNA, 25 bp, Mus musculus
gacactgcagcacagtcgaggtttt

SEQ ID NO: 446464 - DNA, 25 bp, Mus musculus
gacactgcagcagagtcgaggtttt

SEQ ID NO: 446465 - DNA, 25 bp, Mus musculus
gacactgcagcatcgtgactactgt

SEQ ID NO: 446466 - DNA, 25 bp, Mus musculus
gacactgcagcgcaccttacagaaa

SEQ ID NO: 446467 - DNA, 25 bp, Mus musculus
gacactgcagcggaccttacagaaa

SEQ ID NO: 446468 - DNA, 25 bp, Mus musculus
gacactgcagctcaatgagaaaaga

SEQ ID NO: 446469 - DNA, 25 bp, Mus musculus
gacactgcagctgaatgagaaaaga

SEQ ID NO: 446470 - DNA, 25 bp, Mus musculus
gacactgcagtgagccaacattagc

SEQ ID NO: 446471 - DNA, 25 bp, Mus musculus
gacactgcagtgtgccaacattagc

SEQ ID NO: 446472 - DNA, 25 bp, Mus musculus
gacactgcattcatctgactatcac

SEQ ID NO: 446473 - DNA, 25 bp, Mus musculus
gacactgcattcttctgactatcac

SEQ ID NO: 446474 - DNA, 25 bp, Mus musculus
gacactgcatttatgaaggtaccgg

SEQ ID NO: 446475 - DNA, 25 bp, Mus musculus
gacactgcatttttgaaggtaccgg

SEQ ID NO: 446476 - DNA, 25 bp, Mus musculus
gacactgccaccacatggtctgatt

SEQ ID NO: 446477 - DNA, 25 bp, Mus musculus
gacactgccacctcatggtctgatt

SEQ ID NO: 446478 - DNA, 25 bp, Mus musculus
gacactgccataaactactgtgcca

SEQ ID NO: 446479 - DNA, 25 bp, Mus musculus
gacactgccatatactactgtgcca

SEQ ID NO: 446480 - DNA, 25 bp, Mus musculus
gacactgcccatatactgggactag

SEQ ID NO: 446481 - DNA, 25 bp, Mus musculus
gacactgcccatttactgggactag

SEQ ID NO: 446482 - DNA, 25 bp, Mus musculus
gacactgccctgacagggacaataa

SEQ ID NO: 446483 - DNA, 25 bp, Mus musculus
gacactgccctgtcagggacaataa

SEQ ID NO: 446484 - DNA, 25 bp, Mus musculus
gacactgcctctagggaatgggcaa

SEQ ID NO: 446485 - DNA, 25 bp, Mus musculus
gacactgcctcttgggaatgggcaa

SEQ ID NO: 446486 - DNA, 25 bp, Mus musculus
gacactgccttcaagctgggattta

SEQ ID NO: 446487 - DNA, 25 bp, Mus musculus
gacactgccttctagctgggattta

SEQ ID NO: 446488 - DNA, 25 bp, Mus musculus
gacactgcgcctcgcagatcaaggg

SEQ ID NO: 446489 - DNA, 25 bp, Mus musculus
gacactgcgcctggcagatcaaggg

SEQ ID NO: 446490 - DNA, 25 bp, Mus musculus
gacactgcggttcaagagttggctc

SEQ ID NO: 446491 - DNA, 25 bp, Mus musculus
gacactgcggttgaagagttggctc

SEQ ID NO: 446492 - DNA, 25 bp, Mus musculus
gacactgcgtgaacacctttgtata

SEQ ID NO: 446493 - DNA, 25 bp, Mus musculus
gacactgcgtgatcacctttgtata

SEQ ID NO: 446494 - DNA, 25 bp, Mus musculus
gacactgcgtgcctgcgtctgtaca

SEQ ID NO: 446495 - DNA, 25 bp, Mus musculus
gacactgcgtgcgtgcgtctgtaca

SEQ ID NO: 446496 - DNA, 25 bp, Mus musculus
gacactgctaaaagtttccatggga

SEQ ID NO: 446497 - DNA, 25 bp, Mus musculus
gacactgctaaatgtttccatggga

SEQ ID NO: 446498 - DNA, 25 bp, Mus musculus
gacactgctaatcaaccctggcatt

SEQ ID NO: 446499 - DNA, 25 bp, Mus musculus
gacactgctaatgaaccctggcatt

SEQ ID NO: 446500 - DNA, 25 bp, Mus musculus
gacactgctaccaggtttggccatt

SEQ ID NO: 446501 - DNA, 25 bp, Mus musculus
gacactgctacctggtttggccatt

SEQ ID NO: 446502 - DNA, 25 bp, Mus musculus
gacactgctactccctacaaagaga

SEQ ID NO: 446503 - DNA, 25 bp, Mus musculus
gacactgctactgcctacaaagaga

SEQ ID NO: 446504 - DNA, 25 bp, Mus musculus
gacactgctcacagagcagcagggc

SEQ ID NO: 446505 - DNA, 25 bp, Mus musculus
gacactgctcactgagcagcagggc

SEQ ID NO: 446506 - DNA, 25 bp, Mus musculus
gacactgctcagagcctctgtgctg

SEQ ID NO: 446507 - DNA, 25 bp, Mus musculus
gacactgctcagtgcctctgtgctg

SEQ ID NO: 446508 - DNA, 25 bp, Mus musculus
gacactgctccaacccaaatcaatg

SEQ ID NO: 446509 - DNA, 25 bp, Mus musculus
gacactgctccatcccaaatcaatg

SEQ ID NO: 446510 - DNA, 25 bp, Mus musculus
gacactgctcttagtctagcaaata

SEQ ID NO: 446511 - DNA, 25 bp, Mus musculus
gacactgctctttgtctagcaaata

SEQ ID NO: 446512 - DNA, 25 bp, Mus musculus
gacactgctgaacaaggcggctgat

SEQ ID NO: 446513 - DNA, 25 bp, Mus musculus
gacactgctgaagaaggcggctgat

SEQ ID NO: 446514 - DNA, 25 bp, Mus musculus
gacactgctgagccctgaagctggc

SEQ ID NO: 446515 - DNA, 25 bp, Mus musculus
gacactgctgaggcctgaagctggc

SEQ ID NO: 446516 - DNA, 25 bp, Mus musculus
gacactgctgctacattaccaaaaa

SEQ ID NO: 446517 - DNA, 25 bp, Mus musculus
gacactgctgcttcattaccaaaaa

SEQ ID NO: 446518 - DNA, 25 bp, Mus musculus
gacactgctgtcaccttaatatgct

SEQ ID NO: 446519 - DNA, 25 bp, Mus musculus
gacactgctgtctccttaatatgct

SEQ ID NO: 446520 - DNA, 25 bp, Mus musculus
gacactgcttccaaatgttagcgct

SEQ ID NO: 446521 - DNA, 25 bp, Mus musculus
gacactgcttcctaatgttagcgct

SEQ ID NO: 446522 - DNA, 25 bp, Mus musculus
gacactgctttaatccccagagaat

SEQ ID NO: 446523 - DNA, 25 bp, Mus musculus
gacactgctttattccccagagaat

SEQ ID NO: 446524 - DNA, 25 bp, Mus musculus
gacactggaatcctctggactctgg

SEQ ID NO: 446525 - DNA, 25 bp, Mus musculus
gacactggaatcgtctggactctgg

SEQ ID NO: 446526 - DNA, 25 bp, Mus musculus
gacactggacaaaaggtacttgtac

SEQ ID NO: 446527 - DNA, 25 bp, Mus musculus
gacactggacaataggtacttgtac

SEQ ID NO: 446528 - DNA, 25 bp, Mus musculus
gacactggacataacctcaaaactg

SEQ ID NO: 446529 - DNA, 25 bp, Mus musculus
gacactggacattacctcaaaactg

SEQ ID NO: 446530 - DNA, 25 bp, Mus musculus
gacactggaccacaaaagtcttggt

SEQ ID NO: 446531 - DNA, 25 bp, Mus musculus
gacactggaccaccatgtattctct

SEQ ID NO: 446532 - DNA, 25 bp, Mus musculus
gacactggaccagaaaagtcttggt

SEQ ID NO: 446533 - DNA, 25 bp, Mus musculus
gacactggaccagcatgtattctct

SEQ ID NO: 446534 - DNA, 25 bp, Mus musculus
gacactggactccattccaacaggt

SEQ ID NO: 446535 - DNA, 25 bp, Mus musculus
gacactggactcgattccaacaggt

SEQ ID NO: 446536 - DNA, 25 bp, Mus musculus
gacactggagctctcatcattcagt

SEQ ID NO: 446537 - DNA, 25 bp, Mus musculus
gacactggagctgtcatcattcagt

SEQ ID NO: 446538 - DNA, 25 bp, Mus musculus
gacactggaggaagtctcgatatca

SEQ ID NO: 446539 - DNA, 25 bp, Mus musculus
gacactggaggatgtctcgatatca

SEQ ID NO: 446540 - DNA, 25 bp, Mus musculus
gacactggaggtcaggatgcaccca

SEQ ID NO: 446541 - DNA, 25 bp, Mus musculus
gacactggaggtgaggatgcaccca

SEQ ID NO: 446542 - DNA, 25 bp, Mus musculus
gacactggcacaatgattgcgttac

SEQ ID NO: 446543 - DNA, 25 bp, Mus musculus
gacactggcacattgattgcgttac

SEQ ID NO: 446544 - DNA, 25 bp, Mus musculus
gacactggcactatatagttttcta

SEQ ID NO: 446545 - DNA, 25 bp, Mus musculus
gacactggcactttatagttttcta

SEQ ID NO: 446546 - DNA, 25 bp, Mus musculus
gacactggcagcctaagggcaaatt

SEQ ID NO: 446547 - DNA, 25 bp, Mus musculus
gacactggcagccttaagtccctgt

SEQ ID NO: 446548 - DNA, 25 bp, Mus musculus
gacactggcagcgtaagggcaaatt

SEQ ID NO: 446549 - DNA, 25 bp, Mus musculus
gacactggcagcgttaagtccctgt

SEQ ID NO: 446550 - DNA, 25 bp, Mus musculus
gacactggccaaccttgatcttttt

SEQ ID NO: 446551 - DNA, 25 bp, Mus musculus
gacactggccaagcttgatcttttt

SEQ ID NO: 446552 - DNA, 25 bp, Mus musculus
gacactggcccacgtttgaaatgat

SEQ ID NO: 446553 - DNA, 25 bp, Mus musculus
gacactggcccaggtttgaaatgat

SEQ ID NO: 446554 - DNA, 25 bp, Mus musculus
gacactggcccgagagcagcgacag

SEQ ID NO: 446555 - DNA, 25 bp, Mus musculus
gacactggcccgtgagcagcgacag

SEQ ID NO: 446556 - DNA, 25 bp, Mus musculus
gacactggcctgagttatgagcatc

SEQ ID NO: 446557 - DNA, 25 bp, Mus musculus
gacactggcctgtgttatgagcatc

SEQ ID NO: 446558 - DNA, 25 bp, Mus musculus
gacactggctgtcgaatttccggaa

SEQ ID NO: 446559 - DNA, 25 bp, Mus musculus
gacactggctgtggaatttccggaa

SEQ ID NO: 446560 - DNA, 25 bp, Mus musculus
gacactgggactattatcctgttgt

SEQ ID NO: 446561 - DNA, 25 bp, Mus musculus
gacactgggacttttatcctgttgt

SEQ ID NO: 446562 - DNA, 25 bp, Mus musculus
gacactgggatcatttaccaggaga

SEQ ID NO: 446563 - DNA, 25 bp, Mus musculus
gacactgggatcttttaccaggaga

SEQ ID NO: 446564 - DNA, 25 bp, Mus musculus
gacactgggatgaacactactgtag

SEQ ID NO: 446565 - DNA, 25 bp, Mus musculus
gacactgggatgtacactactgtag

SEQ ID NO: 446566 - DNA, 25 bp, Mus musculus
gacactgggcaccatttggtccaaa

SEQ ID NO: 446567 - DNA, 25 bp, Mus musculus
gacactgggcacgatttggtccaaa

SEQ ID NO: 446568 - DNA, 25 bp, Mus musculus
gacactgggcatattggatttctac

SEQ ID NO: 446569 - DNA, 25 bp, Mus musculus
gacactgggcattttggatttctac

SEQ ID NO: 446570 - DNA, 25 bp, Mus musculus
gacactgggctaccttgattcttca

SEQ ID NO: 446571 - DNA, 25 bp, Mus musculus
gacactgggctagcttgattcttca

SEQ ID NO: 446572 - DNA, 25 bp, Mus musculus
gacactgggctcagaggtttcctgc

SEQ ID NO: 446573 - DNA, 25 bp, Mus musculus
gacactgggctctgaggtttcctgc

SEQ ID NO: 446574 - DNA, 25 bp, Mus musculus
gacactgggcttcccttgtctagaa

SEQ ID NO: 446575 - DNA, 25 bp, Mus musculus
gacactgggcttgccttgtctagaa

SEQ ID NO: 446576 - DNA, 25 bp, Mus musculus
gacactgggtagaacattgcttttg

SEQ ID NO: 446577 - DNA, 25 bp, Mus musculus
gacactgggtagtacattgcttttg

SEQ ID NO: 446578 - DNA, 25 bp, Mus musculus
gacactgggtgtcttcttcaactgt

SEQ ID NO: 446579 - DNA, 25 bp, Mus musculus
gacactgggtgtgttcttcaactgt

SEQ ID NO: 446580 - DNA, 25 bp, Mus musculus
gacactgggttgcagtccttttcat

SEQ ID NO: 446581 - DNA, 25 bp, Mus musculus
gacactgggttggagtccttttcat

SEQ ID NO: 446582 - DNA, 25 bp, Mus musculus
gacactggtgacaacttgaattttt

SEQ ID NO: 446583 - DNA, 25 bp, Mus musculus
gacactggtgactacttgaattttt

SEQ ID NO: 446584 - DNA, 25 bp, Mus musculus
gacactggtggccaagatgcttaca

SEQ ID NO: 446585 - DNA, 25 bp, Mus musculus
gacactggtggcgaagatgcttaca

SEQ ID NO: 446586 - DNA, 25 bp, Mus musculus
gacactggtgtaactcagaatggga

SEQ ID NO: 446587 - DNA, 25 bp, Mus musculus
gacactggtgtatctcagaatggga

SEQ ID NO: 446588 - DNA, 25 bp, Mus musculus
gacactggtgtcagagtacactgaa

SEQ ID NO: 446589 - DNA, 25 bp, Mus musculus
gacactggtgtctgagtacactgaa

SEQ ID NO: 446590 - DNA, 25 bp, Mus musculus
gacactggttcaacctttatctcgg

SEQ ID NO: 446591 - DNA, 25 bp, Mus musculus
gacactggttcacatctacagctat

SEQ ID NO: 446592 - DNA, 25 bp, Mus musculus
gacactggttcagatctacagctat

SEQ ID NO: 446593 - DNA, 25 bp, Mus musculus
gacactggttcatcctttatctcgg

SEQ ID NO: 446594 - DNA, 25 bp, Mus musculus
gacactggttctcattccagccaga

SEQ ID NO: 446595 - DNA, 25 bp, Mus musculus
gacactggttctgattccagccaga

SEQ ID NO: 446596 - DNA, 25 bp, Mus musculus
gacactggttgaactcttagaagcc

SEQ ID NO: 446597 - DNA, 25 bp, Mus musculus
gacactggttgatctcttagaagcc

SEQ ID NO: 446598 - DNA, 25 bp, Mus musculus
gacactggttgtaatcttctactcc

SEQ ID NO: 446599 - DNA, 25 bp, Mus musculus
gacactggttgtacaaaatatccta

SEQ ID NO: 446600 - DNA, 25 bp, Mus musculus
gacactggttgttatcttctactcc

SEQ ID NO: 446601 - DNA, 25 bp, Mus musculus
gacactggttgttcaaaatatccta

SEQ ID NO: 446602 - DNA, 25 bp, Mus musculus
gacactgtaaccctcatgtagcgaa

SEQ ID NO: 446603 - DNA, 25 bp, Mus musculus
gacactgtaaccgtcatgtagcgaa

SEQ ID NO: 446604 - DNA, 25 bp, Mus musculus
gacactgtaagactattgttacctg

SEQ ID NO: 446605 - DNA, 25 bp, Mus musculus
gacactgtaagagtattgttacctg

SEQ ID NO: 446606 - DNA, 25 bp, Mus musculus
gacactgtacagagtgccatgaagc

SEQ ID NO: 446607 - DNA, 25 bp, Mus musculus
gacactgtacagtgtgccatgaagc

SEQ ID NO: 446608 - DNA, 25 bp, Mus musculus
gacactgtacatatgtacccaacca

SEQ ID NO: 446609 - DNA, 25 bp, Mus musculus
gacactgtacatcagttatgccaat

SEQ ID NO: 446610 - DNA, 25 bp, Mus musculus
gacactgtacatgagttatgccaat

SEQ ID NO: 446611 - DNA, 25 bp, Mus musculus
gacactgtacatttgtacccaacca

SEQ ID NO: 446612 - DNA, 25 bp, Mus musculus
gacactgtacccacatagtgcttat

SEQ ID NO: 446613 - DNA, 25 bp, Mus musculus
gacactgtaccctcatagtgcttat

SEQ ID NO: 446614 - DNA, 25 bp, Mus musculus
gacactgtactacatgttcattgca

SEQ ID NO: 446615 - DNA, 25 bp, Mus musculus
gacactgtactagatgttcattgca

SEQ ID NO: 446616 - DNA, 25 bp, Mus musculus
gacactgtactgaacctccatgaag

SEQ ID NO: 446617 - DNA, 25 bp, Mus musculus
gacactgtactgtacctccatgaag

SEQ ID NO: 446618 - DNA, 25 bp, Mus musculus
gacactgtagataattgaatgtttg

SEQ ID NO: 446619 - DNA, 25 bp, Mus musculus
gacactgtagattattgaatgtttg

SEQ ID NO: 446620 - DNA, 25 bp, Mus musculus
gacactgtaggcagttactggttat

SEQ ID NO: 446621 - DNA, 25 bp, Mus musculus
gacactgtaggctgttactggttat

SEQ ID NO: 446622 - DNA, 25 bp, Mus musculus
gacactgtagggaacaagcccttcc

SEQ ID NO: 446623 - DNA, 25 bp, Mus musculus
gacactgtagggtacaagcccttcc

SEQ ID NO: 446624 - DNA, 25 bp, Mus musculus
gacactgtatgcagccctgctggta

SEQ ID NO: 446625 - DNA, 25 bp, Mus musculus
gacactgtatgctgccctgctggta

SEQ ID NO: 446626 - DNA, 25 bp, Mus musculus
gacactgtcagacactttagacatg

SEQ ID NO: 446627 - DNA, 25 bp, Mus musculus
gacactgtcagagactttagacatg

SEQ ID NO: 446628 - DNA, 25 bp, Mus musculus
gacactgtcatgagggacatcaccc

SEQ ID NO: 446629 - DNA, 25 bp, Mus musculus
gacactgtcatgtgggacatcaccc

SEQ ID NO: 446630 - DNA, 25 bp, Mus musculus
gacactgtcgcaccaattttcagtc

SEQ ID NO: 446631 - DNA, 25 bp, Mus musculus
gacactgtcgcagcaattttcagtc

SEQ ID NO: 446632 - DNA, 25 bp, Mus musculus
gacactgtcgtgacagtagccgcag

SEQ ID NO: 446633 - DNA, 25 bp, Mus musculus
gacactgtcgtgtcagtagccgcag

SEQ ID NO: 446634 - DNA, 25 bp, Mus musculus
gacactgtctctagcaatacaatca

SEQ ID NO: 446635 - DNA, 25 bp, Mus musculus
gacactgtctctcaggaactgctgg

SEQ ID NO: 446636 - DNA, 25 bp, Mus musculus
gacactgtctctgaggaactgctgg

SEQ ID NO: 446637 - DNA, 25 bp, Mus musculus
gacactgtctcttgcaatacaatca

SEQ ID NO: 446638 - DNA, 25 bp, Mus musculus
gacactgtctgacatcctcatttca

SEQ ID NO: 446639 - DNA, 25 bp, Mus musculus
gacactgtctgacgcaggatgtcca

SEQ ID NO: 446640 - DNA, 25 bp, Mus musculus
gacactgtctgagatcctcatttca

SEQ ID NO: 446641 - DNA, 25 bp, Mus musculus
gacactgtctgaggcaggatgtcca

SEQ ID NO: 446642 - DNA, 25 bp, Mus musculus
gacactgtctgcctggacacactgc

SEQ ID NO: 446643 - DNA, 25 bp, Mus musculus
gacactgtctgcgtggacacactgc

SEQ ID NO: 446644 - DNA, 25 bp, Mus musculus
gacactgtctttattgggccaggtc

SEQ ID NO: 446645 - DNA, 25 bp, Mus musculus
gacactgtcttttttgggccaggtc

SEQ ID NO: 446646 - DNA, 25 bp, Mus musculus
gacactgtgacccttgtttccagaa

SEQ ID NO: 446647 - DNA, 25 bp, Mus musculus
gacactgtgaccgttgtttccagaa

SEQ ID NO: 446648 - DNA, 25 bp, Mus musculus
gacactgtgacgctcgtgtgcattg

SEQ ID NO: 446649 - DNA, 25 bp, Mus musculus
gacactgtgacggtcgtgtgcattg

SEQ ID NO: 446650 - DNA, 25 bp, Mus musculus
gacactgtgactagccaaaccaaag

SEQ ID NO: 446651 - DNA, 25 bp, Mus musculus
gacactgtgacttgccaaaccaaag

SEQ ID NO: 446652 - DNA, 25 bp, Mus musculus
gacactgtgagaattgattggccca

SEQ ID NO: 446653 - DNA, 25 bp, Mus musculus
gacactgtgagactcgggaccactt

SEQ ID NO: 446654 - DNA, 25 bp, Mus musculus
gacactgtgagagtcgggaccactt

SEQ ID NO: 446655 - DNA, 25 bp, Mus musculus
gacactgtgagatttgattggccca

SEQ ID NO: 446656 - DNA, 25 bp, Mus musculus
gacactgtgataaatcaaagtgcac

SEQ ID NO: 446657 - DNA, 25 bp, Mus musculus
gacactgtgatatatcaaagtgcac

SEQ ID NO: 446658 - DNA, 25 bp, Mus musculus
gacactgtgatgagagactcccttt

SEQ ID NO: 446659 - DNA, 25 bp, Mus musculus
gacactgtgatgtgagactcccttt

SEQ ID NO: 446660 - DNA, 25 bp, Mus musculus
gacactgtgcaacgtttataccgag

SEQ ID NO: 446661 - DNA, 25 bp, Mus musculus
gacactgtgcaaggtttataccgag

SEQ ID NO: 446662 - DNA, 25 bp, Mus musculus
gacactgtgcataacccatggaaca

SEQ ID NO: 446663 - DNA, 25 bp, Mus musculus
gacactgtgcattacccatggaaca

SEQ ID NO: 446664 - DNA, 25 bp, Mus musculus
gacactgtgccaacaccagaagatt

SEQ ID NO: 446665 - DNA, 25 bp, Mus musculus
gacactgtgccatcaccagaagatt

SEQ ID NO: 446666 - DNA, 25 bp, Mus musculus
gacactgtgcctcgtaacttgggtt

SEQ ID NO: 446667 - DNA, 25 bp, Mus musculus
gacactgtgcctggtaacttgggtt

SEQ ID NO: 446668 - DNA, 25 bp, Mus musculus
gacactgtgcttaccaccatagagg

SEQ ID NO: 446669 - DNA, 25 bp, Mus musculus
gacactgtgctttccaccatagagg

SEQ ID NO: 446670 - DNA, 25 bp, Mus musculus
gacactgtggtaatttctgggaccc

SEQ ID NO: 446671 - DNA, 25 bp, Mus musculus
gacactgtggtattttctgggaccc

SEQ ID NO: 446672 - DNA, 25 bp, Mus musculus
gacactgtgtaaatgaatccgatca

SEQ ID NO: 446673 - DNA, 25 bp, Mus musculus
gacactgtgtaattgaatccgatca

SEQ ID NO: 446674 - DNA, 25 bp, Mus musculus
gacactgtgtgacgcaatccacttt

SEQ ID NO: 446675 - DNA, 25 bp, Mus musculus
gacactgtgtgacgtcagcatctca

SEQ ID NO: 446676 - DNA, 25 bp, Mus musculus
gacactgtgtgaggcaatccacttt

SEQ ID NO: 446677 - DNA, 25 bp, Mus musculus
gacactgtgtgaggtcagcatctca

SEQ ID NO: 446678 - DNA, 25 bp, Mus musculus
gacactgttaagcagcctggtttcc

SEQ ID NO: 446679 - DNA, 25 bp, Mus musculus
gacactgttaaggagcctggtttcc

SEQ ID NO: 446680 - DNA, 25 bp, Mus musculus
gacactgttagacgctaaagtagca

SEQ ID NO: 446681 - DNA, 25 bp, Mus musculus
gacactgttagaggctaaagtagca

SEQ ID NO: 446682 - DNA, 25 bp, Mus musculus
gacactgttagccactcaaccaaga

SEQ ID NO: 446683 - DNA, 25 bp, Mus musculus
gacactgttagcgactcaaccaaga

SEQ ID NO: 446684 - DNA, 25 bp, Mus musculus
gacactgttatcatcgctgtttctt

SEQ ID NO: 446685 - DNA, 25 bp, Mus musculus
gacactgttatcttcgctgtttctt

SEQ ID NO: 446686 - DNA, 25 bp, Mus musculus
gacactgttcatatgtgagtcagta

SEQ ID NO: 446687 - DNA, 25 bp, Mus musculus
gacactgttcatctgtaaccccagc

SEQ ID NO: 446688 - DNA, 25 bp, Mus musculus
gacactgttcatgtgtaaccccagc

SEQ ID NO: 446689 - DNA, 25 bp, Mus musculus
gacactgttcatttgtgagtcagta

SEQ ID NO: 446690 - DNA, 25 bp, Mus musculus
gacactgttcttagctcaatgagca

SEQ ID NO: 446691 - DNA, 25 bp, Mus musculus
gacactgttctttgctcaatgagca

SEQ ID NO: 446692 - DNA, 25 bp, Mus musculus
gacactgttggtcacttttaagaca

SEQ ID NO: 446693 - DNA, 25 bp, Mus musculus
gacactgttggtgacttttaagaca

SEQ ID NO: 446694 - DNA, 25 bp, Mus musculus
gacactgttgtaacttgcgttggtt

SEQ ID NO: 446695 - DNA, 25 bp, Mus musculus
gacactgttgtatcttgcgttggtt

SEQ ID NO: 446696 - DNA, 25 bp, Mus musculus
gacactgtttcgacctgagcaggag

SEQ ID NO: 446697 - DNA, 25 bp, Mus musculus
gacactgtttcgtcctgagcaggag

SEQ ID NO: 446698 - DNA, 25 bp, Mus musculus
gacactgtttctagctagccaacat

SEQ ID NO: 446699 - DNA, 25 bp, Mus musculus
gacactgtttcttgctagccaacat

SEQ ID NO: 446700 - DNA, 25 bp, Mus musculus
gacacttaacacctgcagagatctg

SEQ ID NO: 446701 - DNA, 25 bp, Mus musculus
gacacttaacacgtgcagagatctg

SEQ ID NO: 446702 - DNA, 25 bp, Mus musculus
gacacttaagaactctcgtcctggg

SEQ ID NO: 446703 - DNA, 25 bp, Mus musculus
gacacttaagaagtctcgtcctggg

SEQ ID NO: 446704 - DNA, 25 bp, Mus musculus
gacacttaagtcatttagcatgcgt

SEQ ID NO: 446705 - DNA, 25 bp, Mus musculus
gacacttaagtcttttagcatgcgt

SEQ ID NO: 446706 - DNA, 25 bp, Mus musculus
gacacttaatggagacttcttgctt

SEQ ID NO: 446707 - DNA, 25 bp, Mus musculus
gacacttaatggtgacttcttgctt

SEQ ID NO: 446708 - DNA, 25 bp, Mus musculus
gacacttacacgctatggtccacta

SEQ ID NO: 446709 - DNA, 25 bp, Mus musculus
gacacttacacggtatggtccacta

SEQ ID NO: 446710 - DNA, 25 bp, Mus musculus
gacacttacagcactcaatgtggct

SEQ ID NO: 446711 - DNA, 25 bp, Mus musculus
gacacttacagcatgagtctcagct

SEQ ID NO: 446712 - DNA, 25 bp, Mus musculus
gacacttacagctctcaatgtggct

SEQ ID NO: 446713 - DNA, 25 bp, Mus musculus
gacacttacagcttgagtctcagct

SEQ ID NO: 446714 - DNA, 25 bp, Mus musculus
gacacttacggacagtgctgtacaa

SEQ ID NO: 446715 - DNA, 25 bp, Mus musculus
gacacttacggagagtgctgtacaa

SEQ ID NO: 446716 - DNA, 25 bp, Mus musculus
gacacttactccatgtggccaagaa

SEQ ID NO: 446717 - DNA, 25 bp, Mus musculus
gacacttactccttgtggccaagaa

SEQ ID NO: 446718 - DNA, 25 bp, Mus musculus
gacacttactgtctgtgacaggtta

SEQ ID NO: 446719 - DNA, 25 bp, Mus musculus
gacacttactgtgtgtgacaggtta

SEQ ID NO: 446720 - DNA, 25 bp, Mus musculus
gacacttattgtccatgggcttggg

SEQ ID NO: 446721 - DNA, 25 bp, Mus musculus
gacacttattgtgcatgggcttggg

SEQ ID NO: 446722 - DNA, 25 bp, Mus musculus
gacacttcacataatactggaacac

SEQ ID NO: 446723 - DNA, 25 bp, Mus musculus
gacacttcacatcatcactggttta

SEQ ID NO: 446724 - DNA, 25 bp, Mus musculus
gacacttcacatgatcactggttta

SEQ ID NO: 446725 - DNA, 25 bp, Mus musculus
gacacttcacattatactggaacac

SEQ ID NO: 446726 - DNA, 25 bp, Mus musculus
gacacttcagagactcaccaggaat

SEQ ID NO: 446727 - DNA, 25 bp, Mus musculus
gacacttcagagtctcaccaggaat

SEQ ID NO: 446728 - DNA, 25 bp, Mus musculus
gacacttcagtaaacctcgcttgga

SEQ ID NO: 446729 - DNA, 25 bp, Mus musculus
gacacttcagtactgacctttcctc

SEQ ID NO: 446730 - DNA, 25 bp, Mus musculus
gacacttcagtagtgacctttcctc

SEQ ID NO: 446731 - DNA, 25 bp, Mus musculus
gacacttcagtatacctcgcttgga

SEQ ID NO: 446732 - DNA, 25 bp, Mus musculus
gacacttcagtgagcacagcattca

SEQ ID NO: 446733 - DNA, 25 bp, Mus musculus
gacacttcagtgtgcacagcattca

SEQ ID NO: 446734 - DNA, 25 bp, Mus musculus
gacacttcatagaatcagtagacag

SEQ ID NO: 446735 - DNA, 25 bp, Mus musculus
gacacttcatagtatcagtagacag

SEQ ID NO: 446736 - DNA, 25 bp, Mus musculus
gacacttcatgaaaaccctgagtca

SEQ ID NO: 446737 - DNA, 25 bp, Mus musculus
gacacttcatgataaccctgagtca

SEQ ID NO: 446738 - DNA, 25 bp, Mus musculus
gacacttccaagcaccaaacctgag

SEQ ID NO: 446739 - DNA, 25 bp, Mus musculus
gacacttccaaggaccaaacctgag

SEQ ID NO: 446740 - DNA, 25 bp, Mus musculus
gacacttccaatcagtccagctcag

SEQ ID NO: 446741 - DNA, 25 bp, Mus musculus
gacacttccaatgagtccagctcag

SEQ ID NO: 446742 - DNA, 25 bp, Mus musculus
gacacttcctgaagagccgatggaa

SEQ ID NO: 446743 - DNA, 25 bp, Mus musculus
gacacttcctgacactagtgtttct

SEQ ID NO: 446744 - DNA, 25 bp, Mus musculus
gacacttcctgagactagtgtttct

SEQ ID NO: 446745 - DNA, 25 bp, Mus musculus
gacacttcctgatgagccgatggaa

SEQ ID NO: 446746 - DNA, 25 bp, Mus musculus
gacacttctaggatttgatgacttt

SEQ ID NO: 446747 - DNA, 25 bp, Mus musculus
gacacttctaggttttgatgacttt

SEQ ID NO: 446748 - DNA, 25 bp, Mus musculus
gacacttctcatatgatttcctagt

SEQ ID NO: 446749 - DNA, 25 bp, Mus musculus
gacacttctcatttgatttcctagt

SEQ ID NO: 446750 - DNA, 25 bp, Mus musculus
gacacttctcccagacttttcattc

SEQ ID NO: 446751 - DNA, 25 bp, Mus musculus
gacacttctccctgacttttcattc

SEQ ID NO: 446752 - DNA, 25 bp, Mus musculus
gacacttctggacatgtaatgcttt

SEQ ID NO: 446753 - DNA, 25 bp, Mus musculus
gacacttctggagatgtaatgcttt

SEQ ID NO: 446754 - DNA, 25 bp, Mus musculus
gacacttctgtgacctcagttaaat

SEQ ID NO: 446755 - DNA, 25 bp, Mus musculus
gacacttctgtgtcctcagttaaat

SEQ ID NO: 446756 - DNA, 25 bp, Mus musculus
gacacttctgttatcatgaccacca

SEQ ID NO: 446757 - DNA, 25 bp, Mus musculus
gacacttctgttttcatgaccacca

SEQ ID NO: 446758 - DNA, 25 bp, Mus musculus
gacacttcttatactatttctcatg

SEQ ID NO: 446759 - DNA, 25 bp, Mus musculus
gacacttcttattctatttctcatg

SEQ ID NO: 446760 - DNA, 25 bp, Mus musculus
gacacttcttttccgttgcaatcta

SEQ ID NO: 446761 - DNA, 25 bp, Mus musculus
gacacttcttttgcgttgcaatcta

SEQ ID NO: 446762 - DNA, 25 bp, Mus musculus
gacacttgaataattgcggtttgca

SEQ ID NO: 446763 - DNA, 25 bp, Mus musculus
gacacttgaatatttgcggtttgca

SEQ ID NO: 446764 - DNA, 25 bp, Mus musculus
gacacttgacagcataggatgagca

SEQ ID NO: 446765 - DNA, 25 bp, Mus musculus
gacacttgacaggataggatgagca

SEQ ID NO: 446766 - DNA, 25 bp, Mus musculus
gacacttgagacatgttcttgggcc

SEQ ID NO: 446767 - DNA, 25 bp, Mus musculus
gacacttgagacttgttcttgggcc

SEQ ID NO: 446768 - DNA, 25 bp, Mus musculus
gacacttgaggtctgaatggaccca

SEQ ID NO: 446769 - DNA, 25 bp, Mus musculus
gacacttgaggtgtgaatggaccca

SEQ ID NO: 446770 - DNA, 25 bp, Mus musculus
gacacttgagtgaattcagcctaga

SEQ ID NO: 446771 - DNA, 25 bp, Mus musculus
gacacttgagtgtattcagcctaga

SEQ ID NO: 446772 - DNA, 25 bp, Mus musculus
gacacttgatagaaaaatggctttc

SEQ ID NO: 446773 - DNA, 25 bp, Mus musculus
gacacttgatagtaaaatggctttc

SEQ ID NO: 446774 - DNA, 25 bp, Mus musculus
gacacttgattaaacagtttttctt

SEQ ID NO: 446775 - DNA, 25 bp, Mus musculus
gacacttgattatacagtttttctt

SEQ ID NO: 446776 - DNA, 25 bp, Mus musculus
gacacttgcagtcagtctaagcctg

SEQ ID NO: 446777 - DNA, 25 bp, Mus musculus
gacacttgcagtgagtctaagcctg

SEQ ID NO: 446778 - DNA, 25 bp, Mus musculus
gacacttgcgtcacgtttactagag

SEQ ID NO: 446779 - DNA, 25 bp, Mus musculus
gacacttgcgtctcgtttactagag

SEQ ID NO: 446780 - DNA, 25 bp, Mus musculus
gacacttgctggctccacctaagac

SEQ ID NO: 446781 - DNA, 25 bp, Mus musculus
gacacttgctgggtccacctaagac

SEQ ID NO: 446782 - DNA, 25 bp, Mus musculus
gacacttgctgtaggctgtagagta

SEQ ID NO: 446783 - DNA, 25 bp, Mus musculus
gacacttgctgttggctgtagagta

SEQ ID NO: 446784 - DNA, 25 bp, Mus musculus
gacacttggaatctggctgccgcgc

SEQ ID NO: 446785 - DNA, 25 bp, Mus musculus
gacacttggaatgtggctgccgcgc

SEQ ID NO: 446786 - DNA, 25 bp, Mus musculus
gacacttggcagaaggaccgtgccc

SEQ ID NO: 446787 - DNA, 25 bp, Mus musculus
gacacttggcagtaggaccgtgccc

SEQ ID NO: 446788 - DNA, 25 bp, Mus musculus
gacacttggcccatgttgagttaat

SEQ ID NO: 446789 - DNA, 25 bp, Mus musculus
gacacttggcccttgttgagttaat

SEQ ID NO: 446790 - DNA, 25 bp, Mus musculus
gacacttggcctatattagccgggt

SEQ ID NO: 446791 - DNA, 25 bp, Mus musculus
gacacttggcctttattagccgggt

SEQ ID NO: 446792 - DNA, 25 bp, Mus musculus
gacacttggcgacaaagccagacct

SEQ ID NO: 446793 - DNA, 25 bp, Mus musculus
gacacttggcgagaaagccagacct

SEQ ID NO: 446794 - DNA, 25 bp, Mus musculus
gacacttggcttactcctgctgtgt

SEQ ID NO: 446795 - DNA, 25 bp, Mus musculus
gacacttggctttctcctgctgtgt

SEQ ID NO: 446796 - DNA, 25 bp, Mus musculus
gacacttgggagagtcttttcaatt

SEQ ID NO: 446797 - DNA, 25 bp, Mus musculus
gacacttgggagtgtcttttcaatt

SEQ ID NO: 446798 - DNA, 25 bp, Mus musculus
gacacttgtaaacctgcggagcaga

SEQ ID NO: 446799 - DNA, 25 bp, Mus musculus
gacacttgtaaagctgcggagcaga

SEQ ID NO: 446800 - DNA, 25 bp, Mus musculus
gacacttgtatcctattagcactga

SEQ ID NO: 446801 - DNA, 25 bp, Mus musculus
gacacttgtatcgtattagcactga

SEQ ID NO: 446802 - DNA, 25 bp, Mus musculus
gacacttgtgaaatactaactgctg

SEQ ID NO: 446803 - DNA, 25 bp, Mus musculus
gacacttgtgaattactaactgctg

SEQ ID NO: 446804 - DNA, 25 bp, Mus musculus
gacacttgtgggaattcacgctcaa

SEQ ID NO: 446805 - DNA, 25 bp, Mus musculus
gacacttgtgggtattcacgctcaa

SEQ ID NO: 446806 - DNA, 25 bp, Mus musculus
gacacttgtttgctctacggtatct

SEQ ID NO: 446807 - DNA, 25 bp, Mus musculus
gacacttgtttggtctacggtatct

SEQ ID NO: 446808 - DNA, 25 bp, Mus musculus
gacactttaaagcactaccagccac

SEQ ID NO: 446809 - DNA, 25 bp, Mus musculus
gacactttaaaggactaccagccac

SEQ ID NO: 446810 - DNA, 25 bp, Mus musculus
gacactttaagaaggtttttcctct

SEQ ID NO: 446811 - DNA, 25 bp, Mus musculus
gacactttaagatggtttttcctct

SEQ ID NO: 446812 - DNA, 25 bp, Mus musculus
gacactttaagtatccaattctgaa

SEQ ID NO: 446813 - DNA, 25 bp, Mus musculus
gacactttaagtttccaattctgaa

SEQ ID NO: 446814 - DNA, 25 bp, Mus musculus
gacactttaatgatccatgcttggt

SEQ ID NO: 446815 - DNA, 25 bp, Mus musculus
gacactttaatgttccatgcttggt

SEQ ID NO: 446816 - DNA, 25 bp, Mus musculus
gacactttacatctgttctcacaca

SEQ ID NO: 446817 - DNA, 25 bp, Mus musculus
gacactttacatcttgatttcccca

SEQ ID NO: 446818 - DNA, 25 bp, Mus musculus
gacactttacatgtgttctcacaca

SEQ ID NO: 446819 - DNA, 25 bp, Mus musculus
gacactttacatgttgatttcccca

SEQ ID NO: 446820 - DNA, 25 bp, Mus musculus
gacactttaccaaagagcactctgc

SEQ ID NO: 446821 - DNA, 25 bp, Mus musculus
gacactttaccatagagcactctgc

SEQ ID NO: 446822 - DNA, 25 bp, Mus musculus
gacactttcccgataattgatgagg

SEQ ID NO: 446823 - DNA, 25 bp, Mus musculus
gacactttcccgttaattgatgagg

SEQ ID NO: 446824 - DNA, 25 bp, Mus musculus
gacactttccctcagaatcttaaac

SEQ ID NO: 446825 - DNA, 25 bp, Mus musculus
gacactttccctgagaatcttaaac

SEQ ID NO: 446826 - DNA, 25 bp, Mus musculus
gacactttcctaattctcaacatat

SEQ ID NO: 446827 - DNA, 25 bp, Mus musculus
gacactttcctatttctcaacatat

SEQ ID NO: 446828 - DNA, 25 bp, Mus musculus
gacactttctccagtatcatagcat

SEQ ID NO: 446829 - DNA, 25 bp, Mus musculus
gacactttctcctgtatcatagcat

SEQ ID NO: 446830 - DNA, 25 bp, Mus musculus
gacactttgaacagacaccaggccc

SEQ ID NO: 446831 - DNA, 25 bp, Mus musculus
gacactttgaactgacaccaggccc

SEQ ID NO: 446832 - DNA, 25 bp, Mus musculus
gacactttgagcaggccagtcacgt

SEQ ID NO: 446833 - DNA, 25 bp, Mus musculus
gacactttgagctggccagtcacgt

SEQ ID NO: 446834 - DNA, 25 bp, Mus musculus
gacactttgataatgtattccaccg

SEQ ID NO: 446835 - DNA, 25 bp, Mus musculus
gacactttgatattgtattccaccg

SEQ ID NO: 446836 - DNA, 25 bp, Mus musculus
gacactttgctaaggattccatgag

SEQ ID NO: 446837 - DNA, 25 bp, Mus musculus
gacactttgctatggattccatgag

SEQ ID NO: 446838 - DNA, 25 bp, Mus musculus
gacactttgctgatttagctcacaa

SEQ ID NO: 446839 - DNA, 25 bp, Mus musculus
gacactttgctgttttagctcacaa

SEQ ID NO: 446840 - DNA, 25 bp, Mus musculus
gacactttggtgcaatggcttggta

SEQ ID NO: 446841 - DNA, 25 bp, Mus musculus
gacactttggtggaatggcttggta

SEQ ID NO: 446842 - DNA, 25 bp, Mus musculus
gacactttgtagatgagatgctgtt

SEQ ID NO: 446843 - DNA, 25 bp, Mus musculus
gacactttgtagttgagatgctgtt

SEQ ID NO: 446844 - DNA, 25 bp, Mus musculus
gacacttttaagcttgtgcctgaca

SEQ ID NO: 446845 - DNA, 25 bp, Mus musculus
gacacttttaaggttgtgcctgaca

SEQ ID NO: 446846 - DNA, 25 bp, Mus musculus
gacacttttccacccttacctgatg

SEQ ID NO: 446847 - DNA, 25 bp, Mus musculus
gacacttttccagccttacctgatg

SEQ ID NO: 446848 - DNA, 25 bp, Mus musculus
gacacttttcttacaggtggcttta

SEQ ID NO: 446849 - DNA, 25 bp, Mus musculus
gacacttttctttcaggtggcttta

SEQ ID NO: 446850 - DNA, 25 bp, Mus musculus
gacacttttgatagctgggtttcca

SEQ ID NO: 446851 - DNA, 25 bp, Mus musculus
gacacttttgattgctgggtttcca

SEQ ID NO: 446852 - DNA, 25 bp, Mus musculus
gacacttttgtcacattcttgctag

SEQ ID NO: 446853 - DNA, 25 bp, Mus musculus
gacacttttgtcattttacccagtt

SEQ ID NO: 446854 - DNA, 25 bp, Mus musculus
gacacttttgtctcattcttgctag

SEQ ID NO: 446855 - DNA, 25 bp, Mus musculus
gacacttttgtctttttacccagtt

SEQ ID NO: 446856 - DNA, 25 bp, Mus musculus
gacacttttgtgcattacgatgttg

SEQ ID NO: 446857 - DNA, 25 bp, Mus musculus
gacacttttgtggattacgatgttg

SEQ ID NO: 446858 - DNA, 25 bp, Mus musculus
gacactttttccagctcaaatgcta

SEQ ID NO: 446859 - DNA, 25 bp, Mus musculus
gacactttttcctgctcaaatgcta

SEQ ID NO: 446860 - DNA, 25 bp, Mus musculus
gacactttttgcagatggaacatcc

SEQ ID NO: 446861 - DNA, 25 bp, Mus musculus
gacactttttgctgatggaacatcc

SEQ ID NO: 446862 - DNA, 25 bp, Mus musculus
gacagaaaaatacattcagccggta

SEQ ID NO: 446863 - DNA, 25 bp, Mus musculus
gacagaaaaatagattcagccggta

SEQ ID NO: 446864 - DNA, 25 bp, Mus musculus
gacagaaaaggcacccttcgattcg

SEQ ID NO: 446865 - DNA, 25 bp, Mus musculus
gacagaaaaggctcccttcgattcg

SEQ ID NO: 446866 - DNA, 25 bp, Mus musculus
gacagaaaagtcactgggaaggccc

SEQ ID NO: 446867 - DNA, 25 bp, Mus musculus
gacagaaaagtctctgggaaggccc

SEQ ID NO: 446868 - DNA, 25 bp, Mus musculus
gacagaaacagtccctcagggccaa

SEQ ID NO: 446869 - DNA, 25 bp, Mus musculus
gacagaaacagtgcctcagggccaa

SEQ ID NO: 446870 - DNA, 25 bp, Mus musculus
gacagaaaccaacaggctggagctt

SEQ ID NO: 446871 - DNA, 25 bp, Mus musculus
gacagaaaccaagaggctggagctt

SEQ ID NO: 446872 - DNA, 25 bp, Mus musculus
gacagaaacgtgcttttactgtagg

SEQ ID NO: 446873 - DNA, 25 bp, Mus musculus
gacagaaacgtggttttactgtagg

SEQ ID NO: 446874 - DNA, 25 bp, Mus musculus
gacagaaactgcagtggctgcccga

SEQ ID NO: 446875 - DNA, 25 bp, Mus musculus
gacagaaactgctgtggctgcccga

SEQ ID NO: 446876 - DNA, 25 bp, Mus musculus
gacagaaagaccagggtttcaccaa

SEQ ID NO: 446877 - DNA, 25 bp, Mus musculus
gacagaaagacctgggtttcaccaa

SEQ ID NO: 446878 - DNA, 25 bp, Mus musculus
gacagaaagcacaaggaacctaggg

SEQ ID NO: 446879 - DNA, 25 bp, Mus musculus
gacagaaagcactaggaacctaggg

SEQ ID NO: 446880 - DNA, 25 bp, Mus musculus
gacagaaagtatacccagttgggcg

SEQ ID NO: 446881 - DNA, 25 bp, Mus musculus
gacagaaagtattcccagttgggcg

SEQ ID NO: 446882 - DNA, 25 bp, Mus musculus
gacagaaagtcacctagatcctatg

SEQ ID NO: 446883 - DNA, 25 bp, Mus musculus
gacagaaagtcagctagatcctatg

SEQ ID NO: 446884 - DNA, 25 bp, Mus musculus
gacagaaagttgaatagctttcaaa

SEQ ID NO: 446885 - DNA, 25 bp, Mus musculus
gacagaaagttgtatagctttcaaa

SEQ ID NO: 446886 - DNA, 25 bp, Mus musculus
gacagaaatgatctattttccttaa

SEQ ID NO: 446887 - DNA, 25 bp, Mus musculus
gacagaaatgatgtattttccttaa

SEQ ID NO: 446888 - DNA, 25 bp, Mus musculus
gacagaaatgctactctagacacat

SEQ ID NO: 446889 - DNA, 25 bp, Mus musculus
gacagaaatgcttctctagacacat

SEQ ID NO: 446890 - DNA, 25 bp, Mus musculus
gacagaacaatcactagggtgtaca

SEQ ID NO: 446891 - DNA, 25 bp, Mus musculus
gacagaacaatctctagggtgtaca

SEQ ID NO: 446892 - DNA, 25 bp, Mus musculus
gacagaacacagacctttccatgag

SEQ ID NO: 446893 - DNA, 25 bp, Mus musculus
gacagaacacagtcctttccatgag

SEQ ID NO: 446894 - DNA, 25 bp, Mus musculus
gacagaacagaaccaaggctcccag

SEQ ID NO: 446895 - DNA, 25 bp, Mus musculus
gacagaacagaagcaaggctcccag

SEQ ID NO: 446896 - DNA, 25 bp, Mus musculus
gacagaacagataattccttaccct

SEQ ID NO: 446897 - DNA, 25 bp, Mus musculus
gacagaacagattattccttaccct

SEQ ID NO: 446898 - DNA, 25 bp, Mus musculus
gacagaacatccaccatttgtgctt

SEQ ID NO: 446899 - DNA, 25 bp, Mus musculus
gacagaacatcctccatttgtgctt

SEQ ID NO: 446900 - DNA, 25 bp, Mus musculus
gacagaacatgcaagagatcaggag

SEQ ID NO: 446901 - DNA, 25 bp, Mus musculus
gacagaacatgctagagatcaggag

SEQ ID NO: 446902 - DNA, 25 bp, Mus musculus
gacagaacatttctctgtttttctt

SEQ ID NO: 446903 - DNA, 25 bp, Mus musculus
gacagaacatttgtctgtttttctt

SEQ ID NO: 446904 - DNA, 25 bp, Mus musculus
gacagaaccaagatcggactcctgc

SEQ ID NO: 446905 - DNA, 25 bp, Mus musculus
gacagaaccaagttcggactcctgc

SEQ ID NO: 446906 - DNA, 25 bp, Mus musculus
gacagaaccatccaaagtttcccag

SEQ ID NO: 446907 - DNA, 25 bp, Mus musculus
gacagaaccatcgaaagtttcccag

SEQ ID NO: 446908 - DNA, 25 bp, Mus musculus
gacagaacccaaaggcttgagcagc

SEQ ID NO: 446909 - DNA, 25 bp, Mus musculus
gacagaacccaatggcttgagcagc

SEQ ID NO: 446910 - DNA, 25 bp, Mus musculus
gacagaacccaccacagataaaagc

SEQ ID NO: 446911 - DNA, 25 bp, Mus musculus
gacagaacccacgacagataaaagc

SEQ ID NO: 446912 - DNA, 25 bp, Mus musculus
gacagaaccccactgaggcggagct

SEQ ID NO: 446913 - DNA, 25 bp, Mus musculus
gacagaaccccagtgaggcggagct

SEQ ID NO: 446914 - DNA, 25 bp, Mus musculus
gacagaacgaggctcccagggactc

SEQ ID NO: 446915 - DNA, 25 bp, Mus musculus
gacagaacgagggtcccagggactc

SEQ ID NO: 446916 - DNA, 25 bp, Mus musculus
gacagaacgcaaagcccgcacgtaa

SEQ ID NO: 446917 - DNA, 25 bp, Mus musculus
gacagaacgcaatgcccgcacgtaa

SEQ ID NO: 446918 - DNA, 25 bp, Mus musculus
gacagaacgctgacatccataaaca

SEQ ID NO: 446919 - DNA, 25 bp, Mus musculus
gacagaacgctgtcatccataaaca

SEQ ID NO: 446920 - DNA, 25 bp, Mus musculus
gacagaacggccacagagacacagt

SEQ ID NO: 446921 - DNA, 25 bp, Mus musculus
gacagaacggcctcagagacacagt

SEQ ID NO: 446922 - DNA, 25 bp, Mus musculus
gacagaacgggtcagccttatggct

SEQ ID NO: 446923 - DNA, 25 bp, Mus musculus
gacagaacgggtgagccttatggct

SEQ ID NO: 446924 - DNA, 25 bp, Mus musculus
gacagaactccaaggatctttcatg

SEQ ID NO: 446925 - DNA, 25 bp, Mus musculus
gacagaactccatggatctttcatg

SEQ ID NO: 446926 - DNA, 25 bp, Mus musculus
gacagaactgaactcctctctcttg

SEQ ID NO: 446927 - DNA, 25 bp, Mus musculus
gacagaactgaagtcctctctcttg

SEQ ID NO: 446928 - DNA, 25 bp, Mus musculus
gacagaactgccctgtaactcaaat

SEQ ID NO: 446929 - DNA, 25 bp, Mus musculus
gacagaactgccgtgtaactcaaat

SEQ ID NO: 446930 - DNA, 25 bp, Mus musculus
gacagaactgtcaattgtaatacca

SEQ ID NO: 446931 - DNA, 25 bp, Mus musculus
gacagaactgtctattgtaatacca

SEQ ID NO: 446932 - DNA, 25 bp, Mus musculus
gacagaactgttactcttgcctatg

SEQ ID NO: 446933 - DNA, 25 bp, Mus musculus
gacagaactgtttctcttgcctatg

SEQ ID NO: 446934 - DNA, 25 bp, Mus musculus
gacagaacttgtacctatcgattca

SEQ ID NO: 446935 - DNA, 25 bp, Mus musculus
gacagaacttgttcctatcgattca

SEQ ID NO: 446936 - DNA, 25 bp, Mus musculus
gacagaactttcacatagcaacaag

SEQ ID NO: 446937 - DNA, 25 bp, Mus musculus
gacagaactttcatcctttgacttg

SEQ ID NO: 446938 - DNA, 25 bp, Mus musculus
gacagaactttctcatagcaacaag

SEQ ID NO: 446939 - DNA, 25 bp, Mus musculus
gacagaactttcttcctttgacttg

SEQ ID NO: 446940 - DNA, 25 bp, Mus musculus
gacagaagaatcatcatgtgtgcct

SEQ ID NO: 446941 - DNA, 25 bp, Mus musculus
gacagaagaatcttcatgtgtgcct

SEQ ID NO: 446942 - DNA, 25 bp, Mus musculus
gacagaagaattaccccactgggaa

SEQ ID NO: 446943 - DNA, 25 bp, Mus musculus
gacagaagaatttccccactgggaa

SEQ ID NO: 446944 - DNA, 25 bp, Mus musculus
gacagaagacgcatgtgtgcagaca

SEQ ID NO: 446945 - DNA, 25 bp, Mus musculus
gacagaagacgcttgtgtgcagaca

SEQ ID NO: 446946 - DNA, 25 bp, Mus musculus
gacagaagacggcatcacctgggat

SEQ ID NO: 446947 - DNA, 25 bp, Mus musculus
gacagaagacgggatcacctgggat

SEQ ID NO: 446948 - DNA, 25 bp, Mus musculus
gacagaagactcacctcgactcaaa

SEQ ID NO: 446949 - DNA, 25 bp, Mus musculus
gacagaagactctcctcgactcaaa

SEQ ID NO: 446950 - DNA, 25 bp, Mus musculus
gacagaagaggcagtgtttgcaaac

SEQ ID NO: 446951 - DNA, 25 bp, Mus musculus
gacagaagaggctgtgtttgcaaac

SEQ ID NO: 446952 - DNA, 25 bp, Mus musculus
gacagaagccatacacctctgtgaa

SEQ ID NO: 446953 - DNA, 25 bp, Mus musculus
gacagaagccattcacctctgtgaa

SEQ ID NO: 446954 - DNA, 25 bp, Mus musculus
gacagaagcctgcacacccctggtg

SEQ ID NO: 446955 - DNA, 25 bp, Mus musculus
gacagaagcctggacacccctggtg

SEQ ID NO: 446956 - DNA, 25 bp, Mus musculus
gacagaagcgatcctcctcggagga

SEQ ID NO: 446957 - DNA, 25 bp, Mus musculus
gacagaagcgatgctcctcggagga

SEQ ID NO: 446958 - DNA, 25 bp, Mus musculus
gacagaagcggtacctacaattaaa

SEQ ID NO: 446959 - DNA, 25 bp, Mus musculus
gacagaagcggttcctacaattaaa

SEQ ID NO: 446960 - DNA, 25 bp, Mus musculus
gacagaagctcgatattcacttata

SEQ ID NO: 446961 - DNA, 25 bp, Mus musculus
gacagaagctcgttattcacttata

SEQ ID NO: 446962 - DNA, 25 bp, Mus musculus
gacagaagctgccgagccccacagg

SEQ ID NO: 446963 - DNA, 25 bp, Mus musculus
gacagaagctgcggagccccacagg

SEQ ID NO: 446964 - DNA, 25 bp, Mus musculus
gacagaagctggatgcggcctacgt

SEQ ID NO: 446965 - DNA, 25 bp, Mus musculus
gacagaagctggttgcggcctacgt

SEQ ID NO: 446966 - DNA, 25 bp, Mus musculus
gacagaagcttcaatggcaggataa

SEQ ID NO: 446967 - DNA, 25 bp, Mus musculus
gacagaagcttcctatttatagaac

SEQ ID NO: 446968 - DNA, 25 bp, Mus musculus
gacagaagcttcgtatttatagaac

SEQ ID NO: 446969 - DNA, 25 bp, Mus musculus
gacagaagcttctatggcaggataa

SEQ ID NO: 446970 - DNA, 25 bp, Mus musculus
gacagaaggaatctgtcttctcaag

SEQ ID NO: 446971 - DNA, 25 bp, Mus musculus
gacagaaggaatgtgtcttctcaag

SEQ ID NO: 446972 - DNA, 25 bp, Mus musculus
gacagaaggataccgttgctccctc

SEQ ID NO: 446973 - DNA, 25 bp, Mus musculus
gacagaaggatagcgttgctccctc

SEQ ID NO: 446974 - DNA, 25 bp, Mus musculus
gacagaaggctcctgaactcatgag

SEQ ID NO: 446975 - DNA, 25 bp, Mus musculus
gacagaaggctcgtgaactcatgag

SEQ ID NO: 446976 - DNA, 25 bp, Mus musculus
gacagaaggcttagcattacaccaa

SEQ ID NO: 446977 - DNA, 25 bp, Mus musculus
gacagaaggcttatgaacactgatt

SEQ ID NO: 446978 - DNA, 25 bp, Mus musculus
gacagaaggctttgcattacaccaa

SEQ ID NO: 446979 - DNA, 25 bp, Mus musculus
gacagaaggcttttgaacactgatt

SEQ ID NO: 446980 - DNA, 25 bp, Mus musculus
gacagaagggacaggtagcttgaac

SEQ ID NO: 446981 - DNA, 25 bp, Mus musculus
gacagaagggactggtagcttgaac

SEQ ID NO: 446982 - DNA, 25 bp, Mus musculus
gacagaagggagaacagaagcgcct

SEQ ID NO: 446983 - DNA, 25 bp, Mus musculus
gacagaagggagtacagaagcgcct

SEQ ID NO: 446984 - DNA, 25 bp, Mus musculus
gacagaagtccacggccagactacc

SEQ ID NO: 446985 - DNA, 25 bp, Mus musculus
gacagaagtccagggccagactacc

SEQ ID NO: 446986 - DNA, 25 bp, Mus musculus
gacagaagtctcatgcagtggtcat

SEQ ID NO: 446987 - DNA, 25 bp, Mus musculus
gacagaagtctcttgcagtggtcat

SEQ ID NO: 446988 - DNA, 25 bp, Mus musculus
gacagaagttcactaaattcttacc

SEQ ID NO: 446989 - DNA, 25 bp, Mus musculus
gacagaagttcagtaaattcttacc

SEQ ID NO: 446990 - DNA, 25 bp, Mus musculus
gacagaagtttgatccccaggcata

SEQ ID NO: 446991 - DNA, 25 bp, Mus musculus
gacagaagtttgttccccaggcata

SEQ ID NO: 446992 - DNA, 25 bp, Mus musculus
gacagaataaccaggacaggtgcct

SEQ ID NO: 446993 - DNA, 25 bp, Mus musculus
gacagaataacctggacaggtgcct

SEQ ID NO: 446994 - DNA, 25 bp, Mus musculus
gacagaatacataagagactcccaa

SEQ ID NO: 446995 - DNA, 25 bp, Mus musculus
gacagaatacattagagactcccaa

SEQ ID NO: 446996 - DNA, 25 bp, Mus musculus
gacagaatagagacatcacagtgat

SEQ ID NO: 446997 - DNA, 25 bp, Mus musculus
gacagaatagagtcatcacagtgat

SEQ ID NO: 446998 - DNA, 25 bp, Mus musculus
gacagaatattcctatgtctgacaa

SEQ ID NO: 446999 - DNA, 25 bp, Mus musculus
gacagaatattcgtatgtctgacaa

SEQ ID NO: 447000 - DNA, 25 bp, Mus musculus
gacagaatccacacctaagttagga

SEQ ID NO: 447001 - DNA, 25 bp, Mus musculus
gacagaatccactcctaagttagga

SEQ ID NO: 447002 - DNA, 25 bp, Mus musculus
gacagaatccttatccttgaacctt

SEQ ID NO: 447003 - DNA, 25 bp, Mus musculus
gacagaatccttttccttgaacctt

SEQ ID NO: 447004 - DNA, 25 bp, Mus musculus
gacagaatctctagctattatttag

SEQ ID NO: 447005 - DNA, 25 bp, Mus musculus
gacagaatctcttgctattatttag

SEQ ID NO: 447006 - DNA, 25 bp, Mus musculus
gacagaatctgtcaatgagcccata

SEQ ID NO: 447007 - DNA, 25 bp, Mus musculus
gacagaatctgtgaatgagcccata

SEQ ID NO: 447008 - DNA, 25 bp, Mus musculus
gacagaatcttaaaacacttggagt

SEQ ID NO: 447009 - DNA, 25 bp, Mus musculus
gacagaatcttataacacttggagt

SEQ ID NO: 447010 - DNA, 25 bp, Mus musculus
gacagaatgactcgtctcagacatt

SEQ ID NO: 447011 - DNA, 25 bp, Mus musculus
gacagaatgactggtctcagacatt

SEQ ID NO: 447012 - DNA, 25 bp, Mus musculus
gacagaatgtacattccttactgga

SEQ ID NO: 447013 - DNA, 25 bp, Mus musculus
gacagaatgtactttccttactgga

SEQ ID NO: 447014 - DNA, 25 bp, Mus musculus
gacagaatgtccatgcacgcaagaa

SEQ ID NO: 447015 - DNA, 25 bp, Mus musculus
gacagaatgtccttgcacgcaagaa

SEQ ID NO: 447016 - DNA, 25 bp, Mus musculus
gacagaattattctttccagcagtg

SEQ ID NO: 447017 - DNA, 25 bp, Mus musculus
gacagaattattgtttccagcagtg

SEQ ID NO: 447018 - DNA, 25 bp, Mus musculus
gacagaattcacacatattcgggca

SEQ ID NO: 447019 - DNA, 25 bp, Mus musculus
gacagaattcactcatattcgggca

SEQ ID NO: 447020 - DNA, 25 bp, Mus musculus
gacagaattcccaaaagcctctaag

SEQ ID NO: 447021 - DNA, 25 bp, Mus musculus
gacagaattccctaaagcctctaag

SEQ ID NO: 447022 - DNA, 25 bp, Mus musculus
gacagaattcctctttcaaagttac

SEQ ID NO: 447023 - DNA, 25 bp, Mus musculus
gacagaattcctgtttcaaagttac

SEQ ID NO: 447024 - DNA, 25 bp, Mus musculus
gacagaattgaaatgcctgtggcca

SEQ ID NO: 447025 - DNA, 25 bp, Mus musculus
gacagaattgaattgcctgtggcca

SEQ ID NO: 447026 - DNA, 25 bp, Mus musculus
gacagaattgacatccccccaggag

SEQ ID NO: 447027 - DNA, 25 bp, Mus musculus
gacagaattgacttccccccaggag

SEQ ID NO: 447028 - DNA, 25 bp, Mus musculus
gacagaattgagaacatgcctttct

SEQ ID NO: 447029 - DNA, 25 bp, Mus musculus
gacagaattgagtacatgcctttct

SEQ ID NO: 447030 - DNA, 25 bp, Mus musculus
gacagaatttacagctattggtatt

SEQ ID NO: 447031 - DNA, 25 bp, Mus musculus
gacagaatttactgctattggtatt

SEQ ID NO: 447032 - DNA, 25 bp, Mus musculus
gacagacaaagtatcctccagcgaa

SEQ ID NO: 447033 - DNA, 25 bp, Mus musculus
gacagacaaagtttcctccagcgaa

SEQ ID NO: 447034 - DNA, 25 bp, Mus musculus
gacagacaacacacaaccggataaa

SEQ ID NO: 447035 - DNA, 25 bp, Mus musculus
gacagacaacactcaaccggataaa

SEQ ID NO: 447036 - DNA, 25 bp, Mus musculus
gacagacaagataggagcccagctt

SEQ ID NO: 447037 - DNA, 25 bp, Mus musculus
gacagacaagattggagcccagctt

SEQ ID NO: 447038 - DNA, 25 bp, Mus musculus
gacagacaagcaagtcccttaggaa

SEQ ID NO: 447039 - DNA, 25 bp, Mus musculus
gacagacaagcaagttcttatccta

SEQ ID NO: 447040 - DNA, 25 bp, Mus musculus
gacagacaagcatgtcccttaggaa

SEQ ID NO: 447041 - DNA, 25 bp, Mus musculus
gacagacaagcatgttcttatccta

SEQ ID NO: 447042 - DNA, 25 bp, Mus musculus
gacagacaagtacatcctttgctcc

SEQ ID NO: 447043 - DNA, 25 bp, Mus musculus
gacagacaagtagatcctttgctcc

SEQ ID NO: 447044 - DNA, 25 bp, Mus musculus
gacagacaatgccaggcgctgaact

SEQ ID NO: 447045 - DNA, 25 bp, Mus musculus
gacagacaatgcgaggcgctgaact

SEQ ID NO: 447046 - DNA, 25 bp, Mus musculus
gacagacaatgtcaaagtgccattc

SEQ ID NO: 447047 - DNA, 25 bp, Mus musculus
gacagacaatgtgaaagtgccattc

SEQ ID NO: 447048 - DNA, 25 bp, Mus musculus
gacagacacacaagacactcggtga

SEQ ID NO: 447049 - DNA, 25 bp, Mus musculus
gacagacacacatgacactcggtga

SEQ ID NO: 447050 - DNA, 25 bp, Mus musculus
gacagacacagcagtacagactgaa

SEQ ID NO: 447051 - DNA, 25 bp, Mus musculus
gacagacacagctgtacagactgaa

SEQ ID NO: 447052 - DNA, 25 bp, Mus musculus
gacagacacagtagccttctttata

SEQ ID NO: 447053 - DNA, 25 bp, Mus musculus
gacagacacagttgccttctttata

SEQ ID NO: 447054 - DNA, 25 bp, Mus musculus
gacagacacataagcctgtgatttt

SEQ ID NO: 447055 - DNA, 25 bp, Mus musculus
gacagacacatatgcctgtgatttt

SEQ ID NO: 447056 - DNA, 25 bp, Mus musculus
gacagacacattaagatggaatctt

SEQ ID NO: 447057 - DNA, 25 bp, Mus musculus
gacagacacatttagatggaatctt

SEQ ID NO: 447058 - DNA, 25 bp, Mus musculus
gacagacacctcagggttgaaggga

SEQ ID NO: 447059 - DNA, 25 bp, Mus musculus
gacagacacctctgggttgaaggga

SEQ ID NO: 447060 - DNA, 25 bp, Mus musculus
gacagacaccttcagagggttttat

SEQ ID NO: 447061 - DNA, 25 bp, Mus musculus
gacagacaccttgagagggttttat

SEQ ID NO: 447062 - DNA, 25 bp, Mus musculus
gacagacacgcacggagtccgagct

SEQ ID NO: 447063 - DNA, 25 bp, Mus musculus
gacagacacgcagggagtccgagct

SEQ ID NO: 447064 - DNA, 25 bp, Mus musculus
gacagacacggaaacctacagagac

SEQ ID NO: 447065 - DNA, 25 bp, Mus musculus
gacagacacggatacctacagagac

SEQ ID NO: 447066 - DNA, 25 bp, Mus musculus
gacagacactaactttgtactggtt

SEQ ID NO: 447067 - DNA, 25 bp, Mus musculus
gacagacactaagtttgtactggtt

SEQ ID NO: 447068 - DNA, 25 bp, Mus musculus
gacagacactcaagacagcaagctt

SEQ ID NO: 447069 - DNA, 25 bp, Mus musculus
gacagacactcatgacagcaagctt

SEQ ID NO: 447070 - DNA, 25 bp, Mus musculus
gacagacactgtcttcaaggacgta

SEQ ID NO: 447071 - DNA, 25 bp, Mus musculus
gacagacactgtgttcaaggacgta

SEQ ID NO: 447072 - DNA, 25 bp, Mus musculus
gacagacacttaactcagtaccatg

SEQ ID NO: 447073 - DNA, 25 bp, Mus musculus
gacagacacttatctcagtaccatg

SEQ ID NO: 447074 - DNA, 25 bp, Mus musculus
gacagacactttccccagaagcgta

SEQ ID NO: 447075 - DNA, 25 bp, Mus musculus
gacagacactttgcccagaagcgta

SEQ ID NO: 447076 - DNA, 25 bp, Mus musculus
gacagacagaccactagcgacggca

SEQ ID NO: 447077 - DNA, 25 bp, Mus musculus
gacagacagacctctagcgacggca

SEQ ID NO: 447078 - DNA, 25 bp, Mus musculus
gacagacagcccctcaggatagagt

SEQ ID NO: 447079 - DNA, 25 bp, Mus musculus
gacagacagcccgtcaggatagagt

SEQ ID NO: 447080 - DNA, 25 bp, Mus musculus
gacagacagcttacaaggtcccttg

SEQ ID NO: 447081 - DNA, 25 bp, Mus musculus
gacagacagctttcaaggtcccttg

SEQ ID NO: 447082 - DNA, 25 bp, Mus musculus
gacagacaggcgcatccaacactcg

SEQ ID NO: 447083 - DNA, 25 bp, Mus musculus
gacagacaggcggatccaacactcg

SEQ ID NO: 447084 - DNA, 25 bp, Mus musculus
gacagacagggcacttacatacaca

SEQ ID NO: 447085 - DNA, 25 bp, Mus musculus
gacagacagggctcttacatacaca

SEQ ID NO: 447086 - DNA, 25 bp, Mus musculus
gacagacaggtgcaactgccagtat

SEQ ID NO: 447087 - DNA, 25 bp, Mus musculus
gacagacaggtggaactgccagtat

SEQ ID NO: 447088 - DNA, 25 bp, Mus musculus
gacagacagtgtccattttgggact

SEQ ID NO: 447089 - DNA, 25 bp, Mus musculus
gacagacagtgtgcattttgggact

SEQ ID NO: 447090 - DNA, 25 bp, Mus musculus
gacagacatagccagactcaactct

SEQ ID NO: 447091 - DNA, 25 bp, Mus musculus
gacagacatagcgagactcaactct

SEQ ID NO: 447092 - DNA, 25 bp, Mus musculus
gacagacatatgatgacgccggcat

SEQ ID NO: 447093 - DNA, 25 bp, Mus musculus
gacagacatatgttgacgccggcat

SEQ ID NO: 447094 - DNA, 25 bp, Mus musculus
gacagacatccgcagagacgacaga

SEQ ID NO: 447095 - DNA, 25 bp, Mus musculus
gacagacatccggagagacgacaga

SEQ ID NO: 447096 - DNA, 25 bp, Mus musculus
gacagacatctccatgaacgtattt

SEQ ID NO: 447097 - DNA, 25 bp, Mus musculus
gacagacatctcgatgaacgtattt

SEQ ID NO: 447098 - DNA, 25 bp, Mus musculus
gacagacatctgagtcttctgctca

SEQ ID NO: 447099 - DNA, 25 bp, Mus musculus
gacagacatctgtgtcttctgctca

SEQ ID NO: 447100 - DNA, 25 bp, Mus musculus
gacagacatgccatacaggtacttt

SEQ ID NO: 447101 - DNA, 25 bp, Mus musculus
gacagacatgccttacaggtacttt

SEQ ID NO: 447102 - DNA, 25 bp, Mus musculus
gacagacatgctcaagacagagcta

SEQ ID NO: 447103 - DNA, 25 bp, Mus musculus
gacagacatgctctctgcaaataag

SEQ ID NO: 447104 - DNA, 25 bp, Mus musculus
gacagacatgctgaagacagagcta

SEQ ID NO: 447105 - DNA, 25 bp, Mus musculus
gacagacatgctgtctgcaaataag

SEQ ID NO: 447106 - DNA, 25 bp, Mus musculus
gacagacattccaactctgtgcaac

SEQ ID NO: 447107 - DNA, 25 bp, Mus musculus
gacagacattcctactctgtgcaac

SEQ ID NO: 447108 - DNA, 25 bp, Mus musculus
gacagacattcgaaatgtgcttatc

SEQ ID NO: 447109 - DNA, 25 bp, Mus musculus
gacagacattcgtaatgtgcttatc

SEQ ID NO: 447110 - DNA, 25 bp, Mus musculus
gacagacattctaccatctaaggaa

SEQ ID NO: 447111 - DNA, 25 bp, Mus musculus
gacagacattcttccatctaaggaa

SEQ ID NO: 447112 - DNA, 25 bp, Mus musculus
gacagacattgcagcctttgtgaag

SEQ ID NO: 447113 - DNA, 25 bp, Mus musculus
gacagacattgctgcctttgtgaag

SEQ ID NO: 447114 - DNA, 25 bp, Mus musculus
gacagacccaaacttcttctctagc

SEQ ID NO: 447115 - DNA, 25 bp, Mus musculus
gacagacccaaagttcttctctagc

SEQ ID NO: 447116 - DNA, 25 bp, Mus musculus
gacagacccagaagtgccacgtggc

SEQ ID NO: 447117 - DNA, 25 bp, Mus musculus
gacagacccagatgtgccacgtggc

SEQ ID NO: 447118 - DNA, 25 bp, Mus musculus
gacagacccgtgaaactggtttaca

SEQ ID NO: 447119 - DNA, 25 bp, Mus musculus
gacagacccgtgtaactggtttaca

SEQ ID NO: 447120 - DNA, 25 bp, Mus musculus
gacagaccgaacctgccgggtaatc

SEQ ID NO: 447121 - DNA, 25 bp, Mus musculus
gacagaccgaacgtgccgggtaatc

SEQ ID NO: 447122 - DNA, 25 bp, Mus musculus
gacagaccgagtcgcctttaacgaa

SEQ ID NO: 447123 - DNA, 25 bp, Mus musculus
gacagaccgagtggcctttaacgaa

SEQ ID NO: 447124 - DNA, 25 bp, Mus musculus
gacagaccggaaactctgctctgat

SEQ ID NO: 447125 - DNA, 25 bp, Mus musculus
gacagaccggaatctctgctctgat

SEQ ID NO: 447126 - DNA, 25 bp, Mus musculus
gacagacctgaaaagtgacctcctt

SEQ ID NO: 447127 - DNA, 25 bp, Mus musculus
gacagacctgaacggtgacgaccta

SEQ ID NO: 447128 - DNA, 25 bp, Mus musculus
gacagacctgaagggtgacgaccta

SEQ ID NO: 447129 - DNA, 25 bp, Mus musculus
gacagacctgaatagtgacctcctt

SEQ ID NO: 447130 - DNA, 25 bp, Mus musculus
gacagacctgatatgggacaccacc

SEQ ID NO: 447131 - DNA, 25 bp, Mus musculus
gacagacctgatttgggacaccacc

SEQ ID NO: 447132 - DNA, 25 bp, Mus musculus
gacagacctggtattgcaagtacta

SEQ ID NO: 447133 - DNA, 25 bp, Mus musculus
gacagacctggttttgcaagtacta

SEQ ID NO: 447134 - DNA, 25 bp, Mus musculus
gacagacctgtccagaaatgctcag

SEQ ID NO: 447135 - DNA, 25 bp, Mus musculus
gacagacctgtcgagaaatgctcag

SEQ ID NO: 447136 - DNA, 25 bp, Mus musculus
gacagacctttactgaggcaaaccc

SEQ ID NO: 447137 - DNA, 25 bp, Mus musculus
gacagacctttagtgaggcaaaccc

SEQ ID NO: 447138 - DNA, 25 bp, Mus musculus
gacagacgaagtattgacccatgac

SEQ ID NO: 447139 - DNA, 25 bp, Mus musculus
gacagacgaagttttgacccatgac

SEQ ID NO: 447140 - DNA, 25 bp, Mus musculus
gacagacgagtcatcacttaaactt

SEQ ID NO: 447141 - DNA, 25 bp, Mus musculus
gacagacgagtcttcacttaaactt

SEQ ID NO: 447142 - DNA, 25 bp, Mus musculus
gacagacgcaagcaatctcaccaat

SEQ ID NO: 447143 - DNA, 25 bp, Mus musculus
gacagacgcaaggaatctcaccaat

SEQ ID NO: 447144 - DNA, 25 bp, Mus musculus
gacagacgcctgattccacggaagt

SEQ ID NO: 447145 - DNA, 25 bp, Mus musculus
gacagacgcctgtttccacggaagt

SEQ ID NO: 447146 - DNA, 25 bp, Mus musculus
gacagacgcgcgacaagcatagccg

SEQ ID NO: 447147 - DNA, 25 bp, Mus musculus
gacagacgcgcgtcaagcatagccg

SEQ ID NO: 447148 - DNA, 25 bp, Mus musculus
gacagacgcgggagcttcctgttgc

SEQ ID NO: 447149 - DNA, 25 bp, Mus musculus
gacagacgcgggtgcttcctgttgc

SEQ ID NO: 447150 - DNA, 25 bp, Mus musculus
gacagacgcttgagtgatggatcca

SEQ ID NO: 447151 - DNA, 25 bp, Mus musculus
gacagacgcttgtgtgatggatcca

SEQ ID NO: 447152 - DNA, 25 bp, Mus musculus
gacagacgggatagccaaggaagtt

SEQ ID NO: 447153 - DNA, 25 bp, Mus musculus
gacagacgggattgccaaggaagtt

SEQ ID NO: 447154 - DNA, 25 bp, Mus musculus
gacagacgggccaagcccggacata

SEQ ID NO: 447155 - DNA, 25 bp, Mus musculus
gacagacgggcctagcccggacata

SEQ ID NO: 447156 - DNA, 25 bp, Mus musculus
gacagacggttactagagagcagct

SEQ ID NO: 447157 - DNA, 25 bp, Mus musculus
gacagacggttagtagagagcagct

SEQ ID NO: 447158 - DNA, 25 bp, Mus musculus
gacagacgtcgtcggcatgacagac

SEQ ID NO: 447159 - DNA, 25 bp, Mus musculus
gacagacgtcgtgggcatgacagac

SEQ ID NO: 447160 - DNA, 25 bp, Mus musculus
gacagacgtctacgctggttccttt

SEQ ID NO: 447161 - DNA, 25 bp, Mus musculus
gacagacgtctaggctggttccttt

SEQ ID NO: 447162 - DNA, 25 bp, Mus musculus
gacagacgtctcctaagattcttat

SEQ ID NO: 447163 - DNA, 25 bp, Mus musculus
gacagacgtctcgtaagattcttat

SEQ ID NO: 447164 - DNA, 25 bp, Mus musculus
gacagacgtgcgagagacgggagat

SEQ ID NO: 447165 - DNA, 25 bp, Mus musculus
gacagacgtgcgtgagacgggagat

SEQ ID NO: 447166 - DNA, 25 bp, Mus musculus
gacagacgtttgaggcaatgcggct

SEQ ID NO: 447167 - DNA, 25 bp, Mus musculus
gacagacgtttgtggcaatgcggct

SEQ ID NO: 447168 - DNA, 25 bp, Mus musculus
gacagactaaccacttgagttctag

SEQ ID NO: 447169 - DNA, 25 bp, Mus musculus
gacagactaacctcttgagttctag

SEQ ID NO: 447170 - DNA, 25 bp, Mus musculus
gacagactagacagcgtggtcccag

SEQ ID NO: 447171 - DNA, 25 bp, Mus musculus
gacagactagactgcgtggtcccag

SEQ ID NO: 447172 - DNA, 25 bp, Mus musculus
gacagactagttaacacactgtggg

SEQ ID NO: 447173 - DNA, 25 bp, Mus musculus
gacagactagtttacacactgtggg

SEQ ID NO: 447174 - DNA, 25 bp, Mus musculus
gacagactatcactttttcaaaatt

SEQ ID NO: 447175 - DNA, 25 bp, Mus musculus
gacagactatcagtttttcaaaatt

SEQ ID NO: 447176 - DNA, 25 bp, Mus musculus
gacagactcattatatgcagtggac

SEQ ID NO: 447177 - DNA, 25 bp, Mus musculus
gacagactcattttatgcagtggac

SEQ ID NO: 447178 - DNA, 25 bp, Mus musculus
gacagactctaccttgacgtggtcg

SEQ ID NO: 447179 - DNA, 25 bp, Mus musculus
gacagactctacgttgacgtggtcg

SEQ ID NO: 447180 - DNA, 25 bp, Mus musculus
gacagactcttaccacagcgtgttt

SEQ ID NO: 447181 - DNA, 25 bp, Mus musculus
gacagactcttagcacagcgtgttt

SEQ ID NO: 447182 - DNA, 25 bp, Mus musculus
gacagactgaatagggccttcaact

SEQ ID NO: 447183 - DNA, 25 bp, Mus musculus
gacagactgaattgggccttcaact

SEQ ID NO: 447184 - DNA, 25 bp, Mus musculus
gacagactgaggatggagctgaact

SEQ ID NO: 447185 - DNA, 25 bp, Mus musculus
gacagactgaggcaaaattccctga

SEQ ID NO: 447186 - DNA, 25 bp, Mus musculus
gacagactgagggaaaattccctga

SEQ ID NO: 447187 - DNA, 25 bp, Mus musculus
gacagactgaggttggagctgaact

SEQ ID NO: 447188 - DNA, 25 bp, Mus musculus
gacagactgcctcgggcgctgctta

SEQ ID NO: 447189 - DNA, 25 bp, Mus musculus
gacagactgcctggggcgctgctta

SEQ ID NO: 447190 - DNA, 25 bp, Mus musculus
gacagactgctacactggatgttta

SEQ ID NO: 447191 - DNA, 25 bp, Mus musculus
gacagactgctagactggatgttta

SEQ ID NO: 447192 - DNA, 25 bp, Mus musculus
gacagactggaaagacatgtccaag

SEQ ID NO: 447193 - DNA, 25 bp, Mus musculus
gacagactggaatgacatgtccaag

SEQ ID NO: 447194 - DNA, 25 bp, Mus musculus
gacagactggatcccattatttggc

SEQ ID NO: 447195 - DNA, 25 bp, Mus musculus
gacagactggatgccattatttggc

SEQ ID NO: 447196 - DNA, 25 bp, Mus musculus
gacagactgtgactgggaccttgca

SEQ ID NO: 447197 - DNA, 25 bp, Mus musculus
gacagactgtgagtgggaccttgca

SEQ ID NO: 447198 - DNA, 25 bp, Mus musculus
gacagacttaaaactgcttcctcca

SEQ ID NO: 447199 - DNA, 25 bp, Mus musculus
gacagacttaaatctgcttcctcca

SEQ ID NO: 447200 - DNA, 25 bp, Mus musculus
gacagacttaacactctagttcctt

SEQ ID NO: 447201 - DNA, 25 bp, Mus musculus
gacagacttaactctctagttcctt

SEQ ID NO: 447202 - DNA, 25 bp, Mus musculus
gacagacttcctaacagtggcccca

SEQ ID NO: 447203 - DNA, 25 bp, Mus musculus
gacagacttccttacagtggcccca

SEQ ID NO: 447204 - DNA, 25 bp, Mus musculus
gacagacttctgaggacatgccggg

SEQ ID NO: 447205 - DNA, 25 bp, Mus musculus
gacagacttctgtggacatgccggg

SEQ ID NO: 447206 - DNA, 25 bp, Mus musculus
gacagacttgtcattacatttgtaa

SEQ ID NO: 447207 - DNA, 25 bp, Mus musculus
gacagacttgtctttacatttgtaa

SEQ ID NO: 447208 - DNA, 25 bp, Mus musculus
gacagactttatctaccagacccaa

SEQ ID NO: 447209 - DNA, 25 bp, Mus musculus
gacagactttatgtaccagacccaa

SEQ ID NO: 447210 - DNA, 25 bp, Mus musculus
gacagactttctcatgaacccaatg

SEQ ID NO: 447211 - DNA, 25 bp, Mus musculus
gacagactttctgatgaacccaatg

SEQ ID NO: 447212 - DNA, 25 bp, Mus musculus
gacagactttgtacagctcacttac

SEQ ID NO: 447213 - DNA, 25 bp, Mus musculus
gacagactttgttcagctcacttac

SEQ ID NO: 447214 - DNA, 25 bp, Mus musculus
gacagagaaacgatcgctacttatc

SEQ ID NO: 447215 - DNA, 25 bp, Mus musculus
gacagagaaacgttcgctacttatc

SEQ ID NO: 447216 - DNA, 25 bp, Mus musculus
gacagagaacacctagcaggaatgt

SEQ ID NO: 447217 - DNA, 25 bp, Mus musculus
gacagagaacacgtagcaggaatgt

SEQ ID NO: 447218 - DNA, 25 bp, Mus musculus
gacagagaaccccaacagaagcggg

SEQ ID NO: 447219 - DNA, 25 bp, Mus musculus
gacagagaacccgaacagaagcggg

SEQ ID NO: 447220 - DNA, 25 bp, Mus musculus
gacagagaaccgctactgcgtgcag

SEQ ID NO: 447221 - DNA, 25 bp, Mus musculus
gacagagaaccggtactgcgtgcag

SEQ ID NO: 447222 - DNA, 25 bp, Mus musculus
gacagagaacggcattaaacaggat

SEQ ID NO: 447223 - DNA, 25 bp, Mus musculus
gacagagaacgggattaaacaggat

SEQ ID NO: 447224 - DNA, 25 bp, Mus musculus
gacagagaactgaggcgactgcact

SEQ ID NO: 447225 - DNA, 25 bp, Mus musculus
gacagagaactgtggcgactgcact

SEQ ID NO: 447226 - DNA, 25 bp, Mus musculus
gacagagaataaatttgtacttatt

SEQ ID NO: 447227 - DNA, 25 bp, Mus musculus
gacagagaataattttgtacttatt

SEQ ID NO: 447228 - DNA, 25 bp, Mus musculus
gacagagaatgcacggccttcagag

SEQ ID NO: 447229 - DNA, 25 bp, Mus musculus
gacagagaatgctcggccttcagag

SEQ ID NO: 447230 - DNA, 25 bp, Mus musculus
gacagagacaccaggcatgccagaa

SEQ ID NO: 447231 - DNA, 25 bp, Mus musculus
gacagagacacctggcatgccagaa

SEQ ID NO: 447232 - DNA, 25 bp, Mus musculus
gacagagacagacatgagccttcac

SEQ ID NO: 447233 - DNA, 25 bp, Mus musculus
gacagagacagagatgagccttcac

SEQ ID NO: 447234 - DNA, 25 bp, Mus musculus
gacagagacaggcattctagagata

SEQ ID NO: 447235 - DNA, 25 bp, Mus musculus
gacagagacagggattctagagata

SEQ ID NO: 447236 - DNA, 25 bp, Mus musculus
gacagagacagtacacacctagtgt

SEQ ID NO: 447237 - DNA, 25 bp, Mus musculus
gacagagacagttcacacctagtgt

SEQ ID NO: 447238 - DNA, 25 bp, Mus musculus
gacagagacattcagagcccagcct

SEQ ID NO: 447239 - DNA, 25 bp, Mus musculus
gacagagacattgagagcccagcct

SEQ ID NO: 447240 - DNA, 25 bp, Mus musculus
gacagagaccccaagctgcccattt

SEQ ID NO: 447241 - DNA, 25 bp, Mus musculus
gacagagacccctagctgcccattt

SEQ ID NO: 447242 - DNA, 25 bp, Mus musculus
gacagagaccgaaactacaggaatt

SEQ ID NO: 447243 - DNA, 25 bp, Mus musculus
gacagagaccgatactacaggaatt

SEQ ID NO: 447244 - DNA, 25 bp, Mus musculus
gacagagacctaacgtatttttatt

SEQ ID NO: 447245 - DNA, 25 bp, Mus musculus
gacagagacctatcgtatttttatt

SEQ ID NO: 447246 - DNA, 25 bp, Mus musculus
gacagagactctagaaacatcacaa

SEQ ID NO: 447247 - DNA, 25 bp, Mus musculus
gacagagactcttgaaacatcacaa

SEQ ID NO: 447248 - DNA, 25 bp, Mus musculus
gacagagactgtagaggagcccttg

SEQ ID NO: 447249 - DNA, 25 bp, Mus musculus
gacagagactgttgaggagcccttg

SEQ ID NO: 447250 - DNA, 25 bp, Mus musculus
gacagagagagtcctcatcagttaa

SEQ ID NO: 447251 - DNA, 25 bp, Mus musculus
gacagagagagtgctcatcagttaa

SEQ ID NO: 447252 - DNA, 25 bp, Mus musculus
gacagagagcacaagcttccttctt

SEQ ID NO: 447253 - DNA, 25 bp, Mus musculus
gacagagagcactagcttccttctt

SEQ ID NO: 447254 - DNA, 25 bp, Mus musculus
gacagagagcccacccaagatgcaa

SEQ ID NO: 447255 - DNA, 25 bp, Mus musculus
gacagagagccctcccaagatgcaa

SEQ ID NO: 447256 - DNA, 25 bp, Mus musculus
gacagagaggcgctccctccaggtc

SEQ ID NO: 447257 - DNA, 25 bp, Mus musculus
gacagagaggcggtccctccaggtc

SEQ ID NO: 447258 - DNA, 25 bp, Mus musculus
gacagagagtgcacatgccaagaga

SEQ ID NO: 447259 - DNA, 25 bp, Mus musculus
gacagagagtgcctttccctgcagt

SEQ ID NO: 447260 - DNA, 25 bp, Mus musculus
gacagagagtgcgtttccctgcagt

SEQ ID NO: 447261 - DNA, 25 bp, Mus musculus
gacagagagtgctcatgccaagaga

SEQ ID NO: 447262 - DNA, 25 bp, Mus musculus
gacagagatagtctctgccctcctg

SEQ ID NO: 447263 - DNA, 25 bp, Mus musculus
gacagagatagtgtctgccctcctg

SEQ ID NO: 447264 - DNA, 25 bp, Mus musculus
gacagagattaacgcgaacatctga

SEQ ID NO: 447265 - DNA, 25 bp, Mus musculus
gacagagattaaggcgaacatctga

SEQ ID NO: 447266 - DNA, 25 bp, Mus musculus
gacagagattagattcttagtgcta

SEQ ID NO: 447267 - DNA, 25 bp, Mus musculus
gacagagattagtttcttagtgcta

SEQ ID NO: 447268 - DNA, 25 bp, Mus musculus
gacagagattgaatcttcgagacta

SEQ ID NO: 447269 - DNA, 25 bp, Mus musculus
gacagagattgattcttcgagacta

SEQ ID NO: 447270 - DNA, 25 bp, Mus musculus
gacagagcaaacatcaacaatgaga

SEQ ID NO: 447271 - DNA, 25 bp, Mus musculus
gacagagcaaacttcaacaatgaga

SEQ ID NO: 447272 - DNA, 25 bp, Mus musculus
gacagagcaatccagtcaatgtgtt

SEQ ID NO: 447273 - DNA, 25 bp, Mus musculus
gacagagcaatcgagtcaatgtgtt

SEQ ID NO: 447274 - DNA, 25 bp, Mus musculus
gacagagcacagatactcttgttta

SEQ ID NO: 447275 - DNA, 25 bp, Mus musculus
gacagagcacagttactcttgttta

SEQ ID NO: 447276 - DNA, 25 bp, Mus musculus
gacagagcactgccctccaggagtg

SEQ ID NO: 447277 - DNA, 25 bp, Mus musculus
gacagagcactggcctccaggagtg

SEQ ID NO: 447278 - DNA, 25 bp, Mus musculus
gacagagcacttaagggctacgatt

SEQ ID NO: 447279 - DNA, 25 bp, Mus musculus
gacagagcacttaatgtggctttag

SEQ ID NO: 447280 - DNA, 25 bp, Mus musculus
gacagagcacttctcaaggatggag

SEQ ID NO: 447281 - DNA, 25 bp, Mus musculus
gacagagcacttgtcaaggatggag

SEQ ID NO: 447282 - DNA, 25 bp, Mus musculus
gacagagcactttagggctacgatt

SEQ ID NO: 447283 - DNA, 25 bp, Mus musculus
gacagagcactttatgtggctttag

SEQ ID NO: 447284 - DNA, 25 bp, Mus musculus
gacagagcagcaaccagtgagcttc

SEQ ID NO: 447285 - DNA, 25 bp, Mus musculus
gacagagcagcaccagtactggctt

SEQ ID NO: 447286 - DNA, 25 bp, Mus musculus
gacagagcagcagcagtactggctt

SEQ ID NO: 447287 - DNA, 25 bp, Mus musculus
gacagagcagcatccagtgagcttc

SEQ ID NO: 447288 - DNA, 25 bp, Mus musculus
gacagagcaggccaaggctgatctc

SEQ ID NO: 447289 - DNA, 25 bp, Mus musculus
gacagagcaggcgaaggctgatctc

SEQ ID NO: 447290 - DNA, 25 bp, Mus musculus
gacagagcatccacatttcagggaa

SEQ ID NO: 447291 - DNA, 25 bp, Mus musculus
gacagagcatcctcatttcagggaa

SEQ ID NO: 447292 - DNA, 25 bp, Mus musculus
gacagagcatctaacagacatttct

SEQ ID NO: 447293 - DNA, 25 bp, Mus musculus
gacagagcatcttacagacatttct

SEQ ID NO: 447294 - DNA, 25 bp, Mus musculus
gacagagcattgataaccctttcag

SEQ ID NO: 447295 - DNA, 25 bp, Mus musculus
gacagagcattgttaaccctttcag

SEQ ID NO: 447296 - DNA, 25 bp, Mus musculus
gacagagccaatacactgttgaatc

SEQ ID NO: 447297 - DNA, 25 bp, Mus musculus
gacagagccaattcactgttgaatc

SEQ ID NO: 447298 - DNA, 25 bp, Mus musculus
gacagagccatcctgtcttactctt

SEQ ID NO: 447299 - DNA, 25 bp, Mus musculus
gacagagccatcgtgtcttactctt

SEQ ID NO: 447300 - DNA, 25 bp, Mus musculus
gacagagcccatatgtagggccata

SEQ ID NO: 447301 - DNA, 25 bp, Mus musculus
gacagagcccatttgtagggccata

SEQ ID NO: 447302 - DNA, 25 bp, Mus musculus
gacagagccctcataccagagagtg

SEQ ID NO: 447303 - DNA, 25 bp, Mus musculus
gacagagccctcttaccagagagtg

SEQ ID NO: 447304 - DNA, 25 bp, Mus musculus
gacagagccggaattatttagaaag

SEQ ID NO: 447305 - DNA, 25 bp, Mus musculus
gacagagccggatttatttagaaag

SEQ ID NO: 447306 - DNA, 25 bp, Mus musculus
gacagagcctgacgtgcctgttctg

SEQ ID NO: 447307 - DNA, 25 bp, Mus musculus
gacagagcctgaggtgcctgttctg

SEQ ID NO: 447308 - DNA, 25 bp, Mus musculus
gacagagcctgcagcgtccattcct

SEQ ID NO: 447309 - DNA, 25 bp, Mus musculus
gacagagcctgctgcgtccattcct

SEQ ID NO: 447310 - DNA, 25 bp, Mus musculus
gacagagccttgctattttcacagt

SEQ ID NO: 447311 - DNA, 25 bp, Mus musculus
gacagagccttggtattttcacagt

SEQ ID NO: 447312 - DNA, 25 bp, Mus musculus
gacagagcggagacggtgccactca

SEQ ID NO: 447313 - DNA, 25 bp, Mus musculus
gacagagcggagtcggtgccactca

SEQ ID NO: 447314 - DNA, 25 bp, Mus musculus
gacagagcgttgagtcacctataga

SEQ ID NO: 447315 - DNA, 25 bp, Mus musculus
gacagagcgttgtgtcacctataga

SEQ ID NO: 447316 - DNA, 25 bp, Mus musculus
gacagagctaagacttgatgttgat

SEQ ID NO: 447317 - DNA, 25 bp, Mus musculus
gacagagctaagtcttgatgttgat

SEQ ID NO: 447318 - DNA, 25 bp, Mus musculus
gacagagctagacctagcccgtcac

SEQ ID NO: 447319 - DNA, 25 bp, Mus musculus
gacagagctagagctagcccgtcac

SEQ ID NO: 447320 - DNA, 25 bp, Mus musculus
gacagagctctgaaacgcaacccga

SEQ ID NO: 447321 - DNA, 25 bp, Mus musculus
gacagagctctgatcttgctgaaat

SEQ ID NO: 447322 - DNA, 25 bp, Mus musculus
gacagagctctgtaacgcaacccga

SEQ ID NO: 447323 - DNA, 25 bp, Mus musculus
gacagagctctgttcttgctgaaat

SEQ ID NO: 447324 - DNA, 25 bp, Mus musculus
gacagagctcttcatgcttttaaga

SEQ ID NO: 447325 - DNA, 25 bp, Mus musculus
gacagagctcttgatgcttttaaga

SEQ ID NO: 447326 - DNA, 25 bp, Mus musculus
gacagagctgaaccagacagtgcag

SEQ ID NO: 447327 - DNA, 25 bp, Mus musculus
gacagagctgaagcagacagtgcag

SEQ ID NO: 447328 - DNA, 25 bp, Mus musculus
gacagagctgagcttcctttcttgc

SEQ ID NO: 447329 - DNA, 25 bp, Mus musculus
gacagagctgaggttcctttcttgc

SEQ ID NO: 447330 - DNA, 25 bp, Mus musculus
gacagagctggtcccttcaccaggt

SEQ ID NO: 447331 - DNA, 25 bp, Mus musculus
gacagagctggtgccttcaccaggt

SEQ ID NO: 447332 - DNA, 25 bp, Mus musculus
gacagagctgtaaaattgcaaagat

SEQ ID NO: 447333 - DNA, 25 bp, Mus musculus
gacagagctgtataattgcaaagat

SEQ ID NO: 447334 - DNA, 25 bp, Mus musculus
gacagagcttcgcagtccctgcgaa

SEQ ID NO: 447335 - DNA, 25 bp, Mus musculus
gacagagcttcggagtccctgcgaa

SEQ ID NO: 447336 - DNA, 25 bp, Mus musculus
gacagagcttctatcaattcaagag

SEQ ID NO: 447337 - DNA, 25 bp, Mus musculus
gacagagcttctttcaattcaagag

SEQ ID NO: 447338 - DNA, 25 bp, Mus musculus
gacagagcttgaacttcccgagtgt

SEQ ID NO: 447339 - DNA, 25 bp, Mus musculus
gacagagcttgatcttcccgagtgt

SEQ ID NO: 447340 - DNA, 25 bp, Mus musculus
gacagagctttccatacacagtaga

SEQ ID NO: 447341 - DNA, 25 bp, Mus musculus
gacagagctttcgatacacagtaga

SEQ ID NO: 447342 - DNA, 25 bp, Mus musculus
gacagaggacgcagtgcgccgctac

SEQ ID NO: 447343 - DNA, 25 bp, Mus musculus
gacagaggacgctgtgcgccgctac

SEQ ID NO: 447344 - DNA, 25 bp, Mus musculus
gacagaggacggccaacccctacag

SEQ ID NO: 447345 - DNA, 25 bp, Mus musculus
gacagaggacgggcaacccctacag

SEQ ID NO: 447346 - DNA, 25 bp, Mus musculus
gacagaggactgacgggccttgcca

SEQ ID NO: 447347 - DNA, 25 bp, Mus musculus
gacagaggactgcttgagacaacat

SEQ ID NO: 447348 - DNA, 25 bp, Mus musculus
gacagaggactggttgagacaacat

SEQ ID NO: 447349 - DNA, 25 bp, Mus musculus
gacagaggactgtcgggccttgcca

SEQ ID NO: 447350 - DNA, 25 bp, Mus musculus
gacagaggatcaagcctagccagga

SEQ ID NO: 447351 - DNA, 25 bp, Mus musculus
gacagaggatcatgcctagccagga

SEQ ID NO: 447352 - DNA, 25 bp, Mus musculus
gacagaggcatccatgtgcccaaga

SEQ ID NO: 447353 - DNA, 25 bp, Mus musculus
gacagaggcatcgatgtgcccaaga

SEQ ID NO: 447354 - DNA, 25 bp, Mus musculus
gacagaggccctcttagactgtgat

SEQ ID NO: 447355 - DNA, 25 bp, Mus musculus
gacagaggccctgttagactgtgat

SEQ ID NO: 447356 - DNA, 25 bp, Mus musculus
gacagaggcctcattgtattgtaga

SEQ ID NO: 447357 - DNA, 25 bp, Mus musculus
gacagaggcctctttgtattgtaga

SEQ ID NO: 447358 - DNA, 25 bp, Mus musculus
gacagaggcgatcacgacgcccact

SEQ ID NO: 447359 - DNA, 25 bp, Mus musculus
gacagaggcgatgacgacgcccact

SEQ ID NO: 447360 - DNA, 25 bp, Mus musculus
gacagaggctcaccttttaacagga

SEQ ID NO: 447361 - DNA, 25 bp, Mus musculus
gacagaggctcagcttttaacagga

SEQ ID NO: 447362 - DNA, 25 bp, Mus musculus
gacagaggctcgagctgaaagcagc

SEQ ID NO: 447363 - DNA, 25 bp, Mus musculus
gacagaggctcgtgctgaaagcagc

SEQ ID NO: 447364 - DNA, 25 bp, Mus musculus
gacagaggctgcctcctagcttcga

SEQ ID NO: 447365 - DNA, 25 bp, Mus musculus
gacagaggctgcgtcctagcttcga

SEQ ID NO: 447366 - DNA, 25 bp, Mus musculus
gacagaggctggaccttcttgagga

SEQ ID NO: 447367 - DNA, 25 bp, Mus musculus
gacagaggctggtccttcttgagga

SEQ ID NO: 447368 - DNA, 25 bp, Mus musculus
gacagagggacaatgttcactatga

SEQ ID NO: 447369 - DNA, 25 bp, Mus musculus
gacagagggacattgttcactatga

SEQ ID NO: 447370 - DNA, 25 bp, Mus musculus
gacagagggataaacttttagactc

SEQ ID NO: 447371 - DNA, 25 bp, Mus musculus
gacagagggatatacttttagactc

SEQ ID NO: 447372 - DNA, 25 bp, Mus musculus
gacagagggtcaaccttcaagtcac

SEQ ID NO: 447373 - DNA, 25 bp, Mus musculus
gacagagggtcatccttcaagtcac

SEQ ID NO: 447374 - DNA, 25 bp, Mus musculus
gacagagggttcctatttgacgagt

SEQ ID NO: 447375 - DNA, 25 bp, Mus musculus
gacagagggttcgtatttgacgagt

SEQ ID NO: 447376 - DNA, 25 bp, Mus musculus
gacagaggtcagacaagggtcagat

SEQ ID NO: 447377 - DNA, 25 bp, Mus musculus
gacagaggtcagtcaagggtcagat

SEQ ID NO: 447378 - DNA, 25 bp, Mus musculus
gacagaggtccacagagtacgatag

SEQ ID NO: 447379 - DNA, 25 bp, Mus musculus
gacagaggtccagagagtacgatag

SEQ ID NO: 447380 - DNA, 25 bp, Mus musculus
gacagaggttctcggcttacaaaat

SEQ ID NO: 447381 - DNA, 25 bp, Mus musculus
gacagaggttctgggcttacaaaat

SEQ ID NO: 447382 - DNA, 25 bp, Mus musculus
gacagagtacacaccttgtccgaca

SEQ ID NO: 447383 - DNA, 25 bp, Mus musculus
gacagagtacactccttgtccgaca

SEQ ID NO: 447384 - DNA, 25 bp, Mus musculus
gacagagtagaccagcttttagaaa

SEQ ID NO: 447385 - DNA, 25 bp, Mus musculus
gacagagtagacgagcttttagaaa

SEQ ID NO: 447386 - DNA, 25 bp, Mus musculus
gacagagtatggcactgacctagag

SEQ ID NO: 447387 - DNA, 25 bp, Mus musculus
gacagagtatgggactgacctagag

SEQ ID NO: 447388 - DNA, 25 bp, Mus musculus
gacagagtcagaaagcctagattca

SEQ ID NO: 447389 - DNA, 25 bp, Mus musculus
gacagagtcagaaatgtgagccatt

SEQ ID NO: 447390 - DNA, 25 bp, Mus musculus
gacagagtcagaaccttttatgagc

SEQ ID NO: 447391 - DNA, 25 bp, Mus musculus
gacagagtcagatagcctagattca

SEQ ID NO: 447392 - DNA, 25 bp, Mus musculus
gacagagtcagatatgtgagccatt

SEQ ID NO: 447393 - DNA, 25 bp, Mus musculus
gacagagtcagatccttttatgagc

SEQ ID NO: 447394 - DNA, 25 bp, Mus musculus
gacagagtccaaaataccacttgta

SEQ ID NO: 447395 - DNA, 25 bp, Mus musculus
gacagagtccaatataccacttgta

SEQ ID NO: 447396 - DNA, 25 bp, Mus musculus
gacagagtccagatggctgctctac

SEQ ID NO: 447397 - DNA, 25 bp, Mus musculus
gacagagtccagttggctgctctac

SEQ ID NO: 447398 - DNA, 25 bp, Mus musculus
gacagagtccctaatgaacccagtt

SEQ ID NO: 447399 - DNA, 25 bp, Mus musculus
gacagagtcccttatgaacccagtt

SEQ ID NO: 447400 - DNA, 25 bp, Mus musculus
gacagagtcgtaactggcaaaccca

SEQ ID NO: 447401 - DNA, 25 bp, Mus musculus
gacagagtcgtatctggcaaaccca

SEQ ID NO: 447402 - DNA, 25 bp, Mus musculus
gacagagtcgtcagagctctcacag

SEQ ID NO: 447403 - DNA, 25 bp, Mus musculus
gacagagtcgtctgagctctcacag

SEQ ID NO: 447404 - DNA, 25 bp, Mus musculus
gacagagtctaacgatggaagcaca

SEQ ID NO: 447405 - DNA, 25 bp, Mus musculus
gacagagtctaaggatggaagcaca

SEQ ID NO: 447406 - DNA, 25 bp, Mus musculus
gacagagtctcacgcaagcagagta

SEQ ID NO: 447407 - DNA, 25 bp, Mus musculus
gacagagtctcaggcaagcagagta

SEQ ID NO: 447408 - DNA, 25 bp, Mus musculus
gacagagtctgcaccttaagactga

SEQ ID NO: 447409 - DNA, 25 bp, Mus musculus
gacagagtctgctccttaagactga

SEQ ID NO: 447410 - DNA, 25 bp, Mus musculus
gacagagtgggacaatggctttcaa

SEQ ID NO: 447411 - DNA, 25 bp, Mus musculus
gacagagtgggagaatggctttcaa

SEQ ID NO: 447412 - DNA, 25 bp, Mus musculus
gacagagtgggcactcttcatactt

SEQ ID NO: 447413 - DNA, 25 bp, Mus musculus
gacagagtgggctctcttcatactt

SEQ ID NO: 447414 - DNA, 25 bp, Mus musculus
gacagagtgtgcacaggcatacaaa

SEQ ID NO: 447415 - DNA, 25 bp, Mus musculus
gacagagtgtgctcaggcatacaaa

SEQ ID NO: 447416 - DNA, 25 bp, Mus musculus
gacagagtgttgcatccttaagacc

SEQ ID NO: 447417 - DNA, 25 bp, Mus musculus
gacagagtgttggatccttaagacc

SEQ ID NO: 447418 - DNA, 25 bp, Mus musculus
gacagagttagtatccaggcagtct

SEQ ID NO: 447419 - DNA, 25 bp, Mus musculus
gacagagttagtttccaggcagtct

SEQ ID NO: 447420 - DNA, 25 bp, Mus musculus
gacagagttggccaagtcctgcact

SEQ ID NO: 447421 - DNA, 25 bp, Mus musculus
gacagagttggcgaagtcctgcact

SEQ ID NO: 447422 - DNA, 25 bp, Mus musculus
gacagagttgtcatgtgtctgcctg

SEQ ID NO: 447423 - DNA, 25 bp, Mus musculus
gacagagttgtcttgtgtctgcctg

SEQ ID NO: 447424 - DNA, 25 bp, Mus musculus
gacagataaatgatagcctagggca

SEQ ID NO: 447425 - DNA, 25 bp, Mus musculus
gacagataaatgttagcctagggca

SEQ ID NO: 447426 - DNA, 25 bp, Mus musculus
gacagataacctatttcctgttatt

SEQ ID NO: 447427 - DNA, 25 bp, Mus musculus
gacagataacctttttcctgttatt

SEQ ID NO: 447428 - DNA, 25 bp, Mus musculus
gacagatacacaactatttgaggtt

SEQ ID NO: 447429 - DNA, 25 bp, Mus musculus
gacagatacacacatattgccaccc

SEQ ID NO: 447430 - DNA, 25 bp, Mus musculus
gacagatacacagatattgccaccc

SEQ ID NO: 447431 - DNA, 25 bp, Mus musculus
gacagatacacatctatttgaggtt

SEQ ID NO: 447432 - DNA, 25 bp, Mus musculus
gacagatacagtaatcattctttca

SEQ ID NO: 447433 - DNA, 25 bp, Mus musculus
gacagatacagttatcattctttca

SEQ ID NO: 447434 - DNA, 25 bp, Mus musculus
gacagatactcgctcatctctggga

SEQ ID NO: 447435 - DNA, 25 bp, Mus musculus
gacagatactcggtcatctctggga

SEQ ID NO: 447436 - DNA, 25 bp, Mus musculus
gacagatacttcatataggaggttt

SEQ ID NO: 447437 - DNA, 25 bp, Mus musculus
gacagatacttcttataggaggttt

SEQ ID NO: 447438 - DNA, 25 bp, Mus musculus
gacagatagatcacaagattgccct

SEQ ID NO: 447439 - DNA, 25 bp, Mus musculus
gacagatagatctcaagattgccct

SEQ ID NO: 447440 - DNA, 25 bp, Mus musculus
gacagataggctatgactaaggaga

SEQ ID NO: 447441 - DNA, 25 bp, Mus musculus
gacagataggctttgactaaggaga

SEQ ID NO: 447442 - DNA, 25 bp, Mus musculus
gacagatagtggctggcaccaacct

SEQ ID NO: 447443 - DNA, 25 bp, Mus musculus
gacagatagtgggtggcaccaacct

SEQ ID NO: 447444 - DNA, 25 bp, Mus musculus
gacagatattgaccctgcacccaaa

SEQ ID NO: 447445 - DNA, 25 bp, Mus musculus
gacagatattgagcctgcacccaaa

SEQ ID NO: 447446 - DNA, 25 bp, Mus musculus
gacagatcaaggacagggacaggac

SEQ ID NO: 447447 - DNA, 25 bp, Mus musculus
gacagatcaaggtcagggacaggac

SEQ ID NO: 447448 - DNA, 25 bp, Mus musculus
gacagatcacatagttcaggagaac

SEQ ID NO: 447449 - DNA, 25 bp, Mus musculus
gacagatcacatctccagacgggaa

SEQ ID NO: 447450 - DNA, 25 bp, Mus musculus
gacagatcacatgtccagacgggaa

SEQ ID NO: 447451 - DNA, 25 bp, Mus musculus
gacagatcacattgttcaggagaac

SEQ ID NO: 447452 - DNA, 25 bp, Mus musculus
gacagatcacttatctttctcctta

SEQ ID NO: 447453 - DNA, 25 bp, Mus musculus
gacagatcacttttctttctcctta

SEQ ID NO: 447454 - DNA, 25 bp, Mus musculus
gacagatcagaaaattccaagtcat

SEQ ID NO: 447455 - DNA, 25 bp, Mus musculus
gacagatcagaatattccaagtcat

SEQ ID NO: 447456 - DNA, 25 bp, Mus musculus
gacagatcatacaactcaggctttt

SEQ ID NO: 447457 - DNA, 25 bp, Mus musculus
gacagatcatactactcaggctttt

SEQ ID NO: 447458 - DNA, 25 bp, Mus musculus
gacagatcatgaatatgtgttcttt

SEQ ID NO: 447459 - DNA, 25 bp, Mus musculus
gacagatcatgattatgtgttcttt

SEQ ID NO: 447460 - DNA, 25 bp, Mus musculus
gacagatccaaactaccagacgctg

SEQ ID NO: 447461 - DNA, 25 bp, Mus musculus
gacagatccaaagtaccagacgctg

SEQ ID NO: 447462 - DNA, 25 bp, Mus musculus
gacagatccaccattgctaggcatt

SEQ ID NO: 447463 - DNA, 25 bp, Mus musculus
gacagatccacctttgctaggcatt

SEQ ID NO: 447464 - DNA, 25 bp, Mus musculus
gacagatcccaaatataactacctt

SEQ ID NO: 447465 - DNA, 25 bp, Mus musculus
gacagatcccaattataactacctt

SEQ ID NO: 447466 - DNA, 25 bp, Mus musculus
gacagatccccgagtttgaggtcag

SEQ ID NO: 447467 - DNA, 25 bp, Mus musculus
gacagatccccgtgtttgaggtcag

SEQ ID NO: 447468 - DNA, 25 bp, Mus musculus
gacagatcctctatgtgtaatacta

SEQ ID NO: 447469 - DNA, 25 bp, Mus musculus
gacagatcctctttgtgtaatacta

SEQ ID NO: 447470 - DNA, 25 bp, Mus musculus
gacagatcctgaaaccaatgattga

SEQ ID NO: 447471 - DNA, 25 bp, Mus musculus
gacagatcctgataccaatgattga

SEQ ID NO: 447472 - DNA, 25 bp, Mus musculus
gacagatccttccttgttacgtggg

SEQ ID NO: 447473 - DNA, 25 bp, Mus musculus
gacagatccttcgttgttacgtggg

SEQ ID NO: 447474 - DNA, 25 bp, Mus musculus
gacagatctctgagcatgagtccag

SEQ ID NO: 447475 - DNA, 25 bp, Mus musculus
gacagatctctgtgcatgagtccag

SEQ ID NO: 447476 - DNA, 25 bp, Mus musculus
gacagatctgatccatctcatcgta

SEQ ID NO: 447477 - DNA, 25 bp, Mus musculus
gacagatctgatcgcctgggctcga

SEQ ID NO: 447478 - DNA, 25 bp, Mus musculus
gacagatctgatgcatctcatcgta

SEQ ID NO: 447479 - DNA, 25 bp, Mus musculus
gacagatctgatggcctgggctcga

SEQ ID NO: 447480 - DNA, 25 bp, Mus musculus
gacagatctggcatgtttgttgtat

SEQ ID NO: 447481 - DNA, 25 bp, Mus musculus
gacagatctggcttgtttgttgtat

SEQ ID NO: 447482 - DNA, 25 bp, Mus musculus
gacagatctgtgctaaccccagtga

SEQ ID NO: 447483 - DNA, 25 bp, Mus musculus
gacagatctgtggtaaccccagtga

SEQ ID NO: 447484 - DNA, 25 bp, Mus musculus
gacagatcttccatggacctgggat

SEQ ID NO: 447485 - DNA, 25 bp, Mus musculus
gacagatcttccttggacctgggat

SEQ ID NO: 447486 - DNA, 25 bp, Mus musculus
gacagatcttctcgaataatttgta

SEQ ID NO: 447487 - DNA, 25 bp, Mus musculus
gacagatcttctggaataatttgta

SEQ ID NO: 447488 - DNA, 25 bp, Mus musculus
gacagatgaacaccggtgactcggc

SEQ ID NO: 447489 - DNA, 25 bp, Mus musculus
gacagatgaacagcggtgactcggc

SEQ ID NO: 447490 - DNA, 25 bp, Mus musculus
gacagatgaatcagaccaaggtggc

SEQ ID NO: 447491 - DNA, 25 bp, Mus musculus
gacagatgaatctgaccaaggtggc

SEQ ID NO: 447492 - DNA, 25 bp, Mus musculus
gacagatgactgaactcactaacaa

SEQ ID NO: 447493 - DNA, 25 bp, Mus musculus
gacagatgactgtactcactaacaa

SEQ ID NO: 447494 - DNA, 25 bp, Mus musculus
gacagatgagtcagtacccgggact

SEQ ID NO: 447495 - DNA, 25 bp, Mus musculus
gacagatgagtctgtacccgggact

SEQ ID NO: 447496 - DNA, 25 bp, Mus musculus
gacagatgattgactctgcattcag

SEQ ID NO: 447497 - DNA, 25 bp, Mus musculus
gacagatgattgagactctcgcgag

SEQ ID NO: 447498 - DNA, 25 bp, Mus musculus
gacagatgattgtctctgcattcag

SEQ ID NO: 447499 - DNA, 25 bp, Mus musculus
gacagatgattgtgactctcgcgag

SEQ ID NO: 447500 - DNA, 25 bp, Mus musculus
gacagatgcaccatggtgtggagtt

SEQ ID NO: 447501 - DNA, 25 bp, Mus musculus
gacagatgcaccttggtgtggagtt

SEQ ID NO: 447502 - DNA, 25 bp, Mus musculus
gacagatgcacgactggacatccag

SEQ ID NO: 447503 - DNA, 25 bp, Mus musculus
gacagatgcacgtctggacatccag

SEQ ID NO: 447504 - DNA, 25 bp, Mus musculus
gacagatgcagacagcttcttccag

SEQ ID NO: 447505 - DNA, 25 bp, Mus musculus
gacagatgcagagagcttcttccag

SEQ ID NO: 447506 - DNA, 25 bp, Mus musculus
gacagatgcagtccctgatggcagt

SEQ ID NO: 447507 - DNA, 25 bp, Mus musculus
gacagatgcagtgcctgatggcagt

SEQ ID NO: 447508 - DNA, 25 bp, Mus musculus
gacagatgcccacagtttacctttc

SEQ ID NO: 447509 - DNA, 25 bp, Mus musculus
gacagatgcccagagtttacctttc

SEQ ID NO: 447510 - DNA, 25 bp, Mus musculus
gacagatgccctatgaagcggcaga

SEQ ID NO: 447511 - DNA, 25 bp, Mus musculus
gacagatgccctcttgtgacagcaa

SEQ ID NO: 447512 - DNA, 25 bp, Mus musculus
gacagatgccctgttgtgacagcaa

SEQ ID NO: 447513 - DNA, 25 bp, Mus musculus
gacagatgccctttgaagcggcaga

SEQ ID NO: 447514 - DNA, 25 bp, Mus musculus
gacagatgcgctactactgaattat

SEQ ID NO: 447515 - DNA, 25 bp, Mus musculus
gacagatgcgcttctactgaattat

SEQ ID NO: 447516 - DNA, 25 bp, Mus musculus
gacagatgctacaaagacaccaaat

SEQ ID NO: 447517 - DNA, 25 bp, Mus musculus
gacagatgctactaagacaccaaat

SEQ ID NO: 447518 - DNA, 25 bp, Mus musculus
gacagatgctgacagtgtctccaca

SEQ ID NO: 447519 - DNA, 25 bp, Mus musculus
gacagatgctgagagtgtctccaca

SEQ ID NO: 447520 - DNA, 25 bp, Mus musculus
gacagatgctgcaatcatagactta

SEQ ID NO: 447521 - DNA, 25 bp, Mus musculus
gacagatgctgctatcatagactta

SEQ ID NO: 447522 - DNA, 25 bp, Mus musculus
gacagatggacacaatggtcacaac

SEQ ID NO: 447523 - DNA, 25 bp, Mus musculus
gacagatggacagaatggtcacaac

SEQ ID NO: 447524 - DNA, 25 bp, Mus musculus
gacagatggacccattccttagaat

SEQ ID NO: 447525 - DNA, 25 bp, Mus musculus
gacagatggaccgattccttagaat

SEQ ID NO: 447526 - DNA, 25 bp, Mus musculus
gacagatggatacttggctctacat

SEQ ID NO: 447527 - DNA, 25 bp, Mus musculus
gacagatggatagttggctctacat

SEQ ID NO: 447528 - DNA, 25 bp, Mus musculus
gacagatgggccctctatgtcaaag

SEQ ID NO: 447529 - DNA, 25 bp, Mus musculus
gacagatgggccgtctatgtcaaag

SEQ ID NO: 447530 - DNA, 25 bp, Mus musculus
gacagatgggtaaagccgttgcctt

SEQ ID NO: 447531 - DNA, 25 bp, Mus musculus
gacagatgggtatagccgttgcctt

SEQ ID NO: 447532 - DNA, 25 bp, Mus musculus
gacagatggtttattcaggcctcaa

SEQ ID NO: 447533 - DNA, 25 bp, Mus musculus
gacagatggttttttcaggcctcaa

SEQ ID NO: 447534 - DNA, 25 bp, Mus musculus
gacagatgtcagagtgtccttctga

SEQ ID NO: 447535 - DNA, 25 bp, Mus musculus
gacagatgtcagtgtgtccttctga

SEQ ID NO: 447536 - DNA, 25 bp, Mus musculus
gacagatgtcctacttcacattgat

SEQ ID NO: 447537 - DNA, 25 bp, Mus musculus
gacagatgtcctattactggaagat

SEQ ID NO: 447538 - DNA, 25 bp, Mus musculus
gacagatgtccttcttcacattgat

SEQ ID NO: 447539 - DNA, 25 bp, Mus musculus
gacagatgtccttttactggaagat

SEQ ID NO: 447540 - DNA, 25 bp, Mus musculus
gacagatgtctcaggtgtgtgtaga

SEQ ID NO: 447541 - DNA, 25 bp, Mus musculus
gacagatgtctctggtgtgtgtaga

SEQ ID NO: 447542 - DNA, 25 bp, Mus musculus
gacagatgtgaccaagaccttcgca

SEQ ID NO: 447543 - DNA, 25 bp, Mus musculus
gacagatgtgacgaagaccttcgca

SEQ ID NO: 447544 - DNA, 25 bp, Mus musculus
gacagatgtgcacctgtggctgcat

SEQ ID NO: 447545 - DNA, 25 bp, Mus musculus
gacagatgtgcagctgtggctgcat

SEQ ID NO: 447546 - DNA, 25 bp, Mus musculus
gacagatgtgggacgtcttgcgctt

SEQ ID NO: 447547 - DNA, 25 bp, Mus musculus
gacagatgtgggtcgtcttgcgctt

SEQ ID NO: 447548 - DNA, 25 bp, Mus musculus
gacagatgtgtcaagcagcaaaagc

SEQ ID NO: 447549 - DNA, 25 bp, Mus musculus
gacagatgtgtctagcagcaaaagc

SEQ ID NO: 447550 - DNA, 25 bp, Mus musculus
gacagatgtgtgctctccgcaaaag

SEQ ID NO: 447551 - DNA, 25 bp, Mus musculus
gacagatgtgtggtctccgcaaaag

SEQ ID NO: 447552 - DNA, 25 bp, Mus musculus
gacagatgttctcttcatcttctct

SEQ ID NO: 447553 - DNA, 25 bp, Mus musculus
gacagatgttctgttcatcttctct

SEQ ID NO: 447554 - DNA, 25 bp, Mus musculus
gacagatgtttaaggcttggtgcct

SEQ ID NO: 447555 - DNA, 25 bp, Mus musculus
gacagatgtttatggcttggtgcct

SEQ ID NO: 447556 - DNA, 25 bp, Mus musculus
gacagatgtttgcttccagagcctg

SEQ ID NO: 447557 - DNA, 25 bp, Mus musculus
gacagatgtttggttccagagcctg

SEQ ID NO: 447558 - DNA, 25 bp, Mus musculus
gacagattagccatcgcagggacct

SEQ ID NO: 447559 - DNA, 25 bp, Mus musculus
gacagattagccttcgcagggacct

SEQ ID NO: 447560 - DNA, 25 bp, Mus musculus
gacagattaggcaccaaaggcaacc

SEQ ID NO: 447561 - DNA, 25 bp, Mus musculus
gacagattaggctccaaaggcaacc

SEQ ID NO: 447562 - DNA, 25 bp, Mus musculus
gacagattatgtcaactgcaaatag

SEQ ID NO: 447563 - DNA, 25 bp, Mus musculus
gacagattatgtgaactgcaaatag

SEQ ID NO: 447564 - DNA, 25 bp, Mus musculus
gacagattccgaagggaaacacgcc

SEQ ID NO: 447565 - DNA, 25 bp, Mus musculus
gacagattccgatgggaaacacgcc

SEQ ID NO: 447566 - DNA, 25 bp, Mus musculus
gacagattcctgacctactgaaaag

SEQ ID NO: 447567 - DNA, 25 bp, Mus musculus
gacagattcctgtcctactgaaaag

SEQ ID NO: 447568 - DNA, 25 bp, Mus musculus
gacagattctgtattctccttgtat

SEQ ID NO: 447569 - DNA, 25 bp, Mus musculus
gacagattctgttttctccttgtat

SEQ ID NO: 447570 - DNA, 25 bp, Mus musculus
gacagattctttcatcgtcagtctc

SEQ ID NO: 447571 - DNA, 25 bp, Mus musculus
gacagattctttgatcgtcagtctc

SEQ ID NO: 447572 - DNA, 25 bp, Mus musculus
gacagattgaccacagcgagctgta

SEQ ID NO: 447573 - DNA, 25 bp, Mus musculus
gacagattgacctcagcgagctgta

SEQ ID NO: 447574 - DNA, 25 bp, Mus musculus
gacagattgatcagcccttgtaggt

SEQ ID NO: 447575 - DNA, 25 bp, Mus musculus
gacagattgatctgcccttgtaggt

SEQ ID NO: 447576 - DNA, 25 bp, Mus musculus
gacagattgcctattatcggatcat

SEQ ID NO: 447577 - DNA, 25 bp, Mus musculus
gacagattgcctccacacagtatgg

SEQ ID NO: 447578 - DNA, 25 bp, Mus musculus
gacagattgcctgcacacagtatgg

SEQ ID NO: 447579 - DNA, 25 bp, Mus musculus
gacagattgccttttatcggatcat

SEQ ID NO: 447580 - DNA, 25 bp, Mus musculus
gacagattggcaattgtggccattt

SEQ ID NO: 447581 - DNA, 25 bp, Mus musculus
gacagattggcatttgtggccattt

SEQ ID NO: 447582 - DNA, 25 bp, Mus musculus
gacagattggctcctaccctgtaac

SEQ ID NO: 447583 - DNA, 25 bp, Mus musculus
gacagattggctgctaccctgtaac

SEQ ID NO: 447584 - DNA, 25 bp, Mus musculus
gacagattggttacatccttttcct

SEQ ID NO: 447585 - DNA, 25 bp, Mus musculus
gacagattggtttcatccttttcct

SEQ ID NO: 447586 - DNA, 25 bp, Mus musculus
gacagatttataatcctccgagtgg

SEQ ID NO: 447587 - DNA, 25 bp, Mus musculus
gacagatttatattcctccgagtgg

SEQ ID NO: 447588 - DNA, 25 bp, Mus musculus
gacagatttatgagaccatcccctc

SEQ ID NO: 447589 - DNA, 25 bp, Mus musculus
gacagatttatgtgaccatcccctc

SEQ ID NO: 447590 - DNA, 25 bp, Mus musculus
gacagatttcatattaagccagccc

SEQ ID NO: 447591 - DNA, 25 bp, Mus musculus
gacagatttcattttaagccagccc

SEQ ID NO: 447592 - DNA, 25 bp, Mus musculus
gacagatttcgcagtgtttccagct

SEQ ID NO: 447593 - DNA, 25 bp, Mus musculus
gacagatttcgctgtgtttccagct

SEQ ID NO: 447594 - DNA, 25 bp, Mus musculus
gacagatttctaatgcaacctttac

SEQ ID NO: 447595 - DNA, 25 bp, Mus musculus
gacagatttctacccagccaagatc

SEQ ID NO: 447596 - DNA, 25 bp, Mus musculus
gacagatttctagccagccaagatc

SEQ ID NO: 447597 - DNA, 25 bp, Mus musculus
gacagatttctattgcaacctttac

SEQ ID NO: 447598 - DNA, 25 bp, Mus musculus
gacagatttgcacggcttgcggctc

SEQ ID NO: 447599 - DNA, 25 bp, Mus musculus
gacagatttgcagggcttgcggctc

SEQ ID NO: 447600 - DNA, 25 bp, Mus musculus
gacagatttgtacacatggctcagc

SEQ ID NO: 447601 - DNA, 25 bp, Mus musculus
gacagatttgtagacatggctcagc

SEQ ID NO: 447602 - DNA, 25 bp, Mus musculus
gacagatttgtgcagtccattccct

SEQ ID NO: 447603 - DNA, 25 bp, Mus musculus
gacagatttgtggagtccattccct

SEQ ID NO: 447604 - DNA, 25 bp, Mus musculus
gacagcaaaacacgccatacaaact

SEQ ID NO: 447605 - DNA, 25 bp, Mus musculus
gacagcaaaacaggccatacaaact

SEQ ID NO: 447606 - DNA, 25 bp, Mus musculus
gacagcaaagataagctatcacatg

SEQ ID NO: 447607 - DNA, 25 bp, Mus musculus
gacagcaaagattagctatcacatg

SEQ ID NO: 447608 - DNA, 25 bp, Mus musculus
gacagcaaagttctcttgtaagata

SEQ ID NO: 447609 - DNA, 25 bp, Mus musculus
gacagcaaagttgtcttgtaagata

SEQ ID NO: 447610 - DNA, 25 bp, Mus musculus
gacagcaacaacagctttgcccaag

SEQ ID NO: 447611 - DNA, 25 bp, Mus musculus
gacagcaacaactgctttgcccaag

SEQ ID NO: 447612 - DNA, 25 bp, Mus musculus
gacagcaacatcctcaggtggttct

SEQ ID NO: 447613 - DNA, 25 bp, Mus musculus
gacagcaacatcgtcaggtggttct

SEQ ID NO: 447614 - DNA, 25 bp, Mus musculus
gacagcaacattccagacccaggat

SEQ ID NO: 447615 - DNA, 25 bp, Mus musculus
gacagcaacattgcagacccaggat

SEQ ID NO: 447616 - DNA, 25 bp, Mus musculus
gacagcaaccatctagtcatacacg

SEQ ID NO: 447617 - DNA, 25 bp, Mus musculus
gacagcaaccatgtagtcatacacg

SEQ ID NO: 447618 - DNA, 25 bp, Mus musculus
gacagcaactggagcagttctcctt

SEQ ID NO: 447619 - DNA, 25 bp, Mus musculus
gacagcaactggtgcagttctcctt

SEQ ID NO: 447620 - DNA, 25 bp, Mus musculus
gacagcaagcacaaggttccaggtg

SEQ ID NO: 447621 - DNA, 25 bp, Mus musculus
gacagcaagcacactggagcgcaac

SEQ ID NO: 447622 - DNA, 25 bp, Mus musculus
gacagcaagcactaggttccaggtg

SEQ ID NO: 447623 - DNA, 25 bp, Mus musculus
gacagcaagcactctggagcgcaac

SEQ ID NO: 447624 - DNA, 25 bp, Mus musculus
gacagcaagctgcactttggaacaa

SEQ ID NO: 447625 - DNA, 25 bp, Mus musculus
gacagcaagctggactttggaacaa

SEQ ID NO: 447626 - DNA, 25 bp, Mus musculus
gacagcaagcttcccacagagccat

SEQ ID NO: 447627 - DNA, 25 bp, Mus musculus
gacagcaagcttgccacagagccat

SEQ ID NO: 447628 - DNA, 25 bp, Mus musculus
gacagcaagggaaggtgttcactca

SEQ ID NO: 447629 - DNA, 25 bp, Mus musculus
gacagcaagggatggtgttcactca

SEQ ID NO: 447630 - DNA, 25 bp, Mus musculus
gacagcaagtgcaatctcactgacc

SEQ ID NO: 447631 - DNA, 25 bp, Mus musculus
gacagcaagtgctatctcactgacc

SEQ ID NO: 447632 - DNA, 25 bp, Mus musculus
gacagcaataaaactttccacaaaa

SEQ ID NO: 447633 - DNA, 25 bp, Mus musculus
gacagcaataaatctttccacaaaa

SEQ ID NO: 447634 - DNA, 25 bp, Mus musculus
gacagcaatatcatcagccatcagg

SEQ ID NO: 447635 - DNA, 25 bp, Mus musculus
gacagcaatatcattaacgttcttc

SEQ ID NO: 447636 - DNA, 25 bp, Mus musculus
gacagcaatatcttcagccatcagg

SEQ ID NO: 447637 - DNA, 25 bp, Mus musculus
gacagcaatatctttaacgttcttc

SEQ ID NO: 447638 - DNA, 25 bp, Mus musculus
gacagcaatccccttggtaatgacc

SEQ ID NO: 447639 - DNA, 25 bp, Mus musculus
gacagcaatcccgttggtaatgacc

SEQ ID NO: 447640 - DNA, 25 bp, Mus musculus
gacagcaatccgattgccaaaggat

SEQ ID NO: 447641 - DNA, 25 bp, Mus musculus
gacagcaatccgtttgccaaaggat

SEQ ID NO: 447642 - DNA, 25 bp, Mus musculus
gacagcaatgatactgcagaggttg

SEQ ID NO: 447643 - DNA, 25 bp, Mus musculus
gacagcaatgattctgcagaggttg

SEQ ID NO: 447644 - DNA, 25 bp, Mus musculus
gacagcaatgccctacggtggatat

SEQ ID NO: 447645 - DNA, 25 bp, Mus musculus
gacagcaatgccgtacggtggatat

SEQ ID NO: 447646 - DNA, 25 bp, Mus musculus
gacagcaatgtaatctctggaggtt

SEQ ID NO: 447647 - DNA, 25 bp, Mus musculus
gacagcaatgtattctctggaggtt

SEQ ID NO: 447648 - DNA, 25 bp, Mus musculus
gacagcaattcaaggttcaagtata

SEQ ID NO: 447649 - DNA, 25 bp, Mus musculus
gacagcaattcatggttcaagtata

SEQ ID NO: 447650 - DNA, 25 bp, Mus musculus
gacagcacaaaactctgcagaatcc

SEQ ID NO: 447651 - DNA, 25 bp, Mus musculus
gacagcacaaaagtctgcagaatcc

SEQ ID NO: 447652 - DNA, 25 bp, Mus musculus
gacagcacaaataagaatggattat

SEQ ID NO: 447653 - DNA, 25 bp, Mus musculus
gacagcacaaataccattgagtcaa

SEQ ID NO: 447654 - DNA, 25 bp, Mus musculus
gacagcacaaattagaatggattat

SEQ ID NO: 447655 - DNA, 25 bp, Mus musculus
gacagcacaaattccattgagtcaa

SEQ ID NO: 447656 - DNA, 25 bp, Mus musculus
gacagcacaagcacgggtcaggatc

SEQ ID NO: 447657 - DNA, 25 bp, Mus musculus
gacagcacaagctcgggtcaggatc

SEQ ID NO: 447658 - DNA, 25 bp, Mus musculus
gacagcacaagtaactcccagttta

SEQ ID NO: 447659 - DNA, 25 bp, Mus musculus
gacagcacaagttactcccagttta

SEQ ID NO: 447660 - DNA, 25 bp, Mus musculus
gacagcacagagaatacatgacact

SEQ ID NO: 447661 - DNA, 25 bp, Mus musculus
gacagcacagagtatacatgacact

SEQ ID NO: 447662 - DNA, 25 bp, Mus musculus
gacagcacagtgctctgtactactc

SEQ ID NO: 447663 - DNA, 25 bp, Mus musculus
gacagcacagtggtctgtactactc

SEQ ID NO: 447664 - DNA, 25 bp, Mus musculus
gacagcacatagagtagttttccca

SEQ ID NO: 447665 - DNA, 25 bp, Mus musculus
gacagcacatagtgtagttttccca

SEQ ID NO: 447666 - DNA, 25 bp, Mus musculus
gacagcacatctctcacatgtggag

SEQ ID NO: 447667 - DNA, 25 bp, Mus musculus
gacagcacatctgtcacatgtggag

SEQ ID NO: 447668 - DNA, 25 bp, Mus musculus
gacagcacatttatccgcacatgta

SEQ ID NO: 447669 - DNA, 25 bp, Mus musculus
gacagcacatttttccgcacatgta

SEQ ID NO: 447670 - DNA, 25 bp, Mus musculus
gacagcaccagaactgagccacagt

SEQ ID NO: 447671 - DNA, 25 bp, Mus musculus
gacagcaccagatctgagccacagt

SEQ ID NO: 447672 - DNA, 25 bp, Mus musculus
gacagcaccaggatcagcattaaac

SEQ ID NO: 447673 - DNA, 25 bp, Mus musculus
gacagcaccaggttcagcattaaac

SEQ ID NO: 447674 - DNA, 25 bp, Mus musculus
gacagcaccgacatctttgagagag

SEQ ID NO: 447675 - DNA, 25 bp, Mus musculus
gacagcaccgacttctttgagagag

SEQ ID NO: 447676 - DNA, 25 bp, Mus musculus
gacagcacctgtaaacttttgtact

SEQ ID NO: 447677 - DNA, 25 bp, Mus musculus
gacagcacctgttaacttttgtact

SEQ ID NO: 447678 - DNA, 25 bp, Mus musculus
gacagcacgacgagagctgcacagt

SEQ ID NO: 447679 - DNA, 25 bp, Mus musculus
gacagcacgacgtgagctgcacagt

SEQ ID NO: 447680 - DNA, 25 bp, Mus musculus
gacagcacgagccagaaggtcacaa

SEQ ID NO: 447681 - DNA, 25 bp, Mus musculus
gacagcacgagcgagaaggtcacaa

SEQ ID NO: 447682 - DNA, 25 bp, Mus musculus
gacagcacgggaactcaggtaggaa

SEQ ID NO: 447683 - DNA, 25 bp, Mus musculus
gacagcacgggatctcaggtaggaa

SEQ ID NO: 447684 - DNA, 25 bp, Mus musculus
gacagcactaccaggcgtctctctg

SEQ ID NO: 447685 - DNA, 25 bp, Mus musculus
gacagcactacctggcgtctctctg

SEQ ID NO: 447686 - DNA, 25 bp, Mus musculus
gacagcactgaaaaacgcatatggc

SEQ ID NO: 447687 - DNA, 25 bp, Mus musculus
gacagcactgaataacgcatatggc

SEQ ID NO: 447688 - DNA, 25 bp, Mus musculus
gacagcactgctattaatggttgag

SEQ ID NO: 447689 - DNA, 25 bp, Mus musculus
gacagcactgcttttaatggttgag

SEQ ID NO: 447690 - DNA, 25 bp, Mus musculus
gacagcagaagaatcagtctcagca

SEQ ID NO: 447691 - DNA, 25 bp, Mus musculus
gacagcagaagattcagtctcagca

SEQ ID NO: 447692 - DNA, 25 bp, Mus musculus
gacagcagaatgaaagaccaagaga

SEQ ID NO: 447693 - DNA, 25 bp, Mus musculus
gacagcagaatgtaagaccaagaga

SEQ ID NO: 447694 - DNA, 25 bp, Mus musculus
gacagcagagaaaaccagttagagt

SEQ ID NO: 447695 - DNA, 25 bp, Mus musculus
gacagcagagaataccagttagagt

SEQ ID NO: 447696 - DNA, 25 bp, Mus musculus
gacagcagagagaccctgttctgtt

SEQ ID NO: 447697 - DNA, 25 bp, Mus musculus
gacagcagagagtccctgttctgtt

SEQ ID NO: 447698 - DNA, 25 bp, Mus musculus
gacagcagagtgcaacagaatttac

SEQ ID NO: 447699 - DNA, 25 bp, Mus musculus
gacagcagagtggaacagaatttac

SEQ ID NO: 447700 - DNA, 25 bp, Mus musculus
gacagcagatgcattctactggctt

SEQ ID NO: 447701 - DNA, 25 bp, Mus musculus
gacagcagatgccttcagatcacaa

SEQ ID NO: 447702 - DNA, 25 bp, Mus musculus
gacagcagatgcgttcagatcacaa

SEQ ID NO: 447703 - DNA, 25 bp, Mus musculus
gacagcagatgctttctactggctt

SEQ ID NO: 447704 - DNA, 25 bp, Mus musculus
gacagcagattcagtttacatcaga

SEQ ID NO: 447705 - DNA, 25 bp, Mus musculus
gacagcagattcattaggacaccag

SEQ ID NO: 447706 - DNA, 25 bp, Mus musculus
gacagcagattctgtttacatcaga

SEQ ID NO: 447707 - DNA, 25 bp, Mus musculus
gacagcagattctttaggacaccag

SEQ ID NO: 447708 - DNA, 25 bp, Mus musculus
gacagcagattgaaggtctcctcaa

SEQ ID NO: 447709 - DNA, 25 bp, Mus musculus
gacagcagattgtaggtctcctcaa

SEQ ID NO: 447710 - DNA, 25 bp, Mus musculus
gacagcagcaaacggacttcattga

SEQ ID NO: 447711 - DNA, 25 bp, Mus musculus
gacagcagcaaagggacttcattga

SEQ ID NO: 447712 - DNA, 25 bp, Mus musculus
gacagcagcaaccacgatgacgaag

SEQ ID NO: 447713 - DNA, 25 bp, Mus musculus
gacagcagcaacgacgatgacgaag

SEQ ID NO: 447714 - DNA, 25 bp, Mus musculus
gacagcagcaataaccatgctcatg

SEQ ID NO: 447715 - DNA, 25 bp, Mus musculus
gacagcagcaattaccatgctcatg

SEQ ID NO: 447716 - DNA, 25 bp, Mus musculus
gacagcagcactcagacgttggact

SEQ ID NO: 447717 - DNA, 25 bp, Mus musculus
gacagcagcactgagacgttggact

SEQ ID NO: 447718 - DNA, 25 bp, Mus musculus
gacagcagcagcctagaagacgcta

SEQ ID NO: 447719 - DNA, 25 bp, Mus musculus
gacagcagcagcgtagaagacgcta

SEQ ID NO: 447720 - DNA, 25 bp, Mus musculus
gacagcagccttcagtctttgtgaa

SEQ ID NO: 447721 - DNA, 25 bp, Mus musculus
gacagcagccttgagtctttgtgaa

SEQ ID NO: 447722 - DNA, 25 bp, Mus musculus
gacagcagcgctattttctctactt

SEQ ID NO: 447723 - DNA, 25 bp, Mus musculus
gacagcagcgcttttttctctactt

SEQ ID NO: 447724 - DNA, 25 bp, Mus musculus
gacagcagcgggatatggaaccaac

SEQ ID NO: 447725 - DNA, 25 bp, Mus musculus
gacagcagcgggttatggaaccaac

SEQ ID NO: 447726 - DNA, 25 bp, Mus musculus
gacagcagctggactccgtaaatac

SEQ ID NO: 447727 - DNA, 25 bp, Mus musculus
gacagcagctggctcccaattcggg

SEQ ID NO: 447728 - DNA, 25 bp, Mus musculus
gacagcagctgggtcccaattcggg

SEQ ID NO: 447729 - DNA, 25 bp, Mus musculus
gacagcagctggtctccgtaaatac

SEQ ID NO: 447730 - DNA, 25 bp, Mus musculus
gacagcaggaccacaaaggcttcat

SEQ ID NO: 447731 - DNA, 25 bp, Mus musculus
gacagcaggacctcaaaggcttcat

SEQ ID NO: 447732 - DNA, 25 bp, Mus musculus
gacagcaggactagctagagcactt

SEQ ID NO: 447733 - DNA, 25 bp, Mus musculus
gacagcaggacttgctagagcactt

SEQ ID NO: 447734 - DNA, 25 bp, Mus musculus
gacagcaggagactttcaggagatt

SEQ ID NO: 447735 - DNA, 25 bp, Mus musculus
gacagcaggagagtttcaggagatt

SEQ ID NO: 447736 - DNA, 25 bp, Mus musculus
gacagcaggagtaagtcactcctca

SEQ ID NO: 447737 - DNA, 25 bp, Mus musculus
gacagcaggagttagtcactcctca

SEQ ID NO: 447738 - DNA, 25 bp, Mus musculus
gacagcaggtaccttgctgcgaccc

SEQ ID NO: 447739 - DNA, 25 bp, Mus musculus
gacagcaggtacgttgctgcgaccc

SEQ ID NO: 447740 - DNA, 25 bp, Mus musculus
gacagcaggtgtattaccttactaa

SEQ ID NO: 447741 - DNA, 25 bp, Mus musculus
gacagcaggtgtcccatctggaaag

SEQ ID NO: 447742 - DNA, 25 bp, Mus musculus
gacagcaggtgtgccatctggaaag

SEQ ID NO: 447743 - DNA, 25 bp, Mus musculus
gacagcaggtgttttaccttactaa

SEQ ID NO: 447744 - DNA, 25 bp, Mus musculus
gacagcaggttcaagctcttggact

SEQ ID NO: 447745 - DNA, 25 bp, Mus musculus
gacagcaggttctagctcttggact

SEQ ID NO: 447746 - DNA, 25 bp, Mus musculus
gacagcagtattaacgagcatttta

SEQ ID NO: 447747 - DNA, 25 bp, Mus musculus
gacagcagtatttacgagcatttta

SEQ ID NO: 447748 - DNA, 25 bp, Mus musculus
gacagcagtcaacaattcaggcaga

SEQ ID NO: 447749 - DNA, 25 bp, Mus musculus
gacagcagtcaagaattcaggcaga

SEQ ID NO: 447750 - DNA, 25 bp, Mus musculus
gacagcagtctgagggttcctggaa

SEQ ID NO: 447751 - DNA, 25 bp, Mus musculus
gacagcagtctgtgggttcctggaa

SEQ ID NO: 447752 - DNA, 25 bp, Mus musculus
gacagcagtgcaacttgtgaccagc

SEQ ID NO: 447753 - DNA, 25 bp, Mus musculus
gacagcagtgcatcttgtgaccagc

SEQ ID NO: 447754 - DNA, 25 bp, Mus musculus
gacagcagtgtccagtaaagatttt

SEQ ID NO: 447755 - DNA, 25 bp, Mus musculus
gacagcagtgtccttaagcgcagcc

SEQ ID NO: 447756 - DNA, 25 bp, Mus musculus
gacagcagtgtcgagtaaagatttt

SEQ ID NO: 447757 - DNA, 25 bp, Mus musculus
gacagcagtgtcgttaagcgcagcc

SEQ ID NO: 447758 - DNA, 25 bp, Mus musculus
gacagcagtttgcattgttgtagca

SEQ ID NO: 447759 - DNA, 25 bp, Mus musculus
gacagcagtttggattgttgtagca

SEQ ID NO: 447760 - DNA, 25 bp, Mus musculus
gacagcataccaccgtgctgtttta

SEQ ID NO: 447761 - DNA, 25 bp, Mus musculus
gacagcataccagcgtgctgtttta

SEQ ID NO: 447762 - DNA, 25 bp, Mus musculus
gacagcatatctatggttcagttga

SEQ ID NO: 447763 - DNA, 25 bp, Mus musculus
gacagcatatctttggttcagttga

SEQ ID NO: 447764 - DNA, 25 bp, Mus musculus
gacagcatatgacatgagtctggca

SEQ ID NO: 447765 - DNA, 25 bp, Mus musculus
gacagcatatgagatgagtctggca

SEQ ID NO: 447766 - DNA, 25 bp, Mus musculus
gacagcatatgcctataagcctagc

SEQ ID NO: 447767 - DNA, 25 bp, Mus musculus
gacagcatatgcgtataagcctagc

SEQ ID NO: 447768 - DNA, 25 bp, Mus musculus
gacagcatattgcagacccttcaga

SEQ ID NO: 447769 - DNA, 25 bp, Mus musculus
gacagcatattggagacccttcaga

SEQ ID NO: 447770 - DNA, 25 bp, Mus musculus
gacagcatatttactgtgagaatat

SEQ ID NO: 447771 - DNA, 25 bp, Mus musculus
gacagcatattttctgtgagaatat

SEQ ID NO: 447772 - DNA, 25 bp, Mus musculus
gacagcatcaatacgttcttgtttg

SEQ ID NO: 447773 - DNA, 25 bp, Mus musculus
gacagcatcaattcgttcttgtttg

SEQ ID NO: 447774 - DNA, 25 bp, Mus musculus
gacagcatcatgcatggcttcccag

SEQ ID NO: 447775 - DNA, 25 bp, Mus musculus
gacagcatcatggatggcttcccag

SEQ ID NO: 447776 - DNA, 25 bp, Mus musculus
gacagcatcattaccaacatggtct

SEQ ID NO: 447777 - DNA, 25 bp, Mus musculus
gacagcatcatttccaacatggtct

SEQ ID NO: 447778 - DNA, 25 bp, Mus musculus
gacagcatccatattacttcaaagc

SEQ ID NO: 447779 - DNA, 25 bp, Mus musculus
gacagcatccattttacttcaaagc

SEQ ID NO: 447780 - DNA, 25 bp, Mus musculus
gacagcatccttcaatatgtaaaag

SEQ ID NO: 447781 - DNA, 25 bp, Mus musculus
gacagcatccttgaatatgtaaaag

SEQ ID NO: 447782 - DNA, 25 bp, Mus musculus
gacagcatcgacaaactttctctaa

SEQ ID NO: 447783 - DNA, 25 bp, Mus musculus
gacagcatcgactaactttctctaa

SEQ ID NO: 447784 - DNA, 25 bp, Mus musculus
gacagcatctcacatgggagccgga

SEQ ID NO: 447785 - DNA, 25 bp, Mus musculus
gacagcatctcagatgggagccgga

SEQ ID NO: 447786 - DNA, 25 bp, Mus musculus
gacagcatctctctaggtagtgttg

SEQ ID NO: 447787 - DNA, 25 bp, Mus musculus
gacagcatctctgtaggtagtgttg

SEQ ID NO: 447788 - DNA, 25 bp, Mus musculus
gacagcatctggagtggcctgcaga

SEQ ID NO: 447789 - DNA, 25 bp, Mus musculus
gacagcatctggtgtggcctgcaga

SEQ ID NO: 447790 - DNA, 25 bp, Mus musculus
gacagcatgatcctacaagaccact

SEQ ID NO: 447791 - DNA, 25 bp, Mus musculus
gacagcatgatcgtacaagaccact

SEQ ID NO: 447792 - DNA, 25 bp, Mus musculus
gacagcatgattcacagcagtagca

SEQ ID NO: 447793 - DNA, 25 bp, Mus musculus
gacagcatgattgacagcagtagca

SEQ ID NO: 447794 - DNA, 25 bp, Mus musculus
gacagcatgtagcagactaactttt

SEQ ID NO: 447795 - DNA, 25 bp, Mus musculus
gacagcatgtaggagactaactttt

SEQ ID NO: 447796 - DNA, 25 bp, Mus musculus
gacagcatgtgaacctagtacttga

SEQ ID NO: 447797 - DNA, 25 bp, Mus musculus
gacagcatgtgatcctagtacttga

SEQ ID NO: 447798 - DNA, 25 bp, Mus musculus
gacagcatgtgtcgcgactcaagca

SEQ ID NO: 447799 - DNA, 25 bp, Mus musculus
gacagcatgtgtggcgactcaagca

SEQ ID NO: 447800 - DNA, 25 bp, Mus musculus
gacagcattcagagcctattaccac

SEQ ID NO: 447801 - DNA, 25 bp, Mus musculus
gacagcattcagtgcctattaccac

SEQ ID NO: 447802 - DNA, 25 bp, Mus musculus
gacagcattcatatgtacagggaca

SEQ ID NO: 447803 - DNA, 25 bp, Mus musculus
gacagcattcatttgtacagggaca

SEQ ID NO: 447804 - DNA, 25 bp, Mus musculus
gacagcattccaataacaggcatga

SEQ ID NO: 447805 - DNA, 25 bp, Mus musculus
gacagcattccattaacaggcatga

SEQ ID NO: 447806 - DNA, 25 bp, Mus musculus
gacagcattctcaacatctttgttc

SEQ ID NO: 447807 - DNA, 25 bp, Mus musculus
gacagcattctctacatctttgttc

SEQ ID NO: 447808 - DNA, 25 bp, Mus musculus
gacagcattctgagcagtttcactc

SEQ ID NO: 447809 - DNA, 25 bp, Mus musculus
gacagcattctgtgcagtttcactc

SEQ ID NO: 447810 - DNA, 25 bp, Mus musculus
gacagcattgctaatcagacctcca

SEQ ID NO: 447811 - DNA, 25 bp, Mus musculus
gacagcattgcttatcagacctcca

SEQ ID NO: 447812 - DNA, 25 bp, Mus musculus
gacagcattggaacaaccatctctt

SEQ ID NO: 447813 - DNA, 25 bp, Mus musculus
gacagcattggatcaaccatctctt

SEQ ID NO: 447814 - DNA, 25 bp, Mus musculus
gacagcattgtcaacgacgaagttc

SEQ ID NO: 447815 - DNA, 25 bp, Mus musculus
gacagcattgtctacgacgaagttc

SEQ ID NO: 447816 - DNA, 25 bp, Mus musculus
gacagcattgttaggagacttggtt

SEQ ID NO: 447817 - DNA, 25 bp, Mus musculus
gacagcattgtttggagacttggtt

SEQ ID NO: 447818 - DNA, 25 bp, Mus musculus
gacagcatttcaatgtgttaccctt

SEQ ID NO: 447819 - DNA, 25 bp, Mus musculus
gacagcatttcaccactcagtagta

SEQ ID NO: 447820 - DNA, 25 bp, Mus musculus
gacagcatttcagcactcagtagta

SEQ ID NO: 447821 - DNA, 25 bp, Mus musculus
gacagcatttcattgtgttaccctt

SEQ ID NO: 447822 - DNA, 25 bp, Mus musculus
gacagcatttgaacatagtggacgt

SEQ ID NO: 447823 - DNA, 25 bp, Mus musculus
gacagcatttgatcatagtggacgt

SEQ ID NO: 447824 - DNA, 25 bp, Mus musculus
gacagcatttttcgacgttggaaga

SEQ ID NO: 447825 - DNA, 25 bp, Mus musculus
gacagcatttttggacgttggaaga

SEQ ID NO: 447826 - DNA, 25 bp, Mus musculus
gacagccaactgagacctgtggaaa

SEQ ID NO: 447827 - DNA, 25 bp, Mus musculus
gacagccaactgtgacctgtggaaa

SEQ ID NO: 447828 - DNA, 25 bp, Mus musculus
gacagccaagagcacaagatcatct

SEQ ID NO: 447829 - DNA, 25 bp, Mus musculus
gacagccaagaggacaagatcatct

SEQ ID NO: 447830 - DNA, 25 bp, Mus musculus
gacagccaagataccaaacaaaaga

SEQ ID NO: 447831 - DNA, 25 bp, Mus musculus
gacagccaagattccaaacaaaaga

SEQ ID NO: 447832 - DNA, 25 bp, Mus musculus
gacagccaatctcaacttgtgtttc

SEQ ID NO: 447833 - DNA, 25 bp, Mus musculus
gacagccaatctgaacttgtgtttc

SEQ ID NO: 447834 - DNA, 25 bp, Mus musculus
gacagccaattacacattgtcctac

SEQ ID NO: 447835 - DNA, 25 bp, Mus musculus
gacagccaattagacattgtcctac

SEQ ID NO: 447836 - DNA, 25 bp, Mus musculus
gacagccacagcaacgcagtgagac

SEQ ID NO: 447837 - DNA, 25 bp, Mus musculus
gacagccacagctacgcagtgagac

SEQ ID NO: 447838 - DNA, 25 bp, Mus musculus
gacagccacagtcttgtttctggtg

SEQ ID NO: 447839 - DNA, 25 bp, Mus musculus
gacagccacagtgttgtttctggtg

SEQ ID NO: 447840 - DNA, 25 bp, Mus musculus
gacagccacataacctgattcttga

SEQ ID NO: 447841 - DNA, 25 bp, Mus musculus
gacagccacatatcctgattcttga

SEQ ID NO: 447842 - DNA, 25 bp, Mus musculus
gacagccacatcaacattagcttga

SEQ ID NO: 447843 - DNA, 25 bp, Mus musculus
gacagccacatctacattagcttga

SEQ ID NO: 447844 - DNA, 25 bp, Mus musculus
gacagccactagcaagagttctcgt

SEQ ID NO: 447845 - DNA, 25 bp, Mus musculus
gacagccactaggaagagttctcgt

SEQ ID NO: 447846 - DNA, 25 bp, Mus musculus
gacagccagacgatgatgtccctat

SEQ ID NO: 447847 - DNA, 25 bp, Mus musculus
gacagccagacgttgatgtccctat

SEQ ID NO: 447848 - DNA, 25 bp, Mus musculus
gacagccagatgcacattagccaaa

SEQ ID NO: 447849 - DNA, 25 bp, Mus musculus
gacagccagatggacattagccaaa

SEQ ID NO: 447850 - DNA, 25 bp, Mus musculus
gacagccagcaactacacagatcgt

SEQ ID NO: 447851 - DNA, 25 bp, Mus musculus
gacagccagcaagtacacagatcgt

SEQ ID NO: 447852 - DNA, 25 bp, Mus musculus
gacagccagcttctcgctggcagaa

SEQ ID NO: 447853 - DNA, 25 bp, Mus musculus
gacagccagcttgtcgctggcagaa

SEQ ID NO: 447854 - DNA, 25 bp, Mus musculus
gacagccagttaccaagacatcagt

SEQ ID NO: 447855 - DNA, 25 bp, Mus musculus
gacagccagttagcaagacatcagt

SEQ ID NO: 447856 - DNA, 25 bp, Mus musculus
gacagccagttcatcctgtaagact

SEQ ID NO: 447857 - DNA, 25 bp, Mus musculus
gacagccagttcttcctgtaagact

SEQ ID NO: 447858 - DNA, 25 bp, Mus musculus
gacagccataccaagatgctattgt

SEQ ID NO: 447859 - DNA, 25 bp, Mus musculus
gacagccatacctagatgctattgt

SEQ ID NO: 447860 - DNA, 25 bp, Mus musculus
gacagccatcctcaagctagaacaa

SEQ ID NO: 447861 - DNA, 25 bp, Mus musculus
gacagccatcctgaagctagaacaa

SEQ ID NO: 447862 - DNA, 25 bp, Mus musculus
gacagccatctacacaccaaggaga

SEQ ID NO: 447863 - DNA, 25 bp, Mus musculus
gacagccatctagacaccaaggaga

SEQ ID NO: 447864 - DNA, 25 bp, Mus musculus
gacagccatctgacttcctttagtg

SEQ ID NO: 447865 - DNA, 25 bp, Mus musculus
gacagccatctgtcttcctttagtg

SEQ ID NO: 447866 - DNA, 25 bp, Mus musculus
gacagccatggtcctagtgtatcat

SEQ ID NO: 447867 - DNA, 25 bp, Mus musculus
gacagccatggtgctagtgtatcat

SEQ ID NO: 447868 - DNA, 25 bp, Mus musculus
gacagccattgtacaggtgctcagc

SEQ ID NO: 447869 - DNA, 25 bp, Mus musculus
gacagccattgtactattgaagcgg

SEQ ID NO: 447870 - DNA, 25 bp, Mus musculus
gacagccattgttcaggtgctcagc

SEQ ID NO: 447871 - DNA, 25 bp, Mus musculus
gacagccattgttctattgaagcgg

SEQ ID NO: 447872 - DNA, 25 bp, Mus musculus
gacagcccaactcagttttgcaaag

SEQ ID NO: 447873 - DNA, 25 bp, Mus musculus
gacagcccaactgagttttgcaaag

SEQ ID NO: 447874 - DNA, 25 bp, Mus musculus
gacagcccacatctgcccagagatg

SEQ ID NO: 447875 - DNA, 25 bp, Mus musculus
gacagcccacatgtgcccagagatg

SEQ ID NO: 447876 - DNA, 25 bp, Mus musculus
gacagcccaggaaacaaggatgaac

SEQ ID NO: 447877 - DNA, 25 bp, Mus musculus
gacagcccaggatacaaggatgaac

SEQ ID NO: 447878 - DNA, 25 bp, Mus musculus
gacagcccagtgaaccctaatggta

SEQ ID NO: 447879 - DNA, 25 bp, Mus musculus
gacagcccagtgtaccctaatggta

SEQ ID NO: 447880 - DNA, 25 bp, Mus musculus
gacagcccatgtcacagggtcagac

SEQ ID NO: 447881 - DNA, 25 bp, Mus musculus
gacagcccatgtgacagggtcagac

SEQ ID NO: 447882 - DNA, 25 bp, Mus musculus
gacagccccaacaggaagcatgctt

SEQ ID NO: 447883 - DNA, 25 bp, Mus musculus
gacagccccaactggaagcatgctt

SEQ ID NO: 447884 - DNA, 25 bp, Mus musculus
gacagccccaagaaacaacagttca

SEQ ID NO: 447885 - DNA, 25 bp, Mus musculus
gacagccccaagtaacaacagttca

SEQ ID NO: 447886 - DNA, 25 bp, Mus musculus
gacagccccactctgacaagatgtg

SEQ ID NO: 447887 - DNA, 25 bp, Mus musculus
gacagccccactgtgacaagatgtg

SEQ ID NO: 447888 - DNA, 25 bp, Mus musculus
gacagccccagaactaagcggtgtg

SEQ ID NO: 447889 - DNA, 25 bp, Mus musculus
gacagccccagatctaagcggtgtg

SEQ ID NO: 447890 - DNA, 25 bp, Mus musculus
gacagccccatcattttgtggtgga

SEQ ID NO: 447891 - DNA, 25 bp, Mus musculus
gacagccccatctttttgtggtgga

SEQ ID NO: 447892 - DNA, 25 bp, Mus musculus
gacagccccgacaagactttagcag

SEQ ID NO: 447893 - DNA, 25 bp, Mus musculus
gacagccccgactagactttagcag

SEQ ID NO: 447894 - DNA, 25 bp, Mus musculus
gacagccccgttctttggtaaactg

SEQ ID NO: 447895 - DNA, 25 bp, Mus musculus
gacagccccgttgtttggtaaactg

SEQ ID NO: 447896 - DNA, 25 bp, Mus musculus
gacagcccctatcagggtggagtat

SEQ ID NO: 447897 - DNA, 25 bp, Mus musculus
gacagcccctatgagggtggagtat

SEQ ID NO: 447898 - DNA, 25 bp, Mus musculus
gacagcccctgaattccagataaat

SEQ ID NO: 447899 - DNA, 25 bp, Mus musculus
gacagcccctgatttccagataaat

SEQ ID NO: 447900 - DNA, 25 bp, Mus musculus
gacagcccgcgcaagtggcagaaca

SEQ ID NO: 447901 - DNA, 25 bp, Mus musculus
gacagcccgcgctagtggcagaaca

SEQ ID NO: 447902 - DNA, 25 bp, Mus musculus
gacagcccgcttcagtaattatttg

SEQ ID NO: 447903 - DNA, 25 bp, Mus musculus
gacagcccgcttgagtaattatttg

SEQ ID NO: 447904 - DNA, 25 bp, Mus musculus
gacagcccgggtccccatgttaaag

SEQ ID NO: 447905 - DNA, 25 bp, Mus musculus
gacagcccgggtgcccatgttaaag

SEQ ID NO: 447906 - DNA, 25 bp, Mus musculus
gacagccctaatatttgttccttta

SEQ ID NO: 447907 - DNA, 25 bp, Mus musculus
gacagccctaatttttgttccttta

SEQ ID NO: 447908 - DNA, 25 bp, Mus musculus
gacagccctagacacgactgcataa

SEQ ID NO: 447909 - DNA, 25 bp, Mus musculus
gacagccctagagacgactgcataa

SEQ ID NO: 447910 - DNA, 25 bp, Mus musculus
gacagccctagcattgaactctaat

SEQ ID NO: 447911 - DNA, 25 bp, Mus musculus
gacagccctagctttgaactctaat

SEQ ID NO: 447912 - DNA, 25 bp, Mus musculus
gacagccctagtcttacactggttc

SEQ ID NO: 447913 - DNA, 25 bp, Mus musculus
gacagccctagtgttacactggttc

SEQ ID NO: 447914 - DNA, 25 bp, Mus musculus
gacagccctgttaataacaagccgt

SEQ ID NO: 447915 - DNA, 25 bp, Mus musculus
gacagccctgtttataacaagccgt

SEQ ID NO: 447916 - DNA, 25 bp, Mus musculus
gacagcccttttctgagaagcagaa

SEQ ID NO: 447917 - DNA, 25 bp, Mus musculus
gacagcccttttgtgagaagcagaa

SEQ ID NO: 447918 - DNA, 25 bp, Mus musculus
gacagccgcgtgacactgtttgagg

SEQ ID NO: 447919 - DNA, 25 bp, Mus musculus
gacagccgcgtgtcactgtttgagg

SEQ ID NO: 447920 - DNA, 25 bp, Mus musculus
gacagccggcacattcaagcagaga

SEQ ID NO: 447921 - DNA, 25 bp, Mus musculus
gacagccggcactttcaagcagaga

SEQ ID NO: 447922 - DNA, 25 bp, Mus musculus
gacagccggctgataatttctacta

SEQ ID NO: 447923 - DNA, 25 bp, Mus musculus
gacagccggctgttaatttctacta

SEQ ID NO: 447924 - DNA, 25 bp, Mus musculus
gacagccggtgtatatagaccttgt

SEQ ID NO: 447925 - DNA, 25 bp, Mus musculus
gacagccggtgtttatagaccttgt

SEQ ID NO: 447926 - DNA, 25 bp, Mus musculus
gacagccgtgtcagtgggagtccaa

SEQ ID NO: 447927 - DNA, 25 bp, Mus musculus
gacagccgtgtctgtgggagtccaa

SEQ ID NO: 447928 - DNA, 25 bp, Mus musculus
gacagcctaaatactcttagaagta

SEQ ID NO: 447929 - DNA, 25 bp, Mus musculus
gacagcctaaattctcttagaagta

SEQ ID NO: 447930 - DNA, 25 bp, Mus musculus
gacagcctaacccagacgtatgtga

SEQ ID NO: 447931 - DNA, 25 bp, Mus musculus
gacagcctaaccgagacgtatgtga

SEQ ID NO: 447932 - DNA, 25 bp, Mus musculus
gacagcctacgtataaccctcagag

SEQ ID NO: 447933 - DNA, 25 bp, Mus musculus
gacagcctacgtttaaccctcagag

SEQ ID NO: 447934 - DNA, 25 bp, Mus musculus
gacagcctcttgacatttagctact

SEQ ID NO: 447935 - DNA, 25 bp, Mus musculus
gacagcctcttgtcatttagctact

SEQ ID NO: 447936 - DNA, 25 bp, Mus musculus
gacagcctgaatacagtctctgaga

SEQ ID NO: 447937 - DNA, 25 bp, Mus musculus
gacagcctgaatccacattctgaac

SEQ ID NO: 447938 - DNA, 25 bp, Mus musculus
gacagcctgaatccttagcatagtt

SEQ ID NO: 447939 - DNA, 25 bp, Mus musculus
gacagcctgaatgcacattctgaac

SEQ ID NO: 447940 - DNA, 25 bp, Mus musculus
gacagcctgaatgcttagcatagtt

SEQ ID NO: 447941 - DNA, 25 bp, Mus musculus
gacagcctgaattcagtctctgaga

SEQ ID NO: 447942 - DNA, 25 bp, Mus musculus
gacagcctgatcaactaataagtaa

SEQ ID NO: 447943 - DNA, 25 bp, Mus musculus
gacagcctgatctactaataagtaa

SEQ ID NO: 447944 - DNA, 25 bp, Mus musculus
gacagcctgcaacacaaatggaaca

SEQ ID NO: 447945 - DNA, 25 bp, Mus musculus
gacagcctgcaagacaaatggaaca

SEQ ID NO: 447946 - DNA, 25 bp, Mus musculus
gacagcctgcctctgagtgaatcac

SEQ ID NO: 447947 - DNA, 25 bp, Mus musculus
gacagcctgcctgtgagtgaatcac

SEQ ID NO: 447948 - DNA, 25 bp, Mus musculus
gacagcctggatccccatagcagaa

SEQ ID NO: 447949 - DNA, 25 bp, Mus musculus
gacagcctggatgcccatagcagaa

SEQ ID NO: 447950 - DNA, 25 bp, Mus musculus
gacagcctggcaacttaagtacatt

SEQ ID NO: 447951 - DNA, 25 bp, Mus musculus
gacagcctggcatcttaagtacatt

SEQ ID NO: 447952 - DNA, 25 bp, Mus musculus
gacagcctggccaaccataatgata

SEQ ID NO: 447953 - DNA, 25 bp, Mus musculus
gacagcctggccacattgctagcac

SEQ ID NO: 447954 - DNA, 25 bp, Mus musculus
gacagcctggcctaccataatgata

SEQ ID NO: 447955 - DNA, 25 bp, Mus musculus
gacagcctggcctcattgctagcac

SEQ ID NO: 447956 - DNA, 25 bp, Mus musculus
gacagcctgtgtcagtcgggtttct

SEQ ID NO: 447957 - DNA, 25 bp, Mus musculus
gacagcctgtgtgagtcgggtttct

SEQ ID NO: 447958 - DNA, 25 bp, Mus musculus
gacagcctgttcctctgtcgaggag

SEQ ID NO: 447959 - DNA, 25 bp, Mus musculus
gacagcctgttcgtctgtcgaggag

SEQ ID NO: 447960 - DNA, 25 bp, Mus musculus
gacagcctgtttcctatgacatgga

SEQ ID NO: 447961 - DNA, 25 bp, Mus musculus
gacagcctgtttgctatgacatgga

SEQ ID NO: 447962 - DNA, 25 bp, Mus musculus
gacagccttcatcatagcagacaat

SEQ ID NO: 447963 - DNA, 25 bp, Mus musculus
gacagccttcatgatagcagacaat

SEQ ID NO: 447964 - DNA, 25 bp, Mus musculus
gacagccttctgagtaactcaaaat

SEQ ID NO: 447965 - DNA, 25 bp, Mus musculus
gacagccttctgtgtaactcaaaat

SEQ ID NO: 447966 - DNA, 25 bp, Mus musculus
gacagccttgacctgaactgtgaca

SEQ ID NO: 447967 - DNA, 25 bp, Mus musculus
gacagccttgacgtgaactgtgaca

SEQ ID NO: 447968 - DNA, 25 bp, Mus musculus
gacagccttgttcatattccaggtg

SEQ ID NO: 447969 - DNA, 25 bp, Mus musculus
gacagccttgttgatattccaggtg

SEQ ID NO: 447970 - DNA, 25 bp, Mus musculus
gacagcgaaaaccacattgcgggac

SEQ ID NO: 447971 - DNA, 25 bp, Mus musculus
gacagcgaaaacgacattgcgggac

SEQ ID NO: 447972 - DNA, 25 bp, Mus musculus
gacagcgacacaatcagaaagaatg

SEQ ID NO: 447973 - DNA, 25 bp, Mus musculus
gacagcgacacattcagaaagaatg

SEQ ID NO: 447974 - DNA, 25 bp, Mus musculus
gacagcgacagtagctcagaagaca

SEQ ID NO: 447975 - DNA, 25 bp, Mus musculus
gacagcgacagttgctcagaagaca

SEQ ID NO: 447976 - DNA, 25 bp, Mus musculus
gacagcgacatgaccccgaaaggca

SEQ ID NO: 447977 - DNA, 25 bp, Mus musculus
gacagcgacatgtccccgaaaggca

SEQ ID NO: 447978 - DNA, 25 bp, Mus musculus
gacagcgacctgagaaactgtgaac

SEQ ID NO: 447979 - DNA, 25 bp, Mus musculus
gacagcgacctgtgaaactgtgaac

SEQ ID NO: 447980 - DNA, 25 bp, Mus musculus
gacagcgagagtcttgcaacctgcc

SEQ ID NO: 447981 - DNA, 25 bp, Mus musculus
gacagcgagagtgttgcaacctgcc

SEQ ID NO: 447982 - DNA, 25 bp, Mus musculus
gacagcgatagccaatgcggttgtt

SEQ ID NO: 447983 - DNA, 25 bp, Mus musculus
gacagcgatagcgaatgcggttgtt

SEQ ID NO: 447984 - DNA, 25 bp, Mus musculus
gacagcgatcacagcagccatagcg

SEQ ID NO: 447985 - DNA, 25 bp, Mus musculus
gacagcgatcactgcagccatagcg

SEQ ID NO: 447986 - DNA, 25 bp, Mus musculus
gacagcgatcatacaggattcatct

SEQ ID NO: 447987 - DNA, 25 bp, Mus musculus
gacagcgatcattcaggattcatct

SEQ ID NO: 447988 - DNA, 25 bp, Mus musculus
gacagcgatgaaatgccgtttggtt

SEQ ID NO: 447989 - DNA, 25 bp, Mus musculus
gacagcgatgaattgccgtttggtt

SEQ ID NO: 447990 - DNA, 25 bp, Mus musculus
gacagcgatgagctcaggtctctct

SEQ ID NO: 447991 - DNA, 25 bp, Mus musculus
gacagcgatgaggtcaggtctctct

SEQ ID NO: 447992 - DNA, 25 bp, Mus musculus
gacagcgatgatcatgcccacgacc

SEQ ID NO: 447993 - DNA, 25 bp, Mus musculus
gacagcgatgatgatgcccacgacc

SEQ ID NO: 447994 - DNA, 25 bp, Mus musculus
gacagcgatggcacttcagcacaca

SEQ ID NO: 447995 - DNA, 25 bp, Mus musculus
gacagcgatggctcttcagcacaca

SEQ ID NO: 447996 - DNA, 25 bp, Mus musculus
gacagcgatgtgaatcaagtgccta

SEQ ID NO: 447997 - DNA, 25 bp, Mus musculus
gacagcgatgtgtatcaagtgccta

SEQ ID NO: 447998 - DNA, 25 bp, Mus musculus
gacagcgattaaccgtagcactcta

SEQ ID NO: 447999 - DNA, 25 bp, Mus musculus
gacagcgattaagcgtagcactcta

SEQ ID NO: 448000 - DNA, 25 bp, Mus musculus
gacagcgattcacaggatggagaca

SEQ ID NO: 448001 - DNA, 25 bp, Mus musculus
gacagcgattcagaggatggagaca

SEQ ID NO: 448002 - DNA, 25 bp, Mus musculus
gacagcgcaacaagggcagcccaaa

SEQ ID NO: 448003 - DNA, 25 bp, Mus musculus
gacagcgcaacatgggcagcccaaa

SEQ ID NO: 448004 - DNA, 25 bp, Mus musculus
gacagcgcataccatttccgggtag

SEQ ID NO: 448005 - DNA, 25 bp, Mus musculus
gacagcgcatacgatttccgggtag

SEQ ID NO: 448006 - DNA, 25 bp, Mus musculus
gacagcgccacactgatttttctca

SEQ ID NO: 448007 - DNA, 25 bp, Mus musculus
gacagcgccacagtgatttttctca

SEQ ID NO: 448008 - DNA, 25 bp, Mus musculus
gacagcgcccatcgcttgttcatcg

SEQ ID NO: 448009 - DNA, 25 bp, Mus musculus
gacagcgcccatggcttgttcatcg

SEQ ID NO: 448010 - DNA, 25 bp, Mus musculus
gacagcgcccgcagttcaggagccg

SEQ ID NO: 448011 - DNA, 25 bp, Mus musculus
gacagcgcccgctgttcaggagccg

SEQ ID NO: 448012 - DNA, 25 bp, Mus musculus
gacagcgccggtacaagccttggat

SEQ ID NO: 448013 - DNA, 25 bp, Mus musculus
gacagcgccggttcaagccttggat

SEQ ID NO: 448014 - DNA, 25 bp, Mus musculus
gacagcgcctcaaggaagctaccaa

SEQ ID NO: 448015 - DNA, 25 bp, Mus musculus
gacagcgcctcatggaagctaccaa

SEQ ID NO: 448016 - DNA, 25 bp, Mus musculus
gacagcgccttgcatgtttattgaa

SEQ ID NO: 448017 - DNA, 25 bp, Mus musculus
gacagcgccttggatgtttattgaa

SEQ ID NO: 448018 - DNA, 25 bp, Mus musculus
gacagcgcggacagagggctttttt

SEQ ID NO: 448019 - DNA, 25 bp, Mus musculus
gacagcgcggactgagggctttttt

SEQ ID NO: 448020 - DNA, 25 bp, Mus musculus
gacagcgctcgcagaagagctacac

SEQ ID NO: 448021 - DNA, 25 bp, Mus musculus
gacagcgctcgctgaagagctacac

SEQ ID NO: 448022 - DNA, 25 bp, Mus musculus
gacagcgctctcctgtggagtgaaa

SEQ ID NO: 448023 - DNA, 25 bp, Mus musculus
gacagcgctctcgtgtggagtgaaa

SEQ ID NO: 448024 - DNA, 25 bp, Mus musculus
gacagcgctgaacactctagctcaa

SEQ ID NO: 448025 - DNA, 25 bp, Mus musculus
gacagcgctgaagactctagctcaa

SEQ ID NO: 448026 - DNA, 25 bp, Mus musculus
gacagcgctggaatctatgatttcc

SEQ ID NO: 448027 - DNA, 25 bp, Mus musculus
gacagcgctggattctatgatttcc

SEQ ID NO: 448028 - DNA, 25 bp, Mus musculus
gacagcgctgtacgaagaccagcag

SEQ ID NO: 448029 - DNA, 25 bp, Mus musculus
gacagcgctgtaggaagaccagcag

SEQ ID NO: 448030 - DNA, 25 bp, Mus musculus
gacagcgctgtgctttccaaacaag

SEQ ID NO: 448031 - DNA, 25 bp, Mus musculus
gacagcgctgtggtttccaaacaag

SEQ ID NO: 448032 - DNA, 25 bp, Mus musculus
gacagcgctgttactgggcacttgg

SEQ ID NO: 448033 - DNA, 25 bp, Mus musculus
gacagcgctgtttctgggcacttgg

SEQ ID NO: 448034 - DNA, 25 bp, Mus musculus
gacagcggacctatttatgacacat

SEQ ID NO: 448035 - DNA, 25 bp, Mus musculus
gacagcggacctttttatgacacat

SEQ ID NO: 448036 - DNA, 25 bp, Mus musculus
gacagcggcaggataagtccctgga

SEQ ID NO: 448037 - DNA, 25 bp, Mus musculus
gacagcggcaggttaagtccctgga

SEQ ID NO: 448038 - DNA, 25 bp, Mus musculus
gacagcggcgttactacacaggaag

SEQ ID NO: 448039 - DNA, 25 bp, Mus musculus
gacagcggcgtttctacacaggaag

SEQ ID NO: 448040 - DNA, 25 bp, Mus musculus
gacagcggctttcttcaacttgtat

SEQ ID NO: 448041 - DNA, 25 bp, Mus musculus
gacagcggctttgttcaacttgtat

SEQ ID NO: 448042 - DNA, 25 bp, Mus musculus
gacagcgggtcacattttcaaggaa

SEQ ID NO: 448043 - DNA, 25 bp, Mus musculus
gacagcgggtcagattttcaaggaa

SEQ ID NO: 448044 - DNA, 25 bp, Mus musculus
gacagcggtaccatcacttgcatag

SEQ ID NO: 448045 - DNA, 25 bp, Mus musculus
gacagcggtaccttcacttgcatag

SEQ ID NO: 448046 - DNA, 25 bp, Mus musculus
gacagcggtcgtaaagttcacggac

SEQ ID NO: 448047 - DNA, 25 bp, Mus musculus
gacagcggtcgttaagttcacggac

SEQ ID NO: 448048 - DNA, 25 bp, Mus musculus
gacagcggtgtcattgtcaacaata

SEQ ID NO: 448049 - DNA, 25 bp, Mus musculus
gacagcggtgtctttgtcaacaata

SEQ ID NO: 448050 - DNA, 25 bp, Mus musculus
gacagcggttcacaagatccagttt

SEQ ID NO: 448051 - DNA, 25 bp, Mus musculus
gacagcggttcagaagatccagttt

SEQ ID NO: 448052 - DNA, 25 bp, Mus musculus
gacagcgtagcaatgagctcgtcag

SEQ ID NO: 448053 - DNA, 25 bp, Mus musculus
gacagcgtagcattgagctcgtcag

SEQ ID NO: 448054 - DNA, 25 bp, Mus musculus
gacagcgtcttgatttccacagggt

SEQ ID NO: 448055 - DNA, 25 bp, Mus musculus
gacagcgtcttgttttccacagggt

SEQ ID NO: 448056 - DNA, 25 bp, Mus musculus
gacagcgtgacaaagcccgacaagg

SEQ ID NO: 448057 - DNA, 25 bp, Mus musculus
gacagcgtgacatagcccgacaagg

SEQ ID NO: 448058 - DNA, 25 bp, Mus musculus
gacagcgtgagtagacctgcttgct

SEQ ID NO: 448059 - DNA, 25 bp, Mus musculus
gacagcgtgagttgacctgcttgct

SEQ ID NO: 448060 - DNA, 25 bp, Mus musculus
gacagcgtgctcaactctgcagata

SEQ ID NO: 448061 - DNA, 25 bp, Mus musculus
gacagcgtgctctactctgcagata

SEQ ID NO: 448062 - DNA, 25 bp, Mus musculus
gacagcgtgtctcagagcacaggca

SEQ ID NO: 448063 - DNA, 25 bp, Mus musculus
gacagcgtgtctgagagcacaggca

SEQ ID NO: 448064 - DNA, 25 bp, Mus musculus
gacagcgttcctccaacaaaatggg

SEQ ID NO: 448065 - DNA, 25 bp, Mus musculus
gacagcgttcctgcaacaaaatggg

SEQ ID NO: 448066 - DNA, 25 bp, Mus musculus
gacagcgttgacatgacagactttt

SEQ ID NO: 448067 - DNA, 25 bp, Mus musculus
gacagcgttgacttgacagactttt

SEQ ID NO: 448068 - DNA, 25 bp, Mus musculus
gacagcgttgcacaaggacttgaag

SEQ ID NO: 448069 - DNA, 25 bp, Mus musculus
gacagcgttgcagaaggacttgaag

SEQ ID NO: 448070 - DNA, 25 bp, Mus musculus
gacagcgtttagcaactagtcatct

SEQ ID NO: 448071 - DNA, 25 bp, Mus musculus
gacagcgtttaggaactagtcatct

SEQ ID NO: 448072 - DNA, 25 bp, Mus musculus
gacagcgtttggcacattgtctctt

SEQ ID NO: 448073 - DNA, 25 bp, Mus musculus
gacagcgtttgggacattgtctctt

SEQ ID NO: 448074 - DNA, 25 bp, Mus musculus
gacagctaagtacgacttcctggaa

SEQ ID NO: 448075 - DNA, 25 bp, Mus musculus
gacagctaagtaggacttcctggaa

SEQ ID NO: 448076 - DNA, 25 bp, Mus musculus
gacagctaatttacaatggtacata

SEQ ID NO: 448077 - DNA, 25 bp, Mus musculus
gacagctaattttcaatggtacata

SEQ ID NO: 448078 - DNA, 25 bp, Mus musculus
gacagctacaagcaacacaggcaaa

SEQ ID NO: 448079 - DNA, 25 bp, Mus musculus
gacagctacaaggaacacaggcaaa

SEQ ID NO: 448080 - DNA, 25 bp, Mus musculus
gacagctacacgacctgaagggtca

SEQ ID NO: 448081 - DNA, 25 bp, Mus musculus
gacagctacacgtcctgaagggtca

SEQ ID NO: 448082 - DNA, 25 bp, Mus musculus
gacagctacagtctctaaataaata

SEQ ID NO: 448083 - DNA, 25 bp, Mus musculus
gacagctacagtgtctaaataaata

SEQ ID NO: 448084 - DNA, 25 bp, Mus musculus
gacagctaccgcagcgagcgctact

SEQ ID NO: 448085 - DNA, 25 bp, Mus musculus
gacagctaccgctgcgagcgctact

SEQ ID NO: 448086 - DNA, 25 bp, Mus musculus
gacagctagaagaaaggcagcctga

SEQ ID NO: 448087 - DNA, 25 bp, Mus musculus
gacagctagaagtaaggcagcctga

SEQ ID NO: 448088 - DNA, 25 bp, Mus musculus
gacagctagcaaagcaacctgctgt

SEQ ID NO: 448089 - DNA, 25 bp, Mus musculus
gacagctagcaacagctccagcagg

SEQ ID NO: 448090 - DNA, 25 bp, Mus musculus
gacagctagcaagagctccagcagg

SEQ ID NO: 448091 - DNA, 25 bp, Mus musculus
gacagctagcaatgcaacctgctgt

SEQ ID NO: 448092 - DNA, 25 bp, Mus musculus
gacagctatagtatattcacatcca

SEQ ID NO: 448093 - DNA, 25 bp, Mus musculus
gacagctatagtttattcacatcca

SEQ ID NO: 448094 - DNA, 25 bp, Mus musculus
gacagctatatcaggtagcttctga

SEQ ID NO: 448095 - DNA, 25 bp, Mus musculus
gacagctatatctggtagcttctga

SEQ ID NO: 448096 - DNA, 25 bp, Mus musculus
gacagctatggtcctgtatgtacca

SEQ ID NO: 448097 - DNA, 25 bp, Mus musculus
gacagctatggtgctgtatgtacca

SEQ ID NO: 448098 - DNA, 25 bp, Mus musculus
gacagctatgtcatcatggctatct

SEQ ID NO: 448099 - DNA, 25 bp, Mus musculus
gacagctatgtcttcatggctatct

SEQ ID NO: 448100 - DNA, 25 bp, Mus musculus
gacagctatttaacaccaagacaac

SEQ ID NO: 448101 - DNA, 25 bp, Mus musculus
gacagctatttatcaccaagacaac

SEQ ID NO: 448102 - DNA, 25 bp, Mus musculus
gacagctcaaatcgcatgctgcctg

SEQ ID NO: 448103 - DNA, 25 bp, Mus musculus
gacagctcaaatggcatgctgcctg

SEQ ID NO: 448104 - DNA, 25 bp, Mus musculus
gacagctcaagccattctcagtcct

SEQ ID NO: 448105 - DNA, 25 bp, Mus musculus
gacagctcaagcgattctcagtcct

SEQ ID NO: 448106 - DNA, 25 bp, Mus musculus
gacagctcaaggctaaaagacgctt

SEQ ID NO: 448107 - DNA, 25 bp, Mus musculus
gacagctcaagggtaaaagacgctt

SEQ ID NO: 448108 - DNA, 25 bp, Mus musculus
gacagctcaataccaaactccagtt

SEQ ID NO: 448109 - DNA, 25 bp, Mus musculus
gacagctcaatagcaaactccagtt

SEQ ID NO: 448110 - DNA, 25 bp, Mus musculus
gacagctcacgcagattgctttggg

SEQ ID NO: 448111 - DNA, 25 bp, Mus musculus
gacagctcacgctgattgctttggg

SEQ ID NO: 448112 - DNA, 25 bp, Mus musculus
gacagctcagagaaccatttgttat

SEQ ID NO: 448113 - DNA, 25 bp, Mus musculus
gacagctcagagagcagtcagctca

SEQ ID NO: 448114 - DNA, 25 bp, Mus musculus
gacagctcagagtaccatttgttat

SEQ ID NO: 448115 - DNA, 25 bp, Mus musculus
gacagctcagagtgcagtcagctca

SEQ ID NO: 448116 - DNA, 25 bp, Mus musculus
gacagctcagcgctacaaagcaatc

SEQ ID NO: 448117 - DNA, 25 bp, Mus musculus
gacagctcagcggtacaaagcaatc

SEQ ID NO: 448118 - DNA, 25 bp, Mus musculus
gacagctcaggacgcctatgagtct

SEQ ID NO: 448119 - DNA, 25 bp, Mus musculus
gacagctcaggaggcctatgagtct

SEQ ID NO: 448120 - DNA, 25 bp, Mus musculus
gacagctcataaatgcctgcaactc

SEQ ID NO: 448121 - DNA, 25 bp, Mus musculus
gacagctcataattgcctgcaactc

SEQ ID NO: 448122 - DNA, 25 bp, Mus musculus
gacagctccagaatatattgttcag

SEQ ID NO: 448123 - DNA, 25 bp, Mus musculus
gacagctccagaatgcctatggcag

SEQ ID NO: 448124 - DNA, 25 bp, Mus musculus
gacagctccagattatattgttcag

SEQ ID NO: 448125 - DNA, 25 bp, Mus musculus
gacagctccagattgcctatggcag

SEQ ID NO: 448126 - DNA, 25 bp, Mus musculus
gacagctccatgcacttctagaatc

SEQ ID NO: 448127 - DNA, 25 bp, Mus musculus
gacagctccatggacttctagaatc

SEQ ID NO: 448128 - DNA, 25 bp, Mus musculus
gacagctcccacctgagaaacgaat

SEQ ID NO: 448129 - DNA, 25 bp, Mus musculus
gacagctcccacgtgagaaacgaat

SEQ ID NO: 448130 - DNA, 25 bp, Mus musculus
gacagctcccagatctagaagaatt

SEQ ID NO: 448131 - DNA, 25 bp, Mus musculus
gacagctcccagttctagaagaatt

SEQ ID NO: 448132 - DNA, 25 bp, Mus musculus
gacagctccgtaaggatgacgcaat

SEQ ID NO: 448133 - DNA, 25 bp, Mus musculus
gacagctccgtatggatgacgcaat

SEQ ID NO: 448134 - DNA, 25 bp, Mus musculus
gacagctcctcaaggcctcgtgctg

SEQ ID NO: 448135 - DNA, 25 bp, Mus musculus
gacagctcctcatggcctcgtgctg

SEQ ID NO: 448136 - DNA, 25 bp, Mus musculus
gacagctcctcgagctctggcgcgg

SEQ ID NO: 448137 - DNA, 25 bp, Mus musculus
gacagctcctcgtgctctggcgcgg

SEQ ID NO: 448138 - DNA, 25 bp, Mus musculus
gacagctcctttaacttcatgacat

SEQ ID NO: 448139 - DNA, 25 bp, Mus musculus
gacagctccttttacttcatgacat

SEQ ID NO: 448140 - DNA, 25 bp, Mus musculus
gacagctcggaacagctcattcagt

SEQ ID NO: 448141 - DNA, 25 bp, Mus musculus
gacagctcggaagagctcattcagt

SEQ ID NO: 448142 - DNA, 25 bp, Mus musculus
gacagctcggacaggatcgtctggc

SEQ ID NO: 448143 - DNA, 25 bp, Mus musculus
gacagctcggactggatcgtctggc

SEQ ID NO: 448144 - DNA, 25 bp, Mus musculus
gacagctctataccaagtgtccaat

SEQ ID NO: 448145 - DNA, 25 bp, Mus musculus
gacagctctatagcaagtgtccaat

SEQ ID NO: 448146 - DNA, 25 bp, Mus musculus
gacagctctcagactttcagaatgc

SEQ ID NO: 448147 - DNA, 25 bp, Mus musculus
gacagctctcagtctttcagaatgc

SEQ ID NO: 448148 - DNA, 25 bp, Mus musculus
gacagctctcgacgcacaggaaggc

SEQ ID NO: 448149 - DNA, 25 bp, Mus musculus
gacagctctcgaggcacaggaaggc

SEQ ID NO: 448150 - DNA, 25 bp, Mus musculus
gacagctctgctctttggtctttcc

SEQ ID NO: 448151 - DNA, 25 bp, Mus musculus
gacagctctgctgtttggtctttcc

SEQ ID NO: 448152 - DNA, 25 bp, Mus musculus
gacagctctgtgcaagacttttatg

SEQ ID NO: 448153 - DNA, 25 bp, Mus musculus
gacagctctgtggaagacttttatg

SEQ ID NO: 448154 - DNA, 25 bp, Mus musculus
gacagctcttacatcagcagcgatg

SEQ ID NO: 448155 - DNA, 25 bp, Mus musculus
gacagctcttacttcagcagcgatg

SEQ ID NO: 448156 - DNA, 25 bp, Mus musculus
gacagctcttctagggagacactgc

SEQ ID NO: 448157 - DNA, 25 bp, Mus musculus
gacagctcttcttgggagacactgc

SEQ ID NO: 448158 - DNA, 25 bp, Mus musculus
gacagctcttgacaaaggtacatga

SEQ ID NO: 448159 - DNA, 25 bp, Mus musculus
gacagctcttgagaaaggtacatga

SEQ ID NO: 448160 - DNA, 25 bp, Mus musculus
gacagctcttggcagtccaggcttt

SEQ ID NO: 448161 - DNA, 25 bp, Mus musculus
gacagctcttgggagtccaggcttt

SEQ ID NO: 448162 - DNA, 25 bp, Mus musculus
gacagctctttcatatattccatcc

SEQ ID NO: 448163 - DNA, 25 bp, Mus musculus
gacagctctttcttatattccatcc

SEQ ID NO: 448164 - DNA, 25 bp, Mus musculus
gacagctgaaagacgatcacgggcc

SEQ ID NO: 448165 - DNA, 25 bp, Mus musculus
gacagctgaaagtcgatcacgggcc

SEQ ID NO: 448166 - DNA, 25 bp, Mus musculus
gacagctgacaaattggacagtctc

SEQ ID NO: 448167 - DNA, 25 bp, Mus musculus
gacagctgacaatttggacagtctc

SEQ ID NO: 448168 - DNA, 25 bp, Mus musculus
gacagctgacagatctttccttgac

SEQ ID NO: 448169 - DNA, 25 bp, Mus musculus
gacagctgacagttctttccttgac

SEQ ID NO: 448170 - DNA, 25 bp, Mus musculus
gacagctgagatccatacaccaatg

SEQ ID NO: 448171 - DNA, 25 bp, Mus musculus
gacagctgagatgcatacaccaatg

SEQ ID NO: 448172 - DNA, 25 bp, Mus musculus
gacagctgagtcatagtgcaatgcc

SEQ ID NO: 448173 - DNA, 25 bp, Mus musculus
gacagctgagtcttagtgcaatgcc

SEQ ID NO: 448174 - DNA, 25 bp, Mus musculus
gacagctgatatatgcacatgactt

SEQ ID NO: 448175 - DNA, 25 bp, Mus musculus
gacagctgatatttgcacatgactt

SEQ ID NO: 448176 - DNA, 25 bp, Mus musculus
gacagctgatcacttaaaactggtt

SEQ ID NO: 448177 - DNA, 25 bp, Mus musculus
gacagctgatcagttaaaactggtt

SEQ ID NO: 448178 - DNA, 25 bp, Mus musculus
gacagctgatttaggtctggtcaga

SEQ ID NO: 448179 - DNA, 25 bp, Mus musculus
gacagctgattttggtctggtcaga

SEQ ID NO: 448180 - DNA, 25 bp, Mus musculus
gacagctgcacaattggcatgcttt

SEQ ID NO: 448181 - DNA, 25 bp, Mus musculus
gacagctgcacatttggcatgcttt

SEQ ID NO: 448182 - DNA, 25 bp, Mus musculus
gacagctgcaccatgtgggtcaggt

SEQ ID NO: 448183 - DNA, 25 bp, Mus musculus
gacagctgcaccttgtgggtcaggt

SEQ ID NO: 448184 - DNA, 25 bp, Mus musculus
gacagctgcagaactctcaagtatc

SEQ ID NO: 448185 - DNA, 25 bp, Mus musculus
gacagctgcagatctctcaagtatc

SEQ ID NO: 448186 - DNA, 25 bp, Mus musculus
gacagctgcatgattacaaacccaa

SEQ ID NO: 448187 - DNA, 25 bp, Mus musculus
gacagctgcatgtttacaaacccaa

SEQ ID NO: 448188 - DNA, 25 bp, Mus musculus
gacagctgcctacatctgaaacatg

SEQ ID NO: 448189 - DNA, 25 bp, Mus musculus
gacagctgcctagatctgaaacatg

SEQ ID NO: 448190 - DNA, 25 bp, Mus musculus
gacagctgccttagtgtttaacatt

SEQ ID NO: 448191 - DNA, 25 bp, Mus musculus
gacagctgcctttgtgtttaacatt

SEQ ID NO: 448192 - DNA, 25 bp, Mus musculus
gacagctgcgcgaccggagccaagc

SEQ ID NO: 448193 - DNA, 25 bp, Mus musculus
gacagctgcgcgtccggagccaagc

SEQ ID NO: 448194 - DNA, 25 bp, Mus musculus
gacagctgctacaccaagagacttt

SEQ ID NO: 448195 - DNA, 25 bp, Mus musculus
gacagctgctactccaagagacttt

SEQ ID NO: 448196 - DNA, 25 bp, Mus musculus
gacagctgctgtacactcaagccaa

SEQ ID NO: 448197 - DNA, 25 bp, Mus musculus
gacagctgctgttcactcaagccaa

SEQ ID NO: 448198 - DNA, 25 bp, Mus musculus
gacagctggaagatcttagcaattc

SEQ ID NO: 448199 - DNA, 25 bp, Mus musculus
gacagctggaagttcttagcaattc

SEQ ID NO: 448200 - DNA, 25 bp, Mus musculus
gacagctggagcaaggactcttttg

SEQ ID NO: 448201 - DNA, 25 bp, Mus musculus
gacagctggagcacgaggccctgac

SEQ ID NO: 448202 - DNA, 25 bp, Mus musculus
gacagctggagctaggactcttttg

SEQ ID NO: 448203 - DNA, 25 bp, Mus musculus
gacagctggagctcgaggccctgac

SEQ ID NO: 448204 - DNA, 25 bp, Mus musculus
gacagctggagtaggacactgttaa

SEQ ID NO: 448205 - DNA, 25 bp, Mus musculus
gacagctggagttggacactgttaa

SEQ ID NO: 448206 - DNA, 25 bp, Mus musculus
gacagctggcgtctgcacagtgaaa

SEQ ID NO: 448207 - DNA, 25 bp, Mus musculus
gacagctggcgtgtgcacagtgaaa

SEQ ID NO: 448208 - DNA, 25 bp, Mus musculus
gacagctgggtcattgtaggtgcta

SEQ ID NO: 448209 - DNA, 25 bp, Mus musculus
gacagctgggtctttgtaggtgcta

SEQ ID NO: 448210 - DNA, 25 bp, Mus musculus
gacagctgggtgctcctcctagagc

SEQ ID NO: 448211 - DNA, 25 bp, Mus musculus
gacagctgggtggtcctcctagagc

SEQ ID NO: 448212 - DNA, 25 bp, Mus musculus
gacagctgtaccatggccatcaaaa

SEQ ID NO: 448213 - DNA, 25 bp, Mus musculus
gacagctgtaccttggccatcaaaa

SEQ ID NO: 448214 - DNA, 25 bp, Mus musculus
gacagctgtaggaatcgtttgggaa

SEQ ID NO: 448215 - DNA, 25 bp, Mus musculus
gacagctgtaggtatcgtttgggaa

SEQ ID NO: 448216 - DNA, 25 bp, Mus musculus
gacagctgtcccattttgtgacagt

SEQ ID NO: 448217 - DNA, 25 bp, Mus musculus
gacagctgtccctttttgtgacagt

SEQ ID NO: 448218 - DNA, 25 bp, Mus musculus
gacagctgtcttaaagtttatcccg

SEQ ID NO: 448219 - DNA, 25 bp, Mus musculus
gacagctgtctttaagtttatcccg

SEQ ID NO: 448220 - DNA, 25 bp, Mus musculus
gacagctgtggccacacacatgaca

SEQ ID NO: 448221 - DNA, 25 bp, Mus musculus
gacagctgtggcgacacacatgaca

SEQ ID NO: 448222 - DNA, 25 bp, Mus musculus
gacagctgtgtcatctgctttgaag

SEQ ID NO: 448223 - DNA, 25 bp, Mus musculus
gacagctgtgtcttctgctttgaag

SEQ ID NO: 448224 - DNA, 25 bp, Mus musculus
gacagctgtgttattatccccaaat

SEQ ID NO: 448225 - DNA, 25 bp, Mus musculus
gacagctgtgtttttatccccaaat

SEQ ID NO: 448226 - DNA, 25 bp, Mus musculus
gacagctgttccatggacctgagta

SEQ ID NO: 448227 - DNA, 25 bp, Mus musculus
gacagctgttccttggacctgagta

SEQ ID NO: 448228 - DNA, 25 bp, Mus musculus
gacagctgttctctgacttgacagt

SEQ ID NO: 448229 - DNA, 25 bp, Mus musculus
gacagctgttctgtgacttgacagt

SEQ ID NO: 448230 - DNA, 25 bp, Mus musculus
gacagcttaaaactcccacgttgtg

SEQ ID NO: 448231 - DNA, 25 bp, Mus musculus
gacagcttaaaagtcccacgttgtg

SEQ ID NO: 448232 - DNA, 25 bp, Mus musculus
gacagcttaacaagcagatgttgat

SEQ ID NO: 448233 - DNA, 25 bp, Mus musculus
gacagcttaacatgcagatgttgat

SEQ ID NO: 448234 - DNA, 25 bp, Mus musculus
gacagcttaggtcattctggtatag

SEQ ID NO: 448235 - DNA, 25 bp, Mus musculus
gacagcttaggtgattctggtatag

SEQ ID NO: 448236 - DNA, 25 bp, Mus musculus
gacagcttagtaattgggtcaagta

SEQ ID NO: 448237 - DNA, 25 bp, Mus musculus
gacagcttagtatttgggtcaagta

SEQ ID NO: 448238 - DNA, 25 bp, Mus musculus
gacagcttatcaaccttaatgtata

SEQ ID NO: 448239 - DNA, 25 bp, Mus musculus
gacagcttatcatccttaatgtata

SEQ ID NO: 448240 - DNA, 25 bp, Mus musculus
gacagcttattcagccttggtaatg

SEQ ID NO: 448241 - DNA, 25 bp, Mus musculus
gacagcttattctgccttggtaatg

SEQ ID NO: 448242 - DNA, 25 bp, Mus musculus
gacagcttcaacacacagtgcctga

SEQ ID NO: 448243 - DNA, 25 bp, Mus musculus
gacagcttcaactcacagtgcctga

SEQ ID NO: 448244 - DNA, 25 bp, Mus musculus
gacagcttcaatctggtgtccacac

SEQ ID NO: 448245 - DNA, 25 bp, Mus musculus
gacagcttcaatgtggtgtccacac

SEQ ID NO: 448246 - DNA, 25 bp, Mus musculus
gacagcttcacccttccttgagctg

SEQ ID NO: 448247 - DNA, 25 bp, Mus musculus
gacagcttcaccgttccttgagctg

SEQ ID NO: 448248 - DNA, 25 bp, Mus musculus
gacagcttcctaagaacctggtagc

SEQ ID NO: 448249 - DNA, 25 bp, Mus musculus
gacagcttcctatgaacctggtagc

SEQ ID NO: 448250 - DNA, 25 bp, Mus musculus
gacagcttcctcaatgagctcatgg

SEQ ID NO: 448251 - DNA, 25 bp, Mus musculus
gacagcttcctctatgagctcatgg

SEQ ID NO: 448252 - DNA, 25 bp, Mus musculus
gacagcttcctgagttttcccaagg

SEQ ID NO: 448253 - DNA, 25 bp, Mus musculus
gacagcttcctgtgttttcccaagg

SEQ ID NO: 448254 - DNA, 25 bp, Mus musculus
gacagcttcggacgttggaatcaac

SEQ ID NO: 448255 - DNA, 25 bp, Mus musculus
gacagcttcggaggttggaatcaac

SEQ ID NO: 448256 - DNA, 25 bp, Mus musculus
gacagcttctatcaccgggttgaaa

SEQ ID NO: 448257 - DNA, 25 bp, Mus musculus
gacagcttctatgaccgggttgaaa

SEQ ID NO: 448258 - DNA, 25 bp, Mus musculus
gacagcttctcacagcatgcctaaa

SEQ ID NO: 448259 - DNA, 25 bp, Mus musculus
gacagcttctcacgctctgcttgca

SEQ ID NO: 448260 - DNA, 25 bp, Mus musculus
gacagcttctcagagcatgcctaaa

SEQ ID NO: 448261 - DNA, 25 bp, Mus musculus
gacagcttctcaggctctgcttgca

SEQ ID NO: 448262 - DNA, 25 bp, Mus musculus
gacagcttctccatggagcctgaga

SEQ ID NO: 448263 - DNA, 25 bp, Mus musculus
gacagcttctccttggagcctgaga

SEQ ID NO: 448264 - DNA, 25 bp, Mus musculus
gacagcttctctacagatggtggat

SEQ ID NO: 448265 - DNA, 25 bp, Mus musculus
gacagcttctcttcagatggtggat

SEQ ID NO: 448266 - DNA, 25 bp, Mus musculus
gacagcttcttaacttctggagagc

SEQ ID NO: 448267 - DNA, 25 bp, Mus musculus
gacagcttcttatcttctggagagc

SEQ ID NO: 448268 - DNA, 25 bp, Mus musculus
gacagcttgactccctctcagagaa

SEQ ID NO: 448269 - DNA, 25 bp, Mus musculus
gacagcttgactgcctctcagagaa

SEQ ID NO: 448270 - DNA, 25 bp, Mus musculus
gacagcttgcaacattctcttctct

SEQ ID NO: 448271 - DNA, 25 bp, Mus musculus
gacagcttgcaagattctcttctct

SEQ ID NO: 448272 - DNA, 25 bp, Mus musculus
gacagcttgcttccctttgacatac

SEQ ID NO: 448273 - DNA, 25 bp, Mus musculus
gacagcttgcttgcctttgacatac

SEQ ID NO: 448274 - DNA, 25 bp, Mus musculus
gacagcttggccaactgatttaaaa

SEQ ID NO: 448275 - DNA, 25 bp, Mus musculus
gacagcttggcctactgatttaaaa

SEQ ID NO: 448276 - DNA, 25 bp, Mus musculus
gacagcttggtcagtaaatgcctga

SEQ ID NO: 448277 - DNA, 25 bp, Mus musculus
gacagcttggtctgtaaatgcctga

SEQ ID NO: 448278 - DNA, 25 bp, Mus musculus
gacagcttgtagacattggttctcg

SEQ ID NO: 448279 - DNA, 25 bp, Mus musculus
gacagcttgtagtcattggttctcg

SEQ ID NO: 448280 - DNA, 25 bp, Mus musculus
gacagcttgtcacactattcccatt

SEQ ID NO: 448281 - DNA, 25 bp, Mus musculus
gacagcttgtcagactattcccatt

SEQ ID NO: 448282 - DNA, 25 bp, Mus musculus
gacagcttgtggaaggtctttcctt

SEQ ID NO: 448283 - DNA, 25 bp, Mus musculus
gacagcttgtggtaggtctttcctt

SEQ ID NO: 448284 - DNA, 25 bp, Mus musculus
gacagctttaaaacaccaggcacag

SEQ ID NO: 448285 - DNA, 25 bp, Mus musculus
gacagctttaaatcaccaggcacag

SEQ ID NO: 448286 - DNA, 25 bp, Mus musculus
gacagctttactcccaagcacaaaa

SEQ ID NO: 448287 - DNA, 25 bp, Mus musculus
gacagctttactgccaagcacaaaa

SEQ ID NO: 448288 - DNA, 25 bp, Mus musculus
gacagctttagcctcattgttgaat

SEQ ID NO: 448289 - DNA, 25 bp, Mus musculus
gacagctttagcgtcattgttgaat

SEQ ID NO: 448290 - DNA, 25 bp, Mus musculus
gacagctttatgagcatagtgctca

SEQ ID NO: 448291 - DNA, 25 bp, Mus musculus
gacagctttatgctcgccaaactca

SEQ ID NO: 448292 - DNA, 25 bp, Mus musculus
gacagctttatggtcgccaaactca

SEQ ID NO: 448293 - DNA, 25 bp, Mus musculus
gacagctttatgtgcatagtgctca

SEQ ID NO: 448294 - DNA, 25 bp, Mus musculus
gacagctttattcttaagtgctgca

SEQ ID NO: 448295 - DNA, 25 bp, Mus musculus
gacagctttattgttaagtgctgca

SEQ ID NO: 448296 - DNA, 25 bp, Mus musculus
gacagctttcacaagagcttgacag

SEQ ID NO: 448297 - DNA, 25 bp, Mus musculus
gacagctttcactagagcttgacag

SEQ ID NO: 448298 - DNA, 25 bp, Mus musculus
gacagctttgggacagcccgaggct

SEQ ID NO: 448299 - DNA, 25 bp, Mus musculus
gacagctttgggtcagcccgaggct

SEQ ID NO: 448300 - DNA, 25 bp, Mus musculus
gacagcttttctcaagagatccatt

SEQ ID NO: 448301 - DNA, 25 bp, Mus musculus
gacagcttttctgaagagatccatt

SEQ ID NO: 448302 - DNA, 25 bp, Mus musculus
gacagcttttggaatgacctctttc

SEQ ID NO: 448303 - DNA, 25 bp, Mus musculus
gacagcttttggtatgacctctttc

SEQ ID NO: 448304 - DNA, 25 bp, Mus musculus
gacagcttttgtatgctacacacct

SEQ ID NO: 448305 - DNA, 25 bp, Mus musculus
gacagcttttgtcatgtttcaaatt

SEQ ID NO: 448306 - DNA, 25 bp, Mus musculus
gacagcttttgtgatgtttcaaatt

SEQ ID NO: 448307 - DNA, 25 bp, Mus musculus
gacagcttttgtttgctacacacct

SEQ ID NO: 448308 - DNA, 25 bp, Mus musculus
gacaggaaacgaccttgtgttctga

SEQ ID NO: 448309 - DNA, 25 bp, Mus musculus
gacaggaaacgagcttgtgttctga

SEQ ID NO: 448310 - DNA, 25 bp, Mus musculus
gacaggaacaaaactccataggcaa

SEQ ID NO: 448311 - DNA, 25 bp, Mus musculus
gacaggaacaaatctccataggcaa

SEQ ID NO: 448312 - DNA, 25 bp, Mus musculus
gacaggaacacaaagcgggatataa

SEQ ID NO: 448313 - DNA, 25 bp, Mus musculus
gacaggaacacatagcgggatataa

SEQ ID NO: 448314 - DNA, 25 bp, Mus musculus
gacaggaacaccctggcgctgacca

SEQ ID NO: 448315 - DNA, 25 bp, Mus musculus
gacaggaacaccgtggcgctgacca

SEQ ID NO: 448316 - DNA, 25 bp, Mus musculus
gacaggaacatcatgggccttagac

SEQ ID NO: 448317 - DNA, 25 bp, Mus musculus
gacaggaacatcttgggccttagac

SEQ ID NO: 448318 - DNA, 25 bp, Mus musculus
gacaggaaccttaatgtgatacatg

SEQ ID NO: 448319 - DNA, 25 bp, Mus musculus
gacaggaacctttatgtgatacatg

SEQ ID NO: 448320 - DNA, 25 bp, Mus musculus
gacaggaactgaagctcgagtcccc

SEQ ID NO: 448321 - DNA, 25 bp, Mus musculus
gacaggaactgaatcaactctcaat

SEQ ID NO: 448322 - DNA, 25 bp, Mus musculus
gacaggaactgatgctcgagtcccc

SEQ ID NO: 448323 - DNA, 25 bp, Mus musculus
gacaggaactgattcaactctcaat

SEQ ID NO: 448324 - DNA, 25 bp, Mus musculus
gacaggaagacaaggcccttgtcaa

SEQ ID NO: 448325 - DNA, 25 bp, Mus musculus
gacaggaagacatggcccttgtcaa

SEQ ID NO: 448326 - DNA, 25 bp, Mus musculus
gacaggaagactctctccggccatc

SEQ ID NO: 448327 - DNA, 25 bp, Mus musculus
gacaggaagactgtctccggccatc

SEQ ID NO: 448328 - DNA, 25 bp, Mus musculus
gacaggaagcacatcggtttcattt

SEQ ID NO: 448329 - DNA, 25 bp, Mus musculus
gacaggaagcacttcggtttcattt

SEQ ID NO: 448330 - DNA, 25 bp, Mus musculus
gacaggaagcagaggtcttcagcca

SEQ ID NO: 448331 - DNA, 25 bp, Mus musculus
gacaggaagcagtggtcttcagcca

SEQ ID NO: 448332 - DNA, 25 bp, Mus musculus
gacaggaagcctcacccaactatgt

SEQ ID NO: 448333 - DNA, 25 bp, Mus musculus
gacaggaagcctgacccaactatgt

SEQ ID NO: 448334 - DNA, 25 bp, Mus musculus
gacaggaagcttacgtaagctcttt

SEQ ID NO: 448335 - DNA, 25 bp, Mus musculus
gacaggaagctttcgtaagctcttt

SEQ ID NO: 448336 - DNA, 25 bp, Mus musculus
gacaggaaggatattggattcccct

SEQ ID NO: 448337 - DNA, 25 bp, Mus musculus
gacaggaaggattttggattcccct

SEQ ID NO: 448338 - DNA, 25 bp, Mus musculus
gacaggaaggcaatgtcctagacac

SEQ ID NO: 448339 - DNA, 25 bp, Mus musculus
gacaggaaggcattgtcctagacac

SEQ ID NO: 448340 - DNA, 25 bp, Mus musculus
gacaggaagtccacagcatagttag

SEQ ID NO: 448341 - DNA, 25 bp, Mus musculus
gacaggaagtcctcagcatagttag

SEQ ID NO: 448342 - DNA, 25 bp, Mus musculus
gacaggacaagcagaaggtgcacat

SEQ ID NO: 448343 - DNA, 25 bp, Mus musculus
gacaggacaagctgaaggtgcacat

SEQ ID NO: 448344 - DNA, 25 bp, Mus musculus
gacaggacacctagcattcagcatg

SEQ ID NO: 448345 - DNA, 25 bp, Mus musculus
gacaggacaccttgcattcagcatg

SEQ ID NO: 448346 - DNA, 25 bp, Mus musculus
gacaggacactgctaacaacgttca

SEQ ID NO: 448347 - DNA, 25 bp, Mus musculus
gacaggacactggtaacaacgttca

SEQ ID NO: 448348 - DNA, 25 bp, Mus musculus
gacaggacagctcgtgaagcaagcc

SEQ ID NO: 448349 - DNA, 25 bp, Mus musculus
gacaggacagctggtgaagcaagcc

SEQ ID NO: 448350 - DNA, 25 bp, Mus musculus
gacaggacagtcaagcctccagagg

SEQ ID NO: 448351 - DNA, 25 bp, Mus musculus
gacaggacagtctagcctccagagg

SEQ ID NO: 448352 - DNA, 25 bp, Mus musculus
gacaggacatgtagcggtaagagaa

SEQ ID NO: 448353 - DNA, 25 bp, Mus musculus
gacaggacatgttgcggtaagagaa

SEQ ID NO: 448354 - DNA, 25 bp, Mus musculus
gacaggaccacacattgaccttgat

SEQ ID NO: 448355 - DNA, 25 bp, Mus musculus
gacaggaccacagattgaccttgat

SEQ ID NO: 448356 - DNA, 25 bp, Mus musculus
gacaggaccaggaggtgtcctgcac

SEQ ID NO: 448357 - DNA, 25 bp, Mus musculus
gacaggaccaggtggtgtcctgcac

SEQ ID NO: 448358 - DNA, 25 bp, Mus musculus
gacaggacccttcaaaaccagcttt

SEQ ID NO: 448359 - DNA, 25 bp, Mus musculus
gacaggacccttgaaaaccagcttt

SEQ ID NO: 448360 - DNA, 25 bp, Mus musculus
gacaggacgcacaaggctcatcaag

SEQ ID NO: 448361 - DNA, 25 bp, Mus musculus
gacaggacgcactaggctcatcaag

SEQ ID NO: 448362 - DNA, 25 bp, Mus musculus
gacaggactaagacgggagatggaa

SEQ ID NO: 448363 - DNA, 25 bp, Mus musculus
gacaggactaagtcgggagatggaa

SEQ ID NO: 448364 - DNA, 25 bp, Mus musculus
gacaggactacaatgccagcttcct

SEQ ID NO: 448365 - DNA, 25 bp, Mus musculus
gacaggactacattgccagcttcct

SEQ ID NO: 448366 - DNA, 25 bp, Mus musculus
gacaggactcagaccatcagcaatt

SEQ ID NO: 448367 - DNA, 25 bp, Mus musculus
gacaggactcagtccatcagcaatt

SEQ ID NO: 448368 - DNA, 25 bp, Mus musculus
gacaggactgtacaaggatatctaa

SEQ ID NO: 448369 - DNA, 25 bp, Mus musculus
gacaggactgtagaaggatatctaa

SEQ ID NO: 448370 - DNA, 25 bp, Mus musculus
gacaggactgttctttgcacattga

SEQ ID NO: 448371 - DNA, 25 bp, Mus musculus
gacaggactgttgtttgcacattga

SEQ ID NO: 448372 - DNA, 25 bp, Mus musculus
gacaggacttataaccaggaactat

SEQ ID NO: 448373 - DNA, 25 bp, Mus musculus
gacaggacttattaccaggaactat

SEQ ID NO: 448374 - DNA, 25 bp, Mus musculus
gacaggacttctccttcgaggtcac

SEQ ID NO: 448375 - DNA, 25 bp, Mus musculus
gacaggacttctgcttcgaggtcac

SEQ ID NO: 448376 - DNA, 25 bp, Mus musculus
gacaggagaatcatctattatgtac

SEQ ID NO: 448377 - DNA, 25 bp, Mus musculus
gacaggagaatcttctattatgtac

SEQ ID NO: 448378 - DNA, 25 bp, Mus musculus
gacaggagacccagctaagaaacat

SEQ ID NO: 448379 - DNA, 25 bp, Mus musculus
gacaggagaccctgctaagaaacat

SEQ ID NO: 448380 - DNA, 25 bp, Mus musculus
gacaggagacgcactcaatttggag

SEQ ID NO: 448381 - DNA, 25 bp, Mus musculus
gacaggagacgctctcaatttggag

SEQ ID NO: 448382 - DNA, 25 bp, Mus musculus
gacaggagacggacaccaggaagct

SEQ ID NO: 448383 - DNA, 25 bp, Mus musculus
gacaggagacggtcaccaggaagct

SEQ ID NO: 448384 - DNA, 25 bp, Mus musculus
gacaggagactacgacccacaagtt

SEQ ID NO: 448385 - DNA, 25 bp, Mus musculus
gacaggagactaggacccacaagtt

SEQ ID NO: 448386 - DNA, 25 bp, Mus musculus
gacaggagagctccgcaagtgtata

SEQ ID NO: 448387 - DNA, 25 bp, Mus musculus
gacaggagagctgcgcaagtgtata

SEQ ID NO: 448388 - DNA, 25 bp, Mus musculus
gacaggagcatcatgcatgtggtta

SEQ ID NO: 448389 - DNA, 25 bp, Mus musculus
gacaggagcatcttgcatgtggtta

SEQ ID NO: 448390 - DNA, 25 bp, Mus musculus
gacaggagcctcaagtgtgcaaatc

SEQ ID NO: 448391 - DNA, 25 bp, Mus musculus
gacaggagcctctagtgtgcaaatc

SEQ ID NO: 448392 - DNA, 25 bp, Mus musculus
gacaggagctacatagtccttcctt

SEQ ID NO: 448393 - DNA, 25 bp, Mus musculus
gacaggagctacttagtccttcctt

SEQ ID NO: 448394 - DNA, 25 bp, Mus musculus
gacaggagctctctgctcagcagaa

SEQ ID NO: 448395 - DNA, 25 bp, Mus musculus
gacaggagctctgtgctcagcagaa

SEQ ID NO: 448396 - DNA, 25 bp, Mus musculus
gacaggagctttctgttctaatcac

SEQ ID NO: 448397 - DNA, 25 bp, Mus musculus
gacaggagctttgtgttctaatcac

SEQ ID NO: 448398 - DNA, 25 bp, Mus musculus
gacaggaggaatatttgctataaac

SEQ ID NO: 448399 - DNA, 25 bp, Mus musculus
gacaggaggaatttttgctataaac

SEQ ID NO: 448400 - DNA, 25 bp, Mus musculus
gacaggaggactcttttaccctcca

SEQ ID NO: 448401 - DNA, 25 bp, Mus musculus
gacaggaggactgttttaccctcca

SEQ ID NO: 448402 - DNA, 25 bp, Mus musculus
gacaggaggcagattgagcttcact

SEQ ID NO: 448403 - DNA, 25 bp, Mus musculus
gacaggaggcagtttgagcttcact

SEQ ID NO: 448404 - DNA, 25 bp, Mus musculus
gacaggagggttaccacagctgcct

SEQ ID NO: 448405 - DNA, 25 bp, Mus musculus
gacaggagggtttccacagctgcct

SEQ ID NO: 448406 - DNA, 25 bp, Mus musculus
gacaggaggtgcattcatacacaca

SEQ ID NO: 448407 - DNA, 25 bp, Mus musculus
gacaggaggtgctttcatacacaca

SEQ ID NO: 448408 - DNA, 25 bp, Mus musculus
gacaggagtaaacagatcatttcag

SEQ ID NO: 448409 - DNA, 25 bp, Mus musculus
gacaggagtaaagagatcatttcag

SEQ ID NO: 448410 - DNA, 25 bp, Mus musculus
gacaggagtcctcttgactcaatct

SEQ ID NO: 448411 - DNA, 25 bp, Mus musculus
gacaggagtcctgttgactcaatct

SEQ ID NO: 448412 - DNA, 25 bp, Mus musculus
gacaggagtcttaccaaatggcctt

SEQ ID NO: 448413 - DNA, 25 bp, Mus musculus
gacaggagtctttccaaatggcctt

SEQ ID NO: 448414 - DNA, 25 bp, Mus musculus
gacaggagtgcgatgtacagttcaa

SEQ ID NO: 448415 - DNA, 25 bp, Mus musculus
gacaggagtgcgttgtacagttcaa

SEQ ID NO: 448416 - DNA, 25 bp, Mus musculus
gacaggagtgctaattgacataaga

SEQ ID NO: 448417 - DNA, 25 bp, Mus musculus
gacaggagtgctcagccgttcaaac

SEQ ID NO: 448418 - DNA, 25 bp, Mus musculus
gacaggagtgctgagccgttcaaac

SEQ ID NO: 448419 - DNA, 25 bp, Mus musculus
gacaggagtgcttattgacataaga

SEQ ID NO: 448420 - DNA, 25 bp, Mus musculus
gacaggatactcattcatgacagga

SEQ ID NO: 448421 - DNA, 25 bp, Mus musculus
gacaggatactctttcatgacagga

SEQ ID NO: 448422 - DNA, 25 bp, Mus musculus
gacaggatatccaattggcccaggt

SEQ ID NO: 448423 - DNA, 25 bp, Mus musculus
gacaggatatcctattggcccaggt

SEQ ID NO: 448424 - DNA, 25 bp, Mus musculus
gacaggatcactcagactctttgtg

SEQ ID NO: 448425 - DNA, 25 bp, Mus musculus
gacaggatcactgagactctttgtg

SEQ ID NO: 448426 - DNA, 25 bp, Mus musculus
gacaggatcatacgtagtccaggtt

SEQ ID NO: 448427 - DNA, 25 bp, Mus musculus
gacaggatcataggtagtccaggtt

SEQ ID NO: 448428 - DNA, 25 bp, Mus musculus
gacaggatccagagcttgctagatt

SEQ ID NO: 448429 - DNA, 25 bp, Mus musculus
gacaggatccagtgcttgctagatt

SEQ ID NO: 448430 - DNA, 25 bp, Mus musculus
gacaggatcctgagttcagccgcca

SEQ ID NO: 448431 - DNA, 25 bp, Mus musculus
gacaggatcctgtgttcagccgcca

SEQ ID NO: 448432 - DNA, 25 bp, Mus musculus
gacaggatccttagatcacaaggca

SEQ ID NO: 448433 - DNA, 25 bp, Mus musculus
gacaggatccttcgcactgtttaag

SEQ ID NO: 448434 - DNA, 25 bp, Mus musculus
gacaggatccttggcactgtttaag

SEQ ID NO: 448435 - DNA, 25 bp, Mus musculus
gacaggatcctttgatcacaaggca

SEQ ID NO: 448436 - DNA, 25 bp, Mus musculus
gacaggatctgaattacctacgaga

SEQ ID NO: 448437 - DNA, 25 bp, Mus musculus
gacaggatctgacatagcttggcat

SEQ ID NO: 448438 - DNA, 25 bp, Mus musculus
gacaggatctgactttgactttgag

SEQ ID NO: 448439 - DNA, 25 bp, Mus musculus
gacaggatctgagatagcttggcat

SEQ ID NO: 448440 - DNA, 25 bp, Mus musculus
gacaggatctgagtttgactttgag

SEQ ID NO: 448441 - DNA, 25 bp, Mus musculus
gacaggatctgatttacctacgaga

SEQ ID NO: 448442 - DNA, 25 bp, Mus musculus
gacaggatctgtcggctgtcatctc

SEQ ID NO: 448443 - DNA, 25 bp, Mus musculus
gacaggatctgtgggctgtcatctc

SEQ ID NO: 448444 - DNA, 25 bp, Mus musculus
gacaggatcttgaagtagctaggag

SEQ ID NO: 448445 - DNA, 25 bp, Mus musculus
gacaggatcttgatattgtagctca

SEQ ID NO: 448446 - DNA, 25 bp, Mus musculus
gacaggatcttgctacccagcccaa

SEQ ID NO: 448447 - DNA, 25 bp, Mus musculus
gacaggatcttggtacccagcccaa

SEQ ID NO: 448448 - DNA, 25 bp, Mus musculus
gacaggatcttgtagtagctaggag

SEQ ID NO: 448449 - DNA, 25 bp, Mus musculus
gacaggatcttgttattgtagctca

SEQ ID NO: 448450 - DNA, 25 bp, Mus musculus
gacaggatgcttacacggatctcat

SEQ ID NO: 448451 - DNA, 25 bp, Mus musculus
gacaggatgctttcacggatctcat

SEQ ID NO: 448452 - DNA, 25 bp, Mus musculus
gacaggatggccacctaagtgtgaa

SEQ ID NO: 448453 - DNA, 25 bp, Mus musculus
gacaggatggcctcctaagtgtgaa

SEQ ID NO: 448454 - DNA, 25 bp, Mus musculus
gacaggatgggtacttgctttcctc

SEQ ID NO: 448455 - DNA, 25 bp, Mus musculus
gacaggatgggttcttgctttcctc

SEQ ID NO: 448456 - DNA, 25 bp, Mus musculus
gacaggatggtgctcatgtctccag

SEQ ID NO: 448457 - DNA, 25 bp, Mus musculus
gacaggatggtggtcatgtctccag

SEQ ID NO: 448458 - DNA, 25 bp, Mus musculus
gacaggatgtctctgtgttttctct

SEQ ID NO: 448459 - DNA, 25 bp, Mus musculus
gacaggatgtctgtgtgttttctct

SEQ ID NO: 448460 - DNA, 25 bp, Mus musculus
gacaggatgtttaatttcttctttt

SEQ ID NO: 448461 - DNA, 25 bp, Mus musculus
gacaggatgttttatttcttctttt

SEQ ID NO: 448462 - DNA, 25 bp, Mus musculus
gacaggattcttactcttggctagt

SEQ ID NO: 448463 - DNA, 25 bp, Mus musculus
gacaggattctttctcttggctagt

SEQ ID NO: 448464 - DNA, 25 bp, Mus musculus
gacaggatttcaattccgggaggca

SEQ ID NO: 448465 - DNA, 25 bp, Mus musculus
gacaggatttcatttccgggaggca

SEQ ID NO: 448466 - DNA, 25 bp, Mus musculus
gacaggatttctacagtttgcaatt

SEQ ID NO: 448467 - DNA, 25 bp, Mus musculus
gacaggatttcttcagtttgcaatt

SEQ ID NO: 448468 - DNA, 25 bp, Mus musculus
gacaggattttaactcaagtactag

SEQ ID NO: 448469 - DNA, 25 bp, Mus musculus
gacaggattttatctcaagtactag

SEQ ID NO: 448470 - DNA, 25 bp, Mus musculus
gacaggcaaacacgaatcttctgta

SEQ ID NO: 448471 - DNA, 25 bp, Mus musculus
gacaggcaaacaggaatcttctgta

SEQ ID NO: 448472 - DNA, 25 bp, Mus musculus
gacaggcaaatcatacttccaggac

SEQ ID NO: 448473 - DNA, 25 bp, Mus musculus
gacaggcaaatcttacttccaggac

SEQ ID NO: 448474 - DNA, 25 bp, Mus musculus
gacaggcaactaacatcattcaaca

SEQ ID NO: 448475 - DNA, 25 bp, Mus musculus
gacaggcaactatcatcattcaaca

SEQ ID NO: 448476 - DNA, 25 bp, Mus musculus
gacaggcaatcgatgatccctctta

SEQ ID NO: 448477 - DNA, 25 bp, Mus musculus
gacaggcaatcgttgatccctctta

SEQ ID NO: 448478 - DNA, 25 bp, Mus musculus
gacaggcacatgactcattagggaa

SEQ ID NO: 448479 - DNA, 25 bp, Mus musculus
gacaggcacatgtctcattagggaa

SEQ ID NO: 448480 - DNA, 25 bp, Mus musculus
gacaggcaccatctttagggcagca

SEQ ID NO: 448481 - DNA, 25 bp, Mus musculus
gacaggcaccatgtttagggcagca

SEQ ID NO: 448482 - DNA, 25 bp, Mus musculus
gacaggcacgccactgtgtgaaaca

SEQ ID NO: 448483 - DNA, 25 bp, Mus musculus
gacaggcacgcctctgtgtgaaaca

SEQ ID NO: 448484 - DNA, 25 bp, Mus musculus
gacaggcactgtaacatggaaaact

SEQ ID NO: 448485 - DNA, 25 bp, Mus musculus
gacaggcactgttacatggaaaact

SEQ ID NO: 448486 - DNA, 25 bp, Mus musculus
gacaggcagactattcgccacagcg

SEQ ID NO: 448487 - DNA, 25 bp, Mus musculus
gacaggcagacttttcgccacagcg

SEQ ID NO: 448488 - DNA, 25 bp, Mus musculus
gacaggcagagcatcccgggaagcc

SEQ ID NO: 448489 - DNA, 25 bp, Mus musculus
gacaggcagagcttcccgggaagcc

SEQ ID NO: 448490 - DNA, 25 bp, Mus musculus
gacaggcagcagcactgattactct

SEQ ID NO: 448491 - DNA, 25 bp, Mus musculus
gacaggcagcaggactgattactct

SEQ ID NO: 448492 - DNA, 25 bp, Mus musculus
gacaggcagccaagtttccaggtgt

SEQ ID NO: 448493 - DNA, 25 bp, Mus musculus
gacaggcagccatgtttccaggtgt

SEQ ID NO: 448494 - DNA, 25 bp, Mus musculus
gacaggcagcgacactcttctaagg

SEQ ID NO: 448495 - DNA, 25 bp, Mus musculus
gacaggcagcgagactcttctaagg

SEQ ID NO: 448496 - DNA, 25 bp, Mus musculus
gacaggcagctaacactaagtggca

SEQ ID NO: 448497 - DNA, 25 bp, Mus musculus
gacaggcagctatcactaagtggca

SEQ ID NO: 448498 - DNA, 25 bp, Mus musculus
gacaggcagctcataactaactacc

SEQ ID NO: 448499 - DNA, 25 bp, Mus musculus
gacaggcagctcttaactaactacc

SEQ ID NO: 448500 - DNA, 25 bp, Mus musculus
gacaggcaggatatctgaagggcat

SEQ ID NO: 448501 - DNA, 25 bp, Mus musculus
gacaggcaggatttctgaagggcat

SEQ ID NO: 448502 - DNA, 25 bp, Mus musculus
gacaggcaggcaagtgtgttgacaa

SEQ ID NO: 448503 - DNA, 25 bp, Mus musculus
gacaggcaggcatgtgtgttgacaa

SEQ ID NO: 448504 - DNA, 25 bp, Mus musculus
gacaggcagtccagagaccaagaga

SEQ ID NO: 448505 - DNA, 25 bp, Mus musculus
gacaggcagtcctgagaccaagaga

SEQ ID NO: 448506 - DNA, 25 bp, Mus musculus
gacaggcagtgaagactcatctcag

SEQ ID NO: 448507 - DNA, 25 bp, Mus musculus
gacaggcagtgatgactcatctcag

SEQ ID NO: 448508 - DNA, 25 bp, Mus musculus
gacaggcagtgccttactgacagaa

SEQ ID NO: 448509 - DNA, 25 bp, Mus musculus
gacaggcagtgcgttactgacagaa

SEQ ID NO: 448510 - DNA, 25 bp, Mus musculus
gacaggcatcataaatactccccac

SEQ ID NO: 448511 - DNA, 25 bp, Mus musculus
gacaggcatcataacacaaggagct

SEQ ID NO: 448512 - DNA, 25 bp, Mus musculus
gacaggcatcattaatactccccac

SEQ ID NO: 448513 - DNA, 25 bp, Mus musculus
gacaggcatcattacacaaggagct

SEQ ID NO: 448514 - DNA, 25 bp, Mus musculus
gacaggcatgaacctgtcctccagg

SEQ ID NO: 448515 - DNA, 25 bp, Mus musculus
gacaggcatgaagctgtcctccagg

SEQ ID NO: 448516 - DNA, 25 bp, Mus musculus
gacaggcatggcatgcacctcaata

SEQ ID NO: 448517 - DNA, 25 bp, Mus musculus
gacaggcatggcttgcacctcaata

SEQ ID NO: 448518 - DNA, 25 bp, Mus musculus
gacaggccactcattgtgagcagga

SEQ ID NO: 448519 - DNA, 25 bp, Mus musculus
gacaggccactctttgtgagcagga

SEQ ID NO: 448520 - DNA, 25 bp, Mus musculus
gacaggccagtactttgtcagtata

SEQ ID NO: 448521 - DNA, 25 bp, Mus musculus
gacaggccagtagtttgtcagtata

SEQ ID NO: 448522 - DNA, 25 bp, Mus musculus
gacaggccatatcttctgagacatc

SEQ ID NO: 448523 - DNA, 25 bp, Mus musculus
gacaggccatatgttctgagacatc

SEQ ID NO: 448524 - DNA, 25 bp, Mus musculus
gacaggccgaagaacagacccaaga

SEQ ID NO: 448525 - DNA, 25 bp, Mus musculus
gacaggccgaagtacagacccaaga

SEQ ID NO: 448526 - DNA, 25 bp, Mus musculus
gacaggccgagccaggtaagaccct

SEQ ID NO: 448527 - DNA, 25 bp, Mus musculus
gacaggccgagcgaggtaagaccct

SEQ ID NO: 448528 - DNA, 25 bp, Mus musculus
gacaggccgtgactgtcttgcacta

SEQ ID NO: 448529 - DNA, 25 bp, Mus musculus
gacaggccgtgagtgtcttgcacta

SEQ ID NO: 448530 - DNA, 25 bp, Mus musculus
gacaggcctcaacgagctttggata

SEQ ID NO: 448531 - DNA, 25 bp, Mus musculus
gacaggcctcaaggagctttggata

SEQ ID NO: 448532 - DNA, 25 bp, Mus musculus
gacaggcctcataactgagtgcttc

SEQ ID NO: 448533 - DNA, 25 bp, Mus musculus
gacaggcctcattactgagtgcttc

SEQ ID NO: 448534 - DNA, 25 bp, Mus musculus
gacaggcctggaaatcaaaattctc

SEQ ID NO: 448535 - DNA, 25 bp, Mus musculus
gacaggcctggatatcaaaattctc

SEQ ID NO: 448536 - DNA, 25 bp, Mus musculus
gacaggccttgtcttatttctttat

SEQ ID NO: 448537 - DNA, 25 bp, Mus musculus
gacaggccttgtgttatttctttat

SEQ ID NO: 448538 - DNA, 25 bp, Mus musculus
gacaggcgattacgcgggacaccct

SEQ ID NO: 448539 - DNA, 25 bp, Mus musculus
gacaggcgattaggcgggacaccct

SEQ ID NO: 448540 - DNA, 25 bp, Mus musculus
gacaggcgcagtactgattgcagta

SEQ ID NO: 448541 - DNA, 25 bp, Mus musculus
gacaggcgcagttctgattgcagta

SEQ ID NO: 448542 - DNA, 25 bp, Mus musculus
gacaggcggcaccttcaatgtgaca

SEQ ID NO: 448543 - DNA, 25 bp, Mus musculus
gacaggcggcacgttcaatgtgaca

SEQ ID NO: 448544 - DNA, 25 bp, Mus musculus
gacaggcgggctagagctttgcggc

SEQ ID NO: 448545 - DNA, 25 bp, Mus musculus
gacaggcgggcttgagctttgcggc

SEQ ID NO: 448546 - DNA, 25 bp, Mus musculus
gacaggcgtacacactgtcgtgtat

SEQ ID NO: 448547 - DNA, 25 bp, Mus musculus
gacaggcgtacagactgtcgtgtat

SEQ ID NO: 448548 - DNA, 25 bp, Mus musculus
gacaggcgtcaccaaactgaacgac

SEQ ID NO: 448549 - DNA, 25 bp, Mus musculus
gacaggcgtcacgaaactgaacgac

SEQ ID NO: 448550 - DNA, 25 bp, Mus musculus
gacaggcgtccaagaagatacacat

SEQ ID NO: 448551 - DNA, 25 bp, Mus musculus
gacaggcgtccatgaagatacacat

SEQ ID NO: 448552 - DNA, 25 bp, Mus musculus
gacaggcgtcttcgcatttaactaa

SEQ ID NO: 448553 - DNA, 25 bp, Mus musculus
gacaggcgtcttggcatttaactaa

SEQ ID NO: 448554 - DNA, 25 bp, Mus musculus
gacaggcgtgttatccgggatagaa

SEQ ID NO: 448555 - DNA, 25 bp, Mus musculus
gacaggcgtgttttccgggatagaa

SEQ ID NO: 448556 - DNA, 25 bp, Mus musculus
gacaggcgttctaccctcagctgat

SEQ ID NO: 448557 - DNA, 25 bp, Mus musculus
gacaggcgttcttccctcagctgat

SEQ ID NO: 448558 - DNA, 25 bp, Mus musculus
gacaggctaaccctgatgtccagaa

SEQ ID NO: 448559 - DNA, 25 bp, Mus musculus
gacaggctaaccgtgatgtccagaa

SEQ ID NO: 448560 - DNA, 25 bp, Mus musculus
gacaggctaattcctatcataacag

SEQ ID NO: 448561 - DNA, 25 bp, Mus musculus
gacaggctaattgctatcataacag

SEQ ID NO: 448562 - DNA, 25 bp, Mus musculus
gacaggctagacattcgctatagta

SEQ ID NO: 448563 - DNA, 25 bp, Mus musculus
gacaggctagactttcgctatagta

SEQ ID NO: 448564 - DNA, 25 bp, Mus musculus
gacaggctagctcttgaagcacaga

SEQ ID NO: 448565 - DNA, 25 bp, Mus musculus
gacaggctagctgttgaagcacaga

SEQ ID NO: 448566 - DNA, 25 bp, Mus musculus
gacaggctatcgagaatggcagctg

SEQ ID NO: 448567 - DNA, 25 bp, Mus musculus
gacaggctatcgtgaatggcagctg

SEQ ID NO: 448568 - DNA, 25 bp, Mus musculus
gacaggctatgcattggactccaga

SEQ ID NO: 448569 - DNA, 25 bp, Mus musculus
gacaggctatgctttggactccaga

SEQ ID NO: 448570 - DNA, 25 bp, Mus musculus
gacaggctcacaagggcatttgcta

SEQ ID NO: 448571 - DNA, 25 bp, Mus musculus
gacaggctcacacgttgccagaggt

SEQ ID NO: 448572 - DNA, 25 bp, Mus musculus
gacaggctcacaggttgccagaggt

SEQ ID NO: 448573 - DNA, 25 bp, Mus musculus
gacaggctcacatgggcatttgcta

SEQ ID NO: 448574 - DNA, 25 bp, Mus musculus
gacaggctcacgagtgccaaggagt

SEQ ID NO: 448575 - DNA, 25 bp, Mus musculus
gacaggctcacgtgtgccaaggagt

SEQ ID NO: 448576 - DNA, 25 bp, Mus musculus
gacaggctcagtctactcatatcta

SEQ ID NO: 448577 - DNA, 25 bp, Mus musculus
gacaggctcagtgtactcatatcta

SEQ ID NO: 448578 - DNA, 25 bp, Mus musculus
gacaggctcattattgactggcttg

SEQ ID NO: 448579 - DNA, 25 bp, Mus musculus
gacaggctcatttttgactggcttg

SEQ ID NO: 448580 - DNA, 25 bp, Mus musculus
gacaggctctgcatagaatctgcac

SEQ ID NO: 448581 - DNA, 25 bp, Mus musculus
gacaggctctgcttagaatctgcac

SEQ ID NO: 448582 - DNA, 25 bp, Mus musculus
gacaggctcttaaggacatgtgtac

SEQ ID NO: 448583 - DNA, 25 bp, Mus musculus
gacaggctcttatggacatgtgtac

SEQ ID NO: 448584 - DNA, 25 bp, Mus musculus
gacaggctggaacacgacctaccgc

SEQ ID NO: 448585 - DNA, 25 bp, Mus musculus
gacaggctggaagacgacctaccgc

SEQ ID NO: 448586 - DNA, 25 bp, Mus musculus
gacaggctggccacacttactattt

SEQ ID NO: 448587 - DNA, 25 bp, Mus musculus
gacaggctggcctcacttactattt

SEQ ID NO: 448588 - DNA, 25 bp, Mus musculus
gacaggctgtcactgctggcaaacg

SEQ ID NO: 448589 - DNA, 25 bp, Mus musculus
gacaggctgtcagtgctggcaaacg

SEQ ID NO: 448590 - DNA, 25 bp, Mus musculus
gacaggctgtgtacacaacgtggat

SEQ ID NO: 448591 - DNA, 25 bp, Mus musculus
gacaggctgtgttcacaacgtggat

SEQ ID NO: 448592 - DNA, 25 bp, Mus musculus
gacaggctgttaagtcagggttttt

SEQ ID NO: 448593 - DNA, 25 bp, Mus musculus
gacaggctgttatgtcagggttttt

SEQ ID NO: 448594 - DNA, 25 bp, Mus musculus
gacaggcttataatctcttcaccaa

SEQ ID NO: 448595 - DNA, 25 bp, Mus musculus
gacaggcttatattctcttcaccaa

SEQ ID NO: 448596 - DNA, 25 bp, Mus musculus
gacaggcttcctatagtcctaaatg

SEQ ID NO: 448597 - DNA, 25 bp, Mus musculus
gacaggcttcctttagtcctaaatg

SEQ ID NO: 448598 - DNA, 25 bp, Mus musculus
gacaggcttctccaggtaaccctgg

SEQ ID NO: 448599 - DNA, 25 bp, Mus musculus
gacaggcttctcgaggtaaccctgg

SEQ ID NO: 448600 - DNA, 25 bp, Mus musculus
gacaggcttctgcatgaatcagcac

SEQ ID NO: 448601 - DNA, 25 bp, Mus musculus
gacaggcttctggatgaatcagcac

SEQ ID NO: 448602 - DNA, 25 bp, Mus musculus
gacaggcttcttctgcagttattat

SEQ ID NO: 448603 - DNA, 25 bp, Mus musculus
gacaggcttcttgtgcagttattat

SEQ ID NO: 448604 - DNA, 25 bp, Mus musculus
gacaggcttgcacctatgttcagag

SEQ ID NO: 448605 - DNA, 25 bp, Mus musculus
gacaggcttgcagctatgttcagag

SEQ ID NO: 448606 - DNA, 25 bp, Mus musculus
gacaggctttgaccgccgtatcaat

SEQ ID NO: 448607 - DNA, 25 bp, Mus musculus
gacaggctttgagcgccgtatcaat

SEQ ID NO: 448608 - DNA, 25 bp, Mus musculus
gacaggctttgccaagtaaacccag

SEQ ID NO: 448609 - DNA, 25 bp, Mus musculus
gacaggctttgcctcctaagaagtc

SEQ ID NO: 448610 - DNA, 25 bp, Mus musculus
gacaggctttgcgaagtaaacccag

SEQ ID NO: 448611 - DNA, 25 bp, Mus musculus
gacaggctttgcgtcctaagaagtc

SEQ ID NO: 448612 - DNA, 25 bp, Mus musculus
gacaggcttttactgtttcttcaaa

SEQ ID NO: 448613 - DNA, 25 bp, Mus musculus
gacaggcttttagtgtttcttcaaa

SEQ ID NO: 448614 - DNA, 25 bp, Mus musculus
gacagggaacatccccatgtgaagt

SEQ ID NO: 448615 - DNA, 25 bp, Mus musculus
gacagggaacatgcccatgtgaagt

SEQ ID NO: 448616 - DNA, 25 bp, Mus musculus
gacagggaaccgacagaccaagtgt

SEQ ID NO: 448617 - DNA, 25 bp, Mus musculus
gacagggaaccgtcagaccaagtgt

SEQ ID NO: 448618 - DNA, 25 bp, Mus musculus
gacagggaagccagattgccgaatg

SEQ ID NO: 448619 - DNA, 25 bp, Mus musculus
gacagggaagcctgattgccgaatg

SEQ ID NO: 448620 - DNA, 25 bp, Mus musculus
gacagggaagctacaggttacaaca

SEQ ID NO: 448621 - DNA, 25 bp, Mus musculus
gacagggaagcttcaggttacaaca

SEQ ID NO: 448622 - DNA, 25 bp, Mus musculus
gacagggacgccatattctgcagat

SEQ ID NO: 448623 - DNA, 25 bp, Mus musculus
gacagggacgccttattctgcagat

SEQ ID NO: 448624 - DNA, 25 bp, Mus musculus
gacagggactatatgcctttctcac

SEQ ID NO: 448625 - DNA, 25 bp, Mus musculus
gacagggactatttgcctttctcac

SEQ ID NO: 448626 - DNA, 25 bp, Mus musculus
gacagggaggacctccttttactct

SEQ ID NO: 448627 - DNA, 25 bp, Mus musculus
gacagggaggacgtccttttactct

SEQ ID NO: 448628 - DNA, 25 bp, Mus musculus
gacagggaggatacttggtattctc

SEQ ID NO: 448629 - DNA, 25 bp, Mus musculus
gacagggaggattcttggtattctc

SEQ ID NO: 448630 - DNA, 25 bp, Mus musculus
gacagggagtgaccagttttgcttt

SEQ ID NO: 448631 - DNA, 25 bp, Mus musculus
gacagggagtgagcagttttgcttt

SEQ ID NO: 448632 - DNA, 25 bp, Mus musculus
gacagggatacaaaccatcaaccta

SEQ ID NO: 448633 - DNA, 25 bp, Mus musculus
gacagggatacataccatcaaccta

SEQ ID NO: 448634 - DNA, 25 bp, Mus musculus
gacagggatcccctcaagcttcagg

SEQ ID NO: 448635 - DNA, 25 bp, Mus musculus
gacagggatcccgtcaagcttcagg

SEQ ID NO: 448636 - DNA, 25 bp, Mus musculus
gacagggatctgagttctaggttat

SEQ ID NO: 448637 - DNA, 25 bp, Mus musculus
gacagggatctgtgttctaggttat

SEQ ID NO: 448638 - DNA, 25 bp, Mus musculus
gacagggatgaaccatagggaccta

SEQ ID NO: 448639 - DNA, 25 bp, Mus musculus
gacagggatgaagcatagggaccta

SEQ ID NO: 448640 - DNA, 25 bp, Mus musculus
gacagggatgccacttcggaactaa

SEQ ID NO: 448641 - DNA, 25 bp, Mus musculus
gacagggatgcctcttcggaactaa

SEQ ID NO: 448642 - DNA, 25 bp, Mus musculus
gacagggcaaacaaggttttcccat

SEQ ID NO: 448643 - DNA, 25 bp, Mus musculus
gacagggcaaactaggttttcccat

SEQ ID NO: 448644 - DNA, 25 bp, Mus musculus
gacagggcaaatatggcactctcaa

SEQ ID NO: 448645 - DNA, 25 bp, Mus musculus
gacagggcaaatttggcactctcaa

SEQ ID NO: 448646 - DNA, 25 bp, Mus musculus
gacagggcaccaacttacatttaca

SEQ ID NO: 448647 - DNA, 25 bp, Mus musculus
gacagggcaccatcttacatttaca

SEQ ID NO: 448648 - DNA, 25 bp, Mus musculus
gacagggcagccctttagctttgac

SEQ ID NO: 448649 - DNA, 25 bp, Mus musculus
gacagggcagccgtttagctttgac

SEQ ID NO: 448650 - DNA, 25 bp, Mus musculus
gacagggcagctatgaaacactcga

SEQ ID NO: 448651 - DNA, 25 bp, Mus musculus
gacagggcagctttgaaacactcga

SEQ ID NO: 448652 - DNA, 25 bp, Mus musculus
gacagggcatatacttggtaccagc

SEQ ID NO: 448653 - DNA, 25 bp, Mus musculus
gacagggcatattcttggtaccagc

SEQ ID NO: 448654 - DNA, 25 bp, Mus musculus
gacagggcatcccagctggcgacaa

SEQ ID NO: 448655 - DNA, 25 bp, Mus musculus
gacagggcatccgagctggcgacaa

SEQ ID NO: 448656 - DNA, 25 bp, Mus musculus
gacagggcattgcaacccttgtata

SEQ ID NO: 448657 - DNA, 25 bp, Mus musculus
gacagggcattggaacccttgtata

SEQ ID NO: 448658 - DNA, 25 bp, Mus musculus
gacagggccaacatgcagcacagat

SEQ ID NO: 448659 - DNA, 25 bp, Mus musculus
gacagggccaacttgcagcacagat

SEQ ID NO: 448660 - DNA, 25 bp, Mus musculus
gacagggccagtcaatctcagctga

SEQ ID NO: 448661 - DNA, 25 bp, Mus musculus
gacagggccagtgaatctcagctga

SEQ ID NO: 448662 - DNA, 25 bp, Mus musculus
gacagggccataaatgaacttgcta

SEQ ID NO: 448663 - DNA, 25 bp, Mus musculus
gacagggccatatatgaacttgcta

SEQ ID NO: 448664 - DNA, 25 bp, Mus musculus
gacagggcccagagttggccttgac

SEQ ID NO: 448665 - DNA, 25 bp, Mus musculus
gacagggcccagtgttggccttgac

SEQ ID NO: 448666 - DNA, 25 bp, Mus musculus
gacagggcccgtactcctcgttgat

SEQ ID NO: 448667 - DNA, 25 bp, Mus musculus
gacagggcccgttctcctcgttgat

SEQ ID NO: 448668 - DNA, 25 bp, Mus musculus
gacagggccctgatgcacctaagtg

SEQ ID NO: 448669 - DNA, 25 bp, Mus musculus
gacagggccctgttgcacctaagtg

SEQ ID NO: 448670 - DNA, 25 bp, Mus musculus
gacagggcctggcagatcttcagtc

SEQ ID NO: 448671 - DNA, 25 bp, Mus musculus
gacagggcctgggagatcttcagtc

SEQ ID NO: 448672 - DNA, 25 bp, Mus musculus
gacagggcgaatcacaacacttcca

SEQ ID NO: 448673 - DNA, 25 bp, Mus musculus
gacagggcgaatgacaacacttcca

SEQ ID NO: 448674 - DNA, 25 bp, Mus musculus
gacagggcgtggagtacataactgt

SEQ ID NO: 448675 - DNA, 25 bp, Mus musculus
gacagggcgtggtgtacataactgt

SEQ ID NO: 448676 - DNA, 25 bp, Mus musculus
gacagggctctcatgatctggaagc

SEQ ID NO: 448677 - DNA, 25 bp, Mus musculus
gacagggctctcttgatctggaagc

SEQ ID NO: 448678 - DNA, 25 bp, Mus musculus
gacagggctgacacggcagtattta

SEQ ID NO: 448679 - DNA, 25 bp, Mus musculus
gacagggctgactcggcagtattta

SEQ ID NO: 448680 - DNA, 25 bp, Mus musculus
gacagggctgtcaccttaaggaaga

SEQ ID NO: 448681 - DNA, 25 bp, Mus musculus
gacagggctgtctccttaaggaaga

SEQ ID NO: 448682 - DNA, 25 bp, Mus musculus
gacagggcttggaggattactaaat

SEQ ID NO: 448683 - DNA, 25 bp, Mus musculus
gacagggcttggtggattactaaat

SEQ ID NO: 448684 - DNA, 25 bp, Mus musculus
gacaggggacttatgcaaacatcag

SEQ ID NO: 448685 - DNA, 25 bp, Mus musculus
gacaggggacttttgcaaacatcag

SEQ ID NO: 448686 - DNA, 25 bp, Mus musculus
gacagggggtcacagccctttctca

SEQ ID NO: 448687 - DNA, 25 bp, Mus musculus
gacagggggtcagagccctttctca

SEQ ID NO: 448688 - DNA, 25 bp, Mus musculus
gacaggggtcacagtagtagcagcc

SEQ ID NO: 448689 - DNA, 25 bp, Mus musculus
gacaggggtcactgtagtagcagcc

SEQ ID NO: 448690 - DNA, 25 bp, Mus musculus
gacagggtacctcagacacagttca

SEQ ID NO: 448691 - DNA, 25 bp, Mus musculus
gacagggtacctgagacacagttca

SEQ ID NO: 448692 - DNA, 25 bp, Mus musculus
gacagggtatcgagttccttctcgg

SEQ ID NO: 448693 - DNA, 25 bp, Mus musculus
gacagggtatcgtgttccttctcgg

SEQ ID NO: 448694 - DNA, 25 bp, Mus musculus
gacagggtatgtcatgatgtagctc

SEQ ID NO: 448695 - DNA, 25 bp, Mus musculus
gacagggtatgtgatgatgtagctc

SEQ ID NO: 448696 - DNA, 25 bp, Mus musculus
gacagggtcaagatcccaggtccta

SEQ ID NO: 448697 - DNA, 25 bp, Mus musculus
gacagggtcaagttcccaggtccta

SEQ ID NO: 448698 - DNA, 25 bp, Mus musculus
gacagggtcacactaatgacacgat

SEQ ID NO: 448699 - DNA, 25 bp, Mus musculus
gacagggtcacagtaatgacacgat

SEQ ID NO: 448700 - DNA, 25 bp, Mus musculus
gacagggtcattcgactcgctaagg

SEQ ID NO: 448701 - DNA, 25 bp, Mus musculus
gacagggtcattggactcgctaagg

SEQ ID NO: 448702 - DNA, 25 bp, Mus musculus
gacagggtccttcagtgacacaact

SEQ ID NO: 448703 - DNA, 25 bp, Mus musculus
gacagggtccttgagtgacacaact

SEQ ID NO: 448704 - DNA, 25 bp, Mus musculus
gacagggtcggacagttccagacca

SEQ ID NO: 448705 - DNA, 25 bp, Mus musculus
gacagggtcggagagttccagacca

SEQ ID NO: 448706 - DNA, 25 bp, Mus musculus
gacagggtcgtcatactacatggcc

SEQ ID NO: 448707 - DNA, 25 bp, Mus musculus
gacagggtcgtcttactacatggcc

SEQ ID NO: 448708 - DNA, 25 bp, Mus musculus
gacagggtctaaccttgactgactt

SEQ ID NO: 448709 - DNA, 25 bp, Mus musculus
gacagggtctaagcttgactgactt

SEQ ID NO: 448710 - DNA, 25 bp, Mus musculus
gacagggtctcacattgttaactct

SEQ ID NO: 448711 - DNA, 25 bp, Mus musculus
gacagggtctcaccgttttgagatc

SEQ ID NO: 448712 - DNA, 25 bp, Mus musculus
gacagggtctcagattgttaactct

SEQ ID NO: 448713 - DNA, 25 bp, Mus musculus
gacagggtctcagcgttttgagatc

SEQ ID NO: 448714 - DNA, 25 bp, Mus musculus
gacagggtctctcaccgaacaagag

SEQ ID NO: 448715 - DNA, 25 bp, Mus musculus
gacagggtctctgaccgaacaagag

SEQ ID NO: 448716 - DNA, 25 bp, Mus musculus
gacagggtctggctttgtagctccc

SEQ ID NO: 448717 - DNA, 25 bp, Mus musculus
gacagggtctgggtttgtagctccc

SEQ ID NO: 448718 - DNA, 25 bp, Mus musculus
gacagggtcttcagtggctcagcca

SEQ ID NO: 448719 - DNA, 25 bp, Mus musculus
gacagggtcttctgtggctcagcca

SEQ ID NO: 448720 - DNA, 25 bp, Mus musculus
gacagggtcttgatacttagccccg

SEQ ID NO: 448721 - DNA, 25 bp, Mus musculus
gacagggtcttgttacttagccccg

SEQ ID NO: 448722 - DNA, 25 bp, Mus musculus
gacagggtgggtatccatgatgtgt

SEQ ID NO: 448723 - DNA, 25 bp, Mus musculus
gacagggtgggtttccatgatgtgt

SEQ ID NO: 448724 - DNA, 25 bp, Mus musculus
gacagggttacacctatccgtacac

SEQ ID NO: 448725 - DNA, 25 bp, Mus musculus
gacagggttacagctatccgtacac

SEQ ID NO: 448726 - DNA, 25 bp, Mus musculus
gacagggttcataccttggaggttt

SEQ ID NO: 448727 - DNA, 25 bp, Mus musculus
gacagggttcattccttggaggttt

SEQ ID NO: 448728 - DNA, 25 bp, Mus musculus
gacagggttgcacctacacttctga

SEQ ID NO: 448729 - DNA, 25 bp, Mus musculus
gacagggttgcagctacacttctga

SEQ ID NO: 448730 - DNA, 25 bp, Mus musculus
gacagggttgtcattatttaacatt

SEQ ID NO: 448731 - DNA, 25 bp, Mus musculus
gacagggttgtctttatttaacatt

SEQ ID NO: 448732 - DNA, 25 bp, Mus musculus
gacagggttgtgacctcggtacttc

SEQ ID NO: 448733 - DNA, 25 bp, Mus musculus
gacagggttgtgtcctcggtacttc

SEQ ID NO: 448734 - DNA, 25 bp, Mus musculus
gacaggtaacttatctaaatcttca

SEQ ID NO: 448735 - DNA, 25 bp, Mus musculus
gacaggtaacttttctaaatcttca

SEQ ID NO: 448736 - DNA, 25 bp, Mus musculus
gacaggtaatgtaagaatggcgagt

SEQ ID NO: 448737 - DNA, 25 bp, Mus musculus
gacaggtaatgttagaatggcgagt

SEQ ID NO: 448738 - DNA, 25 bp, Mus musculus
gacaggtacatcaagagttcaagac

SEQ ID NO: 448739 - DNA, 25 bp, Mus musculus
gacaggtacatctagagttcaagac

SEQ ID NO: 448740 - DNA, 25 bp, Mus musculus
gacaggtactgtattgcacttggag

SEQ ID NO: 448741 - DNA, 25 bp, Mus musculus
gacaggtactgttttgcacttggag

SEQ ID NO: 448742 - DNA, 25 bp, Mus musculus
gacaggtagataaccttgagtacag

SEQ ID NO: 448743 - DNA, 25 bp, Mus musculus
gacaggtagatatccttgagtacag

SEQ ID NO: 448744 - DNA, 25 bp, Mus musculus
gacaggtagtaaatttgccccaagc

SEQ ID NO: 448745 - DNA, 25 bp, Mus musculus
gacaggtagtaattttgccccaagc

SEQ ID NO: 448746 - DNA, 25 bp, Mus musculus
gacaggtatctgagtcactggttga

SEQ ID NO: 448747 - DNA, 25 bp, Mus musculus
gacaggtatctgagtgtcattatac

SEQ ID NO: 448748 - DNA, 25 bp, Mus musculus
gacaggtatctgtgtcactggttga

SEQ ID NO: 448749 - DNA, 25 bp, Mus musculus
gacaggtatctgtgtgtcattatac

SEQ ID NO: 448750 - DNA, 25 bp, Mus musculus
gacaggtattggaggttcgttcttt

SEQ ID NO: 448751 - DNA, 25 bp, Mus musculus
gacaggtattggtggttcgttcttt

SEQ ID NO: 448752 - DNA, 25 bp, Mus musculus
gacaggtcaaacacaggcctatgta

SEQ ID NO: 448753 - DNA, 25 bp, Mus musculus
gacaggtcaaactcaggcctatgta

SEQ ID NO: 448754 - DNA, 25 bp, Mus musculus
gacaggtcaagtacaaggccccgaa

SEQ ID NO: 448755 - DNA, 25 bp, Mus musculus
gacaggtcaagttcaaggccccgaa

SEQ ID NO: 448756 - DNA, 25 bp, Mus musculus
gacaggtcactcacattcgatgcgt

SEQ ID NO: 448757 - DNA, 25 bp, Mus musculus
gacaggtcactctcattcgatgcgt

SEQ ID NO: 448758 - DNA, 25 bp, Mus musculus
gacaggtcagtgatcacaagccgtc

SEQ ID NO: 448759 - DNA, 25 bp, Mus musculus
gacaggtcagtgttcacaagccgtc

SEQ ID NO: 448760 - DNA, 25 bp, Mus musculus
gacaggtccattactggttggaacg

SEQ ID NO: 448761 - DNA, 25 bp, Mus musculus
gacaggtccattagggttggtcata

SEQ ID NO: 448762 - DNA, 25 bp, Mus musculus
gacaggtccatttctggttggaacg

SEQ ID NO: 448763 - DNA, 25 bp, Mus musculus
gacaggtccatttgggttggtcata

SEQ ID NO: 448764 - DNA, 25 bp, Mus musculus
gacaggtccgaacctgaggagtcat

SEQ ID NO: 448765 - DNA, 25 bp, Mus musculus
gacaggtccgaagctgaggagtcat

SEQ ID NO: 448766 - DNA, 25 bp, Mus musculus
gacaggtccttcaatggtgctcaaa

SEQ ID NO: 448767 - DNA, 25 bp, Mus musculus
gacaggtccttctatggtgctcaaa

SEQ ID NO: 448768 - DNA, 25 bp, Mus musculus
gacaggtcgcgaccaggattggaga

SEQ ID NO: 448769 - DNA, 25 bp, Mus musculus
gacaggtcgcgagcaggattggaga

SEQ ID NO: 448770 - DNA, 25 bp, Mus musculus
gacaggtctactaaaatttactctt

SEQ ID NO: 448771 - DNA, 25 bp, Mus musculus
gacaggtctacttaaatttactctt

SEQ ID NO: 448772 - DNA, 25 bp, Mus musculus
gacaggtctcaacctttttagactt

SEQ ID NO: 448773 - DNA, 25 bp, Mus musculus
gacaggtctcaagctttttagactt

SEQ ID NO: 448774 - DNA, 25 bp, Mus musculus
gacaggtctcctaatgtctgtccta

SEQ ID NO: 448775 - DNA, 25 bp, Mus musculus
gacaggtctccttatgtctgtccta

SEQ ID NO: 448776 - DNA, 25 bp, Mus musculus
gacaggtctctgcaacgttatgggt

SEQ ID NO: 448777 - DNA, 25 bp, Mus musculus
gacaggtctctggaacgttatgggt

SEQ ID NO: 448778 - DNA, 25 bp, Mus musculus
gacaggtctgggagttctgttccac

SEQ ID NO: 448779 - DNA, 25 bp, Mus musculus
gacaggtctgggtgttctgttccac

SEQ ID NO: 448780 - DNA, 25 bp, Mus musculus
gacaggtctttaagattttgaggct

SEQ ID NO: 448781 - DNA, 25 bp, Mus musculus
gacaggtctttatgattttgaggct

SEQ ID NO: 448782 - DNA, 25 bp, Mus musculus
gacaggtgacacaatttatgacggt

SEQ ID NO: 448783 - DNA, 25 bp, Mus musculus
gacaggtgacactatttatgacggt

SEQ ID NO: 448784 - DNA, 25 bp, Mus musculus
gacaggtgaccccttctcaggagaa

SEQ ID NO: 448785 - DNA, 25 bp, Mus musculus
gacaggtgacccgttctcaggagaa

SEQ ID NO: 448786 - DNA, 25 bp, Mus musculus
gacaggtgcccaatatgagatgaaa

SEQ ID NO: 448787 - DNA, 25 bp, Mus musculus
gacaggtgcccattatgagatgaaa

SEQ ID NO: 448788 - DNA, 25 bp, Mus musculus
gacaggtgctctagttcacagttac

SEQ ID NO: 448789 - DNA, 25 bp, Mus musculus
gacaggtgctcttgttcacagttac

SEQ ID NO: 448790 - DNA, 25 bp, Mus musculus
gacaggtggaacagccagtatagaa

SEQ ID NO: 448791 - DNA, 25 bp, Mus musculus
gacaggtggaactgccagtatagaa

SEQ ID NO: 448792 - DNA, 25 bp, Mus musculus
gacaggtggattcgtagcccagtaa

SEQ ID NO: 448793 - DNA, 25 bp, Mus musculus
gacaggtggattggtagcccagtaa

SEQ ID NO: 448794 - DNA, 25 bp, Mus musculus
gacaggtggctactattgccactga

SEQ ID NO: 448795 - DNA, 25 bp, Mus musculus
gacaggtggctagtattgccactga

SEQ ID NO: 448796 - DNA, 25 bp, Mus musculus
gacaggtggttactgtgccctcatg

SEQ ID NO: 448797 - DNA, 25 bp, Mus musculus
gacaggtggttagtgtgccctcatg

SEQ ID NO: 448798 - DNA, 25 bp, Mus musculus
gacaggtgtagtcgttcacttcttt

SEQ ID NO: 448799 - DNA, 25 bp, Mus musculus
gacaggtgtagtggttcacttcttt

SEQ ID NO: 448800 - DNA, 25 bp, Mus musculus
gacaggtgtcagaggtattttcagg

SEQ ID NO: 448801 - DNA, 25 bp, Mus musculus
gacaggtgtcagtggtattttcagg

SEQ ID NO: 448802 - DNA, 25 bp, Mus musculus
gacaggtgtcatattcttaagcagc

SEQ ID NO: 448803 - DNA, 25 bp, Mus musculus
gacaggtgtcattttcttaagcagc

SEQ ID NO: 448804 - DNA, 25 bp, Mus musculus
gacaggtgtcctacagctcgggaga

SEQ ID NO: 448805 - DNA, 25 bp, Mus musculus
gacaggtgtccttcagctcgggaga

SEQ ID NO: 448806 - DNA, 25 bp, Mus musculus
gacaggtgtggcactggttccagtt

SEQ ID NO: 448807 - DNA, 25 bp, Mus musculus
gacaggtgtggctctggttccagtt

SEQ ID NO: 448808 - DNA, 25 bp, Mus musculus
gacaggtgttagcaatctggcccat

SEQ ID NO: 448809 - DNA, 25 bp, Mus musculus
gacaggtgttaggaatctggcccat

SEQ ID NO: 448810 - DNA, 25 bp, Mus musculus
gacaggtgttttccattttcgatcg

SEQ ID NO: 448811 - DNA, 25 bp, Mus musculus
gacaggtgttttgcattttcgatcg

SEQ ID NO: 448812 - DNA, 25 bp, Mus musculus
gacaggttaactatccgagcaagaa

SEQ ID NO: 448813 - DNA, 25 bp, Mus musculus
gacaggttaactttccgagcaagaa

SEQ ID NO: 448814 - DNA, 25 bp, Mus musculus
gacaggttatgaagctatttgttaa

SEQ ID NO: 448815 - DNA, 25 bp, Mus musculus
gacaggttatgatgctatttgttaa

SEQ ID NO: 448816 - DNA, 25 bp, Mus musculus
gacaggttattcaaaatctccatcc

SEQ ID NO: 448817 - DNA, 25 bp, Mus musculus
gacaggttattctaaatctccatcc

SEQ ID NO: 448818 - DNA, 25 bp, Mus musculus
gacaggttcagccatctgcagcaga

SEQ ID NO: 448819 - DNA, 25 bp, Mus musculus
gacaggttcagcgatctgcagcaga

SEQ ID NO: 448820 - DNA, 25 bp, Mus musculus
gacaggttcctacaccggagcgcat

SEQ ID NO: 448821 - DNA, 25 bp, Mus musculus
gacaggttcctagaccggagcgcat

SEQ ID NO: 448822 - DNA, 25 bp, Mus musculus
gacaggttccttaatcactttgcaa

SEQ ID NO: 448823 - DNA, 25 bp, Mus musculus
gacaggttcctttatcactttgcaa

SEQ ID NO: 448824 - DNA, 25 bp, Mus musculus
gacaggttctgcacatcaaagacca

SEQ ID NO: 448825 - DNA, 25 bp, Mus musculus
gacaggttctgctcatcaaagacca

SEQ ID NO: 448826 - DNA, 25 bp, Mus musculus
gacaggttctggcacttaacaaagc

SEQ ID NO: 448827 - DNA, 25 bp, Mus musculus
gacaggttctgggacttaacaaagc

SEQ ID NO: 448828 - DNA, 25 bp, Mus musculus
gacaggttgagcagcacgagtttct

SEQ ID NO: 448829 - DNA, 25 bp, Mus musculus
gacaggttgagctgcacgagtttct

SEQ ID NO: 448830 - DNA, 25 bp, Mus musculus
gacaggttgcttagggagctttccc

SEQ ID NO: 448831 - DNA, 25 bp, Mus musculus
gacaggttgctttgggagctttccc

SEQ ID NO: 448832 - DNA, 25 bp, Mus musculus
gacaggttgtgacttcacgttccgc

SEQ ID NO: 448833 - DNA, 25 bp, Mus musculus
gacaggttgtgagttcacgttccgc

SEQ ID NO: 448834 - DNA, 25 bp, Mus musculus
gacaggtttcttacggcaagacaca

SEQ ID NO: 448835 - DNA, 25 bp, Mus musculus
gacaggtttctttcggcaagacaca

SEQ ID NO: 448836 - DNA, 25 bp, Mus musculus
gacaggtttgtcaagggctacttaa

SEQ ID NO: 448837 - DNA, 25 bp, Mus musculus
gacaggtttgtcctctgagaacaat

SEQ ID NO: 448838 - DNA, 25 bp, Mus musculus
gacaggtttgtcgtctgagaacaat

SEQ ID NO: 448839 - DNA, 25 bp, Mus musculus
gacaggtttgtctagggctacttaa

SEQ ID NO: 448840 - DNA, 25 bp, Mus musculus
gacaggttttgaattctgaatggta

SEQ ID NO: 448841 - DNA, 25 bp, Mus musculus
gacaggttttgatttctgaatggta

SEQ ID NO: 448842 - DNA, 25 bp, Mus musculus
gacaggttttgccaaacagctagca

SEQ ID NO: 448843 - DNA, 25 bp, Mus musculus
gacaggttttgcgaaacagctagca

SEQ ID NO: 448844 - DNA, 25 bp, Mus musculus
gacaggttttgtccttcgggatact

SEQ ID NO: 448845 - DNA, 25 bp, Mus musculus
gacaggttttgtgcttcgggatact

SEQ ID NO: 448846 - DNA, 25 bp, Mus musculus
gacagtaaatgtcctacagtcacct

SEQ ID NO: 448847 - DNA, 25 bp, Mus musculus
gacagtaaatgtgctacagtcacct

SEQ ID NO: 448848 - DNA, 25 bp, Mus musculus
gacagtaacaggctaacactttgga

SEQ ID NO: 448849 - DNA, 25 bp, Mus musculus
gacagtaacagggtaacactttgga

SEQ ID NO: 448850 - DNA, 25 bp, Mus musculus
gacagtaacatgctcgctttggcca

SEQ ID NO: 448851 - DNA, 25 bp, Mus musculus
gacagtaacatggtcgctttggcca

SEQ ID NO: 448852 - DNA, 25 bp, Mus musculus
gacagtaaccatagtgggtacctac

SEQ ID NO: 448853 - DNA, 25 bp, Mus musculus
gacagtaaccattgtgggtacctac

SEQ ID NO: 448854 - DNA, 25 bp, Mus musculus
gacagtaacccgcaagccttagact

SEQ ID NO: 448855 - DNA, 25 bp, Mus musculus
gacagtaacccggaagccttagact

SEQ ID NO: 448856 - DNA, 25 bp, Mus musculus
gacagtaaccctatcacagctggag

SEQ ID NO: 448857 - DNA, 25 bp, Mus musculus
gacagtaaccctttcacagctggag

SEQ ID NO: 448858 - DNA, 25 bp, Mus musculus
gacagtaaccgtcttcacttctgtg

SEQ ID NO: 448859 - DNA, 25 bp, Mus musculus
gacagtaaccgtgttcacttctgtg

SEQ ID NO: 448860 - DNA, 25 bp, Mus musculus
gacagtaacttcacgttactcgtag

SEQ ID NO: 448861 - DNA, 25 bp, Mus musculus
gacagtaacttctcgttactcgtag

SEQ ID NO: 448862 - DNA, 25 bp, Mus musculus
gacagtaatctacaggtcctcctaa

SEQ ID NO: 448863 - DNA, 25 bp, Mus musculus
gacagtaatctagaggtcctcctaa

SEQ ID NO: 448864 - DNA, 25 bp, Mus musculus
gacagtaattgccagggatgcacct

SEQ ID NO: 448865 - DNA, 25 bp, Mus musculus
gacagtaattgcgagggatgcacct

SEQ ID NO: 448866 - DNA, 25 bp, Mus musculus
gacagtacaagtagaccacagttta

SEQ ID NO: 448867 - DNA, 25 bp, Mus musculus
gacagtacaagttgaccacagttta

SEQ ID NO: 448868 - DNA, 25 bp, Mus musculus
gacagtacacacacagaccacacat

SEQ ID NO: 448869 - DNA, 25 bp, Mus musculus
gacagtacacacaggcatcacgaca

SEQ ID NO: 448870 - DNA, 25 bp, Mus musculus
gacagtacacactcagaccacacat

SEQ ID NO: 448871 - DNA, 25 bp, Mus musculus
gacagtacacactggcatcacgaca

SEQ ID NO: 448872 - DNA, 25 bp, Mus musculus
gacagtacagaccataggccctgct

SEQ ID NO: 448873 - DNA, 25 bp, Mus musculus
gacagtacagacgataggccctgct

SEQ ID NO: 448874 - DNA, 25 bp, Mus musculus
gacagtacagctagagccttctctg

SEQ ID NO: 448875 - DNA, 25 bp, Mus musculus
gacagtacagcttgagccttctctg

SEQ ID NO: 448876 - DNA, 25 bp, Mus musculus
gacagtacaggacccagatgagcca

SEQ ID NO: 448877 - DNA, 25 bp, Mus musculus
gacagtacaggagccagatgagcca

SEQ ID NO: 448878 - DNA, 25 bp, Mus musculus
gacagtacatcacattctcttcaag

SEQ ID NO: 448879 - DNA, 25 bp, Mus musculus
gacagtacatcagattctcttcaag

SEQ ID NO: 448880 - DNA, 25 bp, Mus musculus
gacagtaccagaacgcatctcggaa

SEQ ID NO: 448881 - DNA, 25 bp, Mus musculus
gacagtaccagatcgcatctcggaa

SEQ ID NO: 448882 - DNA, 25 bp, Mus musculus
gacagtaccaggagtgcctgcagct

SEQ ID NO: 448883 - DNA, 25 bp, Mus musculus
gacagtaccaggtgtgcctgcagct

SEQ ID NO: 448884 - DNA, 25 bp, Mus musculus
gacagtaccgtccagtgccagacat

SEQ ID NO: 448885 - DNA, 25 bp, Mus musculus
gacagtaccgtcgagtgccagacat

SEQ ID NO: 448886 - DNA, 25 bp, Mus musculus
gacagtacctccagggcatttgtgg

SEQ ID NO: 448887 - DNA, 25 bp, Mus musculus
gacagtacctcctgggcatttgtgg

SEQ ID NO: 448888 - DNA, 25 bp, Mus musculus
gacagtacctctaacttgtaataac

SEQ ID NO: 448889 - DNA, 25 bp, Mus musculus
gacagtacctcttacttgtaataac

SEQ ID NO: 448890 - DNA, 25 bp, Mus musculus
gacagtactacccattcatctattg

SEQ ID NO: 448891 - DNA, 25 bp, Mus musculus
gacagtactaccgattcatctattg

SEQ ID NO: 448892 - DNA, 25 bp, Mus musculus
gacagtactatgctatccatacact

SEQ ID NO: 448893 - DNA, 25 bp, Mus musculus
gacagtactatggtatccatacact

SEQ ID NO: 448894 - DNA, 25 bp, Mus musculus
gacagtactgaccaagccttggatt

SEQ ID NO: 448895 - DNA, 25 bp, Mus musculus
gacagtactgacgaagccttggatt

SEQ ID NO: 448896 - DNA, 25 bp, Mus musculus
gacagtactggcagagtccactaag

SEQ ID NO: 448897 - DNA, 25 bp, Mus musculus
gacagtactggctgagtccactaag

SEQ ID NO: 448898 - DNA, 25 bp, Mus musculus
gacagtactgtcatatcatccctga

SEQ ID NO: 448899 - DNA, 25 bp, Mus musculus
gacagtactgtcttatcatccctga

SEQ ID NO: 448900 - DNA, 25 bp, Mus musculus
gacagtacttatcttgattcgtgag

SEQ ID NO: 448901 - DNA, 25 bp, Mus musculus
gacagtacttatgttgattcgtgag

SEQ ID NO: 448902 - DNA, 25 bp, Mus musculus
gacagtagaaatacagccccacctt

SEQ ID NO: 448903 - DNA, 25 bp, Mus musculus
gacagtagaaattcagccccacctt

SEQ ID NO: 448904 - DNA, 25 bp, Mus musculus
gacagtagagagagtttcgccacaa

SEQ ID NO: 448905 - DNA, 25 bp, Mus musculus
gacagtagagagtgtttcgccacaa

SEQ ID NO: 448906 - DNA, 25 bp, Mus musculus
gacagtagatcccagaatgcattgc

SEQ ID NO: 448907 - DNA, 25 bp, Mus musculus
gacagtagatccgagaatgcattgc

SEQ ID NO: 448908 - DNA, 25 bp, Mus musculus
gacagtagcctactttttggaaggg

SEQ ID NO: 448909 - DNA, 25 bp, Mus musculus
gacagtagcctagtttttggaaggg

SEQ ID NO: 448910 - DNA, 25 bp, Mus musculus
gacagtagcctcaacctgtgctttt

SEQ ID NO: 448911 - DNA, 25 bp, Mus musculus
gacagtagcctctacctgtgctttt

SEQ ID NO: 448912 - DNA, 25 bp, Mus musculus
gacagtagtcatcatccaaaaacaa

SEQ ID NO: 448913 - DNA, 25 bp, Mus musculus
gacagtagtcatgatccaaaaacaa

SEQ ID NO: 448914 - DNA, 25 bp, Mus musculus
gacagtagtcccaggttgcagatgt

SEQ ID NO: 448915 - DNA, 25 bp, Mus musculus
gacagtagtccctggttgcagatgt

SEQ ID NO: 448916 - DNA, 25 bp, Mus musculus
gacagtagtgtgctactagtaacaa

SEQ ID NO: 448917 - DNA, 25 bp, Mus musculus
gacagtagtgtggtactagtaacaa

SEQ ID NO: 448918 - DNA, 25 bp, Mus musculus
gacagtagttggatattcccgtaat

SEQ ID NO: 448919 - DNA, 25 bp, Mus musculus
gacagtagttggttattcccgtaat

SEQ ID NO: 448920 - DNA, 25 bp, Mus musculus
gacagtatatcaccatctgctattt

SEQ ID NO: 448921 - DNA, 25 bp, Mus musculus
gacagtatatcagcatctgctattt

SEQ ID NO: 448922 - DNA, 25 bp, Mus musculus
gacagtatccgtacagtatccgctg

SEQ ID NO: 448923 - DNA, 25 bp, Mus musculus
gacagtatccgttcagtatccgctg

SEQ ID NO: 448924 - DNA, 25 bp, Mus musculus
gacagtatctaccattgttcctagg

SEQ ID NO: 448925 - DNA, 25 bp, Mus musculus
gacagtatctacgattgttcctagg

SEQ ID NO: 448926 - DNA, 25 bp, Mus musculus
gacagtatctgcattattggtggta

SEQ ID NO: 448927 - DNA, 25 bp, Mus musculus
gacagtatctgctttattggtggta

SEQ ID NO: 448928 - DNA, 25 bp, Mus musculus
gacagtatgatacaaatacaccatt

SEQ ID NO: 448929 - DNA, 25 bp, Mus musculus
gacagtatgatagaaatacaccatt

SEQ ID NO: 448930 - DNA, 25 bp, Mus musculus
gacagtatgctgacacccaatgatt

SEQ ID NO: 448931 - DNA, 25 bp, Mus musculus
gacagtatgctgtcacccaatgatt

SEQ ID NO: 448932 - DNA, 25 bp, Mus musculus
gacagtatgtagaaacccatccaat

SEQ ID NO: 448933 - DNA, 25 bp, Mus musculus
gacagtatgtagtaacccatccaat

SEQ ID NO: 448934 - DNA, 25 bp, Mus musculus
gacagtatgtggcttgtggttctaa

SEQ ID NO: 448935 - DNA, 25 bp, Mus musculus
gacagtatgtgggttgtggttctaa

SEQ ID NO: 448936 - DNA, 25 bp, Mus musculus
gacagtatgtgtcacccacaatgtt

SEQ ID NO: 448937 - DNA, 25 bp, Mus musculus
gacagtatgtgtgacccacaatgtt

SEQ ID NO: 448938 - DNA, 25 bp, Mus musculus
gacagtattactaaacaggtgagga

SEQ ID NO: 448939 - DNA, 25 bp, Mus musculus
gacagtattactacagcgcagatgg

SEQ ID NO: 448940 - DNA, 25 bp, Mus musculus
gacagtattacttaacaggtgagga

SEQ ID NO: 448941 - DNA, 25 bp, Mus musculus
gacagtattacttcagcgcagatgg

SEQ ID NO: 448942 - DNA, 25 bp, Mus musculus
gacagtattatgaggccctgaataa

SEQ ID NO: 448943 - DNA, 25 bp, Mus musculus
gacagtattatgtggccctgaataa

SEQ ID NO: 448944 - DNA, 25 bp, Mus musculus
gacagtattcaccattagcctgaag

SEQ ID NO: 448945 - DNA, 25 bp, Mus musculus
gacagtattcacgattagcctgaag

SEQ ID NO: 448946 - DNA, 25 bp, Mus musculus
gacagtattccaaatcaggatcgct

SEQ ID NO: 448947 - DNA, 25 bp, Mus musculus
gacagtattccaattccggacatga

SEQ ID NO: 448948 - DNA, 25 bp, Mus musculus
gacagtattccatatcaggatcgct

SEQ ID NO: 448949 - DNA, 25 bp, Mus musculus
gacagtattccatttccggacatga

SEQ ID NO: 448950 - DNA, 25 bp, Mus musculus
gacagtattcccataaatttatagc

SEQ ID NO: 448951 - DNA, 25 bp, Mus musculus
gacagtattcccttaaatttatagc

SEQ ID NO: 448952 - DNA, 25 bp, Mus musculus
gacagtattctcagtgccagtgtcg

SEQ ID NO: 448953 - DNA, 25 bp, Mus musculus
gacagtattctctgtgccagtgtcg

SEQ ID NO: 448954 - DNA, 25 bp, Mus musculus
gacagtattgagagagccggtgaca

SEQ ID NO: 448955 - DNA, 25 bp, Mus musculus
gacagtattgagtgagccggtgaca

SEQ ID NO: 448956 - DNA, 25 bp, Mus musculus
gacagtattgctatatacagttctt

SEQ ID NO: 448957 - DNA, 25 bp, Mus musculus
gacagtattgctttatacagttctt

SEQ ID NO: 448958 - DNA, 25 bp, Mus musculus
gacagtattgtcagaagatcccagg

SEQ ID NO: 448959 - DNA, 25 bp, Mus musculus
gacagtattgtccagcatgttatca

SEQ ID NO: 448960 - DNA, 25 bp, Mus musculus
gacagtattgtcgagcatgttatca

SEQ ID NO: 448961 - DNA, 25 bp, Mus musculus
gacagtattgtctgaagatcccagg

SEQ ID NO: 448962 - DNA, 25 bp, Mus musculus
gacagtatttatagttttcccagaa

SEQ ID NO: 448963 - DNA, 25 bp, Mus musculus
gacagtatttattgttttcccagaa

SEQ ID NO: 448964 - DNA, 25 bp, Mus musculus
gacagtatttggcactatctacttt

SEQ ID NO: 448965 - DNA, 25 bp, Mus musculus
gacagtatttgggactatctacttt

SEQ ID NO: 448966 - DNA, 25 bp, Mus musculus
gacagtattttaatatccctatata

SEQ ID NO: 448967 - DNA, 25 bp, Mus musculus
gacagtattttattatccctatata

SEQ ID NO: 448968 - DNA, 25 bp, Mus musculus
gacagtcaaacaaggatatgcctga

SEQ ID NO: 448969 - DNA, 25 bp, Mus musculus
gacagtcaaacatggatatgcctga

SEQ ID NO: 448970 - DNA, 25 bp, Mus musculus
gacagtcaaagtcactattgatctt

SEQ ID NO: 448971 - DNA, 25 bp, Mus musculus
gacagtcaaagtgactattgatctt

SEQ ID NO: 448972 - DNA, 25 bp, Mus musculus
gacagtcaaataactgttgagttca

SEQ ID NO: 448973 - DNA, 25 bp, Mus musculus
gacagtcaaatatctgttgagttca

SEQ ID NO: 448974 - DNA, 25 bp, Mus musculus
gacagtcaactgaactttatgcagt

SEQ ID NO: 448975 - DNA, 25 bp, Mus musculus
gacagtcaactgtactttatgcagt

SEQ ID NO: 448976 - DNA, 25 bp, Mus musculus
gacagtcaagatccaggtgtatcaa

SEQ ID NO: 448977 - DNA, 25 bp, Mus musculus
gacagtcaagatgcaggtgtatcaa

SEQ ID NO: 448978 - DNA, 25 bp, Mus musculus
gacagtcaagtgatagagcctacaa

SEQ ID NO: 448979 - DNA, 25 bp, Mus musculus
gacagtcaagtgttagagcctacaa

SEQ ID NO: 448980 - DNA, 25 bp, Mus musculus
gacagtcacaaacattcagatcaag

SEQ ID NO: 448981 - DNA, 25 bp, Mus musculus
gacagtcacaaagattcagatcaag

SEQ ID NO: 448982 - DNA, 25 bp, Mus musculus
gacagtcacaatccacatgttgaga

SEQ ID NO: 448983 - DNA, 25 bp, Mus musculus
gacagtcacaatgcacatgttgaga

SEQ ID NO: 448984 - DNA, 25 bp, Mus musculus
gacagtcacagccagggcaggttac

SEQ ID NO: 448985 - DNA, 25 bp, Mus musculus
gacagtcacagcgagggcaggttac

SEQ ID NO: 448986 - DNA, 25 bp, Mus musculus
gacagtcacattactacaagggctt

SEQ ID NO: 448987 - DNA, 25 bp, Mus musculus
gacagtcacatttctacaagggctt

SEQ ID NO: 448988 - DNA, 25 bp, Mus musculus
gacagtcaccacctgaacagtagct

SEQ ID NO: 448989 - DNA, 25 bp, Mus musculus
gacagtcaccacgtgaacagtagct

SEQ ID NO: 448990 - DNA, 25 bp, Mus musculus
gacagtcaccggatgtcagcacaga

SEQ ID NO: 448991 - DNA, 25 bp, Mus musculus
gacagtcaccggttgtcagcacaga

SEQ ID NO: 448992 - DNA, 25 bp, Mus musculus
gacagtcagagcaggttgcacagag

SEQ ID NO: 448993 - DNA, 25 bp, Mus musculus
gacagtcagagctggttgcacagag

SEQ ID NO: 448994 - DNA, 25 bp, Mus musculus
gacagtcagctcacagctcctgggt

SEQ ID NO: 448995 - DNA, 25 bp, Mus musculus
gacagtcagctctcagctcctgggt

SEQ ID NO: 448996 - DNA, 25 bp, Mus musculus
gacagtcaggacaccaggatcaatg

SEQ ID NO: 448997 - DNA, 25 bp, Mus musculus
gacagtcaggactccaggatcaatg

SEQ ID NO: 448998 - DNA, 25 bp, Mus musculus
gacagtcagggaagaagccctgtct

SEQ ID NO: 448999 - DNA, 25 bp, Mus musculus
gacagtcagggatgaagccctgtct

SEQ ID NO: 449000 - DNA, 25 bp, Mus musculus
gacagtcaggttcgatcatttgtaa

SEQ ID NO: 449001 - DNA, 25 bp, Mus musculus
gacagtcaggttggatcatttgtaa

SEQ ID NO: 449002 - DNA, 25 bp, Mus musculus
gacagtcagtataatcgccggcgac

SEQ ID NO: 449003 - DNA, 25 bp, Mus musculus
gacagtcagtattatcgccggcgac

SEQ ID NO: 449004 - DNA, 25 bp, Mus musculus
gacagtcagtcacctcatttctgga

SEQ ID NO: 449005 - DNA, 25 bp, Mus musculus
gacagtcagtcagctcatttctgga

SEQ ID NO: 449006 - DNA, 25 bp, Mus musculus
gacagtcagttgctccgtgtccaaa

SEQ ID NO: 449007 - DNA, 25 bp, Mus musculus
gacagtcagttggtccgtgtccaaa

SEQ ID NO: 449008 - DNA, 25 bp, Mus musculus
gacagtcataaacgcacttctgcaa

SEQ ID NO: 449009 - DNA, 25 bp, Mus musculus
gacagtcataaaggcacttctgcaa

SEQ ID NO: 449010 - DNA, 25 bp, Mus musculus
gacagtcatatcatttcaggtacaa

SEQ ID NO: 449011 - DNA, 25 bp, Mus musculus
gacagtcatatcttttcaggtacaa

SEQ ID NO: 449012 - DNA, 25 bp, Mus musculus
gacagtcatgtgctttgtgaggcca

SEQ ID NO: 449013 - DNA, 25 bp, Mus musculus
gacagtcatgtggtttgtgaggcca

SEQ ID NO: 449014 - DNA, 25 bp, Mus musculus
gacagtcattacaacttaggcctca

SEQ ID NO: 449015 - DNA, 25 bp, Mus musculus
gacagtcattactacttaggcctca

SEQ ID NO: 449016 - DNA, 25 bp, Mus musculus
gacagtcattggatctgagttcatt

SEQ ID NO: 449017 - DNA, 25 bp, Mus musculus
gacagtcattggttctgagttcatt

SEQ ID NO: 449018 - DNA, 25 bp, Mus musculus
gacagtccaaatacaaacaaagcaa

SEQ ID NO: 449019 - DNA, 25 bp, Mus musculus
gacagtccaaattcaaacaaagcaa

SEQ ID NO: 449020 - DNA, 25 bp, Mus musculus
gacagtcccaaacttaccagtggca

SEQ ID NO: 449021 - DNA, 25 bp, Mus musculus
gacagtcccaaagttaccagtggca

SEQ ID NO: 449022 - DNA, 25 bp, Mus musculus
gacagtcccagcatattgtgtgtaa

SEQ ID NO: 449023 - DNA, 25 bp, Mus musculus
gacagtcccagcttattgtgtgtaa

SEQ ID NO: 449024 - DNA, 25 bp, Mus musculus
gacagtcccaggctcactggacagt

SEQ ID NO: 449025 - DNA, 25 bp, Mus musculus
gacagtcccagggtcactggacagt

SEQ ID NO: 449026 - DNA, 25 bp, Mus musculus
gacagtcccttcaactatgactggg

SEQ ID NO: 449027 - DNA, 25 bp, Mus musculus
gacagtcccttctactatgactggg

SEQ ID NO: 449028 - DNA, 25 bp, Mus musculus
gacagtccgaagatccactagttaa

SEQ ID NO: 449029 - DNA, 25 bp, Mus musculus
gacagtccgaagttccactagttaa

SEQ ID NO: 449030 - DNA, 25 bp, Mus musculus
gacagtccgtccctattgaagtata

SEQ ID NO: 449031 - DNA, 25 bp, Mus musculus
gacagtccgtccgtattgaagtata

SEQ ID NO: 449032 - DNA, 25 bp, Mus musculus
gacagtcctcataagagctcaggct

SEQ ID NO: 449033 - DNA, 25 bp, Mus musculus
gacagtcctcattagagctcaggct

SEQ ID NO: 449034 - DNA, 25 bp, Mus musculus
gacagtcctgaaaaggttatgacct

SEQ ID NO: 449035 - DNA, 25 bp, Mus musculus
gacagtcctgaataggttatgacct

SEQ ID NO: 449036 - DNA, 25 bp, Mus musculus
gacagtcctgtcatattatttctta

SEQ ID NO: 449037 - DNA, 25 bp, Mus musculus
gacagtcctgtcttattatttctta

SEQ ID NO: 449038 - DNA, 25 bp, Mus musculus
gacagtcctgtgcttacttagtgtt

SEQ ID NO: 449039 - DNA, 25 bp, Mus musculus
gacagtcctgtggttacttagtgtt

SEQ ID NO: 449040 - DNA, 25 bp, Mus musculus
gacagtccttaactttccagaaatt

SEQ ID NO: 449041 - DNA, 25 bp, Mus musculus
gacagtccttaagtttccagaaatt

SEQ ID NO: 449042 - DNA, 25 bp, Mus musculus
gacagtcgacttactacagggtaaa

SEQ ID NO: 449043 - DNA, 25 bp, Mus musculus
gacagtcgactttctacagggtaaa

SEQ ID NO: 449044 - DNA, 25 bp, Mus musculus
gacagtcgatataccacagttatag

SEQ ID NO: 449045 - DNA, 25 bp, Mus musculus
gacagtcgatattccacagttatag

SEQ ID NO: 449046 - DNA, 25 bp, Mus musculus
gacagtcgatgcaacttgcacacac

SEQ ID NO: 449047 - DNA, 25 bp, Mus musculus
gacagtcgatgctacttgcacacac

SEQ ID NO: 449048 - DNA, 25 bp, Mus musculus
gacagtcgctgactactcataacct

SEQ ID NO: 449049 - DNA, 25 bp, Mus musculus
gacagtcgctgagtactcataacct

SEQ ID NO: 449050 - DNA, 25 bp, Mus musculus
gacagtcgctgtctgtggcaaagct

SEQ ID NO: 449051 - DNA, 25 bp, Mus musculus
gacagtcgctgtgtgtggcaaagct

SEQ ID NO: 449052 - DNA, 25 bp, Mus musculus
gacagtcggcatacagatcactctt

SEQ ID NO: 449053 - DNA, 25 bp, Mus musculus
gacagtcggcattcagatcactctt

SEQ ID NO: 449054 - DNA, 25 bp, Mus musculus
gacagtcgtcaccaaattgatttcc

SEQ ID NO: 449055 - DNA, 25 bp, Mus musculus
gacagtcgtcacgaaattgatttcc

SEQ ID NO: 449056 - DNA, 25 bp, Mus musculus
gacagtcgtcccaaatgcattagag

SEQ ID NO: 449057 - DNA, 25 bp, Mus musculus
gacagtcgtccctaatgcattagag

SEQ ID NO: 449058 - DNA, 25 bp, Mus musculus
gacagtcgtgagcatatgaccacca

SEQ ID NO: 449059 - DNA, 25 bp, Mus musculus
gacagtcgtgaggatatgaccacca

SEQ ID NO: 449060 - DNA, 25 bp, Mus musculus
gacagtctaaaccttttcgaatgat

SEQ ID NO: 449061 - DNA, 25 bp, Mus musculus
gacagtctaaacgttttcgaatgat

SEQ ID NO: 449062 - DNA, 25 bp, Mus musculus
gacagtctactaactgcaggtcaaa

SEQ ID NO: 449063 - DNA, 25 bp, Mus musculus
gacagtctactatctgcaggtcaaa

SEQ ID NO: 449064 - DNA, 25 bp, Mus musculus
gacagtctagaccagcacgaagctt

SEQ ID NO: 449065 - DNA, 25 bp, Mus musculus
gacagtctagacgagcacgaagctt

SEQ ID NO: 449066 - DNA, 25 bp, Mus musculus
gacagtctagcaatttccctattac

SEQ ID NO: 449067 - DNA, 25 bp, Mus musculus
gacagtctagcattttccctattac

SEQ ID NO: 449068 - DNA, 25 bp, Mus musculus
gacagtctatatctagctagctagc

SEQ ID NO: 449069 - DNA, 25 bp, Mus musculus
gacagtctatatgtagctagctagc

SEQ ID NO: 449070 - DNA, 25 bp, Mus musculus
gacagtctcatgatttcaattcctt

SEQ ID NO: 449071 - DNA, 25 bp, Mus musculus
gacagtctcatgttttcaattcctt

SEQ ID NO: 449072 - DNA, 25 bp, Mus musculus
gacagtctccgcagctgctgtgacc

SEQ ID NO: 449073 - DNA, 25 bp, Mus musculus
gacagtctccgctgctgctgtgacc

SEQ ID NO: 449074 - DNA, 25 bp, Mus musculus
gacagtctccggctcttaaatgact

SEQ ID NO: 449075 - DNA, 25 bp, Mus musculus
gacagtctccgggtcttaaatgact

SEQ ID NO: 449076 - DNA, 25 bp, Mus musculus
gacagtctctacactcatggagttg

SEQ ID NO: 449077 - DNA, 25 bp, Mus musculus
gacagtctctactctcatggagttg

SEQ ID NO: 449078 - DNA, 25 bp, Mus musculus
gacagtctctatcgctccctaggtt

SEQ ID NO: 449079 - DNA, 25 bp, Mus musculus
gacagtctctatggctccctaggtt

SEQ ID NO: 449080 - DNA, 25 bp, Mus musculus
gacagtctctgtccaggaccctgcg

SEQ ID NO: 449081 - DNA, 25 bp, Mus musculus
gacagtctctgtgcaggaccctgcg

SEQ ID NO: 449082 - DNA, 25 bp, Mus musculus
gacagtctcttactgagcacgtttt

SEQ ID NO: 449083 - DNA, 25 bp, Mus musculus
gacagtctcttagtgagcacgtttt

SEQ ID NO: 449084 - DNA, 25 bp, Mus musculus
gacagtctcttgctacatagggcat

SEQ ID NO: 449085 - DNA, 25 bp, Mus musculus
gacagtctcttggtacatagggcat

SEQ ID NO: 449086 - DNA, 25 bp, Mus musculus
gacagtctgcagagagaactcaact

SEQ ID NO: 449087 - DNA, 25 bp, Mus musculus
gacagtctgcagtgagaactcaact

SEQ ID NO: 449088 - DNA, 25 bp, Mus musculus
gacagtctggacatcagccaacagg

SEQ ID NO: 449089 - DNA, 25 bp, Mus musculus
gacagtctggacttcagccaacagg

SEQ ID NO: 449090 - DNA, 25 bp, Mus musculus
gacagtctggtgatttccatttgct

SEQ ID NO: 449091 - DNA, 25 bp, Mus musculus
gacagtctggtgttttccatttgct

SEQ ID NO: 449092 - DNA, 25 bp, Mus musculus
gacagtctggttaggcttgtactta

SEQ ID NO: 449093 - DNA, 25 bp, Mus musculus
gacagtctggtttggcttgtactta

SEQ ID NO: 449094 - DNA, 25 bp, Mus musculus
gacagtctgtatcttgaccagaggc

SEQ ID NO: 449095 - DNA, 25 bp, Mus musculus
gacagtctgtatgttgaccagaggc

SEQ ID NO: 449096 - DNA, 25 bp, Mus musculus
gacagtcttagccaggtatgtgctt

SEQ ID NO: 449097 - DNA, 25 bp, Mus musculus
gacagtcttagcgaggtatgtgctt

SEQ ID NO: 449098 - DNA, 25 bp, Mus musculus
gacagtcttcagcattgagattgtt

SEQ ID NO: 449099 - DNA, 25 bp, Mus musculus
gacagtcttcaggattgagattgtt

SEQ ID NO: 449100 - DNA, 25 bp, Mus musculus
gacagtcttgcacacctatggaagc

SEQ ID NO: 449101 - DNA, 25 bp, Mus musculus
gacagtcttgcagacctatggaagc

SEQ ID NO: 449102 - DNA, 25 bp, Mus musculus
gacagtcttgctcgctgttctgaac

SEQ ID NO: 449103 - DNA, 25 bp, Mus musculus
gacagtcttgctggctgttctgaac

SEQ ID NO: 449104 - DNA, 25 bp, Mus musculus
gacagtcttggacaaaggccgcctg

SEQ ID NO: 449105 - DNA, 25 bp, Mus musculus
gacagtcttggagaaaggccgcctg

SEQ ID NO: 449106 - DNA, 25 bp, Mus musculus
gacagtcttgtcataaatgccttct

SEQ ID NO: 449107 - DNA, 25 bp, Mus musculus
gacagtcttgtcttaaatgccttct

SEQ ID NO: 449108 - DNA, 25 bp, Mus musculus
gacagtctttgaatctcctattcat

SEQ ID NO: 449109 - DNA, 25 bp, Mus musculus
gacagtctttgattctcctattcat

SEQ ID NO: 449110 - DNA, 25 bp, Mus musculus
gacagtctttgccttcacactgaac

SEQ ID NO: 449111 - DNA, 25 bp, Mus musculus
gacagtctttgcgttcacactgaac

SEQ ID NO: 449112 - DNA, 25 bp, Mus musculus
gacagtcttttcatgctggacattt

SEQ ID NO: 449113 - DNA, 25 bp, Mus musculus
gacagtcttttcttgctggacattt

SEQ ID NO: 449114 - DNA, 25 bp, Mus musculus
gacagtgaaaaacaagcccatccct

SEQ ID NO: 449115 - DNA, 25 bp, Mus musculus
gacagtgaaaaagaagcccatccct

SEQ ID NO: 449116 - DNA, 25 bp, Mus musculus
gacagtgaaaatctagccttgggtg

SEQ ID NO: 449117 - DNA, 25 bp, Mus musculus
gacagtgaaaatgtagccttgggtg

SEQ ID NO: 449118 - DNA, 25 bp, Mus musculus
gacagtgaaagcctagtacatgcga

SEQ ID NO: 449119 - DNA, 25 bp, Mus musculus
gacagtgaaagcgtagtacatgcga

SEQ ID NO: 449120 - DNA, 25 bp, Mus musculus
gacagtgaaccgcatggagcagtac

SEQ ID NO: 449121 - DNA, 25 bp, Mus musculus
gacagtgaaccggatggagcagtac

SEQ ID NO: 449122 - DNA, 25 bp, Mus musculus
gacagtgaacgtacgcacgcgagat

SEQ ID NO: 449123 - DNA, 25 bp, Mus musculus
gacagtgaacgttcgcacgcgagat

SEQ ID NO: 449124 - DNA, 25 bp, Mus musculus
gacagtgaacttcaatttatctttg

SEQ ID NO: 449125 - DNA, 25 bp, Mus musculus
gacagtgaacttgaatttatctttg

SEQ ID NO: 449126 - DNA, 25 bp, Mus musculus
gacagtgaaggccattctcctccaa

SEQ ID NO: 449127 - DNA, 25 bp, Mus musculus
gacagtgaaggcgattctcctccaa

SEQ ID NO: 449128 - DNA, 25 bp, Mus musculus
gacagtgacacccaaaggttttctt

SEQ ID NO: 449129 - DNA, 25 bp, Mus musculus
gacagtgacaccctgtctaaaaggg

SEQ ID NO: 449130 - DNA, 25 bp, Mus musculus
gacagtgacaccgaaaggttttctt

SEQ ID NO: 449131 - DNA, 25 bp, Mus musculus
gacagtgacaccgtgtctaaaaggg

SEQ ID NO: 449132 - DNA, 25 bp, Mus musculus
gacagtgacagtctctcaccatata

SEQ ID NO: 449133 - DNA, 25 bp, Mus musculus
gacagtgacagtgtctcaccatata

SEQ ID NO: 449134 - DNA, 25 bp, Mus musculus
gacagtgacccgctgtgcaaagcac

SEQ ID NO: 449135 - DNA, 25 bp, Mus musculus
gacagtgacccggtgtgcaaagcac

SEQ ID NO: 449136 - DNA, 25 bp, Mus musculus
gacagtgaccttatagacagcacca

SEQ ID NO: 449137 - DNA, 25 bp, Mus musculus
gacagtgaccttttagacagcacca

SEQ ID NO: 449138 - DNA, 25 bp, Mus musculus
gacagtgacgtcagtccaggaccac

SEQ ID NO: 449139 - DNA, 25 bp, Mus musculus
gacagtgacgtctgtccaggaccac

SEQ ID NO: 449140 - DNA, 25 bp, Mus musculus
gacagtgactctcacagggcgtttt

SEQ ID NO: 449141 - DNA, 25 bp, Mus musculus
gacagtgactctgacagggcgtttt

SEQ ID NO: 449142 - DNA, 25 bp, Mus musculus
gacagtgactgacaatagctcatga

SEQ ID NO: 449143 - DNA, 25 bp, Mus musculus
gacagtgactgagaatagctcatga

SEQ ID NO: 449144 - DNA, 25 bp, Mus musculus
gacagtgactggagaacacgcactc

SEQ ID NO: 449145 - DNA, 25 bp, Mus musculus
gacagtgactggtgaacacgcactc

SEQ ID NO: 449146 - DNA, 25 bp, Mus musculus
gacagtgactgtcgtgcctttgtat

SEQ ID NO: 449147 - DNA, 25 bp, Mus musculus
gacagtgactgtggtgcctttgtat

SEQ ID NO: 449148 - DNA, 25 bp, Mus musculus
gacagtgacttaattcattgaccgt

SEQ ID NO: 449149 - DNA, 25 bp, Mus musculus
gacagtgacttatttcattgaccgt

SEQ ID NO: 449150 - DNA, 25 bp, Mus musculus
gacagtgacttcagttaccagagtc

SEQ ID NO: 449151 - DNA, 25 bp, Mus musculus
gacagtgacttctgttaccagagtc

SEQ ID NO: 449152 - DNA, 25 bp, Mus musculus
gacagtgacttgatagacatttcta

SEQ ID NO: 449153 - DNA, 25 bp, Mus musculus
gacagtgacttgttagacatttcta

SEQ ID NO: 449154 - DNA, 25 bp, Mus musculus
gacagtgactttctccaaagacgat

SEQ ID NO: 449155 - DNA, 25 bp, Mus musculus
gacagtgactttgtccaaagacgat

SEQ ID NO: 449156 - DNA, 25 bp, Mus musculus
gacagtgagaccaggtgcttagaaa

SEQ ID NO: 449157 - DNA, 25 bp, Mus musculus
gacagtgagacctggtgcttagaaa

SEQ ID NO: 449158 - DNA, 25 bp, Mus musculus
gacagtgagacgcttgcctggctaa

SEQ ID NO: 449159 - DNA, 25 bp, Mus musculus
gacagtgagacggttgcctggctaa

SEQ ID NO: 449160 - DNA, 25 bp, Mus musculus
gacagtgagactcgcgttacccttg

SEQ ID NO: 449161 - DNA, 25 bp, Mus musculus
gacagtgagactggcgttacccttg

SEQ ID NO: 449162 - DNA, 25 bp, Mus musculus
gacagtgagattccccgcctgagaa

SEQ ID NO: 449163 - DNA, 25 bp, Mus musculus
gacagtgagattgcccgcctgagaa

SEQ ID NO: 449164 - DNA, 25 bp, Mus musculus
gacagtgagcccactgagttaccga

SEQ ID NO: 449165 - DNA, 25 bp, Mus musculus
gacagtgagccctctgagttaccga

SEQ ID NO: 449166 - DNA, 25 bp, Mus musculus
gacagtgagctcacattgtacctgg

SEQ ID NO: 449167 - DNA, 25 bp, Mus musculus
gacagtgagctcattttattgaaga

SEQ ID NO: 449168 - DNA, 25 bp, Mus musculus
gacagtgagctctcattgtacctgg

SEQ ID NO: 449169 - DNA, 25 bp, Mus musculus
gacagtgagctctttttattgaaga

SEQ ID NO: 449170 - DNA, 25 bp, Mus musculus
gacagtgaggacaatttcttgatcc

SEQ ID NO: 449171 - DNA, 25 bp, Mus musculus
gacagtgaggactatttcttgatcc

SEQ ID NO: 449172 - DNA, 25 bp, Mus musculus
gacagtgagtacaacgtggattcct

SEQ ID NO: 449173 - DNA, 25 bp, Mus musculus
gacagtgagtactacgtggattcct

SEQ ID NO: 449174 - DNA, 25 bp, Mus musculus
gacagtgagtcgcagtcgtccctgt

SEQ ID NO: 449175 - DNA, 25 bp, Mus musculus
gacagtgagtcggagtcgtccctgt

SEQ ID NO: 449176 - DNA, 25 bp, Mus musculus
gacagtgagtgtcctaggaaacccc

SEQ ID NO: 449177 - DNA, 25 bp, Mus musculus
gacagtgagtgtgctaggaaacccc

SEQ ID NO: 449178 - DNA, 25 bp, Mus musculus
gacagtgagttgatatcctttcttg

SEQ ID NO: 449179 - DNA, 25 bp, Mus musculus
gacagtgagttgttatcctttcttg

SEQ ID NO: 449180 - DNA, 25 bp, Mus musculus
gacagtgatactctggccatctctc

SEQ ID NO: 449181 - DNA, 25 bp, Mus musculus
gacagtgatactgtggccatctctc

SEQ ID NO: 449182 - DNA, 25 bp, Mus musculus
gacagtgatcacagtctgcatccta

SEQ ID NO: 449183 - DNA, 25 bp, Mus musculus
gacagtgatcactgtctgcatccta

SEQ ID NO: 449184 - DNA, 25 bp, Mus musculus
gacagtgatcgaaattcttaacccc

SEQ ID NO: 449185 - DNA, 25 bp, Mus musculus
gacagtgatcgatattcttaacccc

SEQ ID NO: 449186 - DNA, 25 bp, Mus musculus
gacagtgatctcctgtatcgtagcg

SEQ ID NO: 449187 - DNA, 25 bp, Mus musculus
gacagtgatctcgtgtatcgtagcg

SEQ ID NO: 449188 - DNA, 25 bp, Mus musculus
gacagtgatctgaactgaatcctat

SEQ ID NO: 449189 - DNA, 25 bp, Mus musculus
gacagtgatctgctcattctacatg

SEQ ID NO: 449190 - DNA, 25 bp, Mus musculus
gacagtgatctggtcattctacatg

SEQ ID NO: 449191 - DNA, 25 bp, Mus musculus
gacagtgatctgtactgaatcctat

SEQ ID NO: 449192 - DNA, 25 bp, Mus musculus
gacagtgatgctcgcaatatgacca

SEQ ID NO: 449193 - DNA, 25 bp, Mus musculus
gacagtgatgctggcaatatgacca

SEQ ID NO: 449194 - DNA, 25 bp, Mus musculus
gacagtgatggcattgtggcccact

SEQ ID NO: 449195 - DNA, 25 bp, Mus musculus
gacagtgatggctttgtggcccact

SEQ ID NO: 449196 - DNA, 25 bp, Mus musculus
gacagtgattcaacgtcagataatt

SEQ ID NO: 449197 - DNA, 25 bp, Mus musculus
gacagtgattcatcgtcagataatt

SEQ ID NO: 449198 - DNA, 25 bp, Mus musculus
gacagtgattgtcttttccattcat

SEQ ID NO: 449199 - DNA, 25 bp, Mus musculus
gacagtgattgtgttttccattcat

SEQ ID NO: 449200 - DNA, 25 bp, Mus musculus
gacagtgatttcaaactctagcatc

SEQ ID NO: 449201 - DNA, 25 bp, Mus musculus
gacagtgatttctaactctagcatc

SEQ ID NO: 449202 - DNA, 25 bp, Mus musculus
gacagtgcaattactggtaccacag

SEQ ID NO: 449203 - DNA, 25 bp, Mus musculus
gacagtgcaatttctggtaccacag

SEQ ID NO: 449204 - DNA, 25 bp, Mus musculus
gacagtgcacctagacttgtgctag

SEQ ID NO: 449205 - DNA, 25 bp, Mus musculus
gacagtgcaccttgacttgtgctag

SEQ ID NO: 449206 - DNA, 25 bp, Mus musculus
gacagtgcactcagttcaattttaa

SEQ ID NO: 449207 - DNA, 25 bp, Mus musculus
gacagtgcactctgttcaattttaa

SEQ ID NO: 449208 - DNA, 25 bp, Mus musculus
gacagtgcactgcttgtaaattcac

SEQ ID NO: 449209 - DNA, 25 bp, Mus musculus
gacagtgcactggttgtaaattcac

SEQ ID NO: 449210 - DNA, 25 bp, Mus musculus
gacagtgcatgcaatgcttgaccac

SEQ ID NO: 449211 - DNA, 25 bp, Mus musculus
gacagtgcatgctatgcttgaccac

SEQ ID NO: 449212 - DNA, 25 bp, Mus musculus
gacagtgccacacatgtacatgctg

SEQ ID NO: 449213 - DNA, 25 bp, Mus musculus
gacagtgccacagatgtacatgctg

SEQ ID NO: 449214 - DNA, 25 bp, Mus musculus
gacagtgccagcagggtagaccctg

SEQ ID NO: 449215 - DNA, 25 bp, Mus musculus
gacagtgccagctgggtagaccctg

SEQ ID NO: 449216 - DNA, 25 bp, Mus musculus
gacagtgcccacatcaatttgtgtg

SEQ ID NO: 449217 - DNA, 25 bp, Mus musculus
gacagtgcccacttcaatttgtgtg

SEQ ID NO: 449218 - DNA, 25 bp, Mus musculus
gacagtgcctaaccactgggtccaa

SEQ ID NO: 449219 - DNA, 25 bp, Mus musculus
gacagtgcctaagcactgggtccaa

SEQ ID NO: 449220 - DNA, 25 bp, Mus musculus
gacagtgcctgacacgtgttcagta

SEQ ID NO: 449221 - DNA, 25 bp, Mus musculus
gacagtgcctgagacgtgttcagta

SEQ ID NO: 449222 - DNA, 25 bp, Mus musculus
gacagtgcggaaagagttcatcata

SEQ ID NO: 449223 - DNA, 25 bp, Mus musculus
gacagtgcggaatgagttcatcata

SEQ ID NO: 449224 - DNA, 25 bp, Mus musculus
gacagtgcgtttacctttctaatat

SEQ ID NO: 449225 - DNA, 25 bp, Mus musculus
gacagtgcgttttcctttctaatat

SEQ ID NO: 449226 - DNA, 25 bp, Mus musculus
gacagtgctaagagaagcccaacag

SEQ ID NO: 449227 - DNA, 25 bp, Mus musculus
gacagtgctaagcttcagctccgac

SEQ ID NO: 449228 - DNA, 25 bp, Mus musculus
gacagtgctaaggttcagctccgac

SEQ ID NO: 449229 - DNA, 25 bp, Mus musculus
gacagtgctaagtgaagcccaacag

SEQ ID NO: 449230 - DNA, 25 bp, Mus musculus
gacagtgctattatcgtccagtctc

SEQ ID NO: 449231 - DNA, 25 bp, Mus musculus
gacagtgctattttcgtccagtctc

SEQ ID NO: 449232 - DNA, 25 bp, Mus musculus
gacagtgctcacaaacatttgccac

SEQ ID NO: 449233 - DNA, 25 bp, Mus musculus
gacagtgctcactaacatttgccac

SEQ ID NO: 449234 - DNA, 25 bp, Mus musculus
gacagtgctctcagaccttatcaaa

SEQ ID NO: 449235 - DNA, 25 bp, Mus musculus
gacagtgctctctgaccttatcaaa

SEQ ID NO: 449236 - DNA, 25 bp, Mus musculus
gacagtgctctgaaatggaccttac

SEQ ID NO: 449237 - DNA, 25 bp, Mus musculus
gacagtgctctgactcattgccaca

SEQ ID NO: 449238 - DNA, 25 bp, Mus musculus
gacagtgctctgtaatggaccttac

SEQ ID NO: 449239 - DNA, 25 bp, Mus musculus
gacagtgctctgtctcattgccaca

SEQ ID NO: 449240 - DNA, 25 bp, Mus musculus
gacagtgctgatccatcacaaggct

SEQ ID NO: 449241 - DNA, 25 bp, Mus musculus
gacagtgctgatgcatcacaaggct

SEQ ID NO: 449242 - DNA, 25 bp, Mus musculus
gacagtgctgcaagacttttcagtc

SEQ ID NO: 449243 - DNA, 25 bp, Mus musculus
gacagtgctgcatgacttttcagtc

SEQ ID NO: 449244 - DNA, 25 bp, Mus musculus
gacagtgctgctcgacgagtacctt

SEQ ID NO: 449245 - DNA, 25 bp, Mus musculus
gacagtgctgctggacgagtacctt

SEQ ID NO: 449246 - DNA, 25 bp, Mus musculus
gacagtgctggacacacaaccgaga

SEQ ID NO: 449247 - DNA, 25 bp, Mus musculus
gacagtgctggagacacaaccgaga

SEQ ID NO: 449248 - DNA, 25 bp, Mus musculus
gacagtgctggcaatggacccgaaa

SEQ ID NO: 449249 - DNA, 25 bp, Mus musculus
gacagtgctggctatggacccgaaa

SEQ ID NO: 449250 - DNA, 25 bp, Mus musculus
gacagtgcttagaggtagagcgcat

SEQ ID NO: 449251 - DNA, 25 bp, Mus musculus
gacagtgcttagtggtagagcgcat

SEQ ID NO: 449252 - DNA, 25 bp, Mus musculus
gacagtgcttccagaacaattcttg

SEQ ID NO: 449253 - DNA, 25 bp, Mus musculus
gacagtgcttcctgaacaattcttg

SEQ ID NO: 449254 - DNA, 25 bp, Mus musculus
gacagtgcttctcaccggattagaa

SEQ ID NO: 449255 - DNA, 25 bp, Mus musculus
gacagtgcttctcgttcagatcgat

SEQ ID NO: 449256 - DNA, 25 bp, Mus musculus
gacagtgcttctgaccggattagaa

SEQ ID NO: 449257 - DNA, 25 bp, Mus musculus
gacagtgcttctggttcagatcgat

SEQ ID NO: 449258 - DNA, 25 bp, Mus musculus
gacagtgcttgcatggtactccaga

SEQ ID NO: 449259 - DNA, 25 bp, Mus musculus
gacagtgcttgcttggtactccaga

SEQ ID NO: 449260 - DNA, 25 bp, Mus musculus
gacagtggacatagctgctggacca

SEQ ID NO: 449261 - DNA, 25 bp, Mus musculus
gacagtggacatatgccttgcatca

SEQ ID NO: 449262 - DNA, 25 bp, Mus musculus
gacagtggacattgctgctggacca

SEQ ID NO: 449263 - DNA, 25 bp, Mus musculus
gacagtggacatttgccttgcatca

SEQ ID NO: 449264 - DNA, 25 bp, Mus musculus
gacagtggacttatctttcaaatgc

SEQ ID NO: 449265 - DNA, 25 bp, Mus musculus
gacagtggacttttctttcaaatgc

SEQ ID NO: 449266 - DNA, 25 bp, Mus musculus
gacagtggagatagagcctgaactt

SEQ ID NO: 449267 - DNA, 25 bp, Mus musculus
gacagtggagattgagcctgaactt

SEQ ID NO: 449268 - DNA, 25 bp, Mus musculus
gacagtggatcccacagcctgtgcg

SEQ ID NO: 449269 - DNA, 25 bp, Mus musculus
gacagtggatccgacagcctgtgcg

SEQ ID NO: 449270 - DNA, 25 bp, Mus musculus
gacagtggatctccgcaagtgttcc

SEQ ID NO: 449271 - DNA, 25 bp, Mus musculus
gacagtggatctgcgcaagtgttcc

SEQ ID NO: 449272 - DNA, 25 bp, Mus musculus
gacagtggcaacataggatcctgtt

SEQ ID NO: 449273 - DNA, 25 bp, Mus musculus
gacagtggcaacttaggatcctgtt

SEQ ID NO: 449274 - DNA, 25 bp, Mus musculus
gacagtggcactagcatggactctg

SEQ ID NO: 449275 - DNA, 25 bp, Mus musculus
gacagtggcacttgcatggactctg

SEQ ID NO: 449276 - DNA, 25 bp, Mus musculus
gacagtggctgaaatggtcttcaaa

SEQ ID NO: 449277 - DNA, 25 bp, Mus musculus
gacagtggctgatatggtcttcaaa

SEQ ID NO: 449278 - DNA, 25 bp, Mus musculus
gacagtggctggctccttgattaga

SEQ ID NO: 449279 - DNA, 25 bp, Mus musculus
gacagtggctgggtccttgattaga

SEQ ID NO: 449280 - DNA, 25 bp, Mus musculus
gacagtggctttccaggttcagact

SEQ ID NO: 449281 - DNA, 25 bp, Mus musculus
gacagtggctttgcaggttcagact

SEQ ID NO: 449282 - DNA, 25 bp, Mus musculus
gacagtgggccaatccgaaaataat

SEQ ID NO: 449283 - DNA, 25 bp, Mus musculus
gacagtgggccattccgaaaataat

SEQ ID NO: 449284 - DNA, 25 bp, Mus musculus
gacagtgggctaccctcagagagtt

SEQ ID NO: 449285 - DNA, 25 bp, Mus musculus
gacagtgggctagcctcagagagtt

SEQ ID NO: 449286 - DNA, 25 bp, Mus musculus
gacagtggtaacattactcgttgga

SEQ ID NO: 449287 - DNA, 25 bp, Mus musculus
gacagtggtaactttactcgttgga

SEQ ID NO: 449288 - DNA, 25 bp, Mus musculus
gacagtggtatcactttttggtggg

SEQ ID NO: 449289 - DNA, 25 bp, Mus musculus
gacagtggtatctctttttggtggg

SEQ ID NO: 449290 - DNA, 25 bp, Mus musculus
gacagtggtccaacatctcaaaaaa

SEQ ID NO: 449291 - DNA, 25 bp, Mus musculus
gacagtggtccatcatctcaaaaaa

SEQ ID NO: 449292 - DNA, 25 bp, Mus musculus
gacagtggtcctatggtacgttgct

SEQ ID NO: 449293 - DNA, 25 bp, Mus musculus
gacagtggtcctttggtacgttgct

SEQ ID NO: 449294 - DNA, 25 bp, Mus musculus
gacagtggtctcagtgttaaagata

SEQ ID NO: 449295 - DNA, 25 bp, Mus musculus
gacagtggtctctgtgttaaagata

SEQ ID NO: 449296 - DNA, 25 bp, Mus musculus
gacagtggtcttcctaaggctgaca

SEQ ID NO: 449297 - DNA, 25 bp, Mus musculus
gacagtggtcttgctaaggctgaca

SEQ ID NO: 449298 - DNA, 25 bp, Mus musculus
gacagtggtgaccacttcttcattg

SEQ ID NO: 449299 - DNA, 25 bp, Mus musculus
gacagtggtgacgacttcttcattg

SEQ ID NO: 449300 - DNA, 25 bp, Mus musculus
gacagtggtgcactgccagttttgc

SEQ ID NO: 449301 - DNA, 25 bp, Mus musculus
gacagtggtgcagtgccagttttgc

SEQ ID NO: 449302 - DNA, 25 bp, Mus musculus
gacagtggtggtactcgctacccta

SEQ ID NO: 449303 - DNA, 25 bp, Mus musculus
gacagtggtggttctcgctacccta

SEQ ID NO: 449304 - DNA, 25 bp, Mus musculus
gacagtggttcgatacacgttctac

SEQ ID NO: 449305 - DNA, 25 bp, Mus musculus
gacagtggttcgttacacgttctac

SEQ ID NO: 449306 - DNA, 25 bp, Mus musculus
gacagtgtaaaccttcctaacgctt

SEQ ID NO: 449307 - DNA, 25 bp, Mus musculus
gacagtgtaaacgttcctaacgctt

SEQ ID NO: 449308 - DNA, 25 bp, Mus musculus
gacagtgtaacaccagagggccaaa

SEQ ID NO: 449309 - DNA, 25 bp, Mus musculus
gacagtgtaacagcagagggccaaa

SEQ ID NO: 449310 - DNA, 25 bp, Mus musculus
gacagtgtacccatgcttgatctgt

SEQ ID NO: 449311 - DNA, 25 bp, Mus musculus
gacagtgtacccttgcttgatctgt

SEQ ID NO: 449312 - DNA, 25 bp, Mus musculus
gacagtgtacctatccagggtatca

SEQ ID NO: 449313 - DNA, 25 bp, Mus musculus
gacagtgtacctcactatgggcttg

SEQ ID NO: 449314 - DNA, 25 bp, Mus musculus
gacagtgtacctgactatgggcttg

SEQ ID NO: 449315 - DNA, 25 bp, Mus musculus
gacagtgtacctttccagggtatca

SEQ ID NO: 449316 - DNA, 25 bp, Mus musculus
gacagtgtactgatgttcttgcatt

SEQ ID NO: 449317 - DNA, 25 bp, Mus musculus
gacagtgtactgttgttcttgcatt

SEQ ID NO: 449318 - DNA, 25 bp, Mus musculus
gacagtgtacttcacttaccaggga

SEQ ID NO: 449319 - DNA, 25 bp, Mus musculus
gacagtgtacttgacttaccaggga

SEQ ID NO: 449320 - DNA, 25 bp, Mus musculus
gacagtgtagatattcatgtaccta

SEQ ID NO: 449321 - DNA, 25 bp, Mus musculus
gacagtgtagattttcatgtaccta

SEQ ID NO: 449322 - DNA, 25 bp, Mus musculus
gacagtgtaggcaacttttctcata

SEQ ID NO: 449323 - DNA, 25 bp, Mus musculus
gacagtgtaggctacttttctcata

SEQ ID NO: 449324 - DNA, 25 bp, Mus musculus
gacagtgtatgaacattcttgctag

SEQ ID NO: 449325 - DNA, 25 bp, Mus musculus
gacagtgtatgatcattcttgctag

SEQ ID NO: 449326 - DNA, 25 bp, Mus musculus
gacagtgtcacaaagccagatcaag

SEQ ID NO: 449327 - DNA, 25 bp, Mus musculus
gacagtgtcacaatgttctatggct

SEQ ID NO: 449328 - DNA, 25 bp, Mus musculus
gacagtgtcacatagccagatcaag

SEQ ID NO: 449329 - DNA, 25 bp, Mus musculus
gacagtgtcacattgttctatggct

SEQ ID NO: 449330 - DNA, 25 bp, Mus musculus
gacagtgtcaggaagccacatataa

SEQ ID NO: 449331 - DNA, 25 bp, Mus musculus
gacagtgtcaggtagccacatataa

SEQ ID NO: 449332 - DNA, 25 bp, Mus musculus
gacagtgtcattactgcagccaact

SEQ ID NO: 449333 - DNA, 25 bp, Mus musculus
gacagtgtcatttctgcagccaact

SEQ ID NO: 449334 - DNA, 25 bp, Mus musculus
gacagtgtccaactcttcagttaca

SEQ ID NO: 449335 - DNA, 25 bp, Mus musculus
gacagtgtccaagtcttcagttaca

SEQ ID NO: 449336 - DNA, 25 bp, Mus musculus
gacagtgtcccgagtaggtgcccag

SEQ ID NO: 449337 - DNA, 25 bp, Mus musculus
gacagtgtcccgtgtaggtgcccag

SEQ ID NO: 449338 - DNA, 25 bp, Mus musculus
gacagtgtccgtatgttcagtgtga

SEQ ID NO: 449339 - DNA, 25 bp, Mus musculus
gacagtgtccgtctgcccggatgaa

SEQ ID NO: 449340 - DNA, 25 bp, Mus musculus
gacagtgtccgtgtgcccggatgaa

SEQ ID NO: 449341 - DNA, 25 bp, Mus musculus
gacagtgtccgtttgttcagtgtga

SEQ ID NO: 449342 - DNA, 25 bp, Mus musculus
gacagtgtcgttctgaagcaggact

SEQ ID NO: 449343 - DNA, 25 bp, Mus musculus
gacagtgtcgttgtgaagcaggact

SEQ ID NO: 449344 - DNA, 25 bp, Mus musculus
gacagtgtctacagtcgtgtgacat

SEQ ID NO: 449345 - DNA, 25 bp, Mus musculus
gacagtgtctactgtcgtgtgacat

SEQ ID NO: 449346 - DNA, 25 bp, Mus musculus
gacagtgtctccaagctatgtgggc

SEQ ID NO: 449347 - DNA, 25 bp, Mus musculus
gacagtgtctccaagctggctgcag

SEQ ID NO: 449348 - DNA, 25 bp, Mus musculus
gacagtgtctcctagctatgtgggc

SEQ ID NO: 449349 - DNA, 25 bp, Mus musculus
gacagtgtctcctagctggctgcag

SEQ ID NO: 449350 - DNA, 25 bp, Mus musculus
gacagtgtctctccgagttttgccg

SEQ ID NO: 449351 - DNA, 25 bp, Mus musculus
gacagtgtctctgcgagttttgccg

SEQ ID NO: 449352 - DNA, 25 bp, Mus musculus
gacagtgtcttcacaatctctgaaa

SEQ ID NO: 449353 - DNA, 25 bp, Mus musculus
gacagtgtcttctcaatctctgaaa

SEQ ID NO: 449354 - DNA, 25 bp, Mus musculus
gacagtgtgacaacctcgtaagaag

SEQ ID NO: 449355 - DNA, 25 bp, Mus musculus
gacagtgtgacatcctcgtaagaag

SEQ ID NO: 449356 - DNA, 25 bp, Mus musculus
gacagtgtgcctacttagatttgca

SEQ ID NO: 449357 - DNA, 25 bp, Mus musculus
gacagtgtgccttcttagatttgca

SEQ ID NO: 449358 - DNA, 25 bp, Mus musculus
gacagtgtggcccacattccaagga

SEQ ID NO: 449359 - DNA, 25 bp, Mus musculus
gacagtgtggccgacattccaagga

SEQ ID NO: 449360 - DNA, 25 bp, Mus musculus
gacagtgtggtgctttgagcatttt

SEQ ID NO: 449361 - DNA, 25 bp, Mus musculus
gacagtgtggtggtttgagcatttt

SEQ ID NO: 449362 - DNA, 25 bp, Mus musculus
gacagtgtggttcatctgattgact

SEQ ID NO: 449363 - DNA, 25 bp, Mus musculus
gacagtgtggttgatctgattgact

SEQ ID NO: 449364 - DNA, 25 bp, Mus musculus
gacagtgtgtccagcatcatggcct

SEQ ID NO: 449365 - DNA, 25 bp, Mus musculus
gacagtgtgtcctgcatcatggcct

SEQ ID NO: 449366 - DNA, 25 bp, Mus musculus
gacagtgtgtgtacctgataatact

SEQ ID NO: 449367 - DNA, 25 bp, Mus musculus
gacagtgtgtgttcctgataatact

SEQ ID NO: 449368 - DNA, 25 bp, Mus musculus
gacagtgtgtttcattacggaatag

SEQ ID NO: 449369 - DNA, 25 bp, Mus musculus
gacagtgtgtttgattacggaatag

SEQ ID NO: 449370 - DNA, 25 bp, Mus musculus
gacagtgttcaacgtactatcctca

SEQ ID NO: 449371 - DNA, 25 bp, Mus musculus
gacagtgttcaaggtactatcctca

SEQ ID NO: 449372 - DNA, 25 bp, Mus musculus
gacagtgttcagaggcaaagctagt

SEQ ID NO: 449373 - DNA, 25 bp, Mus musculus
gacagtgttcagtggcaaagctagt

SEQ ID NO: 449374 - DNA, 25 bp, Mus musculus
gacagtgttcccaggtgttttggag

SEQ ID NO: 449375 - DNA, 25 bp, Mus musculus
gacagtgttccctggtgttttggag

SEQ ID NO: 449376 - DNA, 25 bp, Mus musculus
gacagtgttgatcttcatatgagca

SEQ ID NO: 449377 - DNA, 25 bp, Mus musculus
gacagtgttgatgttcatatgagca

SEQ ID NO: 449378 - DNA, 25 bp, Mus musculus
gacagtgttgtcatgactggatcct

SEQ ID NO: 449379 - DNA, 25 bp, Mus musculus
gacagtgttgtcttgactggatcct

SEQ ID NO: 449380 - DNA, 25 bp, Mus musculus
gacagtgttgtgagcacttcagcac

SEQ ID NO: 449381 - DNA, 25 bp, Mus musculus
gacagtgttgtgtgcacttcagcac

SEQ ID NO: 449382 - DNA, 25 bp, Mus musculus
gacagtgttgttaacaagaccatat

SEQ ID NO: 449383 - DNA, 25 bp, Mus musculus
gacagtgttgttcgttggctatatc

SEQ ID NO: 449384 - DNA, 25 bp, Mus musculus
gacagtgttgttggttggctatatc

SEQ ID NO: 449385 - DNA, 25 bp, Mus musculus
gacagtgttgtttacaagaccatat

SEQ ID NO: 449386 - DNA, 25 bp, Mus musculus
gacagtgtttatacatcccaactcc

SEQ ID NO: 449387 - DNA, 25 bp, Mus musculus
gacagtgtttattcatcccaactcc

SEQ ID NO: 449388 - DNA, 25 bp, Mus musculus
gacagtgtttccaccgtattagaat

SEQ ID NO: 449389 - DNA, 25 bp, Mus musculus
gacagtgtttcctccgtattagaat

SEQ ID NO: 449390 - DNA, 25 bp, Mus musculus
gacagtgttttaagctctcagatca

SEQ ID NO: 449391 - DNA, 25 bp, Mus musculus
gacagtgttttatgctctcagatca

SEQ ID NO: 449392 - DNA, 25 bp, Mus musculus
gacagttacaatctggaatccacag

SEQ ID NO: 449393 - DNA, 25 bp, Mus musculus
gacagttacaatgtggaatccacag

SEQ ID NO: 449394 - DNA, 25 bp, Mus musculus
gacagttacagtatgcacatgagaa

SEQ ID NO: 449395 - DNA, 25 bp, Mus musculus
gacagttacagtttgcacatgagaa

SEQ ID NO: 449396 - DNA, 25 bp, Mus musculus
gacagttaccaccataaaggcacat

SEQ ID NO: 449397 - DNA, 25 bp, Mus musculus
gacagttaccacgataaaggcacat

SEQ ID NO: 449398 - DNA, 25 bp, Mus musculus
gacagttacctgataagttcctatt

SEQ ID NO: 449399 - DNA, 25 bp, Mus musculus
gacagttacctgttaagttcctatt

SEQ ID NO: 449400 - DNA, 25 bp, Mus musculus
gacagttaggaaagccctcaccttg

SEQ ID NO: 449401 - DNA, 25 bp, Mus musculus
gacagttaggaatgccctcaccttg

SEQ ID NO: 449402 - DNA, 25 bp, Mus musculus
gacagttagggcatcaagaatgatt

SEQ ID NO: 449403 - DNA, 25 bp, Mus musculus
gacagttagggcttcaagaatgatt

SEQ ID NO: 449404 - DNA, 25 bp, Mus musculus
gacagttatatacaccgctttagca

SEQ ID NO: 449405 - DNA, 25 bp, Mus musculus
gacagttatatagaccgctttagca

SEQ ID NO: 449406 - DNA, 25 bp, Mus musculus
gacagttatcatcctggaagccaga

SEQ ID NO: 449407 - DNA, 25 bp, Mus musculus
gacagttatcatgctggaagccaga

SEQ ID NO: 449408 - DNA, 25 bp, Mus musculus
gacagttatctccattagggatgtt

SEQ ID NO: 449409 - DNA, 25 bp, Mus musculus
gacagttatctcgattagggatgtt

SEQ ID NO: 449410 - DNA, 25 bp, Mus musculus
gacagttattagatggccacgtgga

SEQ ID NO: 449411 - DNA, 25 bp, Mus musculus
gacagttattagttggccacgtgga

SEQ ID NO: 449412 - DNA, 25 bp, Mus musculus
gacagttcaaatagtcccacgtcac

SEQ ID NO: 449413 - DNA, 25 bp, Mus musculus
gacagttcaaattgtcccacgtcac

SEQ ID NO: 449414 - DNA, 25 bp, Mus musculus
gacagttcagaaagggttagctctt

SEQ ID NO: 449415 - DNA, 25 bp, Mus musculus
gacagttcagaatgggttagctctt

SEQ ID NO: 449416 - DNA, 25 bp, Mus musculus
gacagttcaggacatcagatggcca

SEQ ID NO: 449417 - DNA, 25 bp, Mus musculus
gacagttcaggagatcagatggcca

SEQ ID NO: 449418 - DNA, 25 bp, Mus musculus
gacagttcatgtccaagctctgcca

SEQ ID NO: 449419 - DNA, 25 bp, Mus musculus
gacagttcatgtgcaagctctgcca

SEQ ID NO: 449420 - DNA, 25 bp, Mus musculus
gacagttcattaatcacagcttaga

SEQ ID NO: 449421 - DNA, 25 bp, Mus musculus
gacagttcattattcacagcttaga

SEQ ID NO: 449422 - DNA, 25 bp, Mus musculus
gacagttccagacagtatcatcacc

SEQ ID NO: 449423 - DNA, 25 bp, Mus musculus
gacagttccagagagtatcatcacc

SEQ ID NO: 449424 - DNA, 25 bp, Mus musculus
gacagttccatgagaccggctgaag

SEQ ID NO: 449425 - DNA, 25 bp, Mus musculus
gacagttccatgtgaccggctgaag

SEQ ID NO: 449426 - DNA, 25 bp, Mus musculus
gacagttccctgatgatgtgtgcaa

SEQ ID NO: 449427 - DNA, 25 bp, Mus musculus
gacagttccctgttgatgtgtgcaa

SEQ ID NO: 449428 - DNA, 25 bp, Mus musculus
gacagttccgagaccttctatagaa

SEQ ID NO: 449429 - DNA, 25 bp, Mus musculus
gacagttccgagtccttctatagaa

SEQ ID NO: 449430 - DNA, 25 bp, Mus musculus
gacagttcctgcctgaggcaaagcg

SEQ ID NO: 449431 - DNA, 25 bp, Mus musculus
gacagttcctgcgtgaggcaaagcg

SEQ ID NO: 449432 - DNA, 25 bp, Mus musculus
gacagttccttaagtgccacaggtg

SEQ ID NO: 449433 - DNA, 25 bp, Mus musculus
gacagttccttaatttattgcagaa

SEQ ID NO: 449434 - DNA, 25 bp, Mus musculus
gacagttccttatgtgccacaggtg

SEQ ID NO: 449435 - DNA, 25 bp, Mus musculus
gacagttccttattttattgcagaa

SEQ ID NO: 449436 - DNA, 25 bp, Mus musculus
gacagttccttcattgaggtctcat

SEQ ID NO: 449437 - DNA, 25 bp, Mus musculus
gacagttccttctttgaggtctcat

SEQ ID NO: 449438 - DNA, 25 bp, Mus musculus
gacagttctaatcgcctgcacagat

SEQ ID NO: 449439 - DNA, 25 bp, Mus musculus
gacagttctaatggcctgcacagat

SEQ ID NO: 449440 - DNA, 25 bp, Mus musculus
gacagttctactataaatactacag

SEQ ID NO: 449441 - DNA, 25 bp, Mus musculus
gacagttctactttaaatactacag

SEQ ID NO: 449442 - DNA, 25 bp, Mus musculus
gacagttctatacctagctcctttt

SEQ ID NO: 449443 - DNA, 25 bp, Mus musculus
gacagttctatagctagctcctttt

SEQ ID NO: 449444 - DNA, 25 bp, Mus musculus
gacagttctctactcttatttattg

SEQ ID NO: 449445 - DNA, 25 bp, Mus musculus
gacagttctctagtcttatttattg

SEQ ID NO: 449446 - DNA, 25 bp, Mus musculus
gacagttctggcaccagactacatg

SEQ ID NO: 449447 - DNA, 25 bp, Mus musculus
gacagttctggctccagactacatg

SEQ ID NO: 449448 - DNA, 25 bp, Mus musculus
gacagttctgtccagctgaggtact

SEQ ID NO: 449449 - DNA, 25 bp, Mus musculus
gacagttctgtcgagctgaggtact

SEQ ID NO: 449450 - DNA, 25 bp, Mus musculus
gacagttcttaccaggacacaggct

SEQ ID NO: 449451 - DNA, 25 bp, Mus musculus
gacagttcttacgaggacacaggct

SEQ ID NO: 449452 - DNA, 25 bp, Mus musculus
gacagttcttcccacagcgacagtt

SEQ ID NO: 449453 - DNA, 25 bp, Mus musculus
gacagttcttccgacagcgacagtt

SEQ ID NO: 449454 - DNA, 25 bp, Mus musculus
gacagttcttggaatttttcacaca

SEQ ID NO: 449455 - DNA, 25 bp, Mus musculus
gacagttcttggtatttttcacaca

SEQ ID NO: 449456 - DNA, 25 bp, Mus musculus
gacagttctttgcaatgctcccatt

SEQ ID NO: 449457 - DNA, 25 bp, Mus musculus
gacagttctttggaatgctcccatt

SEQ ID NO: 449458 - DNA, 25 bp, Mus musculus
gacagttgagaaaacgctccggagt

SEQ ID NO: 449459 - DNA, 25 bp, Mus musculus
gacagttgagaatacgctccggagt

SEQ ID NO: 449460 - DNA, 25 bp, Mus musculus
gacagttgatgtcgctgcttctact

SEQ ID NO: 449461 - DNA, 25 bp, Mus musculus
gacagttgatgtggctgcttctact

SEQ ID NO: 449462 - DNA, 25 bp, Mus musculus
gacagttgcaaaaccccgtagtctt

SEQ ID NO: 449463 - DNA, 25 bp, Mus musculus
gacagttgcaaatccccgtagtctt

SEQ ID NO: 449464 - DNA, 25 bp, Mus musculus
gacagttgcataatggcagcacaca

SEQ ID NO: 449465 - DNA, 25 bp, Mus musculus
gacagttgcatattggcagcacaca

SEQ ID NO: 449466 - DNA, 25 bp, Mus musculus
gacagttgctccaccaaaggtgcag

SEQ ID NO: 449467 - DNA, 25 bp, Mus musculus
gacagttgctcctccaaaggtgcag

SEQ ID NO: 449468 - DNA, 25 bp, Mus musculus
gacagttgctgaaaggaggtccaat

SEQ ID NO: 449469 - DNA, 25 bp, Mus musculus
gacagttgctgaatgctaacctaga

SEQ ID NO: 449470 - DNA, 25 bp, Mus musculus
gacagttgctgaccaggtgctagta

SEQ ID NO: 449471 - DNA, 25 bp, Mus musculus
gacagttgctgagcaggtgctagta

SEQ ID NO: 449472 - DNA, 25 bp, Mus musculus
gacagttgctgataggaggtccaat

SEQ ID NO: 449473 - DNA, 25 bp, Mus musculus
gacagttgctgattgctaacctaga

SEQ ID NO: 449474 - DNA, 25 bp, Mus musculus
gacagttgctgtacctgcaatcggc

SEQ ID NO: 449475 - DNA, 25 bp, Mus musculus
gacagttgctgttcctgcaatcggc

SEQ ID NO: 449476 - DNA, 25 bp, Mus musculus
gacagttgcttaaatgttaggctgc

SEQ ID NO: 449477 - DNA, 25 bp, Mus musculus
gacagttgcttacagcaggtggcat

SEQ ID NO: 449478 - DNA, 25 bp, Mus musculus
gacagttgcttagagcaggtggcat

SEQ ID NO: 449479 - DNA, 25 bp, Mus musculus
gacagttgcttatatgttaggctgc

SEQ ID NO: 449480 - DNA, 25 bp, Mus musculus
gacagttggaacatttgtttacact

SEQ ID NO: 449481 - DNA, 25 bp, Mus musculus
gacagttggaacttttgtttacact

SEQ ID NO: 449482 - DNA, 25 bp, Mus musculus
gacagttggactacaatccctaaga

SEQ ID NO: 449483 - DNA, 25 bp, Mus musculus
gacagttggacttcaatccctaaga

SEQ ID NO: 449484 - DNA, 25 bp, Mus musculus
gacagttggatcctccctctggaca

SEQ ID NO: 449485 - DNA, 25 bp, Mus musculus
gacagttggatcgtccctctggaca

SEQ ID NO: 449486 - DNA, 25 bp, Mus musculus
gacagttggcaacatattttatggt

SEQ ID NO: 449487 - DNA, 25 bp, Mus musculus
gacagttggcaaccgacctaagtga

SEQ ID NO: 449488 - DNA, 25 bp, Mus musculus
gacagttggcaagatattttatggt

SEQ ID NO: 449489 - DNA, 25 bp, Mus musculus
gacagttggcaagcgacctaagtga

SEQ ID NO: 449490 - DNA, 25 bp, Mus musculus
gacagttggcatatcagatgtgatt

SEQ ID NO: 449491 - DNA, 25 bp, Mus musculus
gacagttggcatttcagatgtgatt

SEQ ID NO: 449492 - DNA, 25 bp, Mus musculus
gacagttggcgcaggcccacctcga

SEQ ID NO: 449493 - DNA, 25 bp, Mus musculus
gacagttggcgctggcccacctcga

SEQ ID NO: 449494 - DNA, 25 bp, Mus musculus
gacagttggcttattcttaccaagc

SEQ ID NO: 449495 - DNA, 25 bp, Mus musculus
gacagttggctttttcttaccaagc

SEQ ID NO: 449496 - DNA, 25 bp, Mus musculus
gacagttgtaacacaagataacata

SEQ ID NO: 449497 - DNA, 25 bp, Mus musculus
gacagttgtaactcaagataacata

SEQ ID NO: 449498 - DNA, 25 bp, Mus musculus
gacagttgtactacacattgtttgt

SEQ ID NO: 449499 - DNA, 25 bp, Mus musculus
gacagttgtacttcacattgtttgt

SEQ ID NO: 449500 - DNA, 25 bp, Mus musculus
gacagttgtatacggcagttcacta

SEQ ID NO: 449501 - DNA, 25 bp, Mus musculus
gacagttgtatagggcagttcacta

SEQ ID NO: 449502 - DNA, 25 bp, Mus musculus
gacagttgtcacacagcatagctaa

SEQ ID NO: 449503 - DNA, 25 bp, Mus musculus
gacagttgtcactcagcatagctaa

SEQ ID NO: 449504 - DNA, 25 bp, Mus musculus
gacagttgtgctcagcctggcatca

SEQ ID NO: 449505 - DNA, 25 bp, Mus musculus
gacagttgtgctgagcctggcatca

SEQ ID NO: 449506 - DNA, 25 bp, Mus musculus
gacagttgtgttaatgataacctcg

SEQ ID NO: 449507 - DNA, 25 bp, Mus musculus
gacagttgtgtttatgataacctcg

SEQ ID NO: 449508 - DNA, 25 bp, Mus musculus
gacagttgttccctagggcggaact

SEQ ID NO: 449509 - DNA, 25 bp, Mus musculus
gacagttgttccgtagggcggaact

SEQ ID NO: 449510 - DNA, 25 bp, Mus musculus
gacagttgttggctatggtacttac

SEQ ID NO: 449511 - DNA, 25 bp, Mus musculus
gacagttgttgggtatggtacttac

SEQ ID NO: 449512 - DNA, 25 bp, Mus musculus
gacagttgttgtcatcagctggctt

SEQ ID NO: 449513 - DNA, 25 bp, Mus musculus
gacagttgttgtgatcagctggctt

SEQ ID NO: 449514 - DNA, 25 bp, Mus musculus
gacagttgtttcaagcctcattcat

SEQ ID NO: 449515 - DNA, 25 bp, Mus musculus
gacagttgtttctagcctcattcat

SEQ ID NO: 449516 - DNA, 25 bp, Mus musculus
gacagtttaactcaattcatgcttc

SEQ ID NO: 449517 - DNA, 25 bp, Mus musculus
gacagtttaactccttttgaaaaat

SEQ ID NO: 449518 - DNA, 25 bp, Mus musculus
gacagtttaactgaattcatgcttc

SEQ ID NO: 449519 - DNA, 25 bp, Mus musculus
gacagtttaactgcttttgaaaaat

SEQ ID NO: 449520 - DNA, 25 bp, Mus musculus
gacagtttactccagataccacgta

SEQ ID NO: 449521 - DNA, 25 bp, Mus musculus
gacagtttactcgagataccacgta

SEQ ID NO: 449522 - DNA, 25 bp, Mus musculus
gacagtttacttctttactccagtg

SEQ ID NO: 449523 - DNA, 25 bp, Mus musculus
gacagtttacttgtttactccagtg

SEQ ID NO: 449524 - DNA, 25 bp, Mus musculus
gacagtttaggtcacatctcaggga

SEQ ID NO: 449525 - DNA, 25 bp, Mus musculus
gacagtttaggtgacatctcaggga

SEQ ID NO: 449526 - DNA, 25 bp, Mus musculus
gacagtttataccagttttgcacca

SEQ ID NO: 449527 - DNA, 25 bp, Mus musculus
gacagtttatacgagttttgcacca

SEQ ID NO: 449528 - DNA, 25 bp, Mus musculus
gacagtttatccaatttacacatga

SEQ ID NO: 449529 - DNA, 25 bp, Mus musculus
gacagtttatcctatttacacatga

SEQ ID NO: 449530 - DNA, 25 bp, Mus musculus
gacagtttatttcctgttgctcagt

SEQ ID NO: 449531 - DNA, 25 bp, Mus musculus
gacagtttatttgctgttgctcagt

SEQ ID NO: 449532 - DNA, 25 bp, Mus musculus
gacagtttccatatattaacccagt

SEQ ID NO: 449533 - DNA, 25 bp, Mus musculus
gacagtttccatcacatacctggtg

SEQ ID NO: 449534 - DNA, 25 bp, Mus musculus
gacagtttccatgacatacctggtg

SEQ ID NO: 449535 - DNA, 25 bp, Mus musculus
gacagtttccatttattaacccagt

SEQ ID NO: 449536 - DNA, 25 bp, Mus musculus
gacagtttcctgcccgtcgacatcc

SEQ ID NO: 449537 - DNA, 25 bp, Mus musculus
gacagtttcctggccgtcgacatcc

SEQ ID NO: 449538 - DNA, 25 bp, Mus musculus
gacagtttccttcttagttacgact

SEQ ID NO: 449539 - DNA, 25 bp, Mus musculus
gacagtttccttgttagttacgact

SEQ ID NO: 449540 - DNA, 25 bp, Mus musculus
gacagtttcgtgaaactcccaggaa

SEQ ID NO: 449541 - DNA, 25 bp, Mus musculus
gacagtttcgtgtaactcccaggaa

SEQ ID NO: 449542 - DNA, 25 bp, Mus musculus
gacagtttctacctggagatgatcc

SEQ ID NO: 449543 - DNA, 25 bp, Mus musculus
gacagtttctacgtggagatgatcc

SEQ ID NO: 449544 - DNA, 25 bp, Mus musculus
gacagtttctatcagtctctaacaa

SEQ ID NO: 449545 - DNA, 25 bp, Mus musculus
gacagtttctatgagtctctaacaa

SEQ ID NO: 449546 - DNA, 25 bp, Mus musculus
gacagtttctccaggtgatctctag

SEQ ID NO: 449547 - DNA, 25 bp, Mus musculus
gacagtttctcctggtgatctctag

SEQ ID NO: 449548 - DNA, 25 bp, Mus musculus
gacagtttctgaactccatagttta

SEQ ID NO: 449549 - DNA, 25 bp, Mus musculus
gacagtttctgacactggtaccttc

SEQ ID NO: 449550 - DNA, 25 bp, Mus musculus
gacagtttctgagactggtaccttc

SEQ ID NO: 449551 - DNA, 25 bp, Mus musculus
gacagtttctgatctccatagttta

SEQ ID NO: 449552 - DNA, 25 bp, Mus musculus
gacagtttctgtcaatgacgacaac

SEQ ID NO: 449553 - DNA, 25 bp, Mus musculus
gacagtttctgtgaatgacgacaac

SEQ ID NO: 449554 - DNA, 25 bp, Mus musculus
gacagtttgcttccctattcttcta

SEQ ID NO: 449555 - DNA, 25 bp, Mus musculus
gacagtttgcttgcctattcttcta

SEQ ID NO: 449556 - DNA, 25 bp, Mus musculus
gacagtttggaaatttgggtgctat

SEQ ID NO: 449557 - DNA, 25 bp, Mus musculus
gacagtttggaattttgggtgctat

SEQ ID NO: 449558 - DNA, 25 bp, Mus musculus
gacagtttgggcagcgacagctcca

SEQ ID NO: 449559 - DNA, 25 bp, Mus musculus
gacagtttgggctgcgacagctcca

SEQ ID NO: 449560 - DNA, 25 bp, Mus musculus
gacagtttgtgaccgtctgttctca

SEQ ID NO: 449561 - DNA, 25 bp, Mus musculus
gacagtttgtgagcgtctgttctca

SEQ ID NO: 449562 - DNA, 25 bp, Mus musculus
gacagttttaacactttgacagctg

SEQ ID NO: 449563 - DNA, 25 bp, Mus musculus
gacagttttaactctttgacagctg

SEQ ID NO: 449564 - DNA, 25 bp, Mus musculus
gacagttttcagaaagacatcacat

SEQ ID NO: 449565 - DNA, 25 bp, Mus musculus
gacagttttcagtaagacatcacat

SEQ ID NO: 449566 - DNA, 25 bp, Mus musculus
gacagttttccaagacactgcttca

SEQ ID NO: 449567 - DNA, 25 bp, Mus musculus
gacagttttccatgacactgcttca

SEQ ID NO: 449568 - DNA, 25 bp, Mus musculus
gacagttttcccagaggactcctga

SEQ ID NO: 449569 - DNA, 25 bp, Mus musculus
gacagttttccctgaggactcctga

SEQ ID NO: 449570 - DNA, 25 bp, Mus musculus
gacagttttctacagcggttcctag

SEQ ID NO: 449571 - DNA, 25 bp, Mus musculus
gacagttttctagagcggttcctag

SEQ ID NO: 449572 - DNA, 25 bp, Mus musculus
gacagttttgcacaggttcttgaaa

SEQ ID NO: 449573 - DNA, 25 bp, Mus musculus
gacagttttgcagaggttcttgaaa

SEQ ID NO: 449574 - DNA, 25 bp, Mus musculus
gacagttttgtcatttctaatcctt

SEQ ID NO: 449575 - DNA, 25 bp, Mus musculus
gacagttttgtccttgttgaaattt

SEQ ID NO: 449576 - DNA, 25 bp, Mus musculus
gacagttttgtcgttgttgaaattt

SEQ ID NO: 449577 - DNA, 25 bp, Mus musculus
gacagttttgtcttttctaatcctt

SEQ ID NO: 449578 - DNA, 25 bp, Mus musculus
gacagtttttataacaccacgttgt

SEQ ID NO: 449579 - DNA, 25 bp, Mus musculus
gacagtttttattacaccacgttgt

SEQ ID NO: 449580 - DNA, 25 bp, Mus musculus
gacagtttttgtaatcatgatgaca

SEQ ID NO: 449581 - DNA, 25 bp, Mus musculus
gacagtttttgttatcatgatgaca

SEQ ID NO: 449582 - DNA, 25 bp, Mus musculus
gacataaaacctatggctagctcat

SEQ ID NO: 449583 - DNA, 25 bp, Mus musculus
gacataaaacctttggctagctcat

SEQ ID NO: 449584 - DNA, 25 bp, Mus musculus
gacataaaagatctgttccctcctc

SEQ ID NO: 449585 - DNA, 25 bp, Mus musculus
gacataaaagatgtgttccctcctc

SEQ ID NO: 449586 - DNA, 25 bp, Mus musculus
gacataaaagtgaatggcccttcct

SEQ ID NO: 449587 - DNA, 25 bp, Mus musculus
gacataaaagtgtatggcccttcct

SEQ ID NO: 449588 - DNA, 25 bp, Mus musculus
gacataaaatgcatcctccttatct

SEQ ID NO: 449589 - DNA, 25 bp, Mus musculus
gacataaaatgcttcctccttatct

SEQ ID NO: 449590 - DNA, 25 bp, Mus musculus
gacataaacgcccacgatggtcagg

SEQ ID NO: 449591 - DNA, 25 bp, Mus musculus
gacataaacgccgacgatggtcagg

SEQ ID NO: 449592 - DNA, 25 bp, Mus musculus
gacataaacttaccaggaatccact

SEQ ID NO: 449593 - DNA, 25 bp, Mus musculus
gacataaacttagcaggaatccact

SEQ ID NO: 449594 - DNA, 25 bp, Mus musculus
gacataaagctacttatcacacacc

SEQ ID NO: 449595 - DNA, 25 bp, Mus musculus
gacataaagctagttatcacacacc

SEQ ID NO: 449596 - DNA, 25 bp, Mus musculus
gacataaatagtagccagcatacca

SEQ ID NO: 449597 - DNA, 25 bp, Mus musculus
gacataaatagtcctgttggtgcac

SEQ ID NO: 449598 - DNA, 25 bp, Mus musculus
gacataaatagtgctgttggtgcac

SEQ ID NO: 449599 - DNA, 25 bp, Mus musculus
gacataaatagttgccagcatacca

SEQ ID NO: 449600 - DNA, 25 bp, Mus musculus
gacataaatattacatcacagatcc

SEQ ID NO: 449601 - DNA, 25 bp, Mus musculus
gacataaatatttcatcacagatcc

SEQ ID NO: 449602 - DNA, 25 bp, Mus musculus
gacataaatccaactgtaatatatt

SEQ ID NO: 449603 - DNA, 25 bp, Mus musculus
gacataaatccatctgtaatatatt

SEQ ID NO: 449604 - DNA, 25 bp, Mus musculus
gacataaatgaaaggctgttttgct

SEQ ID NO: 449605 - DNA, 25 bp, Mus musculus
gacataaatgaatggctgttttgct

SEQ ID NO: 449606 - DNA, 25 bp, Mus musculus
gacataacattaactgctccttggc

SEQ ID NO: 449607 - DNA, 25 bp, Mus musculus
gacataacattatctgctccttggc

SEQ ID NO: 449608 - DNA, 25 bp, Mus musculus
gacataaccacacagccagctgatg

SEQ ID NO: 449609 - DNA, 25 bp, Mus musculus
gacataaccacagagccagctgatg

SEQ ID NO: 449610 - DNA, 25 bp, Mus musculus
gacataacgctgctccatgggaatt

SEQ ID NO: 449611 - DNA, 25 bp, Mus musculus
gacataacgctggtccatgggaatt

SEQ ID NO: 449612 - DNA, 25 bp, Mus musculus
gacataacggcaaatgacattcagc

SEQ ID NO: 449613 - DNA, 25 bp, Mus musculus
gacataacggcatatgacattcagc

SEQ ID NO: 449614 - DNA, 25 bp, Mus musculus
gacataactattcatgccaacccat

SEQ ID NO: 449615 - DNA, 25 bp, Mus musculus
gacataactattgatgccaacccat

SEQ ID NO: 449616 - DNA, 25 bp, Mus musculus
gacataactcatcattccccagaaa

SEQ ID NO: 449617 - DNA, 25 bp, Mus musculus
gacataactcatgattccccagaaa

SEQ ID NO: 449618 - DNA, 25 bp, Mus musculus
gacataactgaaagtttcctggcca

SEQ ID NO: 449619 - DNA, 25 bp, Mus musculus
gacataactgaatgtttcctggcca

SEQ ID NO: 449620 - DNA, 25 bp, Mus musculus
gacataacttcgctacatgcctttg

SEQ ID NO: 449621 - DNA, 25 bp, Mus musculus
gacataacttcggtacatgcctttg

SEQ ID NO: 449622 - DNA, 25 bp, Mus musculus
gacataacttctagcaagcttagag

SEQ ID NO: 449623 - DNA, 25 bp, Mus musculus
gacataacttcttgcaagcttagag

SEQ ID NO: 449624 - DNA, 25 bp, Mus musculus
gacataagaataccattttccaggg

SEQ ID NO: 449625 - DNA, 25 bp, Mus musculus
gacataagaatagcattttccaggg

SEQ ID NO: 449626 - DNA, 25 bp, Mus musculus
gacataagacagatgacctgttcct

SEQ ID NO: 449627 - DNA, 25 bp, Mus musculus
gacataagacagttgacctgttcct

SEQ ID NO: 449628 - DNA, 25 bp, Mus musculus
gacataaggaatcgcgaccccagca

SEQ ID NO: 449629 - DNA, 25 bp, Mus musculus
gacataaggaatggcgaccccagca

SEQ ID NO: 449630 - DNA, 25 bp, Mus musculus
gacataaggactctttggaaaactt

SEQ ID NO: 449631 - DNA, 25 bp, Mus musculus
gacataaggactgtttggaaaactt

SEQ ID NO: 449632 - DNA, 25 bp, Mus musculus
gacataagtggtattggtcatgcta

SEQ ID NO: 449633 - DNA, 25 bp, Mus musculus
gacataagtggttttggtcatgcta

SEQ ID NO: 449634 - DNA, 25 bp, Mus musculus
gacataagttttacccttgaaatag

SEQ ID NO: 449635 - DNA, 25 bp, Mus musculus
gacataagtttttcccttgaaatag

SEQ ID NO: 449636 - DNA, 25 bp, Mus musculus
gacataatacacactggatttccaa

SEQ ID NO: 449637 - DNA, 25 bp, Mus musculus
gacataatacactctggatttccaa

SEQ ID NO: 449638 - DNA, 25 bp, Mus musculus
gacataatagcactttcacaaaatg

SEQ ID NO: 449639 - DNA, 25 bp, Mus musculus
gacataatagcagtttcacaaaatg

SEQ ID NO: 449640 - DNA, 25 bp, Mus musculus
gacataatcacacccaatccttgga

SEQ ID NO: 449641 - DNA, 25 bp, Mus musculus
gacataatcacagccaatccttgga

SEQ ID NO: 449642 - DNA, 25 bp, Mus musculus
gacataatcatactgttttctcaaa

SEQ ID NO: 449643 - DNA, 25 bp, Mus musculus
gacataatcatagtgttttctcaaa

SEQ ID NO: 449644 - DNA, 25 bp, Mus musculus
gacataatcatccagcctcatgcca

SEQ ID NO: 449645 - DNA, 25 bp, Mus musculus
gacataatcatcgagcctcatgcca

SEQ ID NO: 449646 - DNA, 25 bp, Mus musculus
gacataatcattcaagctgcccctg

SEQ ID NO: 449647 - DNA, 25 bp, Mus musculus
gacataatcattgaagctgcccctg

SEQ ID NO: 449648 - DNA, 25 bp, Mus musculus
gacataatgcggcacaaactcttga

SEQ ID NO: 449649 - DNA, 25 bp, Mus musculus
gacataatgcgggacaaactcttga

SEQ ID NO: 449650 - DNA, 25 bp, Mus musculus
gacataatggaacgcgttacccctt

SEQ ID NO: 449651 - DNA, 25 bp, Mus musculus
gacataatggaaggcgttacccctt

SEQ ID NO: 449652 - DNA, 25 bp, Mus musculus
gacataattatgctaacagactgag

SEQ ID NO: 449653 - DNA, 25 bp, Mus musculus
gacataattatggtaacagactgag

SEQ ID NO: 449654 - DNA, 25 bp, Mus musculus
gacataattctgacaaccagggtct

SEQ ID NO: 449655 - DNA, 25 bp, Mus musculus
gacataattctgtcaaccagggtct

SEQ ID NO: 449656 - DNA, 25 bp, Mus musculus
gacataattttccatagctgacact

SEQ ID NO: 449657 - DNA, 25 bp, Mus musculus
gacataattttcgatagctgacact

SEQ ID NO: 449658 - DNA, 25 bp, Mus musculus
gacatacaaatacgcagacacttat

SEQ ID NO: 449659 - DNA, 25 bp, Mus musculus
gacatacaaataggcagacacttat

SEQ ID NO: 449660 - DNA, 25 bp, Mus musculus
gacatacaaccaagggcattagaaa

SEQ ID NO: 449661 - DNA, 25 bp, Mus musculus
gacatacaaccatgggcattagaaa

SEQ ID NO: 449662 - DNA, 25 bp, Mus musculus
gacatacaactgctttctggactgt

SEQ ID NO: 449663 - DNA, 25 bp, Mus musculus
gacatacaactggtttctggactgt

SEQ ID NO: 449664 - DNA, 25 bp, Mus musculus
gacatacacatgctgctcacgtata

SEQ ID NO: 449665 - DNA, 25 bp, Mus musculus
gacatacacatggtgctcacgtata

SEQ ID NO: 449666 - DNA, 25 bp, Mus musculus
gacatacaccatatagacctccagg

SEQ ID NO: 449667 - DNA, 25 bp, Mus musculus
gacatacaccatttagacctccagg

SEQ ID NO: 449668 - DNA, 25 bp, Mus musculus
gacatacacctacatctccagataa

SEQ ID NO: 449669 - DNA, 25 bp, Mus musculus
gacatacacctagatctccagataa

SEQ ID NO: 449670 - DNA, 25 bp, Mus musculus
gacatacactctacggtctgagtca

SEQ ID NO: 449671 - DNA, 25 bp, Mus musculus
gacatacactcttcggtctgagtca

SEQ ID NO: 449672 - DNA, 25 bp, Mus musculus
gacatacacttcagattcttgttta

SEQ ID NO: 449673 - DNA, 25 bp, Mus musculus
gacatacacttctgattcttgttta

SEQ ID NO: 449674 - DNA, 25 bp, Mus musculus
gacatacagtacctgttcttcctta

SEQ ID NO: 449675 - DNA, 25 bp, Mus musculus
gacatacagtacgtgttcttcctta

SEQ ID NO: 449676 - DNA, 25 bp, Mus musculus
gacatacagtgtagagagatactta

SEQ ID NO: 449677 - DNA, 25 bp, Mus musculus
gacatacagtgttgagagatactta

SEQ ID NO: 449678 - DNA, 25 bp, Mus musculus
gacatacagttaaggttctctcttt

SEQ ID NO: 449679 - DNA, 25 bp, Mus musculus
gacatacagttatggttctctcttt

SEQ ID NO: 449680 - DNA, 25 bp, Mus musculus
gacatacatcaaatctgcctttaga

SEQ ID NO: 449681 - DNA, 25 bp, Mus musculus
gacatacatcaattctgcctttaga

SEQ ID NO: 449682 - DNA, 25 bp, Mus musculus
gacatacatcccctgctaaacttgg

SEQ ID NO: 449683 - DNA, 25 bp, Mus musculus
gacatacatcccgtgctaaacttgg

SEQ ID NO: 449684 - DNA, 25 bp, Mus musculus
gacatacatcctaatataattctcc

SEQ ID NO: 449685 - DNA, 25 bp, Mus musculus
gacatacatccttatataattctcc

SEQ ID NO: 449686 - DNA, 25 bp, Mus musculus
gacatacatggaccacacacactga

SEQ ID NO: 449687 - DNA, 25 bp, Mus musculus
gacatacatggagcacacacactga

SEQ ID NO: 449688 - DNA, 25 bp, Mus musculus
gacatacatggcatgcaggaaaaat

SEQ ID NO: 449689 - DNA, 25 bp, Mus musculus
gacatacatggcttgcaggaaaaat

SEQ ID NO: 449690 - DNA, 25 bp, Mus musculus
gacatacattaaaaacctggatcgg

SEQ ID NO: 449691 - DNA, 25 bp, Mus musculus
gacatacattaataacctggatcgg

SEQ ID NO: 449692 - DNA, 25 bp, Mus musculus
gacatacattttcacggtacttcat

SEQ ID NO: 449693 - DNA, 25 bp, Mus musculus
gacatacattttgacggtacttcat

SEQ ID NO: 449694 - DNA, 25 bp, Mus musculus
gacataccacgaagcattgcaatat

SEQ ID NO: 449695 - DNA, 25 bp, Mus musculus
gacataccacgatgcattgcaatat

SEQ ID NO: 449696 - DNA, 25 bp, Mus musculus
gacataccacttcagagggacccag

SEQ ID NO: 449697 - DNA, 25 bp, Mus musculus
gacataccacttgagagggacccag

SEQ ID NO: 449698 - DNA, 25 bp, Mus musculus
gacataccagcaactgagcagttaa

SEQ ID NO: 449699 - DNA, 25 bp, Mus musculus
gacataccagcatctgagcagttaa

SEQ ID NO: 449700 - DNA, 25 bp, Mus musculus
gacataccaggcacgattacaacag

SEQ ID NO: 449701 - DNA, 25 bp, Mus musculus
gacataccaggctcgattacaacag

SEQ ID NO: 449702 - DNA, 25 bp, Mus musculus
gacatacccactatgtctttggcat

SEQ ID NO: 449703 - DNA, 25 bp, Mus musculus
gacatacccactttgtctttggcat

SEQ ID NO: 449704 - DNA, 25 bp, Mus musculus
gacatacccattaattcctgcatga

SEQ ID NO: 449705 - DNA, 25 bp, Mus musculus
gacatacccatttattcctgcatga

SEQ ID NO: 449706 - DNA, 25 bp, Mus musculus
gacataccccttaacaaatcactat

SEQ ID NO: 449707 - DNA, 25 bp, Mus musculus
gacatacccctttacaaatcactat

SEQ ID NO: 449708 - DNA, 25 bp, Mus musculus
gacataccctatctctccgttctat

SEQ ID NO: 449709 - DNA, 25 bp, Mus musculus
gacataccctatgtctccgttctat

SEQ ID NO: 449710 - DNA, 25 bp, Mus musculus
gacatacctacaagctgaggccgaa

SEQ ID NO: 449711 - DNA, 25 bp, Mus musculus
gacatacctacatgctgaggccgaa

SEQ ID NO: 449712 - DNA, 25 bp, Mus musculus
gacataccttaaaatgtgtgcctgt

SEQ ID NO: 449713 - DNA, 25 bp, Mus musculus
gacataccttaatatgtgtgcctgt

SEQ ID NO: 449714 - DNA, 25 bp, Mus musculus
gacataccttgcatgcttccaaata

SEQ ID NO: 449715 - DNA, 25 bp, Mus musculus
gacataccttgcttgcttccaaata

SEQ ID NO: 449716 - DNA, 25 bp, Mus musculus
gacatacggattcggcaagcccgaa

SEQ ID NO: 449717 - DNA, 25 bp, Mus musculus
gacatacggattgggcaagcccgaa

SEQ ID NO: 449718 - DNA, 25 bp, Mus musculus
gacatacggcagctggccattgagt

SEQ ID NO: 449719 - DNA, 25 bp, Mus musculus
gacatacggcaggtggccattgagt

SEQ ID NO: 449720 - DNA, 25 bp, Mus musculus
gacatacggctcattagaggccctt

SEQ ID NO: 449721 - DNA, 25 bp, Mus musculus
gacatacggctctttagaggccctt

SEQ ID NO: 449722 - DNA, 25 bp, Mus musculus
gacatacgtattagttggcacatat

SEQ ID NO: 449723 - DNA, 25 bp, Mus musculus
gacatacgtatttgttggcacatat

SEQ ID NO: 449724 - DNA, 25 bp, Mus musculus
gacatacgtcatatctgatcactgt

SEQ ID NO: 449725 - DNA, 25 bp, Mus musculus
gacatacgtcatttctgatcactgt

SEQ ID NO: 449726 - DNA, 25 bp, Mus musculus
gacatactaataatcacttacgcag

SEQ ID NO: 449727 - DNA, 25 bp, Mus musculus
gacatactaatattcacttacgcag

SEQ ID NO: 449728 - DNA, 25 bp, Mus musculus
gacatactatatccatgcaaaacat

SEQ ID NO: 449729 - DNA, 25 bp, Mus musculus
gacatactatatgcatgcaaaacat

SEQ ID NO: 449730 - DNA, 25 bp, Mus musculus
gacatactatgccaacatgccctgg

SEQ ID NO: 449731 - DNA, 25 bp, Mus musculus
gacatactatgcgaacatgccctgg

SEQ ID NO: 449732 - DNA, 25 bp, Mus musculus
gacatactcagaatgacaccccata

SEQ ID NO: 449733 - DNA, 25 bp, Mus musculus
gacatactcagattgacaccccata

SEQ ID NO: 449734 - DNA, 25 bp, Mus musculus
gacatactcccaatagtgtgtaaat

SEQ ID NO: 449735 - DNA, 25 bp, Mus musculus
gacatactcccattagtgtgtaaat

SEQ ID NO: 449736 - DNA, 25 bp, Mus musculus
gacatactccccacgcaaagagaaa

SEQ ID NO: 449737 - DNA, 25 bp, Mus musculus
gacatactcccctcgcaaagagaaa

SEQ ID NO: 449738 - DNA, 25 bp, Mus musculus
gacatactctggagccacgaggcta

SEQ ID NO: 449739 - DNA, 25 bp, Mus musculus
gacatactctggtgccacgaggcta

SEQ ID NO: 449740 - DNA, 25 bp, Mus musculus
gacatactgacccttctaaagcttg

SEQ ID NO: 449741 - DNA, 25 bp, Mus musculus
gacatactgaccgttctaaagcttg

SEQ ID NO: 449742 - DNA, 25 bp, Mus musculus
gacatactgactcaggcaattctga

SEQ ID NO: 449743 - DNA, 25 bp, Mus musculus
gacatactgactgaggcaattctga

SEQ ID NO: 449744 - DNA, 25 bp, Mus musculus
gacatacttagtatcatatttgttc

SEQ ID NO: 449745 - DNA, 25 bp, Mus musculus
gacatacttagtttcatatttgttc

SEQ ID NO: 449746 - DNA, 25 bp, Mus musculus
gacatacttctgcagaggatcgaca

SEQ ID NO: 449747 - DNA, 25 bp, Mus musculus
gacatacttctggagaggatcgaca

SEQ ID NO: 449748 - DNA, 25 bp, Mus musculus
gacatacttgcaaatctgatcctgg

SEQ ID NO: 449749 - DNA, 25 bp, Mus musculus
gacatacttgcatatctgatcctgg

SEQ ID NO: 449750 - DNA, 25 bp, Mus musculus
gacatactttagatggaagtttagt

SEQ ID NO: 449751 - DNA, 25 bp, Mus musculus
gacatactttagttggaagtttagt

SEQ ID NO: 449752 - DNA, 25 bp, Mus musculus
gacatactttatagaattggcagaa

SEQ ID NO: 449753 - DNA, 25 bp, Mus musculus
gacatactttattgaattggcagaa

SEQ ID NO: 449754 - DNA, 25 bp, Mus musculus
gacatactttcgagaagaccctgat

SEQ ID NO: 449755 - DNA, 25 bp, Mus musculus
gacatactttcgtgaagaccctgat

SEQ ID NO: 449756 - DNA, 25 bp, Mus musculus
gacatagaacaaagacagcaacagt

SEQ ID NO: 449757 - DNA, 25 bp, Mus musculus
gacatagaacaatgacagcaacagt

SEQ ID NO: 449758 - DNA, 25 bp, Mus musculus
gacatagaagtcaaaggccaaacat

SEQ ID NO: 449759 - DNA, 25 bp, Mus musculus
gacatagaagtccagcaccgagagc

SEQ ID NO: 449760 - DNA, 25 bp, Mus musculus
gacatagaagtcgagcaccgagagc

SEQ ID NO: 449761 - DNA, 25 bp, Mus musculus
gacatagaagtctaaggccaaacat

SEQ ID NO: 449762 - DNA, 25 bp, Mus musculus
gacatagacaccaagaccagaccag

SEQ ID NO: 449763 - DNA, 25 bp, Mus musculus
gacatagacacctagaccagaccag

SEQ ID NO: 449764 - DNA, 25 bp, Mus musculus
gacatagacagtatggactccagtt

SEQ ID NO: 449765 - DNA, 25 bp, Mus musculus
gacatagacagtttggactccagtt

SEQ ID NO: 449766 - DNA, 25 bp, Mus musculus
gacatagacctgactctgagggaca

SEQ ID NO: 449767 - DNA, 25 bp, Mus musculus
gacatagacctgtctctgagggaca

SEQ ID NO: 449768 - DNA, 25 bp, Mus musculus
gacatagaccttatttgttccactt

SEQ ID NO: 449769 - DNA, 25 bp, Mus musculus
gacatagaccttttttgttccactt

SEQ ID NO: 449770 - DNA, 25 bp, Mus musculus
gacatagagaaccacctcatcggtg

SEQ ID NO: 449771 - DNA, 25 bp, Mus musculus
gacatagagaacgacctcatcggtg

SEQ ID NO: 449772 - DNA, 25 bp, Mus musculus
gacatagagcgccagaaccaggagt

SEQ ID NO: 449773 - DNA, 25 bp, Mus musculus
gacatagagcgcgagaaccaggagt

SEQ ID NO: 449774 - DNA, 25 bp, Mus musculus
gacatagagctacccaatatcccac

SEQ ID NO: 449775 - DNA, 25 bp, Mus musculus
gacatagagctagccaatatcccac

SEQ ID NO: 449776 - DNA, 25 bp, Mus musculus
gacatagagctgagcgggctgcact

SEQ ID NO: 449777 - DNA, 25 bp, Mus musculus
gacatagagctgcttctgtgtaaat

SEQ ID NO: 449778 - DNA, 25 bp, Mus musculus
gacatagagctggttctgtgtaaat

SEQ ID NO: 449779 - DNA, 25 bp, Mus musculus
gacatagagctgtgcgggctgcact

SEQ ID NO: 449780 - DNA, 25 bp, Mus musculus
gacatagaggctatgaacttccggg

SEQ ID NO: 449781 - DNA, 25 bp, Mus musculus
gacatagaggctttgaacttccggg

SEQ ID NO: 449782 - DNA, 25 bp, Mus musculus
gacatagatcctcggaaagccacaa

SEQ ID NO: 449783 - DNA, 25 bp, Mus musculus
gacatagatcctgggaaagccacaa

SEQ ID NO: 449784 - DNA, 25 bp, Mus musculus
gacatagatggaagatgctccttcc

SEQ ID NO: 449785 - DNA, 25 bp, Mus musculus
gacatagatggatgatgctccttcc

SEQ ID NO: 449786 - DNA, 25 bp, Mus musculus
gacatagatttaacctagttcctta

SEQ ID NO: 449787 - DNA, 25 bp, Mus musculus
gacatagatttatcctagttcctta

SEQ ID NO: 449788 - DNA, 25 bp, Mus musculus
gacatagcactcactagtcttctgg

SEQ ID NO: 449789 - DNA, 25 bp, Mus musculus
gacatagcactctctagtcttctgg

SEQ ID NO: 449790 - DNA, 25 bp, Mus musculus
gacatagcagctaggcgagtgtttt

SEQ ID NO: 449791 - DNA, 25 bp, Mus musculus
gacatagcagcttggcgagtgtttt

SEQ ID NO: 449792 - DNA, 25 bp, Mus musculus
gacatagcatagctcagcccttgcc

SEQ ID NO: 449793 - DNA, 25 bp, Mus musculus
gacatagcataggtcagcccttgcc

SEQ ID NO: 449794 - DNA, 25 bp, Mus musculus
gacatagcattcatccagtattctc

SEQ ID NO: 449795 - DNA, 25 bp, Mus musculus
gacatagcattcttccagtattctc

SEQ ID NO: 449796 - DNA, 25 bp, Mus musculus
gacatagccacactttaatccacat

SEQ ID NO: 449797 - DNA, 25 bp, Mus musculus
gacatagccacagtttaatccacat

SEQ ID NO: 449798 - DNA, 25 bp, Mus musculus
gacatagccagcaggaacaccgaga

SEQ ID NO: 449799 - DNA, 25 bp, Mus musculus
gacatagccagctggaacaccgaga

SEQ ID NO: 449800 - DNA, 25 bp, Mus musculus
gacatagccaggaatctcatctctt

SEQ ID NO: 449801 - DNA, 25 bp, Mus musculus
gacatagccaggtatctcatctctt

SEQ ID NO: 449802 - DNA, 25 bp, Mus musculus
gacatagcctgactgggcatcactg

SEQ ID NO: 449803 - DNA, 25 bp, Mus musculus
gacatagcctgagtgggcatcactg

SEQ ID NO: 449804 - DNA, 25 bp, Mus musculus
gacatagccttcacattcctctttt

SEQ ID NO: 449805 - DNA, 25 bp, Mus musculus
gacatagccttctcattcctctttt

SEQ ID NO: 449806 - DNA, 25 bp, Mus musculus
gacatagctcctctgtgttgcagtt

SEQ ID NO: 449807 - DNA, 25 bp, Mus musculus
gacatagctcctgtgtgttgcagtt

SEQ ID NO: 449808 - DNA, 25 bp, Mus musculus
gacatagctgtcctcctgagtttga

SEQ ID NO: 449809 - DNA, 25 bp, Mus musculus
gacatagctgtcgtcctgagtttga

SEQ ID NO: 449810 - DNA, 25 bp, Mus musculus
gacatagcttagcattctaggacta

SEQ ID NO: 449811 - DNA, 25 bp, Mus musculus
gacatagcttaggattctaggacta

SEQ ID NO: 449812 - DNA, 25 bp, Mus musculus
gacatagctttgctcttgctcaaat

SEQ ID NO: 449813 - DNA, 25 bp, Mus musculus
gacatagctttggtcttgctcaaat

SEQ ID NO: 449814 - DNA, 25 bp, Mus musculus
gacataggcaatctagtccccgttg

SEQ ID NO: 449815 - DNA, 25 bp, Mus musculus
gacataggcaatgtagtccccgttg

SEQ ID NO: 449816 - DNA, 25 bp, Mus musculus
gacataggccagatacacctgtctg

SEQ ID NO: 449817 - DNA, 25 bp, Mus musculus
gacataggccagttacacctgtctg

SEQ ID NO: 449818 - DNA, 25 bp, Mus musculus
gacataggcctgagtcagacgccag

SEQ ID NO: 449819 - DNA, 25 bp, Mus musculus
gacataggcctgtgtcagacgccag

SEQ ID NO: 449820 - DNA, 25 bp, Mus musculus
gacataggccttaagctctcttggg

SEQ ID NO: 449821 - DNA, 25 bp, Mus musculus
gacataggcctttagctctcttggg

SEQ ID NO: 449822 - DNA, 25 bp, Mus musculus
gacatagggaagacgtgtgcctgct

SEQ ID NO: 449823 - DNA, 25 bp, Mus musculus
gacatagggaagtcgtgtgcctgct

SEQ ID NO: 449824 - DNA, 25 bp, Mus musculus
gacatagggattagctttcctttga

SEQ ID NO: 449825 - DNA, 25 bp, Mus musculus
gacatagggatttgctttcctttga

SEQ ID NO: 449826 - DNA, 25 bp, Mus musculus
gacataggtcagagccacaggagag

SEQ ID NO: 449827 - DNA, 25 bp, Mus musculus
gacataggtcagtgccacaggagag

SEQ ID NO: 449828 - DNA, 25 bp, Mus musculus
gacatagtagctcatctgccagatg

SEQ ID NO: 449829 - DNA, 25 bp, Mus musculus
gacatagtagctgatctgccagatg

SEQ ID NO: 449830 - DNA, 25 bp, Mus musculus
gacatagtatttctcctttgcaata

SEQ ID NO: 449831 - DNA, 25 bp, Mus musculus
gacatagtatttgtcctttgcaata

SEQ ID NO: 449832 - DNA, 25 bp, Mus musculus
gacatagtctttatctcttgtggaa

SEQ ID NO: 449833 - DNA, 25 bp, Mus musculus
gacatagtctttttctcttgtggaa

SEQ ID NO: 449834 - DNA, 25 bp, Mus musculus
gacatagtgtccctcaaatcagaaa

SEQ ID NO: 449835 - DNA, 25 bp, Mus musculus
gacatagtgtccgtcaaatcagaaa

SEQ ID NO: 449836 - DNA, 25 bp, Mus musculus
gacatagtgtctattctctggagtg

SEQ ID NO: 449837 - DNA, 25 bp, Mus musculus
gacatagtgtcttttctctggagtg

SEQ ID NO: 449838 - DNA, 25 bp, Mus musculus
gacatagttcttctcctggtgtcaa

SEQ ID NO: 449839 - DNA, 25 bp, Mus musculus
gacatagttcttgtcctggtgtcaa

SEQ ID NO: 449840 - DNA, 25 bp, Mus musculus
gacatagttgtaccagaagatccag

SEQ ID NO: 449841 - DNA, 25 bp, Mus musculus
gacatagttgtagcagaagatccag

SEQ ID NO: 449842 - DNA, 25 bp, Mus musculus
gacatagttgtcctgaggtttcaaa

SEQ ID NO: 449843 - DNA, 25 bp, Mus musculus
gacatagttgtcgtgaggtttcaaa

SEQ ID NO: 449844 - DNA, 25 bp, Mus musculus
gacatataacctatttacagtactt

SEQ ID NO: 449845 - DNA, 25 bp, Mus musculus
gacatataacctctggtccaccctt

SEQ ID NO: 449846 - DNA, 25 bp, Mus musculus
gacatataacctgtggtccaccctt

SEQ ID NO: 449847 - DNA, 25 bp, Mus musculus
gacatataacctttttacagtactt

SEQ ID NO: 449848 - DNA, 25 bp, Mus musculus
gacatataacttatccttctgatgg

SEQ ID NO: 449849 - DNA, 25 bp, Mus musculus
gacatataacttttccttctgatgg

SEQ ID NO: 449850 - DNA, 25 bp, Mus musculus
gacatatatgcaagtagtgacaatg

SEQ ID NO: 449851 - DNA, 25 bp, Mus musculus
gacatatatgcactttggtctcatg

SEQ ID NO: 449852 - DNA, 25 bp, Mus musculus
gacatatatgcagtttggtctcatg

SEQ ID NO: 449853 - DNA, 25 bp, Mus musculus
gacatatatgcatgtagtgacaatg

SEQ ID NO: 449854 - DNA, 25 bp, Mus musculus
gacatatatgctatttgtgaccagc

SEQ ID NO: 449855 - DNA, 25 bp, Mus musculus
gacatatatgctttttgtgaccagc

SEQ ID NO: 449856 - DNA, 25 bp, Mus musculus
gacatatattctctcatctttccat

SEQ ID NO: 449857 - DNA, 25 bp, Mus musculus
gacatatattctgtcatctttccat

SEQ ID NO: 449858 - DNA, 25 bp, Mus musculus
gacatatattgcatttttctctcat

SEQ ID NO: 449859 - DNA, 25 bp, Mus musculus
gacatatattgcttttttctctcat

SEQ ID NO: 449860 - DNA, 25 bp, Mus musculus
gacatatcacctcttcaggacaggc

SEQ ID NO: 449861 - DNA, 25 bp, Mus musculus
gacatatcacctgttcaggacaggc

SEQ ID NO: 449862 - DNA, 25 bp, Mus musculus
gacatatcagacaacgggacccggc

SEQ ID NO: 449863 - DNA, 25 bp, Mus musculus
gacatatcagactacgggacccggc

SEQ ID NO: 449864 - DNA, 25 bp, Mus musculus
gacatatccaagcaaggcctgggct

SEQ ID NO: 449865 - DNA, 25 bp, Mus musculus
gacatatccaaggaaggcctgggct

SEQ ID NO: 449866 - DNA, 25 bp, Mus musculus
gacatatccttcctgtaagctactg

SEQ ID NO: 449867 - DNA, 25 bp, Mus musculus
gacatatccttcgtgtaagctactg

SEQ ID NO: 449868 - DNA, 25 bp, Mus musculus
gacatatctagtcaatttctaccca

SEQ ID NO: 449869 - DNA, 25 bp, Mus musculus
gacatatctagtgaatttctaccca

SEQ ID NO: 449870 - DNA, 25 bp, Mus musculus
gacatatctctaacaagcttctctg

SEQ ID NO: 449871 - DNA, 25 bp, Mus musculus
gacatatctctatcaagcttctctg

SEQ ID NO: 449872 - DNA, 25 bp, Mus musculus
gacatatgagatccagttttcccag

SEQ ID NO: 449873 - DNA, 25 bp, Mus musculus
gacatatgagatgcagttttcccag

SEQ ID NO: 449874 - DNA, 25 bp, Mus musculus
gacatatgatctccatgatcctaag

SEQ ID NO: 449875 - DNA, 25 bp, Mus musculus
gacatatgatctctgctcgtttaac

SEQ ID NO: 449876 - DNA, 25 bp, Mus musculus
gacatatgatctgcatgatcctaag

SEQ ID NO: 449877 - DNA, 25 bp, Mus musculus
gacatatgatctgtgctcgtttaac

SEQ ID NO: 449878 - DNA, 25 bp, Mus musculus
gacatatgctatcaagcctggctta

SEQ ID NO: 449879 - DNA, 25 bp, Mus musculus
gacatatgctatgaagcctggctta

SEQ ID NO: 449880 - DNA, 25 bp, Mus musculus
gacatatggcatagaaccttgatat

SEQ ID NO: 449881 - DNA, 25 bp, Mus musculus
gacatatggcattgaaccttgatat

SEQ ID NO: 449882 - DNA, 25 bp, Mus musculus
gacatatgtccacatgtgctgattt

SEQ ID NO: 449883 - DNA, 25 bp, Mus musculus
gacatatgtccagatgtgctgattt

SEQ ID NO: 449884 - DNA, 25 bp, Mus musculus
gacatatgtgaccaggcatttcatg

SEQ ID NO: 449885 - DNA, 25 bp, Mus musculus
gacatatgtgacgaggcatttcatg

SEQ ID NO: 449886 - DNA, 25 bp, Mus musculus
gacatattatagattacgtgccagt

SEQ ID NO: 449887 - DNA, 25 bp, Mus musculus
gacatattatagtttacgtgccagt

SEQ ID NO: 449888 - DNA, 25 bp, Mus musculus
gacatattatgaacagttctaccct

SEQ ID NO: 449889 - DNA, 25 bp, Mus musculus
gacatattatgatcagttctaccct

SEQ ID NO: 449890 - DNA, 25 bp, Mus musculus
gacatattattcatacaggtgtttg

SEQ ID NO: 449891 - DNA, 25 bp, Mus musculus
gacatattattcttacaggtgtttg

SEQ ID NO: 449892 - DNA, 25 bp, Mus musculus
gacatattcacacgttacaagctca

SEQ ID NO: 449893 - DNA, 25 bp, Mus musculus
gacatattcacaggttacaagctca

SEQ ID NO: 449894 - DNA, 25 bp, Mus musculus
gacatattccataccctggtgtgag

SEQ ID NO: 449895 - DNA, 25 bp, Mus musculus
gacatattccattccctggtgtgag

SEQ ID NO: 449896 - DNA, 25 bp, Mus musculus
gacatattcttgattcactggaacg

SEQ ID NO: 449897 - DNA, 25 bp, Mus musculus
gacatattcttgtttcactggaacg

SEQ ID NO: 449898 - DNA, 25 bp, Mus musculus
gacatattgataacaggcctacagc

SEQ ID NO: 449899 - DNA, 25 bp, Mus musculus
gacatattgatatcaggcctacagc

SEQ ID NO: 449900 - DNA, 25 bp, Mus musculus
gacatattgctcagactaaggtaca

SEQ ID NO: 449901 - DNA, 25 bp, Mus musculus
gacatattgctctgactaaggtaca

SEQ ID NO: 449902 - DNA, 25 bp, Mus musculus
gacatattgtttcggccagtgttcc

SEQ ID NO: 449903 - DNA, 25 bp, Mus musculus
gacatattgtttgggccagtgttcc

SEQ ID NO: 449904 - DNA, 25 bp, Mus musculus
gacatatttagcctcaagcatacgg

SEQ ID NO: 449905 - DNA, 25 bp, Mus musculus
gacatatttagcgtcaagcatacgg

SEQ ID NO: 449906 - DNA, 25 bp, Mus musculus
gacatatttattccctgtacatact

SEQ ID NO: 449907 - DNA, 25 bp, Mus musculus
gacatatttattgcctgtacatact

SEQ ID NO: 449908 - DNA, 25 bp, Mus musculus
gacatatttcagatctaccctgctg

SEQ ID NO: 449909 - DNA, 25 bp, Mus musculus
gacatatttcagttctaccctgctg

SEQ ID NO: 449910 - DNA, 25 bp, Mus musculus
gacatattttacacagtgccaccgt

SEQ ID NO: 449911 - DNA, 25 bp, Mus musculus
gacatattttactcagtgccaccgt

SEQ ID NO: 449912 - DNA, 25 bp, Mus musculus
gacatattttcaaacgcctttaatc

SEQ ID NO: 449913 - DNA, 25 bp, Mus musculus
gacatattttcatacgcctttaatc

SEQ ID NO: 449914 - DNA, 25 bp, Mus musculus
gacatattttgtagcagaatttttt

SEQ ID NO: 449915 - DNA, 25 bp, Mus musculus
gacatattttgttgcagaatttttt

SEQ ID NO: 449916 - DNA, 25 bp, Mus musculus
gacatatttttcataattctaacac

SEQ ID NO: 449917 - DNA, 25 bp, Mus musculus
gacatatttttcttaattctaacac

SEQ ID NO: 449918 - DNA, 25 bp, Mus musculus
gacatcaaaacaacggcttttccct

SEQ ID NO: 449919 - DNA, 25 bp, Mus musculus
gacatcaaaacatcggcttttccct

SEQ ID NO: 449920 - DNA, 25 bp, Mus musculus
gacatcaaagacatctgcactcacg

SEQ ID NO: 449921 - DNA, 25 bp, Mus musculus
gacatcaaagacttctgcactcacg

SEQ ID NO: 449922 - DNA, 25 bp, Mus musculus
gacatcaaagcaaaagctgctctct

SEQ ID NO: 449923 - DNA, 25 bp, Mus musculus
gacatcaaagcataagctgctctct

SEQ ID NO: 449924 - DNA, 25 bp, Mus musculus
gacatcaaagctattcttccgtggg

SEQ ID NO: 449925 - DNA, 25 bp, Mus musculus
gacatcaaagcttttcttccgtggg

SEQ ID NO: 449926 - DNA, 25 bp, Mus musculus
gacatcaacagcatcgaccagtggg

SEQ ID NO: 449927 - DNA, 25 bp, Mus musculus
gacatcaacagcttcgaccagtggg

SEQ ID NO: 449928 - DNA, 25 bp, Mus musculus
gacatcaacagtcgtgcagtggagt

SEQ ID NO: 449929 - DNA, 25 bp, Mus musculus
gacatcaacagtggtgcagtggagt

SEQ ID NO: 449930 - DNA, 25 bp, Mus musculus
gacatcaacatcaaccagctgaagg

SEQ ID NO: 449931 - DNA, 25 bp, Mus musculus
gacatcaacatctaccagctgaagg

SEQ ID NO: 449932 - DNA, 25 bp, Mus musculus
gacatcaacccaccatgagacttgt

SEQ ID NO: 449933 - DNA, 25 bp, Mus musculus
gacatcaacccagcatgagacttgt

SEQ ID NO: 449934 - DNA, 25 bp, Mus musculus
gacatcaacgaaaggtccccaacgg

SEQ ID NO: 449935 - DNA, 25 bp, Mus musculus
gacatcaacgaatggtccccaacgg

SEQ ID NO: 449936 - DNA, 25 bp, Mus musculus
gacatcaagacgctcattatcgcca

SEQ ID NO: 449937 - DNA, 25 bp, Mus musculus
gacatcaagacggtcattatcgcca

SEQ ID NO: 449938 - DNA, 25 bp, Mus musculus
gacatcaagcatactttcctatttg

SEQ ID NO: 449939 - DNA, 25 bp, Mus musculus
gacatcaagcattctttcctatttg

SEQ ID NO: 449940 - DNA, 25 bp, Mus musculus
gacatcaagcctacagaggacaagg

SEQ ID NO: 449941 - DNA, 25 bp, Mus musculus
gacatcaagccttcagaggacaagg

SEQ ID NO: 449942 - DNA, 25 bp, Mus musculus
gacatcaatatgcaggttcttcaca

SEQ ID NO: 449943 - DNA, 25 bp, Mus musculus
gacatcaatatggaggttcttcaca

SEQ ID NO: 449944 - DNA, 25 bp, Mus musculus
gacatcaatcatacatagggacaca

SEQ ID NO: 449945 - DNA, 25 bp, Mus musculus
gacatcaatcattcatagggacaca

SEQ ID NO: 449946 - DNA, 25 bp, Mus musculus
gacatcaatgagatcctggaggcct

SEQ ID NO: 449947 - DNA, 25 bp, Mus musculus
gacatcaatgagttcctggaggcct

SEQ ID NO: 449948 - DNA, 25 bp, Mus musculus
gacatcaatgcaccaatcgaaaggt

SEQ ID NO: 449949 - DNA, 25 bp, Mus musculus
gacatcaatgcagcaatcgaaaggt

SEQ ID NO: 449950 - DNA, 25 bp, Mus musculus
gacatcaattcaccgaagggaccca

SEQ ID NO: 449951 - DNA, 25 bp, Mus musculus
gacatcaattcactggacgccaatt

SEQ ID NO: 449952 - DNA, 25 bp, Mus musculus
gacatcaattcagcgaagggaccca

SEQ ID NO: 449953 - DNA, 25 bp, Mus musculus
gacatcaattcagtggacgccaatt

SEQ ID NO: 449954 - DNA, 25 bp, Mus musculus
gacatcacacacctggtgccatgac

SEQ ID NO: 449955 - DNA, 25 bp, Mus musculus
gacatcacacacgtggtgccatgac

SEQ ID NO: 449956 - DNA, 25 bp, Mus musculus
gacatcacagccaaggtgcagtaca

SEQ ID NO: 449957 - DNA, 25 bp, Mus musculus
gacatcacagcctaggtgcagtaca

SEQ ID NO: 449958 - DNA, 25 bp, Mus musculus
gacatcacaggtagcttcggaacag

SEQ ID NO: 449959 - DNA, 25 bp, Mus musculus
gacatcacaggttgcttcggaacag

SEQ ID NO: 449960 - DNA, 25 bp, Mus musculus
gacatcacagtacagcaagcggtgg

SEQ ID NO: 449961 - DNA, 25 bp, Mus musculus
gacatcacagtagagcaagcggtgg

SEQ ID NO: 449962 - DNA, 25 bp, Mus musculus
gacatcacatcacacaactgagttt

SEQ ID NO: 449963 - DNA, 25 bp, Mus musculus
gacatcacatcacttccagattgga

SEQ ID NO: 449964 - DNA, 25 bp, Mus musculus
gacatcacatcagacaactgagttt

SEQ ID NO: 449965 - DNA, 25 bp, Mus musculus
gacatcacatcagttccagattgga

SEQ ID NO: 449966 - DNA, 25 bp, Mus musculus
gacatcacatctaggctatctttta

SEQ ID NO: 449967 - DNA, 25 bp, Mus musculus
gacatcacatcttggctatctttta

SEQ ID NO: 449968 - DNA, 25 bp, Mus musculus
gacatcacatgtagttttcctatgg

SEQ ID NO: 449969 - DNA, 25 bp, Mus musculus
gacatcacatgttgttttcctatgg

SEQ ID NO: 449970 - DNA, 25 bp, Mus musculus
gacatcacattaccctaagagccaa

SEQ ID NO: 449971 - DNA, 25 bp, Mus musculus
gacatcacattagcctaagagccaa

SEQ ID NO: 449972 - DNA, 25 bp, Mus musculus
gacatcaccaaccaccaatataagg

SEQ ID NO: 449973 - DNA, 25 bp, Mus musculus
gacatcaccaacgaccaatataagg

SEQ ID NO: 449974 - DNA, 25 bp, Mus musculus
gacatcaccacaaatgttcaccaca

SEQ ID NO: 449975 - DNA, 25 bp, Mus musculus
gacatcaccacatatgttcaccaca

SEQ ID NO: 449976 - DNA, 25 bp, Mus musculus
gacatcaccagaacctacctgagtt

SEQ ID NO: 449977 - DNA, 25 bp, Mus musculus
gacatcaccagatcctacctgagtt

SEQ ID NO: 449978 - DNA, 25 bp, Mus musculus
gacatcaccagcagagatagtggaa

SEQ ID NO: 449979 - DNA, 25 bp, Mus musculus
gacatcaccagctgagatagtggaa

SEQ ID NO: 449980 - DNA, 25 bp, Mus musculus
gacatcaccagtcccgagtctgaga

SEQ ID NO: 449981 - DNA, 25 bp, Mus musculus
gacatcaccagtgccgagtctgaga

SEQ ID NO: 449982 - DNA, 25 bp, Mus musculus
gacatcacccctaatgtagggtcat

SEQ ID NO: 449983 - DNA, 25 bp, Mus musculus
gacatcaccccttatgtagggtcat

SEQ ID NO: 449984 - DNA, 25 bp, Mus musculus
gacatcacctttacctatctgttaa

SEQ ID NO: 449985 - DNA, 25 bp, Mus musculus
gacatcaccttttcctatctgttaa

SEQ ID NO: 449986 - DNA, 25 bp, Mus musculus
gacatcacgagtatcttgcatcaaa

SEQ ID NO: 449987 - DNA, 25 bp, Mus musculus
gacatcacgagtttcttgcatcaaa

SEQ ID NO: 449988 - DNA, 25 bp, Mus musculus
gacatcacgcaacacgcggtgacgt

SEQ ID NO: 449989 - DNA, 25 bp, Mus musculus
gacatcacgcaagacgcggtgacgt

SEQ ID NO: 449990 - DNA, 25 bp, Mus musculus
gacatcacgccactatttatctaaa

SEQ ID NO: 449991 - DNA, 25 bp, Mus musculus
gacatcacgccagtatttatctaaa

SEQ ID NO: 449992 - DNA, 25 bp, Mus musculus
gacatcacggatcagcgcaaaggca

SEQ ID NO: 449993 - DNA, 25 bp, Mus musculus
gacatcacggatgagcgcaaaggca

SEQ ID NO: 449994 - DNA, 25 bp, Mus musculus
gacatcactaacagtggcctgcaga

SEQ ID NO: 449995 - DNA, 25 bp, Mus musculus
gacatcactaactgtggcctgcaga

SEQ ID NO: 449996 - DNA, 25 bp, Mus musculus
gacatcactggactctagggactgg

SEQ ID NO: 449997 - DNA, 25 bp, Mus musculus
gacatcactggagtctagggactgg

SEQ ID NO: 449998 - DNA, 25 bp, Mus musculus
gacatcactgggacatcagatcctt

SEQ ID NO: 449999 - DNA, 25 bp, Mus musculus
gacatcactgggactacctcagaat

SEQ ID NO: 450000 - DNA, 25 bp, Mus musculus
gacatcactgggtcatcagatcctt

SEQ ID NO: 450001 - DNA, 25 bp, Mus musculus
gacatcactgggtctacctcagaat

SEQ ID NO: 450002 - DNA, 25 bp, Mus musculus
gacatcactggtaggactgaaatcc

SEQ ID NO: 450003 - DNA, 25 bp, Mus musculus
gacatcactggttggactgaaatcc

SEQ ID NO: 450004 - DNA, 25 bp, Mus musculus
gacatcactgtcctttgggcttgct

SEQ ID NO: 450005 - DNA, 25 bp, Mus musculus
gacatcactgtcgtttgggcttgct

SEQ ID NO: 450006 - DNA, 25 bp, Mus musculus
gacatcacttgcaagtctgtttctg

SEQ ID NO: 450007 - DNA, 25 bp, Mus musculus
gacatcacttgctagtctgtttctg

SEQ ID NO: 450008 - DNA, 25 bp, Mus musculus
gacatcagaaagctgggtacggcaa

SEQ ID NO: 450009 - DNA, 25 bp, Mus musculus
gacatcagaaaggtgggtacggcaa

SEQ ID NO: 450010 - DNA, 25 bp, Mus musculus
gacatcagatggctggcttacagtc

SEQ ID NO: 450011 - DNA, 25 bp, Mus musculus
gacatcagatgggtggcttacagtc

SEQ ID NO: 450012 - DNA, 25 bp, Mus musculus
gacatcagcagacttactcaggcaa

SEQ ID NO: 450013 - DNA, 25 bp, Mus musculus
gacatcagcagagttactcaggcaa

SEQ ID NO: 450014 - DNA, 25 bp, Mus musculus
gacatcagccaacggttcggagtac

SEQ ID NO: 450015 - DNA, 25 bp, Mus musculus
gacatcagccaagggttcggagtac

SEQ ID NO: 450016 - DNA, 25 bp, Mus musculus
gacatcagcccaagcaggataggtt

SEQ ID NO: 450017 - DNA, 25 bp, Mus musculus
gacatcagcccatgcaggataggtt

SEQ ID NO: 450018 - DNA, 25 bp, Mus musculus
gacatcagctggaatggctttcagt

SEQ ID NO: 450019 - DNA, 25 bp, Mus musculus
gacatcagctggtatggctttcagt

SEQ ID NO: 450020 - DNA, 25 bp, Mus musculus
gacatcagctgtaacacatggccca

SEQ ID NO: 450021 - DNA, 25 bp, Mus musculus
gacatcagctgttacacatggccca

SEQ ID NO: 450022 - DNA, 25 bp, Mus musculus
gacatcaggcatctaaggatcgctt

SEQ ID NO: 450023 - DNA, 25 bp, Mus musculus
gacatcaggcatgtaaggatcgctt

SEQ ID NO: 450024 - DNA, 25 bp, Mus musculus
gacatcaggccaatacagacttcaa

SEQ ID NO: 450025 - DNA, 25 bp, Mus musculus
gacatcaggccattacagacttcaa

SEQ ID NO: 450026 - DNA, 25 bp, Mus musculus
gacatcaggcggctgccacagaaaa

SEQ ID NO: 450027 - DNA, 25 bp, Mus musculus
gacatcaggcgggtgccacagaaaa

SEQ ID NO: 450028 - DNA, 25 bp, Mus musculus
gacatcaggtagcagcctgtgttct

SEQ ID NO: 450029 - DNA, 25 bp, Mus musculus
gacatcaggtaggagcctgtgttct

SEQ ID NO: 450030 - DNA, 25 bp, Mus musculus
gacatcaggtttcatgttgcatgat

SEQ ID NO: 450031 - DNA, 25 bp, Mus musculus
gacatcaggtttgatgttgcatgat

SEQ ID NO: 450032 - DNA, 25 bp, Mus musculus
gacatcagtacccaaagcctgcgga

SEQ ID NO: 450033 - DNA, 25 bp, Mus musculus
gacatcagtaccgaaagcctgcgga

SEQ ID NO: 450034 - DNA, 25 bp, Mus musculus
gacatcagtagacagaatatccttc

SEQ ID NO: 450035 - DNA, 25 bp, Mus musculus
gacatcagtagagagaatatccttc

SEQ ID NO: 450036 - DNA, 25 bp, Mus musculus
gacatcagtattatccgcaagggtt

SEQ ID NO: 450037 - DNA, 25 bp, Mus musculus
gacatcagtattttccgcaagggtt

SEQ ID NO: 450038 - DNA, 25 bp, Mus musculus
gacatcagtcaccagattaaataaa

SEQ ID NO: 450039 - DNA, 25 bp, Mus musculus
gacatcagtcacgagattaaataaa

SEQ ID NO: 450040 - DNA, 25 bp, Mus musculus
gacatcagtctgaggctggagctct

SEQ ID NO: 450041 - DNA, 25 bp, Mus musculus
gacatcagtctgtggctggagctct

SEQ ID NO: 450042 - DNA, 25 bp, Mus musculus
gacatcagtgtcattgagaagcaca

SEQ ID NO: 450043 - DNA, 25 bp, Mus musculus
gacatcagtgtctttgagaagcaca

SEQ ID NO: 450044 - DNA, 25 bp, Mus musculus
gacatcatagagcattgcagtccaa

SEQ ID NO: 450045 - DNA, 25 bp, Mus musculus
gacatcatagaggattgcagtccaa

SEQ ID NO: 450046 - DNA, 25 bp, Mus musculus
gacatcataggaaaggtcccttttg

SEQ ID NO: 450047 - DNA, 25 bp, Mus musculus
gacatcataggataggtcccttttg

SEQ ID NO: 450048 - DNA, 25 bp, Mus musculus
gacatcatcaatcccttgtgcttca

SEQ ID NO: 450049 - DNA, 25 bp, Mus musculus
gacatcatcaatgccttgtgcttca

SEQ ID NO: 450050 - DNA, 25 bp, Mus musculus
gacatcatcacactgaaagctcctg

SEQ ID NO: 450051 - DNA, 25 bp, Mus musculus
gacatcatcacagtgaaagctcctg

SEQ ID NO: 450052 - DNA, 25 bp, Mus musculus
gacatcatcactctagaacgcttta

SEQ ID NO: 450053 - DNA, 25 bp, Mus musculus
gacatcatcactgtagaacgcttta

SEQ ID NO: 450054 - DNA, 25 bp, Mus musculus
gacatcatcatccagaccttcgagg

SEQ ID NO: 450055 - DNA, 25 bp, Mus musculus
gacatcatcatcgagaccttcgagg

SEQ ID NO: 450056 - DNA, 25 bp, Mus musculus
gacatcatcccaattgtagcaggcg

SEQ ID NO: 450057 - DNA, 25 bp, Mus musculus
gacatcatcccatttgtagcaggcg

SEQ ID NO: 450058 - DNA, 25 bp, Mus musculus
gacatcatccgcattaattatctag

SEQ ID NO: 450059 - DNA, 25 bp, Mus musculus
gacatcatccgctttaattatctag

SEQ ID NO: 450060 - DNA, 25 bp, Mus musculus
gacatcatcctgcaaagcatcccaa

SEQ ID NO: 450061 - DNA, 25 bp, Mus musculus
gacatcatcctggaaagcatcccaa

SEQ ID NO: 450062 - DNA, 25 bp, Mus musculus
gacatcatcgtgcaggacttcattg

SEQ ID NO: 450063 - DNA, 25 bp, Mus musculus
gacatcatcgtggaggacttcattg

SEQ ID NO: 450064 - DNA, 25 bp, Mus musculus
gacatcatctacatttggagttctg

SEQ ID NO: 450065 - DNA, 25 bp, Mus musculus
gacatcatctacttttggagttctg

SEQ ID NO: 450066 - DNA, 25 bp, Mus musculus
gacatcatctagactttgttttctg

SEQ ID NO: 450067 - DNA, 25 bp, Mus musculus
gacatcatctagtctttgttttctg

SEQ ID NO: 450068 - DNA, 25 bp, Mus musculus
gacatcatctcaactgaaggtgacg

SEQ ID NO: 450069 - DNA, 25 bp, Mus musculus
gacatcatctcatctgaaggtgacg

SEQ ID NO: 450070 - DNA, 25 bp, Mus musculus
gacatcatctcgcaggagcaatttg

SEQ ID NO: 450071 - DNA, 25 bp, Mus musculus
gacatcatctcggaggagcaatttg

SEQ ID NO: 450072 - DNA, 25 bp, Mus musculus
gacatcatgatcagcatcctgggcc

SEQ ID NO: 450073 - DNA, 25 bp, Mus musculus
gacatcatgatctgcatcctgggcc

SEQ ID NO: 450074 - DNA, 25 bp, Mus musculus
gacatcatgcaacctgttttccaca

SEQ ID NO: 450075 - DNA, 25 bp, Mus musculus
gacatcatgcaagctgttttccaca

SEQ ID NO: 450076 - DNA, 25 bp, Mus musculus
gacatcatgcatcatcactttttta

SEQ ID NO: 450077 - DNA, 25 bp, Mus musculus
gacatcatgcatgatcactttttta

SEQ ID NO: 450078 - DNA, 25 bp, Mus musculus
gacatcatggagcacctggacacaa

SEQ ID NO: 450079 - DNA, 25 bp, Mus musculus
gacatcatggaggacctggacacaa

SEQ ID NO: 450080 - DNA, 25 bp, Mus musculus
gacatcatggtaatccccttactaa

SEQ ID NO: 450081 - DNA, 25 bp, Mus musculus
gacatcatggtattccccttactaa

SEQ ID NO: 450082 - DNA, 25 bp, Mus musculus
gacatcatgtcaatggtcggcctac

SEQ ID NO: 450083 - DNA, 25 bp, Mus musculus
gacatcatgtcattggtcggcctac

SEQ ID NO: 450084 - DNA, 25 bp, Mus musculus
gacatcatgtggcaacttcttatct

SEQ ID NO: 450085 - DNA, 25 bp, Mus musculus
gacatcatgtgggaacttcttatct

SEQ ID NO: 450086 - DNA, 25 bp, Mus musculus
gacatcatgtttctgcactttagac

SEQ ID NO: 450087 - DNA, 25 bp, Mus musculus
gacatcatgtttgtgcactttagac

SEQ ID NO: 450088 - DNA, 25 bp, Mus musculus
gacatcattagtaccgacacttgtg

SEQ ID NO: 450089 - DNA, 25 bp, Mus musculus
gacatcattagttccgacacttgtg

SEQ ID NO: 450090 - DNA, 25 bp, Mus musculus
gacatcattgatccagggataacta

SEQ ID NO: 450091 - DNA, 25 bp, Mus musculus
gacatcattgatgcagggataacta

SEQ ID NO: 450092 - DNA, 25 bp, Mus musculus
gacatcattgtgaccctggacatgc

SEQ ID NO: 450093 - DNA, 25 bp, Mus musculus
gacatcattgtgctcaatggcacca

SEQ ID NO: 450094 - DNA, 25 bp, Mus musculus
gacatcattgtggtcaatggcacca

SEQ ID NO: 450095 - DNA, 25 bp, Mus musculus
gacatcattgtgtccctggacatgc

SEQ ID NO: 450096 - DNA, 25 bp, Mus musculus
gacatcatttaaaacctgacactta

SEQ ID NO: 450097 - DNA, 25 bp, Mus musculus
gacatcatttaatacctgacactta

SEQ ID NO: 450098 - DNA, 25 bp, Mus musculus
gacatcatttacacactgctgactc

SEQ ID NO: 450099 - DNA, 25 bp, Mus musculus
gacatcatttactcactgctgactc

SEQ ID NO: 450100 - DNA, 25 bp, Mus musculus
gacatcatttccctcatgttgttag

SEQ ID NO: 450101 - DNA, 25 bp, Mus musculus
gacatcatttccgtcatgttgttag

SEQ ID NO: 450102 - DNA, 25 bp, Mus musculus
gacatcatttctcagcaacaataca

SEQ ID NO: 450103 - DNA, 25 bp, Mus musculus
gacatcatttctgagcaacaataca

SEQ ID NO: 450104 - DNA, 25 bp, Mus musculus
gacatcattttccattgttccaatc

SEQ ID NO: 450105 - DNA, 25 bp, Mus musculus
gacatcattttccttgacagaagca

SEQ ID NO: 450106 - DNA, 25 bp, Mus musculus
gacatcattttcgattgttccaatc

SEQ ID NO: 450107 - DNA, 25 bp, Mus musculus
gacatcattttcgttgacagaagca

SEQ ID NO: 450108 - DNA, 25 bp, Mus musculus
gacatccaatggaccccacaaactt

SEQ ID NO: 450109 - DNA, 25 bp, Mus musculus
gacatccaatggtccccacaaactt

SEQ ID NO: 450110 - DNA, 25 bp, Mus musculus
gacatccacagaccagagacccagt

SEQ ID NO: 450111 - DNA, 25 bp, Mus musculus
gacatccacagagcagagacccagt

SEQ ID NO: 450112 - DNA, 25 bp, Mus musculus
gacatccacattatctctagttcat

SEQ ID NO: 450113 - DNA, 25 bp, Mus musculus
gacatccacattttctctagttcat

SEQ ID NO: 450114 - DNA, 25 bp, Mus musculus
gacatccactaaagtttacatacca

SEQ ID NO: 450115 - DNA, 25 bp, Mus musculus
gacatccactaatgtttacatacca

SEQ ID NO: 450116 - DNA, 25 bp, Mus musculus
gacatccactcaagtattctaggca

SEQ ID NO: 450117 - DNA, 25 bp, Mus musculus
gacatccactcatgtattctaggca

SEQ ID NO: 450118 - DNA, 25 bp, Mus musculus
gacatccactgccaggagctatatt

SEQ ID NO: 450119 - DNA, 25 bp, Mus musculus
gacatccactgcgaggagctatatt

SEQ ID NO: 450120 - DNA, 25 bp, Mus musculus
gacatccagatgattcaccactgtt

SEQ ID NO: 450121 - DNA, 25 bp, Mus musculus
gacatccagatgtttcaccactgtt

SEQ ID NO: 450122 - DNA, 25 bp, Mus musculus
gacatccagcctaatatttgcttaa

SEQ ID NO: 450123 - DNA, 25 bp, Mus musculus
gacatccagccttatatttgcttaa

SEQ ID NO: 450124 - DNA, 25 bp, Mus musculus
gacatccaggaacacgtgacagcta

SEQ ID NO: 450125 - DNA, 25 bp, Mus musculus
gacatccaggaagacgtgacagcta

SEQ ID NO: 450126 - DNA, 25 bp, Mus musculus
gacatccaggacatcttttaccagg

SEQ ID NO: 450127 - DNA, 25 bp, Mus musculus
gacatccaggacttcttttaccagg

SEQ ID NO: 450128 - DNA, 25 bp, Mus musculus
gacatccaggctcagattttatttt

SEQ ID NO: 450129 - DNA, 25 bp, Mus musculus
gacatccaggctgagattttatttt

SEQ ID NO: 450130 - DNA, 25 bp, Mus musculus
gacatccaggtgatacagactcagt

SEQ ID NO: 450131 - DNA, 25 bp, Mus musculus
gacatccaggtgttacagactcagt

SEQ ID NO: 450132 - DNA, 25 bp, Mus musculus
gacatccagtctcatgagctgaaca

SEQ ID NO: 450133 - DNA, 25 bp, Mus musculus
gacatccagtctgatgagctgaaca

SEQ ID NO: 450134 - DNA, 25 bp, Mus musculus
gacatccagtttatgtagagtctct

SEQ ID NO: 450135 - DNA, 25 bp, Mus musculus
gacatccagtttttgtagagtctct

SEQ ID NO: 450136 - DNA, 25 bp, Mus musculus
gacatccataacactttgatcccaa

SEQ ID NO: 450137 - DNA, 25 bp, Mus musculus
gacatccataactctttgatcccaa

SEQ ID NO: 450138 - DNA, 25 bp, Mus musculus
gacatccataagatagacagctata

SEQ ID NO: 450139 - DNA, 25 bp, Mus musculus
gacatccataagttagacagctata

SEQ ID NO: 450140 - DNA, 25 bp, Mus musculus
gacatccatacccaagtgaatgtga

SEQ ID NO: 450141 - DNA, 25 bp, Mus musculus
gacatccataccgaagtgaatgtga

SEQ ID NO: 450142 - DNA, 25 bp, Mus musculus
gacatccatagtcaggccatggtgt

SEQ ID NO: 450143 - DNA, 25 bp, Mus musculus
gacatccatagtgaggccatggtgt

SEQ ID NO: 450144 - DNA, 25 bp, Mus musculus
gacatccatccaacttaaggacttg

SEQ ID NO: 450145 - DNA, 25 bp, Mus musculus
gacatccatccatcttaaggacttg

SEQ ID NO: 450146 - DNA, 25 bp, Mus musculus
gacatccatgggaatgccctgcagt

SEQ ID NO: 450147 - DNA, 25 bp, Mus musculus
gacatccatgggtatgccctgcagt

SEQ ID NO: 450148 - DNA, 25 bp, Mus musculus
gacatccatgtacaagtatccctct

SEQ ID NO: 450149 - DNA, 25 bp, Mus musculus
gacatccatgtagaagtatccctct

SEQ ID NO: 450150 - DNA, 25 bp, Mus musculus
gacatccattgcacgtagtaaatgt

SEQ ID NO: 450151 - DNA, 25 bp, Mus musculus
gacatccattgctcgtagtaaatgt

SEQ ID NO: 450152 - DNA, 25 bp, Mus musculus
gacatcccaatacctgtgctaagtg

SEQ ID NO: 450153 - DNA, 25 bp, Mus musculus
gacatcccaatagctgtgctaagtg

SEQ ID NO: 450154 - DNA, 25 bp, Mus musculus
gacatcccagcacatgagaccagcg

SEQ ID NO: 450155 - DNA, 25 bp, Mus musculus
gacatcccagcagatgagaccagcg

SEQ ID NO: 450156 - DNA, 25 bp, Mus musculus
gacatcccagggattgcacatctgt

SEQ ID NO: 450157 - DNA, 25 bp, Mus musculus
gacatcccagggtttgcacatctgt

SEQ ID NO: 450158 - DNA, 25 bp, Mus musculus
gacatcccatgcaccaatcaaaggg

SEQ ID NO: 450159 - DNA, 25 bp, Mus musculus
gacatcccatgctccaatcaaaggg

SEQ ID NO: 450160 - DNA, 25 bp, Mus musculus
gacatcccatgtcctaaaattattt

SEQ ID NO: 450161 - DNA, 25 bp, Mus musculus
gacatcccatgtgctaaaattattt

SEQ ID NO: 450162 - DNA, 25 bp, Mus musculus
gacatccccctgcttggttttatca

SEQ ID NO: 450163 - DNA, 25 bp, Mus musculus
gacatccccctggttggttttatca

SEQ ID NO: 450164 - DNA, 25 bp, Mus musculus
gacatcccgagacattaaattccaa

SEQ ID NO: 450165 - DNA, 25 bp, Mus musculus
gacatcccgagagattaaattccaa

SEQ ID NO: 450166 - DNA, 25 bp, Mus musculus
gacatcccgcaacctaaggacaaga

SEQ ID NO: 450167 - DNA, 25 bp, Mus musculus
gacatcccgcaagctaaggacaaga

SEQ ID NO: 450168 - DNA, 25 bp, Mus musculus
gacatcccgtcgcagaagcaatgaa

SEQ ID NO: 450169 - DNA, 25 bp, Mus musculus
gacatcccgtcggagaagcaatgaa

SEQ ID NO: 450170 - DNA, 25 bp, Mus musculus
gacatcccttgacgcatctttatat

SEQ ID NO: 450171 - DNA, 25 bp, Mus musculus
gacatcccttgaggcatctttatat

SEQ ID NO: 450172 - DNA, 25 bp, Mus musculus
gacatccgactcaaactggagctcg

SEQ ID NO: 450173 - DNA, 25 bp, Mus musculus
gacatccgactctaactggagctcg

SEQ ID NO: 450174 - DNA, 25 bp, Mus musculus
gacatccgagacacctacgaactag

SEQ ID NO: 450175 - DNA, 25 bp, Mus musculus
gacatccgagactcctacgaactag

SEQ ID NO: 450176 - DNA, 25 bp, Mus musculus
gacatccgagtcaagtgaagccagt

SEQ ID NO: 450177 - DNA, 25 bp, Mus musculus
gacatccgagtctagtgaagccagt

SEQ ID NO: 450178 - DNA, 25 bp, Mus musculus
gacatccgcaaacatttgtatgcta

SEQ ID NO: 450179 - DNA, 25 bp, Mus musculus
gacatccgcaaagatttgtatgcta

SEQ ID NO: 450180 - DNA, 25 bp, Mus musculus
gacatccgcagtcgcgtgctaggca

SEQ ID NO: 450181 - DNA, 25 bp, Mus musculus
gacatccgcagtggcgtgctaggca

SEQ ID NO: 450182 - DNA, 25 bp, Mus musculus
gacatccggacaatatcttcagaaa

SEQ ID NO: 450183 - DNA, 25 bp, Mus musculus
gacatccggacattatcttcagaaa

SEQ ID NO: 450184 - DNA, 25 bp, Mus musculus
gacatccggctcatcatcgtggatg

SEQ ID NO: 450185 - DNA, 25 bp, Mus musculus
gacatccggctcttcatcgtggatg

SEQ ID NO: 450186 - DNA, 25 bp, Mus musculus
gacatccggtgtcacatcgggccga

SEQ ID NO: 450187 - DNA, 25 bp, Mus musculus
gacatccggtgtgacatcgggccga

SEQ ID NO: 450188 - DNA, 25 bp, Mus musculus
gacatccgttttccacagagccaca

SEQ ID NO: 450189 - DNA, 25 bp, Mus musculus
gacatccgttttgcacagagccaca

SEQ ID NO: 450190 - DNA, 25 bp, Mus musculus
gacatcctaggacagtgttctctgt

SEQ ID NO: 450191 - DNA, 25 bp, Mus musculus
gacatcctaggagagtgttctctgt

SEQ ID NO: 450192 - DNA, 25 bp, Mus musculus
gacatcctatagatggcggctgctc

SEQ ID NO: 450193 - DNA, 25 bp, Mus musculus
gacatcctatagttggcggctgctc

SEQ ID NO: 450194 - DNA, 25 bp, Mus musculus
gacatcctcactctttttgtaagaa

SEQ ID NO: 450195 - DNA, 25 bp, Mus musculus
gacatcctcactgtttttgtaagaa

SEQ ID NO: 450196 - DNA, 25 bp, Mus musculus
gacatcctcaggctggcaagtttag

SEQ ID NO: 450197 - DNA, 25 bp, Mus musculus
gacatcctcagggtggcaagtttag

SEQ ID NO: 450198 - DNA, 25 bp, Mus musculus
gacatcctcggacagctctaaatta

SEQ ID NO: 450199 - DNA, 25 bp, Mus musculus
gacatcctcggagagctctaaatta

SEQ ID NO: 450200 - DNA, 25 bp, Mus musculus
gacatcctcgtcactatattgaaaa

SEQ ID NO: 450201 - DNA, 25 bp, Mus musculus
gacatcctcgtctctatattgaaaa

SEQ ID NO: 450202 - DNA, 25 bp, Mus musculus
gacatcctctgtatctcaaaaacaa

SEQ ID NO: 450203 - DNA, 25 bp, Mus musculus
gacatcctctgtttctcaaaaacaa

SEQ ID NO: 450204 - DNA, 25 bp, Mus musculus
gacatcctgaccatactagttttct

SEQ ID NO: 450205 - DNA, 25 bp, Mus musculus
gacatcctgaccttactagttttct

SEQ ID NO: 450206 - DNA, 25 bp, Mus musculus
gacatcctgagcacattgtttctag

SEQ ID NO: 450207 - DNA, 25 bp, Mus musculus
gacatcctgagctcattgtttctag

SEQ ID NO: 450208 - DNA, 25 bp, Mus musculus
gacatcctgagtactgcaccatgac

SEQ ID NO: 450209 - DNA, 25 bp, Mus musculus
gacatcctgagtctcccagaggacc

SEQ ID NO: 450210 - DNA, 25 bp, Mus musculus
gacatcctgagtgtcccagaggacc

SEQ ID NO: 450211 - DNA, 25 bp, Mus musculus
gacatcctgagttctgcaccatgac

SEQ ID NO: 450212 - DNA, 25 bp, Mus musculus
gacatcctgatacaagctctactgg

SEQ ID NO: 450213 - DNA, 25 bp, Mus musculus
gacatcctgatagaagctctactgg

SEQ ID NO: 450214 - DNA, 25 bp, Mus musculus
gacatcctgctaaaggcaaggctgt

SEQ ID NO: 450215 - DNA, 25 bp, Mus musculus
gacatcctgctataggcaaggctgt

SEQ ID NO: 450216 - DNA, 25 bp, Mus musculus
gacatcctggaaatgactgtgcgct

SEQ ID NO: 450217 - DNA, 25 bp, Mus musculus
gacatcctggaacactggacagcca

SEQ ID NO: 450218 - DNA, 25 bp, Mus musculus
gacatcctggaagactggacagcca

SEQ ID NO: 450219 - DNA, 25 bp, Mus musculus
gacatcctggaattgactgtgcgct

SEQ ID NO: 450220 - DNA, 25 bp, Mus musculus
gacatcctgtagatatgaccagtct

SEQ ID NO: 450221 - DNA, 25 bp, Mus musculus
gacatcctgtagttatgaccagtct

SEQ ID NO: 450222 - DNA, 25 bp, Mus musculus
gacatccttctacagcaagagtcct

SEQ ID NO: 450223 - DNA, 25 bp, Mus musculus
gacatccttctagagcaagagtcct

SEQ ID NO: 450224 - DNA, 25 bp, Mus musculus
gacatccttctgacaggctgagcaa

SEQ ID NO: 450225 - DNA, 25 bp, Mus musculus
gacatccttctgtcaggctgagcaa

SEQ ID NO: 450226 - DNA, 25 bp, Mus musculus
gacatccttgccagcatgcactatg

SEQ ID NO: 450227 - DNA, 25 bp, Mus musculus
gacatccttgcctgcatgcactatg

SEQ ID NO: 450228 - DNA, 25 bp, Mus musculus
gacatccttggaaactaacatacct

SEQ ID NO: 450229 - DNA, 25 bp, Mus musculus
gacatccttggaaatcaatccagta

SEQ ID NO: 450230 - DNA, 25 bp, Mus musculus
gacatccttggatactaacatacct

SEQ ID NO: 450231 - DNA, 25 bp, Mus musculus
gacatccttggatatcaatccagta

SEQ ID NO: 450232 - DNA, 25 bp, Mus musculus
gacatccttgggacttaacaatcta

SEQ ID NO: 450233 - DNA, 25 bp, Mus musculus
gacatccttgggtcttaacaatcta

SEQ ID NO: 450234 - DNA, 25 bp, Mus musculus
gacatccttggtagaattcttagca

SEQ ID NO: 450235 - DNA, 25 bp, Mus musculus
gacatccttggttgaattcttagca

SEQ ID NO: 450236 - DNA, 25 bp, Mus musculus
gacatcctttcacaatatacagcca

SEQ ID NO: 450237 - DNA, 25 bp, Mus musculus
gacatcctttcagaatatacagcca

SEQ ID NO: 450238 - DNA, 25 bp, Mus musculus
gacatcctttcgattgaggacgcca

SEQ ID NO: 450239 - DNA, 25 bp, Mus musculus
gacatcctttcgtttgaggacgcca

SEQ ID NO: 450240 - DNA, 25 bp, Mus musculus
gacatcctttgaaaataactcaggt

SEQ ID NO: 450241 - DNA, 25 bp, Mus musculus
gacatcctttgataataactcaggt

SEQ ID NO: 450242 - DNA, 25 bp, Mus musculus
gacatcctttgcacatagtaaaatg

SEQ ID NO: 450243 - DNA, 25 bp, Mus musculus
gacatcctttgctcatagtaaaatg

SEQ ID NO: 450244 - DNA, 25 bp, Mus musculus
gacatcgaaataaaaccctgaggtt

SEQ ID NO: 450245 - DNA, 25 bp, Mus musculus
gacatcgaaatataaccctgaggtt

SEQ ID NO: 450246 - DNA, 25 bp, Mus musculus
gacatcgaagttctgtcacaacaga

SEQ ID NO: 450247 - DNA, 25 bp, Mus musculus
gacatcgaagttgtgtcacaacaga

SEQ ID NO: 450248 - DNA, 25 bp, Mus musculus
gacatcgacaacatggagcaggcag

SEQ ID NO: 450249 - DNA, 25 bp, Mus musculus
gacatcgacaacttggagcaggcag

SEQ ID NO: 450250 - DNA, 25 bp, Mus musculus
gacatcgaccatctgttctcagagg

SEQ ID NO: 450251 - DNA, 25 bp, Mus musculus
gacatcgaccatgtgttctcagagg

SEQ ID NO: 450252 - DNA, 25 bp, Mus musculus
gacatcgacgggaagtctcacctca

SEQ ID NO: 450253 - DNA, 25 bp, Mus musculus
gacatcgacgggtagtctcacctca

SEQ ID NO: 450254 - DNA, 25 bp, Mus musculus
gacatcgagaataaatcccagcacc

SEQ ID NO: 450255 - DNA, 25 bp, Mus musculus
gacatcgagaattaatcccagcacc

SEQ ID NO: 450256 - DNA, 25 bp, Mus musculus
gacatcgagcagcagctgtgtaatg

SEQ ID NO: 450257 - DNA, 25 bp, Mus musculus
gacatcgagcaggagctgtgtaatg

SEQ ID NO: 450258 - DNA, 25 bp, Mus musculus
gacatcgatatgctggtttcacttc

SEQ ID NO: 450259 - DNA, 25 bp, Mus musculus
gacatcgatatggtggtttcacttc

SEQ ID NO: 450260 - DNA, 25 bp, Mus musculus
gacatcgatgacagagaataatttt

SEQ ID NO: 450261 - DNA, 25 bp, Mus musculus
gacatcgatgactgagaataatttt

SEQ ID NO: 450262 - DNA, 25 bp, Mus musculus
gacatcgatggccaacatttgtaga

SEQ ID NO: 450263 - DNA, 25 bp, Mus musculus
gacatcgatggcgaacatttgtaga

SEQ ID NO: 450264 - DNA, 25 bp, Mus musculus
gacatcgattatcacttcctcaacg

SEQ ID NO: 450265 - DNA, 25 bp, Mus musculus
gacatcgattatgacttcctcaacg

SEQ ID NO: 450266 - DNA, 25 bp, Mus musculus
gacatcgcacccatggacattggag

SEQ ID NO: 450267 - DNA, 25 bp, Mus musculus
gacatcgcacccttggacattggag

SEQ ID NO: 450268 - DNA, 25 bp, Mus musculus
gacatcgcagaaatggctgcatttt

SEQ ID NO: 450269 - DNA, 25 bp, Mus musculus
gacatcgcagaattggctgcatttt

SEQ ID NO: 450270 - DNA, 25 bp, Mus musculus
gacatcgccaccacagagaaaactt

SEQ ID NO: 450271 - DNA, 25 bp, Mus musculus
gacatcgccacctcagagaaaactt

SEQ ID NO: 450272 - DNA, 25 bp, Mus musculus
gacatcgctcacaaaatctcaggct

SEQ ID NO: 450273 - DNA, 25 bp, Mus musculus
gacatcgctcactaaatctcaggct

SEQ ID NO: 450274 - DNA, 25 bp, Mus musculus
gacatcgctttacttactgttaatg

SEQ ID NO: 450275 - DNA, 25 bp, Mus musculus
gacatcgctttagttactgttaatg

SEQ ID NO: 450276 - DNA, 25 bp, Mus musculus
gacatcggaaatacattagcctcta

SEQ ID NO: 450277 - DNA, 25 bp, Mus musculus
gacatcggaaattcattagcctcta

SEQ ID NO: 450278 - DNA, 25 bp, Mus musculus
gacatcggaagacagatcgcagcct

SEQ ID NO: 450279 - DNA, 25 bp, Mus musculus
gacatcggaagagagatcgcagcct

SEQ ID NO: 450280 - DNA, 25 bp, Mus musculus
gacatcggcaaaactggatctgcag

SEQ ID NO: 450281 - DNA, 25 bp, Mus musculus
gacatcggcaaatctggatctgcag

SEQ ID NO: 450282 - DNA, 25 bp, Mus musculus
gacatcggccaaaggaaccaagtaa

SEQ ID NO: 450283 - DNA, 25 bp, Mus musculus
gacatcggccaatggaaccaagtaa

SEQ ID NO: 450284 - DNA, 25 bp, Mus musculus
gacatcggctagagacagtacgtgt

SEQ ID NO: 450285 - DNA, 25 bp, Mus musculus
gacatcggctagtgacagtacgtgt

SEQ ID NO: 450286 - DNA, 25 bp, Mus musculus
gacatcggctctattgagctcgaat

SEQ ID NO: 450287 - DNA, 25 bp, Mus musculus
gacatcggctcttttgagctcgaat

SEQ ID NO: 450288 - DNA, 25 bp, Mus musculus
gacatcgtccatcatctagaaggtg

SEQ ID NO: 450289 - DNA, 25 bp, Mus musculus
gacatcgtccatgatctagaaggtg

SEQ ID NO: 450290 - DNA, 25 bp, Mus musculus
gacatcgtcccaacaaatttaccac

SEQ ID NO: 450291 - DNA, 25 bp, Mus musculus
gacatcgtcccacccttgagaagtt

SEQ ID NO: 450292 - DNA, 25 bp, Mus musculus
gacatcgtcccagccttgagaagtt

SEQ ID NO: 450293 - DNA, 25 bp, Mus musculus
gacatcgtcccatcaaatttaccac

SEQ ID NO: 450294 - DNA, 25 bp, Mus musculus
gacatcgtcgatcggggatacgtcc

SEQ ID NO: 450295 - DNA, 25 bp, Mus musculus
gacatcgtcgatgggggatacgtcc

SEQ ID NO: 450296 - DNA, 25 bp, Mus musculus
gacatcgtcgtgaggacacctgagt

SEQ ID NO: 450297 - DNA, 25 bp, Mus musculus
gacatcgtcgtgtggacacctgagt

SEQ ID NO: 450298 - DNA, 25 bp, Mus musculus
gacatcgtgaataacaactcaggtt

SEQ ID NO: 450299 - DNA, 25 bp, Mus musculus
gacatcgtgaattacaactcaggtt

SEQ ID NO: 450300 - DNA, 25 bp, Mus musculus
gacatcgtgcgaaatttgcgttccg

SEQ ID NO: 450301 - DNA, 25 bp, Mus musculus
gacatcgtgcgatatttgcgttccg

SEQ ID NO: 450302 - DNA, 25 bp, Mus musculus
gacatcgtgtttcaggactttgccc

SEQ ID NO: 450303 - DNA, 25 bp, Mus musculus
gacatcgtgtttgaggactttgccc

SEQ ID NO: 450304 - DNA, 25 bp, Mus musculus
gacatcgttcatcccttcctgtcga

SEQ ID NO: 450305 - DNA, 25 bp, Mus musculus
gacatcgttcatgccttcctgtcga

SEQ ID NO: 450306 - DNA, 25 bp, Mus musculus
gacatcgtttgtaccactcaacagt

SEQ ID NO: 450307 - DNA, 25 bp, Mus musculus
gacatcgtttgttccactcaacagt

SEQ ID NO: 450308 - DNA, 25 bp, Mus musculus
gacatctaagtcatctgctgggata

SEQ ID NO: 450309 - DNA, 25 bp, Mus musculus
gacatctaagtcttctgctgggata

SEQ ID NO: 450310 - DNA, 25 bp, Mus musculus
gacatctacaacatagtgacttggt

SEQ ID NO: 450311 - DNA, 25 bp, Mus musculus
gacatctacaacttagtgacttggt

SEQ ID NO: 450312 - DNA, 25 bp, Mus musculus
gacatctacagcacgtgcaggaact

SEQ ID NO: 450313 - DNA, 25 bp, Mus musculus
gacatctacagctcgtgcaggaact

SEQ ID NO: 450314 - DNA, 25 bp, Mus musculus
gacatctaccagatttcacatgata

SEQ ID NO: 450315 - DNA, 25 bp, Mus musculus
gacatctaccagttttcacatgata

SEQ ID NO: 450316 - DNA, 25 bp, Mus musculus
gacatctaccttatatttcaaccct

SEQ ID NO: 450317 - DNA, 25 bp, Mus musculus
gacatctaccttttatttcaaccct

SEQ ID NO: 450318 - DNA, 25 bp, Mus musculus
gacatctacttccagtgaccttgga

SEQ ID NO: 450319 - DNA, 25 bp, Mus musculus
gacatctacttcgagtgaccttgga

SEQ ID NO: 450320 - DNA, 25 bp, Mus musculus
gacatctacttgaatctcagaggac

SEQ ID NO: 450321 - DNA, 25 bp, Mus musculus
gacatctacttgtatctcagaggac

SEQ ID NO: 450322 - DNA, 25 bp, Mus musculus
gacatctagaatcatccccgacatg

SEQ ID NO: 450323 - DNA, 25 bp, Mus musculus
gacatctagaatgatccccgacatg

SEQ ID NO: 450324 - DNA, 25 bp, Mus musculus
gacatctagattaggatatcaagaa

SEQ ID NO: 450325 - DNA, 25 bp, Mus musculus
gacatctagatttggatatcaagaa

SEQ ID NO: 450326 - DNA, 25 bp, Mus musculus
gacatctatcatctactgggtctat

SEQ ID NO: 450327 - DNA, 25 bp, Mus musculus
gacatctatcatgtactgggtctat

SEQ ID NO: 450328 - DNA, 25 bp, Mus musculus
gacatctcacgtctccaggaacaga

SEQ ID NO: 450329 - DNA, 25 bp, Mus musculus
gacatctcacgtgtccaggaacaga

SEQ ID NO: 450330 - DNA, 25 bp, Mus musculus
gacatctcagaaaagaccatgcagc

SEQ ID NO: 450331 - DNA, 25 bp, Mus musculus
gacatctcagaatagaccatgcagc

SEQ ID NO: 450332 - DNA, 25 bp, Mus musculus
gacatctcaggcatttgtgggacat

SEQ ID NO: 450333 - DNA, 25 bp, Mus musculus
gacatctcaggcttttgtgggacat

SEQ ID NO: 450334 - DNA, 25 bp, Mus musculus
gacatctccaagaacagaccttcca

SEQ ID NO: 450335 - DNA, 25 bp, Mus musculus
gacatctccaagatctacctgaagg

SEQ ID NO: 450336 - DNA, 25 bp, Mus musculus
gacatctccaagtacagaccttcca

SEQ ID NO: 450337 - DNA, 25 bp, Mus musculus
gacatctccaagttctacctgaagg

SEQ ID NO: 450338 - DNA, 25 bp, Mus musculus
gacatctccaataggctctcctact

SEQ ID NO: 450339 - DNA, 25 bp, Mus musculus
gacatctccaattggctctcctact

SEQ ID NO: 450340 - DNA, 25 bp, Mus musculus
gacatctcccgaaatctatctacag

SEQ ID NO: 450341 - DNA, 25 bp, Mus musculus
gacatctcccgatatctatctacag

SEQ ID NO: 450342 - DNA, 25 bp, Mus musculus
gacatctccttgatagcatgacact

SEQ ID NO: 450343 - DNA, 25 bp, Mus musculus
gacatctccttgttagcatgacact

SEQ ID NO: 450344 - DNA, 25 bp, Mus musculus
gacatctcctttcaaggccaggtat

SEQ ID NO: 450345 - DNA, 25 bp, Mus musculus
gacatctcctttgaaggccaggtat

SEQ ID NO: 450346 - DNA, 25 bp, Mus musculus
gacatctcgattactggatcctcaa

SEQ ID NO: 450347 - DNA, 25 bp, Mus musculus
gacatctcgatttctggatcctcaa

SEQ ID NO: 450348 - DNA, 25 bp, Mus musculus
gacatctcgcccacgtggtgttaag

SEQ ID NO: 450349 - DNA, 25 bp, Mus musculus
gacatctcgccctcgtggtgttaag

SEQ ID NO: 450350 - DNA, 25 bp, Mus musculus
gacatctctatgatccttgcagaag

SEQ ID NO: 450351 - DNA, 25 bp, Mus musculus
gacatctctatgttccttgcagaag

SEQ ID NO: 450352 - DNA, 25 bp, Mus musculus
gacatctctcaaattcaggatcttt

SEQ ID NO: 450353 - DNA, 25 bp, Mus musculus
gacatctctcaatttcaggatcttt

SEQ ID NO: 450354 - DNA, 25 bp, Mus musculus
gacatctctgacagctgtgcacaaa

SEQ ID NO: 450355 - DNA, 25 bp, Mus musculus
gacatctctgactgctgtgcacaaa

SEQ ID NO: 450356 - DNA, 25 bp, Mus musculus
gacatctctgagcacaatttccaac

SEQ ID NO: 450357 - DNA, 25 bp, Mus musculus
gacatctctgaggacaatttccaac

SEQ ID NO: 450358 - DNA, 25 bp, Mus musculus
gacatctctgggacacgtgcctggt

SEQ ID NO: 450359 - DNA, 25 bp, Mus musculus
gacatctctgggatcacgtgcatca

SEQ ID NO: 450360 - DNA, 25 bp, Mus musculus
gacatctctgggtcacgtgcctggt

SEQ ID NO: 450361 - DNA, 25 bp, Mus musculus
gacatctctgggttcacgtgcatca

SEQ ID NO: 450362 - DNA, 25 bp, Mus musculus
gacatctcttccatctaaacaagtg

SEQ ID NO: 450363 - DNA, 25 bp, Mus musculus
gacatctcttccttctaaacaagtg

SEQ ID NO: 450364 - DNA, 25 bp, Mus musculus
gacatctctttcatcctggggagaa

SEQ ID NO: 450365 - DNA, 25 bp, Mus musculus
gacatctctttcttcctggggagaa

SEQ ID NO: 450366 - DNA, 25 bp, Mus musculus
gacatctgaaacagtgcctatgaat

SEQ ID NO: 450367 - DNA, 25 bp, Mus musculus
gacatctgaaactgtgcctatgaat

SEQ ID NO: 450368 - DNA, 25 bp, Mus musculus
gacatctgagtcactgagctggttg

SEQ ID NO: 450369 - DNA, 25 bp, Mus musculus
gacatctgagtctctgagctggttg

SEQ ID NO: 450370 - DNA, 25 bp, Mus musculus
gacatctgagttactattacattta

SEQ ID NO: 450371 - DNA, 25 bp, Mus musculus
gacatctgagtttctattacattta

SEQ ID NO: 450372 - DNA, 25 bp, Mus musculus
gacatctgatagcacactcttgtga

SEQ ID NO: 450373 - DNA, 25 bp, Mus musculus
gacatctgataggacactcttgtga

SEQ ID NO: 450374 - DNA, 25 bp, Mus musculus
gacatctgcaagacttttaagcaac

SEQ ID NO: 450375 - DNA, 25 bp, Mus musculus
gacatctgcaagtcttttaagcaac

SEQ ID NO: 450376 - DNA, 25 bp, Mus musculus
gacatctgcactatctacttaaatc

SEQ ID NO: 450377 - DNA, 25 bp, Mus musculus
gacatctgcactttctacttaaatc

SEQ ID NO: 450378 - DNA, 25 bp, Mus musculus
gacatctgcttaaccatcagtcagt

SEQ ID NO: 450379 - DNA, 25 bp, Mus musculus
gacatctgcttatccatcagtcagt

SEQ ID NO: 450380 - DNA, 25 bp, Mus musculus
gacatctgctttattagtcactgat

SEQ ID NO: 450381 - DNA, 25 bp, Mus musculus
gacatctgctttcatgtggagactg

SEQ ID NO: 450382 - DNA, 25 bp, Mus musculus
gacatctgctttgatgtggagactg

SEQ ID NO: 450383 - DNA, 25 bp, Mus musculus
gacatctgcttttttagtcactgat

SEQ ID NO: 450384 - DNA, 25 bp, Mus musculus
gacatctggaataagaatctgtatt

SEQ ID NO: 450385 - DNA, 25 bp, Mus musculus
gacatctggaattagaatctgtatt

SEQ ID NO: 450386 - DNA, 25 bp, Mus musculus
gacatctggatcagaaggctcgcac

SEQ ID NO: 450387 - DNA, 25 bp, Mus musculus
gacatctggatctgaaggctcgcac

SEQ ID NO: 450388 - DNA, 25 bp, Mus musculus
gacatctggcataacttgtgaagca

SEQ ID NO: 450389 - DNA, 25 bp, Mus musculus
gacatctggcattacttgtgaagca

SEQ ID NO: 450390 - DNA, 25 bp, Mus musculus
gacatctggccaaatcccttgcagt

SEQ ID NO: 450391 - DNA, 25 bp, Mus musculus
gacatctggccatatcccttgcagt

SEQ ID NO: 450392 - DNA, 25 bp, Mus musculus
gacatctgggaccttacacgtgcaa

SEQ ID NO: 450393 - DNA, 25 bp, Mus musculus
gacatctgggacgttacacgtgcaa

SEQ ID NO: 450394 - DNA, 25 bp, Mus musculus
gacatctgggtcataaggcttccac

SEQ ID NO: 450395 - DNA, 25 bp, Mus musculus
gacatctgggtcttaaggcttccac

SEQ ID NO: 450396 - DNA, 25 bp, Mus musculus
gacatctgggttatggatcactaca

SEQ ID NO: 450397 - DNA, 25 bp, Mus musculus
gacatctgggttttggatcactaca

SEQ ID NO: 450398 - DNA, 25 bp, Mus musculus
gacatctgtagcacgctgggctgag

SEQ ID NO: 450399 - DNA, 25 bp, Mus musculus
gacatctgtagctcgctgggctgag

SEQ ID NO: 450400 - DNA, 25 bp, Mus musculus
gacatctgtagtccttttctttaag

SEQ ID NO: 450401 - DNA, 25 bp, Mus musculus
gacatctgtagtgcttttctttaag

SEQ ID NO: 450402 - DNA, 25 bp, Mus musculus
gacatctgtattagcctccttggca

SEQ ID NO: 450403 - DNA, 25 bp, Mus musculus
gacatctgtatttgcctccttggca

SEQ ID NO: 450404 - DNA, 25 bp, Mus musculus
gacatctgtcagattccaggctttg

SEQ ID NO: 450405 - DNA, 25 bp, Mus musculus
gacatctgtcagtttccaggctttg

SEQ ID NO: 450406 - DNA, 25 bp, Mus musculus
gacatctgtcctccacaagtataat

SEQ ID NO: 450407 - DNA, 25 bp, Mus musculus
gacatctgtcctgcacaagtataat

SEQ ID NO: 450408 - DNA, 25 bp, Mus musculus
gacatctgtctcataagttactgca

SEQ ID NO: 450409 - DNA, 25 bp, Mus musculus
gacatctgtctcatattccatatct

SEQ ID NO: 450410 - DNA, 25 bp, Mus musculus
gacatctgtctcttaagttactgca

SEQ ID NO: 450411 - DNA, 25 bp, Mus musculus
gacatctgtctcttattccatatct

SEQ ID NO: 450412 - DNA, 25 bp, Mus musculus
gacatctgtctgagtaaggattcca

SEQ ID NO: 450413 - DNA, 25 bp, Mus musculus
gacatctgtctgtgtaaggattcca

SEQ ID NO: 450414 - DNA, 25 bp, Mus musculus
gacatctgtcttatcattgtacatg

SEQ ID NO: 450415 - DNA, 25 bp, Mus musculus
gacatctgtcttttcattgtacatg

SEQ ID NO: 450416 - DNA, 25 bp, Mus musculus
gacatctgtgaaaaccgtccttatt

SEQ ID NO: 450417 - DNA, 25 bp, Mus musculus
gacatctgtgaataccgtccttatt

SEQ ID NO: 450418 - DNA, 25 bp, Mus musculus
gacatctgtgtcatgatatatcctt

SEQ ID NO: 450419 - DNA, 25 bp, Mus musculus
gacatctgtgtcttgatatatcctt

SEQ ID NO: 450420 - DNA, 25 bp, Mus musculus
gacatctgtgttatcacctgtgttt

SEQ ID NO: 450421 - DNA, 25 bp, Mus musculus
gacatctgtgttttcacctgtgttt

SEQ ID NO: 450422 - DNA, 25 bp, Mus musculus
gacatctgttccagtgaaacatcac

SEQ ID NO: 450423 - DNA, 25 bp, Mus musculus
gacatctgttcctgtgaaacatcac

SEQ ID NO: 450424 - DNA, 25 bp, Mus musculus
gacatctgttgaagcttagaccctt

SEQ ID NO: 450425 - DNA, 25 bp, Mus musculus
gacatctgttgacatctgttggcaa

SEQ ID NO: 450426 - DNA, 25 bp, Mus musculus
gacatctgttgagatctgttggcaa

SEQ ID NO: 450427 - DNA, 25 bp, Mus musculus
gacatctgttgatgcttagaccctt

SEQ ID NO: 450428 - DNA, 25 bp, Mus musculus
gacatctgttgcaccagggatttta

SEQ ID NO: 450429 - DNA, 25 bp, Mus musculus
gacatctgttgctccagggatttta

SEQ ID NO: 450430 - DNA, 25 bp, Mus musculus
gacatctgttgtctggcttcaaaac

SEQ ID NO: 450431 - DNA, 25 bp, Mus musculus
gacatctgttgtgtggcttcaaaac

SEQ ID NO: 450432 - DNA, 25 bp, Mus musculus
gacatcttagtaactgcctttttaa

SEQ ID NO: 450433 - DNA, 25 bp, Mus musculus
gacatcttagtatctgcctttttaa

SEQ ID NO: 450434 - DNA, 25 bp, Mus musculus
gacatcttatccctgtgttatttta

SEQ ID NO: 450435 - DNA, 25 bp, Mus musculus
gacatcttatccgtgtgttatttta

SEQ ID NO: 450436 - DNA, 25 bp, Mus musculus
gacatcttatggcacccaggcactc

SEQ ID NO: 450437 - DNA, 25 bp, Mus musculus
gacatcttatgggacccaggcactc

SEQ ID NO: 450438 - DNA, 25 bp, Mus musculus
gacatcttgactcattttacactga

SEQ ID NO: 450439 - DNA, 25 bp, Mus musculus
gacatcttgactgattttacactga

SEQ ID NO: 450440 - DNA, 25 bp, Mus musculus
gacatcttgatgctatagactatcg

SEQ ID NO: 450441 - DNA, 25 bp, Mus musculus
gacatcttgatggtatagactatcg

SEQ ID NO: 450442 - DNA, 25 bp, Mus musculus
gacatcttgattaccaggctgtgct

SEQ ID NO: 450443 - DNA, 25 bp, Mus musculus
gacatcttgatttccaggctgtgct

SEQ ID NO: 450444 - DNA, 25 bp, Mus musculus
gacatcttgcagaatatccgggacc

SEQ ID NO: 450445 - DNA, 25 bp, Mus musculus
gacatcttgcagtatatccgggacc

SEQ ID NO: 450446 - DNA, 25 bp, Mus musculus
gacatcttggaaaattcatcagcct

SEQ ID NO: 450447 - DNA, 25 bp, Mus musculus
gacatcttggaatattcatcagcct

SEQ ID NO: 450448 - DNA, 25 bp, Mus musculus
gacatcttggacattgacttcctgg

SEQ ID NO: 450449 - DNA, 25 bp, Mus musculus
gacatcttggactttgacttcctgg

SEQ ID NO: 450450 - DNA, 25 bp, Mus musculus
gacatcttgtatattgcatataaac

SEQ ID NO: 450451 - DNA, 25 bp, Mus musculus
gacatcttgtattttgcatataaac

SEQ ID NO: 450452 - DNA, 25 bp, Mus musculus
gacatcttgtggcatctcacagcca

SEQ ID NO: 450453 - DNA, 25 bp, Mus musculus
gacatcttgtgggatctcacagcca

SEQ ID NO: 450454 - DNA, 25 bp, Mus musculus
gacatctttccaaactcaggtcaca

SEQ ID NO: 450455 - DNA, 25 bp, Mus musculus
gacatctttccatactcaggtcaca

SEQ ID NO: 450456 - DNA, 25 bp, Mus musculus
gacatctttcgcattaggaaatgca

SEQ ID NO: 450457 - DNA, 25 bp, Mus musculus
gacatctttcgctttaggaaatgca

SEQ ID NO: 450458 - DNA, 25 bp, Mus musculus
gacatctttctcaaatgctctagga

SEQ ID NO: 450459 - DNA, 25 bp, Mus musculus
gacatctttctctaatgctctagga

SEQ ID NO: 450460 - DNA, 25 bp, Mus musculus
gacatctttgacatgctgctcacat

SEQ ID NO: 450461 - DNA, 25 bp, Mus musculus
gacatctttgacttgctgctcacat

SEQ ID NO: 450462 - DNA, 25 bp, Mus musculus
gacatctttgtaccctgtgttcata

SEQ ID NO: 450463 - DNA, 25 bp, Mus musculus
gacatctttgtagcctgtgttcata

SEQ ID NO: 450464 - DNA, 25 bp, Mus musculus
gacatctttgttctttagtgcagtt

SEQ ID NO: 450465 - DNA, 25 bp, Mus musculus
gacatctttgttgtttagtgcagtt

SEQ ID NO: 450466 - DNA, 25 bp, Mus musculus
gacatcttttctagggctacagggt

SEQ ID NO: 450467 - DNA, 25 bp, Mus musculus
gacatcttttcttgggctacagggt

SEQ ID NO: 450468 - DNA, 25 bp, Mus musculus
gacatgaaaagtacctgtattttca

SEQ ID NO: 450469 - DNA, 25 bp, Mus musculus
gacatgaaaagttcctgtattttca

SEQ ID NO: 450470 - DNA, 25 bp, Mus musculus
gacatgaaaatcccacttctttacc

SEQ ID NO: 450471 - DNA, 25 bp, Mus musculus
gacatgaaaatcgcacttctttacc

SEQ ID NO: 450472 - DNA, 25 bp, Mus musculus
gacatgaaaccgcacactgtgagaa

SEQ ID NO: 450473 - DNA, 25 bp, Mus musculus
gacatgaaaccggacactgtgagaa

SEQ ID NO: 450474 - DNA, 25 bp, Mus musculus
gacatgaaagtcctcgatgacctga

SEQ ID NO: 450475 - DNA, 25 bp, Mus musculus
gacatgaaagtcgtcgatgacctga

SEQ ID NO: 450476 - DNA, 25 bp, Mus musculus
gacatgaaagtgaccagcacagaca

SEQ ID NO: 450477 - DNA, 25 bp, Mus musculus
gacatgaaagtgtccagcacagaca

SEQ ID NO: 450478 - DNA, 25 bp, Mus musculus
gacatgaaatccctccaacttgaat

SEQ ID NO: 450479 - DNA, 25 bp, Mus musculus
gacatgaaatccgtccaacttgaat

SEQ ID NO: 450480 - DNA, 25 bp, Mus musculus
gacatgaaatgcagctttctcttgg

SEQ ID NO: 450481 - DNA, 25 bp, Mus musculus
gacatgaaatgctgctttctcttgg

SEQ ID NO: 450482 - DNA, 25 bp, Mus musculus
gacatgaagcaactctccttatgaa

SEQ ID NO: 450483 - DNA, 25 bp, Mus musculus
gacatgaagcaagtctccttatgaa

SEQ ID NO: 450484 - DNA, 25 bp, Mus musculus
gacatgaatacgcaggtcaccttgg

SEQ ID NO: 450485 - DNA, 25 bp, Mus musculus
gacatgaatacggaggtcaccttgg

SEQ ID NO: 450486 - DNA, 25 bp, Mus musculus
gacatgaattcaagttccccaaccg

SEQ ID NO: 450487 - DNA, 25 bp, Mus musculus
gacatgaattcatgttccccaaccg

SEQ ID NO: 450488 - DNA, 25 bp, Mus musculus
gacatgaattctatttccgaggccc

SEQ ID NO: 450489 - DNA, 25 bp, Mus musculus
gacatgaattctttttccgaggccc

SEQ ID NO: 450490 - DNA, 25 bp, Mus musculus
gacatgacacctcagtgcatttatg

SEQ ID NO: 450491 - DNA, 25 bp, Mus musculus
gacatgacacctgagtgcatttatg

SEQ ID NO: 450492 - DNA, 25 bp, Mus musculus
gacatgacagccatttattctgctt

SEQ ID NO: 450493 - DNA, 25 bp, Mus musculus
gacatgacagccttttattctgctt

SEQ ID NO: 450494 - DNA, 25 bp, Mus musculus
gacatgacaggcaggtactccacta

SEQ ID NO: 450495 - DNA, 25 bp, Mus musculus
gacatgacaggctggtactccacta

SEQ ID NO: 450496 - DNA, 25 bp, Mus musculus
gacatgacatgtcctctgtttttta

SEQ ID NO: 450497 - DNA, 25 bp, Mus musculus
gacatgacatgtgctctgtttttta

SEQ ID NO: 450498 - DNA, 25 bp, Mus musculus
gacatgaccaagatagcacaccaga

SEQ ID NO: 450499 - DNA, 25 bp, Mus musculus
gacatgaccaagttagcacaccaga

SEQ ID NO: 450500 - DNA, 25 bp, Mus musculus
gacatgaccaccaggtaaccgtagt

SEQ ID NO: 450501 - DNA, 25 bp, Mus musculus
gacatgaccacctggtaaccgtagt

SEQ ID NO: 450502 - DNA, 25 bp, Mus musculus
gacatgaccatgcacccagatcaga

SEQ ID NO: 450503 - DNA, 25 bp, Mus musculus
gacatgaccatggacccagatcaga

SEQ ID NO: 450504 - DNA, 25 bp, Mus musculus
gacatgacctaactctttaagacac

SEQ ID NO: 450505 - DNA, 25 bp, Mus musculus
gacatgacctaagtctttaagacac

SEQ ID NO: 450506 - DNA, 25 bp, Mus musculus
gacatgacgtctaacttgctggatc

SEQ ID NO: 450507 - DNA, 25 bp, Mus musculus
gacatgacgtcttacttgctggatc

SEQ ID NO: 450508 - DNA, 25 bp, Mus musculus
gacatgactaacctctgttaatggc

SEQ ID NO: 450509 - DNA, 25 bp, Mus musculus
gacatgactaacgtctgttaatggc

SEQ ID NO: 450510 - DNA, 25 bp, Mus musculus
gacatgactattccagatatactga

SEQ ID NO: 450511 - DNA, 25 bp, Mus musculus
gacatgactattgcagatatactga

SEQ ID NO: 450512 - DNA, 25 bp, Mus musculus
gacatgactcatcttgaaccccaag

SEQ ID NO: 450513 - DNA, 25 bp, Mus musculus
gacatgactcatgttgaaccccaag

SEQ ID NO: 450514 - DNA, 25 bp, Mus musculus
gacatgactgaaaaacgattctctg

SEQ ID NO: 450515 - DNA, 25 bp, Mus musculus
gacatgactgaataacgattctctg

SEQ ID NO: 450516 - DNA, 25 bp, Mus musculus
gacatgacttgtctcacttccatgg

SEQ ID NO: 450517 - DNA, 25 bp, Mus musculus
gacatgacttgtgtcacttccatgg

SEQ ID NO: 450518 - DNA, 25 bp, Mus musculus
gacatgactttcattcagcactgtt

SEQ ID NO: 450519 - DNA, 25 bp, Mus musculus
gacatgactttctttcagcactgtt

SEQ ID NO: 450520 - DNA, 25 bp, Mus musculus
gacatgagaccgcaaggccttctgg

SEQ ID NO: 450521 - DNA, 25 bp, Mus musculus
gacatgagaccggaaggccttctgg

SEQ ID NO: 450522 - DNA, 25 bp, Mus musculus
gacatgagactcaaggcctgacaag

SEQ ID NO: 450523 - DNA, 25 bp, Mus musculus
gacatgagactctaggcctgacaag

SEQ ID NO: 450524 - DNA, 25 bp, Mus musculus
gacatgagcaatatcccacagtgtg

SEQ ID NO: 450525 - DNA, 25 bp, Mus musculus
gacatgagcaatttcccacagtgtg

SEQ ID NO: 450526 - DNA, 25 bp, Mus musculus
gacatgagcatcaggaggtactgtt

SEQ ID NO: 450527 - DNA, 25 bp, Mus musculus
gacatgagcatctggaggtactgtt

SEQ ID NO: 450528 - DNA, 25 bp, Mus musculus
gacatgagccatcaagtgaatctta

SEQ ID NO: 450529 - DNA, 25 bp, Mus musculus
gacatgagccatgaagtgaatctta

SEQ ID NO: 450530 - DNA, 25 bp, Mus musculus
gacatgagcctcagactgtaaaata

SEQ ID NO: 450531 - DNA, 25 bp, Mus musculus
gacatgagcctctgactgtaaaata

SEQ ID NO: 450532 - DNA, 25 bp, Mus musculus
gacatgagcctgcatagctctggga

SEQ ID NO: 450533 - DNA, 25 bp, Mus musculus
gacatgagcctggatagctctggga

SEQ ID NO: 450534 - DNA, 25 bp, Mus musculus
gacatgagcggaacagtttctacct

SEQ ID NO: 450535 - DNA, 25 bp, Mus musculus
gacatgagcggatcagtttctacct

SEQ ID NO: 450536 - DNA, 25 bp, Mus musculus
gacatgagctctcacacatgtgaat

SEQ ID NO: 450537 - DNA, 25 bp, Mus musculus
gacatgagctctgacacatgtgaat

SEQ ID NO: 450538 - DNA, 25 bp, Mus musculus
gacatgagcttcacgttagcacatc

SEQ ID NO: 450539 - DNA, 25 bp, Mus musculus
gacatgagcttctcgttagcacatc

SEQ ID NO: 450540 - DNA, 25 bp, Mus musculus
gacatgagctttaacaactgggaca

SEQ ID NO: 450541 - DNA, 25 bp, Mus musculus
gacatgagcttttacaactgggaca

SEQ ID NO: 450542 - DNA, 25 bp, Mus musculus
gacatgaggacgaccacatgacact

SEQ ID NO: 450543 - DNA, 25 bp, Mus musculus
gacatgaggacgtccacatgacact

SEQ ID NO: 450544 - DNA, 25 bp, Mus musculus
gacatgaggtgactcctgagctcca

SEQ ID NO: 450545 - DNA, 25 bp, Mus musculus
gacatgaggtgagtcctgagctcca

SEQ ID NO: 450546 - DNA, 25 bp, Mus musculus
gacatgagtcccagagtggaacttt

SEQ ID NO: 450547 - DNA, 25 bp, Mus musculus
gacatgagtccctgagtggaacttt

SEQ ID NO: 450548 - DNA, 25 bp, Mus musculus
gacatgagtcctacactcccagaag

SEQ ID NO: 450549 - DNA, 25 bp, Mus musculus
gacatgagtccttcactcccagaag

SEQ ID NO: 450550 - DNA, 25 bp, Mus musculus
gacatgagtctgaagtagccagcag

SEQ ID NO: 450551 - DNA, 25 bp, Mus musculus
gacatgagtctgtagtagccagcag

SEQ ID NO: 450552 - DNA, 25 bp, Mus musculus
gacatgagttacatgctgagcccag

SEQ ID NO: 450553 - DNA, 25 bp, Mus musculus
gacatgagttacttgctgagcccag

SEQ ID NO: 450554 - DNA, 25 bp, Mus musculus
gacatgagttcaccagaccagcagg

SEQ ID NO: 450555 - DNA, 25 bp, Mus musculus
gacatgagttcagcagaccagcagg

SEQ ID NO: 450556 - DNA, 25 bp, Mus musculus
gacatgatagctacgaggtgcacct

SEQ ID NO: 450557 - DNA, 25 bp, Mus musculus
gacatgatagcttcgaggtgcacct

SEQ ID NO: 450558 - DNA, 25 bp, Mus musculus
gacatgatcacacccgttcttatag

SEQ ID NO: 450559 - DNA, 25 bp, Mus musculus
gacatgatcacagccgttcttatag

SEQ ID NO: 450560 - DNA, 25 bp, Mus musculus
gacatgatccatagcctgacagatt

SEQ ID NO: 450561 - DNA, 25 bp, Mus musculus
gacatgatccattgcctgacagatt

SEQ ID NO: 450562 - DNA, 25 bp, Mus musculus
gacatgatcgagagccttccttcaa

SEQ ID NO: 450563 - DNA, 25 bp, Mus musculus
gacatgatcgagtgccttccttcaa

SEQ ID NO: 450564 - DNA, 25 bp, Mus musculus
gacatgatctgaccgctcttatgca

SEQ ID NO: 450565 - DNA, 25 bp, Mus musculus
gacatgatctgagcgctcttatgca

SEQ ID NO: 450566 - DNA, 25 bp, Mus musculus
gacatgatctggctctaaactctga

SEQ ID NO: 450567 - DNA, 25 bp, Mus musculus
gacatgatctgggtctaaactctga

SEQ ID NO: 450568 - DNA, 25 bp, Mus musculus
gacatgatctgtccgatcctggaca

SEQ ID NO: 450569 - DNA, 25 bp, Mus musculus
gacatgatctgtgcgatcctggaca

SEQ ID NO: 450570 - DNA, 25 bp, Mus musculus
gacatgatgatgagccaagaccaag

SEQ ID NO: 450571 - DNA, 25 bp, Mus musculus
gacatgatgatgcagtccctcaagg

SEQ ID NO: 450572 - DNA, 25 bp, Mus musculus
gacatgatgatggagtccctcaagg

SEQ ID NO: 450573 - DNA, 25 bp, Mus musculus
gacatgatgatgtgccaagaccaag

SEQ ID NO: 450574 - DNA, 25 bp, Mus musculus
gacatgatgctcctccggcagtttc

SEQ ID NO: 450575 - DNA, 25 bp, Mus musculus
gacatgatgctcgtccggcagtttc

SEQ ID NO: 450576 - DNA, 25 bp, Mus musculus
gacatgatgcttcacgtgcagacta

SEQ ID NO: 450577 - DNA, 25 bp, Mus musculus
gacatgatgcttgacgtgcagacta

SEQ ID NO: 450578 - DNA, 25 bp, Mus musculus
gacatgatggacagtgaggacagac

SEQ ID NO: 450579 - DNA, 25 bp, Mus musculus
gacatgatggactgtgaggacagac

SEQ ID NO: 450580 - DNA, 25 bp, Mus musculus
gacatgatggatcctcctcagttga

SEQ ID NO: 450581 - DNA, 25 bp, Mus musculus
gacatgatggatgctcctcagttga

SEQ ID NO: 450582 - DNA, 25 bp, Mus musculus
gacatgatggcacatatctgttgta

SEQ ID NO: 450583 - DNA, 25 bp, Mus musculus
gacatgatggcagatatctgttgta

SEQ ID NO: 450584 - DNA, 25 bp, Mus musculus
gacatgatgggtcagcatcctacct

SEQ ID NO: 450585 - DNA, 25 bp, Mus musculus
gacatgatgggtgagcatcctacct

SEQ ID NO: 450586 - DNA, 25 bp, Mus musculus
gacatgatgtgaccagtcgctgcca

SEQ ID NO: 450587 - DNA, 25 bp, Mus musculus
gacatgatgtgagcagtcgctgcca

SEQ ID NO: 450588 - DNA, 25 bp, Mus musculus
gacatgatgtgtctggatcctgttt

SEQ ID NO: 450589 - DNA, 25 bp, Mus musculus
gacatgatgtgtgtggatcctgttt

SEQ ID NO: 450590 - DNA, 25 bp, Mus musculus
gacatgattgggattcagggactcc

SEQ ID NO: 450591 - DNA, 25 bp, Mus musculus
gacatgattgggtttcagggactcc

SEQ ID NO: 450592 - DNA, 25 bp, Mus musculus
gacatgatttcactcacactcaaaa

SEQ ID NO: 450593 - DNA, 25 bp, Mus musculus
gacatgatttcagtcacactcaaaa

SEQ ID NO: 450594 - DNA, 25 bp, Mus musculus
gacatgcaactacttacctcagggt

SEQ ID NO: 450595 - DNA, 25 bp, Mus musculus
gacatgcaactagttacctcagggt

SEQ ID NO: 450596 - DNA, 25 bp, Mus musculus
gacatgcaagagcttgttctgagcc

SEQ ID NO: 450597 - DNA, 25 bp, Mus musculus
gacatgcaagaggttgttctgagcc

SEQ ID NO: 450598 - DNA, 25 bp, Mus musculus
gacatgcaagcacttttaactccat

SEQ ID NO: 450599 - DNA, 25 bp, Mus musculus
gacatgcaagcagttttaactccat

SEQ ID NO: 450600 - DNA, 25 bp, Mus musculus
gacatgcaagtacgaccctttcttt

SEQ ID NO: 450601 - DNA, 25 bp, Mus musculus
gacatgcaagtaggaccctttcttt

SEQ ID NO: 450602 - DNA, 25 bp, Mus musculus
gacatgcaagtcatccaggacactg

SEQ ID NO: 450603 - DNA, 25 bp, Mus musculus
gacatgcaagtcttccaggacactg

SEQ ID NO: 450604 - DNA, 25 bp, Mus musculus
gacatgcacacacaggtttgtttcc

SEQ ID NO: 450605 - DNA, 25 bp, Mus musculus
gacatgcacacagaggtttgtttcc

SEQ ID NO: 450606 - DNA, 25 bp, Mus musculus
gacatgcacagcattaacgtaaaat

SEQ ID NO: 450607 - DNA, 25 bp, Mus musculus
gacatgcacagctttaacgtaaaat

SEQ ID NO: 450608 - DNA, 25 bp, Mus musculus
gacatgcacgacatctttgtgggac

SEQ ID NO: 450609 - DNA, 25 bp, Mus musculus
gacatgcacgacttctttgtgggac

SEQ ID NO: 450610 - DNA, 25 bp, Mus musculus
gacatgcagatacgattgcttctct

SEQ ID NO: 450611 - DNA, 25 bp, Mus musculus
gacatgcagataggattgcttctct

SEQ ID NO: 450612 - DNA, 25 bp, Mus musculus
gacatgcagctaagtgaatttcctt

SEQ ID NO: 450613 - DNA, 25 bp, Mus musculus
gacatgcagctacagactctgggct

SEQ ID NO: 450614 - DNA, 25 bp, Mus musculus
gacatgcagctagagactctgggct

SEQ ID NO: 450615 - DNA, 25 bp, Mus musculus
gacatgcagctatgtgaatttcctt

SEQ ID NO: 450616 - DNA, 25 bp, Mus musculus
gacatgcaggacacctgatacagga

SEQ ID NO: 450617 - DNA, 25 bp, Mus musculus
gacatgcaggactcctgatacagga

SEQ ID NO: 450618 - DNA, 25 bp, Mus musculus
gacatgcagttcaatattttgtttt

SEQ ID NO: 450619 - DNA, 25 bp, Mus musculus
gacatgcagttctatattttgtttt

SEQ ID NO: 450620 - DNA, 25 bp, Mus musculus
gacatgcagttgaatatgttgtttg

SEQ ID NO: 450621 - DNA, 25 bp, Mus musculus
gacatgcagttgtatatgttgtttg

SEQ ID NO: 450622 - DNA, 25 bp, Mus musculus
gacatgcagtttataggttgtgggt

SEQ ID NO: 450623 - DNA, 25 bp, Mus musculus
gacatgcagtttttaggttgtgggt

SEQ ID NO: 450624 - DNA, 25 bp, Mus musculus
gacatgcataaaacacaacatacat

SEQ ID NO: 450625 - DNA, 25 bp, Mus musculus
gacatgcataaatcacaacatacat

SEQ ID NO: 450626 - DNA, 25 bp, Mus musculus
gacatgcatgtacgccagggccttg

SEQ ID NO: 450627 - DNA, 25 bp, Mus musculus
gacatgcatgtaggccagggccttg

SEQ ID NO: 450628 - DNA, 25 bp, Mus musculus
gacatgcattcaaaaggtctgcgaa

SEQ ID NO: 450629 - DNA, 25 bp, Mus musculus
gacatgcattcataaggtctgcgaa

SEQ ID NO: 450630 - DNA, 25 bp, Mus musculus
gacatgccacagacctggtggcgag

SEQ ID NO: 450631 - DNA, 25 bp, Mus musculus
gacatgccacagagcacacacgtga

SEQ ID NO: 450632 - DNA, 25 bp, Mus musculus
gacatgccacagtcctggtggcgag

SEQ ID NO: 450633 - DNA, 25 bp, Mus musculus
gacatgccacagtgcacacacgtga

SEQ ID NO: 450634 - DNA, 25 bp, Mus musculus
gacatgccacttcagctaaagctag

SEQ ID NO: 450635 - DNA, 25 bp, Mus musculus
gacatgccacttgagctaaagctag

SEQ ID NO: 450636 - DNA, 25 bp, Mus musculus
gacatgccaggaatggttggtcaga

SEQ ID NO: 450637 - DNA, 25 bp, Mus musculus
gacatgccaggattggttggtcaga

SEQ ID NO: 450638 - DNA, 25 bp, Mus musculus
gacatgccataaacccaaggctggt

SEQ ID NO: 450639 - DNA, 25 bp, Mus musculus
gacatgccataactttgtaaatcta

SEQ ID NO: 450640 - DNA, 25 bp, Mus musculus
gacatgccataagtttgtaaatcta

SEQ ID NO: 450641 - DNA, 25 bp, Mus musculus
gacatgccataatcccaaggctggt

SEQ ID NO: 450642 - DNA, 25 bp, Mus musculus
gacatgccatagagcaccgagtctg

SEQ ID NO: 450643 - DNA, 25 bp, Mus musculus
gacatgccatagtgcaccgagtctg

SEQ ID NO: 450644 - DNA, 25 bp, Mus musculus
gacatgccatctagactgtagggtc

SEQ ID NO: 450645 - DNA, 25 bp, Mus musculus
gacatgccatcttgactgtagggtc

SEQ ID NO: 450646 - DNA, 25 bp, Mus musculus
gacatgcccaggatttaaaggtcct

SEQ ID NO: 450647 - DNA, 25 bp, Mus musculus
gacatgcccaggttttaaaggtcct

SEQ ID NO: 450648 - DNA, 25 bp, Mus musculus
gacatgcccggaactaacaagaata

SEQ ID NO: 450649 - DNA, 25 bp, Mus musculus
gacatgcccggatctaacaagaata

SEQ ID NO: 450650 - DNA, 25 bp, Mus musculus
gacatgccgaacattctggaagccc

SEQ ID NO: 450651 - DNA, 25 bp, Mus musculus
gacatgccgaactttctggaagccc

SEQ ID NO: 450652 - DNA, 25 bp, Mus musculus
gacatgccggacattgaggatgatg

SEQ ID NO: 450653 - DNA, 25 bp, Mus musculus
gacatgccggactttgaggatgatg

SEQ ID NO: 450654 - DNA, 25 bp, Mus musculus
gacatgcctacactcctaataaaac

SEQ ID NO: 450655 - DNA, 25 bp, Mus musculus
gacatgcctacagtcctaataaaac

SEQ ID NO: 450656 - DNA, 25 bp, Mus musculus
gacatgcctaccctgaaagcagctg

SEQ ID NO: 450657 - DNA, 25 bp, Mus musculus
gacatgcctaccgtgaaagcagctg

SEQ ID NO: 450658 - DNA, 25 bp, Mus musculus
gacatgcctattaagaacacctcta

SEQ ID NO: 450659 - DNA, 25 bp, Mus musculus
gacatgcctatttagaacacctcta

SEQ ID NO: 450660 - DNA, 25 bp, Mus musculus
gacatgcctggcaagttggaactct

SEQ ID NO: 450661 - DNA, 25 bp, Mus musculus
gacatgcctggcaggacatttactt

SEQ ID NO: 450662 - DNA, 25 bp, Mus musculus
gacatgcctggctagttggaactct

SEQ ID NO: 450663 - DNA, 25 bp, Mus musculus
gacatgcctggctggacatttactt

SEQ ID NO: 450664 - DNA, 25 bp, Mus musculus
gacatgcctgttctgagatgaacct

SEQ ID NO: 450665 - DNA, 25 bp, Mus musculus
gacatgcctgttgtgagatgaacct

SEQ ID NO: 450666 - DNA, 25 bp, Mus musculus
gacatgcctttaatgacccgtttgt

SEQ ID NO: 450667 - DNA, 25 bp, Mus musculus
gacatgcctttattgacccgtttgt

SEQ ID NO: 450668 - DNA, 25 bp, Mus musculus
gacatgcgagatacggtctctgccc

SEQ ID NO: 450669 - DNA, 25 bp, Mus musculus
gacatgcgagattcggtctctgccc

SEQ ID NO: 450670 - DNA, 25 bp, Mus musculus
gacatgcgccccagagaggactaga

SEQ ID NO: 450671 - DNA, 25 bp, Mus musculus
gacatgcgccccatgaagaagctgg

SEQ ID NO: 450672 - DNA, 25 bp, Mus musculus
gacatgcgcccctgagaggactaga

SEQ ID NO: 450673 - DNA, 25 bp, Mus musculus
gacatgcgccccttgaagaagctgg

SEQ ID NO: 450674 - DNA, 25 bp, Mus musculus
gacatgcgctggaatttggttaaat

SEQ ID NO: 450675 - DNA, 25 bp, Mus musculus
gacatgcgctggtatttggttaaat

SEQ ID NO: 450676 - DNA, 25 bp, Mus musculus
gacatgcggtctagtccagtttttt

SEQ ID NO: 450677 - DNA, 25 bp, Mus musculus
gacatgcggtcttgtccagtttttt

SEQ ID NO: 450678 - DNA, 25 bp, Mus musculus
gacatgcgtcttagtacagctttaa

SEQ ID NO: 450679 - DNA, 25 bp, Mus musculus
gacatgcgtctttgtacagctttaa

SEQ ID NO: 450680 - DNA, 25 bp, Mus musculus
gacatgcgtgttaactatgcacagg

SEQ ID NO: 450681 - DNA, 25 bp, Mus musculus
gacatgcgtgtttactatgcacagg

SEQ ID NO: 450682 - DNA, 25 bp, Mus musculus
gacatgcgtttgattccacagtttt

SEQ ID NO: 450683 - DNA, 25 bp, Mus musculus
gacatgcgtttgcagacagtcctta

SEQ ID NO: 450684 - DNA, 25 bp, Mus musculus
gacatgcgtttggagacagtcctta

SEQ ID NO: 450685 - DNA, 25 bp, Mus musculus
gacatgcgtttgtttccacagtttt

SEQ ID NO: 450686 - DNA, 25 bp, Mus musculus
gacatgctacctaggattgtcctgt

SEQ ID NO: 450687 - DNA, 25 bp, Mus musculus
gacatgctaccttggattgtcctgt

SEQ ID NO: 450688 - DNA, 25 bp, Mus musculus
gacatgctatcacgtatggacacaa

SEQ ID NO: 450689 - DNA, 25 bp, Mus musculus
gacatgctatcaggtatggacacaa

SEQ ID NO: 450690 - DNA, 25 bp, Mus musculus
gacatgctatgtaatagtcaacctt

SEQ ID NO: 450691 - DNA, 25 bp, Mus musculus
gacatgctatgttatagtcaacctt

SEQ ID NO: 450692 - DNA, 25 bp, Mus musculus
gacatgctcaggagtatgctgggaa

SEQ ID NO: 450693 - DNA, 25 bp, Mus musculus
gacatgctcaggtgtatgctgggaa

SEQ ID NO: 450694 - DNA, 25 bp, Mus musculus
gacatgctcatgctgaagccgggat

SEQ ID NO: 450695 - DNA, 25 bp, Mus musculus
gacatgctcatggtgaagccgggat

SEQ ID NO: 450696 - DNA, 25 bp, Mus musculus
gacatgctccccaaaacgaaaatga

SEQ ID NO: 450697 - DNA, 25 bp, Mus musculus
gacatgctcccctaaacgaaaatga

SEQ ID NO: 450698 - DNA, 25 bp, Mus musculus
gacatgctcctgactgaaaaccttg

SEQ ID NO: 450699 - DNA, 25 bp, Mus musculus
gacatgctcctgtctgaaaaccttg

SEQ ID NO: 450700 - DNA, 25 bp, Mus musculus
gacatgctccttagcctaatagtta

SEQ ID NO: 450701 - DNA, 25 bp, Mus musculus
gacatgctcctttgcctaatagtta

SEQ ID NO: 450702 - DNA, 25 bp, Mus musculus
gacatgctctatcggcagccggaga

SEQ ID NO: 450703 - DNA, 25 bp, Mus musculus
gacatgctctatgggcagccggaga

SEQ ID NO: 450704 - DNA, 25 bp, Mus musculus
gacatgctctggactcattcaatgc

SEQ ID NO: 450705 - DNA, 25 bp, Mus musculus
gacatgctctggtctcattcaatgc

SEQ ID NO: 450706 - DNA, 25 bp, Mus musculus
gacatgctctgtagggcagtttcct

SEQ ID NO: 450707 - DNA, 25 bp, Mus musculus
gacatgctctgttgggcagtttcct

SEQ ID NO: 450708 - DNA, 25 bp, Mus musculus
gacatgctgctgagtacgtccggcc

SEQ ID NO: 450709 - DNA, 25 bp, Mus musculus
gacatgctgctgcaacaagtggtta

SEQ ID NO: 450710 - DNA, 25 bp, Mus musculus
gacatgctgctggaacaagtggtta

SEQ ID NO: 450711 - DNA, 25 bp, Mus musculus
gacatgctgctgtgtacgtccggcc

SEQ ID NO: 450712 - DNA, 25 bp, Mus musculus
gacatgctggacatggcttccagga

SEQ ID NO: 450713 - DNA, 25 bp, Mus musculus
gacatgctggacttggcttccagga

SEQ ID NO: 450714 - DNA, 25 bp, Mus musculus
gacatgctgggtcttttaatcaatg

SEQ ID NO: 450715 - DNA, 25 bp, Mus musculus
gacatgctgggtgttttaatcaatg

SEQ ID NO: 450716 - DNA, 25 bp, Mus musculus
gacatgctggtaattgcccatgacc

SEQ ID NO: 450717 - DNA, 25 bp, Mus musculus
gacatgctggtatttgcccatgacc

SEQ ID NO: 450718 - DNA, 25 bp, Mus musculus
gacatgctgtcccttaacgctacgt

SEQ ID NO: 450719 - DNA, 25 bp, Mus musculus
gacatgctgtccgttaacgctacgt

SEQ ID NO: 450720 - DNA, 25 bp, Mus musculus
gacatgctgtttctttagtcactac

SEQ ID NO: 450721 - DNA, 25 bp, Mus musculus
gacatgctgtttgtttagtcactac

SEQ ID NO: 450722 - DNA, 25 bp, Mus musculus
gacatgcttagcaagcattctgccc

SEQ ID NO: 450723 - DNA, 25 bp, Mus musculus
gacatgcttagctagcattctgccc

SEQ ID NO: 450724 - DNA, 25 bp, Mus musculus
gacatgcttctgacagggagcacct

SEQ ID NO: 450725 - DNA, 25 bp, Mus musculus
gacatgcttctgtcagggagcacct

SEQ ID NO: 450726 - DNA, 25 bp, Mus musculus
gacatgcttgaaaggcacatccaaa

SEQ ID NO: 450727 - DNA, 25 bp, Mus musculus
gacatgcttgaatggcacatccaaa

SEQ ID NO: 450728 - DNA, 25 bp, Mus musculus
gacatgcttgaccagaaacaaaaac

SEQ ID NO: 450729 - DNA, 25 bp, Mus musculus
gacatgcttgacgagaaacaaaaac

SEQ ID NO: 450730 - DNA, 25 bp, Mus musculus
gacatgcttttgctgaggtgacccg

SEQ ID NO: 450731 - DNA, 25 bp, Mus musculus
gacatgcttttggtgaggtgacccg

SEQ ID NO: 450732 - DNA, 25 bp, Mus musculus
gacatggaagccagccttgtgtttc

SEQ ID NO: 450733 - DNA, 25 bp, Mus musculus
gacatggaagcctgccttgtgtttc

SEQ ID NO: 450734 - DNA, 25 bp, Mus musculus
gacatggaattgcttcgcttctcgc

SEQ ID NO: 450735 - DNA, 25 bp, Mus musculus
gacatggaattggttcgcttctcgc

SEQ ID NO: 450736 - DNA, 25 bp, Mus musculus
gacatggacaatcaccctttggtgt

SEQ ID NO: 450737 - DNA, 25 bp, Mus musculus
gacatggacaatgaccctttggtgt

SEQ ID NO: 450738 - DNA, 25 bp, Mus musculus
gacatggaccataactctgctatac

SEQ ID NO: 450739 - DNA, 25 bp, Mus musculus
gacatggaccattactctgctatac

SEQ ID NO: 450740 - DNA, 25 bp, Mus musculus
gacatggagacacacccctcagagg

SEQ ID NO: 450741 - DNA, 25 bp, Mus musculus
gacatggagacagacccctcagagg

SEQ ID NO: 450742 - DNA, 25 bp, Mus musculus
gacatggagctgagacagtgtctcc

SEQ ID NO: 450743 - DNA, 25 bp, Mus musculus
gacatggagctgtgacagtgtctcc

SEQ ID NO: 450744 - DNA, 25 bp, Mus musculus
gacatggaggcaacatcccttttaa

SEQ ID NO: 450745 - DNA, 25 bp, Mus musculus
gacatggaggcatcatcccttttaa

SEQ ID NO: 450746 - DNA, 25 bp, Mus musculus
gacatggagtcccatctggatggct

SEQ ID NO: 450747 - DNA, 25 bp, Mus musculus
gacatggagtccgatctggatggct

SEQ ID NO: 450748 - DNA, 25 bp, Mus musculus
gacatggagttactgcacccaagct

SEQ ID NO: 450749 - DNA, 25 bp, Mus musculus
gacatggagttagtgcacccaagct

SEQ ID NO: 450750 - DNA, 25 bp, Mus musculus
gacatggatacactttgtgtgcttt

SEQ ID NO: 450751 - DNA, 25 bp, Mus musculus
gacatggatacagtttgtgtgcttt

SEQ ID NO: 450752 - DNA, 25 bp, Mus musculus
gacatggatcaaatacagccgcttc

SEQ ID NO: 450753 - DNA, 25 bp, Mus musculus
gacatggatcaattacagccgcttc

SEQ ID NO: 450754 - DNA, 25 bp, Mus musculus
gacatggatgtgcaggtttctcttg

SEQ ID NO: 450755 - DNA, 25 bp, Mus musculus
gacatggatgtggaggtttctcttg

SEQ ID NO: 450756 - DNA, 25 bp, Mus musculus
gacatggattctcttttgctaacct

SEQ ID NO: 450757 - DNA, 25 bp, Mus musculus
gacatggattctgttttgctaacct

SEQ ID NO: 450758 - DNA, 25 bp, Mus musculus
gacatggcaaaaatcttttcctgca

SEQ ID NO: 450759 - DNA, 25 bp, Mus musculus
gacatggcaaaattcttttcctgca

SEQ ID NO: 450760 - DNA, 25 bp, Mus musculus
gacatggcacataggcaagcagcga

SEQ ID NO: 450761 - DNA, 25 bp, Mus musculus
gacatggcacattggcaagcagcga

SEQ ID NO: 450762 - DNA, 25 bp, Mus musculus
gacatggcaccaattgcccaagagg

SEQ ID NO: 450763 - DNA, 25 bp, Mus musculus
gacatggcaccatttgcccaagagg

SEQ ID NO: 450764 - DNA, 25 bp, Mus musculus
gacatggcagcccaattacgggagc

SEQ ID NO: 450765 - DNA, 25 bp, Mus musculus
gacatggcagccgaattacgggagc

SEQ ID NO: 450766 - DNA, 25 bp, Mus musculus
gacatggcagctatggctggtctta

SEQ ID NO: 450767 - DNA, 25 bp, Mus musculus
gacatggcagctttggctggtctta

SEQ ID NO: 450768 - DNA, 25 bp, Mus musculus
gacatggcagtcagcttctgtccaa

SEQ ID NO: 450769 - DNA, 25 bp, Mus musculus
gacatggcagtctgcttctgtccaa

SEQ ID NO: 450770 - DNA, 25 bp, Mus musculus
gacatggcatagatctttgaagtag

SEQ ID NO: 450771 - DNA, 25 bp, Mus musculus
gacatggcatagttctttgaagtag

SEQ ID NO: 450772 - DNA, 25 bp, Mus musculus
gacatggcatggctattgttcttat

SEQ ID NO: 450773 - DNA, 25 bp, Mus musculus
gacatggcatgggtattgttcttat

SEQ ID NO: 450774 - DNA, 25 bp, Mus musculus
gacatggcattgaccactttactta

SEQ ID NO: 450775 - DNA, 25 bp, Mus musculus
gacatggcattgtccactttactta

SEQ ID NO: 450776 - DNA, 25 bp, Mus musculus
gacatggcatttcaggatccctgac

SEQ ID NO: 450777 - DNA, 25 bp, Mus musculus
gacatggcatttgaggatccctgac

SEQ ID NO: 450778 - DNA, 25 bp, Mus musculus
gacatggccaagaatcggagcattc

SEQ ID NO: 450779 - DNA, 25 bp, Mus musculus
gacatggccaagtatcggagcattc

SEQ ID NO: 450780 - DNA, 25 bp, Mus musculus
gacatggccaccaacgctgcctgtg

SEQ ID NO: 450781 - DNA, 25 bp, Mus musculus
gacatggccacctacgctgcctgtg

SEQ ID NO: 450782 - DNA, 25 bp, Mus musculus
gacatggccatacactacgagaact

SEQ ID NO: 450783 - DNA, 25 bp, Mus musculus
gacatggccatagactacgagaact

SEQ ID NO: 450784 - DNA, 25 bp, Mus musculus
gacatggccctaatcatgggacgtt

SEQ ID NO: 450785 - DNA, 25 bp, Mus musculus
gacatggccctattcatgggacgtt

SEQ ID NO: 450786 - DNA, 25 bp, Mus musculus
gacatggccctgaatgtggtggaac

SEQ ID NO: 450787 - DNA, 25 bp, Mus musculus
gacatggccctgtatgtggtggaac

SEQ ID NO: 450788 - DNA, 25 bp, Mus musculus
gacatggccggcctgcagtacagcc

SEQ ID NO: 450789 - DNA, 25 bp, Mus musculus
gacatggccggcgtgcagtacagcc

SEQ ID NO: 450790 - DNA, 25 bp, Mus musculus
gacatggcctggagggcgtttcttc

SEQ ID NO: 450791 - DNA, 25 bp, Mus musculus
gacatggcctggtgggcgtttcttc

SEQ ID NO: 450792 - DNA, 25 bp, Mus musculus
gacatggcctgtcgagtcatcttgc

SEQ ID NO: 450793 - DNA, 25 bp, Mus musculus
gacatggcctgtggagtcatcttgc

SEQ ID NO: 450794 - DNA, 25 bp, Mus musculus
gacatggcgctaactggcactcaaa

SEQ ID NO: 450795 - DNA, 25 bp, Mus musculus
gacatggcgctatctggcactcaaa

SEQ ID NO: 450796 - DNA, 25 bp, Mus musculus
gacatggctactaaagtttttaact

SEQ ID NO: 450797 - DNA, 25 bp, Mus musculus
gacatggctacttaagtttttaact

SEQ ID NO: 450798 - DNA, 25 bp, Mus musculus
gacatggctcagacaaacactctgg

SEQ ID NO: 450799 - DNA, 25 bp, Mus musculus
gacatggctcagtcaaacactctgg

SEQ ID NO: 450800 - DNA, 25 bp, Mus musculus
gacatggctgaaccctctgaagctg

SEQ ID NO: 450801 - DNA, 25 bp, Mus musculus
gacatggctgaagcctctgaagctg

SEQ ID NO: 450802 - DNA, 25 bp, Mus musculus
gacatggctggacaataagcccaac

SEQ ID NO: 450803 - DNA, 25 bp, Mus musculus
gacatggctggagaataagcccaac

SEQ ID NO: 450804 - DNA, 25 bp, Mus musculus
gacatggcttggctacgtgaacagt

SEQ ID NO: 450805 - DNA, 25 bp, Mus musculus
gacatggcttgggtacgtgaacagt

SEQ ID NO: 450806 - DNA, 25 bp, Mus musculus
gacatggcttgtaagcttgggctaa

SEQ ID NO: 450807 - DNA, 25 bp, Mus musculus
gacatggcttgttagcttgggctaa

SEQ ID NO: 450808 - DNA, 25 bp, Mus musculus
gacatggctttacatcgtcttgtaa

SEQ ID NO: 450809 - DNA, 25 bp, Mus musculus
gacatggctttaccattccagtgtt

SEQ ID NO: 450810 - DNA, 25 bp, Mus musculus
gacatggctttagatcgtcttgtaa

SEQ ID NO: 450811 - DNA, 25 bp, Mus musculus
gacatggctttagcattccagtgtt

SEQ ID NO: 450812 - DNA, 25 bp, Mus musculus
gacatgggaattaatccttactaaa

SEQ ID NO: 450813 - DNA, 25 bp, Mus musculus
gacatgggaatttatccttactaaa

SEQ ID NO: 450814 - DNA, 25 bp, Mus musculus
gacatgggacacatgcaagggcaga

SEQ ID NO: 450815 - DNA, 25 bp, Mus musculus
gacatgggacacttgcaagggcaga

SEQ ID NO: 450816 - DNA, 25 bp, Mus musculus
gacatgggactacaggacgaacgaa

SEQ ID NO: 450817 - DNA, 25 bp, Mus musculus
gacatgggactagaggacgaacgaa

SEQ ID NO: 450818 - DNA, 25 bp, Mus musculus
gacatgggagcacatgccactcacc

SEQ ID NO: 450819 - DNA, 25 bp, Mus musculus
gacatgggagcagatgccactcacc

SEQ ID NO: 450820 - DNA, 25 bp, Mus musculus
gacatgggagccaggaactcgtacc

SEQ ID NO: 450821 - DNA, 25 bp, Mus musculus
gacatgggagcctggaactcgtacc

SEQ ID NO: 450822 - DNA, 25 bp, Mus musculus
gacatgggatgtcctttgccactta

SEQ ID NO: 450823 - DNA, 25 bp, Mus musculus
gacatgggatgtgctttgccactta

SEQ ID NO: 450824 - DNA, 25 bp, Mus musculus
gacatgggatttcctctctacagaa

SEQ ID NO: 450825 - DNA, 25 bp, Mus musculus
gacatgggatttgctctctacagaa

SEQ ID NO: 450826 - DNA, 25 bp, Mus musculus
gacatgggcatacattaaaacttaa

SEQ ID NO: 450827 - DNA, 25 bp, Mus musculus
gacatgggcatagattaaaacttaa

SEQ ID NO: 450828 - DNA, 25 bp, Mus musculus
gacatgggccacactatgacaatga

SEQ ID NO: 450829 - DNA, 25 bp, Mus musculus
gacatgggccactctatgacaatga

SEQ ID NO: 450830 - DNA, 25 bp, Mus musculus
gacatgggccccatgcagtggtgac

SEQ ID NO: 450831 - DNA, 25 bp, Mus musculus
gacatgggccccttgcagtggtgac

SEQ ID NO: 450832 - DNA, 25 bp, Mus musculus
gacatgggctggatcttactcagta

SEQ ID NO: 450833 - DNA, 25 bp, Mus musculus
gacatgggctggttcttactcagta

SEQ ID NO: 450834 - DNA, 25 bp, Mus musculus
gacatgggctttccagacccttcat

SEQ ID NO: 450835 - DNA, 25 bp, Mus musculus
gacatgggctttgcagacccttcat

SEQ ID NO: 450836 - DNA, 25 bp, Mus musculus
gacatggggcttagatgttcttcca

SEQ ID NO: 450837 - DNA, 25 bp, Mus musculus
gacatggggctttgatgttcttcca

SEQ ID NO: 450838 - DNA, 25 bp, Mus musculus
gacatgggtaaaacgactcagactt

SEQ ID NO: 450839 - DNA, 25 bp, Mus musculus
gacatgggtaaatcgactcagactt

SEQ ID NO: 450840 - DNA, 25 bp, Mus musculus
gacatgggttccaagctttgattat

SEQ ID NO: 450841 - DNA, 25 bp, Mus musculus
gacatgggttcctagctttgattat

SEQ ID NO: 450842 - DNA, 25 bp, Mus musculus
gacatggtacggctttgcgacacag

SEQ ID NO: 450843 - DNA, 25 bp, Mus musculus
gacatggtacgggtttgcgacacag

SEQ ID NO: 450844 - DNA, 25 bp, Mus musculus
gacatggtagataggccttccagga

SEQ ID NO: 450845 - DNA, 25 bp, Mus musculus
gacatggtagattggccttccagga

SEQ ID NO: 450846 - DNA, 25 bp, Mus musculus
gacatggtagcgactacgttgggta

SEQ ID NO: 450847 - DNA, 25 bp, Mus musculus
gacatggtagcgtctacgttgggta

SEQ ID NO: 450848 - DNA, 25 bp, Mus musculus
gacatggtaggtacaccatcagcct

SEQ ID NO: 450849 - DNA, 25 bp, Mus musculus
gacatggtaggttcaccatcagcct

SEQ ID NO: 450850 - DNA, 25 bp, Mus musculus
gacatggtatgtcggccaggacccc

SEQ ID NO: 450851 - DNA, 25 bp, Mus musculus
gacatggtatgtgggccaggacccc

SEQ ID NO: 450852 - DNA, 25 bp, Mus musculus
gacatggtattgcatttctatcttt

SEQ ID NO: 450853 - DNA, 25 bp, Mus musculus
gacatggtattggatttctatcttt

SEQ ID NO: 450854 - DNA, 25 bp, Mus musculus
gacatggtccagaaggaccttggaa

SEQ ID NO: 450855 - DNA, 25 bp, Mus musculus
gacatggtccagtaggaccttggaa

SEQ ID NO: 450856 - DNA, 25 bp, Mus musculus
gacatggtcctcaatgtttgggatt

SEQ ID NO: 450857 - DNA, 25 bp, Mus musculus
gacatggtcctcattcaacattttc

SEQ ID NO: 450858 - DNA, 25 bp, Mus musculus
gacatggtcctctatgtttgggatt

SEQ ID NO: 450859 - DNA, 25 bp, Mus musculus
gacatggtcctctttcaacattttc

SEQ ID NO: 450860 - DNA, 25 bp, Mus musculus
gacatggtcgatcacatttcccagg

SEQ ID NO: 450861 - DNA, 25 bp, Mus musculus
gacatggtcgatgacatttcccagg

SEQ ID NO: 450862 - DNA, 25 bp, Mus musculus
gacatggtctctagtctgaggccat

SEQ ID NO: 450863 - DNA, 25 bp, Mus musculus
gacatggtctctatgacatacctct

SEQ ID NO: 450864 - DNA, 25 bp, Mus musculus
gacatggtctcttgtctgaggccat

SEQ ID NO: 450865 - DNA, 25 bp, Mus musculus
gacatggtctctttgacatacctct

SEQ ID NO: 450866 - DNA, 25 bp, Mus musculus
gacatggtctgcatccggcctgaag

SEQ ID NO: 450867 - DNA, 25 bp, Mus musculus
gacatggtctgcttccggcctgaag

SEQ ID NO: 450868 - DNA, 25 bp, Mus musculus
gacatggtctttcgaactccatcct

SEQ ID NO: 450869 - DNA, 25 bp, Mus musculus
gacatggtctttcttgaccactgga

SEQ ID NO: 450870 - DNA, 25 bp, Mus musculus
gacatggtctttggaactccatcct

SEQ ID NO: 450871 - DNA, 25 bp, Mus musculus
gacatggtctttgttgaccactgga

SEQ ID NO: 450872 - DNA, 25 bp, Mus musculus
gacatggtgaaaatgaccaagtcca

SEQ ID NO: 450873 - DNA, 25 bp, Mus musculus
gacatggtgaaattgaccaagtcca

SEQ ID NO: 450874 - DNA, 25 bp, Mus musculus
gacatggtgcctattgaccttcata

SEQ ID NO: 450875 - DNA, 25 bp, Mus musculus
gacatggtgccttttgaccttcata

SEQ ID NO: 450876 - DNA, 25 bp, Mus musculus
gacatggtggcacgctaagcatgaa

SEQ ID NO: 450877 - DNA, 25 bp, Mus musculus
gacatggtggcaggctaagcatgaa

SEQ ID NO: 450878 - DNA, 25 bp, Mus musculus
gacatggtggccaggctgggaagct

SEQ ID NO: 450879 - DNA, 25 bp, Mus musculus
gacatggtggcccatcccatggcca

SEQ ID NO: 450880 - DNA, 25 bp, Mus musculus
gacatggtggccgatcccatggcca

SEQ ID NO: 450881 - DNA, 25 bp, Mus musculus
gacatggtggcctggctgggaagct

SEQ ID NO: 450882 - DNA, 25 bp, Mus musculus
gacatggtgtccacttttggatccg

SEQ ID NO: 450883 - DNA, 25 bp, Mus musculus
gacatggtgtcctcttttggatccg

SEQ ID NO: 450884 - DNA, 25 bp, Mus musculus
gacatggtgtggacacaggatttgc

SEQ ID NO: 450885 - DNA, 25 bp, Mus musculus
gacatggtgtggtcacaggatttgc

SEQ ID NO: 450886 - DNA, 25 bp, Mus musculus
gacatggttaagagcctgctggctt

SEQ ID NO: 450887 - DNA, 25 bp, Mus musculus
gacatggttaagtgcctgctggctt

SEQ ID NO: 450888 - DNA, 25 bp, Mus musculus
gacatggttaatacttattaatttg

SEQ ID NO: 450889 - DNA, 25 bp, Mus musculus
gacatggttaattcttattaatttg

SEQ ID NO: 450890 - DNA, 25 bp, Mus musculus
gacatggttactacagtgtccttta

SEQ ID NO: 450891 - DNA, 25 bp, Mus musculus
gacatggttacttcagtgtccttta

SEQ ID NO: 450892 - DNA, 25 bp, Mus musculus
gacatggttagtatcctgactgcag

SEQ ID NO: 450893 - DNA, 25 bp, Mus musculus
gacatggttagtttcctgactgcag

SEQ ID NO: 450894 - DNA, 25 bp, Mus musculus
gacatggttcacacagatacctctg

SEQ ID NO: 450895 - DNA, 25 bp, Mus musculus
gacatggttcactcagatacctctg

SEQ ID NO: 450896 - DNA, 25 bp, Mus musculus
gacatggttcagcagttacagtaga

SEQ ID NO: 450897 - DNA, 25 bp, Mus musculus
gacatggttcaggagttacagtaga

SEQ ID NO: 450898 - DNA, 25 bp, Mus musculus
gacatggttccaatgttcagtgtgg

SEQ ID NO: 450899 - DNA, 25 bp, Mus musculus
gacatggttccattgttcagtgtgg

SEQ ID NO: 450900 - DNA, 25 bp, Mus musculus
gacatggttccccttctcagaagtc

SEQ ID NO: 450901 - DNA, 25 bp, Mus musculus
gacatggttcccgttctcagaagtc

SEQ ID NO: 450902 - DNA, 25 bp, Mus musculus
gacatggttgcacctgaggttcccc

SEQ ID NO: 450903 - DNA, 25 bp, Mus musculus
gacatggttgcagctgaggttcccc

SEQ ID NO: 450904 - DNA, 25 bp, Mus musculus
gacatggtttatatttagtgctatt

SEQ ID NO: 450905 - DNA, 25 bp, Mus musculus
gacatggtttatttttagtgctatt

SEQ ID NO: 450906 - DNA, 25 bp, Mus musculus
gacatgtaacctcgtgggtctgcag

SEQ ID NO: 450907 - DNA, 25 bp, Mus musculus
gacatgtaacctggtgggtctgcag

SEQ ID NO: 450908 - DNA, 25 bp, Mus musculus
gacatgtagacaactgtcaggtaaa

SEQ ID NO: 450909 - DNA, 25 bp, Mus musculus
gacatgtagacatctgtcaggtaaa

SEQ ID NO: 450910 - DNA, 25 bp, Mus musculus
gacatgtagagtctcctaaagagac

SEQ ID NO: 450911 - DNA, 25 bp, Mus musculus
gacatgtagagtgtcctaaagagac

SEQ ID NO: 450912 - DNA, 25 bp, Mus musculus
gacatgtagcacaaacaggtatctt

SEQ ID NO: 450913 - DNA, 25 bp, Mus musculus
gacatgtagcactaacaggtatctt

SEQ ID NO: 450914 - DNA, 25 bp, Mus musculus
gacatgtatgcccacagctggtgag

SEQ ID NO: 450915 - DNA, 25 bp, Mus musculus
gacatgtatgccgacagctggtgag

SEQ ID NO: 450916 - DNA, 25 bp, Mus musculus
gacatgtatgttccagggatcattt

SEQ ID NO: 450917 - DNA, 25 bp, Mus musculus
gacatgtatgttgcagggatcattt

SEQ ID NO: 450918 - DNA, 25 bp, Mus musculus
gacatgtattcccagtgctcggagg

SEQ ID NO: 450919 - DNA, 25 bp, Mus musculus
gacatgtattccgagtgctcggagg

SEQ ID NO: 450920 - DNA, 25 bp, Mus musculus
gacatgtcaacaagaatgcacatat

SEQ ID NO: 450921 - DNA, 25 bp, Mus musculus
gacatgtcaacatgaatgcacatat

SEQ ID NO: 450922 - DNA, 25 bp, Mus musculus
gacatgtcacggagtactgcgttct

SEQ ID NO: 450923 - DNA, 25 bp, Mus musculus
gacatgtcacggtgtactgcgttct

SEQ ID NO: 450924 - DNA, 25 bp, Mus musculus
gacatgtcacttcagacttttgaaa

SEQ ID NO: 450925 - DNA, 25 bp, Mus musculus
gacatgtcacttgagacttttgaaa

SEQ ID NO: 450926 - DNA, 25 bp, Mus musculus
gacatgtcagtcacaccaaatctga

SEQ ID NO: 450927 - DNA, 25 bp, Mus musculus
gacatgtcagtctcaccaaatctga

SEQ ID NO: 450928 - DNA, 25 bp, Mus musculus
gacatgtcatggagaatggccctac

SEQ ID NO: 450929 - DNA, 25 bp, Mus musculus
gacatgtcatggtgaatggccctac

SEQ ID NO: 450930 - DNA, 25 bp, Mus musculus
gacatgtcatttcgtccctttgatg

SEQ ID NO: 450931 - DNA, 25 bp, Mus musculus
gacatgtcatttggtccctttgatg

SEQ ID NO: 450932 - DNA, 25 bp, Mus musculus
gacatgtccagtaagattctcacag

SEQ ID NO: 450933 - DNA, 25 bp, Mus musculus
gacatgtccagttagattctcacag

SEQ ID NO: 450934 - DNA, 25 bp, Mus musculus
gacatgtccatgactaacactcacg

SEQ ID NO: 450935 - DNA, 25 bp, Mus musculus
gacatgtccatgtctaacactcacg

SEQ ID NO: 450936 - DNA, 25 bp, Mus musculus
gacatgtccattaaatcatttcaag

SEQ ID NO: 450937 - DNA, 25 bp, Mus musculus
gacatgtccatttaatcatttcaag

SEQ ID NO: 450938 - DNA, 25 bp, Mus musculus
gacatgtcccctagaaaatttggca

SEQ ID NO: 450939 - DNA, 25 bp, Mus musculus
gacatgtccccttgaaaatttggca

SEQ ID NO: 450940 - DNA, 25 bp, Mus musculus
gacatgtcccgccacttataatata

SEQ ID NO: 450941 - DNA, 25 bp, Mus musculus
gacatgtcccgcgacttataatata

SEQ ID NO: 450942 - DNA, 25 bp, Mus musculus
gacatgtccctcatccgtatcaggg

SEQ ID NO: 450943 - DNA, 25 bp, Mus musculus
gacatgtccctcttccgtatcaggg

SEQ ID NO: 450944 - DNA, 25 bp, Mus musculus
gacatgtcctacaatgcttgatggt

SEQ ID NO: 450945 - DNA, 25 bp, Mus musculus
gacatgtcctactatgcttgatggt

SEQ ID NO: 450946 - DNA, 25 bp, Mus musculus
gacatgtcctccatactttttgata

SEQ ID NO: 450947 - DNA, 25 bp, Mus musculus
gacatgtcctccttactttttgata

SEQ ID NO: 450948 - DNA, 25 bp, Mus musculus
gacatgtcctctcctatttataaag

SEQ ID NO: 450949 - DNA, 25 bp, Mus musculus
gacatgtcctctgctatttataaag

SEQ ID NO: 450950 - DNA, 25 bp, Mus musculus
gacatgtcctgaactgagcttggta

SEQ ID NO: 450951 - DNA, 25 bp, Mus musculus
gacatgtcctgatctgagcttggta

SEQ ID NO: 450952 - DNA, 25 bp, Mus musculus
gacatgtcgcagatacaaatatgaa

SEQ ID NO: 450953 - DNA, 25 bp, Mus musculus
gacatgtcgcagttacaaatatgaa

SEQ ID NO: 450954 - DNA, 25 bp, Mus musculus
gacatgtcgggacccgtgccaagca

SEQ ID NO: 450955 - DNA, 25 bp, Mus musculus
gacatgtcgggagccgtgccaagca

SEQ ID NO: 450956 - DNA, 25 bp, Mus musculus
gacatgtctgggaactccgacacat

SEQ ID NO: 450957 - DNA, 25 bp, Mus musculus
gacatgtctgggtactccgacacat

SEQ ID NO: 450958 - DNA, 25 bp, Mus musculus
gacatgtctgtaattagtcttcagt

SEQ ID NO: 450959 - DNA, 25 bp, Mus musculus
gacatgtctgtatttagtcttcagt

SEQ ID NO: 450960 - DNA, 25 bp, Mus musculus
gacatgtctgtcatcatggttcatg

SEQ ID NO: 450961 - DNA, 25 bp, Mus musculus
gacatgtctgtcttcatggttcatg

SEQ ID NO: 450962 - DNA, 25 bp, Mus musculus
gacatgtctgtgctgctttgatagc

SEQ ID NO: 450963 - DNA, 25 bp, Mus musculus
gacatgtctgtggtgctttgatagc

SEQ ID NO: 450964 - DNA, 25 bp, Mus musculus
gacatgtctttaaccattcaagaga

SEQ ID NO: 450965 - DNA, 25 bp, Mus musculus
gacatgtctttatccattcaagaga

SEQ ID NO: 450966 - DNA, 25 bp, Mus musculus
gacatgtgacacaactgactggcca

SEQ ID NO: 450967 - DNA, 25 bp, Mus musculus
gacatgtgacactactgactggcca

SEQ ID NO: 450968 - DNA, 25 bp, Mus musculus
gacatgtgacctagagaggagccct

SEQ ID NO: 450969 - DNA, 25 bp, Mus musculus
gacatgtgaccttgagaggagccct

SEQ ID NO: 450970 - DNA, 25 bp, Mus musculus
gacatgtgacggattagcagcaact

SEQ ID NO: 450971 - DNA, 25 bp, Mus musculus
gacatgtgacggtttagcagcaact

SEQ ID NO: 450972 - DNA, 25 bp, Mus musculus
gacatgtgagacagggcaggcttca

SEQ ID NO: 450973 - DNA, 25 bp, Mus musculus
gacatgtgagactgggcaggcttca

SEQ ID NO: 450974 - DNA, 25 bp, Mus musculus
gacatgtgagtgaccctattctccc

SEQ ID NO: 450975 - DNA, 25 bp, Mus musculus
gacatgtgagtgtccctattctccc

SEQ ID NO: 450976 - DNA, 25 bp, Mus musculus
gacatgtgataacggttcgcttgct

SEQ ID NO: 450977 - DNA, 25 bp, Mus musculus
gacatgtgataagggttcgcttgct

SEQ ID NO: 450978 - DNA, 25 bp, Mus musculus
gacatgtgattcaagtcccatcctt

SEQ ID NO: 450979 - DNA, 25 bp, Mus musculus
gacatgtgattcctggcatccttct

SEQ ID NO: 450980 - DNA, 25 bp, Mus musculus
gacatgtgattcgtggcatccttct

SEQ ID NO: 450981 - DNA, 25 bp, Mus musculus
gacatgtgattctagtcccatcctt

SEQ ID NO: 450982 - DNA, 25 bp, Mus musculus
gacatgtgcactcacacctattgaa

SEQ ID NO: 450983 - DNA, 25 bp, Mus musculus
gacatgtgcactgacacctattgaa

SEQ ID NO: 450984 - DNA, 25 bp, Mus musculus
gacatgtgctctaaggtggctgttt

SEQ ID NO: 450985 - DNA, 25 bp, Mus musculus
gacatgtgctcttaggtggctgttt

SEQ ID NO: 450986 - DNA, 25 bp, Mus musculus
gacatgtgctttacctaaaaattca

SEQ ID NO: 450987 - DNA, 25 bp, Mus musculus
gacatgtgcttttcctaaaaattca

SEQ ID NO: 450988 - DNA, 25 bp, Mus musculus
gacatgtgggccaaacttatagtta

SEQ ID NO: 450989 - DNA, 25 bp, Mus musculus
gacatgtgggcctaacttatagtta

SEQ ID NO: 450990 - DNA, 25 bp, Mus musculus
gacatgtgggctatatttcctattt

SEQ ID NO: 450991 - DNA, 25 bp, Mus musculus
gacatgtgggctttatttcctattt

SEQ ID NO: 450992 - DNA, 25 bp, Mus musculus
gacatgtgtcaacgccacttggtga

SEQ ID NO: 450993 - DNA, 25 bp, Mus musculus
gacatgtgtcaaggccacttggtga

SEQ ID NO: 450994 - DNA, 25 bp, Mus musculus
gacatgtgtcacacaatcacactgt

SEQ ID NO: 450995 - DNA, 25 bp, Mus musculus
gacatgtgtcactcaatcacactgt

SEQ ID NO: 450996 - DNA, 25 bp, Mus musculus
gacatgtgtctgaaatgttagcatt

SEQ ID NO: 450997 - DNA, 25 bp, Mus musculus
gacatgtgtctgtaatgttagcatt

SEQ ID NO: 450998 - DNA, 25 bp, Mus musculus
gacatgtgtggacccttaggaccct

SEQ ID NO: 450999 - DNA, 25 bp, Mus musculus
gacatgtgtggagccttaggaccct

SEQ ID NO: 451000 - DNA, 25 bp, Mus musculus
gacatgtgttgaccctgcgcattgg

SEQ ID NO: 451001 - DNA, 25 bp, Mus musculus
gacatgtgttgagcctgcgcattgg

SEQ ID NO: 451002 - DNA, 25 bp, Mus musculus
gacatgtgttgtctgtcagtacaaa

SEQ ID NO: 451003 - DNA, 25 bp, Mus musculus
gacatgtgttgtgtgtcagtacaaa

SEQ ID NO: 451004 - DNA, 25 bp, Mus musculus
gacatgtgtttaacctattcccatc

SEQ ID NO: 451005 - DNA, 25 bp, Mus musculus
gacatgtgtttatcctattcccatc

SEQ ID NO: 451006 - DNA, 25 bp, Mus musculus
gacatgttaaacaaccgatctttgt

SEQ ID NO: 451007 - DNA, 25 bp, Mus musculus
gacatgttaaactaccgatctttgt

SEQ ID NO: 451008 - DNA, 25 bp, Mus musculus
gacatgttaaatatgtggtctctaa

SEQ ID NO: 451009 - DNA, 25 bp, Mus musculus
gacatgttaaatttgtggtctctaa

SEQ ID NO: 451010 - DNA, 25 bp, Mus musculus
gacatgttaccaatgcttgtttgat

SEQ ID NO: 451011 - DNA, 25 bp, Mus musculus
gacatgttaccattgcttgtttgat

SEQ ID NO: 451012 - DNA, 25 bp, Mus musculus
gacatgttacctctgacatacctga

SEQ ID NO: 451013 - DNA, 25 bp, Mus musculus
gacatgttacctgtgacatacctga

SEQ ID NO: 451014 - DNA, 25 bp, Mus musculus
gacatgttatttcttcctcacatcc

SEQ ID NO: 451015 - DNA, 25 bp, Mus musculus
gacatgttatttgttcctcacatcc

SEQ ID NO: 451016 - DNA, 25 bp, Mus musculus
gacatgttcactattcatcgtctat

SEQ ID NO: 451017 - DNA, 25 bp, Mus musculus
gacatgttcacttttcatcgtctat

SEQ ID NO: 451018 - DNA, 25 bp, Mus musculus
gacatgttcagactatggcttcccc

SEQ ID NO: 451019 - DNA, 25 bp, Mus musculus
gacatgttcagagtatggcttcccc

SEQ ID NO: 451020 - DNA, 25 bp, Mus musculus
gacatgttcaggaaaaggaccttaa

SEQ ID NO: 451021 - DNA, 25 bp, Mus musculus
gacatgttcaggcatcgccaggcgt

SEQ ID NO: 451022 - DNA, 25 bp, Mus musculus
gacatgttcagggatcgccaggcgt

SEQ ID NO: 451023 - DNA, 25 bp, Mus musculus
gacatgttcaggtaaaggaccttaa

SEQ ID NO: 451024 - DNA, 25 bp, Mus musculus
gacatgttcagtccctacagcagag

SEQ ID NO: 451025 - DNA, 25 bp, Mus musculus
gacatgttcagtgcctacagcagag

SEQ ID NO: 451026 - DNA, 25 bp, Mus musculus
gacatgttccaactcccagaatagt

SEQ ID NO: 451027 - DNA, 25 bp, Mus musculus
gacatgttccaagtcccagaatagt

SEQ ID NO: 451028 - DNA, 25 bp, Mus musculus
gacatgttccacagccatttcagaa

SEQ ID NO: 451029 - DNA, 25 bp, Mus musculus
gacatgttccactgccatttcagaa

SEQ ID NO: 451030 - DNA, 25 bp, Mus musculus
gacatgttccatctgactggcagat

SEQ ID NO: 451031 - DNA, 25 bp, Mus musculus
gacatgttccatgtgactggcagat

SEQ ID NO: 451032 - DNA, 25 bp, Mus musculus
gacatgttcgacagtgtgtacccca

SEQ ID NO: 451033 - DNA, 25 bp, Mus musculus
gacatgttcgactgtgtgtacccca

SEQ ID NO: 451034 - DNA, 25 bp, Mus musculus
gacatgttctgcagagtctcgaagg

SEQ ID NO: 451035 - DNA, 25 bp, Mus musculus
gacatgttctgctgagtctcgaagg

SEQ ID NO: 451036 - DNA, 25 bp, Mus musculus
gacatgttgaacagcctgcaggctg

SEQ ID NO: 451037 - DNA, 25 bp, Mus musculus
gacatgttgaacatcgttcgcagga

SEQ ID NO: 451038 - DNA, 25 bp, Mus musculus
gacatgttgaactgcctgcaggctg

SEQ ID NO: 451039 - DNA, 25 bp, Mus musculus
gacatgttgaacttcgttcgcagga

SEQ ID NO: 451040 - DNA, 25 bp, Mus musculus
gacatgttgaagagatccaataggc

SEQ ID NO: 451041 - DNA, 25 bp, Mus musculus
gacatgttgaagtgatccaataggc

SEQ ID NO: 451042 - DNA, 25 bp, Mus musculus
gacatgttgactagcgctctcttga

SEQ ID NO: 451043 - DNA, 25 bp, Mus musculus
gacatgttgacttgcgctctcttga

SEQ ID NO: 451044 - DNA, 25 bp, Mus musculus
gacatgttgatccaagtgacttttt

SEQ ID NO: 451045 - DNA, 25 bp, Mus musculus
gacatgttgatcgaagtgacttttt

SEQ ID NO: 451046 - DNA, 25 bp, Mus musculus
gacatgttgcatacacagtcaagtt

SEQ ID NO: 451047 - DNA, 25 bp, Mus musculus
gacatgttgcatagtggtagcctag

SEQ ID NO: 451048 - DNA, 25 bp, Mus musculus
gacatgttgcatatcttttccattt

SEQ ID NO: 451049 - DNA, 25 bp, Mus musculus
gacatgttgcattcacagtcaagtt

SEQ ID NO: 451050 - DNA, 25 bp, Mus musculus
gacatgttgcattgtggtagcctag

SEQ ID NO: 451051 - DNA, 25 bp, Mus musculus
gacatgttgcatttcttttccattt

SEQ ID NO: 451052 - DNA, 25 bp, Mus musculus
gacatgttgctgagacctgttttgt

SEQ ID NO: 451053 - DNA, 25 bp, Mus musculus
gacatgttgctgtgacctgttttgt

SEQ ID NO: 451054 - DNA, 25 bp, Mus musculus
gacatgttggaaacaagtgctcttt

SEQ ID NO: 451055 - DNA, 25 bp, Mus musculus
gacatgttggaatcaagtgctcttt

SEQ ID NO: 451056 - DNA, 25 bp, Mus musculus
gacatgttgttgacactgtgcctca

SEQ ID NO: 451057 - DNA, 25 bp, Mus musculus
gacatgttgttgtcactgtgcctca

SEQ ID NO: 451058 - DNA, 25 bp, Mus musculus
gacatgtttacaacagtttctatgg

SEQ ID NO: 451059 - DNA, 25 bp, Mus musculus
gacatgtttacaccaatgccaagaa

SEQ ID NO: 451060 - DNA, 25 bp, Mus musculus
gacatgtttacagcaatgccaagaa

SEQ ID NO: 451061 - DNA, 25 bp, Mus musculus
gacatgtttacatcagtttctatgg

SEQ ID NO: 451062 - DNA, 25 bp, Mus musculus
gacatgtttacccacactttttgat

SEQ ID NO: 451063 - DNA, 25 bp, Mus musculus
gacatgtttaccgacactttttgat

SEQ ID NO: 451064 - DNA, 25 bp, Mus musculus
gacatgtttcaacagaatttctact

SEQ ID NO: 451065 - DNA, 25 bp, Mus musculus
gacatgtttcaagagaatttctact

SEQ ID NO: 451066 - DNA, 25 bp, Mus musculus
gacatgtttccacacgtgcatttaa

SEQ ID NO: 451067 - DNA, 25 bp, Mus musculus
gacatgtttccactgtgccaggaga

SEQ ID NO: 451068 - DNA, 25 bp, Mus musculus
gacatgtttccagacgtgcatttaa

SEQ ID NO: 451069 - DNA, 25 bp, Mus musculus
gacatgtttccagtgtgccaggaga

SEQ ID NO: 451070 - DNA, 25 bp, Mus musculus
gacatgtttgcaacgtcgttgaaaa

SEQ ID NO: 451071 - DNA, 25 bp, Mus musculus
gacatgtttgcatcgtcgttgaaaa

SEQ ID NO: 451072 - DNA, 25 bp, Mus musculus
gacatgtttgtacctgtacagtgga

SEQ ID NO: 451073 - DNA, 25 bp, Mus musculus
gacatgtttgtagctgtacagtgga

SEQ ID NO: 451074 - DNA, 25 bp, Mus musculus
gacatgttttatatgctgtactgga

SEQ ID NO: 451075 - DNA, 25 bp, Mus musculus
gacatgttttatttgctgtactgga

SEQ ID NO: 451076 - DNA, 25 bp, Mus musculus
gacatgttttcacacagagtcaaat

SEQ ID NO: 451077 - DNA, 25 bp, Mus musculus
gacatgttttcagacagagtcaaat

SEQ ID NO: 451078 - DNA, 25 bp, Mus musculus
gacattaaaattcgagtgctttcac

SEQ ID NO: 451079 - DNA, 25 bp, Mus musculus
gacattaaaattggagtgctttcac

SEQ ID NO: 451080 - DNA, 25 bp, Mus musculus
gacattaacacgctctgcttttatc

SEQ ID NO: 451081 - DNA, 25 bp, Mus musculus
gacattaacacggtctgcttttatc

SEQ ID NO: 451082 - DNA, 25 bp, Mus musculus
gacattaactctcagctcctacttg

SEQ ID NO: 451083 - DNA, 25 bp, Mus musculus
gacattaactctgagctcctacttg

SEQ ID NO: 451084 - DNA, 25 bp, Mus musculus
gacattaacttccttctaaagcctg

SEQ ID NO: 451085 - DNA, 25 bp, Mus musculus
gacattaacttcgttctaaagcctg

SEQ ID NO: 451086 - DNA, 25 bp, Mus musculus
gacattaagacaactggagcagaaa

SEQ ID NO: 451087 - DNA, 25 bp, Mus musculus
gacattaagacatctggagcagaaa

SEQ ID NO: 451088 - DNA, 25 bp, Mus musculus
gacattaagcgtctatactccctct

SEQ ID NO: 451089 - DNA, 25 bp, Mus musculus
gacattaagcgtgtatactccctct

SEQ ID NO: 451090 - DNA, 25 bp, Mus musculus
gacattaaggtccaaaccaggcacc

SEQ ID NO: 451091 - DNA, 25 bp, Mus musculus
gacattaaggtcgaaaccaggcacc

SEQ ID NO: 451092 - DNA, 25 bp, Mus musculus
gacattaattgaacacagccacctg

SEQ ID NO: 451093 - DNA, 25 bp, Mus musculus
gacattaattgatcacagccacctg

SEQ ID NO: 451094 - DNA, 25 bp, Mus musculus
gacattacagcactcctctccaacc

SEQ ID NO: 451095 - DNA, 25 bp, Mus musculus
gacattacagcagtcctctccaacc

SEQ ID NO: 451096 - DNA, 25 bp, Mus musculus
gacattacagtgattatccagatac

SEQ ID NO: 451097 - DNA, 25 bp, Mus musculus
gacattacagtgtttatccagatac

SEQ ID NO: 451098 - DNA, 25 bp, Mus musculus
gacattaccagtaagttttcctgcc

SEQ ID NO: 451099 - DNA, 25 bp, Mus musculus
gacattaccagttagttttcctgcc

SEQ ID NO: 451100 - DNA, 25 bp, Mus musculus
gacattacctttaagcagattccag

SEQ ID NO: 451101 - DNA, 25 bp, Mus musculus
gacattaccttttagcagattccag

SEQ ID NO: 451102 - DNA, 25 bp, Mus musculus
gacattacggcaaagcttcctttta

SEQ ID NO: 451103 - DNA, 25 bp, Mus musculus
gacattacggcatagcttcctttta

SEQ ID NO: 451104 - DNA, 25 bp, Mus musculus
gacattactaatcctacacgcttgt

SEQ ID NO: 451105 - DNA, 25 bp, Mus musculus
gacattactaatgctacacgcttgt

SEQ ID NO: 451106 - DNA, 25 bp, Mus musculus
gacattactacgctagtagctcgtt

SEQ ID NO: 451107 - DNA, 25 bp, Mus musculus
gacattactacggtagtagctcgtt

SEQ ID NO: 451108 - DNA, 25 bp, Mus musculus
gacattactgggaaaacagctgctt

SEQ ID NO: 451109 - DNA, 25 bp, Mus musculus
gacattactgggtaaacagctgctt

SEQ ID NO: 451110 - DNA, 25 bp, Mus musculus
gacattacttctaccttatagctgt

SEQ ID NO: 451111 - DNA, 25 bp, Mus musculus
gacattacttcttccttatagctgt

SEQ ID NO: 451112 - DNA, 25 bp, Mus musculus
gacattacttggcaactgagcctca

SEQ ID NO: 451113 - DNA, 25 bp, Mus musculus
gacattacttgggaactgagcctca

SEQ ID NO: 451114 - DNA, 25 bp, Mus musculus
gacattagatttacctaaggaggac

SEQ ID NO: 451115 - DNA, 25 bp, Mus musculus
gacattagattttcctaaggaggac

SEQ ID NO: 451116 - DNA, 25 bp, Mus musculus
gacattagcacaaaacttccatcga

SEQ ID NO: 451117 - DNA, 25 bp, Mus musculus
gacattagcacataacttccatcga

SEQ ID NO: 451118 - DNA, 25 bp, Mus musculus
gacattagcagtaactttccgcagc

SEQ ID NO: 451119 - DNA, 25 bp, Mus musculus
gacattagcagttactttccgcagc

SEQ ID NO: 451120 - DNA, 25 bp, Mus musculus
gacattagctgaaatgccccacaaa

SEQ ID NO: 451121 - DNA, 25 bp, Mus musculus
gacattagctgatatgccccacaaa

SEQ ID NO: 451122 - DNA, 25 bp, Mus musculus
gacattaggagcactgcttgcaagt

SEQ ID NO: 451123 - DNA, 25 bp, Mus musculus
gacattaggagctctgcttgcaagt

SEQ ID NO: 451124 - DNA, 25 bp, Mus musculus
gacattagtggccacagcatggtat

SEQ ID NO: 451125 - DNA, 25 bp, Mus musculus
gacattagtggcgacagcatggtat

SEQ ID NO: 451126 - DNA, 25 bp, Mus musculus
gacattagttccaacatttcgtttt

SEQ ID NO: 451127 - DNA, 25 bp, Mus musculus
gacattagttccatccagagacgga

SEQ ID NO: 451128 - DNA, 25 bp, Mus musculus
gacattagttcctacatttcgtttt

SEQ ID NO: 451129 - DNA, 25 bp, Mus musculus
gacattagttccttccagagacgga

SEQ ID NO: 451130 - DNA, 25 bp, Mus musculus
gacattagttctcctactgcttctg

SEQ ID NO: 451131 - DNA, 25 bp, Mus musculus
gacattagttctgctactgcttctg

SEQ ID NO: 451132 - DNA, 25 bp, Mus musculus
gacattagtttgaggcagtacatgt

SEQ ID NO: 451133 - DNA, 25 bp, Mus musculus
gacattagtttgtggcagtacatgt

SEQ ID NO: 451134 - DNA, 25 bp, Mus musculus
gacattataagtcgaaagtggcaaa

SEQ ID NO: 451135 - DNA, 25 bp, Mus musculus
gacattataagtggaaagtggcaaa

SEQ ID NO: 451136 - DNA, 25 bp, Mus musculus
gacattatacgtctaaacagtgtgg

SEQ ID NO: 451137 - DNA, 25 bp, Mus musculus
gacattatacgtgtaaacagtgtgg

SEQ ID NO: 451138 - DNA, 25 bp, Mus musculus
gacattatatctaacatatagacct

SEQ ID NO: 451139 - DNA, 25 bp, Mus musculus
gacattatatcttacatatagacct

SEQ ID NO: 451140 - DNA, 25 bp, Mus musculus
gacattatatgtcactggcgccgtc

SEQ ID NO: 451141 - DNA, 25 bp, Mus musculus
gacattatatgtgactggcgccgtc

SEQ ID NO: 451142 - DNA, 25 bp, Mus musculus
gacattatcaaaatgccccaatttt

SEQ ID NO: 451143 - DNA, 25 bp, Mus musculus
gacattatcaaattgccccaatttt

SEQ ID NO: 451144 - DNA, 25 bp, Mus musculus
gacattatcgagaacagctgcagca

SEQ ID NO: 451145 - DNA, 25 bp, Mus musculus
gacattatcgagtacagctgcagca

SEQ ID NO: 451146 - DNA, 25 bp, Mus musculus
gacattatcgctagccatggtggta

SEQ ID NO: 451147 - DNA, 25 bp, Mus musculus
gacattatcgcttgccatggtggta

SEQ ID NO: 451148 - DNA, 25 bp, Mus musculus
gacattatcttactcatttgtactt

SEQ ID NO: 451149 - DNA, 25 bp, Mus musculus
gacattatcttagtcatttgtactt

SEQ ID NO: 451150 - DNA, 25 bp, Mus musculus
gacattatggctatggttggctctt

SEQ ID NO: 451151 - DNA, 25 bp, Mus musculus
gacattatggctttggttggctctt

SEQ ID NO: 451152 - DNA, 25 bp, Mus musculus
gacattatgttgctcaagctctctt

SEQ ID NO: 451153 - DNA, 25 bp, Mus musculus
gacattatgttggtcaagctctctt

SEQ ID NO: 451154 - DNA, 25 bp, Mus musculus
gacattattgaccttgaggacctca

SEQ ID NO: 451155 - DNA, 25 bp, Mus musculus
gacattattgacgttgaggacctca

SEQ ID NO: 451156 - DNA, 25 bp, Mus musculus
gacattcaaagcattttgctctagt

SEQ ID NO: 451157 - DNA, 25 bp, Mus musculus
gacattcaaagctttttgctctagt

SEQ ID NO: 451158 - DNA, 25 bp, Mus musculus
gacattcaacagctagtcggctaaa

SEQ ID NO: 451159 - DNA, 25 bp, Mus musculus
gacattcaacaggtagtcggctaaa

SEQ ID NO: 451160 - DNA, 25 bp, Mus musculus
gacattcaacctcgtcaacacatga

SEQ ID NO: 451161 - DNA, 25 bp, Mus musculus
gacattcaacctggtcaacacatga

SEQ ID NO: 451162 - DNA, 25 bp, Mus musculus
gacattcaagtcattgagatgttag

SEQ ID NO: 451163 - DNA, 25 bp, Mus musculus
gacattcaagtctttgagatgttag

SEQ ID NO: 451164 - DNA, 25 bp, Mus musculus
gacattcacacccacctaaagagaa

SEQ ID NO: 451165 - DNA, 25 bp, Mus musculus
gacattcacaccgacctaaagagaa

SEQ ID NO: 451166 - DNA, 25 bp, Mus musculus
gacattcacagcacctgccagagaa

SEQ ID NO: 451167 - DNA, 25 bp, Mus musculus
gacattcacagctcctgccagagaa

SEQ ID NO: 451168 - DNA, 25 bp, Mus musculus
gacattcaccatcatgcctgagtct

SEQ ID NO: 451169 - DNA, 25 bp, Mus musculus
gacattcaccatgatgcctgagtct

SEQ ID NO: 451170 - DNA, 25 bp, Mus musculus
gacattcacttccatagttttcagc

SEQ ID NO: 451171 - DNA, 25 bp, Mus musculus
gacattcacttcgatagttttcagc

SEQ ID NO: 451172 - DNA, 25 bp, Mus musculus
gacattcagaacaccattatccacc

SEQ ID NO: 451173 - DNA, 25 bp, Mus musculus
gacattcagaaccaccttcaagatg

SEQ ID NO: 451174 - DNA, 25 bp, Mus musculus
gacattcagaacgaccttcaagatg

SEQ ID NO: 451175 - DNA, 25 bp, Mus musculus
gacattcagaactccattatccacc

SEQ ID NO: 451176 - DNA, 25 bp, Mus musculus
gacattcagactaagcagttccatg

SEQ ID NO: 451177 - DNA, 25 bp, Mus musculus
gacattcagacttagcagttccatg

SEQ ID NO: 451178 - DNA, 25 bp, Mus musculus
gacattcagctcactgcttaactga

SEQ ID NO: 451179 - DNA, 25 bp, Mus musculus
gacattcagctctctgcttaactga

SEQ ID NO: 451180 - DNA, 25 bp, Mus musculus
gacattcagctgcagttcgtgcgca

SEQ ID NO: 451181 - DNA, 25 bp, Mus musculus
gacattcagctggagttcgtgcgca

SEQ ID NO: 451182 - DNA, 25 bp, Mus musculus
gacattcagcttaattcatgggttc

SEQ ID NO: 451183 - DNA, 25 bp, Mus musculus
gacattcagctttattcatgggttc

SEQ ID NO: 451184 - DNA, 25 bp, Mus musculus
gacattcaggcgcacaagttcattg

SEQ ID NO: 451185 - DNA, 25 bp, Mus musculus
gacattcaggcggacaagttcattg

SEQ ID NO: 451186 - DNA, 25 bp, Mus musculus
gacattcagtacagcctttgctgga

SEQ ID NO: 451187 - DNA, 25 bp, Mus musculus
gacattcagtactgcctttgctgga

SEQ ID NO: 451188 - DNA, 25 bp, Mus musculus
gacattcatctgatcagtccactga

SEQ ID NO: 451189 - DNA, 25 bp, Mus musculus
gacattcatctgttcagtccactga

SEQ ID NO: 451190 - DNA, 25 bp, Mus musculus
gacattcatcttattcatattgctt

SEQ ID NO: 451191 - DNA, 25 bp, Mus musculus
gacattcatctttttcatattgctt

SEQ ID NO: 451192 - DNA, 25 bp, Mus musculus
gacattcatgccacagagcaagata

SEQ ID NO: 451193 - DNA, 25 bp, Mus musculus
gacattcatgcctcagagcaagata

SEQ ID NO: 451194 - DNA, 25 bp, Mus musculus
gacattcattgcaaggagacccgtt

SEQ ID NO: 451195 - DNA, 25 bp, Mus musculus
gacattcattgctaggagacccgtt

SEQ ID NO: 451196 - DNA, 25 bp, Mus musculus
gacattcatttcacctaataacctt

SEQ ID NO: 451197 - DNA, 25 bp, Mus musculus
gacattcatttctcctaataacctt

SEQ ID NO: 451198 - DNA, 25 bp, Mus musculus
gacattccagcaccttatgggtaga

SEQ ID NO: 451199 - DNA, 25 bp, Mus musculus
gacattccagcagcttatgggtaga

SEQ ID NO: 451200 - DNA, 25 bp, Mus musculus
gacattccaggacctagccatttag

SEQ ID NO: 451201 - DNA, 25 bp, Mus musculus
gacattccaggagctagccatttag

SEQ ID NO: 451202 - DNA, 25 bp, Mus musculus
gacattccataaagttgctgcccat

SEQ ID NO: 451203 - DNA, 25 bp, Mus musculus
gacattccataatgttgctgcccat

SEQ ID NO: 451204 - DNA, 25 bp, Mus musculus
gacattccatgtagccgtagacata

SEQ ID NO: 451205 - DNA, 25 bp, Mus musculus
gacattccatgttgccgtagacata

SEQ ID NO: 451206 - DNA, 25 bp, Mus musculus
gacattccattcatttgcacttacc

SEQ ID NO: 451207 - DNA, 25 bp, Mus musculus
gacattccattcttttgcacttacc

SEQ ID NO: 451208 - DNA, 25 bp, Mus musculus
gacattccctacactttggagctaa

SEQ ID NO: 451209 - DNA, 25 bp, Mus musculus
gacattccctactctttggagctaa

SEQ ID NO: 451210 - DNA, 25 bp, Mus musculus
gacattccctcccatatatgaagtg

SEQ ID NO: 451211 - DNA, 25 bp, Mus musculus
gacattccctccgatatatgaagtg

SEQ ID NO: 451212 - DNA, 25 bp, Mus musculus
gacattccctgcaggtatactccac

SEQ ID NO: 451213 - DNA, 25 bp, Mus musculus
gacattccctgctggtatactccac

SEQ ID NO: 451214 - DNA, 25 bp, Mus musculus
gacattcctattctagattttgcaa

SEQ ID NO: 451215 - DNA, 25 bp, Mus musculus
gacattcctattgtagattttgcaa

SEQ ID NO: 451216 - DNA, 25 bp, Mus musculus
gacattcctgtaaggtcactggatt

SEQ ID NO: 451217 - DNA, 25 bp, Mus musculus
gacattcctgtatggtcactggatt

SEQ ID NO: 451218 - DNA, 25 bp, Mus musculus
gacattccttccaaagttaccgatg

SEQ ID NO: 451219 - DNA, 25 bp, Mus musculus
gacattccttcctaagttaccgatg

SEQ ID NO: 451220 - DNA, 25 bp, Mus musculus
gacattcgaaggaacctggctcctg

SEQ ID NO: 451221 - DNA, 25 bp, Mus musculus
gacattcgaaggtacctggctcctg

SEQ ID NO: 451222 - DNA, 25 bp, Mus musculus
gacattcgagagatggtgcccagta

SEQ ID NO: 451223 - DNA, 25 bp, Mus musculus
gacattcgagagttggtgcccagta

SEQ ID NO: 451224 - DNA, 25 bp, Mus musculus
gacattcgatttagaacctgccaga

SEQ ID NO: 451225 - DNA, 25 bp, Mus musculus
gacattcgattttgaacctgccaga

SEQ ID NO: 451226 - DNA, 25 bp, Mus musculus
gacattcgcagtactagggactctt

SEQ ID NO: 451227 - DNA, 25 bp, Mus musculus
gacattcgcagttctagggactctt

SEQ ID NO: 451228 - DNA, 25 bp, Mus musculus
gacattctacagcaaaacacaatac

SEQ ID NO: 451229 - DNA, 25 bp, Mus musculus
gacattctacaggaaaacacaatac

SEQ ID NO: 451230 - DNA, 25 bp, Mus musculus
gacattctagtgaaggttaggacga

SEQ ID NO: 451231 - DNA, 25 bp, Mus musculus
gacattctagtgtaggttaggacga

SEQ ID NO: 451232 - DNA, 25 bp, Mus musculus
gacattctcaacagtcaggtgcgtc

SEQ ID NO: 451233 - DNA, 25 bp, Mus musculus
gacattctcaactgtcaggtgcgtc

SEQ ID NO: 451234 - DNA, 25 bp, Mus musculus
gacattctcatgctgagactccgga

SEQ ID NO: 451235 - DNA, 25 bp, Mus musculus
gacattctcatggtgagactccgga

SEQ ID NO: 451236 - DNA, 25 bp, Mus musculus
gacattctccaaccttgtattccct

SEQ ID NO: 451237 - DNA, 25 bp, Mus musculus
gacattctccaagcttgtattccct

SEQ ID NO: 451238 - DNA, 25 bp, Mus musculus
gacattctccacattgatgattata

SEQ ID NO: 451239 - DNA, 25 bp, Mus musculus
gacattctccactttgatgattata

SEQ ID NO: 451240 - DNA, 25 bp, Mus musculus
gacattctccagcatcaagatatac

SEQ ID NO: 451241 - DNA, 25 bp, Mus musculus
gacattctccaggatcaagatatac

SEQ ID NO: 451242 - DNA, 25 bp, Mus musculus
gacattctccttctaaacatcttcc

SEQ ID NO: 451243 - DNA, 25 bp, Mus musculus
gacattctccttgtaaacatcttcc

SEQ ID NO: 451244 - DNA, 25 bp, Mus musculus
gacattctctaacctgttgagctgt

SEQ ID NO: 451245 - DNA, 25 bp, Mus musculus
gacattctctaagctgttgagctgt

SEQ ID NO: 451246 - DNA, 25 bp, Mus musculus
gacattctctatcgtgtcactgggc

SEQ ID NO: 451247 - DNA, 25 bp, Mus musculus
gacattctctatggtgtcactgggc

SEQ ID NO: 451248 - DNA, 25 bp, Mus musculus
gacattctctggaaggacggtcaca

SEQ ID NO: 451249 - DNA, 25 bp, Mus musculus
gacattctctggtaggacggtcaca

SEQ ID NO: 451250 - DNA, 25 bp, Mus musculus
gacattctctgtccaacggtgggct

SEQ ID NO: 451251 - DNA, 25 bp, Mus musculus
gacattctctgtgcaacggtgggct

SEQ ID NO: 451252 - DNA, 25 bp, Mus musculus
gacattctctttcttttgcatctag

SEQ ID NO: 451253 - DNA, 25 bp, Mus musculus
gacattctctttgttttgcatctag

SEQ ID NO: 451254 - DNA, 25 bp, Mus musculus
gacattctggagatgcatgaagata

SEQ ID NO: 451255 - DNA, 25 bp, Mus musculus
gacattctggagttgcatgaagata

SEQ ID NO: 451256 - DNA, 25 bp, Mus musculus
gacattcttcatatacttcttttgg

SEQ ID NO: 451257 - DNA, 25 bp, Mus musculus
gacattcttcatttacttcttttgg

SEQ ID NO: 451258 - DNA, 25 bp, Mus musculus
gacattcttcctagaagatcttact

SEQ ID NO: 451259 - DNA, 25 bp, Mus musculus
gacattcttccttgaagatcttact

SEQ ID NO: 451260 - DNA, 25 bp, Mus musculus
gacattcttcggaagaagctggagg

SEQ ID NO: 451261 - DNA, 25 bp, Mus musculus
gacattcttcggtagaagctggagg

SEQ ID NO: 451262 - DNA, 25 bp, Mus musculus
gacattcttctgatgcaaggctggg

SEQ ID NO: 451263 - DNA, 25 bp, Mus musculus
gacattcttctgttgcaaggctggg

SEQ ID NO: 451264 - DNA, 25 bp, Mus musculus
gacattcttgatataaagctctcag

SEQ ID NO: 451265 - DNA, 25 bp, Mus musculus
gacattcttgatttaaagctctcag

SEQ ID NO: 451266 - DNA, 25 bp, Mus musculus
gacattcttggtactctttatttaa

SEQ ID NO: 451267 - DNA, 25 bp, Mus musculus
gacattcttggttctctttatttaa

SEQ ID NO: 451268 - DNA, 25 bp, Mus musculus
gacattcttgtcactgggcaggcag

SEQ ID NO: 451269 - DNA, 25 bp, Mus musculus
gacattcttgtctctgggcaggcag

SEQ ID NO: 451270 - DNA, 25 bp, Mus musculus
gacattctttaaccacccttgagct

SEQ ID NO: 451271 - DNA, 25 bp, Mus musculus
gacattctttaagcacccttgagct

SEQ ID NO: 451272 - DNA, 25 bp, Mus musculus
gacattctttatagctcagactgac

SEQ ID NO: 451273 - DNA, 25 bp, Mus musculus
gacattctttatcacatcacggaga

SEQ ID NO: 451274 - DNA, 25 bp, Mus musculus
gacattctttatgacatcacggaga

SEQ ID NO: 451275 - DNA, 25 bp, Mus musculus
gacattctttattgctcagactgac

SEQ ID NO: 451276 - DNA, 25 bp, Mus musculus
gacattctttggacaaggatacagc

SEQ ID NO: 451277 - DNA, 25 bp, Mus musculus
gacattctttggtcaaggatacagc

SEQ ID NO: 451278 - DNA, 25 bp, Mus musculus
gacattgaaaacaggtgtgcccaga

SEQ ID NO: 451279 - DNA, 25 bp, Mus musculus
gacattgaaaactggtgtgcccaga

SEQ ID NO: 451280 - DNA, 25 bp, Mus musculus
gacattgaagagatggtggaacgca

SEQ ID NO: 451281 - DNA, 25 bp, Mus musculus
gacattgaagagttggtggaacgca

SEQ ID NO: 451282 - DNA, 25 bp, Mus musculus
gacattgaaggaactctagtcatta

SEQ ID NO: 451283 - DNA, 25 bp, Mus musculus
gacattgaaggatctctagtcatta

SEQ ID NO: 451284 - DNA, 25 bp, Mus musculus
gacattgaattcaaactgcccttca

SEQ ID NO: 451285 - DNA, 25 bp, Mus musculus
gacattgaattctaactgcccttca

SEQ ID NO: 451286 - DNA, 25 bp, Mus musculus
gacattgacatcctccgggtatcag

SEQ ID NO: 451287 - DNA, 25 bp, Mus musculus
gacattgacatcgtccgggtatcag

SEQ ID NO: 451288 - DNA, 25 bp, Mus musculus
gacattgacgccctggaggtcccac

SEQ ID NO: 451289 - DNA, 25 bp, Mus musculus
gacattgacgccgtggaggtcccac

SEQ ID NO: 451290 - DNA, 25 bp, Mus musculus
gacattgactttaaccttccccgag

SEQ ID NO: 451291 - DNA, 25 bp, Mus musculus
gacattgacttttaccttccccgag

SEQ ID NO: 451292 - DNA, 25 bp, Mus musculus
gacattgagcagacgtacatcaaca

SEQ ID NO: 451293 - DNA, 25 bp, Mus musculus
gacattgagcagtcgtacatcaaca

SEQ ID NO: 451294 - DNA, 25 bp, Mus musculus
gacattgagctgactgacgatcctt

SEQ ID NO: 451295 - DNA, 25 bp, Mus musculus
gacattgagctgtctgacgatcctt

SEQ ID NO: 451296 - DNA, 25 bp, Mus musculus
gacattgagcttaaagaagtacctg

SEQ ID NO: 451297 - DNA, 25 bp, Mus musculus
gacattgagctttaagaagtacctg

SEQ ID NO: 451298 - DNA, 25 bp, Mus musculus
gacattgaggagcactataccacag

SEQ ID NO: 451299 - DNA, 25 bp, Mus musculus
gacattgaggaggactataccacag

SEQ ID NO: 451300 - DNA, 25 bp, Mus musculus
gacattgagggtagacgccttgcta

SEQ ID NO: 451301 - DNA, 25 bp, Mus musculus
gacattgagggttgacgccttgcta

SEQ ID NO: 451302 - DNA, 25 bp, Mus musculus
gacattgatatccagaagaccatcc

SEQ ID NO: 451303 - DNA, 25 bp, Mus musculus
gacattgatatcgagaagaccatcc

SEQ ID NO: 451304 - DNA, 25 bp, Mus musculus
gacattgatcagcaaacgccagcaa

SEQ ID NO: 451305 - DNA, 25 bp, Mus musculus
gacattgatcaggaaacgccagcaa

SEQ ID NO: 451306 - DNA, 25 bp, Mus musculus
gacattgatgacacgcacgtcttcg

SEQ ID NO: 451307 - DNA, 25 bp, Mus musculus
gacattgatgactcgcacgtcttcg

SEQ ID NO: 451308 - DNA, 25 bp, Mus musculus
gacattgatgatcttcttgatgcca

SEQ ID NO: 451309 - DNA, 25 bp, Mus musculus
gacattgatgatgttcttgatgcca

SEQ ID NO: 451310 - DNA, 25 bp, Mus musculus
gacattgatgctcatgtgctgcaga

SEQ ID NO: 451311 - DNA, 25 bp, Mus musculus
gacattgatgctgatgtgctgcaga

SEQ ID NO: 451312 - DNA, 25 bp, Mus musculus
gacattgatgtgcacgtcaacgttg

SEQ ID NO: 451313 - DNA, 25 bp, Mus musculus
gacattgatgtgcagctcagctctg

SEQ ID NO: 451314 - DNA, 25 bp, Mus musculus
gacattgatgtggacgtcaacgttg

SEQ ID NO: 451315 - DNA, 25 bp, Mus musculus
gacattgatgtggagctcagctctg

SEQ ID NO: 451316 - DNA, 25 bp, Mus musculus
gacattgattatccaaggcatccat

SEQ ID NO: 451317 - DNA, 25 bp, Mus musculus
gacattgattatgcaaggcatccat

SEQ ID NO: 451318 - DNA, 25 bp, Mus musculus
gacattgcaagtacccattttcatc

SEQ ID NO: 451319 - DNA, 25 bp, Mus musculus
gacattgcaagttcccattttcatc

SEQ ID NO: 451320 - DNA, 25 bp, Mus musculus
gacattgcaattaatgacttaactg

SEQ ID NO: 451321 - DNA, 25 bp, Mus musculus
gacattgcaatttatgacttaactg

SEQ ID NO: 451322 - DNA, 25 bp, Mus musculus
gacattgcagatcttttctctgatc

SEQ ID NO: 451323 - DNA, 25 bp, Mus musculus
gacattgcagatgttttctctgatc

SEQ ID NO: 451324 - DNA, 25 bp, Mus musculus
gacattgcagctctccccagtttga

SEQ ID NO: 451325 - DNA, 25 bp, Mus musculus
gacattgcagctgtccccagtttga

SEQ ID NO: 451326 - DNA, 25 bp, Mus musculus
gacattgcatttccccatttatggt

SEQ ID NO: 451327 - DNA, 25 bp, Mus musculus
gacattgcatttgcccatttatggt

SEQ ID NO: 451328 - DNA, 25 bp, Mus musculus
gacattgccactactccaaagaaag

SEQ ID NO: 451329 - DNA, 25 bp, Mus musculus
gacattgccactcacacttaattat

SEQ ID NO: 451330 - DNA, 25 bp, Mus musculus
gacattgccactgacacttaattat

SEQ ID NO: 451331 - DNA, 25 bp, Mus musculus
gacattgccacttctccaaagaaag

SEQ ID NO: 451332 - DNA, 25 bp, Mus musculus
gacattgcccggacacgtgtggaga

SEQ ID NO: 451333 - DNA, 25 bp, Mus musculus
gacattgcccggtcacgtgtggaga

SEQ ID NO: 451334 - DNA, 25 bp, Mus musculus
gacattgccctgcttagattgcaag

SEQ ID NO: 451335 - DNA, 25 bp, Mus musculus
gacattgccctggttagattgcaag

SEQ ID NO: 451336 - DNA, 25 bp, Mus musculus
gacattgccgccaagtacaaggagc

SEQ ID NO: 451337 - DNA, 25 bp, Mus musculus
gacattgccgcctagtacaaggagc

SEQ ID NO: 451338 - DNA, 25 bp, Mus musculus
gacattgcctggattgttagtgact

SEQ ID NO: 451339 - DNA, 25 bp, Mus musculus
gacattgcctggtttgttagtgact

SEQ ID NO: 451340 - DNA, 25 bp, Mus musculus
gacattgccttgatgttgaagggct

SEQ ID NO: 451341 - DNA, 25 bp, Mus musculus
gacattgccttgttgttgaagggct

SEQ ID NO: 451342 - DNA, 25 bp, Mus musculus
gacattgcgagacatcaggcttcct

SEQ ID NO: 451343 - DNA, 25 bp, Mus musculus
gacattgcgagagatcaggcttcct

SEQ ID NO: 451344 - DNA, 25 bp, Mus musculus
gacattgctaatcttctgtatgata

SEQ ID NO: 451345 - DNA, 25 bp, Mus musculus
gacattgctaatgttctgtatgata

SEQ ID NO: 451346 - DNA, 25 bp, Mus musculus
gacattgctcatactgataaattaa

SEQ ID NO: 451347 - DNA, 25 bp, Mus musculus
gacattgctcattctgataaattaa

SEQ ID NO: 451348 - DNA, 25 bp, Mus musculus
gacattgctcttcggtggtctctga

SEQ ID NO: 451349 - DNA, 25 bp, Mus musculus
gacattgctcttgggtggtctctga

SEQ ID NO: 451350 - DNA, 25 bp, Mus musculus
gacattgctgggaccttctgagaaa

SEQ ID NO: 451351 - DNA, 25 bp, Mus musculus
gacattgctgggtccttctgagaaa

SEQ ID NO: 451352 - DNA, 25 bp, Mus musculus
gacattggaaacaggtctggctgag

SEQ ID NO: 451353 - DNA, 25 bp, Mus musculus
gacattggaaactggtctggctgag

SEQ ID NO: 451354 - DNA, 25 bp, Mus musculus
gacattggaaagacaacgttcaata

SEQ ID NO: 451355 - DNA, 25 bp, Mus musculus
gacattggaaagtcaacgttcaata

SEQ ID NO: 451356 - DNA, 25 bp, Mus musculus
gacattggagagctgaggatatact

SEQ ID NO: 451357 - DNA, 25 bp, Mus musculus
gacattggagaggtgaggatatact

SEQ ID NO: 451358 - DNA, 25 bp, Mus musculus
gacattggatatactctttgccatt

SEQ ID NO: 451359 - DNA, 25 bp, Mus musculus
gacattggatattctctttgccatt

SEQ ID NO: 451360 - DNA, 25 bp, Mus musculus
gacattggatgacctcctagcggcg

SEQ ID NO: 451361 - DNA, 25 bp, Mus musculus
gacattggatgagctcctagcggcg

SEQ ID NO: 451362 - DNA, 25 bp, Mus musculus
gacattggcacactctggtattcta

SEQ ID NO: 451363 - DNA, 25 bp, Mus musculus
gacattggcacagtctggtattcta

SEQ ID NO: 451364 - DNA, 25 bp, Mus musculus
gacattggcagacatcaacccagca

SEQ ID NO: 451365 - DNA, 25 bp, Mus musculus
gacattggcagagatcaacccagca

SEQ ID NO: 451366 - DNA, 25 bp, Mus musculus
gacattggcagtaattcgctcagct

SEQ ID NO: 451367 - DNA, 25 bp, Mus musculus
gacattggcagtcttttggttcaga

SEQ ID NO: 451368 - DNA, 25 bp, Mus musculus
gacattggcagtgttttggttcaga

SEQ ID NO: 451369 - DNA, 25 bp, Mus musculus
gacattggcagttattcgctcagct

SEQ ID NO: 451370 - DNA, 25 bp, Mus musculus
gacattggcataccgaggcttcatc

SEQ ID NO: 451371 - DNA, 25 bp, Mus musculus
gacattggcatagcgaggcttcatc

SEQ ID NO: 451372 - DNA, 25 bp, Mus musculus
gacattggcatcattctcatcaacc

SEQ ID NO: 451373 - DNA, 25 bp, Mus musculus
gacattggcatctttctcatcaacc

SEQ ID NO: 451374 - DNA, 25 bp, Mus musculus
gacattggcattcaggcaggaaatt

SEQ ID NO: 451375 - DNA, 25 bp, Mus musculus
gacattggcattgaggcaggaaatt

SEQ ID NO: 451376 - DNA, 25 bp, Mus musculus
gacattggccctcgacattggtttc

SEQ ID NO: 451377 - DNA, 25 bp, Mus musculus
gacattggccctggacattggtttc

SEQ ID NO: 451378 - DNA, 25 bp, Mus musculus
gacattggcctgactgcaaacttgt

SEQ ID NO: 451379 - DNA, 25 bp, Mus musculus
gacattggcctgtctgcaaacttgt

SEQ ID NO: 451380 - DNA, 25 bp, Mus musculus
gacattggctaccatgagttccggt

SEQ ID NO: 451381 - DNA, 25 bp, Mus musculus
gacattggctacgatgagttccggt

SEQ ID NO: 451382 - DNA, 25 bp, Mus musculus
gacattggctccacaagcacagatt

SEQ ID NO: 451383 - DNA, 25 bp, Mus musculus
gacattggctcctcaagcacagatt

SEQ ID NO: 451384 - DNA, 25 bp, Mus musculus
gacattggctggctttacatggcga

SEQ ID NO: 451385 - DNA, 25 bp, Mus musculus
gacattggctgggtttacatggcga

SEQ ID NO: 451386 - DNA, 25 bp, Mus musculus
gacattgggctacacatgttcagca

SEQ ID NO: 451387 - DNA, 25 bp, Mus musculus
gacattgggctagacatgttcagca

SEQ ID NO: 451388 - DNA, 25 bp, Mus musculus
gacattgggcttacagagttgtttg

SEQ ID NO: 451389 - DNA, 25 bp, Mus musculus
gacattgggctttcagagttgtttg

SEQ ID NO: 451390 - DNA, 25 bp, Mus musculus
gacattgggtttacagggtacaact

SEQ ID NO: 451391 - DNA, 25 bp, Mus musculus
gacattgggttttcagggtacaact

SEQ ID NO: 451392 - DNA, 25 bp, Mus musculus
gacattggtaacagtttccatgact

SEQ ID NO: 451393 - DNA, 25 bp, Mus musculus
gacattggtaactgtttccatgact

SEQ ID NO: 451394 - DNA, 25 bp, Mus musculus
gacattggtactatggtccttcctc

SEQ ID NO: 451395 - DNA, 25 bp, Mus musculus
gacattggtactttggtccttcctc

SEQ ID NO: 451396 - DNA, 25 bp, Mus musculus
gacattggtctgactgtgcctgctt

SEQ ID NO: 451397 - DNA, 25 bp, Mus musculus
gacattggtctgtctgtgcctgctt

SEQ ID NO: 451398 - DNA, 25 bp, Mus musculus
gacattggtgagatcctttattaaa

SEQ ID NO: 451399 - DNA, 25 bp, Mus musculus
gacattggtgagttcctttattaaa

SEQ ID NO: 451400 - DNA, 25 bp, Mus musculus
gacattggtgccaagggcctgaatg

SEQ ID NO: 451401 - DNA, 25 bp, Mus musculus
gacattggtgcctagggcctgaatg

SEQ ID NO: 451402 - DNA, 25 bp, Mus musculus
gacattggtggcatttgataaagag

SEQ ID NO: 451403 - DNA, 25 bp, Mus musculus
gacattggtggcttttgataaagag

SEQ ID NO: 451404 - DNA, 25 bp, Mus musculus
gacattggtgttcattttggcgtac

SEQ ID NO: 451405 - DNA, 25 bp, Mus musculus
gacattggtgttgattttggcgtac

SEQ ID NO: 451406 - DNA, 25 bp, Mus musculus
gacattgtacgactctgggacactg

SEQ ID NO: 451407 - DNA, 25 bp, Mus musculus
gacattgtacgagtctgggacactg

SEQ ID NO: 451408 - DNA, 25 bp, Mus musculus
gacattgtacgtacttcagatcact

SEQ ID NO: 451409 - DNA, 25 bp, Mus musculus
gacattgtacgttcttcagatcact

SEQ ID NO: 451410 - DNA, 25 bp, Mus musculus
gacattgtagggaagccagattcaa

SEQ ID NO: 451411 - DNA, 25 bp, Mus musculus
gacattgtagggtagccagattcaa

SEQ ID NO: 451412 - DNA, 25 bp, Mus musculus
gacattgtaggtatccttacgctgt

SEQ ID NO: 451413 - DNA, 25 bp, Mus musculus
gacattgtaggtttccttacgctgt

SEQ ID NO: 451414 - DNA, 25 bp, Mus musculus
gacattgtatcaattcttcacctat

SEQ ID NO: 451415 - DNA, 25 bp, Mus musculus
gacattgtatcatttcttcacctat

SEQ ID NO: 451416 - DNA, 25 bp, Mus musculus
gacattgtatccattatagtctaat

SEQ ID NO: 451417 - DNA, 25 bp, Mus musculus
gacattgtatcccaaatgcacacat

SEQ ID NO: 451418 - DNA, 25 bp, Mus musculus
gacattgtatccgaaatgcacacat

SEQ ID NO: 451419 - DNA, 25 bp, Mus musculus
gacattgtatcctttatagtctaat

SEQ ID NO: 451420 - DNA, 25 bp, Mus musculus
gacattgtcaggctgagctccagaa

SEQ ID NO: 451421 - DNA, 25 bp, Mus musculus
gacattgtcagggtgagctccagaa

SEQ ID NO: 451422 - DNA, 25 bp, Mus musculus
gacattgtcagtaaagtctggtcaa

SEQ ID NO: 451423 - DNA, 25 bp, Mus musculus
gacattgtcagttaagtctggtcaa

SEQ ID NO: 451424 - DNA, 25 bp, Mus musculus
gacattgtccagatgctactggcaa

SEQ ID NO: 451425 - DNA, 25 bp, Mus musculus
gacattgtccagttgctactggcaa

SEQ ID NO: 451426 - DNA, 25 bp, Mus musculus
gacattgtccccaaagaaccaggaa

SEQ ID NO: 451427 - DNA, 25 bp, Mus musculus
gacattgtcccctaagaaccaggaa

SEQ ID NO: 451428 - DNA, 25 bp, Mus musculus
gacattgtcgcaagtcacagaatta

SEQ ID NO: 451429 - DNA, 25 bp, Mus musculus
gacattgtcgcatgtcacagaatta

SEQ ID NO: 451430 - DNA, 25 bp, Mus musculus
gacattgtcgccatggatggacctc

SEQ ID NO: 451431 - DNA, 25 bp, Mus musculus
gacattgtcgccttggatggacctc

SEQ ID NO: 451432 - DNA, 25 bp, Mus musculus
gacattgtctaaatgcagcccaact

SEQ ID NO: 451433 - DNA, 25 bp, Mus musculus
gacattgtctaacccgcagcagtgg

SEQ ID NO: 451434 - DNA, 25 bp, Mus musculus
gacattgtctaagccgcagcagtgg

SEQ ID NO: 451435 - DNA, 25 bp, Mus musculus
gacattgtctaattgcagcccaact

SEQ ID NO: 451436 - DNA, 25 bp, Mus musculus
gacattgtctacacatcaacaggcg

SEQ ID NO: 451437 - DNA, 25 bp, Mus musculus
gacattgtctactcatcaacaggcg

SEQ ID NO: 451438 - DNA, 25 bp, Mus musculus
gacattgtctctcgccacaagaaga

SEQ ID NO: 451439 - DNA, 25 bp, Mus musculus
gacattgtctctcggttggaacttt

SEQ ID NO: 451440 - DNA, 25 bp, Mus musculus
gacattgtctctggccacaagaaga

SEQ ID NO: 451441 - DNA, 25 bp, Mus musculus
gacattgtctctgggttggaacttt

SEQ ID NO: 451442 - DNA, 25 bp, Mus musculus
gacattgtcttgaagcttgctgagt

SEQ ID NO: 451443 - DNA, 25 bp, Mus musculus
gacattgtcttgtagcttgctgagt

SEQ ID NO: 451444 - DNA, 25 bp, Mus musculus
gacattgtgattaccgtgattcctg

SEQ ID NO: 451445 - DNA, 25 bp, Mus musculus
gacattgtgatttccgtgattcctg

SEQ ID NO: 451446 - DNA, 25 bp, Mus musculus
gacattgtgcttcggatctgcatca

SEQ ID NO: 451447 - DNA, 25 bp, Mus musculus
gacattgtgcttgggatctgcatca

SEQ ID NO: 451448 - DNA, 25 bp, Mus musculus
gacattgtggacatcttgttactga

SEQ ID NO: 451449 - DNA, 25 bp, Mus musculus
gacattgtggacttcttgttactga

SEQ ID NO: 451450 - DNA, 25 bp, Mus musculus
gacattgtgtatacggcttcatagt

SEQ ID NO: 451451 - DNA, 25 bp, Mus musculus
gacattgtgtattcggcttcatagt

SEQ ID NO: 451452 - DNA, 25 bp, Mus musculus
gacattgtgttgaggtcttgagcga

SEQ ID NO: 451453 - DNA, 25 bp, Mus musculus
gacattgtgttgtggtcttgagcga

SEQ ID NO: 451454 - DNA, 25 bp, Mus musculus
gacattgtgtttcgatgtttcctac

SEQ ID NO: 451455 - DNA, 25 bp, Mus musculus
gacattgtgtttggatgtttcctac

SEQ ID NO: 451456 - DNA, 25 bp, Mus musculus
gacattgttcaaccgcactaaggtt

SEQ ID NO: 451457 - DNA, 25 bp, Mus musculus
gacattgttcaagcgcactaaggtt

SEQ ID NO: 451458 - DNA, 25 bp, Mus musculus
gacattgttcatctgcatgatcctg

SEQ ID NO: 451459 - DNA, 25 bp, Mus musculus
gacattgttcatgtgcatgatcctg

SEQ ID NO: 451460 - DNA, 25 bp, Mus musculus
gacattgttctaatttgccaagctg

SEQ ID NO: 451461 - DNA, 25 bp, Mus musculus
gacattgttctattttgccaagctg

SEQ ID NO: 451462 - DNA, 25 bp, Mus musculus
gacattgttgagaaatacccactgg

SEQ ID NO: 451463 - DNA, 25 bp, Mus musculus
gacattgttgagtaatacccactgg

SEQ ID NO: 451464 - DNA, 25 bp, Mus musculus
gacattgttgctagactacagacac

SEQ ID NO: 451465 - DNA, 25 bp, Mus musculus
gacattgttgcttgactacagacac

SEQ ID NO: 451466 - DNA, 25 bp, Mus musculus
gacattgtttctacatccggaggca

SEQ ID NO: 451467 - DNA, 25 bp, Mus musculus
gacattgtttctatcctgaattagg

SEQ ID NO: 451468 - DNA, 25 bp, Mus musculus
gacattgtttcttcatccggaggca

SEQ ID NO: 451469 - DNA, 25 bp, Mus musculus
gacattgtttctttcctgaattagg

SEQ ID NO: 451470 - DNA, 25 bp, Mus musculus
gacattgtttggcatgtgtcagtaa

SEQ ID NO: 451471 - DNA, 25 bp, Mus musculus
gacattgtttgggatgtgtcagtaa

SEQ ID NO: 451472 - DNA, 25 bp, Mus musculus
gacattgttttgagcctactttata

SEQ ID NO: 451473 - DNA, 25 bp, Mus musculus
gacattgttttgtgcctactttata

SEQ ID NO: 451474 - DNA, 25 bp, Mus musculus
gacatttaaactaaaactctcctgg

SEQ ID NO: 451475 - DNA, 25 bp, Mus musculus
gacatttaaacttaaactctcctgg

SEQ ID NO: 451476 - DNA, 25 bp, Mus musculus
gacatttaaaggacatactaatctg

SEQ ID NO: 451477 - DNA, 25 bp, Mus musculus
gacatttaaaggtcatactaatctg

SEQ ID NO: 451478 - DNA, 25 bp, Mus musculus
gacatttaacagagaccattccagg

SEQ ID NO: 451479 - DNA, 25 bp, Mus musculus
gacatttaacagtgaccattccagg

SEQ ID NO: 451480 - DNA, 25 bp, Mus musculus
gacatttaaccacgagacacagcct

SEQ ID NO: 451481 - DNA, 25 bp, Mus musculus
gacatttaaccaggagacacagcct

SEQ ID NO: 451482 - DNA, 25 bp, Mus musculus
gacatttaacttccatcttcttgca

SEQ ID NO: 451483 - DNA, 25 bp, Mus musculus
gacatttaacttgcatcttcttgca

SEQ ID NO: 451484 - DNA, 25 bp, Mus musculus
gacatttaagacatcatcactgtag

SEQ ID NO: 451485 - DNA, 25 bp, Mus musculus
gacatttaagacttcatcactgtag

SEQ ID NO: 451486 - DNA, 25 bp, Mus musculus
gacatttaaggtagagtcgccttga

SEQ ID NO: 451487 - DNA, 25 bp, Mus musculus
gacatttaaggttgagtcgccttga

SEQ ID NO: 451488 - DNA, 25 bp, Mus musculus
gacatttaagttacagtgtttctgg

SEQ ID NO: 451489 - DNA, 25 bp, Mus musculus
gacatttaagtttcagtgtttctgg

SEQ ID NO: 451490 - DNA, 25 bp, Mus musculus
gacatttacatcatactgactgttg

SEQ ID NO: 451491 - DNA, 25 bp, Mus musculus
gacatttacatcttactgactgttg

SEQ ID NO: 451492 - DNA, 25 bp, Mus musculus
gacatttactatactgcaggccaag

SEQ ID NO: 451493 - DNA, 25 bp, Mus musculus
gacatttactattctgcaggccaag

SEQ ID NO: 451494 - DNA, 25 bp, Mus musculus
gacatttactgcaaacacacttgag

SEQ ID NO: 451495 - DNA, 25 bp, Mus musculus
gacatttactgctaacacacttgag

SEQ ID NO: 451496 - DNA, 25 bp, Mus musculus
gacatttactttacacgcgatggaa

SEQ ID NO: 451497 - DNA, 25 bp, Mus musculus
gacatttacttttcacgcgatggaa

SEQ ID NO: 451498 - DNA, 25 bp, Mus musculus
gacatttagcagagagcactttagt

SEQ ID NO: 451499 - DNA, 25 bp, Mus musculus
gacatttagcagtgagcactttagt

SEQ ID NO: 451500 - DNA, 25 bp, Mus musculus
gacatttagtatattctggttcttt

SEQ ID NO: 451501 - DNA, 25 bp, Mus musculus
gacatttagtattttctggttcttt

SEQ ID NO: 451502 - DNA, 25 bp, Mus musculus
gacatttagttgctttccacatcct

SEQ ID NO: 451503 - DNA, 25 bp, Mus musculus
gacatttagttggtttccacatcct

SEQ ID NO: 451504 - DNA, 25 bp, Mus musculus
gacatttatatacttctcatgccca

SEQ ID NO: 451505 - DNA, 25 bp, Mus musculus
gacatttatatagttctcatgccca

SEQ ID NO: 451506 - DNA, 25 bp, Mus musculus
gacatttatattacccagctctggc

SEQ ID NO: 451507 - DNA, 25 bp, Mus musculus
gacatttatattcctgtgagctctc

SEQ ID NO: 451508 - DNA, 25 bp, Mus musculus
gacatttatattgctgtgagctctc

SEQ ID NO: 451509 - DNA, 25 bp, Mus musculus
gacatttatatttcccagctctggc

SEQ ID NO: 451510 - DNA, 25 bp, Mus musculus
gacatttatgaacagctccgcagat

SEQ ID NO: 451511 - DNA, 25 bp, Mus musculus
gacatttatgaagagctccgcagat

SEQ ID NO: 451512 - DNA, 25 bp, Mus musculus
gacatttatttgagttaacccagag

SEQ ID NO: 451513 - DNA, 25 bp, Mus musculus
gacatttatttgtgttaacccagag

SEQ ID NO: 451514 - DNA, 25 bp, Mus musculus
gacatttcaaacattcttctctaag

SEQ ID NO: 451515 - DNA, 25 bp, Mus musculus
gacatttcaaactttcttctctaag

SEQ ID NO: 451516 - DNA, 25 bp, Mus musculus
gacatttcaaccatgcggcctgaaa

SEQ ID NO: 451517 - DNA, 25 bp, Mus musculus
gacatttcaaccttgcggcctgaaa

SEQ ID NO: 451518 - DNA, 25 bp, Mus musculus
gacatttcaactacgcaggtatctg

SEQ ID NO: 451519 - DNA, 25 bp, Mus musculus
gacatttcaacttcgcaggtatctg

SEQ ID NO: 451520 - DNA, 25 bp, Mus musculus
gacatttcagatctccccattgctg

SEQ ID NO: 451521 - DNA, 25 bp, Mus musculus
gacatttcagatgtccccattgctg

SEQ ID NO: 451522 - DNA, 25 bp, Mus musculus
gacatttcaggcacatactaccatc

SEQ ID NO: 451523 - DNA, 25 bp, Mus musculus
gacatttcaggccagagcttgagga

SEQ ID NO: 451524 - DNA, 25 bp, Mus musculus
gacatttcaggcgagagcttgagga

SEQ ID NO: 451525 - DNA, 25 bp, Mus musculus
gacatttcaggctcatactaccatc

SEQ ID NO: 451526 - DNA, 25 bp, Mus musculus
gacatttcagggactagggcactca

SEQ ID NO: 451527 - DNA, 25 bp, Mus musculus
gacatttcagggtctagggcactca

SEQ ID NO: 451528 - DNA, 25 bp, Mus musculus
gacatttcatggaccaggtgacaga

SEQ ID NO: 451529 - DNA, 25 bp, Mus musculus
gacatttcatggaggcgattcttgc

SEQ ID NO: 451530 - DNA, 25 bp, Mus musculus
gacatttcatggtccaggtgacaga

SEQ ID NO: 451531 - DNA, 25 bp, Mus musculus
gacatttcatggtggcgattcttgc

SEQ ID NO: 451532 - DNA, 25 bp, Mus musculus
gacatttccaaacctggcgtgagtc

SEQ ID NO: 451533 - DNA, 25 bp, Mus musculus
gacatttccaaagctggcgtgagtc

SEQ ID NO: 451534 - DNA, 25 bp, Mus musculus
gacatttccaggcatatcccagaat

SEQ ID NO: 451535 - DNA, 25 bp, Mus musculus
gacatttccagggatatcccagaat

SEQ ID NO: 451536 - DNA, 25 bp, Mus musculus
gacatttccgacagacttttgtaga

SEQ ID NO: 451537 - DNA, 25 bp, Mus musculus
gacatttccgactgacttttgtaga

SEQ ID NO: 451538 - DNA, 25 bp, Mus musculus
gacatttccgtgatctattccagag

SEQ ID NO: 451539 - DNA, 25 bp, Mus musculus
gacatttccgtgttctattccagag

SEQ ID NO: 451540 - DNA, 25 bp, Mus musculus
gacatttcctccaacattgagcaga

SEQ ID NO: 451541 - DNA, 25 bp, Mus musculus
gacatttcctcctacattgagcaga

SEQ ID NO: 451542 - DNA, 25 bp, Mus musculus
gacatttcgaaaaggctgttgcagt

SEQ ID NO: 451543 - DNA, 25 bp, Mus musculus
gacatttcgaaatggctgttgcagt

SEQ ID NO: 451544 - DNA, 25 bp, Mus musculus
gacatttcgagaattctgcggacct

SEQ ID NO: 451545 - DNA, 25 bp, Mus musculus
gacatttcgagatttctgcggacct

SEQ ID NO: 451546 - DNA, 25 bp, Mus musculus
gacatttcgatgatcctggctgaag

SEQ ID NO: 451547 - DNA, 25 bp, Mus musculus
gacatttcgatgttcctggctgaag

SEQ ID NO: 451548 - DNA, 25 bp, Mus musculus
gacatttctaccaagctgttaacat

SEQ ID NO: 451549 - DNA, 25 bp, Mus musculus
gacatttctacctagctgttaacat

SEQ ID NO: 451550 - DNA, 25 bp, Mus musculus
gacatttctactcgtaccttacgaa

SEQ ID NO: 451551 - DNA, 25 bp, Mus musculus
gacatttctactggtaccttacgaa

SEQ ID NO: 451552 - DNA, 25 bp, Mus musculus
gacatttctcaaaatgtggctacaa

SEQ ID NO: 451553 - DNA, 25 bp, Mus musculus
gacatttctcaacaacttttctgga

SEQ ID NO: 451554 - DNA, 25 bp, Mus musculus
gacatttctcaagaacttttctgga

SEQ ID NO: 451555 - DNA, 25 bp, Mus musculus
gacatttctcaatatgtggctacaa

SEQ ID NO: 451556 - DNA, 25 bp, Mus musculus
gacatttctcacactgtagtggaat

SEQ ID NO: 451557 - DNA, 25 bp, Mus musculus
gacatttctcactctgtagtggaat

SEQ ID NO: 451558 - DNA, 25 bp, Mus musculus
gacatttctcttcctgaggttctgt

SEQ ID NO: 451559 - DNA, 25 bp, Mus musculus
gacatttctcttgctgaggttctgt

SEQ ID NO: 451560 - DNA, 25 bp, Mus musculus
gacatttctgaaagtaggccacctc

SEQ ID NO: 451561 - DNA, 25 bp, Mus musculus
gacatttctgaatgtaggccacctc

SEQ ID NO: 451562 - DNA, 25 bp, Mus musculus
gacatttctgtacccaggttgacac

SEQ ID NO: 451563 - DNA, 25 bp, Mus musculus
gacatttctgtagccaggttgacac

SEQ ID NO: 451564 - DNA, 25 bp, Mus musculus
gacatttctgttactcgtagttggt

SEQ ID NO: 451565 - DNA, 25 bp, Mus musculus
gacatttctgtttctcgtagttggt

SEQ ID NO: 451566 - DNA, 25 bp, Mus musculus
gacatttcttacacacactttccat

SEQ ID NO: 451567 - DNA, 25 bp, Mus musculus
gacatttcttactcacactttccat

SEQ ID NO: 451568 - DNA, 25 bp, Mus musculus
gacatttcttggaattgtgacagca

SEQ ID NO: 451569 - DNA, 25 bp, Mus musculus
gacatttcttggtattgtgacagca

SEQ ID NO: 451570 - DNA, 25 bp, Mus musculus
gacatttcttgtaatcctaatggga

SEQ ID NO: 451571 - DNA, 25 bp, Mus musculus
gacatttcttgttatcctaatggga

SEQ ID NO: 451572 - DNA, 25 bp, Mus musculus
gacatttctttaagtataggaaaag

SEQ ID NO: 451573 - DNA, 25 bp, Mus musculus
gacatttctttatgtataggaaaag

SEQ ID NO: 451574 - DNA, 25 bp, Mus musculus
gacatttgaaggaatcgccgggcag

SEQ ID NO: 451575 - DNA, 25 bp, Mus musculus
gacatttgaaggtatcgccgggcag

SEQ ID NO: 451576 - DNA, 25 bp, Mus musculus
gacatttgacccaagactggaccat

SEQ ID NO: 451577 - DNA, 25 bp, Mus musculus
gacatttgaccctagactggaccat

SEQ ID NO: 451578 - DNA, 25 bp, Mus musculus
gacatttgactgacccatacatggg

SEQ ID NO: 451579 - DNA, 25 bp, Mus musculus
gacatttgactgtcccatacatggg

SEQ ID NO: 451580 - DNA, 25 bp, Mus musculus
gacatttgagtactgtttcccagat

SEQ ID NO: 451581 - DNA, 25 bp, Mus musculus
gacatttgagtagtgtttcccagat

SEQ ID NO: 451582 - DNA, 25 bp, Mus musculus
gacatttgagtgcttttcacttgct

SEQ ID NO: 451583 - DNA, 25 bp, Mus musculus
gacatttgagtggttttcacttgct

SEQ ID NO: 451584 - DNA, 25 bp, Mus musculus
gacatttgcacaagttacagcatcc

SEQ ID NO: 451585 - DNA, 25 bp, Mus musculus
gacatttgcacatgttacagcatcc

SEQ ID NO: 451586 - DNA, 25 bp, Mus musculus
gacatttgcactatacctttatgct

SEQ ID NO: 451587 - DNA, 25 bp, Mus musculus
gacatttgcactttacctttatgct

SEQ ID NO: 451588 - DNA, 25 bp, Mus musculus
gacatttgcatcaattcccttgtaa

SEQ ID NO: 451589 - DNA, 25 bp, Mus musculus
gacatttgcatctattcccttgtaa

SEQ ID NO: 451590 - DNA, 25 bp, Mus musculus
gacatttgccaactctgcatgcaat

SEQ ID NO: 451591 - DNA, 25 bp, Mus musculus
gacatttgccaagtctgcatgcaat

SEQ ID NO: 451592 - DNA, 25 bp, Mus musculus
gacatttgccacagtggtactgcca

SEQ ID NO: 451593 - DNA, 25 bp, Mus musculus
gacatttgccactgtggtactgcca

SEQ ID NO: 451594 - DNA, 25 bp, Mus musculus
gacatttgccagctcaggcatttca

SEQ ID NO: 451595 - DNA, 25 bp, Mus musculus
gacatttgccaggtcaggcatttca

SEQ ID NO: 451596 - DNA, 25 bp, Mus musculus
gacatttgccccaaattacagtaat

SEQ ID NO: 451597 - DNA, 25 bp, Mus musculus
gacatttgcccctaattacagtaat

SEQ ID NO: 451598 - DNA, 25 bp, Mus musculus
gacatttgcctcctatcaaagccac

SEQ ID NO: 451599 - DNA, 25 bp, Mus musculus
gacatttgcctcgtatcaaagccac

SEQ ID NO: 451600 - DNA, 25 bp, Mus musculus
gacatttgctcaactccttctgagg

SEQ ID NO: 451601 - DNA, 25 bp, Mus musculus
gacatttgctcatctccttctgagg

SEQ ID NO: 451602 - DNA, 25 bp, Mus musculus
gacatttgctgccaagctgcaagct

SEQ ID NO: 451603 - DNA, 25 bp, Mus musculus
gacatttgctgcgaagctgcaagct

SEQ ID NO: 451604 - DNA, 25 bp, Mus musculus
gacatttggagcacaggcctggcac

SEQ ID NO: 451605 - DNA, 25 bp, Mus musculus
gacatttggagctcaggcctggcac

SEQ ID NO: 451606 - DNA, 25 bp, Mus musculus
gacatttggataccccgcgaggata

SEQ ID NO: 451607 - DNA, 25 bp, Mus musculus
gacatttggatagcccgcgaggata

SEQ ID NO: 451608 - DNA, 25 bp, Mus musculus
gacatttggcgtaatttcacatttg

SEQ ID NO: 451609 - DNA, 25 bp, Mus musculus
gacatttggcgttatttcacatttg

SEQ ID NO: 451610 - DNA, 25 bp, Mus musculus
gacatttgggcgctgagcacctacc

SEQ ID NO: 451611 - DNA, 25 bp, Mus musculus
gacatttgggcggtgagcacctacc

SEQ ID NO: 451612 - DNA, 25 bp, Mus musculus
gacatttggtgtccattctctgagg

SEQ ID NO: 451613 - DNA, 25 bp, Mus musculus
gacatttggtgtgcattctctgagg

SEQ ID NO: 451614 - DNA, 25 bp, Mus musculus
gacatttgtactaggctctaatccc

SEQ ID NO: 451615 - DNA, 25 bp, Mus musculus
gacatttgtacttggctctaatccc

SEQ ID NO: 451616 - DNA, 25 bp, Mus musculus
gacatttgtatgagagggccttgta

SEQ ID NO: 451617 - DNA, 25 bp, Mus musculus
gacatttgtatgtgagggccttgta

SEQ ID NO: 451618 - DNA, 25 bp, Mus musculus
gacatttgtattcatctttctccaa

SEQ ID NO: 451619 - DNA, 25 bp, Mus musculus
gacatttgtattgatctttctccaa

SEQ ID NO: 451620 - DNA, 25 bp, Mus musculus
gacatttgtcatactagtcacggaa

SEQ ID NO: 451621 - DNA, 25 bp, Mus musculus
gacatttgtcattctagtcacggaa

SEQ ID NO: 451622 - DNA, 25 bp, Mus musculus
gacatttgtgtgatccaggttcctc

SEQ ID NO: 451623 - DNA, 25 bp, Mus musculus
gacatttgtgtgttccaggttcctc

SEQ ID NO: 451624 - DNA, 25 bp, Mus musculus
gacatttgttcaagcacccacatat

SEQ ID NO: 451625 - DNA, 25 bp, Mus musculus
gacatttgttcatgcacccacatat

SEQ ID NO: 451626 - DNA, 25 bp, Mus musculus
gacatttgttgacaccattctcaga

SEQ ID NO: 451627 - DNA, 25 bp, Mus musculus
gacatttgttgagaccattctcaga

SEQ ID NO: 451628 - DNA, 25 bp, Mus musculus
gacatttgtttcacttatccactaa

SEQ ID NO: 451629 - DNA, 25 bp, Mus musculus
gacatttgtttctcttatccactaa

SEQ ID NO: 451630 - DNA, 25 bp, Mus musculus
gacattttaaatcttgccgtacttc

SEQ ID NO: 451631 - DNA, 25 bp, Mus musculus
gacattttaaatgttgccgtacttc

SEQ ID NO: 451632 - DNA, 25 bp, Mus musculus
gacattttaaccacagtctgaacac

SEQ ID NO: 451633 - DNA, 25 bp, Mus musculus
gacattttaacctcagtctgaacac

SEQ ID NO: 451634 - DNA, 25 bp, Mus musculus
gacattttaagtatattgtgcacaa

SEQ ID NO: 451635 - DNA, 25 bp, Mus musculus
gacattttaagtttattgtgcacaa

SEQ ID NO: 451636 - DNA, 25 bp, Mus musculus
gacattttacacctgagctgagaca

SEQ ID NO: 451637 - DNA, 25 bp, Mus musculus
gacattttacacgtgagctgagaca

SEQ ID NO: 451638 - DNA, 25 bp, Mus musculus
gacattttaccacccctttaagttg

SEQ ID NO: 451639 - DNA, 25 bp, Mus musculus
gacattttaccagccctttaagttg

SEQ ID NO: 451640 - DNA, 25 bp, Mus musculus
gacattttaccccttgatgtagctg

SEQ ID NO: 451641 - DNA, 25 bp, Mus musculus
gacattttacccgttgatgtagctg

SEQ ID NO: 451642 - DNA, 25 bp, Mus musculus
gacattttacctcaacaccggtgat

SEQ ID NO: 451643 - DNA, 25 bp, Mus musculus
gacattttacctgaacaccggtgat

SEQ ID NO: 451644 - DNA, 25 bp, Mus musculus
gacattttatctagtccgtgaagat

SEQ ID NO: 451645 - DNA, 25 bp, Mus musculus
gacattttatctcaccagccgtgac

SEQ ID NO: 451646 - DNA, 25 bp, Mus musculus
gacattttatctgaccagccgtgac

SEQ ID NO: 451647 - DNA, 25 bp, Mus musculus
gacattttatcttgtccgtgaagat

SEQ ID NO: 451648 - DNA, 25 bp, Mus musculus
gacattttatgacctaaagctttat

SEQ ID NO: 451649 - DNA, 25 bp, Mus musculus
gacattttatgagctaaagctttat

SEQ ID NO: 451650 - DNA, 25 bp, Mus musculus
gacattttatgtcttcctcgtaagg

SEQ ID NO: 451651 - DNA, 25 bp, Mus musculus
gacattttatgtgttcctcgtaagg

SEQ ID NO: 451652 - DNA, 25 bp, Mus musculus
gacattttattgcttataggccttc

SEQ ID NO: 451653 - DNA, 25 bp, Mus musculus
gacattttattggttataggccttc

SEQ ID NO: 451654 - DNA, 25 bp, Mus musculus
gacattttcaaaccagtgagtgctg

SEQ ID NO: 451655 - DNA, 25 bp, Mus musculus
gacattttcaaagcagtgagtgctg

SEQ ID NO: 451656 - DNA, 25 bp, Mus musculus
gacattttcaacaatgcgggtgtgg

SEQ ID NO: 451657 - DNA, 25 bp, Mus musculus
gacattttcaactatgcgggtgtgg

SEQ ID NO: 451658 - DNA, 25 bp, Mus musculus
gacattttcatccatcagttgccac

SEQ ID NO: 451659 - DNA, 25 bp, Mus musculus
gacattttcatcgatcagttgccac

SEQ ID NO: 451660 - DNA, 25 bp, Mus musculus
gacattttcattcatgggcatcaca

SEQ ID NO: 451661 - DNA, 25 bp, Mus musculus
gacattttcattgatgggcatcaca

SEQ ID NO: 451662 - DNA, 25 bp, Mus musculus
gacattttccttatgagtgtgcctt

SEQ ID NO: 451663 - DNA, 25 bp, Mus musculus
gacattttccttttgagtgtgcctt

SEQ ID NO: 451664 - DNA, 25 bp, Mus musculus
gacattttcgtcacatcaagttcat

SEQ ID NO: 451665 - DNA, 25 bp, Mus musculus
gacattttcgtctcatcaagttcat

SEQ ID NO: 451666 - DNA, 25 bp, Mus musculus
gacattttctcaataggtggtgatc

SEQ ID NO: 451667 - DNA, 25 bp, Mus musculus
gacattttctcattaggtggtgatc

SEQ ID NO: 451668 - DNA, 25 bp, Mus musculus
gacattttctttctacatagaagct

SEQ ID NO: 451669 - DNA, 25 bp, Mus musculus
gacattttctttgtacatagaagct

SEQ ID NO: 451670 - DNA, 25 bp, Mus musculus
gacattttgagcaccctccaaattt

SEQ ID NO: 451671 - DNA, 25 bp, Mus musculus
gacattttgagctccctccaaattt

SEQ ID NO: 451672 - DNA, 25 bp, Mus musculus
gacattttgcagacacatcttacag

SEQ ID NO: 451673 - DNA, 25 bp, Mus musculus
gacattttgcagcttcaatatgaag

SEQ ID NO: 451674 - DNA, 25 bp, Mus musculus
gacattttgcaggttcaatatgaag

SEQ ID NO: 451675 - DNA, 25 bp, Mus musculus
gacattttgcagtcacatcttacag

SEQ ID NO: 451676 - DNA, 25 bp, Mus musculus
gacattttgcctcttctctgaatag

SEQ ID NO: 451677 - DNA, 25 bp, Mus musculus
gacattttgcctgttctctgaatag

SEQ ID NO: 451678 - DNA, 25 bp, Mus musculus
gacattttgggcactgtgagatcct

SEQ ID NO: 451679 - DNA, 25 bp, Mus musculus
gacattttgggctctgtgagatcct

SEQ ID NO: 451680 - DNA, 25 bp, Mus musculus
gacattttgggtcagtagactgaac

SEQ ID NO: 451681 - DNA, 25 bp, Mus musculus
gacattttgggtgagtagactgaac

SEQ ID NO: 451682 - DNA, 25 bp, Mus musculus
gacattttgtatagtgctcatccta

SEQ ID NO: 451683 - DNA, 25 bp, Mus musculus
gacattttgtattgtgctcatccta

SEQ ID NO: 451684 - DNA, 25 bp, Mus musculus
gacattttgtgtattgcgccagcta

SEQ ID NO: 451685 - DNA, 25 bp, Mus musculus
gacattttgtgttttgcgccagcta

SEQ ID NO: 451686 - DNA, 25 bp, Mus musculus
gacatttttaatcacctagaatatt

SEQ ID NO: 451687 - DNA, 25 bp, Mus musculus
gacatttttaatgacctagaatatt

SEQ ID NO: 451688 - DNA, 25 bp, Mus musculus
gacatttttaccatttcatctagac

SEQ ID NO: 451689 - DNA, 25 bp, Mus musculus
gacatttttaccttttcatctagac

SEQ ID NO: 451690 - DNA, 25 bp, Mus musculus
gacatttttaggcaacttgcccttg

SEQ ID NO: 451691 - DNA, 25 bp, Mus musculus
gacatttttagggaacttgcccttg

SEQ ID NO: 451692 - DNA, 25 bp, Mus musculus
gacatttttgtcataattctattta

SEQ ID NO: 451693 - DNA, 25 bp, Mus musculus
gacatttttgtcttaattctattta

SEQ ID NO: 451694 - DNA, 25 bp, Mus musculus
gacatttttgtgaaagctgcaggcc

SEQ ID NO: 451695 - DNA, 25 bp, Mus musculus
gacatttttgtgtaagctgcaggcc

SEQ ID NO: 451696 - DNA, 25 bp, Mus musculus
gacatttttgttactagtgcctaga

SEQ ID NO: 451697 - DNA, 25 bp, Mus musculus
gacatttttgtttctagtgcctaga

SEQ ID NO: 451698 - DNA, 25 bp, Mus musculus
gacattttttccaacatagcatcat

SEQ ID NO: 451699 - DNA, 25 bp, Mus musculus
gacattttttcctacatagcatcat

SEQ ID NO: 451700 - DNA, 25 bp, Mus musculus
gaccaaaaagcacacccgttgaaag

SEQ ID NO: 451701 - DNA, 25 bp, Mus musculus
gaccaaaaagcagacccgttgaaag

SEQ ID NO: 451702 - DNA, 25 bp, Mus musculus
gaccaaaaatgtcctatctactgtg

SEQ ID NO: 451703 - DNA, 25 bp, Mus musculus
gaccaaaaatgtgctatctactgtg

SEQ ID NO: 451704 - DNA, 25 bp, Mus musculus
gaccaaaactatcccgtcagtctgt

SEQ ID NO: 451705 - DNA, 25 bp, Mus musculus
gaccaaaactatcgtaggcaaccag

SEQ ID NO: 451706 - DNA, 25 bp, Mus musculus
gaccaaaactatgccgtcagtctgt

SEQ ID NO: 451707 - DNA, 25 bp, Mus musculus
gaccaaaactatggtaggcaaccag

SEQ ID NO: 451708 - DNA, 25 bp, Mus musculus
gaccaaaactctataagttaccaat

SEQ ID NO: 451709 - DNA, 25 bp, Mus musculus
gaccaaaactctttaagttaccaat

SEQ ID NO: 451710 - DNA, 25 bp, Mus musculus
gaccaaaacttaacggaatgccatt

SEQ ID NO: 451711 - DNA, 25 bp, Mus musculus
gaccaaaacttatcggaatgccatt

SEQ ID NO: 451712 - DNA, 25 bp, Mus musculus
gaccaaaacttcaattcacttcaat

SEQ ID NO: 451713 - DNA, 25 bp, Mus musculus
gaccaaaacttctattcacttcaat

SEQ ID NO: 451714 - DNA, 25 bp, Mus musculus
gaccaaaaggtcatcagggctctag

SEQ ID NO: 451715 - DNA, 25 bp, Mus musculus
gaccaaaaggtcttcagggctctag

SEQ ID NO: 451716 - DNA, 25 bp, Mus musculus
gaccaaaagtgcatgttctcaccac

SEQ ID NO: 451717 - DNA, 25 bp, Mus musculus
gaccaaaagtgcttgttctcaccac

SEQ ID NO: 451718 - DNA, 25 bp, Mus musculus
gaccaaaataagctcccgtgttcct

SEQ ID NO: 451719 - DNA, 25 bp, Mus musculus
gaccaaaataaggtcccgtgttcct

SEQ ID NO: 451720 - DNA, 25 bp, Mus musculus
gaccaaaatcccaactcagagacac

SEQ ID NO: 451721 - DNA, 25 bp, Mus musculus
gaccaaaatccctactcagagacac

SEQ ID NO: 451722 - DNA, 25 bp, Mus musculus
gaccaaaatctgaggccatgagcca

SEQ ID NO: 451723 - DNA, 25 bp, Mus musculus
gaccaaaatctgtggccatgagcca

SEQ ID NO: 451724 - DNA, 25 bp, Mus musculus
gaccaaaatgaaatgcaggtgctct

SEQ ID NO: 451725 - DNA, 25 bp, Mus musculus
gaccaaaatgaattgcaggtgctct

SEQ ID NO: 451726 - DNA, 25 bp, Mus musculus
gaccaaaattatacccatcgggatt

SEQ ID NO: 451727 - DNA, 25 bp, Mus musculus
gaccaaaattattcccatcgggatt

SEQ ID NO: 451728 - DNA, 25 bp, Mus musculus
gaccaaacaggtcaagggctactgg

SEQ ID NO: 451729 - DNA, 25 bp, Mus musculus
gaccaaacaggtgaagggctactgg

SEQ ID NO: 451730 - DNA, 25 bp, Mus musculus
gaccaaacagttcctggctctggat

SEQ ID NO: 451731 - DNA, 25 bp, Mus musculus
gaccaaacagttgctggctctggat

SEQ ID NO: 451732 - DNA, 25 bp, Mus musculus
gaccaaacatggcatgattcttact

SEQ ID NO: 451733 - DNA, 25 bp, Mus musculus
gaccaaacatgggatgattcttact

SEQ ID NO: 451734 - DNA, 25 bp, Mus musculus
gaccaaaccgttctatcaggcatta

SEQ ID NO: 451735 - DNA, 25 bp, Mus musculus
gaccaaaccgttgtatcaggcatta

SEQ ID NO: 451736 - DNA, 25 bp, Mus musculus
gaccaaacggatccgaacttctttc

SEQ ID NO: 451737 - DNA, 25 bp, Mus musculus
gaccaaacggatgcgaacttctttc

SEQ ID NO: 451738 - DNA, 25 bp, Mus musculus
gaccaaactcccagtgtgtgaactt

SEQ ID NO: 451739 - DNA, 25 bp, Mus musculus
gaccaaactccctgtgtgtgaactt

SEQ ID NO: 451740 - DNA, 25 bp, Mus musculus
gaccaaactctgaacttccaagctg

SEQ ID NO: 451741 - DNA, 25 bp, Mus musculus
gaccaaactctgtacttccaagctg

SEQ ID NO: 451742 - DNA, 25 bp, Mus musculus
gaccaaactgcccttgacctcagtt

SEQ ID NO: 451743 - DNA, 25 bp, Mus musculus
gaccaaactgccgttgacctcagtt

SEQ ID NO: 451744 - DNA, 25 bp, Mus musculus
gaccaaacttctcattttgatttga

SEQ ID NO: 451745 - DNA, 25 bp, Mus musculus
gaccaaacttctgattttgatttga

SEQ ID NO: 451746 - DNA, 25 bp, Mus musculus
gaccaaagactcagaaatccctcac

SEQ ID NO: 451747 - DNA, 25 bp, Mus musculus
gaccaaagactctgaaatccctcac

SEQ ID NO: 451748 - DNA, 25 bp, Mus musculus
gaccaaagagtaattctctaagcag

SEQ ID NO: 451749 - DNA, 25 bp, Mus musculus
gaccaaagagtatttctctaagcag

SEQ ID NO: 451750 - DNA, 25 bp, Mus musculus
gaccaaagatgaatactacaggatt

SEQ ID NO: 451751 - DNA, 25 bp, Mus musculus
gaccaaagatgattactacaggatt

SEQ ID NO: 451752 - DNA, 25 bp, Mus musculus
gaccaaagatggactcttggatgtc

SEQ ID NO: 451753 - DNA, 25 bp, Mus musculus
gaccaaagatggtctcttggatgtc

SEQ ID NO: 451754 - DNA, 25 bp, Mus musculus
gaccaaagattgcattctagcaaat

SEQ ID NO: 451755 - DNA, 25 bp, Mus musculus
gaccaaagattggattctagcaaat

SEQ ID NO: 451756 - DNA, 25 bp, Mus musculus
gaccaaagcttgctgaccttggagc

SEQ ID NO: 451757 - DNA, 25 bp, Mus musculus
gaccaaagcttggtgaccttggagc

SEQ ID NO: 451758 - DNA, 25 bp, Mus musculus
gaccaaaggccgatactgcatgcag

SEQ ID NO: 451759 - DNA, 25 bp, Mus musculus
gaccaaaggccgttactgcatgcag

SEQ ID NO: 451760 - DNA, 25 bp, Mus musculus
gaccaaagggagaggccgagcctca

SEQ ID NO: 451761 - DNA, 25 bp, Mus musculus
gaccaaagggagtggccgagcctca

SEQ ID NO: 451762 - DNA, 25 bp, Mus musculus
gaccaaagggtgcttcagtaatgct

SEQ ID NO: 451763 - DNA, 25 bp, Mus musculus
gaccaaagggtggttcagtaatgct

SEQ ID NO: 451764 - DNA, 25 bp, Mus musculus
gaccaaagtaacatctggccctata

SEQ ID NO: 451765 - DNA, 25 bp, Mus musculus
gaccaaagtaacttctggccctata

SEQ ID NO: 451766 - DNA, 25 bp, Mus musculus
gaccaaagtacactttctgcgggaa

SEQ ID NO: 451767 - DNA, 25 bp, Mus musculus
gaccaaagtacagtttctgcgggaa

SEQ ID NO: 451768 - DNA, 25 bp, Mus musculus
gaccaaagtactaatctctagttcc

SEQ ID NO: 451769 - DNA, 25 bp, Mus musculus
gaccaaagtacttatctctagttcc

SEQ ID NO: 451770 - DNA, 25 bp, Mus musculus
gaccaaagtcagagatctctttgca

SEQ ID NO: 451771 - DNA, 25 bp, Mus musculus
gaccaaagtcagtgatctctttgca

SEQ ID NO: 451772 - DNA, 25 bp, Mus musculus
gaccaaagtgacaggcctcagtacc

SEQ ID NO: 451773 - DNA, 25 bp, Mus musculus
gaccaaagtgactggcctcagtacc

SEQ ID NO: 451774 - DNA, 25 bp, Mus musculus
gaccaaagtggaaggcgagccccaa

SEQ ID NO: 451775 - DNA, 25 bp, Mus musculus
gaccaaagtggatggcgagccccaa

SEQ ID NO: 451776 - DNA, 25 bp, Mus musculus
gaccaaagtgggaactgctattttt

SEQ ID NO: 451777 - DNA, 25 bp, Mus musculus
gaccaaagtgggtactgctattttt

SEQ ID NO: 451778 - DNA, 25 bp, Mus musculus
gaccaaagttctagttccttaccag

SEQ ID NO: 451779 - DNA, 25 bp, Mus musculus
gaccaaagttcttgttccttaccag

SEQ ID NO: 451780 - DNA, 25 bp, Mus musculus
gaccaaatatttatcctcacatcga

SEQ ID NO: 451781 - DNA, 25 bp, Mus musculus
gaccaaatatttttcctcacatcga

SEQ ID NO: 451782 - DNA, 25 bp, Mus musculus
gaccaaatcacaccaagcaactaac

SEQ ID NO: 451783 - DNA, 25 bp, Mus musculus
gaccaaatcacagcaagcaactaac

SEQ ID NO: 451784 - DNA, 25 bp, Mus musculus
gaccaaatcactaagagaaatccag

SEQ ID NO: 451785 - DNA, 25 bp, Mus musculus
gaccaaatcacttagagaaatccag

SEQ ID NO: 451786 - DNA, 25 bp, Mus musculus
gaccaaatcgacaatggcttctttt

SEQ ID NO: 451787 - DNA, 25 bp, Mus musculus
gaccaaatcgactatggcttctttt

SEQ ID NO: 451788 - DNA, 25 bp, Mus musculus
gaccaaatctgaagatcgccctttt

SEQ ID NO: 451789 - DNA, 25 bp, Mus musculus
gaccaaatctgatgatcgccctttt

SEQ ID NO: 451790 - DNA, 25 bp, Mus musculus
gaccaaatgtgtagtaggtggcatt

SEQ ID NO: 451791 - DNA, 25 bp, Mus musculus
gaccaaatgtgttgtaggtggcatt

SEQ ID NO: 451792 - DNA, 25 bp, Mus musculus
gaccaaattatcagtgcatttaagg

SEQ ID NO: 451793 - DNA, 25 bp, Mus musculus
gaccaaattatctgtgcatttaagg

SEQ ID NO: 451794 - DNA, 25 bp, Mus musculus
gaccaaattgtcacttctaacccag

SEQ ID NO: 451795 - DNA, 25 bp, Mus musculus
gaccaaattgtctcttctaacccag

SEQ ID NO: 451796 - DNA, 25 bp, Mus musculus
gaccaacaagttctgggatttcaca

SEQ ID NO: 451797 - DNA, 25 bp, Mus musculus
gaccaacaagttgtgggatttcaca

SEQ ID NO: 451798 - DNA, 25 bp, Mus musculus
gaccaacacacaacatccttcatga

SEQ ID NO: 451799 - DNA, 25 bp, Mus musculus
gaccaacacacatcatccttcatga

SEQ ID NO: 451800 - DNA, 25 bp, Mus musculus
gaccaacagcctcagtttctatgaa

SEQ ID NO: 451801 - DNA, 25 bp, Mus musculus
gaccaacagcctgagtttctatgaa

SEQ ID NO: 451802 - DNA, 25 bp, Mus musculus
gaccaacagtctcaagaaaccttga

SEQ ID NO: 451803 - DNA, 25 bp, Mus musculus
gaccaacagtctgaagaaaccttga

SEQ ID NO: 451804 - DNA, 25 bp, Mus musculus
gaccaacagtgaccgaggacagact

SEQ ID NO: 451805 - DNA, 25 bp, Mus musculus
gaccaacagtgagcgaggacagact

SEQ ID NO: 451806 - DNA, 25 bp, Mus musculus
gaccaacatactcttttattctttt

SEQ ID NO: 451807 - DNA, 25 bp, Mus musculus
gaccaacatactgttttattctttt

SEQ ID NO: 451808 - DNA, 25 bp, Mus musculus
gaccaaccaccacaagctttaggga

SEQ ID NO: 451809 - DNA, 25 bp, Mus musculus
gaccaaccaccagaagctttaggga

SEQ ID NO: 451810 - DNA, 25 bp, Mus musculus
gaccaaccatggaggctactgtgct

SEQ ID NO: 451811 - DNA, 25 bp, Mus musculus
gaccaaccatggtggctactgtgct

SEQ ID NO: 451812 - DNA, 25 bp, Mus musculus
gaccaaccccatatggatcaagctt

SEQ ID NO: 451813 - DNA, 25 bp, Mus musculus
gaccaaccccatttggatcaagctt

SEQ ID NO: 451814 - DNA, 25 bp, Mus musculus
gaccaaccctacataatggtgctct

SEQ ID NO: 451815 - DNA, 25 bp, Mus musculus
gaccaaccctacttaatggtgctct

SEQ ID NO: 451816 - DNA, 25 bp, Mus musculus
gaccaaccctcaagtttgtaagctg

SEQ ID NO: 451817 - DNA, 25 bp, Mus musculus
gaccaaccctcatgtttgtaagctg

SEQ ID NO: 451818 - DNA, 25 bp, Mus musculus
gaccaaccctgccaagtcttaatgg

SEQ ID NO: 451819 - DNA, 25 bp, Mus musculus
gaccaaccctgcgaagtcttaatgg

SEQ ID NO: 451820 - DNA, 25 bp, Mus musculus
gaccaaccggcaagtgccattgtca

SEQ ID NO: 451821 - DNA, 25 bp, Mus musculus
gaccaaccggcatgtgccattgtca

SEQ ID NO: 451822 - DNA, 25 bp, Mus musculus
gaccaacctggtcaatgtttgccta

SEQ ID NO: 451823 - DNA, 25 bp, Mus musculus
gaccaacctggtgaatgtttgccta

SEQ ID NO: 451824 - DNA, 25 bp, Mus musculus
gaccaacgaactctgtcttatcagg

SEQ ID NO: 451825 - DNA, 25 bp, Mus musculus
gaccaacgaactgtgtcttatcagg

SEQ ID NO: 451826 - DNA, 25 bp, Mus musculus
gaccaacgctatattctgggcttag

SEQ ID NO: 451827 - DNA, 25 bp, Mus musculus
gaccaacgctattttctgggcttag

SEQ ID NO: 451828 - DNA, 25 bp, Mus musculus
gaccaacggtctcctgtaagttcaa

SEQ ID NO: 451829 - DNA, 25 bp, Mus musculus
gaccaacggtctgctgtaagttcaa

SEQ ID NO: 451830 - DNA, 25 bp, Mus musculus
gaccaactatgaagtcttcgaaaag

SEQ ID NO: 451831 - DNA, 25 bp, Mus musculus
gaccaactatgatgtcttcgaaaag

SEQ ID NO: 451832 - DNA, 25 bp, Mus musculus
gaccaactcagtactagggcctcag

SEQ ID NO: 451833 - DNA, 25 bp, Mus musculus
gaccaactcagttctagggcctcag

SEQ ID NO: 451834 - DNA, 25 bp, Mus musculus
gaccaactctcacaatgtaccacaa

SEQ ID NO: 451835 - DNA, 25 bp, Mus musculus
gaccaactctcagaatgtaccacaa

SEQ ID NO: 451836 - DNA, 25 bp, Mus musculus
gaccaactgcaacttaatgtgggtt

SEQ ID NO: 451837 - DNA, 25 bp, Mus musculus
gaccaactgcaagttaatgtgggtt

SEQ ID NO: 451838 - DNA, 25 bp, Mus musculus
gaccaactgtcaattgctctgtgaa

SEQ ID NO: 451839 - DNA, 25 bp, Mus musculus
gaccaactgtcatttgctctgtgaa

SEQ ID NO: 451840 - DNA, 25 bp, Mus musculus
gaccaacttctgatattgtgtgtta

SEQ ID NO: 451841 - DNA, 25 bp, Mus musculus
gaccaacttctgttattgtgtgtta

SEQ ID NO: 451842 - DNA, 25 bp, Mus musculus
gaccaactttcccttgtggtgagaa

SEQ ID NO: 451843 - DNA, 25 bp, Mus musculus
gaccaactttccgttgtggtgagaa

SEQ ID NO: 451844 - DNA, 25 bp, Mus musculus
gaccaactttttaaacccacatgag

SEQ ID NO: 451845 - DNA, 25 bp, Mus musculus
gaccaacttttttaacccacatgag

SEQ ID NO: 451846 - DNA, 25 bp, Mus musculus
gaccaagaacatccctgaactttaa

SEQ ID NO: 451847 - DNA, 25 bp, Mus musculus
gaccaagaacatgcctgaactttaa

SEQ ID NO: 451848 - DNA, 25 bp, Mus musculus
gaccaagaagccattccgtcattga

SEQ ID NO: 451849 - DNA, 25 bp, Mus musculus
gaccaagaagcctttccgtcattga

SEQ ID NO: 451850 - DNA, 25 bp, Mus musculus
gaccaagaagcgaatcttccagatt

SEQ ID NO: 451851 - DNA, 25 bp, Mus musculus
gaccaagaagcgtatcttccagatt

SEQ ID NO: 451852 - DNA, 25 bp, Mus musculus
gaccaagaatttctctttctgcttg

SEQ ID NO: 451853 - DNA, 25 bp, Mus musculus
gaccaagaatttgtctttctgcttg

SEQ ID NO: 451854 - DNA, 25 bp, Mus musculus
gaccaagagacaattaaagtacaat

SEQ ID NO: 451855 - DNA, 25 bp, Mus musculus
gaccaagagacatttaaagtacaat

SEQ ID NO: 451856 - DNA, 25 bp, Mus musculus
gaccaagagaggacccctgggacct

SEQ ID NO: 451857 - DNA, 25 bp, Mus musculus
gaccaagagaggtcccctgggacct

SEQ ID NO: 451858 - DNA, 25 bp, Mus musculus
gaccaagagatgcagtttaggcctg

SEQ ID NO: 451859 - DNA, 25 bp, Mus musculus
gaccaagagatggagtttaggcctg

SEQ ID NO: 451860 - DNA, 25 bp, Mus musculus
gaccaagagcagattcatgcctcaa

SEQ ID NO: 451861 - DNA, 25 bp, Mus musculus
gaccaagagcagtttcatgcctcaa

SEQ ID NO: 451862 - DNA, 25 bp, Mus musculus
gaccaagagccccattctttcggct

SEQ ID NO: 451863 - DNA, 25 bp, Mus musculus
gaccaagagcccgattctttcggct

SEQ ID NO: 451864 - DNA, 25 bp, Mus musculus
gaccaagaggtcacttccagggctg

SEQ ID NO: 451865 - DNA, 25 bp, Mus musculus
gaccaagaggtctcttccagggctg

SEQ ID NO: 451866 - DNA, 25 bp, Mus musculus
gaccaagagtgtctctaatagtatc

SEQ ID NO: 451867 - DNA, 25 bp, Mus musculus
gaccaagagtgtgtctaatagtatc

SEQ ID NO: 451868 - DNA, 25 bp, Mus musculus
gaccaagatcctccatcactttaag

SEQ ID NO: 451869 - DNA, 25 bp, Mus musculus
gaccaagatcctgcatcactttaag

SEQ ID NO: 451870 - DNA, 25 bp, Mus musculus
gaccaagatctaattcctggtttcc

SEQ ID NO: 451871 - DNA, 25 bp, Mus musculus
gaccaagatctatttcctggtttcc

SEQ ID NO: 451872 - DNA, 25 bp, Mus musculus
gaccaagatgcacattcgtttcctc

SEQ ID NO: 451873 - DNA, 25 bp, Mus musculus
gaccaagatgcagattcgtttcctc

SEQ ID NO: 451874 - DNA, 25 bp, Mus musculus
gaccaagatgctagtgaggccactt

SEQ ID NO: 451875 - DNA, 25 bp, Mus musculus
gaccaagatgcttgtgaggccactt

SEQ ID NO: 451876 - DNA, 25 bp, Mus musculus
gaccaagatggaaatcctgcagcac

SEQ ID NO: 451877 - DNA, 25 bp, Mus musculus
gaccaagatggatatcctgcagcac

SEQ ID NO: 451878 - DNA, 25 bp, Mus musculus
gaccaagatggccagtttgacctgg

SEQ ID NO: 451879 - DNA, 25 bp, Mus musculus
gaccaagatggcgagtttgacctgg

SEQ ID NO: 451880 - DNA, 25 bp, Mus musculus
gaccaagatgtccactgatctgttt

SEQ ID NO: 451881 - DNA, 25 bp, Mus musculus
gaccaagatgtcgactgatctgttt

SEQ ID NO: 451882 - DNA, 25 bp, Mus musculus
gaccaagattagataatcacccaaa

SEQ ID NO: 451883 - DNA, 25 bp, Mus musculus
gaccaagattagttaatcacccaaa

SEQ ID NO: 451884 - DNA, 25 bp, Mus musculus
gaccaagcaaatccagttcttttct

SEQ ID NO: 451885 - DNA, 25 bp, Mus musculus
gaccaagcaaatgcagttcttttct

SEQ ID NO: 451886 - DNA, 25 bp, Mus musculus
gaccaagcaagcattcttactacct

SEQ ID NO: 451887 - DNA, 25 bp, Mus musculus
gaccaagcaagctttcttactacct

SEQ ID NO: 451888 - DNA, 25 bp, Mus musculus
gaccaagcacctcaggacacatggg

SEQ ID NO: 451889 - DNA, 25 bp, Mus musculus
gaccaagcacctgaggacacatggg

SEQ ID NO: 451890 - DNA, 25 bp, Mus musculus
gaccaagcactacaactcttttgag

SEQ ID NO: 451891 - DNA, 25 bp, Mus musculus
gaccaagcactagaactcttttgag

SEQ ID NO: 451892 - DNA, 25 bp, Mus musculus
gaccaagcagacatccagaaccaga

SEQ ID NO: 451893 - DNA, 25 bp, Mus musculus
gaccaagcagacttccagaaccaga

SEQ ID NO: 451894 - DNA, 25 bp, Mus musculus
gaccaagcagggaatgtctctctgt

SEQ ID NO: 451895 - DNA, 25 bp, Mus musculus
gaccaagcagggtatgtctctctgt

SEQ ID NO: 451896 - DNA, 25 bp, Mus musculus
gaccaagcagtcctgccagcttttt

SEQ ID NO: 451897 - DNA, 25 bp, Mus musculus
gaccaagcagtcgtgccagcttttt

SEQ ID NO: 451898 - DNA, 25 bp, Mus musculus
gaccaagccatcctgattgtcagtc

SEQ ID NO: 451899 - DNA, 25 bp, Mus musculus
gaccaagccatcgtgattgtcagtc

SEQ ID NO: 451900 - DNA, 25 bp, Mus musculus
gaccaagcccagaaattttagtatt

SEQ ID NO: 451901 - DNA, 25 bp, Mus musculus
gaccaagcccagtaattttagtatt

SEQ ID NO: 451902 - DNA, 25 bp, Mus musculus
gaccaagccgaacaataaccacaat

SEQ ID NO: 451903 - DNA, 25 bp, Mus musculus
gaccaagccgaagaataaccacaat

SEQ ID NO: 451904 - DNA, 25 bp, Mus musculus
gaccaagccttactgtggacagcac

SEQ ID NO: 451905 - DNA, 25 bp, Mus musculus
gaccaagccttagtgtggacagcac

SEQ ID NO: 451906 - DNA, 25 bp, Mus musculus
gaccaagctcctcagatcctatgat

SEQ ID NO: 451907 - DNA, 25 bp, Mus musculus
gaccaagctcctgagatcctatgat

SEQ ID NO: 451908 - DNA, 25 bp, Mus musculus
gaccaagctctcagaagtaaaacca

SEQ ID NO: 451909 - DNA, 25 bp, Mus musculus
gaccaagctctctgaagtaaaacca

SEQ ID NO: 451910 - DNA, 25 bp, Mus musculus
gaccaagctgcaatgcagtattaat

SEQ ID NO: 451911 - DNA, 25 bp, Mus musculus
gaccaagctgcattgcagtattaat

SEQ ID NO: 451912 - DNA, 25 bp, Mus musculus
gaccaagctgtaacttttccagtag

SEQ ID NO: 451913 - DNA, 25 bp, Mus musculus
gaccaagctgtatcttttccagtag

SEQ ID NO: 451914 - DNA, 25 bp, Mus musculus
gaccaagctgtgagaccagctgttg

SEQ ID NO: 451915 - DNA, 25 bp, Mus musculus
gaccaagctgtgattatgctcatag

SEQ ID NO: 451916 - DNA, 25 bp, Mus musculus
gaccaagctgtgtgaccagctgttg

SEQ ID NO: 451917 - DNA, 25 bp, Mus musculus
gaccaagctgtgtttatgctcatag

SEQ ID NO: 451918 - DNA, 25 bp, Mus musculus
gaccaagcttggcatcataacaaaa

SEQ ID NO: 451919 - DNA, 25 bp, Mus musculus
gaccaagcttgggatcataacaaaa

SEQ ID NO: 451920 - DNA, 25 bp, Mus musculus
gaccaagcttgtcaccggatttacc

SEQ ID NO: 451921 - DNA, 25 bp, Mus musculus
gaccaagcttgtgaccggatttacc

SEQ ID NO: 451922 - DNA, 25 bp, Mus musculus
gaccaaggaaatccttacgatgctg

SEQ ID NO: 451923 - DNA, 25 bp, Mus musculus
gaccaaggaaatgcttacgatgctg

SEQ ID NO: 451924 - DNA, 25 bp, Mus musculus
gaccaaggaacacctgtgtaaatac

SEQ ID NO: 451925 - DNA, 25 bp, Mus musculus
gaccaaggaacagctgtgtaaatac

SEQ ID NO: 451926 - DNA, 25 bp, Mus musculus
gaccaaggaagtcacgcccctgcga

SEQ ID NO: 451927 - DNA, 25 bp, Mus musculus
gaccaaggaagtgacgcccctgcga

SEQ ID NO: 451928 - DNA, 25 bp, Mus musculus
gaccaaggaatcatcagtcccggac

SEQ ID NO: 451929 - DNA, 25 bp, Mus musculus
gaccaaggaatcttcagtcccggac

SEQ ID NO: 451930 - DNA, 25 bp, Mus musculus
gaccaaggacagacttttcctgtgc

SEQ ID NO: 451931 - DNA, 25 bp, Mus musculus
gaccaaggacagtcttttcctgtgc

SEQ ID NO: 451932 - DNA, 25 bp, Mus musculus
gaccaaggacctctcatgtgcaaga

SEQ ID NO: 451933 - DNA, 25 bp, Mus musculus
gaccaaggacctgtcatgtgcaaga

SEQ ID NO: 451934 - DNA, 25 bp, Mus musculus
gaccaaggactcatctgtaatcttc

SEQ ID NO: 451935 - DNA, 25 bp, Mus musculus
gaccaaggactcttctgtaatcttc

SEQ ID NO: 451936 - DNA, 25 bp, Mus musculus
gaccaaggactgctttagaggcatc

SEQ ID NO: 451937 - DNA, 25 bp, Mus musculus
gaccaaggactggtttagaggcatc

SEQ ID NO: 451938 - DNA, 25 bp, Mus musculus
gaccaaggagcaagtgcctcgggaa

SEQ ID NO: 451939 - DNA, 25 bp, Mus musculus
gaccaaggagcatgtgcctcgggaa

SEQ ID NO: 451940 - DNA, 25 bp, Mus musculus
gaccaaggagttatctgttaggaat

SEQ ID NO: 451941 - DNA, 25 bp, Mus musculus
gaccaaggagttttctgttaggaat

SEQ ID NO: 451942 - DNA, 25 bp, Mus musculus
gaccaaggatctaccaagttgtctg

SEQ ID NO: 451943 - DNA, 25 bp, Mus musculus
gaccaaggatcttccaagttgtctg

SEQ ID NO: 451944 - DNA, 25 bp, Mus musculus
gaccaaggcacgcattcatcggctg

SEQ ID NO: 451945 - DNA, 25 bp, Mus musculus
gaccaaggcacggattcatcggctg

SEQ ID NO: 451946 - DNA, 25 bp, Mus musculus
gaccaaggcagcatatacttacaga

SEQ ID NO: 451947 - DNA, 25 bp, Mus musculus
gaccaaggcagcttatacttacaga

SEQ ID NO: 451948 - DNA, 25 bp, Mus musculus
gaccaaggcaggataggatgactaa

SEQ ID NO: 451949 - DNA, 25 bp, Mus musculus
gaccaaggcaggttaggatgactaa

SEQ ID NO: 451950 - DNA, 25 bp, Mus musculus
gaccaaggcattatcaatttcattt

SEQ ID NO: 451951 - DNA, 25 bp, Mus musculus
gaccaaggcattttcaatttcattt

SEQ ID NO: 451952 - DNA, 25 bp, Mus musculus
gaccaaggccgacgcaggcatatct

SEQ ID NO: 451953 - DNA, 25 bp, Mus musculus
gaccaaggccgaggcaggcatatct

SEQ ID NO: 451954 - DNA, 25 bp, Mus musculus
gaccaaggcggcagctgctggtcct

SEQ ID NO: 451955 - DNA, 25 bp, Mus musculus
gaccaaggcggctgctgctggtcct

SEQ ID NO: 451956 - DNA, 25 bp, Mus musculus
gaccaaggctcaaattactgtgctt

SEQ ID NO: 451957 - DNA, 25 bp, Mus musculus
gaccaaggctcatattactgtgctt

SEQ ID NO: 451958 - DNA, 25 bp, Mus musculus
gaccaagggaaacttctctcactga

SEQ ID NO: 451959 - DNA, 25 bp, Mus musculus
gaccaagggaaagttctctcactga

SEQ ID NO: 451960 - DNA, 25 bp, Mus musculus
gaccaagggagtctccctgtcaaat

SEQ ID NO: 451961 - DNA, 25 bp, Mus musculus
gaccaagggagtgtccctgtcaaat

SEQ ID NO: 451962 - DNA, 25 bp, Mus musculus
gaccaagggccacctcctgtagctt

SEQ ID NO: 451963 - DNA, 25 bp, Mus musculus
gaccaagggccagctcctgtagctt

SEQ ID NO: 451964 - DNA, 25 bp, Mus musculus
gaccaagggctgagattatctttcc

SEQ ID NO: 451965 - DNA, 25 bp, Mus musculus
gaccaagggctgtgattatctttcc

SEQ ID NO: 451966 - DNA, 25 bp, Mus musculus
gaccaagggcttacataaccctgtg

SEQ ID NO: 451967 - DNA, 25 bp, Mus musculus
gaccaagggctttcataaccctgtg

SEQ ID NO: 451968 - DNA, 25 bp, Mus musculus
gaccaagggtctacctcctaagaag

SEQ ID NO: 451969 - DNA, 25 bp, Mus musculus
gaccaagggtcttcctcctaagaag

SEQ ID NO: 451970 - DNA, 25 bp, Mus musculus
gaccaaggtcttatagggaggctga

SEQ ID NO: 451971 - DNA, 25 bp, Mus musculus
gaccaaggtcttttagggaggctga

SEQ ID NO: 451972 - DNA, 25 bp, Mus musculus
gaccaaggtgagcactttccagcct

SEQ ID NO: 451973 - DNA, 25 bp, Mus musculus
gaccaaggtgaggactttccagcct

SEQ ID NO: 451974 - DNA, 25 bp, Mus musculus
gaccaagtaaggatcctcctgagtc

SEQ ID NO: 451975 - DNA, 25 bp, Mus musculus
gaccaagtaaggttcctcctgagtc

SEQ ID NO: 451976 - DNA, 25 bp, Mus musculus
gaccaagtacagatcctgccagtga

SEQ ID NO: 451977 - DNA, 25 bp, Mus musculus
gaccaagtacagttcctgccagtga

SEQ ID NO: 451978 - DNA, 25 bp, Mus musculus
gaccaagtagaactgaagtgtaaac

SEQ ID NO: 451979 - DNA, 25 bp, Mus musculus
gaccaagtagaagtgaagtgtaaac

SEQ ID NO: 451980 - DNA, 25 bp, Mus musculus
gaccaagtagagaccacctgttgag

SEQ ID NO: 451981 - DNA, 25 bp, Mus musculus
gaccaagtagagtccacctgttgag

SEQ ID NO: 451982 - DNA, 25 bp, Mus musculus
gaccaagtagccaggagagttgaca

SEQ ID NO: 451983 - DNA, 25 bp, Mus musculus
gaccaagtagcctggagagttgaca

SEQ ID NO: 451984 - DNA, 25 bp, Mus musculus
gaccaagtatacagagttgtcctct

SEQ ID NO: 451985 - DNA, 25 bp, Mus musculus
gaccaagtatactgagttgtcctct

SEQ ID NO: 451986 - DNA, 25 bp, Mus musculus
gaccaagtcaggaggctagtcttcc

SEQ ID NO: 451987 - DNA, 25 bp, Mus musculus
gaccaagtcaggtggctagtcttcc

SEQ ID NO: 451988 - DNA, 25 bp, Mus musculus
gaccaagtcatacattaaagcacat

SEQ ID NO: 451989 - DNA, 25 bp, Mus musculus
gaccaagtcatagattaaagcacat

SEQ ID NO: 451990 - DNA, 25 bp, Mus musculus
gaccaagtcattccagttcatcttt

SEQ ID NO: 451991 - DNA, 25 bp, Mus musculus
gaccaagtcattgcagttcatcttt

SEQ ID NO: 451992 - DNA, 25 bp, Mus musculus
gaccaagtccaaaactttccaagct

SEQ ID NO: 451993 - DNA, 25 bp, Mus musculus
gaccaagtccaatactttccaagct

SEQ ID NO: 451994 - DNA, 25 bp, Mus musculus
gaccaagtctgaccctaagtaggtt

SEQ ID NO: 451995 - DNA, 25 bp, Mus musculus
gaccaagtctgagcctaagtaggtt

SEQ ID NO: 451996 - DNA, 25 bp, Mus musculus
gaccaagtgacaccaatgctgtttc

SEQ ID NO: 451997 - DNA, 25 bp, Mus musculus
gaccaagtgacagcaatgctgtttc

SEQ ID NO: 451998 - DNA, 25 bp, Mus musculus
gaccaagtgatactcctctgtagga

SEQ ID NO: 451999 - DNA, 25 bp, Mus musculus
gaccaagtgatagtcctctgtagga

SEQ ID NO: 452000 - DNA, 25 bp, Mus musculus
gaccaagtggccataaagtcccagc

SEQ ID NO: 452001 - DNA, 25 bp, Mus musculus
gaccaagtggccttaaagtcccagc

SEQ ID NO: 452002 - DNA, 25 bp, Mus musculus
gaccaagtgtcaatgggctggcata

SEQ ID NO: 452003 - DNA, 25 bp, Mus musculus
gaccaagtgtcattgggctggcata

SEQ ID NO: 452004 - DNA, 25 bp, Mus musculus
gaccaagtgtgcattgcccggttaa

SEQ ID NO: 452005 - DNA, 25 bp, Mus musculus
gaccaagtgtgctttgcccggttaa

SEQ ID NO: 452006 - DNA, 25 bp, Mus musculus
gaccaagtgttccacacagggactt

SEQ ID NO: 452007 - DNA, 25 bp, Mus musculus
gaccaagtgttcgacacagggactt

SEQ ID NO: 452008 - DNA, 25 bp, Mus musculus
gaccaagttcatctgtgtgacacca

SEQ ID NO: 452009 - DNA, 25 bp, Mus musculus
gaccaagttcatgtgtgtgacacca

SEQ ID NO: 452010 - DNA, 25 bp, Mus musculus
gaccaagttccacaactctgaaagg

SEQ ID NO: 452011 - DNA, 25 bp, Mus musculus
gaccaagttccagaactctgaaagg

SEQ ID NO: 452012 - DNA, 25 bp, Mus musculus
gaccaagttctgctaatacttcgtc

SEQ ID NO: 452013 - DNA, 25 bp, Mus musculus
gaccaagttctggtaatacttcgtc

SEQ ID NO: 452014 - DNA, 25 bp, Mus musculus
gaccaagttgctcacctatcaggta

SEQ ID NO: 452015 - DNA, 25 bp, Mus musculus
gaccaagttgctgacctatcaggta

SEQ ID NO: 452016 - DNA, 25 bp, Mus musculus
gaccaataaattccggaccccatct

SEQ ID NO: 452017 - DNA, 25 bp, Mus musculus
gaccaataaattgcggaccccatct

SEQ ID NO: 452018 - DNA, 25 bp, Mus musculus
gaccaataatttcatccctcagtac

SEQ ID NO: 452019 - DNA, 25 bp, Mus musculus
gaccaataatttgatccctcagtac

SEQ ID NO: 452020 - DNA, 25 bp, Mus musculus
gaccaatacggacacaggttcttat

SEQ ID NO: 452021 - DNA, 25 bp, Mus musculus
gaccaatacggagacaggttcttat

SEQ ID NO: 452022 - DNA, 25 bp, Mus musculus
gaccaatagccaatattttgccact

SEQ ID NO: 452023 - DNA, 25 bp, Mus musculus
gaccaatagccattattttgccact

SEQ ID NO: 452024 - DNA, 25 bp, Mus musculus
gaccaatagggcatccgcaggatct

SEQ ID NO: 452025 - DNA, 25 bp, Mus musculus
gaccaatagggcttccgcaggatct

SEQ ID NO: 452026 - DNA, 25 bp, Mus musculus
gaccaatagtgtatgtttcctgatt

SEQ ID NO: 452027 - DNA, 25 bp, Mus musculus
gaccaatagtgtttgtttcctgatt

SEQ ID NO: 452028 - DNA, 25 bp, Mus musculus
gaccaatcaactcttgctattcagc

SEQ ID NO: 452029 - DNA, 25 bp, Mus musculus
gaccaatcaactgttgctattcagc

SEQ ID NO: 452030 - DNA, 25 bp, Mus musculus
gaccaatcagcaccagcttatgcaa

SEQ ID NO: 452031 - DNA, 25 bp, Mus musculus
gaccaatcagcagcagcttatgcaa

SEQ ID NO: 452032 - DNA, 25 bp, Mus musculus
gaccaatccaggaccagggcgcctg

SEQ ID NO: 452033 - DNA, 25 bp, Mus musculus
gaccaatccaggtccagggcgcctg

SEQ ID NO: 452034 - DNA, 25 bp, Mus musculus
gaccaatccagtctcacgattcatg

SEQ ID NO: 452035 - DNA, 25 bp, Mus musculus
gaccaatccagtgtcacgattcatg

SEQ ID NO: 452036 - DNA, 25 bp, Mus musculus
gaccaatccgttaatctagtgagac

SEQ ID NO: 452037 - DNA, 25 bp, Mus musculus
gaccaatccgtttatctagtgagac

SEQ ID NO: 452038 - DNA, 25 bp, Mus musculus
gaccaatcttctatcagtcacagaa

SEQ ID NO: 452039 - DNA, 25 bp, Mus musculus
gaccaatcttctttcagtcacagaa

SEQ ID NO: 452040 - DNA, 25 bp, Mus musculus
gaccaatcttttcttaatgttcatg

SEQ ID NO: 452041 - DNA, 25 bp, Mus musculus
gaccaatcttttgttaatgttcatg

SEQ ID NO: 452042 - DNA, 25 bp, Mus musculus
gaccaatggcctatggaccttgcaa

SEQ ID NO: 452043 - DNA, 25 bp, Mus musculus
gaccaatggcctttggaccttgcaa

SEQ ID NO: 452044 - DNA, 25 bp, Mus musculus
gaccaatgtctgagctcgagggatt

SEQ ID NO: 452045 - DNA, 25 bp, Mus musculus
gaccaatgtctgtgctcgagggatt

SEQ ID NO: 452046 - DNA, 25 bp, Mus musculus
gaccaatgtcttcttagaccgagtt

SEQ ID NO: 452047 - DNA, 25 bp, Mus musculus
gaccaatgtcttgttagaccgagtt

SEQ ID NO: 452048 - DNA, 25 bp, Mus musculus
gaccaatgtggcctattacagtgtg

SEQ ID NO: 452049 - DNA, 25 bp, Mus musculus
gaccaatgtggcgtattacagtgtg

SEQ ID NO: 452050 - DNA, 25 bp, Mus musculus
gaccaatgtgtcctaagtgccatct

SEQ ID NO: 452051 - DNA, 25 bp, Mus musculus
gaccaatgtgtcgtaagtgccatct

SEQ ID NO: 452052 - DNA, 25 bp, Mus musculus
gaccaatgtttcaataggttatgct

SEQ ID NO: 452053 - DNA, 25 bp, Mus musculus
gaccaatgtttctataggttatgct

SEQ ID NO: 452054 - DNA, 25 bp, Mus musculus
gaccaattaaaaaacccagagacag

SEQ ID NO: 452055 - DNA, 25 bp, Mus musculus
gaccaattaaaatacccagagacag

SEQ ID NO: 452056 - DNA, 25 bp, Mus musculus
gaccaattaattcgcctctctcgaa

SEQ ID NO: 452057 - DNA, 25 bp, Mus musculus
gaccaattaattggcctctctcgaa

SEQ ID NO: 452058 - DNA, 25 bp, Mus musculus
gaccaattaggtactgtagccactg

SEQ ID NO: 452059 - DNA, 25 bp, Mus musculus
gaccaattaggttctgtagccactg

SEQ ID NO: 452060 - DNA, 25 bp, Mus musculus
gaccaattcaggacacgggaggcac

SEQ ID NO: 452061 - DNA, 25 bp, Mus musculus
gaccaattcaggtcacgggaggcac

SEQ ID NO: 452062 - DNA, 25 bp, Mus musculus
gaccaattcggtagagctcactctc

SEQ ID NO: 452063 - DNA, 25 bp, Mus musculus
gaccaattcggttgagctcactctc

SEQ ID NO: 452064 - DNA, 25 bp, Mus musculus
gaccaattgtctacacagcgacaca

SEQ ID NO: 452065 - DNA, 25 bp, Mus musculus
gaccaattgtcttcacagcgacaca

SEQ ID NO: 452066 - DNA, 25 bp, Mus musculus
gaccaattgtttcaagtttccatgt

SEQ ID NO: 452067 - DNA, 25 bp, Mus musculus
gaccaattgtttgaagtttccatgt

SEQ ID NO: 452068 - DNA, 25 bp, Mus musculus
gaccaatttctcaaaggtttcaaag

SEQ ID NO: 452069 - DNA, 25 bp, Mus musculus
gaccaatttctctaaggtttcaaag

SEQ ID NO: 452070 - DNA, 25 bp, Mus musculus
gaccacaaagtgagccttgcagaaa

SEQ ID NO: 452071 - DNA, 25 bp, Mus musculus
gaccacaaagtgtgccttgcagaaa

SEQ ID NO: 452072 - DNA, 25 bp, Mus musculus
gaccacaagcacaggtgaggaccaa

SEQ ID NO: 452073 - DNA, 25 bp, Mus musculus
gaccacaagcactggtgaggaccaa

SEQ ID NO: 452074 - DNA, 25 bp, Mus musculus
gaccacaagccaacgagcaagcagg

SEQ ID NO: 452075 - DNA, 25 bp, Mus musculus
gaccacaagccatcgagcaagcagg

SEQ ID NO: 452076 - DNA, 25 bp, Mus musculus
gaccacaagctgcacctgtttgaga

SEQ ID NO: 452077 - DNA, 25 bp, Mus musculus
gaccacaagctggacctgtttgaga

SEQ ID NO: 452078 - DNA, 25 bp, Mus musculus
gaccacaataaaacccttgttctgg

SEQ ID NO: 452079 - DNA, 25 bp, Mus musculus
gaccacaataaatcccttgttctgg

SEQ ID NO: 452080 - DNA, 25 bp, Mus musculus
gaccacaatcacagggtatttgcaa

SEQ ID NO: 452081 - DNA, 25 bp, Mus musculus
gaccacaatcactgggtatttgcaa

SEQ ID NO: 452082 - DNA, 25 bp, Mus musculus
gaccacacaactatccatcgaagaa

SEQ ID NO: 452083 - DNA, 25 bp, Mus musculus
gaccacacaactttccatcgaagaa

SEQ ID NO: 452084 - DNA, 25 bp, Mus musculus
gaccacacacacatcagatcactag

SEQ ID NO: 452085 - DNA, 25 bp, Mus musculus
gaccacacacacttcagatcactag

SEQ ID NO: 452086 - DNA, 25 bp, Mus musculus
gaccacacacttacattcagtctgt

SEQ ID NO: 452087 - DNA, 25 bp, Mus musculus
gaccacacactttcattcagtctgt

SEQ ID NO: 452088 - DNA, 25 bp, Mus musculus
gaccacacagaaacttttcagcagt

SEQ ID NO: 452089 - DNA, 25 bp, Mus musculus
gaccacacagaatcttttcagcagt

SEQ ID NO: 452090 - DNA, 25 bp, Mus musculus
gaccacacatatacacagtaaccat

SEQ ID NO: 452091 - DNA, 25 bp, Mus musculus
gaccacacatatcaggatctcggaa

SEQ ID NO: 452092 - DNA, 25 bp, Mus musculus
gaccacacatatgaggatctcggaa

SEQ ID NO: 452093 - DNA, 25 bp, Mus musculus
gaccacacatattcacagtaaccat

SEQ ID NO: 452094 - DNA, 25 bp, Mus musculus
gaccacaccaccacgggcaaagtag

SEQ ID NO: 452095 - DNA, 25 bp, Mus musculus
gaccacaccacctcgggcaaagtag

SEQ ID NO: 452096 - DNA, 25 bp, Mus musculus
gaccacacccatactcactgtgaat

SEQ ID NO: 452097 - DNA, 25 bp, Mus musculus
gaccacacccattctcactgtgaat

SEQ ID NO: 452098 - DNA, 25 bp, Mus musculus
gaccacaccgtgagctatctgctct

SEQ ID NO: 452099 - DNA, 25 bp, Mus musculus
gaccacaccgtgtgctatctgctct

SEQ ID NO: 452100 - DNA, 25 bp, Mus musculus
gaccacacctataaatcaggcctgg

SEQ ID NO: 452101 - DNA, 25 bp, Mus musculus
gaccacacctattaatcaggcctgg

SEQ ID NO: 452102 - DNA, 25 bp, Mus musculus
gaccacaccttgaattccaagcaat

SEQ ID NO: 452103 - DNA, 25 bp, Mus musculus
gaccacaccttgtattccaagcaat

SEQ ID NO: 452104 - DNA, 25 bp, Mus musculus
gaccacactaaactaagcttccaac

SEQ ID NO: 452105 - DNA, 25 bp, Mus musculus
gaccacactaaagtaagcttccaac

SEQ ID NO: 452106 - DNA, 25 bp, Mus musculus
gaccacactaggatactgctttctt

SEQ ID NO: 452107 - DNA, 25 bp, Mus musculus
gaccacactaggttactgctttctt

SEQ ID NO: 452108 - DNA, 25 bp, Mus musculus
gaccacactgcaaacagggacttcc

SEQ ID NO: 452109 - DNA, 25 bp, Mus musculus
gaccacactgcatacagggacttcc

SEQ ID NO: 452110 - DNA, 25 bp, Mus musculus
gaccacacttaaattcaccttgatg

SEQ ID NO: 452111 - DNA, 25 bp, Mus musculus
gaccacacttaatttcaccttgatg

SEQ ID NO: 452112 - DNA, 25 bp, Mus musculus
gaccacagcaggagggtgcacttta

SEQ ID NO: 452113 - DNA, 25 bp, Mus musculus
gaccacagcaggtgggtgcacttta

SEQ ID NO: 452114 - DNA, 25 bp, Mus musculus
gaccacagcttacgtaattccaaag

SEQ ID NO: 452115 - DNA, 25 bp, Mus musculus
gaccacagcttaggtaattccaaag

SEQ ID NO: 452116 - DNA, 25 bp, Mus musculus
gaccacaggccgctttaatggccag

SEQ ID NO: 452117 - DNA, 25 bp, Mus musculus
gaccacaggccggtttaatggccag

SEQ ID NO: 452118 - DNA, 25 bp, Mus musculus
gaccacagggccaccagaaggcaga

SEQ ID NO: 452119 - DNA, 25 bp, Mus musculus
gaccacagggcctccagaaggcaga

SEQ ID NO: 452120 - DNA, 25 bp, Mus musculus
gaccacagggtaccccagagttgct

SEQ ID NO: 452121 - DNA, 25 bp, Mus musculus
gaccacagggtagcccagagttgct

SEQ ID NO: 452122 - DNA, 25 bp, Mus musculus
gaccacaggtggctgaccctggctt

SEQ ID NO: 452123 - DNA, 25 bp, Mus musculus
gaccacaggtgggtgaccctggctt

SEQ ID NO: 452124 - DNA, 25 bp, Mus musculus
gaccacagtacccttctgatgagta

SEQ ID NO: 452125 - DNA, 25 bp, Mus musculus
gaccacagtaccgttctgatgagta

SEQ ID NO: 452126 - DNA, 25 bp, Mus musculus
gaccacagtattcacctggtgttat

SEQ ID NO: 452127 - DNA, 25 bp, Mus musculus
gaccacagtattcccaacttgttta

SEQ ID NO: 452128 - DNA, 25 bp, Mus musculus
gaccacagtattgacctggtgttat

SEQ ID NO: 452129 - DNA, 25 bp, Mus musculus
gaccacagtattgccaacttgttta

SEQ ID NO: 452130 - DNA, 25 bp, Mus musculus
gaccacagtgctcgatcatgaactt

SEQ ID NO: 452131 - DNA, 25 bp, Mus musculus
gaccacagtgctggatcatgaactt

SEQ ID NO: 452132 - DNA, 25 bp, Mus musculus
gaccacagttcaaatatgttcactt

SEQ ID NO: 452133 - DNA, 25 bp, Mus musculus
gaccacagttcatatatgttcactt

SEQ ID NO: 452134 - DNA, 25 bp, Mus musculus
gaccacagttggcatgtactacatg

SEQ ID NO: 452135 - DNA, 25 bp, Mus musculus
gaccacagttgggatgtactacatg

SEQ ID NO: 452136 - DNA, 25 bp, Mus musculus
gaccacagtttaatggatgggcact

SEQ ID NO: 452137 - DNA, 25 bp, Mus musculus
gaccacagtttattggatgggcact

SEQ ID NO: 452138 - DNA, 25 bp, Mus musculus
gaccacagtttgaacaagagaccaa

SEQ ID NO: 452139 - DNA, 25 bp, Mus musculus
gaccacagtttgtacaagagaccaa

SEQ ID NO: 452140 - DNA, 25 bp, Mus musculus
gaccacatacatatcacagggccat

SEQ ID NO: 452141 - DNA, 25 bp, Mus musculus
gaccacatacatttcacagggccat

SEQ ID NO: 452142 - DNA, 25 bp, Mus musculus
gaccacatacgaccctgcttcaaaa

SEQ ID NO: 452143 - DNA, 25 bp, Mus musculus
gaccacatacgagcctgcttcaaaa

SEQ ID NO: 452144 - DNA, 25 bp, Mus musculus
gaccacatagaaaactgccttccat

SEQ ID NO: 452145 - DNA, 25 bp, Mus musculus
gaccacatagaatactgccttccat

SEQ ID NO: 452146 - DNA, 25 bp, Mus musculus
gaccacatatatcagggctttatct

SEQ ID NO: 452147 - DNA, 25 bp, Mus musculus
gaccacatatatgagggctttatct

SEQ ID NO: 452148 - DNA, 25 bp, Mus musculus
gaccacatcatgagagcccagtagc

SEQ ID NO: 452149 - DNA, 25 bp, Mus musculus
gaccacatcatgtgagcccagtagc

SEQ ID NO: 452150 - DNA, 25 bp, Mus musculus
gaccacatgcataactatcagggta

SEQ ID NO: 452151 - DNA, 25 bp, Mus musculus
gaccacatgcattactatcagggta

SEQ ID NO: 452152 - DNA, 25 bp, Mus musculus
gaccacatgtccattgctttagcat

SEQ ID NO: 452153 - DNA, 25 bp, Mus musculus
gaccacatgtcctttgctttagcat

SEQ ID NO: 452154 - DNA, 25 bp, Mus musculus
gaccacattacaacttcatgtcatt

SEQ ID NO: 452155 - DNA, 25 bp, Mus musculus
gaccacattacatcttcatgtcatt

SEQ ID NO: 452156 - DNA, 25 bp, Mus musculus
gaccacattagccttaagaaagtct

SEQ ID NO: 452157 - DNA, 25 bp, Mus musculus
gaccacattagcgttaagaaagtct

SEQ ID NO: 452158 - DNA, 25 bp, Mus musculus
gaccacattcctaccaagcaaaaat

SEQ ID NO: 452159 - DNA, 25 bp, Mus musculus
gaccacattccttccaagcaaaaat

SEQ ID NO: 452160 - DNA, 25 bp, Mus musculus
gaccacatttttcttcagtagcctg

SEQ ID NO: 452161 - DNA, 25 bp, Mus musculus
gaccacatttttgttcagtagcctg

SEQ ID NO: 452162 - DNA, 25 bp, Mus musculus
gaccaccaagccagtaaatgcagga

SEQ ID NO: 452163 - DNA, 25 bp, Mus musculus
gaccaccaagcctgtaaatgcagga

SEQ ID NO: 452164 - DNA, 25 bp, Mus musculus
gaccaccaaggacgccctggatgag

SEQ ID NO: 452165 - DNA, 25 bp, Mus musculus
gaccaccaaggaggccctggatgag

SEQ ID NO: 452166 - DNA, 25 bp, Mus musculus
gaccaccaatatagctatttattat

SEQ ID NO: 452167 - DNA, 25 bp, Mus musculus
gaccaccaatattgctatttattat

SEQ ID NO: 452168 - DNA, 25 bp, Mus musculus
gaccaccaatcacaagtttactatt

SEQ ID NO: 452169 - DNA, 25 bp, Mus musculus
gaccaccaatcagaagtttactatt

SEQ ID NO: 452170 - DNA, 25 bp, Mus musculus
gaccaccaatccacaggagctgacg

SEQ ID NO: 452171 - DNA, 25 bp, Mus musculus
gaccaccaatcctcaggagctgacg

SEQ ID NO: 452172 - DNA, 25 bp, Mus musculus
gaccaccaatctaggccattttata

SEQ ID NO: 452173 - DNA, 25 bp, Mus musculus
gaccaccaatcttggccattttata

SEQ ID NO: 452174 - DNA, 25 bp, Mus musculus
gaccaccaccagagtaacatatcag

SEQ ID NO: 452175 - DNA, 25 bp, Mus musculus
gaccaccaccagtgtaacatatcag

SEQ ID NO: 452176 - DNA, 25 bp, Mus musculus
gaccaccacttgagtgggtgctgaa

SEQ ID NO: 452177 - DNA, 25 bp, Mus musculus
gaccaccacttgtgtgggtgctgaa

SEQ ID NO: 452178 - DNA, 25 bp, Mus musculus
gaccaccagagacctgttcgtacaa

SEQ ID NO: 452179 - DNA, 25 bp, Mus musculus
gaccaccagagagctgttcgtacaa

SEQ ID NO: 452180 - DNA, 25 bp, Mus musculus
gaccaccagatacatatttgttgtt

SEQ ID NO: 452181 - DNA, 25 bp, Mus musculus
gaccaccagatagatatttgttgtt

SEQ ID NO: 452182 - DNA, 25 bp, Mus musculus
gaccaccatgggaacatcgagtcct

SEQ ID NO: 452183 - DNA, 25 bp, Mus musculus
gaccaccatgggtacatcgagtcct

SEQ ID NO: 452184 - DNA, 25 bp, Mus musculus
gaccaccattgccataggccagtgg

SEQ ID NO: 452185 - DNA, 25 bp, Mus musculus
gaccaccattgcgataggccagtgg

SEQ ID NO: 452186 - DNA, 25 bp, Mus musculus
gaccacccagtgaacgccagatttt

SEQ ID NO: 452187 - DNA, 25 bp, Mus musculus
gaccacccagtgtacgccagatttt

SEQ ID NO: 452188 - DNA, 25 bp, Mus musculus
gaccaccctaacactatcatgataa

SEQ ID NO: 452189 - DNA, 25 bp, Mus musculus
gaccaccctaactctatcatgataa

SEQ ID NO: 452190 - DNA, 25 bp, Mus musculus
gaccaccctgtactggtcctaggtt

SEQ ID NO: 452191 - DNA, 25 bp, Mus musculus
gaccaccctgtagtggtcctaggtt

SEQ ID NO: 452192 - DNA, 25 bp, Mus musculus
gaccaccgacctcgacttgagtgta

SEQ ID NO: 452193 - DNA, 25 bp, Mus musculus
gaccaccgacctggacttgagtgta

SEQ ID NO: 452194 - DNA, 25 bp, Mus musculus
gaccaccgctttcgcagtaccagag

SEQ ID NO: 452195 - DNA, 25 bp, Mus musculus
gaccaccgctttggcagtaccagag

SEQ ID NO: 452196 - DNA, 25 bp, Mus musculus
gaccaccggtctataagagcagcct

SEQ ID NO: 452197 - DNA, 25 bp, Mus musculus
gaccaccggtctttaagagcagcct

SEQ ID NO: 452198 - DNA, 25 bp, Mus musculus
gaccaccgtctcataaaatatagca

SEQ ID NO: 452199 - DNA, 25 bp, Mus musculus
gaccaccgtctcttaaaatatagca

SEQ ID NO: 452200 - DNA, 25 bp, Mus musculus
gaccaccgtgcacatttcacaagcg

SEQ ID NO: 452201 - DNA, 25 bp, Mus musculus
gaccaccgtgcagatttcacaagcg

SEQ ID NO: 452202 - DNA, 25 bp, Mus musculus
gaccacctacggcaccacagatata

SEQ ID NO: 452203 - DNA, 25 bp, Mus musculus
gaccacctacgggaccacagatata

SEQ ID NO: 452204 - DNA, 25 bp, Mus musculus
gaccacctatcacgattcaacgttt

SEQ ID NO: 452205 - DNA, 25 bp, Mus musculus
gaccacctatcaggattcaacgttt

SEQ ID NO: 452206 - DNA, 25 bp, Mus musculus
gaccacctcagcagcgggaaggtat

SEQ ID NO: 452207 - DNA, 25 bp, Mus musculus
gaccacctcagctgcgggaaggtat

SEQ ID NO: 452208 - DNA, 25 bp, Mus musculus
gaccacctccaactcattgaatcat

SEQ ID NO: 452209 - DNA, 25 bp, Mus musculus
gaccacctccaagtcattgaatcat

SEQ ID NO: 452210 - DNA, 25 bp, Mus musculus
gaccacctccccagctatgtggtgg

SEQ ID NO: 452211 - DNA, 25 bp, Mus musculus
gaccacctcccctgctatgtggtgg

SEQ ID NO: 452212 - DNA, 25 bp, Mus musculus
gaccacctgagtatgaattcttctg

SEQ ID NO: 452213 - DNA, 25 bp, Mus musculus
gaccacctgagtttgaattcttctg

SEQ ID NO: 452214 - DNA, 25 bp, Mus musculus
gaccacctgggtcagtccgaagcag

SEQ ID NO: 452215 - DNA, 25 bp, Mus musculus
gaccacctgggtgagtccgaagcag

SEQ ID NO: 452216 - DNA, 25 bp, Mus musculus
gaccacctgttaaggattttgctcc

SEQ ID NO: 452217 - DNA, 25 bp, Mus musculus
gaccacctgttatggattttgctcc

SEQ ID NO: 452218 - DNA, 25 bp, Mus musculus
gaccaccttatccttcagaatattt

SEQ ID NO: 452219 - DNA, 25 bp, Mus musculus
gaccaccttatcgttcagaatattt

SEQ ID NO: 452220 - DNA, 25 bp, Mus musculus
gaccaccttgagctctaatgattgt

SEQ ID NO: 452221 - DNA, 25 bp, Mus musculus
gaccaccttgaggtctaatgattgt

SEQ ID NO: 452222 - DNA, 25 bp, Mus musculus
gaccaccttgttcctagagatatag

SEQ ID NO: 452223 - DNA, 25 bp, Mus musculus
gaccaccttgttgctagagatatag

SEQ ID NO: 452224 - DNA, 25 bp, Mus musculus
gaccacctttttagattgtaactct

SEQ ID NO: 452225 - DNA, 25 bp, Mus musculus
gaccaccttttttgattgtaactct

SEQ ID NO: 452226 - DNA, 25 bp, Mus musculus
gaccacgaatccatttcactgggaa

SEQ ID NO: 452227 - DNA, 25 bp, Mus musculus
gaccacgaatccttttcactgggaa

SEQ ID NO: 452228 - DNA, 25 bp, Mus musculus
gaccacgactatacagtgctttgct

SEQ ID NO: 452229 - DNA, 25 bp, Mus musculus
gaccacgactattcagtgctttgct

SEQ ID NO: 452230 - DNA, 25 bp, Mus musculus
gaccacgagaacagggtgtccagct

SEQ ID NO: 452231 - DNA, 25 bp, Mus musculus
gaccacgagaactgggtgtccagct

SEQ ID NO: 452232 - DNA, 25 bp, Mus musculus
gaccacgagatacataccgcttttt

SEQ ID NO: 452233 - DNA, 25 bp, Mus musculus
gaccacgagatagataccgcttttt

SEQ ID NO: 452234 - DNA, 25 bp, Mus musculus
gaccacgaggtgaaagggaaatctt

SEQ ID NO: 452235 - DNA, 25 bp, Mus musculus
gaccacgaggtgtaagggaaatctt

SEQ ID NO: 452236 - DNA, 25 bp, Mus musculus
gaccacgatggccttgacattatat

SEQ ID NO: 452237 - DNA, 25 bp, Mus musculus
gaccacgatggcgttgacattatat

SEQ ID NO: 452238 - DNA, 25 bp, Mus musculus
gaccacgcagtgatccatgttaaag

SEQ ID NO: 452239 - DNA, 25 bp, Mus musculus
gaccacgcagtgttccatgttaaag

SEQ ID NO: 452240 - DNA, 25 bp, Mus musculus
gaccacgcgcatagctactttgagg

SEQ ID NO: 452241 - DNA, 25 bp, Mus musculus
gaccacgcgcattgctactttgagg

SEQ ID NO: 452242 - DNA, 25 bp, Mus musculus
gaccacgcggctcctttagatacga

SEQ ID NO: 452243 - DNA, 25 bp, Mus musculus
gaccacgcggctgctttagatacga

SEQ ID NO: 452244 - DNA, 25 bp, Mus musculus
gaccacgcttgcagaaggctcacat

SEQ ID NO: 452245 - DNA, 25 bp, Mus musculus
gaccacgcttgctgaaggctcacat

SEQ ID NO: 452246 - DNA, 25 bp, Mus musculus
gaccacgcttttctcaaggtttgca

SEQ ID NO: 452247 - DNA, 25 bp, Mus musculus
gaccacgcttttgtcaaggtttgca

SEQ ID NO: 452248 - DNA, 25 bp, Mus musculus
gaccacggagtcagccatgaagaaa

SEQ ID NO: 452249 - DNA, 25 bp, Mus musculus
gaccacggagtctgccatgaagaaa

SEQ ID NO: 452250 - DNA, 25 bp, Mus musculus
gaccacggcatcaccagctatgagt

SEQ ID NO: 452251 - DNA, 25 bp, Mus musculus
gaccacggcatctccagctatgagt

SEQ ID NO: 452252 - DNA, 25 bp, Mus musculus
gaccacggtgtgataaacattccat

SEQ ID NO: 452253 - DNA, 25 bp, Mus musculus
gaccacggtgtgttaaacattccat

SEQ ID NO: 452254 - DNA, 25 bp, Mus musculus
gaccacggttctcagcaagtctgca

SEQ ID NO: 452255 - DNA, 25 bp, Mus musculus
gaccacggttctgagcaagtctgca

SEQ ID NO: 452256 - DNA, 25 bp, Mus musculus
gaccacgtagctcggccaacttgat

SEQ ID NO: 452257 - DNA, 25 bp, Mus musculus
gaccacgtagctgggccaacttgat

SEQ ID NO: 452258 - DNA, 25 bp, Mus musculus
gaccacgtctctcctaccagaattt

SEQ ID NO: 452259 - DNA, 25 bp, Mus musculus
gaccacgtctctgctaccagaattt

SEQ ID NO: 452260 - DNA, 25 bp, Mus musculus
gaccacgtgacacagggctgcctag

SEQ ID NO: 452261 - DNA, 25 bp, Mus musculus
gaccacgtgacagagggctgcctag

SEQ ID NO: 452262 - DNA, 25 bp, Mus musculus
gaccacgtgcacaacttagtcacca

SEQ ID NO: 452263 - DNA, 25 bp, Mus musculus
gaccacgtgcactacttagtcacca

SEQ ID NO: 452264 - DNA, 25 bp, Mus musculus
gaccacgtgcccaacatggtagcca

SEQ ID NO: 452265 - DNA, 25 bp, Mus musculus
gaccacgtgccctacatggtagcca

SEQ ID NO: 452266 - DNA, 25 bp, Mus musculus
gaccacgttttcaacgatatgattt

SEQ ID NO: 452267 - DNA, 25 bp, Mus musculus
gaccacgttttctacgatatgattt

SEQ ID NO: 452268 - DNA, 25 bp, Mus musculus
gaccactaagagacatcaccgtctg

SEQ ID NO: 452269 - DNA, 25 bp, Mus musculus
gaccactaagagtcatcaccgtctg

SEQ ID NO: 452270 - DNA, 25 bp, Mus musculus
gaccactaatgtcctagaacagact

SEQ ID NO: 452271 - DNA, 25 bp, Mus musculus
gaccactaatgtgctagaacagact

SEQ ID NO: 452272 - DNA, 25 bp, Mus musculus
gaccactacgtaaacttcagttcca

SEQ ID NO: 452273 - DNA, 25 bp, Mus musculus
gaccactacgtatacttcagttcca

SEQ ID NO: 452274 - DNA, 25 bp, Mus musculus
gaccactactggatacctatgttgt

SEQ ID NO: 452275 - DNA, 25 bp, Mus musculus
gaccactactggttacctatgttgt

SEQ ID NO: 452276 - DNA, 25 bp, Mus musculus
gaccactatagtatgatgccatctc

SEQ ID NO: 452277 - DNA, 25 bp, Mus musculus
gaccactatagtttgatgccatctc

SEQ ID NO: 452278 - DNA, 25 bp, Mus musculus
gaccactatggtctagaattcagag

SEQ ID NO: 452279 - DNA, 25 bp, Mus musculus
gaccactatggtgtagaattcagag

SEQ ID NO: 452280 - DNA, 25 bp, Mus musculus
gaccactattggcacattctctctc

SEQ ID NO: 452281 - DNA, 25 bp, Mus musculus
gaccactattgggacattctctctc

SEQ ID NO: 452282 - DNA, 25 bp, Mus musculus
gaccactcaataccagaagcacatc

SEQ ID NO: 452283 - DNA, 25 bp, Mus musculus
gaccactcaatagcagaagcacatc

SEQ ID NO: 452284 - DNA, 25 bp, Mus musculus
gaccactcacacacatgatgcaagg

SEQ ID NO: 452285 - DNA, 25 bp, Mus musculus
gaccactcacactcatgatgcaagg

SEQ ID NO: 452286 - DNA, 25 bp, Mus musculus
gaccactcacagctttcacactaga

SEQ ID NO: 452287 - DNA, 25 bp, Mus musculus
gaccactcacaggtttcacactaga

SEQ ID NO: 452288 - DNA, 25 bp, Mus musculus
gaccactcaggacggaagggaccaa

SEQ ID NO: 452289 - DNA, 25 bp, Mus musculus
gaccactcaggagggaagggaccaa

SEQ ID NO: 452290 - DNA, 25 bp, Mus musculus
gaccactcagtaaacattgattctt

SEQ ID NO: 452291 - DNA, 25 bp, Mus musculus
gaccactcagtatacattgattctt

SEQ ID NO: 452292 - DNA, 25 bp, Mus musculus
gaccactcccataagggctataact

SEQ ID NO: 452293 - DNA, 25 bp, Mus musculus
gaccactcccattagggctataact

SEQ ID NO: 452294 - DNA, 25 bp, Mus musculus
gaccactctaagctagcttctaagg

SEQ ID NO: 452295 - DNA, 25 bp, Mus musculus
gaccactctaaggtagcttctaagg

SEQ ID NO: 452296 - DNA, 25 bp, Mus musculus
gaccactctctcctgataaattttg

SEQ ID NO: 452297 - DNA, 25 bp, Mus musculus
gaccactctctcgtgataaattttg

SEQ ID NO: 452298 - DNA, 25 bp, Mus musculus
gaccactctgagattagaatagcca

SEQ ID NO: 452299 - DNA, 25 bp, Mus musculus
gaccactctgagtttagaatagcca

SEQ ID NO: 452300 - DNA, 25 bp, Mus musculus
gaccactctggactgttctgtaaag

SEQ ID NO: 452301 - DNA, 25 bp, Mus musculus
gaccactctggagtgttctgtaaag

SEQ ID NO: 452302 - DNA, 25 bp, Mus musculus
gaccactctggtagctgctttacag

SEQ ID NO: 452303 - DNA, 25 bp, Mus musculus
gaccactctggttgctgctttacag

SEQ ID NO: 452304 - DNA, 25 bp, Mus musculus
gaccactcttggactgccgagagag

SEQ ID NO: 452305 - DNA, 25 bp, Mus musculus
gaccactcttggtctgccgagagag

SEQ ID NO: 452306 - DNA, 25 bp, Mus musculus
gaccactgaactaaaccttggcgat

SEQ ID NO: 452307 - DNA, 25 bp, Mus musculus
gaccactgaacttaaccttggcgat

SEQ ID NO: 452308 - DNA, 25 bp, Mus musculus
gaccactgatcgcagctctgggaat

SEQ ID NO: 452309 - DNA, 25 bp, Mus musculus
gaccactgatcggagctctgggaat

SEQ ID NO: 452310 - DNA, 25 bp, Mus musculus
gaccactggagtcgcctttggacac

SEQ ID NO: 452311 - DNA, 25 bp, Mus musculus
gaccactggagtggcctttggacac

SEQ ID NO: 452312 - DNA, 25 bp, Mus musculus
gaccactggcctagagtgtgtacaa

SEQ ID NO: 452313 - DNA, 25 bp, Mus musculus
gaccactggccttgagtgtgtacaa

SEQ ID NO: 452314 - DNA, 25 bp, Mus musculus
gaccactggctactgactggcataa

SEQ ID NO: 452315 - DNA, 25 bp, Mus musculus
gaccactggctagtgactggcataa

SEQ ID NO: 452316 - DNA, 25 bp, Mus musculus
gaccactggctgacttaactctgag

SEQ ID NO: 452317 - DNA, 25 bp, Mus musculus
gaccactggctgtcttaactctgag

SEQ ID NO: 452318 - DNA, 25 bp, Mus musculus
gaccactggcttaggcatgatctat

SEQ ID NO: 452319 - DNA, 25 bp, Mus musculus
gaccactggctttggcatgatctat

SEQ ID NO: 452320 - DNA, 25 bp, Mus musculus
gaccactgggaaagttatctgcaac

SEQ ID NO: 452321 - DNA, 25 bp, Mus musculus
gaccactgggaatgttatctgcaac

SEQ ID NO: 452322 - DNA, 25 bp, Mus musculus
gaccactgggcacaactgtatgttt

SEQ ID NO: 452323 - DNA, 25 bp, Mus musculus
gaccactgggcagaactgtatgttt

SEQ ID NO: 452324 - DNA, 25 bp, Mus musculus
gaccactgggcgcttgattagccaa

SEQ ID NO: 452325 - DNA, 25 bp, Mus musculus
gaccactgggcggttgattagccaa

SEQ ID NO: 452326 - DNA, 25 bp, Mus musculus
gaccactgtagcaattgaactttct

SEQ ID NO: 452327 - DNA, 25 bp, Mus musculus
gaccactgtagctattgaactttct

SEQ ID NO: 452328 - DNA, 25 bp, Mus musculus
gaccactgtaggacagcgaaggcat

SEQ ID NO: 452329 - DNA, 25 bp, Mus musculus
gaccactgtaggtcagcgaaggcat

SEQ ID NO: 452330 - DNA, 25 bp, Mus musculus
gaccactgtcctatcaagtctagaa

SEQ ID NO: 452331 - DNA, 25 bp, Mus musculus
gaccactgtcctttcaagtctagaa

SEQ ID NO: 452332 - DNA, 25 bp, Mus musculus
gaccactgtctaagatgtgcactca

SEQ ID NO: 452333 - DNA, 25 bp, Mus musculus
gaccactgtctatgatgtgcactca

SEQ ID NO: 452334 - DNA, 25 bp, Mus musculus
gaccactgtcttacgttggcagatt

SEQ ID NO: 452335 - DNA, 25 bp, Mus musculus
gaccactgtctttcgttggcagatt

SEQ ID NO: 452336 - DNA, 25 bp, Mus musculus
gaccactgtgaaccgaaaagtgtat

SEQ ID NO: 452337 - DNA, 25 bp, Mus musculus
gaccactgtgaagcgaaaagtgtat

SEQ ID NO: 452338 - DNA, 25 bp, Mus musculus
gaccactgtgcacggcattgcggac

SEQ ID NO: 452339 - DNA, 25 bp, Mus musculus
gaccactgtgcagggcattgcggac

SEQ ID NO: 452340 - DNA, 25 bp, Mus musculus
gaccactgtggaagtcatacacccg

SEQ ID NO: 452341 - DNA, 25 bp, Mus musculus
gaccactgtggatgtcatacacccg

SEQ ID NO: 452342 - DNA, 25 bp, Mus musculus
gaccactgtgtcctatagatgtatt

SEQ ID NO: 452343 - DNA, 25 bp, Mus musculus
gaccactgtgtcgtatagatgtatt

SEQ ID NO: 452344 - DNA, 25 bp, Mus musculus
gaccacttcaggaatatgttagtac

SEQ ID NO: 452345 - DNA, 25 bp, Mus musculus
gaccacttcaggtatatgttagtac

SEQ ID NO: 452346 - DNA, 25 bp, Mus musculus
gaccacttcattctatctgtatctt

SEQ ID NO: 452347 - DNA, 25 bp, Mus musculus
gaccacttcattgtatctgtatctt

SEQ ID NO: 452348 - DNA, 25 bp, Mus musculus
gaccacttccagagtacagcactga

SEQ ID NO: 452349 - DNA, 25 bp, Mus musculus
gaccacttccagtgtacagcactga

SEQ ID NO: 452350 - DNA, 25 bp, Mus musculus
gaccacttcctaattgtttcacaac

SEQ ID NO: 452351 - DNA, 25 bp, Mus musculus
gaccacttcctatttgtttcacaac

SEQ ID NO: 452352 - DNA, 25 bp, Mus musculus
gaccacttccttaacagctgtatta

SEQ ID NO: 452353 - DNA, 25 bp, Mus musculus
gaccacttcctttacagctgtatta

SEQ ID NO: 452354 - DNA, 25 bp, Mus musculus
gaccacttctgtcataattggctca

SEQ ID NO: 452355 - DNA, 25 bp, Mus musculus
gaccacttctgtgataattggctca

SEQ ID NO: 452356 - DNA, 25 bp, Mus musculus
gaccacttgcagaatttacggctgg

SEQ ID NO: 452357 - DNA, 25 bp, Mus musculus
gaccacttgcagtatttacggctgg

SEQ ID NO: 452358 - DNA, 25 bp, Mus musculus
gaccacttggctactgtttagttag

SEQ ID NO: 452359 - DNA, 25 bp, Mus musculus
gaccacttggcttctgtttagttag

SEQ ID NO: 452360 - DNA, 25 bp, Mus musculus
gaccacttgtgcaagggtcccagac

SEQ ID NO: 452361 - DNA, 25 bp, Mus musculus
gaccacttgtgctagggtcccagac

SEQ ID NO: 452362 - DNA, 25 bp, Mus musculus
gaccacttgttgctcattgttagaa

SEQ ID NO: 452363 - DNA, 25 bp, Mus musculus
gaccacttgttggtcattgttagaa

SEQ ID NO: 452364 - DNA, 25 bp, Mus musculus
gaccactttcagacaatactttcct

SEQ ID NO: 452365 - DNA, 25 bp, Mus musculus
gaccactttcagtcaatactttcct

SEQ ID NO: 452366 - DNA, 25 bp, Mus musculus
gaccactttcctattggaagcacct

SEQ ID NO: 452367 - DNA, 25 bp, Mus musculus
gaccactttccttttggaagcacct

SEQ ID NO: 452368 - DNA, 25 bp, Mus musculus
gaccactttgcaattgggatgccga

SEQ ID NO: 452369 - DNA, 25 bp, Mus musculus
gaccactttgcatttgggatgccga

SEQ ID NO: 452370 - DNA, 25 bp, Mus musculus
gaccactttgtaatgctctcagagg

SEQ ID NO: 452371 - DNA, 25 bp, Mus musculus
gaccactttgtattgctctcagagg

SEQ ID NO: 452372 - DNA, 25 bp, Mus musculus
gaccacttttagatacaaagaggct

SEQ ID NO: 452373 - DNA, 25 bp, Mus musculus
gaccacttttagttacaaagaggct

SEQ ID NO: 452374 - DNA, 25 bp, Mus musculus
gaccagaaagggactccctggccaa

SEQ ID NO: 452375 - DNA, 25 bp, Mus musculus
gaccagaaagggtctccctggccaa

SEQ ID NO: 452376 - DNA, 25 bp, Mus musculus
gaccagaacagcctaactcatgaag

SEQ ID NO: 452377 - DNA, 25 bp, Mus musculus
gaccagaacagcgtaactcatgaag

SEQ ID NO: 452378 - DNA, 25 bp, Mus musculus
gaccagaacataactcctgttagag

SEQ ID NO: 452379 - DNA, 25 bp, Mus musculus
gaccagaacatatctcctgttagag

SEQ ID NO: 452380 - DNA, 25 bp, Mus musculus
gaccagaactctcagctgtgtagct

SEQ ID NO: 452381 - DNA, 25 bp, Mus musculus
gaccagaactctgagctgtgtagct

SEQ ID NO: 452382 - DNA, 25 bp, Mus musculus
gaccagaagacgcagggattttgat

SEQ ID NO: 452383 - DNA, 25 bp, Mus musculus
gaccagaagacggagggattttgat

SEQ ID NO: 452384 - DNA, 25 bp, Mus musculus
gaccagaaggaaatgtagagcagct

SEQ ID NO: 452385 - DNA, 25 bp, Mus musculus
gaccagaaggaattgtagagcagct

SEQ ID NO: 452386 - DNA, 25 bp, Mus musculus
gaccagaaggctcgactgtgagcct

SEQ ID NO: 452387 - DNA, 25 bp, Mus musculus
gaccagaaggctggactgtgagcct

SEQ ID NO: 452388 - DNA, 25 bp, Mus musculus
gaccagaaggtactgcttgcctgaa

SEQ ID NO: 452389 - DNA, 25 bp, Mus musculus
gaccagaaggtagtgcttgcctgaa

SEQ ID NO: 452390 - DNA, 25 bp, Mus musculus
gaccagaaggttcccaatcaaactt

SEQ ID NO: 452391 - DNA, 25 bp, Mus musculus
gaccagaaggttgccaatcaaactt

SEQ ID NO: 452392 - DNA, 25 bp, Mus musculus
gaccagaagtcacatcaccaagcgg

SEQ ID NO: 452393 - DNA, 25 bp, Mus musculus
gaccagaagtcagatcaccaagcgg

SEQ ID NO: 452394 - DNA, 25 bp, Mus musculus
gaccagaagtgaagccttggcacac

SEQ ID NO: 452395 - DNA, 25 bp, Mus musculus
gaccagaagtgatgccttggcacac

SEQ ID NO: 452396 - DNA, 25 bp, Mus musculus
gaccagaagtgtctattccagcccc

SEQ ID NO: 452397 - DNA, 25 bp, Mus musculus
gaccagaagtgtgtattccagcccc

SEQ ID NO: 452398 - DNA, 25 bp, Mus musculus
gaccagaatatccagactgtctttt

SEQ ID NO: 452399 - DNA, 25 bp, Mus musculus
gaccagaatatcgagactgtctttt

SEQ ID NO: 452400 - DNA, 25 bp, Mus musculus
gaccagaatcctcttaaaaagagga

SEQ ID NO: 452401 - DNA, 25 bp, Mus musculus
gaccagaatcctgttaaaaagagga

SEQ ID NO: 452402 - DNA, 25 bp, Mus musculus
gaccagaatctgatgtatgcccagg

SEQ ID NO: 452403 - DNA, 25 bp, Mus musculus
gaccagaatctgcagctacacttgc

SEQ ID NO: 452404 - DNA, 25 bp, Mus musculus
gaccagaatctgcagttcatcgacc

SEQ ID NO: 452405 - DNA, 25 bp, Mus musculus
gaccagaatctggagctacacttgc

SEQ ID NO: 452406 - DNA, 25 bp, Mus musculus
gaccagaatctggagttcatcgacc

SEQ ID NO: 452407 - DNA, 25 bp, Mus musculus
gaccagaatctgttgtatgcccagg

SEQ ID NO: 452408 - DNA, 25 bp, Mus musculus
gaccagaatgcaaccactttaccaa

SEQ ID NO: 452409 - DNA, 25 bp, Mus musculus
gaccagaatgcatccactttaccaa

SEQ ID NO: 452410 - DNA, 25 bp, Mus musculus
gaccagaattagaatgccagcactt

SEQ ID NO: 452411 - DNA, 25 bp, Mus musculus
gaccagaattagtatgccagcactt

SEQ ID NO: 452412 - DNA, 25 bp, Mus musculus
gaccagaattctagggaaaatgctt

SEQ ID NO: 452413 - DNA, 25 bp, Mus musculus
gaccagaattcttgggaaaatgctt

SEQ ID NO: 452414 - DNA, 25 bp, Mus musculus
gaccagacaaagaagcatgccaccc

SEQ ID NO: 452415 - DNA, 25 bp, Mus musculus
gaccagacaaagtagcatgccaccc

SEQ ID NO: 452416 - DNA, 25 bp, Mus musculus
gaccagacacccctccatgggtatg

SEQ ID NO: 452417 - DNA, 25 bp, Mus musculus
gaccagacacccgtccatgggtatg

SEQ ID NO: 452418 - DNA, 25 bp, Mus musculus
gaccagacaccgaagaggactcgcg

SEQ ID NO: 452419 - DNA, 25 bp, Mus musculus
gaccagacaccgtagaggactcgcg

SEQ ID NO: 452420 - DNA, 25 bp, Mus musculus
gaccagacacttaactgtagcagac

SEQ ID NO: 452421 - DNA, 25 bp, Mus musculus
gaccagacactttactgtagcagac

SEQ ID NO: 452422 - DNA, 25 bp, Mus musculus
gaccagacagtgatgcctcatcctc

SEQ ID NO: 452423 - DNA, 25 bp, Mus musculus
gaccagacagtgttgcctcatcctc

SEQ ID NO: 452424 - DNA, 25 bp, Mus musculus
gaccagacagttcatggacatgttt

SEQ ID NO: 452425 - DNA, 25 bp, Mus musculus
gaccagacagttgatggacatgttt

SEQ ID NO: 452426 - DNA, 25 bp, Mus musculus
gaccagacatgcaagccgcggagga

SEQ ID NO: 452427 - DNA, 25 bp, Mus musculus
gaccagacatgctagccgcggagga

SEQ ID NO: 452428 - DNA, 25 bp, Mus musculus
gaccagaccaacattgctctttgtg

SEQ ID NO: 452429 - DNA, 25 bp, Mus musculus
gaccagaccaactttgctctttgtg

SEQ ID NO: 452430 - DNA, 25 bp, Mus musculus
gaccagaccaagaagggcatcccgg

SEQ ID NO: 452431 - DNA, 25 bp, Mus musculus
gaccagaccaagtagggcatcccgg

SEQ ID NO: 452432 - DNA, 25 bp, Mus musculus
gaccagaccagcactgaatcctaaa

SEQ ID NO: 452433 - DNA, 25 bp, Mus musculus
gaccagaccagctctgaatcctaaa

SEQ ID NO: 452434 - DNA, 25 bp, Mus musculus
gaccagaccaggcagcaggcttaat

SEQ ID NO: 452435 - DNA, 25 bp, Mus musculus
gaccagaccagggagcaggcttaat

SEQ ID NO: 452436 - DNA, 25 bp, Mus musculus
gaccagaccctcatcttgtttgcca

SEQ ID NO: 452437 - DNA, 25 bp, Mus musculus
gaccagaccctcttcttgtttgcca

SEQ ID NO: 452438 - DNA, 25 bp, Mus musculus
gaccagaccttaataaagctttgtt

SEQ ID NO: 452439 - DNA, 25 bp, Mus musculus
gaccagaccttattaaagctttgtt

SEQ ID NO: 452440 - DNA, 25 bp, Mus musculus
gaccagaccttgatttgtgggccag

SEQ ID NO: 452441 - DNA, 25 bp, Mus musculus
gaccagaccttgttttgtgggccag

SEQ ID NO: 452442 - DNA, 25 bp, Mus musculus
gaccagacgggacagtcattcctaa

SEQ ID NO: 452443 - DNA, 25 bp, Mus musculus
gaccagacgggagagtcattcctaa

SEQ ID NO: 452444 - DNA, 25 bp, Mus musculus
gaccagactcacatcaaactcatag

SEQ ID NO: 452445 - DNA, 25 bp, Mus musculus
gaccagactcacttcaaactcatag

SEQ ID NO: 452446 - DNA, 25 bp, Mus musculus
gaccagactggaacctcagccctga

SEQ ID NO: 452447 - DNA, 25 bp, Mus musculus
gaccagactggaagctatgttataa

SEQ ID NO: 452448 - DNA, 25 bp, Mus musculus
gaccagactggatcctcagccctga

SEQ ID NO: 452449 - DNA, 25 bp, Mus musculus
gaccagactggatgctatgttataa

SEQ ID NO: 452450 - DNA, 25 bp, Mus musculus
gaccagactgtgatgggcgacagct

SEQ ID NO: 452451 - DNA, 25 bp, Mus musculus
gaccagactgtgttgggcgacagct

SEQ ID NO: 452452 - DNA, 25 bp, Mus musculus
gaccagagaataaagtgaaaccaca

SEQ ID NO: 452453 - DNA, 25 bp, Mus musculus
gaccagagaatatagtgaaaccaca

SEQ ID NO: 452454 - DNA, 25 bp, Mus musculus
gaccagagaattcgcattttctaca

SEQ ID NO: 452455 - DNA, 25 bp, Mus musculus
gaccagagaattggcattttctaca

SEQ ID NO: 452456 - DNA, 25 bp, Mus musculus
gaccagagacgaagatgatggcaaa

SEQ ID NO: 452457 - DNA, 25 bp, Mus musculus
gaccagagacgatgatgatggcaaa

SEQ ID NO: 452458 - DNA, 25 bp, Mus musculus
gaccagagactaatctaccctgaac

SEQ ID NO: 452459 - DNA, 25 bp, Mus musculus
gaccagagactattctaccctgaac

SEQ ID NO: 452460 - DNA, 25 bp, Mus musculus
gaccagagagagcacgcttggccta

SEQ ID NO: 452461 - DNA, 25 bp, Mus musculus
gaccagagagaggacgcttggccta

SEQ ID NO: 452462 - DNA, 25 bp, Mus musculus
gaccagagaggtcggcacttgtcca

SEQ ID NO: 452463 - DNA, 25 bp, Mus musculus
gaccagagaggtgggcacttgtcca

SEQ ID NO: 452464 - DNA, 25 bp, Mus musculus
gaccagagagttaacatgttctcta

SEQ ID NO: 452465 - DNA, 25 bp, Mus musculus
gaccagagagtttacatgttctcta

SEQ ID NO: 452466 - DNA, 25 bp, Mus musculus
gaccagagatttccctaggacctga

SEQ ID NO: 452467 - DNA, 25 bp, Mus musculus
gaccagagatttgcctaggacctga

SEQ ID NO: 452468 - DNA, 25 bp, Mus musculus
gaccagagcaagacctgagccttct

SEQ ID NO: 452469 - DNA, 25 bp, Mus musculus
gaccagagcaagtcctgagccttct

SEQ ID NO: 452470 - DNA, 25 bp, Mus musculus
gaccagagcagtataggagattgta

SEQ ID NO: 452471 - DNA, 25 bp, Mus musculus
gaccagagcagtattgttacctgag

SEQ ID NO: 452472 - DNA, 25 bp, Mus musculus
gaccagagcagtttaggagattgta

SEQ ID NO: 452473 - DNA, 25 bp, Mus musculus
gaccagagcagttttgttacctgag

SEQ ID NO: 452474 - DNA, 25 bp, Mus musculus
gaccagagctgtcctgcagattact

SEQ ID NO: 452475 - DNA, 25 bp, Mus musculus
gaccagagctgtgctgcagattact

SEQ ID NO: 452476 - DNA, 25 bp, Mus musculus
gaccagaggagtcagtttttgcctt

SEQ ID NO: 452477 - DNA, 25 bp, Mus musculus
gaccagaggagtgagtttttgcctt

SEQ ID NO: 452478 - DNA, 25 bp, Mus musculus
gaccagaggccccatggagccatat

SEQ ID NO: 452479 - DNA, 25 bp, Mus musculus
gaccagaggcccgatggagccatat

SEQ ID NO: 452480 - DNA, 25 bp, Mus musculus
gaccagaggctcaacagaatgggtt

SEQ ID NO: 452481 - DNA, 25 bp, Mus musculus
gaccagaggctctacagaatgggtt

SEQ ID NO: 452482 - DNA, 25 bp, Mus musculus
gaccagaggctgagaccacaggaat

SEQ ID NO: 452483 - DNA, 25 bp, Mus musculus
gaccagaggctgtgaccacaggaat

SEQ ID NO: 452484 - DNA, 25 bp, Mus musculus
gaccagaggtagacttgataaccac

SEQ ID NO: 452485 - DNA, 25 bp, Mus musculus
gaccagaggtagtcttgataaccac

SEQ ID NO: 452486 - DNA, 25 bp, Mus musculus
gaccagaggtcccagttgatttttc

SEQ ID NO: 452487 - DNA, 25 bp, Mus musculus
gaccagaggtccgagttgatttttc

SEQ ID NO: 452488 - DNA, 25 bp, Mus musculus
gaccagagtcggcttagttctctct

SEQ ID NO: 452489 - DNA, 25 bp, Mus musculus
gaccagagtcgggttagttctctct

SEQ ID NO: 452490 - DNA, 25 bp, Mus musculus
gaccagagtctgagtttgtctacaa

SEQ ID NO: 452491 - DNA, 25 bp, Mus musculus
gaccagagtctgtgtttgtctacaa

SEQ ID NO: 452492 - DNA, 25 bp, Mus musculus
gaccagagtgaaacccaggctccga

SEQ ID NO: 452493 - DNA, 25 bp, Mus musculus
gaccagagtgaacaactgtgcgtgt

SEQ ID NO: 452494 - DNA, 25 bp, Mus musculus
gaccagagtgaagaactgtgcgtgt

SEQ ID NO: 452495 - DNA, 25 bp, Mus musculus
gaccagagtgaatcccaggctccga

SEQ ID NO: 452496 - DNA, 25 bp, Mus musculus
gaccagagtgtgcactgcatcccga

SEQ ID NO: 452497 - DNA, 25 bp, Mus musculus
gaccagagtgtggactgcatcccga

SEQ ID NO: 452498 - DNA, 25 bp, Mus musculus
gaccagagtttgaggatccgctcac

SEQ ID NO: 452499 - DNA, 25 bp, Mus musculus
gaccagagtttgtggatccgctcac

SEQ ID NO: 452500 - DNA, 25 bp, Mus musculus
gaccagatacttcactgagtgccca

SEQ ID NO: 452501 - DNA, 25 bp, Mus musculus
gaccagatacttgactgagtgccca

SEQ ID NO: 452502 - DNA, 25 bp, Mus musculus
gaccagatatggctgcgcttacaca

SEQ ID NO: 452503 - DNA, 25 bp, Mus musculus
gaccagatatgggtgcgcttacaca

SEQ ID NO: 452504 - DNA, 25 bp, Mus musculus
gaccagatcacaccttctgaacatg

SEQ ID NO: 452505 - DNA, 25 bp, Mus musculus
gaccagatcacagcttctgaacatg

SEQ ID NO: 452506 - DNA, 25 bp, Mus musculus
gaccagatcacgctcgtgaggcaaa

SEQ ID NO: 452507 - DNA, 25 bp, Mus musculus
gaccagatcacggtcgtgaggcaaa

SEQ ID NO: 452508 - DNA, 25 bp, Mus musculus
gaccagatcagacacctattcagtt

SEQ ID NO: 452509 - DNA, 25 bp, Mus musculus
gaccagatcagagacctattcagtt

SEQ ID NO: 452510 - DNA, 25 bp, Mus musculus
gaccagatcctacctgattgttatc

SEQ ID NO: 452511 - DNA, 25 bp, Mus musculus
gaccagatcctagctgattgttatc

SEQ ID NO: 452512 - DNA, 25 bp, Mus musculus
gaccagatcctcaataacctaagca

SEQ ID NO: 452513 - DNA, 25 bp, Mus musculus
gaccagatcctctataacctaagca

SEQ ID NO: 452514 - DNA, 25 bp, Mus musculus
gaccagatcctgaagttttaattct

SEQ ID NO: 452515 - DNA, 25 bp, Mus musculus
gaccagatcctgtagttttaattct

SEQ ID NO: 452516 - DNA, 25 bp, Mus musculus
gaccagatcgatcgaatagttcatt

SEQ ID NO: 452517 - DNA, 25 bp, Mus musculus
gaccagatcgatggaatagttcatt

SEQ ID NO: 452518 - DNA, 25 bp, Mus musculus
gaccagatcttgaggttgtttgatg

SEQ ID NO: 452519 - DNA, 25 bp, Mus musculus
gaccagatcttgtggttgtttgatg

SEQ ID NO: 452520 - DNA, 25 bp, Mus musculus
gaccagatgaccattgatgacttga

SEQ ID NO: 452521 - DNA, 25 bp, Mus musculus
gaccagatgacctttgatgacttga

SEQ ID NO: 452522 - DNA, 25 bp, Mus musculus
gaccagatggctaaggcttcagcat

SEQ ID NO: 452523 - DNA, 25 bp, Mus musculus
gaccagatggcttaggcttcagcat

SEQ ID NO: 452524 - DNA, 25 bp, Mus musculus
gaccagatgggcctcttatattctc

SEQ ID NO: 452525 - DNA, 25 bp, Mus musculus
gaccagatgggcgtcttatattctc

SEQ ID NO: 452526 - DNA, 25 bp, Mus musculus
gaccagatggttcgcttgatttgac

SEQ ID NO: 452527 - DNA, 25 bp, Mus musculus
gaccagatggttggcttgatttgac

SEQ ID NO: 452528 - DNA, 25 bp, Mus musculus
gaccagatgtggctttctactttaa

SEQ ID NO: 452529 - DNA, 25 bp, Mus musculus
gaccagatgtgggtttctactttaa

SEQ ID NO: 452530 - DNA, 25 bp, Mus musculus
gaccagatttacagttgcttcagag

SEQ ID NO: 452531 - DNA, 25 bp, Mus musculus
gaccagatttactgttgcttcagag

SEQ ID NO: 452532 - DNA, 25 bp, Mus musculus
gaccagatttatacagcttgctctt

SEQ ID NO: 452533 - DNA, 25 bp, Mus musculus
gaccagatttattcagcttgctctt

SEQ ID NO: 452534 - DNA, 25 bp, Mus musculus
gaccagatttcaagaagttgagagt

SEQ ID NO: 452535 - DNA, 25 bp, Mus musculus
gaccagatttcatgaagttgagagt

SEQ ID NO: 452536 - DNA, 25 bp, Mus musculus
gaccagcaaacgctcttaacttctg

SEQ ID NO: 452537 - DNA, 25 bp, Mus musculus
gaccagcaaacggtcttaacttctg

SEQ ID NO: 452538 - DNA, 25 bp, Mus musculus
gaccagcaaagtcgctcactgctat

SEQ ID NO: 452539 - DNA, 25 bp, Mus musculus
gaccagcaaagtggctcactgctat

SEQ ID NO: 452540 - DNA, 25 bp, Mus musculus
gaccagcaagatacccgcatttatg

SEQ ID NO: 452541 - DNA, 25 bp, Mus musculus
gaccagcaagattcccgcatttatg

SEQ ID NO: 452542 - DNA, 25 bp, Mus musculus
gaccagcaagcacatcaaagtcagg

SEQ ID NO: 452543 - DNA, 25 bp, Mus musculus
gaccagcaagcaccacaaggcctga

SEQ ID NO: 452544 - DNA, 25 bp, Mus musculus
gaccagcaagcagatcaaagtcagg

SEQ ID NO: 452545 - DNA, 25 bp, Mus musculus
gaccagcaagcagcacaaggcctga

SEQ ID NO: 452546 - DNA, 25 bp, Mus musculus
gaccagcaagtgattatcctgactt

SEQ ID NO: 452547 - DNA, 25 bp, Mus musculus
gaccagcaagtgtttatcctgactt

SEQ ID NO: 452548 - DNA, 25 bp, Mus musculus
gaccagcaatcacccttgggagcta

SEQ ID NO: 452549 - DNA, 25 bp, Mus musculus
gaccagcaatcagccttgggagcta

SEQ ID NO: 452550 - DNA, 25 bp, Mus musculus
gaccagcacgcacaggataccaaac

SEQ ID NO: 452551 - DNA, 25 bp, Mus musculus
gaccagcacgcagaggataccaaac

SEQ ID NO: 452552 - DNA, 25 bp, Mus musculus
gaccagcactgtctggcatgtgttc

SEQ ID NO: 452553 - DNA, 25 bp, Mus musculus
gaccagcactgtgtggcatgtgttc

SEQ ID NO: 452554 - DNA, 25 bp, Mus musculus
gaccagcacttgacttttagctact

SEQ ID NO: 452555 - DNA, 25 bp, Mus musculus
gaccagcacttgtcttttagctact

SEQ ID NO: 452556 - DNA, 25 bp, Mus musculus
gaccagcagactaacctgtttcaaa

SEQ ID NO: 452557 - DNA, 25 bp, Mus musculus
gaccagcagactcgcaacctcaaga

SEQ ID NO: 452558 - DNA, 25 bp, Mus musculus
gaccagcagactggcaacctcaaga

SEQ ID NO: 452559 - DNA, 25 bp, Mus musculus
gaccagcagacttacctgtttcaaa

SEQ ID NO: 452560 - DNA, 25 bp, Mus musculus
gaccagcagcacagactgtaaactc

SEQ ID NO: 452561 - DNA, 25 bp, Mus musculus
gaccagcagcactgactgtaaactc

SEQ ID NO: 452562 - DNA, 25 bp, Mus musculus
gaccagcagcggcagacgactcatc

SEQ ID NO: 452563 - DNA, 25 bp, Mus musculus
gaccagcagcgggagacgactcatc

SEQ ID NO: 452564 - DNA, 25 bp, Mus musculus
gaccagcataatacctgtcatttgt

SEQ ID NO: 452565 - DNA, 25 bp, Mus musculus
gaccagcataattcctgtcatttgt

SEQ ID NO: 452566 - DNA, 25 bp, Mus musculus
gaccagcatattacaagcatagtag

SEQ ID NO: 452567 - DNA, 25 bp, Mus musculus
gaccagcatatttcaagcatagtag

SEQ ID NO: 452568 - DNA, 25 bp, Mus musculus
gaccagcatgagaagcaccgtgcca

SEQ ID NO: 452569 - DNA, 25 bp, Mus musculus
gaccagcatgagtagcaccgtgcca

SEQ ID NO: 452570 - DNA, 25 bp, Mus musculus
gaccagcatgctccaggtagtagca

SEQ ID NO: 452571 - DNA, 25 bp, Mus musculus
gaccagcatgctgcaggtagtagca

SEQ ID NO: 452572 - DNA, 25 bp, Mus musculus
gaccagcatgttcactatacttggt

SEQ ID NO: 452573 - DNA, 25 bp, Mus musculus
gaccagcatgttgactatacttggt

SEQ ID NO: 452574 - DNA, 25 bp, Mus musculus
gaccagcattccatggcagttctga

SEQ ID NO: 452575 - DNA, 25 bp, Mus musculus
gaccagcattccttggcagttctga

SEQ ID NO: 452576 - DNA, 25 bp, Mus musculus
gaccagccaaatcagtatttacact

SEQ ID NO: 452577 - DNA, 25 bp, Mus musculus
gaccagccaaatgagtatttacact

SEQ ID NO: 452578 - DNA, 25 bp, Mus musculus
gaccagccaacacgtttaccagttc

SEQ ID NO: 452579 - DNA, 25 bp, Mus musculus
gaccagccaacaggtttaccagttc

SEQ ID NO: 452580 - DNA, 25 bp, Mus musculus
gaccagccagcaatctcagatagta

SEQ ID NO: 452581 - DNA, 25 bp, Mus musculus
gaccagccagcattctcagatagta

SEQ ID NO: 452582 - DNA, 25 bp, Mus musculus
gaccagccccgacagagtttcgtgg

SEQ ID NO: 452583 - DNA, 25 bp, Mus musculus
gaccagccccgagagagtttcgtgg

SEQ ID NO: 452584 - DNA, 25 bp, Mus musculus
gaccagccctttatgggttcatttt

SEQ ID NO: 452585 - DNA, 25 bp, Mus musculus
gaccagccctttcagaggctttcct

SEQ ID NO: 452586 - DNA, 25 bp, Mus musculus
gaccagccctttgagaggctttcct

SEQ ID NO: 452587 - DNA, 25 bp, Mus musculus
gaccagccctttttgggttcatttt

SEQ ID NO: 452588 - DNA, 25 bp, Mus musculus
gaccagccgcaacctaaagactcat

SEQ ID NO: 452589 - DNA, 25 bp, Mus musculus
gaccagccgcaagctaaagactcat

SEQ ID NO: 452590 - DNA, 25 bp, Mus musculus
gaccagcctaacattcagaggactg

SEQ ID NO: 452591 - DNA, 25 bp, Mus musculus
gaccagcctaactttcagaggactg

SEQ ID NO: 452592 - DNA, 25 bp, Mus musculus
gaccagcctcaaagaagcggaagaa

SEQ ID NO: 452593 - DNA, 25 bp, Mus musculus
gaccagcctcaatgaagcggaagaa

SEQ ID NO: 452594 - DNA, 25 bp, Mus musculus
gaccagcctctgaagagtccagatg

SEQ ID NO: 452595 - DNA, 25 bp, Mus musculus
gaccagcctctgtagagtccagatg

SEQ ID NO: 452596 - DNA, 25 bp, Mus musculus
gaccagcctggtagactcagtaaat

SEQ ID NO: 452597 - DNA, 25 bp, Mus musculus
gaccagcctggttgactcagtaaat

SEQ ID NO: 452598 - DNA, 25 bp, Mus musculus
gaccagccttccctggactgaaggg

SEQ ID NO: 452599 - DNA, 25 bp, Mus musculus
gaccagccttccgtggactgaaggg

SEQ ID NO: 452600 - DNA, 25 bp, Mus musculus
gaccagcgaaacaagcttactgagt

SEQ ID NO: 452601 - DNA, 25 bp, Mus musculus
gaccagcgaaactagcttactgagt

SEQ ID NO: 452602 - DNA, 25 bp, Mus musculus
gaccagcgacttctcaaggtgtttt

SEQ ID NO: 452603 - DNA, 25 bp, Mus musculus
gaccagcgacttgtcaaggtgtttt

SEQ ID NO: 452604 - DNA, 25 bp, Mus musculus
gaccagcgcccacagaagagcatag

SEQ ID NO: 452605 - DNA, 25 bp, Mus musculus
gaccagcgcccagagaagagcatag

SEQ ID NO: 452606 - DNA, 25 bp, Mus musculus
gaccagcggaaacacttcgagccta

SEQ ID NO: 452607 - DNA, 25 bp, Mus musculus
gaccagcggaaagacttcgagccta

SEQ ID NO: 452608 - DNA, 25 bp, Mus musculus
gaccagctagaaacacatatttatt

SEQ ID NO: 452609 - DNA, 25 bp, Mus musculus
gaccagctagaatcacatatttatt

SEQ ID NO: 452610 - DNA, 25 bp, Mus musculus
gaccagctatgcacgagaatttctg

SEQ ID NO: 452611 - DNA, 25 bp, Mus musculus
gaccagctatgctcgagaatttctg

SEQ ID NO: 452612 - DNA, 25 bp, Mus musculus
gaccagctcagactacagtgggacg

SEQ ID NO: 452613 - DNA, 25 bp, Mus musculus
gaccagctcagagtacagtgggacg

SEQ ID NO: 452614 - DNA, 25 bp, Mus musculus
gaccagctcatgacttttagcggca

SEQ ID NO: 452615 - DNA, 25 bp, Mus musculus
gaccagctcatgtcttttagcggca

SEQ ID NO: 452616 - DNA, 25 bp, Mus musculus
gaccagctccggcaaaaggcccagg

SEQ ID NO: 452617 - DNA, 25 bp, Mus musculus
gaccagctccgggaaaaggcccagg

SEQ ID NO: 452618 - DNA, 25 bp, Mus musculus
gaccagctcgtacgaaagatgctca

SEQ ID NO: 452619 - DNA, 25 bp, Mus musculus
gaccagctcgtaggaaagatgctca

SEQ ID NO: 452620 - DNA, 25 bp, Mus musculus
gaccagctctaacctggtgggtttg

SEQ ID NO: 452621 - DNA, 25 bp, Mus musculus
gaccagctctaagctggtgggtttg

SEQ ID NO: 452622 - DNA, 25 bp, Mus musculus
gaccagctctgtcgcatggagtaga

SEQ ID NO: 452623 - DNA, 25 bp, Mus musculus
gaccagctctgtggcatggagtaga

SEQ ID NO: 452624 - DNA, 25 bp, Mus musculus
gaccagctcttacagggtggccttt

SEQ ID NO: 452625 - DNA, 25 bp, Mus musculus
gaccagctcttagagggtggccttt

SEQ ID NO: 452626 - DNA, 25 bp, Mus musculus
gaccagctgacaactgacaggcaca

SEQ ID NO: 452627 - DNA, 25 bp, Mus musculus
gaccagctgacatctgacaggcaca

SEQ ID NO: 452628 - DNA, 25 bp, Mus musculus
gaccagctgagcatcaacacttttg

SEQ ID NO: 452629 - DNA, 25 bp, Mus musculus
gaccagctgagccaacatcaggagt

SEQ ID NO: 452630 - DNA, 25 bp, Mus musculus
gaccagctgagcgaacatcaggagt

SEQ ID NO: 452631 - DNA, 25 bp, Mus musculus
gaccagctgagcttcaacacttttg

SEQ ID NO: 452632 - DNA, 25 bp, Mus musculus
gaccagctgagtaacctgaatgact

SEQ ID NO: 452633 - DNA, 25 bp, Mus musculus
gaccagctgagttacctgaatgact

SEQ ID NO: 452634 - DNA, 25 bp, Mus musculus
gaccagctgattctagacaccgtgt

SEQ ID NO: 452635 - DNA, 25 bp, Mus musculus
gaccagctgattgtagacaccgtgt

SEQ ID NO: 452636 - DNA, 25 bp, Mus musculus
gaccagctgccaagaaaaatgttgt

SEQ ID NO: 452637 - DNA, 25 bp, Mus musculus
gaccagctgccatgaaaaatgttgt

SEQ ID NO: 452638 - DNA, 25 bp, Mus musculus
gaccagctgcgcagaaaggtaccca

SEQ ID NO: 452639 - DNA, 25 bp, Mus musculus
gaccagctgcgctgaaaggtaccca

SEQ ID NO: 452640 - DNA, 25 bp, Mus musculus
gaccagctgctccaaatgagtaaaa

SEQ ID NO: 452641 - DNA, 25 bp, Mus musculus
gaccagctgctcgaaatgagtaaaa

SEQ ID NO: 452642 - DNA, 25 bp, Mus musculus
gaccagctggatactttaggcagaa

SEQ ID NO: 452643 - DNA, 25 bp, Mus musculus
gaccagctggattctttaggcagaa

SEQ ID NO: 452644 - DNA, 25 bp, Mus musculus
gaccagcttgatcgagcttcccaaa

SEQ ID NO: 452645 - DNA, 25 bp, Mus musculus
gaccagcttgatggagcttcccaaa

SEQ ID NO: 452646 - DNA, 25 bp, Mus musculus
gaccagcttggtcaggacaggcaaa

SEQ ID NO: 452647 - DNA, 25 bp, Mus musculus
gaccagcttggtccatgtgaatgct

SEQ ID NO: 452648 - DNA, 25 bp, Mus musculus
gaccagcttggtgaggacaggcaaa

SEQ ID NO: 452649 - DNA, 25 bp, Mus musculus
gaccagcttggtgcatgtgaatgct

SEQ ID NO: 452650 - DNA, 25 bp, Mus musculus
gaccagctttagattcactatgtag

SEQ ID NO: 452651 - DNA, 25 bp, Mus musculus
gaccagctttagtttcactatgtag

SEQ ID NO: 452652 - DNA, 25 bp, Mus musculus
gaccagctttgaccacattcagaga

SEQ ID NO: 452653 - DNA, 25 bp, Mus musculus
gaccagctttgagcacattcagaga

SEQ ID NO: 452654 - DNA, 25 bp, Mus musculus
gaccaggaaaacagccatcacactc

SEQ ID NO: 452655 - DNA, 25 bp, Mus musculus
gaccaggaaaactgccatcacactc

SEQ ID NO: 452656 - DNA, 25 bp, Mus musculus
gaccaggaactcagcagtctgtctg

SEQ ID NO: 452657 - DNA, 25 bp, Mus musculus
gaccaggaactctgcagtctgtctg

SEQ ID NO: 452658 - DNA, 25 bp, Mus musculus
gaccaggaagcgaattcctgacccc

SEQ ID NO: 452659 - DNA, 25 bp, Mus musculus
gaccaggaagcgtattcctgacccc

SEQ ID NO: 452660 - DNA, 25 bp, Mus musculus
gaccaggaagctattgacccttgtc

SEQ ID NO: 452661 - DNA, 25 bp, Mus musculus
gaccaggaagctctatctgaatgca

SEQ ID NO: 452662 - DNA, 25 bp, Mus musculus
gaccaggaagctgtatctgaatgca

SEQ ID NO: 452663 - DNA, 25 bp, Mus musculus
gaccaggaagcttttgacccttgtc

SEQ ID NO: 452664 - DNA, 25 bp, Mus musculus
gaccaggaagggaagtatgcgtatt

SEQ ID NO: 452665 - DNA, 25 bp, Mus musculus
gaccaggaagggtagtatgcgtatt

SEQ ID NO: 452666 - DNA, 25 bp, Mus musculus
gaccaggaagtgatgatgtgcccct

SEQ ID NO: 452667 - DNA, 25 bp, Mus musculus
gaccaggaagtgttgatgtgcccct

SEQ ID NO: 452668 - DNA, 25 bp, Mus musculus
gaccaggaatttagtgcttctgagg

SEQ ID NO: 452669 - DNA, 25 bp, Mus musculus
gaccaggaattttgtgcttctgagg

SEQ ID NO: 452670 - DNA, 25 bp, Mus musculus
gaccaggacaccatgattgtcactt

SEQ ID NO: 452671 - DNA, 25 bp, Mus musculus
gaccaggacaccttgattgtcactt

SEQ ID NO: 452672 - DNA, 25 bp, Mus musculus
gaccaggacaggattccatggcttt

SEQ ID NO: 452673 - DNA, 25 bp, Mus musculus
gaccaggacaggtttccatggcttt

SEQ ID NO: 452674 - DNA, 25 bp, Mus musculus
gaccaggacctgctttttgaatcag

SEQ ID NO: 452675 - DNA, 25 bp, Mus musculus
gaccaggacctggtttttgaatcag

SEQ ID NO: 452676 - DNA, 25 bp, Mus musculus
gaccaggactggacggatgctgcta

SEQ ID NO: 452677 - DNA, 25 bp, Mus musculus
gaccaggactggtcggatgctgcta

SEQ ID NO: 452678 - DNA, 25 bp, Mus musculus
gaccaggagaagcatggcatcgaca

SEQ ID NO: 452679 - DNA, 25 bp, Mus musculus
gaccaggagaaggatggcatcgaca

SEQ ID NO: 452680 - DNA, 25 bp, Mus musculus
gaccaggagattagtcttaaagcct

SEQ ID NO: 452681 - DNA, 25 bp, Mus musculus
gaccaggagatttgtcttaaagcct

SEQ ID NO: 452682 - DNA, 25 bp, Mus musculus
gaccaggagcatcctcctgttagag

SEQ ID NO: 452683 - DNA, 25 bp, Mus musculus
gaccaggagcatgctcctgttagag

SEQ ID NO: 452684 - DNA, 25 bp, Mus musculus
gaccaggagccaactaagaagcaga

SEQ ID NO: 452685 - DNA, 25 bp, Mus musculus
gaccaggagccatctaagaagcaga

SEQ ID NO: 452686 - DNA, 25 bp, Mus musculus
gaccaggagcccaggccacgaggct

SEQ ID NO: 452687 - DNA, 25 bp, Mus musculus
gaccaggagccctggccacgaggct

SEQ ID NO: 452688 - DNA, 25 bp, Mus musculus
gaccaggagctgcattcacagaagt

SEQ ID NO: 452689 - DNA, 25 bp, Mus musculus
gaccaggagctggattcacagaagt

SEQ ID NO: 452690 - DNA, 25 bp, Mus musculus
gaccaggaggctactgtctactgca

SEQ ID NO: 452691 - DNA, 25 bp, Mus musculus
gaccaggaggcttctgtctactgca

SEQ ID NO: 452692 - DNA, 25 bp, Mus musculus
gaccaggagttgagagtcagcagaa

SEQ ID NO: 452693 - DNA, 25 bp, Mus musculus
gaccaggagttgtgagtcagcagaa

SEQ ID NO: 452694 - DNA, 25 bp, Mus musculus
gaccaggatagtcatttgaccacag

SEQ ID NO: 452695 - DNA, 25 bp, Mus musculus
gaccaggatagtgatttgaccacag

SEQ ID NO: 452696 - DNA, 25 bp, Mus musculus
gaccaggatcctccatcttatagtg

SEQ ID NO: 452697 - DNA, 25 bp, Mus musculus
gaccaggatcctgcatcttatagtg

SEQ ID NO: 452698 - DNA, 25 bp, Mus musculus
gaccaggatggtatacagtttcttt

SEQ ID NO: 452699 - DNA, 25 bp, Mus musculus
gaccaggatggtttacagtttcttt

SEQ ID NO: 452700 - DNA, 25 bp, Mus musculus
gaccaggattctacaggctccagat

SEQ ID NO: 452701 - DNA, 25 bp, Mus musculus
gaccaggattcttcaggctccagat

SEQ ID NO: 452702 - DNA, 25 bp, Mus musculus
gaccaggcaaacattaactccacaa

SEQ ID NO: 452703 - DNA, 25 bp, Mus musculus
gaccaggcaaactttaactccacaa

SEQ ID NO: 452704 - DNA, 25 bp, Mus musculus
gaccaggcaagaaggctgcaggcca

SEQ ID NO: 452705 - DNA, 25 bp, Mus musculus
gaccaggcaagatggctgcaggcca

SEQ ID NO: 452706 - DNA, 25 bp, Mus musculus
gaccaggcacgacaaggttgccaat

SEQ ID NO: 452707 - DNA, 25 bp, Mus musculus
gaccaggcacgagaaggttgccaat

SEQ ID NO: 452708 - DNA, 25 bp, Mus musculus
gaccaggcagacaagagctatgttt

SEQ ID NO: 452709 - DNA, 25 bp, Mus musculus
gaccaggcagactagagctatgttt

SEQ ID NO: 452710 - DNA, 25 bp, Mus musculus
gaccaggcagccattagaactttag

SEQ ID NO: 452711 - DNA, 25 bp, Mus musculus
gaccaggcagcctttagaactttag

SEQ ID NO: 452712 - DNA, 25 bp, Mus musculus
gaccaggcatctagaaagctttgac

SEQ ID NO: 452713 - DNA, 25 bp, Mus musculus
gaccaggcatcttgaaagctttgac

SEQ ID NO: 452714 - DNA, 25 bp, Mus musculus
gaccaggcatttcatgttccatcaa

SEQ ID NO: 452715 - DNA, 25 bp, Mus musculus
gaccaggcatttgatgttccatcaa

SEQ ID NO: 452716 - DNA, 25 bp, Mus musculus
gaccaggccagaacttcagcagatt

SEQ ID NO: 452717 - DNA, 25 bp, Mus musculus
gaccaggccagatcttcagcagatt

SEQ ID NO: 452718 - DNA, 25 bp, Mus musculus
gaccaggccagcatcaaacttgaaa

SEQ ID NO: 452719 - DNA, 25 bp, Mus musculus
gaccaggccagcttcaaacttgaaa

SEQ ID NO: 452720 - DNA, 25 bp, Mus musculus
gaccaggccatgaagctgggatgct

SEQ ID NO: 452721 - DNA, 25 bp, Mus musculus
gaccaggccatgtagctgggatgct

SEQ ID NO: 452722 - DNA, 25 bp, Mus musculus
gaccaggcctggcttgacgccaaga

SEQ ID NO: 452723 - DNA, 25 bp, Mus musculus
gaccaggcctgggttgacgccaaga

SEQ ID NO: 452724 - DNA, 25 bp, Mus musculus
gaccaggctaccatggacacatcag

SEQ ID NO: 452725 - DNA, 25 bp, Mus musculus
gaccaggctaccttggacacatcag

SEQ ID NO: 452726 - DNA, 25 bp, Mus musculus
gaccaggctcacatggtttgtacaa

SEQ ID NO: 452727 - DNA, 25 bp, Mus musculus
gaccaggctcacttggtttgtacaa

SEQ ID NO: 452728 - DNA, 25 bp, Mus musculus
gaccaggctggaaatattgctagag

SEQ ID NO: 452729 - DNA, 25 bp, Mus musculus
gaccaggctggaccttgcctactat

SEQ ID NO: 452730 - DNA, 25 bp, Mus musculus
gaccaggctggagcttgcctactat

SEQ ID NO: 452731 - DNA, 25 bp, Mus musculus
gaccaggctggatatattgctagag

SEQ ID NO: 452732 - DNA, 25 bp, Mus musculus
gaccaggctggcaggttccatgtaa

SEQ ID NO: 452733 - DNA, 25 bp, Mus musculus
gaccaggctggctggttccatgtaa

SEQ ID NO: 452734 - DNA, 25 bp, Mus musculus
gaccaggctgggactttccactaac

SEQ ID NO: 452735 - DNA, 25 bp, Mus musculus
gaccaggctgggtctttccactaac

SEQ ID NO: 452736 - DNA, 25 bp, Mus musculus
gaccaggctggtatacatactgagt

SEQ ID NO: 452737 - DNA, 25 bp, Mus musculus
gaccaggctggtttacatactgagt

SEQ ID NO: 452738 - DNA, 25 bp, Mus musculus
gaccaggctgtccaactcataaaaa

SEQ ID NO: 452739 - DNA, 25 bp, Mus musculus
gaccaggctgtcgaactcataaaaa

SEQ ID NO: 452740 - DNA, 25 bp, Mus musculus
gaccaggctgttcgcttagaaggca

SEQ ID NO: 452741 - DNA, 25 bp, Mus musculus
gaccaggctgttggcttagaaggca

SEQ ID NO: 452742 - DNA, 25 bp, Mus musculus
gaccaggcttctaatgagtctgcat

SEQ ID NO: 452743 - DNA, 25 bp, Mus musculus
gaccaggcttcttatgagtctgcat

SEQ ID NO: 452744 - DNA, 25 bp, Mus musculus
gaccaggctttcagggttgccaagg

SEQ ID NO: 452745 - DNA, 25 bp, Mus musculus
gaccaggctttcatcagcaaacatg

SEQ ID NO: 452746 - DNA, 25 bp, Mus musculus
gaccaggctttcctggaattctgtg

SEQ ID NO: 452747 - DNA, 25 bp, Mus musculus
gaccaggctttcgtggaattctgtg

SEQ ID NO: 452748 - DNA, 25 bp, Mus musculus
gaccaggctttctgggttgccaagg

SEQ ID NO: 452749 - DNA, 25 bp, Mus musculus
gaccaggctttcttcagcaaacatg

SEQ ID NO: 452750 - DNA, 25 bp, Mus musculus
gaccagggacccctaatttatgatc

SEQ ID NO: 452751 - DNA, 25 bp, Mus musculus
gaccagggacccgtaatttatgatc

SEQ ID NO: 452752 - DNA, 25 bp, Mus musculus
gaccagggatcacgctaactcttga

SEQ ID NO: 452753 - DNA, 25 bp, Mus musculus
gaccagggatcaggctaactcttga

SEQ ID NO: 452754 - DNA, 25 bp, Mus musculus
gaccagggatgacacccagctctga

SEQ ID NO: 452755 - DNA, 25 bp, Mus musculus
gaccagggatgagacccagctctga

SEQ ID NO: 452756 - DNA, 25 bp, Mus musculus
gaccagggcaccaacggctgtgaga

SEQ ID NO: 452757 - DNA, 25 bp, Mus musculus
gaccagggcacccagcattagctac

SEQ ID NO: 452758 - DNA, 25 bp, Mus musculus
gaccagggcaccgagcattagctac

SEQ ID NO: 452759 - DNA, 25 bp, Mus musculus
gaccagggcacctacggctgtgaga

SEQ ID NO: 452760 - DNA, 25 bp, Mus musculus
gaccagggcaggaatccttgatcag

SEQ ID NO: 452761 - DNA, 25 bp, Mus musculus
gaccagggcaggtatccttgatcag

SEQ ID NO: 452762 - DNA, 25 bp, Mus musculus
gaccagggccgacaggaacaccaga

SEQ ID NO: 452763 - DNA, 25 bp, Mus musculus
gaccagggccgagaggaacaccaga

SEQ ID NO: 452764 - DNA, 25 bp, Mus musculus
gaccagggcgaacctctgtgcacag

SEQ ID NO: 452765 - DNA, 25 bp, Mus musculus
gaccagggcgaagctctgtgcacag

SEQ ID NO: 452766 - DNA, 25 bp, Mus musculus
gaccagggtcagatctgagtggcaa

SEQ ID NO: 452767 - DNA, 25 bp, Mus musculus
gaccagggtcagttctgagtggcaa

SEQ ID NO: 452768 - DNA, 25 bp, Mus musculus
gaccagggtctacacgagcttgagt

SEQ ID NO: 452769 - DNA, 25 bp, Mus musculus
gaccagggtctagacgagcttgagt

SEQ ID NO: 452770 - DNA, 25 bp, Mus musculus
gaccagggtgatattctgtcttctt

SEQ ID NO: 452771 - DNA, 25 bp, Mus musculus
gaccagggtgattttctgtcttctt

SEQ ID NO: 452772 - DNA, 25 bp, Mus musculus
gaccagggtgtcatacaggagtacg

SEQ ID NO: 452773 - DNA, 25 bp, Mus musculus
gaccagggtgtcttacaggagtacg

SEQ ID NO: 452774 - DNA, 25 bp, Mus musculus
gaccaggtaatgagcactttttctt

SEQ ID NO: 452775 - DNA, 25 bp, Mus musculus
gaccaggtaatgtgcactttttctt

SEQ ID NO: 452776 - DNA, 25 bp, Mus musculus
gaccaggtatttaagtgatacatcg

SEQ ID NO: 452777 - DNA, 25 bp, Mus musculus
gaccaggtattttagtgatacatcg

SEQ ID NO: 452778 - DNA, 25 bp, Mus musculus
gaccaggtcaggatgtctgcagttg

SEQ ID NO: 452779 - DNA, 25 bp, Mus musculus
gaccaggtcaggttgtctgcagttg

SEQ ID NO: 452780 - DNA, 25 bp, Mus musculus
gaccaggtccacagtaccacataaa

SEQ ID NO: 452781 - DNA, 25 bp, Mus musculus
gaccaggtccactgtaccacataaa

SEQ ID NO: 452782 - DNA, 25 bp, Mus musculus
gaccaggtcctgatagttttgtgtg

SEQ ID NO: 452783 - DNA, 25 bp, Mus musculus
gaccaggtcctgttagttttgtgtg

SEQ ID NO: 452784 - DNA, 25 bp, Mus musculus
gaccaggtccttatgtacctcaatt

SEQ ID NO: 452785 - DNA, 25 bp, Mus musculus
gaccaggtccttttgtacctcaatt

SEQ ID NO: 452786 - DNA, 25 bp, Mus musculus
gaccaggtctcacgtatgtatgcaa

SEQ ID NO: 452787 - DNA, 25 bp, Mus musculus
gaccaggtctcactgttttttgaat

SEQ ID NO: 452788 - DNA, 25 bp, Mus musculus
gaccaggtctcaggtatgtatgcaa

SEQ ID NO: 452789 - DNA, 25 bp, Mus musculus
gaccaggtctcagtgttttttgaat

SEQ ID NO: 452790 - DNA, 25 bp, Mus musculus
gaccaggtctctctcatcaaagtga

SEQ ID NO: 452791 - DNA, 25 bp, Mus musculus
gaccaggtctctgtcatcaaagtga

SEQ ID NO: 452792 - DNA, 25 bp, Mus musculus
gaccaggtctggcaggcaaacacag

SEQ ID NO: 452793 - DNA, 25 bp, Mus musculus
gaccaggtctgggaggcaaacacag

SEQ ID NO: 452794 - DNA, 25 bp, Mus musculus
gaccaggtgaaccacagactgatct

SEQ ID NO: 452795 - DNA, 25 bp, Mus musculus
gaccaggtgaacgacagactgatct

SEQ ID NO: 452796 - DNA, 25 bp, Mus musculus
gaccaggtgaatcgctgttatctac

SEQ ID NO: 452797 - DNA, 25 bp, Mus musculus
gaccaggtgaatggctgttatctac

SEQ ID NO: 452798 - DNA, 25 bp, Mus musculus
gaccaggtggccaggcttctacatc

SEQ ID NO: 452799 - DNA, 25 bp, Mus musculus
gaccaggtggcctggcttctacatc

SEQ ID NO: 452800 - DNA, 25 bp, Mus musculus
gaccaggtgtggctttcacaggccc

SEQ ID NO: 452801 - DNA, 25 bp, Mus musculus
gaccaggtgtgggtttcacaggccc

SEQ ID NO: 452802 - DNA, 25 bp, Mus musculus
gaccaggttagtccacttgccctct

SEQ ID NO: 452803 - DNA, 25 bp, Mus musculus
gaccaggttagtgcacttgccctct

SEQ ID NO: 452804 - DNA, 25 bp, Mus musculus
gaccaggttggaattacattgctaa

SEQ ID NO: 452805 - DNA, 25 bp, Mus musculus
gaccaggttggatttacattgctaa

SEQ ID NO: 452806 - DNA, 25 bp, Mus musculus
gaccaggttgtcacctgcgacttca

SEQ ID NO: 452807 - DNA, 25 bp, Mus musculus
gaccaggttgtcagagactccactt

SEQ ID NO: 452808 - DNA, 25 bp, Mus musculus
gaccaggttgtctcctgcgacttca

SEQ ID NO: 452809 - DNA, 25 bp, Mus musculus
gaccaggttgtctgagactccactt

SEQ ID NO: 452810 - DNA, 25 bp, Mus musculus
gaccaggtttctaagccaaacctct

SEQ ID NO: 452811 - DNA, 25 bp, Mus musculus
gaccaggtttcttagccaaacctct

SEQ ID NO: 452812 - DNA, 25 bp, Mus musculus
gaccaggtttgaacgagggtcaact

SEQ ID NO: 452813 - DNA, 25 bp, Mus musculus
gaccaggtttgatcgagggtcaact

SEQ ID NO: 452814 - DNA, 25 bp, Mus musculus
gaccaggttttgcaccaaggcacat

SEQ ID NO: 452815 - DNA, 25 bp, Mus musculus
gaccaggttttggaccaaggcacat

SEQ ID NO: 452816 - DNA, 25 bp, Mus musculus
gaccaggtttttctcacggttgcag

SEQ ID NO: 452817 - DNA, 25 bp, Mus musculus
gaccaggtttttgtcacggttgcag

SEQ ID NO: 452818 - DNA, 25 bp, Mus musculus
gaccagtaagttctattcgctgttc

SEQ ID NO: 452819 - DNA, 25 bp, Mus musculus
gaccagtaagttgtattcgctgttc

SEQ ID NO: 452820 - DNA, 25 bp, Mus musculus
gaccagtacaacatgttgcaggaca

SEQ ID NO: 452821 - DNA, 25 bp, Mus musculus
gaccagtacaacttgttgcaggaca

SEQ ID NO: 452822 - DNA, 25 bp, Mus musculus
gaccagtacaggcttcccagctgac

SEQ ID NO: 452823 - DNA, 25 bp, Mus musculus
gaccagtacagggttcccagctgac

SEQ ID NO: 452824 - DNA, 25 bp, Mus musculus
gaccagtaccgtatgaccatctgga

SEQ ID NO: 452825 - DNA, 25 bp, Mus musculus
gaccagtaccgtttgaccatctgga

SEQ ID NO: 452826 - DNA, 25 bp, Mus musculus
gaccagtagagcaatgtccttgcct

SEQ ID NO: 452827 - DNA, 25 bp, Mus musculus
gaccagtagagctatgtccttgcct

SEQ ID NO: 452828 - DNA, 25 bp, Mus musculus
gaccagtagcaacacatccaccaag

SEQ ID NO: 452829 - DNA, 25 bp, Mus musculus
gaccagtagcaagacatccaccaag

SEQ ID NO: 452830 - DNA, 25 bp, Mus musculus
gaccagtagctaacacagtggcagt

SEQ ID NO: 452831 - DNA, 25 bp, Mus musculus
gaccagtagctatcacagtggcagt

SEQ ID NO: 452832 - DNA, 25 bp, Mus musculus
gaccagtagtctaaggctccttgag

SEQ ID NO: 452833 - DNA, 25 bp, Mus musculus
gaccagtagtcttaggctccttgag

SEQ ID NO: 452834 - DNA, 25 bp, Mus musculus
gaccagtagttcagttcatctcgta

SEQ ID NO: 452835 - DNA, 25 bp, Mus musculus
gaccagtagttctgttcatctcgta

SEQ ID NO: 452836 - DNA, 25 bp, Mus musculus
gaccagtatgttatcctcaatcagt

SEQ ID NO: 452837 - DNA, 25 bp, Mus musculus
gaccagtatgttttcctcaatcagt

SEQ ID NO: 452838 - DNA, 25 bp, Mus musculus
gaccagtattaaattcttgagaacc

SEQ ID NO: 452839 - DNA, 25 bp, Mus musculus
gaccagtattaatttcttgagaacc

SEQ ID NO: 452840 - DNA, 25 bp, Mus musculus
gaccagtattggctaaacacacccc

SEQ ID NO: 452841 - DNA, 25 bp, Mus musculus
gaccagtattgggtaaacacacccc

SEQ ID NO: 452842 - DNA, 25 bp, Mus musculus
gaccagtatttcaatttcatcaaga

SEQ ID NO: 452843 - DNA, 25 bp, Mus musculus
gaccagtatttctatttcatcaaga

SEQ ID NO: 452844 - DNA, 25 bp, Mus musculus
gaccagtcaggtcgagttttagctc

SEQ ID NO: 452845 - DNA, 25 bp, Mus musculus
gaccagtcaggtggagttttagctc

SEQ ID NO: 452846 - DNA, 25 bp, Mus musculus
gaccagtcatcaccctactgcagtt

SEQ ID NO: 452847 - DNA, 25 bp, Mus musculus
gaccagtcatcagcctactgcagtt

SEQ ID NO: 452848 - DNA, 25 bp, Mus musculus
gaccagtccactcacgtgagtgttt

SEQ ID NO: 452849 - DNA, 25 bp, Mus musculus
gaccagtccactgacgtgagtgttt

SEQ ID NO: 452850 - DNA, 25 bp, Mus musculus
gaccagtccattacagagatgctca

SEQ ID NO: 452851 - DNA, 25 bp, Mus musculus
gaccagtccatttcagagatgctca

SEQ ID NO: 452852 - DNA, 25 bp, Mus musculus
gaccagtccgagcaaccattttatt

SEQ ID NO: 452853 - DNA, 25 bp, Mus musculus
gaccagtccgaggaaccattttatt

SEQ ID NO: 452854 - DNA, 25 bp, Mus musculus
gaccagtcgaatagcctttgttaat

SEQ ID NO: 452855 - DNA, 25 bp, Mus musculus
gaccagtcgaattgcctttgttaat

SEQ ID NO: 452856 - DNA, 25 bp, Mus musculus
gaccagtcggtccatgagttgtgca

SEQ ID NO: 452857 - DNA, 25 bp, Mus musculus
gaccagtcggtcgatgagttgtgca

SEQ ID NO: 452858 - DNA, 25 bp, Mus musculus
gaccagtcgtgaaataacaaggcaa

SEQ ID NO: 452859 - DNA, 25 bp, Mus musculus
gaccagtcgtgatataacaaggcaa

SEQ ID NO: 452860 - DNA, 25 bp, Mus musculus
gaccagtctctgagctgtgcgtttg

SEQ ID NO: 452861 - DNA, 25 bp, Mus musculus
gaccagtctctgtgctgtgcgtttg

SEQ ID NO: 452862 - DNA, 25 bp, Mus musculus
gaccagtctgatcctaagggtagat

SEQ ID NO: 452863 - DNA, 25 bp, Mus musculus
gaccagtctgatgctaagggtagat

SEQ ID NO: 452864 - DNA, 25 bp, Mus musculus
gaccagtgaaacagacagtatgcta

SEQ ID NO: 452865 - DNA, 25 bp, Mus musculus
gaccagtgaaactgacagtatgcta

SEQ ID NO: 452866 - DNA, 25 bp, Mus musculus
gaccagtgaacccaagcatgacatt

SEQ ID NO: 452867 - DNA, 25 bp, Mus musculus
gaccagtgaaccgaagcatgacatt

SEQ ID NO: 452868 - DNA, 25 bp, Mus musculus
gaccagtgaagaagctctttctgaa

SEQ ID NO: 452869 - DNA, 25 bp, Mus musculus
gaccagtgaagatgctctttctgaa

SEQ ID NO: 452870 - DNA, 25 bp, Mus musculus
gaccagtgaagccaccgagatcatt

SEQ ID NO: 452871 - DNA, 25 bp, Mus musculus
gaccagtgaagcgaccgagatcatt

SEQ ID NO: 452872 - DNA, 25 bp, Mus musculus
gaccagtgacagaaacacgggctca

SEQ ID NO: 452873 - DNA, 25 bp, Mus musculus
gaccagtgacagtaacacgggctca

SEQ ID NO: 452874 - DNA, 25 bp, Mus musculus
gaccagtgagaacagcgggcaaacc

SEQ ID NO: 452875 - DNA, 25 bp, Mus musculus
gaccagtgagaagagcgggcaaacc

SEQ ID NO: 452876 - DNA, 25 bp, Mus musculus
gaccagtgcttgacttgccttaggc

SEQ ID NO: 452877 - DNA, 25 bp, Mus musculus
gaccagtgcttgtcttgccttaggc

SEQ ID NO: 452878 - DNA, 25 bp, Mus musculus
gaccagtggcagattctagcaccca

SEQ ID NO: 452879 - DNA, 25 bp, Mus musculus
gaccagtggcagtttctagcaccca

SEQ ID NO: 452880 - DNA, 25 bp, Mus musculus
gaccagtgggaaagattttcataca

SEQ ID NO: 452881 - DNA, 25 bp, Mus musculus
gaccagtgggaatgattttcataca

SEQ ID NO: 452882 - DNA, 25 bp, Mus musculus
gaccagtggtaacagacatatcttt

SEQ ID NO: 452883 - DNA, 25 bp, Mus musculus
gaccagtggtaagagacatatcttt

SEQ ID NO: 452884 - DNA, 25 bp, Mus musculus
gaccagtggttacaacagctgaact

SEQ ID NO: 452885 - DNA, 25 bp, Mus musculus
gaccagtggttagaacagctgaact

SEQ ID NO: 452886 - DNA, 25 bp, Mus musculus
gaccagtgtaagaacagtacctact

SEQ ID NO: 452887 - DNA, 25 bp, Mus musculus
gaccagtgtaagctttttatactga

SEQ ID NO: 452888 - DNA, 25 bp, Mus musculus
gaccagtgtaaggtttttatactga

SEQ ID NO: 452889 - DNA, 25 bp, Mus musculus
gaccagtgtaagtacagtacctact

SEQ ID NO: 452890 - DNA, 25 bp, Mus musculus
gaccagtgtatgacagctgacgaga

SEQ ID NO: 452891 - DNA, 25 bp, Mus musculus
gaccagtgtatgtcagctgacgaga

SEQ ID NO: 452892 - DNA, 25 bp, Mus musculus
gaccagtgtcatcattcaggagcag

SEQ ID NO: 452893 - DNA, 25 bp, Mus musculus
gaccagtgtcatgattcaggagcag

SEQ ID NO: 452894 - DNA, 25 bp, Mus musculus
gaccagtgtcctcagccaaggaaaa

SEQ ID NO: 452895 - DNA, 25 bp, Mus musculus
gaccagtgtcctgagccaaggaaaa

SEQ ID NO: 452896 - DNA, 25 bp, Mus musculus
gaccagtgtctacaatcacaggcaa

SEQ ID NO: 452897 - DNA, 25 bp, Mus musculus
gaccagtgtctagaatcacaggcaa

SEQ ID NO: 452898 - DNA, 25 bp, Mus musculus
gaccagtgtctgagtggtttgttca

SEQ ID NO: 452899 - DNA, 25 bp, Mus musculus
gaccagtgtctgtgtggtttgttca

SEQ ID NO: 452900 - DNA, 25 bp, Mus musculus
gaccagtgtggaacttcattcttgt

SEQ ID NO: 452901 - DNA, 25 bp, Mus musculus
gaccagtgtggatcttcattcttgt

SEQ ID NO: 452902 - DNA, 25 bp, Mus musculus
gaccagtgtgtcaagacgacgagaa

SEQ ID NO: 452903 - DNA, 25 bp, Mus musculus
gaccagtgtgtctagacgacgagaa

SEQ ID NO: 452904 - DNA, 25 bp, Mus musculus
gaccagtgttacactgttccagtgt

SEQ ID NO: 452905 - DNA, 25 bp, Mus musculus
gaccagtgttactctgttccagtgt

SEQ ID NO: 452906 - DNA, 25 bp, Mus musculus
gaccagtgttctattttgacctcta

SEQ ID NO: 452907 - DNA, 25 bp, Mus musculus
gaccagtgttcttttttgacctcta

SEQ ID NO: 452908 - DNA, 25 bp, Mus musculus
gaccagtgtttaacagcactgacta

SEQ ID NO: 452909 - DNA, 25 bp, Mus musculus
gaccagtgtttatcagcactgacta

SEQ ID NO: 452910 - DNA, 25 bp, Mus musculus
gaccagtgtttccatgatgcttctc

SEQ ID NO: 452911 - DNA, 25 bp, Mus musculus
gaccagtgtttcgatgatgcttctc

SEQ ID NO: 452912 - DNA, 25 bp, Mus musculus
gaccagtgtttgcacatcaacagca

SEQ ID NO: 452913 - DNA, 25 bp, Mus musculus
gaccagtgtttggacatcaacagca

SEQ ID NO: 452914 - DNA, 25 bp, Mus musculus
gaccagttacacctaagtgcttcta

SEQ ID NO: 452915 - DNA, 25 bp, Mus musculus
gaccagttacacgtaagtgcttcta

SEQ ID NO: 452916 - DNA, 25 bp, Mus musculus
gaccagttacatcaagagcaagctt

SEQ ID NO: 452917 - DNA, 25 bp, Mus musculus
gaccagttacatgaagagcaagctt

SEQ ID NO: 452918 - DNA, 25 bp, Mus musculus
gaccagttcaacagggtgtcccagc

SEQ ID NO: 452919 - DNA, 25 bp, Mus musculus
gaccagttcaactgggtgtcccagc

SEQ ID NO: 452920 - DNA, 25 bp, Mus musculus
gaccagttcaagctgcctcgggact

SEQ ID NO: 452921 - DNA, 25 bp, Mus musculus
gaccagttcaaggtgcctcgggact

SEQ ID NO: 452922 - DNA, 25 bp, Mus musculus
gaccagttcactatccaaaatcgtt

SEQ ID NO: 452923 - DNA, 25 bp, Mus musculus
gaccagttcactttccaaaatcgtt

SEQ ID NO: 452924 - DNA, 25 bp, Mus musculus
gaccagttccttcaaaatttcctca

SEQ ID NO: 452925 - DNA, 25 bp, Mus musculus
gaccagttccttgaaaatttcctca

SEQ ID NO: 452926 - DNA, 25 bp, Mus musculus
gaccagttctaacttcatttaaact

SEQ ID NO: 452927 - DNA, 25 bp, Mus musculus
gaccagttctaagttcatttaaact

SEQ ID NO: 452928 - DNA, 25 bp, Mus musculus
gaccagttctatctgttgatttgca

SEQ ID NO: 452929 - DNA, 25 bp, Mus musculus
gaccagttctatgtgttgatttgca

SEQ ID NO: 452930 - DNA, 25 bp, Mus musculus
gaccagttctggatttaactgtagt

SEQ ID NO: 452931 - DNA, 25 bp, Mus musculus
gaccagttctggttttaactgtagt

SEQ ID NO: 452932 - DNA, 25 bp, Mus musculus
gaccagttcttcaccaggtaagcat

SEQ ID NO: 452933 - DNA, 25 bp, Mus musculus
gaccagttcttctccaggtaagcat

SEQ ID NO: 452934 - DNA, 25 bp, Mus musculus
gaccagttgcaaaactgtacttcct

SEQ ID NO: 452935 - DNA, 25 bp, Mus musculus
gaccagttgcaatactgtacttcct

SEQ ID NO: 452936 - DNA, 25 bp, Mus musculus
gaccagttgcatctgtttctgccca

SEQ ID NO: 452937 - DNA, 25 bp, Mus musculus
gaccagttgcatgtgtttctgccca

SEQ ID NO: 452938 - DNA, 25 bp, Mus musculus
gaccagttgcggctatcgagtgatt

SEQ ID NO: 452939 - DNA, 25 bp, Mus musculus
gaccagttgcgggtatcgagtgatt

SEQ ID NO: 452940 - DNA, 25 bp, Mus musculus
gaccagttggcaatcagtggtgtaa

SEQ ID NO: 452941 - DNA, 25 bp, Mus musculus
gaccagttggcattcagtggtgtaa

SEQ ID NO: 452942 - DNA, 25 bp, Mus musculus
gaccagttgtctcttttaaacctgc

SEQ ID NO: 452943 - DNA, 25 bp, Mus musculus
gaccagttgtctgttttaaacctgc

SEQ ID NO: 452944 - DNA, 25 bp, Mus musculus
gaccagttgtgcagcaaggaacact

SEQ ID NO: 452945 - DNA, 25 bp, Mus musculus
gaccagttgtgctgcaaggaacact

SEQ ID NO: 452946 - DNA, 25 bp, Mus musculus
gaccagttgtttaagcttcattcca

SEQ ID NO: 452947 - DNA, 25 bp, Mus musculus
gaccagttgttttagcttcattcca

SEQ ID NO: 452948 - DNA, 25 bp, Mus musculus
gaccataaacgaagccgactggcga

SEQ ID NO: 452949 - DNA, 25 bp, Mus musculus
gaccataaacgatgccgactggcga

SEQ ID NO: 452950 - DNA, 25 bp, Mus musculus
gaccataaataccaaagcagcttca

SEQ ID NO: 452951 - DNA, 25 bp, Mus musculus
gaccataaatacgaaagcagcttca

SEQ ID NO: 452952 - DNA, 25 bp, Mus musculus
gaccataacagcacgactgagagtc

SEQ ID NO: 452953 - DNA, 25 bp, Mus musculus
gaccataacagctcgactgagagtc

SEQ ID NO: 452954 - DNA, 25 bp, Mus musculus
gaccataactatcaacacacatgtg

SEQ ID NO: 452955 - DNA, 25 bp, Mus musculus
gaccataactatgaacacacatgtg

SEQ ID NO: 452956 - DNA, 25 bp, Mus musculus
gaccataatactcctagcctcatcg

SEQ ID NO: 452957 - DNA, 25 bp, Mus musculus
gaccataatactgctagcctcatcg

SEQ ID NO: 452958 - DNA, 25 bp, Mus musculus
gaccataatttaatgactccagtgc

SEQ ID NO: 452959 - DNA, 25 bp, Mus musculus
gaccataatttattgactccagtgc

SEQ ID NO: 452960 - DNA, 25 bp, Mus musculus
gaccatacagagctaccggtaagcc

SEQ ID NO: 452961 - DNA, 25 bp, Mus musculus
gaccatacagaggtaccggtaagcc

SEQ ID NO: 452962 - DNA, 25 bp, Mus musculus
gaccatacagcaccaataaactttg

SEQ ID NO: 452963 - DNA, 25 bp, Mus musculus
gaccatacagcagcaataaactttg

SEQ ID NO: 452964 - DNA, 25 bp, Mus musculus
gaccatacataaaatcacttcatgc

SEQ ID NO: 452965 - DNA, 25 bp, Mus musculus
gaccatacataatatcacttcatgc

SEQ ID NO: 452966 - DNA, 25 bp, Mus musculus
gaccatacattcagtaacttctact

SEQ ID NO: 452967 - DNA, 25 bp, Mus musculus
gaccatacattctgtaacttctact

SEQ ID NO: 452968 - DNA, 25 bp, Mus musculus
gaccatacattgaacctatcagtta

SEQ ID NO: 452969 - DNA, 25 bp, Mus musculus
gaccatacattgtacctatcagtta

SEQ ID NO: 452970 - DNA, 25 bp, Mus musculus
gaccatacccatacctaaggcattt

SEQ ID NO: 452971 - DNA, 25 bp, Mus musculus
gaccatacccattcctaaggcattt

SEQ ID NO: 452972 - DNA, 25 bp, Mus musculus
gaccataccgtgagaaagggagctt

SEQ ID NO: 452973 - DNA, 25 bp, Mus musculus
gaccataccgtgtgaaagggagctt

SEQ ID NO: 452974 - DNA, 25 bp, Mus musculus
gaccatacttgaactgggtttctca

SEQ ID NO: 452975 - DNA, 25 bp, Mus musculus
gaccatacttgatctgggtttctca

SEQ ID NO: 452976 - DNA, 25 bp, Mus musculus
gaccatagacaaattcccatgaggt

SEQ ID NO: 452977 - DNA, 25 bp, Mus musculus
gaccatagacaatttcccatgaggt

SEQ ID NO: 452978 - DNA, 25 bp, Mus musculus
gaccatagactgatccatagactgt

SEQ ID NO: 452979 - DNA, 25 bp, Mus musculus
gaccatagactgttccatagactgt

SEQ ID NO: 452980 - DNA, 25 bp, Mus musculus
gaccataggagtcattatctgcata

SEQ ID NO: 452981 - DNA, 25 bp, Mus musculus
gaccataggagtgattatctgcata

SEQ ID NO: 452982 - DNA, 25 bp, Mus musculus
gaccataggattcatgatttctgat

SEQ ID NO: 452983 - DNA, 25 bp, Mus musculus
gaccataggattgatgatttctgat

SEQ ID NO: 452984 - DNA, 25 bp, Mus musculus
gaccatagtggtaaggaattgtttt

SEQ ID NO: 452985 - DNA, 25 bp, Mus musculus
gaccatagtggttaggaattgtttt

SEQ ID NO: 452986 - DNA, 25 bp, Mus musculus
gaccatagtttaagcggataccaaa

SEQ ID NO: 452987 - DNA, 25 bp, Mus musculus
gaccatagtttatgcggataccaaa

SEQ ID NO: 452988 - DNA, 25 bp, Mus musculus
gaccatatacatcttacttcctgaa

SEQ ID NO: 452989 - DNA, 25 bp, Mus musculus
gaccatatacatgttacttcctgaa

SEQ ID NO: 452990 - DNA, 25 bp, Mus musculus
gaccatatacggcgtattaaggttg

SEQ ID NO: 452991 - DNA, 25 bp, Mus musculus
gaccatatacggggtattaaggttg

SEQ ID NO: 452992 - DNA, 25 bp, Mus musculus
gaccatatagctaatcctgctgtta

SEQ ID NO: 452993 - DNA, 25 bp, Mus musculus
gaccatatagctcactgttgtggga

SEQ ID NO: 452994 - DNA, 25 bp, Mus musculus
gaccatatagctgactgttgtggga

SEQ ID NO: 452995 - DNA, 25 bp, Mus musculus
gaccatatagcttatcctgctgtta

SEQ ID NO: 452996 - DNA, 25 bp, Mus musculus
gaccatatattaattgcttttccct

SEQ ID NO: 452997 - DNA, 25 bp, Mus musculus
gaccatatattatttgcttttccct

SEQ ID NO: 452998 - DNA, 25 bp, Mus musculus
gaccatatctccaaaccattgggtt

SEQ ID NO: 452999 - DNA, 25 bp, Mus musculus
gaccatatctcctaaccattgggtt

SEQ ID NO: 453000 - DNA, 25 bp, Mus musculus
gaccatatgcctccatactatgcaa

SEQ ID NO: 453001 - DNA, 25 bp, Mus musculus
gaccatatgcctgcatactatgcaa

SEQ ID NO: 453002 - DNA, 25 bp, Mus musculus
gaccatatggttagagtgcctgcat

SEQ ID NO: 453003 - DNA, 25 bp, Mus musculus
gaccatatggtttgagtgcctgcat

SEQ ID NO: 453004 - DNA, 25 bp, Mus musculus
gaccatatgtagacttcatgtttta

SEQ ID NO: 453005 - DNA, 25 bp, Mus musculus
gaccatatgtagtcttcatgtttta

SEQ ID NO: 453006 - DNA, 25 bp, Mus musculus
gaccatattgatcagttgaagctca

SEQ ID NO: 453007 - DNA, 25 bp, Mus musculus
gaccatattgatgagttgaagctca

SEQ ID NO: 453008 - DNA, 25 bp, Mus musculus
gaccatattttcactacactcaatg

SEQ ID NO: 453009 - DNA, 25 bp, Mus musculus
gaccatattttcagctaaattgtag

SEQ ID NO: 453010 - DNA, 25 bp, Mus musculus
gaccatattttctctacactcaatg

SEQ ID NO: 453011 - DNA, 25 bp, Mus musculus
gaccatattttctgctaaattgtag

SEQ ID NO: 453012 - DNA, 25 bp, Mus musculus
gaccatcaaaccaggatctaactga

SEQ ID NO: 453013 - DNA, 25 bp, Mus musculus
gaccatcaaacctggatctaactga

SEQ ID NO: 453014 - DNA, 25 bp, Mus musculus
gaccatcaaggaattggacttacga

SEQ ID NO: 453015 - DNA, 25 bp, Mus musculus
gaccatcaaggatttggacttacga

SEQ ID NO: 453016 - DNA, 25 bp, Mus musculus
gaccatcaagtaactggacttccga

SEQ ID NO: 453017 - DNA, 25 bp, Mus musculus
gaccatcaagtatctggacttccga

SEQ ID NO: 453018 - DNA, 25 bp, Mus musculus
gaccatcacattcagtagggacttg

SEQ ID NO: 453019 - DNA, 25 bp, Mus musculus
gaccatcacattgagtagggacttg

SEQ ID NO: 453020 - DNA, 25 bp, Mus musculus
gaccatcaccctaagtccaagaaac

SEQ ID NO: 453021 - DNA, 25 bp, Mus musculus
gaccatcacccttagtccaagaaac

SEQ ID NO: 453022 - DNA, 25 bp, Mus musculus
gaccatcacgtcccgggagatccag

SEQ ID NO: 453023 - DNA, 25 bp, Mus musculus
gaccatcacgtcgcgggagatccag

SEQ ID NO: 453024 - DNA, 25 bp, Mus musculus
gaccatcagaaaacgcctggcagtg

SEQ ID NO: 453025 - DNA, 25 bp, Mus musculus
gaccatcagaaatcgcctggcagtg

SEQ ID NO: 453026 - DNA, 25 bp, Mus musculus
gaccatcagcaaccaggtcattgtt

SEQ ID NO: 453027 - DNA, 25 bp, Mus musculus
gaccatcagcaagcaggtcattgtt

SEQ ID NO: 453028 - DNA, 25 bp, Mus musculus
gaccatcagggaacgtgcagggcaa

SEQ ID NO: 453029 - DNA, 25 bp, Mus musculus
gaccatcagggatcgtgcagggcaa

SEQ ID NO: 453030 - DNA, 25 bp, Mus musculus
gaccatcatcaacaaggcagtgaag

SEQ ID NO: 453031 - DNA, 25 bp, Mus musculus
gaccatcatcaagaaggcagtgaag

SEQ ID NO: 453032 - DNA, 25 bp, Mus musculus
gaccatcatctcagggatcctggtg

SEQ ID NO: 453033 - DNA, 25 bp, Mus musculus
gaccatcatctctgggatcctggtg

SEQ ID NO: 453034 - DNA, 25 bp, Mus musculus
gaccatcatggaccacgtacgagac

SEQ ID NO: 453035 - DNA, 25 bp, Mus musculus
gaccatcatggagcacgtacgagac

SEQ ID NO: 453036 - DNA, 25 bp, Mus musculus
gaccatcatgggacagacacacaga

SEQ ID NO: 453037 - DNA, 25 bp, Mus musculus
gaccatcatgggtcagacacacaga

SEQ ID NO: 453038 - DNA, 25 bp, Mus musculus
gaccatcattgaaatcgaccctgcc

SEQ ID NO: 453039 - DNA, 25 bp, Mus musculus
gaccatcattgatatcgaccctgcc

SEQ ID NO: 453040 - DNA, 25 bp, Mus musculus
gaccatcattggagaatccctgaac

SEQ ID NO: 453041 - DNA, 25 bp, Mus musculus
gaccatcattggtgaatccctgaac

SEQ ID NO: 453042 - DNA, 25 bp, Mus musculus
gaccatccaaagcagatagactggg

SEQ ID NO: 453043 - DNA, 25 bp, Mus musculus
gaccatccaaaggagatagactggg

SEQ ID NO: 453044 - DNA, 25 bp, Mus musculus
gaccatccacaaagaagtcctgcgg

SEQ ID NO: 453045 - DNA, 25 bp, Mus musculus
gaccatccacaatgaagtcctgcgg

SEQ ID NO: 453046 - DNA, 25 bp, Mus musculus
gaccatcccaatcagagttgaccaa

SEQ ID NO: 453047 - DNA, 25 bp, Mus musculus
gaccatcccaatgagagttgaccaa

SEQ ID NO: 453048 - DNA, 25 bp, Mus musculus
gaccatcccctaatgcagatattgc

SEQ ID NO: 453049 - DNA, 25 bp, Mus musculus
gaccatcccctattgcagatattgc

SEQ ID NO: 453050 - DNA, 25 bp, Mus musculus
gaccatcccgagctgaatatcgggg

SEQ ID NO: 453051 - DNA, 25 bp, Mus musculus
gaccatcccgaggtgaatatcgggg

SEQ ID NO: 453052 - DNA, 25 bp, Mus musculus
gaccatccctaaaatttcatcaaat

SEQ ID NO: 453053 - DNA, 25 bp, Mus musculus
gaccatccctaatatttcatcaaat

SEQ ID NO: 453054 - DNA, 25 bp, Mus musculus
gaccatccgtggagacttctgcata

SEQ ID NO: 453055 - DNA, 25 bp, Mus musculus
gaccatccgtggtgacttctgcata

SEQ ID NO: 453056 - DNA, 25 bp, Mus musculus
gaccatccgtgtctctttccagctt

SEQ ID NO: 453057 - DNA, 25 bp, Mus musculus
gaccatccgtgtgtctttccagctt

SEQ ID NO: 453058 - DNA, 25 bp, Mus musculus
gaccatcctgttcccgagttggtgc

SEQ ID NO: 453059 - DNA, 25 bp, Mus musculus
gaccatcctgttcttgggcttatag

SEQ ID NO: 453060 - DNA, 25 bp, Mus musculus
gaccatcctgttgccgagttggtgc

SEQ ID NO: 453061 - DNA, 25 bp, Mus musculus
gaccatcctgttgttgggcttatag

SEQ ID NO: 453062 - DNA, 25 bp, Mus musculus
gaccatcgagctcacggcacactga

SEQ ID NO: 453063 - DNA, 25 bp, Mus musculus
gaccatcgagctgacggcacactga

SEQ ID NO: 453064 - DNA, 25 bp, Mus musculus
gaccatcgcacaccaggtgaagcat

SEQ ID NO: 453065 - DNA, 25 bp, Mus musculus
gaccatcgcacagcaggtgaagcat

SEQ ID NO: 453066 - DNA, 25 bp, Mus musculus
gaccatcggtctccatactatgtgg

SEQ ID NO: 453067 - DNA, 25 bp, Mus musculus
gaccatcggtctgcatactatgtgg

SEQ ID NO: 453068 - DNA, 25 bp, Mus musculus
gaccatctactcagtcatgggctat

SEQ ID NO: 453069 - DNA, 25 bp, Mus musculus
gaccatctactctgtcatgggctat

SEQ ID NO: 453070 - DNA, 25 bp, Mus musculus
gaccatctagttatggacctcagag

SEQ ID NO: 453071 - DNA, 25 bp, Mus musculus
gaccatctagttttggacctcagag

SEQ ID NO: 453072 - DNA, 25 bp, Mus musculus
gaccatctcagcagttgtatcaaag

SEQ ID NO: 453073 - DNA, 25 bp, Mus musculus
gaccatctcagctgttgtatcaaag

SEQ ID NO: 453074 - DNA, 25 bp, Mus musculus
gaccatctccaacgctcagattcag

SEQ ID NO: 453075 - DNA, 25 bp, Mus musculus
gaccatctccaaggctcagattcag

SEQ ID NO: 453076 - DNA, 25 bp, Mus musculus
gaccatctctggcagagatcctgct

SEQ ID NO: 453077 - DNA, 25 bp, Mus musculus
gaccatctctgggagagatcctgct

SEQ ID NO: 453078 - DNA, 25 bp, Mus musculus
gaccatctcttgaggaccccaggta

SEQ ID NO: 453079 - DNA, 25 bp, Mus musculus
gaccatctcttgtggaccccaggta

SEQ ID NO: 453080 - DNA, 25 bp, Mus musculus
gaccatctgaccatttagctcaagt

SEQ ID NO: 453081 - DNA, 25 bp, Mus musculus
gaccatctgaccttttagctcaagt

SEQ ID NO: 453082 - DNA, 25 bp, Mus musculus
gaccatctgctgctgttaccatagt

SEQ ID NO: 453083 - DNA, 25 bp, Mus musculus
gaccatctgctggtgttaccatagt

SEQ ID NO: 453084 - DNA, 25 bp, Mus musculus
gaccatctggacaagctaacaggct

SEQ ID NO: 453085 - DNA, 25 bp, Mus musculus
gaccatctggactagctaacaggct

SEQ ID NO: 453086 - DNA, 25 bp, Mus musculus
gaccatctgggtaggtgtatcacaa

SEQ ID NO: 453087 - DNA, 25 bp, Mus musculus
gaccatctgggttggtgtatcacaa

SEQ ID NO: 453088 - DNA, 25 bp, Mus musculus
gaccatctgtctatacaagggcatg

SEQ ID NO: 453089 - DNA, 25 bp, Mus musculus
gaccatctgtctttacaagggcatg

SEQ ID NO: 453090 - DNA, 25 bp, Mus musculus
gaccatctgtgtctggaagcctaca

SEQ ID NO: 453091 - DNA, 25 bp, Mus musculus
gaccatctgtgtgtggaagcctaca

SEQ ID NO: 453092 - DNA, 25 bp, Mus musculus
gaccatcttatcacagggacatctg

SEQ ID NO: 453093 - DNA, 25 bp, Mus musculus
gaccatcttatcctcaatgtcgagt

SEQ ID NO: 453094 - DNA, 25 bp, Mus musculus
gaccatcttatcgtcaatgtcgagt

SEQ ID NO: 453095 - DNA, 25 bp, Mus musculus
gaccatcttatctcagggacatctg

SEQ ID NO: 453096 - DNA, 25 bp, Mus musculus
gaccatcttcttccagccagcagga

SEQ ID NO: 453097 - DNA, 25 bp, Mus musculus
gaccatcttcttgcagccagcagga

SEQ ID NO: 453098 - DNA, 25 bp, Mus musculus
gaccatcttgcgctccatatgaaga

SEQ ID NO: 453099 - DNA, 25 bp, Mus musculus
gaccatcttgcggtccatatgaaga

SEQ ID NO: 453100 - DNA, 25 bp, Mus musculus
gaccatctttgacttgcattactgt

SEQ ID NO: 453101 - DNA, 25 bp, Mus musculus
gaccatctttgagttgcattactgt

SEQ ID NO: 453102 - DNA, 25 bp, Mus musculus
gaccatcttttgattatttgtactg

SEQ ID NO: 453103 - DNA, 25 bp, Mus musculus
gaccatcttttgtttatttgtactg

SEQ ID NO: 453104 - DNA, 25 bp, Mus musculus
gaccatgaagacctgcatgacctct

SEQ ID NO: 453105 - DNA, 25 bp, Mus musculus
gaccatgaagacgtgcatgacctct

SEQ ID NO: 453106 - DNA, 25 bp, Mus musculus
gaccatgaaggtactttccaatgct

SEQ ID NO: 453107 - DNA, 25 bp, Mus musculus
gaccatgaaggttctttccaatgct

SEQ ID NO: 453108 - DNA, 25 bp, Mus musculus
gaccatgacatcagagactcacggt

SEQ ID NO: 453109 - DNA, 25 bp, Mus musculus
gaccatgacatctgagactcacggt

SEQ ID NO: 453110 - DNA, 25 bp, Mus musculus
gaccatgactctactgggaggcagt

SEQ ID NO: 453111 - DNA, 25 bp, Mus musculus
gaccatgactcttctgggaggcagt

SEQ ID NO: 453112 - DNA, 25 bp, Mus musculus
gaccatgactgaagttcgagccaga

SEQ ID NO: 453113 - DNA, 25 bp, Mus musculus
gaccatgactgatgttcgagccaga

SEQ ID NO: 453114 - DNA, 25 bp, Mus musculus
gaccatgagattacccaagtggcat

SEQ ID NO: 453115 - DNA, 25 bp, Mus musculus
gaccatgagatttcccaagtggcat

SEQ ID NO: 453116 - DNA, 25 bp, Mus musculus
gaccatgaggacactgtggcactga

SEQ ID NO: 453117 - DNA, 25 bp, Mus musculus
gaccatgaggactctgtggcactga

SEQ ID NO: 453118 - DNA, 25 bp, Mus musculus
gaccatgaggctacgaaggaaccac

SEQ ID NO: 453119 - DNA, 25 bp, Mus musculus
gaccatgaggcttcgaaggaaccac

SEQ ID NO: 453120 - DNA, 25 bp, Mus musculus
gaccatgaggtcagtaaagtcacca

SEQ ID NO: 453121 - DNA, 25 bp, Mus musculus
gaccatgaggtctgtaaagtcacca

SEQ ID NO: 453122 - DNA, 25 bp, Mus musculus
gaccatgagtacagaggccactgat

SEQ ID NO: 453123 - DNA, 25 bp, Mus musculus
gaccatgagtactgaggccactgat

SEQ ID NO: 453124 - DNA, 25 bp, Mus musculus
gaccatgagtcaatccctcgtagaa

SEQ ID NO: 453125 - DNA, 25 bp, Mus musculus
gaccatgagtcattccctcgtagaa

SEQ ID NO: 453126 - DNA, 25 bp, Mus musculus
gaccatgagtctatgcctgagtgat

SEQ ID NO: 453127 - DNA, 25 bp, Mus musculus
gaccatgagtctttgcctgagtgat

SEQ ID NO: 453128 - DNA, 25 bp, Mus musculus
gaccatgagtgtcccactttcattg

SEQ ID NO: 453129 - DNA, 25 bp, Mus musculus
gaccatgagtgtgccactttcattg

SEQ ID NO: 453130 - DNA, 25 bp, Mus musculus
gaccatgatgacagctttgggctga

SEQ ID NO: 453131 - DNA, 25 bp, Mus musculus
gaccatgatgactgctttgggctga

SEQ ID NO: 453132 - DNA, 25 bp, Mus musculus
gaccatgatggcatgtgaactaact

SEQ ID NO: 453133 - DNA, 25 bp, Mus musculus
gaccatgatggcttgtgaactaact

SEQ ID NO: 453134 - DNA, 25 bp, Mus musculus
gaccatgatgtgaggtccgggccat

SEQ ID NO: 453135 - DNA, 25 bp, Mus musculus
gaccatgatgtgtggtccgggccat

SEQ ID NO: 453136 - DNA, 25 bp, Mus musculus
gaccatgattaaactgatttcctta

SEQ ID NO: 453137 - DNA, 25 bp, Mus musculus
gaccatgattaatctgatttcctta

SEQ ID NO: 453138 - DNA, 25 bp, Mus musculus
gaccatgattctatttcctaggatt

SEQ ID NO: 453139 - DNA, 25 bp, Mus musculus
gaccatgattctttttcctaggatt

SEQ ID NO: 453140 - DNA, 25 bp, Mus musculus
gaccatgattggagtcctgaccagt

SEQ ID NO: 453141 - DNA, 25 bp, Mus musculus
gaccatgattggtgtcctgaccagt

SEQ ID NO: 453142 - DNA, 25 bp, Mus musculus
gaccatgcaagactcgctgcgcttg

SEQ ID NO: 453143 - DNA, 25 bp, Mus musculus
gaccatgcaagactgtcaatgccga

SEQ ID NO: 453144 - DNA, 25 bp, Mus musculus
gaccatgcaagagtcgctgcgcttg

SEQ ID NO: 453145 - DNA, 25 bp, Mus musculus
gaccatgcaagagtgtcaatgccga

SEQ ID NO: 453146 - DNA, 25 bp, Mus musculus
gaccatgcagctaccaaagatgtct

SEQ ID NO: 453147 - DNA, 25 bp, Mus musculus
gaccatgcagcttccaaagatgtct

SEQ ID NO: 453148 - DNA, 25 bp, Mus musculus
gaccatgcatcgatcctgataagtg

SEQ ID NO: 453149 - DNA, 25 bp, Mus musculus
gaccatgcatcgttcctgataagtg

SEQ ID NO: 453150 - DNA, 25 bp, Mus musculus
gaccatgcccaaactgaaatacctg

SEQ ID NO: 453151 - DNA, 25 bp, Mus musculus
gaccatgcccaatctgaaatacctg

SEQ ID NO: 453152 - DNA, 25 bp, Mus musculus
gaccatgcccagaataatagtcttg

SEQ ID NO: 453153 - DNA, 25 bp, Mus musculus
gaccatgcccagtataatagtcttg

SEQ ID NO: 453154 - DNA, 25 bp, Mus musculus
gaccatgccccgaagttcacagatg

SEQ ID NO: 453155 - DNA, 25 bp, Mus musculus
gaccatgccccgtagttcacagatg

SEQ ID NO: 453156 - DNA, 25 bp, Mus musculus
gaccatgcctagctgcaatcacgtc

SEQ ID NO: 453157 - DNA, 25 bp, Mus musculus
gaccatgcctaggtgcaatcacgtc

SEQ ID NO: 453158 - DNA, 25 bp, Mus musculus
gaccatgcctcaataagtcctggag

SEQ ID NO: 453159 - DNA, 25 bp, Mus musculus
gaccatgcctcattaagtcctggag

SEQ ID NO: 453160 - DNA, 25 bp, Mus musculus
gaccatgctaccctgtgctacagag

SEQ ID NO: 453161 - DNA, 25 bp, Mus musculus
gaccatgctaccgtgtgctacagag

SEQ ID NO: 453162 - DNA, 25 bp, Mus musculus
gaccatgctatacacgccacaggag

SEQ ID NO: 453163 - DNA, 25 bp, Mus musculus
gaccatgctatagacgccacaggag

SEQ ID NO: 453164 - DNA, 25 bp, Mus musculus
gaccatgctcacaattgctgtctgg

SEQ ID NO: 453165 - DNA, 25 bp, Mus musculus
gaccatgctcactattgctgtctgg

SEQ ID NO: 453166 - DNA, 25 bp, Mus musculus
gaccatgctggacgacattcgtgaa

SEQ ID NO: 453167 - DNA, 25 bp, Mus musculus
gaccatgctggaggacattcgtgaa

SEQ ID NO: 453168 - DNA, 25 bp, Mus musculus
gaccatgctgtgcggccttcctgtg

SEQ ID NO: 453169 - DNA, 25 bp, Mus musculus
gaccatgctgtggggccttcctgtg

SEQ ID NO: 453170 - DNA, 25 bp, Mus musculus
gaccatgcttggatacatttccagt

SEQ ID NO: 453171 - DNA, 25 bp, Mus musculus
gaccatgcttggttacatttccagt

SEQ ID NO: 453172 - DNA, 25 bp, Mus musculus
gaccatgcttttcaattcttctgtg

SEQ ID NO: 453173 - DNA, 25 bp, Mus musculus
gaccatgcttttgaattcttctgtg

SEQ ID NO: 453174 - DNA, 25 bp, Mus musculus
gaccatggactaagtaaactgttgt

SEQ ID NO: 453175 - DNA, 25 bp, Mus musculus
gaccatggactatgtaaactgttgt

SEQ ID NO: 453176 - DNA, 25 bp, Mus musculus
gaccatggactgcagacctggcagc

SEQ ID NO: 453177 - DNA, 25 bp, Mus musculus
gaccatggactggagacctggcagc

SEQ ID NO: 453178 - DNA, 25 bp, Mus musculus
gaccatggagaaacccagagacctt

SEQ ID NO: 453179 - DNA, 25 bp, Mus musculus
gaccatggagaaagagacctctttc

SEQ ID NO: 453180 - DNA, 25 bp, Mus musculus
gaccatggagaatcccagagacctt

SEQ ID NO: 453181 - DNA, 25 bp, Mus musculus
gaccatggagaatgagacctctttc

SEQ ID NO: 453182 - DNA, 25 bp, Mus musculus
gaccatggaggaacacacttacttg

SEQ ID NO: 453183 - DNA, 25 bp, Mus musculus
gaccatggaggatcacacttacttg

SEQ ID NO: 453184 - DNA, 25 bp, Mus musculus
gaccatggcaaacggcttggaaaac

SEQ ID NO: 453185 - DNA, 25 bp, Mus musculus
gaccatggcaaagggcttggaaaac

SEQ ID NO: 453186 - DNA, 25 bp, Mus musculus
gaccatggccaaagtcttactgtgt

SEQ ID NO: 453187 - DNA, 25 bp, Mus musculus
gaccatggccaatgtcttactgtgt

SEQ ID NO: 453188 - DNA, 25 bp, Mus musculus
gaccatggcgtcattagggctctga

SEQ ID NO: 453189 - DNA, 25 bp, Mus musculus
gaccatggcgtctttagggctctga

SEQ ID NO: 453190 - DNA, 25 bp, Mus musculus
gaccatggctagcatacatctgtta

SEQ ID NO: 453191 - DNA, 25 bp, Mus musculus
gaccatggctaggatacatctgtta

SEQ ID NO: 453192 - DNA, 25 bp, Mus musculus
gaccatggctctaatgtgcacagaa

SEQ ID NO: 453193 - DNA, 25 bp, Mus musculus
gaccatggctctcctcacatttggg

SEQ ID NO: 453194 - DNA, 25 bp, Mus musculus
gaccatggctctgctcacatttggg

SEQ ID NO: 453195 - DNA, 25 bp, Mus musculus
gaccatggctcttatgtgcacagaa

SEQ ID NO: 453196 - DNA, 25 bp, Mus musculus
gaccatggcttaccacatgaggaga

SEQ ID NO: 453197 - DNA, 25 bp, Mus musculus
gaccatggcttagcacatgaggaga

SEQ ID NO: 453198 - DNA, 25 bp, Mus musculus
gaccatggctttaccccaaggaagt

SEQ ID NO: 453199 - DNA, 25 bp, Mus musculus
gaccatggcttttccccaaggaagt

SEQ ID NO: 453200 - DNA, 25 bp, Mus musculus
gaccatgggaatctcttgtgagcat

SEQ ID NO: 453201 - DNA, 25 bp, Mus musculus
gaccatgggaatgtcttgtgagcat

SEQ ID NO: 453202 - DNA, 25 bp, Mus musculus
gaccatgggagtctccgcagagttt

SEQ ID NO: 453203 - DNA, 25 bp, Mus musculus
gaccatgggagtgtccgcagagttt

SEQ ID NO: 453204 - DNA, 25 bp, Mus musculus
gaccatgggtcgcatgcagccagct

SEQ ID NO: 453205 - DNA, 25 bp, Mus musculus
gaccatgggtcggatgcagccagct

SEQ ID NO: 453206 - DNA, 25 bp, Mus musculus
gaccatggtatgaggcagacttgca

SEQ ID NO: 453207 - DNA, 25 bp, Mus musculus
gaccatggtatgcatgatcgttgta

SEQ ID NO: 453208 - DNA, 25 bp, Mus musculus
gaccatggtatggatgatcgttgta

SEQ ID NO: 453209 - DNA, 25 bp, Mus musculus
gaccatggtatgtggcagacttgca

SEQ ID NO: 453210 - DNA, 25 bp, Mus musculus
gaccatggtcatcagcatcggcctt

SEQ ID NO: 453211 - DNA, 25 bp, Mus musculus
gaccatggtcatgagcatcggcctt

SEQ ID NO: 453212 - DNA, 25 bp, Mus musculus
gaccatggtgctattgagttgctgt

SEQ ID NO: 453213 - DNA, 25 bp, Mus musculus
gaccatggtgcttttgagttgctgt

SEQ ID NO: 453214 - DNA, 25 bp, Mus musculus
gaccatggttgaattctattttctg

SEQ ID NO: 453215 - DNA, 25 bp, Mus musculus
gaccatggttgatttctattttctg

SEQ ID NO: 453216 - DNA, 25 bp, Mus musculus
gaccatgtaaaaacacgtcttaatt

SEQ ID NO: 453217 - DNA, 25 bp, Mus musculus
gaccatgtaaaatcacgtcttaatt

SEQ ID NO: 453218 - DNA, 25 bp, Mus musculus
gaccatgtacccagttatgttctgt

SEQ ID NO: 453219 - DNA, 25 bp, Mus musculus
gaccatgtaccctgttatgttctgt

SEQ ID NO: 453220 - DNA, 25 bp, Mus musculus
gaccatgtagccaccaccatcttgg

SEQ ID NO: 453221 - DNA, 25 bp, Mus musculus
gaccatgtagcctccaccatcttgg

SEQ ID NO: 453222 - DNA, 25 bp, Mus musculus
gaccatgtatacaccgtccagtgca

SEQ ID NO: 453223 - DNA, 25 bp, Mus musculus
gaccatgtatactccgtccagtgca

SEQ ID NO: 453224 - DNA, 25 bp, Mus musculus
gaccatgtattaacttttttattcc

SEQ ID NO: 453225 - DNA, 25 bp, Mus musculus
gaccatgtattatcttttttattcc

SEQ ID NO: 453226 - DNA, 25 bp, Mus musculus
gaccatgtcaaaagccaccaagttg

SEQ ID NO: 453227 - DNA, 25 bp, Mus musculus
gaccatgtcaaatgccaccaagttg

SEQ ID NO: 453228 - DNA, 25 bp, Mus musculus
gaccatgtcaatataggaaacccaa

SEQ ID NO: 453229 - DNA, 25 bp, Mus musculus
gaccatgtcaatttaggaaacccaa

SEQ ID NO: 453230 - DNA, 25 bp, Mus musculus
gaccatgtccatcctgggatggcaa

SEQ ID NO: 453231 - DNA, 25 bp, Mus musculus
gaccatgtccatgctgggatggcaa

SEQ ID NO: 453232 - DNA, 25 bp, Mus musculus
gaccatgtctgtatactgttggcct

SEQ ID NO: 453233 - DNA, 25 bp, Mus musculus
gaccatgtctgtttactgttggcct

SEQ ID NO: 453234 - DNA, 25 bp, Mus musculus
gaccatgtgattattgtttcttaaa

SEQ ID NO: 453235 - DNA, 25 bp, Mus musculus
gaccatgtgatttttgtttcttaaa

SEQ ID NO: 453236 - DNA, 25 bp, Mus musculus
gaccatgtgcaaatatctcacacag

SEQ ID NO: 453237 - DNA, 25 bp, Mus musculus
gaccatgtgcaattatctcacacag

SEQ ID NO: 453238 - DNA, 25 bp, Mus musculus
gaccatgtgcatcgagctgtatgcc

SEQ ID NO: 453239 - DNA, 25 bp, Mus musculus
gaccatgtgcatggagctgtatgcc

SEQ ID NO: 453240 - DNA, 25 bp, Mus musculus
gaccatgtgcttatggagtcagcca

SEQ ID NO: 453241 - DNA, 25 bp, Mus musculus
gaccatgtgcttttggagtcagcca

SEQ ID NO: 453242 - DNA, 25 bp, Mus musculus
gaccatgtggttcaactgctgacaa

SEQ ID NO: 453243 - DNA, 25 bp, Mus musculus
gaccatgtggttctcctatctggtt

SEQ ID NO: 453244 - DNA, 25 bp, Mus musculus
gaccatgtggttgaactgctgacaa

SEQ ID NO: 453245 - DNA, 25 bp, Mus musculus
gaccatgtggttgtcctatctggtt

SEQ ID NO: 453246 - DNA, 25 bp, Mus musculus
gaccatgtgtacattcctttcatag

SEQ ID NO: 453247 - DNA, 25 bp, Mus musculus
gaccatgtgtactttcctttcatag

SEQ ID NO: 453248 - DNA, 25 bp, Mus musculus
gaccatgtgtcacacgaacgtgggt

SEQ ID NO: 453249 - DNA, 25 bp, Mus musculus
gaccatgtgtcagacgaacgtgggt

SEQ ID NO: 453250 - DNA, 25 bp, Mus musculus
gaccatgtgtcccttgtgcaagaga

SEQ ID NO: 453251 - DNA, 25 bp, Mus musculus
gaccatgtgtccgttgtgcaagaga

SEQ ID NO: 453252 - DNA, 25 bp, Mus musculus
gaccatgtgtggacccagcatttag

SEQ ID NO: 453253 - DNA, 25 bp, Mus musculus
gaccatgtgtggtcccagcatttag

SEQ ID NO: 453254 - DNA, 25 bp, Mus musculus
gaccatgttgacattgaacttacac

SEQ ID NO: 453255 - DNA, 25 bp, Mus musculus
gaccatgttgactttgaacttacac

SEQ ID NO: 453256 - DNA, 25 bp, Mus musculus
gaccatgttgctcacttgatcagga

SEQ ID NO: 453257 - DNA, 25 bp, Mus musculus
gaccatgttgctctgtgattatctc

SEQ ID NO: 453258 - DNA, 25 bp, Mus musculus
gaccatgttgctgacttgatcagga

SEQ ID NO: 453259 - DNA, 25 bp, Mus musculus
gaccatgttgctgtgtgattatctc

SEQ ID NO: 453260 - DNA, 25 bp, Mus musculus
gaccatgttgttatccagcttttca

SEQ ID NO: 453261 - DNA, 25 bp, Mus musculus
gaccatgttgttttccagcttttca

SEQ ID NO: 453262 - DNA, 25 bp, Mus musculus
gaccatgtttcaccactgtcttaga

SEQ ID NO: 453263 - DNA, 25 bp, Mus musculus
gaccatgtttcagcactgtcttaga

SEQ ID NO: 453264 - DNA, 25 bp, Mus musculus
gaccatgtttgacttcttcacccat

SEQ ID NO: 453265 - DNA, 25 bp, Mus musculus
gaccatgtttgagttcttcacccat

SEQ ID NO: 453266 - DNA, 25 bp, Mus musculus
gaccattaaactagacccttctgct

SEQ ID NO: 453267 - DNA, 25 bp, Mus musculus
gaccattaaacttgacccttctgct

SEQ ID NO: 453268 - DNA, 25 bp, Mus musculus
gaccattaaatgctgttgtaccgtg

SEQ ID NO: 453269 - DNA, 25 bp, Mus musculus
gaccattaaatggtgttgtaccgtg

SEQ ID NO: 453270 - DNA, 25 bp, Mus musculus
gaccattacatcacaacagctgact

SEQ ID NO: 453271 - DNA, 25 bp, Mus musculus
gaccattacatctcaacagctgact

SEQ ID NO: 453272 - DNA, 25 bp, Mus musculus
gaccattaccagacatttttaatga

SEQ ID NO: 453273 - DNA, 25 bp, Mus musculus
gaccattaccagtcatttttaatga

SEQ ID NO: 453274 - DNA, 25 bp, Mus musculus
gaccattacccacttcatagatttt

SEQ ID NO: 453275 - DNA, 25 bp, Mus musculus
gaccattacccagttcatagatttt

SEQ ID NO: 453276 - DNA, 25 bp, Mus musculus
gaccattactacattcaggagactg

SEQ ID NO: 453277 - DNA, 25 bp, Mus musculus
gaccattactactttcaggagactg

SEQ ID NO: 453278 - DNA, 25 bp, Mus musculus
gaccattagcaaccatgttttacct

SEQ ID NO: 453279 - DNA, 25 bp, Mus musculus
gaccattagcaagcatgttttacct

SEQ ID NO: 453280 - DNA, 25 bp, Mus musculus
gaccattagttaagacctttgctgt

SEQ ID NO: 453281 - DNA, 25 bp, Mus musculus
gaccattagttatgacctttgctgt

SEQ ID NO: 453282 - DNA, 25 bp, Mus musculus
gaccattattctaccaaatgaggga

SEQ ID NO: 453283 - DNA, 25 bp, Mus musculus
gaccattattcttccaaatgaggga

SEQ ID NO: 453284 - DNA, 25 bp, Mus musculus
gaccattatttcctgtcagaataaa

SEQ ID NO: 453285 - DNA, 25 bp, Mus musculus
gaccattatttcgtgtcagaataaa

SEQ ID NO: 453286 - DNA, 25 bp, Mus musculus
gaccattcaagccaaagttgtatct

SEQ ID NO: 453287 - DNA, 25 bp, Mus musculus
gaccattcaagcgaaagttgtatct

SEQ ID NO: 453288 - DNA, 25 bp, Mus musculus
gaccattcagatcggatccttccga

SEQ ID NO: 453289 - DNA, 25 bp, Mus musculus
gaccattcagatgggatccttccga

SEQ ID NO: 453290 - DNA, 25 bp, Mus musculus
gaccattcaggacacgggcttgcaa

SEQ ID NO: 453291 - DNA, 25 bp, Mus musculus
gaccattcaggagacgggcttgcaa

SEQ ID NO: 453292 - DNA, 25 bp, Mus musculus
gaccattcagtcaatgaaggagcat

SEQ ID NO: 453293 - DNA, 25 bp, Mus musculus
gaccattcagtctatgaaggagcat

SEQ ID NO: 453294 - DNA, 25 bp, Mus musculus
gaccattccataagtctgatcctgc

SEQ ID NO: 453295 - DNA, 25 bp, Mus musculus
gaccattccatatgtctgatcctgc

SEQ ID NO: 453296 - DNA, 25 bp, Mus musculus
gaccattcctacaagcacaagttta

SEQ ID NO: 453297 - DNA, 25 bp, Mus musculus
gaccattcctactagcacaagttta

SEQ ID NO: 453298 - DNA, 25 bp, Mus musculus
gaccattccttaagtgcagttccac

SEQ ID NO: 453299 - DNA, 25 bp, Mus musculus
gaccattccttatgtgcagttccac

SEQ ID NO: 453300 - DNA, 25 bp, Mus musculus
gaccattctaacactaaaccaacaa

SEQ ID NO: 453301 - DNA, 25 bp, Mus musculus
gaccattctaactctaaaccaacaa

SEQ ID NO: 453302 - DNA, 25 bp, Mus musculus
gaccattctagtctactgccatttc

SEQ ID NO: 453303 - DNA, 25 bp, Mus musculus
gaccattctagtgtactgccatttc

SEQ ID NO: 453304 - DNA, 25 bp, Mus musculus
gaccattctcggcagctgacaaaga

SEQ ID NO: 453305 - DNA, 25 bp, Mus musculus
gaccattctcgggagctgacaaaga

SEQ ID NO: 453306 - DNA, 25 bp, Mus musculus
gaccattctggaagttcccacgcaa

SEQ ID NO: 453307 - DNA, 25 bp, Mus musculus
gaccattctggatgttcccacgcaa

SEQ ID NO: 453308 - DNA, 25 bp, Mus musculus
gaccattctgtcactgatggaacct

SEQ ID NO: 453309 - DNA, 25 bp, Mus musculus
gaccattctgtctctgatggaacct

SEQ ID NO: 453310 - DNA, 25 bp, Mus musculus
gaccattctgtgcacgagagccttg

SEQ ID NO: 453311 - DNA, 25 bp, Mus musculus
gaccattctgtggacgagagccttg

SEQ ID NO: 453312 - DNA, 25 bp, Mus musculus
gaccattgaagcattgggccaggct

SEQ ID NO: 453313 - DNA, 25 bp, Mus musculus
gaccattgaagctttgggccaggct

SEQ ID NO: 453314 - DNA, 25 bp, Mus musculus
gaccattgacctcaagagcggctca

SEQ ID NO: 453315 - DNA, 25 bp, Mus musculus
gaccattgacctgaagagcggctca

SEQ ID NO: 453316 - DNA, 25 bp, Mus musculus
gaccattgagcaaatttgtgtgtac

SEQ ID NO: 453317 - DNA, 25 bp, Mus musculus
gaccattgagcatatttgtgtgtac

SEQ ID NO: 453318 - DNA, 25 bp, Mus musculus
gaccattgatttaagcattgtttgc

SEQ ID NO: 453319 - DNA, 25 bp, Mus musculus
gaccattgattttagcattgtttgc

SEQ ID NO: 453320 - DNA, 25 bp, Mus musculus
gaccattgcatgaactgcttctaaa

SEQ ID NO: 453321 - DNA, 25 bp, Mus musculus
gaccattgcatgtactgcttctaaa

SEQ ID NO: 453322 - DNA, 25 bp, Mus musculus
gaccattgccaacaactagatccaa

SEQ ID NO: 453323 - DNA, 25 bp, Mus musculus
gaccattgccaagaactagatccaa

SEQ ID NO: 453324 - DNA, 25 bp, Mus musculus
gaccattgcccaagaagactgtcaa

SEQ ID NO: 453325 - DNA, 25 bp, Mus musculus
gaccattgcccatgaagactgtcaa

SEQ ID NO: 453326 - DNA, 25 bp, Mus musculus
gaccattgccctccggtaatcgtcg

SEQ ID NO: 453327 - DNA, 25 bp, Mus musculus
gaccattgccctgcggtaatcgtcg

SEQ ID NO: 453328 - DNA, 25 bp, Mus musculus
gaccattgctctcaacttgctgtga

SEQ ID NO: 453329 - DNA, 25 bp, Mus musculus
gaccattgctctcctgacattaaag

SEQ ID NO: 453330 - DNA, 25 bp, Mus musculus
gaccattgctctgaacttgctgtga

SEQ ID NO: 453331 - DNA, 25 bp, Mus musculus
gaccattgctctgctgacattaaag

SEQ ID NO: 453332 - DNA, 25 bp, Mus musculus
gaccattgcttcatggcctggtact

SEQ ID NO: 453333 - DNA, 25 bp, Mus musculus
gaccattgcttcttggcctggtact

SEQ ID NO: 453334 - DNA, 25 bp, Mus musculus
gaccattggcaaacttattgcaagg

SEQ ID NO: 453335 - DNA, 25 bp, Mus musculus
gaccattggcaatcttattgcaagg

SEQ ID NO: 453336 - DNA, 25 bp, Mus musculus
gaccattgggaacacatgaaccttt

SEQ ID NO: 453337 - DNA, 25 bp, Mus musculus
gaccattgggaagacatgaaccttt

SEQ ID NO: 453338 - DNA, 25 bp, Mus musculus
gaccattgggagaaggcctctgtct

SEQ ID NO: 453339 - DNA, 25 bp, Mus musculus
gaccattgggagtaggcctctgtct

SEQ ID NO: 453340 - DNA, 25 bp, Mus musculus
gaccattgggtaattgtagcagctg

SEQ ID NO: 453341 - DNA, 25 bp, Mus musculus
gaccattgggtatttgtagcagctg

SEQ ID NO: 453342 - DNA, 25 bp, Mus musculus
gaccattggtggcttcctgtttaat

SEQ ID NO: 453343 - DNA, 25 bp, Mus musculus
gaccattggtgggttcctgtttaat

SEQ ID NO: 453344 - DNA, 25 bp, Mus musculus
gaccattgtcttaattgtggctttg

SEQ ID NO: 453345 - DNA, 25 bp, Mus musculus
gaccattgtctttattgtggctttg

SEQ ID NO: 453346 - DNA, 25 bp, Mus musculus
gaccattgttttccatgttcatgta

SEQ ID NO: 453347 - DNA, 25 bp, Mus musculus
gaccattgttttccgaccatctaaa

SEQ ID NO: 453348 - DNA, 25 bp, Mus musculus
gaccattgttttgcatgttcatgta

SEQ ID NO: 453349 - DNA, 25 bp, Mus musculus
gaccattgttttgcgaccatctaaa

SEQ ID NO: 453350 - DNA, 25 bp, Mus musculus
gaccatttaaccactaaacgtgctt

SEQ ID NO: 453351 - DNA, 25 bp, Mus musculus
gaccatttaacctctaaacgtgctt

SEQ ID NO: 453352 - DNA, 25 bp, Mus musculus
gaccatttaatgagaccatccatcc

SEQ ID NO: 453353 - DNA, 25 bp, Mus musculus
gaccatttaatgtgaccatccatcc

SEQ ID NO: 453354 - DNA, 25 bp, Mus musculus
gaccatttagctctgtctctgataa

SEQ ID NO: 453355 - DNA, 25 bp, Mus musculus
gaccatttagctgtgtctctgataa

SEQ ID NO: 453356 - DNA, 25 bp, Mus musculus
gaccatttcaagatcaagcccagtt

SEQ ID NO: 453357 - DNA, 25 bp, Mus musculus
gaccatttcaagttcaagcccagtt

SEQ ID NO: 453358 - DNA, 25 bp, Mus musculus
gaccatttcctacatggtgtctata

SEQ ID NO: 453359 - DNA, 25 bp, Mus musculus
gaccatttcctagatggtgtctata

SEQ ID NO: 453360 - DNA, 25 bp, Mus musculus
gaccatttcctgagctttctggaga

SEQ ID NO: 453361 - DNA, 25 bp, Mus musculus
gaccatttcctgtgctttctggaga

SEQ ID NO: 453362 - DNA, 25 bp, Mus musculus
gaccatttctataagggacagcctc

SEQ ID NO: 453363 - DNA, 25 bp, Mus musculus
gaccatttctatactggatgtgcct

SEQ ID NO: 453364 - DNA, 25 bp, Mus musculus
gaccatttctattagggacagcctc

SEQ ID NO: 453365 - DNA, 25 bp, Mus musculus
gaccatttctattctggatgtgcct

SEQ ID NO: 453366 - DNA, 25 bp, Mus musculus
gaccatttgaaacatgcctgattga

SEQ ID NO: 453367 - DNA, 25 bp, Mus musculus
gaccatttgaaagatgcctgattga

SEQ ID NO: 453368 - DNA, 25 bp, Mus musculus
gaccatttgatgctagtgtttcctt

SEQ ID NO: 453369 - DNA, 25 bp, Mus musculus
gaccatttgatggtagtgtttcctt

SEQ ID NO: 453370 - DNA, 25 bp, Mus musculus
gaccatttgcagaggctccctcaat

SEQ ID NO: 453371 - DNA, 25 bp, Mus musculus
gaccatttgcagtggctccctcaat

SEQ ID NO: 453372 - DNA, 25 bp, Mus musculus
gaccatttgctcatttctagtttca

SEQ ID NO: 453373 - DNA, 25 bp, Mus musculus
gaccatttgctcttttctagtttca

SEQ ID NO: 453374 - DNA, 25 bp, Mus musculus
gaccatttgcttatggtcctcacga

SEQ ID NO: 453375 - DNA, 25 bp, Mus musculus
gaccatttgcttttggtcctcacga

SEQ ID NO: 453376 - DNA, 25 bp, Mus musculus
gaccatttgggccactttactatag

SEQ ID NO: 453377 - DNA, 25 bp, Mus musculus
gaccatttgggcgactttactatag

SEQ ID NO: 453378 - DNA, 25 bp, Mus musculus
gaccatttggttaatgaatattcta

SEQ ID NO: 453379 - DNA, 25 bp, Mus musculus
gaccatttggtttatgaatattcta

SEQ ID NO: 453380 - DNA, 25 bp, Mus musculus
gaccatttgtgtagtgttatatcca

SEQ ID NO: 453381 - DNA, 25 bp, Mus musculus
gaccatttgtgttgtgttatatcca

SEQ ID NO: 453382 - DNA, 25 bp, Mus musculus
gaccattttaacatccaggtggata

SEQ ID NO: 453383 - DNA, 25 bp, Mus musculus
gaccattttaacttccaggtggata

SEQ ID NO: 453384 - DNA, 25 bp, Mus musculus
gaccattttatcattacagttctgt

SEQ ID NO: 453385 - DNA, 25 bp, Mus musculus
gaccattttatctttacagttctgt

SEQ ID NO: 453386 - DNA, 25 bp, Mus musculus
gaccattttcagattgttcatactt

SEQ ID NO: 453387 - DNA, 25 bp, Mus musculus
gaccattttcagtttgttcatactt

SEQ ID NO: 453388 - DNA, 25 bp, Mus musculus
gaccattttcatcttcattctgtag

SEQ ID NO: 453389 - DNA, 25 bp, Mus musculus
gaccattttcatgttcattctgtag

SEQ ID NO: 453390 - DNA, 25 bp, Mus musculus
gaccattttctcaggtactcaggga

SEQ ID NO: 453391 - DNA, 25 bp, Mus musculus
gaccattttctctggtactcaggga

SEQ ID NO: 453392 - DNA, 25 bp, Mus musculus
gaccattttggacctttctcttgaa

SEQ ID NO: 453393 - DNA, 25 bp, Mus musculus
gaccattttggagctttctcttgaa

SEQ ID NO: 453394 - DNA, 25 bp, Mus musculus
gaccatttttacagcatggtgatgc

SEQ ID NO: 453395 - DNA, 25 bp, Mus musculus
gaccatttttactgcatggtgatgc

SEQ ID NO: 453396 - DNA, 25 bp, Mus musculus
gaccatttttggcattccgacagtt

SEQ ID NO: 453397 - DNA, 25 bp, Mus musculus
gaccatttttgggattccgacagtt

SEQ ID NO: 453398 - DNA, 25 bp, Mus musculus
gacccaaaacaactaacatggaata

SEQ ID NO: 453399 - DNA, 25 bp, Mus musculus
gacccaaaacaagtaacatggaata

SEQ ID NO: 453400 - DNA, 25 bp, Mus musculus
gacccaaaagataccagccagtgag

SEQ ID NO: 453401 - DNA, 25 bp, Mus musculus
gacccaaaagattccagccagtgag

SEQ ID NO: 453402 - DNA, 25 bp, Mus musculus
gacccaaaatgtagcttttcactac

SEQ ID NO: 453403 - DNA, 25 bp, Mus musculus
gacccaaaatgttgcttttcactac

SEQ ID NO: 453404 - DNA, 25 bp, Mus musculus
gacccaaagtttccacatgtcagtg

SEQ ID NO: 453405 - DNA, 25 bp, Mus musculus
gacccaaagtttgcacatgtcagtg

SEQ ID NO: 453406 - DNA, 25 bp, Mus musculus
gacccaaatgtccaaagctgtgtat

SEQ ID NO: 453407 - DNA, 25 bp, Mus musculus
gacccaaatgtcgaaagctgtgtat

SEQ ID NO: 453408 - DNA, 25 bp, Mus musculus
gacccaaattcactatgtatgtgta

SEQ ID NO: 453409 - DNA, 25 bp, Mus musculus
gacccaaattcagtatgtatgtgta

SEQ ID NO: 453410 - DNA, 25 bp, Mus musculus
gacccaacaaatctccaggtttctt

SEQ ID NO: 453411 - DNA, 25 bp, Mus musculus
gacccaacaaatgtccaggtttctt

SEQ ID NO: 453412 - DNA, 25 bp, Mus musculus
gacccaacagggattccggcttgat

SEQ ID NO: 453413 - DNA, 25 bp, Mus musculus
gacccaacagggtttccggcttgat

SEQ ID NO: 453414 - DNA, 25 bp, Mus musculus
gacccaacatgaattgcagctttct

SEQ ID NO: 453415 - DNA, 25 bp, Mus musculus
gacccaacatgatttgcagctttct

SEQ ID NO: 453416 - DNA, 25 bp, Mus musculus
gacccaacattgatgttcacatttt

SEQ ID NO: 453417 - DNA, 25 bp, Mus musculus
gacccaacattgttgttcacatttt

SEQ ID NO: 453418 - DNA, 25 bp, Mus musculus
gacccaacgcgaagcctgtggtgaa

SEQ ID NO: 453419 - DNA, 25 bp, Mus musculus
gacccaacgcgatgcctgtggtgaa

SEQ ID NO: 453420 - DNA, 25 bp, Mus musculus
gacccaacggtcagtaagagcctct

SEQ ID NO: 453421 - DNA, 25 bp, Mus musculus
gacccaacggtctgtaagagcctct

SEQ ID NO: 453422 - DNA, 25 bp, Mus musculus
gacccaactttgcacttactttcag

SEQ ID NO: 453423 - DNA, 25 bp, Mus musculus
gacccaactttgctcgccagttcta

SEQ ID NO: 453424 - DNA, 25 bp, Mus musculus
gacccaactttggacttactttcag

SEQ ID NO: 453425 - DNA, 25 bp, Mus musculus
gacccaactttggtcgccagttcta

SEQ ID NO: 453426 - DNA, 25 bp, Mus musculus
gacccaagaagtctagaaattctgt

SEQ ID NO: 453427 - DNA, 25 bp, Mus musculus
gacccaagaagtgtagaaattctgt

SEQ ID NO: 453428 - DNA, 25 bp, Mus musculus
gacccaagacccaaggctgtcatga

SEQ ID NO: 453429 - DNA, 25 bp, Mus musculus
gacccaagaccctaggctgtcatga

SEQ ID NO: 453430 - DNA, 25 bp, Mus musculus
gacccaagagataggcagacagctg

SEQ ID NO: 453431 - DNA, 25 bp, Mus musculus
gacccaagagattggcagacagctg

SEQ ID NO: 453432 - DNA, 25 bp, Mus musculus
gacccaagagcaagaaaccagtgtt

SEQ ID NO: 453433 - DNA, 25 bp, Mus musculus
gacccaagagcatgaaaccagtgtt

SEQ ID NO: 453434 - DNA, 25 bp, Mus musculus
gacccaagagctcggtttccagcct

SEQ ID NO: 453435 - DNA, 25 bp, Mus musculus
gacccaagagctgggtttccagcct

SEQ ID NO: 453436 - DNA, 25 bp, Mus musculus
gacccaagaggtcatcttaagaagt

SEQ ID NO: 453437 - DNA, 25 bp, Mus musculus
gacccaagaggtgatcttaagaagt

SEQ ID NO: 453438 - DNA, 25 bp, Mus musculus
gacccaagagtaagtctatctatct

SEQ ID NO: 453439 - DNA, 25 bp, Mus musculus
gacccaagagtatgtctatctatct

SEQ ID NO: 453440 - DNA, 25 bp, Mus musculus
gacccaaggccacttgatcacaggg

SEQ ID NO: 453441 - DNA, 25 bp, Mus musculus
gacccaaggccagttgatcacaggg

SEQ ID NO: 453442 - DNA, 25 bp, Mus musculus
gacccaaggctcaggccatgctcat

SEQ ID NO: 453443 - DNA, 25 bp, Mus musculus
gacccaaggctctggccatgctcat

SEQ ID NO: 453444 - DNA, 25 bp, Mus musculus
gacccaagggccagtgaaggctcga

SEQ ID NO: 453445 - DNA, 25 bp, Mus musculus
gacccaagggcctgtgaaggctcga

SEQ ID NO: 453446 - DNA, 25 bp, Mus musculus
gacccaagggctcgagcgaatccca

SEQ ID NO: 453447 - DNA, 25 bp, Mus musculus
gacccaagggctggagcgaatccca

SEQ ID NO: 453448 - DNA, 25 bp, Mus musculus
gacccaagtaacagagcggttgcat

SEQ ID NO: 453449 - DNA, 25 bp, Mus musculus
gacccaagtaactgagcggttgcat

SEQ ID NO: 453450 - DNA, 25 bp, Mus musculus
gacccaagtctgagttgacatggaa

SEQ ID NO: 453451 - DNA, 25 bp, Mus musculus
gacccaagtctgtgttgacatggaa

SEQ ID NO: 453452 - DNA, 25 bp, Mus musculus
gacccaagttttcaggagctaccaa

SEQ ID NO: 453453 - DNA, 25 bp, Mus musculus
gacccaagttttgaggagctaccaa

SEQ ID NO: 453454 - DNA, 25 bp, Mus musculus
gacccaatcactaaacgtttcttca

SEQ ID NO: 453455 - DNA, 25 bp, Mus musculus
gacccaatcacttaacgtttcttca

SEQ ID NO: 453456 - DNA, 25 bp, Mus musculus
gacccaatgactctggcaggtgcta

SEQ ID NO: 453457 - DNA, 25 bp, Mus musculus
gacccaatgactgtggcaggtgcta

SEQ ID NO: 453458 - DNA, 25 bp, Mus musculus
gacccaatggacatcaaaggccagt

SEQ ID NO: 453459 - DNA, 25 bp, Mus musculus
gacccaatggacttcaaaggccagt

SEQ ID NO: 453460 - DNA, 25 bp, Mus musculus
gacccaatgggcatccgtaccgatg

SEQ ID NO: 453461 - DNA, 25 bp, Mus musculus
gacccaatgggcttccgtaccgatg

SEQ ID NO: 453462 - DNA, 25 bp, Mus musculus
gacccaatgttcaggacgacgcaga

SEQ ID NO: 453463 - DNA, 25 bp, Mus musculus
gacccaatgttctggacgacgcaga

SEQ ID NO: 453464 - DNA, 25 bp, Mus musculus
gacccaattgatcgcacaggctaat

SEQ ID NO: 453465 - DNA, 25 bp, Mus musculus
gacccaattgatggcacaggctaat

SEQ ID NO: 453466 - DNA, 25 bp, Mus musculus
gacccaatttggatccctagaggac

SEQ ID NO: 453467 - DNA, 25 bp, Mus musculus
gacccaatttggttccctagaggac

SEQ ID NO: 453468 - DNA, 25 bp, Mus musculus
gacccacaaaggaaccctgtgagca

SEQ ID NO: 453469 - DNA, 25 bp, Mus musculus
gacccacaaaggtaccctgtgagca

SEQ ID NO: 453470 - DNA, 25 bp, Mus musculus
gacccacaaattagaccaaggtatg

SEQ ID NO: 453471 - DNA, 25 bp, Mus musculus
gacccacaaatttgaccaaggtatg

SEQ ID NO: 453472 - DNA, 25 bp, Mus musculus
gacccacaactcattacttataact

SEQ ID NO: 453473 - DNA, 25 bp, Mus musculus
gacccacaactctttacttataact

SEQ ID NO: 453474 - DNA, 25 bp, Mus musculus
gacccacaccccagagatgttggaa

SEQ ID NO: 453475 - DNA, 25 bp, Mus musculus
gacccacacccctgagatgttggaa

SEQ ID NO: 453476 - DNA, 25 bp, Mus musculus
gacccacactatattattgaactca

SEQ ID NO: 453477 - DNA, 25 bp, Mus musculus
gacccacactattttattgaactca

SEQ ID NO: 453478 - DNA, 25 bp, Mus musculus
gacccacagaatcttgagtgttttc

SEQ ID NO: 453479 - DNA, 25 bp, Mus musculus
gacccacagaatgttgagtgttttc

SEQ ID NO: 453480 - DNA, 25 bp, Mus musculus
gacccacagggactaactaatcagg

SEQ ID NO: 453481 - DNA, 25 bp, Mus musculus
gacccacagggagtaactaatcagg

SEQ ID NO: 453482 - DNA, 25 bp, Mus musculus
gacccacagtctcatagcaacaggc

SEQ ID NO: 453483 - DNA, 25 bp, Mus musculus
gacccacagtctgatagcaacaggc

SEQ ID NO: 453484 - DNA, 25 bp, Mus musculus
gacccacatgtcacaggctacagag

SEQ ID NO: 453485 - DNA, 25 bp, Mus musculus
gacccacatgtctcaggctacagag

SEQ ID NO: 453486 - DNA, 25 bp, Mus musculus
gacccacattaaacttctaaccagc

SEQ ID NO: 453487 - DNA, 25 bp, Mus musculus
gacccacattaatcttctaaccagc

SEQ ID NO: 453488 - DNA, 25 bp, Mus musculus
gacccacattctctagcatgaagac

SEQ ID NO: 453489 - DNA, 25 bp, Mus musculus
gacccacattctgtagcatgaagac

SEQ ID NO: 453490 - DNA, 25 bp, Mus musculus
gacccaccaataaaagtgtttcatg

SEQ ID NO: 453491 - DNA, 25 bp, Mus musculus
gacccaccaatataagtgtttcatg

SEQ ID NO: 453492 - DNA, 25 bp, Mus musculus
gacccaccagagaagtgcctgagct

SEQ ID NO: 453493 - DNA, 25 bp, Mus musculus
gacccaccagagtagtgcctgagct

SEQ ID NO: 453494 - DNA, 25 bp, Mus musculus
gacccaccaggaaaaaccaagtgag

SEQ ID NO: 453495 - DNA, 25 bp, Mus musculus
gacccaccaggataaaccaagtgag

SEQ ID NO: 453496 - DNA, 25 bp, Mus musculus
gacccaccagggactgtttacagag

SEQ ID NO: 453497 - DNA, 25 bp, Mus musculus
gacccaccagggtctgtttacagag

SEQ ID NO: 453498 - DNA, 25 bp, Mus musculus
gacccaccagtcactgagctacagt

SEQ ID NO: 453499 - DNA, 25 bp, Mus musculus
gacccaccagtctctgagctacagt

SEQ ID NO: 453500 - DNA, 25 bp, Mus musculus
gacccaccagtgctattcagagatt

SEQ ID NO: 453501 - DNA, 25 bp, Mus musculus
gacccaccagtggtattcagagatt

SEQ ID NO: 453502 - DNA, 25 bp, Mus musculus
gacccaccatccagagcagttcaaa

SEQ ID NO: 453503 - DNA, 25 bp, Mus musculus
gacccaccatcctgagcagttcaaa

SEQ ID NO: 453504 - DNA, 25 bp, Mus musculus
gacccaccattcaaggtttatagcc

SEQ ID NO: 453505 - DNA, 25 bp, Mus musculus
gacccaccattctaggtttatagcc

SEQ ID NO: 453506 - DNA, 25 bp, Mus musculus
gacccacccatcaggaatggtgact

SEQ ID NO: 453507 - DNA, 25 bp, Mus musculus
gacccacccatctggaatggtgact

SEQ ID NO: 453508 - DNA, 25 bp, Mus musculus
gacccaccgtagcattctctgagta

SEQ ID NO: 453509 - DNA, 25 bp, Mus musculus
gacccaccgtaggattctctgagta

SEQ ID NO: 453510 - DNA, 25 bp, Mus musculus
gacccaccgtgcacacttgtataat

SEQ ID NO: 453511 - DNA, 25 bp, Mus musculus
gacccaccgtgctcacttgtataat

SEQ ID NO: 453512 - DNA, 25 bp, Mus musculus
gacccacctactcactgatgaactg

SEQ ID NO: 453513 - DNA, 25 bp, Mus musculus
gacccacctactgactgatgaactg

SEQ ID NO: 453514 - DNA, 25 bp, Mus musculus
gacccacctcacaggatctagctgg

SEQ ID NO: 453515 - DNA, 25 bp, Mus musculus
gacccacctcactggatctagctgg

SEQ ID NO: 453516 - DNA, 25 bp, Mus musculus
gacccacctgatctctataccgaga

SEQ ID NO: 453517 - DNA, 25 bp, Mus musculus
gacccacctgatgtctataccgaga

SEQ ID NO: 453518 - DNA, 25 bp, Mus musculus
gacccacctgtgacatcaggctagg

SEQ ID NO: 453519 - DNA, 25 bp, Mus musculus
gacccacctgtgatgtagagcatca

SEQ ID NO: 453520 - DNA, 25 bp, Mus musculus
gacccacctgtgcatcaaccaagtg

SEQ ID NO: 453521 - DNA, 25 bp, Mus musculus
gacccacctgtggatcaaccaagtg

SEQ ID NO: 453522 - DNA, 25 bp, Mus musculus
gacccacctgtgtcatcaggctagg

SEQ ID NO: 453523 - DNA, 25 bp, Mus musculus
gacccacctgtgttgtagagcatca

SEQ ID NO: 453524 - DNA, 25 bp, Mus musculus
gacccaccttgtcagaagctattct

SEQ ID NO: 453525 - DNA, 25 bp, Mus musculus
gacccaccttgtgagaagctattct

SEQ ID NO: 453526 - DNA, 25 bp, Mus musculus
gacccacctttcataagagctagtt

SEQ ID NO: 453527 - DNA, 25 bp, Mus musculus
gacccacctttcttaagagctagtt

SEQ ID NO: 453528 - DNA, 25 bp, Mus musculus
gacccacgagttcttcatcacatgg

SEQ ID NO: 453529 - DNA, 25 bp, Mus musculus
gacccacgagttgttcatcacatgg

SEQ ID NO: 453530 - DNA, 25 bp, Mus musculus
gacccacgctggatcttcaaaagtg

SEQ ID NO: 453531 - DNA, 25 bp, Mus musculus
gacccacgctggttcttcaaaagtg

SEQ ID NO: 453532 - DNA, 25 bp, Mus musculus
gacccacggcccagcaggcgatgag

SEQ ID NO: 453533 - DNA, 25 bp, Mus musculus
gacccacggccctgcaggcgatgag

SEQ ID NO: 453534 - DNA, 25 bp, Mus musculus
gacccacggcctactacaaaggatt

SEQ ID NO: 453535 - DNA, 25 bp, Mus musculus
gacccacggccttctacaaaggatt

SEQ ID NO: 453536 - DNA, 25 bp, Mus musculus
gacccacgggatcttgtgctcacgt

SEQ ID NO: 453537 - DNA, 25 bp, Mus musculus
gacccacgggatgttgtgctcacgt

SEQ ID NO: 453538 - DNA, 25 bp, Mus musculus
gacccacgtctcctgaacttagaat

SEQ ID NO: 453539 - DNA, 25 bp, Mus musculus
gacccacgtctcgtgaacttagaat

SEQ ID NO: 453540 - DNA, 25 bp, Mus musculus
gacccactatgaaggagttatacgt

SEQ ID NO: 453541 - DNA, 25 bp, Mus musculus
gacccactatgatggagttatacgt

SEQ ID NO: 453542 - DNA, 25 bp, Mus musculus
gacccactctgaaattcacggtgct

SEQ ID NO: 453543 - DNA, 25 bp, Mus musculus
gacccactctgatattcacggtgct

SEQ ID NO: 453544 - DNA, 25 bp, Mus musculus
gacccactgaggaatagccagcatt

SEQ ID NO: 453545 - DNA, 25 bp, Mus musculus
gacccactgaggtatagccagcatt

SEQ ID NO: 453546 - DNA, 25 bp, Mus musculus
gacccactggacacttcacacagat

SEQ ID NO: 453547 - DNA, 25 bp, Mus musculus
gacccactggactcttcacacagat

SEQ ID NO: 453548 - DNA, 25 bp, Mus musculus
gacccactggtaactttttgagctg

SEQ ID NO: 453549 - DNA, 25 bp, Mus musculus
gacccactggtatctttttgagctg

SEQ ID NO: 453550 - DNA, 25 bp, Mus musculus
gacccactggtcacctatgagggat

SEQ ID NO: 453551 - DNA, 25 bp, Mus musculus
gacccactggtctcctatgagggat

SEQ ID NO: 453552 - DNA, 25 bp, Mus musculus
gacccactgtacactcgatcaaagg

SEQ ID NO: 453553 - DNA, 25 bp, Mus musculus
gacccactgtactctcgatcaaagg

SEQ ID NO: 453554 - DNA, 25 bp, Mus musculus
gacccactgttaaaggaataaagtt

SEQ ID NO: 453555 - DNA, 25 bp, Mus musculus
gacccactgttataggaataaagtt

SEQ ID NO: 453556 - DNA, 25 bp, Mus musculus
gacccacttctgaacctggaggaga

SEQ ID NO: 453557 - DNA, 25 bp, Mus musculus
gacccacttctgtacctggaggaga

SEQ ID NO: 453558 - DNA, 25 bp, Mus musculus
gacccacttgagcatcactcagaga

SEQ ID NO: 453559 - DNA, 25 bp, Mus musculus
gacccacttgaggatcactcagaga

SEQ ID NO: 453560 - DNA, 25 bp, Mus musculus
gacccacttgccagctgttggtgga

SEQ ID NO: 453561 - DNA, 25 bp, Mus musculus
gacccacttgcctgctgttggtgga

SEQ ID NO: 453562 - DNA, 25 bp, Mus musculus
gacccactttgcaccatgagtttgt

SEQ ID NO: 453563 - DNA, 25 bp, Mus musculus
gacccactttgctccatgagtttgt

SEQ ID NO: 453564 - DNA, 25 bp, Mus musculus
gacccagaaagcagcgggttctaat

SEQ ID NO: 453565 - DNA, 25 bp, Mus musculus
gacccagaaagctgcgggttctaat

SEQ ID NO: 453566 - DNA, 25 bp, Mus musculus
gacccagaacagaaaagcccttgct

SEQ ID NO: 453567 - DNA, 25 bp, Mus musculus
gacccagaacagtaaagcccttgct

SEQ ID NO: 453568 - DNA, 25 bp, Mus musculus
gacccagaacttctcattacaggag

SEQ ID NO: 453569 - DNA, 25 bp, Mus musculus
gacccagaacttgtcattacaggag

SEQ ID NO: 453570 - DNA, 25 bp, Mus musculus
gacccagaagagctgactcaaggac

SEQ ID NO: 453571 - DNA, 25 bp, Mus musculus
gacccagaagaggtgactcaaggac

SEQ ID NO: 453572 - DNA, 25 bp, Mus musculus
gacccagaagcaagtcctctatgaa

SEQ ID NO: 453573 - DNA, 25 bp, Mus musculus
gacccagaagcacggctgacagctg

SEQ ID NO: 453574 - DNA, 25 bp, Mus musculus
gacccagaagcacgtttatctcaat

SEQ ID NO: 453575 - DNA, 25 bp, Mus musculus
gacccagaagcagggctgacagctg

SEQ ID NO: 453576 - DNA, 25 bp, Mus musculus
gacccagaagcaggtttatctcaat

SEQ ID NO: 453577 - DNA, 25 bp, Mus musculus
gacccagaagcatgtcctctatgaa

SEQ ID NO: 453578 - DNA, 25 bp, Mus musculus
gacccagaaggtccagacactgtat

SEQ ID NO: 453579 - DNA, 25 bp, Mus musculus
gacccagaaggtgcagacactgtat

SEQ ID NO: 453580 - DNA, 25 bp, Mus musculus
gacccagaagtcactgaagtacgat

SEQ ID NO: 453581 - DNA, 25 bp, Mus musculus
gacccagaagtctctgaagtacgat

SEQ ID NO: 453582 - DNA, 25 bp, Mus musculus
gacccagaatctatatatcaacgga

SEQ ID NO: 453583 - DNA, 25 bp, Mus musculus
gacccagaatctttatatcaacgga

SEQ ID NO: 453584 - DNA, 25 bp, Mus musculus
gacccagacatgatagtgatcggca

SEQ ID NO: 453585 - DNA, 25 bp, Mus musculus
gacccagacatgttagtgatcggca

SEQ ID NO: 453586 - DNA, 25 bp, Mus musculus
gacccagaccctattcagatcctga

SEQ ID NO: 453587 - DNA, 25 bp, Mus musculus
gacccagacccttttcagatcctga

SEQ ID NO: 453588 - DNA, 25 bp, Mus musculus
gacccagacgttaaaagcacccagt

SEQ ID NO: 453589 - DNA, 25 bp, Mus musculus
gacccagacgtttaaagcacccagt

SEQ ID NO: 453590 - DNA, 25 bp, Mus musculus
gacccagactcacccacatggtaaa

SEQ ID NO: 453591 - DNA, 25 bp, Mus musculus
gacccagactcagccacatggtaaa

SEQ ID NO: 453592 - DNA, 25 bp, Mus musculus
gacccagagctgattaaacaatgca

SEQ ID NO: 453593 - DNA, 25 bp, Mus musculus
gacccagagctgtttaaacaatgca

SEQ ID NO: 453594 - DNA, 25 bp, Mus musculus
gacccagaggcgagagattgaactt

SEQ ID NO: 453595 - DNA, 25 bp, Mus musculus
gacccagaggcgtgagattgaactt

SEQ ID NO: 453596 - DNA, 25 bp, Mus musculus
gacccagaggctagttggcttcgca

SEQ ID NO: 453597 - DNA, 25 bp, Mus musculus
gacccagaggcttgttggcttcgca

SEQ ID NO: 453598 - DNA, 25 bp, Mus musculus
gacccagaggtgcatcttacctgga

SEQ ID NO: 453599 - DNA, 25 bp, Mus musculus
gacccagaggtggatcttacctgga

SEQ ID NO: 453600 - DNA, 25 bp, Mus musculus
gacccagagtccacattaggctgcc

SEQ ID NO: 453601 - DNA, 25 bp, Mus musculus
gacccagagtcctcattaggctgcc

SEQ ID NO: 453602 - DNA, 25 bp, Mus musculus
gacccagatcctaaatgctctagat

SEQ ID NO: 453603 - DNA, 25 bp, Mus musculus
gacccagatccttaatgctctagat

SEQ ID NO: 453604 - DNA, 25 bp, Mus musculus
gacccagatgcccactattgagaga

SEQ ID NO: 453605 - DNA, 25 bp, Mus musculus
gacccagatgccgactattgagaga

SEQ ID NO: 453606 - DNA, 25 bp, Mus musculus
gacccagatggcacgaacacattca

SEQ ID NO: 453607 - DNA, 25 bp, Mus musculus
gacccagatggctcgaacacattca

SEQ ID NO: 453608 - DNA, 25 bp, Mus musculus
gacccagcaaaactttctatcataa

SEQ ID NO: 453609 - DNA, 25 bp, Mus musculus
gacccagcaaaagtttctatcataa

SEQ ID NO: 453610 - DNA, 25 bp, Mus musculus
gacccagcaataaagaccaccagat

SEQ ID NO: 453611 - DNA, 25 bp, Mus musculus
gacccagcaatatagaccaccagat

SEQ ID NO: 453612 - DNA, 25 bp, Mus musculus
gacccagcagatcaaggcgctcgga

SEQ ID NO: 453613 - DNA, 25 bp, Mus musculus
gacccagcagatccggctccgagta

SEQ ID NO: 453614 - DNA, 25 bp, Mus musculus
gacccagcagatgaaggcgctcgga

SEQ ID NO: 453615 - DNA, 25 bp, Mus musculus
gacccagcagatgcggctccgagta

SEQ ID NO: 453616 - DNA, 25 bp, Mus musculus
gacccagcagctcattcaacataaa

SEQ ID NO: 453617 - DNA, 25 bp, Mus musculus
gacccagcagctgattcaacataaa

SEQ ID NO: 453618 - DNA, 25 bp, Mus musculus
gacccagcaggccatattagtcatt

SEQ ID NO: 453619 - DNA, 25 bp, Mus musculus
gacccagcaggcgatattagtcatt

SEQ ID NO: 453620 - DNA, 25 bp, Mus musculus
gacccagcaggtctacactttgaaa

SEQ ID NO: 453621 - DNA, 25 bp, Mus musculus
gacccagcaggtgtacactttgaaa

SEQ ID NO: 453622 - DNA, 25 bp, Mus musculus
gacccagcatccaagccctttgtcc

SEQ ID NO: 453623 - DNA, 25 bp, Mus musculus
gacccagcatcctagccctttgtcc

SEQ ID NO: 453624 - DNA, 25 bp, Mus musculus
gacccagccattctagtcagtgatg

SEQ ID NO: 453625 - DNA, 25 bp, Mus musculus
gacccagccattgtagtcagtgatg

SEQ ID NO: 453626 - DNA, 25 bp, Mus musculus
gacccagccccactgggactttcca

SEQ ID NO: 453627 - DNA, 25 bp, Mus musculus
gacccagccccagtgggactttcca

SEQ ID NO: 453628 - DNA, 25 bp, Mus musculus
gacccagcctggatggcgagattgt

SEQ ID NO: 453629 - DNA, 25 bp, Mus musculus
gacccagcctggctaagggaaccat

SEQ ID NO: 453630 - DNA, 25 bp, Mus musculus
gacccagcctgggtaagggaaccat

SEQ ID NO: 453631 - DNA, 25 bp, Mus musculus
gacccagcctggttggcgagattgt

SEQ ID NO: 453632 - DNA, 25 bp, Mus musculus
gacccagcgcagcagcctacaggtg

SEQ ID NO: 453633 - DNA, 25 bp, Mus musculus
gacccagcgcaggagcctacaggtg

SEQ ID NO: 453634 - DNA, 25 bp, Mus musculus
gacccagcgcgtccattgcaaggtg

SEQ ID NO: 453635 - DNA, 25 bp, Mus musculus
gacccagcgcgtgcattgcaaggtg

SEQ ID NO: 453636 - DNA, 25 bp, Mus musculus
gacccagcggaacatgtcctcaata

SEQ ID NO: 453637 - DNA, 25 bp, Mus musculus
gacccagcggaagatgtcctcaata

SEQ ID NO: 453638 - DNA, 25 bp, Mus musculus
gacccagcggcgacaagaacgtttt

SEQ ID NO: 453639 - DNA, 25 bp, Mus musculus
gacccagcggcgtcaagaacgtttt

SEQ ID NO: 453640 - DNA, 25 bp, Mus musculus
gacccagcggtactttgatagcttt

SEQ ID NO: 453641 - DNA, 25 bp, Mus musculus
gacccagcggtagtttgatagcttt

SEQ ID NO: 453642 - DNA, 25 bp, Mus musculus
gacccagctcaacgtgctcagtgtg

SEQ ID NO: 453643 - DNA, 25 bp, Mus musculus
gacccagctcaaggtgctcagtgtg

SEQ ID NO: 453644 - DNA, 25 bp, Mus musculus
gacccagctcagattgccgctcaga

SEQ ID NO: 453645 - DNA, 25 bp, Mus musculus
gacccagctcagtttgccgctcaga

SEQ ID NO: 453646 - DNA, 25 bp, Mus musculus
gacccagctctgaaaatttttgtgg

SEQ ID NO: 453647 - DNA, 25 bp, Mus musculus
gacccagctctgtaaatttttgtgg

SEQ ID NO: 453648 - DNA, 25 bp, Mus musculus
gacccagctgtcacagcagatggta

SEQ ID NO: 453649 - DNA, 25 bp, Mus musculus
gacccagctgtctcagcagatggta

SEQ ID NO: 453650 - DNA, 25 bp, Mus musculus
gacccagcttcccagagacatttag

SEQ ID NO: 453651 - DNA, 25 bp, Mus musculus
gacccagcttccgagagacatttag

SEQ ID NO: 453652 - DNA, 25 bp, Mus musculus
gacccagctttaatatgacccaatt

SEQ ID NO: 453653 - DNA, 25 bp, Mus musculus
gacccagctttattatgacccaatt

SEQ ID NO: 453654 - DNA, 25 bp, Mus musculus
gacccagctttgaagcgcaaggcca

SEQ ID NO: 453655 - DNA, 25 bp, Mus musculus
gacccagctttgtagcgcaaggcca

SEQ ID NO: 453656 - DNA, 25 bp, Mus musculus
gacccagcttttcgaagcttccgag

SEQ ID NO: 453657 - DNA, 25 bp, Mus musculus
gacccagcttttggaagcttccgag

SEQ ID NO: 453658 - DNA, 25 bp, Mus musculus
gacccaggaacacctcatccccaac

SEQ ID NO: 453659 - DNA, 25 bp, Mus musculus
gacccaggaacagctcatccccaac

SEQ ID NO: 453660 - DNA, 25 bp, Mus musculus
gacccaggaattataatcagccttt

SEQ ID NO: 453661 - DNA, 25 bp, Mus musculus
gacccaggaattttaatcagccttt

SEQ ID NO: 453662 - DNA, 25 bp, Mus musculus
gacccaggacctacaagatcaacta

SEQ ID NO: 453663 - DNA, 25 bp, Mus musculus
gacccaggaccttcaagatcaacta

SEQ ID NO: 453664 - DNA, 25 bp, Mus musculus
gacccaggactgaaggccggctcat

SEQ ID NO: 453665 - DNA, 25 bp, Mus musculus
gacccaggactgtaggccggctcat

SEQ ID NO: 453666 - DNA, 25 bp, Mus musculus
gacccaggagcaacactgagcattt

SEQ ID NO: 453667 - DNA, 25 bp, Mus musculus
gacccaggagcatcactgagcattt

SEQ ID NO: 453668 - DNA, 25 bp, Mus musculus
gacccaggagtacctgtgacagagt

SEQ ID NO: 453669 - DNA, 25 bp, Mus musculus
gacccaggagtagctgtgacagagt

SEQ ID NO: 453670 - DNA, 25 bp, Mus musculus
gacccaggatctagagcatgctctg

SEQ ID NO: 453671 - DNA, 25 bp, Mus musculus
gacccaggatcttgagcatgctctg

SEQ ID NO: 453672 - DNA, 25 bp, Mus musculus
gacccaggatgtcaaatagaattta

SEQ ID NO: 453673 - DNA, 25 bp, Mus musculus
gacccaggatgtgaaatagaattta

SEQ ID NO: 453674 - DNA, 25 bp, Mus musculus
gacccaggcaaaagacaataagaag

SEQ ID NO: 453675 - DNA, 25 bp, Mus musculus
gacccaggcaaatgacaataagaag

SEQ ID NO: 453676 - DNA, 25 bp, Mus musculus
gacccaggcagaagctggcacctat

SEQ ID NO: 453677 - DNA, 25 bp, Mus musculus
gacccaggcagatgctggcacctat

SEQ ID NO: 453678 - DNA, 25 bp, Mus musculus
gacccaggcagcaggctgcaagctc

SEQ ID NO: 453679 - DNA, 25 bp, Mus musculus
gacccaggcagctggctgcaagctc

SEQ ID NO: 453680 - DNA, 25 bp, Mus musculus
gacccaggcatacaattggcgcatg

SEQ ID NO: 453681 - DNA, 25 bp, Mus musculus
gacccaggcatagaattggcgcatg

SEQ ID NO: 453682 - DNA, 25 bp, Mus musculus
gacccaggccaccttttgttagagg

SEQ ID NO: 453683 - DNA, 25 bp, Mus musculus
gacccaggccacgttttgttagagg

SEQ ID NO: 453684 - DNA, 25 bp, Mus musculus
gacccaggctcaactgcagggagga

SEQ ID NO: 453685 - DNA, 25 bp, Mus musculus
gacccaggctcactttgtagtaccc

SEQ ID NO: 453686 - DNA, 25 bp, Mus musculus
gacccaggctcagtttgtagtaccc

SEQ ID NO: 453687 - DNA, 25 bp, Mus musculus
gacccaggctcatctgcagggagga

SEQ ID NO: 453688 - DNA, 25 bp, Mus musculus
gacccagggaagaacatcatagaat

SEQ ID NO: 453689 - DNA, 25 bp, Mus musculus
gacccagggaagtacatcatagaat

SEQ ID NO: 453690 - DNA, 25 bp, Mus musculus
gacccagggaccaaaatgaacgaca

SEQ ID NO: 453691 - DNA, 25 bp, Mus musculus
gacccagggacctaaatgaacgaca

SEQ ID NO: 453692 - DNA, 25 bp, Mus musculus
gacccagggatcagttatcgttcac

SEQ ID NO: 453693 - DNA, 25 bp, Mus musculus
gacccagggatctgttatcgttcac

SEQ ID NO: 453694 - DNA, 25 bp, Mus musculus
gacccagggcttcgatttgcttaac

SEQ ID NO: 453695 - DNA, 25 bp, Mus musculus
gacccagggcttggatttgcttaac

SEQ ID NO: 453696 - DNA, 25 bp, Mus musculus
gacccagggtgcaggccgcatatgt

SEQ ID NO: 453697 - DNA, 25 bp, Mus musculus
gacccagggtgctggccgcatatgt

SEQ ID NO: 453698 - DNA, 25 bp, Mus musculus
gacccagggtttatgctcagagaaa

SEQ ID NO: 453699 - DNA, 25 bp, Mus musculus
gacccagggtttttgctcagagaaa

SEQ ID NO: 453700 - DNA, 25 bp, Mus musculus
gacccaggtccgcagctggtaaaga

SEQ ID NO: 453701 - DNA, 25 bp, Mus musculus
gacccaggtccggagctggtaaaga

SEQ ID NO: 453702 - DNA, 25 bp, Mus musculus
gacccaggtgagatttatactgtcc

SEQ ID NO: 453703 - DNA, 25 bp, Mus musculus
gacccaggtgagttttatactgtcc

SEQ ID NO: 453704 - DNA, 25 bp, Mus musculus
gacccaggtggtagcaatcttcagt

SEQ ID NO: 453705 - DNA, 25 bp, Mus musculus
gacccaggtggttgcaatcttcagt

SEQ ID NO: 453706 - DNA, 25 bp, Mus musculus
gacccaggtgtcacatgtggtggca

SEQ ID NO: 453707 - DNA, 25 bp, Mus musculus
gacccaggtgtctcatgtggtggca

SEQ ID NO: 453708 - DNA, 25 bp, Mus musculus
gacccaggtgttcttataactgaac

SEQ ID NO: 453709 - DNA, 25 bp, Mus musculus
gacccaggtgttgttataactgaac

SEQ ID NO: 453710 - DNA, 25 bp, Mus musculus
gacccagtactgaagcccaggagta

SEQ ID NO: 453711 - DNA, 25 bp, Mus musculus
gacccagtactgtagcccaggagta

SEQ ID NO: 453712 - DNA, 25 bp, Mus musculus
gacccagtcatcatgattgtccaga

SEQ ID NO: 453713 - DNA, 25 bp, Mus musculus
gacccagtcatcttgattgtccaga

SEQ ID NO: 453714 - DNA, 25 bp, Mus musculus
gacccagtccaaaccttggatacct

SEQ ID NO: 453715 - DNA, 25 bp, Mus musculus
gacccagtccaatccttggatacct

SEQ ID NO: 453716 - DNA, 25 bp, Mus musculus
gacccagtccttcagggtgttttga

SEQ ID NO: 453717 - DNA, 25 bp, Mus musculus
gacccagtccttgagggtgttttga

SEQ ID NO: 453718 - DNA, 25 bp, Mus musculus
gacccagtcgcgagcagtttagttg

SEQ ID NO: 453719 - DNA, 25 bp, Mus musculus
gacccagtcgcgtgcagtttagttg

SEQ ID NO: 453720 - DNA, 25 bp, Mus musculus
gacccagtctgtattctgtcattaa

SEQ ID NO: 453721 - DNA, 25 bp, Mus musculus
gacccagtctgttttctgtcattaa

SEQ ID NO: 453722 - DNA, 25 bp, Mus musculus
gacccagtgagcagcgacctgctgc

SEQ ID NO: 453723 - DNA, 25 bp, Mus musculus
gacccagtgagctgcgacctgctgc

SEQ ID NO: 453724 - DNA, 25 bp, Mus musculus
gacccagtgcctatgtggcgcacag

SEQ ID NO: 453725 - DNA, 25 bp, Mus musculus
gacccagtgcctttgtggcgcacag

SEQ ID NO: 453726 - DNA, 25 bp, Mus musculus
gacccagtgcgacgctgaaaagcat

SEQ ID NO: 453727 - DNA, 25 bp, Mus musculus
gacccagtgcgaggctgaaaagcat

SEQ ID NO: 453728 - DNA, 25 bp, Mus musculus
gacccagtgctcagactttgatgaa

SEQ ID NO: 453729 - DNA, 25 bp, Mus musculus
gacccagtgctctgactttgatgaa

SEQ ID NO: 453730 - DNA, 25 bp, Mus musculus
gacccagtggacataagatccaaat

SEQ ID NO: 453731 - DNA, 25 bp, Mus musculus
gacccagtggacttaagatccaaat

SEQ ID NO: 453732 - DNA, 25 bp, Mus musculus
gacccagtggccagtctagaggttt

SEQ ID NO: 453733 - DNA, 25 bp, Mus musculus
gacccagtggcctgtctagaggttt

SEQ ID NO: 453734 - DNA, 25 bp, Mus musculus
gacccagtggcgacaatcacttgga

SEQ ID NO: 453735 - DNA, 25 bp, Mus musculus
gacccagtggcgtcaatcacttgga

SEQ ID NO: 453736 - DNA, 25 bp, Mus musculus
gacccagtgggcacttaccagagag

SEQ ID NO: 453737 - DNA, 25 bp, Mus musculus
gacccagtgggctcttaccagagag

SEQ ID NO: 453738 - DNA, 25 bp, Mus musculus
gacccagtgtcaatcagtattttgt

SEQ ID NO: 453739 - DNA, 25 bp, Mus musculus
gacccagtgtcattcagtattttgt

SEQ ID NO: 453740 - DNA, 25 bp, Mus musculus
gacccagtgtggcaagctgtcttca

SEQ ID NO: 453741 - DNA, 25 bp, Mus musculus
gacccagtgtgggaagctgtcttca

SEQ ID NO: 453742 - DNA, 25 bp, Mus musculus
gacccagttctgacctataagattt

SEQ ID NO: 453743 - DNA, 25 bp, Mus musculus
gacccagttctgctgagctgcgacg

SEQ ID NO: 453744 - DNA, 25 bp, Mus musculus
gacccagttctggtgagctgcgacg

SEQ ID NO: 453745 - DNA, 25 bp, Mus musculus
gacccagttctgtcctataagattt

SEQ ID NO: 453746 - DNA, 25 bp, Mus musculus
gacccagttgagatgatttagccct

SEQ ID NO: 453747 - DNA, 25 bp, Mus musculus
gacccagttgagttgatttagccct

SEQ ID NO: 453748 - DNA, 25 bp, Mus musculus
gacccagtttagcttaggagtaatg

SEQ ID NO: 453749 - DNA, 25 bp, Mus musculus
gacccagtttaggttaggagtaatg

SEQ ID NO: 453750 - DNA, 25 bp, Mus musculus
gacccagtttatcaggatctcttaa

SEQ ID NO: 453751 - DNA, 25 bp, Mus musculus
gacccagtttatgaggatctcttaa

SEQ ID NO: 453752 - DNA, 25 bp, Mus musculus
gacccagttttacctcctaatactg

SEQ ID NO: 453753 - DNA, 25 bp, Mus musculus
gacccagttttagctcctaatactg

SEQ ID NO: 453754 - DNA, 25 bp, Mus musculus
gacccagttttcagctctttgtata

SEQ ID NO: 453755 - DNA, 25 bp, Mus musculus
gacccagttttctgctctttgtata

SEQ ID NO: 453756 - DNA, 25 bp, Mus musculus
gacccataccataaagctctctgat

SEQ ID NO: 453757 - DNA, 25 bp, Mus musculus
gacccataccattaagctctctgat

SEQ ID NO: 453758 - DNA, 25 bp, Mus musculus
gacccatacttaaggctcaggcaat

SEQ ID NO: 453759 - DNA, 25 bp, Mus musculus
gacccatacttatggctcaggcaat

SEQ ID NO: 453760 - DNA, 25 bp, Mus musculus
gacccataggccaagaaacttccag

SEQ ID NO: 453761 - DNA, 25 bp, Mus musculus
gacccataggcctagaaacttccag

SEQ ID NO: 453762 - DNA, 25 bp, Mus musculus
gacccatagttcaggtgacctgctt

SEQ ID NO: 453763 - DNA, 25 bp, Mus musculus
gacccatagttctggtgacctgctt

SEQ ID NO: 453764 - DNA, 25 bp, Mus musculus
gacccatatattcaatattgggctg

SEQ ID NO: 453765 - DNA, 25 bp, Mus musculus
gacccatatattgaatattgggctg

SEQ ID NO: 453766 - DNA, 25 bp, Mus musculus
gacccatatgcaaagggacggacac

SEQ ID NO: 453767 - DNA, 25 bp, Mus musculus
gacccatatgcatagggacggacac

SEQ ID NO: 453768 - DNA, 25 bp, Mus musculus
gacccatatttgcatgatatcgatg

SEQ ID NO: 453769 - DNA, 25 bp, Mus musculus
gacccatatttggatgatatcgatg

SEQ ID NO: 453770 - DNA, 25 bp, Mus musculus
gacccatcatctaccatatcattaa

SEQ ID NO: 453771 - DNA, 25 bp, Mus musculus
gacccatcatcttccatatcattaa

SEQ ID NO: 453772 - DNA, 25 bp, Mus musculus
gacccatccaggctttacaaactgt

SEQ ID NO: 453773 - DNA, 25 bp, Mus musculus
gacccatccagggtttacaaactgt

SEQ ID NO: 453774 - DNA, 25 bp, Mus musculus
gacccatcccagcattgcattaact

SEQ ID NO: 453775 - DNA, 25 bp, Mus musculus
gacccatcccaggattgcattaact

SEQ ID NO: 453776 - DNA, 25 bp, Mus musculus
gacccatcgttcctgtacgcagaaa

SEQ ID NO: 453777 - DNA, 25 bp, Mus musculus
gacccatcgttcgtgtacgcagaaa

SEQ ID NO: 453778 - DNA, 25 bp, Mus musculus
gacccatctagtaggaactacccta

SEQ ID NO: 453779 - DNA, 25 bp, Mus musculus
gacccatctagttggaactacccta

SEQ ID NO: 453780 - DNA, 25 bp, Mus musculus
gacccatctgggacctttgtacagt

SEQ ID NO: 453781 - DNA, 25 bp, Mus musculus
gacccatctgggtcctttgtacagt

SEQ ID NO: 453782 - DNA, 25 bp, Mus musculus
gacccatctgttccgctaatcataa

SEQ ID NO: 453783 - DNA, 25 bp, Mus musculus
gacccatctgttgcgctaatcataa

SEQ ID NO: 453784 - DNA, 25 bp, Mus musculus
gacccatcttctaggtggtagcatg

SEQ ID NO: 453785 - DNA, 25 bp, Mus musculus
gacccatcttcttggtggtagcatg

SEQ ID NO: 453786 - DNA, 25 bp, Mus musculus
gacccatgaataacagttcctgtga

SEQ ID NO: 453787 - DNA, 25 bp, Mus musculus
gacccatgaatatcagttcctgtga

SEQ ID NO: 453788 - DNA, 25 bp, Mus musculus
gacccatgactgaacattaggtgga

SEQ ID NO: 453789 - DNA, 25 bp, Mus musculus
gacccatgactgtacattaggtgga

SEQ ID NO: 453790 - DNA, 25 bp, Mus musculus
gacccatgatagaaagctttgaact

SEQ ID NO: 453791 - DNA, 25 bp, Mus musculus
gacccatgatagtaagctttgaact

SEQ ID NO: 453792 - DNA, 25 bp, Mus musculus
gacccatgatggacgattcttaaga

SEQ ID NO: 453793 - DNA, 25 bp, Mus musculus
gacccatgatggtcgattcttaaga

SEQ ID NO: 453794 - DNA, 25 bp, Mus musculus
gacccatgctggattgtgtcatttg

SEQ ID NO: 453795 - DNA, 25 bp, Mus musculus
gacccatgctggtttgtgtcatttg

SEQ ID NO: 453796 - DNA, 25 bp, Mus musculus
gacccatggctactttgaatccttt

SEQ ID NO: 453797 - DNA, 25 bp, Mus musculus
gacccatggctagtttgaatccttt

SEQ ID NO: 453798 - DNA, 25 bp, Mus musculus
gacccatgggtgcaatgtgctgcct

SEQ ID NO: 453799 - DNA, 25 bp, Mus musculus
gacccatgggtggaatgtgctgcct

SEQ ID NO: 453800 - DNA, 25 bp, Mus musculus
gacccatggttcatctctgctgagt

SEQ ID NO: 453801 - DNA, 25 bp, Mus musculus
gacccatggttcttctctgctgagt

SEQ ID NO: 453802 - DNA, 25 bp, Mus musculus
gacccatgtaacattcttagtctca

SEQ ID NO: 453803 - DNA, 25 bp, Mus musculus
gacccatgtaactttcttagtctca

SEQ ID NO: 453804 - DNA, 25 bp, Mus musculus
gacccatgtaagatcctagcagtga

SEQ ID NO: 453805 - DNA, 25 bp, Mus musculus
gacccatgtaagttcctagcagtga

SEQ ID NO: 453806 - DNA, 25 bp, Mus musculus
gacccatgtggtatggtattctcca

SEQ ID NO: 453807 - DNA, 25 bp, Mus musculus
gacccatgtggtcaaaagagctgac

SEQ ID NO: 453808 - DNA, 25 bp, Mus musculus
gacccatgtggtgaaaagagctgac

SEQ ID NO: 453809 - DNA, 25 bp, Mus musculus
gacccatgtggtttggtattctcca

SEQ ID NO: 453810 - DNA, 25 bp, Mus musculus
gacccatgtgtcaatgtctttcata

SEQ ID NO: 453811 - DNA, 25 bp, Mus musculus
gacccatgtgtctatgtctttcata

SEQ ID NO: 453812 - DNA, 25 bp, Mus musculus
gacccatgttggcttctccatgctt

SEQ ID NO: 453813 - DNA, 25 bp, Mus musculus
gacccatgttgggttctccatgctt

SEQ ID NO: 453814 - DNA, 25 bp, Mus musculus
gacccattagagagctgagaccttt

SEQ ID NO: 453815 - DNA, 25 bp, Mus musculus
gacccattagagtgctgagaccttt

SEQ ID NO: 453816 - DNA, 25 bp, Mus musculus
gacccattagttatttcaggcacgt

SEQ ID NO: 453817 - DNA, 25 bp, Mus musculus
gacccattagttttttcaggcacgt

SEQ ID NO: 453818 - DNA, 25 bp, Mus musculus
gacccattctaaattccttcagtat

SEQ ID NO: 453819 - DNA, 25 bp, Mus musculus
gacccattctaatttccttcagtat

SEQ ID NO: 453820 - DNA, 25 bp, Mus musculus
gacccattgactccaggcattttaa

SEQ ID NO: 453821 - DNA, 25 bp, Mus musculus
gacccattgactgcaggcattttaa

SEQ ID NO: 453822 - DNA, 25 bp, Mus musculus
gacccattgatgagtcatagagcaa

SEQ ID NO: 453823 - DNA, 25 bp, Mus musculus
gacccattgatgtgtcatagagcaa

SEQ ID NO: 453824 - DNA, 25 bp, Mus musculus
gacccattgcatcgatatggacttt

SEQ ID NO: 453825 - DNA, 25 bp, Mus musculus
gacccattgcatggatatggacttt

SEQ ID NO: 453826 - DNA, 25 bp, Mus musculus
gacccattgctcctacattttagtt

SEQ ID NO: 453827 - DNA, 25 bp, Mus musculus
gacccattgctcgtacattttagtt

SEQ ID NO: 453828 - DNA, 25 bp, Mus musculus
gacccattggtcagttcctggaaaa

SEQ ID NO: 453829 - DNA, 25 bp, Mus musculus
gacccattggtctgttcctggaaaa

SEQ ID NO: 453830 - DNA, 25 bp, Mus musculus
gacccatttaaaagcctgattctga

SEQ ID NO: 453831 - DNA, 25 bp, Mus musculus
gacccatttaaatgcctgattctga

SEQ ID NO: 453832 - DNA, 25 bp, Mus musculus
gacccatttactcgcttctcggctt

SEQ ID NO: 453833 - DNA, 25 bp, Mus musculus
gacccatttactggcttctcggctt

SEQ ID NO: 453834 - DNA, 25 bp, Mus musculus
gacccatttctaaactcggctaact

SEQ ID NO: 453835 - DNA, 25 bp, Mus musculus
gacccatttctaacatccattccga

SEQ ID NO: 453836 - DNA, 25 bp, Mus musculus
gacccatttctatactcggctaact

SEQ ID NO: 453837 - DNA, 25 bp, Mus musculus
gacccatttctatcatccattccga

SEQ ID NO: 453838 - DNA, 25 bp, Mus musculus
gacccattttgaacagaatgttctc

SEQ ID NO: 453839 - DNA, 25 bp, Mus musculus
gacccattttgatcagaatgttctc

SEQ ID NO: 453840 - DNA, 25 bp, Mus musculus
gaccccaaaagccaggtggagccag

SEQ ID NO: 453841 - DNA, 25 bp, Mus musculus
gaccccaaaagcgaggtggagccag

SEQ ID NO: 453842 - DNA, 25 bp, Mus musculus
gaccccaaaatgcaggtttacaaag

SEQ ID NO: 453843 - DNA, 25 bp, Mus musculus
gaccccaaaatggaggtttacaaag

SEQ ID NO: 453844 - DNA, 25 bp, Mus musculus
gaccccaaatatacatcccattctt

SEQ ID NO: 453845 - DNA, 25 bp, Mus musculus
gaccccaaatattcatcccattctt

SEQ ID NO: 453846 - DNA, 25 bp, Mus musculus
gaccccaaatccctgttatctatta

SEQ ID NO: 453847 - DNA, 25 bp, Mus musculus
gaccccaaatccgtgttatctatta

SEQ ID NO: 453848 - DNA, 25 bp, Mus musculus
gaccccaaatggctgttacaagcag

SEQ ID NO: 453849 - DNA, 25 bp, Mus musculus
gaccccaaatgggtgttacaagcag

SEQ ID NO: 453850 - DNA, 25 bp, Mus musculus
gaccccaacacaacaagcgcaagag

SEQ ID NO: 453851 - DNA, 25 bp, Mus musculus
gaccccaacacatcaagcgcaagag

SEQ ID NO: 453852 - DNA, 25 bp, Mus musculus
gaccccaacagcactgtggagcagt

SEQ ID NO: 453853 - DNA, 25 bp, Mus musculus
gaccccaacagctctgtggagcagt

SEQ ID NO: 453854 - DNA, 25 bp, Mus musculus
gaccccaacatgacttgtgactacg

SEQ ID NO: 453855 - DNA, 25 bp, Mus musculus
gaccccaacatgtcttgtgactacg

SEQ ID NO: 453856 - DNA, 25 bp, Mus musculus
gaccccaacgctcgagcagtatatc

SEQ ID NO: 453857 - DNA, 25 bp, Mus musculus
gaccccaacgctggagcagtatatc

SEQ ID NO: 453858 - DNA, 25 bp, Mus musculus
gaccccaacttcagagtgctaaact

SEQ ID NO: 453859 - DNA, 25 bp, Mus musculus
gaccccaacttctgagtgctaaact

SEQ ID NO: 453860 - DNA, 25 bp, Mus musculus
gaccccaagcgcacagtgaaggagt

SEQ ID NO: 453861 - DNA, 25 bp, Mus musculus
gaccccaagcgctcagtgaaggagt

SEQ ID NO: 453862 - DNA, 25 bp, Mus musculus
gaccccaaggtgatagtggagatcc

SEQ ID NO: 453863 - DNA, 25 bp, Mus musculus
gaccccaaggtgttagtggagatcc

SEQ ID NO: 453864 - DNA, 25 bp, Mus musculus
gaccccaagttgcaaggcggcttct

SEQ ID NO: 453865 - DNA, 25 bp, Mus musculus
gaccccaagttggaaggcggcttct

SEQ ID NO: 453866 - DNA, 25 bp, Mus musculus
gaccccaattgaatattaattagct

SEQ ID NO: 453867 - DNA, 25 bp, Mus musculus
gaccccaattgattattaattagct

SEQ ID NO: 453868 - DNA, 25 bp, Mus musculus
gaccccacaatcagttttctgtaaa

SEQ ID NO: 453869 - DNA, 25 bp, Mus musculus
gaccccacaatctgttttctgtaaa

SEQ ID NO: 453870 - DNA, 25 bp, Mus musculus
gaccccacacaacttgagagccagg

SEQ ID NO: 453871 - DNA, 25 bp, Mus musculus
gaccccacacaagttgagagccagg

SEQ ID NO: 453872 - DNA, 25 bp, Mus musculus
gaccccacaggcacatatatttgca

SEQ ID NO: 453873 - DNA, 25 bp, Mus musculus
gaccccacaggctcatatatttgca

SEQ ID NO: 453874 - DNA, 25 bp, Mus musculus
gaccccaccaagcaagagagacttt

SEQ ID NO: 453875 - DNA, 25 bp, Mus musculus
gaccccaccaaggaagagagacttt

SEQ ID NO: 453876 - DNA, 25 bp, Mus musculus
gaccccacctcaaagaaaccaagat

SEQ ID NO: 453877 - DNA, 25 bp, Mus musculus
gaccccacctcatagaaaccaagat

SEQ ID NO: 453878 - DNA, 25 bp, Mus musculus
gaccccacgatgctgaaactcacaa

SEQ ID NO: 453879 - DNA, 25 bp, Mus musculus
gaccccacgatggtgaaactcacaa

SEQ ID NO: 453880 - DNA, 25 bp, Mus musculus
gaccccactggaccggaacatagga

SEQ ID NO: 453881 - DNA, 25 bp, Mus musculus
gaccccactggagcggaacatagga

SEQ ID NO: 453882 - DNA, 25 bp, Mus musculus
gaccccactgttcgccaaacttgaa

SEQ ID NO: 453883 - DNA, 25 bp, Mus musculus
gaccccactgttggccaaacttgaa

SEQ ID NO: 453884 - DNA, 25 bp, Mus musculus
gaccccagaaccattgtgaatcttc

SEQ ID NO: 453885 - DNA, 25 bp, Mus musculus
gaccccagaacctttgtgaatcttc

SEQ ID NO: 453886 - DNA, 25 bp, Mus musculus
gaccccagactccatagtatgcaaa

SEQ ID NO: 453887 - DNA, 25 bp, Mus musculus
gaccccagactcgatagtatgcaaa

SEQ ID NO: 453888 - DNA, 25 bp, Mus musculus
gaccccagactgaagagatttttat

SEQ ID NO: 453889 - DNA, 25 bp, Mus musculus
gaccccagactgtagagatttttat

SEQ ID NO: 453890 - DNA, 25 bp, Mus musculus
gaccccagagcaagaggcccaggaa

SEQ ID NO: 453891 - DNA, 25 bp, Mus musculus
gaccccagagcatgaggcccaggaa

SEQ ID NO: 453892 - DNA, 25 bp, Mus musculus
gaccccagatggaccatgttgcttt

SEQ ID NO: 453893 - DNA, 25 bp, Mus musculus
gaccccagatggtccatgttgcttt

SEQ ID NO: 453894 - DNA, 25 bp, Mus musculus
gaccccagcaaaatttactacaaat

SEQ ID NO: 453895 - DNA, 25 bp, Mus musculus
gaccccagcaaattttactacaaat

SEQ ID NO: 453896 - DNA, 25 bp, Mus musculus
gaccccagcagcatgctaactttga

SEQ ID NO: 453897 - DNA, 25 bp, Mus musculus
gaccccagcagcttgctaactttga

SEQ ID NO: 453898 - DNA, 25 bp, Mus musculus
gaccccagcgctaagtgctttaaaa

SEQ ID NO: 453899 - DNA, 25 bp, Mus musculus
gaccccagcgcttagtgctttaaaa

SEQ ID NO: 453900 - DNA, 25 bp, Mus musculus
gaccccaggcacaaagagccacaga

SEQ ID NO: 453901 - DNA, 25 bp, Mus musculus
gaccccaggcactaagagccacaga

SEQ ID NO: 453902 - DNA, 25 bp, Mus musculus
gaccccagggatatccaggtactca

SEQ ID NO: 453903 - DNA, 25 bp, Mus musculus
gaccccagggatttccaggtactca

SEQ ID NO: 453904 - DNA, 25 bp, Mus musculus
gaccccagggctatgagacaggttt

SEQ ID NO: 453905 - DNA, 25 bp, Mus musculus
gaccccagggctttgagacaggttt

SEQ ID NO: 453906 - DNA, 25 bp, Mus musculus
gaccccaggttgaataccgaaaatg

SEQ ID NO: 453907 - DNA, 25 bp, Mus musculus
gaccccaggttgtataccgaaaatg

SEQ ID NO: 453908 - DNA, 25 bp, Mus musculus
gaccccataacaaacagcctatata

SEQ ID NO: 453909 - DNA, 25 bp, Mus musculus
gaccccataacatacagcctatata

SEQ ID NO: 453910 - DNA, 25 bp, Mus musculus
gaccccataactcaccatctattgg

SEQ ID NO: 453911 - DNA, 25 bp, Mus musculus
gaccccataactgaccatctattgg

SEQ ID NO: 453912 - DNA, 25 bp, Mus musculus
gaccccataaggaaatctgcctctc

SEQ ID NO: 453913 - DNA, 25 bp, Mus musculus
gaccccataaggtaatctgcctctc

SEQ ID NO: 453914 - DNA, 25 bp, Mus musculus
gaccccatattcaaaagacagcctc

SEQ ID NO: 453915 - DNA, 25 bp, Mus musculus
gaccccatattctaaagacagcctc

SEQ ID NO: 453916 - DNA, 25 bp, Mus musculus
gaccccatcaccaaggagaggctga

SEQ ID NO: 453917 - DNA, 25 bp, Mus musculus
gaccccatcacctaggagaggctga

SEQ ID NO: 453918 - DNA, 25 bp, Mus musculus
gaccccatcctgaccgtaatggtga

SEQ ID NO: 453919 - DNA, 25 bp, Mus musculus
gaccccatcctgatggctatatagc

SEQ ID NO: 453920 - DNA, 25 bp, Mus musculus
gaccccatcctgtccgtaatggtga

SEQ ID NO: 453921 - DNA, 25 bp, Mus musculus
gaccccatcctgttggctatatagc

SEQ ID NO: 453922 - DNA, 25 bp, Mus musculus
gaccccatgctcagtagctttttgg

SEQ ID NO: 453923 - DNA, 25 bp, Mus musculus
gaccccatgctctgtagctttttgg

SEQ ID NO: 453924 - DNA, 25 bp, Mus musculus
gaccccatggatccctcagattagg

SEQ ID NO: 453925 - DNA, 25 bp, Mus musculus
gaccccatggatgcctcagattagg

SEQ ID NO: 453926 - DNA, 25 bp, Mus musculus
gaccccatggctactgttgaatgca

SEQ ID NO: 453927 - DNA, 25 bp, Mus musculus
gaccccatggcttctgttgaatgca

SEQ ID NO: 453928 - DNA, 25 bp, Mus musculus
gaccccatgtcaaaattatatatat

SEQ ID NO: 453929 - DNA, 25 bp, Mus musculus
gaccccatgtcataattatatatat

SEQ ID NO: 453930 - DNA, 25 bp, Mus musculus
gaccccattgttacgtcactggtaa

SEQ ID NO: 453931 - DNA, 25 bp, Mus musculus
gaccccattgtttcgtcactggtaa

SEQ ID NO: 453932 - DNA, 25 bp, Mus musculus
gaccccatttggctaccctggagat

SEQ ID NO: 453933 - DNA, 25 bp, Mus musculus
gaccccatttgggtaccctggagat

SEQ ID NO: 453934 - DNA, 25 bp, Mus musculus
gaccccattttcattgatgcagact

SEQ ID NO: 453935 - DNA, 25 bp, Mus musculus
gaccccattttctttgatgcagact

SEQ ID NO: 453936 - DNA, 25 bp, Mus musculus
gaccccctctggctgaatattttct

SEQ ID NO: 453937 - DNA, 25 bp, Mus musculus
gaccccctctgggtgaatattttct

SEQ ID NO: 453938 - DNA, 25 bp, Mus musculus
gaccccgactccagacctgatgaga

SEQ ID NO: 453939 - DNA, 25 bp, Mus musculus
gaccccgactcctgacctgatgaga

SEQ ID NO: 453940 - DNA, 25 bp, Mus musculus
gaccccgagacgattgctcaggata

SEQ ID NO: 453941 - DNA, 25 bp, Mus musculus
gaccccgagacgtttgctcaggata

SEQ ID NO: 453942 - DNA, 25 bp, Mus musculus
gaccccgaggaccacgtaacagaag

SEQ ID NO: 453943 - DNA, 25 bp, Mus musculus
gaccccgaggacgacgtaacagaag

SEQ ID NO: 453944 - DNA, 25 bp, Mus musculus
gaccccgatactatgatagctggac

SEQ ID NO: 453945 - DNA, 25 bp, Mus musculus
gaccccgatactttgatagctggac

SEQ ID NO: 453946 - DNA, 25 bp, Mus musculus
gaccccgatagaatcctgtgtttga

SEQ ID NO: 453947 - DNA, 25 bp, Mus musculus
gaccccgatagattcctgtgtttga

SEQ ID NO: 453948 - DNA, 25 bp, Mus musculus
gaccccgatgtgatcaagatcctgg

SEQ ID NO: 453949 - DNA, 25 bp, Mus musculus
gaccccgatgtgttcaagatcctgg

SEQ ID NO: 453950 - DNA, 25 bp, Mus musculus
gaccccgatgttcgttcccatgaat

SEQ ID NO: 453951 - DNA, 25 bp, Mus musculus
gaccccgatgttggttcccatgaat

SEQ ID NO: 453952 - DNA, 25 bp, Mus musculus
gaccccgcacagcatgatccggatg

SEQ ID NO: 453953 - DNA, 25 bp, Mus musculus
gaccccgcacaggatgatccggatg

SEQ ID NO: 453954 - DNA, 25 bp, Mus musculus
gaccccgcaggtccttatcgaaaat

SEQ ID NO: 453955 - DNA, 25 bp, Mus musculus
gaccccgcaggtgcttatcgaaaat

SEQ ID NO: 453956 - DNA, 25 bp, Mus musculus
gaccccgcctgaagcgtcaggtgtg

SEQ ID NO: 453957 - DNA, 25 bp, Mus musculus
gaccccgcctgatgcgtcaggtgtg

SEQ ID NO: 453958 - DNA, 25 bp, Mus musculus
gaccccgctacaacaattacaatta

SEQ ID NO: 453959 - DNA, 25 bp, Mus musculus
gaccccgctacatcaattacaatta

SEQ ID NO: 453960 - DNA, 25 bp, Mus musculus
gaccccgcttcaataatgttcaact

SEQ ID NO: 453961 - DNA, 25 bp, Mus musculus
gaccccgcttcattaatgttcaact

SEQ ID NO: 453962 - DNA, 25 bp, Mus musculus
gaccccggcagaacatcagttagaa

SEQ ID NO: 453963 - DNA, 25 bp, Mus musculus
gaccccggcagatcatcagttagaa

SEQ ID NO: 453964 - DNA, 25 bp, Mus musculus
gaccccggtgcactgacacccttcc

SEQ ID NO: 453965 - DNA, 25 bp, Mus musculus
gaccccggtgcagtgacacccttcc

SEQ ID NO: 453966 - DNA, 25 bp, Mus musculus
gaccccgtcaggaaatagcgtttgg

SEQ ID NO: 453967 - DNA, 25 bp, Mus musculus
gaccccgtcaggtaatagcgtttgg

SEQ ID NO: 453968 - DNA, 25 bp, Mus musculus
gacccctaaataaatcagcacctgt

SEQ ID NO: 453969 - DNA, 25 bp, Mus musculus
gacccctaaatatatcagcacctgt

SEQ ID NO: 453970 - DNA, 25 bp, Mus musculus
gacccctaacataatttgcattctc

SEQ ID NO: 453971 - DNA, 25 bp, Mus musculus
gacccctaacattatttgcattctc

SEQ ID NO: 453972 - DNA, 25 bp, Mus musculus
gacccctaaggtatctcagatactg

SEQ ID NO: 453973 - DNA, 25 bp, Mus musculus
gacccctaaggtttctcagatactg

SEQ ID NO: 453974 - DNA, 25 bp, Mus musculus
gacccctaagtcacaagtcagaaag

SEQ ID NO: 453975 - DNA, 25 bp, Mus musculus
gacccctaagtctcaagtcagaaag

SEQ ID NO: 453976 - DNA, 25 bp, Mus musculus
gacccctaatgacttctgtggagat

SEQ ID NO: 453977 - DNA, 25 bp, Mus musculus
gacccctaatgagttctgtggagat

SEQ ID NO: 453978 - DNA, 25 bp, Mus musculus
gacccctagagaccctattgcatta

SEQ ID NO: 453979 - DNA, 25 bp, Mus musculus
gacccctagagagcctattgcatta

SEQ ID NO: 453980 - DNA, 25 bp, Mus musculus
gacccctatgggaagtgtgctggcc

SEQ ID NO: 453981 - DNA, 25 bp, Mus musculus
gacccctatgggtagtgtgctggcc

SEQ ID NO: 453982 - DNA, 25 bp, Mus musculus
gacccctatgtacgaatgtgcttta

SEQ ID NO: 453983 - DNA, 25 bp, Mus musculus
gacccctatgtaggaatgtgcttta

SEQ ID NO: 453984 - DNA, 25 bp, Mus musculus
gacccctattatagacgatagaaac

SEQ ID NO: 453985 - DNA, 25 bp, Mus musculus
gacccctattattgacgatagaaac

SEQ ID NO: 453986 - DNA, 25 bp, Mus musculus
gacccctcaattctggagtctatgg

SEQ ID NO: 453987 - DNA, 25 bp, Mus musculus
gacccctcaattgtggagtctatgg

SEQ ID NO: 453988 - DNA, 25 bp, Mus musculus
gacccctcacacatggcagagctgg

SEQ ID NO: 453989 - DNA, 25 bp, Mus musculus
gacccctcacacttggcagagctgg

SEQ ID NO: 453990 - DNA, 25 bp, Mus musculus
gacccctcagagattgttatgtgtg

SEQ ID NO: 453991 - DNA, 25 bp, Mus musculus
gacccctcagagtttgttatgtgtg

SEQ ID NO: 453992 - DNA, 25 bp, Mus musculus
gacccctcctgtacgggcaatgtga

SEQ ID NO: 453993 - DNA, 25 bp, Mus musculus
gacccctcctgttcgggcaatgtga

SEQ ID NO: 453994 - DNA, 25 bp, Mus musculus
gacccctcgctgagtacggaacttg

SEQ ID NO: 453995 - DNA, 25 bp, Mus musculus
gacccctcgctgtgtacggaacttg

SEQ ID NO: 453996 - DNA, 25 bp, Mus musculus
gacccctcgtgtctgacaacaaagc

SEQ ID NO: 453997 - DNA, 25 bp, Mus musculus
gacccctcgtgtgtgacaacaaagc

SEQ ID NO: 453998 - DNA, 25 bp, Mus musculus
gacccctctaaacaatatggcctga

SEQ ID NO: 453999 - DNA, 25 bp, Mus musculus
gacccctctaaagaatatggcctga

SEQ ID NO: 454000 - DNA, 25 bp, Mus musculus
gacccctctcacctgtagaaaggct

SEQ ID NO: 454001 - DNA, 25 bp, Mus musculus
gacccctctcacgtgtagaaaggct

SEQ ID NO: 454002 - DNA, 25 bp, Mus musculus
gacccctcttacctgaagcagatgg

SEQ ID NO: 454003 - DNA, 25 bp, Mus musculus
gacccctcttacctgttggacagtg

SEQ ID NO: 454004 - DNA, 25 bp, Mus musculus
gacccctcttacgtgaagcagatgg

SEQ ID NO: 454005 - DNA, 25 bp, Mus musculus
gacccctcttacgtgttggacagtg

SEQ ID NO: 454006 - DNA, 25 bp, Mus musculus
gacccctgagggacctgacgaagaa

SEQ ID NO: 454007 - DNA, 25 bp, Mus musculus
gacccctgagggtcctgacgaagaa

SEQ ID NO: 454008 - DNA, 25 bp, Mus musculus
gacccctgagttatggtccagttgg

SEQ ID NO: 454009 - DNA, 25 bp, Mus musculus
gacccctgagttttggtccagttgg

SEQ ID NO: 454010 - DNA, 25 bp, Mus musculus
gacccctgatgactacttgatctga

SEQ ID NO: 454011 - DNA, 25 bp, Mus musculus
gacccctgatgagtacttgatctga

SEQ ID NO: 454012 - DNA, 25 bp, Mus musculus
gacccctgcacaagtgtcatgacat

SEQ ID NO: 454013 - DNA, 25 bp, Mus musculus
gacccctgcacatgtgtcatgacat

SEQ ID NO: 454014 - DNA, 25 bp, Mus musculus
gacccctggaagcaaaggttgctgt

SEQ ID NO: 454015 - DNA, 25 bp, Mus musculus
gacccctggaaggaaaggttgctgt

SEQ ID NO: 454016 - DNA, 25 bp, Mus musculus
gacccctggatccttgtactttgta

SEQ ID NO: 454017 - DNA, 25 bp, Mus musculus
gacccctggatcgttgtactttgta

SEQ ID NO: 454018 - DNA, 25 bp, Mus musculus
gacccctgggcaaggatgttatatt

SEQ ID NO: 454019 - DNA, 25 bp, Mus musculus
gacccctgggcatggatgttatatt

SEQ ID NO: 454020 - DNA, 25 bp, Mus musculus
gacccctgggtacccatcatgctgg

SEQ ID NO: 454021 - DNA, 25 bp, Mus musculus
gacccctgggtagccatcatgctgg

SEQ ID NO: 454022 - DNA, 25 bp, Mus musculus
gacccctgggttattaaatgtgcat

SEQ ID NO: 454023 - DNA, 25 bp, Mus musculus
gacccctgggtttttaaatgtgcat

SEQ ID NO: 454024 - DNA, 25 bp, Mus musculus
gacccctggtgtccgaaggaacctt

SEQ ID NO: 454025 - DNA, 25 bp, Mus musculus
gacccctggtgtgcgaaggaacctt

SEQ ID NO: 454026 - DNA, 25 bp, Mus musculus
gacccctgtaagatctgttattcca

SEQ ID NO: 454027 - DNA, 25 bp, Mus musculus
gacccctgtaagttctgttattcca

SEQ ID NO: 454028 - DNA, 25 bp, Mus musculus
gacccctgtgctacagttctaataa

SEQ ID NO: 454029 - DNA, 25 bp, Mus musculus
gacccctgtgcttcagttctaataa

SEQ ID NO: 454030 - DNA, 25 bp, Mus musculus
gacccctgtgtaaggaggatgagca

SEQ ID NO: 454031 - DNA, 25 bp, Mus musculus
gacccctgtgtatggaggatgagca

SEQ ID NO: 454032 - DNA, 25 bp, Mus musculus
gaccccttagcgagtgaaatcagtt

SEQ ID NO: 454033 - DNA, 25 bp, Mus musculus
gaccccttagcgtgtgaaatcagtt

SEQ ID NO: 454034 - DNA, 25 bp, Mus musculus
gaccccttcatgacctaaggaagac

SEQ ID NO: 454035 - DNA, 25 bp, Mus musculus
gaccccttcatgtcctaaggaagac

SEQ ID NO: 454036 - DNA, 25 bp, Mus musculus
gaccccttccaaattacacatttct

SEQ ID NO: 454037 - DNA, 25 bp, Mus musculus
gaccccttccaacattgtcaattta

SEQ ID NO: 454038 - DNA, 25 bp, Mus musculus
gaccccttccaagattgtcaattta

SEQ ID NO: 454039 - DNA, 25 bp, Mus musculus
gaccccttccaatttacacatttct

SEQ ID NO: 454040 - DNA, 25 bp, Mus musculus
gaccccttcgaccagtatcttatta

SEQ ID NO: 454041 - DNA, 25 bp, Mus musculus
gaccccttcgacgagtatcttatta

SEQ ID NO: 454042 - DNA, 25 bp, Mus musculus
gaccccttctccaatagcgaacagg

SEQ ID NO: 454043 - DNA, 25 bp, Mus musculus
gaccccttctcctatagcgaacagg

SEQ ID NO: 454044 - DNA, 25 bp, Mus musculus
gaccccttctggatttttactacag

SEQ ID NO: 454045 - DNA, 25 bp, Mus musculus
gaccccttctggttttttactacag

SEQ ID NO: 454046 - DNA, 25 bp, Mus musculus
gaccccttgagcctgtttaaagatg

SEQ ID NO: 454047 - DNA, 25 bp, Mus musculus
gaccccttgagcgtgtttaaagatg

SEQ ID NO: 454048 - DNA, 25 bp, Mus musculus
gaccccttggatcaacaatggatgc

SEQ ID NO: 454049 - DNA, 25 bp, Mus musculus
gaccccttggatgaacaatggatgc

SEQ ID NO: 454050 - DNA, 25 bp, Mus musculus
gaccccttggtgagcttacttaatt

SEQ ID NO: 454051 - DNA, 25 bp, Mus musculus
gaccccttggtgtgcttacttaatt

SEQ ID NO: 454052 - DNA, 25 bp, Mus musculus
gaccccttgtgcagtgacccggatg

SEQ ID NO: 454053 - DNA, 25 bp, Mus musculus
gaccccttgtgctgtgacccggatg

SEQ ID NO: 454054 - DNA, 25 bp, Mus musculus
gacccctttagccacacttaaatga

SEQ ID NO: 454055 - DNA, 25 bp, Mus musculus
gacccctttagcgacacttaaatga

SEQ ID NO: 454056 - DNA, 25 bp, Mus musculus
gacccctttgacaatcagttctgaa

SEQ ID NO: 454057 - DNA, 25 bp, Mus musculus
gacccctttgactatcagttctgaa

SEQ ID NO: 454058 - DNA, 25 bp, Mus musculus
gacccctttgatacatagccgttga

SEQ ID NO: 454059 - DNA, 25 bp, Mus musculus
gacccctttgattcatagccgttga

SEQ ID NO: 454060 - DNA, 25 bp, Mus musculus
gacccgaacaagcatgaacatgcta

SEQ ID NO: 454061 - DNA, 25 bp, Mus musculus
gacccgaacaaggatgaacatgcta

SEQ ID NO: 454062 - DNA, 25 bp, Mus musculus
gacccgaatagtccattcaactata

SEQ ID NO: 454063 - DNA, 25 bp, Mus musculus
gacccgaatagtgcattcaactata

SEQ ID NO: 454064 - DNA, 25 bp, Mus musculus
gacccgacacggctcccaggaggtc

SEQ ID NO: 454065 - DNA, 25 bp, Mus musculus
gacccgacacgggtcccaggaggtc

SEQ ID NO: 454066 - DNA, 25 bp, Mus musculus
gacccgactgccatgtagggtatgt

SEQ ID NO: 454067 - DNA, 25 bp, Mus musculus
gacccgactgccttgtagggtatgt

SEQ ID NO: 454068 - DNA, 25 bp, Mus musculus
gacccgactgtcaaagtactacgag

SEQ ID NO: 454069 - DNA, 25 bp, Mus musculus
gacccgactgtctaagtactacgag

SEQ ID NO: 454070 - DNA, 25 bp, Mus musculus
gacccgagactactcaactctgaaa

SEQ ID NO: 454071 - DNA, 25 bp, Mus musculus
gacccgagactagtcaactctgaaa

SEQ ID NO: 454072 - DNA, 25 bp, Mus musculus
gacccgagaggtacatttgttttgt

SEQ ID NO: 454073 - DNA, 25 bp, Mus musculus
gacccgagaggttcatttgttttgt

SEQ ID NO: 454074 - DNA, 25 bp, Mus musculus
gacccgagttgacggcttagaccaa

SEQ ID NO: 454075 - DNA, 25 bp, Mus musculus
gacccgagttgagggcttagaccaa

SEQ ID NO: 454076 - DNA, 25 bp, Mus musculus
gacccgcaaaggctcacaaggactt

SEQ ID NO: 454077 - DNA, 25 bp, Mus musculus
gacccgcaaagggtcacaaggactt

SEQ ID NO: 454078 - DNA, 25 bp, Mus musculus
gacccgcagcaccggaagccttgtg

SEQ ID NO: 454079 - DNA, 25 bp, Mus musculus
gacccgcagcacgggaagccttgtg

SEQ ID NO: 454080 - DNA, 25 bp, Mus musculus
gacccgcatttccactttgtatctt

SEQ ID NO: 454081 - DNA, 25 bp, Mus musculus
gacccgcatttcgactttgtatctt

SEQ ID NO: 454082 - DNA, 25 bp, Mus musculus
gacccgccaccaacgcagatgagtg

SEQ ID NO: 454083 - DNA, 25 bp, Mus musculus
gacccgccaccatcgcagatgagtg

SEQ ID NO: 454084 - DNA, 25 bp, Mus musculus
gacccgccccacaaaaaatatcttg

SEQ ID NO: 454085 - DNA, 25 bp, Mus musculus
gacccgccccactaaaaatatcttg

SEQ ID NO: 454086 - DNA, 25 bp, Mus musculus
gacccgccccagcactgtagataag

SEQ ID NO: 454087 - DNA, 25 bp, Mus musculus
gacccgccccaggactgtagataag

SEQ ID NO: 454088 - DNA, 25 bp, Mus musculus
gacccgcctccaaaaggatagcttt

SEQ ID NO: 454089 - DNA, 25 bp, Mus musculus
gacccgcctccataaggatagcttt

SEQ ID NO: 454090 - DNA, 25 bp, Mus musculus
gacccgcctctcaacgtggataaaa

SEQ ID NO: 454091 - DNA, 25 bp, Mus musculus
gacccgcctctctacgtggataaaa

SEQ ID NO: 454092 - DNA, 25 bp, Mus musculus
gacccgcgatggaagcgccccggga

SEQ ID NO: 454093 - DNA, 25 bp, Mus musculus
gacccgcgatggtagcgccccggga

SEQ ID NO: 454094 - DNA, 25 bp, Mus musculus
gacccgcttacaattatctttaatt

SEQ ID NO: 454095 - DNA, 25 bp, Mus musculus
gacccgcttacatttatctttaatt

SEQ ID NO: 454096 - DNA, 25 bp, Mus musculus
gacccgcttgttctgatgataccga

SEQ ID NO: 454097 - DNA, 25 bp, Mus musculus
gacccgcttgttgtgatgataccga

SEQ ID NO: 454098 - DNA, 25 bp, Mus musculus
gacccggaacttaactctgagatag

SEQ ID NO: 454099 - DNA, 25 bp, Mus musculus
gacccggaactttactctgagatag

SEQ ID NO: 454100 - DNA, 25 bp, Mus musculus
gacccggaaggcacgatccggacga

SEQ ID NO: 454101 - DNA, 25 bp, Mus musculus
gacccggaaggctcgatccggacga

SEQ ID NO: 454102 - DNA, 25 bp, Mus musculus
gacccggactacatttcctaagagg

SEQ ID NO: 454103 - DNA, 25 bp, Mus musculus
gacccggactacttttcctaagagg

SEQ ID NO: 454104 - DNA, 25 bp, Mus musculus
gacccggagaagaggtttacctgtg

SEQ ID NO: 454105 - DNA, 25 bp, Mus musculus
gacccggagaagatgttggccaact

SEQ ID NO: 454106 - DNA, 25 bp, Mus musculus
gacccggagaagtggtttacctgtg

SEQ ID NO: 454107 - DNA, 25 bp, Mus musculus
gacccggagaagttgttggccaact

SEQ ID NO: 454108 - DNA, 25 bp, Mus musculus
gacccggagctaaaggaaacattga

SEQ ID NO: 454109 - DNA, 25 bp, Mus musculus
gacccggagctataggaaacattga

SEQ ID NO: 454110 - DNA, 25 bp, Mus musculus
gacccggagtttcgccgagctgttt

SEQ ID NO: 454111 - DNA, 25 bp, Mus musculus
gacccggagtttggccgagctgttt

SEQ ID NO: 454112 - DNA, 25 bp, Mus musculus
gacccggatgatcagaccagcctgg

SEQ ID NO: 454113 - DNA, 25 bp, Mus musculus
gacccggatgatgagaccagcctgg

SEQ ID NO: 454114 - DNA, 25 bp, Mus musculus
gacccggcagtacaattctgtcttg

SEQ ID NO: 454115 - DNA, 25 bp, Mus musculus
gacccggcagtagaattctgtcttg

SEQ ID NO: 454116 - DNA, 25 bp, Mus musculus
gacccggccggccatgaatatgaac

SEQ ID NO: 454117 - DNA, 25 bp, Mus musculus
gacccggccggcgatgaatatgaac

SEQ ID NO: 454118 - DNA, 25 bp, Mus musculus
gacccggctctgcatcgtaaactgg

SEQ ID NO: 454119 - DNA, 25 bp, Mus musculus
gacccggctctggatcgtaaactgg

SEQ ID NO: 454120 - DNA, 25 bp, Mus musculus
gacccgggactcatctaaagtagct

SEQ ID NO: 454121 - DNA, 25 bp, Mus musculus
gacccgggactcttctaaagtagct

SEQ ID NO: 454122 - DNA, 25 bp, Mus musculus
gacccgggatctcctctctggagac

SEQ ID NO: 454123 - DNA, 25 bp, Mus musculus
gacccgggatctgctctctggagac

SEQ ID NO: 454124 - DNA, 25 bp, Mus musculus
gacccgggatggcttgaccctgcca

SEQ ID NO: 454125 - DNA, 25 bp, Mus musculus
gacccgggatgggttgaccctgcca

SEQ ID NO: 454126 - DNA, 25 bp, Mus musculus
gacccgggcgacaccatctgtaggg

SEQ ID NO: 454127 - DNA, 25 bp, Mus musculus
gacccgggcgactccatctgtaggg

SEQ ID NO: 454128 - DNA, 25 bp, Mus musculus
gacccgggttagaaaagcatgcact

SEQ ID NO: 454129 - DNA, 25 bp, Mus musculus
gacccgggttagtaaagcatgcact

SEQ ID NO: 454130 - DNA, 25 bp, Mus musculus
gacccggtcccaagtgatgatattt

SEQ ID NO: 454131 - DNA, 25 bp, Mus musculus
gacccggtcccatgtgatgatattt

SEQ ID NO: 454132 - DNA, 25 bp, Mus musculus
gacccggtggacacagatgacacag

SEQ ID NO: 454133 - DNA, 25 bp, Mus musculus
gacccggtggactcagatgacacag

SEQ ID NO: 454134 - DNA, 25 bp, Mus musculus
gacccgtaccatacctgcaatggtg

SEQ ID NO: 454135 - DNA, 25 bp, Mus musculus
gacccgtaccattcctgcaatggtg

SEQ ID NO: 454136 - DNA, 25 bp, Mus musculus
gacccgtactggctgcctcttaatt

SEQ ID NO: 454137 - DNA, 25 bp, Mus musculus
gacccgtactgggtgcctcttaatt

SEQ ID NO: 454138 - DNA, 25 bp, Mus musculus
gacccgtagagacattccttacaca

SEQ ID NO: 454139 - DNA, 25 bp, Mus musculus
gacccgtagagagattccttacaca

SEQ ID NO: 454140 - DNA, 25 bp, Mus musculus
gacccgtcacaaaaaaccattctca

SEQ ID NO: 454141 - DNA, 25 bp, Mus musculus
gacccgtcacaataaaccattctca

SEQ ID NO: 454142 - DNA, 25 bp, Mus musculus
gacccgtctgtcacaagtgttcaat

SEQ ID NO: 454143 - DNA, 25 bp, Mus musculus
gacccgtctgtctcaagtgttcaat

SEQ ID NO: 454144 - DNA, 25 bp, Mus musculus
gacccgtgagtccaacattaaacat

SEQ ID NO: 454145 - DNA, 25 bp, Mus musculus
gacccgtgagtcgaacattaaacat

SEQ ID NO: 454146 - DNA, 25 bp, Mus musculus
gacccgtgcgtcacccataaaaaga

SEQ ID NO: 454147 - DNA, 25 bp, Mus musculus
gacccgtgcgtctcccataaaaaga

SEQ ID NO: 454148 - DNA, 25 bp, Mus musculus
gacccgtgctgtaaattctttgtat

SEQ ID NO: 454149 - DNA, 25 bp, Mus musculus
gacccgtgctgttaattctttgtat

SEQ ID NO: 454150 - DNA, 25 bp, Mus musculus
gacccgtggaccatctggtgaacaa

SEQ ID NO: 454151 - DNA, 25 bp, Mus musculus
gacccgtggaccttctggtgaacaa

SEQ ID NO: 454152 - DNA, 25 bp, Mus musculus
gacccgttatttacacaacatcctg

SEQ ID NO: 454153 - DNA, 25 bp, Mus musculus
gacccgttattttcacaacatcctg

SEQ ID NO: 454154 - DNA, 25 bp, Mus musculus
gacccgtttgcaaccatgcatagta

SEQ ID NO: 454155 - DNA, 25 bp, Mus musculus
gacccgtttgcatccatgcatagta

SEQ ID NO: 454156 - DNA, 25 bp, Mus musculus
gaccctaacacgactattctgtttt

SEQ ID NO: 454157 - DNA, 25 bp, Mus musculus
gaccctaacacgtctattctgtttt

SEQ ID NO: 454158 - DNA, 25 bp, Mus musculus
gaccctaaccagcttcttgtagctc

SEQ ID NO: 454159 - DNA, 25 bp, Mus musculus
gaccctaaccaggttcttgtagctc

SEQ ID NO: 454160 - DNA, 25 bp, Mus musculus
gaccctaacctgagaaattccttct

SEQ ID NO: 454161 - DNA, 25 bp, Mus musculus
gaccctaacctgtgaaattccttct

SEQ ID NO: 454162 - DNA, 25 bp, Mus musculus
gaccctaagaagaagtctaatgatt

SEQ ID NO: 454163 - DNA, 25 bp, Mus musculus
gaccctaagaagtagtctaatgatt

SEQ ID NO: 454164 - DNA, 25 bp, Mus musculus
gaccctaagggtatcacatggtaga

SEQ ID NO: 454165 - DNA, 25 bp, Mus musculus
gaccctaagggtttcacatggtaga

SEQ ID NO: 454166 - DNA, 25 bp, Mus musculus
gaccctaagtctagggtactccaga

SEQ ID NO: 454167 - DNA, 25 bp, Mus musculus
gaccctaagtcttgggtactccaga

SEQ ID NO: 454168 - DNA, 25 bp, Mus musculus
gaccctaatctgcaggaacctgatc

SEQ ID NO: 454169 - DNA, 25 bp, Mus musculus
gaccctaatctggaggaacctgatc

SEQ ID NO: 454170 - DNA, 25 bp, Mus musculus
gaccctaatggcattagacagctaa

SEQ ID NO: 454171 - DNA, 25 bp, Mus musculus
gaccctaatggctttagacagctaa

SEQ ID NO: 454172 - DNA, 25 bp, Mus musculus
gaccctaattatctcaacccaggca

SEQ ID NO: 454173 - DNA, 25 bp, Mus musculus
gaccctaattatgtcaacccaggca

SEQ ID NO: 454174 - DNA, 25 bp, Mus musculus
gaccctacaaagcatagcctagctc

SEQ ID NO: 454175 - DNA, 25 bp, Mus musculus
gaccctacaaaggatagcctagctc

SEQ ID NO: 454176 - DNA, 25 bp, Mus musculus
gaccctacaggtctctgtgcaggaa

SEQ ID NO: 454177 - DNA, 25 bp, Mus musculus
gaccctacaggtgtctgtgcaggaa

SEQ ID NO: 454178 - DNA, 25 bp, Mus musculus
gaccctaccagaaaggctgggttat

SEQ ID NO: 454179 - DNA, 25 bp, Mus musculus
gaccctaccagataggctgggttat

SEQ ID NO: 454180 - DNA, 25 bp, Mus musculus
gaccctacctagatgtgaagcttcc

SEQ ID NO: 454181 - DNA, 25 bp, Mus musculus
gaccctacctagttgtgaagcttcc

SEQ ID NO: 454182 - DNA, 25 bp, Mus musculus
gaccctacgcgtctgccgaatgtgg

SEQ ID NO: 454183 - DNA, 25 bp, Mus musculus
gaccctacgcgtgtgccgaatgtgg

SEQ ID NO: 454184 - DNA, 25 bp, Mus musculus
gaccctactgagactagattgtgga

SEQ ID NO: 454185 - DNA, 25 bp, Mus musculus
gaccctactgagtctagattgtgga

SEQ ID NO: 454186 - DNA, 25 bp, Mus musculus
gaccctactggcaggaagtcaagat

SEQ ID NO: 454187 - DNA, 25 bp, Mus musculus
gaccctactggctggaagtcaagat

SEQ ID NO: 454188 - DNA, 25 bp, Mus musculus
gaccctagaggaaccaagctttcaa

SEQ ID NO: 454189 - DNA, 25 bp, Mus musculus
gaccctagaggatccaagctttcaa

SEQ ID NO: 454190 - DNA, 25 bp, Mus musculus
gaccctagctagaatcctatttgaa

SEQ ID NO: 454191 - DNA, 25 bp, Mus musculus
gaccctagctagtatcctatttgaa

SEQ ID NO: 454192 - DNA, 25 bp, Mus musculus
gaccctaggatgcagtccgcatgtg

SEQ ID NO: 454193 - DNA, 25 bp, Mus musculus
gaccctaggatggagtccgcatgtg

SEQ ID NO: 454194 - DNA, 25 bp, Mus musculus
gaccctaggctaaaaatccatccca

SEQ ID NO: 454195 - DNA, 25 bp, Mus musculus
gaccctaggctataaatccatccca

SEQ ID NO: 454196 - DNA, 25 bp, Mus musculus
gaccctagtcaactctgttaattct

SEQ ID NO: 454197 - DNA, 25 bp, Mus musculus
gaccctagtcaagtctgttaattct

SEQ ID NO: 454198 - DNA, 25 bp, Mus musculus
gaccctatacttactttgcatgctt

SEQ ID NO: 454199 - DNA, 25 bp, Mus musculus
gaccctatactttctttgcatgctt

SEQ ID NO: 454200 - DNA, 25 bp, Mus musculus
gaccctatagggaactggctggcat

SEQ ID NO: 454201 - DNA, 25 bp, Mus musculus
gaccctatagggtactggctggcat

SEQ ID NO: 454202 - DNA, 25 bp, Mus musculus
gaccctatagttattccatgttcac

SEQ ID NO: 454203 - DNA, 25 bp, Mus musculus
gaccctatagtttttccatgttcac

SEQ ID NO: 454204 - DNA, 25 bp, Mus musculus
gaccctatatctaacataagcctga

SEQ ID NO: 454205 - DNA, 25 bp, Mus musculus
gaccctatatcttacataagcctga

SEQ ID NO: 454206 - DNA, 25 bp, Mus musculus
gaccctatccttcgaagatggtcca

SEQ ID NO: 454207 - DNA, 25 bp, Mus musculus
gaccctatccttggaagatggtcca

SEQ ID NO: 454208 - DNA, 25 bp, Mus musculus
gaccctatctatctgcttgaagttg

SEQ ID NO: 454209 - DNA, 25 bp, Mus musculus
gaccctatctatgtgcttgaagttg

SEQ ID NO: 454210 - DNA, 25 bp, Mus musculus
gaccctatctcgaatgaatgaatga

SEQ ID NO: 454211 - DNA, 25 bp, Mus musculus
gaccctatctcgtatgaatgaatga

SEQ ID NO: 454212 - DNA, 25 bp, Mus musculus
gaccctatgcaacgataactctgat

SEQ ID NO: 454213 - DNA, 25 bp, Mus musculus
gaccctatgcaaggataactctgat

SEQ ID NO: 454214 - DNA, 25 bp, Mus musculus
gaccctattatgatcagaaagcttg

SEQ ID NO: 454215 - DNA, 25 bp, Mus musculus
gaccctattatgttcagaaagcttg

SEQ ID NO: 454216 - DNA, 25 bp, Mus musculus
gaccctattcaaagtttagctctga

SEQ ID NO: 454217 - DNA, 25 bp, Mus musculus
gaccctattcaatgtttagctctga

SEQ ID NO: 454218 - DNA, 25 bp, Mus musculus
gaccctatttcgctttacatttttg

SEQ ID NO: 454219 - DNA, 25 bp, Mus musculus
gaccctatttcggtttacatttttg

SEQ ID NO: 454220 - DNA, 25 bp, Mus musculus
gaccctatttggaaacccagacatt

SEQ ID NO: 454221 - DNA, 25 bp, Mus musculus
gaccctatttggtaacccagacatt

SEQ ID NO: 454222 - DNA, 25 bp, Mus musculus
gaccctatttgtattgtaccatgta

SEQ ID NO: 454223 - DNA, 25 bp, Mus musculus
gaccctatttgttttgtaccatgta

SEQ ID NO: 454224 - DNA, 25 bp, Mus musculus
gaccctatttttagacacttccatt

SEQ ID NO: 454225 - DNA, 25 bp, Mus musculus
gaccctattttttgacacttccatt

SEQ ID NO: 454226 - DNA, 25 bp, Mus musculus
gaccctcaaaaaagccttcgtggaa

SEQ ID NO: 454227 - DNA, 25 bp, Mus musculus
gaccctcaaaaatgccttcgtggaa

SEQ ID NO: 454228 - DNA, 25 bp, Mus musculus
gaccctcaaagaagtgttgacacat

SEQ ID NO: 454229 - DNA, 25 bp, Mus musculus
gaccctcaaagatgtgttgacacat

SEQ ID NO: 454230 - DNA, 25 bp, Mus musculus
gaccctcaatcaagaaattattttt

SEQ ID NO: 454231 - DNA, 25 bp, Mus musculus
gaccctcaatcatgaaattattttt

SEQ ID NO: 454232 - DNA, 25 bp, Mus musculus
gaccctcaattaaccagcagtgtgt

SEQ ID NO: 454233 - DNA, 25 bp, Mus musculus
gaccctcaattatccagcagtgtgt

SEQ ID NO: 454234 - DNA, 25 bp, Mus musculus
gaccctcaattcacttccagaatgt

SEQ ID NO: 454235 - DNA, 25 bp, Mus musculus
gaccctcaattctcttccagaatgt

SEQ ID NO: 454236 - DNA, 25 bp, Mus musculus
gaccctcacacacgtatttctgttt

SEQ ID NO: 454237 - DNA, 25 bp, Mus musculus
gaccctcacacaggtatttctgttt

SEQ ID NO: 454238 - DNA, 25 bp, Mus musculus
gaccctcacgttaatgtggctaaag

SEQ ID NO: 454239 - DNA, 25 bp, Mus musculus
gaccctcacgtttatgtggctaaag

SEQ ID NO: 454240 - DNA, 25 bp, Mus musculus
gaccctcagagtacactgcacaggg

SEQ ID NO: 454241 - DNA, 25 bp, Mus musculus
gaccctcagagttcactgcacaggg

SEQ ID NO: 454242 - DNA, 25 bp, Mus musculus
gaccctcagcaacatgtggatattc

SEQ ID NO: 454243 - DNA, 25 bp, Mus musculus
gaccctcagcaagatgtggatattc

SEQ ID NO: 454244 - DNA, 25 bp, Mus musculus
gaccctcagcacataccattgtaat

SEQ ID NO: 454245 - DNA, 25 bp, Mus musculus
gaccctcagcacttaccattgtaat

SEQ ID NO: 454246 - DNA, 25 bp, Mus musculus
gaccctcagcttaaatattttgccg

SEQ ID NO: 454247 - DNA, 25 bp, Mus musculus
gaccctcagcttacacgagatgaag

SEQ ID NO: 454248 - DNA, 25 bp, Mus musculus
gaccctcagctttaatattttgccg

SEQ ID NO: 454249 - DNA, 25 bp, Mus musculus
gaccctcagctttcacgagatgaag

SEQ ID NO: 454250 - DNA, 25 bp, Mus musculus
gaccctcaggaaagagcgtggtaca

SEQ ID NO: 454251 - DNA, 25 bp, Mus musculus
gaccctcaggaatgagcgtggtaca

SEQ ID NO: 454252 - DNA, 25 bp, Mus musculus
gaccctcaggccaacaaggagagca

SEQ ID NO: 454253 - DNA, 25 bp, Mus musculus
gaccctcaggccaagagacaaacct

SEQ ID NO: 454254 - DNA, 25 bp, Mus musculus
gaccctcaggcctacaaggagagca

SEQ ID NO: 454255 - DNA, 25 bp, Mus musculus
gaccctcaggcctagagacaaacct

SEQ ID NO: 454256 - DNA, 25 bp, Mus musculus
gaccctcagtgcagaatttcctgtc

SEQ ID NO: 454257 - DNA, 25 bp, Mus musculus
gaccctcagtgctgaatttcctgtc

SEQ ID NO: 454258 - DNA, 25 bp, Mus musculus
gaccctcatacactttttacaacca

SEQ ID NO: 454259 - DNA, 25 bp, Mus musculus
gaccctcatacagtttttacaacca

SEQ ID NO: 454260 - DNA, 25 bp, Mus musculus
gaccctcatctaccagtgccaggag

SEQ ID NO: 454261 - DNA, 25 bp, Mus musculus
gaccctcatctagcagtgccaggag

SEQ ID NO: 454262 - DNA, 25 bp, Mus musculus
gaccctcatgagacaatgctgttcc

SEQ ID NO: 454263 - DNA, 25 bp, Mus musculus
gaccctcatgagtcaatgctgttcc

SEQ ID NO: 454264 - DNA, 25 bp, Mus musculus
gaccctcatgcgcttctatagtcaa

SEQ ID NO: 454265 - DNA, 25 bp, Mus musculus
gaccctcatgcggttctatagtcaa

SEQ ID NO: 454266 - DNA, 25 bp, Mus musculus
gaccctccaagtcgagaccctggtg

SEQ ID NO: 454267 - DNA, 25 bp, Mus musculus
gaccctccaagtggagaccctggtg

SEQ ID NO: 454268 - DNA, 25 bp, Mus musculus
gaccctccaggtagcatctgacagg

SEQ ID NO: 454269 - DNA, 25 bp, Mus musculus
gaccctccaggttgcatctgacagg

SEQ ID NO: 454270 - DNA, 25 bp, Mus musculus
gaccctccattgagaattcttgcaa

SEQ ID NO: 454271 - DNA, 25 bp, Mus musculus
gaccctccattgtgaattcttgcaa

SEQ ID NO: 454272 - DNA, 25 bp, Mus musculus
gaccctccctgccatttagagtata

SEQ ID NO: 454273 - DNA, 25 bp, Mus musculus
gaccctccctgcgatttagagtata

SEQ ID NO: 454274 - DNA, 25 bp, Mus musculus
gaccctccgaaacgttaagtgccat

SEQ ID NO: 454275 - DNA, 25 bp, Mus musculus
gaccctccgaaaggttaagtgccat

SEQ ID NO: 454276 - DNA, 25 bp, Mus musculus
gaccctccggtcatttttgccaaat

SEQ ID NO: 454277 - DNA, 25 bp, Mus musculus
gaccctccggtcttttttgccaaat

SEQ ID NO: 454278 - DNA, 25 bp, Mus musculus
gaccctcctactactatctcaagta

SEQ ID NO: 454279 - DNA, 25 bp, Mus musculus
gaccctcctacttctatctcaagta

SEQ ID NO: 454280 - DNA, 25 bp, Mus musculus
gaccctcctatgaggaatttctcaa

SEQ ID NO: 454281 - DNA, 25 bp, Mus musculus
gaccctcctatgtggaatttctcaa

SEQ ID NO: 454282 - DNA, 25 bp, Mus musculus
gaccctcctgatagcaagaacacac

SEQ ID NO: 454283 - DNA, 25 bp, Mus musculus
gaccctcctgattgcaagaacacac

SEQ ID NO: 454284 - DNA, 25 bp, Mus musculus
gaccctcgagtcagtatctaataag

SEQ ID NO: 454285 - DNA, 25 bp, Mus musculus
gaccctcgagtctgtatctaataag

SEQ ID NO: 454286 - DNA, 25 bp, Mus musculus
gaccctcgctaaaactggatagtta

SEQ ID NO: 454287 - DNA, 25 bp, Mus musculus
gaccctcgctaatactggatagtta

SEQ ID NO: 454288 - DNA, 25 bp, Mus musculus
gaccctcggaacactgacaatgcgt

SEQ ID NO: 454289 - DNA, 25 bp, Mus musculus
gaccctcggaactctgacaatgcgt

SEQ ID NO: 454290 - DNA, 25 bp, Mus musculus
gaccctcgtgtacgtcctgcgcaga

SEQ ID NO: 454291 - DNA, 25 bp, Mus musculus
gaccctcgtgtaggtcctgcgcaga

SEQ ID NO: 454292 - DNA, 25 bp, Mus musculus
gaccctctacttcacacttgttaat

SEQ ID NO: 454293 - DNA, 25 bp, Mus musculus
gaccctctacttgacacttgttaat

SEQ ID NO: 454294 - DNA, 25 bp, Mus musculus
gaccctctcactcttttaaggacag

SEQ ID NO: 454295 - DNA, 25 bp, Mus musculus
gaccctctcactgttttaaggacag

SEQ ID NO: 454296 - DNA, 25 bp, Mus musculus
gaccctctcattcggttgcaacttt

SEQ ID NO: 454297 - DNA, 25 bp, Mus musculus
gaccctctcattgggttgcaacttt

SEQ ID NO: 454298 - DNA, 25 bp, Mus musculus
gaccctctcggacagtgtgtggaaa

SEQ ID NO: 454299 - DNA, 25 bp, Mus musculus
gaccctctcggagagtgtgtggaaa

SEQ ID NO: 454300 - DNA, 25 bp, Mus musculus
gaccctctctggcagcgaaattgga

SEQ ID NO: 454301 - DNA, 25 bp, Mus musculus
gaccctctctgggagcgaaattgga

SEQ ID NO: 454302 - DNA, 25 bp, Mus musculus
gaccctctgaaaacatactgcattg

SEQ ID NO: 454303 - DNA, 25 bp, Mus musculus
gaccctctgaaatcatactgcattg

SEQ ID NO: 454304 - DNA, 25 bp, Mus musculus
gaccctctgacaatttttgttttat

SEQ ID NO: 454305 - DNA, 25 bp, Mus musculus
gaccctctgacattttttgttttat

SEQ ID NO: 454306 - DNA, 25 bp, Mus musculus
gaccctctgactatcgcaatggaaa

SEQ ID NO: 454307 - DNA, 25 bp, Mus musculus
gaccctctgactttcgcaatggaaa

SEQ ID NO: 454308 - DNA, 25 bp, Mus musculus
gaccctctggcgatgctagagatta

SEQ ID NO: 454309 - DNA, 25 bp, Mus musculus
gaccctctggcgttgctagagatta

SEQ ID NO: 454310 - DNA, 25 bp, Mus musculus
gaccctctgggaatatgtctcctga

SEQ ID NO: 454311 - DNA, 25 bp, Mus musculus
gaccctctgggattatgtctcctga

SEQ ID NO: 454312 - DNA, 25 bp, Mus musculus
gaccctctgggcactgaggcttctg

SEQ ID NO: 454313 - DNA, 25 bp, Mus musculus
gaccctctgggcatgcttgtagatg

SEQ ID NO: 454314 - DNA, 25 bp, Mus musculus
gaccctctgggctctgaggcttctg

SEQ ID NO: 454315 - DNA, 25 bp, Mus musculus
gaccctctgggcttgcttgtagatg

SEQ ID NO: 454316 - DNA, 25 bp, Mus musculus
gaccctctgtggataaagactgcat

SEQ ID NO: 454317 - DNA, 25 bp, Mus musculus
gaccctctgtggttaaagactgcat

SEQ ID NO: 454318 - DNA, 25 bp, Mus musculus
gaccctcttagtagtaaaggccata

SEQ ID NO: 454319 - DNA, 25 bp, Mus musculus
gaccctcttagttgtaaaggccata

SEQ ID NO: 454320 - DNA, 25 bp, Mus musculus
gaccctcttggacagaattgccgat

SEQ ID NO: 454321 - DNA, 25 bp, Mus musculus
gaccctcttggagagaattgccgat

SEQ ID NO: 454322 - DNA, 25 bp, Mus musculus
gaccctgaaaacaatagccgccaag

SEQ ID NO: 454323 - DNA, 25 bp, Mus musculus
gaccctgaaaactatagccgccaag

SEQ ID NO: 454324 - DNA, 25 bp, Mus musculus
gaccctgaaaagattccagcactta

SEQ ID NO: 454325 - DNA, 25 bp, Mus musculus
gaccctgaaaagtttccagcactta

SEQ ID NO: 454326 - DNA, 25 bp, Mus musculus
gaccctgaaactactagatgtcatc

SEQ ID NO: 454327 - DNA, 25 bp, Mus musculus
gaccctgaaacttctagatgtcatc

SEQ ID NO: 454328 - DNA, 25 bp, Mus musculus
gaccctgaaagcaaggcacctggga

SEQ ID NO: 454329 - DNA, 25 bp, Mus musculus
gaccctgaaagctaggcacctggga

SEQ ID NO: 454330 - DNA, 25 bp, Mus musculus
gaccctgaaatgagttgctcaggtg

SEQ ID NO: 454331 - DNA, 25 bp, Mus musculus
gaccctgaaatgtgttgctcaggtg

SEQ ID NO: 454332 - DNA, 25 bp, Mus musculus
gaccctgaaattacctcggaatatt

SEQ ID NO: 454333 - DNA, 25 bp, Mus musculus
gaccctgaaatttcctcggaatatt

SEQ ID NO: 454334 - DNA, 25 bp, Mus musculus
gaccctgaacatctaccttttggat

SEQ ID NO: 454335 - DNA, 25 bp, Mus musculus
gaccctgaacatgtaccttttggat

SEQ ID NO: 454336 - DNA, 25 bp, Mus musculus
gaccctgaaccaccaagtggagaat

SEQ ID NO: 454337 - DNA, 25 bp, Mus musculus
gaccctgaaccagcaagtggagaat

SEQ ID NO: 454338 - DNA, 25 bp, Mus musculus
gaccctgaagaaactgtcaaatctg

SEQ ID NO: 454339 - DNA, 25 bp, Mus musculus
gaccctgaagaaagacacgacgtgt

SEQ ID NO: 454340 - DNA, 25 bp, Mus musculus
gaccctgaagaacgcgcggtacaat

SEQ ID NO: 454341 - DNA, 25 bp, Mus musculus
gaccctgaagaaggcgcggtacaat

SEQ ID NO: 454342 - DNA, 25 bp, Mus musculus
gaccctgaagaatctgtcaaatctg

SEQ ID NO: 454343 - DNA, 25 bp, Mus musculus
gaccctgaagaatgacacgacgtgt

SEQ ID NO: 454344 - DNA, 25 bp, Mus musculus
gaccctgaaggcagaaatgaacatt

SEQ ID NO: 454345 - DNA, 25 bp, Mus musculus
gaccctgaaggctgaaatgaacatt

SEQ ID NO: 454346 - DNA, 25 bp, Mus musculus
gaccctgaaggtctggttcggacaa

SEQ ID NO: 454347 - DNA, 25 bp, Mus musculus
gaccctgaaggtgtggttcggacaa

SEQ ID NO: 454348 - DNA, 25 bp, Mus musculus
gaccctgaagtcactctttttcaag

SEQ ID NO: 454349 - DNA, 25 bp, Mus musculus
gaccctgaagtctctctttttcaag

SEQ ID NO: 454350 - DNA, 25 bp, Mus musculus
gaccctgaataccatttttcactat

SEQ ID NO: 454351 - DNA, 25 bp, Mus musculus
gaccctgaatacgatttttcactat

SEQ ID NO: 454352 - DNA, 25 bp, Mus musculus
gaccctgacacgaggatgttcttct

SEQ ID NO: 454353 - DNA, 25 bp, Mus musculus
gaccctgacacgtggatgttcttct

SEQ ID NO: 454354 - DNA, 25 bp, Mus musculus
gaccctgacagaaagcccggacata

SEQ ID NO: 454355 - DNA, 25 bp, Mus musculus
gaccctgacagactctaacttattg

SEQ ID NO: 454356 - DNA, 25 bp, Mus musculus
gaccctgacagagtctaacttattg

SEQ ID NO: 454357 - DNA, 25 bp, Mus musculus
gaccctgacagatagcccggacata

SEQ ID NO: 454358 - DNA, 25 bp, Mus musculus
gaccctgactatatagtgctgcagt

SEQ ID NO: 454359 - DNA, 25 bp, Mus musculus
gaccctgactatttagtgctgcagt

SEQ ID NO: 454360 - DNA, 25 bp, Mus musculus
gaccctgacttactaactggcttgt

SEQ ID NO: 454361 - DNA, 25 bp, Mus musculus
gaccctgacttagtaactggcttgt

SEQ ID NO: 454362 - DNA, 25 bp, Mus musculus
gaccctgactttcaaggttatacag

SEQ ID NO: 454363 - DNA, 25 bp, Mus musculus
gaccctgactttgaaggttatacag

SEQ ID NO: 454364 - DNA, 25 bp, Mus musculus
gaccctgagactattggatgctgat

SEQ ID NO: 454365 - DNA, 25 bp, Mus musculus
gaccctgagacttttggatgctgat

SEQ ID NO: 454366 - DNA, 25 bp, Mus musculus
gaccctgagccgagatcatggctta

SEQ ID NO: 454367 - DNA, 25 bp, Mus musculus
gaccctgagccgtgatcatggctta

SEQ ID NO: 454368 - DNA, 25 bp, Mus musculus
gaccctgagggtattatgtaaccct

SEQ ID NO: 454369 - DNA, 25 bp, Mus musculus
gaccctgagggttttatgtaaccct

SEQ ID NO: 454370 - DNA, 25 bp, Mus musculus
gaccctgagtagacttgaagcccta

SEQ ID NO: 454371 - DNA, 25 bp, Mus musculus
gaccctgagtagtcttgaagcccta

SEQ ID NO: 454372 - DNA, 25 bp, Mus musculus
gaccctgagtcactctcgagaggaa

SEQ ID NO: 454373 - DNA, 25 bp, Mus musculus
gaccctgagtcagtctcgagaggaa

SEQ ID NO: 454374 - DNA, 25 bp, Mus musculus
gaccctgatccacaaaaccaataaa

SEQ ID NO: 454375 - DNA, 25 bp, Mus musculus
gaccctgatccagaaaaccaataaa

SEQ ID NO: 454376 - DNA, 25 bp, Mus musculus
gaccctgatctaacgtgcaaacaga

SEQ ID NO: 454377 - DNA, 25 bp, Mus musculus
gaccctgatctatcgtgcaaacaga

SEQ ID NO: 454378 - DNA, 25 bp, Mus musculus
gaccctgatgaactagactcagaag

SEQ ID NO: 454379 - DNA, 25 bp, Mus musculus
gaccctgatgaagtagactcagaag

SEQ ID NO: 454380 - DNA, 25 bp, Mus musculus
gaccctgatgaccagtacaagctga

SEQ ID NO: 454381 - DNA, 25 bp, Mus musculus
gaccctgatgacgagtacaagctga

SEQ ID NO: 454382 - DNA, 25 bp, Mus musculus
gaccctgatgatcctctcagactat

SEQ ID NO: 454383 - DNA, 25 bp, Mus musculus
gaccctgatgatgctctcagactat

SEQ ID NO: 454384 - DNA, 25 bp, Mus musculus
gaccctgcaaacacatcctagttta

SEQ ID NO: 454385 - DNA, 25 bp, Mus musculus
gaccctgcaaactcatcctagttta

SEQ ID NO: 454386 - DNA, 25 bp, Mus musculus
gaccctgcagaactttcctgtgaga

SEQ ID NO: 454387 - DNA, 25 bp, Mus musculus
gaccctgcagaagtttcctgtgaga

SEQ ID NO: 454388 - DNA, 25 bp, Mus musculus
gaccctgcagacacaggtttcagtg

SEQ ID NO: 454389 - DNA, 25 bp, Mus musculus
gaccctgcagactcaggtttcagtg

SEQ ID NO: 454390 - DNA, 25 bp, Mus musculus
gaccctgcagccaagtatcaagcat

SEQ ID NO: 454391 - DNA, 25 bp, Mus musculus
gaccctgcagcctagtatcaagcat

SEQ ID NO: 454392 - DNA, 25 bp, Mus musculus
gaccctgcaggtaccgtagtgagaa

SEQ ID NO: 454393 - DNA, 25 bp, Mus musculus
gaccctgcaggttccgtagtgagaa

SEQ ID NO: 454394 - DNA, 25 bp, Mus musculus
gaccctgcagtcacagaagttccaa

SEQ ID NO: 454395 - DNA, 25 bp, Mus musculus
gaccctgcagtctcagaagttccaa

SEQ ID NO: 454396 - DNA, 25 bp, Mus musculus
gaccctgcattgcaaacttgaagac

SEQ ID NO: 454397 - DNA, 25 bp, Mus musculus
gaccctgcattggaaacttgaagac

SEQ ID NO: 454398 - DNA, 25 bp, Mus musculus
gaccctgccaagattcctgaagcaa

SEQ ID NO: 454399 - DNA, 25 bp, Mus musculus
gaccctgccaagtttcctgaagcaa

SEQ ID NO: 454400 - DNA, 25 bp, Mus musculus
gaccctgccctccagaaagaaacat

SEQ ID NO: 454401 - DNA, 25 bp, Mus musculus
gaccctgccctcgagaaagaaacat

SEQ ID NO: 454402 - DNA, 25 bp, Mus musculus
gaccctgcctcaatgtacaagatgg

SEQ ID NO: 454403 - DNA, 25 bp, Mus musculus
gaccctgcctcattgtacaagatgg

SEQ ID NO: 454404 - DNA, 25 bp, Mus musculus
gaccctgccttgcagtgatactggg

SEQ ID NO: 454405 - DNA, 25 bp, Mus musculus
gaccctgccttggagtgatactggg

SEQ ID NO: 454406 - DNA, 25 bp, Mus musculus
gaccctgcggaaccctctggaggaa

SEQ ID NO: 454407 - DNA, 25 bp, Mus musculus
gaccctgcggaagcctctggaggaa

SEQ ID NO: 454408 - DNA, 25 bp, Mus musculus
gaccctgctcagctcaagggacatg

SEQ ID NO: 454409 - DNA, 25 bp, Mus musculus
gaccctgctcaggtcaagggacatg

SEQ ID NO: 454410 - DNA, 25 bp, Mus musculus
gaccctgctgaacataacaggcctt

SEQ ID NO: 454411 - DNA, 25 bp, Mus musculus
gaccctgctgaagataacaggcctt

SEQ ID NO: 454412 - DNA, 25 bp, Mus musculus
gaccctgctgacactcaaaaactga

SEQ ID NO: 454413 - DNA, 25 bp, Mus musculus
gaccctgctgactctcaaaaactga

SEQ ID NO: 454414 - DNA, 25 bp, Mus musculus
gaccctgctgataaacatgattaga

SEQ ID NO: 454415 - DNA, 25 bp, Mus musculus
gaccctgctgattaacatgattaga

SEQ ID NO: 454416 - DNA, 25 bp, Mus musculus
gaccctgctgtaaatgccccatttt

SEQ ID NO: 454417 - DNA, 25 bp, Mus musculus
gaccctgctgtatatgccccatttt

SEQ ID NO: 454418 - DNA, 25 bp, Mus musculus
gaccctgctgtgcagaaccttggta

SEQ ID NO: 454419 - DNA, 25 bp, Mus musculus
gaccctgctgtggagaaccttggta

SEQ ID NO: 454420 - DNA, 25 bp, Mus musculus
gaccctgcttccagaatccgttggt

SEQ ID NO: 454421 - DNA, 25 bp, Mus musculus
gaccctgcttcctgaatccgttggt

SEQ ID NO: 454422 - DNA, 25 bp, Mus musculus
gaccctggacatcctcactgtgaag

SEQ ID NO: 454423 - DNA, 25 bp, Mus musculus
gaccctggacatgctcactgtgaag

SEQ ID NO: 454424 - DNA, 25 bp, Mus musculus
gaccctggactcagatgcttagaaa

SEQ ID NO: 454425 - DNA, 25 bp, Mus musculus
gaccctggactctgatgcttagaaa

SEQ ID NO: 454426 - DNA, 25 bp, Mus musculus
gaccctggagagactcggcctatta

SEQ ID NO: 454427 - DNA, 25 bp, Mus musculus
gaccctggagagtctcggcctatta

SEQ ID NO: 454428 - DNA, 25 bp, Mus musculus
gaccctggaggtaggactgtcatcc

SEQ ID NO: 454429 - DNA, 25 bp, Mus musculus
gaccctggaggttggactgtcatcc

SEQ ID NO: 454430 - DNA, 25 bp, Mus musculus
gaccctggagttaattcagacttaa

SEQ ID NO: 454431 - DNA, 25 bp, Mus musculus
gaccctggagtttattcagacttaa

SEQ ID NO: 454432 - DNA, 25 bp, Mus musculus
gaccctggatcacatatgtgtccta

SEQ ID NO: 454433 - DNA, 25 bp, Mus musculus
gaccctggatcagatatgtgtccta

SEQ ID NO: 454434 - DNA, 25 bp, Mus musculus
gaccctggatctcaatagtcctaga

SEQ ID NO: 454435 - DNA, 25 bp, Mus musculus
gaccctggatctgaatagtcctaga

SEQ ID NO: 454436 - DNA, 25 bp, Mus musculus
gaccctggcactctagaggtgtcat

SEQ ID NO: 454437 - DNA, 25 bp, Mus musculus
gaccctggcactgtagaggtgtcat

SEQ ID NO: 454438 - DNA, 25 bp, Mus musculus
gaccctggctacagattgacttgag

SEQ ID NO: 454439 - DNA, 25 bp, Mus musculus
gaccctggctactgattgacttgag

SEQ ID NO: 454440 - DNA, 25 bp, Mus musculus
gaccctggctataaggtgaaacagc

SEQ ID NO: 454441 - DNA, 25 bp, Mus musculus
gaccctggctattaggtgaaacagc

SEQ ID NO: 454442 - DNA, 25 bp, Mus musculus
gaccctgggatgagtgctggtctct

SEQ ID NO: 454443 - DNA, 25 bp, Mus musculus
gaccctgggatgtgtgctggtctct

SEQ ID NO: 454444 - DNA, 25 bp, Mus musculus
gaccctgggcaacgccagaagccta

SEQ ID NO: 454445 - DNA, 25 bp, Mus musculus
gaccctgggcaaggccagaagccta

SEQ ID NO: 454446 - DNA, 25 bp, Mus musculus
gaccctgggtcaaaggctgtgtcta

SEQ ID NO: 454447 - DNA, 25 bp, Mus musculus
gaccctgggtcataggctgtgtcta

SEQ ID NO: 454448 - DNA, 25 bp, Mus musculus
gaccctgggtctagtccagtagcta

SEQ ID NO: 454449 - DNA, 25 bp, Mus musculus
gaccctgggtcttgtccagtagcta

SEQ ID NO: 454450 - DNA, 25 bp, Mus musculus
gaccctgggttcatttgccagtaca

SEQ ID NO: 454451 - DNA, 25 bp, Mus musculus
gaccctgggttcttttgccagtaca

SEQ ID NO: 454452 - DNA, 25 bp, Mus musculus
gaccctggtggaccaggttaccagc

SEQ ID NO: 454453 - DNA, 25 bp, Mus musculus
gaccctggtggagcaggttaccagc

SEQ ID NO: 454454 - DNA, 25 bp, Mus musculus
gaccctggtgtgactaagcatcagg

SEQ ID NO: 454455 - DNA, 25 bp, Mus musculus
gaccctggtgtgtctaagcatcagg

SEQ ID NO: 454456 - DNA, 25 bp, Mus musculus
gaccctggttaaatctctgtttgca

SEQ ID NO: 454457 - DNA, 25 bp, Mus musculus
gaccctggttaattctctgtttgca

SEQ ID NO: 454458 - DNA, 25 bp, Mus musculus
gaccctgtaattcctaccagtaccg

SEQ ID NO: 454459 - DNA, 25 bp, Mus musculus
gaccctgtaattgctaccagtaccg

SEQ ID NO: 454460 - DNA, 25 bp, Mus musculus
gaccctgtagaaattcaagccctgg

SEQ ID NO: 454461 - DNA, 25 bp, Mus musculus
gaccctgtagaatttcaagccctgg

SEQ ID NO: 454462 - DNA, 25 bp, Mus musculus
gaccctgtatcacaaccttgcatgg

SEQ ID NO: 454463 - DNA, 25 bp, Mus musculus
gaccctgtatcagaaccttgcatgg

SEQ ID NO: 454464 - DNA, 25 bp, Mus musculus
gaccctgtcctcaacaaagatgact

SEQ ID NO: 454465 - DNA, 25 bp, Mus musculus
gaccctgtcctctacaaagatgact

SEQ ID NO: 454466 - DNA, 25 bp, Mus musculus
gaccctgtccttctgaacatttcta

SEQ ID NO: 454467 - DNA, 25 bp, Mus musculus
gaccctgtccttgtgaacatttcta

SEQ ID NO: 454468 - DNA, 25 bp, Mus musculus
gaccctgtctaaaatacatcccaga

SEQ ID NO: 454469 - DNA, 25 bp, Mus musculus
gaccctgtctaatatacatcccaga

SEQ ID NO: 454470 - DNA, 25 bp, Mus musculus
gaccctgtcttcacatatagcagag

SEQ ID NO: 454471 - DNA, 25 bp, Mus musculus
gaccctgtcttctcatatagcagag

SEQ ID NO: 454472 - DNA, 25 bp, Mus musculus
gaccctgtgatccaagagcggcata

SEQ ID NO: 454473 - DNA, 25 bp, Mus musculus
gaccctgtgatcgaagagcggcata

SEQ ID NO: 454474 - DNA, 25 bp, Mus musculus
gaccctgtgcctaatttgaactaac

SEQ ID NO: 454475 - DNA, 25 bp, Mus musculus
gaccctgtgccttatttgaactaac

SEQ ID NO: 454476 - DNA, 25 bp, Mus musculus
gaccctgtgctcagaccatttgatg

SEQ ID NO: 454477 - DNA, 25 bp, Mus musculus
gaccctgtgctctgaccatttgatg

SEQ ID NO: 454478 - DNA, 25 bp, Mus musculus
gaccctgtgcttcctagcaggatca

SEQ ID NO: 454479 - DNA, 25 bp, Mus musculus
gaccctgtgcttctagagtggcgtt

SEQ ID NO: 454480 - DNA, 25 bp, Mus musculus
gaccctgtgcttgctagcaggatca

SEQ ID NO: 454481 - DNA, 25 bp, Mus musculus
gaccctgtgcttgtagagtggcgtt

SEQ ID NO: 454482 - DNA, 25 bp, Mus musculus
gaccctgtggagcaccaaagccgaa

SEQ ID NO: 454483 - DNA, 25 bp, Mus musculus
gaccctgtggaggaccaaagccgaa

SEQ ID NO: 454484 - DNA, 25 bp, Mus musculus
gaccctgtggctcatactagcaata

SEQ ID NO: 454485 - DNA, 25 bp, Mus musculus
gaccctgtggctgatactagcaata

SEQ ID NO: 454486 - DNA, 25 bp, Mus musculus
gaccctgtgggaaaactcttcctga

SEQ ID NO: 454487 - DNA, 25 bp, Mus musculus
gaccctgtgggataactcttcctga

SEQ ID NO: 454488 - DNA, 25 bp, Mus musculus
gaccctgtgggtagatccctatgaa

SEQ ID NO: 454489 - DNA, 25 bp, Mus musculus
gaccctgtgggttgatccctatgaa

SEQ ID NO: 454490 - DNA, 25 bp, Mus musculus
gaccctgtggtcatctttaactgtg

SEQ ID NO: 454491 - DNA, 25 bp, Mus musculus
gaccctgtggtcttctttaactgtg

SEQ ID NO: 454492 - DNA, 25 bp, Mus musculus
gaccctgtggtgcacaactcacaaa

SEQ ID NO: 454493 - DNA, 25 bp, Mus musculus
gaccctgtggtgcacgtctggaata

SEQ ID NO: 454494 - DNA, 25 bp, Mus musculus
gaccctgtggtggacaactcacaaa

SEQ ID NO: 454495 - DNA, 25 bp, Mus musculus
gaccctgtggtggacgtctggaata

SEQ ID NO: 454496 - DNA, 25 bp, Mus musculus
gaccctgtgtaccttgtagctagaa

SEQ ID NO: 454497 - DNA, 25 bp, Mus musculus
gaccctgtgtacgttgtagctagaa

SEQ ID NO: 454498 - DNA, 25 bp, Mus musculus
gaccctgtgtcacactgtaaaccag

SEQ ID NO: 454499 - DNA, 25 bp, Mus musculus
gaccctgtgtcagactgtaaaccag

SEQ ID NO: 454500 - DNA, 25 bp, Mus musculus
gaccctgtgtcgcataatttttaca

SEQ ID NO: 454501 - DNA, 25 bp, Mus musculus
gaccctgtgtcggataatttttaca

SEQ ID NO: 454502 - DNA, 25 bp, Mus musculus
gaccctgtgttcagtccagtggtta

SEQ ID NO: 454503 - DNA, 25 bp, Mus musculus
gaccctgtgttccttgttgtgaatc

SEQ ID NO: 454504 - DNA, 25 bp, Mus musculus
gaccctgtgttcgttgttgtgaatc

SEQ ID NO: 454505 - DNA, 25 bp, Mus musculus
gaccctgtgttctgtccagtggtta

SEQ ID NO: 454506 - DNA, 25 bp, Mus musculus
gaccctgttacacacataccctatg

SEQ ID NO: 454507 - DNA, 25 bp, Mus musculus
gaccctgttacagacataccctatg

SEQ ID NO: 454508 - DNA, 25 bp, Mus musculus
gaccctgttcatcaggtgtcactat

SEQ ID NO: 454509 - DNA, 25 bp, Mus musculus
gaccctgttcatgaggtgtcactat

SEQ ID NO: 454510 - DNA, 25 bp, Mus musculus
gaccctgttctgcagtcaatttgta

SEQ ID NO: 454511 - DNA, 25 bp, Mus musculus
gaccctgttctggagtcaatttgta

SEQ ID NO: 454512 - DNA, 25 bp, Mus musculus
gaccctgttggtcatatgccacaat

SEQ ID NO: 454513 - DNA, 25 bp, Mus musculus
gaccctgttggtgatatgccacaat

SEQ ID NO: 454514 - DNA, 25 bp, Mus musculus
gaccctgttgtacgtatttctcctc

SEQ ID NO: 454515 - DNA, 25 bp, Mus musculus
gaccctgttgtaggtatttctcctc

SEQ ID NO: 454516 - DNA, 25 bp, Mus musculus
gaccctgttgttcgaactcatgaaa

SEQ ID NO: 454517 - DNA, 25 bp, Mus musculus
gaccctgttgttggaactcatgaaa

SEQ ID NO: 454518 - DNA, 25 bp, Mus musculus
gaccctgtttcacgattactaacaa

SEQ ID NO: 454519 - DNA, 25 bp, Mus musculus
gaccctgtttcaggattactaacaa

SEQ ID NO: 454520 - DNA, 25 bp, Mus musculus
gaccctgtttccaaatggtaccaat

SEQ ID NO: 454521 - DNA, 25 bp, Mus musculus
gaccctgtttcctaatggtaccaat

SEQ ID NO: 454522 - DNA, 25 bp, Mus musculus
gaccctgtttctaagaatgacactg

SEQ ID NO: 454523 - DNA, 25 bp, Mus musculus
gaccctgtttcttagaatgacactg

SEQ ID NO: 454524 - DNA, 25 bp, Mus musculus
gaccctgttttcaaaaagagaccag

SEQ ID NO: 454525 - DNA, 25 bp, Mus musculus
gaccctgttttctaaaagagaccag

SEQ ID NO: 454526 - DNA, 25 bp, Mus musculus
gacccttaaaacacagcccttgagg

SEQ ID NO: 454527 - DNA, 25 bp, Mus musculus
gacccttaaaactcagcccttgagg

SEQ ID NO: 454528 - DNA, 25 bp, Mus musculus
gacccttaacctaatacctttcatg

SEQ ID NO: 454529 - DNA, 25 bp, Mus musculus
gacccttaaccttatacctttcatg

SEQ ID NO: 454530 - DNA, 25 bp, Mus musculus
gacccttaccagaagcagtgcgatg

SEQ ID NO: 454531 - DNA, 25 bp, Mus musculus
gacccttaccagtagcagtgcgatg

SEQ ID NO: 454532 - DNA, 25 bp, Mus musculus
gacccttatctgcaggagactcgct

SEQ ID NO: 454533 - DNA, 25 bp, Mus musculus
gacccttatctggaggagactcgct

SEQ ID NO: 454534 - DNA, 25 bp, Mus musculus
gacccttcaggactccctggagaag

SEQ ID NO: 454535 - DNA, 25 bp, Mus musculus
gacccttcaggagtccctggagaag

SEQ ID NO: 454536 - DNA, 25 bp, Mus musculus
gacccttcatcccagggtttctagt

SEQ ID NO: 454537 - DNA, 25 bp, Mus musculus
gacccttcatccgagggtttctagt

SEQ ID NO: 454538 - DNA, 25 bp, Mus musculus
gacccttccaatcttttcttttgtg

SEQ ID NO: 454539 - DNA, 25 bp, Mus musculus
gacccttccaatgttttcttttgtg

SEQ ID NO: 454540 - DNA, 25 bp, Mus musculus
gacccttccctcaggtgtgatgaaa

SEQ ID NO: 454541 - DNA, 25 bp, Mus musculus
gacccttccctctggtgtgatgaaa

SEQ ID NO: 454542 - DNA, 25 bp, Mus musculus
gacccttccgagcaagcactatatg

SEQ ID NO: 454543 - DNA, 25 bp, Mus musculus
gacccttccgaggaagcactatatg

SEQ ID NO: 454544 - DNA, 25 bp, Mus musculus
gacccttcctaaaatgtccaagttt

SEQ ID NO: 454545 - DNA, 25 bp, Mus musculus
gacccttcctaatatgtccaagttt

SEQ ID NO: 454546 - DNA, 25 bp, Mus musculus
gacccttctctactcacaagattat

SEQ ID NO: 454547 - DNA, 25 bp, Mus musculus
gacccttctctagtcacaagattat

SEQ ID NO: 454548 - DNA, 25 bp, Mus musculus
gacccttctgtgactactttgggaa

SEQ ID NO: 454549 - DNA, 25 bp, Mus musculus
gacccttctgtgtctactttgggaa

SEQ ID NO: 454550 - DNA, 25 bp, Mus musculus
gacccttcttatcaggacatgagag

SEQ ID NO: 454551 - DNA, 25 bp, Mus musculus
gacccttcttatgaggacatgagag

SEQ ID NO: 454552 - DNA, 25 bp, Mus musculus
gacccttgaagaccaatcagcctgt

SEQ ID NO: 454553 - DNA, 25 bp, Mus musculus
gacccttgaagagcaatcagcctgt

SEQ ID NO: 454554 - DNA, 25 bp, Mus musculus
gacccttgaatacagtttctcacac

SEQ ID NO: 454555 - DNA, 25 bp, Mus musculus
gacccttgaatagagtttctcacac

SEQ ID NO: 454556 - DNA, 25 bp, Mus musculus
gacccttgaatcatgaaccctccat

SEQ ID NO: 454557 - DNA, 25 bp, Mus musculus
gacccttgaatcttgaaccctccat

SEQ ID NO: 454558 - DNA, 25 bp, Mus musculus
gacccttgacctacagttgacttta

SEQ ID NO: 454559 - DNA, 25 bp, Mus musculus
gacccttgaccttcagttgacttta

SEQ ID NO: 454560 - DNA, 25 bp, Mus musculus
gacccttgaggcaccttgcagaaag

SEQ ID NO: 454561 - DNA, 25 bp, Mus musculus
gacccttgaggctccttgcagaaag

SEQ ID NO: 454562 - DNA, 25 bp, Mus musculus
gacccttgagtgaatttcatgaatg

SEQ ID NO: 454563 - DNA, 25 bp, Mus musculus
gacccttgagtgtatttcatgaatg

SEQ ID NO: 454564 - DNA, 25 bp, Mus musculus
gacccttgatctactggctggatct

SEQ ID NO: 454565 - DNA, 25 bp, Mus musculus
gacccttgatcttctggctggatct

SEQ ID NO: 454566 - DNA, 25 bp, Mus musculus
gacccttgatggacattcatcactt

SEQ ID NO: 454567 - DNA, 25 bp, Mus musculus
gacccttgatggtcattcatcactt

SEQ ID NO: 454568 - DNA, 25 bp, Mus musculus
gacccttggaaacgcctgtatactt

SEQ ID NO: 454569 - DNA, 25 bp, Mus musculus
gacccttggaaaggcctgtatactt

SEQ ID NO: 454570 - DNA, 25 bp, Mus musculus
gacccttggagcatgtgcatacaga

SEQ ID NO: 454571 - DNA, 25 bp, Mus musculus
gacccttggagcttgtgcatacaga

SEQ ID NO: 454572 - DNA, 25 bp, Mus musculus
gacccttgggcaaaatctcctctga

SEQ ID NO: 454573 - DNA, 25 bp, Mus musculus
gacccttgggcataatctcctctga

SEQ ID NO: 454574 - DNA, 25 bp, Mus musculus
gacccttgggctagtgtgcatagta

SEQ ID NO: 454575 - DNA, 25 bp, Mus musculus
gacccttgggcttgtgtgcatagta

SEQ ID NO: 454576 - DNA, 25 bp, Mus musculus
gacccttgggtgattaatcgcagca

SEQ ID NO: 454577 - DNA, 25 bp, Mus musculus
gacccttgggtgtttaatcgcagca

SEQ ID NO: 454578 - DNA, 25 bp, Mus musculus
gacccttgtaatctattcagaacct

SEQ ID NO: 454579 - DNA, 25 bp, Mus musculus
gacccttgtaatgtattcagaacct

SEQ ID NO: 454580 - DNA, 25 bp, Mus musculus
gacccttgtccccaaattaatgatc

SEQ ID NO: 454581 - DNA, 25 bp, Mus musculus
gacccttgtcccgaaattaatgatc

SEQ ID NO: 454582 - DNA, 25 bp, Mus musculus
gacccttgtctaaacctgtgtcaag

SEQ ID NO: 454583 - DNA, 25 bp, Mus musculus
gacccttgtctatacctgtgtcaag

SEQ ID NO: 454584 - DNA, 25 bp, Mus musculus
gacccttgtgaacttccttggagct

SEQ ID NO: 454585 - DNA, 25 bp, Mus musculus
gacccttgtgaagttccttggagct

SEQ ID NO: 454586 - DNA, 25 bp, Mus musculus
gacccttgtgatatagccagacacg

SEQ ID NO: 454587 - DNA, 25 bp, Mus musculus
gacccttgtgatttagccagacacg

SEQ ID NO: 454588 - DNA, 25 bp, Mus musculus
gacccttgtgtaagtaaccttgctc

SEQ ID NO: 454589 - DNA, 25 bp, Mus musculus
gacccttgtgtatgtaaccttgctc

SEQ ID NO: 454590 - DNA, 25 bp, Mus musculus
gacccttgtgtcaccactagtgact

SEQ ID NO: 454591 - DNA, 25 bp, Mus musculus
gacccttgtgtctccactagtgact

SEQ ID NO: 454592 - DNA, 25 bp, Mus musculus
gacccttgttctattcacttgcaaa

SEQ ID NO: 454593 - DNA, 25 bp, Mus musculus
gacccttgttcttttcacttgcaaa

SEQ ID NO: 454594 - DNA, 25 bp, Mus musculus
gaccctttaataagcatggaatctg

SEQ ID NO: 454595 - DNA, 25 bp, Mus musculus
gaccctttaatatgcatggaatctg

SEQ ID NO: 454596 - DNA, 25 bp, Mus musculus
gaccctttaatgcacacccttagca

SEQ ID NO: 454597 - DNA, 25 bp, Mus musculus
gaccctttaatgcaggagttggcat

SEQ ID NO: 454598 - DNA, 25 bp, Mus musculus
gaccctttaatgcaggttcatttta

SEQ ID NO: 454599 - DNA, 25 bp, Mus musculus
gaccctttaatggacacccttagca

SEQ ID NO: 454600 - DNA, 25 bp, Mus musculus
gaccctttaatggaggagttggcat

SEQ ID NO: 454601 - DNA, 25 bp, Mus musculus
gaccctttaatggaggttcatttta

SEQ ID NO: 454602 - DNA, 25 bp, Mus musculus
gaccctttagataatatatagatgt

SEQ ID NO: 454603 - DNA, 25 bp, Mus musculus
gaccctttagattatatatagatgt

SEQ ID NO: 454604 - DNA, 25 bp, Mus musculus
gaccctttatgaatttcctgggaat

SEQ ID NO: 454605 - DNA, 25 bp, Mus musculus
gaccctttatgattttcctgggaat

SEQ ID NO: 454606 - DNA, 25 bp, Mus musculus
gaccctttcaacctgtacatcgagt

SEQ ID NO: 454607 - DNA, 25 bp, Mus musculus
gaccctttcaacgtgtacatcgagt

SEQ ID NO: 454608 - DNA, 25 bp, Mus musculus
gaccctttcattattgttacataga

SEQ ID NO: 454609 - DNA, 25 bp, Mus musculus
gaccctttcatttttgttacataga

SEQ ID NO: 454610 - DNA, 25 bp, Mus musculus
gaccctttccacagatgattctgga

SEQ ID NO: 454611 - DNA, 25 bp, Mus musculus
gaccctttccactgatgattctgga

SEQ ID NO: 454612 - DNA, 25 bp, Mus musculus
gaccctttgactacagattttcagg

SEQ ID NO: 454613 - DNA, 25 bp, Mus musculus
gaccctttgactccagagtagagag

SEQ ID NO: 454614 - DNA, 25 bp, Mus musculus
gaccctttgactgcagagtagagag

SEQ ID NO: 454615 - DNA, 25 bp, Mus musculus
gaccctttgacttcagattttcagg

SEQ ID NO: 454616 - DNA, 25 bp, Mus musculus
gaccctttggagaggaagcagtaca

SEQ ID NO: 454617 - DNA, 25 bp, Mus musculus
gaccctttggagtggaagcagtaca

SEQ ID NO: 454618 - DNA, 25 bp, Mus musculus
gaccctttggtcacggagttcatta

SEQ ID NO: 454619 - DNA, 25 bp, Mus musculus
gaccctttggtctcggagttcatta

SEQ ID NO: 454620 - DNA, 25 bp, Mus musculus
gaccctttgtcaatgttacaactga

SEQ ID NO: 454621 - DNA, 25 bp, Mus musculus
gaccctttgtcattgttacaactga

SEQ ID NO: 454622 - DNA, 25 bp, Mus musculus
gaccctttgtccagggcagttggtt

SEQ ID NO: 454623 - DNA, 25 bp, Mus musculus
gaccctttgtcctgggcagttggtt

SEQ ID NO: 454624 - DNA, 25 bp, Mus musculus
gaccctttgtgtattagtgactcag

SEQ ID NO: 454625 - DNA, 25 bp, Mus musculus
gaccctttgtgttttagtgactcag

SEQ ID NO: 454626 - DNA, 25 bp, Mus musculus
gacccttttaaaatattgactgcag

SEQ ID NO: 454627 - DNA, 25 bp, Mus musculus
gacccttttaaattattgactgcag

SEQ ID NO: 454628 - DNA, 25 bp, Mus musculus
gacccttttaagacgtacagttcat

SEQ ID NO: 454629 - DNA, 25 bp, Mus musculus
gacccttttaagtcgtacagttcat

SEQ ID NO: 454630 - DNA, 25 bp, Mus musculus
gacccttttataacctgaggaaaca

SEQ ID NO: 454631 - DNA, 25 bp, Mus musculus
gacccttttatatcctgaggaaaca

SEQ ID NO: 454632 - DNA, 25 bp, Mus musculus
gacccttttcagaaagtgactcatc

SEQ ID NO: 454633 - DNA, 25 bp, Mus musculus
gacccttttcagtaagtgactcatc

SEQ ID NO: 454634 - DNA, 25 bp, Mus musculus
gacccttttcttcttctagtagctt

SEQ ID NO: 454635 - DNA, 25 bp, Mus musculus
gacccttttcttgttctagtagctt

SEQ ID NO: 454636 - DNA, 25 bp, Mus musculus
gacccttttgccagttttaagccag

SEQ ID NO: 454637 - DNA, 25 bp, Mus musculus
gacccttttgcctgttttaagccag

SEQ ID NO: 454638 - DNA, 25 bp, Mus musculus
gacccttttgggatttgcctatcag

SEQ ID NO: 454639 - DNA, 25 bp, Mus musculus
gacccttttgggttttgcctatcag

SEQ ID NO: 454640 - DNA, 25 bp, Mus musculus
gacccttttgttccaagagctgtaa

SEQ ID NO: 454641 - DNA, 25 bp, Mus musculus
gacccttttgttgcaagagctgtaa

SEQ ID NO: 454642 - DNA, 25 bp, Mus musculus
gaccctttttctcagtgcattgtga

SEQ ID NO: 454643 - DNA, 25 bp, Mus musculus
gaccctttttctgagtgcattgtga

SEQ ID NO: 454644 - DNA, 25 bp, Mus musculus
gaccctttttgtcgcatgtctatta

SEQ ID NO: 454645 - DNA, 25 bp, Mus musculus
gaccctttttgtggcatgtctatta

SEQ ID NO: 454646 - DNA, 25 bp, Mus musculus
gacccttttttgacagttgcaaacg

SEQ ID NO: 454647 - DNA, 25 bp, Mus musculus
gacccttttttgtcagttgcaaacg

SEQ ID NO: 454648 - DNA, 25 bp, Mus musculus
gaccgaaaccaacaaatcagaaatg

SEQ ID NO: 454649 - DNA, 25 bp, Mus musculus
gaccgaaaccaagaaatcagaaatg

SEQ ID NO: 454650 - DNA, 25 bp, Mus musculus
gaccgaaagcaacaggtaccccatg

SEQ ID NO: 454651 - DNA, 25 bp, Mus musculus
gaccgaaagcaagaggtaccccatg

SEQ ID NO: 454652 - DNA, 25 bp, Mus musculus
gaccgaaagtcccatccgacttgtt

SEQ ID NO: 454653 - DNA, 25 bp, Mus musculus
gaccgaaagtccgatccgacttgtt

SEQ ID NO: 454654 - DNA, 25 bp, Mus musculus
gaccgaaataggagagaccctgcct

SEQ ID NO: 454655 - DNA, 25 bp, Mus musculus
gaccgaaataggtgagaccctgcct

SEQ ID NO: 454656 - DNA, 25 bp, Mus musculus
gaccgaaatccgacgggaagcctgg

SEQ ID NO: 454657 - DNA, 25 bp, Mus musculus
gaccgaaatccgtcgggaagcctgg

SEQ ID NO: 454658 - DNA, 25 bp, Mus musculus
gaccgaaccaggacattcgcttcga

SEQ ID NO: 454659 - DNA, 25 bp, Mus musculus
gaccgaaccaggtcattcgcttcga

SEQ ID NO: 454660 - DNA, 25 bp, Mus musculus
gaccgaactcacacatcacagttga

SEQ ID NO: 454661 - DNA, 25 bp, Mus musculus
gaccgaactcactcatcacagttga

SEQ ID NO: 454662 - DNA, 25 bp, Mus musculus
gaccgaactggcatcaaagtcttgg

SEQ ID NO: 454663 - DNA, 25 bp, Mus musculus
gaccgaactggcttcaaagtcttgg

SEQ ID NO: 454664 - DNA, 25 bp, Mus musculus
gaccgaagcctgaccataagttgga

SEQ ID NO: 454665 - DNA, 25 bp, Mus musculus
gaccgaagcctgtccataagttgga

SEQ ID NO: 454666 - DNA, 25 bp, Mus musculus
gaccgaagcgttcgtggatcacctc

SEQ ID NO: 454667 - DNA, 25 bp, Mus musculus
gaccgaagcgttggtggatcacctc

SEQ ID NO: 454668 - DNA, 25 bp, Mus musculus
gaccgaagctgtcctactgttgaca

SEQ ID NO: 454669 - DNA, 25 bp, Mus musculus
gaccgaagctgtgctactgttgaca

SEQ ID NO: 454670 - DNA, 25 bp, Mus musculus
gaccgaagtcttcccatttgcagga

SEQ ID NO: 454671 - DNA, 25 bp, Mus musculus
gaccgaagtcttgccatttgcagga

SEQ ID NO: 454672 - DNA, 25 bp, Mus musculus
gaccgaatagttacctattctcttt

SEQ ID NO: 454673 - DNA, 25 bp, Mus musculus
gaccgaatagtttcctattctcttt

SEQ ID NO: 454674 - DNA, 25 bp, Mus musculus
gaccgacaaggactggcccaagcca

SEQ ID NO: 454675 - DNA, 25 bp, Mus musculus
gaccgacaaggagtggcccaagcca

SEQ ID NO: 454676 - DNA, 25 bp, Mus musculus
gaccgaccggagataattccagcaa

SEQ ID NO: 454677 - DNA, 25 bp, Mus musculus
gaccgaccggagttaattccagcaa

SEQ ID NO: 454678 - DNA, 25 bp, Mus musculus
gaccgacctgctatacttgatggat

SEQ ID NO: 454679 - DNA, 25 bp, Mus musculus
gaccgacctgctttacttgatggat

SEQ ID NO: 454680 - DNA, 25 bp, Mus musculus
gaccgaccttgaagtagagacaaag

SEQ ID NO: 454681 - DNA, 25 bp, Mus musculus
gaccgaccttgatgtagagacaaag

SEQ ID NO: 454682 - DNA, 25 bp, Mus musculus
gaccgactaagaatcagagaactgg

SEQ ID NO: 454683 - DNA, 25 bp, Mus musculus
gaccgactaagattcagagaactgg

SEQ ID NO: 454684 - DNA, 25 bp, Mus musculus
gaccgactatctagctacatggagg

SEQ ID NO: 454685 - DNA, 25 bp, Mus musculus
gaccgactatcttgctacatggagg

SEQ ID NO: 454686 - DNA, 25 bp, Mus musculus
gaccgactcagtcgcttattgagga

SEQ ID NO: 454687 - DNA, 25 bp, Mus musculus
gaccgactcagtggcttattgagga

SEQ ID NO: 454688 - DNA, 25 bp, Mus musculus
gaccgactctaaagaagttctacag

SEQ ID NO: 454689 - DNA, 25 bp, Mus musculus
gaccgactctaatgaagttctacag

SEQ ID NO: 454690 - DNA, 25 bp, Mus musculus
gaccgactgacaaccaaagtggaca

SEQ ID NO: 454691 - DNA, 25 bp, Mus musculus
gaccgactgacatccaaagtggaca

SEQ ID NO: 454692 - DNA, 25 bp, Mus musculus
gaccgactgagaagtaaatccccac

SEQ ID NO: 454693 - DNA, 25 bp, Mus musculus
gaccgactgagatgtaaatccccac

SEQ ID NO: 454694 - DNA, 25 bp, Mus musculus
gaccgactgcccctctgcagggtag

SEQ ID NO: 454695 - DNA, 25 bp, Mus musculus
gaccgactgcccgtctgcagggtag

SEQ ID NO: 454696 - DNA, 25 bp, Mus musculus
gaccgagaaaggctctctgcagcgt

SEQ ID NO: 454697 - DNA, 25 bp, Mus musculus
gaccgagaaagggtctctgcagcgt

SEQ ID NO: 454698 - DNA, 25 bp, Mus musculus
gaccgagaaattaggttcaacaatg

SEQ ID NO: 454699 - DNA, 25 bp, Mus musculus
gaccgagaaatttggttcaacaatg

SEQ ID NO: 454700 - DNA, 25 bp, Mus musculus
gaccgagaacaacgactatctccag

SEQ ID NO: 454701 - DNA, 25 bp, Mus musculus
gaccgagaacaaggactatctccag

SEQ ID NO: 454702 - DNA, 25 bp, Mus musculus
gaccgagaatttcatgatgactaat

SEQ ID NO: 454703 - DNA, 25 bp, Mus musculus
gaccgagaatttgatgatgactaat

SEQ ID NO: 454704 - DNA, 25 bp, Mus musculus
gaccgagaccacacagaggccgaag

SEQ ID NO: 454705 - DNA, 25 bp, Mus musculus
gaccgagaccactcagaggccgaag

SEQ ID NO: 454706 - DNA, 25 bp, Mus musculus
gaccgagaccggcacggctacatcg

SEQ ID NO: 454707 - DNA, 25 bp, Mus musculus
gaccgagaccgggacggctacatcg

SEQ ID NO: 454708 - DNA, 25 bp, Mus musculus
gaccgagagacaagccgtcagcgac

SEQ ID NO: 454709 - DNA, 25 bp, Mus musculus
gaccgagagacatgccgtcagcgac

SEQ ID NO: 454710 - DNA, 25 bp, Mus musculus
gaccgagagggtaacacatcatttt

SEQ ID NO: 454711 - DNA, 25 bp, Mus musculus
gaccgagagggttacacatcatttt

SEQ ID NO: 454712 - DNA, 25 bp, Mus musculus
gaccgagaggtgcagtacttcaaga

SEQ ID NO: 454713 - DNA, 25 bp, Mus musculus
gaccgagaggtggagtacttcaaga

SEQ ID NO: 454714 - DNA, 25 bp, Mus musculus
gaccgagatccaacggacttctggg

SEQ ID NO: 454715 - DNA, 25 bp, Mus musculus
gaccgagatccatcggacttctggg

SEQ ID NO: 454716 - DNA, 25 bp, Mus musculus
gaccgagatggaccgcaacgtgaca

SEQ ID NO: 454717 - DNA, 25 bp, Mus musculus
gaccgagatggagcgcaacgtgaca

SEQ ID NO: 454718 - DNA, 25 bp, Mus musculus
gaccgagcaaaacacgagtgagcct

SEQ ID NO: 454719 - DNA, 25 bp, Mus musculus
gaccgagcaaaagacgagtgagcct

SEQ ID NO: 454720 - DNA, 25 bp, Mus musculus
gaccgagcccacattgtacatatga

SEQ ID NO: 454721 - DNA, 25 bp, Mus musculus
gaccgagcccactttgtacatatga

SEQ ID NO: 454722 - DNA, 25 bp, Mus musculus
gaccgagccggaagatcagaattca

SEQ ID NO: 454723 - DNA, 25 bp, Mus musculus
gaccgagccggatgatcagaattca

SEQ ID NO: 454724 - DNA, 25 bp, Mus musculus
gaccgagcgaatagtcaccacctac

SEQ ID NO: 454725 - DNA, 25 bp, Mus musculus
gaccgagcgaattgtcaccacctac

SEQ ID NO: 454726 - DNA, 25 bp, Mus musculus
gaccgagctataacccaaaccaaag

SEQ ID NO: 454727 - DNA, 25 bp, Mus musculus
gaccgagctatatcccaaaccaaag

SEQ ID NO: 454728 - DNA, 25 bp, Mus musculus
gaccgagctgccagtcacagagaat

SEQ ID NO: 454729 - DNA, 25 bp, Mus musculus
gaccgagctgcctgtcacagagaat

SEQ ID NO: 454730 - DNA, 25 bp, Mus musculus
gaccgagctgctcatccgcaagctg

SEQ ID NO: 454731 - DNA, 25 bp, Mus musculus
gaccgagctgctgatccgcaagctg

SEQ ID NO: 454732 - DNA, 25 bp, Mus musculus
gaccgaggacggatgttcagcccta

SEQ ID NO: 454733 - DNA, 25 bp, Mus musculus
gaccgaggacggttgttcagcccta

SEQ ID NO: 454734 - DNA, 25 bp, Mus musculus
gaccgaggagccatagtgaggaact

SEQ ID NO: 454735 - DNA, 25 bp, Mus musculus
gaccgaggagccttagtgaggaact

SEQ ID NO: 454736 - DNA, 25 bp, Mus musculus
gaccgaggcatcctccgcaacaagg

SEQ ID NO: 454737 - DNA, 25 bp, Mus musculus
gaccgaggcatcgtccgcaacaagg

SEQ ID NO: 454738 - DNA, 25 bp, Mus musculus
gaccgagggcctagaacaggatcga

SEQ ID NO: 454739 - DNA, 25 bp, Mus musculus
gaccgagggccttgaacaggatcga

SEQ ID NO: 454740 - DNA, 25 bp, Mus musculus
gaccgagtagccagcaatgcatcta

SEQ ID NO: 454741 - DNA, 25 bp, Mus musculus
gaccgagtagcctgcaatgcatcta

SEQ ID NO: 454742 - DNA, 25 bp, Mus musculus
gaccgagtgacactcaacatgaagt

SEQ ID NO: 454743 - DNA, 25 bp, Mus musculus
gaccgagtgacagtcaacatgaagt

SEQ ID NO: 454744 - DNA, 25 bp, Mus musculus
gaccgagtgtatcacaatctgcgtt

SEQ ID NO: 454745 - DNA, 25 bp, Mus musculus
gaccgagtgtatgacaatctgcgtt

SEQ ID NO: 454746 - DNA, 25 bp, Mus musculus
gaccgagttcaaagcgaacgctgag

SEQ ID NO: 454747 - DNA, 25 bp, Mus musculus
gaccgagttcaatgcgaacgctgag

SEQ ID NO: 454748 - DNA, 25 bp, Mus musculus
gaccgagttctgaatgtcttgaaac

SEQ ID NO: 454749 - DNA, 25 bp, Mus musculus
gaccgagttctgtatgtcttgaaac

SEQ ID NO: 454750 - DNA, 25 bp, Mus musculus
gaccgagttttccaggagtgtctca

SEQ ID NO: 454751 - DNA, 25 bp, Mus musculus
gaccgagttttcgaggagtgtctca

SEQ ID NO: 454752 - DNA, 25 bp, Mus musculus
gaccgataaattcatccacaggaca

SEQ ID NO: 454753 - DNA, 25 bp, Mus musculus
gaccgataaattgatccacaggaca

SEQ ID NO: 454754 - DNA, 25 bp, Mus musculus
gaccgataatgcattctttggctac

SEQ ID NO: 454755 - DNA, 25 bp, Mus musculus
gaccgataatgctttctttggctac

SEQ ID NO: 454756 - DNA, 25 bp, Mus musculus
gaccgatagaatcattggtaatgag

SEQ ID NO: 454757 - DNA, 25 bp, Mus musculus
gaccgatagaatgattggtaatgag

SEQ ID NO: 454758 - DNA, 25 bp, Mus musculus
gaccgatagtgaaccagtaccgtga

SEQ ID NO: 454759 - DNA, 25 bp, Mus musculus
gaccgatagtgatccagtaccgtga

SEQ ID NO: 454760 - DNA, 25 bp, Mus musculus
gaccgatcacccagtagctgagttg

SEQ ID NO: 454761 - DNA, 25 bp, Mus musculus
gaccgatcaccctgtagctgagttg

SEQ ID NO: 454762 - DNA, 25 bp, Mus musculus
gaccgatcagtgatggacacatcca

SEQ ID NO: 454763 - DNA, 25 bp, Mus musculus
gaccgatcagtgttggacacatcca

SEQ ID NO: 454764 - DNA, 25 bp, Mus musculus
gaccgatgaccacatccggatgcat

SEQ ID NO: 454765 - DNA, 25 bp, Mus musculus
gaccgatgaccagatccggatgcat

SEQ ID NO: 454766 - DNA, 25 bp, Mus musculus
gaccgatgatgacacgctaggcaga

SEQ ID NO: 454767 - DNA, 25 bp, Mus musculus
gaccgatgatgagacgctaggcaga

SEQ ID NO: 454768 - DNA, 25 bp, Mus musculus
gaccgatgcatcatacctttttcaa

SEQ ID NO: 454769 - DNA, 25 bp, Mus musculus
gaccgatgcatcttacctttttcaa

SEQ ID NO: 454770 - DNA, 25 bp, Mus musculus
gaccgatggtaaacactactggctg

SEQ ID NO: 454771 - DNA, 25 bp, Mus musculus
gaccgatggtaatcactactggctg

SEQ ID NO: 454772 - DNA, 25 bp, Mus musculus
gaccgatgtgtaaccaagtacttgg

SEQ ID NO: 454773 - DNA, 25 bp, Mus musculus
gaccgatgtgtatccaagtacttgg

SEQ ID NO: 454774 - DNA, 25 bp, Mus musculus
gaccgatgttctcttctggttgaca

SEQ ID NO: 454775 - DNA, 25 bp, Mus musculus
gaccgatgttctgttctggttgaca

SEQ ID NO: 454776 - DNA, 25 bp, Mus musculus
gaccgattcgcaccaatttgaacag

SEQ ID NO: 454777 - DNA, 25 bp, Mus musculus
gaccgattcgcagcaatttgaacag

SEQ ID NO: 454778 - DNA, 25 bp, Mus musculus
gaccgattggtgactctggaggaat

SEQ ID NO: 454779 - DNA, 25 bp, Mus musculus
gaccgattggtgtctctggaggaat

SEQ ID NO: 454780 - DNA, 25 bp, Mus musculus
gaccgattgtgtactatattcttag

SEQ ID NO: 454781 - DNA, 25 bp, Mus musculus
gaccgattgtgttctatattcttag

SEQ ID NO: 454782 - DNA, 25 bp, Mus musculus
gaccgatttattcagactctacatt

SEQ ID NO: 454783 - DNA, 25 bp, Mus musculus
gaccgatttattgagactctacatt

SEQ ID NO: 454784 - DNA, 25 bp, Mus musculus
gaccgatttctgaaggaacgtgcct

SEQ ID NO: 454785 - DNA, 25 bp, Mus musculus
gaccgatttctgtaggaacgtgcct

SEQ ID NO: 454786 - DNA, 25 bp, Mus musculus
gaccgcaaggaacgtgctacgcctt

SEQ ID NO: 454787 - DNA, 25 bp, Mus musculus
gaccgcaaggaaggtgctacgcctt

SEQ ID NO: 454788 - DNA, 25 bp, Mus musculus
gaccgcaagtgcatgaccactgtga

SEQ ID NO: 454789 - DNA, 25 bp, Mus musculus
gaccgcaagtgcttgaccactgtga

SEQ ID NO: 454790 - DNA, 25 bp, Mus musculus
gaccgcaattcactccattttaatc

SEQ ID NO: 454791 - DNA, 25 bp, Mus musculus
gaccgcaattcagtccattttaatc

SEQ ID NO: 454792 - DNA, 25 bp, Mus musculus
gaccgcagaccaccaacagtagtat

SEQ ID NO: 454793 - DNA, 25 bp, Mus musculus
gaccgcagaccagcaacagtagtat

SEQ ID NO: 454794 - DNA, 25 bp, Mus musculus
gaccgcagagcactgcacagcaggt

SEQ ID NO: 454795 - DNA, 25 bp, Mus musculus
gaccgcagagcagtgcacagcaggt

SEQ ID NO: 454796 - DNA, 25 bp, Mus musculus
gaccgcagcagtacttattaaccaa

SEQ ID NO: 454797 - DNA, 25 bp, Mus musculus
gaccgcagcagttcttattaaccaa

SEQ ID NO: 454798 - DNA, 25 bp, Mus musculus
gaccgcagccgaattcaggatctat

SEQ ID NO: 454799 - DNA, 25 bp, Mus musculus
gaccgcagccgatttcaggatctat

SEQ ID NO: 454800 - DNA, 25 bp, Mus musculus
gaccgcaggctgattatactgccag

SEQ ID NO: 454801 - DNA, 25 bp, Mus musculus
gaccgcaggctgtttatactgccag

SEQ ID NO: 454802 - DNA, 25 bp, Mus musculus
gaccgcagtctgctggatgccctga

SEQ ID NO: 454803 - DNA, 25 bp, Mus musculus
gaccgcagtctggtggatgccctga

SEQ ID NO: 454804 - DNA, 25 bp, Mus musculus
gaccgcagtgaacactgttcctgca

SEQ ID NO: 454805 - DNA, 25 bp, Mus musculus
gaccgcagtgaagactgttcctgca

SEQ ID NO: 454806 - DNA, 25 bp, Mus musculus
gaccgcagttgtctctgcgcagaca

SEQ ID NO: 454807 - DNA, 25 bp, Mus musculus
gaccgcagttgtgtctgcgcagaca

SEQ ID NO: 454808 - DNA, 25 bp, Mus musculus
gaccgcatcatccagatcaaacaag

SEQ ID NO: 454809 - DNA, 25 bp, Mus musculus
gaccgcatcatcgagatcaaacaag

SEQ ID NO: 454810 - DNA, 25 bp, Mus musculus
gaccgcatcgtcaaacagtggacac

SEQ ID NO: 454811 - DNA, 25 bp, Mus musculus
gaccgcatcgtctaacagtggacac

SEQ ID NO: 454812 - DNA, 25 bp, Mus musculus
gaccgcatgattacagacatcagta

SEQ ID NO: 454813 - DNA, 25 bp, Mus musculus
gaccgcatgatttcagacatcagta

SEQ ID NO: 454814 - DNA, 25 bp, Mus musculus
gaccgccacaacaccaaacatgtat

SEQ ID NO: 454815 - DNA, 25 bp, Mus musculus
gaccgccacaactccaaacatgtat

SEQ ID NO: 454816 - DNA, 25 bp, Mus musculus
gaccgccacaatatcaccattatga

SEQ ID NO: 454817 - DNA, 25 bp, Mus musculus
gaccgccacaatttcaccattatga

SEQ ID NO: 454818 - DNA, 25 bp, Mus musculus
gaccgccaggccaggaagtgactga

SEQ ID NO: 454819 - DNA, 25 bp, Mus musculus
gaccgccaggcctggaagtgactga

SEQ ID NO: 454820 - DNA, 25 bp, Mus musculus
gaccgccatgtcagctgtggctcag

SEQ ID NO: 454821 - DNA, 25 bp, Mus musculus
gaccgccatgtctgctgtggctcag

SEQ ID NO: 454822 - DNA, 25 bp, Mus musculus
gaccgcccatggactgagactagat

SEQ ID NO: 454823 - DNA, 25 bp, Mus musculus
gaccgcccatggtctgagactagat

SEQ ID NO: 454824 - DNA, 25 bp, Mus musculus
gaccgccctacactgctacaggaag

SEQ ID NO: 454825 - DNA, 25 bp, Mus musculus
gaccgccctacagtgctacaggaag

SEQ ID NO: 454826 - DNA, 25 bp, Mus musculus
gaccgccgatgcaatcttatgtgaa

SEQ ID NO: 454827 - DNA, 25 bp, Mus musculus
gaccgccgatgctatcttatgtgaa

SEQ ID NO: 454828 - DNA, 25 bp, Mus musculus
gaccgcctcaaaacatgtaatttac

SEQ ID NO: 454829 - DNA, 25 bp, Mus musculus
gaccgcctcaaatcatgtaatttac

SEQ ID NO: 454830 - DNA, 25 bp, Mus musculus
gaccgcgagggcaacacctagtaac

SEQ ID NO: 454831 - DNA, 25 bp, Mus musculus
gaccgcgagggctacacctagtaac

SEQ ID NO: 454832 - DNA, 25 bp, Mus musculus
gaccgcgggcttaacttgggaagat

SEQ ID NO: 454833 - DNA, 25 bp, Mus musculus
gaccgcgggctttacttgggaagat

SEQ ID NO: 454834 - DNA, 25 bp, Mus musculus
gaccgcgtcactcccatcaatggaa

SEQ ID NO: 454835 - DNA, 25 bp, Mus musculus
gaccgcgtcactgccatcaatggaa

SEQ ID NO: 454836 - DNA, 25 bp, Mus musculus
gaccgctaacgacagacatcaggaa

SEQ ID NO: 454837 - DNA, 25 bp, Mus musculus
gaccgctaacgagagacatcaggaa

SEQ ID NO: 454838 - DNA, 25 bp, Mus musculus
gaccgctacaccagagagtcattct

SEQ ID NO: 454839 - DNA, 25 bp, Mus musculus
gaccgctacacctgagagtcattct

SEQ ID NO: 454840 - DNA, 25 bp, Mus musculus
gaccgctacttgcagcctgttcact

SEQ ID NO: 454841 - DNA, 25 bp, Mus musculus
gaccgctacttggagcctgttcact

SEQ ID NO: 454842 - DNA, 25 bp, Mus musculus
gaccgctcactgagccctaggaaag

SEQ ID NO: 454843 - DNA, 25 bp, Mus musculus
gaccgctcactgtgccctaggaaag

SEQ ID NO: 454844 - DNA, 25 bp, Mus musculus
gaccgctgctggacccgcagatgaa

SEQ ID NO: 454845 - DNA, 25 bp, Mus musculus
gaccgctgctggtcccgcagatgaa

SEQ ID NO: 454846 - DNA, 25 bp, Mus musculus
gaccgctggcgcagtatgactgtag

SEQ ID NO: 454847 - DNA, 25 bp, Mus musculus
gaccgctggcgctgtatgactgtag

SEQ ID NO: 454848 - DNA, 25 bp, Mus musculus
gaccgctgtgaaatgtacgtttctg

SEQ ID NO: 454849 - DNA, 25 bp, Mus musculus
gaccgctgtgaattgtacgtttctg

SEQ ID NO: 454850 - DNA, 25 bp, Mus musculus
gaccgcttcatgattttatacctta

SEQ ID NO: 454851 - DNA, 25 bp, Mus musculus
gaccgcttcatgtttttatacctta

SEQ ID NO: 454852 - DNA, 25 bp, Mus musculus
gaccgcttctgcactctgatgggag

SEQ ID NO: 454853 - DNA, 25 bp, Mus musculus
gaccgcttctgctctctgatgggag

SEQ ID NO: 454854 - DNA, 25 bp, Mus musculus
gaccgcttgtaccatgggcgttcat

SEQ ID NO: 454855 - DNA, 25 bp, Mus musculus
gaccgcttgtacgatgggcgttcat

SEQ ID NO: 454856 - DNA, 25 bp, Mus musculus
gaccgctttataactcagtttacat

SEQ ID NO: 454857 - DNA, 25 bp, Mus musculus
gaccgctttatatctcagtttacat

SEQ ID NO: 454858 - DNA, 25 bp, Mus musculus
gaccggaaatccctatctagcagga

SEQ ID NO: 454859 - DNA, 25 bp, Mus musculus
gaccggaaatccgtatctagcagga

SEQ ID NO: 454860 - DNA, 25 bp, Mus musculus
gaccggaaggacaggaggactcttt

SEQ ID NO: 454861 - DNA, 25 bp, Mus musculus
gaccggaaggaccatcaccagtgta

SEQ ID NO: 454862 - DNA, 25 bp, Mus musculus
gaccggaaggacgatcaccagtgta

SEQ ID NO: 454863 - DNA, 25 bp, Mus musculus
gaccggaaggactggaggactcttt

SEQ ID NO: 454864 - DNA, 25 bp, Mus musculus
gaccggaaggttcccgaccagcaga

SEQ ID NO: 454865 - DNA, 25 bp, Mus musculus
gaccggaaggttgccgaccagcaga

SEQ ID NO: 454866 - DNA, 25 bp, Mus musculus
gaccggacaggtaacttcacttctg

SEQ ID NO: 454867 - DNA, 25 bp, Mus musculus
gaccggacaggttacttcacttctg

SEQ ID NO: 454868 - DNA, 25 bp, Mus musculus
gaccggactctcatgaaggaacaga

SEQ ID NO: 454869 - DNA, 25 bp, Mus musculus
gaccggactctcttgaaggaacaga

SEQ ID NO: 454870 - DNA, 25 bp, Mus musculus
gaccggacttatccgtcgccttccg

SEQ ID NO: 454871 - DNA, 25 bp, Mus musculus
gaccggacttatgcgtcgccttccg

SEQ ID NO: 454872 - DNA, 25 bp, Mus musculus
gaccggagagcgatggctactttat

SEQ ID NO: 454873 - DNA, 25 bp, Mus musculus
gaccggagagcgttggctactttat

SEQ ID NO: 454874 - DNA, 25 bp, Mus musculus
gaccggagccaaccactggactatg

SEQ ID NO: 454875 - DNA, 25 bp, Mus musculus
gaccggagccaagcactggactatg

SEQ ID NO: 454876 - DNA, 25 bp, Mus musculus
gaccggagcgggaactgccatctct

SEQ ID NO: 454877 - DNA, 25 bp, Mus musculus
gaccggagcgggtactgccatctct

SEQ ID NO: 454878 - DNA, 25 bp, Mus musculus
gaccggagctgacgatcggcatcca

SEQ ID NO: 454879 - DNA, 25 bp, Mus musculus
gaccggagctgaggatcggcatcca

SEQ ID NO: 454880 - DNA, 25 bp, Mus musculus
gaccggagtcacaagtcacagtgaa

SEQ ID NO: 454881 - DNA, 25 bp, Mus musculus
gaccggagtcactagtcacagtgaa

SEQ ID NO: 454882 - DNA, 25 bp, Mus musculus
gaccggatgagtcaatgcccaattt

SEQ ID NO: 454883 - DNA, 25 bp, Mus musculus
gaccggatgagtgaatgcccaattt

SEQ ID NO: 454884 - DNA, 25 bp, Mus musculus
gaccggatgctacagtttccatata

SEQ ID NO: 454885 - DNA, 25 bp, Mus musculus
gaccggatgctagagtttccatata

SEQ ID NO: 454886 - DNA, 25 bp, Mus musculus
gaccggcaagcacccctatataaga

SEQ ID NO: 454887 - DNA, 25 bp, Mus musculus
gaccggcaagcagccctatataaga

SEQ ID NO: 454888 - DNA, 25 bp, Mus musculus
gaccggcacagacttgtcacaagct

SEQ ID NO: 454889 - DNA, 25 bp, Mus musculus
gaccggcacagagttgtcacaagct

SEQ ID NO: 454890 - DNA, 25 bp, Mus musculus
gaccggcagttccaggagctcaatg

SEQ ID NO: 454891 - DNA, 25 bp, Mus musculus
gaccggcagttcgaggagctcaatg

SEQ ID NO: 454892 - DNA, 25 bp, Mus musculus
gaccggcattacctacttcgtggtg

SEQ ID NO: 454893 - DNA, 25 bp, Mus musculus
gaccggcattacgtacttcgtggtg

SEQ ID NO: 454894 - DNA, 25 bp, Mus musculus
gaccggcccaacctgcaggaccagc

SEQ ID NO: 454895 - DNA, 25 bp, Mus musculus
gaccggcccaacgtgcaggaccagc

SEQ ID NO: 454896 - DNA, 25 bp, Mus musculus
gaccggcctgtaagctatccagaaa

SEQ ID NO: 454897 - DNA, 25 bp, Mus musculus
gaccggcctgtatgctatccagaaa

SEQ ID NO: 454898 - DNA, 25 bp, Mus musculus
gaccggccttatcaactgtgggacc

SEQ ID NO: 454899 - DNA, 25 bp, Mus musculus
gaccggccttatgaactgtgggacc

SEQ ID NO: 454900 - DNA, 25 bp, Mus musculus
gaccggccttcaactaacttgtgtg

SEQ ID NO: 454901 - DNA, 25 bp, Mus musculus
gaccggccttcatctaacttgtgtg

SEQ ID NO: 454902 - DNA, 25 bp, Mus musculus
gaccggcgtacaaatgcaagacaac

SEQ ID NO: 454903 - DNA, 25 bp, Mus musculus
gaccggcgtacatatgcaagacaac

SEQ ID NO: 454904 - DNA, 25 bp, Mus musculus
gaccggctactaagttaggacctca

SEQ ID NO: 454905 - DNA, 25 bp, Mus musculus
gaccggctactatgttaggacctca

SEQ ID NO: 454906 - DNA, 25 bp, Mus musculus
gaccggctctgcagatttgaaattt

SEQ ID NO: 454907 - DNA, 25 bp, Mus musculus
gaccggctctgctgatttgaaattt

SEQ ID NO: 454908 - DNA, 25 bp, Mus musculus
gaccggctgacgcacaccagtaagt

SEQ ID NO: 454909 - DNA, 25 bp, Mus musculus
gaccggctgacggacaccagtaagt

SEQ ID NO: 454910 - DNA, 25 bp, Mus musculus
gaccggctgctaattttgttgctgc

SEQ ID NO: 454911 - DNA, 25 bp, Mus musculus
gaccggctgctatttttgttgctgc

SEQ ID NO: 454912 - DNA, 25 bp, Mus musculus
gaccggctggtgatgcataacaaag

SEQ ID NO: 454913 - DNA, 25 bp, Mus musculus
gaccggctggtgttgcataacaaag

SEQ ID NO: 454914 - DNA, 25 bp, Mus musculus
gaccggctgtctactgctgcttgag

SEQ ID NO: 454915 - DNA, 25 bp, Mus musculus
gaccggctgtcttctgctgcttgag

SEQ ID NO: 454916 - DNA, 25 bp, Mus musculus
gaccggcttcaactccggaggaaat

SEQ ID NO: 454917 - DNA, 25 bp, Mus musculus
gaccggcttcaagtccggaggaaat

SEQ ID NO: 454918 - DNA, 25 bp, Mus musculus
gaccgggaacccaagagtgccagat

SEQ ID NO: 454919 - DNA, 25 bp, Mus musculus
gaccgggaaccctagagtgccagat

SEQ ID NO: 454920 - DNA, 25 bp, Mus musculus
gaccgggactcacaggactacgctt

SEQ ID NO: 454921 - DNA, 25 bp, Mus musculus
gaccgggactcagaggactacgctt

SEQ ID NO: 454922 - DNA, 25 bp, Mus musculus
gaccgggactgtcttgaaggactca

SEQ ID NO: 454923 - DNA, 25 bp, Mus musculus
gaccgggactgtgttgaaggactca

SEQ ID NO: 454924 - DNA, 25 bp, Mus musculus
gaccgggagagtaaagcaaaggcta

SEQ ID NO: 454925 - DNA, 25 bp, Mus musculus
gaccgggagagttaagcaaaggcta

SEQ ID NO: 454926 - DNA, 25 bp, Mus musculus
gaccgggaggtgcatagcatctcat

SEQ ID NO: 454927 - DNA, 25 bp, Mus musculus
gaccgggaggtggatagcatctcat

SEQ ID NO: 454928 - DNA, 25 bp, Mus musculus
gaccgggatcacctgatatgtgtgt

SEQ ID NO: 454929 - DNA, 25 bp, Mus musculus
gaccgggatcacgtgatatgtgtgt

SEQ ID NO: 454930 - DNA, 25 bp, Mus musculus
gaccgggatctgcaatctctgagat

SEQ ID NO: 454931 - DNA, 25 bp, Mus musculus
gaccgggatctggaatctctgagat

SEQ ID NO: 454932 - DNA, 25 bp, Mus musculus
gaccgggcaccacatgggaaagcaa

SEQ ID NO: 454933 - DNA, 25 bp, Mus musculus
gaccgggcaccagatgggaaagcaa

SEQ ID NO: 454934 - DNA, 25 bp, Mus musculus
gaccgggcaggtactacccagaacg

SEQ ID NO: 454935 - DNA, 25 bp, Mus musculus
gaccgggcaggttctacccagaacg

SEQ ID NO: 454936 - DNA, 25 bp, Mus musculus
gaccgggccgtcacaatacggagaa

SEQ ID NO: 454937 - DNA, 25 bp, Mus musculus
gaccgggccgtctcaatacggagaa

SEQ ID NO: 454938 - DNA, 25 bp, Mus musculus
gaccgggtcataagttgtttgactt

SEQ ID NO: 454939 - DNA, 25 bp, Mus musculus
gaccgggtcatatgttgtttgactt

SEQ ID NO: 454940 - DNA, 25 bp, Mus musculus
gaccgggtcctcactaagcaaaatg

SEQ ID NO: 454941 - DNA, 25 bp, Mus musculus
gaccgggtcctctctaagcaaaatg

SEQ ID NO: 454942 - DNA, 25 bp, Mus musculus
gaccgggtcttgactaagttgctca

SEQ ID NO: 454943 - DNA, 25 bp, Mus musculus
gaccgggtcttgtctaagttgctca

SEQ ID NO: 454944 - DNA, 25 bp, Mus musculus
gaccggtaccttccatggaacgcag

SEQ ID NO: 454945 - DNA, 25 bp, Mus musculus
gaccggtaccttgcatggaacgcag

SEQ ID NO: 454946 - DNA, 25 bp, Mus musculus
gaccggtagaatccgctccaagtga

SEQ ID NO: 454947 - DNA, 25 bp, Mus musculus
gaccggtagaatgcgctccaagtga

SEQ ID NO: 454948 - DNA, 25 bp, Mus musculus
gaccggtctccacatacctgtggaa

SEQ ID NO: 454949 - DNA, 25 bp, Mus musculus
gaccggtctccagatacctgtggaa

SEQ ID NO: 454950 - DNA, 25 bp, Mus musculus
gaccggtgaacacccaaaacctgct

SEQ ID NO: 454951 - DNA, 25 bp, Mus musculus
gaccggtgaacagccaaaacctgct

SEQ ID NO: 454952 - DNA, 25 bp, Mus musculus
gaccggtgtagcacagattagctca

SEQ ID NO: 454953 - DNA, 25 bp, Mus musculus
gaccggtgtagctcagattagctca

SEQ ID NO: 454954 - DNA, 25 bp, Mus musculus
gaccggtgtggtattttagttgata

SEQ ID NO: 454955 - DNA, 25 bp, Mus musculus
gaccggtgtggttttttagttgata

SEQ ID NO: 454956 - DNA, 25 bp, Mus musculus
gaccggttggtcaatcgcctaaaga

SEQ ID NO: 454957 - DNA, 25 bp, Mus musculus
gaccggttggtctatcgcctaaaga

SEQ ID NO: 454958 - DNA, 25 bp, Mus musculus
gaccggtttgacatttcatccctgc

SEQ ID NO: 454959 - DNA, 25 bp, Mus musculus
gaccggtttgacttttcatccctgc

SEQ ID NO: 454960 - DNA, 25 bp, Mus musculus
gaccgtaaatataaggtgtctccat

SEQ ID NO: 454961 - DNA, 25 bp, Mus musculus
gaccgtaaatattaggtgtctccat

SEQ ID NO: 454962 - DNA, 25 bp, Mus musculus
gaccgtaactatctacagtgctgtg

SEQ ID NO: 454963 - DNA, 25 bp, Mus musculus
gaccgtaactatgtacagtgctgtg

SEQ ID NO: 454964 - DNA, 25 bp, Mus musculus
gaccgtaagagcacccagatcgagc

SEQ ID NO: 454965 - DNA, 25 bp, Mus musculus
gaccgtaagagctcccagatcgagc

SEQ ID NO: 454966 - DNA, 25 bp, Mus musculus
gaccgtacacgcctgctggtagact

SEQ ID NO: 454967 - DNA, 25 bp, Mus musculus
gaccgtacacgcgtgctggtagact

SEQ ID NO: 454968 - DNA, 25 bp, Mus musculus
gaccgtacagtaccctcaatgggat

SEQ ID NO: 454969 - DNA, 25 bp, Mus musculus
gaccgtacagtagcctcaatgggat

SEQ ID NO: 454970 - DNA, 25 bp, Mus musculus
gaccgtacatctctgttgaattact

SEQ ID NO: 454971 - DNA, 25 bp, Mus musculus
gaccgtacatctgtgttgaattact

SEQ ID NO: 454972 - DNA, 25 bp, Mus musculus
gaccgtactaccctgaataagcttg

SEQ ID NO: 454973 - DNA, 25 bp, Mus musculus
gaccgtactaccgtgaataagcttg

SEQ ID NO: 454974 - DNA, 25 bp, Mus musculus
gaccgtaggatgctgatccttctaa

SEQ ID NO: 454975 - DNA, 25 bp, Mus musculus
gaccgtaggatggtgatccttctaa

SEQ ID NO: 454976 - DNA, 25 bp, Mus musculus
gaccgtatgcagaggtttccaaaca

SEQ ID NO: 454977 - DNA, 25 bp, Mus musculus
gaccgtatgcagtggtttccaaaca

SEQ ID NO: 454978 - DNA, 25 bp, Mus musculus
gaccgtattagtatctgtccttgtt

SEQ ID NO: 454979 - DNA, 25 bp, Mus musculus
gaccgtattagtttctgtccttgtt

SEQ ID NO: 454980 - DNA, 25 bp, Mus musculus
gaccgtcacaaaatgtagtgcctga

SEQ ID NO: 454981 - DNA, 25 bp, Mus musculus
gaccgtcacaaattgtagtgcctga

SEQ ID NO: 454982 - DNA, 25 bp, Mus musculus
gaccgtcagcacaattcttacagaa

SEQ ID NO: 454983 - DNA, 25 bp, Mus musculus
gaccgtcagcactattcttacagaa

SEQ ID NO: 454984 - DNA, 25 bp, Mus musculus
gaccgtcatggtcaaaacattcttt

SEQ ID NO: 454985 - DNA, 25 bp, Mus musculus
gaccgtcatggtgaaaacattcttt

SEQ ID NO: 454986 - DNA, 25 bp, Mus musculus
gaccgtccaacgaagccctgatgaa

SEQ ID NO: 454987 - DNA, 25 bp, Mus musculus
gaccgtccaacgtagccctgatgaa

SEQ ID NO: 454988 - DNA, 25 bp, Mus musculus
gaccgtccctggattacaggatgga

SEQ ID NO: 454989 - DNA, 25 bp, Mus musculus
gaccgtccctggtttacaggatgga

SEQ ID NO: 454990 - DNA, 25 bp, Mus musculus
gaccgtccgaaccacgggcataaag

SEQ ID NO: 454991 - DNA, 25 bp, Mus musculus
gaccgtccgaacgacgggcataaag

SEQ ID NO: 454992 - DNA, 25 bp, Mus musculus
gaccgtcctattctaaaattcttca

SEQ ID NO: 454993 - DNA, 25 bp, Mus musculus
gaccgtcctattgtaaaattcttca

SEQ ID NO: 454994 - DNA, 25 bp, Mus musculus
gaccgtcctggacgctgtgatcctg

SEQ ID NO: 454995 - DNA, 25 bp, Mus musculus
gaccgtcctggaggctgtgatcctg

SEQ ID NO: 454996 - DNA, 25 bp, Mus musculus
gaccgtccttggagctgggagtatt

SEQ ID NO: 454997 - DNA, 25 bp, Mus musculus
gaccgtccttggtgctgggagtatt

SEQ ID NO: 454998 - DNA, 25 bp, Mus musculus
gaccgtctaaaaagacaccgtgctc

SEQ ID NO: 454999 - DNA, 25 bp, Mus musculus
gaccgtctaaaatgacaccgtgctc

SEQ ID NO: 455000 - DNA, 25 bp, Mus musculus
gaccgtctaaggagctgtgttgacc

SEQ ID NO: 455001 - DNA, 25 bp, Mus musculus
gaccgtctaaggtgctgtgttgacc

SEQ ID NO: 455002 - DNA, 25 bp, Mus musculus
gaccgtctcacaaaagcaggaacaa

SEQ ID NO: 455003 - DNA, 25 bp, Mus musculus
gaccgtctcacataagcaggaacaa

SEQ ID NO: 455004 - DNA, 25 bp, Mus musculus
gaccgtctgcaaaatttcactggaa

SEQ ID NO: 455005 - DNA, 25 bp, Mus musculus
gaccgtctgcaatatttcactggaa

SEQ ID NO: 455006 - DNA, 25 bp, Mus musculus
gaccgtctgcagcaacttagcctaa

SEQ ID NO: 455007 - DNA, 25 bp, Mus musculus
gaccgtctgcaggaacttagcctaa

SEQ ID NO: 455008 - DNA, 25 bp, Mus musculus
gaccgtctgcctaattcatgagtaa

SEQ ID NO: 455009 - DNA, 25 bp, Mus musculus
gaccgtctgccttattcatgagtaa

SEQ ID NO: 455010 - DNA, 25 bp, Mus musculus
gaccgtctgtgaaattgatgagtat

SEQ ID NO: 455011 - DNA, 25 bp, Mus musculus
gaccgtctgtgatattgatgagtat

SEQ ID NO: 455012 - DNA, 25 bp, Mus musculus
gaccgtctttttaactacatgtact

SEQ ID NO: 455013 - DNA, 25 bp, Mus musculus
gaccgtcttttttactacatgtact

SEQ ID NO: 455014 - DNA, 25 bp, Mus musculus
gaccgtgaaacccagaatgcttcta

SEQ ID NO: 455015 - DNA, 25 bp, Mus musculus
gaccgtgaaaccgagaatgcttcta

SEQ ID NO: 455016 - DNA, 25 bp, Mus musculus
gaccgtgaaacgacagatgctgacc

SEQ ID NO: 455017 - DNA, 25 bp, Mus musculus
gaccgtgaaacgtcagatgctgacc

SEQ ID NO: 455018 - DNA, 25 bp, Mus musculus
gaccgtgaccaaagtgcactcatgt

SEQ ID NO: 455019 - DNA, 25 bp, Mus musculus
gaccgtgaccaatgtgcactcatgt

SEQ ID NO: 455020 - DNA, 25 bp, Mus musculus
gaccgtgactatcagatgacagatc

SEQ ID NO: 455021 - DNA, 25 bp, Mus musculus
gaccgtgactatgagatgacagatc

SEQ ID NO: 455022 - DNA, 25 bp, Mus musculus
gaccgtgactgtctgggacttgacc

SEQ ID NO: 455023 - DNA, 25 bp, Mus musculus
gaccgtgactgtgtgggacttgacc

SEQ ID NO: 455024 - DNA, 25 bp, Mus musculus
gaccgtgagcatagtggagcctttc

SEQ ID NO: 455025 - DNA, 25 bp, Mus musculus
gaccgtgagcattgtggagcctttc

SEQ ID NO: 455026 - DNA, 25 bp, Mus musculus
gaccgtgagggtccaggaacacctc

SEQ ID NO: 455027 - DNA, 25 bp, Mus musculus
gaccgtgagggtgcaggaacacctc

SEQ ID NO: 455028 - DNA, 25 bp, Mus musculus
gaccgtgagtcccagtcaccttggg

SEQ ID NO: 455029 - DNA, 25 bp, Mus musculus
gaccgtgagtccgagtcaccttggg

SEQ ID NO: 455030 - DNA, 25 bp, Mus musculus
gaccgtgcagaactactcccgaggg

SEQ ID NO: 455031 - DNA, 25 bp, Mus musculus
gaccgtgcagaagtactcccgaggg

SEQ ID NO: 455032 - DNA, 25 bp, Mus musculus
gaccgtgccaaacttcttactgaaa

SEQ ID NO: 455033 - DNA, 25 bp, Mus musculus
gaccgtgccaaagttcttactgaaa

SEQ ID NO: 455034 - DNA, 25 bp, Mus musculus
gaccgtgcgcataccctgggacgga

SEQ ID NO: 455035 - DNA, 25 bp, Mus musculus
gaccgtgcgcattccctgggacgga

SEQ ID NO: 455036 - DNA, 25 bp, Mus musculus
gaccgtgcggcccaagaagatcaac

SEQ ID NO: 455037 - DNA, 25 bp, Mus musculus
gaccgtgcggccgaagaagatcaac

SEQ ID NO: 455038 - DNA, 25 bp, Mus musculus
gaccgtgcgtgtctggaagatcccc

SEQ ID NO: 455039 - DNA, 25 bp, Mus musculus
gaccgtgcgtgtgtggaagatcccc

SEQ ID NO: 455040 - DNA, 25 bp, Mus musculus
gaccgtgctgtaagaccccagtgaa

SEQ ID NO: 455041 - DNA, 25 bp, Mus musculus
gaccgtgctgtatgaccccagtgaa

SEQ ID NO: 455042 - DNA, 25 bp, Mus musculus
gaccgtggaatcaggaaactcgcta

SEQ ID NO: 455043 - DNA, 25 bp, Mus musculus
gaccgtggaatctggaaactcgcta

SEQ ID NO: 455044 - DNA, 25 bp, Mus musculus
gaccgtggatgacagctgtttccca

SEQ ID NO: 455045 - DNA, 25 bp, Mus musculus
gaccgtggatgagagctgtttccca

SEQ ID NO: 455046 - DNA, 25 bp, Mus musculus
gaccgtggcggaactgagagcctca

SEQ ID NO: 455047 - DNA, 25 bp, Mus musculus
gaccgtggcggatctgagagcctca

SEQ ID NO: 455048 - DNA, 25 bp, Mus musculus
gaccgtggcttccacagagtgcgca

SEQ ID NO: 455049 - DNA, 25 bp, Mus musculus
gaccgtggcttcgacagagtgcgca

SEQ ID NO: 455050 - DNA, 25 bp, Mus musculus
gaccgtgggtaccagttgtcagtaa

SEQ ID NO: 455051 - DNA, 25 bp, Mus musculus
gaccgtgggtacgagttgtcagtaa

SEQ ID NO: 455052 - DNA, 25 bp, Mus musculus
gaccgtggtctcatgaggtcatgca

SEQ ID NO: 455053 - DNA, 25 bp, Mus musculus
gaccgtggtctcttgaggtcatgca

SEQ ID NO: 455054 - DNA, 25 bp, Mus musculus
gaccgtggtggtcctggaggaatgt

SEQ ID NO: 455055 - DNA, 25 bp, Mus musculus
gaccgtggtggtgctggaggaatgt

SEQ ID NO: 455056 - DNA, 25 bp, Mus musculus
gaccgtggttccacaagcaatgttt

SEQ ID NO: 455057 - DNA, 25 bp, Mus musculus
gaccgtggttcctcaagcaatgttt

SEQ ID NO: 455058 - DNA, 25 bp, Mus musculus
gaccgtggtttgaaagcagaaggca

SEQ ID NO: 455059 - DNA, 25 bp, Mus musculus
gaccgtggtttgtaagcagaaggca

SEQ ID NO: 455060 - DNA, 25 bp, Mus musculus
gaccgtgtaaacctggcatcaggga

SEQ ID NO: 455061 - DNA, 25 bp, Mus musculus
gaccgtgtaaacgtggcatcaggga

SEQ ID NO: 455062 - DNA, 25 bp, Mus musculus
gaccgtgtcctacagttctttttgg

SEQ ID NO: 455063 - DNA, 25 bp, Mus musculus
gaccgtgtcctagagttctttttgg

SEQ ID NO: 455064 - DNA, 25 bp, Mus musculus
gaccgtgtctcaaaatatgtttctg

SEQ ID NO: 455065 - DNA, 25 bp, Mus musculus
gaccgtgtctcataatatgtttctg

SEQ ID NO: 455066 - DNA, 25 bp, Mus musculus
gaccgtgtgacacatgcctgatcac

SEQ ID NO: 455067 - DNA, 25 bp, Mus musculus
gaccgtgtgacagatgcctgatcac

SEQ ID NO: 455068 - DNA, 25 bp, Mus musculus
gaccgtgtgcaaagatgtccaccaa

SEQ ID NO: 455069 - DNA, 25 bp, Mus musculus
gaccgtgtgcaatgatgtccaccaa

SEQ ID NO: 455070 - DNA, 25 bp, Mus musculus
gaccgtgtgcagatcggactattga

SEQ ID NO: 455071 - DNA, 25 bp, Mus musculus
gaccgtgtgcagttcggactattga

SEQ ID NO: 455072 - DNA, 25 bp, Mus musculus
gaccgtgtggatatgggcaatattt

SEQ ID NO: 455073 - DNA, 25 bp, Mus musculus
gaccgtgtggatttgggcaatattt

SEQ ID NO: 455074 - DNA, 25 bp, Mus musculus
gaccgtgtgttcagatcattagtaa

SEQ ID NO: 455075 - DNA, 25 bp, Mus musculus
gaccgtgtgttctgatcattagtaa

SEQ ID NO: 455076 - DNA, 25 bp, Mus musculus
gaccgtgtgttgatagagcatgcta

SEQ ID NO: 455077 - DNA, 25 bp, Mus musculus
gaccgtgtgttgttagagcatgcta

SEQ ID NO: 455078 - DNA, 25 bp, Mus musculus
gaccgttacataagggtgtggccct

SEQ ID NO: 455079 - DNA, 25 bp, Mus musculus
gaccgttacatatgggtgtggccct

SEQ ID NO: 455080 - DNA, 25 bp, Mus musculus
gaccgttaccatcagcaagtctctg

SEQ ID NO: 455081 - DNA, 25 bp, Mus musculus
gaccgttaccatgagcaagtctctg

SEQ ID NO: 455082 - DNA, 25 bp, Mus musculus
gaccgttagggaaccagtgtatcct

SEQ ID NO: 455083 - DNA, 25 bp, Mus musculus
gaccgttagggatccagtgtatcct

SEQ ID NO: 455084 - DNA, 25 bp, Mus musculus
gaccgttaggtgaattgatgccact

SEQ ID NO: 455085 - DNA, 25 bp, Mus musculus
gaccgttaggtgtattgatgccact

SEQ ID NO: 455086 - DNA, 25 bp, Mus musculus
gaccgttatgttctagtaggagccc

SEQ ID NO: 455087 - DNA, 25 bp, Mus musculus
gaccgttatgttgtagtaggagccc

SEQ ID NO: 455088 - DNA, 25 bp, Mus musculus
gaccgttcaggccacgcaatatgag

SEQ ID NO: 455089 - DNA, 25 bp, Mus musculus
gaccgttcaggcgacgcaatatgag

SEQ ID NO: 455090 - DNA, 25 bp, Mus musculus
gaccgttcattaacagtacattaaa

SEQ ID NO: 455091 - DNA, 25 bp, Mus musculus
gaccgttcattatcagtacattaaa

SEQ ID NO: 455092 - DNA, 25 bp, Mus musculus
gaccgttccttgacccatgtgtgtg

SEQ ID NO: 455093 - DNA, 25 bp, Mus musculus
gaccgttccttgtcccatgtgtgtg

SEQ ID NO: 455094 - DNA, 25 bp, Mus musculus
gaccgtttacttcagatacccatgg

SEQ ID NO: 455095 - DNA, 25 bp, Mus musculus
gaccgtttacttgagatacccatgg

SEQ ID NO: 455096 - DNA, 25 bp, Mus musculus
gaccgtttatggaacttgagcttcg

SEQ ID NO: 455097 - DNA, 25 bp, Mus musculus
gaccgtttatggtacttgagcttcg

SEQ ID NO: 455098 - DNA, 25 bp, Mus musculus
gaccgtttccgaaaatgtctaccat

SEQ ID NO: 455099 - DNA, 25 bp, Mus musculus
gaccgtttccgataatgtctaccat

SEQ ID NO: 455100 - DNA, 25 bp, Mus musculus
gaccgtttcggtcactagactgatg

SEQ ID NO: 455101 - DNA, 25 bp, Mus musculus
gaccgtttcggtgactagactgatg

SEQ ID NO: 455102 - DNA, 25 bp, Mus musculus
gaccgtttctagagaccacatgatt

SEQ ID NO: 455103 - DNA, 25 bp, Mus musculus
gaccgtttctagtgaccacatgatt

SEQ ID NO: 455104 - DNA, 25 bp, Mus musculus
gaccgtttgattattcttctgtagt

SEQ ID NO: 455105 - DNA, 25 bp, Mus musculus
gaccgtttgatttttcttctgtagt

SEQ ID NO: 455106 - DNA, 25 bp, Mus musculus
gaccgtttgctaaattcctttttct

SEQ ID NO: 455107 - DNA, 25 bp, Mus musculus
gaccgtttgctatattcctttttct

SEQ ID NO: 455108 - DNA, 25 bp, Mus musculus
gaccgtttgtaccagtcactttgaa

SEQ ID NO: 455109 - DNA, 25 bp, Mus musculus
gaccgtttgtacgagtcactttgaa

SEQ ID NO: 455110 - DNA, 25 bp, Mus musculus
gaccgttttacaaaggatgatccga

SEQ ID NO: 455111 - DNA, 25 bp, Mus musculus
gaccgttttacataggatgatccga

SEQ ID NO: 455112 - DNA, 25 bp, Mus musculus
gaccgttttataccacttactccag

SEQ ID NO: 455113 - DNA, 25 bp, Mus musculus
gaccgttttatagcacttactccag

SEQ ID NO: 455114 - DNA, 25 bp, Mus musculus
gaccgttttggccaattgtatgttg

SEQ ID NO: 455115 - DNA, 25 bp, Mus musculus
gaccgttttggcgaattgtatgttg

SEQ ID NO: 455116 - DNA, 25 bp, Mus musculus
gacctaaaatctacacccgtatgtg

SEQ ID NO: 455117 - DNA, 25 bp, Mus musculus
gacctaaaatcttcacccgtatgtg

SEQ ID NO: 455118 - DNA, 25 bp, Mus musculus
gacctaaacatgcatgtaccacaca

SEQ ID NO: 455119 - DNA, 25 bp, Mus musculus
gacctaaacatggatgtaccacaca

SEQ ID NO: 455120 - DNA, 25 bp, Mus musculus
gacctaaactatattcttatggcag

SEQ ID NO: 455121 - DNA, 25 bp, Mus musculus
gacctaaactattttcttatggcag

SEQ ID NO: 455122 - DNA, 25 bp, Mus musculus
gacctaaagagaaactgtagcttgt

SEQ ID NO: 455123 - DNA, 25 bp, Mus musculus
gacctaaagagatactgtagcttgt

SEQ ID NO: 455124 - DNA, 25 bp, Mus musculus
gacctaaagcgaactcatgtattct

SEQ ID NO: 455125 - DNA, 25 bp, Mus musculus
gacctaaagcgatctcatgtattct

SEQ ID NO: 455126 - DNA, 25 bp, Mus musculus
gacctaaagtggctacccaactgag

SEQ ID NO: 455127 - DNA, 25 bp, Mus musculus
gacctaaagtgggtacccaactgag

SEQ ID NO: 455128 - DNA, 25 bp, Mus musculus
gacctaaattatatctgtggaacgt

SEQ ID NO: 455129 - DNA, 25 bp, Mus musculus
gacctaaattatttctgtggaacgt

SEQ ID NO: 455130 - DNA, 25 bp, Mus musculus
gacctaacaggtactttatttgcaa

SEQ ID NO: 455131 - DNA, 25 bp, Mus musculus
gacctaacaggttctttatttgcaa

SEQ ID NO: 455132 - DNA, 25 bp, Mus musculus
gacctaaccctactccggtgatgta

SEQ ID NO: 455133 - DNA, 25 bp, Mus musculus
gacctaaccctagtccggtgatgta

SEQ ID NO: 455134 - DNA, 25 bp, Mus musculus
gacctaacggtaactgtgatgcact

SEQ ID NO: 455135 - DNA, 25 bp, Mus musculus
gacctaacggtatctgtgatgcact

SEQ ID NO: 455136 - DNA, 25 bp, Mus musculus
gacctaactcggagtgggctagcct

SEQ ID NO: 455137 - DNA, 25 bp, Mus musculus
gacctaactcggtgtgggctagcct

SEQ ID NO: 455138 - DNA, 25 bp, Mus musculus
gacctaactttgatcttgagtccga

SEQ ID NO: 455139 - DNA, 25 bp, Mus musculus
gacctaactttgttcttgagtccga

SEQ ID NO: 455140 - DNA, 25 bp, Mus musculus
gacctaagcctgcaaccatggtgct

SEQ ID NO: 455141 - DNA, 25 bp, Mus musculus
gacctaagcctggaaccatggtgct

SEQ ID NO: 455142 - DNA, 25 bp, Mus musculus
gacctaaggatcacagcctgggtgc

SEQ ID NO: 455143 - DNA, 25 bp, Mus musculus
gacctaaggatctcagcctgggtgc

SEQ ID NO: 455144 - DNA, 25 bp, Mus musculus
gacctaaggcctagagtgtgccagg

SEQ ID NO: 455145 - DNA, 25 bp, Mus musculus
gacctaaggcctatgtagcttgaca

SEQ ID NO: 455146 - DNA, 25 bp, Mus musculus
gacctaaggccttgagtgtgccagg

SEQ ID NO: 455147 - DNA, 25 bp, Mus musculus
gacctaaggcctttgtagcttgaca

SEQ ID NO: 455148 - DNA, 25 bp, Mus musculus
gacctaagtatcaggctgtgccata

SEQ ID NO: 455149 - DNA, 25 bp, Mus musculus
gacctaagtatctggctgtgccata

SEQ ID NO: 455150 - DNA, 25 bp, Mus musculus
gacctaagtgcgcaaaaactacccg

SEQ ID NO: 455151 - DNA, 25 bp, Mus musculus
gacctaagtgcggaaaaactacccg

SEQ ID NO: 455152 - DNA, 25 bp, Mus musculus
gacctaagttatattgctgtcccgt

SEQ ID NO: 455153 - DNA, 25 bp, Mus musculus
gacctaagttattttgctgtcccgt

SEQ ID NO: 455154 - DNA, 25 bp, Mus musculus
gacctaatactgaggctttagctgg

SEQ ID NO: 455155 - DNA, 25 bp, Mus musculus
gacctaatactgtggctttagctgg

SEQ ID NO: 455156 - DNA, 25 bp, Mus musculus
gacctaatagttatgtggttacaat

SEQ ID NO: 455157 - DNA, 25 bp, Mus musculus
gacctaatagttttgtggttacaat

SEQ ID NO: 455158 - DNA, 25 bp, Mus musculus
gacctaatggagagagcttgggctt

SEQ ID NO: 455159 - DNA, 25 bp, Mus musculus
gacctaatggagtgagcttgggctt

SEQ ID NO: 455160 - DNA, 25 bp, Mus musculus
gacctaatggtcagcaaacccagcc

SEQ ID NO: 455161 - DNA, 25 bp, Mus musculus
gacctaatggtctgcaaacccagcc

SEQ ID NO: 455162 - DNA, 25 bp, Mus musculus
gacctaattactaccgtgttgattt

SEQ ID NO: 455163 - DNA, 25 bp, Mus musculus
gacctaattacttccgtgttgattt

SEQ ID NO: 455164 - DNA, 25 bp, Mus musculus
gacctaatttcactcattaccaggg

SEQ ID NO: 455165 - DNA, 25 bp, Mus musculus
gacctaatttcagtcattaccaggg

SEQ ID NO: 455166 - DNA, 25 bp, Mus musculus
gacctacaaaccaacgggtggctct

SEQ ID NO: 455167 - DNA, 25 bp, Mus musculus
gacctacaaacctacgggtggctct

SEQ ID NO: 455168 - DNA, 25 bp, Mus musculus
gacctacaaactaaggaggcttctg

SEQ ID NO: 455169 - DNA, 25 bp, Mus musculus
gacctacaaacttaggaggcttctg

SEQ ID NO: 455170 - DNA, 25 bp, Mus musculus
gacctacaaatgaggcgtcagcagt

SEQ ID NO: 455171 - DNA, 25 bp, Mus musculus
gacctacaaatgtggcgtcagcagt

SEQ ID NO: 455172 - DNA, 25 bp, Mus musculus
gacctacacaggatccgcgatggga

SEQ ID NO: 455173 - DNA, 25 bp, Mus musculus
gacctacacaggttccgcgatggga

SEQ ID NO: 455174 - DNA, 25 bp, Mus musculus
gacctacagagcaattccatcagtg

SEQ ID NO: 455175 - DNA, 25 bp, Mus musculus
gacctacagagctattccatcagtg

SEQ ID NO: 455176 - DNA, 25 bp, Mus musculus
gacctacagatgagattagtgaact

SEQ ID NO: 455177 - DNA, 25 bp, Mus musculus
gacctacagatgtgattagtgaact

SEQ ID NO: 455178 - DNA, 25 bp, Mus musculus
gacctacaggatccaactattccca

SEQ ID NO: 455179 - DNA, 25 bp, Mus musculus
gacctacaggatgcaactattccca

SEQ ID NO: 455180 - DNA, 25 bp, Mus musculus
gacctacagtgtcctattactaaag

SEQ ID NO: 455181 - DNA, 25 bp, Mus musculus
gacctacagtgtgctattactaaag

SEQ ID NO: 455182 - DNA, 25 bp, Mus musculus
gacctacatagcatgtgagatccga

SEQ ID NO: 455183 - DNA, 25 bp, Mus musculus
gacctacatagcttgtgagatccga

SEQ ID NO: 455184 - DNA, 25 bp, Mus musculus
gacctacattcaagtcgggcgctag

SEQ ID NO: 455185 - DNA, 25 bp, Mus musculus
gacctacattcatgtcgggcgctag

SEQ ID NO: 455186 - DNA, 25 bp, Mus musculus
gacctaccacccacttatggaagaa

SEQ ID NO: 455187 - DNA, 25 bp, Mus musculus
gacctaccaccctcttatggaagaa

SEQ ID NO: 455188 - DNA, 25 bp, Mus musculus
gacctaccacgaagagcccagatta

SEQ ID NO: 455189 - DNA, 25 bp, Mus musculus
gacctaccacgatgagcccagatta

SEQ ID NO: 455190 - DNA, 25 bp, Mus musculus
gacctaccagccaataactgttctg

SEQ ID NO: 455191 - DNA, 25 bp, Mus musculus
gacctaccagcctataactgttctg

SEQ ID NO: 455192 - DNA, 25 bp, Mus musculus
gacctacccagcagggagggagctc

SEQ ID NO: 455193 - DNA, 25 bp, Mus musculus
gacctacccagctgggagggagctc

SEQ ID NO: 455194 - DNA, 25 bp, Mus musculus
gacctaccccaacctttgtgatgga

SEQ ID NO: 455195 - DNA, 25 bp, Mus musculus
gacctaccccaagctttgtgatgga

SEQ ID NO: 455196 - DNA, 25 bp, Mus musculus
gacctaccgttaacatggacacagt

SEQ ID NO: 455197 - DNA, 25 bp, Mus musculus
gacctaccgttatcatggacacagt

SEQ ID NO: 455198 - DNA, 25 bp, Mus musculus
gacctacctaagaattcctcaatgc

SEQ ID NO: 455199 - DNA, 25 bp, Mus musculus
gacctacctaagtattcctcaatgc

SEQ ID NO: 455200 - DNA, 25 bp, Mus musculus
gacctacctggactggcccttggat

SEQ ID NO: 455201 - DNA, 25 bp, Mus musculus
gacctacctggagtggcccttggat

SEQ ID NO: 455202 - DNA, 25 bp, Mus musculus
gacctacctttaacccattcagagt

SEQ ID NO: 455203 - DNA, 25 bp, Mus musculus
gacctacctttatcccattcagagt

SEQ ID NO: 455204 - DNA, 25 bp, Mus musculus
gacctacgaacacgaatcagacttt

SEQ ID NO: 455205 - DNA, 25 bp, Mus musculus
gacctacgaacaggaatcagacttt

SEQ ID NO: 455206 - DNA, 25 bp, Mus musculus
gacctacgatcccatcctaaggttc

SEQ ID NO: 455207 - DNA, 25 bp, Mus musculus
gacctacgatccgatcctaaggttc

SEQ ID NO: 455208 - DNA, 25 bp, Mus musculus
gacctacgtgcgcttaatgccacaa

SEQ ID NO: 455209 - DNA, 25 bp, Mus musculus
gacctacgtgcggttaatgccacaa

SEQ ID NO: 455210 - DNA, 25 bp, Mus musculus
gacctacgttcccagtgagcaagaa

SEQ ID NO: 455211 - DNA, 25 bp, Mus musculus
gacctacgttccgagtgagcaagaa

SEQ ID NO: 455212 - DNA, 25 bp, Mus musculus
gacctactaaacagtgaaagccatt

SEQ ID NO: 455213 - DNA, 25 bp, Mus musculus
gacctactaaactgtgaaagccatt

SEQ ID NO: 455214 - DNA, 25 bp, Mus musculus
gacctactacttcaagggcagttct

SEQ ID NO: 455215 - DNA, 25 bp, Mus musculus
gacctactacttgaagggcagttct

SEQ ID NO: 455216 - DNA, 25 bp, Mus musculus
gacctactatatcaatctgattttg

SEQ ID NO: 455217 - DNA, 25 bp, Mus musculus
gacctactatatgaatctgattttg

SEQ ID NO: 455218 - DNA, 25 bp, Mus musculus
gacctactatgaagatcacctgaaa

SEQ ID NO: 455219 - DNA, 25 bp, Mus musculus
gacctactatgatgatcacctgaaa

SEQ ID NO: 455220 - DNA, 25 bp, Mus musculus
gacctactccagagttgctttggcg

SEQ ID NO: 455221 - DNA, 25 bp, Mus musculus
gacctactccagtgttgctttggcg

SEQ ID NO: 455222 - DNA, 25 bp, Mus musculus
gacctactctgaacttgggtaccaa

SEQ ID NO: 455223 - DNA, 25 bp, Mus musculus
gacctactctgatcttgggtaccaa

SEQ ID NO: 455224 - DNA, 25 bp, Mus musculus
gacctactgatactagctgtaactg

SEQ ID NO: 455225 - DNA, 25 bp, Mus musculus
gacctactgatagtagctgtaactg

SEQ ID NO: 455226 - DNA, 25 bp, Mus musculus
gacctactgcctcctcataggagga

SEQ ID NO: 455227 - DNA, 25 bp, Mus musculus
gacctactgcctgctcataggagga

SEQ ID NO: 455228 - DNA, 25 bp, Mus musculus
gacctactgctgagcctgcgagatc

SEQ ID NO: 455229 - DNA, 25 bp, Mus musculus
gacctactgctgtgcctgcgagatc

SEQ ID NO: 455230 - DNA, 25 bp, Mus musculus
gacctacttagactctgcttgtctc

SEQ ID NO: 455231 - DNA, 25 bp, Mus musculus
gacctacttagagtctgcttgtctc

SEQ ID NO: 455232 - DNA, 25 bp, Mus musculus
gacctacttcccaattcacagaaag

SEQ ID NO: 455233 - DNA, 25 bp, Mus musculus
gacctacttcccacactttgatgta

SEQ ID NO: 455234 - DNA, 25 bp, Mus musculus
gacctacttccctattcacagaaag

SEQ ID NO: 455235 - DNA, 25 bp, Mus musculus
gacctacttccctcactttgatgta

SEQ ID NO: 455236 - DNA, 25 bp, Mus musculus
gacctactttccagttctaattttg

SEQ ID NO: 455237 - DNA, 25 bp, Mus musculus
gacctactttcctgttctaattttg

SEQ ID NO: 455238 - DNA, 25 bp, Mus musculus
gacctactttttacatgatctactt

SEQ ID NO: 455239 - DNA, 25 bp, Mus musculus
gacctactttttactgagttggctc

SEQ ID NO: 455240 - DNA, 25 bp, Mus musculus
gacctacttttttcatgatctactt

SEQ ID NO: 455241 - DNA, 25 bp, Mus musculus
gacctacttttttctgagttggctc

SEQ ID NO: 455242 - DNA, 25 bp, Mus musculus
gacctagaaatcacactagcctcaa

SEQ ID NO: 455243 - DNA, 25 bp, Mus musculus
gacctagaaatctcactagcctcaa

SEQ ID NO: 455244 - DNA, 25 bp, Mus musculus
gacctagaattgcatccttggaaga

SEQ ID NO: 455245 - DNA, 25 bp, Mus musculus
gacctagaattggatccttggaaga

SEQ ID NO: 455246 - DNA, 25 bp, Mus musculus
gacctagacatcatgtttcatttct

SEQ ID NO: 455247 - DNA, 25 bp, Mus musculus
gacctagacatcttgtttcatttct

SEQ ID NO: 455248 - DNA, 25 bp, Mus musculus
gacctagacatgacagtctcaccaa

SEQ ID NO: 455249 - DNA, 25 bp, Mus musculus
gacctagacatgtcagtctcaccaa

SEQ ID NO: 455250 - DNA, 25 bp, Mus musculus
gacctagaccaccaaaatcaatgag

SEQ ID NO: 455251 - DNA, 25 bp, Mus musculus
gacctagaccacgaaaatcaatgag

SEQ ID NO: 455252 - DNA, 25 bp, Mus musculus
gacctagaccgaatagcggccagca

SEQ ID NO: 455253 - DNA, 25 bp, Mus musculus
gacctagaccgattagcggccagca

SEQ ID NO: 455254 - DNA, 25 bp, Mus musculus
gacctagacctgaggcggaggctca

SEQ ID NO: 455255 - DNA, 25 bp, Mus musculus
gacctagacctgtggcggaggctca

SEQ ID NO: 455256 - DNA, 25 bp, Mus musculus
gacctagactagactattgcattgc

SEQ ID NO: 455257 - DNA, 25 bp, Mus musculus
gacctagactagtctattgcattgc

SEQ ID NO: 455258 - DNA, 25 bp, Mus musculus
gacctagagctaatttcctcttcat

SEQ ID NO: 455259 - DNA, 25 bp, Mus musculus
gacctagagctattttcctcttcat

SEQ ID NO: 455260 - DNA, 25 bp, Mus musculus
gacctagatctgaaggacaaacctt

SEQ ID NO: 455261 - DNA, 25 bp, Mus musculus
gacctagatctgtaggacaaacctt

SEQ ID NO: 455262 - DNA, 25 bp, Mus musculus
gacctagatgaacccagtactccag

SEQ ID NO: 455263 - DNA, 25 bp, Mus musculus
gacctagatgaagccagtactccag

SEQ ID NO: 455264 - DNA, 25 bp, Mus musculus
gacctagcagtgagcatcccaggct

SEQ ID NO: 455265 - DNA, 25 bp, Mus musculus
gacctagcagtgtgcatcccaggct

SEQ ID NO: 455266 - DNA, 25 bp, Mus musculus
gacctagccttgacaaaccacatgg

SEQ ID NO: 455267 - DNA, 25 bp, Mus musculus
gacctagccttgtcaaaccacatgg

SEQ ID NO: 455268 - DNA, 25 bp, Mus musculus
gacctagctaggaacccatgctgga

SEQ ID NO: 455269 - DNA, 25 bp, Mus musculus
gacctagctaggtacccatgctgga

SEQ ID NO: 455270 - DNA, 25 bp, Mus musculus
gacctagctcttaaacttgtagcca

SEQ ID NO: 455271 - DNA, 25 bp, Mus musculus
gacctagctctttaacttgtagcca

SEQ ID NO: 455272 - DNA, 25 bp, Mus musculus
gacctagctggacaattctgatcat

SEQ ID NO: 455273 - DNA, 25 bp, Mus musculus
gacctagctggagaattctgatcat

SEQ ID NO: 455274 - DNA, 25 bp, Mus musculus
gacctaggacaacaggccagccttt

SEQ ID NO: 455275 - DNA, 25 bp, Mus musculus
gacctaggacaagaggccagccttt

SEQ ID NO: 455276 - DNA, 25 bp, Mus musculus
gacctaggactacctaactccaaag

SEQ ID NO: 455277 - DNA, 25 bp, Mus musculus
gacctaggactagctaactccaaag

SEQ ID NO: 455278 - DNA, 25 bp, Mus musculus
gacctaggcatcaacgttggagagg

SEQ ID NO: 455279 - DNA, 25 bp, Mus musculus
gacctaggcatctacgttggagagg

SEQ ID NO: 455280 - DNA, 25 bp, Mus musculus
gacctaggctttcaattctgttcat

SEQ ID NO: 455281 - DNA, 25 bp, Mus musculus
gacctaggctttgaattctgttcat

SEQ ID NO: 455282 - DNA, 25 bp, Mus musculus
gacctagggagtcagtcacgacctc

SEQ ID NO: 455283 - DNA, 25 bp, Mus musculus
gacctagggagtgagtcacgacctc

SEQ ID NO: 455284 - DNA, 25 bp, Mus musculus
gacctagggcccagtgtacacttaa

SEQ ID NO: 455285 - DNA, 25 bp, Mus musculus
gacctagggccctgtgtacacttaa

SEQ ID NO: 455286 - DNA, 25 bp, Mus musculus
gacctaggtcaaagttaaactcgct

SEQ ID NO: 455287 - DNA, 25 bp, Mus musculus
gacctaggtcaatgttaaactcgct

SEQ ID NO: 455288 - DNA, 25 bp, Mus musculus
gacctaggtctaccatatagcacag

SEQ ID NO: 455289 - DNA, 25 bp, Mus musculus
gacctaggtctagcatatagcacag

SEQ ID NO: 455290 - DNA, 25 bp, Mus musculus
gacctaggtctcaattgctcgagta

SEQ ID NO: 455291 - DNA, 25 bp, Mus musculus
gacctaggtctctattgctcgagta

SEQ ID NO: 455292 - DNA, 25 bp, Mus musculus
gacctagtagatatccaggccgcgc

SEQ ID NO: 455293 - DNA, 25 bp, Mus musculus
gacctagtagatttccaggccgcgc

SEQ ID NO: 455294 - DNA, 25 bp, Mus musculus
gacctagtcatgatctactgccaga

SEQ ID NO: 455295 - DNA, 25 bp, Mus musculus
gacctagtcatgttctactgccaga

SEQ ID NO: 455296 - DNA, 25 bp, Mus musculus
gacctagtccagaggcagtggctat

SEQ ID NO: 455297 - DNA, 25 bp, Mus musculus
gacctagtccagtggcagtggctat

SEQ ID NO: 455298 - DNA, 25 bp, Mus musculus
gacctagtctccctatacgtatgta

SEQ ID NO: 455299 - DNA, 25 bp, Mus musculus
gacctagtctccgtatacgtatgta

SEQ ID NO: 455300 - DNA, 25 bp, Mus musculus
gacctagtgtctacagtgattaaat

SEQ ID NO: 455301 - DNA, 25 bp, Mus musculus
gacctagtgtcttcagtgattaaat

SEQ ID NO: 455302 - DNA, 25 bp, Mus musculus
gacctagtttgaaaatattttgcct

SEQ ID NO: 455303 - DNA, 25 bp, Mus musculus
gacctagtttgataatattttgcct

SEQ ID NO: 455304 - DNA, 25 bp, Mus musculus
gacctagtttgcaattttgctatat

SEQ ID NO: 455305 - DNA, 25 bp, Mus musculus
gacctagtttgctattttgctatat

SEQ ID NO: 455306 - DNA, 25 bp, Mus musculus
gacctatagatcaggatcctgcagt

SEQ ID NO: 455307 - DNA, 25 bp, Mus musculus
gacctatagatctggatcctgcagt

SEQ ID NO: 455308 - DNA, 25 bp, Mus musculus
gacctatagctcaagccacatttgt

SEQ ID NO: 455309 - DNA, 25 bp, Mus musculus
gacctatagctctagccacatttgt

SEQ ID NO: 455310 - DNA, 25 bp, Mus musculus
gacctatatattaaaccctgcacac

SEQ ID NO: 455311 - DNA, 25 bp, Mus musculus
gacctatatatttaaccctgcacac

SEQ ID NO: 455312 - DNA, 25 bp, Mus musculus
gacctatatcttaatccatttcttg

SEQ ID NO: 455313 - DNA, 25 bp, Mus musculus
gacctatatctttatccatttcttg

SEQ ID NO: 455314 - DNA, 25 bp, Mus musculus
gacctatatggactataggctggcc

SEQ ID NO: 455315 - DNA, 25 bp, Mus musculus
gacctatatggagtataggctggcc

SEQ ID NO: 455316 - DNA, 25 bp, Mus musculus
gacctatattcccagcctttagtta

SEQ ID NO: 455317 - DNA, 25 bp, Mus musculus
gacctatattccgagcctttagtta

SEQ ID NO: 455318 - DNA, 25 bp, Mus musculus
gacctatcaaaaagtcccaccttag

SEQ ID NO: 455319 - DNA, 25 bp, Mus musculus
gacctatcaaaatgtcccaccttag

SEQ ID NO: 455320 - DNA, 25 bp, Mus musculus
gacctatcatggcattcccagtcta

SEQ ID NO: 455321 - DNA, 25 bp, Mus musculus
gacctatcatgggattcccagtcta

SEQ ID NO: 455322 - DNA, 25 bp, Mus musculus
gacctatccaggacaccattgtgtt

SEQ ID NO: 455323 - DNA, 25 bp, Mus musculus
gacctatccaggtcaccattgtgtt

SEQ ID NO: 455324 - DNA, 25 bp, Mus musculus
gacctatcctgcctgttccggaaaa

SEQ ID NO: 455325 - DNA, 25 bp, Mus musculus
gacctatcctgcgtgttccggaaaa

SEQ ID NO: 455326 - DNA, 25 bp, Mus musculus
gacctatcctgtacctcccttttat

SEQ ID NO: 455327 - DNA, 25 bp, Mus musculus
gacctatcctgttcctcccttttat

SEQ ID NO: 455328 - DNA, 25 bp, Mus musculus
gacctatctgttcctggtattgttg

SEQ ID NO: 455329 - DNA, 25 bp, Mus musculus
gacctatctgttgctggtattgttg

SEQ ID NO: 455330 - DNA, 25 bp, Mus musculus
gacctatgaatgctcaaaatgtttg

SEQ ID NO: 455331 - DNA, 25 bp, Mus musculus
gacctatgaatggtcaaaatgtttg

SEQ ID NO: 455332 - DNA, 25 bp, Mus musculus
gacctatgacatcgccttttatttc

SEQ ID NO: 455333 - DNA, 25 bp, Mus musculus
gacctatgacatggccttttatttc

SEQ ID NO: 455334 - DNA, 25 bp, Mus musculus
gacctatgagacattggatgccaaa

SEQ ID NO: 455335 - DNA, 25 bp, Mus musculus
gacctatgagactttggatgccaaa

SEQ ID NO: 455336 - DNA, 25 bp, Mus musculus
gacctatgctatagcagtctccttt

SEQ ID NO: 455337 - DNA, 25 bp, Mus musculus
gacctatgctattgcagtctccttt

SEQ ID NO: 455338 - DNA, 25 bp, Mus musculus
gacctatggacacctactttctgtg

SEQ ID NO: 455339 - DNA, 25 bp, Mus musculus
gacctatggacacctgtttttgttg

SEQ ID NO: 455340 - DNA, 25 bp, Mus musculus
gacctatggacagctactttctgtg

SEQ ID NO: 455341 - DNA, 25 bp, Mus musculus
gacctatggacagctgtttttgttg

SEQ ID NO: 455342 - DNA, 25 bp, Mus musculus
gacctatgggtcaagatggctattt

SEQ ID NO: 455343 - DNA, 25 bp, Mus musculus
gacctatgggtccttagactttcaa

SEQ ID NO: 455344 - DNA, 25 bp, Mus musculus
gacctatgggtcgttagactttcaa

SEQ ID NO: 455345 - DNA, 25 bp, Mus musculus
gacctatgggtctagatggctattt

SEQ ID NO: 455346 - DNA, 25 bp, Mus musculus
gacctatgttaccagatagacctca

SEQ ID NO: 455347 - DNA, 25 bp, Mus musculus
gacctatgttacgagatagacctca

SEQ ID NO: 455348 - DNA, 25 bp, Mus musculus
gacctattacttacacattggataa

SEQ ID NO: 455349 - DNA, 25 bp, Mus musculus
gacctattactttcacattggataa

SEQ ID NO: 455350 - DNA, 25 bp, Mus musculus
gacctattagacatgcaattccatt

SEQ ID NO: 455351 - DNA, 25 bp, Mus musculus
gacctattagacttgcaattccatt

SEQ ID NO: 455352 - DNA, 25 bp, Mus musculus
gacctattcagtcatttcagagaac

SEQ ID NO: 455353 - DNA, 25 bp, Mus musculus
gacctattcagtgatttcagagaac

SEQ ID NO: 455354 - DNA, 25 bp, Mus musculus
gacctattccgtccttcagtggaca

SEQ ID NO: 455355 - DNA, 25 bp, Mus musculus
gacctattccgtgcttcagtggaca

SEQ ID NO: 455356 - DNA, 25 bp, Mus musculus
gacctattcctcattgggttccaat

SEQ ID NO: 455357 - DNA, 25 bp, Mus musculus
gacctattcctctttgggttccaat

SEQ ID NO: 455358 - DNA, 25 bp, Mus musculus
gacctattggaacaaaggaatagca

SEQ ID NO: 455359 - DNA, 25 bp, Mus musculus
gacctattggaagaaaggaatagca

SEQ ID NO: 455360 - DNA, 25 bp, Mus musculus
gacctatttctaagtggatggcagc

SEQ ID NO: 455361 - DNA, 25 bp, Mus musculus
gacctatttctatgtggatggcagc

SEQ ID NO: 455362 - DNA, 25 bp, Mus musculus
gacctcaaacaaagatccactcaat

SEQ ID NO: 455363 - DNA, 25 bp, Mus musculus
gacctcaaacaatgatccactcaat

SEQ ID NO: 455364 - DNA, 25 bp, Mus musculus
gacctcaaacttctcagctcttatt

SEQ ID NO: 455365 - DNA, 25 bp, Mus musculus
gacctcaaacttgtcagctcttatt

SEQ ID NO: 455366 - DNA, 25 bp, Mus musculus
gacctcaacagaaactcccactttt

SEQ ID NO: 455367 - DNA, 25 bp, Mus musculus
gacctcaacagatactcccactttt

SEQ ID NO: 455368 - DNA, 25 bp, Mus musculus
gacctcaagagcactaacatcctag

SEQ ID NO: 455369 - DNA, 25 bp, Mus musculus
gacctcaagagctctaacatcctag

SEQ ID NO: 455370 - DNA, 25 bp, Mus musculus
gacctcaagcccattacttgtggtg

SEQ ID NO: 455371 - DNA, 25 bp, Mus musculus
gacctcaagccctttacttgtggtg

SEQ ID NO: 455372 - DNA, 25 bp, Mus musculus
gacctcaagggcaaagccaagtggg

SEQ ID NO: 455373 - DNA, 25 bp, Mus musculus
gacctcaagggctaagccaagtggg

SEQ ID NO: 455374 - DNA, 25 bp, Mus musculus
gacctcaagtaccagctgggtttca

SEQ ID NO: 455375 - DNA, 25 bp, Mus musculus
gacctcaagtacgagctgggtttca

SEQ ID NO: 455376 - DNA, 25 bp, Mus musculus
gacctcaagtgtattttatgcacca

SEQ ID NO: 455377 - DNA, 25 bp, Mus musculus
gacctcaagtgttttttatgcacca

SEQ ID NO: 455378 - DNA, 25 bp, Mus musculus
gacctcaagttaattcttccactta

SEQ ID NO: 455379 - DNA, 25 bp, Mus musculus
gacctcaagttatttcttccactta

SEQ ID NO: 455380 - DNA, 25 bp, Mus musculus
gacctcaattccatattcagctagt

SEQ ID NO: 455381 - DNA, 25 bp, Mus musculus
gacctcaattccttattcagctagt

SEQ ID NO: 455382 - DNA, 25 bp, Mus musculus
gacctcacactgaccgttagttggt

SEQ ID NO: 455383 - DNA, 25 bp, Mus musculus
gacctcacactgtccgttagttggt

SEQ ID NO: 455384 - DNA, 25 bp, Mus musculus
gacctcacagagactagaactcact

SEQ ID NO: 455385 - DNA, 25 bp, Mus musculus
gacctcacagagtctagaactcact

SEQ ID NO: 455386 - DNA, 25 bp, Mus musculus
gacctcacaggaccatgcggttcaa

SEQ ID NO: 455387 - DNA, 25 bp, Mus musculus
gacctcacaggagcatgcggttcaa

SEQ ID NO: 455388 - DNA, 25 bp, Mus musculus
gacctcacagggacccaacatgtaa

SEQ ID NO: 455389 - DNA, 25 bp, Mus musculus
gacctcacagggtcccaacatgtaa

SEQ ID NO: 455390 - DNA, 25 bp, Mus musculus
gacctcacatgcactgcagcgagtg

SEQ ID NO: 455391 - DNA, 25 bp, Mus musculus
gacctcacatgctctgcagcgagtg

SEQ ID NO: 455392 - DNA, 25 bp, Mus musculus
gacctcaccagaatatttaattttc

SEQ ID NO: 455393 - DNA, 25 bp, Mus musculus
gacctcaccagattatttaattttc

SEQ ID NO: 455394 - DNA, 25 bp, Mus musculus
gacctcactgtgcagccagagtcaa

SEQ ID NO: 455395 - DNA, 25 bp, Mus musculus
gacctcactgtggagccagagtcaa

SEQ ID NO: 455396 - DNA, 25 bp, Mus musculus
gacctcacttagaacatcctgtggg

SEQ ID NO: 455397 - DNA, 25 bp, Mus musculus
gacctcacttagtacatcctgtggg

SEQ ID NO: 455398 - DNA, 25 bp, Mus musculus
gacctcagagacctggtctgttttt

SEQ ID NO: 455399 - DNA, 25 bp, Mus musculus
gacctcagagacgtggtctgttttt

SEQ ID NO: 455400 - DNA, 25 bp, Mus musculus
gacctcagaggcatctaccgaaagc

SEQ ID NO: 455401 - DNA, 25 bp, Mus musculus
gacctcagaggcttctaccgaaagc

SEQ ID NO: 455402 - DNA, 25 bp, Mus musculus
gacctcagagtcaggctagcaggct

SEQ ID NO: 455403 - DNA, 25 bp, Mus musculus
gacctcagagtcatgggtgtcaccc

SEQ ID NO: 455404 - DNA, 25 bp, Mus musculus
gacctcagagtctggctagcaggct

SEQ ID NO: 455405 - DNA, 25 bp, Mus musculus
gacctcagagtcttgggtgtcaccc

SEQ ID NO: 455406 - DNA, 25 bp, Mus musculus
gacctcagagttaaaaattcacatg

SEQ ID NO: 455407 - DNA, 25 bp, Mus musculus
gacctcagagtttaaaattcacatg

SEQ ID NO: 455408 - DNA, 25 bp, Mus musculus
gacctcagatgaatccagacgacca

SEQ ID NO: 455409 - DNA, 25 bp, Mus musculus
gacctcagatgattccagacgacca

SEQ ID NO: 455410 - DNA, 25 bp, Mus musculus
gacctcagcacgctaattttctaca

SEQ ID NO: 455411 - DNA, 25 bp, Mus musculus
gacctcagcacggtaattttctaca

SEQ ID NO: 455412 - DNA, 25 bp, Mus musculus
gacctcagccgtctagacaagggac

SEQ ID NO: 455413 - DNA, 25 bp, Mus musculus
gacctcagccgtgtagacaagggac

SEQ ID NO: 455414 - DNA, 25 bp, Mus musculus
gacctcagcctaattctaggacctt

SEQ ID NO: 455415 - DNA, 25 bp, Mus musculus
gacctcagcctatttctaggacctt

SEQ ID NO: 455416 - DNA, 25 bp, Mus musculus
gacctcagcgagaataacatgttgt

SEQ ID NO: 455417 - DNA, 25 bp, Mus musculus
gacctcagcgagtataacatgttgt

SEQ ID NO: 455418 - DNA, 25 bp, Mus musculus
gacctcaggcccatggcttttaata

SEQ ID NO: 455419 - DNA, 25 bp, Mus musculus
gacctcaggcccttggcttttaata

SEQ ID NO: 455420 - DNA, 25 bp, Mus musculus
gacctcagggcgagggcggagatat

SEQ ID NO: 455421 - DNA, 25 bp, Mus musculus
gacctcagggcgtgggcggagatat

SEQ ID NO: 455422 - DNA, 25 bp, Mus musculus
gacctcaggttaactctaagggagt

SEQ ID NO: 455423 - DNA, 25 bp, Mus musculus
gacctcaggttatctctaagggagt

SEQ ID NO: 455424 - DNA, 25 bp, Mus musculus
gacctcagtaatagttcagtctatg

SEQ ID NO: 455425 - DNA, 25 bp, Mus musculus
gacctcagtaattgttcagtctatg

SEQ ID NO: 455426 - DNA, 25 bp, Mus musculus
gacctcagtcaccatgcggtagcga

SEQ ID NO: 455427 - DNA, 25 bp, Mus musculus
gacctcagtcacgatgcggtagcga

SEQ ID NO: 455428 - DNA, 25 bp, Mus musculus
gacctcagtgacatccatcatggaa

SEQ ID NO: 455429 - DNA, 25 bp, Mus musculus
gacctcagtgacttccatcatggaa

SEQ ID NO: 455430 - DNA, 25 bp, Mus musculus
gacctcagtggaagtggcactgtga

SEQ ID NO: 455431 - DNA, 25 bp, Mus musculus
gacctcagtggatgtggcactgtga

SEQ ID NO: 455432 - DNA, 25 bp, Mus musculus
gacctcagtttgaaatacagctgaa

SEQ ID NO: 455433 - DNA, 25 bp, Mus musculus
gacctcagtttgtaatacagctgaa

SEQ ID NO: 455434 - DNA, 25 bp, Mus musculus
gacctcataaatacactctccatta

SEQ ID NO: 455435 - DNA, 25 bp, Mus musculus
gacctcataaattcactctccatta

SEQ ID NO: 455436 - DNA, 25 bp, Mus musculus
gacctcatagtcacatacccatagc

SEQ ID NO: 455437 - DNA, 25 bp, Mus musculus
gacctcatagtctcatacccatagc

SEQ ID NO: 455438 - DNA, 25 bp, Mus musculus
gacctcatatgacccttcagatggt

SEQ ID NO: 455439 - DNA, 25 bp, Mus musculus
gacctcatatgagccttcagatggt

SEQ ID NO: 455440 - DNA, 25 bp, Mus musculus
gacctcatatgtacagcagctcctg

SEQ ID NO: 455441 - DNA, 25 bp, Mus musculus
gacctcatatgttcagcagctcctg

SEQ ID NO: 455442 - DNA, 25 bp, Mus musculus
gacctcatcagtataaggcacagat

SEQ ID NO: 455443 - DNA, 25 bp, Mus musculus
gacctcatcagtttaaggcacagat

SEQ ID NO: 455444 - DNA, 25 bp, Mus musculus
gacctcatcgagaccatgcttaaaa

SEQ ID NO: 455445 - DNA, 25 bp, Mus musculus
gacctcatcgagtccatgcttaaaa

SEQ ID NO: 455446 - DNA, 25 bp, Mus musculus
gacctcatctagagctcacagacga

SEQ ID NO: 455447 - DNA, 25 bp, Mus musculus
gacctcatctagtgctcacagacga

SEQ ID NO: 455448 - DNA, 25 bp, Mus musculus
gacctcatcttaatgggcaaacagt

SEQ ID NO: 455449 - DNA, 25 bp, Mus musculus
gacctcatcttattgggcaaacagt

SEQ ID NO: 455450 - DNA, 25 bp, Mus musculus
gacctcatctttatcacggtgctat

SEQ ID NO: 455451 - DNA, 25 bp, Mus musculus
gacctcatctttttcacggtgctat

SEQ ID NO: 455452 - DNA, 25 bp, Mus musculus
gacctcatgaagcatactctgaagt

SEQ ID NO: 455453 - DNA, 25 bp, Mus musculus
gacctcatgaaggatactctgaagt

SEQ ID NO: 455454 - DNA, 25 bp, Mus musculus
gacctcatgcagctgtgatgtgaag

SEQ ID NO: 455455 - DNA, 25 bp, Mus musculus
gacctcatgcaggtgtgatgtgaag

SEQ ID NO: 455456 - DNA, 25 bp, Mus musculus
gacctcatggagcacagactttggg

SEQ ID NO: 455457 - DNA, 25 bp, Mus musculus
gacctcatggaggacagactttggg

SEQ ID NO: 455458 - DNA, 25 bp, Mus musculus
gacctcatgggtctccactgaggaa

SEQ ID NO: 455459 - DNA, 25 bp, Mus musculus
gacctcatgggtgtccactgaggaa

SEQ ID NO: 455460 - DNA, 25 bp, Mus musculus
gacctcatgtctactgcagagctca

SEQ ID NO: 455461 - DNA, 25 bp, Mus musculus
gacctcatgtcttctgcagagctca

SEQ ID NO: 455462 - DNA, 25 bp, Mus musculus
gacctcatgttacaggaccgggttt

SEQ ID NO: 455463 - DNA, 25 bp, Mus musculus
gacctcatgttagaggaccgggttt

SEQ ID NO: 455464 - DNA, 25 bp, Mus musculus
gacctcattaggatactgccagtga

SEQ ID NO: 455465 - DNA, 25 bp, Mus musculus
gacctcattaggttactgccagtga

SEQ ID NO: 455466 - DNA, 25 bp, Mus musculus
gacctcattcagcaagagctcacta

SEQ ID NO: 455467 - DNA, 25 bp, Mus musculus
gacctcattcaggaagagctcacta

SEQ ID NO: 455468 - DNA, 25 bp, Mus musculus
gacctcattctcctgtatatgcgga

SEQ ID NO: 455469 - DNA, 25 bp, Mus musculus
gacctcattctcgtgtatatgcgga

SEQ ID NO: 455470 - DNA, 25 bp, Mus musculus
gacctcattggtaaaattcagccct

SEQ ID NO: 455471 - DNA, 25 bp, Mus musculus
gacctcattggttaaattcagccct

SEQ ID NO: 455472 - DNA, 25 bp, Mus musculus
gacctcatttgaacatcctatatgg

SEQ ID NO: 455473 - DNA, 25 bp, Mus musculus
gacctcatttgatcatcctatatgg

SEQ ID NO: 455474 - DNA, 25 bp, Mus musculus
gacctcattttcaatagtgtactca

SEQ ID NO: 455475 - DNA, 25 bp, Mus musculus
gacctcattttctatagtgtactca

SEQ ID NO: 455476 - DNA, 25 bp, Mus musculus
gacctccaaagacgttctgacagac

SEQ ID NO: 455477 - DNA, 25 bp, Mus musculus
gacctccaaagaggttctgacagac

SEQ ID NO: 455478 - DNA, 25 bp, Mus musculus
gacctccaactgataaccattttgc

SEQ ID NO: 455479 - DNA, 25 bp, Mus musculus
gacctccaactgttaaccattttgc

SEQ ID NO: 455480 - DNA, 25 bp, Mus musculus
gacctccaagaaaaagtcctaactg

SEQ ID NO: 455481 - DNA, 25 bp, Mus musculus
gacctccaagaataagtcctaactg

SEQ ID NO: 455482 - DNA, 25 bp, Mus musculus
gacctccaagcccagatttcttttt

SEQ ID NO: 455483 - DNA, 25 bp, Mus musculus
gacctccaagccgagatttcttttt

SEQ ID NO: 455484 - DNA, 25 bp, Mus musculus
gacctccaatggaggctgttgcaaa

SEQ ID NO: 455485 - DNA, 25 bp, Mus musculus
gacctccaatggtggctgttgcaaa

SEQ ID NO: 455486 - DNA, 25 bp, Mus musculus
gacctccaccatcgcttgtgtgcat

SEQ ID NO: 455487 - DNA, 25 bp, Mus musculus
gacctccaccatggcttgtgtgcat

SEQ ID NO: 455488 - DNA, 25 bp, Mus musculus
gacctccacggcctggatgccagta

SEQ ID NO: 455489 - DNA, 25 bp, Mus musculus
gacctccacggcgtggatgccagta

SEQ ID NO: 455490 - DNA, 25 bp, Mus musculus
gacctccagacaccggctagcaatg

SEQ ID NO: 455491 - DNA, 25 bp, Mus musculus
gacctccagacagcggctagcaatg

SEQ ID NO: 455492 - DNA, 25 bp, Mus musculus
gacctccagagtctgagcttggaca

SEQ ID NO: 455493 - DNA, 25 bp, Mus musculus
gacctccagagtgtgagcttggaca

SEQ ID NO: 455494 - DNA, 25 bp, Mus musculus
gacctccagcttaggatgatgttgc

SEQ ID NO: 455495 - DNA, 25 bp, Mus musculus
gacctccagctttggatgatgttgc

SEQ ID NO: 455496 - DNA, 25 bp, Mus musculus
gacctccaggaaagcccaaccctag

SEQ ID NO: 455497 - DNA, 25 bp, Mus musculus
gacctccaggaatgcccaaccctag

SEQ ID NO: 455498 - DNA, 25 bp, Mus musculus
gacctccaggcaactaggataacag

SEQ ID NO: 455499 - DNA, 25 bp, Mus musculus
gacctccaggcatctaggataacag

SEQ ID NO: 455500 - DNA, 25 bp, Mus musculus
gacctccaggtgatgatctgtacat

SEQ ID NO: 455501 - DNA, 25 bp, Mus musculus
gacctccaggtgttgatctgtacat

SEQ ID NO: 455502 - DNA, 25 bp, Mus musculus
gacctccagtgtatgtagtgttagt

SEQ ID NO: 455503 - DNA, 25 bp, Mus musculus
gacctccagtgtttgtagtgttagt

SEQ ID NO: 455504 - DNA, 25 bp, Mus musculus
gacctccatgacaagttctgttctt

SEQ ID NO: 455505 - DNA, 25 bp, Mus musculus
gacctccatgacacccttgatggga

SEQ ID NO: 455506 - DNA, 25 bp, Mus musculus
gacctccatgactagttctgttctt

SEQ ID NO: 455507 - DNA, 25 bp, Mus musculus
gacctccatgactcccttgatggga

SEQ ID NO: 455508 - DNA, 25 bp, Mus musculus
gacctccatgcaaggctttgctgct

SEQ ID NO: 455509 - DNA, 25 bp, Mus musculus
gacctccatgcatggctttgctgct

SEQ ID NO: 455510 - DNA, 25 bp, Mus musculus
gacctccatggccagcgggtgtcct

SEQ ID NO: 455511 - DNA, 25 bp, Mus musculus
gacctccatggcctgctgtggtttt

SEQ ID NO: 455512 - DNA, 25 bp, Mus musculus
gacctccatggcgagcgggtgtcct

SEQ ID NO: 455513 - DNA, 25 bp, Mus musculus
gacctccatggcgtgctgtggtttt

SEQ ID NO: 455514 - DNA, 25 bp, Mus musculus
gacctccatgtgagggctcccacat

SEQ ID NO: 455515 - DNA, 25 bp, Mus musculus
gacctccatgtgtgggctcccacat

SEQ ID NO: 455516 - DNA, 25 bp, Mus musculus
gacctccattccatgacttgtttaa

SEQ ID NO: 455517 - DNA, 25 bp, Mus musculus
gacctccattccttgacttgtttaa

SEQ ID NO: 455518 - DNA, 25 bp, Mus musculus
gacctccattgcagactcaaaaggc

SEQ ID NO: 455519 - DNA, 25 bp, Mus musculus
gacctccattgctgactcaaaaggc

SEQ ID NO: 455520 - DNA, 25 bp, Mus musculus
gacctccattggaatgtctgcctgt

SEQ ID NO: 455521 - DNA, 25 bp, Mus musculus
gacctccattggtatgtctgcctgt

SEQ ID NO: 455522 - DNA, 25 bp, Mus musculus
gacctcccagagatatgttatacac

SEQ ID NO: 455523 - DNA, 25 bp, Mus musculus
gacctcccagagttatgttatacac

SEQ ID NO: 455524 - DNA, 25 bp, Mus musculus
gacctcccagccctcaagaagatga

SEQ ID NO: 455525 - DNA, 25 bp, Mus musculus
gacctcccagccgtcaagaagatga

SEQ ID NO: 455526 - DNA, 25 bp, Mus musculus
gacctcccagtaaacacaattggct

SEQ ID NO: 455527 - DNA, 25 bp, Mus musculus
gacctcccagtatacacaattggct

SEQ ID NO: 455528 - DNA, 25 bp, Mus musculus
gacctccctgaactttaaagctatt

SEQ ID NO: 455529 - DNA, 25 bp, Mus musculus
gacctccctgaagtttaaagctatt

SEQ ID NO: 455530 - DNA, 25 bp, Mus musculus
gacctccctgagacatgttttctaa

SEQ ID NO: 455531 - DNA, 25 bp, Mus musculus
gacctccctgagcaaagctctaaag

SEQ ID NO: 455532 - DNA, 25 bp, Mus musculus
gacctccctgaggaaagctctaaag

SEQ ID NO: 455533 - DNA, 25 bp, Mus musculus
gacctccctgagtcatgttttctaa

SEQ ID NO: 455534 - DNA, 25 bp, Mus musculus
gacctccctgggaattaacatcata

SEQ ID NO: 455535 - DNA, 25 bp, Mus musculus
gacctccctgggtattaacatcata

SEQ ID NO: 455536 - DNA, 25 bp, Mus musculus
gacctccgcgccaatcaacagtggg

SEQ ID NO: 455537 - DNA, 25 bp, Mus musculus
gacctccgcgcctatcaacagtggg

SEQ ID NO: 455538 - DNA, 25 bp, Mus musculus
gacctccggactactgcatttagaa

SEQ ID NO: 455539 - DNA, 25 bp, Mus musculus
gacctccggacttctgcatttagaa

SEQ ID NO: 455540 - DNA, 25 bp, Mus musculus
gacctccgggagatcggccatggca

SEQ ID NO: 455541 - DNA, 25 bp, Mus musculus
gacctccgggagttcggccatggca

SEQ ID NO: 455542 - DNA, 25 bp, Mus musculus
gacctcctactgactgtaaagcgca

SEQ ID NO: 455543 - DNA, 25 bp, Mus musculus
gacctcctactgtctgtaaagcgca

SEQ ID NO: 455544 - DNA, 25 bp, Mus musculus
gacctcctagttacctattcagttg

SEQ ID NO: 455545 - DNA, 25 bp, Mus musculus
gacctcctagtttcctattcagttg

SEQ ID NO: 455546 - DNA, 25 bp, Mus musculus
gacctcctcaggattgttcatataa

SEQ ID NO: 455547 - DNA, 25 bp, Mus musculus
gacctcctcaggtttgttcatataa

SEQ ID NO: 455548 - DNA, 25 bp, Mus musculus
gacctcctccggctgttgtgagtgc

SEQ ID NO: 455549 - DNA, 25 bp, Mus musculus
gacctcctccgggtgttgtgagtgc

SEQ ID NO: 455550 - DNA, 25 bp, Mus musculus
gacctcctctggatcttaggccgag

SEQ ID NO: 455551 - DNA, 25 bp, Mus musculus
gacctcctctggttcttaggccgag

SEQ ID NO: 455552 - DNA, 25 bp, Mus musculus
gacctcctgaccacttaaagttgat

SEQ ID NO: 455553 - DNA, 25 bp, Mus musculus
gacctcctgacctcttaaagttgat

SEQ ID NO: 455554 - DNA, 25 bp, Mus musculus
gacctcctgagtctcttcagtgaca

SEQ ID NO: 455555 - DNA, 25 bp, Mus musculus
gacctcctgagtgtcttcagtgaca

SEQ ID NO: 455556 - DNA, 25 bp, Mus musculus
gacctcctgccactgttctgggaaa

SEQ ID NO: 455557 - DNA, 25 bp, Mus musculus
gacctcctgccagtgttctgggaaa

SEQ ID NO: 455558 - DNA, 25 bp, Mus musculus
gacctcctgcgtcctagaaaatttg

SEQ ID NO: 455559 - DNA, 25 bp, Mus musculus
gacctcctgcgtcgcattgtggcca

SEQ ID NO: 455560 - DNA, 25 bp, Mus musculus
gacctcctgcgtgctagaaaatttg

SEQ ID NO: 455561 - DNA, 25 bp, Mus musculus
gacctcctgcgtggcattgtggcca

SEQ ID NO: 455562 - DNA, 25 bp, Mus musculus
gacctcctggaaaacccttttgaga

SEQ ID NO: 455563 - DNA, 25 bp, Mus musculus
gacctcctggaatacccttttgaga

SEQ ID NO: 455564 - DNA, 25 bp, Mus musculus
gacctcctggcacctaagctgttta

SEQ ID NO: 455565 - DNA, 25 bp, Mus musculus
gacctcctggcagctaagctgttta

SEQ ID NO: 455566 - DNA, 25 bp, Mus musculus
gacctcctgtggctatgagagcatc

SEQ ID NO: 455567 - DNA, 25 bp, Mus musculus
gacctcctgtgggtatgagagcatc

SEQ ID NO: 455568 - DNA, 25 bp, Mus musculus
gacctccttcaccaacttaaaaatg

SEQ ID NO: 455569 - DNA, 25 bp, Mus musculus
gacctccttcacgaacttaaaaatg

SEQ ID NO: 455570 - DNA, 25 bp, Mus musculus
gacctccttcagatttcctagatat

SEQ ID NO: 455571 - DNA, 25 bp, Mus musculus
gacctccttcagttttcctagatat

SEQ ID NO: 455572 - DNA, 25 bp, Mus musculus
gacctccttcatccaagtagtgtgg

SEQ ID NO: 455573 - DNA, 25 bp, Mus musculus
gacctccttcatgcaagtagtgtgg

SEQ ID NO: 455574 - DNA, 25 bp, Mus musculus
gacctccttcttactacatttattc

SEQ ID NO: 455575 - DNA, 25 bp, Mus musculus
gacctccttctttctacatttattc

SEQ ID NO: 455576 - DNA, 25 bp, Mus musculus
gacctccttgaacgcgtctttggaa

SEQ ID NO: 455577 - DNA, 25 bp, Mus musculus
gacctccttgaaggcgtctttggaa

SEQ ID NO: 455578 - DNA, 25 bp, Mus musculus
gacctccttgagagatgtgcaactt

SEQ ID NO: 455579 - DNA, 25 bp, Mus musculus
gacctccttgagtgatgtgcaactt

SEQ ID NO: 455580 - DNA, 25 bp, Mus musculus
gacctcgagcacagttgaaatagac

SEQ ID NO: 455581 - DNA, 25 bp, Mus musculus
gacctcgagcactgttgaaatagac

SEQ ID NO: 455582 - DNA, 25 bp, Mus musculus
gacctcgaggtccaaggtacgcaga

SEQ ID NO: 455583 - DNA, 25 bp, Mus musculus
gacctcgaggtcgaaggtacgcaga

SEQ ID NO: 455584 - DNA, 25 bp, Mus musculus
gacctcgcaaacctcttcggaagac

SEQ ID NO: 455585 - DNA, 25 bp, Mus musculus
gacctcgcaaacgtcttcggaagac

SEQ ID NO: 455586 - DNA, 25 bp, Mus musculus
gacctcgcctcgcaggaactacaat

SEQ ID NO: 455587 - DNA, 25 bp, Mus musculus
gacctcgcctcggaggaactacaat

SEQ ID NO: 455588 - DNA, 25 bp, Mus musculus
gacctcggagccatttgtttagtgg

SEQ ID NO: 455589 - DNA, 25 bp, Mus musculus
gacctcggagccttttgtttagtgg

SEQ ID NO: 455590 - DNA, 25 bp, Mus musculus
gacctcggagtcctggaactatgac

SEQ ID NO: 455591 - DNA, 25 bp, Mus musculus
gacctcggagtcgtggaactatgac

SEQ ID NO: 455592 - DNA, 25 bp, Mus musculus
gacctcggagttcctgtatcaggga

SEQ ID NO: 455593 - DNA, 25 bp, Mus musculus
gacctcggagttgctgtatcaggga

SEQ ID NO: 455594 - DNA, 25 bp, Mus musculus
gacctcgggagtagtagctgctgtt

SEQ ID NO: 455595 - DNA, 25 bp, Mus musculus
gacctcgggagttgtagctgctgtt

SEQ ID NO: 455596 - DNA, 25 bp, Mus musculus
gacctcgggcctacagagagtcaga

SEQ ID NO: 455597 - DNA, 25 bp, Mus musculus
gacctcgggccttcagagagtcaga

SEQ ID NO: 455598 - DNA, 25 bp, Mus musculus
gacctcgtcctcaggaaagtcttaa

SEQ ID NO: 455599 - DNA, 25 bp, Mus musculus
gacctcgtcctctggaaagtcttaa

SEQ ID NO: 455600 - DNA, 25 bp, Mus musculus
gacctcgtgaccatttttggaacag

SEQ ID NO: 455601 - DNA, 25 bp, Mus musculus
gacctcgtgaccttttttggaacag

SEQ ID NO: 455602 - DNA, 25 bp, Mus musculus
gacctcgtgcctcgaaatacttcat

SEQ ID NO: 455603 - DNA, 25 bp, Mus musculus
gacctcgtgcctggaaatacttcat

SEQ ID NO: 455604 - DNA, 25 bp, Mus musculus
gacctcgtggtccacatatatgcag

SEQ ID NO: 455605 - DNA, 25 bp, Mus musculus
gacctcgtggtcgacatatatgcag

SEQ ID NO: 455606 - DNA, 25 bp, Mus musculus
gacctcgtttatctgatacgacctt

SEQ ID NO: 455607 - DNA, 25 bp, Mus musculus
gacctcgtttatgtgatacgacctt

SEQ ID NO: 455608 - DNA, 25 bp, Mus musculus
gacctctaaacaatccagtattcag

SEQ ID NO: 455609 - DNA, 25 bp, Mus musculus
gacctctaaacattccagtattcag

SEQ ID NO: 455610 - DNA, 25 bp, Mus musculus
gacctctaaagaacctcagtgcaga

SEQ ID NO: 455611 - DNA, 25 bp, Mus musculus
gacctctaaagatcctcagtgcaga

SEQ ID NO: 455612 - DNA, 25 bp, Mus musculus
gacctctaagtgcacgtttcctaag

SEQ ID NO: 455613 - DNA, 25 bp, Mus musculus
gacctctaagtggacgtttcctaag

SEQ ID NO: 455614 - DNA, 25 bp, Mus musculus
gacctctaccaaatttttctatcca

SEQ ID NO: 455615 - DNA, 25 bp, Mus musculus
gacctctaccaattttttctatcca

SEQ ID NO: 455616 - DNA, 25 bp, Mus musculus
gacctctactcactaggctgtggta

SEQ ID NO: 455617 - DNA, 25 bp, Mus musculus
gacctctactcagtaggctgtggta

SEQ ID NO: 455618 - DNA, 25 bp, Mus musculus
gacctctagacccaaggaagcctat

SEQ ID NO: 455619 - DNA, 25 bp, Mus musculus
gacctctagaccgaaggaagcctat

SEQ ID NO: 455620 - DNA, 25 bp, Mus musculus
gacctctagctcagtcatttgtact

SEQ ID NO: 455621 - DNA, 25 bp, Mus musculus
gacctctagctctgtcatttgtact

SEQ ID NO: 455622 - DNA, 25 bp, Mus musculus
gacctctagtctcctaatgtcaaca

SEQ ID NO: 455623 - DNA, 25 bp, Mus musculus
gacctctagtctgctaatgtcaaca

SEQ ID NO: 455624 - DNA, 25 bp, Mus musculus
gacctctagtttcatgagtcccaaa

SEQ ID NO: 455625 - DNA, 25 bp, Mus musculus
gacctctagtttcctgtgtgatatc

SEQ ID NO: 455626 - DNA, 25 bp, Mus musculus
gacctctagtttgatgagtcccaaa

SEQ ID NO: 455627 - DNA, 25 bp, Mus musculus
gacctctagtttgctgtgtgatatc

SEQ ID NO: 455628 - DNA, 25 bp, Mus musculus
gacctctatataactgtcaccgttt

SEQ ID NO: 455629 - DNA, 25 bp, Mus musculus
gacctctatatatctgtcaccgttt

SEQ ID NO: 455630 - DNA, 25 bp, Mus musculus
gacctctatgccaacacagtgttgt

SEQ ID NO: 455631 - DNA, 25 bp, Mus musculus
gacctctatgcctacacagtgttgt

SEQ ID NO: 455632 - DNA, 25 bp, Mus musculus
gacctctattctctgtattaggaca

SEQ ID NO: 455633 - DNA, 25 bp, Mus musculus
gacctctattctgtgtattaggaca

SEQ ID NO: 455634 - DNA, 25 bp, Mus musculus
gacctctcacagatcggatggatat

SEQ ID NO: 455635 - DNA, 25 bp, Mus musculus
gacctctcacagttcggatggatat

SEQ ID NO: 455636 - DNA, 25 bp, Mus musculus
gacctctcagaaacaaacgaaaatt

SEQ ID NO: 455637 - DNA, 25 bp, Mus musculus
gacctctcagaatcaaacgaaaatt

SEQ ID NO: 455638 - DNA, 25 bp, Mus musculus
gacctctcagctagcttgtatgcaa

SEQ ID NO: 455639 - DNA, 25 bp, Mus musculus
gacctctcagcttgcttgtatgcaa

SEQ ID NO: 455640 - DNA, 25 bp, Mus musculus
gacctctccataacttttgttatat

SEQ ID NO: 455641 - DNA, 25 bp, Mus musculus
gacctctccatatcttttgttatat

SEQ ID NO: 455642 - DNA, 25 bp, Mus musculus
gacctctccccaagtaggacataaa

SEQ ID NO: 455643 - DNA, 25 bp, Mus musculus
gacctctccccatgtaggacataaa

SEQ ID NO: 455644 - DNA, 25 bp, Mus musculus
gacctctcctcgagttacagcagga

SEQ ID NO: 455645 - DNA, 25 bp, Mus musculus
gacctctcctcgtgttacagcagga

SEQ ID NO: 455646 - DNA, 25 bp, Mus musculus
gacctctcgacccactgttcagggt

SEQ ID NO: 455647 - DNA, 25 bp, Mus musculus
gacctctcgaccgactgttcagggt

SEQ ID NO: 455648 - DNA, 25 bp, Mus musculus
gacctctcgctgagcaggctgggat

SEQ ID NO: 455649 - DNA, 25 bp, Mus musculus
gacctctcgctgtgcaggctgggat

SEQ ID NO: 455650 - DNA, 25 bp, Mus musculus
gacctctctaagattctgttatcca

SEQ ID NO: 455651 - DNA, 25 bp, Mus musculus
gacctctctaagtttctgttatcca

SEQ ID NO: 455652 - DNA, 25 bp, Mus musculus
gacctctctaataaacacaatgagt

SEQ ID NO: 455653 - DNA, 25 bp, Mus musculus
gacctctctaataactgctaaaaaa

SEQ ID NO: 455654 - DNA, 25 bp, Mus musculus
gacctctctaattaacacaatgagt

SEQ ID NO: 455655 - DNA, 25 bp, Mus musculus
gacctctctaattactgctaaaaaa

SEQ ID NO: 455656 - DNA, 25 bp, Mus musculus
gacctctctttacggtggctgcaaa

SEQ ID NO: 455657 - DNA, 25 bp, Mus musculus
gacctctctttagggtggctgcaaa

SEQ ID NO: 455658 - DNA, 25 bp, Mus musculus
gacctctgaaatcaactttttgtag

SEQ ID NO: 455659 - DNA, 25 bp, Mus musculus
gacctctgaaatgaactttttgtag

SEQ ID NO: 455660 - DNA, 25 bp, Mus musculus
gacctctgacatccattacttaatc

SEQ ID NO: 455661 - DNA, 25 bp, Mus musculus
gacctctgacatgcattacttaatc

SEQ ID NO: 455662 - DNA, 25 bp, Mus musculus
gacctctgactaccggtggctttta

SEQ ID NO: 455663 - DNA, 25 bp, Mus musculus
gacctctgactagcggtggctttta

SEQ ID NO: 455664 - DNA, 25 bp, Mus musculus
gacctctgactcaagaaacagtgtt

SEQ ID NO: 455665 - DNA, 25 bp, Mus musculus
gacctctgactctagaaacagtgtt

SEQ ID NO: 455666 - DNA, 25 bp, Mus musculus
gacctctgagccaccaacagggttt

SEQ ID NO: 455667 - DNA, 25 bp, Mus musculus
gacctctgagcctccaacagggttt

SEQ ID NO: 455668 - DNA, 25 bp, Mus musculus
gacctctgaggtatgaagtttgtgc

SEQ ID NO: 455669 - DNA, 25 bp, Mus musculus
gacctctgaggtcttctagcctgca

SEQ ID NO: 455670 - DNA, 25 bp, Mus musculus
gacctctgaggtgttctagcctgca

SEQ ID NO: 455671 - DNA, 25 bp, Mus musculus
gacctctgaggtttgaagtttgtgc

SEQ ID NO: 455672 - DNA, 25 bp, Mus musculus
gacctctgatttatccgtggcatga

SEQ ID NO: 455673 - DNA, 25 bp, Mus musculus
gacctctgatttttccgtggcatga

SEQ ID NO: 455674 - DNA, 25 bp, Mus musculus
gacctctgcttgaagagcaaaccaa

SEQ ID NO: 455675 - DNA, 25 bp, Mus musculus
gacctctgcttgtagagcaaaccaa

SEQ ID NO: 455676 - DNA, 25 bp, Mus musculus
gacctctggaagcaactactcctga

SEQ ID NO: 455677 - DNA, 25 bp, Mus musculus
gacctctggaaggaactactcctga

SEQ ID NO: 455678 - DNA, 25 bp, Mus musculus
gacctctggacacgtgcaacaagaa

SEQ ID NO: 455679 - DNA, 25 bp, Mus musculus
gacctctggacaggtgcaacaagaa

SEQ ID NO: 455680 - DNA, 25 bp, Mus musculus
gacctctggcagaccatgcaaattg

SEQ ID NO: 455681 - DNA, 25 bp, Mus musculus
gacctctggcagtccatgcaaattg

SEQ ID NO: 455682 - DNA, 25 bp, Mus musculus
gacctctggccaccgtgaattgggc

SEQ ID NO: 455683 - DNA, 25 bp, Mus musculus
gacctctggccagcgtgaattgggc

SEQ ID NO: 455684 - DNA, 25 bp, Mus musculus
gacctctgggatcttttcatttacc

SEQ ID NO: 455685 - DNA, 25 bp, Mus musculus
gacctctgggatgttttcatttacc

SEQ ID NO: 455686 - DNA, 25 bp, Mus musculus
gacctctgtaagcatctgcatcttc

SEQ ID NO: 455687 - DNA, 25 bp, Mus musculus
gacctctgtaaggatctgcatcttc

SEQ ID NO: 455688 - DNA, 25 bp, Mus musculus
gacctctgtaccaggaacatatgtg

SEQ ID NO: 455689 - DNA, 25 bp, Mus musculus
gacctctgtacctggaacatatgtg

SEQ ID NO: 455690 - DNA, 25 bp, Mus musculus
gacctctgtgaaagcagcgtgcagc

SEQ ID NO: 455691 - DNA, 25 bp, Mus musculus
gacctctgtgaatgcagcgtgcagc

SEQ ID NO: 455692 - DNA, 25 bp, Mus musculus
gacctctgtgatcggacatcttgtg

SEQ ID NO: 455693 - DNA, 25 bp, Mus musculus
gacctctgtgatgggacatcttgtg

SEQ ID NO: 455694 - DNA, 25 bp, Mus musculus
gacctctgtggcatatgctttgtga

SEQ ID NO: 455695 - DNA, 25 bp, Mus musculus
gacctctgtggcttatgctttgtga

SEQ ID NO: 455696 - DNA, 25 bp, Mus musculus
gacctctgttatcggctaagtatag

SEQ ID NO: 455697 - DNA, 25 bp, Mus musculus
gacctctgttatgggctaagtatag

SEQ ID NO: 455698 - DNA, 25 bp, Mus musculus
gacctctgttttctcgacattgtaa

SEQ ID NO: 455699 - DNA, 25 bp, Mus musculus
gacctctgttttgtcgacattgtaa

SEQ ID NO: 455700 - DNA, 25 bp, Mus musculus
gacctcttaacaattcagcccagaa

SEQ ID NO: 455701 - DNA, 25 bp, Mus musculus
gacctcttaacatttcagcccagaa

SEQ ID NO: 455702 - DNA, 25 bp, Mus musculus
gacctcttacccatagggctggaga

SEQ ID NO: 455703 - DNA, 25 bp, Mus musculus
gacctcttacccttagggctggaga

SEQ ID NO: 455704 - DNA, 25 bp, Mus musculus
gacctcttcaaaatcaacaagttca

SEQ ID NO: 455705 - DNA, 25 bp, Mus musculus
gacctcttcaaattcaacaagttca

SEQ ID NO: 455706 - DNA, 25 bp, Mus musculus
gacctcttctcaaggacactaggca

SEQ ID NO: 455707 - DNA, 25 bp, Mus musculus
gacctcttctcatggacactaggca

SEQ ID NO: 455708 - DNA, 25 bp, Mus musculus
gacctcttgagtacacctgcacagg

SEQ ID NO: 455709 - DNA, 25 bp, Mus musculus
gacctcttgagtcaatttttcccct

SEQ ID NO: 455710 - DNA, 25 bp, Mus musculus
gacctcttgagtgaatttttcccct

SEQ ID NO: 455711 - DNA, 25 bp, Mus musculus
gacctcttgagttcacctgcacagg

SEQ ID NO: 455712 - DNA, 25 bp, Mus musculus
gacctcttgcggctactaggcacga

SEQ ID NO: 455713 - DNA, 25 bp, Mus musculus
gacctcttgcgggtactaggcacga

SEQ ID NO: 455714 - DNA, 25 bp, Mus musculus
gacctcttggatctttcaaactgta

SEQ ID NO: 455715 - DNA, 25 bp, Mus musculus
gacctcttggatgtttcaaactgta

SEQ ID NO: 455716 - DNA, 25 bp, Mus musculus
gacctcttggccaaaatggcctcca

SEQ ID NO: 455717 - DNA, 25 bp, Mus musculus
gacctcttggcctaaatggcctcca

SEQ ID NO: 455718 - DNA, 25 bp, Mus musculus
gacctcttggtccaaattctctgga

SEQ ID NO: 455719 - DNA, 25 bp, Mus musculus
gacctcttggtcgaaattctctgga

SEQ ID NO: 455720 - DNA, 25 bp, Mus musculus
gacctctttataagttgactccatt

SEQ ID NO: 455721 - DNA, 25 bp, Mus musculus
gacctctttatatgttgactccatt

SEQ ID NO: 455722 - DNA, 25 bp, Mus musculus
gacctctttcaaatttgtggccttt

SEQ ID NO: 455723 - DNA, 25 bp, Mus musculus
gacctctttcaattttgtggccttt

SEQ ID NO: 455724 - DNA, 25 bp, Mus musculus
gacctctttgaaccaccacatgcac

SEQ ID NO: 455725 - DNA, 25 bp, Mus musculus
gacctctttgaagcaccacatgcac

SEQ ID NO: 455726 - DNA, 25 bp, Mus musculus
gacctctttgggaaggagatacaca

SEQ ID NO: 455727 - DNA, 25 bp, Mus musculus
gacctctttgggtaggagatacaca

SEQ ID NO: 455728 - DNA, 25 bp, Mus musculus
gacctctttttccatctgcttaaag

SEQ ID NO: 455729 - DNA, 25 bp, Mus musculus
gacctctttttcctctcagggatgc

SEQ ID NO: 455730 - DNA, 25 bp, Mus musculus
gacctctttttcgatctgcttaaag

SEQ ID NO: 455731 - DNA, 25 bp, Mus musculus
gacctctttttcgtctcagggatgc

SEQ ID NO: 455732 - DNA, 25 bp, Mus musculus
gacctgaaaatgaggactgctgctg

SEQ ID NO: 455733 - DNA, 25 bp, Mus musculus
gacctgaaaatgtggactgctgctg

SEQ ID NO: 455734 - DNA, 25 bp, Mus musculus
gacctgaaacgcaaactgatcctac

SEQ ID NO: 455735 - DNA, 25 bp, Mus musculus
gacctgaaacgctaactgatcctac

SEQ ID NO: 455736 - DNA, 25 bp, Mus musculus
gacctgaaacgtcctatgtagacta

SEQ ID NO: 455737 - DNA, 25 bp, Mus musculus
gacctgaaacgtgctatgtagacta

SEQ ID NO: 455738 - DNA, 25 bp, Mus musculus
gacctgaaatcaatcttaaatagca

SEQ ID NO: 455739 - DNA, 25 bp, Mus musculus
gacctgaaatcattcttaaatagca

SEQ ID NO: 455740 - DNA, 25 bp, Mus musculus
gacctgaacaagaaccataccaata

SEQ ID NO: 455741 - DNA, 25 bp, Mus musculus
gacctgaacaagtaccataccaata

SEQ ID NO: 455742 - DNA, 25 bp, Mus musculus
gacctgaacatgatccctaggacct

SEQ ID NO: 455743 - DNA, 25 bp, Mus musculus
gacctgaacatgttccctaggacct

SEQ ID NO: 455744 - DNA, 25 bp, Mus musculus
gacctgaacgagatgtagacctccc

SEQ ID NO: 455745 - DNA, 25 bp, Mus musculus
gacctgaacgagttgtagacctccc

SEQ ID NO: 455746 - DNA, 25 bp, Mus musculus
gacctgaacgccatggccgggactc

SEQ ID NO: 455747 - DNA, 25 bp, Mus musculus
gacctgaacgccttggccgggactc

SEQ ID NO: 455748 - DNA, 25 bp, Mus musculus
gacctgaactacagttatgcctgga

SEQ ID NO: 455749 - DNA, 25 bp, Mus musculus
gacctgaactaccttatctacgtgt

SEQ ID NO: 455750 - DNA, 25 bp, Mus musculus
gacctgaactacgttatctacgtgt

SEQ ID NO: 455751 - DNA, 25 bp, Mus musculus
gacctgaactactgttatgcctgga

SEQ ID NO: 455752 - DNA, 25 bp, Mus musculus
gacctgaacttcatactatacggtt

SEQ ID NO: 455753 - DNA, 25 bp, Mus musculus
gacctgaacttcttactatacggtt

SEQ ID NO: 455754 - DNA, 25 bp, Mus musculus
gacctgaagatgataaacgagtcac

SEQ ID NO: 455755 - DNA, 25 bp, Mus musculus
gacctgaagatgttaaacgagtcac

SEQ ID NO: 455756 - DNA, 25 bp, Mus musculus
gacctgaagcacctgtatccagtta

SEQ ID NO: 455757 - DNA, 25 bp, Mus musculus
gacctgaagcacgtgtatccagtta

SEQ ID NO: 455758 - DNA, 25 bp, Mus musculus
gacctgaagtcactggtcagcagaa

SEQ ID NO: 455759 - DNA, 25 bp, Mus musculus
gacctgaagtcagtggtcagcagaa

SEQ ID NO: 455760 - DNA, 25 bp, Mus musculus
gacctgaatataaagtgcatgcaag

SEQ ID NO: 455761 - DNA, 25 bp, Mus musculus
gacctgaatatatagtgcatgcaag

SEQ ID NO: 455762 - DNA, 25 bp, Mus musculus
gacctgaatcatatttgccgggtga

SEQ ID NO: 455763 - DNA, 25 bp, Mus musculus
gacctgaatcatttttgccgggtga

SEQ ID NO: 455764 - DNA, 25 bp, Mus musculus
gacctgaatcgtcactggctggatc

SEQ ID NO: 455765 - DNA, 25 bp, Mus musculus
gacctgaatcgtgactggctggatc

SEQ ID NO: 455766 - DNA, 25 bp, Mus musculus
gacctgaatgatctgttcctgcctg

SEQ ID NO: 455767 - DNA, 25 bp, Mus musculus
gacctgaatgatgtgttcctgcctg

SEQ ID NO: 455768 - DNA, 25 bp, Mus musculus
gacctgaattccacagtggtcttaa

SEQ ID NO: 455769 - DNA, 25 bp, Mus musculus
gacctgaattcctcagtggtcttaa

SEQ ID NO: 455770 - DNA, 25 bp, Mus musculus
gacctgaattttatagtagctttag

SEQ ID NO: 455771 - DNA, 25 bp, Mus musculus
gacctgaattttttagtagctttag

SEQ ID NO: 455772 - DNA, 25 bp, Mus musculus
gacctgacacggcacaaggaataaa

SEQ ID NO: 455773 - DNA, 25 bp, Mus musculus
gacctgacacgggacaaggaataaa

SEQ ID NO: 455774 - DNA, 25 bp, Mus musculus
gacctgacagaaaaggacaagttga

SEQ ID NO: 455775 - DNA, 25 bp, Mus musculus
gacctgacagaataggacaagttga

SEQ ID NO: 455776 - DNA, 25 bp, Mus musculus
gacctgacagccatgaggacgacct

SEQ ID NO: 455777 - DNA, 25 bp, Mus musculus
gacctgacagccttgaggacgacct

SEQ ID NO: 455778 - DNA, 25 bp, Mus musculus
gacctgaccactcctggtgcagtca

SEQ ID NO: 455779 - DNA, 25 bp, Mus musculus
gacctgaccactgctggtgcagtca

SEQ ID NO: 455780 - DNA, 25 bp, Mus musculus
gacctgaccggaagtgcgtttatga

SEQ ID NO: 455781 - DNA, 25 bp, Mus musculus
gacctgaccggatgtgcgtttatga

SEQ ID NO: 455782 - DNA, 25 bp, Mus musculus
gacctgaccgttaacagctgtagcc

SEQ ID NO: 455783 - DNA, 25 bp, Mus musculus
gacctgaccgtttacagctgtagcc

SEQ ID NO: 455784 - DNA, 25 bp, Mus musculus
gacctgactatcagaaagctatttg

SEQ ID NO: 455785 - DNA, 25 bp, Mus musculus
gacctgactatctgaaagctatttg

SEQ ID NO: 455786 - DNA, 25 bp, Mus musculus
gacctgactcagattatccggactt

SEQ ID NO: 455787 - DNA, 25 bp, Mus musculus
gacctgactcagtttatccggactt

SEQ ID NO: 455788 - DNA, 25 bp, Mus musculus
gacctgactccaagtgtcttgtaga

SEQ ID NO: 455789 - DNA, 25 bp, Mus musculus
gacctgactccatgtgtcttgtaga

SEQ ID NO: 455790 - DNA, 25 bp, Mus musculus
gacctgactctcatcaaggacttga

SEQ ID NO: 455791 - DNA, 25 bp, Mus musculus
gacctgactctcttcaaggacttga

SEQ ID NO: 455792 - DNA, 25 bp, Mus musculus
gacctgactgttaaacctgagagat

SEQ ID NO: 455793 - DNA, 25 bp, Mus musculus
gacctgactgtttaacctgagagat

SEQ ID NO: 455794 - DNA, 25 bp, Mus musculus
gacctgacttgtagacgtaagacct

SEQ ID NO: 455795 - DNA, 25 bp, Mus musculus
gacctgacttgttgacgtaagacct

SEQ ID NO: 455796 - DNA, 25 bp, Mus musculus
gacctgacttttaaacctgacaata

SEQ ID NO: 455797 - DNA, 25 bp, Mus musculus
gacctgactttttaacctgacaata

SEQ ID NO: 455798 - DNA, 25 bp, Mus musculus
gacctgagaaccatgctgtctgtat

SEQ ID NO: 455799 - DNA, 25 bp, Mus musculus
gacctgagaaccttgctgtctgtat

SEQ ID NO: 455800 - DNA, 25 bp, Mus musculus
gacctgagagcgaattttgagcata

SEQ ID NO: 455801 - DNA, 25 bp, Mus musculus
gacctgagagcgtattttgagcata

SEQ ID NO: 455802 - DNA, 25 bp, Mus musculus
gacctgagccggaggttttgtgacc

SEQ ID NO: 455803 - DNA, 25 bp, Mus musculus
gacctgagccggtggttttgtgacc

SEQ ID NO: 455804 - DNA, 25 bp, Mus musculus
gacctgagctcactatctggaaccc

SEQ ID NO: 455805 - DNA, 25 bp, Mus musculus
gacctgagctcagtatctggaaccc

SEQ ID NO: 455806 - DNA, 25 bp, Mus musculus
gacctgagcttgactcccatgatgg

SEQ ID NO: 455807 - DNA, 25 bp, Mus musculus
gacctgagcttgtctcccatgatgg

SEQ ID NO: 455808 - DNA, 25 bp, Mus musculus
gacctgaggacccaccagtcagaac

SEQ ID NO: 455809 - DNA, 25 bp, Mus musculus
gacctgaggaccgaccagtcagaac

SEQ ID NO: 455810 - DNA, 25 bp, Mus musculus
gacctgagggctattctaatgagat

SEQ ID NO: 455811 - DNA, 25 bp, Mus musculus
gacctgagggcttttctaatgagat

SEQ ID NO: 455812 - DNA, 25 bp, Mus musculus
gacctgaggtcacaagttgccatct

SEQ ID NO: 455813 - DNA, 25 bp, Mus musculus
gacctgaggtcagaagttgccatct

SEQ ID NO: 455814 - DNA, 25 bp, Mus musculus
gacctgaggtctaggcatgctgttt

SEQ ID NO: 455815 - DNA, 25 bp, Mus musculus
gacctgaggtctcctataacctgaa

SEQ ID NO: 455816 - DNA, 25 bp, Mus musculus
gacctgaggtctgctataacctgaa

SEQ ID NO: 455817 - DNA, 25 bp, Mus musculus
gacctgaggtcttggcatgctgttt

SEQ ID NO: 455818 - DNA, 25 bp, Mus musculus
gacctgagtacaatgaagtgcactt

SEQ ID NO: 455819 - DNA, 25 bp, Mus musculus
gacctgagtacattgaagtgcactt

SEQ ID NO: 455820 - DNA, 25 bp, Mus musculus
gacctgagtcttacactatttattt

SEQ ID NO: 455821 - DNA, 25 bp, Mus musculus
gacctgagtctttcactatttattt

SEQ ID NO: 455822 - DNA, 25 bp, Mus musculus
gacctgagtggacagccagcctcaa

SEQ ID NO: 455823 - DNA, 25 bp, Mus musculus
gacctgagtggagagccagcctcaa

SEQ ID NO: 455824 - DNA, 25 bp, Mus musculus
gacctgagtggtatatttttggcat

SEQ ID NO: 455825 - DNA, 25 bp, Mus musculus
gacctgagtggtttatttttggcat

SEQ ID NO: 455826 - DNA, 25 bp, Mus musculus
gacctgagtgtcagtctttagaata

SEQ ID NO: 455827 - DNA, 25 bp, Mus musculus
gacctgagtgtctgtctttagaata

SEQ ID NO: 455828 - DNA, 25 bp, Mus musculus
gacctgagttagacctcgggatcca

SEQ ID NO: 455829 - DNA, 25 bp, Mus musculus
gacctgagttagtcctcgggatcca

SEQ ID NO: 455830 - DNA, 25 bp, Mus musculus
gacctgagttcacggcttcagcatt

SEQ ID NO: 455831 - DNA, 25 bp, Mus musculus
gacctgagttcagggcttcagcatt

SEQ ID NO: 455832 - DNA, 25 bp, Mus musculus
gacctgagttctcagactcagacct

SEQ ID NO: 455833 - DNA, 25 bp, Mus musculus
gacctgagttctgagactcagacct

SEQ ID NO: 455834 - DNA, 25 bp, Mus musculus
gacctgagttgactccccacgtaaa

SEQ ID NO: 455835 - DNA, 25 bp, Mus musculus
gacctgagttgagtccccacgtaaa

SEQ ID NO: 455836 - DNA, 25 bp, Mus musculus
gacctgagtttgcattttctgttaa

SEQ ID NO: 455837 - DNA, 25 bp, Mus musculus
gacctgagtttggattttctgttaa

SEQ ID NO: 455838 - DNA, 25 bp, Mus musculus
gacctgagttttcccatgatttcca

SEQ ID NO: 455839 - DNA, 25 bp, Mus musculus
gacctgagttttgccatgatttcca

SEQ ID NO: 455840 - DNA, 25 bp, Mus musculus
gacctgataaagagtgttctgtgtt

SEQ ID NO: 455841 - DNA, 25 bp, Mus musculus
gacctgataaagtgtgttctgtgtt

SEQ ID NO: 455842 - DNA, 25 bp, Mus musculus
gacctgataactattcctgcagcac

SEQ ID NO: 455843 - DNA, 25 bp, Mus musculus
gacctgataacttttcctgcagcac

SEQ ID NO: 455844 - DNA, 25 bp, Mus musculus
gacctgataatgctcccactatatt

SEQ ID NO: 455845 - DNA, 25 bp, Mus musculus
gacctgataatggtcccactatatt

SEQ ID NO: 455846 - DNA, 25 bp, Mus musculus
gacctgatagacattgggatgctgg

SEQ ID NO: 455847 - DNA, 25 bp, Mus musculus
gacctgatagactttgggatgctgg

SEQ ID NO: 455848 - DNA, 25 bp, Mus musculus
gacctgatagcacaccctattggaa

SEQ ID NO: 455849 - DNA, 25 bp, Mus musculus
gacctgatagcagaccctattggaa

SEQ ID NO: 455850 - DNA, 25 bp, Mus musculus
gacctgatagtcatgaagatgcatg

SEQ ID NO: 455851 - DNA, 25 bp, Mus musculus
gacctgatagtcttgaagatgcatg

SEQ ID NO: 455852 - DNA, 25 bp, Mus musculus
gacctgatatataccctgtgttctt

SEQ ID NO: 455853 - DNA, 25 bp, Mus musculus
gacctgatatattccctgtgttctt

SEQ ID NO: 455854 - DNA, 25 bp, Mus musculus
gacctgatatctcaggccagtgcct

SEQ ID NO: 455855 - DNA, 25 bp, Mus musculus
gacctgatatctgaggccagtgcct

SEQ ID NO: 455856 - DNA, 25 bp, Mus musculus
gacctgatcaacaactgtctgagct

SEQ ID NO: 455857 - DNA, 25 bp, Mus musculus
gacctgatcaactactgtctgagct

SEQ ID NO: 455858 - DNA, 25 bp, Mus musculus
gacctgatcagcaatgggcaagact

SEQ ID NO: 455859 - DNA, 25 bp, Mus musculus
gacctgatcagctatgggcaagact

SEQ ID NO: 455860 - DNA, 25 bp, Mus musculus
gacctgatcattatagctgagaaat

SEQ ID NO: 455861 - DNA, 25 bp, Mus musculus
gacctgatcattttagctgagaaat

SEQ ID NO: 455862 - DNA, 25 bp, Mus musculus
gacctgatccagagtgcctagcaat

SEQ ID NO: 455863 - DNA, 25 bp, Mus musculus
gacctgatccagtgtgcctagcaat

SEQ ID NO: 455864 - DNA, 25 bp, Mus musculus
gacctgatgtgtattgattcttact

SEQ ID NO: 455865 - DNA, 25 bp, Mus musculus
gacctgatgtgttttgattcttact

SEQ ID NO: 455866 - DNA, 25 bp, Mus musculus
gacctgatgttaattctctaaagaa

SEQ ID NO: 455867 - DNA, 25 bp, Mus musculus
gacctgatgttatttctctaaagaa

SEQ ID NO: 455868 - DNA, 25 bp, Mus musculus
gacctgattagcatgggatccaacg

SEQ ID NO: 455869 - DNA, 25 bp, Mus musculus
gacctgattagcttgggatccaacg

SEQ ID NO: 455870 - DNA, 25 bp, Mus musculus
gacctgattgtcatcaatgggaaac

SEQ ID NO: 455871 - DNA, 25 bp, Mus musculus
gacctgattgtcttcaatgggaaac

SEQ ID NO: 455872 - DNA, 25 bp, Mus musculus
gacctgatttaccatctgtgaataa

SEQ ID NO: 455873 - DNA, 25 bp, Mus musculus
gacctgatttacgatctgtgaataa

SEQ ID NO: 455874 - DNA, 25 bp, Mus musculus
gacctgatttagaagacaatatgac

SEQ ID NO: 455875 - DNA, 25 bp, Mus musculus
gacctgatttagtagacaatatgac

SEQ ID NO: 455876 - DNA, 25 bp, Mus musculus
gacctgcaaagaccttccacaagtt

SEQ ID NO: 455877 - DNA, 25 bp, Mus musculus
gacctgcaaagagcttccacaagtt

SEQ ID NO: 455878 - DNA, 25 bp, Mus musculus
gacctgcaactgatccgcaaactgg

SEQ ID NO: 455879 - DNA, 25 bp, Mus musculus
gacctgcaactgttccgcaaactgg

SEQ ID NO: 455880 - DNA, 25 bp, Mus musculus
gacctgcacacgcaagctggactaa

SEQ ID NO: 455881 - DNA, 25 bp, Mus musculus
gacctgcacacggaagctggactaa

SEQ ID NO: 455882 - DNA, 25 bp, Mus musculus
gacctgcacataattttagcggaca

SEQ ID NO: 455883 - DNA, 25 bp, Mus musculus
gacctgcacatatttttagcggaca

SEQ ID NO: 455884 - DNA, 25 bp, Mus musculus
gacctgcaggaccagttgagtcact

SEQ ID NO: 455885 - DNA, 25 bp, Mus musculus
gacctgcaggacgagttgagtcact

SEQ ID NO: 455886 - DNA, 25 bp, Mus musculus
gacctgcaggatatcttgagccgga

SEQ ID NO: 455887 - DNA, 25 bp, Mus musculus
gacctgcaggatttcttgagccgga

SEQ ID NO: 455888 - DNA, 25 bp, Mus musculus
gacctgcaggcacgtctgtgtcata

SEQ ID NO: 455889 - DNA, 25 bp, Mus musculus
gacctgcaggcaggtctgtgtcata

SEQ ID NO: 455890 - DNA, 25 bp, Mus musculus
gacctgcagggccatacagagtcac

SEQ ID NO: 455891 - DNA, 25 bp, Mus musculus
gacctgcagggcgatacagagtcac

SEQ ID NO: 455892 - DNA, 25 bp, Mus musculus
gacctgcagtcactgatcacatttt

SEQ ID NO: 455893 - DNA, 25 bp, Mus musculus
gacctgcagtcagtgatcacatttt

SEQ ID NO: 455894 - DNA, 25 bp, Mus musculus
gacctgcagtccctatcaggatgtc

SEQ ID NO: 455895 - DNA, 25 bp, Mus musculus
gacctgcagtccgtatcaggatgtc

SEQ ID NO: 455896 - DNA, 25 bp, Mus musculus
gacctgcatcagcttgacccgggag

SEQ ID NO: 455897 - DNA, 25 bp, Mus musculus
gacctgcatcaggttgacccgggag

SEQ ID NO: 455898 - DNA, 25 bp, Mus musculus
gacctgcatcatcttatagtggacc

SEQ ID NO: 455899 - DNA, 25 bp, Mus musculus
gacctgcatcatgttatagtggacc

SEQ ID NO: 455900 - DNA, 25 bp, Mus musculus
gacctgcatcctacagcgtggacaa

SEQ ID NO: 455901 - DNA, 25 bp, Mus musculus
gacctgcatccttcagcgtggacaa

SEQ ID NO: 455902 - DNA, 25 bp, Mus musculus
gacctgcatctgctgttggagcgca

SEQ ID NO: 455903 - DNA, 25 bp, Mus musculus
gacctgcatctggtgttggagcgca

SEQ ID NO: 455904 - DNA, 25 bp, Mus musculus
gacctgcatgccatttctggtagtg

SEQ ID NO: 455905 - DNA, 25 bp, Mus musculus
gacctgcatgccttttctggtagtg

SEQ ID NO: 455906 - DNA, 25 bp, Mus musculus
gacctgcattcaatatcatatccca

SEQ ID NO: 455907 - DNA, 25 bp, Mus musculus
gacctgcattcattatcatatccca

SEQ ID NO: 455908 - DNA, 25 bp, Mus musculus
gacctgccaggcacaatcaagtcag

SEQ ID NO: 455909 - DNA, 25 bp, Mus musculus
gacctgccaggctcaatcaagtcag

SEQ ID NO: 455910 - DNA, 25 bp, Mus musculus
gacctgccagtgctaggaccacaga

SEQ ID NO: 455911 - DNA, 25 bp, Mus musculus
gacctgccagtggtaggaccacaga

SEQ ID NO: 455912 - DNA, 25 bp, Mus musculus
gacctgcccgatccagctagctaat

SEQ ID NO: 455913 - DNA, 25 bp, Mus musculus
gacctgcccgatgcagctagctaat

SEQ ID NO: 455914 - DNA, 25 bp, Mus musculus
gacctgcccgcacatgaagtgtttg

SEQ ID NO: 455915 - DNA, 25 bp, Mus musculus
gacctgcccgcagatgaagtgtttg

SEQ ID NO: 455916 - DNA, 25 bp, Mus musculus
gacctgcctaggattataatatttg

SEQ ID NO: 455917 - DNA, 25 bp, Mus musculus
gacctgcctaggtttataatatttg

SEQ ID NO: 455918 - DNA, 25 bp, Mus musculus
gacctgcctatcaggacttggtttt

SEQ ID NO: 455919 - DNA, 25 bp, Mus musculus
gacctgcctatctggacttggtttt

SEQ ID NO: 455920 - DNA, 25 bp, Mus musculus
gacctgcctcaaatggctctttcta

SEQ ID NO: 455921 - DNA, 25 bp, Mus musculus
gacctgcctcaattggctctttcta

SEQ ID NO: 455922 - DNA, 25 bp, Mus musculus
gacctgcctcctagaatccagagaa

SEQ ID NO: 455923 - DNA, 25 bp, Mus musculus
gacctgcctccttgaatccagagaa

SEQ ID NO: 455924 - DNA, 25 bp, Mus musculus
gacctgcctgagagcgcgcctgagt

SEQ ID NO: 455925 - DNA, 25 bp, Mus musculus
gacctgcctgagtgcgcgcctgagt

SEQ ID NO: 455926 - DNA, 25 bp, Mus musculus
gacctgcctggccttgtggttacat

SEQ ID NO: 455927 - DNA, 25 bp, Mus musculus
gacctgcctggcgttgtggttacat

SEQ ID NO: 455928 - DNA, 25 bp, Mus musculus
gacctgccttatcaatacctcaagc

SEQ ID NO: 455929 - DNA, 25 bp, Mus musculus
gacctgccttatgaatacctcaagc

SEQ ID NO: 455930 - DNA, 25 bp, Mus musculus
gacctgcgacccaagaagactagag

SEQ ID NO: 455931 - DNA, 25 bp, Mus musculus
gacctgcgaccctagaagactagag

SEQ ID NO: 455932 - DNA, 25 bp, Mus musculus
gacctgcgcctacgtttaaaagtat

SEQ ID NO: 455933 - DNA, 25 bp, Mus musculus
gacctgcgcctaggtttaaaagtat

SEQ ID NO: 455934 - DNA, 25 bp, Mus musculus
gacctgcgggcgctgaacacacaga

SEQ ID NO: 455935 - DNA, 25 bp, Mus musculus
gacctgcgggcggtgaacacacaga

SEQ ID NO: 455936 - DNA, 25 bp, Mus musculus
gacctgcgtcagctgtaaacacaac

SEQ ID NO: 455937 - DNA, 25 bp, Mus musculus
gacctgcgtcaggtgtaaacacaac

SEQ ID NO: 455938 - DNA, 25 bp, Mus musculus
gacctgctacaaactgaactttctg

SEQ ID NO: 455939 - DNA, 25 bp, Mus musculus
gacctgctacaatctgaactttctg

SEQ ID NO: 455940 - DNA, 25 bp, Mus musculus
gacctgctacagaccatgttttcta

SEQ ID NO: 455941 - DNA, 25 bp, Mus musculus
gacctgctacagtccatgttttcta

SEQ ID NO: 455942 - DNA, 25 bp, Mus musculus
gacctgctacttaactgtgtcccag

SEQ ID NO: 455943 - DNA, 25 bp, Mus musculus
gacctgctactttactgtgtcccag

SEQ ID NO: 455944 - DNA, 25 bp, Mus musculus
gacctgctgcacattggactcaaaa

SEQ ID NO: 455945 - DNA, 25 bp, Mus musculus
gacctgctgcactttggactcaaaa

SEQ ID NO: 455946 - DNA, 25 bp, Mus musculus
gacctgctgcggactgcagaccctg

SEQ ID NO: 455947 - DNA, 25 bp, Mus musculus
gacctgctgcggtctgcagaccctg

SEQ ID NO: 455948 - DNA, 25 bp, Mus musculus
gacctgctggaaatcctaagacttt

SEQ ID NO: 455949 - DNA, 25 bp, Mus musculus
gacctgctggaactgctatcattca

SEQ ID NO: 455950 - DNA, 25 bp, Mus musculus
gacctgctggaagtgctatcattca

SEQ ID NO: 455951 - DNA, 25 bp, Mus musculus
gacctgctggaattcctaagacttt

SEQ ID NO: 455952 - DNA, 25 bp, Mus musculus
gacctgctggcaattacatacgtgt

SEQ ID NO: 455953 - DNA, 25 bp, Mus musculus
gacctgctggcatttacatacgtgt

SEQ ID NO: 455954 - DNA, 25 bp, Mus musculus
gacctgctgggtaataactccgaga

SEQ ID NO: 455955 - DNA, 25 bp, Mus musculus
gacctgctgggttataactccgaga

SEQ ID NO: 455956 - DNA, 25 bp, Mus musculus
gacctgctggtgatcacagtctaaa

SEQ ID NO: 455957 - DNA, 25 bp, Mus musculus
gacctgctggtgttcacagtctaaa

SEQ ID NO: 455958 - DNA, 25 bp, Mus musculus
gacctgctgtatcctataagccgtg

SEQ ID NO: 455959 - DNA, 25 bp, Mus musculus
gacctgctgtatgctataagccgtg

SEQ ID NO: 455960 - DNA, 25 bp, Mus musculus
gacctgctgtccaagaagagccatt

SEQ ID NO: 455961 - DNA, 25 bp, Mus musculus
gacctgctgtcctagaagagccatt

SEQ ID NO: 455962 - DNA, 25 bp, Mus musculus
gacctgctgtctagttcttattgca

SEQ ID NO: 455963 - DNA, 25 bp, Mus musculus
gacctgctgtcttgttcttattgca

SEQ ID NO: 455964 - DNA, 25 bp, Mus musculus
gacctgcttacaatggactgggaat

SEQ ID NO: 455965 - DNA, 25 bp, Mus musculus
gacctgcttacattggactgggaat

SEQ ID NO: 455966 - DNA, 25 bp, Mus musculus
gacctgcttgctatgggaaggacat

SEQ ID NO: 455967 - DNA, 25 bp, Mus musculus
gacctgcttgctttgggaaggacat

SEQ ID NO: 455968 - DNA, 25 bp, Mus musculus
gacctgcttttcatgttacctgaaa

SEQ ID NO: 455969 - DNA, 25 bp, Mus musculus
gacctgcttttcttgttacctgaaa

SEQ ID NO: 455970 - DNA, 25 bp, Mus musculus
gacctggaaactacatgaaattacg

SEQ ID NO: 455971 - DNA, 25 bp, Mus musculus
gacctggaaacttcatgaaattacg

SEQ ID NO: 455972 - DNA, 25 bp, Mus musculus
gacctggaaagcagcctcatcaatt

SEQ ID NO: 455973 - DNA, 25 bp, Mus musculus
gacctggaaagctgcctcatcaatt

SEQ ID NO: 455974 - DNA, 25 bp, Mus musculus
gacctggaaagtctcttcaaggacg

SEQ ID NO: 455975 - DNA, 25 bp, Mus musculus
gacctggaaagtgtcttcaaggacg

SEQ ID NO: 455976 - DNA, 25 bp, Mus musculus
gacctggaacagagtcagcaacttc

SEQ ID NO: 455977 - DNA, 25 bp, Mus musculus
gacctggaacagtgtcagcaacttc

SEQ ID NO: 455978 - DNA, 25 bp, Mus musculus
gacctggaacccagggatgcccagt

SEQ ID NO: 455979 - DNA, 25 bp, Mus musculus
gacctggaaccctgggatgcccagt

SEQ ID NO: 455980 - DNA, 25 bp, Mus musculus
gacctggaagaccagctctatgccc

SEQ ID NO: 455981 - DNA, 25 bp, Mus musculus
gacctggaagacgagctctatgccc

SEQ ID NO: 455982 - DNA, 25 bp, Mus musculus
gacctggaagatcccgcctgtgaca

SEQ ID NO: 455983 - DNA, 25 bp, Mus musculus
gacctggaagatgccgcctgtgaca

SEQ ID NO: 455984 - DNA, 25 bp, Mus musculus
gacctggaagccaactggacccagt

SEQ ID NO: 455985 - DNA, 25 bp, Mus musculus
gacctggaagcctactggacccagt

SEQ ID NO: 455986 - DNA, 25 bp, Mus musculus
gacctggaagtcacggaacattgtt

SEQ ID NO: 455987 - DNA, 25 bp, Mus musculus
gacctggaagtctcggaacattgtt

SEQ ID NO: 455988 - DNA, 25 bp, Mus musculus
gacctggaatctacaaagccaagct

SEQ ID NO: 455989 - DNA, 25 bp, Mus musculus
gacctggaatcttcaaagccaagct

SEQ ID NO: 455990 - DNA, 25 bp, Mus musculus
gacctggacaacactcagctggact

SEQ ID NO: 455991 - DNA, 25 bp, Mus musculus
gacctggacaactctcagctggact

SEQ ID NO: 455992 - DNA, 25 bp, Mus musculus
gacctggacaagcagcctatcctgg

SEQ ID NO: 455993 - DNA, 25 bp, Mus musculus
gacctggacaaggagcctatcctgg

SEQ ID NO: 455994 - DNA, 25 bp, Mus musculus
gacctggacaggcactttttggcct

SEQ ID NO: 455995 - DNA, 25 bp, Mus musculus
gacctggacagggactttttggcct

SEQ ID NO: 455996 - DNA, 25 bp, Mus musculus
gacctggaccagatgataacccaca

SEQ ID NO: 455997 - DNA, 25 bp, Mus musculus
gacctggaccagttgataacccaca

SEQ ID NO: 455998 - DNA, 25 bp, Mus musculus
gacctggacctaactgagcagtctg

SEQ ID NO: 455999 - DNA, 25 bp, Mus musculus
gacctggacctatctgagcagtctg

SEQ ID NO: 456000 - DNA, 25 bp, Mus musculus
gacctggacgtaaaagtgctcactt

SEQ ID NO: 456001 - DNA, 25 bp, Mus musculus
gacctggacgtataagtgctcactt

SEQ ID NO: 456002 - DNA, 25 bp, Mus musculus
gacctggactctctctttgaaatga

SEQ ID NO: 456003 - DNA, 25 bp, Mus musculus
gacctggactctgtctttgaaatga

SEQ ID NO: 456004 - DNA, 25 bp, Mus musculus
gacctggacttgacggtacgtgttt

SEQ ID NO: 456005 - DNA, 25 bp, Mus musculus
gacctggacttgtcggtacgtgttt

SEQ ID NO: 456006 - DNA, 25 bp, Mus musculus
gacctggagagcactgacacgcagt

SEQ ID NO: 456007 - DNA, 25 bp, Mus musculus
gacctggagagctctgacacgcagt

SEQ ID NO: 456008 - DNA, 25 bp, Mus musculus
gacctggagccgagcgtctcattta

SEQ ID NO: 456009 - DNA, 25 bp, Mus musculus
gacctggagccgtgcgtctcattta

SEQ ID NO: 456010 - DNA, 25 bp, Mus musculus
gacctggagcctccgctcaaaagga

SEQ ID NO: 456011 - DNA, 25 bp, Mus musculus
gacctggagcctgcgctcaaaagga

SEQ ID NO: 456012 - DNA, 25 bp, Mus musculus
gacctggagctactgagaaagcata

SEQ ID NO: 456013 - DNA, 25 bp, Mus musculus
gacctggagctagtgagaaagcata

SEQ ID NO: 456014 - DNA, 25 bp, Mus musculus
gacctggaggatagtgcctgctatt

SEQ ID NO: 456015 - DNA, 25 bp, Mus musculus
gacctggaggattgtgcctgctatt

SEQ ID NO: 456016 - DNA, 25 bp, Mus musculus
gacctggaggctatgcagtcacggc

SEQ ID NO: 456017 - DNA, 25 bp, Mus musculus
gacctggaggctttgcagtcacggc

SEQ ID NO: 456018 - DNA, 25 bp, Mus musculus
gacctggagggcatcataattggga

SEQ ID NO: 456019 - DNA, 25 bp, Mus musculus
gacctggagggcttcataattggga

SEQ ID NO: 456020 - DNA, 25 bp, Mus musculus
gacctggagtcacgagtttatccct

SEQ ID NO: 456021 - DNA, 25 bp, Mus musculus
gacctggagtcaggagtttatccct

SEQ ID NO: 456022 - DNA, 25 bp, Mus musculus
gacctggatcctcttgaagacgtga

SEQ ID NO: 456023 - DNA, 25 bp, Mus musculus
gacctggatcctgttgaagacgtga

SEQ ID NO: 456024 - DNA, 25 bp, Mus musculus
gacctggatgaccatgaagtttctc

SEQ ID NO: 456025 - DNA, 25 bp, Mus musculus
gacctggatgacgatgaagtttctc

SEQ ID NO: 456026 - DNA, 25 bp, Mus musculus
gacctggatgctcatgagttagaag

SEQ ID NO: 456027 - DNA, 25 bp, Mus musculus
gacctggatgctgatgagttagaag

SEQ ID NO: 456028 - DNA, 25 bp, Mus musculus
gacctggcaaagatgatccgggagt

SEQ ID NO: 456029 - DNA, 25 bp, Mus musculus
gacctggcaaagttgatccgggagt

SEQ ID NO: 456030 - DNA, 25 bp, Mus musculus
gacctggcacatccttgagaaaaac

SEQ ID NO: 456031 - DNA, 25 bp, Mus musculus
gacctggcacatgcttgagaaaaac

SEQ ID NO: 456032 - DNA, 25 bp, Mus musculus
gacctggcagcgaggacggaacaat

SEQ ID NO: 456033 - DNA, 25 bp, Mus musculus
gacctggcagcgtggacggaacaat

SEQ ID NO: 456034 - DNA, 25 bp, Mus musculus
gacctggcaggcagctgaaagagtc

SEQ ID NO: 456035 - DNA, 25 bp, Mus musculus
gacctggcaggctgctgaaagagtc

SEQ ID NO: 456036 - DNA, 25 bp, Mus musculus
gacctggccaaaacttgagcctaat

SEQ ID NO: 456037 - DNA, 25 bp, Mus musculus
gacctggccaaatcttgagcctaat

SEQ ID NO: 456038 - DNA, 25 bp, Mus musculus
gacctggccaccagcagaggtcctg

SEQ ID NO: 456039 - DNA, 25 bp, Mus musculus
gacctggccacctgcagaggtcctg

SEQ ID NO: 456040 - DNA, 25 bp, Mus musculus
gacctggccacgaagaacatggaaa

SEQ ID NO: 456041 - DNA, 25 bp, Mus musculus
gacctggccacgtagaacatggaaa

SEQ ID NO: 456042 - DNA, 25 bp, Mus musculus
gacctggccgtgacttctgatttgg

SEQ ID NO: 456043 - DNA, 25 bp, Mus musculus
gacctggccgtgtcttctgatttgg

SEQ ID NO: 456044 - DNA, 25 bp, Mus musculus
gacctggcgcaacactagcacataa

SEQ ID NO: 456045 - DNA, 25 bp, Mus musculus
gacctggcgcaagactagcacataa

SEQ ID NO: 456046 - DNA, 25 bp, Mus musculus
gacctggcgttacagagagttcgct

SEQ ID NO: 456047 - DNA, 25 bp, Mus musculus
gacctggcgttagagagagttcgct

SEQ ID NO: 456048 - DNA, 25 bp, Mus musculus
gacctggctacgctttatcttctgg

SEQ ID NO: 456049 - DNA, 25 bp, Mus musculus
gacctggctacggtttatcttctgg

SEQ ID NO: 456050 - DNA, 25 bp, Mus musculus
gacctggctatgaccattgtggttt

SEQ ID NO: 456051 - DNA, 25 bp, Mus musculus
gacctggctatgtccattgtggttt

SEQ ID NO: 456052 - DNA, 25 bp, Mus musculus
gacctggcttccaagaggactgtca

SEQ ID NO: 456053 - DNA, 25 bp, Mus musculus
gacctggcttccagtatggcaggca

SEQ ID NO: 456054 - DNA, 25 bp, Mus musculus
gacctggcttcctagaggactgtca

SEQ ID NO: 456055 - DNA, 25 bp, Mus musculus
gacctggcttcctgtatggcaggca

SEQ ID NO: 456056 - DNA, 25 bp, Mus musculus
gacctggcttcgctggaccaagtac

SEQ ID NO: 456057 - DNA, 25 bp, Mus musculus
gacctggcttcggtggaccaagtac

SEQ ID NO: 456058 - DNA, 25 bp, Mus musculus
gacctgggacctcggtgaactttgt

SEQ ID NO: 456059 - DNA, 25 bp, Mus musculus
gacctgggacctgggtgaactttgt

SEQ ID NO: 456060 - DNA, 25 bp, Mus musculus
gacctgggaggaattctgcaatgca

SEQ ID NO: 456061 - DNA, 25 bp, Mus musculus
gacctgggaggatttctgcaatgca

SEQ ID NO: 456062 - DNA, 25 bp, Mus musculus
gacctgggcaatctgactgctggaa

SEQ ID NO: 456063 - DNA, 25 bp, Mus musculus
gacctgggcaatgtgactgctggaa

SEQ ID NO: 456064 - DNA, 25 bp, Mus musculus
gacctgggcagcatttcatccatgt

SEQ ID NO: 456065 - DNA, 25 bp, Mus musculus
gacctgggcagcttttcatccatgt

SEQ ID NO: 456066 - DNA, 25 bp, Mus musculus
gacctgggcaggctgtacccaccag

SEQ ID NO: 456067 - DNA, 25 bp, Mus musculus
gacctgggcagggtgtacccaccag

SEQ ID NO: 456068 - DNA, 25 bp, Mus musculus
gacctgggcatcaaacacacatttg

SEQ ID NO: 456069 - DNA, 25 bp, Mus musculus
gacctgggcatcaaatacgacccaa

SEQ ID NO: 456070 - DNA, 25 bp, Mus musculus
gacctgggcatctaacacacatttg

SEQ ID NO: 456071 - DNA, 25 bp, Mus musculus
gacctgggcatctaatacgacccaa

SEQ ID NO: 456072 - DNA, 25 bp, Mus musculus
gacctgggccagagcaggaaacact

SEQ ID NO: 456073 - DNA, 25 bp, Mus musculus
gacctgggccagctagggttcattt

SEQ ID NO: 456074 - DNA, 25 bp, Mus musculus
gacctgggccaggtagggttcattt

SEQ ID NO: 456075 - DNA, 25 bp, Mus musculus
gacctgggccagtgcaggaaacact

SEQ ID NO: 456076 - DNA, 25 bp, Mus musculus
gacctgggcgtgaaagtatctgttc

SEQ ID NO: 456077 - DNA, 25 bp, Mus musculus
gacctgggcgtgtaagtatctgttc

SEQ ID NO: 456078 - DNA, 25 bp, Mus musculus
gacctgggctggaaactgctgcgca

SEQ ID NO: 456079 - DNA, 25 bp, Mus musculus
gacctgggctggtaactgctgcgca

SEQ ID NO: 456080 - DNA, 25 bp, Mus musculus
gacctgggcttacacagtttggacc

SEQ ID NO: 456081 - DNA, 25 bp, Mus musculus
gacctgggcttagacagtttggacc

SEQ ID NO: 456082 - DNA, 25 bp, Mus musculus
gacctgggcttgattggcagcacat

SEQ ID NO: 456083 - DNA, 25 bp, Mus musculus
gacctgggcttgtttggcagcacat

SEQ ID NO: 456084 - DNA, 25 bp, Mus musculus
gacctgggtcatcaaggcttcagac

SEQ ID NO: 456085 - DNA, 25 bp, Mus musculus
gacctgggtcatgaaggcttcagac

SEQ ID NO: 456086 - DNA, 25 bp, Mus musculus
gacctgggtcttcttagggtcttat

SEQ ID NO: 456087 - DNA, 25 bp, Mus musculus
gacctgggtcttgttagggtcttat

SEQ ID NO: 456088 - DNA, 25 bp, Mus musculus
gacctgggtgtactgcttttgtaat

SEQ ID NO: 456089 - DNA, 25 bp, Mus musculus
gacctgggtgtagtgcttttgtaat

SEQ ID NO: 456090 - DNA, 25 bp, Mus musculus
gacctgggttacagagaatccgaaa

SEQ ID NO: 456091 - DNA, 25 bp, Mus musculus
gacctgggttactgagaatccgaaa

SEQ ID NO: 456092 - DNA, 25 bp, Mus musculus
gacctggtagccagagtcccaatgt

SEQ ID NO: 456093 - DNA, 25 bp, Mus musculus
gacctggtagcctgagtcccaatgt

SEQ ID NO: 456094 - DNA, 25 bp, Mus musculus
gacctggtcagtagccttcggaaag

SEQ ID NO: 456095 - DNA, 25 bp, Mus musculus
gacctggtcagttgccttcggaaag

SEQ ID NO: 456096 - DNA, 25 bp, Mus musculus
gacctggtcctgaaacttcgggaga

SEQ ID NO: 456097 - DNA, 25 bp, Mus musculus
gacctggtcctgtaacttcgggaga

SEQ ID NO: 456098 - DNA, 25 bp, Mus musculus
gacctggtctacatgctgaatggct

SEQ ID NO: 456099 - DNA, 25 bp, Mus musculus
gacctggtctacatggaagattctc

SEQ ID NO: 456100 - DNA, 25 bp, Mus musculus
gacctggtctacttgctgaatggct

SEQ ID NO: 456101 - DNA, 25 bp, Mus musculus
gacctggtctacttggaagattctc

SEQ ID NO: 456102 - DNA, 25 bp, Mus musculus
gacctggtctatcttctgcatgaac

SEQ ID NO: 456103 - DNA, 25 bp, Mus musculus
gacctggtctatgttctgcatgaac

SEQ ID NO: 456104 - DNA, 25 bp, Mus musculus
gacctggtctctctttgttaaagat

SEQ ID NO: 456105 - DNA, 25 bp, Mus musculus
gacctggtctctgtttgttaaagat

SEQ ID NO: 456106 - DNA, 25 bp, Mus musculus
gacctggtcttaataccttgcctat

SEQ ID NO: 456107 - DNA, 25 bp, Mus musculus
gacctggtcttattaccttgcctat

SEQ ID NO: 456108 - DNA, 25 bp, Mus musculus
gacctggtgaagaaacctcctactt

SEQ ID NO: 456109 - DNA, 25 bp, Mus musculus
gacctggtgaagtaacctcctactt

SEQ ID NO: 456110 - DNA, 25 bp, Mus musculus
gacctggtgagtactgtggtaccat

SEQ ID NO: 456111 - DNA, 25 bp, Mus musculus
gacctggtgagttctgtggtaccat

SEQ ID NO: 456112 - DNA, 25 bp, Mus musculus
gacctggtggacaaattacaggcga

SEQ ID NO: 456113 - DNA, 25 bp, Mus musculus
gacctggtggactaattacaggcga

SEQ ID NO: 456114 - DNA, 25 bp, Mus musculus
gacctggtggtgatttgttgtgttc

SEQ ID NO: 456115 - DNA, 25 bp, Mus musculus
gacctggtggtgttttgttgtgttc

SEQ ID NO: 456116 - DNA, 25 bp, Mus musculus
gacctggtgtgacagagacactcta

SEQ ID NO: 456117 - DNA, 25 bp, Mus musculus
gacctggtgtgagagagacactcta

SEQ ID NO: 456118 - DNA, 25 bp, Mus musculus
gacctggttagtctgacagtcccac

SEQ ID NO: 456119 - DNA, 25 bp, Mus musculus
gacctggttagtgtgacagtcccac

SEQ ID NO: 456120 - DNA, 25 bp, Mus musculus
gacctggttattcgatttaactccg

SEQ ID NO: 456121 - DNA, 25 bp, Mus musculus
gacctggttattggatttaactccg

SEQ ID NO: 456122 - DNA, 25 bp, Mus musculus
gacctggttgtcagacgtcctatat

SEQ ID NO: 456123 - DNA, 25 bp, Mus musculus
gacctggttgtctgacgtcctatat

SEQ ID NO: 456124 - DNA, 25 bp, Mus musculus
gacctggtttcgctcttgttgaaat

SEQ ID NO: 456125 - DNA, 25 bp, Mus musculus
gacctggtttcggtcttgttgaaat

SEQ ID NO: 456126 - DNA, 25 bp, Mus musculus
gacctgtaatatacgtctccattag

SEQ ID NO: 456127 - DNA, 25 bp, Mus musculus
gacctgtaatattcgtctccattag

SEQ ID NO: 456128 - DNA, 25 bp, Mus musculus
gacctgtaatgtagaacgaccgcct

SEQ ID NO: 456129 - DNA, 25 bp, Mus musculus
gacctgtaatgttgaacgaccgcct

SEQ ID NO: 456130 - DNA, 25 bp, Mus musculus
gacctgtacagacggctgcttgcca

SEQ ID NO: 456131 - DNA, 25 bp, Mus musculus
gacctgtacagagggctgcttgcca

SEQ ID NO: 456132 - DNA, 25 bp, Mus musculus
gacctgtacatgatctggccaagag

SEQ ID NO: 456133 - DNA, 25 bp, Mus musculus
gacctgtacatgttctggccaagag

SEQ ID NO: 456134 - DNA, 25 bp, Mus musculus
gacctgtaccccaggtgccagggtg

SEQ ID NO: 456135 - DNA, 25 bp, Mus musculus
gacctgtacccctggtgccagggtg

SEQ ID NO: 456136 - DNA, 25 bp, Mus musculus
gacctgtacgtgccgcggaaatgct

SEQ ID NO: 456137 - DNA, 25 bp, Mus musculus
gacctgtacgtggcgcggaaatgct

SEQ ID NO: 456138 - DNA, 25 bp, Mus musculus
gacctgtagttgatggcctgggcaa

SEQ ID NO: 456139 - DNA, 25 bp, Mus musculus
gacctgtagttgttggcctgggcaa

SEQ ID NO: 456140 - DNA, 25 bp, Mus musculus
gacctgtatccgagacttttgtttt

SEQ ID NO: 456141 - DNA, 25 bp, Mus musculus
gacctgtatccgtgacttttgtttt

SEQ ID NO: 456142 - DNA, 25 bp, Mus musculus
gacctgtatttaattcccacactag

SEQ ID NO: 456143 - DNA, 25 bp, Mus musculus
gacctgtatttatttcccacactag

SEQ ID NO: 456144 - DNA, 25 bp, Mus musculus
gacctgtcacatcagtccatgctat

SEQ ID NO: 456145 - DNA, 25 bp, Mus musculus
gacctgtcacatgagtccatgctat

SEQ ID NO: 456146 - DNA, 25 bp, Mus musculus
gacctgtcactgaagtctgaagcaa

SEQ ID NO: 456147 - DNA, 25 bp, Mus musculus
gacctgtcactgtagtctgaagcaa

SEQ ID NO: 456148 - DNA, 25 bp, Mus musculus
gacctgtcagcgcatccaaaatggc

SEQ ID NO: 456149 - DNA, 25 bp, Mus musculus
gacctgtcagcggatccaaaatggc

SEQ ID NO: 456150 - DNA, 25 bp, Mus musculus
gacctgtcattgattccattaatta

SEQ ID NO: 456151 - DNA, 25 bp, Mus musculus
gacctgtcattgtttccattaatta

SEQ ID NO: 456152 - DNA, 25 bp, Mus musculus
gacctgtccagacgtactatggtgt

SEQ ID NO: 456153 - DNA, 25 bp, Mus musculus
gacctgtccagaggtactatggtgt

SEQ ID NO: 456154 - DNA, 25 bp, Mus musculus
gacctgtccctcatgtaaccagtag

SEQ ID NO: 456155 - DNA, 25 bp, Mus musculus
gacctgtccctcttgtaaccagtag

SEQ ID NO: 456156 - DNA, 25 bp, Mus musculus
gacctgtcggctagttgacaaaccc

SEQ ID NO: 456157 - DNA, 25 bp, Mus musculus
gacctgtcggcttgttgacaaaccc

SEQ ID NO: 456158 - DNA, 25 bp, Mus musculus
gacctgtcggtcaaaagcactcact

SEQ ID NO: 456159 - DNA, 25 bp, Mus musculus
gacctgtcggtctaaagcactcact

SEQ ID NO: 456160 - DNA, 25 bp, Mus musculus
gacctgtctcgtcacttagcagcat

SEQ ID NO: 456161 - DNA, 25 bp, Mus musculus
gacctgtctcgtgacttagcagcat

SEQ ID NO: 456162 - DNA, 25 bp, Mus musculus
gacctgtctgctcgaggataccctg

SEQ ID NO: 456163 - DNA, 25 bp, Mus musculus
gacctgtctgctggaggataccctg

SEQ ID NO: 456164 - DNA, 25 bp, Mus musculus
gacctgtgaatgaactgtcaagtct

SEQ ID NO: 456165 - DNA, 25 bp, Mus musculus
gacctgtgaatgtactgtcaagtct

SEQ ID NO: 456166 - DNA, 25 bp, Mus musculus
gacctgtgactgctgtattactaac

SEQ ID NO: 456167 - DNA, 25 bp, Mus musculus
gacctgtgactggtgtattactaac

SEQ ID NO: 456168 - DNA, 25 bp, Mus musculus
gacctgtgacttctcatgtggtgat

SEQ ID NO: 456169 - DNA, 25 bp, Mus musculus
gacctgtgacttgtcatgtggtgat

SEQ ID NO: 456170 - DNA, 25 bp, Mus musculus
gacctgtgagcacccagaccgagat

SEQ ID NO: 456171 - DNA, 25 bp, Mus musculus
gacctgtgagcagccagaccgagat

SEQ ID NO: 456172 - DNA, 25 bp, Mus musculus
gacctgtgataccactacacgttgg

SEQ ID NO: 456173 - DNA, 25 bp, Mus musculus
gacctgtgatacgactacacgttgg

SEQ ID NO: 456174 - DNA, 25 bp, Mus musculus
gacctgtgcactcgacagagggttt

SEQ ID NO: 456175 - DNA, 25 bp, Mus musculus
gacctgtgcactggacagagggttt

SEQ ID NO: 456176 - DNA, 25 bp, Mus musculus
gacctgtgccacagggttccatgag

SEQ ID NO: 456177 - DNA, 25 bp, Mus musculus
gacctgtgccactgggttccatgag

SEQ ID NO: 456178 - DNA, 25 bp, Mus musculus
gacctgtgcctccaagtgatgttct

SEQ ID NO: 456179 - DNA, 25 bp, Mus musculus
gacctgtgcctcgaagtgatgttct

SEQ ID NO: 456180 - DNA, 25 bp, Mus musculus
gacctgtgcctgatttcattaggaa

SEQ ID NO: 456181 - DNA, 25 bp, Mus musculus
gacctgtgcctgttttcattaggaa

SEQ ID NO: 456182 - DNA, 25 bp, Mus musculus
gacctgtggccacatggtggcttct

SEQ ID NO: 456183 - DNA, 25 bp, Mus musculus
gacctgtggccagatggtggcttct

SEQ ID NO: 456184 - DNA, 25 bp, Mus musculus
gacctgtgggttctaattcatctct

SEQ ID NO: 456185 - DNA, 25 bp, Mus musculus
gacctgtgggttgtaattcatctct

SEQ ID NO: 456186 - DNA, 25 bp, Mus musculus
gacctgtggtggatccacgaggact

SEQ ID NO: 456187 - DNA, 25 bp, Mus musculus
gacctgtggtggttccacgaggact

SEQ ID NO: 456188 - DNA, 25 bp, Mus musculus
gacctgtgtaccattattaaagcta

SEQ ID NO: 456189 - DNA, 25 bp, Mus musculus
gacctgtgtacctttattaaagcta

SEQ ID NO: 456190 - DNA, 25 bp, Mus musculus
gacctgtgtcatattgagtggctgt

SEQ ID NO: 456191 - DNA, 25 bp, Mus musculus
gacctgtgtcattttgagtggctgt

SEQ ID NO: 456192 - DNA, 25 bp, Mus musculus
gacctgtgtccgatgggtttacctg

SEQ ID NO: 456193 - DNA, 25 bp, Mus musculus
gacctgtgtccgttgggtttacctg

SEQ ID NO: 456194 - DNA, 25 bp, Mus musculus
gacctgtgtcgtaaagaagttggct

SEQ ID NO: 456195 - DNA, 25 bp, Mus musculus
gacctgtgtcgttaagaagttggct

SEQ ID NO: 456196 - DNA, 25 bp, Mus musculus
gacctgtgtggtaatgacttatgta

SEQ ID NO: 456197 - DNA, 25 bp, Mus musculus
gacctgtgtggttatgacttatgta

SEQ ID NO: 456198 - DNA, 25 bp, Mus musculus
gacctgttaattaacttaagtcaag

SEQ ID NO: 456199 - DNA, 25 bp, Mus musculus
gacctgttaatttacttaagtcaag

SEQ ID NO: 456200 - DNA, 25 bp, Mus musculus
gacctgttacatcgtggattaacct

SEQ ID NO: 456201 - DNA, 25 bp, Mus musculus
gacctgttacatggtggattaacct

SEQ ID NO: 456202 - DNA, 25 bp, Mus musculus
gacctgttagacctgtccttgtgaa

SEQ ID NO: 456203 - DNA, 25 bp, Mus musculus
gacctgttagacgtgtccttgtgaa

SEQ ID NO: 456204 - DNA, 25 bp, Mus musculus
gacctgttagcgagcagttgtttat

SEQ ID NO: 456205 - DNA, 25 bp, Mus musculus
gacctgttagcgtgcagttgtttat

SEQ ID NO: 456206 - DNA, 25 bp, Mus musculus
gacctgttatccaaggatcctagaa

SEQ ID NO: 456207 - DNA, 25 bp, Mus musculus
gacctgttatcctaggatcctagaa

SEQ ID NO: 456208 - DNA, 25 bp, Mus musculus
gacctgttatctacagttggtgctc

SEQ ID NO: 456209 - DNA, 25 bp, Mus musculus
gacctgttatcttcagttggtgctc

SEQ ID NO: 456210 - DNA, 25 bp, Mus musculus
gacctgttccgcagggtacgctcca

SEQ ID NO: 456211 - DNA, 25 bp, Mus musculus
gacctgttccgctgggtacgctcca

SEQ ID NO: 456212 - DNA, 25 bp, Mus musculus
gacctgttcgtcagccatagaaagc

SEQ ID NO: 456213 - DNA, 25 bp, Mus musculus
gacctgttcgtctgccatagaaagc

SEQ ID NO: 456214 - DNA, 25 bp, Mus musculus
gacctgttctcaatccctctagagt

SEQ ID NO: 456215 - DNA, 25 bp, Mus musculus
gacctgttctcattccctctagagt

SEQ ID NO: 456216 - DNA, 25 bp, Mus musculus
gacctgttctgaatacttagatctt

SEQ ID NO: 456217 - DNA, 25 bp, Mus musculus
gacctgttctgattacttagatctt

SEQ ID NO: 456218 - DNA, 25 bp, Mus musculus
gacctgttctgcaatgagaccagct

SEQ ID NO: 456219 - DNA, 25 bp, Mus musculus
gacctgttctgctatgagaccagct

SEQ ID NO: 456220 - DNA, 25 bp, Mus musculus
gacctgttgactctactcttggagt

SEQ ID NO: 456221 - DNA, 25 bp, Mus musculus
gacctgttgactgtactcttggagt

SEQ ID NO: 456222 - DNA, 25 bp, Mus musculus
gacctgttgatgaaagatgacggct

SEQ ID NO: 456223 - DNA, 25 bp, Mus musculus
gacctgttgatgtaagatgacggct

SEQ ID NO: 456224 - DNA, 25 bp, Mus musculus
gacctgttgcctctgtgacttcggg

SEQ ID NO: 456225 - DNA, 25 bp, Mus musculus
gacctgttgcctgtgtgacttcggg

SEQ ID NO: 456226 - DNA, 25 bp, Mus musculus
gacctgtttgacatctgttatcatc

SEQ ID NO: 456227 - DNA, 25 bp, Mus musculus
gacctgtttgacttctgttatcatc

SEQ ID NO: 456228 - DNA, 25 bp, Mus musculus
gacctgtttgtgcagttttaagtgc

SEQ ID NO: 456229 - DNA, 25 bp, Mus musculus
gacctgtttgtggagttttaagtgc

SEQ ID NO: 456230 - DNA, 25 bp, Mus musculus
gacctgttttccaacagtgtgcaag

SEQ ID NO: 456231 - DNA, 25 bp, Mus musculus
gacctgttttcctacagtgtgcaag

SEQ ID NO: 456232 - DNA, 25 bp, Mus musculus
gaccttaaaggcaactagaaacttg

SEQ ID NO: 456233 - DNA, 25 bp, Mus musculus
gaccttaaaggctactagaaacttg

SEQ ID NO: 456234 - DNA, 25 bp, Mus musculus
gaccttaaagttctggtcctcctgc

SEQ ID NO: 456235 - DNA, 25 bp, Mus musculus
gaccttaaagttgtggtcctcctgc

SEQ ID NO: 456236 - DNA, 25 bp, Mus musculus
gaccttaaatgcaacctgtttggaa

SEQ ID NO: 456237 - DNA, 25 bp, Mus musculus
gaccttaaatgctacctgtttggaa

SEQ ID NO: 456238 - DNA, 25 bp, Mus musculus
gaccttaacctgcacaagtgctacg

SEQ ID NO: 456239 - DNA, 25 bp, Mus musculus
gaccttaacctggacaagtgctacg

SEQ ID NO: 456240 - DNA, 25 bp, Mus musculus
gaccttaactagcatccactggatg

SEQ ID NO: 456241 - DNA, 25 bp, Mus musculus
gaccttaactaggatccactggatg

SEQ ID NO: 456242 - DNA, 25 bp, Mus musculus
gaccttaagtcaattgtaccctgga

SEQ ID NO: 456243 - DNA, 25 bp, Mus musculus
gaccttaagtcatttgtaccctgga

SEQ ID NO: 456244 - DNA, 25 bp, Mus musculus
gaccttaatcttagtgcagcctgaa

SEQ ID NO: 456245 - DNA, 25 bp, Mus musculus
gaccttaatctttgtgcagcctgaa

SEQ ID NO: 456246 - DNA, 25 bp, Mus musculus
gaccttaatgaaagatctgcagcca

SEQ ID NO: 456247 - DNA, 25 bp, Mus musculus
gaccttaatgaatgatctgcagcca

SEQ ID NO: 456248 - DNA, 25 bp, Mus musculus
gaccttaatgtcatcactaggcaag

SEQ ID NO: 456249 - DNA, 25 bp, Mus musculus
gaccttaatgtcttcactaggcaag

SEQ ID NO: 456250 - DNA, 25 bp, Mus musculus
gaccttacaagcatacctgttcgac

SEQ ID NO: 456251 - DNA, 25 bp, Mus musculus
gaccttacaagcttacctgttcgac

SEQ ID NO: 456252 - DNA, 25 bp, Mus musculus
gaccttacagctaatcatgcactct

SEQ ID NO: 456253 - DNA, 25 bp, Mus musculus
gaccttacagcttatcatgcactct

SEQ ID NO: 456254 - DNA, 25 bp, Mus musculus
gaccttacaggaatcatgactggca

SEQ ID NO: 456255 - DNA, 25 bp, Mus musculus
gaccttacaggattcatgactggca

SEQ ID NO: 456256 - DNA, 25 bp, Mus musculus
gaccttaccacgaaggccttccatg

SEQ ID NO: 456257 - DNA, 25 bp, Mus musculus
gaccttaccacgtaggccttccatg

SEQ ID NO: 456258 - DNA, 25 bp, Mus musculus
gaccttaccagcctcataaagctta

SEQ ID NO: 456259 - DNA, 25 bp, Mus musculus
gaccttaccagcgtcataaagctta

SEQ ID NO: 456260 - DNA, 25 bp, Mus musculus
gaccttacctcaatagattctagta

SEQ ID NO: 456261 - DNA, 25 bp, Mus musculus
gaccttacctcattagattctagta

SEQ ID NO: 456262 - DNA, 25 bp, Mus musculus
gaccttacgaggcactgcaatagct

SEQ ID NO: 456263 - DNA, 25 bp, Mus musculus
gaccttacgagggactgcaatagct

SEQ ID NO: 456264 - DNA, 25 bp, Mus musculus
gaccttactgtcataattatactaa

SEQ ID NO: 456265 - DNA, 25 bp, Mus musculus
gaccttactgtcttaattatactaa

SEQ ID NO: 456266 - DNA, 25 bp, Mus musculus
gaccttacttggcaagtcacatgac

SEQ ID NO: 456267 - DNA, 25 bp, Mus musculus
gaccttacttgggaagtcacatgac

SEQ ID NO: 456268 - DNA, 25 bp, Mus musculus
gaccttagaacacagggaagttgca

SEQ ID NO: 456269 - DNA, 25 bp, Mus musculus
gaccttagaacagagggaagttgca

SEQ ID NO: 456270 - DNA, 25 bp, Mus musculus
gaccttagaataaacttttgatcct

SEQ ID NO: 456271 - DNA, 25 bp, Mus musculus
gaccttagaatatacttttgatcct

SEQ ID NO: 456272 - DNA, 25 bp, Mus musculus
gaccttagacagaaatttccaccca

SEQ ID NO: 456273 - DNA, 25 bp, Mus musculus
gaccttagacagtaatttccaccca

SEQ ID NO: 456274 - DNA, 25 bp, Mus musculus
gaccttagacatatgcagattgcat

SEQ ID NO: 456275 - DNA, 25 bp, Mus musculus
gaccttagacatttgcagattgcat

SEQ ID NO: 456276 - DNA, 25 bp, Mus musculus
gaccttagaccaattgaatctgttt

SEQ ID NO: 456277 - DNA, 25 bp, Mus musculus
gaccttagaccatttgaatctgttt

SEQ ID NO: 456278 - DNA, 25 bp, Mus musculus
gaccttagccaaaagtcagccatgt

SEQ ID NO: 456279 - DNA, 25 bp, Mus musculus
gaccttagccaatagtcagccatgt

SEQ ID NO: 456280 - DNA, 25 bp, Mus musculus
gaccttagcgatattccataaaatg

SEQ ID NO: 456281 - DNA, 25 bp, Mus musculus
gaccttagcgattttccataaaatg

SEQ ID NO: 456282 - DNA, 25 bp, Mus musculus
gaccttagcttactacaatcattgt

SEQ ID NO: 456283 - DNA, 25 bp, Mus musculus
gaccttagcttagtacaatcattgt

SEQ ID NO: 456284 - DNA, 25 bp, Mus musculus
gaccttaggatcacgagctggtgca

SEQ ID NO: 456285 - DNA, 25 bp, Mus musculus
gaccttaggatctcgagctggtgca

SEQ ID NO: 456286 - DNA, 25 bp, Mus musculus
gaccttaggtggataatcactgagg

SEQ ID NO: 456287 - DNA, 25 bp, Mus musculus
gaccttaggtggttaatcactgagg

SEQ ID NO: 456288 - DNA, 25 bp, Mus musculus
gaccttagtgtgactagctgaaata

SEQ ID NO: 456289 - DNA, 25 bp, Mus musculus
gaccttagtgtgtctagctgaaata

SEQ ID NO: 456290 - DNA, 25 bp, Mus musculus
gaccttagttctatttaataccatg

SEQ ID NO: 456291 - DNA, 25 bp, Mus musculus
gaccttagttctttttaataccatg

SEQ ID NO: 456292 - DNA, 25 bp, Mus musculus
gaccttagttgcatcacctgtataa

SEQ ID NO: 456293 - DNA, 25 bp, Mus musculus
gaccttagttgcttcacctgtataa

SEQ ID NO: 456294 - DNA, 25 bp, Mus musculus
gaccttataaggagtggctgccatt

SEQ ID NO: 456295 - DNA, 25 bp, Mus musculus
gaccttataaggtgtggctgccatt

SEQ ID NO: 456296 - DNA, 25 bp, Mus musculus
gaccttatagcccattatgatgaga

SEQ ID NO: 456297 - DNA, 25 bp, Mus musculus
gaccttatagccgattatgatgaga

SEQ ID NO: 456298 - DNA, 25 bp, Mus musculus
gaccttatcagacgcttttagagaa

SEQ ID NO: 456299 - DNA, 25 bp, Mus musculus
gaccttatcagaggcttttagagaa

SEQ ID NO: 456300 - DNA, 25 bp, Mus musculus
gaccttatccctatcaataattcag

SEQ ID NO: 456301 - DNA, 25 bp, Mus musculus
gaccttatccctttcaataattcag

SEQ ID NO: 456302 - DNA, 25 bp, Mus musculus
gaccttatgataatttgtttagacc

SEQ ID NO: 456303 - DNA, 25 bp, Mus musculus
gaccttatgatattttgtttagacc

SEQ ID NO: 456304 - DNA, 25 bp, Mus musculus
gaccttatggaaaatttgtacacct

SEQ ID NO: 456305 - DNA, 25 bp, Mus musculus
gaccttatggaatatttgtacacct

SEQ ID NO: 456306 - DNA, 25 bp, Mus musculus
gaccttatgggtctgacttttcgag

SEQ ID NO: 456307 - DNA, 25 bp, Mus musculus
gaccttatgggtgtgacttttcgag

SEQ ID NO: 456308 - DNA, 25 bp, Mus musculus
gaccttattataagaacaccaatta

SEQ ID NO: 456309 - DNA, 25 bp, Mus musculus
gaccttattatatgaacaccaatta

SEQ ID NO: 456310 - DNA, 25 bp, Mus musculus
gaccttcaaaatactcctagttata

SEQ ID NO: 456311 - DNA, 25 bp, Mus musculus
gaccttcaaaattctcctagttata

SEQ ID NO: 456312 - DNA, 25 bp, Mus musculus
gaccttcaaaggaatgaggcacaga

SEQ ID NO: 456313 - DNA, 25 bp, Mus musculus
gaccttcaaaggcacctatattcgt

SEQ ID NO: 456314 - DNA, 25 bp, Mus musculus
gaccttcaaagggacctatattcgt

SEQ ID NO: 456315 - DNA, 25 bp, Mus musculus
gaccttcaaaggtatgaggcacaga

SEQ ID NO: 456316 - DNA, 25 bp, Mus musculus
gaccttcaaataagctagctcttaa

SEQ ID NO: 456317 - DNA, 25 bp, Mus musculus
gaccttcaaatatgctagctcttaa

SEQ ID NO: 456318 - DNA, 25 bp, Mus musculus
gaccttcaaattcgatcccgtggct

SEQ ID NO: 456319 - DNA, 25 bp, Mus musculus
gaccttcaaattggatcccgtggct

SEQ ID NO: 456320 - DNA, 25 bp, Mus musculus
gaccttcaagatccgcatggaacct

SEQ ID NO: 456321 - DNA, 25 bp, Mus musculus
gaccttcaagatgcgcatggaacct

SEQ ID NO: 456322 - DNA, 25 bp, Mus musculus
gaccttcaagcaccactttgagagc

SEQ ID NO: 456323 - DNA, 25 bp, Mus musculus
gaccttcaagcagcactttgagagc

SEQ ID NO: 456324 - DNA, 25 bp, Mus musculus
gaccttcaagccactcaaagctgaa

SEQ ID NO: 456325 - DNA, 25 bp, Mus musculus
gaccttcaagcctctcaaagctgaa

SEQ ID NO: 456326 - DNA, 25 bp, Mus musculus
gaccttcaagctagtgttgctctgg

SEQ ID NO: 456327 - DNA, 25 bp, Mus musculus
gaccttcaagcttgtgttgctctgg

SEQ ID NO: 456328 - DNA, 25 bp, Mus musculus
gaccttcaataccatgcaatcccag

SEQ ID NO: 456329 - DNA, 25 bp, Mus musculus
gaccttcaatacgatgcaatcccag

SEQ ID NO: 456330 - DNA, 25 bp, Mus musculus
gaccttcaccagcaggcagtgaagg

SEQ ID NO: 456331 - DNA, 25 bp, Mus musculus
gaccttcaccaggaggcagtgaagg

SEQ ID NO: 456332 - DNA, 25 bp, Mus musculus
gaccttcagaggacactatttgcta

SEQ ID NO: 456333 - DNA, 25 bp, Mus musculus
gaccttcagaggtcactatttgcta

SEQ ID NO: 456334 - DNA, 25 bp, Mus musculus
gaccttcagccaatttcttaagagg

SEQ ID NO: 456335 - DNA, 25 bp, Mus musculus
gaccttcagccattttcttaagagg

SEQ ID NO: 456336 - DNA, 25 bp, Mus musculus
gaccttcagctacgattatgtgtga

SEQ ID NO: 456337 - DNA, 25 bp, Mus musculus
gaccttcagctaggattatgtgtga

SEQ ID NO: 456338 - DNA, 25 bp, Mus musculus
gaccttcatcttcatttctttcagc

SEQ ID NO: 456339 - DNA, 25 bp, Mus musculus
gaccttcatcttgatttctttcagc

SEQ ID NO: 456340 - DNA, 25 bp, Mus musculus
gaccttcatgaccttgcagaacttc

SEQ ID NO: 456341 - DNA, 25 bp, Mus musculus
gaccttcatgacgttgcagaacttc

SEQ ID NO: 456342 - DNA, 25 bp, Mus musculus
gaccttcatgttaagaatttagcat

SEQ ID NO: 456343 - DNA, 25 bp, Mus musculus
gaccttcatgtttagaatttagcat

SEQ ID NO: 456344 - DNA, 25 bp, Mus musculus
gaccttcattgaagtggctccagga

SEQ ID NO: 456345 - DNA, 25 bp, Mus musculus
gaccttcattgatgtggctccagga

SEQ ID NO: 456346 - DNA, 25 bp, Mus musculus
gaccttccactaataaacagccatt

SEQ ID NO: 456347 - DNA, 25 bp, Mus musculus
gaccttccactattaaacagccatt

SEQ ID NO: 456348 - DNA, 25 bp, Mus musculus
gaccttccagaaatagggcttgtaa

SEQ ID NO: 456349 - DNA, 25 bp, Mus musculus
gaccttccagaattagggcttgtaa

SEQ ID NO: 456350 - DNA, 25 bp, Mus musculus
gaccttccaggtcctggtcatgctg

SEQ ID NO: 456351 - DNA, 25 bp, Mus musculus
gaccttccaggtgctggtcatgctg

SEQ ID NO: 456352 - DNA, 25 bp, Mus musculus
gaccttccagtccttgttggagctg

SEQ ID NO: 456353 - DNA, 25 bp, Mus musculus
gaccttccagtcgttgttggagctg

SEQ ID NO: 456354 - DNA, 25 bp, Mus musculus
gaccttccatttcttcagagtcctg

SEQ ID NO: 456355 - DNA, 25 bp, Mus musculus
gaccttccatttgttcagagtcctg

SEQ ID NO: 456356 - DNA, 25 bp, Mus musculus
gaccttccccaacagcaaattgcta

SEQ ID NO: 456357 - DNA, 25 bp, Mus musculus
gaccttccccaagagcaaattgcta

SEQ ID NO: 456358 - DNA, 25 bp, Mus musculus
gaccttccgaagagtgatgttttac

SEQ ID NO: 456359 - DNA, 25 bp, Mus musculus
gaccttccgaagtgtgatgttttac

SEQ ID NO: 456360 - DNA, 25 bp, Mus musculus
gaccttccggagactgatgccagat

SEQ ID NO: 456361 - DNA, 25 bp, Mus musculus
gaccttccggagtctgatgccagat

SEQ ID NO: 456362 - DNA, 25 bp, Mus musculus
gaccttcctaatcttgagtttgctt

SEQ ID NO: 456363 - DNA, 25 bp, Mus musculus
gaccttcctaatgttgagtttgctt

SEQ ID NO: 456364 - DNA, 25 bp, Mus musculus
gaccttcctacaagttgactttttt

SEQ ID NO: 456365 - DNA, 25 bp, Mus musculus
gaccttcctacatgttgactttttt

SEQ ID NO: 456366 - DNA, 25 bp, Mus musculus
gaccttcctggactcaacattgaga

SEQ ID NO: 456367 - DNA, 25 bp, Mus musculus
gaccttcctggagtcaacattgaga

SEQ ID NO: 456368 - DNA, 25 bp, Mus musculus
gaccttccttagatagagagtatgg

SEQ ID NO: 456369 - DNA, 25 bp, Mus musculus
gaccttccttagttagagagtatgg

SEQ ID NO: 456370 - DNA, 25 bp, Mus musculus
gaccttcctttacaaagagagagac

SEQ ID NO: 456371 - DNA, 25 bp, Mus musculus
gaccttcctttagaaagagagagac

SEQ ID NO: 456372 - DNA, 25 bp, Mus musculus
gaccttcgaaggattcaaatctact

SEQ ID NO: 456373 - DNA, 25 bp, Mus musculus
gaccttcgaaggtttcaaatctact

SEQ ID NO: 456374 - DNA, 25 bp, Mus musculus
gaccttcgaatgctgaagagctttg

SEQ ID NO: 456375 - DNA, 25 bp, Mus musculus
gaccttcgaatggtgaagagctttg

SEQ ID NO: 456376 - DNA, 25 bp, Mus musculus
gaccttcgagcacaggtagcggcat

SEQ ID NO: 456377 - DNA, 25 bp, Mus musculus
gaccttcgagcagaggtagcggcat

SEQ ID NO: 456378 - DNA, 25 bp, Mus musculus
gaccttcgagtacttgcagggcttc

SEQ ID NO: 456379 - DNA, 25 bp, Mus musculus
gaccttcgagtagttgcagggcttc

SEQ ID NO: 456380 - DNA, 25 bp, Mus musculus
gaccttcgccatcttacattattta

SEQ ID NO: 456381 - DNA, 25 bp, Mus musculus
gaccttcgccatgttacattattta

SEQ ID NO: 456382 - DNA, 25 bp, Mus musculus
gaccttcgctacaagttatcaccaa

SEQ ID NO: 456383 - DNA, 25 bp, Mus musculus
gaccttcgctactagttatcaccaa

SEQ ID NO: 456384 - DNA, 25 bp, Mus musculus
gaccttcgcttaaattttggttgaa

SEQ ID NO: 456385 - DNA, 25 bp, Mus musculus
gaccttcgcttatattttggttgaa

SEQ ID NO: 456386 - DNA, 25 bp, Mus musculus
gaccttcggaagctgacctggccat

SEQ ID NO: 456387 - DNA, 25 bp, Mus musculus
gaccttcggaaggtgacctggccat

SEQ ID NO: 456388 - DNA, 25 bp, Mus musculus
gaccttcggcttctttaggtgcaat

SEQ ID NO: 456389 - DNA, 25 bp, Mus musculus
gaccttcggcttgtttaggtgcaat

SEQ ID NO: 456390 - DNA, 25 bp, Mus musculus
gaccttcgtgaactttataacgcta

SEQ ID NO: 456391 - DNA, 25 bp, Mus musculus
gaccttcgtgaagtttataacgcta

SEQ ID NO: 456392 - DNA, 25 bp, Mus musculus
gaccttctaaccacacttttacagt

SEQ ID NO: 456393 - DNA, 25 bp, Mus musculus
gaccttctaacctcacttttacagt

SEQ ID NO: 456394 - DNA, 25 bp, Mus musculus
gaccttctagaaacagctgaaccct

SEQ ID NO: 456395 - DNA, 25 bp, Mus musculus
gaccttctagaacacaagatcctgc

SEQ ID NO: 456396 - DNA, 25 bp, Mus musculus
gaccttctagaagacaagatcctgc

SEQ ID NO: 456397 - DNA, 25 bp, Mus musculus
gaccttctagaatcagctgaaccct

SEQ ID NO: 456398 - DNA, 25 bp, Mus musculus
gaccttctagagacgcagtcggctt

SEQ ID NO: 456399 - DNA, 25 bp, Mus musculus
gaccttctagagtcgcagtcggctt

SEQ ID NO: 456400 - DNA, 25 bp, Mus musculus
gaccttctatgcagtcaccaaagag

SEQ ID NO: 456401 - DNA, 25 bp, Mus musculus
gaccttctatgctgtcaccaaagag

SEQ ID NO: 456402 - DNA, 25 bp, Mus musculus
gaccttctcagaccaaggcctgaac

SEQ ID NO: 456403 - DNA, 25 bp, Mus musculus
gaccttctcagagcaaggcctgaac

SEQ ID NO: 456404 - DNA, 25 bp, Mus musculus
gaccttctcatgatcttatacacta

SEQ ID NO: 456405 - DNA, 25 bp, Mus musculus
gaccttctcatgttcttatacacta

SEQ ID NO: 456406 - DNA, 25 bp, Mus musculus
gaccttctcattatttccattttca

SEQ ID NO: 456407 - DNA, 25 bp, Mus musculus
gaccttctcattttttccattttca

SEQ ID NO: 456408 - DNA, 25 bp, Mus musculus
gaccttctccaaaacacacttagta

SEQ ID NO: 456409 - DNA, 25 bp, Mus musculus
gaccttctccaatacacacttagta

SEQ ID NO: 456410 - DNA, 25 bp, Mus musculus
gaccttctccttcttgctgtgagtt

SEQ ID NO: 456411 - DNA, 25 bp, Mus musculus
gaccttctccttgttgctgtgagtt

SEQ ID NO: 456412 - DNA, 25 bp, Mus musculus
gaccttctcgttaatattctgcaaa

SEQ ID NO: 456413 - DNA, 25 bp, Mus musculus
gaccttctcgtttatattctgcaaa

SEQ ID NO: 456414 - DNA, 25 bp, Mus musculus
gaccttctgaaaccaatgatcaatg

SEQ ID NO: 456415 - DNA, 25 bp, Mus musculus
gaccttctgaaagcaatgatcaatg

SEQ ID NO: 456416 - DNA, 25 bp, Mus musculus
gaccttctgcagaacctagaacttc

SEQ ID NO: 456417 - DNA, 25 bp, Mus musculus
gaccttctgcagtacctagaacttc

SEQ ID NO: 456418 - DNA, 25 bp, Mus musculus
gaccttctgtagaacctcagtcctg

SEQ ID NO: 456419 - DNA, 25 bp, Mus musculus
gaccttctgtagtacctcagtcctg

SEQ ID NO: 456420 - DNA, 25 bp, Mus musculus
gaccttctgtgtcctctattcagag

SEQ ID NO: 456421 - DNA, 25 bp, Mus musculus
gaccttctgtgtgctctattcagag

SEQ ID NO: 456422 - DNA, 25 bp, Mus musculus
gaccttcttcaaacactgggacatc

SEQ ID NO: 456423 - DNA, 25 bp, Mus musculus
gaccttcttcaatcactgggacatc

SEQ ID NO: 456424 - DNA, 25 bp, Mus musculus
gaccttcttcacactggatgatggg

SEQ ID NO: 456425 - DNA, 25 bp, Mus musculus
gaccttcttcactctggatgatggg

SEQ ID NO: 456426 - DNA, 25 bp, Mus musculus
gaccttcttcataactttggccaag

SEQ ID NO: 456427 - DNA, 25 bp, Mus musculus
gaccttcttcattactttggccaag

SEQ ID NO: 456428 - DNA, 25 bp, Mus musculus
gaccttcttggccagactgaacact

SEQ ID NO: 456429 - DNA, 25 bp, Mus musculus
gaccttcttggcgagactgaacact

SEQ ID NO: 456430 - DNA, 25 bp, Mus musculus
gaccttcttgtcagattaagttcag

SEQ ID NO: 456431 - DNA, 25 bp, Mus musculus
gaccttcttgtctgattaagttcag

SEQ ID NO: 456432 - DNA, 25 bp, Mus musculus
gaccttctttacagttccgtggaca

SEQ ID NO: 456433 - DNA, 25 bp, Mus musculus
gaccttctttactgttccgtggaca

SEQ ID NO: 456434 - DNA, 25 bp, Mus musculus
gaccttctttctacataccgaggaa

SEQ ID NO: 456435 - DNA, 25 bp, Mus musculus
gaccttctttcttcataccgaggaa

SEQ ID NO: 456436 - DNA, 25 bp, Mus musculus
gaccttctttgacggttcatgaata

SEQ ID NO: 456437 - DNA, 25 bp, Mus musculus
gaccttctttgagggttcatgaata

SEQ ID NO: 456438 - DNA, 25 bp, Mus musculus
gaccttgaaactacagggctattcc

SEQ ID NO: 456439 - DNA, 25 bp, Mus musculus
gaccttgaaacttcagggctattcc

SEQ ID NO: 456440 - DNA, 25 bp, Mus musculus
gaccttgaaatcaggtgcacaactt

SEQ ID NO: 456441 - DNA, 25 bp, Mus musculus
gaccttgaaatctggtgcacaactt

SEQ ID NO: 456442 - DNA, 25 bp, Mus musculus
gaccttgaactcctggtttttctgt

SEQ ID NO: 456443 - DNA, 25 bp, Mus musculus
gaccttgaactccttatcttttcag

SEQ ID NO: 456444 - DNA, 25 bp, Mus musculus
gaccttgaactcgtggtttttctgt

SEQ ID NO: 456445 - DNA, 25 bp, Mus musculus
gaccttgaactcgttatcttttcag

SEQ ID NO: 456446 - DNA, 25 bp, Mus musculus
gaccttgaacttatgaccaacttgc

SEQ ID NO: 456447 - DNA, 25 bp, Mus musculus
gaccttgaacttttgaccaacttgc

SEQ ID NO: 456448 - DNA, 25 bp, Mus musculus
gaccttgaagagaggcctgactcca

SEQ ID NO: 456449 - DNA, 25 bp, Mus musculus
gaccttgaagagtggcctgactcca

SEQ ID NO: 456450 - DNA, 25 bp, Mus musculus
gaccttgaagtcactgccagtctat

SEQ ID NO: 456451 - DNA, 25 bp, Mus musculus
gaccttgaagtctctgccagtctat

SEQ ID NO: 456452 - DNA, 25 bp, Mus musculus
gaccttgaatgtatgaatagactat

SEQ ID NO: 456453 - DNA, 25 bp, Mus musculus
gaccttgaatgtttgaatagactat

SEQ ID NO: 456454 - DNA, 25 bp, Mus musculus
gaccttgaatttcttggacttaaag

SEQ ID NO: 456455 - DNA, 25 bp, Mus musculus
gaccttgaatttgttggacttaaag

SEQ ID NO: 456456 - DNA, 25 bp, Mus musculus
gaccttgacagactcactgacctca

SEQ ID NO: 456457 - DNA, 25 bp, Mus musculus
gaccttgacagagtcactgacctca

SEQ ID NO: 456458 - DNA, 25 bp, Mus musculus
gaccttgaccttactagatttgctt

SEQ ID NO: 456459 - DNA, 25 bp, Mus musculus
gaccttgacctttctagatttgctt

SEQ ID NO: 456460 - DNA, 25 bp, Mus musculus
gaccttgactggagagcctgaactt

SEQ ID NO: 456461 - DNA, 25 bp, Mus musculus
gaccttgactggattgctgtgattt

SEQ ID NO: 456462 - DNA, 25 bp, Mus musculus
gaccttgactggtgagcctgaactt

SEQ ID NO: 456463 - DNA, 25 bp, Mus musculus
gaccttgactggtttgctgtgattt

SEQ ID NO: 456464 - DNA, 25 bp, Mus musculus
gaccttgagactaattgtgcaactg

SEQ ID NO: 456465 - DNA, 25 bp, Mus musculus
gaccttgagacttattgtgcaactg

SEQ ID NO: 456466 - DNA, 25 bp, Mus musculus
gaccttgagattctgtgtgcgtgac

SEQ ID NO: 456467 - DNA, 25 bp, Mus musculus
gaccttgagattgtgtgtgcgtgac

SEQ ID NO: 456468 - DNA, 25 bp, Mus musculus
gaccttgagctgaccctgaataatc

SEQ ID NO: 456469 - DNA, 25 bp, Mus musculus
gaccttgagctgaccgtagtgccca

SEQ ID NO: 456470 - DNA, 25 bp, Mus musculus
gaccttgagctgtccctgaataatc

SEQ ID NO: 456471 - DNA, 25 bp, Mus musculus
gaccttgagctgtccgtagtgccca

SEQ ID NO: 456472 - DNA, 25 bp, Mus musculus
gaccttgaggctaaagtatttttct

SEQ ID NO: 456473 - DNA, 25 bp, Mus musculus
gaccttgaggcttaagtatttttct

SEQ ID NO: 456474 - DNA, 25 bp, Mus musculus
gaccttgaggtcacaaatctgtcca

SEQ ID NO: 456475 - DNA, 25 bp, Mus musculus
gaccttgaggtcatctgtgtggact

SEQ ID NO: 456476 - DNA, 25 bp, Mus musculus
gaccttgaggtctcaaatctgtcca

SEQ ID NO: 456477 - DNA, 25 bp, Mus musculus
gaccttgaggtcttctgtgtggact

SEQ ID NO: 456478 - DNA, 25 bp, Mus musculus
gaccttgagtcaagcccagttttat

SEQ ID NO: 456479 - DNA, 25 bp, Mus musculus
gaccttgagtcatgcccagttttat

SEQ ID NO: 456480 - DNA, 25 bp, Mus musculus
gaccttgagttcatttccagtgctt

SEQ ID NO: 456481 - DNA, 25 bp, Mus musculus
gaccttgagttcttttccagtgctt

SEQ ID NO: 456482 - DNA, 25 bp, Mus musculus
gaccttgataaaatcatgcactcat

SEQ ID NO: 456483 - DNA, 25 bp, Mus musculus
gaccttgataaattcatgcactcat

SEQ ID NO: 456484 - DNA, 25 bp, Mus musculus
gaccttgataccagcactttagaat

SEQ ID NO: 456485 - DNA, 25 bp, Mus musculus
gaccttgatacctgcactttagaat

SEQ ID NO: 456486 - DNA, 25 bp, Mus musculus
gaccttgatggacatcagcagcagc

SEQ ID NO: 456487 - DNA, 25 bp, Mus musculus
gaccttgatggagatcagcagcagc

SEQ ID NO: 456488 - DNA, 25 bp, Mus musculus
gaccttgatggcactcaatacttac

SEQ ID NO: 456489 - DNA, 25 bp, Mus musculus
gaccttgatggctctcaatacttac

SEQ ID NO: 456490 - DNA, 25 bp, Mus musculus
gaccttgatgtaccaattctgacgg

SEQ ID NO: 456491 - DNA, 25 bp, Mus musculus
gaccttgatgtagcaattctgacgg

SEQ ID NO: 456492 - DNA, 25 bp, Mus musculus
gaccttgattccaacatgtggaaca

SEQ ID NO: 456493 - DNA, 25 bp, Mus musculus
gaccttgattcctacatgtggaaca

SEQ ID NO: 456494 - DNA, 25 bp, Mus musculus
gaccttgcaatgaccttactctttg

SEQ ID NO: 456495 - DNA, 25 bp, Mus musculus
gaccttgcaatgtccttactctttg

SEQ ID NO: 456496 - DNA, 25 bp, Mus musculus
gaccttgcactccaactacatacag

SEQ ID NO: 456497 - DNA, 25 bp, Mus musculus
gaccttgcactcgaactacatacag

SEQ ID NO: 456498 - DNA, 25 bp, Mus musculus
gaccttgcagagctacactgtgaat

SEQ ID NO: 456499 - DNA, 25 bp, Mus musculus
gaccttgcagaggtacactgtgaat

SEQ ID NO: 456500 - DNA, 25 bp, Mus musculus
gaccttgcagataatcactgtggac

SEQ ID NO: 456501 - DNA, 25 bp, Mus musculus
gaccttgcagattatcactgtggac

SEQ ID NO: 456502 - DNA, 25 bp, Mus musculus
gaccttgcaggcaaacacgattgga

SEQ ID NO: 456503 - DNA, 25 bp, Mus musculus
gaccttgcaggctaacacgattgga

SEQ ID NO: 456504 - DNA, 25 bp, Mus musculus
gaccttgcaggtctcattgtctagg

SEQ ID NO: 456505 - DNA, 25 bp, Mus musculus
gaccttgcaggtgtcattgtctagg

SEQ ID NO: 456506 - DNA, 25 bp, Mus musculus
gaccttgcatccattatattttcct

SEQ ID NO: 456507 - DNA, 25 bp, Mus musculus
gaccttgcatcctttatattttcct

SEQ ID NO: 456508 - DNA, 25 bp, Mus musculus
gaccttgccagtcctcaaaatcgga

SEQ ID NO: 456509 - DNA, 25 bp, Mus musculus
gaccttgccagtgctcaaaatcgga

SEQ ID NO: 456510 - DNA, 25 bp, Mus musculus
gaccttgcccaaagaagcgtaactg

SEQ ID NO: 456511 - DNA, 25 bp, Mus musculus
gaccttgcccaatgaagcgtaactg

SEQ ID NO: 456512 - DNA, 25 bp, Mus musculus
gaccttgcctcacataagagtgact

SEQ ID NO: 456513 - DNA, 25 bp, Mus musculus
gaccttgcctcagataagagtgact

SEQ ID NO: 456514 - DNA, 25 bp, Mus musculus
gaccttgcgctcaacagagcacaga

SEQ ID NO: 456515 - DNA, 25 bp, Mus musculus
gaccttgcgctctacagagcacaga

SEQ ID NO: 456516 - DNA, 25 bp, Mus musculus
gaccttgctcaaagagtggatcact

SEQ ID NO: 456517 - DNA, 25 bp, Mus musculus
gaccttgctcaatgagtggatcact

SEQ ID NO: 456518 - DNA, 25 bp, Mus musculus
gaccttgcttcccaacagctaaagg

SEQ ID NO: 456519 - DNA, 25 bp, Mus musculus
gaccttgcttccgaacagctaaagg

SEQ ID NO: 456520 - DNA, 25 bp, Mus musculus
gaccttgcttgactattttttctaa

SEQ ID NO: 456521 - DNA, 25 bp, Mus musculus
gaccttgcttgagtattttttctaa

SEQ ID NO: 456522 - DNA, 25 bp, Mus musculus
gaccttgctttcaagccttactcaa

SEQ ID NO: 456523 - DNA, 25 bp, Mus musculus
gaccttgctttctagccttactcaa

SEQ ID NO: 456524 - DNA, 25 bp, Mus musculus
gaccttgctttgctggtagatggct

SEQ ID NO: 456525 - DNA, 25 bp, Mus musculus
gaccttgctttggtggtagatggct

SEQ ID NO: 456526 - DNA, 25 bp, Mus musculus
gaccttggaaaaacaaccccagaca

SEQ ID NO: 456527 - DNA, 25 bp, Mus musculus
gaccttggaaaatcaaccccagaca

SEQ ID NO: 456528 - DNA, 25 bp, Mus musculus
gaccttggactccttggatagtcaa

SEQ ID NO: 456529 - DNA, 25 bp, Mus musculus
gaccttggactcgttggatagtcaa

SEQ ID NO: 456530 - DNA, 25 bp, Mus musculus
gaccttggagacagtgccttctctg

SEQ ID NO: 456531 - DNA, 25 bp, Mus musculus
gaccttggagactgtgccttctctg

SEQ ID NO: 456532 - DNA, 25 bp, Mus musculus
gaccttggagatcacattgtgccat

SEQ ID NO: 456533 - DNA, 25 bp, Mus musculus
gaccttggagatgacattgtgccat

SEQ ID NO: 456534 - DNA, 25 bp, Mus musculus
gaccttggagctcgcaagagttcct

SEQ ID NO: 456535 - DNA, 25 bp, Mus musculus
gaccttggagctggcaagagttcct

SEQ ID NO: 456536 - DNA, 25 bp, Mus musculus
gaccttggagtacaagtctgtggaa

SEQ ID NO: 456537 - DNA, 25 bp, Mus musculus
gaccttggagtagaagtctgtggaa

SEQ ID NO: 456538 - DNA, 25 bp, Mus musculus
gaccttggagtcctttagcttctac

SEQ ID NO: 456539 - DNA, 25 bp, Mus musculus
gaccttggagtcgtttagcttctac

SEQ ID NO: 456540 - DNA, 25 bp, Mus musculus
gaccttggattcatatgtgtcgttc

SEQ ID NO: 456541 - DNA, 25 bp, Mus musculus
gaccttggattcttatgtgtcgttc

SEQ ID NO: 456542 - DNA, 25 bp, Mus musculus
gaccttggctttaagtacacactga

SEQ ID NO: 456543 - DNA, 25 bp, Mus musculus
gaccttggcttttagtacacactga

SEQ ID NO: 456544 - DNA, 25 bp, Mus musculus
gaccttgggaaaagcactatcactg

SEQ ID NO: 456545 - DNA, 25 bp, Mus musculus
gaccttgggaaatgcactatcactg

SEQ ID NO: 456546 - DNA, 25 bp, Mus musculus
gaccttgggagaccatgctgccaga

SEQ ID NO: 456547 - DNA, 25 bp, Mus musculus
gaccttgggagagcatgctgccaga

SEQ ID NO: 456548 - DNA, 25 bp, Mus musculus
gaccttgggatacttttccatgtca

SEQ ID NO: 456549 - DNA, 25 bp, Mus musculus
gaccttgggatagttttccatgtca

SEQ ID NO: 456550 - DNA, 25 bp, Mus musculus
gaccttgggcaaatcatgtcaactt

SEQ ID NO: 456551 - DNA, 25 bp, Mus musculus
gaccttgggcaattcatgtcaactt

SEQ ID NO: 456552 - DNA, 25 bp, Mus musculus
gaccttgggcacaatatcttggatg

SEQ ID NO: 456553 - DNA, 25 bp, Mus musculus
gaccttgggcacatcataatttttt

SEQ ID NO: 456554 - DNA, 25 bp, Mus musculus
gaccttgggcactatatcttggatg

SEQ ID NO: 456555 - DNA, 25 bp, Mus musculus
gaccttgggcacttcataatttttt

SEQ ID NO: 456556 - DNA, 25 bp, Mus musculus
gaccttgggcgtaattccagtcagt

SEQ ID NO: 456557 - DNA, 25 bp, Mus musculus
gaccttgggcgttattccagtcagt

SEQ ID NO: 456558 - DNA, 25 bp, Mus musculus
gaccttgggctaaaccatttctaga

SEQ ID NO: 456559 - DNA, 25 bp, Mus musculus
gaccttgggctactctagattcaga

SEQ ID NO: 456560 - DNA, 25 bp, Mus musculus
gaccttgggctagtctagattcaga

SEQ ID NO: 456561 - DNA, 25 bp, Mus musculus
gaccttgggctataccatttctaga

SEQ ID NO: 456562 - DNA, 25 bp, Mus musculus
gaccttgggtaaagctaggcaattg

SEQ ID NO: 456563 - DNA, 25 bp, Mus musculus
gaccttgggtaatgctaggcaattg

SEQ ID NO: 456564 - DNA, 25 bp, Mus musculus
gaccttgggtcactaggacaattgc

SEQ ID NO: 456565 - DNA, 25 bp, Mus musculus
gaccttgggtcagtaggacaattgc

SEQ ID NO: 456566 - DNA, 25 bp, Mus musculus
gaccttgggtccaatccccaatact

SEQ ID NO: 456567 - DNA, 25 bp, Mus musculus
gaccttgggtcctatccccaatact

SEQ ID NO: 456568 - DNA, 25 bp, Mus musculus
gaccttgggtgacgtgtcattcctt

SEQ ID NO: 456569 - DNA, 25 bp, Mus musculus
gaccttgggtgaggtgtcattcctt

SEQ ID NO: 456570 - DNA, 25 bp, Mus musculus
gaccttgggtttatgatccttctgt

SEQ ID NO: 456571 - DNA, 25 bp, Mus musculus
gaccttgggtttttgatccttctgt

SEQ ID NO: 456572 - DNA, 25 bp, Mus musculus
gaccttggtaaccactctagtgatt

SEQ ID NO: 456573 - DNA, 25 bp, Mus musculus
gaccttggtaacgactctagtgatt

SEQ ID NO: 456574 - DNA, 25 bp, Mus musculus
gaccttggtatacgcctgtccttga

SEQ ID NO: 456575 - DNA, 25 bp, Mus musculus
gaccttggtataggcctgtccttga

SEQ ID NO: 456576 - DNA, 25 bp, Mus musculus
gaccttggtctgatcgacttggtga

SEQ ID NO: 456577 - DNA, 25 bp, Mus musculus
gaccttggtctgttcgacttggtga

SEQ ID NO: 456578 - DNA, 25 bp, Mus musculus
gaccttggtgatcgacaaaccggtt

SEQ ID NO: 456579 - DNA, 25 bp, Mus musculus
gaccttggtgatggacaaaccggtt

SEQ ID NO: 456580 - DNA, 25 bp, Mus musculus
gaccttggtgtcagttaccaaagaa

SEQ ID NO: 456581 - DNA, 25 bp, Mus musculus
gaccttggtgtctgttaccaaagaa

SEQ ID NO: 456582 - DNA, 25 bp, Mus musculus
gaccttggttagaagaggagtataa

SEQ ID NO: 456583 - DNA, 25 bp, Mus musculus
gaccttggttagtagaggagtataa

SEQ ID NO: 456584 - DNA, 25 bp, Mus musculus
gaccttgtaaaaacacgtgtattct

SEQ ID NO: 456585 - DNA, 25 bp, Mus musculus
gaccttgtaaaatcacgtgtattct

SEQ ID NO: 456586 - DNA, 25 bp, Mus musculus
gaccttgtaaccacattctttcagc

SEQ ID NO: 456587 - DNA, 25 bp, Mus musculus
gaccttgtaacctcattctttcagc

SEQ ID NO: 456588 - DNA, 25 bp, Mus musculus
gaccttgtaatgaaactgctcttgg

SEQ ID NO: 456589 - DNA, 25 bp, Mus musculus
gaccttgtaatgtaactgctcttgg

SEQ ID NO: 456590 - DNA, 25 bp, Mus musculus
gaccttgtcacccaaacagcaaaat

SEQ ID NO: 456591 - DNA, 25 bp, Mus musculus
gaccttgtcaccgaaacagcaaaat

SEQ ID NO: 456592 - DNA, 25 bp, Mus musculus
gaccttgtcgatagctgtaacatta

SEQ ID NO: 456593 - DNA, 25 bp, Mus musculus
gaccttgtcgattgctgtaacatta

SEQ ID NO: 456594 - DNA, 25 bp, Mus musculus
gaccttgtctatactatttttgaaa

SEQ ID NO: 456595 - DNA, 25 bp, Mus musculus
gaccttgtctattctatttttgaaa

SEQ ID NO: 456596 - DNA, 25 bp, Mus musculus
gaccttgtgcacatcctcctaggct

SEQ ID NO: 456597 - DNA, 25 bp, Mus musculus
gaccttgtgcacttcctcctaggct

SEQ ID NO: 456598 - DNA, 25 bp, Mus musculus
gaccttgtgcctcaaaccagtgaat

SEQ ID NO: 456599 - DNA, 25 bp, Mus musculus
gaccttgtgcctgaaaccagtgaat

SEQ ID NO: 456600 - DNA, 25 bp, Mus musculus
gaccttgtgcggattcttgggaaca

SEQ ID NO: 456601 - DNA, 25 bp, Mus musculus
gaccttgtgcggtttcttgggaaca

SEQ ID NO: 456602 - DNA, 25 bp, Mus musculus
gaccttgtggatattgaagtcaaag

SEQ ID NO: 456603 - DNA, 25 bp, Mus musculus
gaccttgtggattttgaagtcaaag

SEQ ID NO: 456604 - DNA, 25 bp, Mus musculus
gaccttgtgtctcgcatgtacattt

SEQ ID NO: 456605 - DNA, 25 bp, Mus musculus
gaccttgtgtctggcatgtacattt

SEQ ID NO: 456606 - DNA, 25 bp, Mus musculus
gaccttgtgtgtagatggctccatc

SEQ ID NO: 456607 - DNA, 25 bp, Mus musculus
gaccttgtgtgttgatggctccatc

SEQ ID NO: 456608 - DNA, 25 bp, Mus musculus
gaccttgtgttaatatttctctgca

SEQ ID NO: 456609 - DNA, 25 bp, Mus musculus
gaccttgtgttattatttctctgca

SEQ ID NO: 456610 - DNA, 25 bp, Mus musculus
gaccttgtgtttatgaacctttcag

SEQ ID NO: 456611 - DNA, 25 bp, Mus musculus
gaccttgtgtttttgaacctttcag

SEQ ID NO: 456612 - DNA, 25 bp, Mus musculus
gaccttgttcaacccaattatcaca

SEQ ID NO: 456613 - DNA, 25 bp, Mus musculus
gaccttgttcaagccaattatcaca

SEQ ID NO: 456614 - DNA, 25 bp, Mus musculus
gaccttgttccaacgattcactgaa

SEQ ID NO: 456615 - DNA, 25 bp, Mus musculus
gaccttgttccatcgattcactgaa

SEQ ID NO: 456616 - DNA, 25 bp, Mus musculus
gaccttgttgaacatatgcccttta

SEQ ID NO: 456617 - DNA, 25 bp, Mus musculus
gaccttgttgaagatatgcccttta

SEQ ID NO: 456618 - DNA, 25 bp, Mus musculus
gacctttaacaccaacacagagcgt

SEQ ID NO: 456619 - DNA, 25 bp, Mus musculus
gacctttaacacgaacacagagcgt

SEQ ID NO: 456620 - DNA, 25 bp, Mus musculus
gacctttaagtcagagaatcactaa

SEQ ID NO: 456621 - DNA, 25 bp, Mus musculus
gacctttaagtctgagaatcactaa

SEQ ID NO: 456622 - DNA, 25 bp, Mus musculus
gacctttaatccaatggtgaaacaa

SEQ ID NO: 456623 - DNA, 25 bp, Mus musculus
gacctttaatcctatggtgaaacaa

SEQ ID NO: 456624 - DNA, 25 bp, Mus musculus
gacctttacaggagtcgtttcaaat

SEQ ID NO: 456625 - DNA, 25 bp, Mus musculus
gacctttacaggtgtcgtttcaaat

SEQ ID NO: 456626 - DNA, 25 bp, Mus musculus
gacctttacgttccataggcttcag

SEQ ID NO: 456627 - DNA, 25 bp, Mus musculus
gacctttacgttgcataggcttcag

SEQ ID NO: 456628 - DNA, 25 bp, Mus musculus
gacctttacttccagttcagagcct

SEQ ID NO: 456629 - DNA, 25 bp, Mus musculus
gacctttacttcgagttcagagcct

SEQ ID NO: 456630 - DNA, 25 bp, Mus musculus
gacctttagctcctgacattttata

SEQ ID NO: 456631 - DNA, 25 bp, Mus musculus
gacctttagctcgtgacattttata

SEQ ID NO: 456632 - DNA, 25 bp, Mus musculus
gacctttaggctcgtctgtggagta

SEQ ID NO: 456633 - DNA, 25 bp, Mus musculus
gacctttaggctggtctgtggagta

SEQ ID NO: 456634 - DNA, 25 bp, Mus musculus
gacctttatataacggcatcactgt

SEQ ID NO: 456635 - DNA, 25 bp, Mus musculus
gacctttatatatcggcatcactgt

SEQ ID NO: 456636 - DNA, 25 bp, Mus musculus
gacctttatcacaaactctaatgga

SEQ ID NO: 456637 - DNA, 25 bp, Mus musculus
gacctttatcactaactctaatgga

SEQ ID NO: 456638 - DNA, 25 bp, Mus musculus
gacctttatgttctacatccaactt

SEQ ID NO: 456639 - DNA, 25 bp, Mus musculus
gacctttatgttgtacatccaactt

SEQ ID NO: 456640 - DNA, 25 bp, Mus musculus
gacctttccattctatcagagtatc

SEQ ID NO: 456641 - DNA, 25 bp, Mus musculus
gacctttccattgtatcagagtatc

SEQ ID NO: 456642 - DNA, 25 bp, Mus musculus
gacctttcccctagagatccataaa

SEQ ID NO: 456643 - DNA, 25 bp, Mus musculus
gacctttccccttgagatccataaa

SEQ ID NO: 456644 - DNA, 25 bp, Mus musculus
gacctttccctcctttgatcagggg

SEQ ID NO: 456645 - DNA, 25 bp, Mus musculus
gacctttccctcgtttgatcagggg

SEQ ID NO: 456646 - DNA, 25 bp, Mus musculus
gacctttccctgagtctagatttgg

SEQ ID NO: 456647 - DNA, 25 bp, Mus musculus
gacctttccctgtgtctagatttgg

SEQ ID NO: 456648 - DNA, 25 bp, Mus musculus
gacctttccgagaccattgttaatg

SEQ ID NO: 456649 - DNA, 25 bp, Mus musculus
gacctttccgagtccattgttaatg

SEQ ID NO: 456650 - DNA, 25 bp, Mus musculus
gacctttcctccaagtgggactgta

SEQ ID NO: 456651 - DNA, 25 bp, Mus musculus
gacctttcctcctagtgggactgta

SEQ ID NO: 456652 - DNA, 25 bp, Mus musculus
gacctttcctgacactgaggctgga

SEQ ID NO: 456653 - DNA, 25 bp, Mus musculus
gacctttcctgagactgaggctgga

SEQ ID NO: 456654 - DNA, 25 bp, Mus musculus
gacctttcctgcacatgtgaaattg

SEQ ID NO: 456655 - DNA, 25 bp, Mus musculus
gacctttcctgctcatgtgaaattg

SEQ ID NO: 456656 - DNA, 25 bp, Mus musculus
gacctttcctggaccgctggcggag

SEQ ID NO: 456657 - DNA, 25 bp, Mus musculus
gacctttcctggtccgctggcggag

SEQ ID NO: 456658 - DNA, 25 bp, Mus musculus
gacctttcctgtcaaatatccttga

SEQ ID NO: 456659 - DNA, 25 bp, Mus musculus
gacctttcctgtgaaatatccttga

SEQ ID NO: 456660 - DNA, 25 bp, Mus musculus
gacctttccttacacagaccctgtt

SEQ ID NO: 456661 - DNA, 25 bp, Mus musculus
gacctttccttagacagaccctgtt

SEQ ID NO: 456662 - DNA, 25 bp, Mus musculus
gacctttcgactcatgttgctggaa

SEQ ID NO: 456663 - DNA, 25 bp, Mus musculus
gacctttcgactgatgttgctggaa

SEQ ID NO: 456664 - DNA, 25 bp, Mus musculus
gacctttcgctgacaaagggcttct

SEQ ID NO: 456665 - DNA, 25 bp, Mus musculus
gacctttcgctgtcaaagggcttct

SEQ ID NO: 456666 - DNA, 25 bp, Mus musculus
gacctttctaggaaacagtggcctt

SEQ ID NO: 456667 - DNA, 25 bp, Mus musculus
gacctttctaggtaacagtggcctt

SEQ ID NO: 456668 - DNA, 25 bp, Mus musculus
gacctttctatcagtgtgatgagga

SEQ ID NO: 456669 - DNA, 25 bp, Mus musculus
gacctttctatctgtgtgatgagga

SEQ ID NO: 456670 - DNA, 25 bp, Mus musculus
gacctttctcagcacgaccaggtga

SEQ ID NO: 456671 - DNA, 25 bp, Mus musculus
gacctttctcaggacgaccaggtga

SEQ ID NO: 456672 - DNA, 25 bp, Mus musculus
gacctttctcttacgttactgggag

SEQ ID NO: 456673 - DNA, 25 bp, Mus musculus
gacctttctctttcgttactgggag

SEQ ID NO: 456674 - DNA, 25 bp, Mus musculus
gacctttctgagcaacctgttcttg

SEQ ID NO: 456675 - DNA, 25 bp, Mus musculus
gacctttctgaggaacctgttcttg

SEQ ID NO: 456676 - DNA, 25 bp, Mus musculus
gacctttctgtcaattcaagctttg

SEQ ID NO: 456677 - DNA, 25 bp, Mus musculus
gacctttctgtctattcaagctttg

SEQ ID NO: 456678 - DNA, 25 bp, Mus musculus
gacctttctgtgattcatttagtta

SEQ ID NO: 456679 - DNA, 25 bp, Mus musculus
gacctttctgtgtttcatttagtta

SEQ ID NO: 456680 - DNA, 25 bp, Mus musculus
gacctttcttaaactgttgcatcag

SEQ ID NO: 456681 - DNA, 25 bp, Mus musculus
gacctttcttaatctgttgcatcag

SEQ ID NO: 456682 - DNA, 25 bp, Mus musculus
gacctttcttacagttatccattca

SEQ ID NO: 456683 - DNA, 25 bp, Mus musculus
gacctttcttactgttatccattca

SEQ ID NO: 456684 - DNA, 25 bp, Mus musculus
gacctttcttccctatttgaagcaa

SEQ ID NO: 456685 - DNA, 25 bp, Mus musculus
gacctttcttccgtatttgaagcaa

SEQ ID NO: 456686 - DNA, 25 bp, Mus musculus
gacctttcttgaattcttaacagta

SEQ ID NO: 456687 - DNA, 25 bp, Mus musculus
gacctttcttgatttcttaacagta

SEQ ID NO: 456688 - DNA, 25 bp, Mus musculus
gacctttgaatcaccgaattccgag

SEQ ID NO: 456689 - DNA, 25 bp, Mus musculus
gacctttgaatctccgaattccgag

SEQ ID NO: 456690 - DNA, 25 bp, Mus musculus
gacctttgagcgcatgctttggcga

SEQ ID NO: 456691 - DNA, 25 bp, Mus musculus
gacctttgagcggatgctttggcga

SEQ ID NO: 456692 - DNA, 25 bp, Mus musculus
gacctttgattgcagaagtacccca

SEQ ID NO: 456693 - DNA, 25 bp, Mus musculus
gacctttgattggagaagtacccca

SEQ ID NO: 456694 - DNA, 25 bp, Mus musculus
gacctttgccaccattgcacaattt

SEQ ID NO: 456695 - DNA, 25 bp, Mus musculus
gacctttgccacgattgcacaattt

SEQ ID NO: 456696 - DNA, 25 bp, Mus musculus
gacctttgccagaactgtaaatctg

SEQ ID NO: 456697 - DNA, 25 bp, Mus musculus
gacctttgccagtactgtaaatctg

SEQ ID NO: 456698 - DNA, 25 bp, Mus musculus
gacctttgcccaactgctgggtaaa

SEQ ID NO: 456699 - DNA, 25 bp, Mus musculus
gacctttgcccatctgctgggtaaa

SEQ ID NO: 456700 - DNA, 25 bp, Mus musculus
gacctttgcctacgtctccagagct

SEQ ID NO: 456701 - DNA, 25 bp, Mus musculus
gacctttgcctaggtctccagagct

SEQ ID NO: 456702 - DNA, 25 bp, Mus musculus
gacctttgcctcaattatgacatga

SEQ ID NO: 456703 - DNA, 25 bp, Mus musculus
gacctttgcctctattatgacatga

SEQ ID NO: 456704 - DNA, 25 bp, Mus musculus
gacctttgctatatgtagagccaga

SEQ ID NO: 456705 - DNA, 25 bp, Mus musculus
gacctttgctatttgtagagccaga

SEQ ID NO: 456706 - DNA, 25 bp, Mus musculus
gacctttggagtaccagatcgctct

SEQ ID NO: 456707 - DNA, 25 bp, Mus musculus
gacctttggagttccagatcgctct

SEQ ID NO: 456708 - DNA, 25 bp, Mus musculus
gacctttggccccagaagtacagtt

SEQ ID NO: 456709 - DNA, 25 bp, Mus musculus
gacctttggcccgagaagtacagtt

SEQ ID NO: 456710 - DNA, 25 bp, Mus musculus
gacctttggctcaggcagtattaaa

SEQ ID NO: 456711 - DNA, 25 bp, Mus musculus
gacctttggctctggcagtattaaa

SEQ ID NO: 456712 - DNA, 25 bp, Mus musculus
gacctttgggcccatgtggacctca

SEQ ID NO: 456713 - DNA, 25 bp, Mus musculus
gacctttgggccgatgtggacctca

SEQ ID NO: 456714 - DNA, 25 bp, Mus musculus
gacctttggtggcaagaacagctaa

SEQ ID NO: 456715 - DNA, 25 bp, Mus musculus
gacctttggtgggaagaacagctaa

SEQ ID NO: 456716 - DNA, 25 bp, Mus musculus
gacctttgtaaacccaattgccaat

SEQ ID NO: 456717 - DNA, 25 bp, Mus musculus
gacctttgtaaagccaattgccaat

SEQ ID NO: 456718 - DNA, 25 bp, Mus musculus
gacctttgtaatacatatatacttg

SEQ ID NO: 456719 - DNA, 25 bp, Mus musculus
gacctttgtaattcatatatacttg

SEQ ID NO: 456720 - DNA, 25 bp, Mus musculus
gacctttgtagacgttgtttccttg

SEQ ID NO: 456721 - DNA, 25 bp, Mus musculus
gacctttgtagaggttgtttccttg

SEQ ID NO: 456722 - DNA, 25 bp, Mus musculus
gacctttgtggactcaaaattgaga

SEQ ID NO: 456723 - DNA, 25 bp, Mus musculus
gacctttgtggagtcaaaattgaga

SEQ ID NO: 456724 - DNA, 25 bp, Mus musculus
gaccttttacacattctgaattcta

SEQ ID NO: 456725 - DNA, 25 bp, Mus musculus
gaccttttacactttctgaattcta

SEQ ID NO: 456726 - DNA, 25 bp, Mus musculus
gaccttttacgtcattgttttgtgt

SEQ ID NO: 456727 - DNA, 25 bp, Mus musculus
gaccttttacgtgattgttttgtgt

SEQ ID NO: 456728 - DNA, 25 bp, Mus musculus
gaccttttagctcctctatcagaga

SEQ ID NO: 456729 - DNA, 25 bp, Mus musculus
gaccttttagctgctctatcagaga

SEQ ID NO: 456730 - DNA, 25 bp, Mus musculus
gaccttttaggcagtttttctgcat

SEQ ID NO: 456731 - DNA, 25 bp, Mus musculus
gaccttttaggctgtttttctgcat

SEQ ID NO: 456732 - DNA, 25 bp, Mus musculus
gaccttttccgcatacgtgtgggaa

SEQ ID NO: 456733 - DNA, 25 bp, Mus musculus
gaccttttccgcttacgtgtgggaa

SEQ ID NO: 456734 - DNA, 25 bp, Mus musculus
gaccttttctcaaagctgtacagtg

SEQ ID NO: 456735 - DNA, 25 bp, Mus musculus
gaccttttctcatagctgtacagtg

SEQ ID NO: 456736 - DNA, 25 bp, Mus musculus
gaccttttctctcaacagaaggagg

SEQ ID NO: 456737 - DNA, 25 bp, Mus musculus
gaccttttctctgaacagaaggagg

SEQ ID NO: 456738 - DNA, 25 bp, Mus musculus
gaccttttgaatatactgtgcagac

SEQ ID NO: 456739 - DNA, 25 bp, Mus musculus
gaccttttgaatttactgtgcagac

SEQ ID NO: 456740 - DNA, 25 bp, Mus musculus
gaccttttgatcatttgtcctacct

SEQ ID NO: 456741 - DNA, 25 bp, Mus musculus
gaccttttgatcttttgtcctacct

SEQ ID NO: 456742 - DNA, 25 bp, Mus musculus
gaccttttggatactcaagtccagt

SEQ ID NO: 456743 - DNA, 25 bp, Mus musculus
gaccttttggattctcaagtccagt

SEQ ID NO: 456744 - DNA, 25 bp, Mus musculus
gaccttttgggcactccacagaaaa

SEQ ID NO: 456745 - DNA, 25 bp, Mus musculus
gaccttttgggctctccacagaaaa

SEQ ID NO: 456746 - DNA, 25 bp, Mus musculus
gaccttttggtcaatagctaggcag

SEQ ID NO: 456747 - DNA, 25 bp, Mus musculus
gaccttttggtctatagctaggcag

SEQ ID NO: 456748 - DNA, 25 bp, Mus musculus
gaccttttgtcaagaagagcccctt

SEQ ID NO: 456749 - DNA, 25 bp, Mus musculus
gaccttttgtcatgaagagcccctt

SEQ ID NO: 456750 - DNA, 25 bp, Mus musculus
gaccttttgttaagttcctagcaca

SEQ ID NO: 456751 - DNA, 25 bp, Mus musculus
gaccttttgttatgttcctagcaca

SEQ ID NO: 456752 - DNA, 25 bp, Mus musculus
gaccttttgtttcacttgtcttgga

SEQ ID NO: 456753 - DNA, 25 bp, Mus musculus
gaccttttgtttgacttgtcttgga

SEQ ID NO: 456754 - DNA, 25 bp, Mus musculus
gacctttttaggagtgactttcgat

SEQ ID NO: 456755 - DNA, 25 bp, Mus musculus
gacctttttaggtgtgactttcgat

SEQ ID NO: 456756 - DNA, 25 bp, Mus musculus
gacctttttatccaacgctaagact

SEQ ID NO: 456757 - DNA, 25 bp, Mus musculus
gacctttttatcgaacgctaagact

SEQ ID NO: 456758 - DNA, 25 bp, Mus musculus
gacctttttcttagggctgtagaat

SEQ ID NO: 456759 - DNA, 25 bp, Mus musculus
gacctttttcttcctgttatgatga

SEQ ID NO: 456760 - DNA, 25 bp, Mus musculus
gacctttttcttgctgttatgatga

SEQ ID NO: 456761 - DNA, 25 bp, Mus musculus
gacctttttctttgggctgtagaat

SEQ ID NO: 456762 - DNA, 25 bp, Mus musculus
gacctttttggacctgaaccttttg

SEQ ID NO: 456763 - DNA, 25 bp, Mus musculus
gacctttttggagctgaaccttttg

SEQ ID NO: 456764 - DNA, 25 bp, Mus musculus
gacgaaaactgtcactcccagcggt

SEQ ID NO: 456765 - DNA, 25 bp, Mus musculus
gacgaaaactgtgactcccagcggt

SEQ ID NO: 456766 - DNA, 25 bp, Mus musculus
gacgaaaagaccagatccccggtgg

SEQ ID NO: 456767 - DNA, 25 bp, Mus musculus
gacgaaaagacctgatccccggtgg

SEQ ID NO: 456768 - DNA, 25 bp, Mus musculus
gacgaaaattccacgtggccagata

SEQ ID NO: 456769 - DNA, 25 bp, Mus musculus
gacgaaaattcctcgtggccagata

SEQ ID NO: 456770 - DNA, 25 bp, Mus musculus
gacgaaacaacccagaaccctgaga

SEQ ID NO: 456771 - DNA, 25 bp, Mus musculus
gacgaaacaaccgagaaccctgaga

SEQ ID NO: 456772 - DNA, 25 bp, Mus musculus
gacgaaacagatacctctaggcagg

SEQ ID NO: 456773 - DNA, 25 bp, Mus musculus
gacgaaacagattcctctaggcagg

SEQ ID NO: 456774 - DNA, 25 bp, Mus musculus
gacgaaaccgaaattgtatggccct

SEQ ID NO: 456775 - DNA, 25 bp, Mus musculus
gacgaaaccgaatttgtatggccct

SEQ ID NO: 456776 - DNA, 25 bp, Mus musculus
gacgaaacgggactggcttgtcaaa

SEQ ID NO: 456777 - DNA, 25 bp, Mus musculus
gacgaaacgggagtggcttgtcaaa

SEQ ID NO: 456778 - DNA, 25 bp, Mus musculus
gacgaaactgtgagtgactgttccc

SEQ ID NO: 456779 - DNA, 25 bp, Mus musculus
gacgaaactgtgtgtgactgttccc

SEQ ID NO: 456780 - DNA, 25 bp, Mus musculus
gacgaaagcgtgaactgaaatctaa

SEQ ID NO: 456781 - DNA, 25 bp, Mus musculus
gacgaaagcgtgtactgaaatctaa

SEQ ID NO: 456782 - DNA, 25 bp, Mus musculus
gacgaaagcttcacttgctggaaca

SEQ ID NO: 456783 - DNA, 25 bp, Mus musculus
gacgaaagcttctcttgctggaaca

SEQ ID NO: 456784 - DNA, 25 bp, Mus musculus
gacgaaatccaacgtcagatacttt

SEQ ID NO: 456785 - DNA, 25 bp, Mus musculus
gacgaaatccaaggtcagatacttt

SEQ ID NO: 456786 - DNA, 25 bp, Mus musculus
gacgaaatgaacatccgactgtgga

SEQ ID NO: 456787 - DNA, 25 bp, Mus musculus
gacgaaatgaacttccgactgtgga

SEQ ID NO: 456788 - DNA, 25 bp, Mus musculus
gacgaaatgtagagagtcctgttca

SEQ ID NO: 456789 - DNA, 25 bp, Mus musculus
gacgaaatgtagtgagtcctgttca

SEQ ID NO: 456790 - DNA, 25 bp, Mus musculus
gacgaaattgctatgttcagtggaa

SEQ ID NO: 456791 - DNA, 25 bp, Mus musculus
gacgaaattgctattggtgtcttca

SEQ ID NO: 456792 - DNA, 25 bp, Mus musculus
gacgaaattgctttgttcagtggaa

SEQ ID NO: 456793 - DNA, 25 bp, Mus musculus
gacgaaattgcttttggtgtcttca

SEQ ID NO: 456794 - DNA, 25 bp, Mus musculus
gacgaaattgtccttgctgatgcga

SEQ ID NO: 456795 - DNA, 25 bp, Mus musculus
gacgaaattgtcgttgctgatgcga

SEQ ID NO: 456796 - DNA, 25 bp, Mus musculus
gacgaacagatgcttaatgtccaaa

SEQ ID NO: 456797 - DNA, 25 bp, Mus musculus
gacgaacagatggttaatgtccaaa

SEQ ID NO: 456798 - DNA, 25 bp, Mus musculus
gacgaacagcaaaaggaagaccact

SEQ ID NO: 456799 - DNA, 25 bp, Mus musculus
gacgaacagcaataggaagaccact

SEQ ID NO: 456800 - DNA, 25 bp, Mus musculus
gacgaacatctcagcagtgaactat

SEQ ID NO: 456801 - DNA, 25 bp, Mus musculus
gacgaacatctctgcagtgaactat

SEQ ID NO: 456802 - DNA, 25 bp, Mus musculus
gacgaacatgtgacttccagttctc

SEQ ID NO: 456803 - DNA, 25 bp, Mus musculus
gacgaacatgtgtcttccagttctc

SEQ ID NO: 456804 - DNA, 25 bp, Mus musculus
gacgaaccggacaaatgccactcat

SEQ ID NO: 456805 - DNA, 25 bp, Mus musculus
gacgaaccggactaatgccactcat

SEQ ID NO: 456806 - DNA, 25 bp, Mus musculus
gacgaacgaaagatgctcactggat

SEQ ID NO: 456807 - DNA, 25 bp, Mus musculus
gacgaacgaaagttgctcactggat

SEQ ID NO: 456808 - DNA, 25 bp, Mus musculus
gacgaacgcagccagctgagccacg

SEQ ID NO: 456809 - DNA, 25 bp, Mus musculus
gacgaacgcagcgagctgagccacg

SEQ ID NO: 456810 - DNA, 25 bp, Mus musculus
gacgaacgcaggatgatctgtctga

SEQ ID NO: 456811 - DNA, 25 bp, Mus musculus
gacgaacgcaggttgatctgtctga

SEQ ID NO: 456812 - DNA, 25 bp, Mus musculus
gacgaactctctcaaaggcatcctg

SEQ ID NO: 456813 - DNA, 25 bp, Mus musculus
gacgaactctctgaaaggcatcctg

SEQ ID NO: 456814 - DNA, 25 bp, Mus musculus
gacgaactggtcacatgcctattaa

SEQ ID NO: 456815 - DNA, 25 bp, Mus musculus
gacgaactggtctcatgcctattaa

SEQ ID NO: 456816 - DNA, 25 bp, Mus musculus
gacgaagaaactcggcgctcttaca

SEQ ID NO: 456817 - DNA, 25 bp, Mus musculus
gacgaagaaactgggcgctcttaca

SEQ ID NO: 456818 - DNA, 25 bp, Mus musculus
gacgaagaatccccagctgaggaac

SEQ ID NO: 456819 - DNA, 25 bp, Mus musculus
gacgaagaatccgcagctgaggaac

SEQ ID NO: 456820 - DNA, 25 bp, Mus musculus
gacgaagacggcaactgctcgctca

SEQ ID NO: 456821 - DNA, 25 bp, Mus musculus
gacgaagacggctactgctcgctca

SEQ ID NO: 456822 - DNA, 25 bp, Mus musculus
gacgaagagaagactcccagcccga

SEQ ID NO: 456823 - DNA, 25 bp, Mus musculus
gacgaagagaagtctcccagcccga

SEQ ID NO: 456824 - DNA, 25 bp, Mus musculus
gacgaagagtttcgagcacctctcc

SEQ ID NO: 456825 - DNA, 25 bp, Mus musculus
gacgaagagtttggagcacctctcc

SEQ ID NO: 456826 - DNA, 25 bp, Mus musculus
gacgaagatcatcactcaagacggt

SEQ ID NO: 456827 - DNA, 25 bp, Mus musculus
gacgaagatcatgactcaagacggt

SEQ ID NO: 456828 - DNA, 25 bp, Mus musculus
gacgaagcaatgcaacaactgttta

SEQ ID NO: 456829 - DNA, 25 bp, Mus musculus
gacgaagcaatggaacaactgttta

SEQ ID NO: 456830 - DNA, 25 bp, Mus musculus
gacgaagcgaagatccgggactcct

SEQ ID NO: 456831 - DNA, 25 bp, Mus musculus
gacgaagcgaagttccgggactcct

SEQ ID NO: 456832 - DNA, 25 bp, Mus musculus
gacgaagcggctcgcaacctcaaga

SEQ ID NO: 456833 - DNA, 25 bp, Mus musculus
gacgaagcggctggcaacctcaaga

SEQ ID NO: 456834 - DNA, 25 bp, Mus musculus
gacgaagctcttagtgcgggatact

SEQ ID NO: 456835 - DNA, 25 bp, Mus musculus
gacgaagctctttgtgcgggatact

SEQ ID NO: 456836 - DNA, 25 bp, Mus musculus
gacgaagctgggattttctggacaa

SEQ ID NO: 456837 - DNA, 25 bp, Mus musculus
gacgaagctgggtttttctggacaa

SEQ ID NO: 456838 - DNA, 25 bp, Mus musculus
gacgaaggagccattctgtcctgtg

SEQ ID NO: 456839 - DNA, 25 bp, Mus musculus
gacgaaggagcctttctgtcctgtg

SEQ ID NO: 456840 - DNA, 25 bp, Mus musculus
gacgaaggcagtctgtgatcccagt

SEQ ID NO: 456841 - DNA, 25 bp, Mus musculus
gacgaaggcagtgtgtgatcccagt

SEQ ID NO: 456842 - DNA, 25 bp, Mus musculus
gacgaaggcccacgaagctctatca

SEQ ID NO: 456843 - DNA, 25 bp, Mus musculus
gacgaaggcccaggaagctctatca

SEQ ID NO: 456844 - DNA, 25 bp, Mus musculus
gacgaagggaacctcatcctttggt

SEQ ID NO: 456845 - DNA, 25 bp, Mus musculus
gacgaagggaacgtcatcctttggt

SEQ ID NO: 456846 - DNA, 25 bp, Mus musculus
gacgaaggtagccagtcacaaggtt

SEQ ID NO: 456847 - DNA, 25 bp, Mus musculus
gacgaaggtagcgagtcacaaggtt

SEQ ID NO: 456848 - DNA, 25 bp, Mus musculus
gacgaaggtgccaaggcccgtatcg

SEQ ID NO: 456849 - DNA, 25 bp, Mus musculus
gacgaaggtgcctaggcccgtatcg

SEQ ID NO: 456850 - DNA, 25 bp, Mus musculus
gacgaagtacccagacgtgggcact

SEQ ID NO: 456851 - DNA, 25 bp, Mus musculus
gacgaagtaccctgacgtgggcact

SEQ ID NO: 456852 - DNA, 25 bp, Mus musculus
gacgaagtattgacccatgactttt

SEQ ID NO: 456853 - DNA, 25 bp, Mus musculus
gacgaagtattgtcccatgactttt

SEQ ID NO: 456854 - DNA, 25 bp, Mus musculus
gacgaagtcctcactcttaagaagt

SEQ ID NO: 456855 - DNA, 25 bp, Mus musculus
gacgaagtcctctctcttaagaagt

SEQ ID NO: 456856 - DNA, 25 bp, Mus musculus
gacgaagtttgacacctatatcccc

SEQ ID NO: 456857 - DNA, 25 bp, Mus musculus
gacgaagtttgagacctatatcccc

SEQ ID NO: 456858 - DNA, 25 bp, Mus musculus
gacgaatatagcaggcaagcagcag

SEQ ID NO: 456859 - DNA, 25 bp, Mus musculus
gacgaatatagctggcaagcagcag

SEQ ID NO: 456860 - DNA, 25 bp, Mus musculus
gacgaatcaatacagctgccgtgtt

SEQ ID NO: 456861 - DNA, 25 bp, Mus musculus
gacgaatcaatagagctgccgtgtt

SEQ ID NO: 456862 - DNA, 25 bp, Mus musculus
gacgaatcattccaaggccaagctg

SEQ ID NO: 456863 - DNA, 25 bp, Mus musculus
gacgaatcattcgaaggccaagctg

SEQ ID NO: 456864 - DNA, 25 bp, Mus musculus
gacgaatccagtcagcgctgaactt

SEQ ID NO: 456865 - DNA, 25 bp, Mus musculus
gacgaatccagtgagcgctgaactt

SEQ ID NO: 456866 - DNA, 25 bp, Mus musculus
gacgaatcctttattctagcaatta

SEQ ID NO: 456867 - DNA, 25 bp, Mus musculus
gacgaatccttttttctagcaatta

SEQ ID NO: 456868 - DNA, 25 bp, Mus musculus
gacgaatgaagcaatttcatagttt

SEQ ID NO: 456869 - DNA, 25 bp, Mus musculus
gacgaatgaagctatttcatagttt

SEQ ID NO: 456870 - DNA, 25 bp, Mus musculus
gacgaatgaggacagggccctattt

SEQ ID NO: 456871 - DNA, 25 bp, Mus musculus
gacgaatgaggagagggccctattt

SEQ ID NO: 456872 - DNA, 25 bp, Mus musculus
gacgaatgcaacaccataaccataa

SEQ ID NO: 456873 - DNA, 25 bp, Mus musculus
gacgaatgcaactccataaccataa

SEQ ID NO: 456874 - DNA, 25 bp, Mus musculus
gacgaatggtgcactgggccagaca

SEQ ID NO: 456875 - DNA, 25 bp, Mus musculus
gacgaatggtgctctgggccagaca

SEQ ID NO: 456876 - DNA, 25 bp, Mus musculus
gacgaattaatcactcgggcagcca

SEQ ID NO: 456877 - DNA, 25 bp, Mus musculus
gacgaattaatctctcgggcagcca

SEQ ID NO: 456878 - DNA, 25 bp, Mus musculus
gacgaattggatcccattggtacca

SEQ ID NO: 456879 - DNA, 25 bp, Mus musculus
gacgaattggatgccattggtacca

SEQ ID NO: 456880 - DNA, 25 bp, Mus musculus
gacgaatttgtgaccggcaatctct

SEQ ID NO: 456881 - DNA, 25 bp, Mus musculus
gacgaatttgtgtccggcaatctct

SEQ ID NO: 456882 - DNA, 25 bp, Mus musculus
gacgacaaatgtctcatggagccca

SEQ ID NO: 456883 - DNA, 25 bp, Mus musculus
gacgacaaatgtgtcatggagccca

SEQ ID NO: 456884 - DNA, 25 bp, Mus musculus
gacgacaacattaccagtactgctc

SEQ ID NO: 456885 - DNA, 25 bp, Mus musculus
gacgacaacatttccagtactgctc

SEQ ID NO: 456886 - DNA, 25 bp, Mus musculus
gacgacaagaagcatatcaaatcaa

SEQ ID NO: 456887 - DNA, 25 bp, Mus musculus
gacgacaagaaggatatcaaatcaa

SEQ ID NO: 456888 - DNA, 25 bp, Mus musculus
gacgacaaggataagttctttctat

SEQ ID NO: 456889 - DNA, 25 bp, Mus musculus
gacgacaaggattagttctttctat

SEQ ID NO: 456890 - DNA, 25 bp, Mus musculus
gacgacaatccaattcttctttcag

SEQ ID NO: 456891 - DNA, 25 bp, Mus musculus
gacgacaatccatttcttctttcag

SEQ ID NO: 456892 - DNA, 25 bp, Mus musculus
gacgacacacagactgcttgctagg

SEQ ID NO: 456893 - DNA, 25 bp, Mus musculus
gacgacacacagtctgcttgctagg

SEQ ID NO: 456894 - DNA, 25 bp, Mus musculus
gacgacacactcctgctaaaggaag

SEQ ID NO: 456895 - DNA, 25 bp, Mus musculus
gacgacacactcgtgctaaaggaag

SEQ ID NO: 456896 - DNA, 25 bp, Mus musculus
gacgacacctttactgttgggaggg

SEQ ID NO: 456897 - DNA, 25 bp, Mus musculus
gacgacaccttttctgttgggaggg

SEQ ID NO: 456898 - DNA, 25 bp, Mus musculus
gacgacacgatgatgcttcttatct

SEQ ID NO: 456899 - DNA, 25 bp, Mus musculus
gacgacacgatgttgcttcttatct

SEQ ID NO: 456900 - DNA, 25 bp, Mus musculus
gacgacactaccaaaaagctgtgga

SEQ ID NO: 456901 - DNA, 25 bp, Mus musculus
gacgacactacctaaaagctgtgga

SEQ ID NO: 456902 - DNA, 25 bp, Mus musculus
gacgacagaggtacctgtcttcatt

SEQ ID NO: 456903 - DNA, 25 bp, Mus musculus
gacgacagaggttcctgtcttcatt

SEQ ID NO: 456904 - DNA, 25 bp, Mus musculus
gacgacagatggagaataacttttt

SEQ ID NO: 456905 - DNA, 25 bp, Mus musculus
gacgacagatggtgaataacttttt

SEQ ID NO: 456906 - DNA, 25 bp, Mus musculus
gacgacagcattcaagaccttggag

SEQ ID NO: 456907 - DNA, 25 bp, Mus musculus
gacgacagcattgaagaccttggag

SEQ ID NO: 456908 - DNA, 25 bp, Mus musculus
gacgacagcccaactgcaggagaag

SEQ ID NO: 456909 - DNA, 25 bp, Mus musculus
gacgacagcccatctgcaggagaag

SEQ ID NO: 456910 - DNA, 25 bp, Mus musculus
gacgacagcttcatctaccttggca

SEQ ID NO: 456911 - DNA, 25 bp, Mus musculus
gacgacagcttcttctaccttggca

SEQ ID NO: 456912 - DNA, 25 bp, Mus musculus
gacgacaggatgcactttacgtgat

SEQ ID NO: 456913 - DNA, 25 bp, Mus musculus
gacgacaggatggactttacgtgat

SEQ ID NO: 456914 - DNA, 25 bp, Mus musculus
gacgacagtgtcactgtttgcaggt

SEQ ID NO: 456915 - DNA, 25 bp, Mus musculus
gacgacagtgtctctgtttgcaggt

SEQ ID NO: 456916 - DNA, 25 bp, Mus musculus
gacgacatcaccctgtttagcagga

SEQ ID NO: 456917 - DNA, 25 bp, Mus musculus
gacgacatcaccgtgtttagcagga

SEQ ID NO: 456918 - DNA, 25 bp, Mus musculus
gacgacatcgtgagtgagaactatt

SEQ ID NO: 456919 - DNA, 25 bp, Mus musculus
gacgacatcgtgtgtgagaactatt

SEQ ID NO: 456920 - DNA, 25 bp, Mus musculus
gacgacatgttgcacatggctccac

SEQ ID NO: 456921 - DNA, 25 bp, Mus musculus
gacgacatgttggacatggctccac

SEQ ID NO: 456922 - DNA, 25 bp, Mus musculus
gacgacatgtttcagcatcctgcct

SEQ ID NO: 456923 - DNA, 25 bp, Mus musculus
gacgacatgtttgagcatcctgcct

SEQ ID NO: 456924 - DNA, 25 bp, Mus musculus
gacgacattattccctcatttgatc

SEQ ID NO: 456925 - DNA, 25 bp, Mus musculus
gacgacattattgcctcatttgatc

SEQ ID NO: 456926 - DNA, 25 bp, Mus musculus
gacgaccaacgtatgtgacttcact

SEQ ID NO: 456927 - DNA, 25 bp, Mus musculus
gacgaccaacgtttgtgacttcact

SEQ ID NO: 456928 - DNA, 25 bp, Mus musculus
gacgaccagcgtctaacagttaatt

SEQ ID NO: 456929 - DNA, 25 bp, Mus musculus
gacgaccagcgtgtaacagttaatt

SEQ ID NO: 456930 - DNA, 25 bp, Mus musculus
gacgaccattccataaaagagcatt

SEQ ID NO: 456931 - DNA, 25 bp, Mus musculus
gacgaccattccttaaaagagcatt

SEQ ID NO: 456932 - DNA, 25 bp, Mus musculus
gacgaccgacaccagcaaatcagct

SEQ ID NO: 456933 - DNA, 25 bp, Mus musculus
gacgaccgacacgagcaaatcagct

SEQ ID NO: 456934 - DNA, 25 bp, Mus musculus
gacgaccgctcaataataaacctgc

SEQ ID NO: 456935 - DNA, 25 bp, Mus musculus
gacgaccgctcattaataaacctgc

SEQ ID NO: 456936 - DNA, 25 bp, Mus musculus
gacgaccgcttgatgatgacattaa

SEQ ID NO: 456937 - DNA, 25 bp, Mus musculus
gacgaccgcttgttgatgacattaa

SEQ ID NO: 456938 - DNA, 25 bp, Mus musculus
gacgacctacaaactggagcatgcc

SEQ ID NO: 456939 - DNA, 25 bp, Mus musculus
gacgacctacaatctggagcatgcc

SEQ ID NO: 456940 - DNA, 25 bp, Mus musculus
gacgacctcaagacatcgcagctga

SEQ ID NO: 456941 - DNA, 25 bp, Mus musculus
gacgacctcaagtcatcgcagctga

SEQ ID NO: 456942 - DNA, 25 bp, Mus musculus
gacgacctcactaactgtttacaga

SEQ ID NO: 456943 - DNA, 25 bp, Mus musculus
gacgacctcacttactgtttacaga

SEQ ID NO: 456944 - DNA, 25 bp, Mus musculus
gacgacctgcacaagttggtggacg

SEQ ID NO: 456945 - DNA, 25 bp, Mus musculus
gacgacctgcactagttggtggacg

SEQ ID NO: 456946 - DNA, 25 bp, Mus musculus
gacgacctgctaaatgactattatt

SEQ ID NO: 456947 - DNA, 25 bp, Mus musculus
gacgacctgctatatgactattatt

SEQ ID NO: 456948 - DNA, 25 bp, Mus musculus
gacgacctgctgcagagctacatgg

SEQ ID NO: 456949 - DNA, 25 bp, Mus musculus
gacgacctgctggagagctacatgg

SEQ ID NO: 456950 - DNA, 25 bp, Mus musculus
gacgacctggagaatgtgtgcaatt

SEQ ID NO: 456951 - DNA, 25 bp, Mus musculus
gacgacctggagtatgtgtgcaatt

SEQ ID NO: 456952 - DNA, 25 bp, Mus musculus
gacgaccttcacaaaatcctggttt

SEQ ID NO: 456953 - DNA, 25 bp, Mus musculus
gacgaccttcactaaatcctggttt

SEQ ID NO: 456954 - DNA, 25 bp, Mus musculus
gacgacgacaacaatgaccctgcgc

SEQ ID NO: 456955 - DNA, 25 bp, Mus musculus
gacgacgacaaccagacagcagaga

SEQ ID NO: 456956 - DNA, 25 bp, Mus musculus
gacgacgacaacgagacagcagaga

SEQ ID NO: 456957 - DNA, 25 bp, Mus musculus
gacgacgacaactatgaccctgcgc

SEQ ID NO: 456958 - DNA, 25 bp, Mus musculus
gacgacgacgacaagttcattcctt

SEQ ID NO: 456959 - DNA, 25 bp, Mus musculus
gacgacgacgactagttcattcctt

SEQ ID NO: 456960 - DNA, 25 bp, Mus musculus
gacgacgacgatattcctgtgatcc

SEQ ID NO: 456961 - DNA, 25 bp, Mus musculus
gacgacgacgattttcctgtgatcc

SEQ ID NO: 456962 - DNA, 25 bp, Mus musculus
gacgacgactccactggtacccggg

SEQ ID NO: 456963 - DNA, 25 bp, Mus musculus
gacgacgactcctctggtacccggg

SEQ ID NO: 456964 - DNA, 25 bp, Mus musculus
gacgacgaggacatttacactactt

SEQ ID NO: 456965 - DNA, 25 bp, Mus musculus
gacgacgaggacttttacactactt

SEQ ID NO: 456966 - DNA, 25 bp, Mus musculus
gacgacgagggcatctgcgacttcc

SEQ ID NO: 456967 - DNA, 25 bp, Mus musculus
gacgacgagggcttctgcgacttcc

SEQ ID NO: 456968 - DNA, 25 bp, Mus musculus
gacgacgagttccaggagtttcccg

SEQ ID NO: 456969 - DNA, 25 bp, Mus musculus
gacgacgagttcgaggagtttcccg

SEQ ID NO: 456970 - DNA, 25 bp, Mus musculus
gacgacgatcagaaatggcgccacg

SEQ ID NO: 456971 - DNA, 25 bp, Mus musculus
gacgacgatcagtaatggcgccacg

SEQ ID NO: 456972 - DNA, 25 bp, Mus musculus
gacgacgatgatagtgattatggca

SEQ ID NO: 456973 - DNA, 25 bp, Mus musculus
gacgacgatgatcacagcagcgaga

SEQ ID NO: 456974 - DNA, 25 bp, Mus musculus
gacgacgatgatgacagcagcgaga

SEQ ID NO: 456975 - DNA, 25 bp, Mus musculus
gacgacgatgattgtgattatggca

SEQ ID NO: 456976 - DNA, 25 bp, Mus musculus
gacgacgattacaacaaacctctgg

SEQ ID NO: 456977 - DNA, 25 bp, Mus musculus
gacgacgattactacaaacctctgg

SEQ ID NO: 456978 - DNA, 25 bp, Mus musculus
gacgacgcacgcagggatcagtttg

SEQ ID NO: 456979 - DNA, 25 bp, Mus musculus
gacgacgcacgctgggatcagtttg

SEQ ID NO: 456980 - DNA, 25 bp, Mus musculus
gacgacgctccgagttctttattaa

SEQ ID NO: 456981 - DNA, 25 bp, Mus musculus
gacgacgctccgtgttctttattaa

SEQ ID NO: 456982 - DNA, 25 bp, Mus musculus
gacgacgctctgactcatttaggta

SEQ ID NO: 456983 - DNA, 25 bp, Mus musculus
gacgacgctctgtctcatttaggta

SEQ ID NO: 456984 - DNA, 25 bp, Mus musculus
gacgacgctgtgatccactagatgt

SEQ ID NO: 456985 - DNA, 25 bp, Mus musculus
gacgacgctgtgttccactagatgt

SEQ ID NO: 456986 - DNA, 25 bp, Mus musculus
gacgacggaaagatcctctctcaga

SEQ ID NO: 456987 - DNA, 25 bp, Mus musculus
gacgacggaaagttcctctctcaga

SEQ ID NO: 456988 - DNA, 25 bp, Mus musculus
gacgacggacacaccatctgttggg

SEQ ID NO: 456989 - DNA, 25 bp, Mus musculus
gacgacggacactccatctgttggg

SEQ ID NO: 456990 - DNA, 25 bp, Mus musculus
gacgacgggaacactctcagaactg

SEQ ID NO: 456991 - DNA, 25 bp, Mus musculus
gacgacgggaactctctcagaactg

SEQ ID NO: 456992 - DNA, 25 bp, Mus musculus
gacgacgtccgtcgctgagagttta

SEQ ID NO: 456993 - DNA, 25 bp, Mus musculus
gacgacgtccgtggctgagagttta

SEQ ID NO: 456994 - DNA, 25 bp, Mus musculus
gacgacgtggtaaccaatctcggaa

SEQ ID NO: 456995 - DNA, 25 bp, Mus musculus
gacgacgtggtatccaatctcggaa

SEQ ID NO: 456996 - DNA, 25 bp, Mus musculus
gacgacgtttacatctgttgagcct

SEQ ID NO: 456997 - DNA, 25 bp, Mus musculus
gacgacgtttacttctgttgagcct

SEQ ID NO: 456998 - DNA, 25 bp, Mus musculus
gacgactaaaagacaggtctcctca

SEQ ID NO: 456999 - DNA, 25 bp, Mus musculus
gacgactaaaagtcaggtctcctca

SEQ ID NO: 457000 - DNA, 25 bp, Mus musculus
gacgactactatcaggacggcgaag

SEQ ID NO: 457001 - DNA, 25 bp, Mus musculus
gacgactactatgaggacggcgaag

SEQ ID NO: 457002 - DNA, 25 bp, Mus musculus
gacgactattgtcaagcgggtacca

SEQ ID NO: 457003 - DNA, 25 bp, Mus musculus
gacgactattgtgaagcgggtacca

SEQ ID NO: 457004 - DNA, 25 bp, Mus musculus
gacgactcaaagaagctgatgcatt

SEQ ID NO: 457005 - DNA, 25 bp, Mus musculus
gacgactcaaagtagctgatgcatt

SEQ ID NO: 457006 - DNA, 25 bp, Mus musculus
gacgactcatctccatttccaaaga

SEQ ID NO: 457007 - DNA, 25 bp, Mus musculus
gacgactcatctgcatttccaaaga

SEQ ID NO: 457008 - DNA, 25 bp, Mus musculus
gacgactccaagattctactgaaga

SEQ ID NO: 457009 - DNA, 25 bp, Mus musculus
gacgactccaagtttctactgaaga

SEQ ID NO: 457010 - DNA, 25 bp, Mus musculus
gacgactctagtatctatcaagtta

SEQ ID NO: 457011 - DNA, 25 bp, Mus musculus
gacgactctagtttctatcaagtta

SEQ ID NO: 457012 - DNA, 25 bp, Mus musculus
gacgactctgtcacataagcaatgg

SEQ ID NO: 457013 - DNA, 25 bp, Mus musculus
gacgactctgtctcataagcaatgg

SEQ ID NO: 457014 - DNA, 25 bp, Mus musculus
gacgactctgtgctctattattgtg

SEQ ID NO: 457015 - DNA, 25 bp, Mus musculus
gacgactctgtggtctattattgtg

SEQ ID NO: 457016 - DNA, 25 bp, Mus musculus
gacgactgaacaccaggtgccagaa

SEQ ID NO: 457017 - DNA, 25 bp, Mus musculus
gacgactgaacagcaggtgccagaa

SEQ ID NO: 457018 - DNA, 25 bp, Mus musculus
gacgactgagctcaatgtctttact

SEQ ID NO: 457019 - DNA, 25 bp, Mus musculus
gacgactgagctgaatgtctttact

SEQ ID NO: 457020 - DNA, 25 bp, Mus musculus
gacgactgcctcctggagaagctga

SEQ ID NO: 457021 - DNA, 25 bp, Mus musculus
gacgactgcctcgtggagaagctga

SEQ ID NO: 457022 - DNA, 25 bp, Mus musculus
gacgactgtatgatctatgtaaata

SEQ ID NO: 457023 - DNA, 25 bp, Mus musculus
gacgactgtatgttctatgtaaata

SEQ ID NO: 457024 - DNA, 25 bp, Mus musculus
gacgactgtgatcatcaaccaccga

SEQ ID NO: 457025 - DNA, 25 bp, Mus musculus
gacgactgtgatgatcaaccaccga

SEQ ID NO: 457026 - DNA, 25 bp, Mus musculus
gacgacttagagaagggcataggac

SEQ ID NO: 457027 - DNA, 25 bp, Mus musculus
gacgacttagagtagggcataggac

SEQ ID NO: 457028 - DNA, 25 bp, Mus musculus
gacgacttccttaaggtctcttatt

SEQ ID NO: 457029 - DNA, 25 bp, Mus musculus
gacgacttcctttaggtctcttatt

SEQ ID NO: 457030 - DNA, 25 bp, Mus musculus
gacgacttctgcaaagtacacctct

SEQ ID NO: 457031 - DNA, 25 bp, Mus musculus
gacgacttctgctaagtacacctct

SEQ ID NO: 457032 - DNA, 25 bp, Mus musculus
gacgactttagtcttcaccagctga

SEQ ID NO: 457033 - DNA, 25 bp, Mus musculus
gacgactttagtgttcaccagctga

SEQ ID NO: 457034 - DNA, 25 bp, Mus musculus
gacgactttgcactccaggtgtaag

SEQ ID NO: 457035 - DNA, 25 bp, Mus musculus
gacgactttgcagtccaggtgtaag

SEQ ID NO: 457036 - DNA, 25 bp, Mus musculus
gacgagaaaatcactcagctgctga

SEQ ID NO: 457037 - DNA, 25 bp, Mus musculus
gacgagaaaatctctcagctgctga

SEQ ID NO: 457038 - DNA, 25 bp, Mus musculus
gacgagaaaccaataaaaccctcat

SEQ ID NO: 457039 - DNA, 25 bp, Mus musculus
gacgagaaaccattaaaaccctcat

SEQ ID NO: 457040 - DNA, 25 bp, Mus musculus
gacgagaagggcattcaccactctg

SEQ ID NO: 457041 - DNA, 25 bp, Mus musculus
gacgagaagggctttcaccactctg

SEQ ID NO: 457042 - DNA, 25 bp, Mus musculus
gacgagacccaaatgatccgcgtcc

SEQ ID NO: 457043 - DNA, 25 bp, Mus musculus
gacgagacccaattgatccgcgtcc

SEQ ID NO: 457044 - DNA, 25 bp, Mus musculus
gacgagactggtatcttcatttgta

SEQ ID NO: 457045 - DNA, 25 bp, Mus musculus
gacgagactggtttcttcatttgta

SEQ ID NO: 457046 - DNA, 25 bp, Mus musculus
gacgagagtgtcagtcatctgaaag

SEQ ID NO: 457047 - DNA, 25 bp, Mus musculus
gacgagagtgtctgtcatctgaaag

SEQ ID NO: 457048 - DNA, 25 bp, Mus musculus
gacgagatacatcaactctgccttg

SEQ ID NO: 457049 - DNA, 25 bp, Mus musculus
gacgagatacatgaactctgccttg

SEQ ID NO: 457050 - DNA, 25 bp, Mus musculus
gacgagatatttctacctctttcct

SEQ ID NO: 457051 - DNA, 25 bp, Mus musculus
gacgagatatttgtacctctttcct

SEQ ID NO: 457052 - DNA, 25 bp, Mus musculus
gacgagatcatcattcagggagact

SEQ ID NO: 457053 - DNA, 25 bp, Mus musculus
gacgagatcatctttcagggagact

SEQ ID NO: 457054 - DNA, 25 bp, Mus musculus
gacgagatcctactcatttctacat

SEQ ID NO: 457055 - DNA, 25 bp, Mus musculus
gacgagatcctagtcatttctacat

SEQ ID NO: 457056 - DNA, 25 bp, Mus musculus
gacgagatcggcagtgtcattgata

SEQ ID NO: 457057 - DNA, 25 bp, Mus musculus
gacgagatcggctgtgtcattgata

SEQ ID NO: 457058 - DNA, 25 bp, Mus musculus
gacgagatctgcaagctctgtgctg

SEQ ID NO: 457059 - DNA, 25 bp, Mus musculus
gacgagatctgctagctctgtgctg

SEQ ID NO: 457060 - DNA, 25 bp, Mus musculus
gacgagatggccaaggacagcattt

SEQ ID NO: 457061 - DNA, 25 bp, Mus musculus
gacgagatggcctaggacagcattt

SEQ ID NO: 457062 - DNA, 25 bp, Mus musculus
gacgagattctgagcatgccgcgtg

SEQ ID NO: 457063 - DNA, 25 bp, Mus musculus
gacgagattctgtgcatgccgcgtg

SEQ ID NO: 457064 - DNA, 25 bp, Mus musculus
gacgagcaacttcgatgtttgcact

SEQ ID NO: 457065 - DNA, 25 bp, Mus musculus
gacgagcaacttggatgtttgcact

SEQ ID NO: 457066 - DNA, 25 bp, Mus musculus
gacgagcactagaggaaagcagtag

SEQ ID NO: 457067 - DNA, 25 bp, Mus musculus
gacgagcactagtggaaagcagtag

SEQ ID NO: 457068 - DNA, 25 bp, Mus musculus
gacgagccaaaacagctgcgctaca

SEQ ID NO: 457069 - DNA, 25 bp, Mus musculus
gacgagccaaaagagctgcgctaca

SEQ ID NO: 457070 - DNA, 25 bp, Mus musculus
gacgagccagagaaggcggtctcca

SEQ ID NO: 457071 - DNA, 25 bp, Mus musculus
gacgagccagagtaggcggtctcca

SEQ ID NO: 457072 - DNA, 25 bp, Mus musculus
gacgagccatctcacgacatgtttc

SEQ ID NO: 457073 - DNA, 25 bp, Mus musculus
gacgagccatctgacgacatgtttc

SEQ ID NO: 457074 - DNA, 25 bp, Mus musculus
gacgagcccatcagacgacagtttc

SEQ ID NO: 457075 - DNA, 25 bp, Mus musculus
gacgagcccatctgacgacagtttc

SEQ ID NO: 457076 - DNA, 25 bp, Mus musculus
gacgagccccatcatagcttatcta

SEQ ID NO: 457077 - DNA, 25 bp, Mus musculus
gacgagccccatgatagcttatcta

SEQ ID NO: 457078 - DNA, 25 bp, Mus musculus
gacgagccgcatcctggccgcttag

SEQ ID NO: 457079 - DNA, 25 bp, Mus musculus
gacgagccgcatgctggccgcttag

SEQ ID NO: 457080 - DNA, 25 bp, Mus musculus
gacgagcgcaagcgccacgccaaga

SEQ ID NO: 457081 - DNA, 25 bp, Mus musculus
gacgagcgcaagggccacgccaaga

SEQ ID NO: 457082 - DNA, 25 bp, Mus musculus
gacgagctaaagaagaaatacggaa

SEQ ID NO: 457083 - DNA, 25 bp, Mus musculus
gacgagctaaagtagaaatacggaa

SEQ ID NO: 457084 - DNA, 25 bp, Mus musculus
gacgagctctaactggaaggacctt

SEQ ID NO: 457085 - DNA, 25 bp, Mus musculus
gacgagctctaagtggaaggacctt

SEQ ID NO: 457086 - DNA, 25 bp, Mus musculus
gacgagctggaccacgccctcaatg

SEQ ID NO: 457087 - DNA, 25 bp, Mus musculus
gacgagctggacgacgccctcaatg

SEQ ID NO: 457088 - DNA, 25 bp, Mus musculus
gacgaggaagcccacattgtcattg

SEQ ID NO: 457089 - DNA, 25 bp, Mus musculus
gacgaggaagccgacattgtcattg

SEQ ID NO: 457090 - DNA, 25 bp, Mus musculus
gacgaggaataacctctccagcaga

SEQ ID NO: 457091 - DNA, 25 bp, Mus musculus
gacgaggaataagctctccagcaga

SEQ ID NO: 457092 - DNA, 25 bp, Mus musculus
gacgaggaatgcagccatcctatct

SEQ ID NO: 457093 - DNA, 25 bp, Mus musculus
gacgaggaatgctgccatcctatct

SEQ ID NO: 457094 - DNA, 25 bp, Mus musculus
gacgaggacacgctgactggtttcc

SEQ ID NO: 457095 - DNA, 25 bp, Mus musculus
gacgaggacacggtgactggtttcc

SEQ ID NO: 457096 - DNA, 25 bp, Mus musculus
gacgaggacagcattaacaactccc

SEQ ID NO: 457097 - DNA, 25 bp, Mus musculus
gacgaggacagctttaacaactccc

SEQ ID NO: 457098 - DNA, 25 bp, Mus musculus
gacgaggacgacaccagcattggga

SEQ ID NO: 457099 - DNA, 25 bp, Mus musculus
gacgaggacgactccagcattggga

SEQ ID NO: 457100 - DNA, 25 bp, Mus musculus
gacgaggacgctatggctcaagcac

SEQ ID NO: 457101 - DNA, 25 bp, Mus musculus
gacgaggacgctttggctcaagcac

SEQ ID NO: 457102 - DNA, 25 bp, Mus musculus
gacgaggagatgattgggcccattc

SEQ ID NO: 457103 - DNA, 25 bp, Mus musculus
gacgaggagatgtttgggcccattc

SEQ ID NO: 457104 - DNA, 25 bp, Mus musculus
gacgaggatttaaccgaagcagaga

SEQ ID NO: 457105 - DNA, 25 bp, Mus musculus
gacgaggatttatccgaagcagaga

SEQ ID NO: 457106 - DNA, 25 bp, Mus musculus
gacgaggcaggcattggacatgtaa

SEQ ID NO: 457107 - DNA, 25 bp, Mus musculus
gacgaggcaggctttggacatgtaa

SEQ ID NO: 457108 - DNA, 25 bp, Mus musculus
gacgaggccatgatcatagacgaga

SEQ ID NO: 457109 - DNA, 25 bp, Mus musculus
gacgaggccatgttcatagacgaga

SEQ ID NO: 457110 - DNA, 25 bp, Mus musculus
gacgaggccggcactgctgtctcca

SEQ ID NO: 457111 - DNA, 25 bp, Mus musculus
gacgaggccggctctgctgtctcca

SEQ ID NO: 457112 - DNA, 25 bp, Mus musculus
gacgagggactcatgttaacacccc

SEQ ID NO: 457113 - DNA, 25 bp, Mus musculus
gacgagggactcttgttaacacccc

SEQ ID NO: 457114 - DNA, 25 bp, Mus musculus
gacgagggagcacagcgggcgaccg

SEQ ID NO: 457115 - DNA, 25 bp, Mus musculus
gacgagggagcagagcgggcgaccg

SEQ ID NO: 457116 - DNA, 25 bp, Mus musculus
gacgagggatccaacgaccctctta

SEQ ID NO: 457117 - DNA, 25 bp, Mus musculus
gacgagggatcctacgaccctctta

SEQ ID NO: 457118 - DNA, 25 bp, Mus musculus
gacgagggattgatcctggcctcta

SEQ ID NO: 457119 - DNA, 25 bp, Mus musculus
gacgagggattgttcctggcctcta

SEQ ID NO: 457120 - DNA, 25 bp, Mus musculus
gacgagggcctgctatttggatttc

SEQ ID NO: 457121 - DNA, 25 bp, Mus musculus
gacgagggcctggtatttggatttc

SEQ ID NO: 457122 - DNA, 25 bp, Mus musculus
gacgagggcggcaccaactcaggca

SEQ ID NO: 457123 - DNA, 25 bp, Mus musculus
gacgagggcggctccaactcaggca

SEQ ID NO: 457124 - DNA, 25 bp, Mus musculus
gacgagggtatgaccgtgaccatgt

SEQ ID NO: 457125 - DNA, 25 bp, Mus musculus
gacgagggtatgtccgtgaccatgt

SEQ ID NO: 457126 - DNA, 25 bp, Mus musculus
gacgagggtcccaaaagcctctgaa

SEQ ID NO: 457127 - DNA, 25 bp, Mus musculus
gacgagggtccctaaagcctctgaa

SEQ ID NO: 457128 - DNA, 25 bp, Mus musculus
gacgagggtgaaattgccgccttcc

SEQ ID NO: 457129 - DNA, 25 bp, Mus musculus
gacgagggtgaatttgccgccttcc

SEQ ID NO: 457130 - DNA, 25 bp, Mus musculus
gacgaggtaagtcctcatctctcag

SEQ ID NO: 457131 - DNA, 25 bp, Mus musculus
gacgaggtaagtgctcatctctcag

SEQ ID NO: 457132 - DNA, 25 bp, Mus musculus
gacgaggtcaacagagagccatcta

SEQ ID NO: 457133 - DNA, 25 bp, Mus musculus
gacgaggtcaactgagagccatcta

SEQ ID NO: 457134 - DNA, 25 bp, Mus musculus
gacgaggtcagcattccaaaaccac

SEQ ID NO: 457135 - DNA, 25 bp, Mus musculus
gacgaggtcagctttccaaaaccac

SEQ ID NO: 457136 - DNA, 25 bp, Mus musculus
gacgaggtctagaaagctggtgcaa

SEQ ID NO: 457137 - DNA, 25 bp, Mus musculus
gacgaggtctagtaagctggtgcaa

SEQ ID NO: 457138 - DNA, 25 bp, Mus musculus
gacgagtaactgatccaagcttaat

SEQ ID NO: 457139 - DNA, 25 bp, Mus musculus
gacgagtaactgttccaagcttaat

SEQ ID NO: 457140 - DNA, 25 bp, Mus musculus
gacgagtacaaaccatctttcaaca

SEQ ID NO: 457141 - DNA, 25 bp, Mus musculus
gacgagtacaaagcatctttcaaca

SEQ ID NO: 457142 - DNA, 25 bp, Mus musculus
gacgagtatgatcccactatagagg

SEQ ID NO: 457143 - DNA, 25 bp, Mus musculus
gacgagtatgatgccactatagagg

SEQ ID NO: 457144 - DNA, 25 bp, Mus musculus
gacgagtatgctattctcaaataag

SEQ ID NO: 457145 - DNA, 25 bp, Mus musculus
gacgagtatgcttttctcaaataag

SEQ ID NO: 457146 - DNA, 25 bp, Mus musculus
gacgagtcatgcacgcaggacactt

SEQ ID NO: 457147 - DNA, 25 bp, Mus musculus
gacgagtcatgctcgcaggacactt

SEQ ID NO: 457148 - DNA, 25 bp, Mus musculus
gacgagtcccaacccaactggatga

SEQ ID NO: 457149 - DNA, 25 bp, Mus musculus
gacgagtcccaagccaactggatga

SEQ ID NO: 457150 - DNA, 25 bp, Mus musculus
gacgagtcgtctacagggagtcaga

SEQ ID NO: 457151 - DNA, 25 bp, Mus musculus
gacgagtcgtcttcagggagtcaga

SEQ ID NO: 457152 - DNA, 25 bp, Mus musculus
gacgagtctcttaaaagtttctcct

SEQ ID NO: 457153 - DNA, 25 bp, Mus musculus
gacgagtctctttaaagtttctcct

SEQ ID NO: 457154 - DNA, 25 bp, Mus musculus
gacgagtctgttctgttctgattcc

SEQ ID NO: 457155 - DNA, 25 bp, Mus musculus
gacgagtctgttgtgttctgattcc

SEQ ID NO: 457156 - DNA, 25 bp, Mus musculus
gacgagtgaatgctctcaagaatct

SEQ ID NO: 457157 - DNA, 25 bp, Mus musculus
gacgagtgaatggtctcaagaatct

SEQ ID NO: 457158 - DNA, 25 bp, Mus musculus
gacgagtgacctagaggtacccttt

SEQ ID NO: 457159 - DNA, 25 bp, Mus musculus
gacgagtgaccttgaggtacccttt

SEQ ID NO: 457160 - DNA, 25 bp, Mus musculus
gacgagtgccaaatccagtgtgaat

SEQ ID NO: 457161 - DNA, 25 bp, Mus musculus
gacgagtgccaattccagtgtgaat

SEQ ID NO: 457162 - DNA, 25 bp, Mus musculus
gacgagtggacgaatgcccacacat

SEQ ID NO: 457163 - DNA, 25 bp, Mus musculus
gacgagtggacgtatgcccacacat

SEQ ID NO: 457164 - DNA, 25 bp, Mus musculus
gacgagtgtactaattggtccctta

SEQ ID NO: 457165 - DNA, 25 bp, Mus musculus
gacgagtgtacttattggtccctta

SEQ ID NO: 457166 - DNA, 25 bp, Mus musculus
gacgagttataacacatgcgtgtat

SEQ ID NO: 457167 - DNA, 25 bp, Mus musculus
gacgagttataagacatgcgtgtat

SEQ ID NO: 457168 - DNA, 25 bp, Mus musculus
gacgagttataccattttgagagca

SEQ ID NO: 457169 - DNA, 25 bp, Mus musculus
gacgagttatacgattttgagagca

SEQ ID NO: 457170 - DNA, 25 bp, Mus musculus
gacgagttcagtctggccctggtca

SEQ ID NO: 457171 - DNA, 25 bp, Mus musculus
gacgagttcagtgtggccctggtca

SEQ ID NO: 457172 - DNA, 25 bp, Mus musculus
gacgagttcgagcagtttcccgcgg

SEQ ID NO: 457173 - DNA, 25 bp, Mus musculus
gacgagttcgaggagtttcccgcgg

SEQ ID NO: 457174 - DNA, 25 bp, Mus musculus
gacgagttgcaaccatgtctgtgta

SEQ ID NO: 457175 - DNA, 25 bp, Mus musculus
gacgagttgcaagcatgtctgtgta

SEQ ID NO: 457176 - DNA, 25 bp, Mus musculus
gacgataatcagcacaccgctgcag

SEQ ID NO: 457177 - DNA, 25 bp, Mus musculus
gacgataatcaggacaccgctgcag

SEQ ID NO: 457178 - DNA, 25 bp, Mus musculus
gacgataccatcctctgtagacaga

SEQ ID NO: 457179 - DNA, 25 bp, Mus musculus
gacgataccatcgtctgtagacaga

SEQ ID NO: 457180 - DNA, 25 bp, Mus musculus
gacgatagaactcgcaagggactga

SEQ ID NO: 457181 - DNA, 25 bp, Mus musculus
gacgatagaactggcaagggactga

SEQ ID NO: 457182 - DNA, 25 bp, Mus musculus
gacgataggactcgatttctttttg

SEQ ID NO: 457183 - DNA, 25 bp, Mus musculus
gacgataggactggatttctttttg

SEQ ID NO: 457184 - DNA, 25 bp, Mus musculus
gacgatcaaatcactggcagacatt

SEQ ID NO: 457185 - DNA, 25 bp, Mus musculus
gacgatcaaatctctggcagacatt

SEQ ID NO: 457186 - DNA, 25 bp, Mus musculus
gacgatcaaggcctggttatccacc

SEQ ID NO: 457187 - DNA, 25 bp, Mus musculus
gacgatcaaggcgtggttatccacc

SEQ ID NO: 457188 - DNA, 25 bp, Mus musculus
gacgatcacgatcatttacttacaa

SEQ ID NO: 457189 - DNA, 25 bp, Mus musculus
gacgatcacgatgatttacttacaa

SEQ ID NO: 457190 - DNA, 25 bp, Mus musculus
gacgatcagactatggcggtggcca

SEQ ID NO: 457191 - DNA, 25 bp, Mus musculus
gacgatcagactttggcggtggcca

SEQ ID NO: 457192 - DNA, 25 bp, Mus musculus
gacgatcaggacatggtggaagctt

SEQ ID NO: 457193 - DNA, 25 bp, Mus musculus
gacgatcaggacttggtggaagctt

SEQ ID NO: 457194 - DNA, 25 bp, Mus musculus
gacgatcatacacgaattcctttat

SEQ ID NO: 457195 - DNA, 25 bp, Mus musculus
gacgatcatacaggaattcctttat

SEQ ID NO: 457196 - DNA, 25 bp, Mus musculus
gacgatcatcttcggcagtgagagc

SEQ ID NO: 457197 - DNA, 25 bp, Mus musculus
gacgatcatcttgggcagtgagagc

SEQ ID NO: 457198 - DNA, 25 bp, Mus musculus
gacgatcctatgatgctggagctcg

SEQ ID NO: 457199 - DNA, 25 bp, Mus musculus
gacgatcctatgttgctggagctcg

SEQ ID NO: 457200 - DNA, 25 bp, Mus musculus
gacgatcctggaatatcatcaaaaa

SEQ ID NO: 457201 - DNA, 25 bp, Mus musculus
gacgatcctggattatcatcaaaaa

SEQ ID NO: 457202 - DNA, 25 bp, Mus musculus
gacgatcctggcacgggccttcgaa

SEQ ID NO: 457203 - DNA, 25 bp, Mus musculus
gacgatcctggctcgggccttcgaa

SEQ ID NO: 457204 - DNA, 25 bp, Mus musculus
gacgatcgcatcatgtgtcgctgag

SEQ ID NO: 457205 - DNA, 25 bp, Mus musculus
gacgatcgcatcttgtgtcgctgag

SEQ ID NO: 457206 - DNA, 25 bp, Mus musculus
gacgatcttcagacgtgtggaacct

SEQ ID NO: 457207 - DNA, 25 bp, Mus musculus
gacgatcttcagtcgtgtggaacct

SEQ ID NO: 457208 - DNA, 25 bp, Mus musculus
gacgatctttttctagaagagccca

SEQ ID NO: 457209 - DNA, 25 bp, Mus musculus
gacgatctttttgtagaagagccca

SEQ ID NO: 457210 - DNA, 25 bp, Mus musculus
gacgatgaaaccaaccacgagatga

SEQ ID NO: 457211 - DNA, 25 bp, Mus musculus
gacgatgaaacctaccacgagatga

SEQ ID NO: 457212 - DNA, 25 bp, Mus musculus
gacgatgaacatagtccccaggaca

SEQ ID NO: 457213 - DNA, 25 bp, Mus musculus
gacgatgaacattgtccccaggaca

SEQ ID NO: 457214 - DNA, 25 bp, Mus musculus
gacgatgaagcacttgaccctaaat

SEQ ID NO: 457215 - DNA, 25 bp, Mus musculus
gacgatgaagcagttgaccctaaat

SEQ ID NO: 457216 - DNA, 25 bp, Mus musculus
gacgatgaagtgcaggcccccagat

SEQ ID NO: 457217 - DNA, 25 bp, Mus musculus
gacgatgaagtggaggcccccagat

SEQ ID NO: 457218 - DNA, 25 bp, Mus musculus
gacgatgacataaattttttggagg

SEQ ID NO: 457219 - DNA, 25 bp, Mus musculus
gacgatgacatatattttttggagg

SEQ ID NO: 457220 - DNA, 25 bp, Mus musculus
gacgatgacatgctgtttgccttat

SEQ ID NO: 457221 - DNA, 25 bp, Mus musculus
gacgatgacatggtgtttgccttat

SEQ ID NO: 457222 - DNA, 25 bp, Mus musculus
gacgatgacgaacgccccactaaga

SEQ ID NO: 457223 - DNA, 25 bp, Mus musculus
gacgatgacgaaggccccactaaga

SEQ ID NO: 457224 - DNA, 25 bp, Mus musculus
gacgatgacgatcgcgacccagcag

SEQ ID NO: 457225 - DNA, 25 bp, Mus musculus
gacgatgacgatggcgacccagcag

SEQ ID NO: 457226 - DNA, 25 bp, Mus musculus
gacgatgacgtacctctggaatgga

SEQ ID NO: 457227 - DNA, 25 bp, Mus musculus
gacgatgacgtagctctggaatgga

SEQ ID NO: 457228 - DNA, 25 bp, Mus musculus
gacgatgactgcagcttgggcaaca

SEQ ID NO: 457229 - DNA, 25 bp, Mus musculus
gacgatgactgctgcttgggcaaca

SEQ ID NO: 457230 - DNA, 25 bp, Mus musculus
gacgatgagggtcaggaatattaac

SEQ ID NO: 457231 - DNA, 25 bp, Mus musculus
gacgatgagggtgaggaatattaac

SEQ ID NO: 457232 - DNA, 25 bp, Mus musculus
gacgatgaggtcattgtgtctccag

SEQ ID NO: 457233 - DNA, 25 bp, Mus musculus
gacgatgaggtctttgtgtctccag

SEQ ID NO: 457234 - DNA, 25 bp, Mus musculus
gacgatgaggtgacccgcatcctag

SEQ ID NO: 457235 - DNA, 25 bp, Mus musculus
gacgatgaggtgtcccgcatcctag

SEQ ID NO: 457236 - DNA, 25 bp, Mus musculus
gacgatgatatcacgcatgttgaag

SEQ ID NO: 457237 - DNA, 25 bp, Mus musculus
gacgatgatatcctccctatatata

SEQ ID NO: 457238 - DNA, 25 bp, Mus musculus
gacgatgatatcgtccctatatata

SEQ ID NO: 457239 - DNA, 25 bp, Mus musculus
gacgatgatatctcgcatgttgaag

SEQ ID NO: 457240 - DNA, 25 bp, Mus musculus
gacgatgatcagaggcagcacccat

SEQ ID NO: 457241 - DNA, 25 bp, Mus musculus
gacgatgatcagtggcagcacccat

SEQ ID NO: 457242 - DNA, 25 bp, Mus musculus
gacgatgatcggctcaacaaggtca

SEQ ID NO: 457243 - DNA, 25 bp, Mus musculus
gacgatgatcgggtcaacaaggtca

SEQ ID NO: 457244 - DNA, 25 bp, Mus musculus
gacgatgatcttcttgtcagcacat

SEQ ID NO: 457245 - DNA, 25 bp, Mus musculus
gacgatgatcttgttgtcagcacat

SEQ ID NO: 457246 - DNA, 25 bp, Mus musculus
gacgatgatggcagagcacatgtct

SEQ ID NO: 457247 - DNA, 25 bp, Mus musculus
gacgatgatggctgagcacatgtct

SEQ ID NO: 457248 - DNA, 25 bp, Mus musculus
gacgatgccagtatcaacagctatt

SEQ ID NO: 457249 - DNA, 25 bp, Mus musculus
gacgatgccagtttcaacagctatt

SEQ ID NO: 457250 - DNA, 25 bp, Mus musculus
gacgatgccctgaaggttctcctca

SEQ ID NO: 457251 - DNA, 25 bp, Mus musculus
gacgatgccctgtaggttctcctca

SEQ ID NO: 457252 - DNA, 25 bp, Mus musculus
gacgatgcctttatctctttatgac

SEQ ID NO: 457253 - DNA, 25 bp, Mus musculus
gacgatgcctttttctctttatgac

SEQ ID NO: 457254 - DNA, 25 bp, Mus musculus
gacgatgcgctcattgccctgtgag

SEQ ID NO: 457255 - DNA, 25 bp, Mus musculus
gacgatgcgctctttgccctgtgag

SEQ ID NO: 457256 - DNA, 25 bp, Mus musculus
gacgatgctttaacagggcgccaaa

SEQ ID NO: 457257 - DNA, 25 bp, Mus musculus
gacgatgctttatcagggcgccaaa

SEQ ID NO: 457258 - DNA, 25 bp, Mus musculus
gacgatggaattaccacctgtcact

SEQ ID NO: 457259 - DNA, 25 bp, Mus musculus
gacgatggaatttccacctgtcact

SEQ ID NO: 457260 - DNA, 25 bp, Mus musculus
gacgatgggtttcaagacactacac

SEQ ID NO: 457261 - DNA, 25 bp, Mus musculus
gacgatgggtttgaagacactacac

SEQ ID NO: 457262 - DNA, 25 bp, Mus musculus
gacgatgtccagcaaagtttcttcc

SEQ ID NO: 457263 - DNA, 25 bp, Mus musculus
gacgatgtccaggaaagtttcttcc

SEQ ID NO: 457264 - DNA, 25 bp, Mus musculus
gacgatgtcccactaaggtgtttga

SEQ ID NO: 457265 - DNA, 25 bp, Mus musculus
gacgatgtcccagtaaggtgtttga

SEQ ID NO: 457266 - DNA, 25 bp, Mus musculus
gacgatgtcgctaaagagtttgtga

SEQ ID NO: 457267 - DNA, 25 bp, Mus musculus
gacgatgtcgcttaagagtttgtga

SEQ ID NO: 457268 - DNA, 25 bp, Mus musculus
gacgatgtcttaattccaaaccgga

SEQ ID NO: 457269 - DNA, 25 bp, Mus musculus
gacgatgtcttatttccaaaccgga

SEQ ID NO: 457270 - DNA, 25 bp, Mus musculus
gacgattaactactccctcaaaggg

SEQ ID NO: 457271 - DNA, 25 bp, Mus musculus
gacgattaactagtccctcaaaggg

SEQ ID NO: 457272 - DNA, 25 bp, Mus musculus
gacgattaagtgcttcccacacaca

SEQ ID NO: 457273 - DNA, 25 bp, Mus musculus
gacgattaagtggttcccacacaca

SEQ ID NO: 457274 - DNA, 25 bp, Mus musculus
gacgattatccacaaccctacagac

SEQ ID NO: 457275 - DNA, 25 bp, Mus musculus
gacgattatccagaaccctacagac

SEQ ID NO: 457276 - DNA, 25 bp, Mus musculus
gacgattccaacacctacgagaatg

SEQ ID NO: 457277 - DNA, 25 bp, Mus musculus
gacgattccaacagggtcatcatgg

SEQ ID NO: 457278 - DNA, 25 bp, Mus musculus
gacgattccaactcctacgagaatg

SEQ ID NO: 457279 - DNA, 25 bp, Mus musculus
gacgattccaactgggtcatcatgg

SEQ ID NO: 457280 - DNA, 25 bp, Mus musculus
gacgattcgcagagcattatcttca

SEQ ID NO: 457281 - DNA, 25 bp, Mus musculus
gacgattcgcagtgcattatcttca

SEQ ID NO: 457282 - DNA, 25 bp, Mus musculus
gacgattcggctatcagttatgtgt

SEQ ID NO: 457283 - DNA, 25 bp, Mus musculus
gacgattcggctttcagttatgtgt

SEQ ID NO: 457284 - DNA, 25 bp, Mus musculus
gacgattctcgtctgttgcttggaa

SEQ ID NO: 457285 - DNA, 25 bp, Mus musculus
gacgattctcgtgtgttgcttggaa

SEQ ID NO: 457286 - DNA, 25 bp, Mus musculus
gacgattctgaaatgtccagatgta

SEQ ID NO: 457287 - DNA, 25 bp, Mus musculus
gacgattctgaattgtccagatgta

SEQ ID NO: 457288 - DNA, 25 bp, Mus musculus
gacgattctgggataagaaaccttc

SEQ ID NO: 457289 - DNA, 25 bp, Mus musculus
gacgattctgggttaagaaaccttc

SEQ ID NO: 457290 - DNA, 25 bp, Mus musculus
gacgattgagctctgccctggacct

SEQ ID NO: 457291 - DNA, 25 bp, Mus musculus
gacgattgagctgtgccctggacct

SEQ ID NO: 457292 - DNA, 25 bp, Mus musculus
gacgattgctaactttaaggcctat

SEQ ID NO: 457293 - DNA, 25 bp, Mus musculus
gacgattgctaagtttaaggcctat

SEQ ID NO: 457294 - DNA, 25 bp, Mus musculus
gacgattggtcactggagcttctag

SEQ ID NO: 457295 - DNA, 25 bp, Mus musculus
gacgattggtcagtggagcttctag

SEQ ID NO: 457296 - DNA, 25 bp, Mus musculus
gacgatttaacccacaagtacctgt

SEQ ID NO: 457297 - DNA, 25 bp, Mus musculus
gacgatttaaccgacaagtacctgt

SEQ ID NO: 457298 - DNA, 25 bp, Mus musculus
gacgatttctggcacatccaatctg

SEQ ID NO: 457299 - DNA, 25 bp, Mus musculus
gacgatttctgggacatccaatctg

SEQ ID NO: 457300 - DNA, 25 bp, Mus musculus
gacgatttgtacattgattccatta

SEQ ID NO: 457301 - DNA, 25 bp, Mus musculus
gacgatttgtactttgattccatta

SEQ ID NO: 457302 - DNA, 25 bp, Mus musculus
gacgattttgccaacaagttcctga

SEQ ID NO: 457303 - DNA, 25 bp, Mus musculus
gacgattttgcctacaagttcctga

SEQ ID NO: 457304 - DNA, 25 bp, Mus musculus
gacgcaaaatgacggccctacgggt

SEQ ID NO: 457305 - DNA, 25 bp, Mus musculus
gacgcaaaatgagggccctacgggt

SEQ ID NO: 457306 - DNA, 25 bp, Mus musculus
gacgcaaacaggaggcttcatggct

SEQ ID NO: 457307 - DNA, 25 bp, Mus musculus
gacgcaaacaggtggcttcatggct

SEQ ID NO: 457308 - DNA, 25 bp, Mus musculus
gacgcaaatctcacatcttggtttc

SEQ ID NO: 457309 - DNA, 25 bp, Mus musculus
gacgcaaatctctcatcttggtttc

SEQ ID NO: 457310 - DNA, 25 bp, Mus musculus
gacgcaacaagtacagacagaagca

SEQ ID NO: 457311 - DNA, 25 bp, Mus musculus
gacgcaacaagttcagacagaagca

SEQ ID NO: 457312 - DNA, 25 bp, Mus musculus
gacgcaacctctatttgtcttcaga

SEQ ID NO: 457313 - DNA, 25 bp, Mus musculus
gacgcaacctctttttgtcttcaga

SEQ ID NO: 457314 - DNA, 25 bp, Mus musculus
gacgcaagagagaccactctgcctt

SEQ ID NO: 457315 - DNA, 25 bp, Mus musculus
gacgcaagagagtccactctgcctt

SEQ ID NO: 457316 - DNA, 25 bp, Mus musculus
gacgcaagcaccaacattactatgt

SEQ ID NO: 457317 - DNA, 25 bp, Mus musculus
gacgcaagcacctacattactatgt

SEQ ID NO: 457318 - DNA, 25 bp, Mus musculus
gacgcaaggaatctcaccaatccaa

SEQ ID NO: 457319 - DNA, 25 bp, Mus musculus
gacgcaaggaatgtcaccaatccaa

SEQ ID NO: 457320 - DNA, 25 bp, Mus musculus
gacgcaataattcgagggcaaactt

SEQ ID NO: 457321 - DNA, 25 bp, Mus musculus
gacgcaataattggagggcaaactt

SEQ ID NO: 457322 - DNA, 25 bp, Mus musculus
gacgcaatagccaccacatgcagtg

SEQ ID NO: 457323 - DNA, 25 bp, Mus musculus
gacgcaatagcctccacatgcagtg

SEQ ID NO: 457324 - DNA, 25 bp, Mus musculus
gacgcaatgatgcttctatgtcccc

SEQ ID NO: 457325 - DNA, 25 bp, Mus musculus
gacgcaatgatggttctatgtcccc

SEQ ID NO: 457326 - DNA, 25 bp, Mus musculus
gacgcaatgtttctcaagcctttct

SEQ ID NO: 457327 - DNA, 25 bp, Mus musculus
gacgcaatgtttgtcaagcctttct

SEQ ID NO: 457328 - DNA, 25 bp, Mus musculus
gacgcaattgatatattcacctcta

SEQ ID NO: 457329 - DNA, 25 bp, Mus musculus
gacgcaattgatttattcacctcta

SEQ ID NO: 457330 - DNA, 25 bp, Mus musculus
gacgcacaggacatttagacctcat

SEQ ID NO: 457331 - DNA, 25 bp, Mus musculus
gacgcacaggacttttagacctcat

SEQ ID NO: 457332 - DNA, 25 bp, Mus musculus
gacgcaccactaagtcaagcagcag

SEQ ID NO: 457333 - DNA, 25 bp, Mus musculus
gacgcaccactatgtcaagcagcag

SEQ ID NO: 457334 - DNA, 25 bp, Mus musculus
gacgcaccacttcttgtcgagaaat

SEQ ID NO: 457335 - DNA, 25 bp, Mus musculus
gacgcaccacttgttgtcgagaaat

SEQ ID NO: 457336 - DNA, 25 bp, Mus musculus
gacgcacctgctcgagaatctcaaa

SEQ ID NO: 457337 - DNA, 25 bp, Mus musculus
gacgcacctgctggagaatctcaaa

SEQ ID NO: 457338 - DNA, 25 bp, Mus musculus
gacgcacgcatgagaagggccgcca

SEQ ID NO: 457339 - DNA, 25 bp, Mus musculus
gacgcacgcatgtgaagggccgcca

SEQ ID NO: 457340 - DNA, 25 bp, Mus musculus
gacgcactccatctttttgactgga

SEQ ID NO: 457341 - DNA, 25 bp, Mus musculus
gacgcactccatgtttttgactgga

SEQ ID NO: 457342 - DNA, 25 bp, Mus musculus
gacgcactgaggacagctttgaaca

SEQ ID NO: 457343 - DNA, 25 bp, Mus musculus
gacgcactgaggtcagctttgaaca

SEQ ID NO: 457344 - DNA, 25 bp, Mus musculus
gacgcactggtgactgtgtacttcg

SEQ ID NO: 457345 - DNA, 25 bp, Mus musculus
gacgcactggtgtctgtgtacttcg

SEQ ID NO: 457346 - DNA, 25 bp, Mus musculus
gacgcacttagacagacttccggag

SEQ ID NO: 457347 - DNA, 25 bp, Mus musculus
gacgcacttagagagacttccggag

SEQ ID NO: 457348 - DNA, 25 bp, Mus musculus
gacgcacttgtcatcattgcaatga

SEQ ID NO: 457349 - DNA, 25 bp, Mus musculus
gacgcacttgtcttcattgcaatga

SEQ ID NO: 457350 - DNA, 25 bp, Mus musculus
gacgcagaccgcaggagctcaagga

SEQ ID NO: 457351 - DNA, 25 bp, Mus musculus
gacgcagaccgctggagctcaagga

SEQ ID NO: 457352 - DNA, 25 bp, Mus musculus
gacgcagactaacacgtggttcatt

SEQ ID NO: 457353 - DNA, 25 bp, Mus musculus
gacgcagactaagacgtggttcatt

SEQ ID NO: 457354 - DNA, 25 bp, Mus musculus
gacgcagaggttagggctttctacg

SEQ ID NO: 457355 - DNA, 25 bp, Mus musculus
gacgcagaggtttgggctttctacg

SEQ ID NO: 457356 - DNA, 25 bp, Mus musculus
gacgcagataaaatgactctgagac

SEQ ID NO: 457357 - DNA, 25 bp, Mus musculus
gacgcagataaattgactctgagac

SEQ ID NO: 457358 - DNA, 25 bp, Mus musculus
gacgcagcagaaattaccagctgga

SEQ ID NO: 457359 - DNA, 25 bp, Mus musculus
gacgcagcagaatttaccagctgga

SEQ ID NO: 457360 - DNA, 25 bp, Mus musculus
gacgcagccctcaatggtgtctaat

SEQ ID NO: 457361 - DNA, 25 bp, Mus musculus
gacgcagccctctatggtgtctaat

SEQ ID NO: 457362 - DNA, 25 bp, Mus musculus
gacgcagcgcagatacacagagaaa

SEQ ID NO: 457363 - DNA, 25 bp, Mus musculus
gacgcagcgcagttacacagagaaa

SEQ ID NO: 457364 - DNA, 25 bp, Mus musculus
gacgcagctctgcatcatgatcagg

SEQ ID NO: 457365 - DNA, 25 bp, Mus musculus
gacgcagctctggatcatgatcagg

SEQ ID NO: 457366 - DNA, 25 bp, Mus musculus
gacgcagcttccagatgactcgaat

SEQ ID NO: 457367 - DNA, 25 bp, Mus musculus
gacgcagcttcctgatgactcgaat

SEQ ID NO: 457368 - DNA, 25 bp, Mus musculus
gacgcaggaactccagaagacacag

SEQ ID NO: 457369 - DNA, 25 bp, Mus musculus
gacgcaggaactgcagaagacacag

SEQ ID NO: 457370 - DNA, 25 bp, Mus musculus
gacgcaggtactatctgagcttgat

SEQ ID NO: 457371 - DNA, 25 bp, Mus musculus
gacgcaggtactttctgagcttgat

SEQ ID NO: 457372 - DNA, 25 bp, Mus musculus
gacgcaggtgccagcactgcaggaa

SEQ ID NO: 457373 - DNA, 25 bp, Mus musculus
gacgcaggtgcctgcactgcaggaa

SEQ ID NO: 457374 - DNA, 25 bp, Mus musculus
gacgcagtaagactgttctagtttc

SEQ ID NO: 457375 - DNA, 25 bp, Mus musculus
gacgcagtaagagtgttctagtttc

SEQ ID NO: 457376 - DNA, 25 bp, Mus musculus
gacgcagtccatatacgacgacaag

SEQ ID NO: 457377 - DNA, 25 bp, Mus musculus
gacgcagtccatttacgacgacaag

SEQ ID NO: 457378 - DNA, 25 bp, Mus musculus
gacgcagtctgcattttcaggtgta

SEQ ID NO: 457379 - DNA, 25 bp, Mus musculus
gacgcagtctgctttttcaggtgta

SEQ ID NO: 457380 - DNA, 25 bp, Mus musculus
gacgcagtgtccatagggatgccct

SEQ ID NO: 457381 - DNA, 25 bp, Mus musculus
gacgcagtgtccttagggatgccct

SEQ ID NO: 457382 - DNA, 25 bp, Mus musculus
gacgcagttgacctccaggagtcca

SEQ ID NO: 457383 - DNA, 25 bp, Mus musculus
gacgcagttgacgtccaggagtcca

SEQ ID NO: 457384 - DNA, 25 bp, Mus musculus
gacgcatacctacagtatcatcatt

SEQ ID NO: 457385 - DNA, 25 bp, Mus musculus
gacgcatacctagagtatcatcatt

SEQ ID NO: 457386 - DNA, 25 bp, Mus musculus
gacgcatactttctgtcaaccaatg

SEQ ID NO: 457387 - DNA, 25 bp, Mus musculus
gacgcatactttgtgtcaaccaatg

SEQ ID NO: 457388 - DNA, 25 bp, Mus musculus
gacgcatatttacaccaggagccca

SEQ ID NO: 457389 - DNA, 25 bp, Mus musculus
gacgcatatttagaccaggagccca

SEQ ID NO: 457390 - DNA, 25 bp, Mus musculus
gacgcatccgccaggtggattttaa

SEQ ID NO: 457391 - DNA, 25 bp, Mus musculus
gacgcatccgcctggtggattttaa

SEQ ID NO: 457392 - DNA, 25 bp, Mus musculus
gacgcatcgcgtctggatcttcgaa

SEQ ID NO: 457393 - DNA, 25 bp, Mus musculus
gacgcatcgcgtgtggatcttcgaa

SEQ ID NO: 457394 - DNA, 25 bp, Mus musculus
gacgcatctaccatcagagacaatg

SEQ ID NO: 457395 - DNA, 25 bp, Mus musculus
gacgcatctaccttcagagacaatg

SEQ ID NO: 457396 - DNA, 25 bp, Mus musculus
gacgcatgatgtcggttctgtgttt

SEQ ID NO: 457397 - DNA, 25 bp, Mus musculus
gacgcatgatgtgggttctgtgttt

SEQ ID NO: 457398 - DNA, 25 bp, Mus musculus
gacgcatgcttgagttaggctcatt

SEQ ID NO: 457399 - DNA, 25 bp, Mus musculus
gacgcatgcttgtgttaggctcatt

SEQ ID NO: 457400 - DNA, 25 bp, Mus musculus
gacgcatgctttaccttcatgtaga

SEQ ID NO: 457401 - DNA, 25 bp, Mus musculus
gacgcatgcttttccttcatgtaga

SEQ ID NO: 457402 - DNA, 25 bp, Mus musculus
gacgcattatgacttcgacaaccct

SEQ ID NO: 457403 - DNA, 25 bp, Mus musculus
gacgcattatgagttcgacaaccct

SEQ ID NO: 457404 - DNA, 25 bp, Mus musculus
gacgcattattgacacttctctgac

SEQ ID NO: 457405 - DNA, 25 bp, Mus musculus
gacgcattattgtcacttctctgac

SEQ ID NO: 457406 - DNA, 25 bp, Mus musculus
gacgcattgcctatggaggtcacca

SEQ ID NO: 457407 - DNA, 25 bp, Mus musculus
gacgcattgcctttggaggtcacca

SEQ ID NO: 457408 - DNA, 25 bp, Mus musculus
gacgccaaaaataatcatgaacatt

SEQ ID NO: 457409 - DNA, 25 bp, Mus musculus
gacgccaaaaattatcatgaacatt

SEQ ID NO: 457410 - DNA, 25 bp, Mus musculus
gacgccaacgtcaaaaacttttgag

SEQ ID NO: 457411 - DNA, 25 bp, Mus musculus
gacgccaacgtctaaaacttttgag

SEQ ID NO: 457412 - DNA, 25 bp, Mus musculus
gacgccaactgcagtgggacacaca

SEQ ID NO: 457413 - DNA, 25 bp, Mus musculus
gacgccaactgctgtgggacacaca

SEQ ID NO: 457414 - DNA, 25 bp, Mus musculus
gacgccaagcagaggtgtcaccctg

SEQ ID NO: 457415 - DNA, 25 bp, Mus musculus
gacgccaagcagtggtgtcaccctg

SEQ ID NO: 457416 - DNA, 25 bp, Mus musculus
gacgccaaggcacattttgggcaag

SEQ ID NO: 457417 - DNA, 25 bp, Mus musculus
gacgccaaggcagattttgggcaag

SEQ ID NO: 457418 - DNA, 25 bp, Mus musculus
gacgccacatgaacatccattcagg

SEQ ID NO: 457419 - DNA, 25 bp, Mus musculus
gacgccacatgatcatccattcagg

SEQ ID NO: 457420 - DNA, 25 bp, Mus musculus
gacgccacggagaacaagctatgat

SEQ ID NO: 457421 - DNA, 25 bp, Mus musculus
gacgccacggagtacaagctatgat

SEQ ID NO: 457422 - DNA, 25 bp, Mus musculus
gacgccagacgtacatgttcgaaag

SEQ ID NO: 457423 - DNA, 25 bp, Mus musculus
gacgccagacgttcatgttcgaaag

SEQ ID NO: 457424 - DNA, 25 bp, Mus musculus
gacgccagattgctgggccagactc

SEQ ID NO: 457425 - DNA, 25 bp, Mus musculus
gacgccagattggtgggccagactc

SEQ ID NO: 457426 - DNA, 25 bp, Mus musculus
gacgccagcagactcactttgacag

SEQ ID NO: 457427 - DNA, 25 bp, Mus musculus
gacgccagcagagtcactttgacag

SEQ ID NO: 457428 - DNA, 25 bp, Mus musculus
gacgccagcgccatgctgaagcagt

SEQ ID NO: 457429 - DNA, 25 bp, Mus musculus
gacgccagcgccttgctgaagcagt

SEQ ID NO: 457430 - DNA, 25 bp, Mus musculus
gacgccagtaaccagatttctgtct

SEQ ID NO: 457431 - DNA, 25 bp, Mus musculus
gacgccagtaacgagatttctgtct

SEQ ID NO: 457432 - DNA, 25 bp, Mus musculus
gacgccagtcctacagagctaagaa

SEQ ID NO: 457433 - DNA, 25 bp, Mus musculus
gacgccagtccttcagagctaagaa

SEQ ID NO: 457434 - DNA, 25 bp, Mus musculus
gacgccagtctccaaagcaacggaa

SEQ ID NO: 457435 - DNA, 25 bp, Mus musculus
gacgccagtctcgaaagcaacggaa

SEQ ID NO: 457436 - DNA, 25 bp, Mus musculus
gacgccagtggtctgactgacttca

SEQ ID NO: 457437 - DNA, 25 bp, Mus musculus
gacgccagtggtgtgactgacttca

SEQ ID NO: 457438 - DNA, 25 bp, Mus musculus
gacgccatagtgaagctccagcttg

SEQ ID NO: 457439 - DNA, 25 bp, Mus musculus
gacgccatagtgtagctccagcttg

SEQ ID NO: 457440 - DNA, 25 bp, Mus musculus
gacgccatatacatctctaaaagag

SEQ ID NO: 457441 - DNA, 25 bp, Mus musculus
gacgccatatacttctctaaaagag

SEQ ID NO: 457442 - DNA, 25 bp, Mus musculus
gacgccatattcagcagatctgcaa

SEQ ID NO: 457443 - DNA, 25 bp, Mus musculus
gacgccatattctgcagatctgcaa

SEQ ID NO: 457444 - DNA, 25 bp, Mus musculus
gacgccatcacaatttcccaaagtg

SEQ ID NO: 457445 - DNA, 25 bp, Mus musculus
gacgccatcacattttcccaaagtg

SEQ ID NO: 457446 - DNA, 25 bp, Mus musculus
gacgccatcctcagatatgttcgta

SEQ ID NO: 457447 - DNA, 25 bp, Mus musculus
gacgccatcctctgatatgttcgta

SEQ ID NO: 457448 - DNA, 25 bp, Mus musculus
gacgccatctctattaggtacctgt

SEQ ID NO: 457449 - DNA, 25 bp, Mus musculus
gacgccatctcttttaggtacctgt

SEQ ID NO: 457450 - DNA, 25 bp, Mus musculus
gacgccatgagtccctcgttcgaag

SEQ ID NO: 457451 - DNA, 25 bp, Mus musculus
gacgccatgagtgcctcgttcgaag

SEQ ID NO: 457452 - DNA, 25 bp, Mus musculus
gacgccatgccacgtatgcaggaca

SEQ ID NO: 457453 - DNA, 25 bp, Mus musculus
gacgccatgccaggtatgcaggaca

SEQ ID NO: 457454 - DNA, 25 bp, Mus musculus
gacgccatgcgcctgtactatgttt

SEQ ID NO: 457455 - DNA, 25 bp, Mus musculus
gacgccatgcgcgtgtactatgttt

SEQ ID NO: 457456 - DNA, 25 bp, Mus musculus
gacgccattgtgcaagctgtgaaag

SEQ ID NO: 457457 - DNA, 25 bp, Mus musculus
gacgccattgtggaagctgtgaaag

SEQ ID NO: 457458 - DNA, 25 bp, Mus musculus
gacgccatttcgagcaggtaataaa

SEQ ID NO: 457459 - DNA, 25 bp, Mus musculus
gacgccatttcgtgcaggtaataaa

SEQ ID NO: 457460 - DNA, 25 bp, Mus musculus
gacgcccaagggatcctcattagga

SEQ ID NO: 457461 - DNA, 25 bp, Mus musculus
gacgcccaagggttcctcattagga

SEQ ID NO: 457462 - DNA, 25 bp, Mus musculus
gacgcccacgttcatgtaggacaca

SEQ ID NO: 457463 - DNA, 25 bp, Mus musculus
gacgcccacgttgatgtaggacaca

SEQ ID NO: 457464 - DNA, 25 bp, Mus musculus
gacgcccatgagagtcgctatgaga

SEQ ID NO: 457465 - DNA, 25 bp, Mus musculus
gacgcccatgagtgtcgctatgaga

SEQ ID NO: 457466 - DNA, 25 bp, Mus musculus
gacgccccactgctgattacgaaaa

SEQ ID NO: 457467 - DNA, 25 bp, Mus musculus
gacgccccactggtgattacgaaaa

SEQ ID NO: 457468 - DNA, 25 bp, Mus musculus
gacgcccctgagaggagtctaaagg

SEQ ID NO: 457469 - DNA, 25 bp, Mus musculus
gacgcccctgagtggagtctaaagg

SEQ ID NO: 457470 - DNA, 25 bp, Mus musculus
gacgcccgggagatcttcgatctta

SEQ ID NO: 457471 - DNA, 25 bp, Mus musculus
gacgcccgggagttcttcgatctta

SEQ ID NO: 457472 - DNA, 25 bp, Mus musculus
gacgccctactgaagatgaccatca

SEQ ID NO: 457473 - DNA, 25 bp, Mus musculus
gacgccctactgtagatgaccatca

SEQ ID NO: 457474 - DNA, 25 bp, Mus musculus
gacgccctctaccatgtttacctag

SEQ ID NO: 457475 - DNA, 25 bp, Mus musculus
gacgccctctacgatgtttacctag

SEQ ID NO: 457476 - DNA, 25 bp, Mus musculus
gacgccctgtttacatacactgtga

SEQ ID NO: 457477 - DNA, 25 bp, Mus musculus
gacgccctgttttcatacactgtga

SEQ ID NO: 457478 - DNA, 25 bp, Mus musculus
gacgccgaagagcacaagaaggacc

SEQ ID NO: 457479 - DNA, 25 bp, Mus musculus
gacgccgaagaggacaagaaggacc

SEQ ID NO: 457480 - DNA, 25 bp, Mus musculus
gacgccgatattaatcctggttgct

SEQ ID NO: 457481 - DNA, 25 bp, Mus musculus
gacgccgatatttatcctggttgct

SEQ ID NO: 457482 - DNA, 25 bp, Mus musculus
gacgccgatctaagagccttcgcgc

SEQ ID NO: 457483 - DNA, 25 bp, Mus musculus
gacgccgatctatgagccttcgcgc

SEQ ID NO: 457484 - DNA, 25 bp, Mus musculus
gacgccgggcacagttggaaacgaa

SEQ ID NO: 457485 - DNA, 25 bp, Mus musculus
gacgccgggcactgttggaaacgaa

SEQ ID NO: 457486 - DNA, 25 bp, Mus musculus
gacgccgtacaaccaatagttactg

SEQ ID NO: 457487 - DNA, 25 bp, Mus musculus
gacgccgtacaagcaatagttactg

SEQ ID NO: 457488 - DNA, 25 bp, Mus musculus
gacgccgtatttcctttgaggcctt

SEQ ID NO: 457489 - DNA, 25 bp, Mus musculus
gacgccgtatttgctttgaggcctt

SEQ ID NO: 457490 - DNA, 25 bp, Mus musculus
gacgccgtctagaaaatgagcgcaa

SEQ ID NO: 457491 - DNA, 25 bp, Mus musculus
gacgccgtctagtaaatgagcgcaa

SEQ ID NO: 457492 - DNA, 25 bp, Mus musculus
gacgccgtggcaatagcaccgaggt

SEQ ID NO: 457493 - DNA, 25 bp, Mus musculus
gacgccgtggcattagcaccgaggt

SEQ ID NO: 457494 - DNA, 25 bp, Mus musculus
gacgcctacatgacctcagcagagg

SEQ ID NO: 457495 - DNA, 25 bp, Mus musculus
gacgcctacatgtcctcagcagagg

SEQ ID NO: 457496 - DNA, 25 bp, Mus musculus
gacgcctacttactggagcagtccc

SEQ ID NO: 457497 - DNA, 25 bp, Mus musculus
gacgcctacttagtggagcagtccc

SEQ ID NO: 457498 - DNA, 25 bp, Mus musculus
gacgcctactttcaacaagagagca

SEQ ID NO: 457499 - DNA, 25 bp, Mus musculus
gacgcctactttgaacaagagagca

SEQ ID NO: 457500 - DNA, 25 bp, Mus musculus
gacgcctagggacttgtctccggaa

SEQ ID NO: 457501 - DNA, 25 bp, Mus musculus
gacgcctagggagttgtctccggaa

SEQ ID NO: 457502 - DNA, 25 bp, Mus musculus
gacgcctatgccatatgacttacaa

SEQ ID NO: 457503 - DNA, 25 bp, Mus musculus
gacgcctatgccttatgacttacaa

SEQ ID NO: 457504 - DNA, 25 bp, Mus musculus
gacgcctctgtgagcaaaggcgctt

SEQ ID NO: 457505 - DNA, 25 bp, Mus musculus
gacgcctctgtgtgcaaaggcgctt

SEQ ID NO: 457506 - DNA, 25 bp, Mus musculus
gacgcctctttcagaagcgggactg

SEQ ID NO: 457507 - DNA, 25 bp, Mus musculus
gacgcctctttctgaagcgggactg

SEQ ID NO: 457508 - DNA, 25 bp, Mus musculus
gacgcctgcacaacaaggagcatgt

SEQ ID NO: 457509 - DNA, 25 bp, Mus musculus
gacgcctgcacatcaaggagcatgt

SEQ ID NO: 457510 - DNA, 25 bp, Mus musculus
gacgccttaaaccaagctgcttgga

SEQ ID NO: 457511 - DNA, 25 bp, Mus musculus
gacgccttaaacgaagctgcttgga

SEQ ID NO: 457512 - DNA, 25 bp, Mus musculus
gacgccttaggtaggtcctgaggta

SEQ ID NO: 457513 - DNA, 25 bp, Mus musculus
gacgccttaggttggtcctgaggta

SEQ ID NO: 457514 - DNA, 25 bp, Mus musculus
gacgcctttcggcagtttgatacca

SEQ ID NO: 457515 - DNA, 25 bp, Mus musculus
gacgcctttcgggagtttgatacca

SEQ ID NO: 457516 - DNA, 25 bp, Mus musculus
gacgcgacacggcagataagtaatg

SEQ ID NO: 457517 - DNA, 25 bp, Mus musculus
gacgcgacacgggagataagtaatg

SEQ ID NO: 457518 - DNA, 25 bp, Mus musculus
gacgcgacccttaatgacttgatgt

SEQ ID NO: 457519 - DNA, 25 bp, Mus musculus
gacgcgaccctttatgacttgatgt

SEQ ID NO: 457520 - DNA, 25 bp, Mus musculus
gacgcgcattatccagtcctggtgg

SEQ ID NO: 457521 - DNA, 25 bp, Mus musculus
gacgcgcattatgcagtcctggtgg

SEQ ID NO: 457522 - DNA, 25 bp, Mus musculus
gacgcgcatttcatctctttgggaa

SEQ ID NO: 457523 - DNA, 25 bp, Mus musculus
gacgcgcatttcttctctttgggaa

SEQ ID NO: 457524 - DNA, 25 bp, Mus musculus
gacgcgcccgtaattctcgaagacg

SEQ ID NO: 457525 - DNA, 25 bp, Mus musculus
gacgcgcccgtatttctcgaagacg

SEQ ID NO: 457526 - DNA, 25 bp, Mus musculus
gacgcgccctgaccctaataaagag

SEQ ID NO: 457527 - DNA, 25 bp, Mus musculus
gacgcgccctgagcctaataaagag

SEQ ID NO: 457528 - DNA, 25 bp, Mus musculus
gacgcgctactcactgacttctgtg

SEQ ID NO: 457529 - DNA, 25 bp, Mus musculus
gacgcgctactctctgacttctgtg

SEQ ID NO: 457530 - DNA, 25 bp, Mus musculus
gacgcggacctcacagtccagggcg

SEQ ID NO: 457531 - DNA, 25 bp, Mus musculus
gacgcggacctctcagtccagggcg

SEQ ID NO: 457532 - DNA, 25 bp, Mus musculus
gacgcggaccttagggcccgaattg

SEQ ID NO: 457533 - DNA, 25 bp, Mus musculus
gacgcggacctttgggcccgaattg

SEQ ID NO: 457534 - DNA, 25 bp, Mus musculus
gacgcggagccaactggagctgatc

SEQ ID NO: 457535 - DNA, 25 bp, Mus musculus
gacgcggagccatctggagctgatc

SEQ ID NO: 457536 - DNA, 25 bp, Mus musculus
gacgcggaggtcactcttattgatg

SEQ ID NO: 457537 - DNA, 25 bp, Mus musculus
gacgcggaggtctctcttattgatg

SEQ ID NO: 457538 - DNA, 25 bp, Mus musculus
gacgcggcgcttagcaaaaccaaaa

SEQ ID NO: 457539 - DNA, 25 bp, Mus musculus
gacgcggcgctttgcaaaaccaaaa

SEQ ID NO: 457540 - DNA, 25 bp, Mus musculus
gacgcggctataaatttcatctttg

SEQ ID NO: 457541 - DNA, 25 bp, Mus musculus
gacgcggctatatatttcatctttg

SEQ ID NO: 457542 - DNA, 25 bp, Mus musculus
gacgcggtgttcaagaagtaatctc

SEQ ID NO: 457543 - DNA, 25 bp, Mus musculus
gacgcggtgttctagaagtaatctc

SEQ ID NO: 457544 - DNA, 25 bp, Mus musculus
gacgcgtacaccaataaggaccgag

SEQ ID NO: 457545 - DNA, 25 bp, Mus musculus
gacgcgtacacctataaggaccgag

SEQ ID NO: 457546 - DNA, 25 bp, Mus musculus
gacgcgtagaacatcttcagtgttt

SEQ ID NO: 457547 - DNA, 25 bp, Mus musculus
gacgcgtagaacttcttcagtgttt

SEQ ID NO: 457548 - DNA, 25 bp, Mus musculus
gacgcgtatcagatgctgggcatgc

SEQ ID NO: 457549 - DNA, 25 bp, Mus musculus
gacgcgtatcagttgctgggcatgc

SEQ ID NO: 457550 - DNA, 25 bp, Mus musculus
gacgcgtcacagacaatgtcaagag

SEQ ID NO: 457551 - DNA, 25 bp, Mus musculus
gacgcgtcacagtcaatgtcaagag

SEQ ID NO: 457552 - DNA, 25 bp, Mus musculus
gacgctacagcgatggttttagaaa

SEQ ID NO: 457553 - DNA, 25 bp, Mus musculus
gacgctacagcgttggttttagaaa

SEQ ID NO: 457554 - DNA, 25 bp, Mus musculus
gacgctacattcctttccgatggag

SEQ ID NO: 457555 - DNA, 25 bp, Mus musculus
gacgctacattcgtttccgatggag

SEQ ID NO: 457556 - DNA, 25 bp, Mus musculus
gacgctacgctgcttcgaatcctaa

SEQ ID NO: 457557 - DNA, 25 bp, Mus musculus
gacgctacgctggttcgaatcctaa

SEQ ID NO: 457558 - DNA, 25 bp, Mus musculus
gacgctactacaccacttagaatgt

SEQ ID NO: 457559 - DNA, 25 bp, Mus musculus
gacgctactacagcacttagaatgt

SEQ ID NO: 457560 - DNA, 25 bp, Mus musculus
gacgctagcagccatcttaggacta

SEQ ID NO: 457561 - DNA, 25 bp, Mus musculus
gacgctagcagcgatcttaggacta

SEQ ID NO: 457562 - DNA, 25 bp, Mus musculus
gacgctagcattccccgtgattgtt

SEQ ID NO: 457563 - DNA, 25 bp, Mus musculus
gacgctagcattgcccgtgattgtt

SEQ ID NO: 457564 - DNA, 25 bp, Mus musculus
gacgctagctatccgagccgctgca

SEQ ID NO: 457565 - DNA, 25 bp, Mus musculus
gacgctagctatgcgagccgctgca

SEQ ID NO: 457566 - DNA, 25 bp, Mus musculus
gacgctagcttgagacaactaccaa

SEQ ID NO: 457567 - DNA, 25 bp, Mus musculus
gacgctagcttgtgacaactaccaa

SEQ ID NO: 457568 - DNA, 25 bp, Mus musculus
gacgctaggaatactgctcttaaat

SEQ ID NO: 457569 - DNA, 25 bp, Mus musculus
gacgctaggaattctgctcttaaat

SEQ ID NO: 457570 - DNA, 25 bp, Mus musculus
gacgctagggatctcagctgtacat

SEQ ID NO: 457571 - DNA, 25 bp, Mus musculus
gacgctagggatgtcagctgtacat

SEQ ID NO: 457572 - DNA, 25 bp, Mus musculus
gacgctatagacagtggcttttcat

SEQ ID NO: 457573 - DNA, 25 bp, Mus musculus
gacgctatagactgtggcttttcat

SEQ ID NO: 457574 - DNA, 25 bp, Mus musculus
gacgctatgaatctatgctctgcaa

SEQ ID NO: 457575 - DNA, 25 bp, Mus musculus
gacgctatgaatgtatgctctgcaa

SEQ ID NO: 457576 - DNA, 25 bp, Mus musculus
gacgctatgattccttagagatcct

SEQ ID NO: 457577 - DNA, 25 bp, Mus musculus
gacgctatgattgcttagagatcct

SEQ ID NO: 457578 - DNA, 25 bp, Mus musculus
gacgctatgcagagcgggacatcgt

SEQ ID NO: 457579 - DNA, 25 bp, Mus musculus
gacgctatgcagtgcgggacatcgt

SEQ ID NO: 457580 - DNA, 25 bp, Mus musculus
gacgctatgctaaggatactcctgt

SEQ ID NO: 457581 - DNA, 25 bp, Mus musculus
gacgctatgctatggatactcctgt

SEQ ID NO: 457582 - DNA, 25 bp, Mus musculus
gacgctatgggtccgcttgagcttc

SEQ ID NO: 457583 - DNA, 25 bp, Mus musculus
gacgctatgggtgcgcttgagcttc

SEQ ID NO: 457584 - DNA, 25 bp, Mus musculus
gacgctcaatgaatgggactccagg

SEQ ID NO: 457585 - DNA, 25 bp, Mus musculus
gacgctcaatgacctactttactga

SEQ ID NO: 457586 - DNA, 25 bp, Mus musculus
gacgctcaatgagctactttactga

SEQ ID NO: 457587 - DNA, 25 bp, Mus musculus
gacgctcaatgattgggactccagg

SEQ ID NO: 457588 - DNA, 25 bp, Mus musculus
gacgctcacactccatgttcttagt

SEQ ID NO: 457589 - DNA, 25 bp, Mus musculus
gacgctcacactgcatgttcttagt

SEQ ID NO: 457590 - DNA, 25 bp, Mus musculus
gacgctcagaaacgttctacagaac

SEQ ID NO: 457591 - DNA, 25 bp, Mus musculus
gacgctcagaaaggttctacagaac

SEQ ID NO: 457592 - DNA, 25 bp, Mus musculus
gacgctcagaacacagctcctagta

SEQ ID NO: 457593 - DNA, 25 bp, Mus musculus
gacgctcagaactcagctcctagta

SEQ ID NO: 457594 - DNA, 25 bp, Mus musculus
gacgctcaggaaatcagtgccttaa

SEQ ID NO: 457595 - DNA, 25 bp, Mus musculus
gacgctcaggaattcagtgccttaa

SEQ ID NO: 457596 - DNA, 25 bp, Mus musculus
gacgctcataacatgctcttgtttg

SEQ ID NO: 457597 - DNA, 25 bp, Mus musculus
gacgctcataacttgctcttgtttg

SEQ ID NO: 457598 - DNA, 25 bp, Mus musculus
gacgctccaatacgaacgtgagttt

SEQ ID NO: 457599 - DNA, 25 bp, Mus musculus
gacgctccaataggaacgtgagttt

SEQ ID NO: 457600 - DNA, 25 bp, Mus musculus
gacgctccgagtcctaacatattga

SEQ ID NO: 457601 - DNA, 25 bp, Mus musculus
gacgctccgagtgctaacatattga

SEQ ID NO: 457602 - DNA, 25 bp, Mus musculus
gacgctccgatcagcgggttgcgcc

SEQ ID NO: 457603 - DNA, 25 bp, Mus musculus
gacgctccgatctgcgggttgcgcc

SEQ ID NO: 457604 - DNA, 25 bp, Mus musculus
gacgctcctatgacactgctgaaga

SEQ ID NO: 457605 - DNA, 25 bp, Mus musculus
gacgctcctatgtcactgctgaaga

SEQ ID NO: 457606 - DNA, 25 bp, Mus musculus
gacgctcctcctatttgagggtgga

SEQ ID NO: 457607 - DNA, 25 bp, Mus musculus
gacgctcctcctttttgagggtgga

SEQ ID NO: 457608 - DNA, 25 bp, Mus musculus
gacgctcctggaacggcagatcaca

SEQ ID NO: 457609 - DNA, 25 bp, Mus musculus
gacgctcctggatcggcagatcaca

SEQ ID NO: 457610 - DNA, 25 bp, Mus musculus
gacgctcctttcattgggcaagagt

SEQ ID NO: 457611 - DNA, 25 bp, Mus musculus
gacgctcctttctttgggcaagagt

SEQ ID NO: 457612 - DNA, 25 bp, Mus musculus
gacgctctcacccttcctgagggaa

SEQ ID NO: 457613 - DNA, 25 bp, Mus musculus
gacgctctcaccgttcctgagggaa

SEQ ID NO: 457614 - DNA, 25 bp, Mus musculus
gacgctctcgaacccggagttatga

SEQ ID NO: 457615 - DNA, 25 bp, Mus musculus
gacgctctcgaagccggagttatga

SEQ ID NO: 457616 - DNA, 25 bp, Mus musculus
gacgctctcggaccagagacagaga

SEQ ID NO: 457617 - DNA, 25 bp, Mus musculus
gacgctctcggagcagagacagaga

SEQ ID NO: 457618 - DNA, 25 bp, Mus musculus
gacgctctcttcagctatgtctgaa

SEQ ID NO: 457619 - DNA, 25 bp, Mus musculus
gacgctctcttctgctatgtctgaa

SEQ ID NO: 457620 - DNA, 25 bp, Mus musculus
gacgctctgaggatagttggcaagt

SEQ ID NO: 457621 - DNA, 25 bp, Mus musculus
gacgctctgaggttagttggcaagt

SEQ ID NO: 457622 - DNA, 25 bp, Mus musculus
gacgctctggatcgagaacaccgtt

SEQ ID NO: 457623 - DNA, 25 bp, Mus musculus
gacgctctggatggagaacaccgtt

SEQ ID NO: 457624 - DNA, 25 bp, Mus musculus
gacgctctttatacagggcttggaa

SEQ ID NO: 457625 - DNA, 25 bp, Mus musculus
gacgctctttattcagggcttggaa

SEQ ID NO: 457626 - DNA, 25 bp, Mus musculus
gacgctgaaagactttgtccaactt

SEQ ID NO: 457627 - DNA, 25 bp, Mus musculus
gacgctgaaagagtttgtccaactt

SEQ ID NO: 457628 - DNA, 25 bp, Mus musculus
gacgctgaaataatgctgctaggat

SEQ ID NO: 457629 - DNA, 25 bp, Mus musculus
gacgctgaaatattgctgctaggat

SEQ ID NO: 457630 - DNA, 25 bp, Mus musculus
gacgctgaagccaagaaaagctggc

SEQ ID NO: 457631 - DNA, 25 bp, Mus musculus
gacgctgaagcctagaaaagctggc

SEQ ID NO: 457632 - DNA, 25 bp, Mus musculus
gacgctgagccacagcactagatca

SEQ ID NO: 457633 - DNA, 25 bp, Mus musculus
gacgctgagccagagcactagatca

SEQ ID NO: 457634 - DNA, 25 bp, Mus musculus
gacgctgaggacattatcagatcaa

SEQ ID NO: 457635 - DNA, 25 bp, Mus musculus
gacgctgaggactttatcagatcaa

SEQ ID NO: 457636 - DNA, 25 bp, Mus musculus
gacgctgaggtgcacatcttaaaga

SEQ ID NO: 457637 - DNA, 25 bp, Mus musculus
gacgctgaggtggacatcttaaaga

SEQ ID NO: 457638 - DNA, 25 bp, Mus musculus
gacgctgagtataatccactgccca

SEQ ID NO: 457639 - DNA, 25 bp, Mus musculus
gacgctgagtattatccactgccca

SEQ ID NO: 457640 - DNA, 25 bp, Mus musculus
gacgctgagttgcacccacggttca

SEQ ID NO: 457641 - DNA, 25 bp, Mus musculus
gacgctgagttggacccacggttca

SEQ ID NO: 457642 - DNA, 25 bp, Mus musculus
gacgctgatgagagcccaggatctg

SEQ ID NO: 457643 - DNA, 25 bp, Mus musculus
gacgctgatgagtgcccaggatctg

SEQ ID NO: 457644 - DNA, 25 bp, Mus musculus
gacgctgcagaaagctgggtcctga

SEQ ID NO: 457645 - DNA, 25 bp, Mus musculus
gacgctgcagaatgctgggtcctga

SEQ ID NO: 457646 - DNA, 25 bp, Mus musculus
gacgctgcagcaatattgagcaatt

SEQ ID NO: 457647 - DNA, 25 bp, Mus musculus
gacgctgcagcattattgagcaatt

SEQ ID NO: 457648 - DNA, 25 bp, Mus musculus
gacgctgccccaaaaatataacaca

SEQ ID NO: 457649 - DNA, 25 bp, Mus musculus
gacgctgccccataaatataacaca

SEQ ID NO: 457650 - DNA, 25 bp, Mus musculus
gacgctgcgggtcatctgcatctgt

SEQ ID NO: 457651 - DNA, 25 bp, Mus musculus
gacgctgcgggtgatctgcatctgt

SEQ ID NO: 457652 - DNA, 25 bp, Mus musculus
gacgctgctcagaggctactcctca

SEQ ID NO: 457653 - DNA, 25 bp, Mus musculus
gacgctgctcagtggctactcctca

SEQ ID NO: 457654 - DNA, 25 bp, Mus musculus
gacgctgctgaactgaagtacattt

SEQ ID NO: 457655 - DNA, 25 bp, Mus musculus
gacgctgctgaagtgaagtacattt

SEQ ID NO: 457656 - DNA, 25 bp, Mus musculus
gacgctggaagccagtttaggccta

SEQ ID NO: 457657 - DNA, 25 bp, Mus musculus
gacgctggaagcgagtttaggccta

SEQ ID NO: 457658 - DNA, 25 bp, Mus musculus
gacgctggagcgcagagcatgagga

SEQ ID NO: 457659 - DNA, 25 bp, Mus musculus
gacgctggagcggagagcatgagga

SEQ ID NO: 457660 - DNA, 25 bp, Mus musculus
gacgctggaggcagttccctggaac

SEQ ID NO: 457661 - DNA, 25 bp, Mus musculus
gacgctggaggctgttccctggaac

SEQ ID NO: 457662 - DNA, 25 bp, Mus musculus
gacgctggatgtcctgcagtataag

SEQ ID NO: 457663 - DNA, 25 bp, Mus musculus
gacgctggatgtgctgcagtataag

SEQ ID NO: 457664 - DNA, 25 bp, Mus musculus
gacgctgggtgcagcattgtcaaag

SEQ ID NO: 457665 - DNA, 25 bp, Mus musculus
gacgctgggtgctgcattgtcaaag

SEQ ID NO: 457666 - DNA, 25 bp, Mus musculus
gacgctggtcaactatggcacatgc

SEQ ID NO: 457667 - DNA, 25 bp, Mus musculus
gacgctggtcaagtatggcacatgc

SEQ ID NO: 457668 - DNA, 25 bp, Mus musculus
gacgctggtggaccttgaagtcctt

SEQ ID NO: 457669 - DNA, 25 bp, Mus musculus
gacgctggtggagcttgaagtcctt

SEQ ID NO: 457670 - DNA, 25 bp, Mus musculus
gacgctggttaacttaacagcaaca

SEQ ID NO: 457671 - DNA, 25 bp, Mus musculus
gacgctggttaagttaacagcaaca

SEQ ID NO: 457672 - DNA, 25 bp, Mus musculus
gacgctggttgtattcattgtcccc

SEQ ID NO: 457673 - DNA, 25 bp, Mus musculus
gacgctggttgttttcattgtcccc

SEQ ID NO: 457674 - DNA, 25 bp, Mus musculus
gacgctgtacaacaatgtcacctta

SEQ ID NO: 457675 - DNA, 25 bp, Mus musculus
gacgctgtacaagaatgtcacctta

SEQ ID NO: 457676 - DNA, 25 bp, Mus musculus
gacgctgtagaccaagccaaaccta

SEQ ID NO: 457677 - DNA, 25 bp, Mus musculus
gacgctgtagacgaagccaaaccta

SEQ ID NO: 457678 - DNA, 25 bp, Mus musculus
gacgctgtcagtcggcattctcaga

SEQ ID NO: 457679 - DNA, 25 bp, Mus musculus
gacgctgtcagtgggcattctcaga

SEQ ID NO: 457680 - DNA, 25 bp, Mus musculus
gacgctgtctagatattgagccaat

SEQ ID NO: 457681 - DNA, 25 bp, Mus musculus
gacgctgtctagttattgagccaat

SEQ ID NO: 457682 - DNA, 25 bp, Mus musculus
gacgctgtctccactttggttgttt

SEQ ID NO: 457683 - DNA, 25 bp, Mus musculus
gacgctgtctcctctttggttgttt

SEQ ID NO: 457684 - DNA, 25 bp, Mus musculus
gacgctgtcttgaggttctcagcac

SEQ ID NO: 457685 - DNA, 25 bp, Mus musculus
gacgctgtcttgtggttctcagcac

SEQ ID NO: 457686 - DNA, 25 bp, Mus musculus
gacgctgtctttccagtcaaacttt

SEQ ID NO: 457687 - DNA, 25 bp, Mus musculus
gacgctgtctttgcagtcaaacttt

SEQ ID NO: 457688 - DNA, 25 bp, Mus musculus
gacgctgtgcttcacggtggatttt

SEQ ID NO: 457689 - DNA, 25 bp, Mus musculus
gacgctgtgcttgacggtggatttt

SEQ ID NO: 457690 - DNA, 25 bp, Mus musculus
gacgctgtggcccttttatatagtt

SEQ ID NO: 457691 - DNA, 25 bp, Mus musculus
gacgctgtggccgttttatatagtt

SEQ ID NO: 457692 - DNA, 25 bp, Mus musculus
gacgctgtggcgacgttccgaaaaa

SEQ ID NO: 457693 - DNA, 25 bp, Mus musculus
gacgctgtggcgtcgttccgaaaaa

SEQ ID NO: 457694 - DNA, 25 bp, Mus musculus
gacgctgttcagacgagctctaaga

SEQ ID NO: 457695 - DNA, 25 bp, Mus musculus
gacgctgttcagtcgagctctaaga

SEQ ID NO: 457696 - DNA, 25 bp, Mus musculus
gacgctgttcttaggctggttggtt

SEQ ID NO: 457697 - DNA, 25 bp, Mus musculus
gacgctgttctttggctggttggtt

SEQ ID NO: 457698 - DNA, 25 bp, Mus musculus
gacgctgttttcctgcaagaatcgc

SEQ ID NO: 457699 - DNA, 25 bp, Mus musculus
gacgctgttttcgtgcaagaatcgc

SEQ ID NO: 457700 - DNA, 25 bp, Mus musculus
gacgcttaaattatctcttccttta

SEQ ID NO: 457701 - DNA, 25 bp, Mus musculus
gacgcttaaattttctcttccttta

SEQ ID NO: 457702 - DNA, 25 bp, Mus musculus
gacgcttaagcaattcagggctggt

SEQ ID NO: 457703 - DNA, 25 bp, Mus musculus
gacgcttaagcatttcagggctggt

SEQ ID NO: 457704 - DNA, 25 bp, Mus musculus
gacgcttaagtgatcataaatgggc

SEQ ID NO: 457705 - DNA, 25 bp, Mus musculus
gacgcttaagtgttcataaatgggc

SEQ ID NO: 457706 - DNA, 25 bp, Mus musculus
gacgcttagctcatctgcagatatg

SEQ ID NO: 457707 - DNA, 25 bp, Mus musculus
gacgcttagctcttctgcagatatg

SEQ ID NO: 457708 - DNA, 25 bp, Mus musculus
gacgcttatgacacctatgggcaag

SEQ ID NO: 457709 - DNA, 25 bp, Mus musculus
gacgcttatgactcctatgggcaag

SEQ ID NO: 457710 - DNA, 25 bp, Mus musculus
gacgcttcaaccagagcaccaagct

SEQ ID NO: 457711 - DNA, 25 bp, Mus musculus
gacgcttcaacctgagcaccaagct

SEQ ID NO: 457712 - DNA, 25 bp, Mus musculus
gacgcttccctcagaagtcatgtaa

SEQ ID NO: 457713 - DNA, 25 bp, Mus musculus
gacgcttccctctgaagtcatgtaa

SEQ ID NO: 457714 - DNA, 25 bp, Mus musculus
gacgcttctccacccagtgattgtg

SEQ ID NO: 457715 - DNA, 25 bp, Mus musculus
gacgcttctccagccagtgattgtg

SEQ ID NO: 457716 - DNA, 25 bp, Mus musculus
gacgcttctcgacaaatgtgccatt

SEQ ID NO: 457717 - DNA, 25 bp, Mus musculus
gacgcttctcgagaaatgtgccatt

SEQ ID NO: 457718 - DNA, 25 bp, Mus musculus
gacgcttctttgagagccgctggga

SEQ ID NO: 457719 - DNA, 25 bp, Mus musculus
gacgcttctttgtgagccgctggga

SEQ ID NO: 457720 - DNA, 25 bp, Mus musculus
gacgcttgagccatttatgtacttt

SEQ ID NO: 457721 - DNA, 25 bp, Mus musculus
gacgcttgagccttttatgtacttt

SEQ ID NO: 457722 - DNA, 25 bp, Mus musculus
gacgcttgatgaaaattgacattta

SEQ ID NO: 457723 - DNA, 25 bp, Mus musculus
gacgcttgatgataattgacattta

SEQ ID NO: 457724 - DNA, 25 bp, Mus musculus
gacgcttgcaaacactgtctttcaa

SEQ ID NO: 457725 - DNA, 25 bp, Mus musculus
gacgcttgcaaagactgtctttcaa

SEQ ID NO: 457726 - DNA, 25 bp, Mus musculus
gacgcttgcattaccttttttgata

SEQ ID NO: 457727 - DNA, 25 bp, Mus musculus
gacgcttgcatttccttttttgata

SEQ ID NO: 457728 - DNA, 25 bp, Mus musculus
gacgctttaatgctttttgttccaa

SEQ ID NO: 457729 - DNA, 25 bp, Mus musculus
gacgctttaatggtttttgttccaa

SEQ ID NO: 457730 - DNA, 25 bp, Mus musculus
gacgctttacataatttggacagaa

SEQ ID NO: 457731 - DNA, 25 bp, Mus musculus
gacgctttacattatttggacagaa

SEQ ID NO: 457732 - DNA, 25 bp, Mus musculus
gacgctttacctcagagagtaactg

SEQ ID NO: 457733 - DNA, 25 bp, Mus musculus
gacgctttacctgagagagtaactg

SEQ ID NO: 457734 - DNA, 25 bp, Mus musculus
gacgctttagagacatctgatcaca

SEQ ID NO: 457735 - DNA, 25 bp, Mus musculus
gacgctttagagtcatctgatcaca

SEQ ID NO: 457736 - DNA, 25 bp, Mus musculus
gacgctttgactctgggactgaata

SEQ ID NO: 457737 - DNA, 25 bp, Mus musculus
gacgctttgactgtgggactgaata

SEQ ID NO: 457738 - DNA, 25 bp, Mus musculus
gacgctttgatccatgctaactttt

SEQ ID NO: 457739 - DNA, 25 bp, Mus musculus
gacgctttgatcgatgctaactttt

SEQ ID NO: 457740 - DNA, 25 bp, Mus musculus
gacgctttgcccaacgaaatgtagg

SEQ ID NO: 457741 - DNA, 25 bp, Mus musculus
gacgctttgccctacgaaatgtagg

SEQ ID NO: 457742 - DNA, 25 bp, Mus musculus
gacgctttgtccctggatgatgatc

SEQ ID NO: 457743 - DNA, 25 bp, Mus musculus
gacgctttgtccgtggatgatgatc

SEQ ID NO: 457744 - DNA, 25 bp, Mus musculus
gacgctttgtgaacgaagaggttcc

SEQ ID NO: 457745 - DNA, 25 bp, Mus musculus
gacgctttgtgatcgaagaggttcc

SEQ ID NO: 457746 - DNA, 25 bp, Mus musculus
gacgcttttctccaacctgggaagt

SEQ ID NO: 457747 - DNA, 25 bp, Mus musculus
gacgcttttctcgaacctgggaagt

SEQ ID NO: 457748 - DNA, 25 bp, Mus musculus
gacggaaactttcacgatgcgctta

SEQ ID NO: 457749 - DNA, 25 bp, Mus musculus
gacggaaactttgacgatgcgctta

SEQ ID NO: 457750 - DNA, 25 bp, Mus musculus
gacggaaagctgagccttcttcgga

SEQ ID NO: 457751 - DNA, 25 bp, Mus musculus
gacggaaagctgtgccttcttcgga

SEQ ID NO: 457752 - DNA, 25 bp, Mus musculus
gacggaaagggcagtgctctctcag

SEQ ID NO: 457753 - DNA, 25 bp, Mus musculus
gacggaaagggctgtgctctctcag

SEQ ID NO: 457754 - DNA, 25 bp, Mus musculus
gacggaaaggtccatgtgtctccct

SEQ ID NO: 457755 - DNA, 25 bp, Mus musculus
gacggaaaggtcgatgtgtctccct

SEQ ID NO: 457756 - DNA, 25 bp, Mus musculus
gacggaaatccactacataatgtga

SEQ ID NO: 457757 - DNA, 25 bp, Mus musculus
gacggaaatccagtacataatgtga

SEQ ID NO: 457758 - DNA, 25 bp, Mus musculus
gacggaaatgtcactccaagagcag

SEQ ID NO: 457759 - DNA, 25 bp, Mus musculus
gacggaaatgtctctccaagagcag

SEQ ID NO: 457760 - DNA, 25 bp, Mus musculus
gacggaaatttccagcacagtgatt

SEQ ID NO: 457761 - DNA, 25 bp, Mus musculus
gacggaaatttcgagcacagtgatt

SEQ ID NO: 457762 - DNA, 25 bp, Mus musculus
gacggaacacgtagcatgggaacaa

SEQ ID NO: 457763 - DNA, 25 bp, Mus musculus
gacggaacacgttgcatgggaacaa

SEQ ID NO: 457764 - DNA, 25 bp, Mus musculus
gacggaacagtaaactaatgtgtac

SEQ ID NO: 457765 - DNA, 25 bp, Mus musculus
gacggaacagtatactaatgtgtac

SEQ ID NO: 457766 - DNA, 25 bp, Mus musculus
gacggaacggtcaaactctgggact

SEQ ID NO: 457767 - DNA, 25 bp, Mus musculus
gacggaacggtctaactctgggact

SEQ ID NO: 457768 - DNA, 25 bp, Mus musculus
gacggaacttttaaagctctcagct

SEQ ID NO: 457769 - DNA, 25 bp, Mus musculus
gacggaactttttaagctctcagct

SEQ ID NO: 457770 - DNA, 25 bp, Mus musculus
gacggaagagtcagcctagtccaca

SEQ ID NO: 457771 - DNA, 25 bp, Mus musculus
gacggaagagtctgcctagtccaca

SEQ ID NO: 457772 - DNA, 25 bp, Mus musculus
gacggaagggtcattaaagctgtca

SEQ ID NO: 457773 - DNA, 25 bp, Mus musculus
gacggaagggtctttaaagctgtca

SEQ ID NO: 457774 - DNA, 25 bp, Mus musculus
gacggaagtctcacgggagccaacc

SEQ ID NO: 457775 - DNA, 25 bp, Mus musculus
gacggaagtctctcgggagccaacc

SEQ ID NO: 457776 - DNA, 25 bp, Mus musculus
gacggaatcaagcaccgagttctgt

SEQ ID NO: 457777 - DNA, 25 bp, Mus musculus
gacggaatcaaggaccgagttctgt

SEQ ID NO: 457778 - DNA, 25 bp, Mus musculus
gacggaatcatcattcagtcctttg

SEQ ID NO: 457779 - DNA, 25 bp, Mus musculus
gacggaatcatctttcagtcctttg

SEQ ID NO: 457780 - DNA, 25 bp, Mus musculus
gacggaatgcacatacttctctacg

SEQ ID NO: 457781 - DNA, 25 bp, Mus musculus
gacggaatgcacttacttctctacg

SEQ ID NO: 457782 - DNA, 25 bp, Mus musculus
gacggaatttccagcaagctgggca

SEQ ID NO: 457783 - DNA, 25 bp, Mus musculus
gacggaatttcctgcaagctgggca

SEQ ID NO: 457784 - DNA, 25 bp, Mus musculus
gacggacaatgcaggatgtgtttta

SEQ ID NO: 457785 - DNA, 25 bp, Mus musculus
gacggacaatgctggatgtgtttta

SEQ ID NO: 457786 - DNA, 25 bp, Mus musculus
gacggacacagcagggagtcacctc

SEQ ID NO: 457787 - DNA, 25 bp, Mus musculus
gacggacacagctgggagtcacctc

SEQ ID NO: 457788 - DNA, 25 bp, Mus musculus
gacggacacgctagcacaaactctc

SEQ ID NO: 457789 - DNA, 25 bp, Mus musculus
gacggacacgcttgcacaaactctc

SEQ ID NO: 457790 - DNA, 25 bp, Mus musculus
gacggacacgttccttacagcttta

SEQ ID NO: 457791 - DNA, 25 bp, Mus musculus
gacggacacgttgcttacagcttta

SEQ ID NO: 457792 - DNA, 25 bp, Mus musculus
gacggacagacactattccacgctg

SEQ ID NO: 457793 - DNA, 25 bp, Mus musculus
gacggacagacagtattccacgctg

SEQ ID NO: 457794 - DNA, 25 bp, Mus musculus
gacggacatgccctcactttgtagc

SEQ ID NO: 457795 - DNA, 25 bp, Mus musculus
gacggacatgccgtcactttgtagc

SEQ ID NO: 457796 - DNA, 25 bp, Mus musculus
gacggacattcaaatttacacattt

SEQ ID NO: 457797 - DNA, 25 bp, Mus musculus
gacggacattcatatttacacattt

SEQ ID NO: 457798 - DNA, 25 bp, Mus musculus
gacggaccagagattatgggctgta

SEQ ID NO: 457799 - DNA, 25 bp, Mus musculus
gacggaccagagtttatgggctgta

SEQ ID NO: 457800 - DNA, 25 bp, Mus musculus
gacggacccaaaatcctgtgagtca

SEQ ID NO: 457801 - DNA, 25 bp, Mus musculus
gacggacccaaattcctgtgagtca

SEQ ID NO: 457802 - DNA, 25 bp, Mus musculus
gacggaccccaactttgtttggctg

SEQ ID NO: 457803 - DNA, 25 bp, Mus musculus
gacggaccccaagtttgtttggctg

SEQ ID NO: 457804 - DNA, 25 bp, Mus musculus
gacggacccgaaccctgtgtgaatg

SEQ ID NO: 457805 - DNA, 25 bp, Mus musculus
gacggacccgaagcctgtgtgaatg

SEQ ID NO: 457806 - DNA, 25 bp, Mus musculus
gacggaccgagaatttgatgatgac

SEQ ID NO: 457807 - DNA, 25 bp, Mus musculus
gacggaccgagattttgatgatgac

SEQ ID NO: 457808 - DNA, 25 bp, Mus musculus
gacggacctactccgagcagagcag

SEQ ID NO: 457809 - DNA, 25 bp, Mus musculus
gacggacctactgcgagcagagcag

SEQ ID NO: 457810 - DNA, 25 bp, Mus musculus
gacggacctgctactacaagggtag

SEQ ID NO: 457811 - DNA, 25 bp, Mus musculus
gacggacctgcttctacaagggtag

SEQ ID NO: 457812 - DNA, 25 bp, Mus musculus
gacggacgaatgaatctccatgttt

SEQ ID NO: 457813 - DNA, 25 bp, Mus musculus
gacggacgaatgtatctccatgttt

SEQ ID NO: 457814 - DNA, 25 bp, Mus musculus
gacggacgctctcggacctaaaccg

SEQ ID NO: 457815 - DNA, 25 bp, Mus musculus
gacggacgctctgggacctaaaccg

SEQ ID NO: 457816 - DNA, 25 bp, Mus musculus
gacggacgttaaagtgacctgctca

SEQ ID NO: 457817 - DNA, 25 bp, Mus musculus
gacggacgttaatgtgacctgctca

SEQ ID NO: 457818 - DNA, 25 bp, Mus musculus
gacggactggctcctgtctctcctg

SEQ ID NO: 457819 - DNA, 25 bp, Mus musculus
gacggactggctcgacattgttcct

SEQ ID NO: 457820 - DNA, 25 bp, Mus musculus
gacggactggctgctgtctctcctg

SEQ ID NO: 457821 - DNA, 25 bp, Mus musculus
gacggactggctggacattgttcct

SEQ ID NO: 457822 - DNA, 25 bp, Mus musculus
gacggactggtgattctgcccgcca

SEQ ID NO: 457823 - DNA, 25 bp, Mus musculus
gacggactggtgtttctgcccgcca

SEQ ID NO: 457824 - DNA, 25 bp, Mus musculus
gacggacttccgaccaactgtgacc

SEQ ID NO: 457825 - DNA, 25 bp, Mus musculus
gacggacttccgtccaactgtgacc

SEQ ID NO: 457826 - DNA, 25 bp, Mus musculus
gacggacttctaacatcactgtcat

SEQ ID NO: 457827 - DNA, 25 bp, Mus musculus
gacggacttctatcatcactgtcat

SEQ ID NO: 457828 - DNA, 25 bp, Mus musculus
gacggagacaaaactggcaggcata

SEQ ID NO: 457829 - DNA, 25 bp, Mus musculus
gacggagacaaatctggcaggcata

SEQ ID NO: 457830 - DNA, 25 bp, Mus musculus
gacggagatcatcttaagcaaagca

SEQ ID NO: 457831 - DNA, 25 bp, Mus musculus
gacggagatcatgttaagcaaagca

SEQ ID NO: 457832 - DNA, 25 bp, Mus musculus
gacggagatgatcgtcccctgcgtt

SEQ ID NO: 457833 - DNA, 25 bp, Mus musculus
gacggagatgatggtcccctgcgtt

SEQ ID NO: 457834 - DNA, 25 bp, Mus musculus
gacggagcacaaagccatagtgtta

SEQ ID NO: 457835 - DNA, 25 bp, Mus musculus
gacggagcacaatgccatagtgtta

SEQ ID NO: 457836 - DNA, 25 bp, Mus musculus
gacggagcgcagcatggacttctac

SEQ ID NO: 457837 - DNA, 25 bp, Mus musculus
gacggagcgcaggatggacttctac

SEQ ID NO: 457838 - DNA, 25 bp, Mus musculus
gacggagcggccattcatccagaag

SEQ ID NO: 457839 - DNA, 25 bp, Mus musculus
gacggagcggcctttcatccagaag

SEQ ID NO: 457840 - DNA, 25 bp, Mus musculus
gacggagtcaacaacctggtggatt

SEQ ID NO: 457841 - DNA, 25 bp, Mus musculus
gacggagtcaactacctggtggatt

SEQ ID NO: 457842 - DNA, 25 bp, Mus musculus
gacggagtccatccaggcctgtaaa

SEQ ID NO: 457843 - DNA, 25 bp, Mus musculus
gacggagtccatgcaggcctgtaaa

SEQ ID NO: 457844 - DNA, 25 bp, Mus musculus
gacggagtgctaacattactcccca

SEQ ID NO: 457845 - DNA, 25 bp, Mus musculus
gacggagtgctatcattactcccca

SEQ ID NO: 457846 - DNA, 25 bp, Mus musculus
gacggatacggcacctgtactggaa

SEQ ID NO: 457847 - DNA, 25 bp, Mus musculus
gacggatacggctcctgtactggaa

SEQ ID NO: 457848 - DNA, 25 bp, Mus musculus
gacggatagccacgaaggctctccc

SEQ ID NO: 457849 - DNA, 25 bp, Mus musculus
gacggatagccaggaaggctctccc

SEQ ID NO: 457850 - DNA, 25 bp, Mus musculus
gacggatagtgtctgctgtaaacca

SEQ ID NO: 457851 - DNA, 25 bp, Mus musculus
gacggatagtgtgtgctgtaaacca

SEQ ID NO: 457852 - DNA, 25 bp, Mus musculus
gacggatcacgtaattattccagat

SEQ ID NO: 457853 - DNA, 25 bp, Mus musculus
gacggatcacgttattattccagat

SEQ ID NO: 457854 - DNA, 25 bp, Mus musculus
gacggatcccatcaggaactggaaa

SEQ ID NO: 457855 - DNA, 25 bp, Mus musculus
gacggatcccatgaggaactggaaa

SEQ ID NO: 457856 - DNA, 25 bp, Mus musculus
gacggatctctaattcataatgctt

SEQ ID NO: 457857 - DNA, 25 bp, Mus musculus
gacggatctctatttcataatgctt

SEQ ID NO: 457858 - DNA, 25 bp, Mus musculus
gacggatgaactaaggtgtcaccca

SEQ ID NO: 457859 - DNA, 25 bp, Mus musculus
gacggatgaacttaggtgtcaccca

SEQ ID NO: 457860 - DNA, 25 bp, Mus musculus
gacggatgccaaaagcctaactggt

SEQ ID NO: 457861 - DNA, 25 bp, Mus musculus
gacggatgccaatagcctaactggt

SEQ ID NO: 457862 - DNA, 25 bp, Mus musculus
gacggatgcggtaatcaacatgcac

SEQ ID NO: 457863 - DNA, 25 bp, Mus musculus
gacggatgcggttatcaacatgcac

SEQ ID NO: 457864 - DNA, 25 bp, Mus musculus
gacggatggtctccgactgcgaaaa

SEQ ID NO: 457865 - DNA, 25 bp, Mus musculus
gacggatggtctgcgactgcgaaaa

SEQ ID NO: 457866 - DNA, 25 bp, Mus musculus
gacggatgttcacccctatgcctgg

SEQ ID NO: 457867 - DNA, 25 bp, Mus musculus
gacggatgttcagccctatgcctgg

SEQ ID NO: 457868 - DNA, 25 bp, Mus musculus
gacggattggtgatgtcatgcccat

SEQ ID NO: 457869 - DNA, 25 bp, Mus musculus
gacggattggtgttgtcatgcccat

SEQ ID NO: 457870 - DNA, 25 bp, Mus musculus
gacggcaacctgcagtattacctgt

SEQ ID NO: 457871 - DNA, 25 bp, Mus musculus
gacggcaacctggagtattacctgt

SEQ ID NO: 457872 - DNA, 25 bp, Mus musculus
gacggcacacacatgtaacccagca

SEQ ID NO: 457873 - DNA, 25 bp, Mus musculus
gacggcacacacttgtaacccagca

SEQ ID NO: 457874 - DNA, 25 bp, Mus musculus
gacggcaccatgacagcctgaggtt

SEQ ID NO: 457875 - DNA, 25 bp, Mus musculus
gacggcaccatgtcagcctgaggtt

SEQ ID NO: 457876 - DNA, 25 bp, Mus musculus
gacggcacccaacctgatttgtata

SEQ ID NO: 457877 - DNA, 25 bp, Mus musculus
gacggcacccaagctgatttgtata

SEQ ID NO: 457878 - DNA, 25 bp, Mus musculus
gacggcacgctgcattatctcaaga

SEQ ID NO: 457879 - DNA, 25 bp, Mus musculus
gacggcacgctggattatctcaaga

SEQ ID NO: 457880 - DNA, 25 bp, Mus musculus
gacggcactgtgctttttaactgag

SEQ ID NO: 457881 - DNA, 25 bp, Mus musculus
gacggcactgtggtttttaactgag

SEQ ID NO: 457882 - DNA, 25 bp, Mus musculus
gacggcagcactcgcaagttctact

SEQ ID NO: 457883 - DNA, 25 bp, Mus musculus
gacggcagcactggcaagttctact

SEQ ID NO: 457884 - DNA, 25 bp, Mus musculus
gacggcagtgagcattcagcctctt

SEQ ID NO: 457885 - DNA, 25 bp, Mus musculus
gacggcagtgaggattcagcctctt

SEQ ID NO: 457886 - DNA, 25 bp, Mus musculus
gacggcatccgcaaatttgctgctg

SEQ ID NO: 457887 - DNA, 25 bp, Mus musculus
gacggcatccgctaatttgctgctg

SEQ ID NO: 457888 - DNA, 25 bp, Mus musculus
gacggcattctcaatactgtatgta

SEQ ID NO: 457889 - DNA, 25 bp, Mus musculus
gacggcattctctatactgtatgta

SEQ ID NO: 457890 - DNA, 25 bp, Mus musculus
gacggccaacctcatgaatttactt

SEQ ID NO: 457891 - DNA, 25 bp, Mus musculus
gacggccaacctgatgaatttactt

SEQ ID NO: 457892 - DNA, 25 bp, Mus musculus
gacggccaacgtctaaatttcagac

SEQ ID NO: 457893 - DNA, 25 bp, Mus musculus
gacggccaacgtgtaaatttcagac

SEQ ID NO: 457894 - DNA, 25 bp, Mus musculus
gacggccaactgagagcactatgct

SEQ ID NO: 457895 - DNA, 25 bp, Mus musculus
gacggccaactgtgagcactatgct

SEQ ID NO: 457896 - DNA, 25 bp, Mus musculus
gacggccaacttcctcaatgaacag

SEQ ID NO: 457897 - DNA, 25 bp, Mus musculus
gacggccaacttgctcaatgaacag

SEQ ID NO: 457898 - DNA, 25 bp, Mus musculus
gacggccaagccagtatgtaaagac

SEQ ID NO: 457899 - DNA, 25 bp, Mus musculus
gacggccaagcctgtatgtaaagac

SEQ ID NO: 457900 - DNA, 25 bp, Mus musculus
gacggccaagtgaacagttctcacc

SEQ ID NO: 457901 - DNA, 25 bp, Mus musculus
gacggccaagtgtacagttctcacc

SEQ ID NO: 457902 - DNA, 25 bp, Mus musculus
gacggccactttcgcatgtttcctg

SEQ ID NO: 457903 - DNA, 25 bp, Mus musculus
gacggccactttggcatgtttcctg

SEQ ID NO: 457904 - DNA, 25 bp, Mus musculus
gacggccagacaatgcaaaggttca

SEQ ID NO: 457905 - DNA, 25 bp, Mus musculus
gacggccagacattgcaaaggttca

SEQ ID NO: 457906 - DNA, 25 bp, Mus musculus
gacggccatactagacatcttaaat

SEQ ID NO: 457907 - DNA, 25 bp, Mus musculus
gacggccatacttgacatcttaaat

SEQ ID NO: 457908 - DNA, 25 bp, Mus musculus
gacggccatgaactgagatcctgca

SEQ ID NO: 457909 - DNA, 25 bp, Mus musculus
gacggccatgaagtgagatcctgca

SEQ ID NO: 457910 - DNA, 25 bp, Mus musculus
gacggcccaatgaggaactctgcag

SEQ ID NO: 457911 - DNA, 25 bp, Mus musculus
gacggcccaatgtggaactctgcag

SEQ ID NO: 457912 - DNA, 25 bp, Mus musculus
gacggcccagatcattagtcttagt

SEQ ID NO: 457913 - DNA, 25 bp, Mus musculus
gacggcccagatgattagtcttagt

SEQ ID NO: 457914 - DNA, 25 bp, Mus musculus
gacggccccgcactgaatacattct

SEQ ID NO: 457915 - DNA, 25 bp, Mus musculus
gacggccccgcagtgaatacattct

SEQ ID NO: 457916 - DNA, 25 bp, Mus musculus
gacggccctgtgatacagttatttt

SEQ ID NO: 457917 - DNA, 25 bp, Mus musculus
gacggccctgtgttacagttatttt

SEQ ID NO: 457918 - DNA, 25 bp, Mus musculus
gacggcctcgaactgtcggaacgat

SEQ ID NO: 457919 - DNA, 25 bp, Mus musculus
gacggcctcgaagtgtcggaacgat

SEQ ID NO: 457920 - DNA, 25 bp, Mus musculus
gacggcctgttgcatctgattcgaa

SEQ ID NO: 457921 - DNA, 25 bp, Mus musculus
gacggcctgttggatctgattcgaa

SEQ ID NO: 457922 - DNA, 25 bp, Mus musculus
gacggccttacaatctggaagcagt

SEQ ID NO: 457923 - DNA, 25 bp, Mus musculus
gacggccttacattctggaagcagt

SEQ ID NO: 457924 - DNA, 25 bp, Mus musculus
gacggccttcaaaactaatgtgtgt

SEQ ID NO: 457925 - DNA, 25 bp, Mus musculus
gacggccttcaaagttacagcttcc

SEQ ID NO: 457926 - DNA, 25 bp, Mus musculus
gacggccttcaatactaatgtgtgt

SEQ ID NO: 457927 - DNA, 25 bp, Mus musculus
gacggccttcaatgttacagcttcc

SEQ ID NO: 457928 - DNA, 25 bp, Mus musculus
gacggccttgagagcatggccatga

SEQ ID NO: 457929 - DNA, 25 bp, Mus musculus
gacggccttgagtgcatggccatga

SEQ ID NO: 457930 - DNA, 25 bp, Mus musculus
gacggccttgccaagaacactgagg

SEQ ID NO: 457931 - DNA, 25 bp, Mus musculus
gacggccttgcctagaacactgagg

SEQ ID NO: 457932 - DNA, 25 bp, Mus musculus
gacggccttgtcagtaatgtgctga

SEQ ID NO: 457933 - DNA, 25 bp, Mus musculus
gacggccttgtctgtaatgtgctga

SEQ ID NO: 457934 - DNA, 25 bp, Mus musculus
gacggcgagggcactcgaccttcga

SEQ ID NO: 457935 - DNA, 25 bp, Mus musculus
gacggcgagggctctcgaccttcga

SEQ ID NO: 457936 - DNA, 25 bp, Mus musculus
gacggcgatgggatcattaccctgc

SEQ ID NO: 457937 - DNA, 25 bp, Mus musculus
gacggcgatgggttcattaccctgc

SEQ ID NO: 457938 - DNA, 25 bp, Mus musculus
gacggcgcatacatcggcactggtt

SEQ ID NO: 457939 - DNA, 25 bp, Mus musculus
gacggcgcatacttcggcactggtt

SEQ ID NO: 457940 - DNA, 25 bp, Mus musculus
gacggcgctgctagtaaaggtgttt

SEQ ID NO: 457941 - DNA, 25 bp, Mus musculus
gacggcgctgcttgtaaaggtgttt

SEQ ID NO: 457942 - DNA, 25 bp, Mus musculus
gacggcgggaagaccacggaggccg

SEQ ID NO: 457943 - DNA, 25 bp, Mus musculus
gacggcgggaagtccacggaggccg

SEQ ID NO: 457944 - DNA, 25 bp, Mus musculus
gacggcgtgaccaccagctgcaatg

SEQ ID NO: 457945 - DNA, 25 bp, Mus musculus
gacggcgtgacctccagctgcaatg

SEQ ID NO: 457946 - DNA, 25 bp, Mus musculus
gacggcgtgctgaggtccgcaggaa

SEQ ID NO: 457947 - DNA, 25 bp, Mus musculus
gacggcgtgctgtggtccgcaggaa

SEQ ID NO: 457948 - DNA, 25 bp, Mus musculus
gacggcgtttatcagaccagcttcc

SEQ ID NO: 457949 - DNA, 25 bp, Mus musculus
gacggcgtttatgagaccagcttcc

SEQ ID NO: 457950 - DNA, 25 bp, Mus musculus
gacggctacgatatcggcgatgacc

SEQ ID NO: 457951 - DNA, 25 bp, Mus musculus
gacggctacgatttcggcgatgacc

SEQ ID NO: 457952 - DNA, 25 bp, Mus musculus
gacggctactctccaaacagacgat

SEQ ID NO: 457953 - DNA, 25 bp, Mus musculus
gacggctactctgcaaacagacgat

SEQ ID NO: 457954 - DNA, 25 bp, Mus musculus
gacggctactggattgagattctga

SEQ ID NO: 457955 - DNA, 25 bp, Mus musculus
gacggctactggtttgagattctga

SEQ ID NO: 457956 - DNA, 25 bp, Mus musculus
gacggctatggaactccagtgagat

SEQ ID NO: 457957 - DNA, 25 bp, Mus musculus
gacggctatggatctccagtgagat

SEQ ID NO: 457958 - DNA, 25 bp, Mus musculus
gacggctcaccacccacagatgaga

SEQ ID NO: 457959 - DNA, 25 bp, Mus musculus
gacggctcaccagccacagatgaga

SEQ ID NO: 457960 - DNA, 25 bp, Mus musculus
gacggctctaatcttgtacactcca

SEQ ID NO: 457961 - DNA, 25 bp, Mus musculus
gacggctctaatgttgtacactcca

SEQ ID NO: 457962 - DNA, 25 bp, Mus musculus
gacggctctacacaagctgcgcaag

SEQ ID NO: 457963 - DNA, 25 bp, Mus musculus
gacggctctacagaagctgcgcaag

SEQ ID NO: 457964 - DNA, 25 bp, Mus musculus
gacggctctcccaggagcttctgag

SEQ ID NO: 457965 - DNA, 25 bp, Mus musculus
gacggctctccctggagcttctgag

SEQ ID NO: 457966 - DNA, 25 bp, Mus musculus
gacggctctgagaaaacagcacaaa

SEQ ID NO: 457967 - DNA, 25 bp, Mus musculus
gacggctctgagtaaacagcacaaa

SEQ ID NO: 457968 - DNA, 25 bp, Mus musculus
gacggctgaattcggcatacgacat

SEQ ID NO: 457969 - DNA, 25 bp, Mus musculus
gacggctgaattgggcatacgacat

SEQ ID NO: 457970 - DNA, 25 bp, Mus musculus
gacggctgggtaactacggatccaa

SEQ ID NO: 457971 - DNA, 25 bp, Mus musculus
gacggctgggtatctacggatccaa

SEQ ID NO: 457972 - DNA, 25 bp, Mus musculus
gacggctggttcaaaggcacgttac

SEQ ID NO: 457973 - DNA, 25 bp, Mus musculus
gacggctggttctaaggcacgttac

SEQ ID NO: 457974 - DNA, 25 bp, Mus musculus
gacggctgtcacagttagctgacat

SEQ ID NO: 457975 - DNA, 25 bp, Mus musculus
gacggctgtcactgttagctgacat

SEQ ID NO: 457976 - DNA, 25 bp, Mus musculus
gacggcttagggaagcacgttccaa

SEQ ID NO: 457977 - DNA, 25 bp, Mus musculus
gacggcttagggtagcacgttccaa

SEQ ID NO: 457978 - DNA, 25 bp, Mus musculus
gacggcttataacatcaccagggat

SEQ ID NO: 457979 - DNA, 25 bp, Mus musculus
gacggcttataagatcaccagggat

SEQ ID NO: 457980 - DNA, 25 bp, Mus musculus
gacggcttcagtatatgccagcttg

SEQ ID NO: 457981 - DNA, 25 bp, Mus musculus
gacggcttcagtttatgccagcttg

SEQ ID NO: 457982 - DNA, 25 bp, Mus musculus
gacggcttcccgattgatgaagaaa

SEQ ID NO: 457983 - DNA, 25 bp, Mus musculus
gacggcttcccgtttgatgaagaaa

SEQ ID NO: 457984 - DNA, 25 bp, Mus musculus
gacggcttctcacgctttgtttact

SEQ ID NO: 457985 - DNA, 25 bp, Mus musculus
gacggcttctcaggctttgtttact

SEQ ID NO: 457986 - DNA, 25 bp, Mus musculus
gacggctttcaaatggtgctttcta

SEQ ID NO: 457987 - DNA, 25 bp, Mus musculus
gacggctttcaattggtgctttcta

SEQ ID NO: 457988 - DNA, 25 bp, Mus musculus
gacggctttttaagccaattagcag

SEQ ID NO: 457989 - DNA, 25 bp, Mus musculus
gacggctttttatgccaattagcag

SEQ ID NO: 457990 - DNA, 25 bp, Mus musculus
gacgggaaaagtctgttcctacaat

SEQ ID NO: 457991 - DNA, 25 bp, Mus musculus
gacgggaaaagtgtgttcctacaat

SEQ ID NO: 457992 - DNA, 25 bp, Mus musculus
gacgggaaacttattgataatagca

SEQ ID NO: 457993 - DNA, 25 bp, Mus musculus
gacgggaaactttttgataatagca

SEQ ID NO: 457994 - DNA, 25 bp, Mus musculus
gacgggaaatcgcaagccacttttg

SEQ ID NO: 457995 - DNA, 25 bp, Mus musculus
gacgggaaatcggaagccacttttg

SEQ ID NO: 457996 - DNA, 25 bp, Mus musculus
gacgggaacataacaaggcctcttg

SEQ ID NO: 457997 - DNA, 25 bp, Mus musculus
gacgggaacatatcaaggcctcttg

SEQ ID NO: 457998 - DNA, 25 bp, Mus musculus
gacgggaactccatcaaggtgaacc

SEQ ID NO: 457999 - DNA, 25 bp, Mus musculus
gacgggaactccttcaaggtgaacc

SEQ ID NO: 458000 - DNA, 25 bp, Mus musculus
gacgggaacttgctccttcttgccg

SEQ ID NO: 458001 - DNA, 25 bp, Mus musculus
gacgggaacttggtccttcttgccg

SEQ ID NO: 458002 - DNA, 25 bp, Mus musculus
gacgggaagaacctacagatgacaa

SEQ ID NO: 458003 - DNA, 25 bp, Mus musculus
gacgggaagaacgtacagatgacaa

SEQ ID NO: 458004 - DNA, 25 bp, Mus musculus
gacgggaaggtgatcgtctcttctt

SEQ ID NO: 458005 - DNA, 25 bp, Mus musculus
gacgggaaggtgttcgtctcttctt

SEQ ID NO: 458006 - DNA, 25 bp, Mus musculus
gacgggaattccagaccagtgtcat

SEQ ID NO: 458007 - DNA, 25 bp, Mus musculus
gacgggaattcctgaccagtgtcat

SEQ ID NO: 458008 - DNA, 25 bp, Mus musculus
gacgggacactgagacacggaacat

SEQ ID NO: 458009 - DNA, 25 bp, Mus musculus
gacgggacactgtgacacggaacat

SEQ ID NO: 458010 - DNA, 25 bp, Mus musculus
gacgggacagatcctttccatggct

SEQ ID NO: 458011 - DNA, 25 bp, Mus musculus
gacgggacagatgctttccatggct

SEQ ID NO: 458012 - DNA, 25 bp, Mus musculus
gacgggacagtcaccctcatacaga

SEQ ID NO: 458013 - DNA, 25 bp, Mus musculus
gacgggacagtctccctcatacaga

SEQ ID NO: 458014 - DNA, 25 bp, Mus musculus
gacgggacagtgaatgaccatgcat

SEQ ID NO: 458015 - DNA, 25 bp, Mus musculus
gacgggacagtgtatgaccatgcat

SEQ ID NO: 458016 - DNA, 25 bp, Mus musculus
gacgggacatcgagtgacatactcc

SEQ ID NO: 458017 - DNA, 25 bp, Mus musculus
gacgggacatcgtgtgacatactcc

SEQ ID NO: 458018 - DNA, 25 bp, Mus musculus
gacgggacatgcatccagattttct

SEQ ID NO: 458019 - DNA, 25 bp, Mus musculus
gacgggacatgcttccagattttct

SEQ ID NO: 458020 - DNA, 25 bp, Mus musculus
gacgggacatggaggctgattttca

SEQ ID NO: 458021 - DNA, 25 bp, Mus musculus
gacgggacatggtggctgattttca

SEQ ID NO: 458022 - DNA, 25 bp, Mus musculus
gacgggaccagtctgtctagacgac

SEQ ID NO: 458023 - DNA, 25 bp, Mus musculus
gacgggaccagtgtgtctagacgac

SEQ ID NO: 458024 - DNA, 25 bp, Mus musculus
gacgggacgtctccgtgaagactca

SEQ ID NO: 458025 - DNA, 25 bp, Mus musculus
gacgggacgtctgcgtgaagactca

SEQ ID NO: 458026 - DNA, 25 bp, Mus musculus
gacgggagaaaccatggcttataca

SEQ ID NO: 458027 - DNA, 25 bp, Mus musculus
gacgggagaaacgatggcttataca

SEQ ID NO: 458028 - DNA, 25 bp, Mus musculus
gacgggagccctagacagtagacct

SEQ ID NO: 458029 - DNA, 25 bp, Mus musculus
gacgggagcccttgacagtagacct

SEQ ID NO: 458030 - DNA, 25 bp, Mus musculus
gacgggagcctgatgggtttataaa

SEQ ID NO: 458031 - DNA, 25 bp, Mus musculus
gacgggagcctgttgggtttataaa

SEQ ID NO: 458032 - DNA, 25 bp, Mus musculus
gacgggagggaaatctctcttcgac

SEQ ID NO: 458033 - DNA, 25 bp, Mus musculus
gacgggagggaattctctcttcgac

SEQ ID NO: 458034 - DNA, 25 bp, Mus musculus
gacgggagggatcctgataaaaact

SEQ ID NO: 458035 - DNA, 25 bp, Mus musculus
gacgggagggatgctgataaaaact

SEQ ID NO: 458036 - DNA, 25 bp, Mus musculus
gacgggatacttaaaagaacatgtt

SEQ ID NO: 458037 - DNA, 25 bp, Mus musculus
gacgggatactttaaagaacatgtt

SEQ ID NO: 458038 - DNA, 25 bp, Mus musculus
gacgggatattgctttccttaacag

SEQ ID NO: 458039 - DNA, 25 bp, Mus musculus
gacgggatattggtttccttaacag

SEQ ID NO: 458040 - DNA, 25 bp, Mus musculus
gacgggatcattagtgtccccgcgt

SEQ ID NO: 458041 - DNA, 25 bp, Mus musculus
gacgggatcatttgtgtccccgcgt

SEQ ID NO: 458042 - DNA, 25 bp, Mus musculus
gacgggattttcatttacctatact

SEQ ID NO: 458043 - DNA, 25 bp, Mus musculus
gacgggattttcttttacctatact

SEQ ID NO: 458044 - DNA, 25 bp, Mus musculus
gacgggcaagatattaacagtatag

SEQ ID NO: 458045 - DNA, 25 bp, Mus musculus
gacgggcaagattttaacagtatag

SEQ ID NO: 458046 - DNA, 25 bp, Mus musculus
gacgggcaagtgaccttcctccatg

SEQ ID NO: 458047 - DNA, 25 bp, Mus musculus
gacgggcaagtgtccttcctccatg

SEQ ID NO: 458048 - DNA, 25 bp, Mus musculus
gacgggcacgcacagaacctggtac

SEQ ID NO: 458049 - DNA, 25 bp, Mus musculus
gacgggcacgcagagaacctggtac

SEQ ID NO: 458050 - DNA, 25 bp, Mus musculus
gacgggcagctcagataagacagcc

SEQ ID NO: 458051 - DNA, 25 bp, Mus musculus
gacgggcagctctgataagacagcc

SEQ ID NO: 458052 - DNA, 25 bp, Mus musculus
gacgggcaggaaactgactcccaag

SEQ ID NO: 458053 - DNA, 25 bp, Mus musculus
gacgggcaggaatctgactcccaag

SEQ ID NO: 458054 - DNA, 25 bp, Mus musculus
gacgggcaggacacaacaagagcct

SEQ ID NO: 458055 - DNA, 25 bp, Mus musculus
gacgggcaggactcaacaagagcct

SEQ ID NO: 458056 - DNA, 25 bp, Mus musculus
gacgggcagtgcattgggttcaaat

SEQ ID NO: 458057 - DNA, 25 bp, Mus musculus
gacgggcagtgctttgggttcaaat

SEQ ID NO: 458058 - DNA, 25 bp, Mus musculus
gacgggcatagcatcagctcaagca

SEQ ID NO: 458059 - DNA, 25 bp, Mus musculus
gacgggcatagcttcagctcaagca

SEQ ID NO: 458060 - DNA, 25 bp, Mus musculus
gacgggccatgaacacatacggtgg

SEQ ID NO: 458061 - DNA, 25 bp, Mus musculus
gacgggccatgatcacatacggtgg

SEQ ID NO: 458062 - DNA, 25 bp, Mus musculus
gacgggcccactaatttggctaagg

SEQ ID NO: 458063 - DNA, 25 bp, Mus musculus
gacgggcccacttatttggctaagg

SEQ ID NO: 458064 - DNA, 25 bp, Mus musculus
gacgggcctatacttccaatttttg

SEQ ID NO: 458065 - DNA, 25 bp, Mus musculus
gacgggcctatagttccaatttttg

SEQ ID NO: 458066 - DNA, 25 bp, Mus musculus
gacgggctcacacactctggaggta

SEQ ID NO: 458067 - DNA, 25 bp, Mus musculus
gacgggctcacagactctggaggta

SEQ ID NO: 458068 - DNA, 25 bp, Mus musculus
gacgggctctcacctctgtgaaaaa

SEQ ID NO: 458069 - DNA, 25 bp, Mus musculus
gacgggctctcagctctgtgaaaaa

SEQ ID NO: 458070 - DNA, 25 bp, Mus musculus
gacgggctgcagaactggccaacag

SEQ ID NO: 458071 - DNA, 25 bp, Mus musculus
gacgggctgcagtactggccaacag

SEQ ID NO: 458072 - DNA, 25 bp, Mus musculus
gacgggtacgggagtccgcaccaca

SEQ ID NO: 458073 - DNA, 25 bp, Mus musculus
gacgggtacgggtgtccgcaccaca

SEQ ID NO: 458074 - DNA, 25 bp, Mus musculus
gacgggtatttcactgcatcaattt

SEQ ID NO: 458075 - DNA, 25 bp, Mus musculus
gacgggtatttctctgcatcaattt

SEQ ID NO: 458076 - DNA, 25 bp, Mus musculus
gacgggtccaccactctgttaattt

SEQ ID NO: 458077 - DNA, 25 bp, Mus musculus
gacgggtccacctctctgttaattt

SEQ ID NO: 458078 - DNA, 25 bp, Mus musculus
gacgggtctataaatccatggtgct

SEQ ID NO: 458079 - DNA, 25 bp, Mus musculus
gacgggtctatatatccatggtgct

SEQ ID NO: 458080 - DNA, 25 bp, Mus musculus
gacgggtctttgagccaatgctaca

SEQ ID NO: 458081 - DNA, 25 bp, Mus musculus
gacgggtctttgtgccaatgctaca

SEQ ID NO: 458082 - DNA, 25 bp, Mus musculus
gacgggtgatgtcactttgctctgc

SEQ ID NO: 458083 - DNA, 25 bp, Mus musculus
gacgggtgatgtgactttgctctgc

SEQ ID NO: 458084 - DNA, 25 bp, Mus musculus
gacgggtgcattctcagtgaactca

SEQ ID NO: 458085 - DNA, 25 bp, Mus musculus
gacgggtgcattgtcagtgaactca

SEQ ID NO: 458086 - DNA, 25 bp, Mus musculus
gacgggtgccaacctaccagtaaag

SEQ ID NO: 458087 - DNA, 25 bp, Mus musculus
gacgggtgccaagctaccagtaaag

SEQ ID NO: 458088 - DNA, 25 bp, Mus musculus
gacgggtgggacacagctgtaatcc

SEQ ID NO: 458089 - DNA, 25 bp, Mus musculus
gacgggtgggactcagctgtaatcc

SEQ ID NO: 458090 - DNA, 25 bp, Mus musculus
gacgggtgtggtagagccatttctc

SEQ ID NO: 458091 - DNA, 25 bp, Mus musculus
gacgggtgtggttgagccatttctc

SEQ ID NO: 458092 - DNA, 25 bp, Mus musculus
gacgggttcatacatatattccctg

SEQ ID NO: 458093 - DNA, 25 bp, Mus musculus
gacgggttcatagatatattccctg

SEQ ID NO: 458094 - DNA, 25 bp, Mus musculus
gacgggttcatcaacgtggcaaacg

SEQ ID NO: 458095 - DNA, 25 bp, Mus musculus
gacgggttcatctacgtggcaaacg

SEQ ID NO: 458096 - DNA, 25 bp, Mus musculus
gacgggttctaccaagttgactaca

SEQ ID NO: 458097 - DNA, 25 bp, Mus musculus
gacgggttctacgaagttgactaca

SEQ ID NO: 458098 - DNA, 25 bp, Mus musculus
gacgggttgtgtatgtcccagccct

SEQ ID NO: 458099 - DNA, 25 bp, Mus musculus
gacgggttgtgtttgtcccagccct

SEQ ID NO: 458100 - DNA, 25 bp, Mus musculus
gacgggttgttacgagcactccctg

SEQ ID NO: 458101 - DNA, 25 bp, Mus musculus
gacgggttgttaggagcactccctg

SEQ ID NO: 458102 - DNA, 25 bp, Mus musculus
gacgggtttctgacagtgtttgctc

SEQ ID NO: 458103 - DNA, 25 bp, Mus musculus
gacgggtttctgtcagtgtttgctc

SEQ ID NO: 458104 - DNA, 25 bp, Mus musculus
gacggtaccagacccctgataagaa

SEQ ID NO: 458105 - DNA, 25 bp, Mus musculus
gacggtaccagagccctgataagaa

SEQ ID NO: 458106 - DNA, 25 bp, Mus musculus
gacggtactagaatcttttctatcc

SEQ ID NO: 458107 - DNA, 25 bp, Mus musculus
gacggtactagattcttttctatcc

SEQ ID NO: 458108 - DNA, 25 bp, Mus musculus
gacggtagcaggctcaacacagcct

SEQ ID NO: 458109 - DNA, 25 bp, Mus musculus
gacggtagcagggtcaacacagcct

SEQ ID NO: 458110 - DNA, 25 bp, Mus musculus
gacggtagcatgactctggtgctct

SEQ ID NO: 458111 - DNA, 25 bp, Mus musculus
gacggtagcatgtctctggtgctct

SEQ ID NO: 458112 - DNA, 25 bp, Mus musculus
gacggtagccttaaaaagatacaca

SEQ ID NO: 458113 - DNA, 25 bp, Mus musculus
gacggtagcctttaaaagatacaca

SEQ ID NO: 458114 - DNA, 25 bp, Mus musculus
gacggtagggccattatatcctatt

SEQ ID NO: 458115 - DNA, 25 bp, Mus musculus
gacggtagggcctttatatcctatt

SEQ ID NO: 458116 - DNA, 25 bp, Mus musculus
gacggtatagagaacctttctctga

SEQ ID NO: 458117 - DNA, 25 bp, Mus musculus
gacggtatagagtacctttctctga

SEQ ID NO: 458118 - DNA, 25 bp, Mus musculus
gacggtcacagaagatgtgcggatt

SEQ ID NO: 458119 - DNA, 25 bp, Mus musculus
gacggtcacagatgatgtgcggatt

SEQ ID NO: 458120 - DNA, 25 bp, Mus musculus
gacggtcacggacgataagatcaat

SEQ ID NO: 458121 - DNA, 25 bp, Mus musculus
gacggtcacggaggataagatcaat

SEQ ID NO: 458122 - DNA, 25 bp, Mus musculus
gacggtcagagactccaggatacca

SEQ ID NO: 458123 - DNA, 25 bp, Mus musculus
gacggtcagagagtccaggatacca

SEQ ID NO: 458124 - DNA, 25 bp, Mus musculus
gacggtcaggtaaactacgaagagt

SEQ ID NO: 458125 - DNA, 25 bp, Mus musculus
gacggtcaggtatactacgaagagt

SEQ ID NO: 458126 - DNA, 25 bp, Mus musculus
gacggtcatactcaggttgtggctc

SEQ ID NO: 458127 - DNA, 25 bp, Mus musculus
gacggtcatactgaggttgtggctc

SEQ ID NO: 458128 - DNA, 25 bp, Mus musculus
gacggtccagacagtgtcatacggg

SEQ ID NO: 458129 - DNA, 25 bp, Mus musculus
gacggtccagactgtgtcatacggg

SEQ ID NO: 458130 - DNA, 25 bp, Mus musculus
gacggtccaggaagcgctaagtagc

SEQ ID NO: 458131 - DNA, 25 bp, Mus musculus
gacggtccaggatgcgctaagtagc

SEQ ID NO: 458132 - DNA, 25 bp, Mus musculus
gacggtccatatagggtgtcattcc

SEQ ID NO: 458133 - DNA, 25 bp, Mus musculus
gacggtccatattgggtgtcattcc

SEQ ID NO: 458134 - DNA, 25 bp, Mus musculus
gacggtcctagacaaagttatggta

SEQ ID NO: 458135 - DNA, 25 bp, Mus musculus
gacggtcctagagaaagttatggta

SEQ ID NO: 458136 - DNA, 25 bp, Mus musculus
gacggtccttgcagattgcttcata

SEQ ID NO: 458137 - DNA, 25 bp, Mus musculus
gacggtccttgctgattgcttcata

SEQ ID NO: 458138 - DNA, 25 bp, Mus musculus
gacggtctaccactcagagattcct

SEQ ID NO: 458139 - DNA, 25 bp, Mus musculus
gacggtctaccagtcagagattcct

SEQ ID NO: 458140 - DNA, 25 bp, Mus musculus
gacggtctggatactgacgcccagc

SEQ ID NO: 458141 - DNA, 25 bp, Mus musculus
gacggtctggattctgacgcccagc

SEQ ID NO: 458142 - DNA, 25 bp, Mus musculus
gacggtctgttcatatcttaccagt

SEQ ID NO: 458143 - DNA, 25 bp, Mus musculus
gacggtctgttcttatcttaccagt

SEQ ID NO: 458144 - DNA, 25 bp, Mus musculus
gacggtgaaaaactgcttggctcta

SEQ ID NO: 458145 - DNA, 25 bp, Mus musculus
gacggtgaaaaagtgcttggctcta

SEQ ID NO: 458146 - DNA, 25 bp, Mus musculus
gacggtgaacatagccatttccagg

SEQ ID NO: 458147 - DNA, 25 bp, Mus musculus
gacggtgaacattgccatttccagg

SEQ ID NO: 458148 - DNA, 25 bp, Mus musculus
gacggtgaagatcttcactttccta

SEQ ID NO: 458149 - DNA, 25 bp, Mus musculus
gacggtgaagatgttcactttccta

SEQ ID NO: 458150 - DNA, 25 bp, Mus musculus
gacggtgaaggcagtttttgttgtt

SEQ ID NO: 458151 - DNA, 25 bp, Mus musculus
gacggtgaaggctgtttttgttgtt

SEQ ID NO: 458152 - DNA, 25 bp, Mus musculus
gacggtgaagtcagtaggcatgatt

SEQ ID NO: 458153 - DNA, 25 bp, Mus musculus
gacggtgaagtctgtaggcatgatt

SEQ ID NO: 458154 - DNA, 25 bp, Mus musculus
gacggtgaccatcctgttcaggtta

SEQ ID NO: 458155 - DNA, 25 bp, Mus musculus
gacggtgaccatgctgttcaggtta

SEQ ID NO: 458156 - DNA, 25 bp, Mus musculus
gacggtgagcacctactttcatgaa

SEQ ID NO: 458157 - DNA, 25 bp, Mus musculus
gacggtgagcacgtactttcatgaa

SEQ ID NO: 458158 - DNA, 25 bp, Mus musculus
gacggtgagctgatgatttcctaac

SEQ ID NO: 458159 - DNA, 25 bp, Mus musculus
gacggtgagctgttgatttcctaac

SEQ ID NO: 458160 - DNA, 25 bp, Mus musculus
gacggtgatcagagtcctcaagcaa

SEQ ID NO: 458161 - DNA, 25 bp, Mus musculus
gacggtgatcagtgtcctcaagcaa

SEQ ID NO: 458162 - DNA, 25 bp, Mus musculus
gacggtgatgctatgccattgggta

SEQ ID NO: 458163 - DNA, 25 bp, Mus musculus
gacggtgatgctttgccattgggta

SEQ ID NO: 458164 - DNA, 25 bp, Mus musculus
gacggtgattcaatgctcaaaacta

SEQ ID NO: 458165 - DNA, 25 bp, Mus musculus
gacggtgattcattgctcaaaacta

SEQ ID NO: 458166 - DNA, 25 bp, Mus musculus
gacggtgcctgtaacttacctgaag

SEQ ID NO: 458167 - DNA, 25 bp, Mus musculus
gacggtgcctgttacttacctgaag

SEQ ID NO: 458168 - DNA, 25 bp, Mus musculus
gacggtgctcatcactcttctggga

SEQ ID NO: 458169 - DNA, 25 bp, Mus musculus
gacggtgctcatgactcttctggga

SEQ ID NO: 458170 - DNA, 25 bp, Mus musculus
gacggtgctggaccactatgctcta

SEQ ID NO: 458171 - DNA, 25 bp, Mus musculus
gacggtgctggagcactatgctcta

SEQ ID NO: 458172 - DNA, 25 bp, Mus musculus
gacggtgctgtccttaagtctatgg

SEQ ID NO: 458173 - DNA, 25 bp, Mus musculus
gacggtgctgtcgttaagtctatgg

SEQ ID NO: 458174 - DNA, 25 bp, Mus musculus
gacggtgctttaaggaagtcatgat

SEQ ID NO: 458175 - DNA, 25 bp, Mus musculus
gacggtgctttatggaagtcatgat

SEQ ID NO: 458176 - DNA, 25 bp, Mus musculus
gacggtggagtgaattcatcttctg

SEQ ID NO: 458177 - DNA, 25 bp, Mus musculus
gacggtggagtgtattcatcttctg

SEQ ID NO: 458178 - DNA, 25 bp, Mus musculus
gacggtggcagtaaaaactgctctg

SEQ ID NO: 458179 - DNA, 25 bp, Mus musculus
gacggtggcagtagcaatctttctt

SEQ ID NO: 458180 - DNA, 25 bp, Mus musculus
gacggtggcagttaaaactgctctg

SEQ ID NO: 458181 - DNA, 25 bp, Mus musculus
gacggtggcagttgcaatctttctt

SEQ ID NO: 458182 - DNA, 25 bp, Mus musculus
gacggtgggtcgctagaagtcatgc

SEQ ID NO: 458183 - DNA, 25 bp, Mus musculus
gacggtgggtcggtagaagtcatgc

SEQ ID NO: 458184 - DNA, 25 bp, Mus musculus
gacggtggtcataacaccagtgtga

SEQ ID NO: 458185 - DNA, 25 bp, Mus musculus
gacggtggtcattacaccagtgtga

SEQ ID NO: 458186 - DNA, 25 bp, Mus musculus
gacggtggtggccatctcactcttg

SEQ ID NO: 458187 - DNA, 25 bp, Mus musculus
gacggtggtggcgatctcactcttg

SEQ ID NO: 458188 - DNA, 25 bp, Mus musculus
gacggtggttccagtaccttttgag

SEQ ID NO: 458189 - DNA, 25 bp, Mus musculus
gacggtggttcctgtaccttttgag

SEQ ID NO: 458190 - DNA, 25 bp, Mus musculus
gacggtgtacttcacttatctacta

SEQ ID NO: 458191 - DNA, 25 bp, Mus musculus
gacggtgtacttgacttatctacta

SEQ ID NO: 458192 - DNA, 25 bp, Mus musculus
gacggtgtcaacactgacaaggtgc

SEQ ID NO: 458193 - DNA, 25 bp, Mus musculus
gacggtgtcaactctgacaaggtgc

SEQ ID NO: 458194 - DNA, 25 bp, Mus musculus
gacggtgtccctcagtgacttgaga

SEQ ID NO: 458195 - DNA, 25 bp, Mus musculus
gacggtgtccctgagtgacttgaga

SEQ ID NO: 458196 - DNA, 25 bp, Mus musculus
gacggtgtctgtcgcctcatggaca

SEQ ID NO: 458197 - DNA, 25 bp, Mus musculus
gacggtgtctgtggcctcatggaca

SEQ ID NO: 458198 - DNA, 25 bp, Mus musculus
gacggtgtggccaatgtgtccattg

SEQ ID NO: 458199 - DNA, 25 bp, Mus musculus
gacggtgtggcctatgtgtccattg

SEQ ID NO: 458200 - DNA, 25 bp, Mus musculus
gacggtgtggtcaagcactacctat

SEQ ID NO: 458201 - DNA, 25 bp, Mus musculus
gacggtgtggtctagcactacctat

SEQ ID NO: 458202 - DNA, 25 bp, Mus musculus
gacggtgtggtgacaccattcacct

SEQ ID NO: 458203 - DNA, 25 bp, Mus musculus
gacggtgtggtgtcaccattcacct

SEQ ID NO: 458204 - DNA, 25 bp, Mus musculus
gacggtgttaagagcaactgtactg

SEQ ID NO: 458205 - DNA, 25 bp, Mus musculus
gacggtgttaagtgcaactgtactg

SEQ ID NO: 458206 - DNA, 25 bp, Mus musculus
gacggtgttacgacagatcccctct

SEQ ID NO: 458207 - DNA, 25 bp, Mus musculus
gacggtgttacgtcagatcccctct

SEQ ID NO: 458208 - DNA, 25 bp, Mus musculus
gacggtgttgagatactcccaagct

SEQ ID NO: 458209 - DNA, 25 bp, Mus musculus
gacggtgttgagttactcccaagct

SEQ ID NO: 458210 - DNA, 25 bp, Mus musculus
gacggttaacttccatcatgacttt

SEQ ID NO: 458211 - DNA, 25 bp, Mus musculus
gacggttaacttgcatcatgacttt

SEQ ID NO: 458212 - DNA, 25 bp, Mus musculus
gacggttaatggaactttactaatg

SEQ ID NO: 458213 - DNA, 25 bp, Mus musculus
gacggttaatggagtcacccacaca

SEQ ID NO: 458214 - DNA, 25 bp, Mus musculus
gacggttaatggtactttactaatg

SEQ ID NO: 458215 - DNA, 25 bp, Mus musculus
gacggttaatggtgtcacccacaca

SEQ ID NO: 458216 - DNA, 25 bp, Mus musculus
gacggttacaggagaaatccttgta

SEQ ID NO: 458217 - DNA, 25 bp, Mus musculus
gacggttacaggtgaaatccttgta

SEQ ID NO: 458218 - DNA, 25 bp, Mus musculus
gacggttacctaagtgtgtcaatgt

SEQ ID NO: 458219 - DNA, 25 bp, Mus musculus
gacggttacctatgtgtgtcaatgt

SEQ ID NO: 458220 - DNA, 25 bp, Mus musculus
gacggttactccatgagttattaca

SEQ ID NO: 458221 - DNA, 25 bp, Mus musculus
gacggttactccttgagttattaca

SEQ ID NO: 458222 - DNA, 25 bp, Mus musculus
gacggttactgtagaggttctccac

SEQ ID NO: 458223 - DNA, 25 bp, Mus musculus
gacggttactgtccttgtgatcata

SEQ ID NO: 458224 - DNA, 25 bp, Mus musculus
gacggttactgtgcttgtgatcata

SEQ ID NO: 458225 - DNA, 25 bp, Mus musculus
gacggttactgttgaggttctccac

SEQ ID NO: 458226 - DNA, 25 bp, Mus musculus
gacggttagtgaaagctgatctgat

SEQ ID NO: 458227 - DNA, 25 bp, Mus musculus
gacggttagtgatagctgatctgat

SEQ ID NO: 458228 - DNA, 25 bp, Mus musculus
gacggttcaccgaaggaggactcct

SEQ ID NO: 458229 - DNA, 25 bp, Mus musculus
gacggttcaccgtaggaggactcct

SEQ ID NO: 458230 - DNA, 25 bp, Mus musculus
gacggttcagtgaatctttgcctgc

SEQ ID NO: 458231 - DNA, 25 bp, Mus musculus
gacggttcagtgtatctttgcctgc

SEQ ID NO: 458232 - DNA, 25 bp, Mus musculus
gacggttctggccttcccaaactgc

SEQ ID NO: 458233 - DNA, 25 bp, Mus musculus
gacggttctggcgttcccaaactgc

SEQ ID NO: 458234 - DNA, 25 bp, Mus musculus
gacggttgcatgagagcttccgtga

SEQ ID NO: 458235 - DNA, 25 bp, Mus musculus
gacggttgcatgtgagcttccgtga

SEQ ID NO: 458236 - DNA, 25 bp, Mus musculus
gacggtttacagctgggtaactgca

SEQ ID NO: 458237 - DNA, 25 bp, Mus musculus
gacggtttacaggtgggtaactgca

SEQ ID NO: 458238 - DNA, 25 bp, Mus musculus
gacggtttatttcctagttgatttg

SEQ ID NO: 458239 - DNA, 25 bp, Mus musculus
gacggtttatttgctagttgatttg

SEQ ID NO: 458240 - DNA, 25 bp, Mus musculus
gacggtttcaggagccaggaactat

SEQ ID NO: 458241 - DNA, 25 bp, Mus musculus
gacggtttcaggtgccaggaactat

SEQ ID NO: 458242 - DNA, 25 bp, Mus musculus
gacggtttctgtataaattcaggca

SEQ ID NO: 458243 - DNA, 25 bp, Mus musculus
gacggtttctgtctagtgtacaact

SEQ ID NO: 458244 - DNA, 25 bp, Mus musculus
gacggtttctgtgtagtgtacaact

SEQ ID NO: 458245 - DNA, 25 bp, Mus musculus
gacggtttctgtttaaattcaggca

SEQ ID NO: 458246 - DNA, 25 bp, Mus musculus
gacggtttggctagacgttagacac

SEQ ID NO: 458247 - DNA, 25 bp, Mus musculus
gacggtttggcttgacgttagacac

SEQ ID NO: 458248 - DNA, 25 bp, Mus musculus
gacggtttgtgaaagtgccagtcca

SEQ ID NO: 458249 - DNA, 25 bp, Mus musculus
gacggtttgtgatagtgccagtcca

SEQ ID NO: 458250 - DNA, 25 bp, Mus musculus
gacggttttctcatggtcaggaaag

SEQ ID NO: 458251 - DNA, 25 bp, Mus musculus
gacggttttctcttggtcaggaaag

SEQ ID NO: 458252 - DNA, 25 bp, Mus musculus
gacggttttgaccagagctcatccc

SEQ ID NO: 458253 - DNA, 25 bp, Mus musculus
gacggttttgacgagagctcatccc

SEQ ID NO: 458254 - DNA, 25 bp, Mus musculus
gacggtttttagctgacattcatgg

SEQ ID NO: 458255 - DNA, 25 bp, Mus musculus
gacggtttttaggtgacattcatgg

SEQ ID NO: 458256 - DNA, 25 bp, Mus musculus
gacgtaaaatcgaatgcccataggg

SEQ ID NO: 458257 - DNA, 25 bp, Mus musculus
gacgtaaaatcgtatgcccataggg

SEQ ID NO: 458258 - DNA, 25 bp, Mus musculus
gacgtaaaccttcaggtttgcttga

SEQ ID NO: 458259 - DNA, 25 bp, Mus musculus
gacgtaaaccttgaggtttgcttga

SEQ ID NO: 458260 - DNA, 25 bp, Mus musculus
gacgtaaacgcactggtgagagact

SEQ ID NO: 458261 - DNA, 25 bp, Mus musculus
gacgtaaacgcagtggtgagagact

SEQ ID NO: 458262 - DNA, 25 bp, Mus musculus
gacgtaaactacactcagctagtcg

SEQ ID NO: 458263 - DNA, 25 bp, Mus musculus
gacgtaaactactctcagctagtcg

SEQ ID NO: 458264 - DNA, 25 bp, Mus musculus
gacgtaaagcatctgtggaatccca

SEQ ID NO: 458265 - DNA, 25 bp, Mus musculus
gacgtaaagcatgtgtggaatccca

SEQ ID NO: 458266 - DNA, 25 bp, Mus musculus
gacgtaaatcttcccaaggacaaca

SEQ ID NO: 458267 - DNA, 25 bp, Mus musculus
gacgtaaatcttgccaaggacaaca

SEQ ID NO: 458268 - DNA, 25 bp, Mus musculus
gacgtaacccagctataggaagaca

SEQ ID NO: 458269 - DNA, 25 bp, Mus musculus
gacgtaacccaggtataggaagaca

SEQ ID NO: 458270 - DNA, 25 bp, Mus musculus
gacgtaaccctaaggtcttacactt

SEQ ID NO: 458271 - DNA, 25 bp, Mus musculus
gacgtaaccctatggtcttacactt

SEQ ID NO: 458272 - DNA, 25 bp, Mus musculus
gacgtaaccctgcccatggctaaca

SEQ ID NO: 458273 - DNA, 25 bp, Mus musculus
gacgtaaccctggccatggctaaca

SEQ ID NO: 458274 - DNA, 25 bp, Mus musculus
gacgtaacgtaacctactgttcatg

SEQ ID NO: 458275 - DNA, 25 bp, Mus musculus
gacgtaacgtaagctactgttcatg

SEQ ID NO: 458276 - DNA, 25 bp, Mus musculus
gacgtaactacaaaggccttggcca

SEQ ID NO: 458277 - DNA, 25 bp, Mus musculus
gacgtaactacataggccttggcca

SEQ ID NO: 458278 - DNA, 25 bp, Mus musculus
gacgtaacttcccagtcattatgga

SEQ ID NO: 458279 - DNA, 25 bp, Mus musculus
gacgtaacttccgagtcattatgga

SEQ ID NO: 458280 - DNA, 25 bp, Mus musculus
gacgtaagcagtctccttctttgag

SEQ ID NO: 458281 - DNA, 25 bp, Mus musculus
gacgtaagcagtgtccttctttgag

SEQ ID NO: 458282 - DNA, 25 bp, Mus musculus
gacgtaagggtaagtgcgtagactt

SEQ ID NO: 458283 - DNA, 25 bp, Mus musculus
gacgtaagggtatgtgcgtagactt

SEQ ID NO: 458284 - DNA, 25 bp, Mus musculus
gacgtaatcatgacttaagctttat

SEQ ID NO: 458285 - DNA, 25 bp, Mus musculus
gacgtaatcatgtcttaagctttat

SEQ ID NO: 458286 - DNA, 25 bp, Mus musculus
gacgtaatcctcaatgttctcacta

SEQ ID NO: 458287 - DNA, 25 bp, Mus musculus
gacgtaatcctctatgttctcacta

SEQ ID NO: 458288 - DNA, 25 bp, Mus musculus
gacgtaattagtcgctgtctcagtt

SEQ ID NO: 458289 - DNA, 25 bp, Mus musculus
gacgtaattagtggctgtctcagtt

SEQ ID NO: 458290 - DNA, 25 bp, Mus musculus
gacgtacaaagaacagccactcaag

SEQ ID NO: 458291 - DNA, 25 bp, Mus musculus
gacgtacaaagatcagccactcaag

SEQ ID NO: 458292 - DNA, 25 bp, Mus musculus
gacgtacagatgagtgtctgctgac

SEQ ID NO: 458293 - DNA, 25 bp, Mus musculus
gacgtacagatgtgtgtctgctgac

SEQ ID NO: 458294 - DNA, 25 bp, Mus musculus
gacgtacagttacaattgagatttt

SEQ ID NO: 458295 - DNA, 25 bp, Mus musculus
gacgtacagttagaattgagatttt

SEQ ID NO: 458296 - DNA, 25 bp, Mus musculus
gacgtaccagcgaatggagaaccca

SEQ ID NO: 458297 - DNA, 25 bp, Mus musculus
gacgtaccagcgtatggagaaccca

SEQ ID NO: 458298 - DNA, 25 bp, Mus musculus
gacgtacccatacccagtgtagaaa

SEQ ID NO: 458299 - DNA, 25 bp, Mus musculus
gacgtacccatagccagtgtagaaa

SEQ ID NO: 458300 - DNA, 25 bp, Mus musculus
gacgtacctacgcatttggagaaac

SEQ ID NO: 458301 - DNA, 25 bp, Mus musculus
gacgtacctacggatttggagaaac

SEQ ID NO: 458302 - DNA, 25 bp, Mus musculus
gacgtactacctcatggatccaagc

SEQ ID NO: 458303 - DNA, 25 bp, Mus musculus
gacgtactacctgatggatccaagc

SEQ ID NO: 458304 - DNA, 25 bp, Mus musculus
gacgtactatttaccaagagccatg

SEQ ID NO: 458305 - DNA, 25 bp, Mus musculus
gacgtactattttccaagagccatg

SEQ ID NO: 458306 - DNA, 25 bp, Mus musculus
gacgtactcctgctgtgctaagtgc

SEQ ID NO: 458307 - DNA, 25 bp, Mus musculus
gacgtactcctggtgtgctaagtgc

SEQ ID NO: 458308 - DNA, 25 bp, Mus musculus
gacgtactgctgactgtcacaggag

SEQ ID NO: 458309 - DNA, 25 bp, Mus musculus
gacgtactgctgtctgtcacaggag

SEQ ID NO: 458310 - DNA, 25 bp, Mus musculus
gacgtacttcagatacttttgcctt

SEQ ID NO: 458311 - DNA, 25 bp, Mus musculus
gacgtacttcagttacttttgcctt

SEQ ID NO: 458312 - DNA, 25 bp, Mus musculus
gacgtagaacacaaagctccttctc

SEQ ID NO: 458313 - DNA, 25 bp, Mus musculus
gacgtagaacactaagctccttctc

SEQ ID NO: 458314 - DNA, 25 bp, Mus musculus
gacgtagaacttcatgtccagcatg

SEQ ID NO: 458315 - DNA, 25 bp, Mus musculus
gacgtagaacttgatgtccagcatg

SEQ ID NO: 458316 - DNA, 25 bp, Mus musculus
gacgtagaatctatagcctcacttt

SEQ ID NO: 458317 - DNA, 25 bp, Mus musculus
gacgtagaatctttagcctcacttt

SEQ ID NO: 458318 - DNA, 25 bp, Mus musculus
gacgtagcaatcatggttgctggaa

SEQ ID NO: 458319 - DNA, 25 bp, Mus musculus
gacgtagcaatcttggttgctggaa

SEQ ID NO: 458320 - DNA, 25 bp, Mus musculus
gacgtagtagataccgatcccagca

SEQ ID NO: 458321 - DNA, 25 bp, Mus musculus
gacgtagtagattccgatcccagca

SEQ ID NO: 458322 - DNA, 25 bp, Mus musculus
gacgtagtcgttctcattccttttt

SEQ ID NO: 458323 - DNA, 25 bp, Mus musculus
gacgtagtcgttgtcattccttttt

SEQ ID NO: 458324 - DNA, 25 bp, Mus musculus
gacgtatagattattccatattatt

SEQ ID NO: 458325 - DNA, 25 bp, Mus musculus
gacgtatagatttttccatattatt

SEQ ID NO: 458326 - DNA, 25 bp, Mus musculus
gacgtatcacgtactgagaaagcac

SEQ ID NO: 458327 - DNA, 25 bp, Mus musculus
gacgtatcacgttctgagaaagcac

SEQ ID NO: 458328 - DNA, 25 bp, Mus musculus
gacgtatccactactgcgattataa

SEQ ID NO: 458329 - DNA, 25 bp, Mus musculus
gacgtatccacttctgcgattataa

SEQ ID NO: 458330 - DNA, 25 bp, Mus musculus
gacgtatgctatcttaatcttgatg

SEQ ID NO: 458331 - DNA, 25 bp, Mus musculus
gacgtatgctatgttaatcttgatg

SEQ ID NO: 458332 - DNA, 25 bp, Mus musculus
gacgtatggtacaatgctatggact

SEQ ID NO: 458333 - DNA, 25 bp, Mus musculus
gacgtatggtactatgctatggact

SEQ ID NO: 458334 - DNA, 25 bp, Mus musculus
gacgtatgtattcttcgctctctat

SEQ ID NO: 458335 - DNA, 25 bp, Mus musculus
gacgtatgtattgttcgctctctat

SEQ ID NO: 458336 - DNA, 25 bp, Mus musculus
gacgtatttcccaggaaaagtgtgt

SEQ ID NO: 458337 - DNA, 25 bp, Mus musculus
gacgtatttccctggaaaagtgtgt

SEQ ID NO: 458338 - DNA, 25 bp, Mus musculus
gacgtcaaaagcacaatccatgtgt

SEQ ID NO: 458339 - DNA, 25 bp, Mus musculus
gacgtcaaaagctcaatccatgtgt

SEQ ID NO: 458340 - DNA, 25 bp, Mus musculus
gacgtcaacactcctctacaagagg

SEQ ID NO: 458341 - DNA, 25 bp, Mus musculus
gacgtcaacactgctctacaagagg

SEQ ID NO: 458342 - DNA, 25 bp, Mus musculus
gacgtcaacctgaaagtcgtggtga

SEQ ID NO: 458343 - DNA, 25 bp, Mus musculus
gacgtcaacctgtaagtcgtggtga

SEQ ID NO: 458344 - DNA, 25 bp, Mus musculus
gacgtcaagggcaccggatattgtc

SEQ ID NO: 458345 - DNA, 25 bp, Mus musculus
gacgtcaagggctccggatattgtc

SEQ ID NO: 458346 - DNA, 25 bp, Mus musculus
gacgtcacatctcactgcagacttt

SEQ ID NO: 458347 - DNA, 25 bp, Mus musculus
gacgtcacatctgactgcagacttt

SEQ ID NO: 458348 - DNA, 25 bp, Mus musculus
gacgtcaccaaaagctactaccaga

SEQ ID NO: 458349 - DNA, 25 bp, Mus musculus
gacgtcaccaaatgctactaccaga

SEQ ID NO: 458350 - DNA, 25 bp, Mus musculus
gacgtcacccccaagaagtggtggt

SEQ ID NO: 458351 - DNA, 25 bp, Mus musculus
gacgtcaccccctagaagtggtggt

SEQ ID NO: 458352 - DNA, 25 bp, Mus musculus
gacgtcaccggcaatcttgattata

SEQ ID NO: 458353 - DNA, 25 bp, Mus musculus
gacgtcaccggctatcttgattata

SEQ ID NO: 458354 - DNA, 25 bp, Mus musculus
gacgtcacctttctatgctgtgcag

SEQ ID NO: 458355 - DNA, 25 bp, Mus musculus
gacgtcacctttgtatgctgtgcag

SEQ ID NO: 458356 - DNA, 25 bp, Mus musculus
gacgtcagatggaatctagcgtact

SEQ ID NO: 458357 - DNA, 25 bp, Mus musculus
gacgtcagatggtatctagcgtact

SEQ ID NO: 458358 - DNA, 25 bp, Mus musculus
gacgtcagcaaaccaaaccgttcct

SEQ ID NO: 458359 - DNA, 25 bp, Mus musculus
gacgtcagcaaagcaaaccgttcct

SEQ ID NO: 458360 - DNA, 25 bp, Mus musculus
gacgtcagcagtcatctctgtggca

SEQ ID NO: 458361 - DNA, 25 bp, Mus musculus
gacgtcagcagtgatctctgtggca

SEQ ID NO: 458362 - DNA, 25 bp, Mus musculus
gacgtcaggagcattttatttttat

SEQ ID NO: 458363 - DNA, 25 bp, Mus musculus
gacgtcaggagctttttatttttat

SEQ ID NO: 458364 - DNA, 25 bp, Mus musculus
gacgtcagggacaatgtccatgtgc

SEQ ID NO: 458365 - DNA, 25 bp, Mus musculus
gacgtcagggactatgtccatgtgc

SEQ ID NO: 458366 - DNA, 25 bp, Mus musculus
gacgtcagtactcgcatgtgcctta

SEQ ID NO: 458367 - DNA, 25 bp, Mus musculus
gacgtcagtactggcatgtgcctta

SEQ ID NO: 458368 - DNA, 25 bp, Mus musculus
gacgtcagtctgagatgtttccgct

SEQ ID NO: 458369 - DNA, 25 bp, Mus musculus
gacgtcagtctgtgatgtttccgct

SEQ ID NO: 458370 - DNA, 25 bp, Mus musculus
gacgtcagtgttcagcattgttgaa

SEQ ID NO: 458371 - DNA, 25 bp, Mus musculus
gacgtcagtgttgagcattgttgaa

SEQ ID NO: 458372 - DNA, 25 bp, Mus musculus
gacgtcatcaaaagggccagcagct

SEQ ID NO: 458373 - DNA, 25 bp, Mus musculus
gacgtcatcaaatgggccagcagct

SEQ ID NO: 458374 - DNA, 25 bp, Mus musculus
gacgtcatctcgatgggaatgctga

SEQ ID NO: 458375 - DNA, 25 bp, Mus musculus
gacgtcatctcgttgggaatgctga

SEQ ID NO: 458376 - DNA, 25 bp, Mus musculus
gacgtcatcttcaattgcattgcag

SEQ ID NO: 458377 - DNA, 25 bp, Mus musculus
gacgtcatcttctattgcattgcag

SEQ ID NO: 458378 - DNA, 25 bp, Mus musculus
gacgtcatgagaaacccagtggagc

SEQ ID NO: 458379 - DNA, 25 bp, Mus musculus
gacgtcatgagatacccagtggagc

SEQ ID NO: 458380 - DNA, 25 bp, Mus musculus
gacgtcatgggcatcggacctgcct

SEQ ID NO: 458381 - DNA, 25 bp, Mus musculus
gacgtcatgggcttcggacctgcct

SEQ ID NO: 458382 - DNA, 25 bp, Mus musculus
gacgtcatgtgacatccatcctaga

SEQ ID NO: 458383 - DNA, 25 bp, Mus musculus
gacgtcatgtgagatccatcctaga

SEQ ID NO: 458384 - DNA, 25 bp, Mus musculus
gacgtcatttttccagaggctttta

SEQ ID NO: 458385 - DNA, 25 bp, Mus musculus
gacgtcatttttgcagaggctttta

SEQ ID NO: 458386 - DNA, 25 bp, Mus musculus
gacgtccaaaatcactgtccaaaca

SEQ ID NO: 458387 - DNA, 25 bp, Mus musculus
gacgtccaaaatgactgtccaaaca

SEQ ID NO: 458388 - DNA, 25 bp, Mus musculus
gacgtccaacgaaagagcacccagt

SEQ ID NO: 458389 - DNA, 25 bp, Mus musculus
gacgtccaacgatagagcacccagt

SEQ ID NO: 458390 - DNA, 25 bp, Mus musculus
gacgtccaaggcattaccagctata

SEQ ID NO: 458391 - DNA, 25 bp, Mus musculus
gacgtccaaggctttaccagctata

SEQ ID NO: 458392 - DNA, 25 bp, Mus musculus
gacgtccacgtccattacagcacag

SEQ ID NO: 458393 - DNA, 25 bp, Mus musculus
gacgtccacgtcgattacagcacag

SEQ ID NO: 458394 - DNA, 25 bp, Mus musculus
gacgtccagcaacgcccaggaagag

SEQ ID NO: 458395 - DNA, 25 bp, Mus musculus
gacgtccagcaaggcccaggaagag

SEQ ID NO: 458396 - DNA, 25 bp, Mus musculus
gacgtccagcatccaatacaagata

SEQ ID NO: 458397 - DNA, 25 bp, Mus musculus
gacgtccagcatgcaatacaagata

SEQ ID NO: 458398 - DNA, 25 bp, Mus musculus
gacgtccattgtccatcaacttcat

SEQ ID NO: 458399 - DNA, 25 bp, Mus musculus
gacgtccattgtgcatcaacttcat

SEQ ID NO: 458400 - DNA, 25 bp, Mus musculus
gacgtcccagggactgagagtcaga

SEQ ID NO: 458401 - DNA, 25 bp, Mus musculus
gacgtcccagggtctgagagtcaga

SEQ ID NO: 458402 - DNA, 25 bp, Mus musculus
gacgtccccagaaatagctaggcta

SEQ ID NO: 458403 - DNA, 25 bp, Mus musculus
gacgtccccagatatagctaggcta

SEQ ID NO: 458404 - DNA, 25 bp, Mus musculus
gacgtccccatgcatggaatgtctg

SEQ ID NO: 458405 - DNA, 25 bp, Mus musculus
gacgtccccatggatggaatgtctg

SEQ ID NO: 458406 - DNA, 25 bp, Mus musculus
gacgtccctggaagatggcctacaa

SEQ ID NO: 458407 - DNA, 25 bp, Mus musculus
gacgtccctggatgatggcctacaa

SEQ ID NO: 458408 - DNA, 25 bp, Mus musculus
gacgtccctttgaacttgggcatat

SEQ ID NO: 458409 - DNA, 25 bp, Mus musculus
gacgtccctttgtacttgggcatat

SEQ ID NO: 458410 - DNA, 25 bp, Mus musculus
gacgtcctcaagaaggtcctgtgta

SEQ ID NO: 458411 - DNA, 25 bp, Mus musculus
gacgtcctcaagtaggtcctgtgta

SEQ ID NO: 458412 - DNA, 25 bp, Mus musculus
gacgtcctcacaccgagagtggatg

SEQ ID NO: 458413 - DNA, 25 bp, Mus musculus
gacgtcctcacagcgagagtggatg

SEQ ID NO: 458414 - DNA, 25 bp, Mus musculus
gacgtcctccttatcttgtgataac

SEQ ID NO: 458415 - DNA, 25 bp, Mus musculus
gacgtcctccttttcttgtgataac

SEQ ID NO: 458416 - DNA, 25 bp, Mus musculus
gacgtcctcgtcagcaacgggctgg

SEQ ID NO: 458417 - DNA, 25 bp, Mus musculus
gacgtcctcgtctgcaacgggctgg

SEQ ID NO: 458418 - DNA, 25 bp, Mus musculus
gacgtcctgagtatgctcctcagaa

SEQ ID NO: 458419 - DNA, 25 bp, Mus musculus
gacgtcctgagtttgctcctcagaa

SEQ ID NO: 458420 - DNA, 25 bp, Mus musculus
gacgtcctgtataagcatcattgct

SEQ ID NO: 458421 - DNA, 25 bp, Mus musculus
gacgtcctgtattagcatcattgct

SEQ ID NO: 458422 - DNA, 25 bp, Mus musculus
gacgtccttcgtatagacttcgcgt

SEQ ID NO: 458423 - DNA, 25 bp, Mus musculus
gacgtccttcgtttagacttcgcgt

SEQ ID NO: 458424 - DNA, 25 bp, Mus musculus
gacgtccttttgattgtgatgttaa

SEQ ID NO: 458425 - DNA, 25 bp, Mus musculus
gacgtccttttgtttgtgatgttaa

SEQ ID NO: 458426 - DNA, 25 bp, Mus musculus
gacgtcgcccgacgagtgcagaaaa

SEQ ID NO: 458427 - DNA, 25 bp, Mus musculus
gacgtcgcccgaggagtgcagaaaa

SEQ ID NO: 458428 - DNA, 25 bp, Mus musculus
gacgtcgctgtcaatagcaacttct

SEQ ID NO: 458429 - DNA, 25 bp, Mus musculus
gacgtcgctgtctatagcaacttct

SEQ ID NO: 458430 - DNA, 25 bp, Mus musculus
gacgtcggcgctacctggccatgaa

SEQ ID NO: 458431 - DNA, 25 bp, Mus musculus
gacgtcggcgcttcctggccatgaa

SEQ ID NO: 458432 - DNA, 25 bp, Mus musculus
gacgtcgtcaccagtgtggcagatg

SEQ ID NO: 458433 - DNA, 25 bp, Mus musculus
gacgtcgtcacctgtgtggcagatg

SEQ ID NO: 458434 - DNA, 25 bp, Mus musculus
gacgtcgtgcgcatctaaattaatc

SEQ ID NO: 458435 - DNA, 25 bp, Mus musculus
gacgtcgtgcgcttctaaattaatc

SEQ ID NO: 458436 - DNA, 25 bp, Mus musculus
gacgtctaaagaagctccgtgggaa

SEQ ID NO: 458437 - DNA, 25 bp, Mus musculus
gacgtctaaagatgctccgtgggaa

SEQ ID NO: 458438 - DNA, 25 bp, Mus musculus
gacgtctacgacatatacatcaaat

SEQ ID NO: 458439 - DNA, 25 bp, Mus musculus
gacgtctacgacttatacatcaaat

SEQ ID NO: 458440 - DNA, 25 bp, Mus musculus
gacgtctaggatcaaggtgccagca

SEQ ID NO: 458441 - DNA, 25 bp, Mus musculus
gacgtctaggatgaaggtgccagca

SEQ ID NO: 458442 - DNA, 25 bp, Mus musculus
gacgtctatgagcatgtctccccaa

SEQ ID NO: 458443 - DNA, 25 bp, Mus musculus
gacgtctatgaggatgtctccccaa

SEQ ID NO: 458444 - DNA, 25 bp, Mus musculus
gacgtctcagagcagtctaactgct

SEQ ID NO: 458445 - DNA, 25 bp, Mus musculus
gacgtctcagaggagtctaactgct

SEQ ID NO: 458446 - DNA, 25 bp, Mus musculus
gacgtctccacacaaaccaagtact

SEQ ID NO: 458447 - DNA, 25 bp, Mus musculus
gacgtctccacagaaaccaagtact

SEQ ID NO: 458448 - DNA, 25 bp, Mus musculus
gacgtctgcgtgaagactcactgga

SEQ ID NO: 458449 - DNA, 25 bp, Mus musculus
gacgtctgcgtgtagactcactgga

SEQ ID NO: 458450 - DNA, 25 bp, Mus musculus
gacgtctggtcactctacatcgaca

SEQ ID NO: 458451 - DNA, 25 bp, Mus musculus
gacgtctggtcagtctacatcgaca

SEQ ID NO: 458452 - DNA, 25 bp, Mus musculus
gacgtctgtcctagtgatgtgtgtt

SEQ ID NO: 458453 - DNA, 25 bp, Mus musculus
gacgtctgtccttgtgatgtgtgtt

SEQ ID NO: 458454 - DNA, 25 bp, Mus musculus
gacgtctgttgcaagaactgttctg

SEQ ID NO: 458455 - DNA, 25 bp, Mus musculus
gacgtctgttgctagaactgttctg

SEQ ID NO: 458456 - DNA, 25 bp, Mus musculus
gacgtcttaagcagtccatttctgt

SEQ ID NO: 458457 - DNA, 25 bp, Mus musculus
gacgtcttaagctgtccatttctgt

SEQ ID NO: 458458 - DNA, 25 bp, Mus musculus
gacgtcttatctcttctttgggagc

SEQ ID NO: 458459 - DNA, 25 bp, Mus musculus
gacgtcttatctgttctttgggagc

SEQ ID NO: 458460 - DNA, 25 bp, Mus musculus
gacgtcttctatacaatcccaatgt

SEQ ID NO: 458461 - DNA, 25 bp, Mus musculus
gacgtcttctattcaatcccaatgt

SEQ ID NO: 458462 - DNA, 25 bp, Mus musculus
gacgtcttgtgcatgcggtttagaa

SEQ ID NO: 458463 - DNA, 25 bp, Mus musculus
gacgtcttgtgcttgcggtttagaa

SEQ ID NO: 458464 - DNA, 25 bp, Mus musculus
gacgtgaaatataaccctgacagat

SEQ ID NO: 458465 - DNA, 25 bp, Mus musculus
gacgtgaaatattaccctgacagat

SEQ ID NO: 458466 - DNA, 25 bp, Mus musculus
gacgtgaagctcatagccaggcgaa

SEQ ID NO: 458467 - DNA, 25 bp, Mus musculus
gacgtgaagctcttagccaggcgaa

SEQ ID NO: 458468 - DNA, 25 bp, Mus musculus
gacgtgaaggcacaggcctagaata

SEQ ID NO: 458469 - DNA, 25 bp, Mus musculus
gacgtgaaggcagaggcctagaata

SEQ ID NO: 458470 - DNA, 25 bp, Mus musculus
gacgtgacagggaatcgacctccaa

SEQ ID NO: 458471 - DNA, 25 bp, Mus musculus
gacgtgacagggtatcgacctccaa

SEQ ID NO: 458472 - DNA, 25 bp, Mus musculus
gacgtgacatggatgtacgcatttc

SEQ ID NO: 458473 - DNA, 25 bp, Mus musculus
gacgtgacatggttgtacgcatttc

SEQ ID NO: 458474 - DNA, 25 bp, Mus musculus
gacgtgaccttccaatgctgaagag

SEQ ID NO: 458475 - DNA, 25 bp, Mus musculus
gacgtgaccttcgaatgctgaagag

SEQ ID NO: 458476 - DNA, 25 bp, Mus musculus
gacgtgacgtcaacaaacccccatt

SEQ ID NO: 458477 - DNA, 25 bp, Mus musculus
gacgtgacgtcatcaaacccccatt

SEQ ID NO: 458478 - DNA, 25 bp, Mus musculus
gacgtgactcagagggcacatggtg

SEQ ID NO: 458479 - DNA, 25 bp, Mus musculus
gacgtgactcagtgggcacatggtg

SEQ ID NO: 458480 - DNA, 25 bp, Mus musculus
gacgtgactctgacaaatgcttgca

SEQ ID NO: 458481 - DNA, 25 bp, Mus musculus
gacgtgactctgtcaaatgcttgca

SEQ ID NO: 458482 - DNA, 25 bp, Mus musculus
gacgtgactgtgcttgtgaggtcca

SEQ ID NO: 458483 - DNA, 25 bp, Mus musculus
gacgtgactgtggttgtgaggtcca

SEQ ID NO: 458484 - DNA, 25 bp, Mus musculus
gacgtgacttaaacagggtgtatga

SEQ ID NO: 458485 - DNA, 25 bp, Mus musculus
gacgtgacttaatcagggtgtatga

SEQ ID NO: 458486 - DNA, 25 bp, Mus musculus
gacgtgagacgcatactgcatgtct

SEQ ID NO: 458487 - DNA, 25 bp, Mus musculus
gacgtgagacgcttactgcatgtct

SEQ ID NO: 458488 - DNA, 25 bp, Mus musculus
gacgtgatctcgctacgtgttttaa

SEQ ID NO: 458489 - DNA, 25 bp, Mus musculus
gacgtgatctcggtacgtgttttaa

SEQ ID NO: 458490 - DNA, 25 bp, Mus musculus
gacgtgatgaacagctgcctgacgc

SEQ ID NO: 458491 - DNA, 25 bp, Mus musculus
gacgtgatgaactgctgcctgacgc

SEQ ID NO: 458492 - DNA, 25 bp, Mus musculus
gacgtgattcggcatcttttctcaa

SEQ ID NO: 458493 - DNA, 25 bp, Mus musculus
gacgtgattcgggatcttttctcaa

SEQ ID NO: 458494 - DNA, 25 bp, Mus musculus
gacgtgcagctgacagtttcacaaa

SEQ ID NO: 458495 - DNA, 25 bp, Mus musculus
gacgtgcagctgtcagtttcacaaa

SEQ ID NO: 458496 - DNA, 25 bp, Mus musculus
gacgtgcagggcagcagctcctgac

SEQ ID NO: 458497 - DNA, 25 bp, Mus musculus
gacgtgcagggctgcagctcctgac

SEQ ID NO: 458498 - DNA, 25 bp, Mus musculus
gacgtgccactgagtggtatcctta

SEQ ID NO: 458499 - DNA, 25 bp, Mus musculus
gacgtgccactgtgtggtatcctta

SEQ ID NO: 458500 - DNA, 25 bp, Mus musculus
gacgtgccacttaccatcttgtgtt

SEQ ID NO: 458501 - DNA, 25 bp, Mus musculus
gacgtgccactttccatcttgtgtt

SEQ ID NO: 458502 - DNA, 25 bp, Mus musculus
gacgtgccaggcactgtgaacgctg

SEQ ID NO: 458503 - DNA, 25 bp, Mus musculus
gacgtgccaggctctgtgaacgctg

SEQ ID NO: 458504 - DNA, 25 bp, Mus musculus
gacgtgcctgggaaacctgtgaacc

SEQ ID NO: 458505 - DNA, 25 bp, Mus musculus
gacgtgcctgggtaacctgtgaacc

SEQ ID NO: 458506 - DNA, 25 bp, Mus musculus
gacgtgcctgtcatgcagagcaatc

SEQ ID NO: 458507 - DNA, 25 bp, Mus musculus
gacgtgcctgtcttgcagagcaatc

SEQ ID NO: 458508 - DNA, 25 bp, Mus musculus
gacgtgccttccaactcatcgagga

SEQ ID NO: 458509 - DNA, 25 bp, Mus musculus
gacgtgccttcccagccagtgacta

SEQ ID NO: 458510 - DNA, 25 bp, Mus musculus
gacgtgccttccgagccagtgacta

SEQ ID NO: 458511 - DNA, 25 bp, Mus musculus
gacgtgccttcctactcatcgagga

SEQ ID NO: 458512 - DNA, 25 bp, Mus musculus
gacgtgccttctatggattaaacca

SEQ ID NO: 458513 - DNA, 25 bp, Mus musculus
gacgtgccttctttggattaaacca

SEQ ID NO: 458514 - DNA, 25 bp, Mus musculus
gacgtgcgataaagcatctcctgca

SEQ ID NO: 458515 - DNA, 25 bp, Mus musculus
gacgtgcgataatgcatctcctgca

SEQ ID NO: 458516 - DNA, 25 bp, Mus musculus
gacgtgctaagcacttccaaattga

SEQ ID NO: 458517 - DNA, 25 bp, Mus musculus
gacgtgctaagctcttccaaattga

SEQ ID NO: 458518 - DNA, 25 bp, Mus musculus
gacgtgctcagcatcatgggtggaa

SEQ ID NO: 458519 - DNA, 25 bp, Mus musculus
gacgtgctcagcttcatgggtggaa

SEQ ID NO: 458520 - DNA, 25 bp, Mus musculus
gacgtgctcggcattcccggagata

SEQ ID NO: 458521 - DNA, 25 bp, Mus musculus
gacgtgctcggctttcccggagata

SEQ ID NO: 458522 - DNA, 25 bp, Mus musculus
gacgtgctctgacgaccaggcagaa

SEQ ID NO: 458523 - DNA, 25 bp, Mus musculus
gacgtgctctgaggaccaggcagaa

SEQ ID NO: 458524 - DNA, 25 bp, Mus musculus
gacgtgcttttaaatctttaacaaa

SEQ ID NO: 458525 - DNA, 25 bp, Mus musculus
gacgtgcttttatatctttaacaaa

SEQ ID NO: 458526 - DNA, 25 bp, Mus musculus
gacgtggaaggccttgatcctgctc

SEQ ID NO: 458527 - DNA, 25 bp, Mus musculus
gacgtggaaggcgttgatcctgctc

SEQ ID NO: 458528 - DNA, 25 bp, Mus musculus
gacgtggaagttatgcctgcacaat

SEQ ID NO: 458529 - DNA, 25 bp, Mus musculus
gacgtggaagttttgcctgcacaat

SEQ ID NO: 458530 - DNA, 25 bp, Mus musculus
gacgtggacattatgtgtagctttg

SEQ ID NO: 458531 - DNA, 25 bp, Mus musculus
gacgtggacattttgtgtagctttg

SEQ ID NO: 458532 - DNA, 25 bp, Mus musculus
gacgtggacgatagagctgtgccct

SEQ ID NO: 458533 - DNA, 25 bp, Mus musculus
gacgtggacgattgagctgtgccct

SEQ ID NO: 458534 - DNA, 25 bp, Mus musculus
gacgtggacgctcatgaggaagaca

SEQ ID NO: 458535 - DNA, 25 bp, Mus musculus
gacgtggacgctgatgaggaagaca

SEQ ID NO: 458536 - DNA, 25 bp, Mus musculus
gacgtggagaacacgggtaaaaatg

SEQ ID NO: 458537 - DNA, 25 bp, Mus musculus
gacgtggagaactcgggtaaaaatg

SEQ ID NO: 458538 - DNA, 25 bp, Mus musculus
gacgtggagagtaccctgactacca

SEQ ID NO: 458539 - DNA, 25 bp, Mus musculus
gacgtggagagttccctgactacca

SEQ ID NO: 458540 - DNA, 25 bp, Mus musculus
gacgtggagctaaagtcctggaatg

SEQ ID NO: 458541 - DNA, 25 bp, Mus musculus
gacgtggagctatagtcctggaatg

SEQ ID NO: 458542 - DNA, 25 bp, Mus musculus
gacgtggcaaacataggactgctgt

SEQ ID NO: 458543 - DNA, 25 bp, Mus musculus
gacgtggcaaacttaggactgctgt

SEQ ID NO: 458544 - DNA, 25 bp, Mus musculus
gacgtggcaagtatcctggacaaga

SEQ ID NO: 458545 - DNA, 25 bp, Mus musculus
gacgtggcaagtttcctggacaaga

SEQ ID NO: 458546 - DNA, 25 bp, Mus musculus
gacgtggcacctcattaggcttcat

SEQ ID NO: 458547 - DNA, 25 bp, Mus musculus
gacgtggcacctgattaggcttcat

SEQ ID NO: 458548 - DNA, 25 bp, Mus musculus
gacgtggcagcgagaattctcagct

SEQ ID NO: 458549 - DNA, 25 bp, Mus musculus
gacgtggcagcgtgaattctcagct

SEQ ID NO: 458550 - DNA, 25 bp, Mus musculus
gacgtggcagtgaacatcagtgtgt

SEQ ID NO: 458551 - DNA, 25 bp, Mus musculus
gacgtggcagtgtacatcagtgtgt

SEQ ID NO: 458552 - DNA, 25 bp, Mus musculus
gacgtggccagtaaggtcatcttta

SEQ ID NO: 458553 - DNA, 25 bp, Mus musculus
gacgtggccagttaggtcatcttta

SEQ ID NO: 458554 - DNA, 25 bp, Mus musculus
gacgtggctagtatgagtgacagat

SEQ ID NO: 458555 - DNA, 25 bp, Mus musculus
gacgtggctagtttgagtgacagat

SEQ ID NO: 458556 - DNA, 25 bp, Mus musculus
gacgtggctggccatgtcctcaacg

SEQ ID NO: 458557 - DNA, 25 bp, Mus musculus
gacgtggctggcgatgtcctcaacg

SEQ ID NO: 458558 - DNA, 25 bp, Mus musculus
gacgtggcttgacctccgagagcta

SEQ ID NO: 458559 - DNA, 25 bp, Mus musculus
gacgtggcttgagctccgagagcta

SEQ ID NO: 458560 - DNA, 25 bp, Mus musculus
gacgtgggagatctcctcaactgct

SEQ ID NO: 458561 - DNA, 25 bp, Mus musculus
gacgtgggagatgtcctcaactgct

SEQ ID NO: 458562 - DNA, 25 bp, Mus musculus
gacgtgggtctcatactgtttattc

SEQ ID NO: 458563 - DNA, 25 bp, Mus musculus
gacgtgggtctcttactgtttattc

SEQ ID NO: 458564 - DNA, 25 bp, Mus musculus
gacgtgggtcttctatcatatcagt

SEQ ID NO: 458565 - DNA, 25 bp, Mus musculus
gacgtgggtcttgtatcatatcagt

SEQ ID NO: 458566 - DNA, 25 bp, Mus musculus
gacgtggtcactacttatcaaacat

SEQ ID NO: 458567 - DNA, 25 bp, Mus musculus
gacgtggtcacttcttatcaaacat

SEQ ID NO: 458568 - DNA, 25 bp, Mus musculus
gacgtggtcagtcctgagacttact

SEQ ID NO: 458569 - DNA, 25 bp, Mus musculus
gacgtggtcagtgctgagacttact

SEQ ID NO: 458570 - DNA, 25 bp, Mus musculus
gacgtggtcccacagcaacggagat

SEQ ID NO: 458571 - DNA, 25 bp, Mus musculus
gacgtggtcccagagcaacggagat

SEQ ID NO: 458572 - DNA, 25 bp, Mus musculus
gacgtggtcgtcacggtttaagaag

SEQ ID NO: 458573 - DNA, 25 bp, Mus musculus
gacgtggtcgtctcggtttaagaag

SEQ ID NO: 458574 - DNA, 25 bp, Mus musculus
gacgtggtgaagatttatgcttcct

SEQ ID NO: 458575 - DNA, 25 bp, Mus musculus
gacgtggtgaagttttatgcttcct

SEQ ID NO: 458576 - DNA, 25 bp, Mus musculus
gacgtggtgattatgcttctaggca

SEQ ID NO: 458577 - DNA, 25 bp, Mus musculus
gacgtggtgattttgcttctaggca

SEQ ID NO: 458578 - DNA, 25 bp, Mus musculus
gacgtggtgccaagtgaaatgtcac

SEQ ID NO: 458579 - DNA, 25 bp, Mus musculus
gacgtggtgccatgtgaaatgtcac

SEQ ID NO: 458580 - DNA, 25 bp, Mus musculus
gacgtggtggacctcacactggaca

SEQ ID NO: 458581 - DNA, 25 bp, Mus musculus
gacgtggtggacgtcacactggaca

SEQ ID NO: 458582 - DNA, 25 bp, Mus musculus
gacgtgtaggacagcccggatttca

SEQ ID NO: 458583 - DNA, 25 bp, Mus musculus
gacgtgtaggactgcccggatttca

SEQ ID NO: 458584 - DNA, 25 bp, Mus musculus
gacgtgtagttcagaatttaagcaa

SEQ ID NO: 458585 - DNA, 25 bp, Mus musculus
gacgtgtagttctgaatttaagcaa

SEQ ID NO: 458586 - DNA, 25 bp, Mus musculus
gacgtgtattcaatgagtagttctt

SEQ ID NO: 458587 - DNA, 25 bp, Mus musculus
gacgtgtattcattgagtagttctt

SEQ ID NO: 458588 - DNA, 25 bp, Mus musculus
gacgtgtatttcataaaccagacct

SEQ ID NO: 458589 - DNA, 25 bp, Mus musculus
gacgtgtatttcttaaaccagacct

SEQ ID NO: 458590 - DNA, 25 bp, Mus musculus
gacgtgtcacgaagtctgaccggaa

SEQ ID NO: 458591 - DNA, 25 bp, Mus musculus
gacgtgtcacgatgtctgaccggaa

SEQ ID NO: 458592 - DNA, 25 bp, Mus musculus
gacgtgtccccaactctaaaagaaa

SEQ ID NO: 458593 - DNA, 25 bp, Mus musculus
gacgtgtccccatctctaaaagaaa

SEQ ID NO: 458594 - DNA, 25 bp, Mus musculus
gacgtgtgacttcactgtatgagca

SEQ ID NO: 458595 - DNA, 25 bp, Mus musculus
gacgtgtgacttgactgtatgagca

SEQ ID NO: 458596 - DNA, 25 bp, Mus musculus
gacgtgtgcctgcttctgttcagat

SEQ ID NO: 458597 - DNA, 25 bp, Mus musculus
gacgtgtgcctggttctgttcagat

SEQ ID NO: 458598 - DNA, 25 bp, Mus musculus
gacgtgtgcttcagttttacataga

SEQ ID NO: 458599 - DNA, 25 bp, Mus musculus
gacgtgtgcttctgttttacataga

SEQ ID NO: 458600 - DNA, 25 bp, Mus musculus
gacgtgtggtacatgatgtttccat

SEQ ID NO: 458601 - DNA, 25 bp, Mus musculus
gacgtgtggtacttgatgtttccat

SEQ ID NO: 458602 - DNA, 25 bp, Mus musculus
gacgtgtgtaatcctcagaagccat

SEQ ID NO: 458603 - DNA, 25 bp, Mus musculus
gacgtgtgtaatgctcagaagccat

SEQ ID NO: 458604 - DNA, 25 bp, Mus musculus
gacgtgtgtagactattccttaagt

SEQ ID NO: 458605 - DNA, 25 bp, Mus musculus
gacgtgtgtagagtattccttaagt

SEQ ID NO: 458606 - DNA, 25 bp, Mus musculus
gacgtgtgtcctcctggtattttaa

SEQ ID NO: 458607 - DNA, 25 bp, Mus musculus
gacgtgtgtcctgctggtattttaa

SEQ ID NO: 458608 - DNA, 25 bp, Mus musculus
gacgtgtgtgtactcaatcatgcat

SEQ ID NO: 458609 - DNA, 25 bp, Mus musculus
gacgtgtgtgtagtcaatcatgcat

SEQ ID NO: 458610 - DNA, 25 bp, Mus musculus
gacgtgttactcataatcttcatgt

SEQ ID NO: 458611 - DNA, 25 bp, Mus musculus
gacgtgttactcttaatcttcatgt

SEQ ID NO: 458612 - DNA, 25 bp, Mus musculus
gacgtgttatgactccagaatttcc

SEQ ID NO: 458613 - DNA, 25 bp, Mus musculus
gacgtgttatgagtccagaatttcc

SEQ ID NO: 458614 - DNA, 25 bp, Mus musculus
gacgtgttatttcttggtttggaat

SEQ ID NO: 458615 - DNA, 25 bp, Mus musculus
gacgtgttatttgttggtttggaat

SEQ ID NO: 458616 - DNA, 25 bp, Mus musculus
gacgtgttgacacgacttcagctaa

SEQ ID NO: 458617 - DNA, 25 bp, Mus musculus
gacgtgttgacaggacttcagctaa

SEQ ID NO: 458618 - DNA, 25 bp, Mus musculus
gacgtgtttagtagccatggtaatc

SEQ ID NO: 458619 - DNA, 25 bp, Mus musculus
gacgtgtttagttgccatggtaatc

SEQ ID NO: 458620 - DNA, 25 bp, Mus musculus
gacgtgtttcacatttccaagcttt

SEQ ID NO: 458621 - DNA, 25 bp, Mus musculus
gacgtgtttcacttttccaagcttt

SEQ ID NO: 458622 - DNA, 25 bp, Mus musculus
gacgtgtttcagatccaggcaacct

SEQ ID NO: 458623 - DNA, 25 bp, Mus musculus
gacgtgtttcagttccaggcaacct

SEQ ID NO: 458624 - DNA, 25 bp, Mus musculus
gacgtgtttgccatctaaagccagt

SEQ ID NO: 458625 - DNA, 25 bp, Mus musculus
gacgtgtttgccttctaaagccagt

SEQ ID NO: 458626 - DNA, 25 bp, Mus musculus
gacgtgtttggtattgtggaactct

SEQ ID NO: 458627 - DNA, 25 bp, Mus musculus
gacgtgtttggttttgtggaactct

SEQ ID NO: 458628 - DNA, 25 bp, Mus musculus
gacgtgtttgtgaacacccatcaca

SEQ ID NO: 458629 - DNA, 25 bp, Mus musculus
gacgtgtttgtgtacacccatcaca

SEQ ID NO: 458630 - DNA, 25 bp, Mus musculus
gacgtgtttgttataccagcggagg

SEQ ID NO: 458631 - DNA, 25 bp, Mus musculus
gacgtgtttgttttaccagcggagg

SEQ ID NO: 458632 - DNA, 25 bp, Mus musculus
gacgttaaaataatcccagcctttg

SEQ ID NO: 458633 - DNA, 25 bp, Mus musculus
gacgttaaaatattcccagcctttg

SEQ ID NO: 458634 - DNA, 25 bp, Mus musculus
gacgttaatgcccacttgaaagact

SEQ ID NO: 458635 - DNA, 25 bp, Mus musculus
gacgttaatgccgacttgaaagact

SEQ ID NO: 458636 - DNA, 25 bp, Mus musculus
gacgttaatggcagttcctccgaaa

SEQ ID NO: 458637 - DNA, 25 bp, Mus musculus
gacgttaatggctgttcctccgaaa

SEQ ID NO: 458638 - DNA, 25 bp, Mus musculus
gacgttaattacagtgcttcactgt

SEQ ID NO: 458639 - DNA, 25 bp, Mus musculus
gacgttaattactgtgcttcactgt

SEQ ID NO: 458640 - DNA, 25 bp, Mus musculus
gacgttacaacaatgttttgcgcca

SEQ ID NO: 458641 - DNA, 25 bp, Mus musculus
gacgttacaacattgttttgcgcca

SEQ ID NO: 458642 - DNA, 25 bp, Mus musculus
gacgttacacagatatcttctcctg

SEQ ID NO: 458643 - DNA, 25 bp, Mus musculus
gacgttacacagttatcttctcctg

SEQ ID NO: 458644 - DNA, 25 bp, Mus musculus
gacgttacacatcaaccataggact

SEQ ID NO: 458645 - DNA, 25 bp, Mus musculus
gacgttacacatgaaccataggact

SEQ ID NO: 458646 - DNA, 25 bp, Mus musculus
gacgttactcaaacaactttcaatt

SEQ ID NO: 458647 - DNA, 25 bp, Mus musculus
gacgttactcaatcaactttcaatt

SEQ ID NO: 458648 - DNA, 25 bp, Mus musculus
gacgttagtgccattgaagcagctt

SEQ ID NO: 458649 - DNA, 25 bp, Mus musculus
gacgttagtgcctttgaagcagctt

SEQ ID NO: 458650 - DNA, 25 bp, Mus musculus
gacgttcaaaggacccttctctcct

SEQ ID NO: 458651 - DNA, 25 bp, Mus musculus
gacgttcaaaggtcccttctctcct

SEQ ID NO: 458652 - DNA, 25 bp, Mus musculus
gacgttcaacgtattctctattttg

SEQ ID NO: 458653 - DNA, 25 bp, Mus musculus
gacgttcaacgttttctctattttg

SEQ ID NO: 458654 - DNA, 25 bp, Mus musculus
gacgttcaagagactaaaggttggt

SEQ ID NO: 458655 - DNA, 25 bp, Mus musculus
gacgttcaagagtctaaaggttggt

SEQ ID NO: 458656 - DNA, 25 bp, Mus musculus
gacgttcacaggctcgtgattcgaa

SEQ ID NO: 458657 - DNA, 25 bp, Mus musculus
gacgttcacagggtcgtgattcgaa

SEQ ID NO: 458658 - DNA, 25 bp, Mus musculus
gacgttcagggaccttgtcttcatc

SEQ ID NO: 458659 - DNA, 25 bp, Mus musculus
gacgttcagggagcttgtcttcatc

SEQ ID NO: 458660 - DNA, 25 bp, Mus musculus
gacgttcatcatatcatctggacac

SEQ ID NO: 458661 - DNA, 25 bp, Mus musculus
gacgttcatcatttcatctggacac

SEQ ID NO: 458662 - DNA, 25 bp, Mus musculus
gacgttcatttgaatgtctgcttct

SEQ ID NO: 458663 - DNA, 25 bp, Mus musculus
gacgttcatttgtatgtctgcttct

SEQ ID NO: 458664 - DNA, 25 bp, Mus musculus
gacgttccacatacaactctagtta

SEQ ID NO: 458665 - DNA, 25 bp, Mus musculus
gacgttccacattcaactctagtta

SEQ ID NO: 458666 - DNA, 25 bp, Mus musculus
gacgttcccggactttgtctataag

SEQ ID NO: 458667 - DNA, 25 bp, Mus musculus
gacgttcccggagtttgtctataag

SEQ ID NO: 458668 - DNA, 25 bp, Mus musculus
gacgttccggaactggactctgata

SEQ ID NO: 458669 - DNA, 25 bp, Mus musculus
gacgttccggaagtggactctgata

SEQ ID NO: 458670 - DNA, 25 bp, Mus musculus
gacgttcctaaaacttcttgagtgc

SEQ ID NO: 458671 - DNA, 25 bp, Mus musculus
gacgttcctaaaagtatctgatcat

SEQ ID NO: 458672 - DNA, 25 bp, Mus musculus
gacgttcctaaatcttcttgagtgc

SEQ ID NO: 458673 - DNA, 25 bp, Mus musculus
gacgttcctaaatgtatctgatcat

SEQ ID NO: 458674 - DNA, 25 bp, Mus musculus
gacgttcgaagcagccacactttgg

SEQ ID NO: 458675 - DNA, 25 bp, Mus musculus
gacgttcgaagctgccacactttgg

SEQ ID NO: 458676 - DNA, 25 bp, Mus musculus
gacgttcgagtacttctgtatttga

SEQ ID NO: 458677 - DNA, 25 bp, Mus musculus
gacgttcgagtagttctgtatttga

SEQ ID NO: 458678 - DNA, 25 bp, Mus musculus
gacgttcgtgacagcaagggatctt

SEQ ID NO: 458679 - DNA, 25 bp, Mus musculus
gacgttcgtgactgcaagggatctt

SEQ ID NO: 458680 - DNA, 25 bp, Mus musculus
gacgttctagctcatagtcgccatc

SEQ ID NO: 458681 - DNA, 25 bp, Mus musculus
gacgttctagctgatagtcgccatc

SEQ ID NO: 458682 - DNA, 25 bp, Mus musculus
gacgttctagtgaatcagcggacca

SEQ ID NO: 458683 - DNA, 25 bp, Mus musculus
gacgttctagtgtatcagcggacca

SEQ ID NO: 458684 - DNA, 25 bp, Mus musculus
gacgttctatcacaggtttctccag

SEQ ID NO: 458685 - DNA, 25 bp, Mus musculus
gacgttctatcagaggtttctccag

SEQ ID NO: 458686 - DNA, 25 bp, Mus musculus
gacgttctcggcactgtgcattcag

SEQ ID NO: 458687 - DNA, 25 bp, Mus musculus
gacgttctcggctctgtgcattcag

SEQ ID NO: 458688 - DNA, 25 bp, Mus musculus
gacgttctggatcggcctgtatccc

SEQ ID NO: 458689 - DNA, 25 bp, Mus musculus
gacgttctggatgggcctgtatccc

SEQ ID NO: 458690 - DNA, 25 bp, Mus musculus
gacgttctgggcctggattgcatcc

SEQ ID NO: 458691 - DNA, 25 bp, Mus musculus
gacgttctgggcgtggattgcatcc

SEQ ID NO: 458692 - DNA, 25 bp, Mus musculus
gacgttctgtctctttaacgttgga

SEQ ID NO: 458693 - DNA, 25 bp, Mus musculus
gacgttctgtctgtttaacgttgga

SEQ ID NO: 458694 - DNA, 25 bp, Mus musculus
gacgttctgtgtcaactgcatgcag

SEQ ID NO: 458695 - DNA, 25 bp, Mus musculus
gacgttctgtgtgaactgcatgcag

SEQ ID NO: 458696 - DNA, 25 bp, Mus musculus
gacgttctgttgcatcactgacatg

SEQ ID NO: 458697 - DNA, 25 bp, Mus musculus
gacgttctgttggatcactgacatg

SEQ ID NO: 458698 - DNA, 25 bp, Mus musculus
gacgttctgtttcctggtgactaca

SEQ ID NO: 458699 - DNA, 25 bp, Mus musculus
gacgttctgtttgctggtgactaca

SEQ ID NO: 458700 - DNA, 25 bp, Mus musculus
gacgttgaatgtcccagctgtggac

SEQ ID NO: 458701 - DNA, 25 bp, Mus musculus
gacgttgaatgtgccagctgtggac

SEQ ID NO: 458702 - DNA, 25 bp, Mus musculus
gacgttgagtgccatacctgtgcca

SEQ ID NO: 458703 - DNA, 25 bp, Mus musculus
gacgttgagtgcgatacctgtgcca

SEQ ID NO: 458704 - DNA, 25 bp, Mus musculus
gacgttgagtttacaatggcttaca

SEQ ID NO: 458705 - DNA, 25 bp, Mus musculus
gacgttgagttttcaatggcttaca

SEQ ID NO: 458706 - DNA, 25 bp, Mus musculus
gacgttgcactcactgatgattcac

SEQ ID NO: 458707 - DNA, 25 bp, Mus musculus
gacgttgcactctctgatgattcac

SEQ ID NO: 458708 - DNA, 25 bp, Mus musculus
gacgttgccgatacaccagcacttg

SEQ ID NO: 458709 - DNA, 25 bp, Mus musculus
gacgttgccgattcaccagcacttg

SEQ ID NO: 458710 - DNA, 25 bp, Mus musculus
gacgttgcttggagtcagctgacag

SEQ ID NO: 458711 - DNA, 25 bp, Mus musculus
gacgttgcttggtgtcagctgacag

SEQ ID NO: 458712 - DNA, 25 bp, Mus musculus
gacgttggaacaagcactatttaca

SEQ ID NO: 458713 - DNA, 25 bp, Mus musculus
gacgttggaacatgcactatttaca

SEQ ID NO: 458714 - DNA, 25 bp, Mus musculus
gacgttggaatcattcatcccacag

SEQ ID NO: 458715 - DNA, 25 bp, Mus musculus
gacgttggaatctttcatcccacag

SEQ ID NO: 458716 - DNA, 25 bp, Mus musculus
gacgttggccaactttgtcatttgt

SEQ ID NO: 458717 - DNA, 25 bp, Mus musculus
gacgttggccaagtttgtcatttgt

SEQ ID NO: 458718 - DNA, 25 bp, Mus musculus
gacgttggctccctacaagagcgaa

SEQ ID NO: 458719 - DNA, 25 bp, Mus musculus
gacgttggctccgtacaagagcgaa

SEQ ID NO: 458720 - DNA, 25 bp, Mus musculus
gacgttggtactagcattttcgtat

SEQ ID NO: 458721 - DNA, 25 bp, Mus musculus
gacgttggtacttgcattttcgtat

SEQ ID NO: 458722 - DNA, 25 bp, Mus musculus
gacgttgtacctcacacataagaca

SEQ ID NO: 458723 - DNA, 25 bp, Mus musculus
gacgttgtacctgacacataagaca

SEQ ID NO: 458724 - DNA, 25 bp, Mus musculus
gacgttgtgttgactgacttcagcc

SEQ ID NO: 458725 - DNA, 25 bp, Mus musculus
gacgttgtgttgtctgacttcagcc

SEQ ID NO: 458726 - DNA, 25 bp, Mus musculus
gacgttgtttaccatgggtcacctc

SEQ ID NO: 458727 - DNA, 25 bp, Mus musculus
gacgttgtttacgatgggtcacctc

SEQ ID NO: 458728 - DNA, 25 bp, Mus musculus
gacgtttacaccctgatggtctcac

SEQ ID NO: 458729 - DNA, 25 bp, Mus musculus
gacgtttacaccgtgatggtctcac

SEQ ID NO: 458730 - DNA, 25 bp, Mus musculus
gacgtttacatacaatgtcctgttc

SEQ ID NO: 458731 - DNA, 25 bp, Mus musculus
gacgtttacatagaatgtcctgttc

SEQ ID NO: 458732 - DNA, 25 bp, Mus musculus
gacgtttatacccaactgtctattc

SEQ ID NO: 458733 - DNA, 25 bp, Mus musculus
gacgtttataccgaactgtctattc

SEQ ID NO: 458734 - DNA, 25 bp, Mus musculus
gacgtttatgttcatgtctctgaat

SEQ ID NO: 458735 - DNA, 25 bp, Mus musculus
gacgtttatgttgatgtctctgaat

SEQ ID NO: 458736 - DNA, 25 bp, Mus musculus
gacgtttatttcaacctcctggtcg

SEQ ID NO: 458737 - DNA, 25 bp, Mus musculus
gacgtttatttctacctcctggtcg

SEQ ID NO: 458738 - DNA, 25 bp, Mus musculus
gacgtttcatgcacagtccatgtgg

SEQ ID NO: 458739 - DNA, 25 bp, Mus musculus
gacgtttcatgctcagtccatgtgg

SEQ ID NO: 458740 - DNA, 25 bp, Mus musculus
gacgtttccagtagggctttgtaat

SEQ ID NO: 458741 - DNA, 25 bp, Mus musculus
gacgtttccagttgggctttgtaat

SEQ ID NO: 458742 - DNA, 25 bp, Mus musculus
gacgtttcttgaaatgagccccggg

SEQ ID NO: 458743 - DNA, 25 bp, Mus musculus
gacgtttcttgatatgagccccggg

SEQ ID NO: 458744 - DNA, 25 bp, Mus musculus
gacgtttcttgtactgttcacagcg

SEQ ID NO: 458745 - DNA, 25 bp, Mus musculus
gacgtttcttgttctgttcacagcg

SEQ ID NO: 458746 - DNA, 25 bp, Mus musculus
gacgtttgagcacttctatcagaag

SEQ ID NO: 458747 - DNA, 25 bp, Mus musculus
gacgtttgagcagttctatcagaag

SEQ ID NO: 458748 - DNA, 25 bp, Mus musculus
gacgtttgtcacacttgagtagcct

SEQ ID NO: 458749 - DNA, 25 bp, Mus musculus
gacgtttgtcactcttgagtagcct

SEQ ID NO: 458750 - DNA, 25 bp, Mus musculus
gacgtttgtgcactattgaaaagac

SEQ ID NO: 458751 - DNA, 25 bp, Mus musculus
gacgtttgtgcagtattgaaaagac

SEQ ID NO: 458752 - DNA, 25 bp, Mus musculus
gacgtttgttctacggttcacgtgc

SEQ ID NO: 458753 - DNA, 25 bp, Mus musculus
gacgtttgttctagtgtgcattgtg

SEQ ID NO: 458754 - DNA, 25 bp, Mus musculus
gacgtttgttcttcggttcacgtgc

SEQ ID NO: 458755 - DNA, 25 bp, Mus musculus
gacgtttgttcttgtgtgcattgtg

SEQ ID NO: 458756 - DNA, 25 bp, Mus musculus
gacgttttcatgctgaaacttccaa

SEQ ID NO: 458757 - DNA, 25 bp, Mus musculus
gacgttttcatggtgaaacttccaa

SEQ ID NO: 458758 - DNA, 25 bp, Mus musculus
gacgttttctaacaaagtggaagct

SEQ ID NO: 458759 - DNA, 25 bp, Mus musculus
gacgttttctaagaaagtggaagct

SEQ ID NO: 458760 - DNA, 25 bp, Mus musculus
gacgttttctatcctagtctgggta

SEQ ID NO: 458761 - DNA, 25 bp, Mus musculus
gacgttttctatgctagtctgggta

SEQ ID NO: 458762 - DNA, 25 bp, Mus musculus
gacgttttctcgacgtgcaaggaaa

SEQ ID NO: 458763 - DNA, 25 bp, Mus musculus
gacgttttctcgtcgtgcaaggaaa

SEQ ID NO: 458764 - DNA, 25 bp, Mus musculus
gacgttttctctaagtgcaggcata

SEQ ID NO: 458765 - DNA, 25 bp, Mus musculus
gacgttttctcttagtgcaggcata

SEQ ID NO: 458766 - DNA, 25 bp, Mus musculus
gacgttttctgtattcctcagcatc

SEQ ID NO: 458767 - DNA, 25 bp, Mus musculus
gacgttttctgttttcctcagcatc

SEQ ID NO: 458768 - DNA, 25 bp, Mus musculus
gacgttttcttaaagctcaccctta

SEQ ID NO: 458769 - DNA, 25 bp, Mus musculus
gacgttttcttatagctcaccctta

SEQ ID NO: 458770 - DNA, 25 bp, Mus musculus
gacgttttgaggaccaagcttcaca

SEQ ID NO: 458771 - DNA, 25 bp, Mus musculus
gacgttttgaggtccaagcttcaca

SEQ ID NO: 458772 - DNA, 25 bp, Mus musculus
gacgtttttctacctctatcatggg

SEQ ID NO: 458773 - DNA, 25 bp, Mus musculus
gacgtttttctagctctatcatggg

SEQ ID NO: 458774 - DNA, 25 bp, Mus musculus
gactaaaaagttcatttgctaaatg

SEQ ID NO: 458775 - DNA, 25 bp, Mus musculus
gactaaaaagttgatttgctaaatg

SEQ ID NO: 458776 - DNA, 25 bp, Mus musculus
gactaaaacataccttcctcttctc

SEQ ID NO: 458777 - DNA, 25 bp, Mus musculus
gactaaaacatagcttcctcttctc

SEQ ID NO: 458778 - DNA, 25 bp, Mus musculus
gactaaaacggactgggactcttgc

SEQ ID NO: 458779 - DNA, 25 bp, Mus musculus
gactaaaacggagtgggactcttgc

SEQ ID NO: 458780 - DNA, 25 bp, Mus musculus
gactaaaagttaatgccttctgtta

SEQ ID NO: 458781 - DNA, 25 bp, Mus musculus
gactaaaagttattgccttctgtta

SEQ ID NO: 458782 - DNA, 25 bp, Mus musculus
gactaaacagaaactctgccgtgaa

SEQ ID NO: 458783 - DNA, 25 bp, Mus musculus
gactaaacagaatctctgccgtgaa

SEQ ID NO: 458784 - DNA, 25 bp, Mus musculus
gactaaacagggactgggcctcaaa

SEQ ID NO: 458785 - DNA, 25 bp, Mus musculus
gactaaacagggtctgggcctcaaa

SEQ ID NO: 458786 - DNA, 25 bp, Mus musculus
gactaaacctcccatcatgaaacgg

SEQ ID NO: 458787 - DNA, 25 bp, Mus musculus
gactaaacctccgatcatgaaacgg

SEQ ID NO: 458788 - DNA, 25 bp, Mus musculus
gactaaacttctaccagcacagctg

SEQ ID NO: 458789 - DNA, 25 bp, Mus musculus
gactaaacttcttccagcacagctg

SEQ ID NO: 458790 - DNA, 25 bp, Mus musculus
gactaaacttgcaactttgttgaat

SEQ ID NO: 458791 - DNA, 25 bp, Mus musculus
gactaaacttgctactttgttgaat

SEQ ID NO: 458792 - DNA, 25 bp, Mus musculus
gactaaagcaaacccttattgccct

SEQ ID NO: 458793 - DNA, 25 bp, Mus musculus
gactaaagcaaagccttattgccct

SEQ ID NO: 458794 - DNA, 25 bp, Mus musculus
gactaaagctgaaggcagtctccct

SEQ ID NO: 458795 - DNA, 25 bp, Mus musculus
gactaaagctgatggcagtctccct

SEQ ID NO: 458796 - DNA, 25 bp, Mus musculus
gactaaagctggctggtcgctccct

SEQ ID NO: 458797 - DNA, 25 bp, Mus musculus
gactaaagctgggtggtcgctccct

SEQ ID NO: 458798 - DNA, 25 bp, Mus musculus
gactaaagggacatcctgagcagaa

SEQ ID NO: 458799 - DNA, 25 bp, Mus musculus
gactaaagggacttcctgagcagaa

SEQ ID NO: 458800 - DNA, 25 bp, Mus musculus
gactaaagtgagaattaggttgaat

SEQ ID NO: 458801 - DNA, 25 bp, Mus musculus
gactaaagtgagtattaggttgaat

SEQ ID NO: 458802 - DNA, 25 bp, Mus musculus
gactaaagttgcatgctcaatgagt

SEQ ID NO: 458803 - DNA, 25 bp, Mus musculus
gactaaagttgcttgctcaatgagt

SEQ ID NO: 458804 - DNA, 25 bp, Mus musculus
gactaaatatctcgcaggaagggtt

SEQ ID NO: 458805 - DNA, 25 bp, Mus musculus
gactaaatatctggcaggaagggtt

SEQ ID NO: 458806 - DNA, 25 bp, Mus musculus
gactaaatctatctatgtgccgttt

SEQ ID NO: 458807 - DNA, 25 bp, Mus musculus
gactaaatctatgtatgtgccgttt

SEQ ID NO: 458808 - DNA, 25 bp, Mus musculus
gactaaatgataagttgcactgtta

SEQ ID NO: 458809 - DNA, 25 bp, Mus musculus
gactaaatgatatgttgcactgtta

SEQ ID NO: 458810 - DNA, 25 bp, Mus musculus
gactaaatgccacagcgcagccatg

SEQ ID NO: 458811 - DNA, 25 bp, Mus musculus
gactaaatgccagagcgcagccatg

SEQ ID NO: 458812 - DNA, 25 bp, Mus musculus
gactaaatgcctctatacctgatta

SEQ ID NO: 458813 - DNA, 25 bp, Mus musculus
gactaaatgcctgtatacctgatta

SEQ ID NO: 458814 - DNA, 25 bp, Mus musculus
gactaaatgctgaaccctgaggttg

SEQ ID NO: 458815 - DNA, 25 bp, Mus musculus
gactaaatgctgtaccctgaggttg

SEQ ID NO: 458816 - DNA, 25 bp, Mus musculus
gactaaatggttctcctctctaagg

SEQ ID NO: 458817 - DNA, 25 bp, Mus musculus
gactaaatggttgtcctctctaagg

SEQ ID NO: 458818 - DNA, 25 bp, Mus musculus
gactaaatgtctatagtgaacctaa

SEQ ID NO: 458819 - DNA, 25 bp, Mus musculus
gactaaatgtctttagtgaacctaa

SEQ ID NO: 458820 - DNA, 25 bp, Mus musculus
gactaaatgtttcgctctctagact

SEQ ID NO: 458821 - DNA, 25 bp, Mus musculus
gactaaatgtttggctctctagact

SEQ ID NO: 458822 - DNA, 25 bp, Mus musculus
gactaaattcccataacccacatgg

SEQ ID NO: 458823 - DNA, 25 bp, Mus musculus
gactaaattcccttaacccacatgg

SEQ ID NO: 458824 - DNA, 25 bp, Mus musculus
gactaacaaaaccaagactgatgag

SEQ ID NO: 458825 - DNA, 25 bp, Mus musculus
gactaacaaaacgaagactgatgag

SEQ ID NO: 458826 - DNA, 25 bp, Mus musculus
gactaacaaactacacagtagcgaa

SEQ ID NO: 458827 - DNA, 25 bp, Mus musculus
gactaacaaacttcacagtagcgaa

SEQ ID NO: 458828 - DNA, 25 bp, Mus musculus
gactaacacactcgtgactcttcct

SEQ ID NO: 458829 - DNA, 25 bp, Mus musculus
gactaacacactggtgactcttcct

SEQ ID NO: 458830 - DNA, 25 bp, Mus musculus
gactaacacagtaatcattgctgtt

SEQ ID NO: 458831 - DNA, 25 bp, Mus musculus
gactaacacagttatcattgctgtt

SEQ ID NO: 458832 - DNA, 25 bp, Mus musculus
gactaacacatgatgttcggcagtt

SEQ ID NO: 458833 - DNA, 25 bp, Mus musculus
gactaacacatgttgttcggcagtt

SEQ ID NO: 458834 - DNA, 25 bp, Mus musculus
gactaacacgagaatcccgtctata

SEQ ID NO: 458835 - DNA, 25 bp, Mus musculus
gactaacacgagtatcccgtctata

SEQ ID NO: 458836 - DNA, 25 bp, Mus musculus
gactaacaggtgctatctcttctta

SEQ ID NO: 458837 - DNA, 25 bp, Mus musculus
gactaacaggtggtatctcttctta

SEQ ID NO: 458838 - DNA, 25 bp, Mus musculus
gactaacatcttactttcattgaaa

SEQ ID NO: 458839 - DNA, 25 bp, Mus musculus
gactaacatctttctttcattgaaa

SEQ ID NO: 458840 - DNA, 25 bp, Mus musculus
gactaacattttccacccaatgttg

SEQ ID NO: 458841 - DNA, 25 bp, Mus musculus
gactaacattttgcacccaatgttg

SEQ ID NO: 458842 - DNA, 25 bp, Mus musculus
gactaaccacgtatacaggacctga

SEQ ID NO: 458843 - DNA, 25 bp, Mus musculus
gactaaccacgtttacaggacctga

SEQ ID NO: 458844 - DNA, 25 bp, Mus musculus
gactaaccagttctccgtgaccagg

SEQ ID NO: 458845 - DNA, 25 bp, Mus musculus
gactaaccagttgtccgtgaccagg

SEQ ID NO: 458846 - DNA, 25 bp, Mus musculus
gactaacccgagagagtggactaca

SEQ ID NO: 458847 - DNA, 25 bp, Mus musculus
gactaacccgagtgagtggactaca

SEQ ID NO: 458848 - DNA, 25 bp, Mus musculus
gactaacccgcgagggcgcggcttc

SEQ ID NO: 458849 - DNA, 25 bp, Mus musculus
gactaacccgcgtgggcgcggcttc

SEQ ID NO: 458850 - DNA, 25 bp, Mus musculus
gactaacctctgataatggccccac

SEQ ID NO: 458851 - DNA, 25 bp, Mus musculus
gactaacctctgttaatggccccac

SEQ ID NO: 458852 - DNA, 25 bp, Mus musculus
gactaacctgtgctttttttcccat

SEQ ID NO: 458853 - DNA, 25 bp, Mus musculus
gactaacctgtggtttttttcccat

SEQ ID NO: 458854 - DNA, 25 bp, Mus musculus
gactaacgagctcacctactctctg

SEQ ID NO: 458855 - DNA, 25 bp, Mus musculus
gactaacgagctgacctactctctg

SEQ ID NO: 458856 - DNA, 25 bp, Mus musculus
gactaacgagggagatctcctggtg

SEQ ID NO: 458857 - DNA, 25 bp, Mus musculus
gactaacgagggtgatctcctggtg

SEQ ID NO: 458858 - DNA, 25 bp, Mus musculus
gactaacgcaccagagtgctggact

SEQ ID NO: 458859 - DNA, 25 bp, Mus musculus
gactaacgcacctgagtgctggact

SEQ ID NO: 458860 - DNA, 25 bp, Mus musculus
gactaacgtaggcacaaacagtttt

SEQ ID NO: 458861 - DNA, 25 bp, Mus musculus
gactaacgtagggacaaacagtttt

SEQ ID NO: 458862 - DNA, 25 bp, Mus musculus
gactaacgtgaaattccttatgtat

SEQ ID NO: 458863 - DNA, 25 bp, Mus musculus
gactaacgtgaatttccttatgtat

SEQ ID NO: 458864 - DNA, 25 bp, Mus musculus
gactaactacacatgattcacctag

SEQ ID NO: 458865 - DNA, 25 bp, Mus musculus
gactaactacacttgattcacctag

SEQ ID NO: 458866 - DNA, 25 bp, Mus musculus
gactaactacagctgttgacctacc

SEQ ID NO: 458867 - DNA, 25 bp, Mus musculus
gactaactacaggtgttgacctacc

SEQ ID NO: 458868 - DNA, 25 bp, Mus musculus
gactaactgagtcgttcaaatgtaa

SEQ ID NO: 458869 - DNA, 25 bp, Mus musculus
gactaactgagtggttcaaatgtaa

SEQ ID NO: 458870 - DNA, 25 bp, Mus musculus
gactaacttgcactctgactccata

SEQ ID NO: 458871 - DNA, 25 bp, Mus musculus
gactaacttgcagtctgactccata

SEQ ID NO: 458872 - DNA, 25 bp, Mus musculus
gactaacttggtagtgccatctgta

SEQ ID NO: 458873 - DNA, 25 bp, Mus musculus
gactaacttggttgtgccatctgta

SEQ ID NO: 458874 - DNA, 25 bp, Mus musculus
gactaagaaacacgtcactctgacc

SEQ ID NO: 458875 - DNA, 25 bp, Mus musculus
gactaagaaacaggtcactctgacc

SEQ ID NO: 458876 - DNA, 25 bp, Mus musculus
gactaagaagacaagcaaggccctg

SEQ ID NO: 458877 - DNA, 25 bp, Mus musculus
gactaagaagactagcaaggccctg

SEQ ID NO: 458878 - DNA, 25 bp, Mus musculus
gactaagaatttccttccaacactt

SEQ ID NO: 458879 - DNA, 25 bp, Mus musculus
gactaagaatttgcttccaacactt

SEQ ID NO: 458880 - DNA, 25 bp, Mus musculus
gactaagacactcgtctccttgttg

SEQ ID NO: 458881 - DNA, 25 bp, Mus musculus
gactaagacactggtctccttgttg

SEQ ID NO: 458882 - DNA, 25 bp, Mus musculus
gactaagacagcatgctacctccca

SEQ ID NO: 458883 - DNA, 25 bp, Mus musculus
gactaagacagcttgctacctccca

SEQ ID NO: 458884 - DNA, 25 bp, Mus musculus
gactaagacccacttacagctttgg

SEQ ID NO: 458885 - DNA, 25 bp, Mus musculus
gactaagacccagttacagctttgg

SEQ ID NO: 458886 - DNA, 25 bp, Mus musculus
gactaagagcacattcaggaagaat

SEQ ID NO: 458887 - DNA, 25 bp, Mus musculus
gactaagagcactttcaggaagaat

SEQ ID NO: 458888 - DNA, 25 bp, Mus musculus
gactaagagggacacacttttcttt

SEQ ID NO: 458889 - DNA, 25 bp, Mus musculus
gactaagagggagacacttttcttt

SEQ ID NO: 458890 - DNA, 25 bp, Mus musculus
gactaagagtgactggcttctctga

SEQ ID NO: 458891 - DNA, 25 bp, Mus musculus
gactaagagtgagtggcttctctga

SEQ ID NO: 458892 - DNA, 25 bp, Mus musculus
gactaagatcctactgggccacaag

SEQ ID NO: 458893 - DNA, 25 bp, Mus musculus
gactaagatccttctgggccacaag

SEQ ID NO: 458894 - DNA, 25 bp, Mus musculus
gactaagatctacaagccgcagatt

SEQ ID NO: 458895 - DNA, 25 bp, Mus musculus
gactaagatctagaagccgcagatt

SEQ ID NO: 458896 - DNA, 25 bp, Mus musculus
gactaagcagagatctcttcataag

SEQ ID NO: 458897 - DNA, 25 bp, Mus musculus
gactaagcagagttctcttcataag

SEQ ID NO: 458898 - DNA, 25 bp, Mus musculus
gactaagcagatccgtgtctttccc

SEQ ID NO: 458899 - DNA, 25 bp, Mus musculus
gactaagcagatgcgtgtctttccc

SEQ ID NO: 458900 - DNA, 25 bp, Mus musculus
gactaagcatgaaaatccctccctt

SEQ ID NO: 458901 - DNA, 25 bp, Mus musculus
gactaagcatgaagccttgacctaa

SEQ ID NO: 458902 - DNA, 25 bp, Mus musculus
gactaagcatgataatccctccctt

SEQ ID NO: 458903 - DNA, 25 bp, Mus musculus
gactaagcatgatgccttgacctaa

SEQ ID NO: 458904 - DNA, 25 bp, Mus musculus
gactaagcatttattgcctttgcgg

SEQ ID NO: 458905 - DNA, 25 bp, Mus musculus
gactaagcattttttgcctttgcgg

SEQ ID NO: 458906 - DNA, 25 bp, Mus musculus
gactaagccacaaggctgctcctaa

SEQ ID NO: 458907 - DNA, 25 bp, Mus musculus
gactaagccacatggctgctcctaa

SEQ ID NO: 458908 - DNA, 25 bp, Mus musculus
gactaagccagtccaaccagtgaaa

SEQ ID NO: 458909 - DNA, 25 bp, Mus musculus
gactaagccagtgcaaccagtgaaa

SEQ ID NO: 458910 - DNA, 25 bp, Mus musculus
gactaagccctcaaaacctacagaa

SEQ ID NO: 458911 - DNA, 25 bp, Mus musculus
gactaagccctctaaacctacagaa

SEQ ID NO: 458912 - DNA, 25 bp, Mus musculus
gactaagccttgatgattcttctgg

SEQ ID NO: 458913 - DNA, 25 bp, Mus musculus
gactaagccttgttgattcttctgg

SEQ ID NO: 458914 - DNA, 25 bp, Mus musculus
gactaagctaggctttccttttctg

SEQ ID NO: 458915 - DNA, 25 bp, Mus musculus
gactaagctagggtttccttttctg

SEQ ID NO: 458916 - DNA, 25 bp, Mus musculus
gactaagctagtcaatgtagccata

SEQ ID NO: 458917 - DNA, 25 bp, Mus musculus
gactaagctagtgaatgtagccata

SEQ ID NO: 458918 - DNA, 25 bp, Mus musculus
gactaaggaatgattgccaccacaa

SEQ ID NO: 458919 - DNA, 25 bp, Mus musculus
gactaaggaatgtttgccaccacaa

SEQ ID NO: 458920 - DNA, 25 bp, Mus musculus
gactaaggacgtctttcattttaat

SEQ ID NO: 458921 - DNA, 25 bp, Mus musculus
gactaaggacgtgtttcattttaat

SEQ ID NO: 458922 - DNA, 25 bp, Mus musculus
gactaaggatgtacttggttgtttg

SEQ ID NO: 458923 - DNA, 25 bp, Mus musculus
gactaaggatgttcttggttgtttg

SEQ ID NO: 458924 - DNA, 25 bp, Mus musculus
gactaaggctagcacaaaggtttca

SEQ ID NO: 458925 - DNA, 25 bp, Mus musculus
gactaaggctaggacaaaggtttca

SEQ ID NO: 458926 - DNA, 25 bp, Mus musculus
gactaagggtcaactacaggtaaat

SEQ ID NO: 458927 - DNA, 25 bp, Mus musculus
gactaagggtcatctacaggtaaat

SEQ ID NO: 458928 - DNA, 25 bp, Mus musculus
gactaagggttaaaaacagacgctc

SEQ ID NO: 458929 - DNA, 25 bp, Mus musculus
gactaagggttataaacagacgctc

SEQ ID NO: 458930 - DNA, 25 bp, Mus musculus
gactaaggtgctcggcgcattgctc

SEQ ID NO: 458931 - DNA, 25 bp, Mus musculus
gactaaggtgctgggcgcattgctc

SEQ ID NO: 458932 - DNA, 25 bp, Mus musculus
gactaagtccagagccatccctgaa

SEQ ID NO: 458933 - DNA, 25 bp, Mus musculus
gactaagtccagtgccatccctgaa

SEQ ID NO: 458934 - DNA, 25 bp, Mus musculus
gactaagtccgcaaagtgaggcaga

SEQ ID NO: 458935 - DNA, 25 bp, Mus musculus
gactaagtccgctaagtgaggcaga

SEQ ID NO: 458936 - DNA, 25 bp, Mus musculus
gactaagtcttgaattcaaacatga

SEQ ID NO: 458937 - DNA, 25 bp, Mus musculus
gactaagtcttgacactcacacaca

SEQ ID NO: 458938 - DNA, 25 bp, Mus musculus
gactaagtcttgtattcaaacatga

SEQ ID NO: 458939 - DNA, 25 bp, Mus musculus
gactaagtcttgtcactcacacaca

SEQ ID NO: 458940 - DNA, 25 bp, Mus musculus
gactaagtgtgtaacttcctcagac

SEQ ID NO: 458941 - DNA, 25 bp, Mus musculus
gactaagtgtgttacttcctcagac

SEQ ID NO: 458942 - DNA, 25 bp, Mus musculus
gactaagttgcaccctattttctgt

SEQ ID NO: 458943 - DNA, 25 bp, Mus musculus
gactaagttgcagcctattttctgt

SEQ ID NO: 458944 - DNA, 25 bp, Mus musculus
gactaataagttacctgctcttctt

SEQ ID NO: 458945 - DNA, 25 bp, Mus musculus
gactaataagtttcctgctcttctt

SEQ ID NO: 458946 - DNA, 25 bp, Mus musculus
gactaataatagcttccgttggaac

SEQ ID NO: 458947 - DNA, 25 bp, Mus musculus
gactaataataggttccgttggaac

SEQ ID NO: 458948 - DNA, 25 bp, Mus musculus
gactaatacaccagctaactaacga

SEQ ID NO: 458949 - DNA, 25 bp, Mus musculus
gactaatacacctgctaactaacga

SEQ ID NO: 458950 - DNA, 25 bp, Mus musculus
gactaatacgtcaggaagcatggct

SEQ ID NO: 458951 - DNA, 25 bp, Mus musculus
gactaatacgtctggaagcatggct

SEQ ID NO: 458952 - DNA, 25 bp, Mus musculus
gactaataggtccaggtgcctttcc

SEQ ID NO: 458953 - DNA, 25 bp, Mus musculus
gactaataggtcgaggtgcctttcc

SEQ ID NO: 458954 - DNA, 25 bp, Mus musculus
gactaatagtagcatcttgccctca

SEQ ID NO: 458955 - DNA, 25 bp, Mus musculus
gactaatagtaggatcttgccctca

SEQ ID NO: 458956 - DNA, 25 bp, Mus musculus
gactaatattttaacgcatttcgaa

SEQ ID NO: 458957 - DNA, 25 bp, Mus musculus
gactaatatttttacgcatttcgaa

SEQ ID NO: 458958 - DNA, 25 bp, Mus musculus
gactaatcatccacagaataaacat

SEQ ID NO: 458959 - DNA, 25 bp, Mus musculus
gactaatcatcctcagaataaacat

SEQ ID NO: 458960 - DNA, 25 bp, Mus musculus
gactaatccacccactgctcgtaaa

SEQ ID NO: 458961 - DNA, 25 bp, Mus musculus
gactaatccaccgactgctcgtaaa

SEQ ID NO: 458962 - DNA, 25 bp, Mus musculus
gactaatcggtgaatcccttggaaa

SEQ ID NO: 458963 - DNA, 25 bp, Mus musculus
gactaatcggtgtatcccttggaaa

SEQ ID NO: 458964 - DNA, 25 bp, Mus musculus
gactaatctattctctgtatgccag

SEQ ID NO: 458965 - DNA, 25 bp, Mus musculus
gactaatctattgtctgtatgccag

SEQ ID NO: 458966 - DNA, 25 bp, Mus musculus
gactaatctctgctaacttgggtaa

SEQ ID NO: 458967 - DNA, 25 bp, Mus musculus
gactaatctctggtaacttgggtaa

SEQ ID NO: 458968 - DNA, 25 bp, Mus musculus
gactaatctgagaataccatgggaa

SEQ ID NO: 458969 - DNA, 25 bp, Mus musculus
gactaatctgagtataccatgggaa

SEQ ID NO: 458970 - DNA, 25 bp, Mus musculus
gactaatgaagcatacatatttctc

SEQ ID NO: 458971 - DNA, 25 bp, Mus musculus
gactaatgaagcttacatatttctc

SEQ ID NO: 458972 - DNA, 25 bp, Mus musculus
gactaatgataacctgttgactctc

SEQ ID NO: 458973 - DNA, 25 bp, Mus musculus
gactaatgataagctgttgactctc

SEQ ID NO: 458974 - DNA, 25 bp, Mus musculus
gactaatggaacaggccctgtgcga

SEQ ID NO: 458975 - DNA, 25 bp, Mus musculus
gactaatggaactggccctgtgcga

SEQ ID NO: 458976 - DNA, 25 bp, Mus musculus
gactaatggctcagttgtaatacag

SEQ ID NO: 458977 - DNA, 25 bp, Mus musculus
gactaatggctctgttgtaatacag

SEQ ID NO: 458978 - DNA, 25 bp, Mus musculus
gactaatgtcatccttcatcaagag

SEQ ID NO: 458979 - DNA, 25 bp, Mus musculus
gactaatgtcatgcttcatcaagag

SEQ ID NO: 458980 - DNA, 25 bp, Mus musculus
gactaatgtggaatctatttcagtg

SEQ ID NO: 458981 - DNA, 25 bp, Mus musculus
gactaatgtggattctatttcagtg

SEQ ID NO: 458982 - DNA, 25 bp, Mus musculus
gactaatgttctataatgttgccct

SEQ ID NO: 458983 - DNA, 25 bp, Mus musculus
gactaatgttctttaatgttgccct

SEQ ID NO: 458984 - DNA, 25 bp, Mus musculus
gactaattaattcgtagccttcatt

SEQ ID NO: 458985 - DNA, 25 bp, Mus musculus
gactaattaattggtagccttcatt

SEQ ID NO: 458986 - DNA, 25 bp, Mus musculus
gactaattatctccgtgacactgct

SEQ ID NO: 458987 - DNA, 25 bp, Mus musculus
gactaattatctgcgtgacactgct

SEQ ID NO: 458988 - DNA, 25 bp, Mus musculus
gactaattccacacaatgtctttga

SEQ ID NO: 458989 - DNA, 25 bp, Mus musculus
gactaattccactcaatgtctttga

SEQ ID NO: 458990 - DNA, 25 bp, Mus musculus
gactaattctacagagatgccatgg

SEQ ID NO: 458991 - DNA, 25 bp, Mus musculus
gactaattctactgagatgccatgg

SEQ ID NO: 458992 - DNA, 25 bp, Mus musculus
gactaattctttatacttgtgctta

SEQ ID NO: 458993 - DNA, 25 bp, Mus musculus
gactaattctttttacttgtgctta

SEQ ID NO: 458994 - DNA, 25 bp, Mus musculus
gactaattgcatctacagccttgtt

SEQ ID NO: 458995 - DNA, 25 bp, Mus musculus
gactaattgcatgtacagccttgtt

SEQ ID NO: 458996 - DNA, 25 bp, Mus musculus
gactaattggtaacgattccctgga

SEQ ID NO: 458997 - DNA, 25 bp, Mus musculus
gactaattggtatcgattccctgga

SEQ ID NO: 458998 - DNA, 25 bp, Mus musculus
gactaattgtggaactttggtttgt

SEQ ID NO: 458999 - DNA, 25 bp, Mus musculus
gactaattgtggtactttggtttgt

SEQ ID NO: 459000 - DNA, 25 bp, Mus musculus
gactaatttagacaagagcttggtt

SEQ ID NO: 459001 - DNA, 25 bp, Mus musculus
gactaatttagagaagagcttggtt

SEQ ID NO: 459002 - DNA, 25 bp, Mus musculus
gactaatttgccatcaacttgtgtt

SEQ ID NO: 459003 - DNA, 25 bp, Mus musculus
gactaatttgccttcaacttgtgtt

SEQ ID NO: 459004 - DNA, 25 bp, Mus musculus
gactacaaaggactacacggacata

SEQ ID NO: 459005 - DNA, 25 bp, Mus musculus
gactacaaaggagtacacggacata

SEQ ID NO: 459006 - DNA, 25 bp, Mus musculus
gactacaaataacttcaggagcttg

SEQ ID NO: 459007 - DNA, 25 bp, Mus musculus
gactacaaataagttcaggagcttg

SEQ ID NO: 459008 - DNA, 25 bp, Mus musculus
gactacaactcaattctttcagaat

SEQ ID NO: 459009 - DNA, 25 bp, Mus musculus
gactacaactcatttctttcagaat

SEQ ID NO: 459010 - DNA, 25 bp, Mus musculus
gactacaactgaacggatgttgcct

SEQ ID NO: 459011 - DNA, 25 bp, Mus musculus
gactacaactgatcggatgttgcct

SEQ ID NO: 459012 - DNA, 25 bp, Mus musculus
gactacaacttgatgacttctttta

SEQ ID NO: 459013 - DNA, 25 bp, Mus musculus
gactacaacttgttgacttctttta

SEQ ID NO: 459014 - DNA, 25 bp, Mus musculus
gactacaactttacatattcctagg

SEQ ID NO: 459015 - DNA, 25 bp, Mus musculus
gactacaacttttcatattcctagg

SEQ ID NO: 459016 - DNA, 25 bp, Mus musculus
gactacaagaacacctttcccaagt

SEQ ID NO: 459017 - DNA, 25 bp, Mus musculus
gactacaagaactcctttcccaagt

SEQ ID NO: 459018 - DNA, 25 bp, Mus musculus
gactacaagcacatacatgttgaat

SEQ ID NO: 459019 - DNA, 25 bp, Mus musculus
gactacaagcacttacatgttgaat

SEQ ID NO: 459020 - DNA, 25 bp, Mus musculus
gactacaagccaaggatcctgagga

SEQ ID NO: 459021 - DNA, 25 bp, Mus musculus
gactacaagccatggatcctgagga

SEQ ID NO: 459022 - DNA, 25 bp, Mus musculus
gactacaaggtccagctatccaagt

SEQ ID NO: 459023 - DNA, 25 bp, Mus musculus
gactacaaggtcgagctatccaagt

SEQ ID NO: 459024 - DNA, 25 bp, Mus musculus
gactacaagttcaagagcgcctcac

SEQ ID NO: 459025 - DNA, 25 bp, Mus musculus
gactacaagttctagagcgcctcac

SEQ ID NO: 459026 - DNA, 25 bp, Mus musculus
gactacaagttgaaatgtgtgttat

SEQ ID NO: 459027 - DNA, 25 bp, Mus musculus
gactacaagttgtaatgtgtgttat

SEQ ID NO: 459028 - DNA, 25 bp, Mus musculus
gactacaatcatcactacacactgg

SEQ ID NO: 459029 - DNA, 25 bp, Mus musculus
gactacaatcatgactacacactgg

SEQ ID NO: 459030 - DNA, 25 bp, Mus musculus
gactacaatcttacacagggagaag

SEQ ID NO: 459031 - DNA, 25 bp, Mus musculus
gactacaatctttcacagggagaag

SEQ ID NO: 459032 - DNA, 25 bp, Mus musculus
gactacaatgagaacccgaaatgga

SEQ ID NO: 459033 - DNA, 25 bp, Mus musculus
gactacaatgagtacccgaaatgga

SEQ ID NO: 459034 - DNA, 25 bp, Mus musculus
gactacaatgtacagatccgcctct

SEQ ID NO: 459035 - DNA, 25 bp, Mus musculus
gactacaatgtagagatccgcctct

SEQ ID NO: 459036 - DNA, 25 bp, Mus musculus
gactacaatgtcaccagggagcgct

SEQ ID NO: 459037 - DNA, 25 bp, Mus musculus
gactacaatgtctccagggagcgct

SEQ ID NO: 459038 - DNA, 25 bp, Mus musculus
gactacacaagaccctttgttctca

SEQ ID NO: 459039 - DNA, 25 bp, Mus musculus
gactacacaagagcctttgttctca

SEQ ID NO: 459040 - DNA, 25 bp, Mus musculus
gactacacacatcagttccggtgaa

SEQ ID NO: 459041 - DNA, 25 bp, Mus musculus
gactacacacatgagttccggtgaa

SEQ ID NO: 459042 - DNA, 25 bp, Mus musculus
gactacacagggatgatcatgacat

SEQ ID NO: 459043 - DNA, 25 bp, Mus musculus
gactacacagggttgatcatgacat

SEQ ID NO: 459044 - DNA, 25 bp, Mus musculus
gactacacatgtacagatcctggga

SEQ ID NO: 459045 - DNA, 25 bp, Mus musculus
gactacacatgttcagatcctggga

SEQ ID NO: 459046 - DNA, 25 bp, Mus musculus
gactacaccaagctgaccatggacc

SEQ ID NO: 459047 - DNA, 25 bp, Mus musculus
gactacaccaaggtgaccatggacc

SEQ ID NO: 459048 - DNA, 25 bp, Mus musculus
gactacacccatcgcagcggagagg

SEQ ID NO: 459049 - DNA, 25 bp, Mus musculus
gactacacccatggcagcggagagg

SEQ ID NO: 459050 - DNA, 25 bp, Mus musculus
gactacacctgactacgagcgatga

SEQ ID NO: 459051 - DNA, 25 bp, Mus musculus
gactacacctgagtacgagcgatga

SEQ ID NO: 459052 - DNA, 25 bp, Mus musculus
gactacactagtaaaagcagccttt

SEQ ID NO: 459053 - DNA, 25 bp, Mus musculus
gactacactagttaaagcagccttt

SEQ ID NO: 459054 - DNA, 25 bp, Mus musculus
gactacacttaacgtttcatgcgga

SEQ ID NO: 459055 - DNA, 25 bp, Mus musculus
gactacacttaaggtttcatgcgga

SEQ ID NO: 459056 - DNA, 25 bp, Mus musculus
gactacacttacactatagcccatt

SEQ ID NO: 459057 - DNA, 25 bp, Mus musculus
gactacacttactctatagcccatt

SEQ ID NO: 459058 - DNA, 25 bp, Mus musculus
gactacagaaccagaccttgtcaca

SEQ ID NO: 459059 - DNA, 25 bp, Mus musculus
gactacagaacctgaccttgtcaca

SEQ ID NO: 459060 - DNA, 25 bp, Mus musculus
gactacagagggaccagtggagact

SEQ ID NO: 459061 - DNA, 25 bp, Mus musculus
gactacagagggtccagtggagact

SEQ ID NO: 459062 - DNA, 25 bp, Mus musculus
gactacagagtcaacctgggcctgt

SEQ ID NO: 459063 - DNA, 25 bp, Mus musculus
gactacagagtctacctgggcctgt

SEQ ID NO: 459064 - DNA, 25 bp, Mus musculus
gactacagcaacattgacccagagt

SEQ ID NO: 459065 - DNA, 25 bp, Mus musculus
gactacagcaactttgacccagagt

SEQ ID NO: 459066 - DNA, 25 bp, Mus musculus
gactacagcataatgtcgttttatc

SEQ ID NO: 459067 - DNA, 25 bp, Mus musculus
gactacagcatattgtcgttttatc

SEQ ID NO: 459068 - DNA, 25 bp, Mus musculus
gactacagcattcatgcctgtgcaa

SEQ ID NO: 459069 - DNA, 25 bp, Mus musculus
gactacagcattgatgcctgtgcaa

SEQ ID NO: 459070 - DNA, 25 bp, Mus musculus
gactacagccagcagggccatgtca

SEQ ID NO: 459071 - DNA, 25 bp, Mus musculus
gactacagccaggagggccatgtca

SEQ ID NO: 459072 - DNA, 25 bp, Mus musculus
gactacaggactcgtgaagacatat

SEQ ID NO: 459073 - DNA, 25 bp, Mus musculus
gactacaggactggtgaagacatat

SEQ ID NO: 459074 - DNA, 25 bp, Mus musculus
gactacagggaacctacctcacggt

SEQ ID NO: 459075 - DNA, 25 bp, Mus musculus
gactacagggaagctacctcacggt

SEQ ID NO: 459076 - DNA, 25 bp, Mus musculus
gactacagggtaatgtgtgggcttt

SEQ ID NO: 459077 - DNA, 25 bp, Mus musculus
gactacagggtattgtgtgggcttt

SEQ ID NO: 459078 - DNA, 25 bp, Mus musculus
gactacaggttcactggatttcctc

SEQ ID NO: 459079 - DNA, 25 bp, Mus musculus
gactacaggttctctggatttcctc

SEQ ID NO: 459080 - DNA, 25 bp, Mus musculus
gactacagtccccaggaggctttca

SEQ ID NO: 459081 - DNA, 25 bp, Mus musculus
gactacagtcccgaggaggctttca

SEQ ID NO: 459082 - DNA, 25 bp, Mus musculus
gactacagtgttctgctggtttaga

SEQ ID NO: 459083 - DNA, 25 bp, Mus musculus
gactacagtgttgtgctggtttaga

SEQ ID NO: 459084 - DNA, 25 bp, Mus musculus
gactacagttaaaatccccttcgca

SEQ ID NO: 459085 - DNA, 25 bp, Mus musculus
gactacagttaatatccccttcgca

SEQ ID NO: 459086 - DNA, 25 bp, Mus musculus
gactacagttagacatgtatcttct

SEQ ID NO: 459087 - DNA, 25 bp, Mus musculus
gactacagttagtcatgtatcttct

SEQ ID NO: 459088 - DNA, 25 bp, Mus musculus
gactacagtttaacatctctggact

SEQ ID NO: 459089 - DNA, 25 bp, Mus musculus
gactacagtttatcatctctggact

SEQ ID NO: 459090 - DNA, 25 bp, Mus musculus
gactacatacttcaactgtgctgct

SEQ ID NO: 459091 - DNA, 25 bp, Mus musculus
gactacatacttgaactgtgctgct

SEQ ID NO: 459092 - DNA, 25 bp, Mus musculus
gactacatagtgaacgagccacctc

SEQ ID NO: 459093 - DNA, 25 bp, Mus musculus
gactacatagtgacggtgatggttt

SEQ ID NO: 459094 - DNA, 25 bp, Mus musculus
gactacatagtgtacgagccacctc

SEQ ID NO: 459095 - DNA, 25 bp, Mus musculus
gactacatagtgtcggtgatggttt

SEQ ID NO: 459096 - DNA, 25 bp, Mus musculus
gactacatatatacagcttcctgag

SEQ ID NO: 459097 - DNA, 25 bp, Mus musculus
gactacatatattcagcttcctgag

SEQ ID NO: 459098 - DNA, 25 bp, Mus musculus
gactacatattcacattccccattt

SEQ ID NO: 459099 - DNA, 25 bp, Mus musculus
gactacatattctcattccccattt

SEQ ID NO: 459100 - DNA, 25 bp, Mus musculus
gactacatatttaccaggttagctt

SEQ ID NO: 459101 - DNA, 25 bp, Mus musculus
gactacatattttccaggttagctt

SEQ ID NO: 459102 - DNA, 25 bp, Mus musculus
gactacatcaaaatctaactggtta

SEQ ID NO: 459103 - DNA, 25 bp, Mus musculus
gactacatcaaattctaactggtta

SEQ ID NO: 459104 - DNA, 25 bp, Mus musculus
gactacatcagaacacacagttgta

SEQ ID NO: 459105 - DNA, 25 bp, Mus musculus
gactacatcagatcacacagttgta

SEQ ID NO: 459106 - DNA, 25 bp, Mus musculus
gactacatccaacatgaactccagt

SEQ ID NO: 459107 - DNA, 25 bp, Mus musculus
gactacatccaagatgaactccagt

SEQ ID NO: 459108 - DNA, 25 bp, Mus musculus
gactacatcgatagtaacatttttg

SEQ ID NO: 459109 - DNA, 25 bp, Mus musculus
gactacatcgattgtaacatttttg

SEQ ID NO: 459110 - DNA, 25 bp, Mus musculus
gactacatgcatcactaggctttga

SEQ ID NO: 459111 - DNA, 25 bp, Mus musculus
gactacatgcatgactaggctttga

SEQ ID NO: 459112 - DNA, 25 bp, Mus musculus
gactacatgcctcagattcttccaa

SEQ ID NO: 459113 - DNA, 25 bp, Mus musculus
gactacatgcctgagattcttccaa

SEQ ID NO: 459114 - DNA, 25 bp, Mus musculus
gactacatggaaatgtatcctggat

SEQ ID NO: 459115 - DNA, 25 bp, Mus musculus
gactacatggaattgtatcctggat

SEQ ID NO: 459116 - DNA, 25 bp, Mus musculus
gactacatggagagtctcctactcc

SEQ ID NO: 459117 - DNA, 25 bp, Mus musculus
gactacatggagtgtctcctactcc

SEQ ID NO: 459118 - DNA, 25 bp, Mus musculus
gactacatggcacaatgggacacct

SEQ ID NO: 459119 - DNA, 25 bp, Mus musculus
gactacatggcagaatgggacacct

SEQ ID NO: 459120 - DNA, 25 bp, Mus musculus
gactacattaatatagctagcagta

SEQ ID NO: 459121 - DNA, 25 bp, Mus musculus
gactacattaatttagctagcagta

SEQ ID NO: 459122 - DNA, 25 bp, Mus musculus
gactacattacaacgggccaggaag

SEQ ID NO: 459123 - DNA, 25 bp, Mus musculus
gactacattacatcgggccaggaag

SEQ ID NO: 459124 - DNA, 25 bp, Mus musculus
gactacattcagaaaaggcccagtt

SEQ ID NO: 459125 - DNA, 25 bp, Mus musculus
gactacattcagacatttgccagca

SEQ ID NO: 459126 - DNA, 25 bp, Mus musculus
gactacattcagtaaaggcccagtt

SEQ ID NO: 459127 - DNA, 25 bp, Mus musculus
gactacattcagtcatttgccagca

SEQ ID NO: 459128 - DNA, 25 bp, Mus musculus
gactacattctcaggaacaacctgc

SEQ ID NO: 459129 - DNA, 25 bp, Mus musculus
gactacattctctggaacaacctgc

SEQ ID NO: 459130 - DNA, 25 bp, Mus musculus
gactacattgataacatccagacga

SEQ ID NO: 459131 - DNA, 25 bp, Mus musculus
gactacattgattacatccagacga

SEQ ID NO: 459132 - DNA, 25 bp, Mus musculus
gactacattgtacctaattattcca

SEQ ID NO: 459133 - DNA, 25 bp, Mus musculus
gactacattgtagctaattattcca

SEQ ID NO: 459134 - DNA, 25 bp, Mus musculus
gactacatttaccagctggcaacca

SEQ ID NO: 459135 - DNA, 25 bp, Mus musculus
gactacatttacgagctggcaacca

SEQ ID NO: 459136 - DNA, 25 bp, Mus musculus
gactacatttatatcctttccaaac

SEQ ID NO: 459137 - DNA, 25 bp, Mus musculus
gactacatttatttcctttccaaac

SEQ ID NO: 459138 - DNA, 25 bp, Mus musculus
gactacatttgcacacacatacctt

SEQ ID NO: 459139 - DNA, 25 bp, Mus musculus
gactacatttgctcacacatacctt

SEQ ID NO: 459140 - DNA, 25 bp, Mus musculus
gactacattttaatcccagggatag

SEQ ID NO: 459141 - DNA, 25 bp, Mus musculus
gactacattttattcccagggatag

SEQ ID NO: 459142 - DNA, 25 bp, Mus musculus
gactaccaaatcacattgcaatcga

SEQ ID NO: 459143 - DNA, 25 bp, Mus musculus
gactaccaaatctcattgcaatcga

SEQ ID NO: 459144 - DNA, 25 bp, Mus musculus
gactaccaggtacacagcgcaatct

SEQ ID NO: 459145 - DNA, 25 bp, Mus musculus
gactaccaggtagacagcgcaatct

SEQ ID NO: 459146 - DNA, 25 bp, Mus musculus
gactaccagtttcagatctacaggc

SEQ ID NO: 459147 - DNA, 25 bp, Mus musculus
gactaccagtttgagatctacaggc

SEQ ID NO: 459148 - DNA, 25 bp, Mus musculus
gactaccatctaaccagcatgtact

SEQ ID NO: 459149 - DNA, 25 bp, Mus musculus
gactaccatctatccagcatgtact

SEQ ID NO: 459150 - DNA, 25 bp, Mus musculus
gactaccatggtccctgatatccaa

SEQ ID NO: 459151 - DNA, 25 bp, Mus musculus
gactaccatggtgcctgatatccaa

SEQ ID NO: 459152 - DNA, 25 bp, Mus musculus
gactacccatcaaagatatcgcacc

SEQ ID NO: 459153 - DNA, 25 bp, Mus musculus
gactacccatcaatatcatcagact

SEQ ID NO: 459154 - DNA, 25 bp, Mus musculus
gactacccatcatagatatcgcacc

SEQ ID NO: 459155 - DNA, 25 bp, Mus musculus
gactacccatcattatcatcagact

SEQ ID NO: 459156 - DNA, 25 bp, Mus musculus
gactaccccaggcaagacagacttt

SEQ ID NO: 459157 - DNA, 25 bp, Mus musculus
gactaccccagggaagacagacttt

SEQ ID NO: 459158 - DNA, 25 bp, Mus musculus
gactaccgaccactgaagttcttaa

SEQ ID NO: 459159 - DNA, 25 bp, Mus musculus
gactaccgaccagtgaagttcttaa

SEQ ID NO: 459160 - DNA, 25 bp, Mus musculus
gactaccgaggtataacctccacat

SEQ ID NO: 459161 - DNA, 25 bp, Mus musculus
gactaccgaggtttaacctccacat

SEQ ID NO: 459162 - DNA, 25 bp, Mus musculus
gactaccgcggcctgagtctggctc

SEQ ID NO: 459163 - DNA, 25 bp, Mus musculus
gactaccgcggcgtgagtctggctc

SEQ ID NO: 459164 - DNA, 25 bp, Mus musculus
gactaccggagtattgacaagcagt

SEQ ID NO: 459165 - DNA, 25 bp, Mus musculus
gactaccggagttttgacaagcagt

SEQ ID NO: 459166 - DNA, 25 bp, Mus musculus
gactaccgtcttatatgttctatcg

SEQ ID NO: 459167 - DNA, 25 bp, Mus musculus
gactaccgtcttttatgttctatcg

SEQ ID NO: 459168 - DNA, 25 bp, Mus musculus
gactaccgtgtaagggtttcgcaaa

SEQ ID NO: 459169 - DNA, 25 bp, Mus musculus
gactaccgtgtatgggtttcgcaaa

SEQ ID NO: 459170 - DNA, 25 bp, Mus musculus
gactacctaaagcagtttcccaagg

SEQ ID NO: 459171 - DNA, 25 bp, Mus musculus
gactacctaaaggagtttcccaagg

SEQ ID NO: 459172 - DNA, 25 bp, Mus musculus
gactacctacacatggtgcacaggc

SEQ ID NO: 459173 - DNA, 25 bp, Mus musculus
gactacctacacttggtgcacaggc

SEQ ID NO: 459174 - DNA, 25 bp, Mus musculus
gactacctactacattgcacagggc

SEQ ID NO: 459175 - DNA, 25 bp, Mus musculus
gactacctactagattgcacagggc

SEQ ID NO: 459176 - DNA, 25 bp, Mus musculus
gactacctagtgagttttgtcccaa

SEQ ID NO: 459177 - DNA, 25 bp, Mus musculus
gactacctagtgtgttttgtcccaa

SEQ ID NO: 459178 - DNA, 25 bp, Mus musculus
gactacctatacacctatccaatat

SEQ ID NO: 459179 - DNA, 25 bp, Mus musculus
gactacctatactcctatccaatat

SEQ ID NO: 459180 - DNA, 25 bp, Mus musculus
gactacctcaaactgcacatggaca

SEQ ID NO: 459181 - DNA, 25 bp, Mus musculus
gactacctcaaagtgcacatggaca

SEQ ID NO: 459182 - DNA, 25 bp, Mus musculus
gactacctcagaactgacactgcgt

SEQ ID NO: 459183 - DNA, 25 bp, Mus musculus
gactacctcagatctgacactgcgt

SEQ ID NO: 459184 - DNA, 25 bp, Mus musculus
gactacctcattctcttcacgttca

SEQ ID NO: 459185 - DNA, 25 bp, Mus musculus
gactacctcattgtcttcacgttca

SEQ ID NO: 459186 - DNA, 25 bp, Mus musculus
gactacctgaggctttttggcacca

SEQ ID NO: 459187 - DNA, 25 bp, Mus musculus
gactacctgagggtttttggcacca

SEQ ID NO: 459188 - DNA, 25 bp, Mus musculus
gactaccttcccaaacaaagagctg

SEQ ID NO: 459189 - DNA, 25 bp, Mus musculus
gactaccttccctaacaaagagctg

SEQ ID NO: 459190 - DNA, 25 bp, Mus musculus
gactacctttgacagttacccttga

SEQ ID NO: 459191 - DNA, 25 bp, Mus musculus
gactacctttgagagttacccttga

SEQ ID NO: 459192 - DNA, 25 bp, Mus musculus
gactaccttttcacacagttgtaca

SEQ ID NO: 459193 - DNA, 25 bp, Mus musculus
gactaccttttctcacagttgtaca

SEQ ID NO: 459194 - DNA, 25 bp, Mus musculus
gactacgacaaaactctgactttct

SEQ ID NO: 459195 - DNA, 25 bp, Mus musculus
gactacgacaaatctctgactttct

SEQ ID NO: 459196 - DNA, 25 bp, Mus musculus
gactacgacatgctgcattttgctc

SEQ ID NO: 459197 - DNA, 25 bp, Mus musculus
gactacgacatggtgcattttgctc

SEQ ID NO: 459198 - DNA, 25 bp, Mus musculus
gactacgagcagactgggctccatg

SEQ ID NO: 459199 - DNA, 25 bp, Mus musculus
gactacgagcagtctgggctccatg

SEQ ID NO: 459200 - DNA, 25 bp, Mus musculus
gactacgatgacacagatgacgatg

SEQ ID NO: 459201 - DNA, 25 bp, Mus musculus
gactacgatgactcagatgacgatg

SEQ ID NO: 459202 - DNA, 25 bp, Mus musculus
gactacgctgaacgagaactctttc

SEQ ID NO: 459203 - DNA, 25 bp, Mus musculus
gactacgctgaaggagaactctttc

SEQ ID NO: 459204 - DNA, 25 bp, Mus musculus
gactacgctgagctatcaaatgcat

SEQ ID NO: 459205 - DNA, 25 bp, Mus musculus
gactacgctgaggtatcaaatgcat

SEQ ID NO: 459206 - DNA, 25 bp, Mus musculus
gactacggtctcagaacaatcatgg

SEQ ID NO: 459207 - DNA, 25 bp, Mus musculus
gactacggtctctgaacaatcatgg

SEQ ID NO: 459208 - DNA, 25 bp, Mus musculus
gactacggttaacgcttcctttctg

SEQ ID NO: 459209 - DNA, 25 bp, Mus musculus
gactacggttaaggcttcctttctg

SEQ ID NO: 459210 - DNA, 25 bp, Mus musculus
gactacggttgtagtgaccgggctt

SEQ ID NO: 459211 - DNA, 25 bp, Mus musculus
gactacggttgttgtgaccgggctt

SEQ ID NO: 459212 - DNA, 25 bp, Mus musculus
gactacgtaagtaagaccctgccct

SEQ ID NO: 459213 - DNA, 25 bp, Mus musculus
gactacgtaagttagaccctgccct

SEQ ID NO: 459214 - DNA, 25 bp, Mus musculus
gactacgtacagcagtttttcagaa

SEQ ID NO: 459215 - DNA, 25 bp, Mus musculus
gactacgtacaggagtttttcagaa

SEQ ID NO: 459216 - DNA, 25 bp, Mus musculus
gactacgtcctcacatacaactatg

SEQ ID NO: 459217 - DNA, 25 bp, Mus musculus
gactacgtcctctcatacaactatg

SEQ ID NO: 459218 - DNA, 25 bp, Mus musculus
gactacgtctaaactggaatcctta

SEQ ID NO: 459219 - DNA, 25 bp, Mus musculus
gactacgtctaatctggaatcctta

SEQ ID NO: 459220 - DNA, 25 bp, Mus musculus
gactactacagtcacctgaagaagg

SEQ ID NO: 459221 - DNA, 25 bp, Mus musculus
gactactacagtgacctgaagaagg

SEQ ID NO: 459222 - DNA, 25 bp, Mus musculus
gactactacataagaacctgactga

SEQ ID NO: 459223 - DNA, 25 bp, Mus musculus
gactactacatatgaacctgactga

SEQ ID NO: 459224 - DNA, 25 bp, Mus musculus
gactactactatattcttctcataa

SEQ ID NO: 459225 - DNA, 25 bp, Mus musculus
gactactactatcagtttggttggg

SEQ ID NO: 459226 - DNA, 25 bp, Mus musculus
gactactactatgagtttggttggg

SEQ ID NO: 459227 - DNA, 25 bp, Mus musculus
gactactactattttcttctcataa

SEQ ID NO: 459228 - DNA, 25 bp, Mus musculus
gactactactcaagtaacgtcgtgt

SEQ ID NO: 459229 - DNA, 25 bp, Mus musculus
gactactactcatgtaacgtcgtgt

SEQ ID NO: 459230 - DNA, 25 bp, Mus musculus
gactactatgtaattaatgtggaac

SEQ ID NO: 459231 - DNA, 25 bp, Mus musculus
gactactatgtatttaatgtggaac

SEQ ID NO: 459232 - DNA, 25 bp, Mus musculus
gactactatgtccagatgtgcaagg

SEQ ID NO: 459233 - DNA, 25 bp, Mus musculus
gactactatgtcgagatgtgcaagg

SEQ ID NO: 459234 - DNA, 25 bp, Mus musculus
gactactatgttctggacgatgctg

SEQ ID NO: 459235 - DNA, 25 bp, Mus musculus
gactactatgttgtggacgatgctg

SEQ ID NO: 459236 - DNA, 25 bp, Mus musculus
gactactcagatagaagcatcagtg

SEQ ID NO: 459237 - DNA, 25 bp, Mus musculus
gactactcagattgaagcatcagtg

SEQ ID NO: 459238 - DNA, 25 bp, Mus musculus
gactactccagtacgtatggccttg

SEQ ID NO: 459239 - DNA, 25 bp, Mus musculus
gactactccagttcgtatggccttg

SEQ ID NO: 459240 - DNA, 25 bp, Mus musculus
gactactccattagcacttcaggga

SEQ ID NO: 459241 - DNA, 25 bp, Mus musculus
gactactccatttgcacttcaggga

SEQ ID NO: 459242 - DNA, 25 bp, Mus musculus
gactactctgtactgaatccacata

SEQ ID NO: 459243 - DNA, 25 bp, Mus musculus
gactactctgtagtgaatccacata

SEQ ID NO: 459244 - DNA, 25 bp, Mus musculus
gactactgaactctccagaggaaga

SEQ ID NO: 459245 - DNA, 25 bp, Mus musculus
gactactgaactgtccagaggaaga

SEQ ID NO: 459246 - DNA, 25 bp, Mus musculus
gactactgaagcagcagactcaaat

SEQ ID NO: 459247 - DNA, 25 bp, Mus musculus
gactactgaagctgcagactcaaat

SEQ ID NO: 459248 - DNA, 25 bp, Mus musculus
gactactgactgatgagggtgctgt

SEQ ID NO: 459249 - DNA, 25 bp, Mus musculus
gactactgactgttgagggtgctgt

SEQ ID NO: 459250 - DNA, 25 bp, Mus musculus
gactactgagtgagctttccaagga

SEQ ID NO: 459251 - DNA, 25 bp, Mus musculus
gactactgagtgtgctttccaagga

SEQ ID NO: 459252 - DNA, 25 bp, Mus musculus
gactactgatagataacacttggat

SEQ ID NO: 459253 - DNA, 25 bp, Mus musculus
gactactgatagttaacacttggat

SEQ ID NO: 459254 - DNA, 25 bp, Mus musculus
gactactgcagcatcagacacttga

SEQ ID NO: 459255 - DNA, 25 bp, Mus musculus
gactactgcagcttcagacacttga

SEQ ID NO: 459256 - DNA, 25 bp, Mus musculus
gactactgccggagtctgactggaa

SEQ ID NO: 459257 - DNA, 25 bp, Mus musculus
gactactgccggtgtctgactggaa

SEQ ID NO: 459258 - DNA, 25 bp, Mus musculus
gactactgcttcacaagacatctgc

SEQ ID NO: 459259 - DNA, 25 bp, Mus musculus
gactactgcttctcaagacatctgc

SEQ ID NO: 459260 - DNA, 25 bp, Mus musculus
gactactgctttccccgagaagatc

SEQ ID NO: 459261 - DNA, 25 bp, Mus musculus
gactactgctttgcccgagaagatc

SEQ ID NO: 459262 - DNA, 25 bp, Mus musculus
gactactggaacaaaggccctggtg

SEQ ID NO: 459263 - DNA, 25 bp, Mus musculus
gactactggaactaaggccctggtg

SEQ ID NO: 459264 - DNA, 25 bp, Mus musculus
gactactggctaaatcctttcttat

SEQ ID NO: 459265 - DNA, 25 bp, Mus musculus
gactactggctatatcctttcttat

SEQ ID NO: 459266 - DNA, 25 bp, Mus musculus
gactactggtcaatgccttttcttc

SEQ ID NO: 459267 - DNA, 25 bp, Mus musculus
gactactggtcattgccttttcttc

SEQ ID NO: 459268 - DNA, 25 bp, Mus musculus
gactactgtaatacccatttttatg

SEQ ID NO: 459269 - DNA, 25 bp, Mus musculus
gactactgtaattcccatttttatg

SEQ ID NO: 459270 - DNA, 25 bp, Mus musculus
gactactgtgttagtgcttttcaga

SEQ ID NO: 459271 - DNA, 25 bp, Mus musculus
gactactgtgtttgtgcttttcaga

SEQ ID NO: 459272 - DNA, 25 bp, Mus musculus
gactactgttttacaagcttgtatt

SEQ ID NO: 459273 - DNA, 25 bp, Mus musculus
gactactgttttacacccaatgttt

SEQ ID NO: 459274 - DNA, 25 bp, Mus musculus
gactactgtttttcaagcttgtatt

SEQ ID NO: 459275 - DNA, 25 bp, Mus musculus
gactactgtttttcacccaatgttt

SEQ ID NO: 459276 - DNA, 25 bp, Mus musculus
gactacttaataaatgtgtggatct

SEQ ID NO: 459277 - DNA, 25 bp, Mus musculus
gactacttaatatatgtgtggatct

SEQ ID NO: 459278 - DNA, 25 bp, Mus musculus
gactacttaatcctctttactatcc

SEQ ID NO: 459279 - DNA, 25 bp, Mus musculus
gactacttaatcgtctttactatcc

SEQ ID NO: 459280 - DNA, 25 bp, Mus musculus
gactacttcacaatactagctctga

SEQ ID NO: 459281 - DNA, 25 bp, Mus musculus
gactacttcacattactagctctga

SEQ ID NO: 459282 - DNA, 25 bp, Mus musculus
gactacttcagaaactggtcagttt

SEQ ID NO: 459283 - DNA, 25 bp, Mus musculus
gactacttcagatactggtcagttt

SEQ ID NO: 459284 - DNA, 25 bp, Mus musculus
gactacttcagcctcatgaactgca

SEQ ID NO: 459285 - DNA, 25 bp, Mus musculus
gactacttcagcgtcatgaactgca

SEQ ID NO: 459286 - DNA, 25 bp, Mus musculus
gactacttcattcttcagtggccca

SEQ ID NO: 459287 - DNA, 25 bp, Mus musculus
gactacttcattgttcagtggccca

SEQ ID NO: 459288 - DNA, 25 bp, Mus musculus
gactacttcccacagccaaacgaga

SEQ ID NO: 459289 - DNA, 25 bp, Mus musculus
gactacttcccagagccaaacgaga

SEQ ID NO: 459290 - DNA, 25 bp, Mus musculus
gactacttccgtcctacttctagac

SEQ ID NO: 459291 - DNA, 25 bp, Mus musculus
gactacttccgtgctacttctagac

SEQ ID NO: 459292 - DNA, 25 bp, Mus musculus
gactacttgacaaattgtggatcct

SEQ ID NO: 459293 - DNA, 25 bp, Mus musculus
gactacttgacatattgtggatcct

SEQ ID NO: 459294 - DNA, 25 bp, Mus musculus
gactacttgcatactacagagcata

SEQ ID NO: 459295 - DNA, 25 bp, Mus musculus
gactacttgcattctacagagcata

SEQ ID NO: 459296 - DNA, 25 bp, Mus musculus
gactacttgcctcagcaattttggg

SEQ ID NO: 459297 - DNA, 25 bp, Mus musculus
gactacttgcctgagcaattttggg

SEQ ID NO: 459298 - DNA, 25 bp, Mus musculus
gactacttgctgaagctgctcagga

SEQ ID NO: 459299 - DNA, 25 bp, Mus musculus
gactacttgctgtagctgctcagga

SEQ ID NO: 459300 - DNA, 25 bp, Mus musculus
gactacttggctagcttctgaggta

SEQ ID NO: 459301 - DNA, 25 bp, Mus musculus
gactacttggcttgcttctgaggta

SEQ ID NO: 459302 - DNA, 25 bp, Mus musculus
gactacttgggacacactggtctct

SEQ ID NO: 459303 - DNA, 25 bp, Mus musculus
gactacttgggacactacatcatgt

SEQ ID NO: 459304 - DNA, 25 bp, Mus musculus
gactacttgggagacactggtctct

SEQ ID NO: 459305 - DNA, 25 bp, Mus musculus
gactacttgggagactacatcatgt

SEQ ID NO: 459306 - DNA, 25 bp, Mus musculus
gactactttactcaatttgggcgat

SEQ ID NO: 459307 - DNA, 25 bp, Mus musculus
gactactttactgaatttgggcgat

SEQ ID NO: 459308 - DNA, 25 bp, Mus musculus
gactactttgaaacagactgttcct

SEQ ID NO: 459309 - DNA, 25 bp, Mus musculus
gactactttgaatcagactgttcct

SEQ ID NO: 459310 - DNA, 25 bp, Mus musculus
gactactttggccacggtgcaagat

SEQ ID NO: 459311 - DNA, 25 bp, Mus musculus
gactactttggcgacggtgcaagat

SEQ ID NO: 459312 - DNA, 25 bp, Mus musculus
gactacttttacatcattctgagcc

SEQ ID NO: 459313 - DNA, 25 bp, Mus musculus
gactacttttacttcattctgagcc

SEQ ID NO: 459314 - DNA, 25 bp, Mus musculus
gactacttttggacatctggagata

SEQ ID NO: 459315 - DNA, 25 bp, Mus musculus
gactacttttggtcatctggagata

SEQ ID NO: 459316 - DNA, 25 bp, Mus musculus
gactagaaacaccatttgagccact

SEQ ID NO: 459317 - DNA, 25 bp, Mus musculus
gactagaaacacgatttgagccact

SEQ ID NO: 459318 - DNA, 25 bp, Mus musculus
gactagaaactgaagtgtgcctttt

SEQ ID NO: 459319 - DNA, 25 bp, Mus musculus
gactagaaactgtagtgtgcctttt

SEQ ID NO: 459320 - DNA, 25 bp, Mus musculus
gactagaaagatagctccctggtta

SEQ ID NO: 459321 - DNA, 25 bp, Mus musculus
gactagaaagattgctccctggtta

SEQ ID NO: 459322 - DNA, 25 bp, Mus musculus
gactagaaagtaatcccttcaccct

SEQ ID NO: 459323 - DNA, 25 bp, Mus musculus
gactagaaagtattcccttcaccct

SEQ ID NO: 459324 - DNA, 25 bp, Mus musculus
gactagaaagttactttgcctgggt

SEQ ID NO: 459325 - DNA, 25 bp, Mus musculus
gactagaaagtttctttgcctgggt

SEQ ID NO: 459326 - DNA, 25 bp, Mus musculus
gactagaacaggaccagaatgtatt

SEQ ID NO: 459327 - DNA, 25 bp, Mus musculus
gactagaacaggtccagaatgtatt

SEQ ID NO: 459328 - DNA, 25 bp, Mus musculus
gactagaaccccacaaaatcctgga

SEQ ID NO: 459329 - DNA, 25 bp, Mus musculus
gactagaacccctcaaaatcctgga

SEQ ID NO: 459330 - DNA, 25 bp, Mus musculus
gactagaacggcaggctgcttccag

SEQ ID NO: 459331 - DNA, 25 bp, Mus musculus
gactagaacggctggctgcttccag

SEQ ID NO: 459332 - DNA, 25 bp, Mus musculus
gactagaactacacacaaggccctg

SEQ ID NO: 459333 - DNA, 25 bp, Mus musculus
gactagaactacatggccaggagaa

SEQ ID NO: 459334 - DNA, 25 bp, Mus musculus
gactagaactactcacaaggccctg

SEQ ID NO: 459335 - DNA, 25 bp, Mus musculus
gactagaactacttggccaggagaa

SEQ ID NO: 459336 - DNA, 25 bp, Mus musculus
gactagacacggagctgtcacccag

SEQ ID NO: 459337 - DNA, 25 bp, Mus musculus
gactagacacggtgctgtcacccag

SEQ ID NO: 459338 - DNA, 25 bp, Mus musculus
gactagacagtcatctcgggaaacc

SEQ ID NO: 459339 - DNA, 25 bp, Mus musculus
gactagacagtcttctcgggaaacc

SEQ ID NO: 459340 - DNA, 25 bp, Mus musculus
gactagaccacacatttgagcaaat

SEQ ID NO: 459341 - DNA, 25 bp, Mus musculus
gactagaccacagatttgagcaaat

SEQ ID NO: 459342 - DNA, 25 bp, Mus musculus
gactagaccttcaactatgttccag

SEQ ID NO: 459343 - DNA, 25 bp, Mus musculus
gactagaccttctactatgttccag

SEQ ID NO: 459344 - DNA, 25 bp, Mus musculus
gactagacggttagcagatatccaa

SEQ ID NO: 459345 - DNA, 25 bp, Mus musculus
gactagacggtttgcagatatccaa

SEQ ID NO: 459346 - DNA, 25 bp, Mus musculus
gactagactaatcctacatatggtg

SEQ ID NO: 459347 - DNA, 25 bp, Mus musculus
gactagactaatgctacatatggtg

SEQ ID NO: 459348 - DNA, 25 bp, Mus musculus
gactagactagcctcagagagcaca

SEQ ID NO: 459349 - DNA, 25 bp, Mus musculus
gactagactagcgtcagagagcaca

SEQ ID NO: 459350 - DNA, 25 bp, Mus musculus
gactagactcaaatacaggtaccag

SEQ ID NO: 459351 - DNA, 25 bp, Mus musculus
gactagactcaattacaggtaccag

SEQ ID NO: 459352 - DNA, 25 bp, Mus musculus
gactagacttgacctcagaggtgac

SEQ ID NO: 459353 - DNA, 25 bp, Mus musculus
gactagacttgacctgttctcaggc

SEQ ID NO: 459354 - DNA, 25 bp, Mus musculus
gactagacttgagctcagaggtgac

SEQ ID NO: 459355 - DNA, 25 bp, Mus musculus
gactagacttgagctgttctcaggc

SEQ ID NO: 459356 - DNA, 25 bp, Mus musculus
gactagagactcagtatctacaaca

SEQ ID NO: 459357 - DNA, 25 bp, Mus musculus
gactagagactctgtatctacaaca

SEQ ID NO: 459358 - DNA, 25 bp, Mus musculus
gactagagatgaacctactacattg

SEQ ID NO: 459359 - DNA, 25 bp, Mus musculus
gactagagatgatcctactacattg

SEQ ID NO: 459360 - DNA, 25 bp, Mus musculus
gactagagatgtccttttgacacgt

SEQ ID NO: 459361 - DNA, 25 bp, Mus musculus
gactagagatgtgcttttgacacgt

SEQ ID NO: 459362 - DNA, 25 bp, Mus musculus
gactagagccttatgtagtgggcat

SEQ ID NO: 459363 - DNA, 25 bp, Mus musculus
gactagagccttttgtagtgggcat

SEQ ID NO: 459364 - DNA, 25 bp, Mus musculus
gactagaggacacttcatgcagaaa

SEQ ID NO: 459365 - DNA, 25 bp, Mus musculus
gactagaggacagttcatgcagaaa

SEQ ID NO: 459366 - DNA, 25 bp, Mus musculus
gactagaggccacttttgaaccctg

SEQ ID NO: 459367 - DNA, 25 bp, Mus musculus
gactagaggccagttttgaaccctg

SEQ ID NO: 459368 - DNA, 25 bp, Mus musculus
gactagagtgcccactggatgtgca

SEQ ID NO: 459369 - DNA, 25 bp, Mus musculus
gactagagtgccgactggatgtgca

SEQ ID NO: 459370 - DNA, 25 bp, Mus musculus
gactagagttctcggatccgggcaa

SEQ ID NO: 459371 - DNA, 25 bp, Mus musculus
gactagagttctgggatccgggcaa

SEQ ID NO: 459372 - DNA, 25 bp, Mus musculus
gactagagttgtctgataatcgcgt

SEQ ID NO: 459373 - DNA, 25 bp, Mus musculus
gactagagttgtgtgataatcgcgt

SEQ ID NO: 459374 - DNA, 25 bp, Mus musculus
gactagagtttccttcaagttcata

SEQ ID NO: 459375 - DNA, 25 bp, Mus musculus
gactagagtttcgttcaagttcata

SEQ ID NO: 459376 - DNA, 25 bp, Mus musculus
gactagatacttctcggtcttctac

SEQ ID NO: 459377 - DNA, 25 bp, Mus musculus
gactagatacttgtcggtcttctac

SEQ ID NO: 459378 - DNA, 25 bp, Mus musculus
gactagatagccattgacttgacca

SEQ ID NO: 459379 - DNA, 25 bp, Mus musculus
gactagatagcctttgacttgacca

SEQ ID NO: 459380 - DNA, 25 bp, Mus musculus
gactagatattcatccagagcacct

SEQ ID NO: 459381 - DNA, 25 bp, Mus musculus
gactagatattcttccagagcacct

SEQ ID NO: 459382 - DNA, 25 bp, Mus musculus
gactagatctcacaaatcacaattt

SEQ ID NO: 459383 - DNA, 25 bp, Mus musculus
gactagatctcagaaatcacaattt

SEQ ID NO: 459384 - DNA, 25 bp, Mus musculus
gactagatgggtccaaataagaatt

SEQ ID NO: 459385 - DNA, 25 bp, Mus musculus
gactagatgggtgcaaataagaatt

SEQ ID NO: 459386 - DNA, 25 bp, Mus musculus
gactagatggtgactgtggactaca

SEQ ID NO: 459387 - DNA, 25 bp, Mus musculus
gactagatggtgtctgtggactaca

SEQ ID NO: 459388 - DNA, 25 bp, Mus musculus
gactagattatccacaggcttacat

SEQ ID NO: 459389 - DNA, 25 bp, Mus musculus
gactagattatcgacaggcttacat

SEQ ID NO: 459390 - DNA, 25 bp, Mus musculus
gactagattgttaaactgctgctat

SEQ ID NO: 459391 - DNA, 25 bp, Mus musculus
gactagattgtttaactgctgctat

SEQ ID NO: 459392 - DNA, 25 bp, Mus musculus
gactagcacaccacttcataaggag

SEQ ID NO: 459393 - DNA, 25 bp, Mus musculus
gactagcacacctcttcataaggag

SEQ ID NO: 459394 - DNA, 25 bp, Mus musculus
gactagcacattcctgagcacgtgt

SEQ ID NO: 459395 - DNA, 25 bp, Mus musculus
gactagcacattgctgagcacgtgt

SEQ ID NO: 459396 - DNA, 25 bp, Mus musculus
gactagcaccacaatgtcttcttaa

SEQ ID NO: 459397 - DNA, 25 bp, Mus musculus
gactagcaccactatgtcttcttaa

SEQ ID NO: 459398 - DNA, 25 bp, Mus musculus
gactagcactccaggaagtttgcct

SEQ ID NO: 459399 - DNA, 25 bp, Mus musculus
gactagcactcctggaagtttgcct

SEQ ID NO: 459400 - DNA, 25 bp, Mus musculus
gactagcagtcaagagtacaaccct

SEQ ID NO: 459401 - DNA, 25 bp, Mus musculus
gactagcagtcatgagtacaaccct

SEQ ID NO: 459402 - DNA, 25 bp, Mus musculus
gactagcatcagaaggctctattct

SEQ ID NO: 459403 - DNA, 25 bp, Mus musculus
gactagcatcagtaggctctattct

SEQ ID NO: 459404 - DNA, 25 bp, Mus musculus
gactagccaggcactcatcaaaata

SEQ ID NO: 459405 - DNA, 25 bp, Mus musculus
gactagccaggctctcatcaaaata

SEQ ID NO: 459406 - DNA, 25 bp, Mus musculus
gactagcccagaacagaatcatact

SEQ ID NO: 459407 - DNA, 25 bp, Mus musculus
gactagcccagatcagaatcatact

SEQ ID NO: 459408 - DNA, 25 bp, Mus musculus
gactagccctcaaggttattaaatc

SEQ ID NO: 459409 - DNA, 25 bp, Mus musculus
gactagccctcatggttattaaatc

SEQ ID NO: 459410 - DNA, 25 bp, Mus musculus
gactagccgggcagccaaactggac

SEQ ID NO: 459411 - DNA, 25 bp, Mus musculus
gactagccgggctgccaaactggac

SEQ ID NO: 459412 - DNA, 25 bp, Mus musculus
gactagcctcaacaccagaattcga

SEQ ID NO: 459413 - DNA, 25 bp, Mus musculus
gactagcctcaagaccagaattcga

SEQ ID NO: 459414 - DNA, 25 bp, Mus musculus
gactagcctcataagttgcctgtta

SEQ ID NO: 459415 - DNA, 25 bp, Mus musculus
gactagcctcattagttgcctgtta

SEQ ID NO: 459416 - DNA, 25 bp, Mus musculus
gactagcctgggatttttgccggga

SEQ ID NO: 459417 - DNA, 25 bp, Mus musculus
gactagcctgggttttttgccggga

SEQ ID NO: 459418 - DNA, 25 bp, Mus musculus
gactagcgcgcaaacacaacatgga

SEQ ID NO: 459419 - DNA, 25 bp, Mus musculus
gactagcgcgcatacacaacatgga

SEQ ID NO: 459420 - DNA, 25 bp, Mus musculus
gactagcggacaaggccagacctgc

SEQ ID NO: 459421 - DNA, 25 bp, Mus musculus
gactagcggacatggccagacctgc

SEQ ID NO: 459422 - DNA, 25 bp, Mus musculus
gactagcgtagcagatggcccagct

SEQ ID NO: 459423 - DNA, 25 bp, Mus musculus
gactagcgtagctgatggcccagct

SEQ ID NO: 459424 - DNA, 25 bp, Mus musculus
gactagcgtcaaaccagatgtggca

SEQ ID NO: 459425 - DNA, 25 bp, Mus musculus
gactagcgtcaatccagatgtggca

SEQ ID NO: 459426 - DNA, 25 bp, Mus musculus
gactagcgttttaaatagactccct

SEQ ID NO: 459427 - DNA, 25 bp, Mus musculus
gactagcgtttttaatagactccct

SEQ ID NO: 459428 - DNA, 25 bp, Mus musculus
gactagctaaggaatccagccatgt

SEQ ID NO: 459429 - DNA, 25 bp, Mus musculus
gactagctaaggtatccagccatgt

SEQ ID NO: 459430 - DNA, 25 bp, Mus musculus
gactagctacttatcaggattgaga

SEQ ID NO: 459431 - DNA, 25 bp, Mus musculus
gactagctacttttcaggattgaga

SEQ ID NO: 459432 - DNA, 25 bp, Mus musculus
gactagctccgaatcctcacagcag

SEQ ID NO: 459433 - DNA, 25 bp, Mus musculus
gactagctccgattcctcacagcag

SEQ ID NO: 459434 - DNA, 25 bp, Mus musculus
gactagctggctagctcctgcacaa

SEQ ID NO: 459435 - DNA, 25 bp, Mus musculus
gactagctggcttgctcctgcacaa

SEQ ID NO: 459436 - DNA, 25 bp, Mus musculus
gactagctgtttcgcaagttttaga

SEQ ID NO: 459437 - DNA, 25 bp, Mus musculus
gactagctgtttggcaagttttaga

SEQ ID NO: 459438 - DNA, 25 bp, Mus musculus
gactagcttaagaccattgcagagg

SEQ ID NO: 459439 - DNA, 25 bp, Mus musculus
gactagcttaagtccattgcagagg

SEQ ID NO: 459440 - DNA, 25 bp, Mus musculus
gactagcttcttcagaggcgactac

SEQ ID NO: 459441 - DNA, 25 bp, Mus musculus
gactagcttcttgagaggcgactac

SEQ ID NO: 459442 - DNA, 25 bp, Mus musculus
gactagcttgtgaagcatctgcctg

SEQ ID NO: 459443 - DNA, 25 bp, Mus musculus
gactagcttgtgtagcatctgcctg

SEQ ID NO: 459444 - DNA, 25 bp, Mus musculus
gactagctttctacatggttctttt

SEQ ID NO: 459445 - DNA, 25 bp, Mus musculus
gactagctttcttcatggttctttt

SEQ ID NO: 459446 - DNA, 25 bp, Mus musculus
gactagctttgaactcactgcgctc

SEQ ID NO: 459447 - DNA, 25 bp, Mus musculus
gactagctttgatctcactgcgctc

SEQ ID NO: 459448 - DNA, 25 bp, Mus musculus
gactaggaagcccacactgtgcatt

SEQ ID NO: 459449 - DNA, 25 bp, Mus musculus
gactaggaagccgacactgtgcatt

SEQ ID NO: 459450 - DNA, 25 bp, Mus musculus
gactaggacccaagtgagcaagcac

SEQ ID NO: 459451 - DNA, 25 bp, Mus musculus
gactaggacccatgtgagcaagcac

SEQ ID NO: 459452 - DNA, 25 bp, Mus musculus
gactaggagctaagtttctgttttg

SEQ ID NO: 459453 - DNA, 25 bp, Mus musculus
gactaggagctatgtttctgttttg

SEQ ID NO: 459454 - DNA, 25 bp, Mus musculus
gactaggagggcatcatctgacgag

SEQ ID NO: 459455 - DNA, 25 bp, Mus musculus
gactaggagggcttcatctgacgag

SEQ ID NO: 459456 - DNA, 25 bp, Mus musculus
gactaggaggtaatatggacatatc

SEQ ID NO: 459457 - DNA, 25 bp, Mus musculus
gactaggaggtattatggacatatc

SEQ ID NO: 459458 - DNA, 25 bp, Mus musculus
gactaggatcacatactgcctaatg

SEQ ID NO: 459459 - DNA, 25 bp, Mus musculus
gactaggatcacttactgcctaatg

SEQ ID NO: 459460 - DNA, 25 bp, Mus musculus
gactaggatctacattgaaatccaa

SEQ ID NO: 459461 - DNA, 25 bp, Mus musculus
gactaggatctagattgaaatccaa

SEQ ID NO: 459462 - DNA, 25 bp, Mus musculus
gactaggattcccagtaagacagaa

SEQ ID NO: 459463 - DNA, 25 bp, Mus musculus
gactaggattccgagtaagacagaa

SEQ ID NO: 459464 - DNA, 25 bp, Mus musculus
gactaggccagacctgaacgtttta

SEQ ID NO: 459465 - DNA, 25 bp, Mus musculus
gactaggccagagctgaacgtttta

SEQ ID NO: 459466 - DNA, 25 bp, Mus musculus
gactaggcctcacctagacctggta

SEQ ID NO: 459467 - DNA, 25 bp, Mus musculus
gactaggcctcagctagacctggta

SEQ ID NO: 459468 - DNA, 25 bp, Mus musculus
gactaggctgcaacagcttccggta

SEQ ID NO: 459469 - DNA, 25 bp, Mus musculus
gactaggctgcacttgcatctcaga

SEQ ID NO: 459470 - DNA, 25 bp, Mus musculus
gactaggctgcagttgcatctcaga

SEQ ID NO: 459471 - DNA, 25 bp, Mus musculus
gactaggctgcatcagcttccggta

SEQ ID NO: 459472 - DNA, 25 bp, Mus musculus
gactaggctttgcagttggactttt

SEQ ID NO: 459473 - DNA, 25 bp, Mus musculus
gactaggctttggagttggactttt

SEQ ID NO: 459474 - DNA, 25 bp, Mus musculus
gactagggaattccatgtcatagaa

SEQ ID NO: 459475 - DNA, 25 bp, Mus musculus
gactagggaattgcatgtcatagaa

SEQ ID NO: 459476 - DNA, 25 bp, Mus musculus
gactagggactcagtccgtggacct

SEQ ID NO: 459477 - DNA, 25 bp, Mus musculus
gactagggactctgtccgtggacct

SEQ ID NO: 459478 - DNA, 25 bp, Mus musculus
gactagggagtcaataaccactgga

SEQ ID NO: 459479 - DNA, 25 bp, Mus musculus
gactagggagtctataaccactgga

SEQ ID NO: 459480 - DNA, 25 bp, Mus musculus
gactagggcattcctagccccagaa

SEQ ID NO: 459481 - DNA, 25 bp, Mus musculus
gactagggcattgctagccccagaa

SEQ ID NO: 459482 - DNA, 25 bp, Mus musculus
gactagggcctccagtttaaatcat

SEQ ID NO: 459483 - DNA, 25 bp, Mus musculus
gactagggcctcgagtttaaatcat

SEQ ID NO: 459484 - DNA, 25 bp, Mus musculus
gactagggctatcccagtggctttc

SEQ ID NO: 459485 - DNA, 25 bp, Mus musculus
gactagggctatgccagtggctttc

SEQ ID NO: 459486 - DNA, 25 bp, Mus musculus
gactagggctccacgtactgagtat

SEQ ID NO: 459487 - DNA, 25 bp, Mus musculus
gactagggctcctcgtactgagtat

SEQ ID NO: 459488 - DNA, 25 bp, Mus musculus
gactagggctgcagtcggaccagca

SEQ ID NO: 459489 - DNA, 25 bp, Mus musculus
gactagggctgctgtcggaccagca

SEQ ID NO: 459490 - DNA, 25 bp, Mus musculus
gactagggctggatctggcttaccg

SEQ ID NO: 459491 - DNA, 25 bp, Mus musculus
gactagggctggttctggcttaccg

SEQ ID NO: 459492 - DNA, 25 bp, Mus musculus
gactagggtacaaccaggacctggg

SEQ ID NO: 459493 - DNA, 25 bp, Mus musculus
gactagggtacatccaggacctggg

SEQ ID NO: 459494 - DNA, 25 bp, Mus musculus
gactagggttttcttctcagaggaa

SEQ ID NO: 459495 - DNA, 25 bp, Mus musculus
gactagggttttgttctcagaggaa

SEQ ID NO: 459496 - DNA, 25 bp, Mus musculus
gactaggtctttcttcctgttgtac

SEQ ID NO: 459497 - DNA, 25 bp, Mus musculus
gactaggtctttgttcctgttgtac

SEQ ID NO: 459498 - DNA, 25 bp, Mus musculus
gactaggtgctcagtaaaactttac

SEQ ID NO: 459499 - DNA, 25 bp, Mus musculus
gactaggtgctctgtaaaactttac

SEQ ID NO: 459500 - DNA, 25 bp, Mus musculus
gactaggtgcttcccttgaaaacaa

SEQ ID NO: 459501 - DNA, 25 bp, Mus musculus
gactaggtgcttgccttgaaaacaa

SEQ ID NO: 459502 - DNA, 25 bp, Mus musculus
gactaggtggatcctgtttgtcctt

SEQ ID NO: 459503 - DNA, 25 bp, Mus musculus
gactaggtggatgctgtttgtcctt

SEQ ID NO: 459504 - DNA, 25 bp, Mus musculus
gactaggtgtaaattccttgccctt

SEQ ID NO: 459505 - DNA, 25 bp, Mus musculus
gactaggtgtaatttccttgccctt

SEQ ID NO: 459506 - DNA, 25 bp, Mus musculus
gactaggttattctggttattcttc

SEQ ID NO: 459507 - DNA, 25 bp, Mus musculus
gactaggttattgtggttattcttc

SEQ ID NO: 459508 - DNA, 25 bp, Mus musculus
gactaggttctacggcagtggttct

SEQ ID NO: 459509 - DNA, 25 bp, Mus musculus
gactaggttctagggcagtggttct

SEQ ID NO: 459510 - DNA, 25 bp, Mus musculus
gactaggttctgacttaatgcaaag

SEQ ID NO: 459511 - DNA, 25 bp, Mus musculus
gactaggttctgtcttaatgcaaag

SEQ ID NO: 459512 - DNA, 25 bp, Mus musculus
gactagtacccaatcttatcaggat

SEQ ID NO: 459513 - DNA, 25 bp, Mus musculus
gactagtacccattcttatcaggat

SEQ ID NO: 459514 - DNA, 25 bp, Mus musculus
gactagtcatggacagacgcgcaga

SEQ ID NO: 459515 - DNA, 25 bp, Mus musculus
gactagtcatggtcagacgcgcaga

SEQ ID NO: 459516 - DNA, 25 bp, Mus musculus
gactagtcattgagcgtcccacccc

SEQ ID NO: 459517 - DNA, 25 bp, Mus musculus
gactagtcattgtgcgtcccacccc

SEQ ID NO: 459518 - DNA, 25 bp, Mus musculus
gactagtccaacctccagttaaaat

SEQ ID NO: 459519 - DNA, 25 bp, Mus musculus
gactagtccaacgtccagttaaaat

SEQ ID NO: 459520 - DNA, 25 bp, Mus musculus
gactagtcctcactgtaattgcaca

SEQ ID NO: 459521 - DNA, 25 bp, Mus musculus
gactagtcctcagtgtaattgcaca

SEQ ID NO: 459522 - DNA, 25 bp, Mus musculus
gactagtcgaatcaaggatctaccg

SEQ ID NO: 459523 - DNA, 25 bp, Mus musculus
gactagtcgaatgaaggatctaccg

SEQ ID NO: 459524 - DNA, 25 bp, Mus musculus
gactagtctactcggcttttagctc

SEQ ID NO: 459525 - DNA, 25 bp, Mus musculus
gactagtctactgggcttttagctc

SEQ ID NO: 459526 - DNA, 25 bp, Mus musculus
gactagtctggacagattccacaat

SEQ ID NO: 459527 - DNA, 25 bp, Mus musculus
gactagtctggagagattccacaat

SEQ ID NO: 459528 - DNA, 25 bp, Mus musculus
gactagtgacctcgaagcaccgata

SEQ ID NO: 459529 - DNA, 25 bp, Mus musculus
gactagtgacctggaagcaccgata

SEQ ID NO: 459530 - DNA, 25 bp, Mus musculus
gactagtgactactagcctcacact

SEQ ID NO: 459531 - DNA, 25 bp, Mus musculus
gactagtgactagtagcctcacact

SEQ ID NO: 459532 - DNA, 25 bp, Mus musculus
gactagtgcagccatcagccatatg

SEQ ID NO: 459533 - DNA, 25 bp, Mus musculus
gactagtgcagcgatcagccatatg

SEQ ID NO: 459534 - DNA, 25 bp, Mus musculus
gactagtgccgccaaaggacatgta

SEQ ID NO: 459535 - DNA, 25 bp, Mus musculus
gactagtgccgcgaaaggacatgta

SEQ ID NO: 459536 - DNA, 25 bp, Mus musculus
gactagtgctgaagcttattaatgc

SEQ ID NO: 459537 - DNA, 25 bp, Mus musculus
gactagtgctgatgcttattaatgc

SEQ ID NO: 459538 - DNA, 25 bp, Mus musculus
gactagtggactcgagttccttcaa

SEQ ID NO: 459539 - DNA, 25 bp, Mus musculus
gactagtggactggagttccttcaa

SEQ ID NO: 459540 - DNA, 25 bp, Mus musculus
gactagtggtcacgccagctagcag

SEQ ID NO: 459541 - DNA, 25 bp, Mus musculus
gactagtggtcaggccagctagcag

SEQ ID NO: 459542 - DNA, 25 bp, Mus musculus
gactagtgtcccaaagacagtcaac

SEQ ID NO: 459543 - DNA, 25 bp, Mus musculus
gactagtgtccctaagacagtcaac

SEQ ID NO: 459544 - DNA, 25 bp, Mus musculus
gactagtgttcacaagcccagggtt

SEQ ID NO: 459545 - DNA, 25 bp, Mus musculus
gactagtgttcagaagcccagggtt

SEQ ID NO: 459546 - DNA, 25 bp, Mus musculus
gactagtgtttcatggctatgctgg

SEQ ID NO: 459547 - DNA, 25 bp, Mus musculus
gactagtgtttcttggctatgctgg

SEQ ID NO: 459548 - DNA, 25 bp, Mus musculus
gactagttaagactttggtctcaaa

SEQ ID NO: 459549 - DNA, 25 bp, Mus musculus
gactagttaagagtttggtctcaaa

SEQ ID NO: 459550 - DNA, 25 bp, Mus musculus
gactagttggatagctgtacctcaa

SEQ ID NO: 459551 - DNA, 25 bp, Mus musculus
gactagttggattgctgtacctcaa

SEQ ID NO: 459552 - DNA, 25 bp, Mus musculus
gactagttggcccttctaaatcaat

SEQ ID NO: 459553 - DNA, 25 bp, Mus musculus
gactagttggccgttctaaatcaat

SEQ ID NO: 459554 - DNA, 25 bp, Mus musculus
gactagttgtggaagaacatgcctt

SEQ ID NO: 459555 - DNA, 25 bp, Mus musculus
gactagttgtggtagaacatgcctt

SEQ ID NO: 459556 - DNA, 25 bp, Mus musculus
gactagtttaaaaccatcccagcac

SEQ ID NO: 459557 - DNA, 25 bp, Mus musculus
gactagtttaaatccatcccagcac

SEQ ID NO: 459558 - DNA, 25 bp, Mus musculus
gactagtttagtatatccgtgattg

SEQ ID NO: 459559 - DNA, 25 bp, Mus musculus
gactagtttagtttatccgtgattg

SEQ ID NO: 459560 - DNA, 25 bp, Mus musculus
gactagtttattatgttggctcact

SEQ ID NO: 459561 - DNA, 25 bp, Mus musculus
gactagtttattttgttggctcact

SEQ ID NO: 459562 - DNA, 25 bp, Mus musculus
gactagttttacctttgagccccag

SEQ ID NO: 459563 - DNA, 25 bp, Mus musculus
gactagttttacgtttgagccccag

SEQ ID NO: 459564 - DNA, 25 bp, Mus musculus
gactataaccacctgcaactggagg

SEQ ID NO: 459565 - DNA, 25 bp, Mus musculus
gactataaccacgtgcaactggagg

SEQ ID NO: 459566 - DNA, 25 bp, Mus musculus
gactataacgtcatgcttcctgagc

SEQ ID NO: 459567 - DNA, 25 bp, Mus musculus
gactataacgtcttgcttcctgagc

SEQ ID NO: 459568 - DNA, 25 bp, Mus musculus
gactataaggtgaccagacctccta

SEQ ID NO: 459569 - DNA, 25 bp, Mus musculus
gactataaggtgtccagacctccta

SEQ ID NO: 459570 - DNA, 25 bp, Mus musculus
gactataatcctctggatcacacca

SEQ ID NO: 459571 - DNA, 25 bp, Mus musculus
gactataatcctgtggatcacacca

SEQ ID NO: 459572 - DNA, 25 bp, Mus musculus
gactataatgttcactgtaaggctt

SEQ ID NO: 459573 - DNA, 25 bp, Mus musculus
gactataatgttgactgtaaggctt

SEQ ID NO: 459574 - DNA, 25 bp, Mus musculus
gactatacaagtctctgttagaaag

SEQ ID NO: 459575 - DNA, 25 bp, Mus musculus
gactatacaagtgtctgttagaaag

SEQ ID NO: 459576 - DNA, 25 bp, Mus musculus
gactatacaatgctgtgctttgtga

SEQ ID NO: 459577 - DNA, 25 bp, Mus musculus
gactatacaatggtgtgctttgtga

SEQ ID NO: 459578 - DNA, 25 bp, Mus musculus
gactatacacctatgagggcctcag

SEQ ID NO: 459579 - DNA, 25 bp, Mus musculus
gactatacacctttgagggcctcag

SEQ ID NO: 459580 - DNA, 25 bp, Mus musculus
gactatacagtgcacaatgagctat

SEQ ID NO: 459581 - DNA, 25 bp, Mus musculus
gactatacagtggacaatgagctat

SEQ ID NO: 459582 - DNA, 25 bp, Mus musculus
gactataccgtaaagctcagcttgc

SEQ ID NO: 459583 - DNA, 25 bp, Mus musculus
gactataccgtatagctcagcttgc

SEQ ID NO: 459584 - DNA, 25 bp, Mus musculus
gactatacgaaaaggctctacctct

SEQ ID NO: 459585 - DNA, 25 bp, Mus musculus
gactatacgaaatggctctacctct

SEQ ID NO: 459586 - DNA, 25 bp, Mus musculus
gactatacgctgagtcaggctgact

SEQ ID NO: 459587 - DNA, 25 bp, Mus musculus
gactatacgctgtgtcaggctgact

SEQ ID NO: 459588 - DNA, 25 bp, Mus musculus
gactatacggtccttaaagaagcag

SEQ ID NO: 459589 - DNA, 25 bp, Mus musculus
gactatacggtcgttaaagaagcag

SEQ ID NO: 459590 - DNA, 25 bp, Mus musculus
gactatactgtgagttttctcagag

SEQ ID NO: 459591 - DNA, 25 bp, Mus musculus
gactatactgtgtgttttctcagag

SEQ ID NO: 459592 - DNA, 25 bp, Mus musculus
gactatacttccagtttctgggctt

SEQ ID NO: 459593 - DNA, 25 bp, Mus musculus
gactatacttcctgtttctgggctt

SEQ ID NO: 459594 - DNA, 25 bp, Mus musculus
gactatagaagtctcattcctgtca

SEQ ID NO: 459595 - DNA, 25 bp, Mus musculus
gactatagaagtgtcattcctgtca

SEQ ID NO: 459596 - DNA, 25 bp, Mus musculus
gactatagacaaaccagcctggcta

SEQ ID NO: 459597 - DNA, 25 bp, Mus musculus
gactatagacaatccagcctggcta

SEQ ID NO: 459598 - DNA, 25 bp, Mus musculus
gactatataatacttttcctgcaga

SEQ ID NO: 459599 - DNA, 25 bp, Mus musculus
gactatataatagttttcctgcaga

SEQ ID NO: 459600 - DNA, 25 bp, Mus musculus
gactatataattaatttccactaaa

SEQ ID NO: 459601 - DNA, 25 bp, Mus musculus
gactatataatttatttccactaaa

SEQ ID NO: 459602 - DNA, 25 bp, Mus musculus
gactatatacatacccgattgttga

SEQ ID NO: 459603 - DNA, 25 bp, Mus musculus
gactatatacattcccgattgttga

SEQ ID NO: 459604 - DNA, 25 bp, Mus musculus
gactatatccctccttatattagtg

SEQ ID NO: 459605 - DNA, 25 bp, Mus musculus
gactatatccctgcttatattagtg

SEQ ID NO: 459606 - DNA, 25 bp, Mus musculus
gactatatccttcaactgggactgg

SEQ ID NO: 459607 - DNA, 25 bp, Mus musculus
gactatatccttgaactgggactgg

SEQ ID NO: 459608 - DNA, 25 bp, Mus musculus
gactatatcgtcatgtgccctggag

SEQ ID NO: 459609 - DNA, 25 bp, Mus musculus
gactatatcgtcttgtgccctggag

SEQ ID NO: 459610 - DNA, 25 bp, Mus musculus
gactatatctacactttatttgggt

SEQ ID NO: 459611 - DNA, 25 bp, Mus musculus
gactatatctactctttatttgggt

SEQ ID NO: 459612 - DNA, 25 bp, Mus musculus
gactatattcagctcatgacatatg

SEQ ID NO: 459613 - DNA, 25 bp, Mus musculus
gactatattcaggtcatgacatatg

SEQ ID NO: 459614 - DNA, 25 bp, Mus musculus
gactatattgtgcaccagaggatcc

SEQ ID NO: 459615 - DNA, 25 bp, Mus musculus
gactatattgtggaccagaggatcc

SEQ ID NO: 459616 - DNA, 25 bp, Mus musculus
gactatcaagacacagccataccag

SEQ ID NO: 459617 - DNA, 25 bp, Mus musculus
gactatcaagactcagccataccag

SEQ ID NO: 459618 - DNA, 25 bp, Mus musculus
gactatcacactatcacaacatctt

SEQ ID NO: 459619 - DNA, 25 bp, Mus musculus
gactatcacactttcacaacatctt

SEQ ID NO: 459620 - DNA, 25 bp, Mus musculus
gactatcacatcaggttttctgctg

SEQ ID NO: 459621 - DNA, 25 bp, Mus musculus
gactatcacatctggttttctgctg

SEQ ID NO: 459622 - DNA, 25 bp, Mus musculus
gactatcaccaaagtcctgaggagc

SEQ ID NO: 459623 - DNA, 25 bp, Mus musculus
gactatcaccaatgtcctgaggagc

SEQ ID NO: 459624 - DNA, 25 bp, Mus musculus
gactatcacgtcaaaatgacagctt

SEQ ID NO: 459625 - DNA, 25 bp, Mus musculus
gactatcacgtctaaatgacagctt

SEQ ID NO: 459626 - DNA, 25 bp, Mus musculus
gactatcagaatagtaccatccaga

SEQ ID NO: 459627 - DNA, 25 bp, Mus musculus
gactatcagaattgtaccatccaga

SEQ ID NO: 459628 - DNA, 25 bp, Mus musculus
gactatcagtctatatgtttctatg

SEQ ID NO: 459629 - DNA, 25 bp, Mus musculus
gactatcagtctttatgtttctatg

SEQ ID NO: 459630 - DNA, 25 bp, Mus musculus
gactatcagtggaattgcccgactt

SEQ ID NO: 459631 - DNA, 25 bp, Mus musculus
gactatcagtggtattgcccgactt

SEQ ID NO: 459632 - DNA, 25 bp, Mus musculus
gactatcataagcaacaggcagcac

SEQ ID NO: 459633 - DNA, 25 bp, Mus musculus
gactatcataaggaacaggcagcac

SEQ ID NO: 459634 - DNA, 25 bp, Mus musculus
gactatcatataatctctatccagg

SEQ ID NO: 459635 - DNA, 25 bp, Mus musculus
gactatcatatattctctatccagg

SEQ ID NO: 459636 - DNA, 25 bp, Mus musculus
gactatcatcatagctttgtggctg

SEQ ID NO: 459637 - DNA, 25 bp, Mus musculus
gactatcatcattgctttgtggctg

SEQ ID NO: 459638 - DNA, 25 bp, Mus musculus
gactatcatctaatggtggaacctt

SEQ ID NO: 459639 - DNA, 25 bp, Mus musculus
gactatcatctattggtggaacctt

SEQ ID NO: 459640 - DNA, 25 bp, Mus musculus
gactatcatgcccaaaagcttctct

SEQ ID NO: 459641 - DNA, 25 bp, Mus musculus
gactatcatgccgaaaagcttctct

SEQ ID NO: 459642 - DNA, 25 bp, Mus musculus
gactatccatgaatgatcctcctac

SEQ ID NO: 459643 - DNA, 25 bp, Mus musculus
gactatccatgattgatcctcctac

SEQ ID NO: 459644 - DNA, 25 bp, Mus musculus
gactatccatgtctgtattaattat

SEQ ID NO: 459645 - DNA, 25 bp, Mus musculus
gactatccatgtgtgtattaattat

SEQ ID NO: 459646 - DNA, 25 bp, Mus musculus
gactatcccatcaagacaacagtaa

SEQ ID NO: 459647 - DNA, 25 bp, Mus musculus
gactatcccatctagacaacagtaa

SEQ ID NO: 459648 - DNA, 25 bp, Mus musculus
gactatcctagtagttgccagacca

SEQ ID NO: 459649 - DNA, 25 bp, Mus musculus
gactatcctagttgttgccagacca

SEQ ID NO: 459650 - DNA, 25 bp, Mus musculus
gactatcctattcctgggagactaa

SEQ ID NO: 459651 - DNA, 25 bp, Mus musculus
gactatcctattgctgggagactaa

SEQ ID NO: 459652 - DNA, 25 bp, Mus musculus
gactatcgaaggagaggccgcagac

SEQ ID NO: 459653 - DNA, 25 bp, Mus musculus
gactatcgaaggtgaggccgcagac

SEQ ID NO: 459654 - DNA, 25 bp, Mus musculus
gactatcgatagctctgacatttgt

SEQ ID NO: 459655 - DNA, 25 bp, Mus musculus
gactatcgataggtctgacatttgt

SEQ ID NO: 459656 - DNA, 25 bp, Mus musculus
gactatctccgaatgcagctatgtg

SEQ ID NO: 459657 - DNA, 25 bp, Mus musculus
gactatctccgattgcagctatgtg

SEQ ID NO: 459658 - DNA, 25 bp, Mus musculus
gactatctgactattgattttattt

SEQ ID NO: 459659 - DNA, 25 bp, Mus musculus
gactatctgacttttgattttattt

SEQ ID NO: 459660 - DNA, 25 bp, Mus musculus
gactatctgagccacaggaatgaag

SEQ ID NO: 459661 - DNA, 25 bp, Mus musculus
gactatctgagcgacaggaatgaag

SEQ ID NO: 459662 - DNA, 25 bp, Mus musculus
gactatctgataatgcttgttccta

SEQ ID NO: 459663 - DNA, 25 bp, Mus musculus
gactatctgatattgcttgttccta

SEQ ID NO: 459664 - DNA, 25 bp, Mus musculus
gactatctggagaattctcttccca

SEQ ID NO: 459665 - DNA, 25 bp, Mus musculus
gactatctggagctgatgcccaatc

SEQ ID NO: 459666 - DNA, 25 bp, Mus musculus
gactatctggaggtgatgcccaatc

SEQ ID NO: 459667 - DNA, 25 bp, Mus musculus
gactatctggagtattctcttccca

SEQ ID NO: 459668 - DNA, 25 bp, Mus musculus
gactatctgtgtcaggctctcgggt

SEQ ID NO: 459669 - DNA, 25 bp, Mus musculus
gactatctgtgtgaggctctcgggt

SEQ ID NO: 459670 - DNA, 25 bp, Mus musculus
gactatctgttcaacaaatccctag

SEQ ID NO: 459671 - DNA, 25 bp, Mus musculus
gactatctgttctacaaatccctag

SEQ ID NO: 459672 - DNA, 25 bp, Mus musculus
gactatcttcagattcagtgttttg

SEQ ID NO: 459673 - DNA, 25 bp, Mus musculus
gactatcttcagtttcagtgttttg

SEQ ID NO: 459674 - DNA, 25 bp, Mus musculus
gactatcttcatacaaaccactcta

SEQ ID NO: 459675 - DNA, 25 bp, Mus musculus
gactatcttcattcaaaccactcta

SEQ ID NO: 459676 - DNA, 25 bp, Mus musculus
gactatcttgtcagcactgttgacc

SEQ ID NO: 459677 - DNA, 25 bp, Mus musculus
gactatcttgtctgcactgttgacc

SEQ ID NO: 459678 - DNA, 25 bp, Mus musculus
gactatctttatcaattcagtggca

SEQ ID NO: 459679 - DNA, 25 bp, Mus musculus
gactatctttatccttccctaaaat

SEQ ID NO: 459680 - DNA, 25 bp, Mus musculus
gactatctttatgaattcagtggca

SEQ ID NO: 459681 - DNA, 25 bp, Mus musculus
gactatctttatgcttccctaaaat

SEQ ID NO: 459682 - DNA, 25 bp, Mus musculus
gactatgaaagtcgacgggccattc

SEQ ID NO: 459683 - DNA, 25 bp, Mus musculus
gactatgaaagtggacgggccattc

SEQ ID NO: 459684 - DNA, 25 bp, Mus musculus
gactatgacagcaatgtacgaccat

SEQ ID NO: 459685 - DNA, 25 bp, Mus musculus
gactatgacagctatgtacgaccat

SEQ ID NO: 459686 - DNA, 25 bp, Mus musculus
gactatgaccgaagggcagacaagc

SEQ ID NO: 459687 - DNA, 25 bp, Mus musculus
gactatgaccgatgggcagacaagc

SEQ ID NO: 459688 - DNA, 25 bp, Mus musculus
gactatgacgagatcctggaattca

SEQ ID NO: 459689 - DNA, 25 bp, Mus musculus
gactatgacgagttcctggaattca

SEQ ID NO: 459690 - DNA, 25 bp, Mus musculus
gactatgactcccagtgagaaggaa

SEQ ID NO: 459691 - DNA, 25 bp, Mus musculus
gactatgactccgagtgagaaggaa

SEQ ID NO: 459692 - DNA, 25 bp, Mus musculus
gactatgaggagctcccgaatccta

SEQ ID NO: 459693 - DNA, 25 bp, Mus musculus
gactatgaggaggtcccgaatccta

SEQ ID NO: 459694 - DNA, 25 bp, Mus musculus
gactatgatctgaactgcttctgga

SEQ ID NO: 459695 - DNA, 25 bp, Mus musculus
gactatgatctgtactgcttctgga

SEQ ID NO: 459696 - DNA, 25 bp, Mus musculus
gactatgatttaatggctcagccga

SEQ ID NO: 459697 - DNA, 25 bp, Mus musculus
gactatgatttattggctcagccga

SEQ ID NO: 459698 - DNA, 25 bp, Mus musculus
gactatgcaactctcccgggcagag

SEQ ID NO: 459699 - DNA, 25 bp, Mus musculus
gactatgcaactgtcccgggcagag

SEQ ID NO: 459700 - DNA, 25 bp, Mus musculus
gactatgcaatgactgccttccagg

SEQ ID NO: 459701 - DNA, 25 bp, Mus musculus
gactatgcaatgtctgccttccagg

SEQ ID NO: 459702 - DNA, 25 bp, Mus musculus
gactatgcagtgaccgtagagccgc

SEQ ID NO: 459703 - DNA, 25 bp, Mus musculus
gactatgcagtgtccgtagagccgc

SEQ ID NO: 459704 - DNA, 25 bp, Mus musculus
gactatgcatagagctacaaggcta

SEQ ID NO: 459705 - DNA, 25 bp, Mus musculus
gactatgcatagtgctacaaggcta

SEQ ID NO: 459706 - DNA, 25 bp, Mus musculus
gactatgcatatagcccagttcctc

SEQ ID NO: 459707 - DNA, 25 bp, Mus musculus
gactatgcatattgcccagttcctc

SEQ ID NO: 459708 - DNA, 25 bp, Mus musculus
gactatgcccgcaacgtgcatgaag

SEQ ID NO: 459709 - DNA, 25 bp, Mus musculus
gactatgcccgctacgtgcatgaag

SEQ ID NO: 459710 - DNA, 25 bp, Mus musculus
gactatgcctgcatcgccaggagca

SEQ ID NO: 459711 - DNA, 25 bp, Mus musculus
gactatgcctgcttcgccaggagca

SEQ ID NO: 459712 - DNA, 25 bp, Mus musculus
gactatgcgcagcaataccattctt

SEQ ID NO: 459713 - DNA, 25 bp, Mus musculus
gactatgcgcaggaataccattctt

SEQ ID NO: 459714 - DNA, 25 bp, Mus musculus
gactatgcggatctactgaacccac

SEQ ID NO: 459715 - DNA, 25 bp, Mus musculus
gactatgcggatgtactgaacccac

SEQ ID NO: 459716 - DNA, 25 bp, Mus musculus
gactatgctactattatcattcaga

SEQ ID NO: 459717 - DNA, 25 bp, Mus musculus
gactatgctacttttatcattcaga

SEQ ID NO: 459718 - DNA, 25 bp, Mus musculus
gactatgctcctagccggaggatga

SEQ ID NO: 459719 - DNA, 25 bp, Mus musculus
gactatgctccttgccggaggatga

SEQ ID NO: 459720 - DNA, 25 bp, Mus musculus
gactatgctgataccagttgcttga

SEQ ID NO: 459721 - DNA, 25 bp, Mus musculus
gactatgctgattccagttgcttga

SEQ ID NO: 459722 - DNA, 25 bp, Mus musculus
gactatgctggccaggaggctgatg

SEQ ID NO: 459723 - DNA, 25 bp, Mus musculus
gactatgctggcgaggaggctgatg

SEQ ID NO: 459724 - DNA, 25 bp, Mus musculus
gactatgctggtctggttttatgaa

SEQ ID NO: 459725 - DNA, 25 bp, Mus musculus
gactatgctggtgtggttttatgaa

SEQ ID NO: 459726 - DNA, 25 bp, Mus musculus
gactatggaccgataagctgggcaa

SEQ ID NO: 459727 - DNA, 25 bp, Mus musculus
gactatggaccgttaagctgggcaa

SEQ ID NO: 459728 - DNA, 25 bp, Mus musculus
gactatggactcaggaaggagatct

SEQ ID NO: 459729 - DNA, 25 bp, Mus musculus
gactatggactctggaaggagatct

SEQ ID NO: 459730 - DNA, 25 bp, Mus musculus
gactatggagccatgttcttcagta

SEQ ID NO: 459731 - DNA, 25 bp, Mus musculus
gactatggagccttgttcttcagta

SEQ ID NO: 459732 - DNA, 25 bp, Mus musculus
gactatggagtactggactctacca

SEQ ID NO: 459733 - DNA, 25 bp, Mus musculus
gactatggagtagtggactctacca

SEQ ID NO: 459734 - DNA, 25 bp, Mus musculus
gactatggcataaactcttggcatt

SEQ ID NO: 459735 - DNA, 25 bp, Mus musculus
gactatggcatatactcttggcatt

SEQ ID NO: 459736 - DNA, 25 bp, Mus musculus
gactatggcatcaatatctgaatga

SEQ ID NO: 459737 - DNA, 25 bp, Mus musculus
gactatggcatcattacatttctgg

SEQ ID NO: 459738 - DNA, 25 bp, Mus musculus
gactatggcatctatatctgaatga

SEQ ID NO: 459739 - DNA, 25 bp, Mus musculus
gactatggcatctttacatttctgg

SEQ ID NO: 459740 - DNA, 25 bp, Mus musculus
gactatggccatatcctatgcttaa

SEQ ID NO: 459741 - DNA, 25 bp, Mus musculus
gactatggccatttcctatgcttaa

SEQ ID NO: 459742 - DNA, 25 bp, Mus musculus
gactatggctttagttctactacat

SEQ ID NO: 459743 - DNA, 25 bp, Mus musculus
gactatggcttttgttctactacat

SEQ ID NO: 459744 - DNA, 25 bp, Mus musculus
gactatgggcttagctttctcctct

SEQ ID NO: 459745 - DNA, 25 bp, Mus musculus
gactatgggctttgctttctcctct

SEQ ID NO: 459746 - DNA, 25 bp, Mus musculus
gactatgggtgcaccaatgtcccta

SEQ ID NO: 459747 - DNA, 25 bp, Mus musculus
gactatgggtgctccaatgtcccta

SEQ ID NO: 459748 - DNA, 25 bp, Mus musculus
gactatggtacaacctagctctgct

SEQ ID NO: 459749 - DNA, 25 bp, Mus musculus
gactatggtacatcctagctctgct

SEQ ID NO: 459750 - DNA, 25 bp, Mus musculus
gactatggtccaagactcagctcat

SEQ ID NO: 459751 - DNA, 25 bp, Mus musculus
gactatggtccatgactcagctcat

SEQ ID NO: 459752 - DNA, 25 bp, Mus musculus
gactatggtcttcagacatctgatc

SEQ ID NO: 459753 - DNA, 25 bp, Mus musculus
gactatggtcttgagacatctgatc

SEQ ID NO: 459754 - DNA, 25 bp, Mus musculus
gactatggtgaaaactctggattac

SEQ ID NO: 459755 - DNA, 25 bp, Mus musculus
gactatggtgaatactctggattac

SEQ ID NO: 459756 - DNA, 25 bp, Mus musculus
gactatgtacaacaaaatcctgaac

SEQ ID NO: 459757 - DNA, 25 bp, Mus musculus
gactatgtacaagaaaatcctgaac

SEQ ID NO: 459758 - DNA, 25 bp, Mus musculus
gactatgtacggcatcatccagttt

SEQ ID NO: 459759 - DNA, 25 bp, Mus musculus
gactatgtacgggatcatccagttt

SEQ ID NO: 459760 - DNA, 25 bp, Mus musculus
gactatgtagctcgccctgtgtaaa

SEQ ID NO: 459761 - DNA, 25 bp, Mus musculus
gactatgtagctggccctgtgtaaa

SEQ ID NO: 459762 - DNA, 25 bp, Mus musculus
gactatgtaggcacactttcaaaca

SEQ ID NO: 459763 - DNA, 25 bp, Mus musculus
gactatgtaggctcactttcaaaca

SEQ ID NO: 459764 - DNA, 25 bp, Mus musculus
gactatgtagtcagccacacactga

SEQ ID NO: 459765 - DNA, 25 bp, Mus musculus
gactatgtagtctgccacacactga

SEQ ID NO: 459766 - DNA, 25 bp, Mus musculus
gactatgtcatgagttcctaggaga

SEQ ID NO: 459767 - DNA, 25 bp, Mus musculus
gactatgtcatgtgttcctaggaga

SEQ ID NO: 459768 - DNA, 25 bp, Mus musculus
gactatgtccgcatcatgcaggaaa

SEQ ID NO: 459769 - DNA, 25 bp, Mus musculus
gactatgtccgcttcatgcaggaaa

SEQ ID NO: 459770 - DNA, 25 bp, Mus musculus
gactatgtcttacacccagcaaaag

SEQ ID NO: 459771 - DNA, 25 bp, Mus musculus
gactatgtcttagacccagcaaaag

SEQ ID NO: 459772 - DNA, 25 bp, Mus musculus
gactatgtgaatccggaccatggcc

SEQ ID NO: 459773 - DNA, 25 bp, Mus musculus
gactatgtgaatgcggaccatggcc

SEQ ID NO: 459774 - DNA, 25 bp, Mus musculus
gactatgtgacgaagactaggagac

SEQ ID NO: 459775 - DNA, 25 bp, Mus musculus
gactatgtgacgtagactaggagac

SEQ ID NO: 459776 - DNA, 25 bp, Mus musculus
gactatgtgagaaactcttgggagt

SEQ ID NO: 459777 - DNA, 25 bp, Mus musculus
gactatgtgagatactcttgggagt

SEQ ID NO: 459778 - DNA, 25 bp, Mus musculus
gactatgtgatacgtatgtgtccat

SEQ ID NO: 459779 - DNA, 25 bp, Mus musculus
gactatgtgataggtatgtgtccat

SEQ ID NO: 459780 - DNA, 25 bp, Mus musculus
gactatgtgattccagctctggcac

SEQ ID NO: 459781 - DNA, 25 bp, Mus musculus
gactatgtgattgcagctctggcac

SEQ ID NO: 459782 - DNA, 25 bp, Mus musculus
gactatgtgcttctgggctatgaac

SEQ ID NO: 459783 - DNA, 25 bp, Mus musculus
gactatgtgcttgtgggctatgaac

SEQ ID NO: 459784 - DNA, 25 bp, Mus musculus
gactatgtggccaaacctggagaca

SEQ ID NO: 459785 - DNA, 25 bp, Mus musculus
gactatgtggcctaacctggagaca

SEQ ID NO: 459786 - DNA, 25 bp, Mus musculus
gactatgtggcgcacaagaacacca

SEQ ID NO: 459787 - DNA, 25 bp, Mus musculus
gactatgtggcggacaagaacacca

SEQ ID NO: 459788 - DNA, 25 bp, Mus musculus
gactatgtggtcaacacctacttcc

SEQ ID NO: 459789 - DNA, 25 bp, Mus musculus
gactatgtggtctacacctacttcc

SEQ ID NO: 459790 - DNA, 25 bp, Mus musculus
gactatgtggtgaccagccgagctt

SEQ ID NO: 459791 - DNA, 25 bp, Mus musculus
gactatgtggtgtccagccgagctt

SEQ ID NO: 459792 - DNA, 25 bp, Mus musculus
gactatgttcttagagtcctaacca

SEQ ID NO: 459793 - DNA, 25 bp, Mus musculus
gactatgttctttgagtcctaacca

SEQ ID NO: 459794 - DNA, 25 bp, Mus musculus
gactatgttgtgagccaggttggtt

SEQ ID NO: 459795 - DNA, 25 bp, Mus musculus
gactatgttgtgtgccaggttggtt

SEQ ID NO: 459796 - DNA, 25 bp, Mus musculus
gactatgtttacatttcaggctggt

SEQ ID NO: 459797 - DNA, 25 bp, Mus musculus
gactatgtttacttttcaggctggt

SEQ ID NO: 459798 - DNA, 25 bp, Mus musculus
gactatgtttgtatcctaagcctca

SEQ ID NO: 459799 - DNA, 25 bp, Mus musculus
gactatgtttgtttcctaagcctca

SEQ ID NO: 459800 - DNA, 25 bp, Mus musculus
gactattaagctacctgaggtcccc

SEQ ID NO: 459801 - DNA, 25 bp, Mus musculus
gactattaagcttcctgaggtcccc

SEQ ID NO: 459802 - DNA, 25 bp, Mus musculus
gactattacgtcaagcctgtagcct

SEQ ID NO: 459803 - DNA, 25 bp, Mus musculus
gactattacgtctagcctgtagcct

SEQ ID NO: 459804 - DNA, 25 bp, Mus musculus
gactattactctaggattatgttcc

SEQ ID NO: 459805 - DNA, 25 bp, Mus musculus
gactattactcttggattatgttcc

SEQ ID NO: 459806 - DNA, 25 bp, Mus musculus
gactattagaatacccacccattgg

SEQ ID NO: 459807 - DNA, 25 bp, Mus musculus
gactattagaattcccacccattgg

SEQ ID NO: 459808 - DNA, 25 bp, Mus musculus
gactattagtcaccggcagcagtga

SEQ ID NO: 459809 - DNA, 25 bp, Mus musculus
gactattagtcagcggcagcagtga

SEQ ID NO: 459810 - DNA, 25 bp, Mus musculus
gactattatctacctctataacatt

SEQ ID NO: 459811 - DNA, 25 bp, Mus musculus
gactattatctagctctataacatt

SEQ ID NO: 459812 - DNA, 25 bp, Mus musculus
gactattcaaccctccataaaaaga

SEQ ID NO: 459813 - DNA, 25 bp, Mus musculus
gactattcaaccgtccataaaaaga

SEQ ID NO: 459814 - DNA, 25 bp, Mus musculus
gactattccattctcttttgtaaaa

SEQ ID NO: 459815 - DNA, 25 bp, Mus musculus
gactattccattgtcttttgtaaaa

SEQ ID NO: 459816 - DNA, 25 bp, Mus musculus
gactattccctgctagtaatgcaaa

SEQ ID NO: 459817 - DNA, 25 bp, Mus musculus
gactattccctggtagtaatgcaaa

SEQ ID NO: 459818 - DNA, 25 bp, Mus musculus
gactattcctacagtgggacaccct

SEQ ID NO: 459819 - DNA, 25 bp, Mus musculus
gactattcctactgtgggacaccct

SEQ ID NO: 459820 - DNA, 25 bp, Mus musculus
gactattctctaagctaatgtggac

SEQ ID NO: 459821 - DNA, 25 bp, Mus musculus
gactattctctatgctaatgtggac

SEQ ID NO: 459822 - DNA, 25 bp, Mus musculus
gactattctcttctaaaactaaagg

SEQ ID NO: 459823 - DNA, 25 bp, Mus musculus
gactattctcttgtaaaactaaagg

SEQ ID NO: 459824 - DNA, 25 bp, Mus musculus
gactattctgatctgcttttctgga

SEQ ID NO: 459825 - DNA, 25 bp, Mus musculus
gactattctgatgtgcttttctgga

SEQ ID NO: 459826 - DNA, 25 bp, Mus musculus
gactattcttctcactcttttattt

SEQ ID NO: 459827 - DNA, 25 bp, Mus musculus
gactattcttctgactcttttattt

SEQ ID NO: 459828 - DNA, 25 bp, Mus musculus
gactattcttttagcagagctctga

SEQ ID NO: 459829 - DNA, 25 bp, Mus musculus
gactattctttttgcagagctctga

SEQ ID NO: 459830 - DNA, 25 bp, Mus musculus
gactattgacataggtctgtctgtg

SEQ ID NO: 459831 - DNA, 25 bp, Mus musculus
gactattgacattggtctgtctgtg

SEQ ID NO: 459832 - DNA, 25 bp, Mus musculus
gactattgagagagagaaaaaccca

SEQ ID NO: 459833 - DNA, 25 bp, Mus musculus
gactattgagagtgagaaaaaccca

SEQ ID NO: 459834 - DNA, 25 bp, Mus musculus
gactattggacaagtctccaggttt

SEQ ID NO: 459835 - DNA, 25 bp, Mus musculus
gactattggacatgtctccaggttt

SEQ ID NO: 459836 - DNA, 25 bp, Mus musculus
gactattgtaggactagagctcccc

SEQ ID NO: 459837 - DNA, 25 bp, Mus musculus
gactattgtaggtctagagctcccc

SEQ ID NO: 459838 - DNA, 25 bp, Mus musculus
gactattgttgcagtcaagggtaat

SEQ ID NO: 459839 - DNA, 25 bp, Mus musculus
gactattgttgctgtcaagggtaat

SEQ ID NO: 459840 - DNA, 25 bp, Mus musculus
gactatttcaaaagtactcaaaagt

SEQ ID NO: 459841 - DNA, 25 bp, Mus musculus
gactatttcaaatgtactcaaaagt

SEQ ID NO: 459842 - DNA, 25 bp, Mus musculus
gactatttcaggaggacttaaattt

SEQ ID NO: 459843 - DNA, 25 bp, Mus musculus
gactatttcaggtggacttaaattt

SEQ ID NO: 459844 - DNA, 25 bp, Mus musculus
gactatttcagtcataatggctcct

SEQ ID NO: 459845 - DNA, 25 bp, Mus musculus
gactatttcagtgataatggctcct

SEQ ID NO: 459846 - DNA, 25 bp, Mus musculus
gactatttcatacgatccttcttca

SEQ ID NO: 459847 - DNA, 25 bp, Mus musculus
gactatttcataggatccttcttca

SEQ ID NO: 459848 - DNA, 25 bp, Mus musculus
gactatttctgtcagatcccatctt

SEQ ID NO: 459849 - DNA, 25 bp, Mus musculus
gactatttctgtgagatcccatctt

SEQ ID NO: 459850 - DNA, 25 bp, Mus musculus
gactatttctttacagactccggca

SEQ ID NO: 459851 - DNA, 25 bp, Mus musculus
gactatttcttttcagactccggca

SEQ ID NO: 459852 - DNA, 25 bp, Mus musculus
gactatttgactacagttcatgtaa

SEQ ID NO: 459853 - DNA, 25 bp, Mus musculus
gactatttgacttcagttcatgtaa

SEQ ID NO: 459854 - DNA, 25 bp, Mus musculus
gactatttgcacatcattcatgcta

SEQ ID NO: 459855 - DNA, 25 bp, Mus musculus
gactatttgcacttcattcatgcta

SEQ ID NO: 459856 - DNA, 25 bp, Mus musculus
gactatttgtaaaccagcacactgt

SEQ ID NO: 459857 - DNA, 25 bp, Mus musculus
gactatttgtaatccagcacactgt

SEQ ID NO: 459858 - DNA, 25 bp, Mus musculus
gactatttgttgaatcatttagcag

SEQ ID NO: 459859 - DNA, 25 bp, Mus musculus
gactatttgttgtatcatttagcag

SEQ ID NO: 459860 - DNA, 25 bp, Mus musculus
gactattttagcctctgatctccag

SEQ ID NO: 459861 - DNA, 25 bp, Mus musculus
gactattttagcgtctgatctccag

SEQ ID NO: 459862 - DNA, 25 bp, Mus musculus
gactattttataatacatggcccaa

SEQ ID NO: 459863 - DNA, 25 bp, Mus musculus
gactattttatattacatggcccaa

SEQ ID NO: 459864 - DNA, 25 bp, Mus musculus
gactattttgatactaacccttact

SEQ ID NO: 459865 - DNA, 25 bp, Mus musculus
gactattttgattctaacccttact

SEQ ID NO: 459866 - DNA, 25 bp, Mus musculus
gactattttggaccaggttacctgt

SEQ ID NO: 459867 - DNA, 25 bp, Mus musculus
gactattttggagcaggttacctgt

SEQ ID NO: 459868 - DNA, 25 bp, Mus musculus
gactattttgtacttcaggctgctt

SEQ ID NO: 459869 - DNA, 25 bp, Mus musculus
gactattttgtagttcaggctgctt

SEQ ID NO: 459870 - DNA, 25 bp, Mus musculus
gactatttttagagtgaatttgatg

SEQ ID NO: 459871 - DNA, 25 bp, Mus musculus
gactatttttagtgtgaatttgatg

SEQ ID NO: 459872 - DNA, 25 bp, Mus musculus
gactattttttacctgccctcataa

SEQ ID NO: 459873 - DNA, 25 bp, Mus musculus
gactattttttagctgccctcataa

SEQ ID NO: 459874 - DNA, 25 bp, Mus musculus
gactcaaaacaaacgtctttgcttg

SEQ ID NO: 459875 - DNA, 25 bp, Mus musculus
gactcaaaacaatcgtctttgcttg

SEQ ID NO: 459876 - DNA, 25 bp, Mus musculus
gactcaaaactgcaccaactcaaga

SEQ ID NO: 459877 - DNA, 25 bp, Mus musculus
gactcaaaactggaccaactcaaga

SEQ ID NO: 459878 - DNA, 25 bp, Mus musculus
gactcaaaagggagagctgctttca

SEQ ID NO: 459879 - DNA, 25 bp, Mus musculus
gactcaaaagggtgagctgctttca

SEQ ID NO: 459880 - DNA, 25 bp, Mus musculus
gactcaaaatatccctgcagcacat

SEQ ID NO: 459881 - DNA, 25 bp, Mus musculus
gactcaaaatatgcctgcagcacat

SEQ ID NO: 459882 - DNA, 25 bp, Mus musculus
gactcaaaatctattcattttccct

SEQ ID NO: 459883 - DNA, 25 bp, Mus musculus
gactcaaaatcttttcattttccct

SEQ ID NO: 459884 - DNA, 25 bp, Mus musculus
gactcaaacttgaagttccaggtct

SEQ ID NO: 459885 - DNA, 25 bp, Mus musculus
gactcaaacttgtagttccaggtct

SEQ ID NO: 459886 - DNA, 25 bp, Mus musculus
gactcaaagagccaccactacttta

SEQ ID NO: 459887 - DNA, 25 bp, Mus musculus
gactcaaagagcgaccactacttta

SEQ ID NO: 459888 - DNA, 25 bp, Mus musculus
gactcaaagcttcatgcacgctggg

SEQ ID NO: 459889 - DNA, 25 bp, Mus musculus
gactcaaagcttgatgcacgctggg

SEQ ID NO: 459890 - DNA, 25 bp, Mus musculus
gactcaaagtagatcctgccaagct

SEQ ID NO: 459891 - DNA, 25 bp, Mus musculus
gactcaaagtagttcctgccaagct

SEQ ID NO: 459892 - DNA, 25 bp, Mus musculus
gactcaaatacaatctactgctctg

SEQ ID NO: 459893 - DNA, 25 bp, Mus musculus
gactcaaatacattctactgctctg

SEQ ID NO: 459894 - DNA, 25 bp, Mus musculus
gactcaaatcagatgtgttcctctg

SEQ ID NO: 459895 - DNA, 25 bp, Mus musculus
gactcaaatcagttgtgttcctctg

SEQ ID NO: 459896 - DNA, 25 bp, Mus musculus
gactcaaatcttcttaggtgatgcc

SEQ ID NO: 459897 - DNA, 25 bp, Mus musculus
gactcaaatcttgttaggtgatgcc

SEQ ID NO: 459898 - DNA, 25 bp, Mus musculus
gactcaaatgtcagggacctcctga

SEQ ID NO: 459899 - DNA, 25 bp, Mus musculus
gactcaaatgtctgggacctcctga

SEQ ID NO: 459900 - DNA, 25 bp, Mus musculus
gactcaacaataacatcaacttaag

SEQ ID NO: 459901 - DNA, 25 bp, Mus musculus
gactcaacaatatcatcaacttaag

SEQ ID NO: 459902 - DNA, 25 bp, Mus musculus
gactcaacataaacctttctgactg

SEQ ID NO: 459903 - DNA, 25 bp, Mus musculus
gactcaacataatcctttctgactg

SEQ ID NO: 459904 - DNA, 25 bp, Mus musculus
gactcaaccattaagggttcttgct

SEQ ID NO: 459905 - DNA, 25 bp, Mus musculus
gactcaaccatttagggttcttgct

SEQ ID NO: 459906 - DNA, 25 bp, Mus musculus
gactcaacccaactcatttgtcttc

SEQ ID NO: 459907 - DNA, 25 bp, Mus musculus
gactcaacccaagtcatttgtcttc

SEQ ID NO: 459908 - DNA, 25 bp, Mus musculus
gactcaacctagaagtcatcaaggt

SEQ ID NO: 459909 - DNA, 25 bp, Mus musculus
gactcaacctagtagtcatcaaggt

SEQ ID NO: 459910 - DNA, 25 bp, Mus musculus
gactcaacctctcttctaaggactg

SEQ ID NO: 459911 - DNA, 25 bp, Mus musculus
gactcaacctctgttctaaggactg

SEQ ID NO: 459912 - DNA, 25 bp, Mus musculus
gactcaactctcacatgcacaaatg

SEQ ID NO: 459913 - DNA, 25 bp, Mus musculus
gactcaactctctcatgcacaaatg

SEQ ID NO: 459914 - DNA, 25 bp, Mus musculus
gactcaactctgcttgtgccatgaa

SEQ ID NO: 459915 - DNA, 25 bp, Mus musculus
gactcaactctggttgtgccatgaa

SEQ ID NO: 459916 - DNA, 25 bp, Mus musculus
gactcaagaaacactttcacaggct

SEQ ID NO: 459917 - DNA, 25 bp, Mus musculus
gactcaagaaactctttcacaggct

SEQ ID NO: 459918 - DNA, 25 bp, Mus musculus
gactcaagaattatcggccaacatg

SEQ ID NO: 459919 - DNA, 25 bp, Mus musculus
gactcaagaattttcggccaacatg

SEQ ID NO: 459920 - DNA, 25 bp, Mus musculus
gactcaagagttcgcagccttggaa

SEQ ID NO: 459921 - DNA, 25 bp, Mus musculus
gactcaagagttggcagccttggaa

SEQ ID NO: 459922 - DNA, 25 bp, Mus musculus
gactcaagattcatacctcatctct

SEQ ID NO: 459923 - DNA, 25 bp, Mus musculus
gactcaagattcttacctcatctct

SEQ ID NO: 459924 - DNA, 25 bp, Mus musculus
gactcaagccggctgccagtcaagt

SEQ ID NO: 459925 - DNA, 25 bp, Mus musculus
gactcaagccgggtgccagtcaagt

SEQ ID NO: 459926 - DNA, 25 bp, Mus musculus
gactcaagctcacggctttgtaaaa

SEQ ID NO: 459927 - DNA, 25 bp, Mus musculus
gactcaagctcagggctttgtaaaa

SEQ ID NO: 459928 - DNA, 25 bp, Mus musculus
gactcaagctggcttctaattaaat

SEQ ID NO: 459929 - DNA, 25 bp, Mus musculus
gactcaagctgggttctaattaaat

SEQ ID NO: 459930 - DNA, 25 bp, Mus musculus
gactcaaggagcaactgcggcaatt

SEQ ID NO: 459931 - DNA, 25 bp, Mus musculus
gactcaaggagctactgcggcaatt

SEQ ID NO: 459932 - DNA, 25 bp, Mus musculus
gactcaaggattctgggcaaactct

SEQ ID NO: 459933 - DNA, 25 bp, Mus musculus
gactcaaggattgtgggcaaactct

SEQ ID NO: 459934 - DNA, 25 bp, Mus musculus
gactcaaggcagcttatcaatgtaa

SEQ ID NO: 459935 - DNA, 25 bp, Mus musculus
gactcaaggcaggttatcaatgtaa

SEQ ID NO: 459936 - DNA, 25 bp, Mus musculus
gactcaagggacattcggtgccggt

SEQ ID NO: 459937 - DNA, 25 bp, Mus musculus
gactcaagggactttcggtgccggt

SEQ ID NO: 459938 - DNA, 25 bp, Mus musculus
gactcaagggtgacctctaggtttt

SEQ ID NO: 459939 - DNA, 25 bp, Mus musculus
gactcaagggtgagacccggccccg

SEQ ID NO: 459940 - DNA, 25 bp, Mus musculus
gactcaagggtgtcctctaggtttt

SEQ ID NO: 459941 - DNA, 25 bp, Mus musculus
gactcaagggtgtgacccggccccg

SEQ ID NO: 459942 - DNA, 25 bp, Mus musculus
gactcaagtaagatttggcttccgt

SEQ ID NO: 459943 - DNA, 25 bp, Mus musculus
gactcaagtaagttttggcttccgt

SEQ ID NO: 459944 - DNA, 25 bp, Mus musculus
gactcaagtctgatattacgagcct

SEQ ID NO: 459945 - DNA, 25 bp, Mus musculus
gactcaagtctgttattacgagcct

SEQ ID NO: 459946 - DNA, 25 bp, Mus musculus
gactcaagtgatagaccaggctcag

SEQ ID NO: 459947 - DNA, 25 bp, Mus musculus
gactcaagtgattgaccaggctcag

SEQ ID NO: 459948 - DNA, 25 bp, Mus musculus
gactcaagtgccaggtgatcattca

SEQ ID NO: 459949 - DNA, 25 bp, Mus musculus
gactcaagtgcctggtgatcattca

SEQ ID NO: 459950 - DNA, 25 bp, Mus musculus
gactcaagttaccaattcacataga

SEQ ID NO: 459951 - DNA, 25 bp, Mus musculus
gactcaagttacgaattcacataga

SEQ ID NO: 459952 - DNA, 25 bp, Mus musculus
gactcaagtttcaaaccccaggtgg

SEQ ID NO: 459953 - DNA, 25 bp, Mus musculus
gactcaagtttctaaccccaggtgg

SEQ ID NO: 459954 - DNA, 25 bp, Mus musculus
gactcaagttttatgctttctcttt

SEQ ID NO: 459955 - DNA, 25 bp, Mus musculus
gactcaagttttttgctttctcttt

SEQ ID NO: 459956 - DNA, 25 bp, Mus musculus
gactcaataccacgctcagtatctg

SEQ ID NO: 459957 - DNA, 25 bp, Mus musculus
gactcaataccaggctcagtatctg

SEQ ID NO: 459958 - DNA, 25 bp, Mus musculus
gactcaatagagagtttatcgagca

SEQ ID NO: 459959 - DNA, 25 bp, Mus musculus
gactcaatagagtgtttatcgagca

SEQ ID NO: 459960 - DNA, 25 bp, Mus musculus
gactcaatagtgactagtacaggca

SEQ ID NO: 459961 - DNA, 25 bp, Mus musculus
gactcaatagtgtctagtacaggca

SEQ ID NO: 459962 - DNA, 25 bp, Mus musculus
gactcaatattaatgttgctcctta

SEQ ID NO: 459963 - DNA, 25 bp, Mus musculus
gactcaatattattgttgctcctta

SEQ ID NO: 459964 - DNA, 25 bp, Mus musculus
gactcaatatttctctgtgtccaaa

SEQ ID NO: 459965 - DNA, 25 bp, Mus musculus
gactcaatatttgtctgtgtccaaa

SEQ ID NO: 459966 - DNA, 25 bp, Mus musculus
gactcaatcttgcaagtttaatcgg

SEQ ID NO: 459967 - DNA, 25 bp, Mus musculus
gactcaatcttggaagtttaatcgg

SEQ ID NO: 459968 - DNA, 25 bp, Mus musculus
gactcaatgaggcacttagccactt

SEQ ID NO: 459969 - DNA, 25 bp, Mus musculus
gactcaatgagggacttagccactt

SEQ ID NO: 459970 - DNA, 25 bp, Mus musculus
gactcaatgcaaagtagctcgttct

SEQ ID NO: 459971 - DNA, 25 bp, Mus musculus
gactcaatgcaatgtagctcgttct

SEQ ID NO: 459972 - DNA, 25 bp, Mus musculus
gactcaatgcatcctttaggtttta

SEQ ID NO: 459973 - DNA, 25 bp, Mus musculus
gactcaatgcatgctttaggtttta

SEQ ID NO: 459974 - DNA, 25 bp, Mus musculus
gactcaatgctaagtgttctcaagg

SEQ ID NO: 459975 - DNA, 25 bp, Mus musculus
gactcaatgctatgtgttctcaagg

SEQ ID NO: 459976 - DNA, 25 bp, Mus musculus
gactcaattagaacctcattcacaa

SEQ ID NO: 459977 - DNA, 25 bp, Mus musculus
gactcaattagatcctcattcacaa

SEQ ID NO: 459978 - DNA, 25 bp, Mus musculus
gactcaattgaacggctctgggatc

SEQ ID NO: 459979 - DNA, 25 bp, Mus musculus
gactcaattgaagggctctgggatc

SEQ ID NO: 459980 - DNA, 25 bp, Mus musculus
gactcacaacatcttcttggtgtat

SEQ ID NO: 459981 - DNA, 25 bp, Mus musculus
gactcacaacatgttcttggtgtat

SEQ ID NO: 459982 - DNA, 25 bp, Mus musculus
gactcacaatgaacacttggctgga

SEQ ID NO: 459983 - DNA, 25 bp, Mus musculus
gactcacaatgatcacttggctgga

SEQ ID NO: 459984 - DNA, 25 bp, Mus musculus
gactcacacacgagaactacccatt

SEQ ID NO: 459985 - DNA, 25 bp, Mus musculus
gactcacacacgtgaactacccatt

SEQ ID NO: 459986 - DNA, 25 bp, Mus musculus
gactcacaccttcgtcaaggcgttg

SEQ ID NO: 459987 - DNA, 25 bp, Mus musculus
gactcacaccttggtcaaggcgttg

SEQ ID NO: 459988 - DNA, 25 bp, Mus musculus
gactcacacgtgatcaggcataact

SEQ ID NO: 459989 - DNA, 25 bp, Mus musculus
gactcacacgtgttcaggcataact

SEQ ID NO: 459990 - DNA, 25 bp, Mus musculus
gactcacagaaacttccctactgaa

SEQ ID NO: 459991 - DNA, 25 bp, Mus musculus
gactcacagaaagttccctactgaa

SEQ ID NO: 459992 - DNA, 25 bp, Mus musculus
gactcacagcagaccctttcagtca

SEQ ID NO: 459993 - DNA, 25 bp, Mus musculus
gactcacagcagtccctttcagtca

SEQ ID NO: 459994 - DNA, 25 bp, Mus musculus
gactcacagtcgctgttcagcttga

SEQ ID NO: 459995 - DNA, 25 bp, Mus musculus
gactcacagtcggtgttcagcttga

SEQ ID NO: 459996 - DNA, 25 bp, Mus musculus
gactcacagtgacgaggcctgacac

SEQ ID NO: 459997 - DNA, 25 bp, Mus musculus
gactcacagtgaggaggcctgacac

SEQ ID NO: 459998 - DNA, 25 bp, Mus musculus
gactcacatgacacggacatttccg

SEQ ID NO: 459999 - DNA, 25 bp, Mus musculus
gactcacatgactcggacatttccg

SEQ ID NO: 460000 - DNA, 25 bp, Mus musculus
gactcacatgcgaaaaccaacttct

SEQ ID NO: 460001 - DNA, 25 bp, Mus musculus
gactcacatgcgtaaaccaacttct

SEQ ID NO: 460002 - DNA, 25 bp, Mus musculus
gactcacattaaaggcagttatttt

SEQ ID NO: 460003 - DNA, 25 bp, Mus musculus
gactcacattaatggcagttatttt

SEQ ID NO: 460004 - DNA, 25 bp, Mus musculus
gactcaccaaatagctcacggtttt

SEQ ID NO: 460005 - DNA, 25 bp, Mus musculus
gactcaccaaattgctcacggtttt

SEQ ID NO: 460006 - DNA, 25 bp, Mus musculus
gactcaccaagaaccaagtgatggg

SEQ ID NO: 460007 - DNA, 25 bp, Mus musculus
gactcaccaagatccaagtgatggg

SEQ ID NO: 460008 - DNA, 25 bp, Mus musculus
gactcacccaatccttaagaataga

SEQ ID NO: 460009 - DNA, 25 bp, Mus musculus
gactcacccaatgcttaagaataga

SEQ ID NO: 460010 - DNA, 25 bp, Mus musculus
gactcacccaggcttaagttcgaat

SEQ ID NO: 460011 - DNA, 25 bp, Mus musculus
gactcacccagggttaagttcgaat

SEQ ID NO: 460012 - DNA, 25 bp, Mus musculus
gactcacccgtgcagaatgatccta

SEQ ID NO: 460013 - DNA, 25 bp, Mus musculus
gactcacccgtggagaatgatccta

SEQ ID NO: 460014 - DNA, 25 bp, Mus musculus
gactcaccctcaagcagttgatagt

SEQ ID NO: 460015 - DNA, 25 bp, Mus musculus
gactcaccctcatgcagttgatagt

SEQ ID NO: 460016 - DNA, 25 bp, Mus musculus
gactcacctagcctggttttatgaa

SEQ ID NO: 460017 - DNA, 25 bp, Mus musculus
gactcacctagcgtggttttatgaa

SEQ ID NO: 460018 - DNA, 25 bp, Mus musculus
gactcacctggtcacaggcagggct

SEQ ID NO: 460019 - DNA, 25 bp, Mus musculus
gactcacctggtgacaggcagggct

SEQ ID NO: 460020 - DNA, 25 bp, Mus musculus
gactcaccttccagtctactgtaag

SEQ ID NO: 460021 - DNA, 25 bp, Mus musculus
gactcaccttcctgtctactgtaag

SEQ ID NO: 460022 - DNA, 25 bp, Mus musculus
gactcacgagatcgcgaccatcttg

SEQ ID NO: 460023 - DNA, 25 bp, Mus musculus
gactcacgagatggcgaccatcttg

SEQ ID NO: 460024 - DNA, 25 bp, Mus musculus
gactcacgccatcaagaagaccatt

SEQ ID NO: 460025 - DNA, 25 bp, Mus musculus
gactcacgccatgaagaagaccatt

SEQ ID NO: 460026 - DNA, 25 bp, Mus musculus
gactcacgccttaaagccacacttt

SEQ ID NO: 460027 - DNA, 25 bp, Mus musculus
gactcacgcctttaagccacacttt

SEQ ID NO: 460028 - DNA, 25 bp, Mus musculus
gactcacggatcctagcctgataaa

SEQ ID NO: 460029 - DNA, 25 bp, Mus musculus
gactcacggatcgtagcctgataaa

SEQ ID NO: 460030 - DNA, 25 bp, Mus musculus
gactcacgggtgacagatgatagta

SEQ ID NO: 460031 - DNA, 25 bp, Mus musculus
gactcacgggtgtcagatgatagta

SEQ ID NO: 460032 - DNA, 25 bp, Mus musculus
gactcacgtagacattcagctcatt

SEQ ID NO: 460033 - DNA, 25 bp, Mus musculus
gactcacgtagagattcagctcatt

SEQ ID NO: 460034 - DNA, 25 bp, Mus musculus
gactcacgtagccattcccaaagtt

SEQ ID NO: 460035 - DNA, 25 bp, Mus musculus
gactcacgtagcgattcccaaagtt

SEQ ID NO: 460036 - DNA, 25 bp, Mus musculus
gactcactaacgacaaaccagttgg

SEQ ID NO: 460037 - DNA, 25 bp, Mus musculus
gactcactaacgtcaaaccagttgg

SEQ ID NO: 460038 - DNA, 25 bp, Mus musculus
gactcactaattacaccactcttat

SEQ ID NO: 460039 - DNA, 25 bp, Mus musculus
gactcactaatttcaccactcttat

SEQ ID NO: 460040 - DNA, 25 bp, Mus musculus
gactcactcagcaagtaatccttac

SEQ ID NO: 460041 - DNA, 25 bp, Mus musculus
gactcactcagctagtaatccttac

SEQ ID NO: 460042 - DNA, 25 bp, Mus musculus
gactcactccagcatcctggaacca

SEQ ID NO: 460043 - DNA, 25 bp, Mus musculus
gactcactccaggatcctggaacca

SEQ ID NO: 460044 - DNA, 25 bp, Mus musculus
gactcactcgtgataataagactct

SEQ ID NO: 460045 - DNA, 25 bp, Mus musculus
gactcactcgtgttaataagactct

SEQ ID NO: 460046 - DNA, 25 bp, Mus musculus
gactcactctgcagtctgattcagg

SEQ ID NO: 460047 - DNA, 25 bp, Mus musculus
gactcactctgctgtctgattcagg

SEQ ID NO: 460048 - DNA, 25 bp, Mus musculus
gactcactgaccaactagaggctat

SEQ ID NO: 460049 - DNA, 25 bp, Mus musculus
gactcactgacctactagaggctat

SEQ ID NO: 460050 - DNA, 25 bp, Mus musculus
gactcactgagaccggcaaatccca

SEQ ID NO: 460051 - DNA, 25 bp, Mus musculus
gactcactgagagcggcaaatccca

SEQ ID NO: 460052 - DNA, 25 bp, Mus musculus
gactcactgcacacgtagttcttaa

SEQ ID NO: 460053 - DNA, 25 bp, Mus musculus
gactcactgcactcgtagttcttaa

SEQ ID NO: 460054 - DNA, 25 bp, Mus musculus
gactcactgcttcagatgaaagcaa

SEQ ID NO: 460055 - DNA, 25 bp, Mus musculus
gactcactgcttgagatgaaagcaa

SEQ ID NO: 460056 - DNA, 25 bp, Mus musculus
gactcactggaaagatgcaaagcaa

SEQ ID NO: 460057 - DNA, 25 bp, Mus musculus
gactcactggaatgatgcaaagcaa

SEQ ID NO: 460058 - DNA, 25 bp, Mus musculus
gactcactggagactctaacttgga

SEQ ID NO: 460059 - DNA, 25 bp, Mus musculus
gactcactggagattcctttcaaat

SEQ ID NO: 460060 - DNA, 25 bp, Mus musculus
gactcactggagcattcacccgaag

SEQ ID NO: 460061 - DNA, 25 bp, Mus musculus
gactcactggaggattcacccgaag

SEQ ID NO: 460062 - DNA, 25 bp, Mus musculus
gactcactggagtctctaacttgga

SEQ ID NO: 460063 - DNA, 25 bp, Mus musculus
gactcactggagtttcctttcaaat

SEQ ID NO: 460064 - DNA, 25 bp, Mus musculus
gactcactggctcacccatatcact

SEQ ID NO: 460065 - DNA, 25 bp, Mus musculus
gactcactggctgacccatatcact

SEQ ID NO: 460066 - DNA, 25 bp, Mus musculus
gactcactgggtcagtcagctagca

SEQ ID NO: 460067 - DNA, 25 bp, Mus musculus
gactcactgggtgagtcagctagca

SEQ ID NO: 460068 - DNA, 25 bp, Mus musculus
gactcactggtaagcttgtttctgg

SEQ ID NO: 460069 - DNA, 25 bp, Mus musculus
gactcactggtatgcttgtttctgg

SEQ ID NO: 460070 - DNA, 25 bp, Mus musculus
gactcacttccaccccgtagattga

SEQ ID NO: 460071 - DNA, 25 bp, Mus musculus
gactcacttccagcccgtagattga

SEQ ID NO: 460072 - DNA, 25 bp, Mus musculus
gactcacttctcaacagtttccaaa

SEQ ID NO: 460073 - DNA, 25 bp, Mus musculus
gactcacttctctacagtttccaaa

SEQ ID NO: 460074 - DNA, 25 bp, Mus musculus
gactcacttgatctgcttacactct

SEQ ID NO: 460075 - DNA, 25 bp, Mus musculus
gactcacttgatgtgcttacactct

SEQ ID NO: 460076 - DNA, 25 bp, Mus musculus
gactcacttgcaatatttcaacatg

SEQ ID NO: 460077 - DNA, 25 bp, Mus musculus
gactcacttgcattatttcaacatg

SEQ ID NO: 460078 - DNA, 25 bp, Mus musculus
gactcagaaactcgctttgcttctt

SEQ ID NO: 460079 - DNA, 25 bp, Mus musculus
gactcagaaactggctttgcttctt

SEQ ID NO: 460080 - DNA, 25 bp, Mus musculus
gactcagaacccaggaccattttga

SEQ ID NO: 460081 - DNA, 25 bp, Mus musculus
gactcagaaccctggaccattttga

SEQ ID NO: 460082 - DNA, 25 bp, Mus musculus
gactcagaactgaatatggcaccta

SEQ ID NO: 460083 - DNA, 25 bp, Mus musculus
gactcagaactgtatatggcaccta

SEQ ID NO: 460084 - DNA, 25 bp, Mus musculus
gactcagaagcaaccacaaagccag

SEQ ID NO: 460085 - DNA, 25 bp, Mus musculus
gactcagaagcatccacaaagccag

SEQ ID NO: 460086 - DNA, 25 bp, Mus musculus
gactcagaaggtcacgcactgtcta

SEQ ID NO: 460087 - DNA, 25 bp, Mus musculus
gactcagaaggtgacgcactgtcta

SEQ ID NO: 460088 - DNA, 25 bp, Mus musculus
gactcagaagtaagccatgtgatgc

SEQ ID NO: 460089 - DNA, 25 bp, Mus musculus
gactcagaagtaagcgatgtaatta

SEQ ID NO: 460090 - DNA, 25 bp, Mus musculus
gactcagaagtatgccatgtgatgc

SEQ ID NO: 460091 - DNA, 25 bp, Mus musculus
gactcagaagtatgcgatgtaatta

SEQ ID NO: 460092 - DNA, 25 bp, Mus musculus
gactcagaatatagttttgtaggtt

SEQ ID NO: 460093 - DNA, 25 bp, Mus musculus
gactcagaatattgttttgtaggtt

SEQ ID NO: 460094 - DNA, 25 bp, Mus musculus
gactcagaatggctagggcttgcta

SEQ ID NO: 460095 - DNA, 25 bp, Mus musculus
gactcagaatgggtagggcttgcta

SEQ ID NO: 460096 - DNA, 25 bp, Mus musculus
gactcagacaacaggtcctctgtgt

SEQ ID NO: 460097 - DNA, 25 bp, Mus musculus
gactcagacaactggtcctctgtgt

SEQ ID NO: 460098 - DNA, 25 bp, Mus musculus
gactcagacagaacccatcacttgt

SEQ ID NO: 460099 - DNA, 25 bp, Mus musculus
gactcagacagatcccatcacttgt

SEQ ID NO: 460100 - DNA, 25 bp, Mus musculus
gactcagaccgcagtgctgggaaca

SEQ ID NO: 460101 - DNA, 25 bp, Mus musculus
gactcagaccgctgtgctgggaaca

SEQ ID NO: 460102 - DNA, 25 bp, Mus musculus
gactcagacctgagcatcatgtgac

SEQ ID NO: 460103 - DNA, 25 bp, Mus musculus
gactcagacctgtgcatcatgtgac

SEQ ID NO: 460104 - DNA, 25 bp, Mus musculus
gactcagacgaaaggcccacacggt

SEQ ID NO: 460105 - DNA, 25 bp, Mus musculus
gactcagacgaatggcccacacggt

SEQ ID NO: 460106 - DNA, 25 bp, Mus musculus
gactcagactcactactgttattta

SEQ ID NO: 460107 - DNA, 25 bp, Mus musculus
gactcagactcagtactgttattta

SEQ ID NO: 460108 - DNA, 25 bp, Mus musculus
gactcagactcgcaagggatattca

SEQ ID NO: 460109 - DNA, 25 bp, Mus musculus
gactcagactcggaagggatattca

SEQ ID NO: 460110 - DNA, 25 bp, Mus musculus
gactcagactttattcacattttat

SEQ ID NO: 460111 - DNA, 25 bp, Mus musculus
gactcagacttttttcacattttat

SEQ ID NO: 460112 - DNA, 25 bp, Mus musculus
gactcagagacaccccttctacaga

SEQ ID NO: 460113 - DNA, 25 bp, Mus musculus
gactcagagacagcccttctacaga

SEQ ID NO: 460114 - DNA, 25 bp, Mus musculus
gactcagagacccagaataacctta

SEQ ID NO: 460115 - DNA, 25 bp, Mus musculus
gactcagagaccgagaataacctta

SEQ ID NO: 460116 - DNA, 25 bp, Mus musculus
gactcagagagtagtgacggcgaac

SEQ ID NO: 460117 - DNA, 25 bp, Mus musculus
gactcagagagttgtgacggcgaac

SEQ ID NO: 460118 - DNA, 25 bp, Mus musculus
gactcagaggcacctgtgttaccag

SEQ ID NO: 460119 - DNA, 25 bp, Mus musculus
gactcagaggcagctgtgttaccag

SEQ ID NO: 460120 - DNA, 25 bp, Mus musculus
gactcagaggccagggtacaaataa

SEQ ID NO: 460121 - DNA, 25 bp, Mus musculus
gactcagaggccctaaataacaagg

SEQ ID NO: 460122 - DNA, 25 bp, Mus musculus
gactcagaggccgtaaataacaagg

SEQ ID NO: 460123 - DNA, 25 bp, Mus musculus
gactcagaggcctgggtacaaataa

SEQ ID NO: 460124 - DNA, 25 bp, Mus musculus
gactcagatcctatataagatggca

SEQ ID NO: 460125 - DNA, 25 bp, Mus musculus
gactcagatcctttataagatggca

SEQ ID NO: 460126 - DNA, 25 bp, Mus musculus
gactcagatctgagtgggaaacccg

SEQ ID NO: 460127 - DNA, 25 bp, Mus musculus
gactcagatctgtgtgggaaacccg

SEQ ID NO: 460128 - DNA, 25 bp, Mus musculus
gactcagatgctctggtgaaagcca

SEQ ID NO: 460129 - DNA, 25 bp, Mus musculus
gactcagatgctgtggtgaaagcca

SEQ ID NO: 460130 - DNA, 25 bp, Mus musculus
gactcagattatacagtctggcaaa

SEQ ID NO: 460131 - DNA, 25 bp, Mus musculus
gactcagattattcagtctggcaaa

SEQ ID NO: 460132 - DNA, 25 bp, Mus musculus
gactcagattccctcagatgacccc

SEQ ID NO: 460133 - DNA, 25 bp, Mus musculus
gactcagattccgtcagatgacccc

SEQ ID NO: 460134 - DNA, 25 bp, Mus musculus
gactcagcaagaaatgggccaacat

SEQ ID NO: 460135 - DNA, 25 bp, Mus musculus
gactcagcaagatatgggccaacat

SEQ ID NO: 460136 - DNA, 25 bp, Mus musculus
gactcagcaagtctgtatacataca

SEQ ID NO: 460137 - DNA, 25 bp, Mus musculus
gactcagcaagtgtgtatacataca

SEQ ID NO: 460138 - DNA, 25 bp, Mus musculus
gactcagcacgcatgtgacgttcag

SEQ ID NO: 460139 - DNA, 25 bp, Mus musculus
gactcagcacgcttgtgacgttcag

SEQ ID NO: 460140 - DNA, 25 bp, Mus musculus
gactcagcagcaagggacctgccac

SEQ ID NO: 460141 - DNA, 25 bp, Mus musculus
gactcagcagcactggatgttcttc

SEQ ID NO: 460142 - DNA, 25 bp, Mus musculus
gactcagcagcagtggatgttcttc

SEQ ID NO: 460143 - DNA, 25 bp, Mus musculus
gactcagcagcatgggacctgccac

SEQ ID NO: 460144 - DNA, 25 bp, Mus musculus
gactcagcaggaaacaaccgcccag

SEQ ID NO: 460145 - DNA, 25 bp, Mus musculus
gactcagcaggaatgcagtttgctt

SEQ ID NO: 460146 - DNA, 25 bp, Mus musculus
gactcagcaggatacaaccgcccag

SEQ ID NO: 460147 - DNA, 25 bp, Mus musculus
gactcagcaggattgcagtttgctt

SEQ ID NO: 460148 - DNA, 25 bp, Mus musculus
gactcagcagtcatggaaataacga

SEQ ID NO: 460149 - DNA, 25 bp, Mus musculus
gactcagcagtcttggaaataacga

SEQ ID NO: 460150 - DNA, 25 bp, Mus musculus
gactcagcatccacgaagcatcatg

SEQ ID NO: 460151 - DNA, 25 bp, Mus musculus
gactcagcatcctcgaagcatcatg

SEQ ID NO: 460152 - DNA, 25 bp, Mus musculus
gactcagcatgccaatctgatgaaa

SEQ ID NO: 460153 - DNA, 25 bp, Mus musculus
gactcagcatgcgaatctgatgaaa

SEQ ID NO: 460154 - DNA, 25 bp, Mus musculus
gactcagcattacatgcagctcctg

SEQ ID NO: 460155 - DNA, 25 bp, Mus musculus
gactcagcattagatgcagctcctg

SEQ ID NO: 460156 - DNA, 25 bp, Mus musculus
gactcagccaagctcactcggtaaa

SEQ ID NO: 460157 - DNA, 25 bp, Mus musculus
gactcagccaagctctcacaggcat

SEQ ID NO: 460158 - DNA, 25 bp, Mus musculus
gactcagccaaggtcactcggtaaa

SEQ ID NO: 460159 - DNA, 25 bp, Mus musculus
gactcagccaaggtctcacaggcat

SEQ ID NO: 460160 - DNA, 25 bp, Mus musculus
gactcagcccgacgaaatcgcagat

SEQ ID NO: 460161 - DNA, 25 bp, Mus musculus
gactcagcccgaggaaatcgcagat

SEQ ID NO: 460162 - DNA, 25 bp, Mus musculus
gactcagccgagaaccgattcaagt

SEQ ID NO: 460163 - DNA, 25 bp, Mus musculus
gactcagccgagtaccgattcaagt

SEQ ID NO: 460164 - DNA, 25 bp, Mus musculus
gactcagcctacaagcagaagtggt

SEQ ID NO: 460165 - DNA, 25 bp, Mus musculus
gactcagcctactagcagaagtggt

SEQ ID NO: 460166 - DNA, 25 bp, Mus musculus
gactcagccttgagtagggtcccaa

SEQ ID NO: 460167 - DNA, 25 bp, Mus musculus
gactcagccttgtgtagggtcccaa

SEQ ID NO: 460168 - DNA, 25 bp, Mus musculus
gactcagcgcctcttctttaagtgg

SEQ ID NO: 460169 - DNA, 25 bp, Mus musculus
gactcagcgcctgttctttaagtgg

SEQ ID NO: 460170 - DNA, 25 bp, Mus musculus
gactcagcgggcaaaggtactttct

SEQ ID NO: 460171 - DNA, 25 bp, Mus musculus
gactcagcgggctaaggtactttct

SEQ ID NO: 460172 - DNA, 25 bp, Mus musculus
gactcagctcctaatgaaatggttt

SEQ ID NO: 460173 - DNA, 25 bp, Mus musculus
gactcagctccttatgaaatggttt

SEQ ID NO: 460174 - DNA, 25 bp, Mus musculus
gactcagctcggctgtgtgcagcat

SEQ ID NO: 460175 - DNA, 25 bp, Mus musculus
gactcagctcgggtgtgtgcagcat

SEQ ID NO: 460176 - DNA, 25 bp, Mus musculus
gactcagctcgtattgggtttttgt

SEQ ID NO: 460177 - DNA, 25 bp, Mus musculus
gactcagctcgttttgggtttttgt

SEQ ID NO: 460178 - DNA, 25 bp, Mus musculus
gactcagctgcactgttccttgcat

SEQ ID NO: 460179 - DNA, 25 bp, Mus musculus
gactcagctgcagtgttccttgcat

SEQ ID NO: 460180 - DNA, 25 bp, Mus musculus
gactcagctgctatattaccacgtt

SEQ ID NO: 460181 - DNA, 25 bp, Mus musculus
gactcagctgctttattaccacgtt

SEQ ID NO: 460182 - DNA, 25 bp, Mus musculus
gactcagctgtactaaatctgcaac

SEQ ID NO: 460183 - DNA, 25 bp, Mus musculus
gactcagctgtagtaaatctgcaac

SEQ ID NO: 460184 - DNA, 25 bp, Mus musculus
gactcagctgtcaatttttgtgcca

SEQ ID NO: 460185 - DNA, 25 bp, Mus musculus
gactcagctgtctatttttgtgcca

SEQ ID NO: 460186 - DNA, 25 bp, Mus musculus
gactcagcttcacgactgggaggac

SEQ ID NO: 460187 - DNA, 25 bp, Mus musculus
gactcagcttcaggactgggaggac

SEQ ID NO: 460188 - DNA, 25 bp, Mus musculus
gactcagcttctcacattctgatga

SEQ ID NO: 460189 - DNA, 25 bp, Mus musculus
gactcagcttctgacattctgatga

SEQ ID NO: 460190 - DNA, 25 bp, Mus musculus
gactcagcttttaaccagggacacg

SEQ ID NO: 460191 - DNA, 25 bp, Mus musculus
gactcagcttttagaacccagcata

SEQ ID NO: 460192 - DNA, 25 bp, Mus musculus
gactcagctttttaccagggacacg

SEQ ID NO: 460193 - DNA, 25 bp, Mus musculus
gactcagctttttgaacccagcata

SEQ ID NO: 460194 - DNA, 25 bp, Mus musculus
gactcaggaagaaaccatggtgctc

SEQ ID NO: 460195 - DNA, 25 bp, Mus musculus
gactcaggaagataccatggtgctc

SEQ ID NO: 460196 - DNA, 25 bp, Mus musculus
gactcaggacaaagactattttctt

SEQ ID NO: 460197 - DNA, 25 bp, Mus musculus
gactcaggacaaaggtttaacatat

SEQ ID NO: 460198 - DNA, 25 bp, Mus musculus
gactcaggacaatgactattttctt

SEQ ID NO: 460199 - DNA, 25 bp, Mus musculus
gactcaggacaatggtttaacatat

SEQ ID NO: 460200 - DNA, 25 bp, Mus musculus
gactcaggacagctgacgttcagga

SEQ ID NO: 460201 - DNA, 25 bp, Mus musculus
gactcaggacaggtgacgttcagga

SEQ ID NO: 460202 - DNA, 25 bp, Mus musculus
gactcaggacctacggattcatcta

SEQ ID NO: 460203 - DNA, 25 bp, Mus musculus
gactcaggaccttcggattcatcta

SEQ ID NO: 460204 - DNA, 25 bp, Mus musculus
gactcaggagtgacagccagacttg

SEQ ID NO: 460205 - DNA, 25 bp, Mus musculus
gactcaggagtgtcagccagacttg

SEQ ID NO: 460206 - DNA, 25 bp, Mus musculus
gactcaggatgtccccggagcagca

SEQ ID NO: 460207 - DNA, 25 bp, Mus musculus
gactcaggatgtgcccggagcagca

SEQ ID NO: 460208 - DNA, 25 bp, Mus musculus
gactcaggccacacaaagctgtaga

SEQ ID NO: 460209 - DNA, 25 bp, Mus musculus
gactcaggccactcaaagctgtaga

SEQ ID NO: 460210 - DNA, 25 bp, Mus musculus
gactcaggccggcatcgagaattct

SEQ ID NO: 460211 - DNA, 25 bp, Mus musculus
gactcaggccgggatcgagaattct

SEQ ID NO: 460212 - DNA, 25 bp, Mus musculus
gactcaggcctccagtgcttttcaa

SEQ ID NO: 460213 - DNA, 25 bp, Mus musculus
gactcaggcctcgagtgcttttcaa

SEQ ID NO: 460214 - DNA, 25 bp, Mus musculus
gactcaggcttcattaagggtgaca

SEQ ID NO: 460215 - DNA, 25 bp, Mus musculus
gactcaggcttctttaagggtgaca

SEQ ID NO: 460216 - DNA, 25 bp, Mus musculus
gactcagggaggcaagacacaccta

SEQ ID NO: 460217 - DNA, 25 bp, Mus musculus
gactcagggagggaagacacaccta

SEQ ID NO: 460218 - DNA, 25 bp, Mus musculus
gactcagggcatccagtgccctctt

SEQ ID NO: 460219 - DNA, 25 bp, Mus musculus
gactcagggcatgcagtgccctctt

SEQ ID NO: 460220 - DNA, 25 bp, Mus musculus
gactcagggcttccaattactcgat

SEQ ID NO: 460221 - DNA, 25 bp, Mus musculus
gactcagggcttgcaattactcgat

SEQ ID NO: 460222 - DNA, 25 bp, Mus musculus
gactcagggtgacgtccattccgag

SEQ ID NO: 460223 - DNA, 25 bp, Mus musculus
gactcagggtgaggtccattccgag

SEQ ID NO: 460224 - DNA, 25 bp, Mus musculus
gactcaggtaagagactcttgggct

SEQ ID NO: 460225 - DNA, 25 bp, Mus musculus
gactcaggtaagtgactcttgggct

SEQ ID NO: 460226 - DNA, 25 bp, Mus musculus
gactcaggtcctcagcattagtggg

SEQ ID NO: 460227 - DNA, 25 bp, Mus musculus
gactcaggtcctgagcattagtggg

SEQ ID NO: 460228 - DNA, 25 bp, Mus musculus
gactcaggttataacactctacaaa

SEQ ID NO: 460229 - DNA, 25 bp, Mus musculus
gactcaggttattacactctacaaa

SEQ ID NO: 460230 - DNA, 25 bp, Mus musculus
gactcaggttccaaaaccctaacag

SEQ ID NO: 460231 - DNA, 25 bp, Mus musculus
gactcaggttcctaaaccctaacag

SEQ ID NO: 460232 - DNA, 25 bp, Mus musculus
gactcagtaacaattccaacttagg

SEQ ID NO: 460233 - DNA, 25 bp, Mus musculus
gactcagtaacatttccaacttagg

SEQ ID NO: 460234 - DNA, 25 bp, Mus musculus
gactcagtacatctagcacaccact

SEQ ID NO: 460235 - DNA, 25 bp, Mus musculus
gactcagtacatgtagcacaccact

SEQ ID NO: 460236 - DNA, 25 bp, Mus musculus
gactcagtactaaatctttacaaag

SEQ ID NO: 460237 - DNA, 25 bp, Mus musculus
gactcagtactacggtgcatgctta

SEQ ID NO: 460238 - DNA, 25 bp, Mus musculus
gactcagtactagggtgcatgctta

SEQ ID NO: 460239 - DNA, 25 bp, Mus musculus
gactcagtactatatctttacaaag

SEQ ID NO: 460240 - DNA, 25 bp, Mus musculus
gactcagtagtacagcattttctct

SEQ ID NO: 460241 - DNA, 25 bp, Mus musculus
gactcagtagtagagcattttctct

SEQ ID NO: 460242 - DNA, 25 bp, Mus musculus
gactcagtagtgcttagctcccaag

SEQ ID NO: 460243 - DNA, 25 bp, Mus musculus
gactcagtagtggttagctcccaag

SEQ ID NO: 460244 - DNA, 25 bp, Mus musculus
gactcagtcaccctggtcagctaat

SEQ ID NO: 460245 - DNA, 25 bp, Mus musculus
gactcagtcaccgtggtcagctaat

SEQ ID NO: 460246 - DNA, 25 bp, Mus musculus
gactcagtccacagtgagtggcacc

SEQ ID NO: 460247 - DNA, 25 bp, Mus musculus
gactcagtccactgtgagtggcacc

SEQ ID NO: 460248 - DNA, 25 bp, Mus musculus
gactcagtctcacaaattgccattg

SEQ ID NO: 460249 - DNA, 25 bp, Mus musculus
gactcagtctcagaaattgccattg

SEQ ID NO: 460250 - DNA, 25 bp, Mus musculus
gactcagtctcgatctttccggatc

SEQ ID NO: 460251 - DNA, 25 bp, Mus musculus
gactcagtctcgttctttccggatc

SEQ ID NO: 460252 - DNA, 25 bp, Mus musculus
gactcagtctgaaccatggcgcata

SEQ ID NO: 460253 - DNA, 25 bp, Mus musculus
gactcagtctgatccatggcgcata

SEQ ID NO: 460254 - DNA, 25 bp, Mus musculus
gactcagtgagtctggtcctatgga

SEQ ID NO: 460255 - DNA, 25 bp, Mus musculus
gactcagtgagtgtggtcctatgga

SEQ ID NO: 460256 - DNA, 25 bp, Mus musculus
gactcagtgattcaaaaacgtgcct

SEQ ID NO: 460257 - DNA, 25 bp, Mus musculus
gactcagtgattgaaaaacgtgcct

SEQ ID NO: 460258 - DNA, 25 bp, Mus musculus
gactcagtggacataccccatgaaa

SEQ ID NO: 460259 - DNA, 25 bp, Mus musculus
gactcagtggacttaccccatgaaa

SEQ ID NO: 460260 - DNA, 25 bp, Mus musculus
gactcagtggcccagcctgcagctg

SEQ ID NO: 460261 - DNA, 25 bp, Mus musculus
gactcagtggccgagcctgcagctg

SEQ ID NO: 460262 - DNA, 25 bp, Mus musculus
gactcagtgttaatggaatgttctt

SEQ ID NO: 460263 - DNA, 25 bp, Mus musculus
gactcagtgttattggaatgttctt

SEQ ID NO: 460264 - DNA, 25 bp, Mus musculus
gactcagttactcatttagggtaca

SEQ ID NO: 460265 - DNA, 25 bp, Mus musculus
gactcagttactgatttagggtaca

SEQ ID NO: 460266 - DNA, 25 bp, Mus musculus
gactcagttatgatttccttacacg

SEQ ID NO: 460267 - DNA, 25 bp, Mus musculus
gactcagttatgttttccttacacg

SEQ ID NO: 460268 - DNA, 25 bp, Mus musculus
gactcagttcatcagttactttaat

SEQ ID NO: 460269 - DNA, 25 bp, Mus musculus
gactcagttcatgagttactttaat

SEQ ID NO: 460270 - DNA, 25 bp, Mus musculus
gactcagttcgaaggtacagtccaa

SEQ ID NO: 460271 - DNA, 25 bp, Mus musculus
gactcagttcgatggtacagtccaa

SEQ ID NO: 460272 - DNA, 25 bp, Mus musculus
gactcagttcttctgcatatagctt

SEQ ID NO: 460273 - DNA, 25 bp, Mus musculus
gactcagttcttgtgcatatagctt

SEQ ID NO: 460274 - DNA, 25 bp, Mus musculus
gactcagttgacagtctcagactgt

SEQ ID NO: 460275 - DNA, 25 bp, Mus musculus
gactcagttgactgtctcagactgt

SEQ ID NO: 460276 - DNA, 25 bp, Mus musculus
gactcagtttagatgatcccaatct

SEQ ID NO: 460277 - DNA, 25 bp, Mus musculus
gactcagtttagttgatcccaatct

SEQ ID NO: 460278 - DNA, 25 bp, Mus musculus
gactcagttttcaactcagtgtgtt

SEQ ID NO: 460279 - DNA, 25 bp, Mus musculus
gactcagttttctactcagtgtgtt

SEQ ID NO: 460280 - DNA, 25 bp, Mus musculus
gactcataacttctacaattgcaga

SEQ ID NO: 460281 - DNA, 25 bp, Mus musculus
gactcataacttgtacaattgcaga

SEQ ID NO: 460282 - DNA, 25 bp, Mus musculus
gactcataaggtcgcagttgtccat

SEQ ID NO: 460283 - DNA, 25 bp, Mus musculus
gactcataaggtggcagttgtccat

SEQ ID NO: 460284 - DNA, 25 bp, Mus musculus
gactcatatccaagatatcgctggg

SEQ ID NO: 460285 - DNA, 25 bp, Mus musculus
gactcatatccatgatatcgctggg

SEQ ID NO: 460286 - DNA, 25 bp, Mus musculus
gactcatatctcaagcttctttcag

SEQ ID NO: 460287 - DNA, 25 bp, Mus musculus
gactcatatctctagcttctttcag

SEQ ID NO: 460288 - DNA, 25 bp, Mus musculus
gactcatatgttcaggcttgcctca

SEQ ID NO: 460289 - DNA, 25 bp, Mus musculus
gactcatatgttgaggcttgcctca

SEQ ID NO: 460290 - DNA, 25 bp, Mus musculus
gactcatcacaaagaacgtttgcaa

SEQ ID NO: 460291 - DNA, 25 bp, Mus musculus
gactcatcacaatgaacgtttgcaa

SEQ ID NO: 460292 - DNA, 25 bp, Mus musculus
gactcatcagctcgacaaggtgttc

SEQ ID NO: 460293 - DNA, 25 bp, Mus musculus
gactcatcagctggacaaggtgttc

SEQ ID NO: 460294 - DNA, 25 bp, Mus musculus
gactcatcatgacaacactcgagaa

SEQ ID NO: 460295 - DNA, 25 bp, Mus musculus
gactcatcatgagaacactcgagaa

SEQ ID NO: 460296 - DNA, 25 bp, Mus musculus
gactcatcccagatggaactgcaac

SEQ ID NO: 460297 - DNA, 25 bp, Mus musculus
gactcatcccagcaggattacagga

SEQ ID NO: 460298 - DNA, 25 bp, Mus musculus
gactcatcccaggaggattacagga

SEQ ID NO: 460299 - DNA, 25 bp, Mus musculus
gactcatcccagttggaactgcaac

SEQ ID NO: 460300 - DNA, 25 bp, Mus musculus
gactcatccttaaatcctaacatgg

SEQ ID NO: 460301 - DNA, 25 bp, Mus musculus
gactcatccttatatcctaacatgg

SEQ ID NO: 460302 - DNA, 25 bp, Mus musculus
gactcatcctttcctgagatctgag

SEQ ID NO: 460303 - DNA, 25 bp, Mus musculus
gactcatcctttgctgagatctgag

SEQ ID NO: 460304 - DNA, 25 bp, Mus musculus
gactcatcgaacaaacagacccttt

SEQ ID NO: 460305 - DNA, 25 bp, Mus musculus
gactcatcgaactaacagacccttt

SEQ ID NO: 460306 - DNA, 25 bp, Mus musculus
gactcatcgtccaggaatcccaaga

SEQ ID NO: 460307 - DNA, 25 bp, Mus musculus
gactcatcgtcctggaatcccaaga

SEQ ID NO: 460308 - DNA, 25 bp, Mus musculus
gactcatcttcgactgacctaatgg

SEQ ID NO: 460309 - DNA, 25 bp, Mus musculus
gactcatcttcgtctgacctaatgg

SEQ ID NO: 460310 - DNA, 25 bp, Mus musculus
gactcatgagctagacggtgtccag

SEQ ID NO: 460311 - DNA, 25 bp, Mus musculus
gactcatgagcttgacggtgtccag

SEQ ID NO: 460312 - DNA, 25 bp, Mus musculus
gactcatgagggaattttcacttca

SEQ ID NO: 460313 - DNA, 25 bp, Mus musculus
gactcatgagggtattttcacttca

SEQ ID NO: 460314 - DNA, 25 bp, Mus musculus
gactcatgccatcctttggaatagg

SEQ ID NO: 460315 - DNA, 25 bp, Mus musculus
gactcatgccatgctttggaatagg

SEQ ID NO: 460316 - DNA, 25 bp, Mus musculus
gactcatgccccattgagctgatgg

SEQ ID NO: 460317 - DNA, 25 bp, Mus musculus
gactcatgcccctttgagctgatgg

SEQ ID NO: 460318 - DNA, 25 bp, Mus musculus
gactcatgcctgagagatttgccac

SEQ ID NO: 460319 - DNA, 25 bp, Mus musculus
gactcatgcctgtgagatttgccac

SEQ ID NO: 460320 - DNA, 25 bp, Mus musculus
gactcatgctcaaaaggaggaactc

SEQ ID NO: 460321 - DNA, 25 bp, Mus musculus
gactcatgctcacctaggtttctta

SEQ ID NO: 460322 - DNA, 25 bp, Mus musculus
gactcatgctcagctaggtttctta

SEQ ID NO: 460323 - DNA, 25 bp, Mus musculus
gactcatgctcataaggaggaactc

SEQ ID NO: 460324 - DNA, 25 bp, Mus musculus
gactcatgctctagggaggcccagt

SEQ ID NO: 460325 - DNA, 25 bp, Mus musculus
gactcatgctcttgggaggcccagt

SEQ ID NO: 460326 - DNA, 25 bp, Mus musculus
gactcatgctttagttaccctcaag

SEQ ID NO: 460327 - DNA, 25 bp, Mus musculus
gactcatgcttttgttaccctcaag

SEQ ID NO: 460328 - DNA, 25 bp, Mus musculus
gactcatggcttctaaactgctaaa

SEQ ID NO: 460329 - DNA, 25 bp, Mus musculus
gactcatggcttgtaaactgctaaa

SEQ ID NO: 460330 - DNA, 25 bp, Mus musculus
gactcatgggaaagctgtccttctc

SEQ ID NO: 460331 - DNA, 25 bp, Mus musculus
gactcatgggaatgctgtccttctc

SEQ ID NO: 460332 - DNA, 25 bp, Mus musculus
gactcatggtaaccagtcttcggcc

SEQ ID NO: 460333 - DNA, 25 bp, Mus musculus
gactcatggtaagcagtcttcggcc

SEQ ID NO: 460334 - DNA, 25 bp, Mus musculus
gactcatgtctacatatagcctctg

SEQ ID NO: 460335 - DNA, 25 bp, Mus musculus
gactcatgtctagatatagcctctg

SEQ ID NO: 460336 - DNA, 25 bp, Mus musculus
gactcatgtctcagactcatggtct

SEQ ID NO: 460337 - DNA, 25 bp, Mus musculus
gactcatgtctctgactcatggtct

SEQ ID NO: 460338 - DNA, 25 bp, Mus musculus
gactcatgtctgcttaaaattcacg

SEQ ID NO: 460339 - DNA, 25 bp, Mus musculus
gactcatgtctggttaaaattcacg

SEQ ID NO: 460340 - DNA, 25 bp, Mus musculus
gactcatgtggtagaaccctcagcg

SEQ ID NO: 460341 - DNA, 25 bp, Mus musculus
gactcatgtggttgaaccctcagcg

SEQ ID NO: 460342 - DNA, 25 bp, Mus musculus
gactcatgtttactctgatgacctg

SEQ ID NO: 460343 - DNA, 25 bp, Mus musculus
gactcatgtttagtctgatgacctg

SEQ ID NO: 460344 - DNA, 25 bp, Mus musculus
gactcattacttatatcgtgaccca

SEQ ID NO: 460345 - DNA, 25 bp, Mus musculus
gactcattacttttatcgtgaccca

SEQ ID NO: 460346 - DNA, 25 bp, Mus musculus
gactcattagcacggcagaggtaac

SEQ ID NO: 460347 - DNA, 25 bp, Mus musculus
gactcattagcagggcagaggtaac

SEQ ID NO: 460348 - DNA, 25 bp, Mus musculus
gactcattccgtagtgatcggctac

SEQ ID NO: 460349 - DNA, 25 bp, Mus musculus
gactcattccgttgtgatcggctac

SEQ ID NO: 460350 - DNA, 25 bp, Mus musculus
gactcattccttactggtaggatca

SEQ ID NO: 460351 - DNA, 25 bp, Mus musculus
gactcattcctttctggtaggatca

SEQ ID NO: 460352 - DNA, 25 bp, Mus musculus
gactcattctgtcagatctctctga

SEQ ID NO: 460353 - DNA, 25 bp, Mus musculus
gactcattctgtgagatctctctga

SEQ ID NO: 460354 - DNA, 25 bp, Mus musculus
gactcattcttacgcaattgcttct

SEQ ID NO: 460355 - DNA, 25 bp, Mus musculus
gactcattcttaggcaattgcttct

SEQ ID NO: 460356 - DNA, 25 bp, Mus musculus
gactcattgacgaattgcacgacct

SEQ ID NO: 460357 - DNA, 25 bp, Mus musculus
gactcattgacgtattgcacgacct

SEQ ID NO: 460358 - DNA, 25 bp, Mus musculus
gactcattgagcactcctggaatac

SEQ ID NO: 460359 - DNA, 25 bp, Mus musculus
gactcattgagctctcctggaatac

SEQ ID NO: 460360 - DNA, 25 bp, Mus musculus
gactcattgcacaggaagaaggttt

SEQ ID NO: 460361 - DNA, 25 bp, Mus musculus
gactcattgcactggaagaaggttt

SEQ ID NO: 460362 - DNA, 25 bp, Mus musculus
gactcattgcctcccagaactgaaa

SEQ ID NO: 460363 - DNA, 25 bp, Mus musculus
gactcattgcctgccagaactgaaa

SEQ ID NO: 460364 - DNA, 25 bp, Mus musculus
gactcattgctgatgtgtgcttgtt

SEQ ID NO: 460365 - DNA, 25 bp, Mus musculus
gactcattgctgttgtgtgcttgtt

SEQ ID NO: 460366 - DNA, 25 bp, Mus musculus
gactcatttagacaatcctgcatca

SEQ ID NO: 460367 - DNA, 25 bp, Mus musculus
gactcatttagagaatcctgcatca

SEQ ID NO: 460368 - DNA, 25 bp, Mus musculus
gactcatttctaagtctcactactg

SEQ ID NO: 460369 - DNA, 25 bp, Mus musculus
gactcatttctatgtctcactactg

SEQ ID NO: 460370 - DNA, 25 bp, Mus musculus
gactcattttatccagtggacccca

SEQ ID NO: 460371 - DNA, 25 bp, Mus musculus
gactcattttatgcagtggacccca

SEQ ID NO: 460372 - DNA, 25 bp, Mus musculus
gactcattttcaacctgctgagact

SEQ ID NO: 460373 - DNA, 25 bp, Mus musculus
gactcattttcatcctgctgagact

SEQ ID NO: 460374 - DNA, 25 bp, Mus musculus
gactcattttctctgtgactgaacg

SEQ ID NO: 460375 - DNA, 25 bp, Mus musculus
gactcattttctgtgtgactgaacg

SEQ ID NO: 460376 - DNA, 25 bp, Mus musculus
gactcattttgactctctgaacaca

SEQ ID NO: 460377 - DNA, 25 bp, Mus musculus
gactcattttgagtctctgaacaca

SEQ ID NO: 460378 - DNA, 25 bp, Mus musculus
gactccaaagctctatgcctgttta

SEQ ID NO: 460379 - DNA, 25 bp, Mus musculus
gactccaaagctgtatgcctgttta

SEQ ID NO: 460380 - DNA, 25 bp, Mus musculus
gactccaaaggaacattgtgctgcc

SEQ ID NO: 460381 - DNA, 25 bp, Mus musculus
gactccaaaggatcattgtgctgcc

SEQ ID NO: 460382 - DNA, 25 bp, Mus musculus
gactccaacactcatgagggtttct

SEQ ID NO: 460383 - DNA, 25 bp, Mus musculus
gactccaacactgatgagggtttct

SEQ ID NO: 460384 - DNA, 25 bp, Mus musculus
gactccaacatcattcttttgccaa

SEQ ID NO: 460385 - DNA, 25 bp, Mus musculus
gactccaacatctttcttttgccaa

SEQ ID NO: 460386 - DNA, 25 bp, Mus musculus
gactccaaccaacaacatgatgata

SEQ ID NO: 460387 - DNA, 25 bp, Mus musculus
gactccaaccaagaacatgatgata

SEQ ID NO: 460388 - DNA, 25 bp, Mus musculus
gactccaaccgtccaagaggagagt

SEQ ID NO: 460389 - DNA, 25 bp, Mus musculus
gactccaaccgtgcaagaggagagt

SEQ ID NO: 460390 - DNA, 25 bp, Mus musculus
gactccaaccttagcttgattcaag

SEQ ID NO: 460391 - DNA, 25 bp, Mus musculus
gactccaacctttgcttgattcaag

SEQ ID NO: 460392 - DNA, 25 bp, Mus musculus
gactccaactgcacgtgcaagcaaa

SEQ ID NO: 460393 - DNA, 25 bp, Mus musculus
gactccaactgctcgtgcaagcaaa

SEQ ID NO: 460394 - DNA, 25 bp, Mus musculus
gactccaacttcagcagcgacagca

SEQ ID NO: 460395 - DNA, 25 bp, Mus musculus
gactccaacttctgcagcgacagca

SEQ ID NO: 460396 - DNA, 25 bp, Mus musculus
gactccaagggcaacttacatatta

SEQ ID NO: 460397 - DNA, 25 bp, Mus musculus
gactccaagggctacttacatatta

SEQ ID NO: 460398 - DNA, 25 bp, Mus musculus
gactccaaggtaatgttcagacctc

SEQ ID NO: 460399 - DNA, 25 bp, Mus musculus
gactccaaggtattgttcagacctc

SEQ ID NO: 460400 - DNA, 25 bp, Mus musculus
gactccaagtcacgtggtagcggca

SEQ ID NO: 460401 - DNA, 25 bp, Mus musculus
gactccaagtcaggtggtagcggca

SEQ ID NO: 460402 - DNA, 25 bp, Mus musculus
gactccaagtctaaaccacactttg

SEQ ID NO: 460403 - DNA, 25 bp, Mus musculus
gactccaagtcttaaccacactttg

SEQ ID NO: 460404 - DNA, 25 bp, Mus musculus
gactccacaaaacggaagaaggtag

SEQ ID NO: 460405 - DNA, 25 bp, Mus musculus
gactccacaaaagggaagaaggtag

SEQ ID NO: 460406 - DNA, 25 bp, Mus musculus
gactccacaccaaaacaaactaaat

SEQ ID NO: 460407 - DNA, 25 bp, Mus musculus
gactccacaccataacaaactaaat

SEQ ID NO: 460408 - DNA, 25 bp, Mus musculus
gactccacatgaccttggaagcttt

SEQ ID NO: 460409 - DNA, 25 bp, Mus musculus
gactccacatgagcttggaagcttt

SEQ ID NO: 460410 - DNA, 25 bp, Mus musculus
gactccaccactatcttcagataag

SEQ ID NO: 460411 - DNA, 25 bp, Mus musculus
gactccaccactttcttcagataag

SEQ ID NO: 460412 - DNA, 25 bp, Mus musculus
gactccacccagataccagaaaagg

SEQ ID NO: 460413 - DNA, 25 bp, Mus musculus
gactccacccagttaccagaaaagg

SEQ ID NO: 460414 - DNA, 25 bp, Mus musculus
gactccaccctgagaaactgacaag

SEQ ID NO: 460415 - DNA, 25 bp, Mus musculus
gactccaccctgtgaaactgacaag

SEQ ID NO: 460416 - DNA, 25 bp, Mus musculus
gactccacgactcttgaacatcaga

SEQ ID NO: 460417 - DNA, 25 bp, Mus musculus
gactccacgactgttgaacatcaga

SEQ ID NO: 460418 - DNA, 25 bp, Mus musculus
gactccacgtggcattatgttcctg

SEQ ID NO: 460419 - DNA, 25 bp, Mus musculus
gactccacgtgggattatgttcctg

SEQ ID NO: 460420 - DNA, 25 bp, Mus musculus
gactccacgttcagagatgtcgcaa

SEQ ID NO: 460421 - DNA, 25 bp, Mus musculus
gactccacgttctgagatgtcgcaa

SEQ ID NO: 460422 - DNA, 25 bp, Mus musculus
gactccactactcaacagtgtcaac

SEQ ID NO: 460423 - DNA, 25 bp, Mus musculus
gactccactactgaacagtgtcaac

SEQ ID NO: 460424 - DNA, 25 bp, Mus musculus
gactccactggcctgtttggaacag

SEQ ID NO: 460425 - DNA, 25 bp, Mus musculus
gactccactggcgtgtttggaacag

SEQ ID NO: 460426 - DNA, 25 bp, Mus musculus
gactccactgtaccggtaggatgcc

SEQ ID NO: 460427 - DNA, 25 bp, Mus musculus
gactccactgtagcggtaggatgcc

SEQ ID NO: 460428 - DNA, 25 bp, Mus musculus
gactccactgttaaaagcagaactc

SEQ ID NO: 460429 - DNA, 25 bp, Mus musculus
gactccactgtttaaagcagaactc

SEQ ID NO: 460430 - DNA, 25 bp, Mus musculus
gactccagaaaaccttttaaatatg

SEQ ID NO: 460431 - DNA, 25 bp, Mus musculus
gactccagaaaagcttttaaatatg

SEQ ID NO: 460432 - DNA, 25 bp, Mus musculus
gactccagaaatagttagcatgaac

SEQ ID NO: 460433 - DNA, 25 bp, Mus musculus
gactccagaaattgttagcatgaac

SEQ ID NO: 460434 - DNA, 25 bp, Mus musculus
gactccagacacaaaactgttggtg

SEQ ID NO: 460435 - DNA, 25 bp, Mus musculus
gactccagacactaaactgttggtg

SEQ ID NO: 460436 - DNA, 25 bp, Mus musculus
gactccagagcaattagcagaatta

SEQ ID NO: 460437 - DNA, 25 bp, Mus musculus
gactccagagcatttagcagaatta

SEQ ID NO: 460438 - DNA, 25 bp, Mus musculus
gactccagagtccttctacctcaga

SEQ ID NO: 460439 - DNA, 25 bp, Mus musculus
gactccagagtcgttctacctcaga

SEQ ID NO: 460440 - DNA, 25 bp, Mus musculus
gactccagatgcctgcagaatccat

SEQ ID NO: 460441 - DNA, 25 bp, Mus musculus
gactccagatgcgtgcagaatccat

SEQ ID NO: 460442 - DNA, 25 bp, Mus musculus
gactccagcagacgtgtggccaaga

SEQ ID NO: 460443 - DNA, 25 bp, Mus musculus
gactccagcagaggtgtggccaaga

SEQ ID NO: 460444 - DNA, 25 bp, Mus musculus
gactccagcataccttcagacagga

SEQ ID NO: 460445 - DNA, 25 bp, Mus musculus
gactccagcatagcttcagacagga

SEQ ID NO: 460446 - DNA, 25 bp, Mus musculus
gactccagcattacaagaagtagag

SEQ ID NO: 460447 - DNA, 25 bp, Mus musculus
gactccagcatttcaagaagtagag

SEQ ID NO: 460448 - DNA, 25 bp, Mus musculus
gactccagccaactttcttgatgtt

SEQ ID NO: 460449 - DNA, 25 bp, Mus musculus
gactccagccaagtttcttgatgtt

SEQ ID NO: 460450 - DNA, 25 bp, Mus musculus
gactccagcccgatgccgcgggatg

SEQ ID NO: 460451 - DNA, 25 bp, Mus musculus
gactccagcccgttgccgcgggatg

SEQ ID NO: 460452 - DNA, 25 bp, Mus musculus
gactccagcgcacactgatttgagt

SEQ ID NO: 460453 - DNA, 25 bp, Mus musculus
gactccagcgcagactgatttgagt

SEQ ID NO: 460454 - DNA, 25 bp, Mus musculus
gactccaggaaactgctttttatct

SEQ ID NO: 460455 - DNA, 25 bp, Mus musculus
gactccaggaaagtgctttttatct

SEQ ID NO: 460456 - DNA, 25 bp, Mus musculus
gactccaggaatcttctgtgatccc

SEQ ID NO: 460457 - DNA, 25 bp, Mus musculus
gactccaggaatgttctgtgatccc

SEQ ID NO: 460458 - DNA, 25 bp, Mus musculus
gactccaggagacaagctagatctt

SEQ ID NO: 460459 - DNA, 25 bp, Mus musculus
gactccaggagagaagctagatctt

SEQ ID NO: 460460 - DNA, 25 bp, Mus musculus
gactccaggatcaaagtccgtgcag

SEQ ID NO: 460461 - DNA, 25 bp, Mus musculus
gactccaggatctaagtccgtgcag

SEQ ID NO: 460462 - DNA, 25 bp, Mus musculus
gactccaggcgcctgatgctcaacg

SEQ ID NO: 460463 - DNA, 25 bp, Mus musculus
gactccaggcgcgtgatgctcaacg

SEQ ID NO: 460464 - DNA, 25 bp, Mus musculus
gactccaggcttacgtgatttatca

SEQ ID NO: 460465 - DNA, 25 bp, Mus musculus
gactccaggctttcgtgatttatca

SEQ ID NO: 460466 - DNA, 25 bp, Mus musculus
gactccagggaaattcagtgatgac

SEQ ID NO: 460467 - DNA, 25 bp, Mus musculus
gactccagggaaccatcaataggca

SEQ ID NO: 460468 - DNA, 25 bp, Mus musculus
gactccagggaagcatcaataggca

SEQ ID NO: 460469 - DNA, 25 bp, Mus musculus
gactccagggaatttcagtgatgac

SEQ ID NO: 460470 - DNA, 25 bp, Mus musculus
gactccagggcaaagaattatatct

SEQ ID NO: 460471 - DNA, 25 bp, Mus musculus
gactccagggcatagaattatatct

SEQ ID NO: 460472 - DNA, 25 bp, Mus musculus
gactccaggtggcattcggtaccga

SEQ ID NO: 460473 - DNA, 25 bp, Mus musculus
gactccaggtgggattcggtaccga

SEQ ID NO: 460474 - DNA, 25 bp, Mus musculus
gactccagtactcccttttattatt

SEQ ID NO: 460475 - DNA, 25 bp, Mus musculus
gactccagtactgccttttattatt

SEQ ID NO: 460476 - DNA, 25 bp, Mus musculus
gactccagtccaacaattgggccag

SEQ ID NO: 460477 - DNA, 25 bp, Mus musculus
gactccagtccatcaattgggccag

SEQ ID NO: 460478 - DNA, 25 bp, Mus musculus
gactccagtcgccaaggagcttaat

SEQ ID NO: 460479 - DNA, 25 bp, Mus musculus
gactccagtcgcgaaggagcttaat

SEQ ID NO: 460480 - DNA, 25 bp, Mus musculus
gactccagtgagaaccagcctaaac

SEQ ID NO: 460481 - DNA, 25 bp, Mus musculus
gactccagtgagtaccagcctaaac

SEQ ID NO: 460482 - DNA, 25 bp, Mus musculus
gactccagtggaaatgttgtgaaca

SEQ ID NO: 460483 - DNA, 25 bp, Mus musculus
gactccagtggatatgttgtgaaca

SEQ ID NO: 460484 - DNA, 25 bp, Mus musculus
gactccagtgtgaacatcctaacta

SEQ ID NO: 460485 - DNA, 25 bp, Mus musculus
gactccagtgtgtacatcctaacta

SEQ ID NO: 460486 - DNA, 25 bp, Mus musculus
gactccagtttccatgctttagtag

SEQ ID NO: 460487 - DNA, 25 bp, Mus musculus
gactccagtttcgatgctttagtag

SEQ ID NO: 460488 - DNA, 25 bp, Mus musculus
gactccataggaagtatttgctcgt

SEQ ID NO: 460489 - DNA, 25 bp, Mus musculus
gactccataggatgtatttgctcgt

SEQ ID NO: 460490 - DNA, 25 bp, Mus musculus
gactccatatgaattagggctcctc

SEQ ID NO: 460491 - DNA, 25 bp, Mus musculus
gactccatatgatttagggctcctc

SEQ ID NO: 460492 - DNA, 25 bp, Mus musculus
gactccatcagtcagattttaggca

SEQ ID NO: 460493 - DNA, 25 bp, Mus musculus
gactccatcagtgagattttaggca

SEQ ID NO: 460494 - DNA, 25 bp, Mus musculus
gactccatcgtgaagtggtcactga

SEQ ID NO: 460495 - DNA, 25 bp, Mus musculus
gactccatcgtgtagtggtcactga

SEQ ID NO: 460496 - DNA, 25 bp, Mus musculus
gactccatctaaacatcttaaaccc

SEQ ID NO: 460497 - DNA, 25 bp, Mus musculus
gactccatctaatcatcttaaaccc

SEQ ID NO: 460498 - DNA, 25 bp, Mus musculus
gactccatctcaatggcccaggaag

SEQ ID NO: 460499 - DNA, 25 bp, Mus musculus
gactccatctcattggcccaggaag

SEQ ID NO: 460500 - DNA, 25 bp, Mus musculus
gactccatcttaactctgtatggta

SEQ ID NO: 460501 - DNA, 25 bp, Mus musculus
gactccatcttatctctgtatggta

SEQ ID NO: 460502 - DNA, 25 bp, Mus musculus
gactccatgctactcacagcaggtc

SEQ ID NO: 460503 - DNA, 25 bp, Mus musculus
gactccatgctagtcacagcaggtc

SEQ ID NO: 460504 - DNA, 25 bp, Mus musculus
gactccatggagagactgagacaga

SEQ ID NO: 460505 - DNA, 25 bp, Mus musculus
gactccatggagtgactgagacaga

SEQ ID NO: 460506 - DNA, 25 bp, Mus musculus
gactccatgtaacttattggcctca

SEQ ID NO: 460507 - DNA, 25 bp, Mus musculus
gactccatgtaagttattggcctca

SEQ ID NO: 460508 - DNA, 25 bp, Mus musculus
gactccatgtctcggatgacctcac

SEQ ID NO: 460509 - DNA, 25 bp, Mus musculus
gactccatgtctgggatgacctcac

SEQ ID NO: 460510 - DNA, 25 bp, Mus musculus
gactccatgttcactgtacgggctg

SEQ ID NO: 460511 - DNA, 25 bp, Mus musculus
gactccatgttctctgtacgggctg

SEQ ID NO: 460512 - DNA, 25 bp, Mus musculus
gactccattgacaggattctcccta

SEQ ID NO: 460513 - DNA, 25 bp, Mus musculus
gactccattgactggattctcccta

SEQ ID NO: 460514 - DNA, 25 bp, Mus musculus
gactccattgagactacggcaggat

SEQ ID NO: 460515 - DNA, 25 bp, Mus musculus
gactccattgagtctacggcaggat

SEQ ID NO: 460516 - DNA, 25 bp, Mus musculus
gactccattgttcgtcagtgtcccc

SEQ ID NO: 460517 - DNA, 25 bp, Mus musculus
gactccattgttggtcagtgtcccc

SEQ ID NO: 460518 - DNA, 25 bp, Mus musculus
gactccatttatattccagaagcag

SEQ ID NO: 460519 - DNA, 25 bp, Mus musculus
gactccatttattttccagaagcag

SEQ ID NO: 460520 - DNA, 25 bp, Mus musculus
gactccatttgaacacagagagcac

SEQ ID NO: 460521 - DNA, 25 bp, Mus musculus
gactccatttgatcacagagagcac

SEQ ID NO: 460522 - DNA, 25 bp, Mus musculus
gactccatttgcaatagggcccagg

SEQ ID NO: 460523 - DNA, 25 bp, Mus musculus
gactccatttgctatagggcccagg

SEQ ID NO: 460524 - DNA, 25 bp, Mus musculus
gactcccaaagtctttctctgtaat

SEQ ID NO: 460525 - DNA, 25 bp, Mus musculus
gactcccaaagtgtttctctgtaat

SEQ ID NO: 460526 - DNA, 25 bp, Mus musculus
gactcccaaatcaatgtgccgaaaa

SEQ ID NO: 460527 - DNA, 25 bp, Mus musculus
gactcccaaatctatgtgccgaaaa

SEQ ID NO: 460528 - DNA, 25 bp, Mus musculus
gactcccaaatgacagttcctctga

SEQ ID NO: 460529 - DNA, 25 bp, Mus musculus
gactcccaaatgtcagttcctctga

SEQ ID NO: 460530 - DNA, 25 bp, Mus musculus
gactcccaacacaataaacatctat

SEQ ID NO: 460531 - DNA, 25 bp, Mus musculus
gactcccaacactataaacatctat

SEQ ID NO: 460532 - DNA, 25 bp, Mus musculus
gactcccaattaatatctagcgctt

SEQ ID NO: 460533 - DNA, 25 bp, Mus musculus
gactcccaattattatctagcgctt

SEQ ID NO: 460534 - DNA, 25 bp, Mus musculus
gactcccacaaacgccggaagcggt

SEQ ID NO: 460535 - DNA, 25 bp, Mus musculus
gactcccacaaaggccggaagcggt

SEQ ID NO: 460536 - DNA, 25 bp, Mus musculus
gactcccacttgatttgtctaaaac

SEQ ID NO: 460537 - DNA, 25 bp, Mus musculus
gactcccacttgttttgtctaaaac

SEQ ID NO: 460538 - DNA, 25 bp, Mus musculus
gactcccagaccaatgttctttttg

SEQ ID NO: 460539 - DNA, 25 bp, Mus musculus
gactcccagacctatgttctttttg

SEQ ID NO: 460540 - DNA, 25 bp, Mus musculus
gactcccagagcagatgctgttgta

SEQ ID NO: 460541 - DNA, 25 bp, Mus musculus
gactcccagagctgatgctgttgta

SEQ ID NO: 460542 - DNA, 25 bp, Mus musculus
gactcccagattctagaactcagaa

SEQ ID NO: 460543 - DNA, 25 bp, Mus musculus
gactcccagattgtagaactcagaa

SEQ ID NO: 460544 - DNA, 25 bp, Mus musculus
gactcccagctaaggtggcgtttta

SEQ ID NO: 460545 - DNA, 25 bp, Mus musculus
gactcccagctatggtggcgtttta

SEQ ID NO: 460546 - DNA, 25 bp, Mus musculus
gactcccagggaagctgaactatgc

SEQ ID NO: 460547 - DNA, 25 bp, Mus musculus
gactcccagggatgctgaactatgc

SEQ ID NO: 460548 - DNA, 25 bp, Mus musculus
gactcccaggttcacaataaacgca

SEQ ID NO: 460549 - DNA, 25 bp, Mus musculus
gactcccaggttgacaataaacgca

SEQ ID NO: 460550 - DNA, 25 bp, Mus musculus
gactcccagtcacgatgcattctta

SEQ ID NO: 460551 - DNA, 25 bp, Mus musculus
gactcccagtcaggatgcattctta

SEQ ID NO: 460552 - DNA, 25 bp, Mus musculus
gactcccagttgagctctgaaggtt

SEQ ID NO: 460553 - DNA, 25 bp, Mus musculus
gactcccagttgtgctctgaaggtt

SEQ ID NO: 460554 - DNA, 25 bp, Mus musculus
gactcccagtttctaattcctgttt

SEQ ID NO: 460555 - DNA, 25 bp, Mus musculus
gactcccagtttgtaattcctgttt

SEQ ID NO: 460556 - DNA, 25 bp, Mus musculus
gactcccataatccaaatcatcatg

SEQ ID NO: 460557 - DNA, 25 bp, Mus musculus
gactcccataatgcaaatcatcatg

SEQ ID NO: 460558 - DNA, 25 bp, Mus musculus
gactcccatcatcaagtacttgttg

SEQ ID NO: 460559 - DNA, 25 bp, Mus musculus
gactcccatcatgaagtacttgttg

SEQ ID NO: 460560 - DNA, 25 bp, Mus musculus
gactcccatgagagtaaatgatgct

SEQ ID NO: 460561 - DNA, 25 bp, Mus musculus
gactcccatgagtgtaaatgatgct

SEQ ID NO: 460562 - DNA, 25 bp, Mus musculus
gactcccatgcaactatctggttga

SEQ ID NO: 460563 - DNA, 25 bp, Mus musculus
gactcccatgcatctatctggttga

SEQ ID NO: 460564 - DNA, 25 bp, Mus musculus
gactcccattatacagtaaaccctc

SEQ ID NO: 460565 - DNA, 25 bp, Mus musculus
gactcccattattcagtaaaccctc

SEQ ID NO: 460566 - DNA, 25 bp, Mus musculus
gactccccaagaaaatgctcgggat

SEQ ID NO: 460567 - DNA, 25 bp, Mus musculus
gactccccaagataatgctcgggat

SEQ ID NO: 460568 - DNA, 25 bp, Mus musculus
gactccccagacaggcgtgtgtgag

SEQ ID NO: 460569 - DNA, 25 bp, Mus musculus
gactccccagactggcgtgtgtgag

SEQ ID NO: 460570 - DNA, 25 bp, Mus musculus
gactccccaggtaagggaagccctg

SEQ ID NO: 460571 - DNA, 25 bp, Mus musculus
gactccccaggttagggaagccctg

SEQ ID NO: 460572 - DNA, 25 bp, Mus musculus
gactccccttgtcagcagatgtgag

SEQ ID NO: 460573 - DNA, 25 bp, Mus musculus
gactccccttgtgagcagatgtgag

SEQ ID NO: 460574 - DNA, 25 bp, Mus musculus
gactcccgaatcattctctggaagg

SEQ ID NO: 460575 - DNA, 25 bp, Mus musculus
gactcccgaatctttctctggaagg

SEQ ID NO: 460576 - DNA, 25 bp, Mus musculus
gactcccgcactcagacatacatgg

SEQ ID NO: 460577 - DNA, 25 bp, Mus musculus
gactcccgcactgagacatacatgg

SEQ ID NO: 460578 - DNA, 25 bp, Mus musculus
gactccctaaagacataaatctgct

SEQ ID NO: 460579 - DNA, 25 bp, Mus musculus
gactccctaaagtcataaatctgct

SEQ ID NO: 460580 - DNA, 25 bp, Mus musculus
gactccctactaagtcctaggcatt

SEQ ID NO: 460581 - DNA, 25 bp, Mus musculus
gactccctactatgtcctaggcatt

SEQ ID NO: 460582 - DNA, 25 bp, Mus musculus
gactccctcattcagttacgtgttc

SEQ ID NO: 460583 - DNA, 25 bp, Mus musculus
gactccctcattgagttacgtgttc

SEQ ID NO: 460584 - DNA, 25 bp, Mus musculus
gactccctccacagaatataggtga

SEQ ID NO: 460585 - DNA, 25 bp, Mus musculus
gactccctccactgaatataggtga

SEQ ID NO: 460586 - DNA, 25 bp, Mus musculus
gactccctcccacataggtgtaatc

SEQ ID NO: 460587 - DNA, 25 bp, Mus musculus
gactccctcccagataggtgtaatc

SEQ ID NO: 460588 - DNA, 25 bp, Mus musculus
gactccctctgaaactgcttgaaaa

SEQ ID NO: 460589 - DNA, 25 bp, Mus musculus
gactccctctgatactgcttgaaaa

SEQ ID NO: 460590 - DNA, 25 bp, Mus musculus
gactccctctttctaaggcttattt

SEQ ID NO: 460591 - DNA, 25 bp, Mus musculus
gactccctctttgtaaggcttattt

SEQ ID NO: 460592 - DNA, 25 bp, Mus musculus
gactccctgagaaaactctgagctg

SEQ ID NO: 460593 - DNA, 25 bp, Mus musculus
gactccctgagataactctgagctg

SEQ ID NO: 460594 - DNA, 25 bp, Mus musculus
gactccctgatcacgaatcgtcatg

SEQ ID NO: 460595 - DNA, 25 bp, Mus musculus
gactccctgatctcgaatcgtcatg

SEQ ID NO: 460596 - DNA, 25 bp, Mus musculus
gactccctgcttcatggtgtgcatt

SEQ ID NO: 460597 - DNA, 25 bp, Mus musculus
gactccctgcttgatggtgtgcatt

SEQ ID NO: 460598 - DNA, 25 bp, Mus musculus
gactccctggaaacggtcaactgga

SEQ ID NO: 460599 - DNA, 25 bp, Mus musculus
gactccctggaatcggtcaactgga

SEQ ID NO: 460600 - DNA, 25 bp, Mus musculus
gactccctggagaagtcaggcagcc

SEQ ID NO: 460601 - DNA, 25 bp, Mus musculus
gactccctggagtagtcaggcagcc

SEQ ID NO: 460602 - DNA, 25 bp, Mus musculus
gactccctgtcaaaaagctggcttt

SEQ ID NO: 460603 - DNA, 25 bp, Mus musculus
gactccctgtcataaagctggcttt

SEQ ID NO: 460604 - DNA, 25 bp, Mus musculus
gactcccttactaaacagaccctgg

SEQ ID NO: 460605 - DNA, 25 bp, Mus musculus
gactcccttacttaacagaccctgg

SEQ ID NO: 460606 - DNA, 25 bp, Mus musculus
gactcccttataatatttcctgtaa

SEQ ID NO: 460607 - DNA, 25 bp, Mus musculus
gactcccttatattatttcctgtaa

SEQ ID NO: 460608 - DNA, 25 bp, Mus musculus
gactccctttaaattagctgaacaa

SEQ ID NO: 460609 - DNA, 25 bp, Mus musculus
gactccctttaatttagctgaacaa

SEQ ID NO: 460610 - DNA, 25 bp, Mus musculus
gactccgaagtgcagccgagcctgt

SEQ ID NO: 460611 - DNA, 25 bp, Mus musculus
gactccgaagtggagccgagcctgt

SEQ ID NO: 460612 - DNA, 25 bp, Mus musculus
gactccgacaatcgccgagcttggt

SEQ ID NO: 460613 - DNA, 25 bp, Mus musculus
gactccgacaatggccgagcttggt

SEQ ID NO: 460614 - DNA, 25 bp, Mus musculus
gactccgacacgattgcagtcgaat

SEQ ID NO: 460615 - DNA, 25 bp, Mus musculus
gactccgacacgtttgcagtcgaat

SEQ ID NO: 460616 - DNA, 25 bp, Mus musculus
gactccgagcttaaattctctttta

SEQ ID NO: 460617 - DNA, 25 bp, Mus musculus
gactccgagctttaattctctttta

SEQ ID NO: 460618 - DNA, 25 bp, Mus musculus
gactccgaggatacttacattttct

SEQ ID NO: 460619 - DNA, 25 bp, Mus musculus
gactccgaggattcttacattttct

SEQ ID NO: 460620 - DNA, 25 bp, Mus musculus
gactccgagtgcagcactttcaagt

SEQ ID NO: 460621 - DNA, 25 bp, Mus musculus
gactccgagtgcagcccaccaggag

SEQ ID NO: 460622 - DNA, 25 bp, Mus musculus
gactccgagtgctgcactttcaagt

SEQ ID NO: 460623 - DNA, 25 bp, Mus musculus
gactccgagtgctgcccaccaggag

SEQ ID NO: 460624 - DNA, 25 bp, Mus musculus
gactccgcactgagagatgcttatc

SEQ ID NO: 460625 - DNA, 25 bp, Mus musculus
gactccgcactgtgagatgcttatc

SEQ ID NO: 460626 - DNA, 25 bp, Mus musculus
gactccgccaaaactctagctgtat

SEQ ID NO: 460627 - DNA, 25 bp, Mus musculus
gactccgccaaatctctagctgtat

SEQ ID NO: 460628 - DNA, 25 bp, Mus musculus
gactccgcttacaggtgtggtccat

SEQ ID NO: 460629 - DNA, 25 bp, Mus musculus
gactccgcttactggtgtggtccat

SEQ ID NO: 460630 - DNA, 25 bp, Mus musculus
gactccggactacatgaatcttctt

SEQ ID NO: 460631 - DNA, 25 bp, Mus musculus
gactccggactagatgaatcttctt

SEQ ID NO: 460632 - DNA, 25 bp, Mus musculus
gactccggagcaacggctgcaggaa

SEQ ID NO: 460633 - DNA, 25 bp, Mus musculus
gactccggagcatcggctgcaggaa

SEQ ID NO: 460634 - DNA, 25 bp, Mus musculus
gactccggcatacgttcagagcatg

SEQ ID NO: 460635 - DNA, 25 bp, Mus musculus
gactccggcataggttcagagcatg

SEQ ID NO: 460636 - DNA, 25 bp, Mus musculus
gactccggctttagagcacttgaaa

SEQ ID NO: 460637 - DNA, 25 bp, Mus musculus
gactccggcttttgagcacttgaaa

SEQ ID NO: 460638 - DNA, 25 bp, Mus musculus
gactccgggacgcagatgcaaacct

SEQ ID NO: 460639 - DNA, 25 bp, Mus musculus
gactccgggacggagatgcaaacct

SEQ ID NO: 460640 - DNA, 25 bp, Mus musculus
gactccgggatgctctctctctatg

SEQ ID NO: 460641 - DNA, 25 bp, Mus musculus
gactccgggatggtctctctctatg

SEQ ID NO: 460642 - DNA, 25 bp, Mus musculus
gactccggtcaccaaggaaactctg

SEQ ID NO: 460643 - DNA, 25 bp, Mus musculus
gactccggtcacgaaggaaactctg

SEQ ID NO: 460644 - DNA, 25 bp, Mus musculus
gactccggttacataggatccaaca

SEQ ID NO: 460645 - DNA, 25 bp, Mus musculus
gactccggttacttaggatccaaca

SEQ ID NO: 460646 - DNA, 25 bp, Mus musculus
gactccgtagagaacccagcgatca

SEQ ID NO: 460647 - DNA, 25 bp, Mus musculus
gactccgtagagtacccagcgatca

SEQ ID NO: 460648 - DNA, 25 bp, Mus musculus
gactccgtagctcggaagtgagcta

SEQ ID NO: 460649 - DNA, 25 bp, Mus musculus
gactccgtagctgggaagtgagcta

SEQ ID NO: 460650 - DNA, 25 bp, Mus musculus
gactccgtgattaagggtgcactgc

SEQ ID NO: 460651 - DNA, 25 bp, Mus musculus
gactccgtgatttagggtgcactgc

SEQ ID NO: 460652 - DNA, 25 bp, Mus musculus
gactccgtgcggacaaaaatgctat

SEQ ID NO: 460653 - DNA, 25 bp, Mus musculus
gactccgtgcggtcaaaaatgctat

SEQ ID NO: 460654 - DNA, 25 bp, Mus musculus
gactccgtgggcaccagcttatgca

SEQ ID NO: 460655 - DNA, 25 bp, Mus musculus
gactccgtgggctccagcttatgca

SEQ ID NO: 460656 - DNA, 25 bp, Mus musculus
gactccgtgtaaccacctggactaa

SEQ ID NO: 460657 - DNA, 25 bp, Mus musculus
gactccgtgtaagcacctggactaa

SEQ ID NO: 460658 - DNA, 25 bp, Mus musculus
gactccgttgagagcccagggtgtc

SEQ ID NO: 460659 - DNA, 25 bp, Mus musculus
gactccgttgagtgcccagggtgtc

SEQ ID NO: 460660 - DNA, 25 bp, Mus musculus
gactccgttgttagcagtgatgctt

SEQ ID NO: 460661 - DNA, 25 bp, Mus musculus
gactccgttgtttgcagtgatgctt

SEQ ID NO: 460662 - DNA, 25 bp, Mus musculus
gactcctaaaatcttcgggccctat

SEQ ID NO: 460663 - DNA, 25 bp, Mus musculus
gactcctaaaatgttcgggccctat

SEQ ID NO: 460664 - DNA, 25 bp, Mus musculus
gactcctaaagaaccatgtactcca

SEQ ID NO: 460665 - DNA, 25 bp, Mus musculus
gactcctaaagatccatgtactcca

SEQ ID NO: 460666 - DNA, 25 bp, Mus musculus
gactcctaacaaatattgtgcttac

SEQ ID NO: 460667 - DNA, 25 bp, Mus musculus
gactcctaacaattattgtgcttac

SEQ ID NO: 460668 - DNA, 25 bp, Mus musculus
gactcctaagacaacgaccctttga

SEQ ID NO: 460669 - DNA, 25 bp, Mus musculus
gactcctaagactacgaccctttga

SEQ ID NO: 460670 - DNA, 25 bp, Mus musculus
gactcctaagtgagggttctctcta

SEQ ID NO: 460671 - DNA, 25 bp, Mus musculus
gactcctaagtgtgggttctctcta

SEQ ID NO: 460672 - DNA, 25 bp, Mus musculus
gactcctacaatacttttgagcaag

SEQ ID NO: 460673 - DNA, 25 bp, Mus musculus
gactcctacaattcttttgagcaag

SEQ ID NO: 460674 - DNA, 25 bp, Mus musculus
gactcctaccgtatcttgagtttat

SEQ ID NO: 460675 - DNA, 25 bp, Mus musculus
gactcctaccgtttcttgagtttat

SEQ ID NO: 460676 - DNA, 25 bp, Mus musculus
gactcctacctaaagcaaagccaga

SEQ ID NO: 460677 - DNA, 25 bp, Mus musculus
gactcctacctatagcaaagccaga

SEQ ID NO: 460678 - DNA, 25 bp, Mus musculus
gactcctacgcacacggtggcacgg

SEQ ID NO: 460679 - DNA, 25 bp, Mus musculus
gactcctacgcagacggtggcacgg

SEQ ID NO: 460680 - DNA, 25 bp, Mus musculus
gactcctagcttcttaacccgaagt

SEQ ID NO: 460681 - DNA, 25 bp, Mus musculus
gactcctagcttgttaacccgaagt

SEQ ID NO: 460682 - DNA, 25 bp, Mus musculus
gactcctaggagagtttgtagacca

SEQ ID NO: 460683 - DNA, 25 bp, Mus musculus
gactcctaggagtgtttgtagacca

SEQ ID NO: 460684 - DNA, 25 bp, Mus musculus
gactcctatcagattgctggtgcag

SEQ ID NO: 460685 - DNA, 25 bp, Mus musculus
gactcctatcagtttgctggtgcag

SEQ ID NO: 460686 - DNA, 25 bp, Mus musculus
gactcctatgacaacagctacagca

SEQ ID NO: 460687 - DNA, 25 bp, Mus musculus
gactcctatgactacagctacagca

SEQ ID NO: 460688 - DNA, 25 bp, Mus musculus
gactcctatgcacacagctgccatt

SEQ ID NO: 460689 - DNA, 25 bp, Mus musculus
gactcctatgcagacagctgccatt

SEQ ID NO: 460690 - DNA, 25 bp, Mus musculus
gactcctattgtccagatgactcct

SEQ ID NO: 460691 - DNA, 25 bp, Mus musculus
gactcctattgtgcagatgactcct

SEQ ID NO: 460692 - DNA, 25 bp, Mus musculus
gactcctcaaggagctaggctggct

SEQ ID NO: 460693 - DNA, 25 bp, Mus musculus
gactcctcaaggcttttgatcaata

SEQ ID NO: 460694 - DNA, 25 bp, Mus musculus
gactcctcaagggttttgatcaata

SEQ ID NO: 460695 - DNA, 25 bp, Mus musculus
gactcctcaaggtgctaggctggct

SEQ ID NO: 460696 - DNA, 25 bp, Mus musculus
gactcctcaagtctcagggtcagag

SEQ ID NO: 460697 - DNA, 25 bp, Mus musculus
gactcctcaagtgtcagggtcagag

SEQ ID NO: 460698 - DNA, 25 bp, Mus musculus
gactcctcacacacataaagaccaa

SEQ ID NO: 460699 - DNA, 25 bp, Mus musculus
gactcctcacactcataaagaccaa

SEQ ID NO: 460700 - DNA, 25 bp, Mus musculus
gactcctcagctaatggtttaggcc

SEQ ID NO: 460701 - DNA, 25 bp, Mus musculus
gactcctcagcttatggtttaggcc

SEQ ID NO: 460702 - DNA, 25 bp, Mus musculus
gactcctcagtgcacagttttgctg

SEQ ID NO: 460703 - DNA, 25 bp, Mus musculus
gactcctcagtggacagttttgctg

SEQ ID NO: 460704 - DNA, 25 bp, Mus musculus
gactcctccacaacatcagagatga

SEQ ID NO: 460705 - DNA, 25 bp, Mus musculus
gactcctccacatcatcagagatga

SEQ ID NO: 460706 - DNA, 25 bp, Mus musculus
gactcctcccaaaaactagccgggt

SEQ ID NO: 460707 - DNA, 25 bp, Mus musculus
gactcctcccaataactagccgggt

SEQ ID NO: 460708 - DNA, 25 bp, Mus musculus
gactcctccctgaaagactgtgtag

SEQ ID NO: 460709 - DNA, 25 bp, Mus musculus
gactcctccctgtaagactgtgtag

SEQ ID NO: 460710 - DNA, 25 bp, Mus musculus
gactcctccgtacaaacacagggtg

SEQ ID NO: 460711 - DNA, 25 bp, Mus musculus
gactcctccgtagaaacacagggtg

SEQ ID NO: 460712 - DNA, 25 bp, Mus musculus
gactcctcctaaaggcaacctggta

SEQ ID NO: 460713 - DNA, 25 bp, Mus musculus
gactcctcctaatggcaacctggta

SEQ ID NO: 460714 - DNA, 25 bp, Mus musculus
gactcctccttaaaaaatggctccc

SEQ ID NO: 460715 - DNA, 25 bp, Mus musculus
gactcctccttataaaatggctccc

SEQ ID NO: 460716 - DNA, 25 bp, Mus musculus
gactcctcctttaaggatgtccaga

SEQ ID NO: 460717 - DNA, 25 bp, Mus musculus
gactcctccttttaggatgtccaga

SEQ ID NO: 460718 - DNA, 25 bp, Mus musculus
gactcctcgagcagatggtaggcct

SEQ ID NO: 460719 - DNA, 25 bp, Mus musculus
gactcctcgagctgatggtaggcct

SEQ ID NO: 460720 - DNA, 25 bp, Mus musculus
gactcctcgggcacagacgaagagg

SEQ ID NO: 460721 - DNA, 25 bp, Mus musculus
gactcctcgggctcagacgaagagg

SEQ ID NO: 460722 - DNA, 25 bp, Mus musculus
gactcctctaagatcactcaaattg

SEQ ID NO: 460723 - DNA, 25 bp, Mus musculus
gactcctctaagttcactcaaattg

SEQ ID NO: 460724 - DNA, 25 bp, Mus musculus
gactcctctactaggtgtctaagac

SEQ ID NO: 460725 - DNA, 25 bp, Mus musculus
gactcctctactatctttggaccca

SEQ ID NO: 460726 - DNA, 25 bp, Mus musculus
gactcctctacttggtgtctaagac

SEQ ID NO: 460727 - DNA, 25 bp, Mus musculus
gactcctctactttctttggaccca

SEQ ID NO: 460728 - DNA, 25 bp, Mus musculus
gactcctctcaaagctctgtagtgg

SEQ ID NO: 460729 - DNA, 25 bp, Mus musculus
gactcctctcaatgctctgtagtgg

SEQ ID NO: 460730 - DNA, 25 bp, Mus musculus
gactcctctcccattcagtgaggga

SEQ ID NO: 460731 - DNA, 25 bp, Mus musculus
gactcctctccctttcagtgaggga

SEQ ID NO: 460732 - DNA, 25 bp, Mus musculus
gactcctctgggacttgagctaaaa

SEQ ID NO: 460733 - DNA, 25 bp, Mus musculus
gactcctctgggtcttgagctaaaa

SEQ ID NO: 460734 - DNA, 25 bp, Mus musculus
gactcctgaaagacctgcacaagca

SEQ ID NO: 460735 - DNA, 25 bp, Mus musculus
gactcctgaaagtcctgcacaagca

SEQ ID NO: 460736 - DNA, 25 bp, Mus musculus
gactcctgacagcaacttggaccag

SEQ ID NO: 460737 - DNA, 25 bp, Mus musculus
gactcctgacaggaacttggaccag

SEQ ID NO: 460738 - DNA, 25 bp, Mus musculus
gactcctgacttctgagcgggaaga

SEQ ID NO: 460739 - DNA, 25 bp, Mus musculus
gactcctgacttgtgagcgggaaga

SEQ ID NO: 460740 - DNA, 25 bp, Mus musculus
gactcctgagagaaatgctgttaga

SEQ ID NO: 460741 - DNA, 25 bp, Mus musculus
gactcctgagagtaatgctgttaga

SEQ ID NO: 460742 - DNA, 25 bp, Mus musculus
gactcctgagatctgctgctcttct

SEQ ID NO: 460743 - DNA, 25 bp, Mus musculus
gactcctgagatgtgctgctcttct

SEQ ID NO: 460744 - DNA, 25 bp, Mus musculus
gactcctgagccctggatgtctaga

SEQ ID NO: 460745 - DNA, 25 bp, Mus musculus
gactcctgagccgtggatgtctaga

SEQ ID NO: 460746 - DNA, 25 bp, Mus musculus
gactcctgagctcgttgtgtagaaa

SEQ ID NO: 460747 - DNA, 25 bp, Mus musculus
gactcctgagctggttgtgtagaaa

SEQ ID NO: 460748 - DNA, 25 bp, Mus musculus
gactcctgaggacttccttaatgcc

SEQ ID NO: 460749 - DNA, 25 bp, Mus musculus
gactcctgaggagttccttaatgcc

SEQ ID NO: 460750 - DNA, 25 bp, Mus musculus
gactcctgcaacctaccttatttga

SEQ ID NO: 460751 - DNA, 25 bp, Mus musculus
gactcctgcaacgtaccttatttga

SEQ ID NO: 460752 - DNA, 25 bp, Mus musculus
gactcctgctaactggacactttta

SEQ ID NO: 460753 - DNA, 25 bp, Mus musculus
gactcctgctaagtggacactttta

SEQ ID NO: 460754 - DNA, 25 bp, Mus musculus
gactcctgctgtaaatgctgcttat

SEQ ID NO: 460755 - DNA, 25 bp, Mus musculus
gactcctgctgttaatgctgcttat

SEQ ID NO: 460756 - DNA, 25 bp, Mus musculus
gactcctggaagatgagccaatgaa

SEQ ID NO: 460757 - DNA, 25 bp, Mus musculus
gactcctggaagttgagccaatgaa

SEQ ID NO: 460758 - DNA, 25 bp, Mus musculus
gactcctggcgcctgggtgtcacct

SEQ ID NO: 460759 - DNA, 25 bp, Mus musculus
gactcctggcgcgtgggtgtcacct

SEQ ID NO: 460760 - DNA, 25 bp, Mus musculus
gactcctggctaatatttggttcat

SEQ ID NO: 460761 - DNA, 25 bp, Mus musculus
gactcctggctattatttggttcat

SEQ ID NO: 460762 - DNA, 25 bp, Mus musculus
gactcctgggccaagtctcagggca

SEQ ID NO: 460763 - DNA, 25 bp, Mus musculus
gactcctgggcctagtctcagggca

SEQ ID NO: 460764 - DNA, 25 bp, Mus musculus
gactcctggtgtaccatatgtactt

SEQ ID NO: 460765 - DNA, 25 bp, Mus musculus
gactcctggtgttccatatgtactt

SEQ ID NO: 460766 - DNA, 25 bp, Mus musculus
gactcctggttcagttgtgttgagg

SEQ ID NO: 460767 - DNA, 25 bp, Mus musculus
gactcctggttctgttgtgttgagg

SEQ ID NO: 460768 - DNA, 25 bp, Mus musculus
gactcctgtattcacatcctataaa

SEQ ID NO: 460769 - DNA, 25 bp, Mus musculus
gactcctgtattgacatcctataaa

SEQ ID NO: 460770 - DNA, 25 bp, Mus musculus
gactcctgtgatcttaggtttacta

SEQ ID NO: 460771 - DNA, 25 bp, Mus musculus
gactcctgtgatgttaggtttacta

SEQ ID NO: 460772 - DNA, 25 bp, Mus musculus
gactcctgtgcgatagctactttta

SEQ ID NO: 460773 - DNA, 25 bp, Mus musculus
gactcctgtgcgttagctactttta

SEQ ID NO: 460774 - DNA, 25 bp, Mus musculus
gactcctgttgaaagccgattcctg

SEQ ID NO: 460775 - DNA, 25 bp, Mus musculus
gactcctgttgatagccgattcctg

SEQ ID NO: 460776 - DNA, 25 bp, Mus musculus
gactcctgtttgatctttgagagac

SEQ ID NO: 460777 - DNA, 25 bp, Mus musculus
gactcctgtttgttctttgagagac

SEQ ID NO: 460778 - DNA, 25 bp, Mus musculus
gactcctgttttaacctcagctata

SEQ ID NO: 460779 - DNA, 25 bp, Mus musculus
gactcctgttttatgtcaaaaagat

SEQ ID NO: 460780 - DNA, 25 bp, Mus musculus
gactcctgtttttacctcagctata

SEQ ID NO: 460781 - DNA, 25 bp, Mus musculus
gactcctgttttttgtcaaaaagat

SEQ ID NO: 460782 - DNA, 25 bp, Mus musculus
gactccttacacacctaactgtgat

SEQ ID NO: 460783 - DNA, 25 bp, Mus musculus
gactccttacaccagacaatcaatc

SEQ ID NO: 460784 - DNA, 25 bp, Mus musculus
gactccttacacgagacaatcaatc

SEQ ID NO: 460785 - DNA, 25 bp, Mus musculus
gactccttacactcctaactgtgat

SEQ ID NO: 460786 - DNA, 25 bp, Mus musculus
gactccttacatacctggcttggaa

SEQ ID NO: 460787 - DNA, 25 bp, Mus musculus
gactccttacattcctggcttggaa

SEQ ID NO: 460788 - DNA, 25 bp, Mus musculus
gactccttagctacatcctatgaaa

SEQ ID NO: 460789 - DNA, 25 bp, Mus musculus
gactccttagcttcatcctatgaaa

SEQ ID NO: 460790 - DNA, 25 bp, Mus musculus
gactccttaggaacacaactcctgt

SEQ ID NO: 460791 - DNA, 25 bp, Mus musculus
gactccttaggatcacaactcctgt

SEQ ID NO: 460792 - DNA, 25 bp, Mus musculus
gactccttcaagaacgaaagcaggt

SEQ ID NO: 460793 - DNA, 25 bp, Mus musculus
gactccttcaagtacgaaagcaggt

SEQ ID NO: 460794 - DNA, 25 bp, Mus musculus
gactccttccccatcatggttaaag

SEQ ID NO: 460795 - DNA, 25 bp, Mus musculus
gactccttccccttcatggttaaag

SEQ ID NO: 460796 - DNA, 25 bp, Mus musculus
gactccttccctcggttgtatggac

SEQ ID NO: 460797 - DNA, 25 bp, Mus musculus
gactccttccctgggttgtatggac

SEQ ID NO: 460798 - DNA, 25 bp, Mus musculus
gactccttccttcaaatatacctga

SEQ ID NO: 460799 - DNA, 25 bp, Mus musculus
gactccttccttcgcttatatggac

SEQ ID NO: 460800 - DNA, 25 bp, Mus musculus
gactccttccttgaaatatacctga

SEQ ID NO: 460801 - DNA, 25 bp, Mus musculus
gactccttccttggcttatatggac

SEQ ID NO: 460802 - DNA, 25 bp, Mus musculus
gactccttcggaaaaaacatgcgtt

SEQ ID NO: 460803 - DNA, 25 bp, Mus musculus
gactccttcggataaaacatgcgtt

SEQ ID NO: 460804 - DNA, 25 bp, Mus musculus
gactccttgagaaatacaaccccac

SEQ ID NO: 460805 - DNA, 25 bp, Mus musculus
gactccttgagatatacaaccccac

SEQ ID NO: 460806 - DNA, 25 bp, Mus musculus
gactccttgcaactaaagctctctg

SEQ ID NO: 460807 - DNA, 25 bp, Mus musculus
gactccttgcaagtaaagctctctg

SEQ ID NO: 460808 - DNA, 25 bp, Mus musculus
gactccttgtgtcttttcttcatgt

SEQ ID NO: 460809 - DNA, 25 bp, Mus musculus
gactccttgtgtgttttcttcatgt

SEQ ID NO: 460810 - DNA, 25 bp, Mus musculus
gactcctttatcagcctagatttca

SEQ ID NO: 460811 - DNA, 25 bp, Mus musculus
gactcctttatctgcctagatttca

SEQ ID NO: 460812 - DNA, 25 bp, Mus musculus
gactcctttcctacaaacctgtgga

SEQ ID NO: 460813 - DNA, 25 bp, Mus musculus
gactcctttccttcaaacctgtgga

SEQ ID NO: 460814 - DNA, 25 bp, Mus musculus
gactccttttcacaaaggccaacag

SEQ ID NO: 460815 - DNA, 25 bp, Mus musculus
gactccttttcagaaaggccaacag

SEQ ID NO: 460816 - DNA, 25 bp, Mus musculus
gactccttttgcatgtccgggaaat

SEQ ID NO: 460817 - DNA, 25 bp, Mus musculus
gactccttttgcttgtccgggaaat

SEQ ID NO: 460818 - DNA, 25 bp, Mus musculus
gactcgaacccgcaacctttgaatg

SEQ ID NO: 460819 - DNA, 25 bp, Mus musculus
gactcgaacccggaacctttgaatg

SEQ ID NO: 460820 - DNA, 25 bp, Mus musculus
gactcgaactaactcccaggacagt

SEQ ID NO: 460821 - DNA, 25 bp, Mus musculus
gactcgaactaagtcccaggacagt

SEQ ID NO: 460822 - DNA, 25 bp, Mus musculus
gactcgaatgtaaccagtttacctg

SEQ ID NO: 460823 - DNA, 25 bp, Mus musculus
gactcgaatgtatccagtttacctg

SEQ ID NO: 460824 - DNA, 25 bp, Mus musculus
gactcgacaagcaattggccaaaaa

SEQ ID NO: 460825 - DNA, 25 bp, Mus musculus
gactcgacaagctattggccaaaaa

SEQ ID NO: 460826 - DNA, 25 bp, Mus musculus
gactcgacacttaattcaggttagg

SEQ ID NO: 460827 - DNA, 25 bp, Mus musculus
gactcgacactttattcaggttagg

SEQ ID NO: 460828 - DNA, 25 bp, Mus musculus
gactcgacatacacgatttgttgct

SEQ ID NO: 460829 - DNA, 25 bp, Mus musculus
gactcgacatactcgatttgttgct

SEQ ID NO: 460830 - DNA, 25 bp, Mus musculus
gactcgaccagaccgtgtggcaatg

SEQ ID NO: 460831 - DNA, 25 bp, Mus musculus
gactcgaccagagcgtgtggcaatg

SEQ ID NO: 460832 - DNA, 25 bp, Mus musculus
gactcgacgtccaacaacaacacgg

SEQ ID NO: 460833 - DNA, 25 bp, Mus musculus
gactcgacgtcctacaacaacacgg

SEQ ID NO: 460834 - DNA, 25 bp, Mus musculus
gactcgactgcccttcatgaaatgg

SEQ ID NO: 460835 - DNA, 25 bp, Mus musculus
gactcgactgccgttcatgaaatgg

SEQ ID NO: 460836 - DNA, 25 bp, Mus musculus
gactcgagacaacgtcctgattaga

SEQ ID NO: 460837 - DNA, 25 bp, Mus musculus
gactcgagacaaggtcctgattaga

SEQ ID NO: 460838 - DNA, 25 bp, Mus musculus
gactcgagacttcgtagaatccttt

SEQ ID NO: 460839 - DNA, 25 bp, Mus musculus
gactcgagacttggtagaatccttt

SEQ ID NO: 460840 - DNA, 25 bp, Mus musculus
gactcgagagcactggtgcacacca

SEQ ID NO: 460841 - DNA, 25 bp, Mus musculus
gactcgagagcagtggtgcacacca

SEQ ID NO: 460842 - DNA, 25 bp, Mus musculus
gactcgagctcacagctctggtgct

SEQ ID NO: 460843 - DNA, 25 bp, Mus musculus
gactcgagctcagagctctggtgct

SEQ ID NO: 460844 - DNA, 25 bp, Mus musculus
gactcgagctgaacctgagcaatgc

SEQ ID NO: 460845 - DNA, 25 bp, Mus musculus
gactcgagctgatcctgagcaatgc

SEQ ID NO: 460846 - DNA, 25 bp, Mus musculus
gactcgaggttgctgatgtttgctt

SEQ ID NO: 460847 - DNA, 25 bp, Mus musculus
gactcgaggttggtgatgtttgctt

SEQ ID NO: 460848 - DNA, 25 bp, Mus musculus
gactcgatattgaccactgacatgg

SEQ ID NO: 460849 - DNA, 25 bp, Mus musculus
gactcgatattgtccactgacatgg

SEQ ID NO: 460850 - DNA, 25 bp, Mus musculus
gactcgatgaagcacatttctgtgt

SEQ ID NO: 460851 - DNA, 25 bp, Mus musculus
gactcgatgaaggacatttctgtgt

SEQ ID NO: 460852 - DNA, 25 bp, Mus musculus
gactcgcaggatccgccaagaaact

SEQ ID NO: 460853 - DNA, 25 bp, Mus musculus
gactcgcaggatgcgccaagaaact

SEQ ID NO: 460854 - DNA, 25 bp, Mus musculus
gactcgcaggtacgacaccgtgttc

SEQ ID NO: 460855 - DNA, 25 bp, Mus musculus
gactcgcaggtaggacaccgtgttc

SEQ ID NO: 460856 - DNA, 25 bp, Mus musculus
gactcgccagaaagtagcagttcct

SEQ ID NO: 460857 - DNA, 25 bp, Mus musculus
gactcgccagaatgtagcagttcct

SEQ ID NO: 460858 - DNA, 25 bp, Mus musculus
gactcgccagatcattcacaggatt

SEQ ID NO: 460859 - DNA, 25 bp, Mus musculus
gactcgccagatgattcacaggatt

SEQ ID NO: 460860 - DNA, 25 bp, Mus musculus
gactcgccatatagtgcggcggcgc

SEQ ID NO: 460861 - DNA, 25 bp, Mus musculus
gactcgccatattgtgcggcggcgc

SEQ ID NO: 460862 - DNA, 25 bp, Mus musculus
gactcgcctgatcaactccaagggc

SEQ ID NO: 460863 - DNA, 25 bp, Mus musculus
gactcgcctgatgaactccaagggc

SEQ ID NO: 460864 - DNA, 25 bp, Mus musculus
gactcgcgacctccagaaaggcttg

SEQ ID NO: 460865 - DNA, 25 bp, Mus musculus
gactcgcgacctgcagaaaggcttg

SEQ ID NO: 460866 - DNA, 25 bp, Mus musculus
gactcgcgggaacgtgacccagtca

SEQ ID NO: 460867 - DNA, 25 bp, Mus musculus
gactcgcgggaaggtgacccagtca

SEQ ID NO: 460868 - DNA, 25 bp, Mus musculus
gactcgcgggtcatgcgttggaaca

SEQ ID NO: 460869 - DNA, 25 bp, Mus musculus
gactcgcgggtcttgcgttggaaca

SEQ ID NO: 460870 - DNA, 25 bp, Mus musculus
gactcgctagtgaatgttaaaagta

SEQ ID NO: 460871 - DNA, 25 bp, Mus musculus
gactcgctagtgtatgttaaaagta

SEQ ID NO: 460872 - DNA, 25 bp, Mus musculus
gactcgctccagcttatggttcaag

SEQ ID NO: 460873 - DNA, 25 bp, Mus musculus
gactcgctccaggttatggttcaag

SEQ ID NO: 460874 - DNA, 25 bp, Mus musculus
gactcgctgcctctatttaaaggca

SEQ ID NO: 460875 - DNA, 25 bp, Mus musculus
gactcgctgcctgtatttaaaggca

SEQ ID NO: 460876 - DNA, 25 bp, Mus musculus
gactcgctgttgaatgtgatccaca

SEQ ID NO: 460877 - DNA, 25 bp, Mus musculus
gactcgctgttgtatgtgatccaca

SEQ ID NO: 460878 - DNA, 25 bp, Mus musculus
gactcgcttctgctaaaactgactg

SEQ ID NO: 460879 - DNA, 25 bp, Mus musculus
gactcgcttctggtaaaactgactg

SEQ ID NO: 460880 - DNA, 25 bp, Mus musculus
gactcgctttaaatattcctgtgtt

SEQ ID NO: 460881 - DNA, 25 bp, Mus musculus
gactcgctttaattattcctgtgtt

SEQ ID NO: 460882 - DNA, 25 bp, Mus musculus
gactcggaacaaccaaatgtccagg

SEQ ID NO: 460883 - DNA, 25 bp, Mus musculus
gactcggaacaagcaaatgtccagg

SEQ ID NO: 460884 - DNA, 25 bp, Mus musculus
gactcggaagggatattcattgact

SEQ ID NO: 460885 - DNA, 25 bp, Mus musculus
gactcggaagggttattcattgact

SEQ ID NO: 460886 - DNA, 25 bp, Mus musculus
gactcggacaagcaacagtggctat

SEQ ID NO: 460887 - DNA, 25 bp, Mus musculus
gactcggacaaggaacagtggctat

SEQ ID NO: 460888 - DNA, 25 bp, Mus musculus
gactcggagacacagttactgctgt

SEQ ID NO: 460889 - DNA, 25 bp, Mus musculus
gactcggagacagagttactgctgt

SEQ ID NO: 460890 - DNA, 25 bp, Mus musculus
gactcggatatcaacctcggaggga

SEQ ID NO: 460891 - DNA, 25 bp, Mus musculus
gactcggatatctacctcggaggga

SEQ ID NO: 460892 - DNA, 25 bp, Mus musculus
gactcggatgcacgaaaaacttgga

SEQ ID NO: 460893 - DNA, 25 bp, Mus musculus
gactcggatgcaggaaaaacttgga

SEQ ID NO: 460894 - DNA, 25 bp, Mus musculus
gactcggatgttaactgggatcact

SEQ ID NO: 460895 - DNA, 25 bp, Mus musculus
gactcggatgtttactgggatcact

SEQ ID NO: 460896 - DNA, 25 bp, Mus musculus
gactcggatttaaaagcatatttca

SEQ ID NO: 460897 - DNA, 25 bp, Mus musculus
gactcggatttataagcatatttca

SEQ ID NO: 460898 - DNA, 25 bp, Mus musculus
gactcggcctataaacattcctgta

SEQ ID NO: 460899 - DNA, 25 bp, Mus musculus
gactcggcctattaacattcctgta

SEQ ID NO: 460900 - DNA, 25 bp, Mus musculus
gactcggctcaactctcaaggacat

SEQ ID NO: 460901 - DNA, 25 bp, Mus musculus
gactcggctcaagtctcaaggacat

SEQ ID NO: 460902 - DNA, 25 bp, Mus musculus
gactcgggaagaatgtcctgcagaa

SEQ ID NO: 460903 - DNA, 25 bp, Mus musculus
gactcgggaagattgtcctgcagaa

SEQ ID NO: 460904 - DNA, 25 bp, Mus musculus
gactcgggaatcctgaagactctgg

SEQ ID NO: 460905 - DNA, 25 bp, Mus musculus
gactcgggaatcgtgaagactctgg

SEQ ID NO: 460906 - DNA, 25 bp, Mus musculus
gactcgggacacacagcttataaca

SEQ ID NO: 460907 - DNA, 25 bp, Mus musculus
gactcgggacactcagcttataaca

SEQ ID NO: 460908 - DNA, 25 bp, Mus musculus
gactcgggagatcgcttattgtgaa

SEQ ID NO: 460909 - DNA, 25 bp, Mus musculus
gactcgggagatggcttattgtgaa

SEQ ID NO: 460910 - DNA, 25 bp, Mus musculus
gactcgggcactcttgtcatcagag

SEQ ID NO: 460911 - DNA, 25 bp, Mus musculus
gactcgggcactgttgtcatcagag

SEQ ID NO: 460912 - DNA, 25 bp, Mus musculus
gactcgggccccactgtggagctgt

SEQ ID NO: 460913 - DNA, 25 bp, Mus musculus
gactcgggcccctctgtggagctgt

SEQ ID NO: 460914 - DNA, 25 bp, Mus musculus
gactcgggctccacacagaatgtga

SEQ ID NO: 460915 - DNA, 25 bp, Mus musculus
gactcgggctcctcacagaatgtga

SEQ ID NO: 460916 - DNA, 25 bp, Mus musculus
gactcgggtggaatctttgaaatca

SEQ ID NO: 460917 - DNA, 25 bp, Mus musculus
gactcgggtggattctttgaaatca

SEQ ID NO: 460918 - DNA, 25 bp, Mus musculus
gactcggtacaaagcttggtacaca

SEQ ID NO: 460919 - DNA, 25 bp, Mus musculus
gactcggtacaatgcttggtacaca

SEQ ID NO: 460920 - DNA, 25 bp, Mus musculus
gactcggtaggtagtatttgtgcat

SEQ ID NO: 460921 - DNA, 25 bp, Mus musculus
gactcggtaggttgtatttgtgcat

SEQ ID NO: 460922 - DNA, 25 bp, Mus musculus
gactcggtccacctgtgtaggttca

SEQ ID NO: 460923 - DNA, 25 bp, Mus musculus
gactcggtccacgtgtgtaggttca

SEQ ID NO: 460924 - DNA, 25 bp, Mus musculus
gactcggtcccacatcggctcaaat

SEQ ID NO: 460925 - DNA, 25 bp, Mus musculus
gactcggtcccagatcggctcaaat

SEQ ID NO: 460926 - DNA, 25 bp, Mus musculus
gactcggtctccatgaaagaagcag

SEQ ID NO: 460927 - DNA, 25 bp, Mus musculus
gactcggtctccttgaaagaagcag

SEQ ID NO: 460928 - DNA, 25 bp, Mus musculus
gactcggtgccacatgattcattgc

SEQ ID NO: 460929 - DNA, 25 bp, Mus musculus
gactcggtgccagatgattcattgc

SEQ ID NO: 460930 - DNA, 25 bp, Mus musculus
gactcgtcagagatcagtttttata

SEQ ID NO: 460931 - DNA, 25 bp, Mus musculus
gactcgtcagagttcagtttttata

SEQ ID NO: 460932 - DNA, 25 bp, Mus musculus
gactcgtctgccattgatatcagtg

SEQ ID NO: 460933 - DNA, 25 bp, Mus musculus
gactcgtctgcctttgatatcagtg

SEQ ID NO: 460934 - DNA, 25 bp, Mus musculus
gactcgtctggtatgctggtgggta

SEQ ID NO: 460935 - DNA, 25 bp, Mus musculus
gactcgtctggtttgctggtgggta

SEQ ID NO: 460936 - DNA, 25 bp, Mus musculus
gactcgtgacttactgcgttcagaa

SEQ ID NO: 460937 - DNA, 25 bp, Mus musculus
gactcgtgactttctgcgttcagaa

SEQ ID NO: 460938 - DNA, 25 bp, Mus musculus
gactcgtgagccctgtttcaccttg

SEQ ID NO: 460939 - DNA, 25 bp, Mus musculus
gactcgtgagccgtgtttcaccttg

SEQ ID NO: 460940 - DNA, 25 bp, Mus musculus
gactcgtgagtactcctttgaccta

SEQ ID NO: 460941 - DNA, 25 bp, Mus musculus
gactcgtgagtagtcctttgaccta

SEQ ID NO: 460942 - DNA, 25 bp, Mus musculus
gactcgtgcaatcttttctgtgcta

SEQ ID NO: 460943 - DNA, 25 bp, Mus musculus
gactcgtgcaatgttttctgtgcta

SEQ ID NO: 460944 - DNA, 25 bp, Mus musculus
gactcgtgcacaccagggaggcatt

SEQ ID NO: 460945 - DNA, 25 bp, Mus musculus
gactcgtgcacagcagggaggcatt

SEQ ID NO: 460946 - DNA, 25 bp, Mus musculus
gactcgtgccttagaagccataaga

SEQ ID NO: 460947 - DNA, 25 bp, Mus musculus
gactcgtgcctttgaagccataaga

SEQ ID NO: 460948 - DNA, 25 bp, Mus musculus
gactcgtggtgacctaacctgagaa

SEQ ID NO: 460949 - DNA, 25 bp, Mus musculus
gactcgtggtgagctaacctgagaa

SEQ ID NO: 460950 - DNA, 25 bp, Mus musculus
gactcgtgtgctatagaatcaactc

SEQ ID NO: 460951 - DNA, 25 bp, Mus musculus
gactcgtgtgctttagaatcaactc

SEQ ID NO: 460952 - DNA, 25 bp, Mus musculus
gactcgtgtggaacctgtgtgtgta

SEQ ID NO: 460953 - DNA, 25 bp, Mus musculus
gactcgtgtggatcctgtgtgtgta

SEQ ID NO: 460954 - DNA, 25 bp, Mus musculus
gactcgtgttacacagattttcaat

SEQ ID NO: 460955 - DNA, 25 bp, Mus musculus
gactcgtgttactcagattttcaat

SEQ ID NO: 460956 - DNA, 25 bp, Mus musculus
gactcgttccacaatcatggttgac

SEQ ID NO: 460957 - DNA, 25 bp, Mus musculus
gactcgttccactatcatggttgac

SEQ ID NO: 460958 - DNA, 25 bp, Mus musculus
gactcgttgctcaatagggtttatt

SEQ ID NO: 460959 - DNA, 25 bp, Mus musculus
gactcgttgctctatagggtttatt

SEQ ID NO: 460960 - DNA, 25 bp, Mus musculus
gactcgtttttaactgtttctgtga

SEQ ID NO: 460961 - DNA, 25 bp, Mus musculus
gactcgtttttatctgtttctgtga

SEQ ID NO: 460962 - DNA, 25 bp, Mus musculus
gactctaaaagcattctgtgcagga

SEQ ID NO: 460963 - DNA, 25 bp, Mus musculus
gactctaaaagctttctgtgcagga

SEQ ID NO: 460964 - DNA, 25 bp, Mus musculus
gactctaacagcagctgtaccatcc

SEQ ID NO: 460965 - DNA, 25 bp, Mus musculus
gactctaacagctgctgtaccatcc

SEQ ID NO: 460966 - DNA, 25 bp, Mus musculus
gactctaacaggagtgattgacgac

SEQ ID NO: 460967 - DNA, 25 bp, Mus musculus
gactctaacaggtgtgattgacgac

SEQ ID NO: 460968 - DNA, 25 bp, Mus musculus
gactctaagcaacataaagcaagcc

SEQ ID NO: 460969 - DNA, 25 bp, Mus musculus
gactctaagcaagataaagcaagcc

SEQ ID NO: 460970 - DNA, 25 bp, Mus musculus
gactctaagcagacagttttgatat

SEQ ID NO: 460971 - DNA, 25 bp, Mus musculus
gactctaagcagtcagttttgatat

SEQ ID NO: 460972 - DNA, 25 bp, Mus musculus
gactctaagtttactcaatacccta

SEQ ID NO: 460973 - DNA, 25 bp, Mus musculus
gactctaagttttctcaatacccta

SEQ ID NO: 460974 - DNA, 25 bp, Mus musculus
gactctaatagtattgtctcctttt

SEQ ID NO: 460975 - DNA, 25 bp, Mus musculus
gactctaatagttttgtctcctttt

SEQ ID NO: 460976 - DNA, 25 bp, Mus musculus
gactctaatgcccttactaactgta

SEQ ID NO: 460977 - DNA, 25 bp, Mus musculus
gactctaatgccgttactaactgta

SEQ ID NO: 460978 - DNA, 25 bp, Mus musculus
gactctaattctatgctttagacct

SEQ ID NO: 460979 - DNA, 25 bp, Mus musculus
gactctaattctttgctttagacct

SEQ ID NO: 460980 - DNA, 25 bp, Mus musculus
gactctacagccaatgagcttcttt

SEQ ID NO: 460981 - DNA, 25 bp, Mus musculus
gactctacagcctatgagcttcttt

SEQ ID NO: 460982 - DNA, 25 bp, Mus musculus
gactctacatttaggtccaccttat

SEQ ID NO: 460983 - DNA, 25 bp, Mus musculus
gactctacattttggtccaccttat

SEQ ID NO: 460984 - DNA, 25 bp, Mus musculus
gactctaccaccaaagggtcttgga

SEQ ID NO: 460985 - DNA, 25 bp, Mus musculus
gactctaccacctaagggtcttgga

SEQ ID NO: 460986 - DNA, 25 bp, Mus musculus
gactctacccgcaacaaattgaaat

SEQ ID NO: 460987 - DNA, 25 bp, Mus musculus
gactctacccgctacaaattgaaat

SEQ ID NO: 460988 - DNA, 25 bp, Mus musculus
gactctacctcaccggtctggaaga

SEQ ID NO: 460989 - DNA, 25 bp, Mus musculus
gactctacctcagcggtctggaaga

SEQ ID NO: 460990 - DNA, 25 bp, Mus musculus
gactctaccttgctttgaatcgcag

SEQ ID NO: 460991 - DNA, 25 bp, Mus musculus
gactctaccttggtttgaatcgcag

SEQ ID NO: 460992 - DNA, 25 bp, Mus musculus
gactctactgaactgaacaactgct

SEQ ID NO: 460993 - DNA, 25 bp, Mus musculus
gactctactgaagtgaacaactgct

SEQ ID NO: 460994 - DNA, 25 bp, Mus musculus
gactctactgctaagtacagccact

SEQ ID NO: 460995 - DNA, 25 bp, Mus musculus
gactctactgcttagtacagccact

SEQ ID NO: 460996 - DNA, 25 bp, Mus musculus
gactctactgtcacagaccttaggt

SEQ ID NO: 460997 - DNA, 25 bp, Mus musculus
gactctactgtctcagaccttaggt

SEQ ID NO: 460998 - DNA, 25 bp, Mus musculus
gactctactgttctaggacccagct

SEQ ID NO: 460999 - DNA, 25 bp, Mus musculus
gactctactgttgtaggacccagct

SEQ ID NO: 461000 - DNA, 25 bp, Mus musculus
gactctacttttaactgtctggaat

SEQ ID NO: 461001 - DNA, 25 bp, Mus musculus
gactctactttttactgtctggaat

SEQ ID NO: 461002 - DNA, 25 bp, Mus musculus
gactctagagccagaaccacgtgga

SEQ ID NO: 461003 - DNA, 25 bp, Mus musculus
gactctagagcctgaaccacgtgga

SEQ ID NO: 461004 - DNA, 25 bp, Mus musculus
gactctagcctcagggacacgtcag

SEQ ID NO: 461005 - DNA, 25 bp, Mus musculus
gactctagcctctgggacacgtcag

SEQ ID NO: 461006 - DNA, 25 bp, Mus musculus
gactctagcggcactgggcacattc

SEQ ID NO: 461007 - DNA, 25 bp, Mus musculus
gactctagcggctctgggcacattc

SEQ ID NO: 461008 - DNA, 25 bp, Mus musculus
gactctagctgccaaatggccatca

SEQ ID NO: 461009 - DNA, 25 bp, Mus musculus
gactctagctgcgaaatggccatca

SEQ ID NO: 461010 - DNA, 25 bp, Mus musculus
gactctagctggaagtcactaggct

SEQ ID NO: 461011 - DNA, 25 bp, Mus musculus
gactctagctggtagtcactaggct

SEQ ID NO: 461012 - DNA, 25 bp, Mus musculus
gactctagcttacatgtcatccctt

SEQ ID NO: 461013 - DNA, 25 bp, Mus musculus
gactctagcttagatgtcatccctt

SEQ ID NO: 461014 - DNA, 25 bp, Mus musculus
gactctaggactattcttctgattc

SEQ ID NO: 461015 - DNA, 25 bp, Mus musculus
gactctaggacttttcttctgattc

SEQ ID NO: 461016 - DNA, 25 bp, Mus musculus
gactctaggctacgctatggtgaat

SEQ ID NO: 461017 - DNA, 25 bp, Mus musculus
gactctaggctaggctatggtgaat

SEQ ID NO: 461018 - DNA, 25 bp, Mus musculus
gactctaggtagaatagttcattta

SEQ ID NO: 461019 - DNA, 25 bp, Mus musculus
gactctaggtagtatagttcattta

SEQ ID NO: 461020 - DNA, 25 bp, Mus musculus
gactctaggttgaaagtgttcgcaa

SEQ ID NO: 461021 - DNA, 25 bp, Mus musculus
gactctaggttgtaagtgttcgcaa

SEQ ID NO: 461022 - DNA, 25 bp, Mus musculus
gactctagtaagatgcttgcctatg

SEQ ID NO: 461023 - DNA, 25 bp, Mus musculus
gactctagtaagttgcttgcctatg

SEQ ID NO: 461024 - DNA, 25 bp, Mus musculus
gactctagtcacagccgttagcttt

SEQ ID NO: 461025 - DNA, 25 bp, Mus musculus
gactctagtcactgccgttagcttt

SEQ ID NO: 461026 - DNA, 25 bp, Mus musculus
gactctagtccgatacacatgttaa

SEQ ID NO: 461027 - DNA, 25 bp, Mus musculus
gactctagtccgttacacatgttaa

SEQ ID NO: 461028 - DNA, 25 bp, Mus musculus
gactctagttaacagctggaacccc

SEQ ID NO: 461029 - DNA, 25 bp, Mus musculus
gactctagttaagagctggaacccc

SEQ ID NO: 461030 - DNA, 25 bp, Mus musculus
gactctagtttactcacaggacgcc

SEQ ID NO: 461031 - DNA, 25 bp, Mus musculus
gactctagtttagtcacaggacgcc

SEQ ID NO: 461032 - DNA, 25 bp, Mus musculus
gactctataaaaaggctgttggctt

SEQ ID NO: 461033 - DNA, 25 bp, Mus musculus
gactctataaaatggctgttggctt

SEQ ID NO: 461034 - DNA, 25 bp, Mus musculus
gactctataagacagcctaagaagc

SEQ ID NO: 461035 - DNA, 25 bp, Mus musculus
gactctataagagagcctaagaagc

SEQ ID NO: 461036 - DNA, 25 bp, Mus musculus
gactctatagagatcagccagccta

SEQ ID NO: 461037 - DNA, 25 bp, Mus musculus
gactctatagagttcagccagccta

SEQ ID NO: 461038 - DNA, 25 bp, Mus musculus
gactctatagctatcagtgtattta

SEQ ID NO: 461039 - DNA, 25 bp, Mus musculus
gactctatagctttcagtgtattta

SEQ ID NO: 461040 - DNA, 25 bp, Mus musculus
gactctatagtgctatgatccctat

SEQ ID NO: 461041 - DNA, 25 bp, Mus musculus
gactctatagtggtatgatccctat

SEQ ID NO: 461042 - DNA, 25 bp, Mus musculus
gactctatatccatgtacatattga

SEQ ID NO: 461043 - DNA, 25 bp, Mus musculus
gactctatatccttgtacatattga

SEQ ID NO: 461044 - DNA, 25 bp, Mus musculus
gactctatcaggagcttattgacac

SEQ ID NO: 461045 - DNA, 25 bp, Mus musculus
gactctatcaggtgcttattgacac

SEQ ID NO: 461046 - DNA, 25 bp, Mus musculus
gactctatcccaccctacagatgaa

SEQ ID NO: 461047 - DNA, 25 bp, Mus musculus
gactctatcccagcctacagatgaa

SEQ ID NO: 461048 - DNA, 25 bp, Mus musculus
gactctatcgatcttctatttttgg

SEQ ID NO: 461049 - DNA, 25 bp, Mus musculus
gactctatcgatgttctatttttgg

SEQ ID NO: 461050 - DNA, 25 bp, Mus musculus
gactctatgagaaccaggcacctga

SEQ ID NO: 461051 - DNA, 25 bp, Mus musculus
gactctatgagatccaggcacctga

SEQ ID NO: 461052 - DNA, 25 bp, Mus musculus
gactctatgagcaaccacagtggca

SEQ ID NO: 461053 - DNA, 25 bp, Mus musculus
gactctatgagctaccacagtggca

SEQ ID NO: 461054 - DNA, 25 bp, Mus musculus
gactctatgaggcaccaagacccgg

SEQ ID NO: 461055 - DNA, 25 bp, Mus musculus
gactctatgagggaccaagacccgg

SEQ ID NO: 461056 - DNA, 25 bp, Mus musculus
gactctatgccacgccggttggata

SEQ ID NO: 461057 - DNA, 25 bp, Mus musculus
gactctatgccaggccggttggata

SEQ ID NO: 461058 - DNA, 25 bp, Mus musculus
gactctatggaacatgccaacaaga

SEQ ID NO: 461059 - DNA, 25 bp, Mus musculus
gactctatggaagatgccaacaaga

SEQ ID NO: 461060 - DNA, 25 bp, Mus musculus
gactctatggaccaggaagccttcc

SEQ ID NO: 461061 - DNA, 25 bp, Mus musculus
gactctatggacgaggaagccttcc

SEQ ID NO: 461062 - DNA, 25 bp, Mus musculus
gactctattataagactgcaagcag

SEQ ID NO: 461063 - DNA, 25 bp, Mus musculus
gactctattatatgactgcaagcag

SEQ ID NO: 461064 - DNA, 25 bp, Mus musculus
gactctattatcactaacaatgact

SEQ ID NO: 461065 - DNA, 25 bp, Mus musculus
gactctattatctctaacaatgact

SEQ ID NO: 461066 - DNA, 25 bp, Mus musculus
gactctattcaacattcattctcca

SEQ ID NO: 461067 - DNA, 25 bp, Mus musculus
gactctattcaagattcattctcca

SEQ ID NO: 461068 - DNA, 25 bp, Mus musculus
gactctattcatactagatactcca

SEQ ID NO: 461069 - DNA, 25 bp, Mus musculus
gactctattcattctagatactcca

SEQ ID NO: 461070 - DNA, 25 bp, Mus musculus
gactctattccaagctcaggctggg

SEQ ID NO: 461071 - DNA, 25 bp, Mus musculus
gactctattccatgctcaggctggg

SEQ ID NO: 461072 - DNA, 25 bp, Mus musculus
gactctattctccaggttgtccaga

SEQ ID NO: 461073 - DNA, 25 bp, Mus musculus
gactctattctcgaggttgtccaga

SEQ ID NO: 461074 - DNA, 25 bp, Mus musculus
gactctattcttcgttggtgaccat

SEQ ID NO: 461075 - DNA, 25 bp, Mus musculus
gactctattcttggttggtgaccat

SEQ ID NO: 461076 - DNA, 25 bp, Mus musculus
gactctcaaatcaaaattggccaaa

SEQ ID NO: 461077 - DNA, 25 bp, Mus musculus
gactctcaaatctaaattggccaaa

SEQ ID NO: 461078 - DNA, 25 bp, Mus musculus
gactctcaagaacgtgcaggctctc

SEQ ID NO: 461079 - DNA, 25 bp, Mus musculus
gactctcaagaaggtgcaggctctc

SEQ ID NO: 461080 - DNA, 25 bp, Mus musculus
gactctcaagctagcagagagctct

SEQ ID NO: 461081 - DNA, 25 bp, Mus musculus
gactctcaagcttgcagagagctct

SEQ ID NO: 461082 - DNA, 25 bp, Mus musculus
gactctcaagtcagatgttctagaa

SEQ ID NO: 461083 - DNA, 25 bp, Mus musculus
gactctcaagtctgatgttctagaa

SEQ ID NO: 461084 - DNA, 25 bp, Mus musculus
gactctcacagaaccatcctgaagt

SEQ ID NO: 461085 - DNA, 25 bp, Mus musculus
gactctcacagatccatcctgaagt

SEQ ID NO: 461086 - DNA, 25 bp, Mus musculus
gactctcaccctcatagctgctgaa

SEQ ID NO: 461087 - DNA, 25 bp, Mus musculus
gactctcaccctgatagctgctgaa

SEQ ID NO: 461088 - DNA, 25 bp, Mus musculus
gactctcactgtacataaggcgggc

SEQ ID NO: 461089 - DNA, 25 bp, Mus musculus
gactctcactgtaggatgacttctg

SEQ ID NO: 461090 - DNA, 25 bp, Mus musculus
gactctcactgttcataaggcgggc

SEQ ID NO: 461091 - DNA, 25 bp, Mus musculus
gactctcactgttggatgacttctg

SEQ ID NO: 461092 - DNA, 25 bp, Mus musculus
gactctcagatacctagctttcttg

SEQ ID NO: 461093 - DNA, 25 bp, Mus musculus
gactctcagatagctagctttcttg

SEQ ID NO: 461094 - DNA, 25 bp, Mus musculus
gactctcagcagagccagtgctgcc

SEQ ID NO: 461095 - DNA, 25 bp, Mus musculus
gactctcagcagcatgatcatggcc

SEQ ID NO: 461096 - DNA, 25 bp, Mus musculus
gactctcagcaggatgatcatggcc

SEQ ID NO: 461097 - DNA, 25 bp, Mus musculus
gactctcagcagtgccagtgctgcc

SEQ ID NO: 461098 - DNA, 25 bp, Mus musculus
gactctcagcccacttgtgagactt

SEQ ID NO: 461099 - DNA, 25 bp, Mus musculus
gactctcagccctcttgtgagactt

SEQ ID NO: 461100 - DNA, 25 bp, Mus musculus
gactctcaggcacgaagggaccctt

SEQ ID NO: 461101 - DNA, 25 bp, Mus musculus
gactctcaggcaggaagggaccctt

SEQ ID NO: 461102 - DNA, 25 bp, Mus musculus
gactctcaggccatagggcagaagt

SEQ ID NO: 461103 - DNA, 25 bp, Mus musculus
gactctcaggccttagggcagaagt

SEQ ID NO: 461104 - DNA, 25 bp, Mus musculus
gactctcaggctatgtggcacatag

SEQ ID NO: 461105 - DNA, 25 bp, Mus musculus
gactctcaggctctatgtagctttt

SEQ ID NO: 461106 - DNA, 25 bp, Mus musculus
gactctcaggctgtatgtagctttt

SEQ ID NO: 461107 - DNA, 25 bp, Mus musculus
gactctcaggctttgtggcacatag

SEQ ID NO: 461108 - DNA, 25 bp, Mus musculus
gactctcagggaatctgagcccaga

SEQ ID NO: 461109 - DNA, 25 bp, Mus musculus
gactctcagggattctgagcccaga

SEQ ID NO: 461110 - DNA, 25 bp, Mus musculus
gactctcagggtcgaactgactttt

SEQ ID NO: 461111 - DNA, 25 bp, Mus musculus
gactctcagggtggaactgactttt

SEQ ID NO: 461112 - DNA, 25 bp, Mus musculus
gactctcagtagcatcacaagccaa

SEQ ID NO: 461113 - DNA, 25 bp, Mus musculus
gactctcagtaggatcacaagccaa

SEQ ID NO: 461114 - DNA, 25 bp, Mus musculus
gactctcagtgactactcattttgt

SEQ ID NO: 461115 - DNA, 25 bp, Mus musculus
gactctcagtgagtactcattttgt

SEQ ID NO: 461116 - DNA, 25 bp, Mus musculus
gactctcagtttaacctgttgacag

SEQ ID NO: 461117 - DNA, 25 bp, Mus musculus
gactctcagttttacctgttgacag

SEQ ID NO: 461118 - DNA, 25 bp, Mus musculus
gactctcatagccagcaggacgtta

SEQ ID NO: 461119 - DNA, 25 bp, Mus musculus
gactctcatagcgagcaggacgtta

SEQ ID NO: 461120 - DNA, 25 bp, Mus musculus
gactctcatgtgctgcaataagcaa

SEQ ID NO: 461121 - DNA, 25 bp, Mus musculus
gactctcatgtggtgcaataagcaa

SEQ ID NO: 461122 - DNA, 25 bp, Mus musculus
gactctccaaatacttgcctgtcga

SEQ ID NO: 461123 - DNA, 25 bp, Mus musculus
gactctccaaattcttgcctgtcga

SEQ ID NO: 461124 - DNA, 25 bp, Mus musculus
gactctccaactataggaacctcga

SEQ ID NO: 461125 - DNA, 25 bp, Mus musculus
gactctccaactttaggaacctcga

SEQ ID NO: 461126 - DNA, 25 bp, Mus musculus
gactctccacagatccgaagacggg

SEQ ID NO: 461127 - DNA, 25 bp, Mus musculus
gactctccacagttccgaagacggg

SEQ ID NO: 461128 - DNA, 25 bp, Mus musculus
gactctccacatcatcttaggacct

SEQ ID NO: 461129 - DNA, 25 bp, Mus musculus
gactctccacatgatcttaggacct

SEQ ID NO: 461130 - DNA, 25 bp, Mus musculus
gactctccagagacattacagggca

SEQ ID NO: 461131 - DNA, 25 bp, Mus musculus
gactctccagagtcattacagggca

SEQ ID NO: 461132 - DNA, 25 bp, Mus musculus
gactctccaggacagttttagctct

SEQ ID NO: 461133 - DNA, 25 bp, Mus musculus
gactctccaggagagttttagctct

SEQ ID NO: 461134 - DNA, 25 bp, Mus musculus
gactctccagtgagtcttaaaagta

SEQ ID NO: 461135 - DNA, 25 bp, Mus musculus
gactctccagtgtgtcttaaaagta

SEQ ID NO: 461136 - DNA, 25 bp, Mus musculus
gactctccatctagaactttcgggt

SEQ ID NO: 461137 - DNA, 25 bp, Mus musculus
gactctccatcttgaactttcgggt

SEQ ID NO: 461138 - DNA, 25 bp, Mus musculus
gactctccattcaaggtcgcaggaa

SEQ ID NO: 461139 - DNA, 25 bp, Mus musculus
gactctccattctaggtcgcaggaa

SEQ ID NO: 461140 - DNA, 25 bp, Mus musculus
gactctccatttatacatgagtgtt

SEQ ID NO: 461141 - DNA, 25 bp, Mus musculus
gactctccatttttacatgagtgtt

SEQ ID NO: 461142 - DNA, 25 bp, Mus musculus
gactctccccttcgaaataacaatt

SEQ ID NO: 461143 - DNA, 25 bp, Mus musculus
gactctccccttggaaataacaatt

SEQ ID NO: 461144 - DNA, 25 bp, Mus musculus
gactctcccgatcggacggatgtat

SEQ ID NO: 461145 - DNA, 25 bp, Mus musculus
gactctcccgatgggacggatgtat

SEQ ID NO: 461146 - DNA, 25 bp, Mus musculus
gactctccctttccatagtggttga

SEQ ID NO: 461147 - DNA, 25 bp, Mus musculus
gactctccctttgcatagtggttga

SEQ ID NO: 461148 - DNA, 25 bp, Mus musculus
gactctccggtccatatatggttga

SEQ ID NO: 461149 - DNA, 25 bp, Mus musculus
gactctccggtcgatatatggttga

SEQ ID NO: 461150 - DNA, 25 bp, Mus musculus
gactctcctcaccacgttgggaagt

SEQ ID NO: 461151 - DNA, 25 bp, Mus musculus
gactctcctcacgacgttgggaagt

SEQ ID NO: 461152 - DNA, 25 bp, Mus musculus
gactctcctgtgcatgtgcatatct

SEQ ID NO: 461153 - DNA, 25 bp, Mus musculus
gactctcctgtggatgtgcatatct

SEQ ID NO: 461154 - DNA, 25 bp, Mus musculus
gactctccttatagctctgaggcat

SEQ ID NO: 461155 - DNA, 25 bp, Mus musculus
gactctccttattgctctgaggcat

SEQ ID NO: 461156 - DNA, 25 bp, Mus musculus
gactctcgcacaacatatgcactag

SEQ ID NO: 461157 - DNA, 25 bp, Mus musculus
gactctcgcacatcatatgcactag

SEQ ID NO: 461158 - DNA, 25 bp, Mus musculus
gactctcggaccagcaagggacttt

SEQ ID NO: 461159 - DNA, 25 bp, Mus musculus
gactctcggacctgcaagggacttt

SEQ ID NO: 461160 - DNA, 25 bp, Mus musculus
gactctcggatgaagaaggatcaga

SEQ ID NO: 461161 - DNA, 25 bp, Mus musculus
gactctcggatgtagaaggatcaga

SEQ ID NO: 461162 - DNA, 25 bp, Mus musculus
gactctcggcaccattgtctccgga

SEQ ID NO: 461163 - DNA, 25 bp, Mus musculus
gactctcggcacgattgtctccgga

SEQ ID NO: 461164 - DNA, 25 bp, Mus musculus
gactctctagtgctttttcgaagaa

SEQ ID NO: 461165 - DNA, 25 bp, Mus musculus
gactctctagtggtttttcgaagaa

SEQ ID NO: 461166 - DNA, 25 bp, Mus musculus
gactctctcaatctttaaacacctt

SEQ ID NO: 461167 - DNA, 25 bp, Mus musculus
gactctctcaatgtttaaacacctt

SEQ ID NO: 461168 - DNA, 25 bp, Mus musculus
gactctctcgccagctgtaaactgt

SEQ ID NO: 461169 - DNA, 25 bp, Mus musculus
gactctctcgcctgctgtaaactgt

SEQ ID NO: 461170 - DNA, 25 bp, Mus musculus
gactctctctgcaccgtttatttgt

SEQ ID NO: 461171 - DNA, 25 bp, Mus musculus
gactctctctgctccgtttatttgt

SEQ ID NO: 461172 - DNA, 25 bp, Mus musculus
gactctctctggctcatttcagtga

SEQ ID NO: 461173 - DNA, 25 bp, Mus musculus
gactctctctgggtcatttcagtga

SEQ ID NO: 461174 - DNA, 25 bp, Mus musculus
gactctctgacaagtgttaaaggta

SEQ ID NO: 461175 - DNA, 25 bp, Mus musculus
gactctctgacatgtgttaaaggta

SEQ ID NO: 461176 - DNA, 25 bp, Mus musculus
gactctctgagaatttcacatcata

SEQ ID NO: 461177 - DNA, 25 bp, Mus musculus
gactctctgagattttcacatcata

SEQ ID NO: 461178 - DNA, 25 bp, Mus musculus
gactctctgccactgatgaaaatat

SEQ ID NO: 461179 - DNA, 25 bp, Mus musculus
gactctctgccagtgatgaaaatat

SEQ ID NO: 461180 - DNA, 25 bp, Mus musculus
gactctctgcctattcagcatgtaa

SEQ ID NO: 461181 - DNA, 25 bp, Mus musculus
gactctctgccttttcagcatgtaa

SEQ ID NO: 461182 - DNA, 25 bp, Mus musculus
gactctctggatcacagtggcagct

SEQ ID NO: 461183 - DNA, 25 bp, Mus musculus
gactctctggatgacagtggcagct

SEQ ID NO: 461184 - DNA, 25 bp, Mus musculus
gactctctgtataatcctctgctac

SEQ ID NO: 461185 - DNA, 25 bp, Mus musculus
gactctctgtattatcctctgctac

SEQ ID NO: 461186 - DNA, 25 bp, Mus musculus
gactctcttagtattctttcttata

SEQ ID NO: 461187 - DNA, 25 bp, Mus musculus
gactctcttagttttctttcttata

SEQ ID NO: 461188 - DNA, 25 bp, Mus musculus
gactctcttctacaatcaggctctg

SEQ ID NO: 461189 - DNA, 25 bp, Mus musculus
gactctcttctagaatcaggctctg

SEQ ID NO: 461190 - DNA, 25 bp, Mus musculus
gactctcttgtgacctgagtttaga

SEQ ID NO: 461191 - DNA, 25 bp, Mus musculus
gactctcttgtgtcctgagtttaga

SEQ ID NO: 461192 - DNA, 25 bp, Mus musculus
gactctgaaaagctcatttggacag

SEQ ID NO: 461193 - DNA, 25 bp, Mus musculus
gactctgaaaaggtcatttggacag

SEQ ID NO: 461194 - DNA, 25 bp, Mus musculus
gactctgaacatctgattcggactt

SEQ ID NO: 461195 - DNA, 25 bp, Mus musculus
gactctgaacatgtgattcggactt

SEQ ID NO: 461196 - DNA, 25 bp, Mus musculus
gactctgaacgcatattaaaactga

SEQ ID NO: 461197 - DNA, 25 bp, Mus musculus
gactctgaacgcttattaaaactga

SEQ ID NO: 461198 - DNA, 25 bp, Mus musculus
gactctgaactcagagatatcttgg

SEQ ID NO: 461199 - DNA, 25 bp, Mus musculus
gactctgaactctgagatatcttgg

SEQ ID NO: 461200 - DNA, 25 bp, Mus musculus
gactctgaacttatctgctttggca

SEQ ID NO: 461201 - DNA, 25 bp, Mus musculus
gactctgaacttttctgctttggca

SEQ ID NO: 461202 - DNA, 25 bp, Mus musculus
gactctgaagctatgtgtgctagta

SEQ ID NO: 461203 - DNA, 25 bp, Mus musculus
gactctgaagctttgtgtgctagta

SEQ ID NO: 461204 - DNA, 25 bp, Mus musculus
gactctgaaggtctggtcctgccag

SEQ ID NO: 461205 - DNA, 25 bp, Mus musculus
gactctgaaggtgtggtcctgccag

SEQ ID NO: 461206 - DNA, 25 bp, Mus musculus
gactctgaagtcaggtagcctgtga

SEQ ID NO: 461207 - DNA, 25 bp, Mus musculus
gactctgaagtctggtagcctgtga

SEQ ID NO: 461208 - DNA, 25 bp, Mus musculus
gactctgaagttaggtggtcatgtc

SEQ ID NO: 461209 - DNA, 25 bp, Mus musculus
gactctgaagtttggtggtcatgtc

SEQ ID NO: 461210 - DNA, 25 bp, Mus musculus
gactctgaatagctcttgtctgctg

SEQ ID NO: 461211 - DNA, 25 bp, Mus musculus
gactctgaataggtcttgtctgctg

SEQ ID NO: 461212 - DNA, 25 bp, Mus musculus
gactctgaatggagaggtttcctcc

SEQ ID NO: 461213 - DNA, 25 bp, Mus musculus
gactctgaatggtgaggtttcctcc

SEQ ID NO: 461214 - DNA, 25 bp, Mus musculus
gactctgacactacaggaacctcaa

SEQ ID NO: 461215 - DNA, 25 bp, Mus musculus
gactctgacactagatggctgattt

SEQ ID NO: 461216 - DNA, 25 bp, Mus musculus
gactctgacacttcaggaacctcaa

SEQ ID NO: 461217 - DNA, 25 bp, Mus musculus
gactctgacacttgatggctgattt

SEQ ID NO: 461218 - DNA, 25 bp, Mus musculus
gactctgacatcattataattcacc

SEQ ID NO: 461219 - DNA, 25 bp, Mus musculus
gactctgacatctttataattcacc

SEQ ID NO: 461220 - DNA, 25 bp, Mus musculus
gactctgacatgcaggtcccaggaa

SEQ ID NO: 461221 - DNA, 25 bp, Mus musculus
gactctgacatggaggtcccaggaa

SEQ ID NO: 461222 - DNA, 25 bp, Mus musculus
gactctgacattagcgtataggctg

SEQ ID NO: 461223 - DNA, 25 bp, Mus musculus
gactctgacatttgcgtataggctg

SEQ ID NO: 461224 - DNA, 25 bp, Mus musculus
gactctgaccatagctgatggcaca

SEQ ID NO: 461225 - DNA, 25 bp, Mus musculus
gactctgaccattgctgatggcaca

SEQ ID NO: 461226 - DNA, 25 bp, Mus musculus
gactctgaccgactcgtctttacaa

SEQ ID NO: 461227 - DNA, 25 bp, Mus musculus
gactctgaccgagtcgtctttacaa

SEQ ID NO: 461228 - DNA, 25 bp, Mus musculus
gactctgaccttaaatactgagcgc

SEQ ID NO: 461229 - DNA, 25 bp, Mus musculus
gactctgacctttaatactgagcgc

SEQ ID NO: 461230 - DNA, 25 bp, Mus musculus
gactctgacggacacatcattctac

SEQ ID NO: 461231 - DNA, 25 bp, Mus musculus
gactctgacggagacatcattctac

SEQ ID NO: 461232 - DNA, 25 bp, Mus musculus
gactctgactacatgcttatttttg

SEQ ID NO: 461233 - DNA, 25 bp, Mus musculus
gactctgactacttgcttatttttg

SEQ ID NO: 461234 - DNA, 25 bp, Mus musculus
gactctgactcactgtttgcctgta

SEQ ID NO: 461235 - DNA, 25 bp, Mus musculus
gactctgactcagtgtttgcctgta

SEQ ID NO: 461236 - DNA, 25 bp, Mus musculus
gactctgactccattagttttatac

SEQ ID NO: 461237 - DNA, 25 bp, Mus musculus
gactctgactcctttagttttatac

SEQ ID NO: 461238 - DNA, 25 bp, Mus musculus
gactctgactctcagtgaagtttta

SEQ ID NO: 461239 - DNA, 25 bp, Mus musculus
gactctgactctgagtgaagtttta

SEQ ID NO: 461240 - DNA, 25 bp, Mus musculus
gactctgactgtctgcatgttggca

SEQ ID NO: 461241 - DNA, 25 bp, Mus musculus
gactctgactgtgtgcatgttggca

SEQ ID NO: 461242 - DNA, 25 bp, Mus musculus
gactctgacttccaggtggtgtacc

SEQ ID NO: 461243 - DNA, 25 bp, Mus musculus
gactctgacttcgaggtggtgtacc

SEQ ID NO: 461244 - DNA, 25 bp, Mus musculus
gactctgactttcagacggtgtacc

SEQ ID NO: 461245 - DNA, 25 bp, Mus musculus
gactctgactttgagacggtgtacc

SEQ ID NO: 461246 - DNA, 25 bp, Mus musculus
gactctgagagaccaatgccacgac

SEQ ID NO: 461247 - DNA, 25 bp, Mus musculus
gactctgagagagcaatgccacgac

SEQ ID NO: 461248 - DNA, 25 bp, Mus musculus
gactctgagagtcacactttctcgt

SEQ ID NO: 461249 - DNA, 25 bp, Mus musculus
gactctgagagtgacactttctcgt

SEQ ID NO: 461250 - DNA, 25 bp, Mus musculus
gactctgagattctgagctgggaat

SEQ ID NO: 461251 - DNA, 25 bp, Mus musculus
gactctgagattgtgagctgggaat

SEQ ID NO: 461252 - DNA, 25 bp, Mus musculus
gactctgagcaccaagctggcggac

SEQ ID NO: 461253 - DNA, 25 bp, Mus musculus
gactctgagcacgaagctggcggac

SEQ ID NO: 461254 - DNA, 25 bp, Mus musculus
gactctgagctcatttatactgtca

SEQ ID NO: 461255 - DNA, 25 bp, Mus musculus
gactctgagctcttttatactgtca

SEQ ID NO: 461256 - DNA, 25 bp, Mus musculus
gactctgaggccaggtgtgaagctt

SEQ ID NO: 461257 - DNA, 25 bp, Mus musculus
gactctgaggcctggtgtgaagctt

SEQ ID NO: 461258 - DNA, 25 bp, Mus musculus
gactctgagggaatctatttcttag

SEQ ID NO: 461259 - DNA, 25 bp, Mus musculus
gactctgagggattctatttcttag

SEQ ID NO: 461260 - DNA, 25 bp, Mus musculus
gactctgagtagctcagccagccca

SEQ ID NO: 461261 - DNA, 25 bp, Mus musculus
gactctgagtaggtcagccagccca

SEQ ID NO: 461262 - DNA, 25 bp, Mus musculus
gactctgagtgaaggaactagaccc

SEQ ID NO: 461263 - DNA, 25 bp, Mus musculus
gactctgagtgatggaactagaccc

SEQ ID NO: 461264 - DNA, 25 bp, Mus musculus
gactctgagttgatcttttctccac

SEQ ID NO: 461265 - DNA, 25 bp, Mus musculus
gactctgagttgttcttttctccac

SEQ ID NO: 461266 - DNA, 25 bp, Mus musculus
gactctgataaaacatctccggtat

SEQ ID NO: 461267 - DNA, 25 bp, Mus musculus
gactctgataaatcatctccggtat

SEQ ID NO: 461268 - DNA, 25 bp, Mus musculus
gactctgataatagaccctggtgtt

SEQ ID NO: 461269 - DNA, 25 bp, Mus musculus
gactctgataattgaccctggtgtt

SEQ ID NO: 461270 - DNA, 25 bp, Mus musculus
gactctgatactaccacaagatgtt

SEQ ID NO: 461271 - DNA, 25 bp, Mus musculus
gactctgatactctctgggttctga

SEQ ID NO: 461272 - DNA, 25 bp, Mus musculus
gactctgatactgtctgggttctga

SEQ ID NO: 461273 - DNA, 25 bp, Mus musculus
gactctgatacttccacaagatgtt

SEQ ID NO: 461274 - DNA, 25 bp, Mus musculus
gactctgatctgctcaggtcagtga

SEQ ID NO: 461275 - DNA, 25 bp, Mus musculus
gactctgatctggtcaggtcagtga

SEQ ID NO: 461276 - DNA, 25 bp, Mus musculus
gactctgatgtaaagccttgccaac

SEQ ID NO: 461277 - DNA, 25 bp, Mus musculus
gactctgatgtatagccttgccaac

SEQ ID NO: 461278 - DNA, 25 bp, Mus musculus
gactctgatgttaccagctcatagt

SEQ ID NO: 461279 - DNA, 25 bp, Mus musculus
gactctgatgttcactgtaccgata

SEQ ID NO: 461280 - DNA, 25 bp, Mus musculus
gactctgatgttgactgtaccgata

SEQ ID NO: 461281 - DNA, 25 bp, Mus musculus
gactctgatgtttccagctcatagt

SEQ ID NO: 461282 - DNA, 25 bp, Mus musculus
gactctgattctaccaaagagccgt

SEQ ID NO: 461283 - DNA, 25 bp, Mus musculus
gactctgattctccaaggcattcca

SEQ ID NO: 461284 - DNA, 25 bp, Mus musculus
gactctgattctgcaaggcattcca

SEQ ID NO: 461285 - DNA, 25 bp, Mus musculus
gactctgattcttccaaagagccgt

SEQ ID NO: 461286 - DNA, 25 bp, Mus musculus
gactctgatttcagggtcctatgac

SEQ ID NO: 461287 - DNA, 25 bp, Mus musculus
gactctgatttctgggtcctatgac

SEQ ID NO: 461288 - DNA, 25 bp, Mus musculus
gactctgcaaacctcttttacgcca

SEQ ID NO: 461289 - DNA, 25 bp, Mus musculus
gactctgcaaacgtcttttacgcca

SEQ ID NO: 461290 - DNA, 25 bp, Mus musculus
gactctgcaaggacttctgactcaa

SEQ ID NO: 461291 - DNA, 25 bp, Mus musculus
gactctgcaaggtcttctgactcaa

SEQ ID NO: 461292 - DNA, 25 bp, Mus musculus
gactctgcagtccaggtgtgtctat

SEQ ID NO: 461293 - DNA, 25 bp, Mus musculus
gactctgcagtcgaggtgtgtctat

SEQ ID NO: 461294 - DNA, 25 bp, Mus musculus
gactctgcagttcctagtgctggac

SEQ ID NO: 461295 - DNA, 25 bp, Mus musculus
gactctgcagttcgctgttcattta

SEQ ID NO: 461296 - DNA, 25 bp, Mus musculus
gactctgcagttgctagtgctggac

SEQ ID NO: 461297 - DNA, 25 bp, Mus musculus
gactctgcagttggctgttcattta

SEQ ID NO: 461298 - DNA, 25 bp, Mus musculus
gactctgcatttctggtagcagtta

SEQ ID NO: 461299 - DNA, 25 bp, Mus musculus
gactctgcatttgtggtagcagtta

SEQ ID NO: 461300 - DNA, 25 bp, Mus musculus
gactctgccaatatcttgtcaggga

SEQ ID NO: 461301 - DNA, 25 bp, Mus musculus
gactctgccaatttcttgtcaggga

SEQ ID NO: 461302 - DNA, 25 bp, Mus musculus
gactctgccccacgagcttggcagg

SEQ ID NO: 461303 - DNA, 25 bp, Mus musculus
gactctgccccaggagcttggcagg

SEQ ID NO: 461304 - DNA, 25 bp, Mus musculus
gactctgccggcatgtggccaggaa

SEQ ID NO: 461305 - DNA, 25 bp, Mus musculus
gactctgccggcttgtggccaggaa

SEQ ID NO: 461306 - DNA, 25 bp, Mus musculus
gactctgcctacaggagtgtgcctt

SEQ ID NO: 461307 - DNA, 25 bp, Mus musculus
gactctgcctactggagtgtgcctt

SEQ ID NO: 461308 - DNA, 25 bp, Mus musculus
gactctgcctcgcgatctgatgaat

SEQ ID NO: 461309 - DNA, 25 bp, Mus musculus
gactctgcctcgggatctgatgaat

SEQ ID NO: 461310 - DNA, 25 bp, Mus musculus
gactctgctacaaacagggtccatg

SEQ ID NO: 461311 - DNA, 25 bp, Mus musculus
gactctgctacatacagggtccatg

SEQ ID NO: 461312 - DNA, 25 bp, Mus musculus
gactctgctagcatgacaggagctc

SEQ ID NO: 461313 - DNA, 25 bp, Mus musculus
gactctgctagcttgacaggagctc

SEQ ID NO: 461314 - DNA, 25 bp, Mus musculus
gactctgctcataagttacctagca

SEQ ID NO: 461315 - DNA, 25 bp, Mus musculus
gactctgctcattagttacctagca

SEQ ID NO: 461316 - DNA, 25 bp, Mus musculus
gactctgctgcaatttacacacgtg

SEQ ID NO: 461317 - DNA, 25 bp, Mus musculus
gactctgctgcattttacacacgtg

SEQ ID NO: 461318 - DNA, 25 bp, Mus musculus
gactctgctgttacaagcgtggact

SEQ ID NO: 461319 - DNA, 25 bp, Mus musculus
gactctgctgtttcaagcgtggact

SEQ ID NO: 461320 - DNA, 25 bp, Mus musculus
gactctgcttttaaccttgatcaaa

SEQ ID NO: 461321 - DNA, 25 bp, Mus musculus
gactctgctttttaccttgatcaaa

SEQ ID NO: 461322 - DNA, 25 bp, Mus musculus
gactctggaaacaaagccttttaca

SEQ ID NO: 461323 - DNA, 25 bp, Mus musculus
gactctggaaactaagccttttaca

SEQ ID NO: 461324 - DNA, 25 bp, Mus musculus
gactctggacttacaaaggcttggg

SEQ ID NO: 461325 - DNA, 25 bp, Mus musculus
gactctggactttcaaaggcttggg

SEQ ID NO: 461326 - DNA, 25 bp, Mus musculus
gactctggagagcaattactgttca

SEQ ID NO: 461327 - DNA, 25 bp, Mus musculus
gactctggagaggaattactgttca

SEQ ID NO: 461328 - DNA, 25 bp, Mus musculus
gactctggagccctacgaaagggac

SEQ ID NO: 461329 - DNA, 25 bp, Mus musculus
gactctggagccgtacgaaagggac

SEQ ID NO: 461330 - DNA, 25 bp, Mus musculus
gactctggagtcacagggacctcag

SEQ ID NO: 461331 - DNA, 25 bp, Mus musculus
gactctggagtctcagggacctcag

SEQ ID NO: 461332 - DNA, 25 bp, Mus musculus
gactctggatctatctatcaaagct

SEQ ID NO: 461333 - DNA, 25 bp, Mus musculus
gactctggatctttctatcaaagct

SEQ ID NO: 461334 - DNA, 25 bp, Mus musculus
gactctggattcaaaatttggttca

SEQ ID NO: 461335 - DNA, 25 bp, Mus musculus
gactctggattctaaatttggttca

SEQ ID NO: 461336 - DNA, 25 bp, Mus musculus
gactctggcaatagggtttttcgaa

SEQ ID NO: 461337 - DNA, 25 bp, Mus musculus
gactctggcaattgggtttttcgaa

SEQ ID NO: 461338 - DNA, 25 bp, Mus musculus
gactctggcagactgctcagattga

SEQ ID NO: 461339 - DNA, 25 bp, Mus musculus
gactctggcagagtgctcagattga

SEQ ID NO: 461340 - DNA, 25 bp, Mus musculus
gactctggcatgagatcatttttga

SEQ ID NO: 461341 - DNA, 25 bp, Mus musculus
gactctggcatgtgatcatttttga

SEQ ID NO: 461342 - DNA, 25 bp, Mus musculus
gactctggccagatggaagtgtctc

SEQ ID NO: 461343 - DNA, 25 bp, Mus musculus
gactctggccagcacttcttacaag

SEQ ID NO: 461344 - DNA, 25 bp, Mus musculus
gactctggccaggacttcttacaag

SEQ ID NO: 461345 - DNA, 25 bp, Mus musculus
gactctggccagttggaagtgtctc

SEQ ID NO: 461346 - DNA, 25 bp, Mus musculus
gactctggccctcattttatactta

SEQ ID NO: 461347 - DNA, 25 bp, Mus musculus
gactctggccctgattttatactta

SEQ ID NO: 461348 - DNA, 25 bp, Mus musculus
gactctggcctaagaattcgtttaa

SEQ ID NO: 461349 - DNA, 25 bp, Mus musculus
gactctggcctatgaattcgtttaa

SEQ ID NO: 461350 - DNA, 25 bp, Mus musculus
gactctggcctgaacctaggaatga

SEQ ID NO: 461351 - DNA, 25 bp, Mus musculus
gactctggcctgtacctaggaatga

SEQ ID NO: 461352 - DNA, 25 bp, Mus musculus
gactctggctacagttaaaatcctg

SEQ ID NO: 461353 - DNA, 25 bp, Mus musculus
gactctggctactgttaaaatcctg

SEQ ID NO: 461354 - DNA, 25 bp, Mus musculus
gactctggctgtaattaaattcctt

SEQ ID NO: 461355 - DNA, 25 bp, Mus musculus
gactctggctgtcagtgtctgtgaa

SEQ ID NO: 461356 - DNA, 25 bp, Mus musculus
gactctggctgtgagtgtctgtgaa

SEQ ID NO: 461357 - DNA, 25 bp, Mus musculus
gactctggctgttattaaattcctt

SEQ ID NO: 461358 - DNA, 25 bp, Mus musculus
gactctggcttcaattaaaggatta

SEQ ID NO: 461359 - DNA, 25 bp, Mus musculus
gactctggcttcatattgtcctagg

SEQ ID NO: 461360 - DNA, 25 bp, Mus musculus
gactctggcttctattaaaggatta

SEQ ID NO: 461361 - DNA, 25 bp, Mus musculus
gactctggcttcttattgtcctagg

SEQ ID NO: 461362 - DNA, 25 bp, Mus musculus
gactctggcttgacttccagttata

SEQ ID NO: 461363 - DNA, 25 bp, Mus musculus
gactctggcttgtcttccagttata

SEQ ID NO: 461364 - DNA, 25 bp, Mus musculus
gactctgggagacccctttgagatg

SEQ ID NO: 461365 - DNA, 25 bp, Mus musculus
gactctgggagagccctttgagatg

SEQ ID NO: 461366 - DNA, 25 bp, Mus musculus
gactctgggatccttatggtattaa

SEQ ID NO: 461367 - DNA, 25 bp, Mus musculus
gactctgggatcgttatggtattaa

SEQ ID NO: 461368 - DNA, 25 bp, Mus musculus
gactctgggcaccttgatttgttat

SEQ ID NO: 461369 - DNA, 25 bp, Mus musculus
gactctgggcacgttgatttgttat

SEQ ID NO: 461370 - DNA, 25 bp, Mus musculus
gactctgggcatatgggacacagca

SEQ ID NO: 461371 - DNA, 25 bp, Mus musculus
gactctgggcatttgggacacagca

SEQ ID NO: 461372 - DNA, 25 bp, Mus musculus
gactctgggcgtaatttgtaaagct

SEQ ID NO: 461373 - DNA, 25 bp, Mus musculus
gactctgggcgttatttgtaaagct

SEQ ID NO: 461374 - DNA, 25 bp, Mus musculus
gactctgggctcattggaatttaca

SEQ ID NO: 461375 - DNA, 25 bp, Mus musculus
gactctgggctctttggaatttaca

SEQ ID NO: 461376 - DNA, 25 bp, Mus musculus
gactctgggtaaacaaaaagcttca

SEQ ID NO: 461377 - DNA, 25 bp, Mus musculus
gactctgggtaatcaaaaagcttca

SEQ ID NO: 461378 - DNA, 25 bp, Mus musculus
gactctgggtatcagcttagcacat

SEQ ID NO: 461379 - DNA, 25 bp, Mus musculus
gactctgggtatgagcttagcacat

SEQ ID NO: 461380 - DNA, 25 bp, Mus musculus
gactctgggtccaaaacatgggcca

SEQ ID NO: 461381 - DNA, 25 bp, Mus musculus
gactctgggtccaaatgctgccgtg

SEQ ID NO: 461382 - DNA, 25 bp, Mus musculus
gactctgggtcctaaacatgggcca

SEQ ID NO: 461383 - DNA, 25 bp, Mus musculus
gactctgggtcctaatgctgccgtg

SEQ ID NO: 461384 - DNA, 25 bp, Mus musculus
gactctgggtgtagtcaagactatc

SEQ ID NO: 461385 - DNA, 25 bp, Mus musculus
gactctgggtgttgtcaagactatc

SEQ ID NO: 461386 - DNA, 25 bp, Mus musculus
gactctggtcaaaaaactgctaaat

SEQ ID NO: 461387 - DNA, 25 bp, Mus musculus
gactctggtcaataaactgctaaat

SEQ ID NO: 461388 - DNA, 25 bp, Mus musculus
gactctggtcatagttctagttctg

SEQ ID NO: 461389 - DNA, 25 bp, Mus musculus
gactctggtcatcattaaatgtagt

SEQ ID NO: 461390 - DNA, 25 bp, Mus musculus
gactctggtcatgattaaatgtagt

SEQ ID NO: 461391 - DNA, 25 bp, Mus musculus
gactctggtcattgttctagttctg

SEQ ID NO: 461392 - DNA, 25 bp, Mus musculus
gactctggtggcactttgggtaaca

SEQ ID NO: 461393 - DNA, 25 bp, Mus musculus
gactctggtggctctttgggtaaca

SEQ ID NO: 461394 - DNA, 25 bp, Mus musculus
gactctggtgtccttggcaaaattt

SEQ ID NO: 461395 - DNA, 25 bp, Mus musculus
gactctggtgtcgttggcaaaattt

SEQ ID NO: 461396 - DNA, 25 bp, Mus musculus
gactctggtgttagtcctcctggta

SEQ ID NO: 461397 - DNA, 25 bp, Mus musculus
gactctggtgtttgtcctcctggta

SEQ ID NO: 461398 - DNA, 25 bp, Mus musculus
gactctggttctcaacttgctataa

SEQ ID NO: 461399 - DNA, 25 bp, Mus musculus
gactctggttctgaacttgctataa

SEQ ID NO: 461400 - DNA, 25 bp, Mus musculus
gactctggtttgcatagatcctgga

SEQ ID NO: 461401 - DNA, 25 bp, Mus musculus
gactctggtttggatagatcctgga

SEQ ID NO: 461402 - DNA, 25 bp, Mus musculus
gactctggttttctcaagggtaaat

SEQ ID NO: 461403 - DNA, 25 bp, Mus musculus
gactctggttttgtcaagggtaaat

SEQ ID NO: 461404 - DNA, 25 bp, Mus musculus
gactctgtaaacagggtgtattttg

SEQ ID NO: 461405 - DNA, 25 bp, Mus musculus
gactctgtaaactgggtgtattttg

SEQ ID NO: 461406 - DNA, 25 bp, Mus musculus
gactctgtaacaactacctcatgag

SEQ ID NO: 461407 - DNA, 25 bp, Mus musculus
gactctgtaacatctacctcatgag

SEQ ID NO: 461408 - DNA, 25 bp, Mus musculus
gactctgtaacgagtgtgaacctca

SEQ ID NO: 461409 - DNA, 25 bp, Mus musculus
gactctgtaacgcttgctttttaaa

SEQ ID NO: 461410 - DNA, 25 bp, Mus musculus
gactctgtaacggttgctttttaaa

SEQ ID NO: 461411 - DNA, 25 bp, Mus musculus
gactctgtaacgtgtgtgaacctca

SEQ ID NO: 461412 - DNA, 25 bp, Mus musculus
gactctgtaattccgataactttgg

SEQ ID NO: 461413 - DNA, 25 bp, Mus musculus
gactctgtaattgcgataactttgg

SEQ ID NO: 461414 - DNA, 25 bp, Mus musculus
gactctgtacaacaagctgaggtaa

SEQ ID NO: 461415 - DNA, 25 bp, Mus musculus
gactctgtacaagaagctgaggtaa

SEQ ID NO: 461416 - DNA, 25 bp, Mus musculus
gactctgtacatcaaacctgtgcgt

SEQ ID NO: 461417 - DNA, 25 bp, Mus musculus
gactctgtacatgaaacctgtgcgt

SEQ ID NO: 461418 - DNA, 25 bp, Mus musculus
gactctgtactaattcagaaaggct

SEQ ID NO: 461419 - DNA, 25 bp, Mus musculus
gactctgtactatttcagaaaggct

SEQ ID NO: 461420 - DNA, 25 bp, Mus musculus
gactctgtagatagagttccagaac

SEQ ID NO: 461421 - DNA, 25 bp, Mus musculus
gactctgtagattgagttccagaac

SEQ ID NO: 461422 - DNA, 25 bp, Mus musculus
gactctgtagcactgccttattttc

SEQ ID NO: 461423 - DNA, 25 bp, Mus musculus
gactctgtagcagtgccttattttc

SEQ ID NO: 461424 - DNA, 25 bp, Mus musculus
gactctgtagctacctgaatcacta

SEQ ID NO: 461425 - DNA, 25 bp, Mus musculus
gactctgtagcttcctgaatcacta

SEQ ID NO: 461426 - DNA, 25 bp, Mus musculus
gactctgtcaacctgcctattggag

SEQ ID NO: 461427 - DNA, 25 bp, Mus musculus
gactctgtcaacgtgcctattggag

SEQ ID NO: 461428 - DNA, 25 bp, Mus musculus
gactctgtcacacccatgcaatggt

SEQ ID NO: 461429 - DNA, 25 bp, Mus musculus
gactctgtcacagccatgcaatggt

SEQ ID NO: 461430 - DNA, 25 bp, Mus musculus
gactctgtcactaggaccacaggaa

SEQ ID NO: 461431 - DNA, 25 bp, Mus musculus
gactctgtcacttggaccacaggaa

SEQ ID NO: 461432 - DNA, 25 bp, Mus musculus
gactctgtcattactggtgtcattt

SEQ ID NO: 461433 - DNA, 25 bp, Mus musculus
gactctgtcatttctggtgtcattt

SEQ ID NO: 461434 - DNA, 25 bp, Mus musculus
gactctgtcggaccctgtgcataca

SEQ ID NO: 461435 - DNA, 25 bp, Mus musculus
gactctgtcggagcctgtgcataca

SEQ ID NO: 461436 - DNA, 25 bp, Mus musculus
gactctgtgatcagcactacttgag

SEQ ID NO: 461437 - DNA, 25 bp, Mus musculus
gactctgtgatctgcactacttgag

SEQ ID NO: 461438 - DNA, 25 bp, Mus musculus
gactctgtggagatcaacaatgcta

SEQ ID NO: 461439 - DNA, 25 bp, Mus musculus
gactctgtggagttcaacaatgcta

SEQ ID NO: 461440 - DNA, 25 bp, Mus musculus
gactctgtggctaggttaaccttga

SEQ ID NO: 461441 - DNA, 25 bp, Mus musculus
gactctgtggcttggttaaccttga

SEQ ID NO: 461442 - DNA, 25 bp, Mus musculus
gactctgtggtgagtttctttttag

SEQ ID NO: 461443 - DNA, 25 bp, Mus musculus
gactctgtggtgtgtttctttttag

SEQ ID NO: 461444 - DNA, 25 bp, Mus musculus
gactctgtgtataactctgggctac

SEQ ID NO: 461445 - DNA, 25 bp, Mus musculus
gactctgtgtataattgggcccata

SEQ ID NO: 461446 - DNA, 25 bp, Mus musculus
gactctgtgtattactctgggctac

SEQ ID NO: 461447 - DNA, 25 bp, Mus musculus
gactctgtgtattattgggcccata

SEQ ID NO: 461448 - DNA, 25 bp, Mus musculus
gactctgtgtgacgctggtaaaccc

SEQ ID NO: 461449 - DNA, 25 bp, Mus musculus
gactctgtgtgaggctggtaaaccc

SEQ ID NO: 461450 - DNA, 25 bp, Mus musculus
gactctgttaatatctattacactg

SEQ ID NO: 461451 - DNA, 25 bp, Mus musculus
gactctgttaatttctattacactg

SEQ ID NO: 461452 - DNA, 25 bp, Mus musculus
gactctgttatacctatctcgtatg

SEQ ID NO: 461453 - DNA, 25 bp, Mus musculus
gactctgttatagctatctcgtatg

SEQ ID NO: 461454 - DNA, 25 bp, Mus musculus
gactctgttgtacatgttggattca

SEQ ID NO: 461455 - DNA, 25 bp, Mus musculus
gactctgttgtagatgttggattca

SEQ ID NO: 461456 - DNA, 25 bp, Mus musculus
gactctgtttgcaagacagcctgta

SEQ ID NO: 461457 - DNA, 25 bp, Mus musculus
gactctgtttgctagacagcctgta

SEQ ID NO: 461458 - DNA, 25 bp, Mus musculus
gactcttaaagacagcttcactcta

SEQ ID NO: 461459 - DNA, 25 bp, Mus musculus
gactcttaaagagagcttcactcta

SEQ ID NO: 461460 - DNA, 25 bp, Mus musculus
gactcttaaataactttgccagcga

SEQ ID NO: 461461 - DNA, 25 bp, Mus musculus
gactcttaaatatctttgccagcga

SEQ ID NO: 461462 - DNA, 25 bp, Mus musculus
gactcttaacacaggatcatccaag

SEQ ID NO: 461463 - DNA, 25 bp, Mus musculus
gactcttaacactggatcatccaag

SEQ ID NO: 461464 - DNA, 25 bp, Mus musculus
gactcttaagaacagcctcttggga

SEQ ID NO: 461465 - DNA, 25 bp, Mus musculus
gactcttaagaagagcctcttggga

SEQ ID NO: 461466 - DNA, 25 bp, Mus musculus
gactcttaagctagggttggcactt

SEQ ID NO: 461467 - DNA, 25 bp, Mus musculus
gactcttaagcttgggttggcactt

SEQ ID NO: 461468 - DNA, 25 bp, Mus musculus
gactcttacgcgcagaatgccaaag

SEQ ID NO: 461469 - DNA, 25 bp, Mus musculus
gactcttacgcggagaatgccaaag

SEQ ID NO: 461470 - DNA, 25 bp, Mus musculus
gactcttagatcactgcctactcat

SEQ ID NO: 461471 - DNA, 25 bp, Mus musculus
gactcttagatctctgcctactcat

SEQ ID NO: 461472 - DNA, 25 bp, Mus musculus
gactcttagctgaggaccgaggaga

SEQ ID NO: 461473 - DNA, 25 bp, Mus musculus
gactcttagctgtggaccgaggaga

SEQ ID NO: 461474 - DNA, 25 bp, Mus musculus
gactcttagtctaaatctatcagcg

SEQ ID NO: 461475 - DNA, 25 bp, Mus musculus
gactcttagtcttaatctatcagcg

SEQ ID NO: 461476 - DNA, 25 bp, Mus musculus
gactcttatatgcattctctgttct

SEQ ID NO: 461477 - DNA, 25 bp, Mus musculus
gactcttatatggattctctgttct

SEQ ID NO: 461478 - DNA, 25 bp, Mus musculus
gactcttatctccagtgttctatga

SEQ ID NO: 461479 - DNA, 25 bp, Mus musculus
gactcttatctcgagtgttctatga

SEQ ID NO: 461480 - DNA, 25 bp, Mus musculus
gactcttatgcacagcatcagctga

SEQ ID NO: 461481 - DNA, 25 bp, Mus musculus
gactcttatgcagagcatcagctga

SEQ ID NO: 461482 - DNA, 25 bp, Mus musculus
gactcttcaagactgaataaaggga

SEQ ID NO: 461483 - DNA, 25 bp, Mus musculus
gactcttcaagagtgaataaaggga

SEQ ID NO: 461484 - DNA, 25 bp, Mus musculus
gactcttcagaaagttctccggaaa

SEQ ID NO: 461485 - DNA, 25 bp, Mus musculus
gactcttcagaacaacgggctgcct

SEQ ID NO: 461486 - DNA, 25 bp, Mus musculus
gactcttcagaagaacgggctgcct

SEQ ID NO: 461487 - DNA, 25 bp, Mus musculus
gactcttcagaatgttctccggaaa

SEQ ID NO: 461488 - DNA, 25 bp, Mus musculus
gactcttcagatcttctgtttgcca

SEQ ID NO: 461489 - DNA, 25 bp, Mus musculus
gactcttcagatgttctgtttgcca

SEQ ID NO: 461490 - DNA, 25 bp, Mus musculus
gactcttcagtgacaggccttgtgt

SEQ ID NO: 461491 - DNA, 25 bp, Mus musculus
gactcttcagtgacatctctctgtg

SEQ ID NO: 461492 - DNA, 25 bp, Mus musculus
gactcttcagtgtcaggccttgtgt

SEQ ID NO: 461493 - DNA, 25 bp, Mus musculus
gactcttcagtgtcatctctctgtg

SEQ ID NO: 461494 - DNA, 25 bp, Mus musculus
gactcttccacactcttatttattg

SEQ ID NO: 461495 - DNA, 25 bp, Mus musculus
gactcttccacagtcttatttattg

SEQ ID NO: 461496 - DNA, 25 bp, Mus musculus
gactcttccattcaacaaagacttg

SEQ ID NO: 461497 - DNA, 25 bp, Mus musculus
gactcttccattgaacaaagacttg

SEQ ID NO: 461498 - DNA, 25 bp, Mus musculus
gactcttcccagcaacttttaagct

SEQ ID NO: 461499 - DNA, 25 bp, Mus musculus
gactcttcccaggaacttttaagct

SEQ ID NO: 461500 - DNA, 25 bp, Mus musculus
gactcttccgataagcaagtcaaat

SEQ ID NO: 461501 - DNA, 25 bp, Mus musculus
gactcttccgattagcaagtcaaat

SEQ ID NO: 461502 - DNA, 25 bp, Mus musculus
gactcttcctcaatccgtaaagtgg

SEQ ID NO: 461503 - DNA, 25 bp, Mus musculus
gactcttcctcattccgtaaagtgg

SEQ ID NO: 461504 - DNA, 25 bp, Mus musculus
gactcttcctggatatcccatatca

SEQ ID NO: 461505 - DNA, 25 bp, Mus musculus
gactcttcctggttatcccatatca

SEQ ID NO: 461506 - DNA, 25 bp, Mus musculus
gactcttcctgtcaatttgtgggtt

SEQ ID NO: 461507 - DNA, 25 bp, Mus musculus
gactcttcctgtgaatttgtgggtt

SEQ ID NO: 461508 - DNA, 25 bp, Mus musculus
gactcttctcacacatttggagctg

SEQ ID NO: 461509 - DNA, 25 bp, Mus musculus
gactcttctcactcatttggagctg

SEQ ID NO: 461510 - DNA, 25 bp, Mus musculus
gactcttctccaagaagtcatgcat

SEQ ID NO: 461511 - DNA, 25 bp, Mus musculus
gactcttctccatgaagtcatgcat

SEQ ID NO: 461512 - DNA, 25 bp, Mus musculus
gactcttctctccttcattatgtta

SEQ ID NO: 461513 - DNA, 25 bp, Mus musculus
gactcttctctcgttcattatgtta

SEQ ID NO: 461514 - DNA, 25 bp, Mus musculus
gactcttctctgagtatatgcaaat

SEQ ID NO: 461515 - DNA, 25 bp, Mus musculus
gactcttctctgtgtatatgcaaat

SEQ ID NO: 461516 - DNA, 25 bp, Mus musculus
gactcttctggtcacagcgtgacta

SEQ ID NO: 461517 - DNA, 25 bp, Mus musculus
gactcttctggtgacagcgtgacta

SEQ ID NO: 461518 - DNA, 25 bp, Mus musculus
gactcttgagggattttatgtagaa

SEQ ID NO: 461519 - DNA, 25 bp, Mus musculus
gactcttgagggtttttatgtagaa

SEQ ID NO: 461520 - DNA, 25 bp, Mus musculus
gactcttgatatactgaagcacttt

SEQ ID NO: 461521 - DNA, 25 bp, Mus musculus
gactcttgatattctgaagcacttt

SEQ ID NO: 461522 - DNA, 25 bp, Mus musculus
gactcttgatgacggtcttaacccc

SEQ ID NO: 461523 - DNA, 25 bp, Mus musculus
gactcttgatgagggtcttaacccc

SEQ ID NO: 461524 - DNA, 25 bp, Mus musculus
gactcttgcagaacatacctttgtg

SEQ ID NO: 461525 - DNA, 25 bp, Mus musculus
gactcttgcagatcatacctttgtg

SEQ ID NO: 461526 - DNA, 25 bp, Mus musculus
gactcttgcagcattgaaatataat

SEQ ID NO: 461527 - DNA, 25 bp, Mus musculus
gactcttgcagctttgaaatataat

SEQ ID NO: 461528 - DNA, 25 bp, Mus musculus
gactcttgcataactgtgctgacat

SEQ ID NO: 461529 - DNA, 25 bp, Mus musculus
gactcttgcatatctgtgctgacat

SEQ ID NO: 461530 - DNA, 25 bp, Mus musculus
gactcttgcgagaataagcccttct

SEQ ID NO: 461531 - DNA, 25 bp, Mus musculus
gactcttgcgagtataagcccttct

SEQ ID NO: 461532 - DNA, 25 bp, Mus musculus
gactcttgctatccagtctactgta

SEQ ID NO: 461533 - DNA, 25 bp, Mus musculus
gactcttgctatgcagtctactgta

SEQ ID NO: 461534 - DNA, 25 bp, Mus musculus
gactcttggagtatccaggtgtctt

SEQ ID NO: 461535 - DNA, 25 bp, Mus musculus
gactcttggagtttccaggtgtctt

SEQ ID NO: 461536 - DNA, 25 bp, Mus musculus
gactcttggcacacgagcctggaaa

SEQ ID NO: 461537 - DNA, 25 bp, Mus musculus
gactcttggcactcgagcctggaaa

SEQ ID NO: 461538 - DNA, 25 bp, Mus musculus
gactcttgggtgctcagtcactgaa

SEQ ID NO: 461539 - DNA, 25 bp, Mus musculus
gactcttgggtggtcagtcactgaa

SEQ ID NO: 461540 - DNA, 25 bp, Mus musculus
gactcttgggttaggtgtgcttgtt

SEQ ID NO: 461541 - DNA, 25 bp, Mus musculus
gactcttgggttcttgctcaggaac

SEQ ID NO: 461542 - DNA, 25 bp, Mus musculus
gactcttgggttgttgctcaggaac

SEQ ID NO: 461543 - DNA, 25 bp, Mus musculus
gactcttgggtttggtgtgcttgtt

SEQ ID NO: 461544 - DNA, 25 bp, Mus musculus
gactcttgtaagctccacagaacag

SEQ ID NO: 461545 - DNA, 25 bp, Mus musculus
gactcttgtaaggtccacagaacag

SEQ ID NO: 461546 - DNA, 25 bp, Mus musculus
gactcttgtataattttgtaccaaa

SEQ ID NO: 461547 - DNA, 25 bp, Mus musculus
gactcttgtatatttttgtaccaaa

SEQ ID NO: 461548 - DNA, 25 bp, Mus musculus
gactcttgtggaatattcctgacga

SEQ ID NO: 461549 - DNA, 25 bp, Mus musculus
gactcttgtggattattcctgacga

SEQ ID NO: 461550 - DNA, 25 bp, Mus musculus
gactcttgtgtaagtctgattgaag

SEQ ID NO: 461551 - DNA, 25 bp, Mus musculus
gactcttgtgtatgtctgattgaag

SEQ ID NO: 461552 - DNA, 25 bp, Mus musculus
gactcttgtgttccattagattctc

SEQ ID NO: 461553 - DNA, 25 bp, Mus musculus
gactcttgtgttgcattagattctc

SEQ ID NO: 461554 - DNA, 25 bp, Mus musculus
gactcttgttagagtcgctctgaca

SEQ ID NO: 461555 - DNA, 25 bp, Mus musculus
gactcttgttagtgtcgctctgaca

SEQ ID NO: 461556 - DNA, 25 bp, Mus musculus
gactctttaactcttcaggacatcg

SEQ ID NO: 461557 - DNA, 25 bp, Mus musculus
gactctttaactgttcaggacatcg

SEQ ID NO: 461558 - DNA, 25 bp, Mus musculus
gactctttaatacaactcttcatgc

SEQ ID NO: 461559 - DNA, 25 bp, Mus musculus
gactctttaatagaactcttcatgc

SEQ ID NO: 461560 - DNA, 25 bp, Mus musculus
gactctttaatgacagaatctctta

SEQ ID NO: 461561 - DNA, 25 bp, Mus musculus
gactctttaatgtcagaatctctta

SEQ ID NO: 461562 - DNA, 25 bp, Mus musculus
gactctttaccaatactaaatcaga

SEQ ID NO: 461563 - DNA, 25 bp, Mus musculus
gactctttaccattactaaatcaga

SEQ ID NO: 461564 - DNA, 25 bp, Mus musculus
gactctttcagcagatgaccacaag

SEQ ID NO: 461565 - DNA, 25 bp, Mus musculus
gactctttcagctgatgaccacaag

SEQ ID NO: 461566 - DNA, 25 bp, Mus musculus
gactctttcagtatccaggatggaa

SEQ ID NO: 461567 - DNA, 25 bp, Mus musculus
gactctttcagtttccaggatggaa

SEQ ID NO: 461568 - DNA, 25 bp, Mus musculus
gactctttcatccttgagacagaac

SEQ ID NO: 461569 - DNA, 25 bp, Mus musculus
gactctttcatcgttgagacagaac

SEQ ID NO: 461570 - DNA, 25 bp, Mus musculus
gactctttcccgatgacgtggtgca

SEQ ID NO: 461571 - DNA, 25 bp, Mus musculus
gactctttcccgttgacgtggtgca

SEQ ID NO: 461572 - DNA, 25 bp, Mus musculus
gactctttccgtacattgtttgctt

SEQ ID NO: 461573 - DNA, 25 bp, Mus musculus
gactctttccgttcattgtttgctt

SEQ ID NO: 461574 - DNA, 25 bp, Mus musculus
gactctttcctcctcattttatgta

SEQ ID NO: 461575 - DNA, 25 bp, Mus musculus
gactctttcctcgtcattttatgta

SEQ ID NO: 461576 - DNA, 25 bp, Mus musculus
gactctttcctgcataaataatgtg

SEQ ID NO: 461577 - DNA, 25 bp, Mus musculus
gactctttcctggataaataatgtg

SEQ ID NO: 461578 - DNA, 25 bp, Mus musculus
gactctttcgctaatggcaagcttt

SEQ ID NO: 461579 - DNA, 25 bp, Mus musculus
gactctttcgcttatggcaagcttt

SEQ ID NO: 461580 - DNA, 25 bp, Mus musculus
gactctttctccctgagttttacag

SEQ ID NO: 461581 - DNA, 25 bp, Mus musculus
gactctttctccgtgagttttacag

SEQ ID NO: 461582 - DNA, 25 bp, Mus musculus
gactctttcttactctgtcctagaa

SEQ ID NO: 461583 - DNA, 25 bp, Mus musculus
gactctttcttagtctgtcctagaa

SEQ ID NO: 461584 - DNA, 25 bp, Mus musculus
gactctttgactacgttctcagttg

SEQ ID NO: 461585 - DNA, 25 bp, Mus musculus
gactctttgacttcgttctcagttg

SEQ ID NO: 461586 - DNA, 25 bp, Mus musculus
gactctttgataatgctgttacctg

SEQ ID NO: 461587 - DNA, 25 bp, Mus musculus
gactctttgataatgttttcttttg

SEQ ID NO: 461588 - DNA, 25 bp, Mus musculus
gactctttgatattgctgttacctg

SEQ ID NO: 461589 - DNA, 25 bp, Mus musculus
gactctttgatattgttttcttttg

SEQ ID NO: 461590 - DNA, 25 bp, Mus musculus
gactctttgcatcgaagtgaaccct

SEQ ID NO: 461591 - DNA, 25 bp, Mus musculus
gactctttgcatctgtacttcatca

SEQ ID NO: 461592 - DNA, 25 bp, Mus musculus
gactctttgcatggaagtgaaccct

SEQ ID NO: 461593 - DNA, 25 bp, Mus musculus
gactctttgcatgtgtacttcatca

SEQ ID NO: 461594 - DNA, 25 bp, Mus musculus
gactctttgcctactgttacagtgt

SEQ ID NO: 461595 - DNA, 25 bp, Mus musculus
gactctttgcctattcaggattcct

SEQ ID NO: 461596 - DNA, 25 bp, Mus musculus
gactctttgccttctgttacagtgt

SEQ ID NO: 461597 - DNA, 25 bp, Mus musculus
gactctttgccttttcaggattcct

SEQ ID NO: 461598 - DNA, 25 bp, Mus musculus
gactctttgggtaacaatagaggaa

SEQ ID NO: 461599 - DNA, 25 bp, Mus musculus
gactctttgggtaatgcagtgccat

SEQ ID NO: 461600 - DNA, 25 bp, Mus musculus
gactctttgggttacaatagaggaa

SEQ ID NO: 461601 - DNA, 25 bp, Mus musculus
gactctttgggttatgcagtgccat

SEQ ID NO: 461602 - DNA, 25 bp, Mus musculus
gactctttgtgaataagttttcaga

SEQ ID NO: 461603 - DNA, 25 bp, Mus musculus
gactctttgtgattaagttttcaga

SEQ ID NO: 461604 - DNA, 25 bp, Mus musculus
gactcttttacgcaggtctatgcca

SEQ ID NO: 461605 - DNA, 25 bp, Mus musculus
gactcttttacggaggtctatgcca

SEQ ID NO: 461606 - DNA, 25 bp, Mus musculus
gactcttttagaagtaccgcatcaa

SEQ ID NO: 461607 - DNA, 25 bp, Mus musculus
gactcttttagatgtaccgcatcaa

SEQ ID NO: 461608 - DNA, 25 bp, Mus musculus
gactcttttatcacatttcctatag

SEQ ID NO: 461609 - DNA, 25 bp, Mus musculus
gactcttttatctcatttcctatag

SEQ ID NO: 461610 - DNA, 25 bp, Mus musculus
gactcttttgcgattagatcacatg

SEQ ID NO: 461611 - DNA, 25 bp, Mus musculus
gactcttttgcgtttagatcacatg

SEQ ID NO: 461612 - DNA, 25 bp, Mus musculus
gactctttttacactgttctttgcc

SEQ ID NO: 461613 - DNA, 25 bp, Mus musculus
gactctttttactctgttctttgcc

SEQ ID NO: 461614 - DNA, 25 bp, Mus musculus
gactctttttggagagtgcagcctt

SEQ ID NO: 461615 - DNA, 25 bp, Mus musculus
gactctttttggtgagtgcagcctt

SEQ ID NO: 461616 - DNA, 25 bp, Mus musculus
gactgaaacactaacaaacaacctg

SEQ ID NO: 461617 - DNA, 25 bp, Mus musculus
gactgaaacacttacaaacaacctg

SEQ ID NO: 461618 - DNA, 25 bp, Mus musculus
gactgaaactccacccaatagaatt

SEQ ID NO: 461619 - DNA, 25 bp, Mus musculus
gactgaaactcctcccaatagaatt

SEQ ID NO: 461620 - DNA, 25 bp, Mus musculus
gactgaaacttgatgacagggtttt

SEQ ID NO: 461621 - DNA, 25 bp, Mus musculus
gactgaaacttgttgacagggtttt

SEQ ID NO: 461622 - DNA, 25 bp, Mus musculus
gactgaaagaatcccgtagctcacc

SEQ ID NO: 461623 - DNA, 25 bp, Mus musculus
gactgaaagaatgccgtagctcacc

SEQ ID NO: 461624 - DNA, 25 bp, Mus musculus
gactgaaagccaccgagtgggtcca

SEQ ID NO: 461625 - DNA, 25 bp, Mus musculus
gactgaaagccagcgagtgggtcca

SEQ ID NO: 461626 - DNA, 25 bp, Mus musculus
gactgaaaggaaatcatgttttcgc

SEQ ID NO: 461627 - DNA, 25 bp, Mus musculus
gactgaaaggaattcatgttttcgc

SEQ ID NO: 461628 - DNA, 25 bp, Mus musculus
gactgaaatcaaagcaacacactgg

SEQ ID NO: 461629 - DNA, 25 bp, Mus musculus
gactgaaatcaacagagcaccccaa

SEQ ID NO: 461630 - DNA, 25 bp, Mus musculus
gactgaaatcaagagagcaccccaa

SEQ ID NO: 461631 - DNA, 25 bp, Mus musculus
gactgaaatcaatgcaacacactgg

SEQ ID NO: 461632 - DNA, 25 bp, Mus musculus
gactgaaatcttctacactggagtg

SEQ ID NO: 461633 - DNA, 25 bp, Mus musculus
gactgaaatcttgtacactggagtg

SEQ ID NO: 461634 - DNA, 25 bp, Mus musculus
gactgaaatggcctgtgtccctaca

SEQ ID NO: 461635 - DNA, 25 bp, Mus musculus
gactgaaatggcgtgtgtccctaca

SEQ ID NO: 461636 - DNA, 25 bp, Mus musculus
gactgaaatgtaatttggtctccta

SEQ ID NO: 461637 - DNA, 25 bp, Mus musculus
gactgaaatgtattttggtctccta

SEQ ID NO: 461638 - DNA, 25 bp, Mus musculus
gactgaaatttgcttgctagcactt

SEQ ID NO: 461639 - DNA, 25 bp, Mus musculus
gactgaaatttggttgctagcactt

SEQ ID NO: 461640 - DNA, 25 bp, Mus musculus
gactgaacaagaatcatgggcacaa

SEQ ID NO: 461641 - DNA, 25 bp, Mus musculus
gactgaacaagattcatgggcacaa

SEQ ID NO: 461642 - DNA, 25 bp, Mus musculus
gactgaacacaaagccataccatta

SEQ ID NO: 461643 - DNA, 25 bp, Mus musculus
gactgaacacaatgccataccatta

SEQ ID NO: 461644 - DNA, 25 bp, Mus musculus
gactgaacactaacagctccacctg

SEQ ID NO: 461645 - DNA, 25 bp, Mus musculus
gactgaacactatcagctccacctg

SEQ ID NO: 461646 - DNA, 25 bp, Mus musculus
gactgaacactcattgtccagactt

SEQ ID NO: 461647 - DNA, 25 bp, Mus musculus
gactgaacactctttgtccagactt

SEQ ID NO: 461648 - DNA, 25 bp, Mus musculus
gactgaacatagatccttccaataa

SEQ ID NO: 461649 - DNA, 25 bp, Mus musculus
gactgaacatagttccttccaataa

SEQ ID NO: 461650 - DNA, 25 bp, Mus musculus
gactgaaccaccaaactgatcttaa

SEQ ID NO: 461651 - DNA, 25 bp, Mus musculus
gactgaaccacccaaaggacctggc

SEQ ID NO: 461652 - DNA, 25 bp, Mus musculus
gactgaaccaccgaaaggacctggc

SEQ ID NO: 461653 - DNA, 25 bp, Mus musculus
gactgaaccacctaactgatcttaa

SEQ ID NO: 461654 - DNA, 25 bp, Mus musculus
gactgaaccctacgctgcggtaaga

SEQ ID NO: 461655 - DNA, 25 bp, Mus musculus
gactgaaccctaggctgcggtaaga

SEQ ID NO: 461656 - DNA, 25 bp, Mus musculus
gactgaaccctgaagccaagcttct

SEQ ID NO: 461657 - DNA, 25 bp, Mus musculus
gactgaaccctgtagccaagcttct

SEQ ID NO: 461658 - DNA, 25 bp, Mus musculus
gactgaaccgttaattcaagcctca

SEQ ID NO: 461659 - DNA, 25 bp, Mus musculus
gactgaaccgtttattcaagcctca

SEQ ID NO: 461660 - DNA, 25 bp, Mus musculus
gactgaacctagctgctcacataag

SEQ ID NO: 461661 - DNA, 25 bp, Mus musculus
gactgaacctaggtgctcacataag

SEQ ID NO: 461662 - DNA, 25 bp, Mus musculus
gactgaacgaccatgcccatggctt

SEQ ID NO: 461663 - DNA, 25 bp, Mus musculus
gactgaacgaccttgcccatggctt

SEQ ID NO: 461664 - DNA, 25 bp, Mus musculus
gactgaacgagaatgaggccactat

SEQ ID NO: 461665 - DNA, 25 bp, Mus musculus
gactgaacgagattgaggccactat

SEQ ID NO: 461666 - DNA, 25 bp, Mus musculus
gactgaacgctcaccaagagcactg

SEQ ID NO: 461667 - DNA, 25 bp, Mus musculus
gactgaacgctctccaagagcactg

SEQ ID NO: 461668 - DNA, 25 bp, Mus musculus
gactgaacggagaagccctggacat

SEQ ID NO: 461669 - DNA, 25 bp, Mus musculus
gactgaacggagtagccctggacat

SEQ ID NO: 461670 - DNA, 25 bp, Mus musculus
gactgaactgctaaatggtttgctt

SEQ ID NO: 461671 - DNA, 25 bp, Mus musculus
gactgaactgcttaatggtttgctt

SEQ ID NO: 461672 - DNA, 25 bp, Mus musculus
gactgaactgtacgctgggcagaca

SEQ ID NO: 461673 - DNA, 25 bp, Mus musculus
gactgaactgtaggctgggcagaca

SEQ ID NO: 461674 - DNA, 25 bp, Mus musculus
gactgaactgtcaacatcacaaaga

SEQ ID NO: 461675 - DNA, 25 bp, Mus musculus
gactgaactgtcatggtaaccactc

SEQ ID NO: 461676 - DNA, 25 bp, Mus musculus
gactgaactgtctacatcacaaaga

SEQ ID NO: 461677 - DNA, 25 bp, Mus musculus
gactgaactgtcttggtaaccactc

SEQ ID NO: 461678 - DNA, 25 bp, Mus musculus
gactgaagaaaaagactgctgcaat

SEQ ID NO: 461679 - DNA, 25 bp, Mus musculus
gactgaagaaaatgactgctgcaat

SEQ ID NO: 461680 - DNA, 25 bp, Mus musculus
gactgaagaccaccagatgctcctg

SEQ ID NO: 461681 - DNA, 25 bp, Mus musculus
gactgaagaccagcagatgctcctg

SEQ ID NO: 461682 - DNA, 25 bp, Mus musculus
gactgaagacctcttgttacctgta

SEQ ID NO: 461683 - DNA, 25 bp, Mus musculus
gactgaagacctgttgttacctgta

SEQ ID NO: 461684 - DNA, 25 bp, Mus musculus
gactgaagatgtaactccaatggaa

SEQ ID NO: 461685 - DNA, 25 bp, Mus musculus
gactgaagatgttactccaatggaa

SEQ ID NO: 461686 - DNA, 25 bp, Mus musculus
gactgaagcaggagctccttgagaa

SEQ ID NO: 461687 - DNA, 25 bp, Mus musculus
gactgaagcaggtgctccttgagaa

SEQ ID NO: 461688 - DNA, 25 bp, Mus musculus
gactgaagcagtagacaatccccaa

SEQ ID NO: 461689 - DNA, 25 bp, Mus musculus
gactgaagcagttgacaatccccaa

SEQ ID NO: 461690 - DNA, 25 bp, Mus musculus
gactgaagcatcatgaggaagggac

SEQ ID NO: 461691 - DNA, 25 bp, Mus musculus
gactgaagcatcttgaggaagggac

SEQ ID NO: 461692 - DNA, 25 bp, Mus musculus
gactgaagcggtatgtcctccctaa

SEQ ID NO: 461693 - DNA, 25 bp, Mus musculus
gactgaagcggtttgtcctccctaa

SEQ ID NO: 461694 - DNA, 25 bp, Mus musculus
gactgaagcttgacagtgctgctgg

SEQ ID NO: 461695 - DNA, 25 bp, Mus musculus
gactgaagcttgtcagtgctgctgg

SEQ ID NO: 461696 - DNA, 25 bp, Mus musculus
gactgaaggacgatatgtacacata

SEQ ID NO: 461697 - DNA, 25 bp, Mus musculus
gactgaaggacgttatgtacacata

SEQ ID NO: 461698 - DNA, 25 bp, Mus musculus
gactgaaggagcatacatgttccct

SEQ ID NO: 461699 - DNA, 25 bp, Mus musculus
gactgaaggagcttacatgttccct

SEQ ID NO: 461700 - DNA, 25 bp, Mus musculus
gactgaaggcccagttacactcaaa

SEQ ID NO: 461701 - DNA, 25 bp, Mus musculus
gactgaaggccctgttacactcaaa

SEQ ID NO: 461702 - DNA, 25 bp, Mus musculus
gactgaaggctgctcaaactgctag

SEQ ID NO: 461703 - DNA, 25 bp, Mus musculus
gactgaaggctggtcaaactgctag

SEQ ID NO: 461704 - DNA, 25 bp, Mus musculus
gactgaagggttagatctcgcattt

SEQ ID NO: 461705 - DNA, 25 bp, Mus musculus
gactgaagggtttgatctcgcattt

SEQ ID NO: 461706 - DNA, 25 bp, Mus musculus
gactgaagtctcaagattcctggaa

SEQ ID NO: 461707 - DNA, 25 bp, Mus musculus
gactgaagtctctagattcctggaa

SEQ ID NO: 461708 - DNA, 25 bp, Mus musculus
gactgaagtctgcaagccggacctg

SEQ ID NO: 461709 - DNA, 25 bp, Mus musculus
gactgaagtctggaagccggacctg

SEQ ID NO: 461710 - DNA, 25 bp, Mus musculus
gactgaagtgagagagcctggacct

SEQ ID NO: 461711 - DNA, 25 bp, Mus musculus
gactgaagtgagtgagcctggacct

SEQ ID NO: 461712 - DNA, 25 bp, Mus musculus
gactgaagtggaaaggctgagccca

SEQ ID NO: 461713 - DNA, 25 bp, Mus musculus
gactgaagtggaatcctttttaaat

SEQ ID NO: 461714 - DNA, 25 bp, Mus musculus
gactgaagtggataggctgagccca

SEQ ID NO: 461715 - DNA, 25 bp, Mus musculus
gactgaagtggattcctttttaaat

SEQ ID NO: 461716 - DNA, 25 bp, Mus musculus
gactgaataaatactctcgctgtta

SEQ ID NO: 461717 - DNA, 25 bp, Mus musculus
gactgaataaattctctcgctgtta

SEQ ID NO: 461718 - DNA, 25 bp, Mus musculus
gactgaatacttagattttcctgtg

SEQ ID NO: 461719 - DNA, 25 bp, Mus musculus
gactgaatactttgattttcctgtg

SEQ ID NO: 461720 - DNA, 25 bp, Mus musculus
gactgaatagtacttgctgcacccc

SEQ ID NO: 461721 - DNA, 25 bp, Mus musculus
gactgaatagtagttgctgcacccc

SEQ ID NO: 461722 - DNA, 25 bp, Mus musculus
gactgaatcaaccattctcttgcga

SEQ ID NO: 461723 - DNA, 25 bp, Mus musculus
gactgaatcaacgattctcttgcga

SEQ ID NO: 461724 - DNA, 25 bp, Mus musculus
gactgaatcacaatcttgctctgca

SEQ ID NO: 461725 - DNA, 25 bp, Mus musculus
gactgaatcacattcttgctctgca

SEQ ID NO: 461726 - DNA, 25 bp, Mus musculus
gactgaatcaccaggcagagaacct

SEQ ID NO: 461727 - DNA, 25 bp, Mus musculus
gactgaatcacctggcagagaacct

SEQ ID NO: 461728 - DNA, 25 bp, Mus musculus
gactgaatcataacttgcttccata

SEQ ID NO: 461729 - DNA, 25 bp, Mus musculus
gactgaatcatatcttgcttccata

SEQ ID NO: 461730 - DNA, 25 bp, Mus musculus
gactgaatctcacctgtaatcgaaa

SEQ ID NO: 461731 - DNA, 25 bp, Mus musculus
gactgaatctcagctgtaatcgaaa

SEQ ID NO: 461732 - DNA, 25 bp, Mus musculus
gactgaatgcaaattcccttttatg

SEQ ID NO: 461733 - DNA, 25 bp, Mus musculus
gactgaatgcaatttcccttttatg

SEQ ID NO: 461734 - DNA, 25 bp, Mus musculus
gactgaatgcccaatggtctcaaag

SEQ ID NO: 461735 - DNA, 25 bp, Mus musculus
gactgaatgccctatggtctcaaag

SEQ ID NO: 461736 - DNA, 25 bp, Mus musculus
gactgaatgcctcacaagactgaaa

SEQ ID NO: 461737 - DNA, 25 bp, Mus musculus
gactgaatgcctgacaagactgaaa

SEQ ID NO: 461738 - DNA, 25 bp, Mus musculus
gactgaatggtaccttttctttctg

SEQ ID NO: 461739 - DNA, 25 bp, Mus musculus
gactgaatggtagcttttctttctg

SEQ ID NO: 461740 - DNA, 25 bp, Mus musculus
gactgaatgtggaccccaactggga

SEQ ID NO: 461741 - DNA, 25 bp, Mus musculus
gactgaatgtggtccccaactggga

SEQ ID NO: 461742 - DNA, 25 bp, Mus musculus
gactgaatgtgtaccgtcactcagc

SEQ ID NO: 461743 - DNA, 25 bp, Mus musculus
gactgaatgtgttccgtcactcagc

SEQ ID NO: 461744 - DNA, 25 bp, Mus musculus
gactgaattaggacccagccacttc

SEQ ID NO: 461745 - DNA, 25 bp, Mus musculus
gactgaattaggtcccagccacttc

SEQ ID NO: 461746 - DNA, 25 bp, Mus musculus
gactgaattccacagtatcatttta

SEQ ID NO: 461747 - DNA, 25 bp, Mus musculus
gactgaattccagagtatcatttta

SEQ ID NO: 461748 - DNA, 25 bp, Mus musculus
gactgaattcccagctatgaggtca

SEQ ID NO: 461749 - DNA, 25 bp, Mus musculus
gactgaattccctgctatgaggtca

SEQ ID NO: 461750 - DNA, 25 bp, Mus musculus
gactgaattggaattctgccctacc

SEQ ID NO: 461751 - DNA, 25 bp, Mus musculus
gactgaattggatttctgccctacc

SEQ ID NO: 461752 - DNA, 25 bp, Mus musculus
gactgaatttgcatacggttgtgtg

SEQ ID NO: 461753 - DNA, 25 bp, Mus musculus
gactgaatttgcttacggttgtgtg

SEQ ID NO: 461754 - DNA, 25 bp, Mus musculus
gactgaattttcactcacgggacta

SEQ ID NO: 461755 - DNA, 25 bp, Mus musculus
gactgaattttctctcacgggacta

SEQ ID NO: 461756 - DNA, 25 bp, Mus musculus
gactgacaaaacaccattgggccaa

SEQ ID NO: 461757 - DNA, 25 bp, Mus musculus
gactgacaaaactccattgggccaa

SEQ ID NO: 461758 - DNA, 25 bp, Mus musculus
gactgacaaaatatcctatacattc

SEQ ID NO: 461759 - DNA, 25 bp, Mus musculus
gactgacaaaatttcctatacattc

SEQ ID NO: 461760 - DNA, 25 bp, Mus musculus
gactgacaaacgatgtgcacacatt

SEQ ID NO: 461761 - DNA, 25 bp, Mus musculus
gactgacaaacgttgtgcacacatt

SEQ ID NO: 461762 - DNA, 25 bp, Mus musculus
gactgacacatgcaaatctgccaca

SEQ ID NO: 461763 - DNA, 25 bp, Mus musculus
gactgacacatggaaatctgccaca

SEQ ID NO: 461764 - DNA, 25 bp, Mus musculus
gactgacacctccaagtaaatgaca

SEQ ID NO: 461765 - DNA, 25 bp, Mus musculus
gactgacacctcgaagtaaatgaca

SEQ ID NO: 461766 - DNA, 25 bp, Mus musculus
gactgacacggtcccaagctcaggc

SEQ ID NO: 461767 - DNA, 25 bp, Mus musculus
gactgacacggtgccaagctcaggc

SEQ ID NO: 461768 - DNA, 25 bp, Mus musculus
gactgacactgaagcaggcacccaa

SEQ ID NO: 461769 - DNA, 25 bp, Mus musculus
gactgacactgatgcaggcacccaa

SEQ ID NO: 461770 - DNA, 25 bp, Mus musculus
gactgacagaagatgaggtagagaa

SEQ ID NO: 461771 - DNA, 25 bp, Mus musculus
gactgacagaagttgaggtagagaa

SEQ ID NO: 461772 - DNA, 25 bp, Mus musculus
gactgacagagcctgactcccaagt

SEQ ID NO: 461773 - DNA, 25 bp, Mus musculus
gactgacagagcgtgactcccaagt

SEQ ID NO: 461774 - DNA, 25 bp, Mus musculus
gactgacagaggacacagggccatt

SEQ ID NO: 461775 - DNA, 25 bp, Mus musculus
gactgacagaggtcacagggccatt

SEQ ID NO: 461776 - DNA, 25 bp, Mus musculus
gactgacagcatcgctcagcaggtc

SEQ ID NO: 461777 - DNA, 25 bp, Mus musculus
gactgacagcatggctcagcaggtc

SEQ ID NO: 461778 - DNA, 25 bp, Mus musculus
gactgacagccgagacgagctactg

SEQ ID NO: 461779 - DNA, 25 bp, Mus musculus
gactgacagccgtgacgagctactg

SEQ ID NO: 461780 - DNA, 25 bp, Mus musculus
gactgacagcggctttgttcaactt

SEQ ID NO: 461781 - DNA, 25 bp, Mus musculus
gactgacagcgggtttgttcaactt

SEQ ID NO: 461782 - DNA, 25 bp, Mus musculus
gactgacagctactctgcagacatt

SEQ ID NO: 461783 - DNA, 25 bp, Mus musculus
gactgacagctagtctgcagacatt

SEQ ID NO: 461784 - DNA, 25 bp, Mus musculus
gactgacagggcctttgctttccaa

SEQ ID NO: 461785 - DNA, 25 bp, Mus musculus
gactgacagggcgtttgctttccaa

SEQ ID NO: 461786 - DNA, 25 bp, Mus musculus
gactgacagtttatagggcacctct

SEQ ID NO: 461787 - DNA, 25 bp, Mus musculus
gactgacagtttttagggcacctct

SEQ ID NO: 461788 - DNA, 25 bp, Mus musculus
gactgacatatgcatagagccacag

SEQ ID NO: 461789 - DNA, 25 bp, Mus musculus
gactgacatatggatagagccacag

SEQ ID NO: 461790 - DNA, 25 bp, Mus musculus
gactgacatcacaggtaccagggac

SEQ ID NO: 461791 - DNA, 25 bp, Mus musculus
gactgacatcactggtaccagggac

SEQ ID NO: 461792 - DNA, 25 bp, Mus musculus
gactgacatctcagctctaggaaat

SEQ ID NO: 461793 - DNA, 25 bp, Mus musculus
gactgacatctctgctctaggaaat

SEQ ID NO: 461794 - DNA, 25 bp, Mus musculus
gactgacatctgagctctgtaaaat

SEQ ID NO: 461795 - DNA, 25 bp, Mus musculus
gactgacatctgtgctctgtaaaat

SEQ ID NO: 461796 - DNA, 25 bp, Mus musculus
gactgacatggtcgtttgcctggaa

SEQ ID NO: 461797 - DNA, 25 bp, Mus musculus
gactgacatggtggtttgcctggaa

SEQ ID NO: 461798 - DNA, 25 bp, Mus musculus
gactgacatgttctccgtgtcccat

SEQ ID NO: 461799 - DNA, 25 bp, Mus musculus
gactgacatgttgtccgtgtcccat

SEQ ID NO: 461800 - DNA, 25 bp, Mus musculus
gactgacatttcaattagaagtatt

SEQ ID NO: 461801 - DNA, 25 bp, Mus musculus
gactgacatttcaggatgcatctgt

SEQ ID NO: 461802 - DNA, 25 bp, Mus musculus
gactgacatttctattagaagtatt

SEQ ID NO: 461803 - DNA, 25 bp, Mus musculus
gactgacatttctggatgcatctgt

SEQ ID NO: 461804 - DNA, 25 bp, Mus musculus
gactgaccacttaagttcaatttta

SEQ ID NO: 461805 - DNA, 25 bp, Mus musculus
gactgaccactttagttcaatttta

SEQ ID NO: 461806 - DNA, 25 bp, Mus musculus
gactgaccagaaagctcttcatgtg

SEQ ID NO: 461807 - DNA, 25 bp, Mus musculus
gactgaccagaatgctcttcatgtg

SEQ ID NO: 461808 - DNA, 25 bp, Mus musculus
gactgaccagcaagagtcctgatgc

SEQ ID NO: 461809 - DNA, 25 bp, Mus musculus
gactgaccagcatgagtcctgatgc

SEQ ID NO: 461810 - DNA, 25 bp, Mus musculus
gactgaccaggaaggtttacagttt

SEQ ID NO: 461811 - DNA, 25 bp, Mus musculus
gactgaccaggatggtttacagttt

SEQ ID NO: 461812 - DNA, 25 bp, Mus musculus
gactgaccagtcatgtacagttttt

SEQ ID NO: 461813 - DNA, 25 bp, Mus musculus
gactgaccagtcttgtacagttttt

SEQ ID NO: 461814 - DNA, 25 bp, Mus musculus
gactgacccaagcatgttataaaga

SEQ ID NO: 461815 - DNA, 25 bp, Mus musculus
gactgacccaaggatgttataaaga

SEQ ID NO: 461816 - DNA, 25 bp, Mus musculus
gactgacccctgcagcacattaagg

SEQ ID NO: 461817 - DNA, 25 bp, Mus musculus
gactgacccctggagcacattaagg

SEQ ID NO: 461818 - DNA, 25 bp, Mus musculus
gactgacccgttaccatcagaaaag

SEQ ID NO: 461819 - DNA, 25 bp, Mus musculus
gactgacccgtttccatcagaaaag

SEQ ID NO: 461820 - DNA, 25 bp, Mus musculus
gactgaccgctaataggtggcaaac

SEQ ID NO: 461821 - DNA, 25 bp, Mus musculus
gactgaccgctattaggtggcaaac

SEQ ID NO: 461822 - DNA, 25 bp, Mus musculus
gactgacctcaaacttttctgtccc

SEQ ID NO: 461823 - DNA, 25 bp, Mus musculus
gactgacctcaatcttttctgtccc

SEQ ID NO: 461824 - DNA, 25 bp, Mus musculus
gactgacctcgtcacctaaagtggg

SEQ ID NO: 461825 - DNA, 25 bp, Mus musculus
gactgacctcgtgacctaaagtggg

SEQ ID NO: 461826 - DNA, 25 bp, Mus musculus
gactgacctgacatgcattttctca

SEQ ID NO: 461827 - DNA, 25 bp, Mus musculus
gactgacctgacttgcattttctca

SEQ ID NO: 461828 - DNA, 25 bp, Mus musculus
gactgacctggtcgtatataacaca

SEQ ID NO: 461829 - DNA, 25 bp, Mus musculus
gactgacctggtggtatataacaca

SEQ ID NO: 461830 - DNA, 25 bp, Mus musculus
gactgacctgtactgattaccactg

SEQ ID NO: 461831 - DNA, 25 bp, Mus musculus
gactgacctgtagtgattaccactg

SEQ ID NO: 461832 - DNA, 25 bp, Mus musculus
gactgacctgtgagcttgggtgcct

SEQ ID NO: 461833 - DNA, 25 bp, Mus musculus
gactgacctgtgtgcttgggtgcct

SEQ ID NO: 461834 - DNA, 25 bp, Mus musculus
gactgaccttaaactcgttctgtag

SEQ ID NO: 461835 - DNA, 25 bp, Mus musculus
gactgaccttaaacttgcagcaatc

SEQ ID NO: 461836 - DNA, 25 bp, Mus musculus
gactgaccttaaccatactttttct

SEQ ID NO: 461837 - DNA, 25 bp, Mus musculus
gactgaccttaagcatactttttct

SEQ ID NO: 461838 - DNA, 25 bp, Mus musculus
gactgaccttaatctcgttctgtag

SEQ ID NO: 461839 - DNA, 25 bp, Mus musculus
gactgaccttaatcttgcagcaatc

SEQ ID NO: 461840 - DNA, 25 bp, Mus musculus
gactgaccttctccagagaacacgc

SEQ ID NO: 461841 - DNA, 25 bp, Mus musculus
gactgaccttctgcagagaacacgc

SEQ ID NO: 461842 - DNA, 25 bp, Mus musculus
gactgaccttgcaaattagtgtgag

SEQ ID NO: 461843 - DNA, 25 bp, Mus musculus
gactgaccttgctaattagtgtgag

SEQ ID NO: 461844 - DNA, 25 bp, Mus musculus
gactgacctttacctttgtaataga

SEQ ID NO: 461845 - DNA, 25 bp, Mus musculus
gactgacctttagctttgtaataga

SEQ ID NO: 461846 - DNA, 25 bp, Mus musculus
gactgacgactgaggtcacttcaca

SEQ ID NO: 461847 - DNA, 25 bp, Mus musculus
gactgacgactgtggtcacttcaca

SEQ ID NO: 461848 - DNA, 25 bp, Mus musculus
gactgacgagaccagcattcacaat

SEQ ID NO: 461849 - DNA, 25 bp, Mus musculus
gactgacgagacgagcattcacaat

SEQ ID NO: 461850 - DNA, 25 bp, Mus musculus
gactgacgaggccacacccatgggc

SEQ ID NO: 461851 - DNA, 25 bp, Mus musculus
gactgacgaggcgacacccatgggc

SEQ ID NO: 461852 - DNA, 25 bp, Mus musculus
gactgacgccagcaatcttaccatg

SEQ ID NO: 461853 - DNA, 25 bp, Mus musculus
gactgacgccaggaatcttaccatg

SEQ ID NO: 461854 - DNA, 25 bp, Mus musculus
gactgacggaataacttatgccaat

SEQ ID NO: 461855 - DNA, 25 bp, Mus musculus
gactgacggaattacttatgccaat

SEQ ID NO: 461856 - DNA, 25 bp, Mus musculus
gactgacggagaaggaatccggtat

SEQ ID NO: 461857 - DNA, 25 bp, Mus musculus
gactgacggagatggaatccggtat

SEQ ID NO: 461858 - DNA, 25 bp, Mus musculus
gactgacggtgccaatgtgtgaatc

SEQ ID NO: 461859 - DNA, 25 bp, Mus musculus
gactgacggtgcgaatgtgtgaatc

SEQ ID NO: 461860 - DNA, 25 bp, Mus musculus
gactgacgtcacaggattcaaacca

SEQ ID NO: 461861 - DNA, 25 bp, Mus musculus
gactgacgtcactggattcaaacca

SEQ ID NO: 461862 - DNA, 25 bp, Mus musculus
gactgactaattccactacacaaca

SEQ ID NO: 461863 - DNA, 25 bp, Mus musculus
gactgactaattgcactacacaaca

SEQ ID NO: 461864 - DNA, 25 bp, Mus musculus
gactgactaccacagtgagcattca

SEQ ID NO: 461865 - DNA, 25 bp, Mus musculus
gactgactaccagagtgagcattca

SEQ ID NO: 461866 - DNA, 25 bp, Mus musculus
gactgactacccagctcttgggaaa

SEQ ID NO: 461867 - DNA, 25 bp, Mus musculus
gactgactaccctgctcttgggaaa

SEQ ID NO: 461868 - DNA, 25 bp, Mus musculus
gactgactactaccaagtggaaccg

SEQ ID NO: 461869 - DNA, 25 bp, Mus musculus
gactgactactagcaagtggaaccg

SEQ ID NO: 461870 - DNA, 25 bp, Mus musculus
gactgactacttagagtactggctg

SEQ ID NO: 461871 - DNA, 25 bp, Mus musculus
gactgactactttgagtactggctg

SEQ ID NO: 461872 - DNA, 25 bp, Mus musculus
gactgactagtcagggccggaatga

SEQ ID NO: 461873 - DNA, 25 bp, Mus musculus
gactgactagtctgggccggaatga

SEQ ID NO: 461874 - DNA, 25 bp, Mus musculus
gactgactagttatgggaatttctt

SEQ ID NO: 461875 - DNA, 25 bp, Mus musculus
gactgactagttttgggaatttctt

SEQ ID NO: 461876 - DNA, 25 bp, Mus musculus
gactgactcaaaccctggtgatgtt

SEQ ID NO: 461877 - DNA, 25 bp, Mus musculus
gactgactcaaagcctggtgatgtt

SEQ ID NO: 461878 - DNA, 25 bp, Mus musculus
gactgactcagtccctggaacatca

SEQ ID NO: 461879 - DNA, 25 bp, Mus musculus
gactgactcagtgcctggaacatca

SEQ ID NO: 461880 - DNA, 25 bp, Mus musculus
gactgactcctcaggacttggagta

SEQ ID NO: 461881 - DNA, 25 bp, Mus musculus
gactgactcctctggacttggagta

SEQ ID NO: 461882 - DNA, 25 bp, Mus musculus
gactgactcggcaatatgttgctta

SEQ ID NO: 461883 - DNA, 25 bp, Mus musculus
gactgactcggctatatgttgctta

SEQ ID NO: 461884 - DNA, 25 bp, Mus musculus
gactgactgaatctgatacagcctc

SEQ ID NO: 461885 - DNA, 25 bp, Mus musculus
gactgactgaatgtgatacagcctc

SEQ ID NO: 461886 - DNA, 25 bp, Mus musculus
gactgactgacaagccctaaggact

SEQ ID NO: 461887 - DNA, 25 bp, Mus musculus
gactgactgacatgccctaaggact

SEQ ID NO: 461888 - DNA, 25 bp, Mus musculus
gactgactgataagtgttcaccctt

SEQ ID NO: 461889 - DNA, 25 bp, Mus musculus
gactgactgatatgtgttcaccctt

SEQ ID NO: 461890 - DNA, 25 bp, Mus musculus
gactgactgcagcacgtggtgatca

SEQ ID NO: 461891 - DNA, 25 bp, Mus musculus
gactgactgcaggacgtggtgatca

SEQ ID NO: 461892 - DNA, 25 bp, Mus musculus
gactgactgcatcatgtgcgactaa

SEQ ID NO: 461893 - DNA, 25 bp, Mus musculus
gactgactgcatgatgtgcgactaa

SEQ ID NO: 461894 - DNA, 25 bp, Mus musculus
gactgactgccaagcattgctgtga

SEQ ID NO: 461895 - DNA, 25 bp, Mus musculus
gactgactgccatgcattgctgtga

SEQ ID NO: 461896 - DNA, 25 bp, Mus musculus
gactgactgcgacgaactcgttcct

SEQ ID NO: 461897 - DNA, 25 bp, Mus musculus
gactgactgcgaggaactcgttcct

SEQ ID NO: 461898 - DNA, 25 bp, Mus musculus
gactgactgcttccatgtgcacctg

SEQ ID NO: 461899 - DNA, 25 bp, Mus musculus
gactgactgcttcttgccaaactgg

SEQ ID NO: 461900 - DNA, 25 bp, Mus musculus
gactgactgcttgcatgtgcacctg

SEQ ID NO: 461901 - DNA, 25 bp, Mus musculus
gactgactgcttgttgccaaactgg

SEQ ID NO: 461902 - DNA, 25 bp, Mus musculus
gactgactggagacctcacatcatg

SEQ ID NO: 461903 - DNA, 25 bp, Mus musculus
gactgactggagtcctcacatcatg

SEQ ID NO: 461904 - DNA, 25 bp, Mus musculus
gactgactggccagctaagaacaca

SEQ ID NO: 461905 - DNA, 25 bp, Mus musculus
gactgactggcctgctaagaacaca

SEQ ID NO: 461906 - DNA, 25 bp, Mus musculus
gactgactggctacattggcctaaa

SEQ ID NO: 461907 - DNA, 25 bp, Mus musculus
gactgactggcttcattggcctaaa

SEQ ID NO: 461908 - DNA, 25 bp, Mus musculus
gactgactgtatctatcctgtgcaa

SEQ ID NO: 461909 - DNA, 25 bp, Mus musculus
gactgactgtatgtatcctgtgcaa

SEQ ID NO: 461910 - DNA, 25 bp, Mus musculus
gactgactgtgtatctaccatgtgt

SEQ ID NO: 461911 - DNA, 25 bp, Mus musculus
gactgactgtgtttctaccatgtgt

SEQ ID NO: 461912 - DNA, 25 bp, Mus musculus
gactgacttataaatgccctgtgag

SEQ ID NO: 461913 - DNA, 25 bp, Mus musculus
gactgacttatatatgccctgtgag

SEQ ID NO: 461914 - DNA, 25 bp, Mus musculus
gactgacttcctcagcttctacact

SEQ ID NO: 461915 - DNA, 25 bp, Mus musculus
gactgacttcctccatgacagaggt

SEQ ID NO: 461916 - DNA, 25 bp, Mus musculus
gactgacttcctgagcttctacact

SEQ ID NO: 461917 - DNA, 25 bp, Mus musculus
gactgacttcctgcatgacagaggt

SEQ ID NO: 461918 - DNA, 25 bp, Mus musculus
gactgacttgacagtatccactggg

SEQ ID NO: 461919 - DNA, 25 bp, Mus musculus
gactgacttgactgtatccactggg

SEQ ID NO: 461920 - DNA, 25 bp, Mus musculus
gactgacttggtaagctcctacata

SEQ ID NO: 461921 - DNA, 25 bp, Mus musculus
gactgacttggtcgatctttttaat

SEQ ID NO: 461922 - DNA, 25 bp, Mus musculus
gactgacttggtggatctttttaat

SEQ ID NO: 461923 - DNA, 25 bp, Mus musculus
gactgacttggttagctcctacata

SEQ ID NO: 461924 - DNA, 25 bp, Mus musculus
gactgactttaacgcccagctagct

SEQ ID NO: 461925 - DNA, 25 bp, Mus musculus
gactgactttaaggcccagctagct

SEQ ID NO: 461926 - DNA, 25 bp, Mus musculus
gactgactttctaacggtgcacatt

SEQ ID NO: 461927 - DNA, 25 bp, Mus musculus
gactgactttcttacggtgcacatt

SEQ ID NO: 461928 - DNA, 25 bp, Mus musculus
gactgactttgaagctacaccagaa

SEQ ID NO: 461929 - DNA, 25 bp, Mus musculus
gactgactttgatgctacaccagaa

SEQ ID NO: 461930 - DNA, 25 bp, Mus musculus
gactgagaaaatcttccgccaaatg

SEQ ID NO: 461931 - DNA, 25 bp, Mus musculus
gactgagaaaatgttccgccaaatg

SEQ ID NO: 461932 - DNA, 25 bp, Mus musculus
gactgagaaatgaaccctcccatat

SEQ ID NO: 461933 - DNA, 25 bp, Mus musculus
gactgagaaatgtaccctcccatat

SEQ ID NO: 461934 - DNA, 25 bp, Mus musculus
gactgagaaccgactatggttcaag

SEQ ID NO: 461935 - DNA, 25 bp, Mus musculus
gactgagaaccgcagcctggactgt

SEQ ID NO: 461936 - DNA, 25 bp, Mus musculus
gactgagaaccggagcctggactgt

SEQ ID NO: 461937 - DNA, 25 bp, Mus musculus
gactgagaaccgtctatggttcaag

SEQ ID NO: 461938 - DNA, 25 bp, Mus musculus
gactgagaactgagcctcctgctgc

SEQ ID NO: 461939 - DNA, 25 bp, Mus musculus
gactgagaactgtgcctcctgctgc

SEQ ID NO: 461940 - DNA, 25 bp, Mus musculus
gactgagaaggtacacgtggacact

SEQ ID NO: 461941 - DNA, 25 bp, Mus musculus
gactgagaaggtacatttcctaaat

SEQ ID NO: 461942 - DNA, 25 bp, Mus musculus
gactgagaaggttcacgtggacact

SEQ ID NO: 461943 - DNA, 25 bp, Mus musculus
gactgagaaggttcatttcctaaat

SEQ ID NO: 461944 - DNA, 25 bp, Mus musculus
gactgagaattactgatgccaccca

SEQ ID NO: 461945 - DNA, 25 bp, Mus musculus
gactgagaattagtgatgccaccca

SEQ ID NO: 461946 - DNA, 25 bp, Mus musculus
gactgagacatgattgtacaaaagg

SEQ ID NO: 461947 - DNA, 25 bp, Mus musculus
gactgagacatgtttgtacaaaagg

SEQ ID NO: 461948 - DNA, 25 bp, Mus musculus
gactgagagatgactctcgcggcca

SEQ ID NO: 461949 - DNA, 25 bp, Mus musculus
gactgagagatgtctctcgcggcca

SEQ ID NO: 461950 - DNA, 25 bp, Mus musculus
gactgagagcttattccgaaggctg

SEQ ID NO: 461951 - DNA, 25 bp, Mus musculus
gactgagagctttttccgaaggctg

SEQ ID NO: 461952 - DNA, 25 bp, Mus musculus
gactgagagtgtcctaatttcctaa

SEQ ID NO: 461953 - DNA, 25 bp, Mus musculus
gactgagagtgtgctaatttcctaa

SEQ ID NO: 461954 - DNA, 25 bp, Mus musculus
gactgagagttaccaaatcctcgat

SEQ ID NO: 461955 - DNA, 25 bp, Mus musculus
gactgagagttagcaaatcctcgat

SEQ ID NO: 461956 - DNA, 25 bp, Mus musculus
gactgagcaacaatcaggtctcttt

SEQ ID NO: 461957 - DNA, 25 bp, Mus musculus
gactgagcaacattcaggtctcttt

SEQ ID NO: 461958 - DNA, 25 bp, Mus musculus
gactgagcaagaacatgcaaagttt

SEQ ID NO: 461959 - DNA, 25 bp, Mus musculus
gactgagcaagatcatgcaaagttt

SEQ ID NO: 461960 - DNA, 25 bp, Mus musculus
gactgagcacagaaactagagggtt

SEQ ID NO: 461961 - DNA, 25 bp, Mus musculus
gactgagcacagaccgcttgagcta

SEQ ID NO: 461962 - DNA, 25 bp, Mus musculus
gactgagcacagtaactagagggtt

SEQ ID NO: 461963 - DNA, 25 bp, Mus musculus
gactgagcacagtccgcttgagcta

SEQ ID NO: 461964 - DNA, 25 bp, Mus musculus
gactgagcatcaaaagagcccgaga

SEQ ID NO: 461965 - DNA, 25 bp, Mus musculus
gactgagcatcataagagcccgaga

SEQ ID NO: 461966 - DNA, 25 bp, Mus musculus
gactgagcatctacaggctttgaaa

SEQ ID NO: 461967 - DNA, 25 bp, Mus musculus
gactgagcatctcagtgcagcccag

SEQ ID NO: 461968 - DNA, 25 bp, Mus musculus
gactgagcatctgagtgcagcccag

SEQ ID NO: 461969 - DNA, 25 bp, Mus musculus
gactgagcatcttcaggctttgaaa

SEQ ID NO: 461970 - DNA, 25 bp, Mus musculus
gactgagcatgaccgtctggagcaa

SEQ ID NO: 461971 - DNA, 25 bp, Mus musculus
gactgagcatgagcgtctggagcaa

SEQ ID NO: 461972 - DNA, 25 bp, Mus musculus
gactgagccagccagcatcatgtga

SEQ ID NO: 461973 - DNA, 25 bp, Mus musculus
gactgagccagcgagcatcatgtga

SEQ ID NO: 461974 - DNA, 25 bp, Mus musculus
gactgagccagtagccaatgccaga

SEQ ID NO: 461975 - DNA, 25 bp, Mus musculus
gactgagccagttgccaatgccaga

SEQ ID NO: 461976 - DNA, 25 bp, Mus musculus
gactgagccatcagggacatacccc

SEQ ID NO: 461977 - DNA, 25 bp, Mus musculus
gactgagccatctgggacatacccc

SEQ ID NO: 461978 - DNA, 25 bp, Mus musculus
gactgagcccctagacttgtataaa

SEQ ID NO: 461979 - DNA, 25 bp, Mus musculus
gactgagcccctatgtgaagttctt

SEQ ID NO: 461980 - DNA, 25 bp, Mus musculus
gactgagccccttgacttgtataaa

SEQ ID NO: 461981 - DNA, 25 bp, Mus musculus
gactgagcccctttgtgaagttctt

SEQ ID NO: 461982 - DNA, 25 bp, Mus musculus
gactgagccgagaaaacctatgttt

SEQ ID NO: 461983 - DNA, 25 bp, Mus musculus
gactgagccgagtaaacctatgttt

SEQ ID NO: 461984 - DNA, 25 bp, Mus musculus
gactgagcctatcccattctagata

SEQ ID NO: 461985 - DNA, 25 bp, Mus musculus
gactgagcctatgccattctagata

SEQ ID NO: 461986 - DNA, 25 bp, Mus musculus
gactgagcctgtaagataagcatcc

SEQ ID NO: 461987 - DNA, 25 bp, Mus musculus
gactgagcctgttagataagcatcc

SEQ ID NO: 461988 - DNA, 25 bp, Mus musculus
gactgagccttgctctgtgcagatg

SEQ ID NO: 461989 - DNA, 25 bp, Mus musculus
gactgagccttggtctgtgcagatg

SEQ ID NO: 461990 - DNA, 25 bp, Mus musculus
gactgagcgacgaggccttcgtttt

SEQ ID NO: 461991 - DNA, 25 bp, Mus musculus
gactgagcgacgtggccttcgtttt

SEQ ID NO: 461992 - DNA, 25 bp, Mus musculus
gactgagctagtaagagtgtcacaa

SEQ ID NO: 461993 - DNA, 25 bp, Mus musculus
gactgagctagttagagtgtcacaa

SEQ ID NO: 461994 - DNA, 25 bp, Mus musculus
gactgagctcatctagcgagtgcaa

SEQ ID NO: 461995 - DNA, 25 bp, Mus musculus
gactgagctcatgtagcgagtgcaa

SEQ ID NO: 461996 - DNA, 25 bp, Mus musculus
gactgagctggacacttttcgctta

SEQ ID NO: 461997 - DNA, 25 bp, Mus musculus
gactgagctggagacttttcgctta

SEQ ID NO: 461998 - DNA, 25 bp, Mus musculus
gactgagcttagcttcttcactggc

SEQ ID NO: 461999 - DNA, 25 bp, Mus musculus
gactgagcttaggttcttcactggc

SEQ ID NO: 462000 - DNA, 25 bp, Mus musculus
gactgaggagacactagaattggga

SEQ ID NO: 462001 - DNA, 25 bp, Mus musculus
gactgaggagactctagaattggga

SEQ ID NO: 462002 - DNA, 25 bp, Mus musculus
gactgaggattacaggcatttggtt

SEQ ID NO: 462003 - DNA, 25 bp, Mus musculus
gactgaggattagaggcatttggtt

SEQ ID NO: 462004 - DNA, 25 bp, Mus musculus
gactgaggcaatactgaaacacaaa

SEQ ID NO: 462005 - DNA, 25 bp, Mus musculus
gactgaggcaattctgaaacacaaa

SEQ ID NO: 462006 - DNA, 25 bp, Mus musculus
gactgaggcacgagcatcccaagag

SEQ ID NO: 462007 - DNA, 25 bp, Mus musculus
gactgaggcacgtgcatcccaagag

SEQ ID NO: 462008 - DNA, 25 bp, Mus musculus
gactgaggcagtctgaacaactagt

SEQ ID NO: 462009 - DNA, 25 bp, Mus musculus
gactgaggcagtgtgaacaactagt

SEQ ID NO: 462010 - DNA, 25 bp, Mus musculus
gactgaggcatcacacacctgggta

SEQ ID NO: 462011 - DNA, 25 bp, Mus musculus
gactgaggcatctcacacctgggta

SEQ ID NO: 462012 - DNA, 25 bp, Mus musculus
gactgaggcatgcagatttctgtga

SEQ ID NO: 462013 - DNA, 25 bp, Mus musculus
gactgaggcatggagatttctgtga

SEQ ID NO: 462014 - DNA, 25 bp, Mus musculus
gactgaggcattcaggaaccccttc

SEQ ID NO: 462015 - DNA, 25 bp, Mus musculus
gactgaggcattgaggaaccccttc

SEQ ID NO: 462016 - DNA, 25 bp, Mus musculus
gactgaggccagattccatacaaag

SEQ ID NO: 462017 - DNA, 25 bp, Mus musculus
gactgaggccagtttccatacaaag

SEQ ID NO: 462018 - DNA, 25 bp, Mus musculus
gactgaggccctcccctcagggaag

SEQ ID NO: 462019 - DNA, 25 bp, Mus musculus
gactgaggccctgccctcagggaag

SEQ ID NO: 462020 - DNA, 25 bp, Mus musculus
gactgaggcctgagaacttaccaaa

SEQ ID NO: 462021 - DNA, 25 bp, Mus musculus
gactgaggcctgtgaacttaccaaa

SEQ ID NO: 462022 - DNA, 25 bp, Mus musculus
gactgaggcgagatggttttcactt

SEQ ID NO: 462023 - DNA, 25 bp, Mus musculus
gactgaggcgagttggttttcactt

SEQ ID NO: 462024 - DNA, 25 bp, Mus musculus
gactgaggcttcaaagtagagacct

SEQ ID NO: 462025 - DNA, 25 bp, Mus musculus
gactgaggcttcaccctaccctgat

SEQ ID NO: 462026 - DNA, 25 bp, Mus musculus
gactgaggcttctaagtagagacct

SEQ ID NO: 462027 - DNA, 25 bp, Mus musculus
gactgaggcttctccctaccctgat

SEQ ID NO: 462028 - DNA, 25 bp, Mus musculus
gactgaggctttatgccacaccttt

SEQ ID NO: 462029 - DNA, 25 bp, Mus musculus
gactgaggctttttgccacaccttt

SEQ ID NO: 462030 - DNA, 25 bp, Mus musculus
gactgagggacacggctcacacaaa

SEQ ID NO: 462031 - DNA, 25 bp, Mus musculus
gactgagggacagggctcacacaaa

SEQ ID NO: 462032 - DNA, 25 bp, Mus musculus
gactgagggagcaatctttcacaga

SEQ ID NO: 462033 - DNA, 25 bp, Mus musculus
gactgagggagctatctttcacaga

SEQ ID NO: 462034 - DNA, 25 bp, Mus musculus
gactgagggcttattaaacttggtg

SEQ ID NO: 462035 - DNA, 25 bp, Mus musculus
gactgagggctttttaaacttggtg

SEQ ID NO: 462036 - DNA, 25 bp, Mus musculus
gactgagggtcacttccagtttccc

SEQ ID NO: 462037 - DNA, 25 bp, Mus musculus
gactgagggtcagttccagtttccc

SEQ ID NO: 462038 - DNA, 25 bp, Mus musculus
gactgaggtaatcaatttgcacctt

SEQ ID NO: 462039 - DNA, 25 bp, Mus musculus
gactgaggtaatgaatttgcacctt

SEQ ID NO: 462040 - DNA, 25 bp, Mus musculus
gactgaggtcctaggtagcctgagt

SEQ ID NO: 462041 - DNA, 25 bp, Mus musculus
gactgaggtccttggtagcctgagt

SEQ ID NO: 462042 - DNA, 25 bp, Mus musculus
gactgaggtctcaggatcccggcct

SEQ ID NO: 462043 - DNA, 25 bp, Mus musculus
gactgaggtctctggatcccggcct

SEQ ID NO: 462044 - DNA, 25 bp, Mus musculus
gactgagtacctcaaccggcatctg

SEQ ID NO: 462045 - DNA, 25 bp, Mus musculus
gactgagtacctgaaccggcatctg

SEQ ID NO: 462046 - DNA, 25 bp, Mus musculus
gactgagtacgcacagtggttattc

SEQ ID NO: 462047 - DNA, 25 bp, Mus musculus
gactgagtacgctcagtggttattc

SEQ ID NO: 462048 - DNA, 25 bp, Mus musculus
gactgagtataacaatgacacctga

SEQ ID NO: 462049 - DNA, 25 bp, Mus musculus
gactgagtataagaatgacacctga

SEQ ID NO: 462050 - DNA, 25 bp, Mus musculus
gactgagtcaaacgctcctgatgtt

SEQ ID NO: 462051 - DNA, 25 bp, Mus musculus
gactgagtcaaaggctcctgatgtt

SEQ ID NO: 462052 - DNA, 25 bp, Mus musculus
gactgagtcacaagatgactgctga

SEQ ID NO: 462053 - DNA, 25 bp, Mus musculus
gactgagtcacatgatgactgctga

SEQ ID NO: 462054 - DNA, 25 bp, Mus musculus
gactgagtcagactgtgttctgctc

SEQ ID NO: 462055 - DNA, 25 bp, Mus musculus
gactgagtcagagtgtgttctgctc

SEQ ID NO: 462056 - DNA, 25 bp, Mus musculus
gactgagtcaggaggcttgcacatt

SEQ ID NO: 462057 - DNA, 25 bp, Mus musculus
gactgagtcaggtggcttgcacatt

SEQ ID NO: 462058 - DNA, 25 bp, Mus musculus
gactgagtcattagtgttctgttaa

SEQ ID NO: 462059 - DNA, 25 bp, Mus musculus
gactgagtcatttgtgttctgttaa

SEQ ID NO: 462060 - DNA, 25 bp, Mus musculus
gactgagtccacattgagacgtctg

SEQ ID NO: 462061 - DNA, 25 bp, Mus musculus
gactgagtccactttgagacgtctg

SEQ ID NO: 462062 - DNA, 25 bp, Mus musculus
gactgagtccagaccatggcaattc

SEQ ID NO: 462063 - DNA, 25 bp, Mus musculus
gactgagtccagtccatggcaattc

SEQ ID NO: 462064 - DNA, 25 bp, Mus musculus
gactgagtctgtcttactaattcct

SEQ ID NO: 462065 - DNA, 25 bp, Mus musculus
gactgagtctgtgttactaattcct

SEQ ID NO: 462066 - DNA, 25 bp, Mus musculus
gactgagtcttcatatacatgtata

SEQ ID NO: 462067 - DNA, 25 bp, Mus musculus
gactgagtcttcttatacatgtata

SEQ ID NO: 462068 - DNA, 25 bp, Mus musculus
gactgagtcttgagtatactttaac

SEQ ID NO: 462069 - DNA, 25 bp, Mus musculus
gactgagtcttgtgtatactttaac

SEQ ID NO: 462070 - DNA, 25 bp, Mus musculus
gactgagtgcagctgatctggccac

SEQ ID NO: 462071 - DNA, 25 bp, Mus musculus
gactgagtgcaggtgatctggccac

SEQ ID NO: 462072 - DNA, 25 bp, Mus musculus
gactgagtggagaaaacttcttatt

SEQ ID NO: 462073 - DNA, 25 bp, Mus musculus
gactgagtggagtaaacttcttatt

SEQ ID NO: 462074 - DNA, 25 bp, Mus musculus
gactgagtggttcggtgttttccta

SEQ ID NO: 462075 - DNA, 25 bp, Mus musculus
gactgagtggttgggtgttttccta

SEQ ID NO: 462076 - DNA, 25 bp, Mus musculus
gactgagtgtagaagcctgcctgcc

SEQ ID NO: 462077 - DNA, 25 bp, Mus musculus
gactgagtgtagtagcctgcctgcc

SEQ ID NO: 462078 - DNA, 25 bp, Mus musculus
gactgagtgtcacctagccagacga

SEQ ID NO: 462079 - DNA, 25 bp, Mus musculus
gactgagtgtcagctagccagacga

SEQ ID NO: 462080 - DNA, 25 bp, Mus musculus
gactgagtgtccataatagaggagt

SEQ ID NO: 462081 - DNA, 25 bp, Mus musculus
gactgagtgtccttaatagaggagt

SEQ ID NO: 462082 - DNA, 25 bp, Mus musculus
gactgagttaccagcattcttgatt

SEQ ID NO: 462083 - DNA, 25 bp, Mus musculus
gactgagttacctgcattcttgatt

SEQ ID NO: 462084 - DNA, 25 bp, Mus musculus
gactgagttcctcctcttgttgctt

SEQ ID NO: 462085 - DNA, 25 bp, Mus musculus
gactgagttcctgctcttgttgctt

SEQ ID NO: 462086 - DNA, 25 bp, Mus musculus
gactgagttctgaacacacttgttt

SEQ ID NO: 462087 - DNA, 25 bp, Mus musculus
gactgagttctgtacacacttgttt

SEQ ID NO: 462088 - DNA, 25 bp, Mus musculus
gactgagtttcaacctagtttaggt

SEQ ID NO: 462089 - DNA, 25 bp, Mus musculus
gactgagtttcatcctagtttaggt

SEQ ID NO: 462090 - DNA, 25 bp, Mus musculus
gactgagtttcccttcaaacttgta

SEQ ID NO: 462091 - DNA, 25 bp, Mus musculus
gactgagtttccgttcaaacttgta

SEQ ID NO: 462092 - DNA, 25 bp, Mus musculus
gactgataaccccagtattttcata

SEQ ID NO: 462093 - DNA, 25 bp, Mus musculus
gactgataacccgagtattttcata

SEQ ID NO: 462094 - DNA, 25 bp, Mus musculus
gactgataactaaggctaactcctg

SEQ ID NO: 462095 - DNA, 25 bp, Mus musculus
gactgataactatggctaactcctg

SEQ ID NO: 462096 - DNA, 25 bp, Mus musculus
gactgatacacacggacacactctc

SEQ ID NO: 462097 - DNA, 25 bp, Mus musculus
gactgatacacagggacacactctc

SEQ ID NO: 462098 - DNA, 25 bp, Mus musculus
gactgatacatgagttccttccttt

SEQ ID NO: 462099 - DNA, 25 bp, Mus musculus
gactgatacatgtgttccttccttt

SEQ ID NO: 462100 - DNA, 25 bp, Mus musculus
gactgatacattctattttctgtat

SEQ ID NO: 462101 - DNA, 25 bp, Mus musculus
gactgatacattgtattttctgtat

SEQ ID NO: 462102 - DNA, 25 bp, Mus musculus
gactgatacccaataggctttctaa

SEQ ID NO: 462103 - DNA, 25 bp, Mus musculus
gactgatacccattaggctttctaa

SEQ ID NO: 462104 - DNA, 25 bp, Mus musculus
gactgatacctacacctggatggcc

SEQ ID NO: 462105 - DNA, 25 bp, Mus musculus
gactgatacctagacctggatggcc

SEQ ID NO: 462106 - DNA, 25 bp, Mus musculus
gactgatacttacgcccaggaaata

SEQ ID NO: 462107 - DNA, 25 bp, Mus musculus
gactgatacttaggcccaggaaata

SEQ ID NO: 462108 - DNA, 25 bp, Mus musculus
gactgatatcagctgcgactgtata

SEQ ID NO: 462109 - DNA, 25 bp, Mus musculus
gactgatatcaggtgcgactgtata

SEQ ID NO: 462110 - DNA, 25 bp, Mus musculus
gactgatattataaccttctacata

SEQ ID NO: 462111 - DNA, 25 bp, Mus musculus
gactgatattattaccttctacata

SEQ ID NO: 462112 - DNA, 25 bp, Mus musculus
gactgatattggcagcatctgggca

SEQ ID NO: 462113 - DNA, 25 bp, Mus musculus
gactgatattgggagcatctgggca

SEQ ID NO: 462114 - DNA, 25 bp, Mus musculus
gactgatcagatcaatcggctttca

SEQ ID NO: 462115 - DNA, 25 bp, Mus musculus
gactgatcagatgaatcggctttca

SEQ ID NO: 462116 - DNA, 25 bp, Mus musculus
gactgatccagcctagactagtttg

SEQ ID NO: 462117 - DNA, 25 bp, Mus musculus
gactgatccagcgtagactagtttg

SEQ ID NO: 462118 - DNA, 25 bp, Mus musculus
gactgatccagtctcggtgtatgag

SEQ ID NO: 462119 - DNA, 25 bp, Mus musculus
gactgatccagtgtcggtgtatgag

SEQ ID NO: 462120 - DNA, 25 bp, Mus musculus
gactgatccctcaaggctggcatgt

SEQ ID NO: 462121 - DNA, 25 bp, Mus musculus
gactgatccctctaggctggcatgt

SEQ ID NO: 462122 - DNA, 25 bp, Mus musculus
gactgatcctggctctgagttgtca

SEQ ID NO: 462123 - DNA, 25 bp, Mus musculus
gactgatcctgggtctgagttgtca

SEQ ID NO: 462124 - DNA, 25 bp, Mus musculus
gactgatgaactccgctgaccctgg

SEQ ID NO: 462125 - DNA, 25 bp, Mus musculus
gactgatgaactgcgctgaccctgg

SEQ ID NO: 462126 - DNA, 25 bp, Mus musculus
gactgatgaagaatctcccgtgctc

SEQ ID NO: 462127 - DNA, 25 bp, Mus musculus
gactgatgaagattctcccgtgctc

SEQ ID NO: 462128 - DNA, 25 bp, Mus musculus
gactgatgaataactttcaacacat

SEQ ID NO: 462129 - DNA, 25 bp, Mus musculus
gactgatgaatatctttcaacacat

SEQ ID NO: 462130 - DNA, 25 bp, Mus musculus
gactgatgacctccactgaaaggca

SEQ ID NO: 462131 - DNA, 25 bp, Mus musculus
gactgatgacctgcactgaaaggca

SEQ ID NO: 462132 - DNA, 25 bp, Mus musculus
gactgatgactgacgactgttttta

SEQ ID NO: 462133 - DNA, 25 bp, Mus musculus
gactgatgactgtcgactgttttta

SEQ ID NO: 462134 - DNA, 25 bp, Mus musculus
gactgatgaggaccagactttcctg

SEQ ID NO: 462135 - DNA, 25 bp, Mus musculus
gactgatgaggagcagactttcctg

SEQ ID NO: 462136 - DNA, 25 bp, Mus musculus
gactgatgagtccttcaatcctggt

SEQ ID NO: 462137 - DNA, 25 bp, Mus musculus
gactgatgagtcgttcaatcctggt

SEQ ID NO: 462138 - DNA, 25 bp, Mus musculus
gactgatgctgtcagatcactatta

SEQ ID NO: 462139 - DNA, 25 bp, Mus musculus
gactgatgctgtgagatcactatta

SEQ ID NO: 462140 - DNA, 25 bp, Mus musculus
gactgatgggagacaaggacccttt

SEQ ID NO: 462141 - DNA, 25 bp, Mus musculus
gactgatgggagtcaaggacccttt

SEQ ID NO: 462142 - DNA, 25 bp, Mus musculus
gactgatgggttaaactctgacccc

SEQ ID NO: 462143 - DNA, 25 bp, Mus musculus
gactgatgggtttaactctgacccc

SEQ ID NO: 462144 - DNA, 25 bp, Mus musculus
gactgatggtcacgactctgtgaac

SEQ ID NO: 462145 - DNA, 25 bp, Mus musculus
gactgatggtcaggactctgtgaac

SEQ ID NO: 462146 - DNA, 25 bp, Mus musculus
gactgatggtccatgctggcttctg

SEQ ID NO: 462147 - DNA, 25 bp, Mus musculus
gactgatggtccttgctggcttctg

SEQ ID NO: 462148 - DNA, 25 bp, Mus musculus
gactgatgtaacagatgtttgccat

SEQ ID NO: 462149 - DNA, 25 bp, Mus musculus
gactgatgtaactgatgtttgccat

SEQ ID NO: 462150 - DNA, 25 bp, Mus musculus
gactgatgtcagaatttagaaagaa

SEQ ID NO: 462151 - DNA, 25 bp, Mus musculus
gactgatgtcagtatttagaaagaa

SEQ ID NO: 462152 - DNA, 25 bp, Mus musculus
gactgatgtcccagaataggcatat

SEQ ID NO: 462153 - DNA, 25 bp, Mus musculus
gactgatgtccctgaataggcatat

SEQ ID NO: 462154 - DNA, 25 bp, Mus musculus
gactgatgtggaatctgtgatcacc

SEQ ID NO: 462155 - DNA, 25 bp, Mus musculus
gactgatgtggaccaaatacccttt

SEQ ID NO: 462156 - DNA, 25 bp, Mus musculus
gactgatgtggagcaaatacccttt

SEQ ID NO: 462157 - DNA, 25 bp, Mus musculus
gactgatgtggattctgtgatcacc

SEQ ID NO: 462158 - DNA, 25 bp, Mus musculus
gactgatgttctaatttcacttatg

SEQ ID NO: 462159 - DNA, 25 bp, Mus musculus
gactgatgttcttatttcacttatg

SEQ ID NO: 462160 - DNA, 25 bp, Mus musculus
gactgattactgactcctgtttaac

SEQ ID NO: 462161 - DNA, 25 bp, Mus musculus
gactgattactgtctcctgtttaac

SEQ ID NO: 462162 - DNA, 25 bp, Mus musculus
gactgattacttatgtgtgactctt

SEQ ID NO: 462163 - DNA, 25 bp, Mus musculus
gactgattacttttgtgtgactctt

SEQ ID NO: 462164 - DNA, 25 bp, Mus musculus
gactgattagaacacactcataaac

SEQ ID NO: 462165 - DNA, 25 bp, Mus musculus
gactgattagaagacactcataaac

SEQ ID NO: 462166 - DNA, 25 bp, Mus musculus
gactgattatctcttctctatttga

SEQ ID NO: 462167 - DNA, 25 bp, Mus musculus
gactgattatctgttctctatttga

SEQ ID NO: 462168 - DNA, 25 bp, Mus musculus
gactgattcaagactcaccatgtag

SEQ ID NO: 462169 - DNA, 25 bp, Mus musculus
gactgattcaagtctcaccatgtag

SEQ ID NO: 462170 - DNA, 25 bp, Mus musculus
gactgattcagacttgatgcctttt

SEQ ID NO: 462171 - DNA, 25 bp, Mus musculus
gactgattcagagttgatgcctttt

SEQ ID NO: 462172 - DNA, 25 bp, Mus musculus
gactgattctctctgcaggatacac

SEQ ID NO: 462173 - DNA, 25 bp, Mus musculus
gactgattctctgtgcaggatacac

SEQ ID NO: 462174 - DNA, 25 bp, Mus musculus
gactgattctggattgttcccaaca

SEQ ID NO: 462175 - DNA, 25 bp, Mus musculus
gactgattctggctctgtcctgacc

SEQ ID NO: 462176 - DNA, 25 bp, Mus musculus
gactgattctgggtctgtcctgacc

SEQ ID NO: 462177 - DNA, 25 bp, Mus musculus
gactgattctggtttgttcccaaca

SEQ ID NO: 462178 - DNA, 25 bp, Mus musculus
gactgattcttaatgattcttaccg

SEQ ID NO: 462179 - DNA, 25 bp, Mus musculus
gactgattcttattgattcttaccg

SEQ ID NO: 462180 - DNA, 25 bp, Mus musculus
gactgattgattcacttcaaggcct

SEQ ID NO: 462181 - DNA, 25 bp, Mus musculus
gactgattgattgacttcaaggcct

SEQ ID NO: 462182 - DNA, 25 bp, Mus musculus
gactgattggaactggaccgtgcaa

SEQ ID NO: 462183 - DNA, 25 bp, Mus musculus
gactgattggaagtggaccgtgcaa

SEQ ID NO: 462184 - DNA, 25 bp, Mus musculus
gactgattggagctagatttgttga

SEQ ID NO: 462185 - DNA, 25 bp, Mus musculus
gactgattggaggtagatttgttga

SEQ ID NO: 462186 - DNA, 25 bp, Mus musculus
gactgattggtaatttggaagcttc

SEQ ID NO: 462187 - DNA, 25 bp, Mus musculus
gactgattggtattttggaagcttc

SEQ ID NO: 462188 - DNA, 25 bp, Mus musculus
gactgatttcctactgtgcatgtaa

SEQ ID NO: 462189 - DNA, 25 bp, Mus musculus
gactgatttccttctgtgcatgtaa

SEQ ID NO: 462190 - DNA, 25 bp, Mus musculus
gactgattttgccaaggtcccacaa

SEQ ID NO: 462191 - DNA, 25 bp, Mus musculus
gactgattttgcgaaggtcccacaa

SEQ ID NO: 462192 - DNA, 25 bp, Mus musculus
gactgattttgtactcttgatccaa

SEQ ID NO: 462193 - DNA, 25 bp, Mus musculus
gactgattttgttctcttgatccaa

SEQ ID NO: 462194 - DNA, 25 bp, Mus musculus
gactgcaaaatccaatgtgcttcct

SEQ ID NO: 462195 - DNA, 25 bp, Mus musculus
gactgcaaaatcgaatgtgcttcct

SEQ ID NO: 462196 - DNA, 25 bp, Mus musculus
gactgcaaaattcctgtgccatctg

SEQ ID NO: 462197 - DNA, 25 bp, Mus musculus
gactgcaaaattgctgtgccatctg

SEQ ID NO: 462198 - DNA, 25 bp, Mus musculus
gactgcaaagtgctccctgcacttt

SEQ ID NO: 462199 - DNA, 25 bp, Mus musculus
gactgcaaagtggtccctgcacttt

SEQ ID NO: 462200 - DNA, 25 bp, Mus musculus
gactgcaacatgattataccactga

SEQ ID NO: 462201 - DNA, 25 bp, Mus musculus
gactgcaacatgtttataccactga

SEQ ID NO: 462202 - DNA, 25 bp, Mus musculus
gactgcaacattcttgcttcagtgt

SEQ ID NO: 462203 - DNA, 25 bp, Mus musculus
gactgcaacattgttgcttcagtgt

SEQ ID NO: 462204 - DNA, 25 bp, Mus musculus
gactgcaacttgacttggtgaatta

SEQ ID NO: 462205 - DNA, 25 bp, Mus musculus
gactgcaacttgtcttggtgaatta

SEQ ID NO: 462206 - DNA, 25 bp, Mus musculus
gactgcaagagtactggccctaatc

SEQ ID NO: 462207 - DNA, 25 bp, Mus musculus
gactgcaagagttctggccctaatc

SEQ ID NO: 462208 - DNA, 25 bp, Mus musculus
gactgcaagtagaatggtcaccaga

SEQ ID NO: 462209 - DNA, 25 bp, Mus musculus
gactgcaagtagtatggtcaccaga

SEQ ID NO: 462210 - DNA, 25 bp, Mus musculus
gactgcaagtcccatgcctgccagg

SEQ ID NO: 462211 - DNA, 25 bp, Mus musculus
gactgcaagtccgatgcctgccagg

SEQ ID NO: 462212 - DNA, 25 bp, Mus musculus
gactgcaataagattttggtctaaa

SEQ ID NO: 462213 - DNA, 25 bp, Mus musculus
gactgcaataagtttttggtctaaa

SEQ ID NO: 462214 - DNA, 25 bp, Mus musculus
gactgcaatgaccagaataaaccca

SEQ ID NO: 462215 - DNA, 25 bp, Mus musculus
gactgcaatgacgagaataaaccca

SEQ ID NO: 462216 - DNA, 25 bp, Mus musculus
gactgcacaaggaaatttgatcact

SEQ ID NO: 462217 - DNA, 25 bp, Mus musculus
gactgcacaaggtaatttgatcact

SEQ ID NO: 462218 - DNA, 25 bp, Mus musculus
gactgcacagcacatgtttttaggg

SEQ ID NO: 462219 - DNA, 25 bp, Mus musculus
gactgcacagcagatgtttttaggg

SEQ ID NO: 462220 - DNA, 25 bp, Mus musculus
gactgcacagtcaaatgttcatcaa

SEQ ID NO: 462221 - DNA, 25 bp, Mus musculus
gactgcacagtctaatgttcatcaa

SEQ ID NO: 462222 - DNA, 25 bp, Mus musculus
gactgcaccagtactgtggacacag

SEQ ID NO: 462223 - DNA, 25 bp, Mus musculus
gactgcaccagttctgtggacacag

SEQ ID NO: 462224 - DNA, 25 bp, Mus musculus
gactgcacccatacaaatccatggt

SEQ ID NO: 462225 - DNA, 25 bp, Mus musculus
gactgcacccattcaaatccatggt

SEQ ID NO: 462226 - DNA, 25 bp, Mus musculus
gactgcaccggaatttccgcaggag

SEQ ID NO: 462227 - DNA, 25 bp, Mus musculus
gactgcaccggattttccgcaggag

SEQ ID NO: 462228 - DNA, 25 bp, Mus musculus
gactgcacgatgacccagactttaa

SEQ ID NO: 462229 - DNA, 25 bp, Mus musculus
gactgcacgatgtcccagactttaa

SEQ ID NO: 462230 - DNA, 25 bp, Mus musculus
gactgcacgcagaacatggagcctg

SEQ ID NO: 462231 - DNA, 25 bp, Mus musculus
gactgcacgcagtacatggagcctg

SEQ ID NO: 462232 - DNA, 25 bp, Mus musculus
gactgcactacacctttgtctaaca

SEQ ID NO: 462233 - DNA, 25 bp, Mus musculus
gactgcactacagctttgtctaaca

SEQ ID NO: 462234 - DNA, 25 bp, Mus musculus
gactgcactgaacttgattccatcc

SEQ ID NO: 462235 - DNA, 25 bp, Mus musculus
gactgcactgaagttgattccatcc

SEQ ID NO: 462236 - DNA, 25 bp, Mus musculus
gactgcactgagaaggacctccgca

SEQ ID NO: 462237 - DNA, 25 bp, Mus musculus
gactgcactgagtaggacctccgca

SEQ ID NO: 462238 - DNA, 25 bp, Mus musculus
gactgcactgcacagttccaagctt

SEQ ID NO: 462239 - DNA, 25 bp, Mus musculus
gactgcactgcagagttccaagctt

SEQ ID NO: 462240 - DNA, 25 bp, Mus musculus
gactgcacttcaagagatctgctaa

SEQ ID NO: 462241 - DNA, 25 bp, Mus musculus
gactgcacttcatgagatctgctaa

SEQ ID NO: 462242 - DNA, 25 bp, Mus musculus
gactgcagacacagacgccagcgaa

SEQ ID NO: 462243 - DNA, 25 bp, Mus musculus
gactgcagacactgacgccagcgaa

SEQ ID NO: 462244 - DNA, 25 bp, Mus musculus
gactgcagacttatttatacctttt

SEQ ID NO: 462245 - DNA, 25 bp, Mus musculus
gactgcagacttttttatacctttt

SEQ ID NO: 462246 - DNA, 25 bp, Mus musculus
gactgcagatctcggttaactcttc

SEQ ID NO: 462247 - DNA, 25 bp, Mus musculus
gactgcagatctgggttaactcttc

SEQ ID NO: 462248 - DNA, 25 bp, Mus musculus
gactgcagcaaacacccgcaatgag

SEQ ID NO: 462249 - DNA, 25 bp, Mus musculus
gactgcagcaaagacccgcaatgag

SEQ ID NO: 462250 - DNA, 25 bp, Mus musculus
gactgcagcacacgttctgattcgg

SEQ ID NO: 462251 - DNA, 25 bp, Mus musculus
gactgcagcacaggttctgattcgg

SEQ ID NO: 462252 - DNA, 25 bp, Mus musculus
gactgcagccaactcgggccacaaa

SEQ ID NO: 462253 - DNA, 25 bp, Mus musculus
gactgcagccaagtcgggccacaaa

SEQ ID NO: 462254 - DNA, 25 bp, Mus musculus
gactgcagcgggaacgagccaacat

SEQ ID NO: 462255 - DNA, 25 bp, Mus musculus
gactgcagcgggtacgagccaacat

SEQ ID NO: 462256 - DNA, 25 bp, Mus musculus
gactgcagctggatagcatttctca

SEQ ID NO: 462257 - DNA, 25 bp, Mus musculus
gactgcagctggttagcatttctca

SEQ ID NO: 462258 - DNA, 25 bp, Mus musculus
gactgcaggcaactcatgcatttcc

SEQ ID NO: 462259 - DNA, 25 bp, Mus musculus
gactgcaggcaagtcatgcatttcc

SEQ ID NO: 462260 - DNA, 25 bp, Mus musculus
gactgcaggcatcgaagcttttgtt

SEQ ID NO: 462261 - DNA, 25 bp, Mus musculus
gactgcaggcatggaagcttttgtt

SEQ ID NO: 462262 - DNA, 25 bp, Mus musculus
gactgcaggccgagttagacctcaa

SEQ ID NO: 462263 - DNA, 25 bp, Mus musculus
gactgcaggccgtgttagacctcaa

SEQ ID NO: 462264 - DNA, 25 bp, Mus musculus
gactgcagggacacagcattagcca

SEQ ID NO: 462265 - DNA, 25 bp, Mus musculus
gactgcagggactcagcattagcca

SEQ ID NO: 462266 - DNA, 25 bp, Mus musculus
gactgcagggtcacgtttggctcat

SEQ ID NO: 462267 - DNA, 25 bp, Mus musculus
gactgcagggtctcgtttggctcat

SEQ ID NO: 462268 - DNA, 25 bp, Mus musculus
gactgcaggttcataacatctgggt

SEQ ID NO: 462269 - DNA, 25 bp, Mus musculus
gactgcaggttcttaacatctgggt

SEQ ID NO: 462270 - DNA, 25 bp, Mus musculus
gactgcaggttgattctagtgctcc

SEQ ID NO: 462271 - DNA, 25 bp, Mus musculus
gactgcaggttgtttctagtgctcc

SEQ ID NO: 462272 - DNA, 25 bp, Mus musculus
gactgcagtaaacgaatttggccac

SEQ ID NO: 462273 - DNA, 25 bp, Mus musculus
gactgcagtaaaggaatttggccac

SEQ ID NO: 462274 - DNA, 25 bp, Mus musculus
gactgcagtccacatatggttctgt

SEQ ID NO: 462275 - DNA, 25 bp, Mus musculus
gactgcagtccagatatggttctgt

SEQ ID NO: 462276 - DNA, 25 bp, Mus musculus
gactgcagtctaaaagctaaacccg

SEQ ID NO: 462277 - DNA, 25 bp, Mus musculus
gactgcagtctataagctaaacccg

SEQ ID NO: 462278 - DNA, 25 bp, Mus musculus
gactgcagtctgcattaggtgaaag

SEQ ID NO: 462279 - DNA, 25 bp, Mus musculus
gactgcagtctggattaggtgaaag

SEQ ID NO: 462280 - DNA, 25 bp, Mus musculus
gactgcagtcttccctaggtgattt

SEQ ID NO: 462281 - DNA, 25 bp, Mus musculus
gactgcagtcttgcctaggtgattt

SEQ ID NO: 462282 - DNA, 25 bp, Mus musculus
gactgcagtggtaatgggttttgaa

SEQ ID NO: 462283 - DNA, 25 bp, Mus musculus
gactgcagtggttatgggttttgaa

SEQ ID NO: 462284 - DNA, 25 bp, Mus musculus
gactgcagtgtaattgtgtggcgat

SEQ ID NO: 462285 - DNA, 25 bp, Mus musculus
gactgcagtgtatttgtgtggcgat

SEQ ID NO: 462286 - DNA, 25 bp, Mus musculus
gactgcagtgtgctgcctgtttata

SEQ ID NO: 462287 - DNA, 25 bp, Mus musculus
gactgcagtgtggtgcctgtttata

SEQ ID NO: 462288 - DNA, 25 bp, Mus musculus
gactgcagtgttagagccttagtta

SEQ ID NO: 462289 - DNA, 25 bp, Mus musculus
gactgcagtgtttgagccttagtta

SEQ ID NO: 462290 - DNA, 25 bp, Mus musculus
gactgcagttgtaatcctgaaataa

SEQ ID NO: 462291 - DNA, 25 bp, Mus musculus
gactgcagttgttatcctgaaataa

SEQ ID NO: 462292 - DNA, 25 bp, Mus musculus
gactgcatactgctatctctgagaa

SEQ ID NO: 462293 - DNA, 25 bp, Mus musculus
gactgcatactggtatctctgagaa

SEQ ID NO: 462294 - DNA, 25 bp, Mus musculus
gactgcatatatcgtactgtatctt

SEQ ID NO: 462295 - DNA, 25 bp, Mus musculus
gactgcatatatggtactgtatctt

SEQ ID NO: 462296 - DNA, 25 bp, Mus musculus
gactgcatcaaacctttccgggagg

SEQ ID NO: 462297 - DNA, 25 bp, Mus musculus
gactgcatcaaagctttccgggagg

SEQ ID NO: 462298 - DNA, 25 bp, Mus musculus
gactgcatcaggcttgtctcatgtg

SEQ ID NO: 462299 - DNA, 25 bp, Mus musculus
gactgcatcagggttgtctcatgtg

SEQ ID NO: 462300 - DNA, 25 bp, Mus musculus
gactgcatcatcatttcggattcaa

SEQ ID NO: 462301 - DNA, 25 bp, Mus musculus
gactgcatcatcttttcggattcaa

SEQ ID NO: 462302 - DNA, 25 bp, Mus musculus
gactgcatccaaattccaaatacca

SEQ ID NO: 462303 - DNA, 25 bp, Mus musculus
gactgcatccaatttccaaatacca

SEQ ID NO: 462304 - DNA, 25 bp, Mus musculus
gactgcatcccgagaggagacggta

SEQ ID NO: 462305 - DNA, 25 bp, Mus musculus
gactgcatcccgtgaggagacggta

SEQ ID NO: 462306 - DNA, 25 bp, Mus musculus
gactgcatccgtctaacctggtaat

SEQ ID NO: 462307 - DNA, 25 bp, Mus musculus
gactgcatccgtgtaacctggtaat

SEQ ID NO: 462308 - DNA, 25 bp, Mus musculus
gactgcatcgccagctaagatgaaa

SEQ ID NO: 462309 - DNA, 25 bp, Mus musculus
gactgcatcgcctgctaagatgaaa

SEQ ID NO: 462310 - DNA, 25 bp, Mus musculus
gactgcatcgctacagtgcaacagt

SEQ ID NO: 462311 - DNA, 25 bp, Mus musculus
gactgcatcgcttcagtgcaacagt

SEQ ID NO: 462312 - DNA, 25 bp, Mus musculus
gactgcatgaccatccaaggcgaag

SEQ ID NO: 462313 - DNA, 25 bp, Mus musculus
gactgcatgaccttccaaggcgaag

SEQ ID NO: 462314 - DNA, 25 bp, Mus musculus
gactgcatgagtctcctaatgacaa

SEQ ID NO: 462315 - DNA, 25 bp, Mus musculus
gactgcatgagtgtcctaatgacaa

SEQ ID NO: 462316 - DNA, 25 bp, Mus musculus
gactgcatgcacactttacatttat

SEQ ID NO: 462317 - DNA, 25 bp, Mus musculus
gactgcatgcactctttacatttat

SEQ ID NO: 462318 - DNA, 25 bp, Mus musculus
gactgcatggaaacctgatccctag

SEQ ID NO: 462319 - DNA, 25 bp, Mus musculus
gactgcatggaatcctgatccctag

SEQ ID NO: 462320 - DNA, 25 bp, Mus musculus
gactgcatgtccacggatatgtata

SEQ ID NO: 462321 - DNA, 25 bp, Mus musculus
gactgcatgtcctcggatatgtata

SEQ ID NO: 462322 - DNA, 25 bp, Mus musculus
gactgcatgtcgaaattttactttt

SEQ ID NO: 462323 - DNA, 25 bp, Mus musculus
gactgcatgtcgtaattttactttt

SEQ ID NO: 462324 - DNA, 25 bp, Mus musculus
gactgcatgtctactgactttttac

SEQ ID NO: 462325 - DNA, 25 bp, Mus musculus
gactgcatgtcttctgactttttac

SEQ ID NO: 462326 - DNA, 25 bp, Mus musculus
gactgcatgttcataatcctataat

SEQ ID NO: 462327 - DNA, 25 bp, Mus musculus
gactgcatgttcttaatcctataat

SEQ ID NO: 462328 - DNA, 25 bp, Mus musculus
gactgcattaatcacactccctagg

SEQ ID NO: 462329 - DNA, 25 bp, Mus musculus
gactgcattaatgacactccctagg

SEQ ID NO: 462330 - DNA, 25 bp, Mus musculus
gactgcattcatataatagacttca

SEQ ID NO: 462331 - DNA, 25 bp, Mus musculus
gactgcattcatttaatagacttca

SEQ ID NO: 462332 - DNA, 25 bp, Mus musculus
gactgcattgcaaagtgtcacccgc

SEQ ID NO: 462333 - DNA, 25 bp, Mus musculus
gactgcattgcatagtgtcacccgc

SEQ ID NO: 462334 - DNA, 25 bp, Mus musculus
gactgcattggaccttcaaagctct

SEQ ID NO: 462335 - DNA, 25 bp, Mus musculus
gactgcattggagcttcaaagctct

SEQ ID NO: 462336 - DNA, 25 bp, Mus musculus
gactgccaaattacaccggtttgcc

SEQ ID NO: 462337 - DNA, 25 bp, Mus musculus
gactgccaaatttcaccggtttgcc

SEQ ID NO: 462338 - DNA, 25 bp, Mus musculus
gactgccaacaacttccagattgaa

SEQ ID NO: 462339 - DNA, 25 bp, Mus musculus
gactgccaacaagttccagattgaa

SEQ ID NO: 462340 - DNA, 25 bp, Mus musculus
gactgccaacagagggagctactcc

SEQ ID NO: 462341 - DNA, 25 bp, Mus musculus
gactgccaacagtgggagctactcc

SEQ ID NO: 462342 - DNA, 25 bp, Mus musculus
gactgccaagtaaaaccttgcccta

SEQ ID NO: 462343 - DNA, 25 bp, Mus musculus
gactgccaagtataaccttgcccta

SEQ ID NO: 462344 - DNA, 25 bp, Mus musculus
gactgccaatgaagtgtcttctgaa

SEQ ID NO: 462345 - DNA, 25 bp, Mus musculus
gactgccaatgatgtgtcttctgaa

SEQ ID NO: 462346 - DNA, 25 bp, Mus musculus
gactgccactacagattcttatttg

SEQ ID NO: 462347 - DNA, 25 bp, Mus musculus
gactgccactactgattcttatttg

SEQ ID NO: 462348 - DNA, 25 bp, Mus musculus
gactgccactgtcacaaatgctgtt

SEQ ID NO: 462349 - DNA, 25 bp, Mus musculus
gactgccactgtgacaaatgctgtt

SEQ ID NO: 462350 - DNA, 25 bp, Mus musculus
gactgccacttgagcgagcgagaga

SEQ ID NO: 462351 - DNA, 25 bp, Mus musculus
gactgccacttgtgcgagcgagaga

SEQ ID NO: 462352 - DNA, 25 bp, Mus musculus
gactgccagccaagttaaaagacca

SEQ ID NO: 462353 - DNA, 25 bp, Mus musculus
gactgccagccatgttaaaagacca

SEQ ID NO: 462354 - DNA, 25 bp, Mus musculus
gactgccagggtcgacatcatgcat

SEQ ID NO: 462355 - DNA, 25 bp, Mus musculus
gactgccagggtggacatcatgcat

SEQ ID NO: 462356 - DNA, 25 bp, Mus musculus
gactgccagtctctaggctgtagaa

SEQ ID NO: 462357 - DNA, 25 bp, Mus musculus
gactgccagtctgtaggctgtagaa

SEQ ID NO: 462358 - DNA, 25 bp, Mus musculus
gactgccattgtcattctgggttgg

SEQ ID NO: 462359 - DNA, 25 bp, Mus musculus
gactgccattgtgattctgggttgg

SEQ ID NO: 462360 - DNA, 25 bp, Mus musculus
gactgcccaaatactgttggtttgt

SEQ ID NO: 462361 - DNA, 25 bp, Mus musculus
gactgcccaaattctgttggtttgt

SEQ ID NO: 462362 - DNA, 25 bp, Mus musculus
gactgcccacagatttaaaacagaa

SEQ ID NO: 462363 - DNA, 25 bp, Mus musculus
gactgcccacagttttaaaacagaa

SEQ ID NO: 462364 - DNA, 25 bp, Mus musculus
gactgcccagctatgcctgggaaaa

SEQ ID NO: 462365 - DNA, 25 bp, Mus musculus
gactgcccagctttgcctgggaaaa

SEQ ID NO: 462366 - DNA, 25 bp, Mus musculus
gactgcccaggcaacagagagcctt

SEQ ID NO: 462367 - DNA, 25 bp, Mus musculus
gactgcccaggctacagagagcctt

SEQ ID NO: 462368 - DNA, 25 bp, Mus musculus
gactgccccagtaaagcattaccag

SEQ ID NO: 462369 - DNA, 25 bp, Mus musculus
gactgccccagttaagcattaccag

SEQ ID NO: 462370 - DNA, 25 bp, Mus musculus
gactgccccatgaattgtagagtgt

SEQ ID NO: 462371 - DNA, 25 bp, Mus musculus
gactgccccatgtattgtagagtgt

SEQ ID NO: 462372 - DNA, 25 bp, Mus musculus
gactgcccctaacctgtgaataatt

SEQ ID NO: 462373 - DNA, 25 bp, Mus musculus
gactgcccctaagctgtgaataatt

SEQ ID NO: 462374 - DNA, 25 bp, Mus musculus
gactgccccttcattagtcatgtga

SEQ ID NO: 462375 - DNA, 25 bp, Mus musculus
gactgccccttctttagtcatgtga

SEQ ID NO: 462376 - DNA, 25 bp, Mus musculus
gactgcccgggcaaggcgcaaatgc

SEQ ID NO: 462377 - DNA, 25 bp, Mus musculus
gactgcccgggctaggcgcaaatgc

SEQ ID NO: 462378 - DNA, 25 bp, Mus musculus
gactgcccgtgtatagcgagtggtc

SEQ ID NO: 462379 - DNA, 25 bp, Mus musculus
gactgcccgtgtttagcgagtggtc

SEQ ID NO: 462380 - DNA, 25 bp, Mus musculus
gactgccctcggctgcctgtgctaa

SEQ ID NO: 462381 - DNA, 25 bp, Mus musculus
gactgccctcgggtgcctgtgctaa

SEQ ID NO: 462382 - DNA, 25 bp, Mus musculus
gactgccctgacaaaaaactcgaga

SEQ ID NO: 462383 - DNA, 25 bp, Mus musculus
gactgccctgactaaaaactcgaga

SEQ ID NO: 462384 - DNA, 25 bp, Mus musculus
gactgccgaggcaggaacccactgg

SEQ ID NO: 462385 - DNA, 25 bp, Mus musculus
gactgccgaggctggaacccactgg

SEQ ID NO: 462386 - DNA, 25 bp, Mus musculus
gactgccgctccattctttcaagga

SEQ ID NO: 462387 - DNA, 25 bp, Mus musculus
gactgccgctcctttctttcaagga

SEQ ID NO: 462388 - DNA, 25 bp, Mus musculus
gactgcctacctctggaggttgtga

SEQ ID NO: 462389 - DNA, 25 bp, Mus musculus
gactgcctacctgtggaggttgtga

SEQ ID NO: 462390 - DNA, 25 bp, Mus musculus
gactgcctagtaccatcaaccaggt

SEQ ID NO: 462391 - DNA, 25 bp, Mus musculus
gactgcctagtagcatcaaccaggt

SEQ ID NO: 462392 - DNA, 25 bp, Mus musculus
gactgcctcagcacgggcacagagc

SEQ ID NO: 462393 - DNA, 25 bp, Mus musculus
gactgcctcagctcgggcacagagc

SEQ ID NO: 462394 - DNA, 25 bp, Mus musculus
gactgcctcagtcagatacttcaat

SEQ ID NO: 462395 - DNA, 25 bp, Mus musculus
gactgcctcagtgagatacttcaat

SEQ ID NO: 462396 - DNA, 25 bp, Mus musculus
gactgcctcgtcattgaagattctc

SEQ ID NO: 462397 - DNA, 25 bp, Mus musculus
gactgcctcgtctttgaagattctc

SEQ ID NO: 462398 - DNA, 25 bp, Mus musculus
gactgcctctgtcaactggcaaaga

SEQ ID NO: 462399 - DNA, 25 bp, Mus musculus
gactgcctctgtctggactcttgga

SEQ ID NO: 462400 - DNA, 25 bp, Mus musculus
gactgcctctgtgaactggcaaaga

SEQ ID NO: 462401 - DNA, 25 bp, Mus musculus
gactgcctctgtgtggactcttgga

SEQ ID NO: 462402 - DNA, 25 bp, Mus musculus
gactgcctctttcctatcttgataa

SEQ ID NO: 462403 - DNA, 25 bp, Mus musculus
gactgcctctttgctatcttgataa

SEQ ID NO: 462404 - DNA, 25 bp, Mus musculus
gactgcctgagcacgggtattcaaa

SEQ ID NO: 462405 - DNA, 25 bp, Mus musculus
gactgcctgagctcgggtattcaaa

SEQ ID NO: 462406 - DNA, 25 bp, Mus musculus
gactgcctgattaaatgctacttcc

SEQ ID NO: 462407 - DNA, 25 bp, Mus musculus
gactgcctgatttaatgctacttcc

SEQ ID NO: 462408 - DNA, 25 bp, Mus musculus
gactgcctgcctaggtccttgcagg

SEQ ID NO: 462409 - DNA, 25 bp, Mus musculus
gactgcctgccttggtccttgcagg

SEQ ID NO: 462410 - DNA, 25 bp, Mus musculus
gactgcctggatctcaatgccatta

SEQ ID NO: 462411 - DNA, 25 bp, Mus musculus
gactgcctggatgtcaatgccatta

SEQ ID NO: 462412 - DNA, 25 bp, Mus musculus
gactgcctggccaaattccaataaa

SEQ ID NO: 462413 - DNA, 25 bp, Mus musculus
gactgcctggcctaattccaataaa

SEQ ID NO: 462414 - DNA, 25 bp, Mus musculus
gactgcctggtgaacacatctcaga

SEQ ID NO: 462415 - DNA, 25 bp, Mus musculus
gactgcctggtgtacacatctcaga

SEQ ID NO: 462416 - DNA, 25 bp, Mus musculus
gactgcctgtatactaggcttgcta

SEQ ID NO: 462417 - DNA, 25 bp, Mus musculus
gactgcctgtattctaggcttgcta

SEQ ID NO: 462418 - DNA, 25 bp, Mus musculus
gactgcctgtcgcaaactagatgct

SEQ ID NO: 462419 - DNA, 25 bp, Mus musculus
gactgcctgtcggaaactagatgct

SEQ ID NO: 462420 - DNA, 25 bp, Mus musculus
gactgccttactaaagatcacagga

SEQ ID NO: 462421 - DNA, 25 bp, Mus musculus
gactgccttacttaagatcacagga

SEQ ID NO: 462422 - DNA, 25 bp, Mus musculus
gactgccttggccaagttactttca

SEQ ID NO: 462423 - DNA, 25 bp, Mus musculus
gactgccttggcgaagttactttca

SEQ ID NO: 462424 - DNA, 25 bp, Mus musculus
gactgccttgggaaggaccttcagt

SEQ ID NO: 462425 - DNA, 25 bp, Mus musculus
gactgccttgggtaggaccttcagt

SEQ ID NO: 462426 - DNA, 25 bp, Mus musculus
gactgcctttcacgtaacagagaag

SEQ ID NO: 462427 - DNA, 25 bp, Mus musculus
gactgcctttcaggtaacagagaag

SEQ ID NO: 462428 - DNA, 25 bp, Mus musculus
gactgcctttccaaacgttctggga

SEQ ID NO: 462429 - DNA, 25 bp, Mus musculus
gactgcctttcctaacgttctggga

SEQ ID NO: 462430 - DNA, 25 bp, Mus musculus
gactgcgacattctgcgccgtgcct

SEQ ID NO: 462431 - DNA, 25 bp, Mus musculus
gactgcgacattgtgcgccgtgcct

SEQ ID NO: 462432 - DNA, 25 bp, Mus musculus
gactgcgatgcacagcaggcctcta

SEQ ID NO: 462433 - DNA, 25 bp, Mus musculus
gactgcgatgcagagcaggcctcta

SEQ ID NO: 462434 - DNA, 25 bp, Mus musculus
gactgcgatgggaaaatctgttttc

SEQ ID NO: 462435 - DNA, 25 bp, Mus musculus
gactgcgatgggtaaatctgttttc

SEQ ID NO: 462436 - DNA, 25 bp, Mus musculus
gactgcgattggctgtcactcagga

SEQ ID NO: 462437 - DNA, 25 bp, Mus musculus
gactgcgattgggtgtcactcagga

SEQ ID NO: 462438 - DNA, 25 bp, Mus musculus
gactgcgcaaccacagagagtacaa

SEQ ID NO: 462439 - DNA, 25 bp, Mus musculus
gactgcgcaacctcagagagtacaa

SEQ ID NO: 462440 - DNA, 25 bp, Mus musculus
gactgcgcaagaagtttagctgatt

SEQ ID NO: 462441 - DNA, 25 bp, Mus musculus
gactgcgcaagatgtttagctgatt

SEQ ID NO: 462442 - DNA, 25 bp, Mus musculus
gactgcgcaatcctgttcagtattg

SEQ ID NO: 462443 - DNA, 25 bp, Mus musculus
gactgcgcaatcgtgttcagtattg

SEQ ID NO: 462444 - DNA, 25 bp, Mus musculus
gactgcgcagagcacgaagcaccac

SEQ ID NO: 462445 - DNA, 25 bp, Mus musculus
gactgcgcagaggacgaagcaccac

SEQ ID NO: 462446 - DNA, 25 bp, Mus musculus
gactgcgccttgcacctgatgaggc

SEQ ID NO: 462447 - DNA, 25 bp, Mus musculus
gactgcgccttggacctgatgaggc

SEQ ID NO: 462448 - DNA, 25 bp, Mus musculus
gactgcgctatgatacttgatttat

SEQ ID NO: 462449 - DNA, 25 bp, Mus musculus
gactgcgctatgttacttgatttat

SEQ ID NO: 462450 - DNA, 25 bp, Mus musculus
gactgcgctccgactcagagggaaa

SEQ ID NO: 462451 - DNA, 25 bp, Mus musculus
gactgcgctccgtctcagagggaaa

SEQ ID NO: 462452 - DNA, 25 bp, Mus musculus
gactgcgcttctagaaggtgggcat

SEQ ID NO: 462453 - DNA, 25 bp, Mus musculus
gactgcgcttcttgaaggtgggcat

SEQ ID NO: 462454 - DNA, 25 bp, Mus musculus
gactgcggacctcagactgattgac

SEQ ID NO: 462455 - DNA, 25 bp, Mus musculus
gactgcggacctgagactgattgac

SEQ ID NO: 462456 - DNA, 25 bp, Mus musculus
gactgcggatatcataattggcttc

SEQ ID NO: 462457 - DNA, 25 bp, Mus musculus
gactgcggatatgataattggcttc

SEQ ID NO: 462458 - DNA, 25 bp, Mus musculus
gactgcggccttcatctctgttggg

SEQ ID NO: 462459 - DNA, 25 bp, Mus musculus
gactgcggccttgatctctgttggg

SEQ ID NO: 462460 - DNA, 25 bp, Mus musculus
gactgcgggcacacgaggacctgct

SEQ ID NO: 462461 - DNA, 25 bp, Mus musculus
gactgcgggcactcgaggacctgct

SEQ ID NO: 462462 - DNA, 25 bp, Mus musculus
gactgcgggcagctgtgcacatcaa

SEQ ID NO: 462463 - DNA, 25 bp, Mus musculus
gactgcgggcaggtgtgcacatcaa

SEQ ID NO: 462464 - DNA, 25 bp, Mus musculus
gactgcggttacagtaggagcctct

SEQ ID NO: 462465 - DNA, 25 bp, Mus musculus
gactgcggttactgtaggagcctct

SEQ ID NO: 462466 - DNA, 25 bp, Mus musculus
gactgcggttccagactgatgaaga

SEQ ID NO: 462467 - DNA, 25 bp, Mus musculus
gactgcggttcctgactgatgaaga

SEQ ID NO: 462468 - DNA, 25 bp, Mus musculus
gactgcgtcagcaaccttataatgt

SEQ ID NO: 462469 - DNA, 25 bp, Mus musculus
gactgcgtcagctaccttataatgt

SEQ ID NO: 462470 - DNA, 25 bp, Mus musculus
gactgcgtgcaacagcgtatttgag

SEQ ID NO: 462471 - DNA, 25 bp, Mus musculus
gactgcgtgcaagagcgtatttgag

SEQ ID NO: 462472 - DNA, 25 bp, Mus musculus
gactgcgtggagactctggaatcca

SEQ ID NO: 462473 - DNA, 25 bp, Mus musculus
gactgcgtggagtctctggaatcca

SEQ ID NO: 462474 - DNA, 25 bp, Mus musculus
gactgcgtgtagcactgaaggtctt

SEQ ID NO: 462475 - DNA, 25 bp, Mus musculus
gactgcgtgtaggactgaaggtctt

SEQ ID NO: 462476 - DNA, 25 bp, Mus musculus
gactgcgttcatcttaatatgccat

SEQ ID NO: 462477 - DNA, 25 bp, Mus musculus
gactgcgttcatgttaatatgccat

SEQ ID NO: 462478 - DNA, 25 bp, Mus musculus
gactgctaaatcaggcggcagccgg

SEQ ID NO: 462479 - DNA, 25 bp, Mus musculus
gactgctaaatctggcggcagccgg

SEQ ID NO: 462480 - DNA, 25 bp, Mus musculus
gactgctaacacatagcgaggagga

SEQ ID NO: 462481 - DNA, 25 bp, Mus musculus
gactgctaacacttagcgaggagga

SEQ ID NO: 462482 - DNA, 25 bp, Mus musculus
gactgctaagttctgttgtgttgac

SEQ ID NO: 462483 - DNA, 25 bp, Mus musculus
gactgctaagttgtgttgtgttgac

SEQ ID NO: 462484 - DNA, 25 bp, Mus musculus
gactgctaataaagggccagcactg

SEQ ID NO: 462485 - DNA, 25 bp, Mus musculus
gactgctaataatgggccagcactg

SEQ ID NO: 462486 - DNA, 25 bp, Mus musculus
gactgctaatacctaccttgtatta

SEQ ID NO: 462487 - DNA, 25 bp, Mus musculus
gactgctaatacgtaccttgtatta

SEQ ID NO: 462488 - DNA, 25 bp, Mus musculus
gactgctacagccaaggtcaggcaa

SEQ ID NO: 462489 - DNA, 25 bp, Mus musculus
gactgctacagcgaaggtcaggcaa

SEQ ID NO: 462490 - DNA, 25 bp, Mus musculus
gactgctaccatcataatttagcaa

SEQ ID NO: 462491 - DNA, 25 bp, Mus musculus
gactgctaccatgataatttagcaa

SEQ ID NO: 462492 - DNA, 25 bp, Mus musculus
gactgctacccacgtcagattggac

SEQ ID NO: 462493 - DNA, 25 bp, Mus musculus
gactgctacccaggtcagattggac

SEQ ID NO: 462494 - DNA, 25 bp, Mus musculus
gactgctacctcaaatacattaacc

SEQ ID NO: 462495 - DNA, 25 bp, Mus musculus
gactgctacctctaatacattaacc

SEQ ID NO: 462496 - DNA, 25 bp, Mus musculus
gactgctactctattccttatgaat

SEQ ID NO: 462497 - DNA, 25 bp, Mus musculus
gactgctactcttttccttatgaat

SEQ ID NO: 462498 - DNA, 25 bp, Mus musculus
gactgctactgaagttttcttgata

SEQ ID NO: 462499 - DNA, 25 bp, Mus musculus
gactgctactgatgttttcttgata

SEQ ID NO: 462500 - DNA, 25 bp, Mus musculus
gactgctagatgatgtctgtgccta

SEQ ID NO: 462501 - DNA, 25 bp, Mus musculus
gactgctagatgttgtctgtgccta

SEQ ID NO: 462502 - DNA, 25 bp, Mus musculus
gactgctaggtcagttcctgaacca

SEQ ID NO: 462503 - DNA, 25 bp, Mus musculus
gactgctaggtctgttcctgaacca

SEQ ID NO: 462504 - DNA, 25 bp, Mus musculus
gactgctatgcaatggcttttggga

SEQ ID NO: 462505 - DNA, 25 bp, Mus musculus
gactgctatgcattggcttttggga

SEQ ID NO: 462506 - DNA, 25 bp, Mus musculus
gactgctattacaggtttcatatat

SEQ ID NO: 462507 - DNA, 25 bp, Mus musculus
gactgctattactggtttcatatat

SEQ ID NO: 462508 - DNA, 25 bp, Mus musculus
gactgctattagctgctgtatcacg

SEQ ID NO: 462509 - DNA, 25 bp, Mus musculus
gactgctattaggtgctgtatcacg

SEQ ID NO: 462510 - DNA, 25 bp, Mus musculus
gactgctattcccatgatacctggc

SEQ ID NO: 462511 - DNA, 25 bp, Mus musculus
gactgctattccgatgatacctggc

SEQ ID NO: 462512 - DNA, 25 bp, Mus musculus
gactgctcaactctgggactttatt

SEQ ID NO: 462513 - DNA, 25 bp, Mus musculus
gactgctcaactgtgggactttatt

SEQ ID NO: 462514 - DNA, 25 bp, Mus musculus
gactgctcaccaccccttgaaagaa

SEQ ID NO: 462515 - DNA, 25 bp, Mus musculus
gactgctcaccagcccttgaaagaa

SEQ ID NO: 462516 - DNA, 25 bp, Mus musculus
gactgctcactgattggtcatcctt

SEQ ID NO: 462517 - DNA, 25 bp, Mus musculus
gactgctcactgtttggtcatcctt

SEQ ID NO: 462518 - DNA, 25 bp, Mus musculus
gactgctcacttattatatatttat

SEQ ID NO: 462519 - DNA, 25 bp, Mus musculus
gactgctcactttttatatatttat

SEQ ID NO: 462520 - DNA, 25 bp, Mus musculus
gactgctcatcaatcgagacttggt

SEQ ID NO: 462521 - DNA, 25 bp, Mus musculus
gactgctcatcattcgagacttggt

SEQ ID NO: 462522 - DNA, 25 bp, Mus musculus
gactgctccaatcaataggtccata

SEQ ID NO: 462523 - DNA, 25 bp, Mus musculus
gactgctccaatgaataggtccata

SEQ ID NO: 462524 - DNA, 25 bp, Mus musculus
gactgctccagtcacaggaacttaa

SEQ ID NO: 462525 - DNA, 25 bp, Mus musculus
gactgctccagtgacaggaacttaa

SEQ ID NO: 462526 - DNA, 25 bp, Mus musculus
gactgctccctaagttgtttcttga

SEQ ID NO: 462527 - DNA, 25 bp, Mus musculus
gactgctccctatgttgtttcttga

SEQ ID NO: 462528 - DNA, 25 bp, Mus musculus
gactgctccgtgatcaactgtgaaa

SEQ ID NO: 462529 - DNA, 25 bp, Mus musculus
gactgctccgtgttcaactgtgaaa

SEQ ID NO: 462530 - DNA, 25 bp, Mus musculus
gactgctcctggaagacatctcaag

SEQ ID NO: 462531 - DNA, 25 bp, Mus musculus
gactgctcctggcatcgtttaagaa

SEQ ID NO: 462532 - DNA, 25 bp, Mus musculus
gactgctcctgggatcgtttaagaa

SEQ ID NO: 462533 - DNA, 25 bp, Mus musculus
gactgctcctggtagacatctcaag

SEQ ID NO: 462534 - DNA, 25 bp, Mus musculus
gactgctcgggactatgccctgaaa

SEQ ID NO: 462535 - DNA, 25 bp, Mus musculus
gactgctcgggagtatgccctgaaa

SEQ ID NO: 462536 - DNA, 25 bp, Mus musculus
gactgctcgtaaattcatctggaca

SEQ ID NO: 462537 - DNA, 25 bp, Mus musculus
gactgctcgtaatttcatctggaca

SEQ ID NO: 462538 - DNA, 25 bp, Mus musculus
gactgctctaatagtgggtggcaat

SEQ ID NO: 462539 - DNA, 25 bp, Mus musculus
gactgctctaattgtgggtggcaat

SEQ ID NO: 462540 - DNA, 25 bp, Mus musculus
gactgctctagcacttctcctggaa

SEQ ID NO: 462541 - DNA, 25 bp, Mus musculus
gactgctctagctcttctcctggaa

SEQ ID NO: 462542 - DNA, 25 bp, Mus musculus
gactgctctattcctgagggacact

SEQ ID NO: 462543 - DNA, 25 bp, Mus musculus
gactgctctattgctgagggacact

SEQ ID NO: 462544 - DNA, 25 bp, Mus musculus
gactgctctctacttcagtttatag

SEQ ID NO: 462545 - DNA, 25 bp, Mus musculus
gactgctctctagttcagtttatag

SEQ ID NO: 462546 - DNA, 25 bp, Mus musculus
gactgctctgtcagttgaggttttt

SEQ ID NO: 462547 - DNA, 25 bp, Mus musculus
gactgctctgtctgttgaggttttt

SEQ ID NO: 462548 - DNA, 25 bp, Mus musculus
gactgctcttgcagaatgatttttt

SEQ ID NO: 462549 - DNA, 25 bp, Mus musculus
gactgctcttgctgaatgatttttt

SEQ ID NO: 462550 - DNA, 25 bp, Mus musculus
gactgctctttcaatgaattggcat

SEQ ID NO: 462551 - DNA, 25 bp, Mus musculus
gactgctctttctatgaattggcat

SEQ ID NO: 462552 - DNA, 25 bp, Mus musculus
gactgctgaactagctcaatgattt

SEQ ID NO: 462553 - DNA, 25 bp, Mus musculus
gactgctgaacttgctcaatgattt

SEQ ID NO: 462554 - DNA, 25 bp, Mus musculus
gactgctgacctaaatcttgttcct

SEQ ID NO: 462555 - DNA, 25 bp, Mus musculus
gactgctgaccttaatcttgttcct

SEQ ID NO: 462556 - DNA, 25 bp, Mus musculus
gactgctgagacctccaaattggtt

SEQ ID NO: 462557 - DNA, 25 bp, Mus musculus
gactgctgagacgtccaaattggtt

SEQ ID NO: 462558 - DNA, 25 bp, Mus musculus
gactgctgagcacaatgccttataa

SEQ ID NO: 462559 - DNA, 25 bp, Mus musculus
gactgctgagcagaatgccttataa

SEQ ID NO: 462560 - DNA, 25 bp, Mus musculus
gactgctgatacctaccttatttga

SEQ ID NO: 462561 - DNA, 25 bp, Mus musculus
gactgctgatacgtaccttatttga

SEQ ID NO: 462562 - DNA, 25 bp, Mus musculus
gactgctgatcccggtgatgcgaat

SEQ ID NO: 462563 - DNA, 25 bp, Mus musculus
gactgctgatccgggtgatgcgaat

SEQ ID NO: 462564 - DNA, 25 bp, Mus musculus
gactgctgatctacatagagggtca

SEQ ID NO: 462565 - DNA, 25 bp, Mus musculus
gactgctgatcttcatagagggtca

SEQ ID NO: 462566 - DNA, 25 bp, Mus musculus
gactgctgatgtaagtgctaggaac

SEQ ID NO: 462567 - DNA, 25 bp, Mus musculus
gactgctgatgtcatggactacata

SEQ ID NO: 462568 - DNA, 25 bp, Mus musculus
gactgctgatgtgatggactacata

SEQ ID NO: 462569 - DNA, 25 bp, Mus musculus
gactgctgatgttagtgctaggaac

SEQ ID NO: 462570 - DNA, 25 bp, Mus musculus
gactgctgcaatcctgagcaggcag

SEQ ID NO: 462571 - DNA, 25 bp, Mus musculus
gactgctgcaatgctgagcaggcag

SEQ ID NO: 462572 - DNA, 25 bp, Mus musculus
gactgctgcagtcccatcgcaatat

SEQ ID NO: 462573 - DNA, 25 bp, Mus musculus
gactgctgcagtgccatcgcaatat

SEQ ID NO: 462574 - DNA, 25 bp, Mus musculus
gactgctgcatcaacctgaaggtga

SEQ ID NO: 462575 - DNA, 25 bp, Mus musculus
gactgctgcatctacctgaaggtga

SEQ ID NO: 462576 - DNA, 25 bp, Mus musculus
gactgctgccctattgggtgtcttg

SEQ ID NO: 462577 - DNA, 25 bp, Mus musculus
gactgctgcccttttgggtgtcttg

SEQ ID NO: 462578 - DNA, 25 bp, Mus musculus
gactgctgcctgagtgagcgcgaca

SEQ ID NO: 462579 - DNA, 25 bp, Mus musculus
gactgctgcctgtgtgagcgcgaca

SEQ ID NO: 462580 - DNA, 25 bp, Mus musculus
gactgctgcggcactttttatgctg

SEQ ID NO: 462581 - DNA, 25 bp, Mus musculus
gactgctgcggccaatgcgaacgac

SEQ ID NO: 462582 - DNA, 25 bp, Mus musculus
gactgctgcggcgaatgcgaacgac

SEQ ID NO: 462583 - DNA, 25 bp, Mus musculus
gactgctgcggctctttttatgctg

SEQ ID NO: 462584 - DNA, 25 bp, Mus musculus
gactgctgctatcctatactctgat

SEQ ID NO: 462585 - DNA, 25 bp, Mus musculus
gactgctgctatgctatactctgat

SEQ ID NO: 462586 - DNA, 25 bp, Mus musculus
gactgctgcttgaatgtgaggctcc

SEQ ID NO: 462587 - DNA, 25 bp, Mus musculus
gactgctgcttgtatgtgaggctcc

SEQ ID NO: 462588 - DNA, 25 bp, Mus musculus
gactgctggaccacagcagctgtgt

SEQ ID NO: 462589 - DNA, 25 bp, Mus musculus
gactgctggaccagaaggccctgaa

SEQ ID NO: 462590 - DNA, 25 bp, Mus musculus
gactgctggacctcagcagctgtgt

SEQ ID NO: 462591 - DNA, 25 bp, Mus musculus
gactgctggacctgaaggccctgaa

SEQ ID NO: 462592 - DNA, 25 bp, Mus musculus
gactgctggatactgagcgtgcatt

SEQ ID NO: 462593 - DNA, 25 bp, Mus musculus
gactgctggatagtgagcgtgcatt

SEQ ID NO: 462594 - DNA, 25 bp, Mus musculus
gactgctggatcattaaacatcaag

SEQ ID NO: 462595 - DNA, 25 bp, Mus musculus
gactgctggatctttaaacatcaag

SEQ ID NO: 462596 - DNA, 25 bp, Mus musculus
gactgctggcataggtcgtctctaa

SEQ ID NO: 462597 - DNA, 25 bp, Mus musculus
gactgctggcattggtcgtctctaa

SEQ ID NO: 462598 - DNA, 25 bp, Mus musculus
gactgctggcccactaaatgcatgg

SEQ ID NO: 462599 - DNA, 25 bp, Mus musculus
gactgctggccctctaaatgcatgg

SEQ ID NO: 462600 - DNA, 25 bp, Mus musculus
gactgctggcgaaggtttgtaatta

SEQ ID NO: 462601 - DNA, 25 bp, Mus musculus
gactgctggcgatggtttgtaatta

SEQ ID NO: 462602 - DNA, 25 bp, Mus musculus
gactgctgggtaaactgacaacgaa

SEQ ID NO: 462603 - DNA, 25 bp, Mus musculus
gactgctgggtactctagctagaat

SEQ ID NO: 462604 - DNA, 25 bp, Mus musculus
gactgctgggtagtctagctagaat

SEQ ID NO: 462605 - DNA, 25 bp, Mus musculus
gactgctgggtatactgacaacgaa

SEQ ID NO: 462606 - DNA, 25 bp, Mus musculus
gactgctgggttctaatgatgacca

SEQ ID NO: 462607 - DNA, 25 bp, Mus musculus
gactgctgggttgtaatgatgacca

SEQ ID NO: 462608 - DNA, 25 bp, Mus musculus
gactgctggtatatcgtggtgtagc

SEQ ID NO: 462609 - DNA, 25 bp, Mus musculus
gactgctggtatttcgtggtgtagc

SEQ ID NO: 462610 - DNA, 25 bp, Mus musculus
gactgctggtctcctgtagggtctt

SEQ ID NO: 462611 - DNA, 25 bp, Mus musculus
gactgctggtctgctgtagggtctt

SEQ ID NO: 462612 - DNA, 25 bp, Mus musculus
gactgctggtgcactgtcacgtgag

SEQ ID NO: 462613 - DNA, 25 bp, Mus musculus
gactgctggtgctctgtcacgtgag

SEQ ID NO: 462614 - DNA, 25 bp, Mus musculus
gactgctgtactatttgttgacctt

SEQ ID NO: 462615 - DNA, 25 bp, Mus musculus
gactgctgtactttttgttgacctt

SEQ ID NO: 462616 - DNA, 25 bp, Mus musculus
gactgctgtagtcaacggctgctag

SEQ ID NO: 462617 - DNA, 25 bp, Mus musculus
gactgctgtagtgaacggctgctag

SEQ ID NO: 462618 - DNA, 25 bp, Mus musculus
gactgctgtccacatcagctcgttg

SEQ ID NO: 462619 - DNA, 25 bp, Mus musculus
gactgctgtccagatcagctcgttg

SEQ ID NO: 462620 - DNA, 25 bp, Mus musculus
gactgctgtcccaggtggagacaga

SEQ ID NO: 462621 - DNA, 25 bp, Mus musculus
gactgctgtcccctgaggactcctg

SEQ ID NO: 462622 - DNA, 25 bp, Mus musculus
gactgctgtcccgtgaggactcctg

SEQ ID NO: 462623 - DNA, 25 bp, Mus musculus
gactgctgtccctggtggagacaga

SEQ ID NO: 462624 - DNA, 25 bp, Mus musculus
gactgctgtcgccagaagacgtgtt

SEQ ID NO: 462625 - DNA, 25 bp, Mus musculus
gactgctgtcgcgagaagacgtgtt

SEQ ID NO: 462626 - DNA, 25 bp, Mus musculus
gactgctgtgtacctgtcctgacat

SEQ ID NO: 462627 - DNA, 25 bp, Mus musculus
gactgctgtgtagctgtcctgacat

SEQ ID NO: 462628 - DNA, 25 bp, Mus musculus
gactgctgttttacttacacgcaca

SEQ ID NO: 462629 - DNA, 25 bp, Mus musculus
gactgctgtttttcttacacgcaca

SEQ ID NO: 462630 - DNA, 25 bp, Mus musculus
gactgcttactccaatgtttctcgg

SEQ ID NO: 462631 - DNA, 25 bp, Mus musculus
gactgcttactcgaatgtttctcgg

SEQ ID NO: 462632 - DNA, 25 bp, Mus musculus
gactgcttagagaacacgtgggcca

SEQ ID NO: 462633 - DNA, 25 bp, Mus musculus
gactgcttagagtacacgtgggcca

SEQ ID NO: 462634 - DNA, 25 bp, Mus musculus
gactgcttcaacagaggatctccat

SEQ ID NO: 462635 - DNA, 25 bp, Mus musculus
gactgcttcaactgaggatctccat

SEQ ID NO: 462636 - DNA, 25 bp, Mus musculus
gactgcttcaagagacttctgacct

SEQ ID NO: 462637 - DNA, 25 bp, Mus musculus
gactgcttcaagtgacttctgacct

SEQ ID NO: 462638 - DNA, 25 bp, Mus musculus
gactgcttcactcccaagctgagtg

SEQ ID NO: 462639 - DNA, 25 bp, Mus musculus
gactgcttcactgccaagctgagtg

SEQ ID NO: 462640 - DNA, 25 bp, Mus musculus
gactgcttccagattatggttggta

SEQ ID NO: 462641 - DNA, 25 bp, Mus musculus
gactgcttccagtttatggttggta

SEQ ID NO: 462642 - DNA, 25 bp, Mus musculus
gactgcttgaaaagccccaaagaca

SEQ ID NO: 462643 - DNA, 25 bp, Mus musculus
gactgcttgaaatgccccaaagaca

SEQ ID NO: 462644 - DNA, 25 bp, Mus musculus
gactgcttgcctcacatggttgaag

SEQ ID NO: 462645 - DNA, 25 bp, Mus musculus
gactgcttgcctgacatggttgaag

SEQ ID NO: 462646 - DNA, 25 bp, Mus musculus
gactgcttggccaactgcggaatag

SEQ ID NO: 462647 - DNA, 25 bp, Mus musculus
gactgcttggcctactgcggaatag

SEQ ID NO: 462648 - DNA, 25 bp, Mus musculus
gactgctttactaagctgcacaggc

SEQ ID NO: 462649 - DNA, 25 bp, Mus musculus
gactgctttacttagctgcacaggc

SEQ ID NO: 462650 - DNA, 25 bp, Mus musculus
gactgctttcatatttccatatcat

SEQ ID NO: 462651 - DNA, 25 bp, Mus musculus
gactgctttcatttttccatatcat

SEQ ID NO: 462652 - DNA, 25 bp, Mus musculus
gactgctttccactaatggtttata

SEQ ID NO: 462653 - DNA, 25 bp, Mus musculus
gactgctttccagtaatggtttata

SEQ ID NO: 462654 - DNA, 25 bp, Mus musculus
gactgctttctaactgtgacagctg

SEQ ID NO: 462655 - DNA, 25 bp, Mus musculus
gactgctttctatctgtgacagctg

SEQ ID NO: 462656 - DNA, 25 bp, Mus musculus
gactgctttctgctggccacatcca

SEQ ID NO: 462657 - DNA, 25 bp, Mus musculus
gactgctttctggtggccacatcca

SEQ ID NO: 462658 - DNA, 25 bp, Mus musculus
gactgctttgaccaaaaggtgagga

SEQ ID NO: 462659 - DNA, 25 bp, Mus musculus
gactgctttgacgaaaaggtgagga

SEQ ID NO: 462660 - DNA, 25 bp, Mus musculus
gactgctttgtaagttttgtggttt

SEQ ID NO: 462661 - DNA, 25 bp, Mus musculus
gactgctttgtactgaattttcata

SEQ ID NO: 462662 - DNA, 25 bp, Mus musculus
gactgctttgtagtgaattttcata

SEQ ID NO: 462663 - DNA, 25 bp, Mus musculus
gactgctttgtatgttttgtggttt

SEQ ID NO: 462664 - DNA, 25 bp, Mus musculus
gactgctttttgagtcgagttacat

SEQ ID NO: 462665 - DNA, 25 bp, Mus musculus
gactgctttttgcttctgtattgag

SEQ ID NO: 462666 - DNA, 25 bp, Mus musculus
gactgctttttggttctgtattgag

SEQ ID NO: 462667 - DNA, 25 bp, Mus musculus
gactgctttttgtgtcgagttacat

SEQ ID NO: 462668 - DNA, 25 bp, Mus musculus
gactggaaaagacctgaaccctgag

SEQ ID NO: 462669 - DNA, 25 bp, Mus musculus
gactggaaaagagctgaaccctgag

SEQ ID NO: 462670 - DNA, 25 bp, Mus musculus
gactggaaactacagactgcacact

SEQ ID NO: 462671 - DNA, 25 bp, Mus musculus
gactggaaactagagactgcacact

SEQ ID NO: 462672 - DNA, 25 bp, Mus musculus
gactggaaagtcatggtttgccaac

SEQ ID NO: 462673 - DNA, 25 bp, Mus musculus
gactggaaagtcttggtttgccaac

SEQ ID NO: 462674 - DNA, 25 bp, Mus musculus
gactggaaatcaccgttctgtcctc

SEQ ID NO: 462675 - DNA, 25 bp, Mus musculus
gactggaaatcagcgttctgtcctc

SEQ ID NO: 462676 - DNA, 25 bp, Mus musculus
gactggaaatttcctgacatcctga

SEQ ID NO: 462677 - DNA, 25 bp, Mus musculus
gactggaaatttgctgacatcctga

SEQ ID NO: 462678 - DNA, 25 bp, Mus musculus
gactggaacagcagagtgtaccagc

SEQ ID NO: 462679 - DNA, 25 bp, Mus musculus
gactggaacagctgagtgtaccagc

SEQ ID NO: 462680 - DNA, 25 bp, Mus musculus
gactggaaccctcataggttgctga

SEQ ID NO: 462681 - DNA, 25 bp, Mus musculus
gactggaaccctgataggttgctga

SEQ ID NO: 462682 - DNA, 25 bp, Mus musculus
gactggaaccttacaagcctcataa

SEQ ID NO: 462683 - DNA, 25 bp, Mus musculus
gactggaacctttcaagcctcataa

SEQ ID NO: 462684 - DNA, 25 bp, Mus musculus
gactggaactatcaaatacacttgt

SEQ ID NO: 462685 - DNA, 25 bp, Mus musculus
gactggaactatgaaatacacttgt

SEQ ID NO: 462686 - DNA, 25 bp, Mus musculus
gactggaactgaagcaagcatcttg

SEQ ID NO: 462687 - DNA, 25 bp, Mus musculus
gactggaactgatgcaagcatcttg

SEQ ID NO: 462688 - DNA, 25 bp, Mus musculus
gactggaagactcagtacttgggaa

SEQ ID NO: 462689 - DNA, 25 bp, Mus musculus
gactggaagactgagtacttgggaa

SEQ ID NO: 462690 - DNA, 25 bp, Mus musculus
gactggaagggtctcagaattacag

SEQ ID NO: 462691 - DNA, 25 bp, Mus musculus
gactggaagggtgtcagaattacag

SEQ ID NO: 462692 - DNA, 25 bp, Mus musculus
gactggaagtcaatatgtttgctga

SEQ ID NO: 462693 - DNA, 25 bp, Mus musculus
gactggaagtcattatgtttgctga

SEQ ID NO: 462694 - DNA, 25 bp, Mus musculus
gactggaagtgtcctaatcctacat

SEQ ID NO: 462695 - DNA, 25 bp, Mus musculus
gactggaagtgtgctaatcctacat

SEQ ID NO: 462696 - DNA, 25 bp, Mus musculus
gactggaagttcaaacagcatggca

SEQ ID NO: 462697 - DNA, 25 bp, Mus musculus
gactggaagttctaacagcatggca

SEQ ID NO: 462698 - DNA, 25 bp, Mus musculus
gactggaagtttacaaaactgccag

SEQ ID NO: 462699 - DNA, 25 bp, Mus musculus
gactggaagtttactcttttacata

SEQ ID NO: 462700 - DNA, 25 bp, Mus musculus
gactggaagttttcaaaactgccag

SEQ ID NO: 462701 - DNA, 25 bp, Mus musculus
gactggaagttttctcttttacata

SEQ ID NO: 462702 - DNA, 25 bp, Mus musculus
gactggaatcctcaagaccagcctc

SEQ ID NO: 462703 - DNA, 25 bp, Mus musculus
gactggaatcctgaagaccagcctc

SEQ ID NO: 462704 - DNA, 25 bp, Mus musculus
gactggaattataagtttgtactta

SEQ ID NO: 462705 - DNA, 25 bp, Mus musculus
gactggaattattagtttgtactta

SEQ ID NO: 462706 - DNA, 25 bp, Mus musculus
gactggaattgcaacttgtcctttt

SEQ ID NO: 462707 - DNA, 25 bp, Mus musculus
gactggaattgctacttgtcctttt

SEQ ID NO: 462708 - DNA, 25 bp, Mus musculus
gactggaatttgatgaggccgagaa

SEQ ID NO: 462709 - DNA, 25 bp, Mus musculus
gactggaatttgttgaggccgagaa

SEQ ID NO: 462710 - DNA, 25 bp, Mus musculus
gactggacaaagcagtgtggccaca

SEQ ID NO: 462711 - DNA, 25 bp, Mus musculus
gactggacaaaggagtgtggccaca

SEQ ID NO: 462712 - DNA, 25 bp, Mus musculus
gactggacacaccttgtttgggcat

SEQ ID NO: 462713 - DNA, 25 bp, Mus musculus
gactggacacacgttgtttgggcat

SEQ ID NO: 462714 - DNA, 25 bp, Mus musculus
gactggacagaccacaggacagttc

SEQ ID NO: 462715 - DNA, 25 bp, Mus musculus
gactggacagacgacaggacagttc

SEQ ID NO: 462716 - DNA, 25 bp, Mus musculus
gactggacatagaccaggccctgag

SEQ ID NO: 462717 - DNA, 25 bp, Mus musculus
gactggacatagtccaggccctgag

SEQ ID NO: 462718 - DNA, 25 bp, Mus musculus
gactggacatcaaagctgcactggg

SEQ ID NO: 462719 - DNA, 25 bp, Mus musculus
gactggacatcatagctgcactggg

SEQ ID NO: 462720 - DNA, 25 bp, Mus musculus
gactggacattcctcctaggaaatt

SEQ ID NO: 462721 - DNA, 25 bp, Mus musculus
gactggacattcgtcctaggaaatt

SEQ ID NO: 462722 - DNA, 25 bp, Mus musculus
gactggaccacaaacatgatgcaga

SEQ ID NO: 462723 - DNA, 25 bp, Mus musculus
gactggaccacatacatgatgcaga

SEQ ID NO: 462724 - DNA, 25 bp, Mus musculus
gactggaccagtatactttgctgga

SEQ ID NO: 462725 - DNA, 25 bp, Mus musculus
gactggaccagtttactttgctgga

SEQ ID NO: 462726 - DNA, 25 bp, Mus musculus
gactggacccacagaacttttctac

SEQ ID NO: 462727 - DNA, 25 bp, Mus musculus
gactggacccactgaacttttctac

SEQ ID NO: 462728 - DNA, 25 bp, Mus musculus
gactggacccagagaggtactttga

SEQ ID NO: 462729 - DNA, 25 bp, Mus musculus
gactggacccagtgaggtactttga

SEQ ID NO: 462730 - DNA, 25 bp, Mus musculus
gactggaccgttattgattgagctg

SEQ ID NO: 462731 - DNA, 25 bp, Mus musculus
gactggaccgtttttgattgagctg

SEQ ID NO: 462732 - DNA, 25 bp, Mus musculus
gactggacctatctttgacttacac

SEQ ID NO: 462733 - DNA, 25 bp, Mus musculus
gactggacctatgtttgacttacac

SEQ ID NO: 462734 - DNA, 25 bp, Mus musculus
gactggaccttcaaaattacctatg

SEQ ID NO: 462735 - DNA, 25 bp, Mus musculus
gactggaccttctaaattacctatg

SEQ ID NO: 462736 - DNA, 25 bp, Mus musculus
gactggactaatcccaggaacccct

SEQ ID NO: 462737 - DNA, 25 bp, Mus musculus
gactggactaatgccaggaacccct

SEQ ID NO: 462738 - DNA, 25 bp, Mus musculus
gactggactatcaagtgacaccgcc

SEQ ID NO: 462739 - DNA, 25 bp, Mus musculus
gactggactatctagtgacaccgcc

SEQ ID NO: 462740 - DNA, 25 bp, Mus musculus
gactggactccacttagccttttaa

SEQ ID NO: 462741 - DNA, 25 bp, Mus musculus
gactggactccagttagccttttaa

SEQ ID NO: 462742 - DNA, 25 bp, Mus musculus
gactggactcctatttacacttaag

SEQ ID NO: 462743 - DNA, 25 bp, Mus musculus
gactggactcctttttacacttaag

SEQ ID NO: 462744 - DNA, 25 bp, Mus musculus
gactggactctaactcagacttgga

SEQ ID NO: 462745 - DNA, 25 bp, Mus musculus
gactggactctatctcagacttgga

SEQ ID NO: 462746 - DNA, 25 bp, Mus musculus
gactggactgaacccaccatgatgt

SEQ ID NO: 462747 - DNA, 25 bp, Mus musculus
gactggactgaagccaccatgatgt

SEQ ID NO: 462748 - DNA, 25 bp, Mus musculus
gactggactgacagggcgttatgat

SEQ ID NO: 462749 - DNA, 25 bp, Mus musculus
gactggactgactgggcgttatgat

SEQ ID NO: 462750 - DNA, 25 bp, Mus musculus
gactggactggcctgttgtaaactg

SEQ ID NO: 462751 - DNA, 25 bp, Mus musculus
gactggactggcgtgttgtaaactg

SEQ ID NO: 462752 - DNA, 25 bp, Mus musculus
gactggacttcccattaacctttgt

SEQ ID NO: 462753 - DNA, 25 bp, Mus musculus
gactggacttccgattaacctttgt

SEQ ID NO: 462754 - DNA, 25 bp, Mus musculus
gactggacttgaacatctctacaga

SEQ ID NO: 462755 - DNA, 25 bp, Mus musculus
gactggacttgatcatctctacaga

SEQ ID NO: 462756 - DNA, 25 bp, Mus musculus
gactggacttgcatcaaaggtaccc

SEQ ID NO: 462757 - DNA, 25 bp, Mus musculus
gactggacttgcttcaaaggtaccc

SEQ ID NO: 462758 - DNA, 25 bp, Mus musculus
gactggagaagccaccctggaactg

SEQ ID NO: 462759 - DNA, 25 bp, Mus musculus
gactggagaagcgaccctggaactg

SEQ ID NO: 462760 - DNA, 25 bp, Mus musculus
gactggagacaaacggagggaaact

SEQ ID NO: 462761 - DNA, 25 bp, Mus musculus
gactggagacaatcggagggaaact

SEQ ID NO: 462762 - DNA, 25 bp, Mus musculus
gactggagaccccttccgatggaaa

SEQ ID NO: 462763 - DNA, 25 bp, Mus musculus
gactggagacccgttccgatggaaa

SEQ ID NO: 462764 - DNA, 25 bp, Mus musculus
gactggagagacaaatttctgcaga

SEQ ID NO: 462765 - DNA, 25 bp, Mus musculus
gactggagagacattctgctctgac

SEQ ID NO: 462766 - DNA, 25 bp, Mus musculus
gactggagagactaatttctgcaga

SEQ ID NO: 462767 - DNA, 25 bp, Mus musculus
gactggagagactttctgctctgac

SEQ ID NO: 462768 - DNA, 25 bp, Mus musculus
gactggagagagcactcagccctta

SEQ ID NO: 462769 - DNA, 25 bp, Mus musculus
gactggagagaggactcagccctta

SEQ ID NO: 462770 - DNA, 25 bp, Mus musculus
gactggagagccaggatatttctaa

SEQ ID NO: 462771 - DNA, 25 bp, Mus musculus
gactggagagccagtgattgcccag

SEQ ID NO: 462772 - DNA, 25 bp, Mus musculus
gactggagagcctggatatttctaa

SEQ ID NO: 462773 - DNA, 25 bp, Mus musculus
gactggagagcctgtgattgcccag

SEQ ID NO: 462774 - DNA, 25 bp, Mus musculus
gactggagagttagtcagcttcttc

SEQ ID NO: 462775 - DNA, 25 bp, Mus musculus
gactggagagtttgtcagcttcttc

SEQ ID NO: 462776 - DNA, 25 bp, Mus musculus
gactggagcagtcatcgcctgttat

SEQ ID NO: 462777 - DNA, 25 bp, Mus musculus
gactggagcagtgatcgcctgttat

SEQ ID NO: 462778 - DNA, 25 bp, Mus musculus
gactggagccctctactgtaattga

SEQ ID NO: 462779 - DNA, 25 bp, Mus musculus
gactggagccctgtactgtaattga

SEQ ID NO: 462780 - DNA, 25 bp, Mus musculus
gactggagctaaatgcagcctgaga

SEQ ID NO: 462781 - DNA, 25 bp, Mus musculus
gactggagctaattgcagcctgaga

SEQ ID NO: 462782 - DNA, 25 bp, Mus musculus
gactggagctggagactcgcatatc

SEQ ID NO: 462783 - DNA, 25 bp, Mus musculus
gactggagctggctgcagctcaaaa

SEQ ID NO: 462784 - DNA, 25 bp, Mus musculus
gactggagctgggtgcagctcaaaa

SEQ ID NO: 462785 - DNA, 25 bp, Mus musculus
gactggagctggtgactcgcatatc

SEQ ID NO: 462786 - DNA, 25 bp, Mus musculus
gactggaggattatcctgtgctgtc

SEQ ID NO: 462787 - DNA, 25 bp, Mus musculus
gactggaggattttcctgtgctgtc

SEQ ID NO: 462788 - DNA, 25 bp, Mus musculus
gactggaggcagaccactgggactt

SEQ ID NO: 462789 - DNA, 25 bp, Mus musculus
gactggaggcagtccactgggactt

SEQ ID NO: 462790 - DNA, 25 bp, Mus musculus
gactggagggaccttcactcccggg

SEQ ID NO: 462791 - DNA, 25 bp, Mus musculus
gactggagggacgttcactcccggg

SEQ ID NO: 462792 - DNA, 25 bp, Mus musculus
gactggaggtacctcccaggacatt

SEQ ID NO: 462793 - DNA, 25 bp, Mus musculus
gactggaggtacgtcccaggacatt

SEQ ID NO: 462794 - DNA, 25 bp, Mus musculus
gactggaggtctatttacaggaatt

SEQ ID NO: 462795 - DNA, 25 bp, Mus musculus
gactggaggtctttttacaggaatt

SEQ ID NO: 462796 - DNA, 25 bp, Mus musculus
gactggagtcaaccttacatgtaaa

SEQ ID NO: 462797 - DNA, 25 bp, Mus musculus
gactggagtcaagcttacatgtaaa

SEQ ID NO: 462798 - DNA, 25 bp, Mus musculus
gactggagtcatctaaagtccggaa

SEQ ID NO: 462799 - DNA, 25 bp, Mus musculus
gactggagtcatgtaaagtccggaa

SEQ ID NO: 462800 - DNA, 25 bp, Mus musculus
gactggagtctgcaacaccgtgtta

SEQ ID NO: 462801 - DNA, 25 bp, Mus musculus
gactggagtctggaacaccgtgtta

SEQ ID NO: 462802 - DNA, 25 bp, Mus musculus
gactggagtgacctgccacccgaga

SEQ ID NO: 462803 - DNA, 25 bp, Mus musculus
gactggagtgacgtgccacccgaga

SEQ ID NO: 462804 - DNA, 25 bp, Mus musculus
gactggataaaacccctgcagctct

SEQ ID NO: 462805 - DNA, 25 bp, Mus musculus
gactggataaaagccctgcagctct

SEQ ID NO: 462806 - DNA, 25 bp, Mus musculus
gactggataagtaccctgattcgct

SEQ ID NO: 462807 - DNA, 25 bp, Mus musculus
gactggataagttccctgattcgct

SEQ ID NO: 462808 - DNA, 25 bp, Mus musculus
gactggataggcctactttggacat

SEQ ID NO: 462809 - DNA, 25 bp, Mus musculus
gactggataggcgtactttggacat

SEQ ID NO: 462810 - DNA, 25 bp, Mus musculus
gactggatcaacacggtgatggcaa

SEQ ID NO: 462811 - DNA, 25 bp, Mus musculus
gactggatcaactcggtgatggcaa

SEQ ID NO: 462812 - DNA, 25 bp, Mus musculus
gactggatcagtaaagccgaaaccg

SEQ ID NO: 462813 - DNA, 25 bp, Mus musculus
gactggatcagtcagcttagaaagg

SEQ ID NO: 462814 - DNA, 25 bp, Mus musculus
gactggatcagtgagcttagaaagg

SEQ ID NO: 462815 - DNA, 25 bp, Mus musculus
gactggatcagttaagccgaaaccg

SEQ ID NO: 462816 - DNA, 25 bp, Mus musculus
gactggatcattcggtccctgtaat

SEQ ID NO: 462817 - DNA, 25 bp, Mus musculus
gactggatcattgggtccctgtaat

SEQ ID NO: 462818 - DNA, 25 bp, Mus musculus
gactggatccagatggacctgcaga

SEQ ID NO: 462819 - DNA, 25 bp, Mus musculus
gactggatccagttggacctgcaga

SEQ ID NO: 462820 - DNA, 25 bp, Mus musculus
gactggatctcacctgcagtgtttt

SEQ ID NO: 462821 - DNA, 25 bp, Mus musculus
gactggatctcagctgcagtgtttt

SEQ ID NO: 462822 - DNA, 25 bp, Mus musculus
gactggatctcgcttactccttaac

SEQ ID NO: 462823 - DNA, 25 bp, Mus musculus
gactggatctcggttactccttaac

SEQ ID NO: 462824 - DNA, 25 bp, Mus musculus
gactggatctgtcacaagccaactt

SEQ ID NO: 462825 - DNA, 25 bp, Mus musculus
gactggatctgtgacaagccaactt

SEQ ID NO: 462826 - DNA, 25 bp, Mus musculus
gactggatgagcactccaggttcca

SEQ ID NO: 462827 - DNA, 25 bp, Mus musculus
gactggatgagctctccaggttcca

SEQ ID NO: 462828 - DNA, 25 bp, Mus musculus
gactggatgccaatatttggcatgc

SEQ ID NO: 462829 - DNA, 25 bp, Mus musculus
gactggatgccattatttggcatgc

SEQ ID NO: 462830 - DNA, 25 bp, Mus musculus
gactggatggcaccttgaatgcaat

SEQ ID NO: 462831 - DNA, 25 bp, Mus musculus
gactggatggcagcttgaatgcaat

SEQ ID NO: 462832 - DNA, 25 bp, Mus musculus
gactggatggccacaacaacctgaa

SEQ ID NO: 462833 - DNA, 25 bp, Mus musculus
gactggatggcctcaacaacctgaa

SEQ ID NO: 462834 - DNA, 25 bp, Mus musculus
gactggatggctactcaattaaaca

SEQ ID NO: 462835 - DNA, 25 bp, Mus musculus
gactggatggcttctcaattaaaca

SEQ ID NO: 462836 - DNA, 25 bp, Mus musculus
gactggatgtctcagatggccttca

SEQ ID NO: 462837 - DNA, 25 bp, Mus musculus
gactggatgtctgagatggccttca

SEQ ID NO: 462838 - DNA, 25 bp, Mus musculus
gactggatgtgcctttatcctctaa

SEQ ID NO: 462839 - DNA, 25 bp, Mus musculus
gactggatgtgcgtttatcctctaa

SEQ ID NO: 462840 - DNA, 25 bp, Mus musculus
gactggatgttgcactcccagaatc

SEQ ID NO: 462841 - DNA, 25 bp, Mus musculus
gactggatgttggactcccagaatc

SEQ ID NO: 462842 - DNA, 25 bp, Mus musculus
gactggattaaaaacgggacctctg

SEQ ID NO: 462843 - DNA, 25 bp, Mus musculus
gactggattaaatacgggacctctg

SEQ ID NO: 462844 - DNA, 25 bp, Mus musculus
gactggattcaaaacgtgctgcggg

SEQ ID NO: 462845 - DNA, 25 bp, Mus musculus
gactggattcaatacgtgctgcggg

SEQ ID NO: 462846 - DNA, 25 bp, Mus musculus
gactggattcataggtttggacatc

SEQ ID NO: 462847 - DNA, 25 bp, Mus musculus
gactggattcattggtttggacatc

SEQ ID NO: 462848 - DNA, 25 bp, Mus musculus
gactggattctaccttaaacacctt

SEQ ID NO: 462849 - DNA, 25 bp, Mus musculus
gactggattctagcttaaacacctt

SEQ ID NO: 462850 - DNA, 25 bp, Mus musculus
gactggattgtgcatctgctatcta

SEQ ID NO: 462851 - DNA, 25 bp, Mus musculus
gactggattgtggatctgctatcta

SEQ ID NO: 462852 - DNA, 25 bp, Mus musculus
gactggatttgccttgtagtcccag

SEQ ID NO: 462853 - DNA, 25 bp, Mus musculus
gactggatttgcgttgtagtcccag

SEQ ID NO: 462854 - DNA, 25 bp, Mus musculus
gactggattttaagctgtggtagac

SEQ ID NO: 462855 - DNA, 25 bp, Mus musculus
gactggattttatgctgtggtagac

SEQ ID NO: 462856 - DNA, 25 bp, Mus musculus
gactggcaaagaattaacactctcc

SEQ ID NO: 462857 - DNA, 25 bp, Mus musculus
gactggcaaagatttaacactctcc

SEQ ID NO: 462858 - DNA, 25 bp, Mus musculus
gactggcaacgcacatatttatttc

SEQ ID NO: 462859 - DNA, 25 bp, Mus musculus
gactggcaacgctcatatttatttc

SEQ ID NO: 462860 - DNA, 25 bp, Mus musculus
gactggcaagcactgtaccgactga

SEQ ID NO: 462861 - DNA, 25 bp, Mus musculus
gactggcaagcagtgtaccgactga

SEQ ID NO: 462862 - DNA, 25 bp, Mus musculus
gactggcaccaacagttgcgtagtt

SEQ ID NO: 462863 - DNA, 25 bp, Mus musculus
gactggcaccaactcctctggagaa

SEQ ID NO: 462864 - DNA, 25 bp, Mus musculus
gactggcaccaagagttgcgtagtt

SEQ ID NO: 462865 - DNA, 25 bp, Mus musculus
gactggcaccaagtcctctggagaa

SEQ ID NO: 462866 - DNA, 25 bp, Mus musculus
gactggcaccagaaagaaaatctaa

SEQ ID NO: 462867 - DNA, 25 bp, Mus musculus
gactggcaccagtaagaaaatctaa

SEQ ID NO: 462868 - DNA, 25 bp, Mus musculus
gactggcaccctcttcagagttgta

SEQ ID NO: 462869 - DNA, 25 bp, Mus musculus
gactggcaccctgttcagagttgta

SEQ ID NO: 462870 - DNA, 25 bp, Mus musculus
gactggcacctgaattgttccttcc

SEQ ID NO: 462871 - DNA, 25 bp, Mus musculus
gactggcacctgtattgttccttcc

SEQ ID NO: 462872 - DNA, 25 bp, Mus musculus
gactggcactgtacttagccaagat

SEQ ID NO: 462873 - DNA, 25 bp, Mus musculus
gactggcactgttcttagccaagat

SEQ ID NO: 462874 - DNA, 25 bp, Mus musculus
gactggcagaaaccctaagttggct

SEQ ID NO: 462875 - DNA, 25 bp, Mus musculus
gactggcagaaagcctaagttggct

SEQ ID NO: 462876 - DNA, 25 bp, Mus musculus
gactggcagatgcagatctatgtta

SEQ ID NO: 462877 - DNA, 25 bp, Mus musculus
gactggcagatggagatctatgtta

SEQ ID NO: 462878 - DNA, 25 bp, Mus musculus
gactggcagtgtcccaatccgggct

SEQ ID NO: 462879 - DNA, 25 bp, Mus musculus
gactggcagtgtgccaatccgggct

SEQ ID NO: 462880 - DNA, 25 bp, Mus musculus
gactggcagtttatattcccttagt

SEQ ID NO: 462881 - DNA, 25 bp, Mus musculus
gactggcagtttttattcccttagt

SEQ ID NO: 462882 - DNA, 25 bp, Mus musculus
gactggcataagagtcttgactcta

SEQ ID NO: 462883 - DNA, 25 bp, Mus musculus
gactggcataagtgtcttgactcta

SEQ ID NO: 462884 - DNA, 25 bp, Mus musculus
gactggcatataagacaccacgtgt

SEQ ID NO: 462885 - DNA, 25 bp, Mus musculus
gactggcatatatgacaccacgtgt

SEQ ID NO: 462886 - DNA, 25 bp, Mus musculus
gactggcatcacactttctatgtag

SEQ ID NO: 462887 - DNA, 25 bp, Mus musculus
gactggcatcactctttctatgtag

SEQ ID NO: 462888 - DNA, 25 bp, Mus musculus
gactggcatgatcctgactatgtca

SEQ ID NO: 462889 - DNA, 25 bp, Mus musculus
gactggcatgatgctgactatgtca

SEQ ID NO: 462890 - DNA, 25 bp, Mus musculus
gactggcatgcaatggtactctcgc

SEQ ID NO: 462891 - DNA, 25 bp, Mus musculus
gactggcatgcattggtactctcgc

SEQ ID NO: 462892 - DNA, 25 bp, Mus musculus
gactggcattttcgattgcggtcct

SEQ ID NO: 462893 - DNA, 25 bp, Mus musculus
gactggcattttggattgcggtcct

SEQ ID NO: 462894 - DNA, 25 bp, Mus musculus
gactggccaaggatgtactagctga

SEQ ID NO: 462895 - DNA, 25 bp, Mus musculus
gactggccaaggttgtactagctga

SEQ ID NO: 462896 - DNA, 25 bp, Mus musculus
gactggccacgtcaatgcttagttc

SEQ ID NO: 462897 - DNA, 25 bp, Mus musculus
gactggccacgtgaatgcttagttc

SEQ ID NO: 462898 - DNA, 25 bp, Mus musculus
gactggccatatcctttcaattttt

SEQ ID NO: 462899 - DNA, 25 bp, Mus musculus
gactggccatatgctttcaattttt

SEQ ID NO: 462900 - DNA, 25 bp, Mus musculus
gactggcccagaatgtatgggtata

SEQ ID NO: 462901 - DNA, 25 bp, Mus musculus
gactggcccagattgtatgggtata

SEQ ID NO: 462902 - DNA, 25 bp, Mus musculus
gactggcccatcacattgcttgaag

SEQ ID NO: 462903 - DNA, 25 bp, Mus musculus
gactggcccatctcattgcttgaag

SEQ ID NO: 462904 - DNA, 25 bp, Mus musculus
gactggccccgactgatgtgttttg

SEQ ID NO: 462905 - DNA, 25 bp, Mus musculus
gactggccccgagtgatgtgttttg

SEQ ID NO: 462906 - DNA, 25 bp, Mus musculus
gactggcccctcagagtagcagccg

SEQ ID NO: 462907 - DNA, 25 bp, Mus musculus
gactggcccctctgagtagcagccg

SEQ ID NO: 462908 - DNA, 25 bp, Mus musculus
gactggccgatcagagtactattca

SEQ ID NO: 462909 - DNA, 25 bp, Mus musculus
gactggccgatctgagtactattca

SEQ ID NO: 462910 - DNA, 25 bp, Mus musculus
gactggccggagacaccaatctcta

SEQ ID NO: 462911 - DNA, 25 bp, Mus musculus
gactggccggagtcaccaatctcta

SEQ ID NO: 462912 - DNA, 25 bp, Mus musculus
gactggccgtaaaagttcccttaat

SEQ ID NO: 462913 - DNA, 25 bp, Mus musculus
gactggccgtaatagttcccttaat

SEQ ID NO: 462914 - DNA, 25 bp, Mus musculus
gactggccgtgtctaatgtgtccaa

SEQ ID NO: 462915 - DNA, 25 bp, Mus musculus
gactggccgtgtgtaatgtgtccaa

SEQ ID NO: 462916 - DNA, 25 bp, Mus musculus
gactggccgttgcttcatatttaat

SEQ ID NO: 462917 - DNA, 25 bp, Mus musculus
gactggccgttggttcatatttaat

SEQ ID NO: 462918 - DNA, 25 bp, Mus musculus
gactggcctcgacaggtatctctac

SEQ ID NO: 462919 - DNA, 25 bp, Mus musculus
gactggcctcgagaggtatctctac

SEQ ID NO: 462920 - DNA, 25 bp, Mus musculus
gactggcctgcaaggcaacaacata

SEQ ID NO: 462921 - DNA, 25 bp, Mus musculus
gactggcctgcatggcaacaacata

SEQ ID NO: 462922 - DNA, 25 bp, Mus musculus
gactggcctggtacgttttcatctg

SEQ ID NO: 462923 - DNA, 25 bp, Mus musculus
gactggcctggttcgttttcatctg

SEQ ID NO: 462924 - DNA, 25 bp, Mus musculus
gactggcctgtaacctaattaacct

SEQ ID NO: 462925 - DNA, 25 bp, Mus musculus
gactggcctgtatcctaattaacct

SEQ ID NO: 462926 - DNA, 25 bp, Mus musculus
gactggccttagattgtgaaacaaa

SEQ ID NO: 462927 - DNA, 25 bp, Mus musculus
gactggccttagtttgtgaaacaaa

SEQ ID NO: 462928 - DNA, 25 bp, Mus musculus
gactggccttttccagcaaggtgct

SEQ ID NO: 462929 - DNA, 25 bp, Mus musculus
gactggccttttgcagcaaggtgct

SEQ ID NO: 462930 - DNA, 25 bp, Mus musculus
gactggcgaccaagaagccttcttt

SEQ ID NO: 462931 - DNA, 25 bp, Mus musculus
gactggcgaccatgaagccttcttt

SEQ ID NO: 462932 - DNA, 25 bp, Mus musculus
gactggcgattgacacaaagtggga

SEQ ID NO: 462933 - DNA, 25 bp, Mus musculus
gactggcgattgtcacaaagtggga

SEQ ID NO: 462934 - DNA, 25 bp, Mus musculus
gactggcgctatcaccgttatcttg

SEQ ID NO: 462935 - DNA, 25 bp, Mus musculus
gactggcgctatgaccgttatcttg

SEQ ID NO: 462936 - DNA, 25 bp, Mus musculus
gactggcgctccatcctggaaaggg

SEQ ID NO: 462937 - DNA, 25 bp, Mus musculus
gactggcgctccttcctggaaaggg

SEQ ID NO: 462938 - DNA, 25 bp, Mus musculus
gactggctaactctaagtggtctca

SEQ ID NO: 462939 - DNA, 25 bp, Mus musculus
gactggctaactgtaagtggtctca

SEQ ID NO: 462940 - DNA, 25 bp, Mus musculus
gactggctagatataggctgaccta

SEQ ID NO: 462941 - DNA, 25 bp, Mus musculus
gactggctagatttaggctgaccta

SEQ ID NO: 462942 - DNA, 25 bp, Mus musculus
gactggctcaatcgcaaggagttca

SEQ ID NO: 462943 - DNA, 25 bp, Mus musculus
gactggctcaatctggagaggttaa

SEQ ID NO: 462944 - DNA, 25 bp, Mus musculus
gactggctcaatggcaaggagttca

SEQ ID NO: 462945 - DNA, 25 bp, Mus musculus
gactggctcaatgtggagaggttaa

SEQ ID NO: 462946 - DNA, 25 bp, Mus musculus
gactggctccatagctttctagcaa

SEQ ID NO: 462947 - DNA, 25 bp, Mus musculus
gactggctccattgctttctagcaa

SEQ ID NO: 462948 - DNA, 25 bp, Mus musculus
gactggctcccaattgagatgtcaa

SEQ ID NO: 462949 - DNA, 25 bp, Mus musculus
gactggctcccatttgagatgtcaa

SEQ ID NO: 462950 - DNA, 25 bp, Mus musculus
gactggctcctgaaaacgatgacct

SEQ ID NO: 462951 - DNA, 25 bp, Mus musculus
gactggctcctgattacgatgcttt

SEQ ID NO: 462952 - DNA, 25 bp, Mus musculus
gactggctcctgtaaacgatgacct

SEQ ID NO: 462953 - DNA, 25 bp, Mus musculus
gactggctcctgtttacgatgcttt

SEQ ID NO: 462954 - DNA, 25 bp, Mus musculus
gactggctgactatgaggcccaaaa

SEQ ID NO: 462955 - DNA, 25 bp, Mus musculus
gactggctgactttgaggcccaaaa

SEQ ID NO: 462956 - DNA, 25 bp, Mus musculus
gactggctgagtatgcctaaccgaa

SEQ ID NO: 462957 - DNA, 25 bp, Mus musculus
gactggctgagtttgcctaaccgaa

SEQ ID NO: 462958 - DNA, 25 bp, Mus musculus
gactggctgatgctcatcttacgat

SEQ ID NO: 462959 - DNA, 25 bp, Mus musculus
gactggctgatggtcatcttacgat

SEQ ID NO: 462960 - DNA, 25 bp, Mus musculus
gactggctgtcgctcagacgtcatt

SEQ ID NO: 462961 - DNA, 25 bp, Mus musculus
gactggctgtcggtcagacgtcatt

SEQ ID NO: 462962 - DNA, 25 bp, Mus musculus
gactggctgtgaagtagtagacact

SEQ ID NO: 462963 - DNA, 25 bp, Mus musculus
gactggctgtgatgtagtagacact

SEQ ID NO: 462964 - DNA, 25 bp, Mus musculus
gactggcttaccaaaagtgttctct

SEQ ID NO: 462965 - DNA, 25 bp, Mus musculus
gactggcttacctaaagtgttctct

SEQ ID NO: 462966 - DNA, 25 bp, Mus musculus
gactggcttcagaagacttatgtat

SEQ ID NO: 462967 - DNA, 25 bp, Mus musculus
gactggcttcagtagacttatgtat

SEQ ID NO: 462968 - DNA, 25 bp, Mus musculus
gactggcttctacagcaggctgtca

SEQ ID NO: 462969 - DNA, 25 bp, Mus musculus
gactggcttctagagcaggctgtca

SEQ ID NO: 462970 - DNA, 25 bp, Mus musculus
gactggcttctgcagagcactttga

SEQ ID NO: 462971 - DNA, 25 bp, Mus musculus
gactggcttctggagagcactttga

SEQ ID NO: 462972 - DNA, 25 bp, Mus musculus
gactggcttcttacttatgttaatc

SEQ ID NO: 462973 - DNA, 25 bp, Mus musculus
gactggcttctttcttatgttaatc

SEQ ID NO: 462974 - DNA, 25 bp, Mus musculus
gactggcttgcaaacatatcctaga

SEQ ID NO: 462975 - DNA, 25 bp, Mus musculus
gactggcttgcatacatatcctaga

SEQ ID NO: 462976 - DNA, 25 bp, Mus musculus
gactggcttgtaatccagatatgga

SEQ ID NO: 462977 - DNA, 25 bp, Mus musculus
gactggcttgtattccagatatgga

SEQ ID NO: 462978 - DNA, 25 bp, Mus musculus
gactggcttgttcagttgctaccta

SEQ ID NO: 462979 - DNA, 25 bp, Mus musculus
gactggcttgttgagttgctaccta

SEQ ID NO: 462980 - DNA, 25 bp, Mus musculus
gactggctttggacagtagttcact

SEQ ID NO: 462981 - DNA, 25 bp, Mus musculus
gactggctttggtcagtagttcact

SEQ ID NO: 462982 - DNA, 25 bp, Mus musculus
gactggctttgtagttaacgctttc

SEQ ID NO: 462983 - DNA, 25 bp, Mus musculus
gactggctttgttgttaacgctttc

SEQ ID NO: 462984 - DNA, 25 bp, Mus musculus
gactggcttttccaagggtctgcaa

SEQ ID NO: 462985 - DNA, 25 bp, Mus musculus
gactggcttttcgaagggtctgcaa

SEQ ID NO: 462986 - DNA, 25 bp, Mus musculus
gactggcttttgcagatgtcttgac

SEQ ID NO: 462987 - DNA, 25 bp, Mus musculus
gactggcttttggagatgtcttgac

SEQ ID NO: 462988 - DNA, 25 bp, Mus musculus
gactgggaacacaaccatacttctt

SEQ ID NO: 462989 - DNA, 25 bp, Mus musculus
gactgggaacactaccatacttctt

SEQ ID NO: 462990 - DNA, 25 bp, Mus musculus
gactgggaagataccatccagcccc

SEQ ID NO: 462991 - DNA, 25 bp, Mus musculus
gactgggaagattccatccagcccc

SEQ ID NO: 462992 - DNA, 25 bp, Mus musculus
gactgggaatccatttttacactgc

SEQ ID NO: 462993 - DNA, 25 bp, Mus musculus
gactgggaatccttttttacactgc

SEQ ID NO: 462994 - DNA, 25 bp, Mus musculus
gactgggaattcatcccatacacag

SEQ ID NO: 462995 - DNA, 25 bp, Mus musculus
gactgggaattcttcccatacacag

SEQ ID NO: 462996 - DNA, 25 bp, Mus musculus
gactgggacaggacctattcctgcc

SEQ ID NO: 462997 - DNA, 25 bp, Mus musculus
gactgggacaggtcctattcctgcc

SEQ ID NO: 462998 - DNA, 25 bp, Mus musculus
gactgggacatcataatgtgttcct

SEQ ID NO: 462999 - DNA, 25 bp, Mus musculus
gactgggacatcttaatgtgttcct

SEQ ID NO: 463000 - DNA, 25 bp, Mus musculus
gactgggaccctcaatgcttagatt

SEQ ID NO: 463001 - DNA, 25 bp, Mus musculus
gactgggaccctgaatgcttagatt

SEQ ID NO: 463002 - DNA, 25 bp, Mus musculus
gactgggactatacacaaccgtgag

SEQ ID NO: 463003 - DNA, 25 bp, Mus musculus
gactgggactattcacaaccgtgag

SEQ ID NO: 463004 - DNA, 25 bp, Mus musculus
gactgggactttaactgaacctcac

SEQ ID NO: 463005 - DNA, 25 bp, Mus musculus
gactgggacttttactgaacctcac

SEQ ID NO: 463006 - DNA, 25 bp, Mus musculus
gactgggagaacacctggtccatgt

SEQ ID NO: 463007 - DNA, 25 bp, Mus musculus
gactgggagaactcctggtccatgt

SEQ ID NO: 463008 - DNA, 25 bp, Mus musculus
gactgggagctgacttatcccaaca

SEQ ID NO: 463009 - DNA, 25 bp, Mus musculus
gactgggagctgctatctcaaagtt

SEQ ID NO: 463010 - DNA, 25 bp, Mus musculus
gactgggagctggtatctcaaagtt

SEQ ID NO: 463011 - DNA, 25 bp, Mus musculus
gactgggagctgtcttatcccaaca

SEQ ID NO: 463012 - DNA, 25 bp, Mus musculus
gactgggagtgtaagaggccaccct

SEQ ID NO: 463013 - DNA, 25 bp, Mus musculus
gactgggagtgttagaggccaccct

SEQ ID NO: 463014 - DNA, 25 bp, Mus musculus
gactgggatataacgtccttagagg

SEQ ID NO: 463015 - DNA, 25 bp, Mus musculus
gactgggatatatcgtccttagagg

SEQ ID NO: 463016 - DNA, 25 bp, Mus musculus
gactgggatccacaactttatagac

SEQ ID NO: 463017 - DNA, 25 bp, Mus musculus
gactgggatccagaactttatagac

SEQ ID NO: 463018 - DNA, 25 bp, Mus musculus
gactgggatgggatactggtttaat

SEQ ID NO: 463019 - DNA, 25 bp, Mus musculus
gactgggatgggttactggtttaat

SEQ ID NO: 463020 - DNA, 25 bp, Mus musculus
gactgggcaaaaatcaggtttccat

SEQ ID NO: 463021 - DNA, 25 bp, Mus musculus
gactgggcaaaattcaggtttccat

SEQ ID NO: 463022 - DNA, 25 bp, Mus musculus
gactgggcaagcatttttcaaacta

SEQ ID NO: 463023 - DNA, 25 bp, Mus musculus
gactgggcaagcttttttcaaacta

SEQ ID NO: 463024 - DNA, 25 bp, Mus musculus
gactgggcagagcaggcactcattt

SEQ ID NO: 463025 - DNA, 25 bp, Mus musculus
gactgggcagaggaggcactcattt

SEQ ID NO: 463026 - DNA, 25 bp, Mus musculus
gactgggcagttctagcaccatctg

SEQ ID NO: 463027 - DNA, 25 bp, Mus musculus
gactgggcagttgtagcaccatctg

SEQ ID NO: 463028 - DNA, 25 bp, Mus musculus
gactgggccagtagacacttccgga

SEQ ID NO: 463029 - DNA, 25 bp, Mus musculus
gactgggccagttgacacttccgga

SEQ ID NO: 463030 - DNA, 25 bp, Mus musculus
gactgggcctagagatgcatgcctt

SEQ ID NO: 463031 - DNA, 25 bp, Mus musculus
gactgggcctagtgatgcatgcctt

SEQ ID NO: 463032 - DNA, 25 bp, Mus musculus
gactgggctatcagtatcttgcctc

SEQ ID NO: 463033 - DNA, 25 bp, Mus musculus
gactgggctatcatgcttgacctat

SEQ ID NO: 463034 - DNA, 25 bp, Mus musculus
gactgggctatctgtatcttgcctc

SEQ ID NO: 463035 - DNA, 25 bp, Mus musculus
gactgggctatcttgcttgacctat

SEQ ID NO: 463036 - DNA, 25 bp, Mus musculus
gactgggctccaaactacacatggg

SEQ ID NO: 463037 - DNA, 25 bp, Mus musculus
gactgggctccatactacacatggg

SEQ ID NO: 463038 - DNA, 25 bp, Mus musculus
gactgggctgaacctgtacaatggt

SEQ ID NO: 463039 - DNA, 25 bp, Mus musculus
gactgggctgaagctgtacaatggt

SEQ ID NO: 463040 - DNA, 25 bp, Mus musculus
gactgggcttctaaagagtgcttga

SEQ ID NO: 463041 - DNA, 25 bp, Mus musculus
gactgggcttcttaagagtgcttga

SEQ ID NO: 463042 - DNA, 25 bp, Mus musculus
gactgggcttgtatgaaccaaccaa

SEQ ID NO: 463043 - DNA, 25 bp, Mus musculus
gactgggcttgtttgaaccaaccaa

SEQ ID NO: 463044 - DNA, 25 bp, Mus musculus
gactgggtagacaacactgagaata

SEQ ID NO: 463045 - DNA, 25 bp, Mus musculus
gactgggtagactacactgagaata

SEQ ID NO: 463046 - DNA, 25 bp, Mus musculus
gactgggtattcatacagggttatt

SEQ ID NO: 463047 - DNA, 25 bp, Mus musculus
gactgggtattcttacagggttatt

SEQ ID NO: 463048 - DNA, 25 bp, Mus musculus
gactgggtcaccaatgagctgaatc

SEQ ID NO: 463049 - DNA, 25 bp, Mus musculus
gactgggtcacctatgagctgaatc

SEQ ID NO: 463050 - DNA, 25 bp, Mus musculus
gactgggtccagaaaaaccagtgac

SEQ ID NO: 463051 - DNA, 25 bp, Mus musculus
gactgggtccagtaaaaccagtgac

SEQ ID NO: 463052 - DNA, 25 bp, Mus musculus
gactgggtcctcatgccctgatgtc

SEQ ID NO: 463053 - DNA, 25 bp, Mus musculus
gactgggtcctcttgccctgatgtc

SEQ ID NO: 463054 - DNA, 25 bp, Mus musculus
gactgggtccttattgtgacatctt

SEQ ID NO: 463055 - DNA, 25 bp, Mus musculus
gactgggtcctttttgtgacatctt

SEQ ID NO: 463056 - DNA, 25 bp, Mus musculus
gactgggtctgaagtttcttacaat

SEQ ID NO: 463057 - DNA, 25 bp, Mus musculus
gactgggtctgatgtttcttacaat

SEQ ID NO: 463058 - DNA, 25 bp, Mus musculus
gactgggtggtcaagtcctgtgtcc

SEQ ID NO: 463059 - DNA, 25 bp, Mus musculus
gactgggtggtctagtcctgtgtcc

SEQ ID NO: 463060 - DNA, 25 bp, Mus musculus
gactgggtgtgaccgaacacactca

SEQ ID NO: 463061 - DNA, 25 bp, Mus musculus
gactgggtgtgagcgaacacactca

SEQ ID NO: 463062 - DNA, 25 bp, Mus musculus
gactgggttactagcactattaaga

SEQ ID NO: 463063 - DNA, 25 bp, Mus musculus
gactgggttactcagtggtctgaaa

SEQ ID NO: 463064 - DNA, 25 bp, Mus musculus
gactgggttactgagtggtctgaaa

SEQ ID NO: 463065 - DNA, 25 bp, Mus musculus
gactgggttacttgcactattaaga

SEQ ID NO: 463066 - DNA, 25 bp, Mus musculus
gactgggttgaaatgagctcctgac

SEQ ID NO: 463067 - DNA, 25 bp, Mus musculus
gactgggttgaattgagctcctgac

SEQ ID NO: 463068 - DNA, 25 bp, Mus musculus
gactgggttgtccttagcatgctca

SEQ ID NO: 463069 - DNA, 25 bp, Mus musculus
gactgggttgtcgttagcatgctca

SEQ ID NO: 463070 - DNA, 25 bp, Mus musculus
gactgggtttggacactgctagcct

SEQ ID NO: 463071 - DNA, 25 bp, Mus musculus
gactgggtttggtcactgctagcct

SEQ ID NO: 463072 - DNA, 25 bp, Mus musculus
gactggtaaccaatctctgtccata

SEQ ID NO: 463073 - DNA, 25 bp, Mus musculus
gactggtaaccattctctgtccata

SEQ ID NO: 463074 - DNA, 25 bp, Mus musculus
gactggtaagccctacttgtactat

SEQ ID NO: 463075 - DNA, 25 bp, Mus musculus
gactggtaagccgtacttgtactat

SEQ ID NO: 463076 - DNA, 25 bp, Mus musculus
gactggtacagtaccgtgatgctgc

SEQ ID NO: 463077 - DNA, 25 bp, Mus musculus
gactggtacagttccgtgatgctgc

SEQ ID NO: 463078 - DNA, 25 bp, Mus musculus
gactggtacatcaagacttctcatg

SEQ ID NO: 463079 - DNA, 25 bp, Mus musculus
gactggtacatctagacttctcatg

SEQ ID NO: 463080 - DNA, 25 bp, Mus musculus
gactggtactatacaaagcatcctt

SEQ ID NO: 463081 - DNA, 25 bp, Mus musculus
gactggtactattcaaagcatcctt

SEQ ID NO: 463082 - DNA, 25 bp, Mus musculus
gactggtagcttcaacttggaccct

SEQ ID NO: 463083 - DNA, 25 bp, Mus musculus
gactggtagcttgaacttggaccct

SEQ ID NO: 463084 - DNA, 25 bp, Mus musculus
gactggtaggctcacaggactgata

SEQ ID NO: 463085 - DNA, 25 bp, Mus musculus
gactggtaggctgacaggactgata

SEQ ID NO: 463086 - DNA, 25 bp, Mus musculus
gactggtatgacagctagcccacca

SEQ ID NO: 463087 - DNA, 25 bp, Mus musculus
gactggtatgactgctagcccacca

SEQ ID NO: 463088 - DNA, 25 bp, Mus musculus
gactggtatgtgagacttcctggta

SEQ ID NO: 463089 - DNA, 25 bp, Mus musculus
gactggtatgtgagtttagttcttc

SEQ ID NO: 463090 - DNA, 25 bp, Mus musculus
gactggtatgtgtgacttcctggta

SEQ ID NO: 463091 - DNA, 25 bp, Mus musculus
gactggtatgtgtgtttagttcttc

SEQ ID NO: 463092 - DNA, 25 bp, Mus musculus
gactggtattaacaagggccctcca

SEQ ID NO: 463093 - DNA, 25 bp, Mus musculus
gactggtattaagaagggccctcca

SEQ ID NO: 463094 - DNA, 25 bp, Mus musculus
gactggtatttgatctatcttggct

SEQ ID NO: 463095 - DNA, 25 bp, Mus musculus
gactggtatttgttctatcttggct

SEQ ID NO: 463096 - DNA, 25 bp, Mus musculus
gactggtcaccacggtcacttaatg

SEQ ID NO: 463097 - DNA, 25 bp, Mus musculus
gactggtcaccacttgtagcaagac

SEQ ID NO: 463098 - DNA, 25 bp, Mus musculus
gactggtcaccagggtcacttaatg

SEQ ID NO: 463099 - DNA, 25 bp, Mus musculus
gactggtcaccagttgtagcaagac

SEQ ID NO: 463100 - DNA, 25 bp, Mus musculus
gactggtcagacaaagctttttaag

SEQ ID NO: 463101 - DNA, 25 bp, Mus musculus
gactggtcagactaagctttttaag

SEQ ID NO: 463102 - DNA, 25 bp, Mus musculus
gactggtcagccactcaaatcgtgg

SEQ ID NO: 463103 - DNA, 25 bp, Mus musculus
gactggtcagcctctcaaatcgtgg

SEQ ID NO: 463104 - DNA, 25 bp, Mus musculus
gactggtcagtacttcacactgcac

SEQ ID NO: 463105 - DNA, 25 bp, Mus musculus
gactggtcagtagttcacactgcac

SEQ ID NO: 463106 - DNA, 25 bp, Mus musculus
gactggtcatgtagatgttgctagc

SEQ ID NO: 463107 - DNA, 25 bp, Mus musculus
gactggtcatgttgatgttgctagc

SEQ ID NO: 463108 - DNA, 25 bp, Mus musculus
gactggtcccatatgcgtgatatca

SEQ ID NO: 463109 - DNA, 25 bp, Mus musculus
gactggtcccatttgcgtgatatca

SEQ ID NO: 463110 - DNA, 25 bp, Mus musculus
gactggtcggtaacatctaggtgtt

SEQ ID NO: 463111 - DNA, 25 bp, Mus musculus
gactggtcggtatcatctaggtgtt

SEQ ID NO: 463112 - DNA, 25 bp, Mus musculus
gactggtctccgaatttgtgatgca

SEQ ID NO: 463113 - DNA, 25 bp, Mus musculus
gactggtctccgtatttgtgatgca

SEQ ID NO: 463114 - DNA, 25 bp, Mus musculus
gactggtctcttatctcttaaagct

SEQ ID NO: 463115 - DNA, 25 bp, Mus musculus
gactggtctcttttctcttaaagct

SEQ ID NO: 463116 - DNA, 25 bp, Mus musculus
gactggtctggcaataaatcttttt

SEQ ID NO: 463117 - DNA, 25 bp, Mus musculus
gactggtctggcattatttgacact

SEQ ID NO: 463118 - DNA, 25 bp, Mus musculus
gactggtctggctataaatcttttt

SEQ ID NO: 463119 - DNA, 25 bp, Mus musculus
gactggtctggctttatttgacact

SEQ ID NO: 463120 - DNA, 25 bp, Mus musculus
gactggtctgtaattctttatgttg

SEQ ID NO: 463121 - DNA, 25 bp, Mus musculus
gactggtctgtatttctttatgttg

SEQ ID NO: 463122 - DNA, 25 bp, Mus musculus
gactggtcttaaatgctctagaatt

SEQ ID NO: 463123 - DNA, 25 bp, Mus musculus
gactggtcttaattgctctagaatt

SEQ ID NO: 463124 - DNA, 25 bp, Mus musculus
gactggtcttggcacactggtctag

SEQ ID NO: 463125 - DNA, 25 bp, Mus musculus
gactggtcttgggacactggtctag

SEQ ID NO: 463126 - DNA, 25 bp, Mus musculus
gactggtgagccaagttggaactct

SEQ ID NO: 463127 - DNA, 25 bp, Mus musculus
gactggtgagccactgtttttcagg

SEQ ID NO: 463128 - DNA, 25 bp, Mus musculus
gactggtgagcctagttggaactct

SEQ ID NO: 463129 - DNA, 25 bp, Mus musculus
gactggtgagcctctgtttttcagg

SEQ ID NO: 463130 - DNA, 25 bp, Mus musculus
gactggtgccacctagctgaataat

SEQ ID NO: 463131 - DNA, 25 bp, Mus musculus
gactggtgccacgtagctgaataat

SEQ ID NO: 463132 - DNA, 25 bp, Mus musculus
gactggtgcgttagcattgtctgca

SEQ ID NO: 463133 - DNA, 25 bp, Mus musculus
gactggtgcgtttgcattgtctgca

SEQ ID NO: 463134 - DNA, 25 bp, Mus musculus
gactggtgctaaacttttataatca

SEQ ID NO: 463135 - DNA, 25 bp, Mus musculus
gactggtgctaatcttttataatca

SEQ ID NO: 463136 - DNA, 25 bp, Mus musculus
gactggtgctcgaataagttcattc

SEQ ID NO: 463137 - DNA, 25 bp, Mus musculus
gactggtgctcgtataagttcattc

SEQ ID NO: 463138 - DNA, 25 bp, Mus musculus
gactggtggaccctagctaagaaca

SEQ ID NO: 463139 - DNA, 25 bp, Mus musculus
gactggtggaccgtagctaagaaca

SEQ ID NO: 463140 - DNA, 25 bp, Mus musculus
gactggtggagcagccccagcttcg

SEQ ID NO: 463141 - DNA, 25 bp, Mus musculus
gactggtggagctgccccagcttcg

SEQ ID NO: 463142 - DNA, 25 bp, Mus musculus
gactggtggtttatgcattactgac

SEQ ID NO: 463143 - DNA, 25 bp, Mus musculus
gactggtggtttttgcattactgac

SEQ ID NO: 463144 - DNA, 25 bp, Mus musculus
gactggtgtcggaatccatttggtg

SEQ ID NO: 463145 - DNA, 25 bp, Mus musculus
gactggtgtcggtatccatttggtg

SEQ ID NO: 463146 - DNA, 25 bp, Mus musculus
gactggtgtggaacaatggccatat

SEQ ID NO: 463147 - DNA, 25 bp, Mus musculus
gactggtgtggatcaatggccatat

SEQ ID NO: 463148 - DNA, 25 bp, Mus musculus
gactggtgtggtaatcctctctgag

SEQ ID NO: 463149 - DNA, 25 bp, Mus musculus
gactggtgtggttatcctctctgag

SEQ ID NO: 463150 - DNA, 25 bp, Mus musculus
gactggtgttaaaactttctgactt

SEQ ID NO: 463151 - DNA, 25 bp, Mus musculus
gactggtgttaatactttctgactt

SEQ ID NO: 463152 - DNA, 25 bp, Mus musculus
gactggttattgcatgtttatgcta

SEQ ID NO: 463153 - DNA, 25 bp, Mus musculus
gactggttattggatgtttatgcta

SEQ ID NO: 463154 - DNA, 25 bp, Mus musculus
gactggttccgactgttctgaacga

SEQ ID NO: 463155 - DNA, 25 bp, Mus musculus
gactggttccgagtgttctgaacga

SEQ ID NO: 463156 - DNA, 25 bp, Mus musculus
gactggttccggcttattcatgaga

SEQ ID NO: 463157 - DNA, 25 bp, Mus musculus
gactggttccgggttattcatgaga

SEQ ID NO: 463158 - DNA, 25 bp, Mus musculus
gactggttctctaggatgctcttgc

SEQ ID NO: 463159 - DNA, 25 bp, Mus musculus
gactggttctcttggatgctcttgc

SEQ ID NO: 463160 - DNA, 25 bp, Mus musculus
gactggttctgcatctgagagccaa

SEQ ID NO: 463161 - DNA, 25 bp, Mus musculus
gactggttctgcttctgagagccaa

SEQ ID NO: 463162 - DNA, 25 bp, Mus musculus
gactggttctttagctggcttgctc

SEQ ID NO: 463163 - DNA, 25 bp, Mus musculus
gactggttcttttgctggcttgctc

SEQ ID NO: 463164 - DNA, 25 bp, Mus musculus
gactggttgatgagatccttcacgt

SEQ ID NO: 463165 - DNA, 25 bp, Mus musculus
gactggttgatgtgatccttcacgt

SEQ ID NO: 463166 - DNA, 25 bp, Mus musculus
gactggttgggaaagagacctcaat

SEQ ID NO: 463167 - DNA, 25 bp, Mus musculus
gactggttgggatagagacctcaat

SEQ ID NO: 463168 - DNA, 25 bp, Mus musculus
gactggttgtgtaatttctgccctt

SEQ ID NO: 463169 - DNA, 25 bp, Mus musculus
gactggttgtgttatttctgccctt

SEQ ID NO: 463170 - DNA, 25 bp, Mus musculus
gactggtttcagcaaatcaagaagt

SEQ ID NO: 463171 - DNA, 25 bp, Mus musculus
gactggtttcaggaaatcaagaagt

SEQ ID NO: 463172 - DNA, 25 bp, Mus musculus
gactggtttccaatgtgagggaccc

SEQ ID NO: 463173 - DNA, 25 bp, Mus musculus
gactggtttccactgaccaagaggt

SEQ ID NO: 463174 - DNA, 25 bp, Mus musculus
gactggtttccagtgaccaagaggt

SEQ ID NO: 463175 - DNA, 25 bp, Mus musculus
gactggtttccattgtgagggaccc

SEQ ID NO: 463176 - DNA, 25 bp, Mus musculus
gactggtttcctcggatgcgagcca

SEQ ID NO: 463177 - DNA, 25 bp, Mus musculus
gactggtttcctgggatgcgagcca

SEQ ID NO: 463178 - DNA, 25 bp, Mus musculus
gactggtttgagcatctccctgaat

SEQ ID NO: 463179 - DNA, 25 bp, Mus musculus
gactggtttgaggatctccctgaat

SEQ ID NO: 463180 - DNA, 25 bp, Mus musculus
gactggtttgctcagtatgtgctta

SEQ ID NO: 463181 - DNA, 25 bp, Mus musculus
gactggtttgctgagtatgtgctta

SEQ ID NO: 463182 - DNA, 25 bp, Mus musculus
gactggtttgttactatgttgaggg

SEQ ID NO: 463183 - DNA, 25 bp, Mus musculus
gactggtttgtttctatgttgaggg

SEQ ID NO: 463184 - DNA, 25 bp, Mus musculus
gactgtaacctgcttactgatggta

SEQ ID NO: 463185 - DNA, 25 bp, Mus musculus
gactgtaacctggttactgatggta

SEQ ID NO: 463186 - DNA, 25 bp, Mus musculus
gactgtaactataaccacctggata

SEQ ID NO: 463187 - DNA, 25 bp, Mus musculus
gactgtaactattaccacctggata

SEQ ID NO: 463188 - DNA, 25 bp, Mus musculus
gactgtaactccaacaatacctgag

SEQ ID NO: 463189 - DNA, 25 bp, Mus musculus
gactgtaactcctacaatacctgag

SEQ ID NO: 463190 - DNA, 25 bp, Mus musculus
gactgtaactctaaggagcccaaca

SEQ ID NO: 463191 - DNA, 25 bp, Mus musculus
gactgtaactcttaggagcccaaca

SEQ ID NO: 463192 - DNA, 25 bp, Mus musculus
gactgtaactgccaggcagcgctta

SEQ ID NO: 463193 - DNA, 25 bp, Mus musculus
gactgtaactgcgaggcagcgctta

SEQ ID NO: 463194 - DNA, 25 bp, Mus musculus
gactgtaagacacctctcctatgga

SEQ ID NO: 463195 - DNA, 25 bp, Mus musculus
gactgtaagacagctctcctatgga

SEQ ID NO: 463196 - DNA, 25 bp, Mus musculus
gactgtaagactattcatctgggac

SEQ ID NO: 463197 - DNA, 25 bp, Mus musculus
gactgtaagacttttcatctgggac

SEQ ID NO: 463198 - DNA, 25 bp, Mus musculus
gactgtaagcatctgtgtcctttcc

SEQ ID NO: 463199 - DNA, 25 bp, Mus musculus
gactgtaagcatgtgtgtcctttcc

SEQ ID NO: 463200 - DNA, 25 bp, Mus musculus
gactgtaaggaccatattccaaaga

SEQ ID NO: 463201 - DNA, 25 bp, Mus musculus
gactgtaaggacgatattccaaaga

SEQ ID NO: 463202 - DNA, 25 bp, Mus musculus
gactgtaaggctacattgcactata

SEQ ID NO: 463203 - DNA, 25 bp, Mus musculus
gactgtaaggcttcattgcactata

SEQ ID NO: 463204 - DNA, 25 bp, Mus musculus
gactgtaagttcaggataactacat

SEQ ID NO: 463205 - DNA, 25 bp, Mus musculus
gactgtaagttctggataactacat

SEQ ID NO: 463206 - DNA, 25 bp, Mus musculus
gactgtaatatgcagcttgggctac

SEQ ID NO: 463207 - DNA, 25 bp, Mus musculus
gactgtaatatggagcttgggctac

SEQ ID NO: 463208 - DNA, 25 bp, Mus musculus
gactgtaatcaaaacttgcagatga

SEQ ID NO: 463209 - DNA, 25 bp, Mus musculus
gactgtaatcaatacttgcagatga

SEQ ID NO: 463210 - DNA, 25 bp, Mus musculus
gactgtaatcatctgcacacccaat

SEQ ID NO: 463211 - DNA, 25 bp, Mus musculus
gactgtaatcatgtgcacacccaat

SEQ ID NO: 463212 - DNA, 25 bp, Mus musculus
gactgtaatgcaaatgtattgtaac

SEQ ID NO: 463213 - DNA, 25 bp, Mus musculus
gactgtaatgcatatgtattgtaac

SEQ ID NO: 463214 - DNA, 25 bp, Mus musculus
gactgtaatgtacagctgcttcctg

SEQ ID NO: 463215 - DNA, 25 bp, Mus musculus
gactgtaatgtagagctgcttcctg

SEQ ID NO: 463216 - DNA, 25 bp, Mus musculus
gactgtaatgtcatcctgggctctg

SEQ ID NO: 463217 - DNA, 25 bp, Mus musculus
gactgtaatgtccaacctaggctga

SEQ ID NO: 463218 - DNA, 25 bp, Mus musculus
gactgtaatgtcgaacctaggctga

SEQ ID NO: 463219 - DNA, 25 bp, Mus musculus
gactgtaatgtcttcctgggctctg

SEQ ID NO: 463220 - DNA, 25 bp, Mus musculus
gactgtaatgtgatcactgcctttg

SEQ ID NO: 463221 - DNA, 25 bp, Mus musculus
gactgtaatgtgttcactgcctttg

SEQ ID NO: 463222 - DNA, 25 bp, Mus musculus
gactgtacacagactctatggtgtt

SEQ ID NO: 463223 - DNA, 25 bp, Mus musculus
gactgtacacagtctctatggtgtt

SEQ ID NO: 463224 - DNA, 25 bp, Mus musculus
gactgtacacatagctgcagcatta

SEQ ID NO: 463225 - DNA, 25 bp, Mus musculus
gactgtacacattgctgcagcatta

SEQ ID NO: 463226 - DNA, 25 bp, Mus musculus
gactgtacacctcgcaggaaatgcc

SEQ ID NO: 463227 - DNA, 25 bp, Mus musculus
gactgtacacctggcaggaaatgcc

SEQ ID NO: 463228 - DNA, 25 bp, Mus musculus
gactgtaccaatctcaatgatttct

SEQ ID NO: 463229 - DNA, 25 bp, Mus musculus
gactgtaccaatgtcaatgatttct

SEQ ID NO: 463230 - DNA, 25 bp, Mus musculus
gactgtacccttatactgtgagcca

SEQ ID NO: 463231 - DNA, 25 bp, Mus musculus
gactgtacccttttactgtgagcca

SEQ ID NO: 463232 - DNA, 25 bp, Mus musculus
gactgtacctaaagtggtcctttct

SEQ ID NO: 463233 - DNA, 25 bp, Mus musculus
gactgtacctaatgtggtcctttct

SEQ ID NO: 463234 - DNA, 25 bp, Mus musculus
gactgtacctgtaagattggccggc

SEQ ID NO: 463235 - DNA, 25 bp, Mus musculus
gactgtacctgttagattggccggc

SEQ ID NO: 463236 - DNA, 25 bp, Mus musculus
gactgtaccttacactacttacttt

SEQ ID NO: 463237 - DNA, 25 bp, Mus musculus
gactgtaccttagactacttacttt

SEQ ID NO: 463238 - DNA, 25 bp, Mus musculus
gactgtactaatcactcccataact

SEQ ID NO: 463239 - DNA, 25 bp, Mus musculus
gactgtactaatgactcccataact

SEQ ID NO: 463240 - DNA, 25 bp, Mus musculus
gactgtactctcctatctatcttga

SEQ ID NO: 463241 - DNA, 25 bp, Mus musculus
gactgtactctcgtatctatcttga

SEQ ID NO: 463242 - DNA, 25 bp, Mus musculus
gactgtactgaaactggatctgttc

SEQ ID NO: 463243 - DNA, 25 bp, Mus musculus
gactgtactgaaagctgttggatct

SEQ ID NO: 463244 - DNA, 25 bp, Mus musculus
gactgtactgaatctggatctgttc

SEQ ID NO: 463245 - DNA, 25 bp, Mus musculus
gactgtactgaatgctgttggatct

SEQ ID NO: 463246 - DNA, 25 bp, Mus musculus
gactgtactggacgttttcctgcat

SEQ ID NO: 463247 - DNA, 25 bp, Mus musculus
gactgtactggaggttttcctgcat

SEQ ID NO: 463248 - DNA, 25 bp, Mus musculus
gactgtactgtaacagaatatcaag

SEQ ID NO: 463249 - DNA, 25 bp, Mus musculus
gactgtactgtatcagaatatcaag

SEQ ID NO: 463250 - DNA, 25 bp, Mus musculus
gactgtactgttctcatgctataaa

SEQ ID NO: 463251 - DNA, 25 bp, Mus musculus
gactgtactgttgtcatgctataaa

SEQ ID NO: 463252 - DNA, 25 bp, Mus musculus
gactgtacttgaattcttggtatta

SEQ ID NO: 463253 - DNA, 25 bp, Mus musculus
gactgtacttgatttcttggtatta

SEQ ID NO: 463254 - DNA, 25 bp, Mus musculus
gactgtacttgcatccatgaagccc

SEQ ID NO: 463255 - DNA, 25 bp, Mus musculus
gactgtacttgcttccatgaagccc

SEQ ID NO: 463256 - DNA, 25 bp, Mus musculus
gactgtagacccactatatggaact

SEQ ID NO: 463257 - DNA, 25 bp, Mus musculus
gactgtagaccctctatatggaact

SEQ ID NO: 463258 - DNA, 25 bp, Mus musculus
gactgtagacctcctcagaaagcta

SEQ ID NO: 463259 - DNA, 25 bp, Mus musculus
gactgtagacctgctcagaaagcta

SEQ ID NO: 463260 - DNA, 25 bp, Mus musculus
gactgtagagaccaccaaattctta

SEQ ID NO: 463261 - DNA, 25 bp, Mus musculus
gactgtagagacgaccaaattctta

SEQ ID NO: 463262 - DNA, 25 bp, Mus musculus
gactgtagattgcttctgtagtgct

SEQ ID NO: 463263 - DNA, 25 bp, Mus musculus
gactgtagattggttctgtagtgct

SEQ ID NO: 463264 - DNA, 25 bp, Mus musculus
gactgtagcagaattttcttcttct

SEQ ID NO: 463265 - DNA, 25 bp, Mus musculus
gactgtagcagatttttcttcttct

SEQ ID NO: 463266 - DNA, 25 bp, Mus musculus
gactgtagccatctaacttgcatac

SEQ ID NO: 463267 - DNA, 25 bp, Mus musculus
gactgtagccatgtaacttgcatac

SEQ ID NO: 463268 - DNA, 25 bp, Mus musculus
gactgtagccgaaccaaggagcctg

SEQ ID NO: 463269 - DNA, 25 bp, Mus musculus
gactgtagccgatccaaggagcctg

SEQ ID NO: 463270 - DNA, 25 bp, Mus musculus
gactgtagctctctggactgcatca

SEQ ID NO: 463271 - DNA, 25 bp, Mus musculus
gactgtagctctgtggactgcatca

SEQ ID NO: 463272 - DNA, 25 bp, Mus musculus
gactgtagcttgagtaaactgatat

SEQ ID NO: 463273 - DNA, 25 bp, Mus musculus
gactgtagcttgctaacactgcaaa

SEQ ID NO: 463274 - DNA, 25 bp, Mus musculus
gactgtagcttggtaacactgcaaa

SEQ ID NO: 463275 - DNA, 25 bp, Mus musculus
gactgtagcttgtgtaaactgatat

SEQ ID NO: 463276 - DNA, 25 bp, Mus musculus
gactgtaggaagctctgaggtcaaa

SEQ ID NO: 463277 - DNA, 25 bp, Mus musculus
gactgtaggaaggtctgaggtcaaa

SEQ ID NO: 463278 - DNA, 25 bp, Mus musculus
gactgtaggacccttacttgttttg

SEQ ID NO: 463279 - DNA, 25 bp, Mus musculus
gactgtaggaccgttacttgttttg

SEQ ID NO: 463280 - DNA, 25 bp, Mus musculus
gactgtaggcttctgaagagagatt

SEQ ID NO: 463281 - DNA, 25 bp, Mus musculus
gactgtaggcttgtgaagagagatt

SEQ ID NO: 463282 - DNA, 25 bp, Mus musculus
gactgtagtagtaggtttaccctgc

SEQ ID NO: 463283 - DNA, 25 bp, Mus musculus
gactgtagtagttggtttaccctgc

SEQ ID NO: 463284 - DNA, 25 bp, Mus musculus
gactgtagtcagctttttcatgtgc

SEQ ID NO: 463285 - DNA, 25 bp, Mus musculus
gactgtagtcaggtttttcatgtgc

SEQ ID NO: 463286 - DNA, 25 bp, Mus musculus
gactgtataggcatctttattgcaa

SEQ ID NO: 463287 - DNA, 25 bp, Mus musculus
gactgtataggcttctttattgcaa

SEQ ID NO: 463288 - DNA, 25 bp, Mus musculus
gactgtatattacttctcttttcat

SEQ ID NO: 463289 - DNA, 25 bp, Mus musculus
gactgtatattagttctcttttcat

SEQ ID NO: 463290 - DNA, 25 bp, Mus musculus
gactgtatcaagctggaatgctagg

SEQ ID NO: 463291 - DNA, 25 bp, Mus musculus
gactgtatcaaggtggaatgctagg

SEQ ID NO: 463292 - DNA, 25 bp, Mus musculus
gactgtatcactagttctacctttt

SEQ ID NO: 463293 - DNA, 25 bp, Mus musculus
gactgtatcacttgttctacctttt

SEQ ID NO: 463294 - DNA, 25 bp, Mus musculus
gactgtatcagtcacctatggatat

SEQ ID NO: 463295 - DNA, 25 bp, Mus musculus
gactgtatcagtgacctatggatat

SEQ ID NO: 463296 - DNA, 25 bp, Mus musculus
gactgtatcatcattcaacccattc

SEQ ID NO: 463297 - DNA, 25 bp, Mus musculus
gactgtatcatctttcaacccattc

SEQ ID NO: 463298 - DNA, 25 bp, Mus musculus
gactgtatcatgacagggtacttcc

SEQ ID NO: 463299 - DNA, 25 bp, Mus musculus
gactgtatcatgatgctgcactcgg

SEQ ID NO: 463300 - DNA, 25 bp, Mus musculus
gactgtatcatgctcatctgtgtta

SEQ ID NO: 463301 - DNA, 25 bp, Mus musculus
gactgtatcatggtcatctgtgtta

SEQ ID NO: 463302 - DNA, 25 bp, Mus musculus
gactgtatcatgtcagggtacttcc

SEQ ID NO: 463303 - DNA, 25 bp, Mus musculus
gactgtatcatgttgctgcactcgg

SEQ ID NO: 463304 - DNA, 25 bp, Mus musculus
gactgtatcctgaaatatgcaacgg

SEQ ID NO: 463305 - DNA, 25 bp, Mus musculus
gactgtatcctgtaatatgcaacgg

SEQ ID NO: 463306 - DNA, 25 bp, Mus musculus
gactgtatcgaaataatttgccaaa

SEQ ID NO: 463307 - DNA, 25 bp, Mus musculus
gactgtatcgaattaatttgccaaa

SEQ ID NO: 463308 - DNA, 25 bp, Mus musculus
gactgtatcgacctttgccaggagc

SEQ ID NO: 463309 - DNA, 25 bp, Mus musculus
gactgtatcgacgtttgccaggagc

SEQ ID NO: 463310 - DNA, 25 bp, Mus musculus
gactgtatctctcaagggtccagcc

SEQ ID NO: 463311 - DNA, 25 bp, Mus musculus
gactgtatctctgaagggtccagcc

SEQ ID NO: 463312 - DNA, 25 bp, Mus musculus
gactgtatctgcagctcaagaccac

SEQ ID NO: 463313 - DNA, 25 bp, Mus musculus
gactgtatctgctgctcaagaccac

SEQ ID NO: 463314 - DNA, 25 bp, Mus musculus
gactgtatcttacttttcctgacaa

SEQ ID NO: 463315 - DNA, 25 bp, Mus musculus
gactgtatcttagttttcctgacaa

SEQ ID NO: 463316 - DNA, 25 bp, Mus musculus
gactgtatctttccaagacatccag

SEQ ID NO: 463317 - DNA, 25 bp, Mus musculus
gactgtatctttgcaagacatccag

SEQ ID NO: 463318 - DNA, 25 bp, Mus musculus
gactgtatgccacttcagagcaata

SEQ ID NO: 463319 - DNA, 25 bp, Mus musculus
gactgtatgccagttcagagcaata

SEQ ID NO: 463320 - DNA, 25 bp, Mus musculus
gactgtatgcctcgcggtcaaagtg

SEQ ID NO: 463321 - DNA, 25 bp, Mus musculus
gactgtatgcctggcggtcaaagtg

SEQ ID NO: 463322 - DNA, 25 bp, Mus musculus
gactgtatggtccagtggtctacct

SEQ ID NO: 463323 - DNA, 25 bp, Mus musculus
gactgtatggtcgagtggtctacct

SEQ ID NO: 463324 - DNA, 25 bp, Mus musculus
gactgtattaagagcgcttgaatgg

SEQ ID NO: 463325 - DNA, 25 bp, Mus musculus
gactgtattaagtgcgcttgaatgg

SEQ ID NO: 463326 - DNA, 25 bp, Mus musculus
gactgtattataagtgcccaagcac

SEQ ID NO: 463327 - DNA, 25 bp, Mus musculus
gactgtattatatgtgcccaagcac

SEQ ID NO: 463328 - DNA, 25 bp, Mus musculus
gactgtattcaacccatttcacatg

SEQ ID NO: 463329 - DNA, 25 bp, Mus musculus
gactgtattcaagccatttcacatg

SEQ ID NO: 463330 - DNA, 25 bp, Mus musculus
gactgtattcgcattgattgtttct

SEQ ID NO: 463331 - DNA, 25 bp, Mus musculus
gactgtattcgctttgattgtttct

SEQ ID NO: 463332 - DNA, 25 bp, Mus musculus
gactgtatttagatctcatgctttt

SEQ ID NO: 463333 - DNA, 25 bp, Mus musculus
gactgtatttagttctcatgctttt

SEQ ID NO: 463334 - DNA, 25 bp, Mus musculus
gactgtatttatctggtggattcct

SEQ ID NO: 463335 - DNA, 25 bp, Mus musculus
gactgtatttatgtggtggattcct

SEQ ID NO: 463336 - DNA, 25 bp, Mus musculus
gactgtattttaagtttgtgctttc

SEQ ID NO: 463337 - DNA, 25 bp, Mus musculus
gactgtattttatgtttgtgctttc

SEQ ID NO: 463338 - DNA, 25 bp, Mus musculus
gactgtcaactacgtggccatggag

SEQ ID NO: 463339 - DNA, 25 bp, Mus musculus
gactgtcaactaggtggccatggag

SEQ ID NO: 463340 - DNA, 25 bp, Mus musculus
gactgtcaacttaatgggtgcctta

SEQ ID NO: 463341 - DNA, 25 bp, Mus musculus
gactgtcaactttatgggtgcctta

SEQ ID NO: 463342 - DNA, 25 bp, Mus musculus
gactgtcaagaaaagcctttccgct

SEQ ID NO: 463343 - DNA, 25 bp, Mus musculus
gactgtcaagaatagcctttccgct

SEQ ID NO: 463344 - DNA, 25 bp, Mus musculus
gactgtcaagatagtatcacactag

SEQ ID NO: 463345 - DNA, 25 bp, Mus musculus
gactgtcaagattgtatcacactag

SEQ ID NO: 463346 - DNA, 25 bp, Mus musculus
gactgtcaagtcagcccaatttggg

SEQ ID NO: 463347 - DNA, 25 bp, Mus musculus
gactgtcaagtctgcccaatttggg

SEQ ID NO: 463348 - DNA, 25 bp, Mus musculus
gactgtcaatatacactggcatcat

SEQ ID NO: 463349 - DNA, 25 bp, Mus musculus
gactgtcaatattcactggcatcat

SEQ ID NO: 463350 - DNA, 25 bp, Mus musculus
gactgtcaatggaatgcatgcaccg

SEQ ID NO: 463351 - DNA, 25 bp, Mus musculus
gactgtcaatggtatgcatgcaccg

SEQ ID NO: 463352 - DNA, 25 bp, Mus musculus
gactgtcaattaatctggcgtttat

SEQ ID NO: 463353 - DNA, 25 bp, Mus musculus
gactgtcaattattctggcgtttat

SEQ ID NO: 463354 - DNA, 25 bp, Mus musculus
gactgtcacaatatccatggagcct

SEQ ID NO: 463355 - DNA, 25 bp, Mus musculus
gactgtcacaatttccatggagcct

SEQ ID NO: 463356 - DNA, 25 bp, Mus musculus
gactgtcaccctacttgtattagat

SEQ ID NO: 463357 - DNA, 25 bp, Mus musculus
gactgtcacccttcttgtattagat

SEQ ID NO: 463358 - DNA, 25 bp, Mus musculus
gactgtcactacagtatacaccaca

SEQ ID NO: 463359 - DNA, 25 bp, Mus musculus
gactgtcactactgtatacaccaca

SEQ ID NO: 463360 - DNA, 25 bp, Mus musculus
gactgtcactggcagcccctggaca

SEQ ID NO: 463361 - DNA, 25 bp, Mus musculus
gactgtcactgggagcccctggaca

SEQ ID NO: 463362 - DNA, 25 bp, Mus musculus
gactgtcagaccacaagaattctta

SEQ ID NO: 463363 - DNA, 25 bp, Mus musculus
gactgtcagacctcaagaattctta

SEQ ID NO: 463364 - DNA, 25 bp, Mus musculus
gactgtcagattctatattctctat

SEQ ID NO: 463365 - DNA, 25 bp, Mus musculus
gactgtcagattgtatattctctat

SEQ ID NO: 463366 - DNA, 25 bp, Mus musculus
gactgtcagcagaagctacagctca

SEQ ID NO: 463367 - DNA, 25 bp, Mus musculus
gactgtcagcagtagctacagctca

SEQ ID NO: 463368 - DNA, 25 bp, Mus musculus
gactgtcagccaccaaagaagctca

SEQ ID NO: 463369 - DNA, 25 bp, Mus musculus
gactgtcagccagcaaagaagctca

SEQ ID NO: 463370 - DNA, 25 bp, Mus musculus
gactgtcagcttacagttacaattg

SEQ ID NO: 463371 - DNA, 25 bp, Mus musculus
gactgtcagctttcagttacaattg

SEQ ID NO: 463372 - DNA, 25 bp, Mus musculus
gactgtcaggatccgcaattatgaa

SEQ ID NO: 463373 - DNA, 25 bp, Mus musculus
gactgtcaggatcggatcaccagcc

SEQ ID NO: 463374 - DNA, 25 bp, Mus musculus
gactgtcaggatgcgcaattatgaa

SEQ ID NO: 463375 - DNA, 25 bp, Mus musculus
gactgtcaggatgggatcaccagcc

SEQ ID NO: 463376 - DNA, 25 bp, Mus musculus
gactgtcagtggacatgcaggccat

SEQ ID NO: 463377 - DNA, 25 bp, Mus musculus
gactgtcagtggtcatgcaggccat

SEQ ID NO: 463378 - DNA, 25 bp, Mus musculus
gactgtcagttacgtatcattcctg

SEQ ID NO: 463379 - DNA, 25 bp, Mus musculus
gactgtcagttaggtatcattcctg

SEQ ID NO: 463380 - DNA, 25 bp, Mus musculus
gactgtcatagtccgtgtattgccc

SEQ ID NO: 463381 - DNA, 25 bp, Mus musculus
gactgtcatagtgcgtgtattgccc

SEQ ID NO: 463382 - DNA, 25 bp, Mus musculus
gactgtcatgaacgtcacgctgcaa

SEQ ID NO: 463383 - DNA, 25 bp, Mus musculus
gactgtcatgaaggtcacgctgcaa

SEQ ID NO: 463384 - DNA, 25 bp, Mus musculus
gactgtcatggacattaacgatttt

SEQ ID NO: 463385 - DNA, 25 bp, Mus musculus
gactgtcatggagattaacgatttt

SEQ ID NO: 463386 - DNA, 25 bp, Mus musculus
gactgtcatttaactaagcattgct

SEQ ID NO: 463387 - DNA, 25 bp, Mus musculus
gactgtcatttatctaagcattgct

SEQ ID NO: 463388 - DNA, 25 bp, Mus musculus
gactgtcatttgacatttgcaagca

SEQ ID NO: 463389 - DNA, 25 bp, Mus musculus
gactgtcatttgtcatttgcaagca

SEQ ID NO: 463390 - DNA, 25 bp, Mus musculus
gactgtcattttctcactctaattt

SEQ ID NO: 463391 - DNA, 25 bp, Mus musculus
gactgtcattttgtcactctaattt

SEQ ID NO: 463392 - DNA, 25 bp, Mus musculus
gactgtccaaacatggagtctctag

SEQ ID NO: 463393 - DNA, 25 bp, Mus musculus
gactgtccaaacttggagtctctag

SEQ ID NO: 463394 - DNA, 25 bp, Mus musculus
gactgtccagacacatgggcgatac

SEQ ID NO: 463395 - DNA, 25 bp, Mus musculus
gactgtccagactcatgggcgatac

SEQ ID NO: 463396 - DNA, 25 bp, Mus musculus
gactgtccaggaatccagggactca

SEQ ID NO: 463397 - DNA, 25 bp, Mus musculus
gactgtccaggacccagacgctgga

SEQ ID NO: 463398 - DNA, 25 bp, Mus musculus
gactgtccaggagccagacgctgga

SEQ ID NO: 463399 - DNA, 25 bp, Mus musculus
gactgtccaggattccagggactca

SEQ ID NO: 463400 - DNA, 25 bp, Mus musculus
gactgtccagttacacatggcaggt

SEQ ID NO: 463401 - DNA, 25 bp, Mus musculus
gactgtccagtttcacatggcaggt

SEQ ID NO: 463402 - DNA, 25 bp, Mus musculus
gactgtcccagaacaaaccgtctag

SEQ ID NO: 463403 - DNA, 25 bp, Mus musculus
gactgtcccagatcaaaccgtctag

SEQ ID NO: 463404 - DNA, 25 bp, Mus musculus
gactgtcccaggctgagtttgccag

SEQ ID NO: 463405 - DNA, 25 bp, Mus musculus
gactgtcccagggtgagtttgccag

SEQ ID NO: 463406 - DNA, 25 bp, Mus musculus
gactgtcccataaacagagactggg

SEQ ID NO: 463407 - DNA, 25 bp, Mus musculus
gactgtcccatatacagagactggg

SEQ ID NO: 463408 - DNA, 25 bp, Mus musculus
gactgtcccattagttagactcgaa

SEQ ID NO: 463409 - DNA, 25 bp, Mus musculus
gactgtcccatttgttagactcgaa

SEQ ID NO: 463410 - DNA, 25 bp, Mus musculus
gactgtccgataacagccatgcaga

SEQ ID NO: 463411 - DNA, 25 bp, Mus musculus
gactgtccgataatcgttccatgcc

SEQ ID NO: 463412 - DNA, 25 bp, Mus musculus
gactgtccgatatcagccatgcaga

SEQ ID NO: 463413 - DNA, 25 bp, Mus musculus
gactgtccgatattcgttccatgcc

SEQ ID NO: 463414 - DNA, 25 bp, Mus musculus
gactgtccgtagcagaactcagcaa

SEQ ID NO: 463415 - DNA, 25 bp, Mus musculus
gactgtccgtaggagaactcagcaa

SEQ ID NO: 463416 - DNA, 25 bp, Mus musculus
gactgtcctaaaaacctatttctga

SEQ ID NO: 463417 - DNA, 25 bp, Mus musculus
gactgtcctaaatacctatttctga

SEQ ID NO: 463418 - DNA, 25 bp, Mus musculus
gactgtcctaggatgtgtgcctata

SEQ ID NO: 463419 - DNA, 25 bp, Mus musculus
gactgtcctaggttgtgtgcctata

SEQ ID NO: 463420 - DNA, 25 bp, Mus musculus
gactgtcctctgacagactctatca

SEQ ID NO: 463421 - DNA, 25 bp, Mus musculus
gactgtcctctgtcagactctatca

SEQ ID NO: 463422 - DNA, 25 bp, Mus musculus
gactgtcctcttcggaagcagctag

SEQ ID NO: 463423 - DNA, 25 bp, Mus musculus
gactgtcctcttgggaagcagctag

SEQ ID NO: 463424 - DNA, 25 bp, Mus musculus
gactgtcctgacattttgagttcca

SEQ ID NO: 463425 - DNA, 25 bp, Mus musculus
gactgtcctgactttttgagttcca

SEQ ID NO: 463426 - DNA, 25 bp, Mus musculus
gactgtcgctaacttcatgggcctc

SEQ ID NO: 463427 - DNA, 25 bp, Mus musculus
gactgtcgctaagttcatgggcctc

SEQ ID NO: 463428 - DNA, 25 bp, Mus musculus
gactgtcggcataatcttcttaagc

SEQ ID NO: 463429 - DNA, 25 bp, Mus musculus
gactgtcggcattatcttcttaagc

SEQ ID NO: 463430 - DNA, 25 bp, Mus musculus
gactgtcggtacctgaacttcacta

SEQ ID NO: 463431 - DNA, 25 bp, Mus musculus
gactgtcggtacgtgaacttcacta

SEQ ID NO: 463432 - DNA, 25 bp, Mus musculus
gactgtctaaacatcagagatggtg

SEQ ID NO: 463433 - DNA, 25 bp, Mus musculus
gactgtctaaacttcagagatggtg

SEQ ID NO: 463434 - DNA, 25 bp, Mus musculus
gactgtctaacacctgtttcatctg

SEQ ID NO: 463435 - DNA, 25 bp, Mus musculus
gactgtctaacagctgtttcatctg

SEQ ID NO: 463436 - DNA, 25 bp, Mus musculus
gactgtctaattattcagaccttga

SEQ ID NO: 463437 - DNA, 25 bp, Mus musculus
gactgtctaatttttcagaccttga

SEQ ID NO: 463438 - DNA, 25 bp, Mus musculus
gactgtctaccgaaggctgctgggt

SEQ ID NO: 463439 - DNA, 25 bp, Mus musculus
gactgtctaccgtaggctgctgggt

SEQ ID NO: 463440 - DNA, 25 bp, Mus musculus
gactgtctacttccttactcaatgt

SEQ ID NO: 463441 - DNA, 25 bp, Mus musculus
gactgtctacttgcttactcaatgt

SEQ ID NO: 463442 - DNA, 25 bp, Mus musculus
gactgtctagtgaccggcactgaat

SEQ ID NO: 463443 - DNA, 25 bp, Mus musculus
gactgtctagtgtccggcactgaat

SEQ ID NO: 463444 - DNA, 25 bp, Mus musculus
gactgtctatgcaaatggtcatcaa

SEQ ID NO: 463445 - DNA, 25 bp, Mus musculus
gactgtctatgctaatggtcatcaa

SEQ ID NO: 463446 - DNA, 25 bp, Mus musculus
gactgtctcaggaatgccccatcaa

SEQ ID NO: 463447 - DNA, 25 bp, Mus musculus
gactgtctcaggtatgccccatcaa

SEQ ID NO: 463448 - DNA, 25 bp, Mus musculus
gactgtctctggataccttgtcaaa

SEQ ID NO: 463449 - DNA, 25 bp, Mus musculus
gactgtctctggttaccttgtcaaa

SEQ ID NO: 463450 - DNA, 25 bp, Mus musculus
gactgtctgaacctgctgaacaaga

SEQ ID NO: 463451 - DNA, 25 bp, Mus musculus
gactgtctgaacgtgctgaacaaga

SEQ ID NO: 463452 - DNA, 25 bp, Mus musculus
gactgtctgagcacatagttgcctc

SEQ ID NO: 463453 - DNA, 25 bp, Mus musculus
gactgtctgagctcatagttgcctc

SEQ ID NO: 463454 - DNA, 25 bp, Mus musculus
gactgtctgcggatgaagaatccac

SEQ ID NO: 463455 - DNA, 25 bp, Mus musculus
gactgtctgcggttgaagaatccac

SEQ ID NO: 463456 - DNA, 25 bp, Mus musculus
gactgtctggctagatcttagaagt

SEQ ID NO: 463457 - DNA, 25 bp, Mus musculus
gactgtctggcttgatcttagaagt

SEQ ID NO: 463458 - DNA, 25 bp, Mus musculus
gactgtctggtgcactggaccttgc

SEQ ID NO: 463459 - DNA, 25 bp, Mus musculus
gactgtctggtggactggaccttgc

SEQ ID NO: 463460 - DNA, 25 bp, Mus musculus
gactgtctgtccagcttagctgtta

SEQ ID NO: 463461 - DNA, 25 bp, Mus musculus
gactgtctgtcctgcttagctgtta

SEQ ID NO: 463462 - DNA, 25 bp, Mus musculus
gactgtctgttcaatgagggctcca

SEQ ID NO: 463463 - DNA, 25 bp, Mus musculus
gactgtctgttctatgagggctcca

SEQ ID NO: 463464 - DNA, 25 bp, Mus musculus
gactgtctgttgatgtaagggctgc

SEQ ID NO: 463465 - DNA, 25 bp, Mus musculus
gactgtctgttgttgtaagggctgc

SEQ ID NO: 463466 - DNA, 25 bp, Mus musculus
gactgtcttattatcaaagttctga

SEQ ID NO: 463467 - DNA, 25 bp, Mus musculus
gactgtcttattttcaaagttctga

SEQ ID NO: 463468 - DNA, 25 bp, Mus musculus
gactgtcttcatcctacatgtagag

SEQ ID NO: 463469 - DNA, 25 bp, Mus musculus
gactgtcttcatctgttaggtgctt

SEQ ID NO: 463470 - DNA, 25 bp, Mus musculus
gactgtcttcatgctacatgtagag

SEQ ID NO: 463471 - DNA, 25 bp, Mus musculus
gactgtcttcatgtgttaggtgctt

SEQ ID NO: 463472 - DNA, 25 bp, Mus musculus
gactgtcttgccaataaacctaggg

SEQ ID NO: 463473 - DNA, 25 bp, Mus musculus
gactgtcttgccatattacacttaa

SEQ ID NO: 463474 - DNA, 25 bp, Mus musculus
gactgtcttgcctataaacctaggg

SEQ ID NO: 463475 - DNA, 25 bp, Mus musculus
gactgtcttgccttattacacttaa

SEQ ID NO: 463476 - DNA, 25 bp, Mus musculus
gactgtcttgttcttaagcaaatgc

SEQ ID NO: 463477 - DNA, 25 bp, Mus musculus
gactgtcttgttgttaagcaaatgc

SEQ ID NO: 463478 - DNA, 25 bp, Mus musculus
gactgtgaacacaaccatctctggg

SEQ ID NO: 463479 - DNA, 25 bp, Mus musculus
gactgtgaacactaccatctctggg

SEQ ID NO: 463480 - DNA, 25 bp, Mus musculus
gactgtgaacatagtctccacctga

SEQ ID NO: 463481 - DNA, 25 bp, Mus musculus
gactgtgaacattgtctccacctga

SEQ ID NO: 463482 - DNA, 25 bp, Mus musculus
gactgtgaacgaatcaacctcatgg

SEQ ID NO: 463483 - DNA, 25 bp, Mus musculus
gactgtgaacgattcaacctcatgg

SEQ ID NO: 463484 - DNA, 25 bp, Mus musculus
gactgtgaatgacatagacatcttt

SEQ ID NO: 463485 - DNA, 25 bp, Mus musculus
gactgtgaatgagatagacatcttt

SEQ ID NO: 463486 - DNA, 25 bp, Mus musculus
gactgtgaattacgcagagaacttc

SEQ ID NO: 463487 - DNA, 25 bp, Mus musculus
gactgtgaattaggcagagaacttc

SEQ ID NO: 463488 - DNA, 25 bp, Mus musculus
gactgtgacatccacgttcctaaaa

SEQ ID NO: 463489 - DNA, 25 bp, Mus musculus
gactgtgacatcgacgttcctaaaa

SEQ ID NO: 463490 - DNA, 25 bp, Mus musculus
gactgtgaccatcgtcttttgggtt

SEQ ID NO: 463491 - DNA, 25 bp, Mus musculus
gactgtgaccatggtcttttgggtt

SEQ ID NO: 463492 - DNA, 25 bp, Mus musculus
gactgtgacccccaatttgacctca

SEQ ID NO: 463493 - DNA, 25 bp, Mus musculus
gactgtgaccccgaatttgacctca

SEQ ID NO: 463494 - DNA, 25 bp, Mus musculus
gactgtgacctaaatgcagcaaata

SEQ ID NO: 463495 - DNA, 25 bp, Mus musculus
gactgtgacctaatactgaggcttt

SEQ ID NO: 463496 - DNA, 25 bp, Mus musculus
gactgtgacctatatgcagcaaata

SEQ ID NO: 463497 - DNA, 25 bp, Mus musculus
gactgtgacctattactgaggcttt

SEQ ID NO: 463498 - DNA, 25 bp, Mus musculus
gactgtgactagcaagttgtagcct

SEQ ID NO: 463499 - DNA, 25 bp, Mus musculus
gactgtgactaggaagttgtagcct

SEQ ID NO: 463500 - DNA, 25 bp, Mus musculus
gactgtgactctaccaaaacttcat

SEQ ID NO: 463501 - DNA, 25 bp, Mus musculus
gactgtgactcttccaaaacttcat

SEQ ID NO: 463502 - DNA, 25 bp, Mus musculus
gactgtgactgaaatcaatgcaaca

SEQ ID NO: 463503 - DNA, 25 bp, Mus musculus
gactgtgactgatatcaatgcaaca

SEQ ID NO: 463504 - DNA, 25 bp, Mus musculus
gactgtgagcaaagccaggctgtgc

SEQ ID NO: 463505 - DNA, 25 bp, Mus musculus
gactgtgagcaatgccaggctgtgc

SEQ ID NO: 463506 - DNA, 25 bp, Mus musculus
gactgtgagctgcaggaaccctacc

SEQ ID NO: 463507 - DNA, 25 bp, Mus musculus
gactgtgagctggaggaaccctacc

SEQ ID NO: 463508 - DNA, 25 bp, Mus musculus
gactgtgaggctaacatccaaatgt

SEQ ID NO: 463509 - DNA, 25 bp, Mus musculus
gactgtgaggctatcataatctacc

SEQ ID NO: 463510 - DNA, 25 bp, Mus musculus
gactgtgaggcttacatccaaatgt

SEQ ID NO: 463511 - DNA, 25 bp, Mus musculus
gactgtgaggctttcataatctacc

SEQ ID NO: 463512 - DNA, 25 bp, Mus musculus
gactgtgagtcaccctgatcattat

SEQ ID NO: 463513 - DNA, 25 bp, Mus musculus
gactgtgagtcagcctgatcattat

SEQ ID NO: 463514 - DNA, 25 bp, Mus musculus
gactgtgagtgaaactgccacttcc

SEQ ID NO: 463515 - DNA, 25 bp, Mus musculus
gactgtgagtgatactgccacttcc

SEQ ID NO: 463516 - DNA, 25 bp, Mus musculus
gactgtgagttcaaattcaaggcca

SEQ ID NO: 463517 - DNA, 25 bp, Mus musculus
gactgtgagttctaattcaaggcca

SEQ ID NO: 463518 - DNA, 25 bp, Mus musculus
gactgtgatagcaattactgggaga

SEQ ID NO: 463519 - DNA, 25 bp, Mus musculus
gactgtgatagctattactgggaga

SEQ ID NO: 463520 - DNA, 25 bp, Mus musculus
gactgtgatcctattagcttgtgat

SEQ ID NO: 463521 - DNA, 25 bp, Mus musculus
gactgtgatccttttagcttgtgat

SEQ ID NO: 463522 - DNA, 25 bp, Mus musculus
gactgtgatctgaagcgttataact

SEQ ID NO: 463523 - DNA, 25 bp, Mus musculus
gactgtgatctgacactagtagtaa

SEQ ID NO: 463524 - DNA, 25 bp, Mus musculus
gactgtgatctgtagcgttataact

SEQ ID NO: 463525 - DNA, 25 bp, Mus musculus
gactgtgatctgtcactagtagtaa

SEQ ID NO: 463526 - DNA, 25 bp, Mus musculus
gactgtgatgcaagatgccggtcct

SEQ ID NO: 463527 - DNA, 25 bp, Mus musculus
gactgtgatgcatgatgccggtcct

SEQ ID NO: 463528 - DNA, 25 bp, Mus musculus
gactgtgatggcaccccctgtgacg

SEQ ID NO: 463529 - DNA, 25 bp, Mus musculus
gactgtgatggctccccctgtgacg

SEQ ID NO: 463530 - DNA, 25 bp, Mus musculus
gactgtgattctcatgttgagacca

SEQ ID NO: 463531 - DNA, 25 bp, Mus musculus
gactgtgattctgatgttgagacca

SEQ ID NO: 463532 - DNA, 25 bp, Mus musculus
gactgtgatttgcaaaccctacttt

SEQ ID NO: 463533 - DNA, 25 bp, Mus musculus
gactgtgatttggaaaccctacttt

SEQ ID NO: 463534 - DNA, 25 bp, Mus musculus
gactgtgcaccaataacactgtcca

SEQ ID NO: 463535 - DNA, 25 bp, Mus musculus
gactgtgcaccacagcataccttaa

SEQ ID NO: 463536 - DNA, 25 bp, Mus musculus
gactgtgcaccagagcataccttaa

SEQ ID NO: 463537 - DNA, 25 bp, Mus musculus
gactgtgcaccattaacactgtcca

SEQ ID NO: 463538 - DNA, 25 bp, Mus musculus
gactgtgcacctcgaagttgttagg

SEQ ID NO: 463539 - DNA, 25 bp, Mus musculus
gactgtgcacctggaagttgttagg

SEQ ID NO: 463540 - DNA, 25 bp, Mus musculus
gactgtgcacggaaaaagctccact

SEQ ID NO: 463541 - DNA, 25 bp, Mus musculus
gactgtgcacggtaaaagctccact

SEQ ID NO: 463542 - DNA, 25 bp, Mus musculus
gactgtgcactgattgttgaaaata

SEQ ID NO: 463543 - DNA, 25 bp, Mus musculus
gactgtgcactgtttgttgaaaata

SEQ ID NO: 463544 - DNA, 25 bp, Mus musculus
gactgtgcagcactcagctctttgg

SEQ ID NO: 463545 - DNA, 25 bp, Mus musculus
gactgtgcagcagtcagctctttgg

SEQ ID NO: 463546 - DNA, 25 bp, Mus musculus
gactgtgcagttcaacaggccattc

SEQ ID NO: 463547 - DNA, 25 bp, Mus musculus
gactgtgcagttgaacaggccattc

SEQ ID NO: 463548 - DNA, 25 bp, Mus musculus
gactgtgcatcacctgtcatatcat

SEQ ID NO: 463549 - DNA, 25 bp, Mus musculus
gactgtgcatcagctgtcatatcat

SEQ ID NO: 463550 - DNA, 25 bp, Mus musculus
gactgtgcatctcgagtcgttcctg

SEQ ID NO: 463551 - DNA, 25 bp, Mus musculus
gactgtgcatctggagtcgttcctg

SEQ ID NO: 463552 - DNA, 25 bp, Mus musculus
gactgtgccagcattatattttcag

SEQ ID NO: 463553 - DNA, 25 bp, Mus musculus
gactgtgccagctttatattttcag

SEQ ID NO: 463554 - DNA, 25 bp, Mus musculus
gactgtgccatgcatgcctgcatca

SEQ ID NO: 463555 - DNA, 25 bp, Mus musculus
gactgtgccatggatgcctgcatca

SEQ ID NO: 463556 - DNA, 25 bp, Mus musculus
gactgtgcccagctcgagcagcgct

SEQ ID NO: 463557 - DNA, 25 bp, Mus musculus
gactgtgcccaggtcgagcagcgct

SEQ ID NO: 463558 - DNA, 25 bp, Mus musculus
gactgtgccccgaccagactgtgac

SEQ ID NO: 463559 - DNA, 25 bp, Mus musculus
gactgtgccccgtccagactgtgac

SEQ ID NO: 463560 - DNA, 25 bp, Mus musculus
gactgtgcccgtcgctggactcttc

SEQ ID NO: 463561 - DNA, 25 bp, Mus musculus
gactgtgcccgtggctggactcttc

SEQ ID NO: 463562 - DNA, 25 bp, Mus musculus
gactgtgccctgatccatgctggaa

SEQ ID NO: 463563 - DNA, 25 bp, Mus musculus
gactgtgccctgttccatgctggaa

SEQ ID NO: 463564 - DNA, 25 bp, Mus musculus
gactgtgcccttatgtgccagaaac

SEQ ID NO: 463565 - DNA, 25 bp, Mus musculus
gactgtgcccttttgtgccagaaac

SEQ ID NO: 463566 - DNA, 25 bp, Mus musculus
gactgtgcgacgaaacatcagcaga

SEQ ID NO: 463567 - DNA, 25 bp, Mus musculus
gactgtgcgacgtaacatcagcaga

SEQ ID NO: 463568 - DNA, 25 bp, Mus musculus
gactgtgcgcttcctacaggagcag

SEQ ID NO: 463569 - DNA, 25 bp, Mus musculus
gactgtgcgcttgctacaggagcag

SEQ ID NO: 463570 - DNA, 25 bp, Mus musculus
gactgtgctcacaagcatacatagt

SEQ ID NO: 463571 - DNA, 25 bp, Mus musculus
gactgtgctcactagcatacatagt

SEQ ID NO: 463572 - DNA, 25 bp, Mus musculus
gactgtgctcataaacctattttag

SEQ ID NO: 463573 - DNA, 25 bp, Mus musculus
gactgtgctcatattttaaactacg

SEQ ID NO: 463574 - DNA, 25 bp, Mus musculus
gactgtgctcattaacctattttag

SEQ ID NO: 463575 - DNA, 25 bp, Mus musculus
gactgtgctcattttttaaactacg

SEQ ID NO: 463576 - DNA, 25 bp, Mus musculus
gactgtgctgaaatctggctccaaa

SEQ ID NO: 463577 - DNA, 25 bp, Mus musculus
gactgtgctgaattctggctccaaa

SEQ ID NO: 463578 - DNA, 25 bp, Mus musculus
gactgtgctgcgctctgcaaatgaa

SEQ ID NO: 463579 - DNA, 25 bp, Mus musculus
gactgtgctgcggtctgcaaatgaa

SEQ ID NO: 463580 - DNA, 25 bp, Mus musculus
gactgtgctgctcgcatgccgatgt

SEQ ID NO: 463581 - DNA, 25 bp, Mus musculus
gactgtgctgctggcatgccgatgt

SEQ ID NO: 463582 - DNA, 25 bp, Mus musculus
gactgtgctggcatatgttttagag

SEQ ID NO: 463583 - DNA, 25 bp, Mus musculus
gactgtgctggcttatgttttagag

SEQ ID NO: 463584 - DNA, 25 bp, Mus musculus
gactgtgcttgtagtattatttagg

SEQ ID NO: 463585 - DNA, 25 bp, Mus musculus
gactgtgcttgttgtattatttagg

SEQ ID NO: 463586 - DNA, 25 bp, Mus musculus
gactgtgctttactagtcagcccct

SEQ ID NO: 463587 - DNA, 25 bp, Mus musculus
gactgtgctttagtagtcagcccct

SEQ ID NO: 463588 - DNA, 25 bp, Mus musculus
gactgtgctttgcaattttgagaac

SEQ ID NO: 463589 - DNA, 25 bp, Mus musculus
gactgtgctttggaattttgagaac

SEQ ID NO: 463590 - DNA, 25 bp, Mus musculus
gactgtggaaggcaacttaccctac

SEQ ID NO: 463591 - DNA, 25 bp, Mus musculus
gactgtggaagggaacttaccctac

SEQ ID NO: 463592 - DNA, 25 bp, Mus musculus
gactgtggacagctctaatttcttt

SEQ ID NO: 463593 - DNA, 25 bp, Mus musculus
gactgtggacaggtctaatttcttt

SEQ ID NO: 463594 - DNA, 25 bp, Mus musculus
gactgtggaccaagcagagcctaaa

SEQ ID NO: 463595 - DNA, 25 bp, Mus musculus
gactgtggaccaatcaagccttgga

SEQ ID NO: 463596 - DNA, 25 bp, Mus musculus
gactgtggaccatgcagagcctaaa

SEQ ID NO: 463597 - DNA, 25 bp, Mus musculus
gactgtggaccattcaagccttgga

SEQ ID NO: 463598 - DNA, 25 bp, Mus musculus
gactgtggagccctattaactgcat

SEQ ID NO: 463599 - DNA, 25 bp, Mus musculus
gactgtggagccgtattaactgcat

SEQ ID NO: 463600 - DNA, 25 bp, Mus musculus
gactgtggaggaagaccctggcacc

SEQ ID NO: 463601 - DNA, 25 bp, Mus musculus
gactgtggaggatgaccctggcacc

SEQ ID NO: 463602 - DNA, 25 bp, Mus musculus
gactgtggatacaccacctctgtgg

SEQ ID NO: 463603 - DNA, 25 bp, Mus musculus
gactgtggatactccacctctgtgg

SEQ ID NO: 463604 - DNA, 25 bp, Mus musculus
gactgtggatatagccagctgcaaa

SEQ ID NO: 463605 - DNA, 25 bp, Mus musculus
gactgtggatattgccagctgcaaa

SEQ ID NO: 463606 - DNA, 25 bp, Mus musculus
gactgtggatggcccctctggaaag

SEQ ID NO: 463607 - DNA, 25 bp, Mus musculus
gactgtggatgggccctctggaaag

SEQ ID NO: 463608 - DNA, 25 bp, Mus musculus
gactgtggcaacatcaagcttctta

SEQ ID NO: 463609 - DNA, 25 bp, Mus musculus
gactgtggcaacttcaagcttctta

SEQ ID NO: 463610 - DNA, 25 bp, Mus musculus
gactgtggcagcagggttatctctt

SEQ ID NO: 463611 - DNA, 25 bp, Mus musculus
gactgtggcagctgggttatctctt

SEQ ID NO: 463612 - DNA, 25 bp, Mus musculus
gactgtggccctcaatgattcactc

SEQ ID NO: 463613 - DNA, 25 bp, Mus musculus
gactgtggccctgaatgattcactc

SEQ ID NO: 463614 - DNA, 25 bp, Mus musculus
gactgtggcgaaatctctctaaaat

SEQ ID NO: 463615 - DNA, 25 bp, Mus musculus
gactgtggcgaattctctctaaaat

SEQ ID NO: 463616 - DNA, 25 bp, Mus musculus
gactgtggctcaaggtcaacggaga

SEQ ID NO: 463617 - DNA, 25 bp, Mus musculus
gactgtggctcatggtcaacggaga

SEQ ID NO: 463618 - DNA, 25 bp, Mus musculus
gactgtggcttgctgcccacgcctg

SEQ ID NO: 463619 - DNA, 25 bp, Mus musculus
gactgtggcttggtgcccacgcctg

SEQ ID NO: 463620 - DNA, 25 bp, Mus musculus
gactgtgggatactgtgccacctga

SEQ ID NO: 463621 - DNA, 25 bp, Mus musculus
gactgtgggatagtgtgccacctga

SEQ ID NO: 463622 - DNA, 25 bp, Mus musculus
gactgtgggattccttggattagca

SEQ ID NO: 463623 - DNA, 25 bp, Mus musculus
gactgtgggattgcttggattagca

SEQ ID NO: 463624 - DNA, 25 bp, Mus musculus
gactgtgggcttatgctgactttaa

SEQ ID NO: 463625 - DNA, 25 bp, Mus musculus
gactgtgggcttttgctgactttaa

SEQ ID NO: 463626 - DNA, 25 bp, Mus musculus
gactgtggtaaaagtacttggtgat

SEQ ID NO: 463627 - DNA, 25 bp, Mus musculus
gactgtggtaaatgtacttggtgat

SEQ ID NO: 463628 - DNA, 25 bp, Mus musculus
gactgtggtacaccatggcattcca

SEQ ID NO: 463629 - DNA, 25 bp, Mus musculus
gactgtggtacagcatggcattcca

SEQ ID NO: 463630 - DNA, 25 bp, Mus musculus
gactgtggtagcagagtgcacacat

SEQ ID NO: 463631 - DNA, 25 bp, Mus musculus
gactgtggtagctgagtgcacacat

SEQ ID NO: 463632 - DNA, 25 bp, Mus musculus
gactgtggtatgaagccacttcagg

SEQ ID NO: 463633 - DNA, 25 bp, Mus musculus
gactgtggtatgtagccacttcagg

SEQ ID NO: 463634 - DNA, 25 bp, Mus musculus
gactgtggtgctatctgcacttaaa

SEQ ID NO: 463635 - DNA, 25 bp, Mus musculus
gactgtggtgctttctgcacttaaa

SEQ ID NO: 463636 - DNA, 25 bp, Mus musculus
gactgtggtgttacatacactagga

SEQ ID NO: 463637 - DNA, 25 bp, Mus musculus
gactgtggtgtttcatacactagga

SEQ ID NO: 463638 - DNA, 25 bp, Mus musculus
gactgtggttagctccctagccagg

SEQ ID NO: 463639 - DNA, 25 bp, Mus musculus
gactgtggttaggtccctagccagg

SEQ ID NO: 463640 - DNA, 25 bp, Mus musculus
gactgtggttgtcgttacagagcaa

SEQ ID NO: 463641 - DNA, 25 bp, Mus musculus
gactgtggttgtggttacagagcaa

SEQ ID NO: 463642 - DNA, 25 bp, Mus musculus
gactgtgtacaaacaacccatcaag

SEQ ID NO: 463643 - DNA, 25 bp, Mus musculus
gactgtgtacaatcaacccatcaag

SEQ ID NO: 463644 - DNA, 25 bp, Mus musculus
gactgtgtacatctcccggaaagga

SEQ ID NO: 463645 - DNA, 25 bp, Mus musculus
gactgtgtacatgtcccggaaagga

SEQ ID NO: 463646 - DNA, 25 bp, Mus musculus
gactgtgtactccatttcatgtgtg

SEQ ID NO: 463647 - DNA, 25 bp, Mus musculus
gactgtgtactcgatttcatgtgtg

SEQ ID NO: 463648 - DNA, 25 bp, Mus musculus
gactgtgtacttcatttcccaaaag

SEQ ID NO: 463649 - DNA, 25 bp, Mus musculus
gactgtgtacttctgtgatctagac

SEQ ID NO: 463650 - DNA, 25 bp, Mus musculus
gactgtgtacttgatttcccaaaag

SEQ ID NO: 463651 - DNA, 25 bp, Mus musculus
gactgtgtacttgtgtgatctagac

SEQ ID NO: 463652 - DNA, 25 bp, Mus musculus
gactgtgtagtaaccattccttaac

SEQ ID NO: 463653 - DNA, 25 bp, Mus musculus
gactgtgtagtatccattccttaac

SEQ ID NO: 463654 - DNA, 25 bp, Mus musculus
gactgtgtagttactctcataagca

SEQ ID NO: 463655 - DNA, 25 bp, Mus musculus
gactgtgtagtttctctcataagca

SEQ ID NO: 463656 - DNA, 25 bp, Mus musculus
gactgtgtattccagagactgttag

SEQ ID NO: 463657 - DNA, 25 bp, Mus musculus
gactgtgtattcgagagactgttag

SEQ ID NO: 463658 - DNA, 25 bp, Mus musculus
gactgtgtcagaacgttgcttttcc

SEQ ID NO: 463659 - DNA, 25 bp, Mus musculus
gactgtgtcagatcgttgcttttcc

SEQ ID NO: 463660 - DNA, 25 bp, Mus musculus
gactgtgtcagcattgatgtactcc

SEQ ID NO: 463661 - DNA, 25 bp, Mus musculus
gactgtgtcagctttgatgtactcc

SEQ ID NO: 463662 - DNA, 25 bp, Mus musculus
gactgtgtcatgacatgtacacccc

SEQ ID NO: 463663 - DNA, 25 bp, Mus musculus
gactgtgtcatgtcatgtacacccc

SEQ ID NO: 463664 - DNA, 25 bp, Mus musculus
gactgtgtccctccaaggttgcaag

SEQ ID NO: 463665 - DNA, 25 bp, Mus musculus
gactgtgtccctgcaaggttgcaag

SEQ ID NO: 463666 - DNA, 25 bp, Mus musculus
gactgtgtccttactctgggaggca

SEQ ID NO: 463667 - DNA, 25 bp, Mus musculus
gactgtgtccttctatgagcaccaa

SEQ ID NO: 463668 - DNA, 25 bp, Mus musculus
gactgtgtccttgtatgagcaccaa

SEQ ID NO: 463669 - DNA, 25 bp, Mus musculus
gactgtgtcctttctctgggaggca

SEQ ID NO: 463670 - DNA, 25 bp, Mus musculus
gactgtgtcgtcagattccagtact

SEQ ID NO: 463671 - DNA, 25 bp, Mus musculus
gactgtgtcgtctgattccagtact

SEQ ID NO: 463672 - DNA, 25 bp, Mus musculus
gactgtgtctccaaggaacatcgga

SEQ ID NO: 463673 - DNA, 25 bp, Mus musculus
gactgtgtctccagccagaatgtga

SEQ ID NO: 463674 - DNA, 25 bp, Mus musculus
gactgtgtctcctaggaacatcgga

SEQ ID NO: 463675 - DNA, 25 bp, Mus musculus
gactgtgtctcctgccagaatgtga

SEQ ID NO: 463676 - DNA, 25 bp, Mus musculus
gactgtgtctctacaatgtgcactg

SEQ ID NO: 463677 - DNA, 25 bp, Mus musculus
gactgtgtctcttcaatgtgcactg

SEQ ID NO: 463678 - DNA, 25 bp, Mus musculus
gactgtgtgagcaaagagcgcagct

SEQ ID NO: 463679 - DNA, 25 bp, Mus musculus
gactgtgtgagctaagagcgcagct

SEQ ID NO: 463680 - DNA, 25 bp, Mus musculus
gactgtgtgattctaaactggcgcc

SEQ ID NO: 463681 - DNA, 25 bp, Mus musculus
gactgtgtgattgtaaactggcgcc

SEQ ID NO: 463682 - DNA, 25 bp, Mus musculus
gactgtgtgctgaccttggaaggaa

SEQ ID NO: 463683 - DNA, 25 bp, Mus musculus
gactgtgtgctgtccttggaaggaa

SEQ ID NO: 463684 - DNA, 25 bp, Mus musculus
gactgtgtgtaaaggacccacctag

SEQ ID NO: 463685 - DNA, 25 bp, Mus musculus
gactgtgtgtaatggacccacctag

SEQ ID NO: 463686 - DNA, 25 bp, Mus musculus
gactgtgtgtgtaaattctcatgct

SEQ ID NO: 463687 - DNA, 25 bp, Mus musculus
gactgtgtgtgttaattctcatgct

SEQ ID NO: 463688 - DNA, 25 bp, Mus musculus
gactgtgtgttaccaagacccatga

SEQ ID NO: 463689 - DNA, 25 bp, Mus musculus
gactgtgtgttagcaagacccatga

SEQ ID NO: 463690 - DNA, 25 bp, Mus musculus
gactgtgtgtttcattgaccatgac

SEQ ID NO: 463691 - DNA, 25 bp, Mus musculus
gactgtgtgtttgattgaccatgac

SEQ ID NO: 463692 - DNA, 25 bp, Mus musculus
gactgtgttaaacacttcacaacaa

SEQ ID NO: 463693 - DNA, 25 bp, Mus musculus
gactgtgttaaacgtatttcattta

SEQ ID NO: 463694 - DNA, 25 bp, Mus musculus
gactgtgttaaagacttcacaacaa

SEQ ID NO: 463695 - DNA, 25 bp, Mus musculus
gactgtgttaaaggtatttcattta

SEQ ID NO: 463696 - DNA, 25 bp, Mus musculus
gactgtgttactcttctctcagttt

SEQ ID NO: 463697 - DNA, 25 bp, Mus musculus
gactgtgttactgttctctcagttt

SEQ ID NO: 463698 - DNA, 25 bp, Mus musculus
gactgtgttcaacctaccattattt

SEQ ID NO: 463699 - DNA, 25 bp, Mus musculus
gactgtgttcaagctaccattattt

SEQ ID NO: 463700 - DNA, 25 bp, Mus musculus
gactgtgttcacacctgagggagat

SEQ ID NO: 463701 - DNA, 25 bp, Mus musculus
gactgtgttcacctccggcagcagt

SEQ ID NO: 463702 - DNA, 25 bp, Mus musculus
gactgtgttcacgtccggcagcagt

SEQ ID NO: 463703 - DNA, 25 bp, Mus musculus
gactgtgttcactcctgagggagat

SEQ ID NO: 463704 - DNA, 25 bp, Mus musculus
gactgtgttcatctttaactgttgt

SEQ ID NO: 463705 - DNA, 25 bp, Mus musculus
gactgtgttcatgtttaactgttgt

SEQ ID NO: 463706 - DNA, 25 bp, Mus musculus
gactgtgttccccaagtcccctgtg

SEQ ID NO: 463707 - DNA, 25 bp, Mus musculus
gactgtgttcccgaagtcccctgtg

SEQ ID NO: 463708 - DNA, 25 bp, Mus musculus
gactgtgttcctacttccaaattag

SEQ ID NO: 463709 - DNA, 25 bp, Mus musculus
gactgtgttccttcttccaaattag

SEQ ID NO: 463710 - DNA, 25 bp, Mus musculus
gactgtgttctgaggttattaatgc

SEQ ID NO: 463711 - DNA, 25 bp, Mus musculus
gactgtgttctgatcaacgctcaaa

SEQ ID NO: 463712 - DNA, 25 bp, Mus musculus
gactgtgttctgtggttattaatgc

SEQ ID NO: 463713 - DNA, 25 bp, Mus musculus
gactgtgttctgttcaacgctcaaa

SEQ ID NO: 463714 - DNA, 25 bp, Mus musculus
gactgtgtttcaatccttggcaaaa

SEQ ID NO: 463715 - DNA, 25 bp, Mus musculus
gactgtgtttcacaaaggaccctgg

SEQ ID NO: 463716 - DNA, 25 bp, Mus musculus
gactgtgtttcagaaaggaccctgg

SEQ ID NO: 463717 - DNA, 25 bp, Mus musculus
gactgtgtttcattccttggcaaaa

SEQ ID NO: 463718 - DNA, 25 bp, Mus musculus
gactgtgtttttaactatcattccc

SEQ ID NO: 463719 - DNA, 25 bp, Mus musculus
gactgtgttttttactatcattccc

SEQ ID NO: 463720 - DNA, 25 bp, Mus musculus
gactgttaaatgcatgctggctatc

SEQ ID NO: 463721 - DNA, 25 bp, Mus musculus
gactgttaaatggatgctggctatc

SEQ ID NO: 463722 - DNA, 25 bp, Mus musculus
gactgttaactcaggacattggttt

SEQ ID NO: 463723 - DNA, 25 bp, Mus musculus
gactgttaactctggacattggttt

SEQ ID NO: 463724 - DNA, 25 bp, Mus musculus
gactgttaagtcagaattctgattt

SEQ ID NO: 463725 - DNA, 25 bp, Mus musculus
gactgttaagtctgaattctgattt

SEQ ID NO: 463726 - DNA, 25 bp, Mus musculus
gactgttaatatactaagtgcctct

SEQ ID NO: 463727 - DNA, 25 bp, Mus musculus
gactgttaatattctaagtgcctct

SEQ ID NO: 463728 - DNA, 25 bp, Mus musculus
gactgttacactcttcaatatgaaa

SEQ ID NO: 463729 - DNA, 25 bp, Mus musculus
gactgttacactgttcaatatgaaa

SEQ ID NO: 463730 - DNA, 25 bp, Mus musculus
gactgttacatgcactttcttggaa

SEQ ID NO: 463731 - DNA, 25 bp, Mus musculus
gactgttacatggactttcttggaa

SEQ ID NO: 463732 - DNA, 25 bp, Mus musculus
gactgttaccttacaggattccttt

SEQ ID NO: 463733 - DNA, 25 bp, Mus musculus
gactgttacctttcaggattccttt

SEQ ID NO: 463734 - DNA, 25 bp, Mus musculus
gactgttacggtcgtggactttcca

SEQ ID NO: 463735 - DNA, 25 bp, Mus musculus
gactgttacggtggtggactttcca

SEQ ID NO: 463736 - DNA, 25 bp, Mus musculus
gactgttactggatcagccgatgct

SEQ ID NO: 463737 - DNA, 25 bp, Mus musculus
gactgttactggttcagccgatgct

SEQ ID NO: 463738 - DNA, 25 bp, Mus musculus
gactgttacttaactaatggagggt

SEQ ID NO: 463739 - DNA, 25 bp, Mus musculus
gactgttacttatctaatggagggt

SEQ ID NO: 463740 - DNA, 25 bp, Mus musculus
gactgttagcaaccacttgacccaa

SEQ ID NO: 463741 - DNA, 25 bp, Mus musculus
gactgttagcaagcacttgacccaa

SEQ ID NO: 463742 - DNA, 25 bp, Mus musculus
gactgttagcagagtggccagttca

SEQ ID NO: 463743 - DNA, 25 bp, Mus musculus
gactgttagcagtgtggccagttca

SEQ ID NO: 463744 - DNA, 25 bp, Mus musculus
gactgttagcatcaagttctgggca

SEQ ID NO: 463745 - DNA, 25 bp, Mus musculus
gactgttagcatgaagttctgggca

SEQ ID NO: 463746 - DNA, 25 bp, Mus musculus
gactgttagctgaaggtagatcaaa

SEQ ID NO: 463747 - DNA, 25 bp, Mus musculus
gactgttagctgtaggtagatcaaa

SEQ ID NO: 463748 - DNA, 25 bp, Mus musculus
gactgttaggccatcttagatttat

SEQ ID NO: 463749 - DNA, 25 bp, Mus musculus
gactgttaggccttcttagatttat

SEQ ID NO: 463750 - DNA, 25 bp, Mus musculus
gactgttagggtcaatgtctgctag

SEQ ID NO: 463751 - DNA, 25 bp, Mus musculus
gactgttagggtgaatgtctgctag

SEQ ID NO: 463752 - DNA, 25 bp, Mus musculus
gactgttatcacaattaagctgtat

SEQ ID NO: 463753 - DNA, 25 bp, Mus musculus
gactgttatcactattaagctgtat

SEQ ID NO: 463754 - DNA, 25 bp, Mus musculus
gactgttatggacaccaggcacata

SEQ ID NO: 463755 - DNA, 25 bp, Mus musculus
gactgttatggagaccaggcacata

SEQ ID NO: 463756 - DNA, 25 bp, Mus musculus
gactgttcaaccacttacatgtcag

SEQ ID NO: 463757 - DNA, 25 bp, Mus musculus
gactgttcaacctcttacatgtcag

SEQ ID NO: 463758 - DNA, 25 bp, Mus musculus
gactgttcaattaattgttgcttaa

SEQ ID NO: 463759 - DNA, 25 bp, Mus musculus
gactgttcaatttattgttgcttaa

SEQ ID NO: 463760 - DNA, 25 bp, Mus musculus
gactgttcactgactttctttgtat

SEQ ID NO: 463761 - DNA, 25 bp, Mus musculus
gactgttcactgtctttctttgtat

SEQ ID NO: 463762 - DNA, 25 bp, Mus musculus
gactgttcagaacctcatagtgact

SEQ ID NO: 463763 - DNA, 25 bp, Mus musculus
gactgttcagaagctcatagtgact

SEQ ID NO: 463764 - DNA, 25 bp, Mus musculus
gactgttcaggccaagtagaacccc

SEQ ID NO: 463765 - DNA, 25 bp, Mus musculus
gactgttcaggcgaagtagaacccc

SEQ ID NO: 463766 - DNA, 25 bp, Mus musculus
gactgttccaagagcatgactgcat

SEQ ID NO: 463767 - DNA, 25 bp, Mus musculus
gactgttccaagtgcatgactgcat

SEQ ID NO: 463768 - DNA, 25 bp, Mus musculus
gactgttccaatatcaccaatatgc

SEQ ID NO: 463769 - DNA, 25 bp, Mus musculus
gactgttccaatttcaccaatatgc

SEQ ID NO: 463770 - DNA, 25 bp, Mus musculus
gactgttccacccttttctgcatat

SEQ ID NO: 463771 - DNA, 25 bp, Mus musculus
gactgttccaccgttttctgcatat

SEQ ID NO: 463772 - DNA, 25 bp, Mus musculus
gactgttccagcctccggattcaac

SEQ ID NO: 463773 - DNA, 25 bp, Mus musculus
gactgttccagcgtccggattcaac

SEQ ID NO: 463774 - DNA, 25 bp, Mus musculus
gactgttcccctataaagaccattc

SEQ ID NO: 463775 - DNA, 25 bp, Mus musculus
gactgttcccctttaaagaccattc

SEQ ID NO: 463776 - DNA, 25 bp, Mus musculus
gactgttcctatcaagaagccactt

SEQ ID NO: 463777 - DNA, 25 bp, Mus musculus
gactgttcctatgaagaagccactt

SEQ ID NO: 463778 - DNA, 25 bp, Mus musculus
gactgttcctcaactttgtaaaagt

SEQ ID NO: 463779 - DNA, 25 bp, Mus musculus
gactgttcctcatctttgtaaaagt

SEQ ID NO: 463780 - DNA, 25 bp, Mus musculus
gactgttccttgaaagcacatcatg

SEQ ID NO: 463781 - DNA, 25 bp, Mus musculus
gactgttccttgtaagcacatcatg

SEQ ID NO: 463782 - DNA, 25 bp, Mus musculus
gactgttcgagactgttgctgtgtt

SEQ ID NO: 463783 - DNA, 25 bp, Mus musculus
gactgttcgagagtgttgctgtgtt

SEQ ID NO: 463784 - DNA, 25 bp, Mus musculus
gactgttcggctcctgggtgaccaa

SEQ ID NO: 463785 - DNA, 25 bp, Mus musculus
gactgttcggctgctgggtgaccaa

SEQ ID NO: 463786 - DNA, 25 bp, Mus musculus
gactgttcgtctcctagtgttggaa

SEQ ID NO: 463787 - DNA, 25 bp, Mus musculus
gactgttcgtctgctagtgttggaa

SEQ ID NO: 463788 - DNA, 25 bp, Mus musculus
gactgttctcacatggctatttatt

SEQ ID NO: 463789 - DNA, 25 bp, Mus musculus
gactgttctcacttggctatttatt

SEQ ID NO: 463790 - DNA, 25 bp, Mus musculus
gactgttctctaacttgctgtgtag

SEQ ID NO: 463791 - DNA, 25 bp, Mus musculus
gactgttctctatcttgctgtgtag

SEQ ID NO: 463792 - DNA, 25 bp, Mus musculus
gactgttcttcaaagagcttgccag

SEQ ID NO: 463793 - DNA, 25 bp, Mus musculus
gactgttcttcatagagcttgccag

SEQ ID NO: 463794 - DNA, 25 bp, Mus musculus
gactgttctttaagtggttgggtgt

SEQ ID NO: 463795 - DNA, 25 bp, Mus musculus
gactgttctttatgtggttgggtgt

SEQ ID NO: 463796 - DNA, 25 bp, Mus musculus
gactgttctttcaatgagcttggaa

SEQ ID NO: 463797 - DNA, 25 bp, Mus musculus
gactgttctttctatgagcttggaa

SEQ ID NO: 463798 - DNA, 25 bp, Mus musculus
gactgttgaggtaacctgtgatctc

SEQ ID NO: 463799 - DNA, 25 bp, Mus musculus
gactgttgaggttacctgtgatctc

SEQ ID NO: 463800 - DNA, 25 bp, Mus musculus
gactgttgagtgatcagagcattaa

SEQ ID NO: 463801 - DNA, 25 bp, Mus musculus
gactgttgagtgttcagagcattaa

SEQ ID NO: 463802 - DNA, 25 bp, Mus musculus
gactgttgagttctttccatgatat

SEQ ID NO: 463803 - DNA, 25 bp, Mus musculus
gactgttgagttgtttccatgatat

SEQ ID NO: 463804 - DNA, 25 bp, Mus musculus
gactgttgcaaccacatgcccgtct

SEQ ID NO: 463805 - DNA, 25 bp, Mus musculus
gactgttgcaacgacatgcccgtct

SEQ ID NO: 463806 - DNA, 25 bp, Mus musculus
gactgttgcctcacgtacatacaga

SEQ ID NO: 463807 - DNA, 25 bp, Mus musculus
gactgttgcctctcgtacatacaga

SEQ ID NO: 463808 - DNA, 25 bp, Mus musculus
gactgttgcggtacaaaagcctgat

SEQ ID NO: 463809 - DNA, 25 bp, Mus musculus
gactgttgcggttcaaaagcctgat

SEQ ID NO: 463810 - DNA, 25 bp, Mus musculus
gactgttgcgttccctgtgttgtgt

SEQ ID NO: 463811 - DNA, 25 bp, Mus musculus
gactgttgcgttgcctgtgttgtgt

SEQ ID NO: 463812 - DNA, 25 bp, Mus musculus
gactgttgctcgacattctgaggcg

SEQ ID NO: 463813 - DNA, 25 bp, Mus musculus
gactgttgctcgtcattctgaggcg

SEQ ID NO: 463814 - DNA, 25 bp, Mus musculus
gactgttgggaaacctattttctca

SEQ ID NO: 463815 - DNA, 25 bp, Mus musculus
gactgttgggaatcctattttctca

SEQ ID NO: 463816 - DNA, 25 bp, Mus musculus
gactgttgggagattatgttcctct

SEQ ID NO: 463817 - DNA, 25 bp, Mus musculus
gactgttgggagtttatgttcctct

SEQ ID NO: 463818 - DNA, 25 bp, Mus musculus
gactgttgggatatctctggcaaat

SEQ ID NO: 463819 - DNA, 25 bp, Mus musculus
gactgttgggatttctctggcaaat

SEQ ID NO: 463820 - DNA, 25 bp, Mus musculus
gactgttgggctccaaaaactggaa

SEQ ID NO: 463821 - DNA, 25 bp, Mus musculus
gactgttgggctgcaaaaactggaa

SEQ ID NO: 463822 - DNA, 25 bp, Mus musculus
gactgttggtgcagatgtacctcca

SEQ ID NO: 463823 - DNA, 25 bp, Mus musculus
gactgttggtgctgatgtacctcca

SEQ ID NO: 463824 - DNA, 25 bp, Mus musculus
gactgttgtaacataatgcttctta

SEQ ID NO: 463825 - DNA, 25 bp, Mus musculus
gactgttgtaacttaatgcttctta

SEQ ID NO: 463826 - DNA, 25 bp, Mus musculus
gactgttgtaatcttgtattcattc

SEQ ID NO: 463827 - DNA, 25 bp, Mus musculus
gactgttgtaatgttgtattcattc

SEQ ID NO: 463828 - DNA, 25 bp, Mus musculus
gactgttgtattctccagccaatca

SEQ ID NO: 463829 - DNA, 25 bp, Mus musculus
gactgttgtattgtccagccaatca

SEQ ID NO: 463830 - DNA, 25 bp, Mus musculus
gactgttgtcacattaaacttccca

SEQ ID NO: 463831 - DNA, 25 bp, Mus musculus
gactgttgtcactttaaacttccca

SEQ ID NO: 463832 - DNA, 25 bp, Mus musculus
gactgttgtctaacccatctaggaa

SEQ ID NO: 463833 - DNA, 25 bp, Mus musculus
gactgttgtctatcccatctaggaa

SEQ ID NO: 463834 - DNA, 25 bp, Mus musculus
gactgttgtctgaatcaggtcccca

SEQ ID NO: 463835 - DNA, 25 bp, Mus musculus
gactgttgtctgtatcaggtcccca

SEQ ID NO: 463836 - DNA, 25 bp, Mus musculus
gactgttgtgatacaagctggactt

SEQ ID NO: 463837 - DNA, 25 bp, Mus musculus
gactgttgtgattcaagctggactt

SEQ ID NO: 463838 - DNA, 25 bp, Mus musculus
gactgttgtgggaaggtttcttttg

SEQ ID NO: 463839 - DNA, 25 bp, Mus musculus
gactgttgtgggtaggtttcttttg

SEQ ID NO: 463840 - DNA, 25 bp, Mus musculus
gactgttgttatatccagctcagac

SEQ ID NO: 463841 - DNA, 25 bp, Mus musculus
gactgttgttatttccagctcagac

SEQ ID NO: 463842 - DNA, 25 bp, Mus musculus
gactgtttactgaagcagggcctga

SEQ ID NO: 463843 - DNA, 25 bp, Mus musculus
gactgtttactgcagttactcagga

SEQ ID NO: 463844 - DNA, 25 bp, Mus musculus
gactgtttactgcatgatatacttt

SEQ ID NO: 463845 - DNA, 25 bp, Mus musculus
gactgtttactggagttactcagga

SEQ ID NO: 463846 - DNA, 25 bp, Mus musculus
gactgtttactggatgatatacttt

SEQ ID NO: 463847 - DNA, 25 bp, Mus musculus
gactgtttactgtagcagggcctga

SEQ ID NO: 463848 - DNA, 25 bp, Mus musculus
gactgtttaggtatttccatgttgt

SEQ ID NO: 463849 - DNA, 25 bp, Mus musculus
gactgtttaggtttttccatgttgt

SEQ ID NO: 463850 - DNA, 25 bp, Mus musculus
gactgtttagttctgaagttctcct

SEQ ID NO: 463851 - DNA, 25 bp, Mus musculus
gactgtttagttgtgaagttctcct

SEQ ID NO: 463852 - DNA, 25 bp, Mus musculus
gactgtttatatcacctccaaatcc

SEQ ID NO: 463853 - DNA, 25 bp, Mus musculus
gactgtttatatgacctccaaatcc

SEQ ID NO: 463854 - DNA, 25 bp, Mus musculus
gactgtttatttccacaggtaccga

SEQ ID NO: 463855 - DNA, 25 bp, Mus musculus
gactgtttatttgcacaggtaccga

SEQ ID NO: 463856 - DNA, 25 bp, Mus musculus
gactgtttcacaataaatacccttt

SEQ ID NO: 463857 - DNA, 25 bp, Mus musculus
gactgtttcacacattgattttttg

SEQ ID NO: 463858 - DNA, 25 bp, Mus musculus
gactgtttcacagattgattttttg

SEQ ID NO: 463859 - DNA, 25 bp, Mus musculus
gactgtttcacattaaatacccttt

SEQ ID NO: 463860 - DNA, 25 bp, Mus musculus
gactgtttcaccacatttataataa

SEQ ID NO: 463861 - DNA, 25 bp, Mus musculus
gactgtttcacctcatttataataa

SEQ ID NO: 463862 - DNA, 25 bp, Mus musculus
gactgtttcattacagtgcttatga

SEQ ID NO: 463863 - DNA, 25 bp, Mus musculus
gactgtttcatttcagtgcttatga

SEQ ID NO: 463864 - DNA, 25 bp, Mus musculus
gactgtttccacatttagctggagt

SEQ ID NO: 463865 - DNA, 25 bp, Mus musculus
gactgtttccacttttagctggagt

SEQ ID NO: 463866 - DNA, 25 bp, Mus musculus
gactgtttccagcactcaaatccat

SEQ ID NO: 463867 - DNA, 25 bp, Mus musculus
gactgtttccaggactcaaatccat

SEQ ID NO: 463868 - DNA, 25 bp, Mus musculus
gactgtttccatagtagaagcttcc

SEQ ID NO: 463869 - DNA, 25 bp, Mus musculus
gactgtttccattgtagaagcttcc

SEQ ID NO: 463870 - DNA, 25 bp, Mus musculus
gactgtttccttactatgcagagtt

SEQ ID NO: 463871 - DNA, 25 bp, Mus musculus
gactgtttcctttctatgcagagtt

SEQ ID NO: 463872 - DNA, 25 bp, Mus musculus
gactgtttcgacagagcccggtgaa

SEQ ID NO: 463873 - DNA, 25 bp, Mus musculus
gactgtttcgactgagcccggtgaa

SEQ ID NO: 463874 - DNA, 25 bp, Mus musculus
gactgtttctctcggagggacttta

SEQ ID NO: 463875 - DNA, 25 bp, Mus musculus
gactgtttctctgggagggacttta

SEQ ID NO: 463876 - DNA, 25 bp, Mus musculus
gactgtttcttaacttggagcacaa

SEQ ID NO: 463877 - DNA, 25 bp, Mus musculus
gactgtttcttatcttggagcacaa

SEQ ID NO: 463878 - DNA, 25 bp, Mus musculus
gactgtttcttgcaagtagccgatg

SEQ ID NO: 463879 - DNA, 25 bp, Mus musculus
gactgtttcttggaagtagccgatg

SEQ ID NO: 463880 - DNA, 25 bp, Mus musculus
gactgtttgctcactgtgttgtgtt

SEQ ID NO: 463881 - DNA, 25 bp, Mus musculus
gactgtttgctctctgtgttgtgtt

SEQ ID NO: 463882 - DNA, 25 bp, Mus musculus
gactgtttgctgaagctgtaactac

SEQ ID NO: 463883 - DNA, 25 bp, Mus musculus
gactgtttgctgtagctgtaactac

SEQ ID NO: 463884 - DNA, 25 bp, Mus musculus
gactgtttgcttcgtatagccataa

SEQ ID NO: 463885 - DNA, 25 bp, Mus musculus
gactgtttgcttggtatagccataa

SEQ ID NO: 463886 - DNA, 25 bp, Mus musculus
gactgtttggacaattttagatatt

SEQ ID NO: 463887 - DNA, 25 bp, Mus musculus
gactgtttggactattttagatatt

SEQ ID NO: 463888 - DNA, 25 bp, Mus musculus
gactgtttggttctaacccatccct

SEQ ID NO: 463889 - DNA, 25 bp, Mus musculus
gactgtttggttgtaacccatccct

SEQ ID NO: 463890 - DNA, 25 bp, Mus musculus
gactgtttgtctagatatgactctg

SEQ ID NO: 463891 - DNA, 25 bp, Mus musculus
gactgtttgtcttgatatgactctg

SEQ ID NO: 463892 - DNA, 25 bp, Mus musculus
gactgttttaatcattcacaatatg

SEQ ID NO: 463893 - DNA, 25 bp, Mus musculus
gactgttttaatgattcacaatatg

SEQ ID NO: 463894 - DNA, 25 bp, Mus musculus
gactgttttcagctctttttatatt

SEQ ID NO: 463895 - DNA, 25 bp, Mus musculus
gactgttttcaggtctttttatatt

SEQ ID NO: 463896 - DNA, 25 bp, Mus musculus
gactgttttccaacgctgttgagca

SEQ ID NO: 463897 - DNA, 25 bp, Mus musculus
gactgttttccatcgctgttgagca

SEQ ID NO: 463898 - DNA, 25 bp, Mus musculus
gactgttttcttaggtgtgcacttt

SEQ ID NO: 463899 - DNA, 25 bp, Mus musculus
gactgttttctttggtgtgcacttt

SEQ ID NO: 463900 - DNA, 25 bp, Mus musculus
gactgttttgcccaacgtgcatatg

SEQ ID NO: 463901 - DNA, 25 bp, Mus musculus
gactgttttgccgaacgtgcatatg

SEQ ID NO: 463902 - DNA, 25 bp, Mus musculus
gacttaaagacacttcctgacaaag

SEQ ID NO: 463903 - DNA, 25 bp, Mus musculus
gacttaaagacagttcctgacaaag

SEQ ID NO: 463904 - DNA, 25 bp, Mus musculus
gacttaaagctgacaacctgctagt

SEQ ID NO: 463905 - DNA, 25 bp, Mus musculus
gacttaaagctgtcaacctgctagt

SEQ ID NO: 463906 - DNA, 25 bp, Mus musculus
gacttaaagtctcgatcctgttctc

SEQ ID NO: 463907 - DNA, 25 bp, Mus musculus
gacttaaagtctggatcctgttctc

SEQ ID NO: 463908 - DNA, 25 bp, Mus musculus
gacttaaatacccactctgttttct

SEQ ID NO: 463909 - DNA, 25 bp, Mus musculus
gacttaaataccgactctgttttct

SEQ ID NO: 463910 - DNA, 25 bp, Mus musculus
gacttaaatctgagttgttccccaa

SEQ ID NO: 463911 - DNA, 25 bp, Mus musculus
gacttaaatctgtgttgttccccaa

SEQ ID NO: 463912 - DNA, 25 bp, Mus musculus
gacttaaatgctatgcaatttcccc

SEQ ID NO: 463913 - DNA, 25 bp, Mus musculus
gacttaaatgctttgcaatttcccc

SEQ ID NO: 463914 - DNA, 25 bp, Mus musculus
gacttaaatgtcagcgtggccaaaa

SEQ ID NO: 463915 - DNA, 25 bp, Mus musculus
gacttaaatgtcagggctggagatg

SEQ ID NO: 463916 - DNA, 25 bp, Mus musculus
gacttaaatgtctgcgtggccaaaa

SEQ ID NO: 463917 - DNA, 25 bp, Mus musculus
gacttaaatgtctgggctggagatg

SEQ ID NO: 463918 - DNA, 25 bp, Mus musculus
gacttaaattgcatgtgaccactga

SEQ ID NO: 463919 - DNA, 25 bp, Mus musculus
gacttaaattgcttgtgaccactga

SEQ ID NO: 463920 - DNA, 25 bp, Mus musculus
gacttaacaaagcatgtagtttcat

SEQ ID NO: 463921 - DNA, 25 bp, Mus musculus
gacttaacaaaggatgtagtttcat

SEQ ID NO: 463922 - DNA, 25 bp, Mus musculus
gacttaacaatgcgaaccccttgtg

SEQ ID NO: 463923 - DNA, 25 bp, Mus musculus
gacttaacaatgggaaccccttgtg

SEQ ID NO: 463924 - DNA, 25 bp, Mus musculus
gacttaacaattctccctctctctt

SEQ ID NO: 463925 - DNA, 25 bp, Mus musculus
gacttaacaattgtccctctctctt

SEQ ID NO: 463926 - DNA, 25 bp, Mus musculus
gacttaacacagaatttcgccttga

SEQ ID NO: 463927 - DNA, 25 bp, Mus musculus
gacttaacacagtatttcgccttga

SEQ ID NO: 463928 - DNA, 25 bp, Mus musculus
gacttaaccaaaaccaatcgctgcc

SEQ ID NO: 463929 - DNA, 25 bp, Mus musculus
gacttaaccaaatccaatcgctgcc

SEQ ID NO: 463930 - DNA, 25 bp, Mus musculus
gacttaaccggcatagataccctgg

SEQ ID NO: 463931 - DNA, 25 bp, Mus musculus
gacttaaccggcttagataccctgg

SEQ ID NO: 463932 - DNA, 25 bp, Mus musculus
gacttaactcacagaatctcacacc

SEQ ID NO: 463933 - DNA, 25 bp, Mus musculus
gacttaactcactgaatctcacacc

SEQ ID NO: 463934 - DNA, 25 bp, Mus musculus
gacttaactgccagtattccatgtg

SEQ ID NO: 463935 - DNA, 25 bp, Mus musculus
gacttaactgccatgatgtaataaa

SEQ ID NO: 463936 - DNA, 25 bp, Mus musculus
gacttaactgcctgtattccatgtg

SEQ ID NO: 463937 - DNA, 25 bp, Mus musculus
gacttaactgccttgatgtaataaa

SEQ ID NO: 463938 - DNA, 25 bp, Mus musculus
gacttaactgctattgctacttgat

SEQ ID NO: 463939 - DNA, 25 bp, Mus musculus
gacttaactgcttttgctacttgat

SEQ ID NO: 463940 - DNA, 25 bp, Mus musculus
gacttaactgtcacacatgtctcat

SEQ ID NO: 463941 - DNA, 25 bp, Mus musculus
gacttaactgtctcacatgtctcat

SEQ ID NO: 463942 - DNA, 25 bp, Mus musculus
gacttaactgttcgtgcctgatgtt

SEQ ID NO: 463943 - DNA, 25 bp, Mus musculus
gacttaactgttggtgcctgatgtt

SEQ ID NO: 463944 - DNA, 25 bp, Mus musculus
gacttaacttcaccctttctaagag

SEQ ID NO: 463945 - DNA, 25 bp, Mus musculus
gacttaacttcagcctttctaagag

SEQ ID NO: 463946 - DNA, 25 bp, Mus musculus
gacttaagaatcctacggttgaata

SEQ ID NO: 463947 - DNA, 25 bp, Mus musculus
gacttaagaatcgtacggttgaata

SEQ ID NO: 463948 - DNA, 25 bp, Mus musculus
gacttaagagttacattgtgtgttt

SEQ ID NO: 463949 - DNA, 25 bp, Mus musculus
gacttaagagtttcattgtgtgttt

SEQ ID NO: 463950 - DNA, 25 bp, Mus musculus
gacttaagctatcgaccatcgtgca

SEQ ID NO: 463951 - DNA, 25 bp, Mus musculus
gacttaagctatggaccatcgtgca

SEQ ID NO: 463952 - DNA, 25 bp, Mus musculus
gacttaagctggattttatcaaaat

SEQ ID NO: 463953 - DNA, 25 bp, Mus musculus
gacttaagctggtttttatcaaaat

SEQ ID NO: 463954 - DNA, 25 bp, Mus musculus
gacttaaggattctctgtagctcaa

SEQ ID NO: 463955 - DNA, 25 bp, Mus musculus
gacttaaggattgtctgtagctcaa

SEQ ID NO: 463956 - DNA, 25 bp, Mus musculus
gacttaaggcatagggatcagacac

SEQ ID NO: 463957 - DNA, 25 bp, Mus musculus
gacttaaggcattgggatcagacac

SEQ ID NO: 463958 - DNA, 25 bp, Mus musculus
gacttaagggatcgccttcttgtcc

SEQ ID NO: 463959 - DNA, 25 bp, Mus musculus
gacttaagggatggccttcttgtcc

SEQ ID NO: 463960 - DNA, 25 bp, Mus musculus
gacttaagtgtcacactaaagcatg

SEQ ID NO: 463961 - DNA, 25 bp, Mus musculus
gacttaagtgtctcactaaagcatg

SEQ ID NO: 463962 - DNA, 25 bp, Mus musculus
gacttaagtttgaaatctcaacatg

SEQ ID NO: 463963 - DNA, 25 bp, Mus musculus
gacttaagtttgattctttcctcca

SEQ ID NO: 463964 - DNA, 25 bp, Mus musculus
gacttaagtttgtaatctcaacatg

SEQ ID NO: 463965 - DNA, 25 bp, Mus musculus
gacttaagtttgtttctttcctcca

SEQ ID NO: 463966 - DNA, 25 bp, Mus musculus
gacttaataagcacctccttagtga

SEQ ID NO: 463967 - DNA, 25 bp, Mus musculus
gacttaataagctcctccttagtga

SEQ ID NO: 463968 - DNA, 25 bp, Mus musculus
gacttaatacatcataccgtgttct

SEQ ID NO: 463969 - DNA, 25 bp, Mus musculus
gacttaatacatgataccgtgttct

SEQ ID NO: 463970 - DNA, 25 bp, Mus musculus
gacttaatagatactgcgtgtggta

SEQ ID NO: 463971 - DNA, 25 bp, Mus musculus
gacttaatagattctgcgtgtggta

SEQ ID NO: 463972 - DNA, 25 bp, Mus musculus
gacttaatatctcataccttagggt

SEQ ID NO: 463973 - DNA, 25 bp, Mus musculus
gacttaatatctgataccttagggt

SEQ ID NO: 463974 - DNA, 25 bp, Mus musculus
gacttaatcaaccattcgtctttag

SEQ ID NO: 463975 - DNA, 25 bp, Mus musculus
gacttaatcaacgattcgtctttag

SEQ ID NO: 463976 - DNA, 25 bp, Mus musculus
gacttaatcaatcaacttcagcaca

SEQ ID NO: 463977 - DNA, 25 bp, Mus musculus
gacttaatcaatccccaggtgccaa

SEQ ID NO: 463978 - DNA, 25 bp, Mus musculus
gacttaatcaatgaacttcagcaca

SEQ ID NO: 463979 - DNA, 25 bp, Mus musculus
gacttaatcaatgcccaggtgccaa

SEQ ID NO: 463980 - DNA, 25 bp, Mus musculus
gacttaatgtctcaatgtccttggg

SEQ ID NO: 463981 - DNA, 25 bp, Mus musculus
gacttaatgtctgaatgtccttggg

SEQ ID NO: 463982 - DNA, 25 bp, Mus musculus
gacttaatgtggacatcggccactc

SEQ ID NO: 463983 - DNA, 25 bp, Mus musculus
gacttaatgtggtcatcggccactc

SEQ ID NO: 463984 - DNA, 25 bp, Mus musculus
gacttaattcgaagatagctctctt

SEQ ID NO: 463985 - DNA, 25 bp, Mus musculus
gacttaattcgatgatagctctctt

SEQ ID NO: 463986 - DNA, 25 bp, Mus musculus
gacttaattgggactcaccaggcgc

SEQ ID NO: 463987 - DNA, 25 bp, Mus musculus
gacttaattgggtctcaccaggcgc

SEQ ID NO: 463988 - DNA, 25 bp, Mus musculus
gacttaatttatcttgctgtttaca

SEQ ID NO: 463989 - DNA, 25 bp, Mus musculus
gacttaatttatgttgctgtttaca

SEQ ID NO: 463990 - DNA, 25 bp, Mus musculus
gacttaatttgcaaggtttccttat

SEQ ID NO: 463991 - DNA, 25 bp, Mus musculus
gacttaatttgcattcttacttcct

SEQ ID NO: 463992 - DNA, 25 bp, Mus musculus
gacttaatttgctaggtttccttat

SEQ ID NO: 463993 - DNA, 25 bp, Mus musculus
gacttaatttgctttcttacttcct

SEQ ID NO: 463994 - DNA, 25 bp, Mus musculus
gacttacaatatactctgtcatggc

SEQ ID NO: 463995 - DNA, 25 bp, Mus musculus
gacttacaatattctctgtcatggc

SEQ ID NO: 463996 - DNA, 25 bp, Mus musculus
gacttacactgtcccttgcaatcga

SEQ ID NO: 463997 - DNA, 25 bp, Mus musculus
gacttacactgtgccttgcaatcga

SEQ ID NO: 463998 - DNA, 25 bp, Mus musculus
gacttacagactaagaaccactgtt

SEQ ID NO: 463999 - DNA, 25 bp, Mus musculus
gacttacagacttagaaccactgtt

SEQ ID NO: 464000 - DNA, 25 bp, Mus musculus
gacttacagatcaatcctcaggaga

SEQ ID NO: 464001 - DNA, 25 bp, Mus musculus
gacttacagatctatcctcaggaga

SEQ ID NO: 464002 - DNA, 25 bp, Mus musculus
gacttacagtttaacaatgccctct

SEQ ID NO: 464003 - DNA, 25 bp, Mus musculus
gacttacagttttacaatgccctct

SEQ ID NO: 464004 - DNA, 25 bp, Mus musculus
gacttacatccgctggcaggacttg

SEQ ID NO: 464005 - DNA, 25 bp, Mus musculus
gacttacatccggtggcaggacttg

SEQ ID NO: 464006 - DNA, 25 bp, Mus musculus
gacttacatgttacactctgtcatg

SEQ ID NO: 464007 - DNA, 25 bp, Mus musculus
gacttacatgtttcactctgtcatg

SEQ ID NO: 464008 - DNA, 25 bp, Mus musculus
gacttacattacagcttcagcgtgt

SEQ ID NO: 464009 - DNA, 25 bp, Mus musculus
gacttacattactgcttcagcgtgt

SEQ ID NO: 464010 - DNA, 25 bp, Mus musculus
gacttacattttacccagggctggc

SEQ ID NO: 464011 - DNA, 25 bp, Mus musculus
gacttacatttttcccagggctggc

SEQ ID NO: 464012 - DNA, 25 bp, Mus musculus
gacttaccaccacagaaaatcatac

SEQ ID NO: 464013 - DNA, 25 bp, Mus musculus
gacttaccaccagagaaaatcatac

SEQ ID NO: 464014 - DNA, 25 bp, Mus musculus
gacttacctattctaactccagctt

SEQ ID NO: 464015 - DNA, 25 bp, Mus musculus
gacttacctattgtaactccagctt

SEQ ID NO: 464016 - DNA, 25 bp, Mus musculus
gacttacctcatcctgtggtgatta

SEQ ID NO: 464017 - DNA, 25 bp, Mus musculus
gacttacctcatgctgtggtgatta

SEQ ID NO: 464018 - DNA, 25 bp, Mus musculus
gacttacctgatacttgagcatgac

SEQ ID NO: 464019 - DNA, 25 bp, Mus musculus
gacttacctgattcttgagcatgac

SEQ ID NO: 464020 - DNA, 25 bp, Mus musculus
gacttacctggaatgcttctcttta

SEQ ID NO: 464021 - DNA, 25 bp, Mus musculus
gacttacctggattgcttctcttta

SEQ ID NO: 464022 - DNA, 25 bp, Mus musculus
gacttacctgtcctatggtctgtta

SEQ ID NO: 464023 - DNA, 25 bp, Mus musculus
gacttacctgtcgtatggtctgtta

SEQ ID NO: 464024 - DNA, 25 bp, Mus musculus
gacttaccttgcattagtttctaga

SEQ ID NO: 464025 - DNA, 25 bp, Mus musculus
gacttaccttgctttagtttctaga

SEQ ID NO: 464026 - DNA, 25 bp, Mus musculus
gacttacgacgtcactgtttaataa

SEQ ID NO: 464027 - DNA, 25 bp, Mus musculus
gacttacgacgtgactgtttaataa

SEQ ID NO: 464028 - DNA, 25 bp, Mus musculus
gacttacggtcaacagtattcaatg

SEQ ID NO: 464029 - DNA, 25 bp, Mus musculus
gacttacggtcatcagtattcaatg

SEQ ID NO: 464030 - DNA, 25 bp, Mus musculus
gacttacgtctcaggagtgttaaga

SEQ ID NO: 464031 - DNA, 25 bp, Mus musculus
gacttacgtctccattacaaacatt

SEQ ID NO: 464032 - DNA, 25 bp, Mus musculus
gacttacgtctcgattacaaacatt

SEQ ID NO: 464033 - DNA, 25 bp, Mus musculus
gacttacgtctctggagtgttaaga

SEQ ID NO: 464034 - DNA, 25 bp, Mus musculus
gacttactagcaattacttctgttg

SEQ ID NO: 464035 - DNA, 25 bp, Mus musculus
gacttactagcatttacttctgttg

SEQ ID NO: 464036 - DNA, 25 bp, Mus musculus
gacttactcagcatcatttcttata

SEQ ID NO: 464037 - DNA, 25 bp, Mus musculus
gacttactcagcttcatttcttata

SEQ ID NO: 464038 - DNA, 25 bp, Mus musculus
gacttactcagtctacccatcagta

SEQ ID NO: 464039 - DNA, 25 bp, Mus musculus
gacttactcagtgtacccatcagta

SEQ ID NO: 464040 - DNA, 25 bp, Mus musculus
gacttactgcatattagctgcctgc

SEQ ID NO: 464041 - DNA, 25 bp, Mus musculus
gacttactgcattttagctgcctgc

SEQ ID NO: 464042 - DNA, 25 bp, Mus musculus
gacttactgccacattagctggtga

SEQ ID NO: 464043 - DNA, 25 bp, Mus musculus
gacttactgccagattagctggtga

SEQ ID NO: 464044 - DNA, 25 bp, Mus musculus
gacttacttctaatctatccctaaa

SEQ ID NO: 464045 - DNA, 25 bp, Mus musculus
gacttacttctaccttgatcttatt

SEQ ID NO: 464046 - DNA, 25 bp, Mus musculus
gacttacttctagcttgatcttatt

SEQ ID NO: 464047 - DNA, 25 bp, Mus musculus
gacttacttctattctatccctaaa

SEQ ID NO: 464048 - DNA, 25 bp, Mus musculus
gacttacttctgagagtgcgtttga

SEQ ID NO: 464049 - DNA, 25 bp, Mus musculus
gacttacttctgtgagtgcgtttga

SEQ ID NO: 464050 - DNA, 25 bp, Mus musculus
gacttacttggtagctatgagcagg

SEQ ID NO: 464051 - DNA, 25 bp, Mus musculus
gacttacttggttgctatgagcagg

SEQ ID NO: 464052 - DNA, 25 bp, Mus musculus
gacttacttgtcaacatactcaact

SEQ ID NO: 464053 - DNA, 25 bp, Mus musculus
gacttacttgtctacatactcaact

SEQ ID NO: 464054 - DNA, 25 bp, Mus musculus
gacttacttgtgaatgtacctcacg

SEQ ID NO: 464055 - DNA, 25 bp, Mus musculus
gacttacttgtgtatgtacctcacg

SEQ ID NO: 464056 - DNA, 25 bp, Mus musculus
gacttagaacctctggctgctgtat

SEQ ID NO: 464057 - DNA, 25 bp, Mus musculus
gacttagaacctgtggctgctgtat

SEQ ID NO: 464058 - DNA, 25 bp, Mus musculus
gacttagaactgcagctacactgtt

SEQ ID NO: 464059 - DNA, 25 bp, Mus musculus
gacttagaactggagctacactgtt

SEQ ID NO: 464060 - DNA, 25 bp, Mus musculus
gacttagaagcaacctgatgtaact

SEQ ID NO: 464061 - DNA, 25 bp, Mus musculus
gacttagaagcatcctgatgtaact

SEQ ID NO: 464062 - DNA, 25 bp, Mus musculus
gacttagaagtcactctaggctggg

SEQ ID NO: 464063 - DNA, 25 bp, Mus musculus
gacttagaagtctctctaggctggg

SEQ ID NO: 464064 - DNA, 25 bp, Mus musculus
gacttagaagttcgcaccttgatga

SEQ ID NO: 464065 - DNA, 25 bp, Mus musculus
gacttagaagttggcaccttgatga

SEQ ID NO: 464066 - DNA, 25 bp, Mus musculus
gacttagacaagacgattgctacat

SEQ ID NO: 464067 - DNA, 25 bp, Mus musculus
gacttagacaagtcgattgctacat

SEQ ID NO: 464068 - DNA, 25 bp, Mus musculus
gacttagacagaaaggccatcccac

SEQ ID NO: 464069 - DNA, 25 bp, Mus musculus
gacttagacagataggccatcccac

SEQ ID NO: 464070 - DNA, 25 bp, Mus musculus
gacttagacatgactttccctcata

SEQ ID NO: 464071 - DNA, 25 bp, Mus musculus
gacttagacatgtctttccctcata

SEQ ID NO: 464072 - DNA, 25 bp, Mus musculus
gacttagactatacaatgcttgcaa

SEQ ID NO: 464073 - DNA, 25 bp, Mus musculus
gacttagactattcaatgcttgcaa

SEQ ID NO: 464074 - DNA, 25 bp, Mus musculus
gacttagactctcaccgatggtgga

SEQ ID NO: 464075 - DNA, 25 bp, Mus musculus
gacttagactctgaccgatggtgga

SEQ ID NO: 464076 - DNA, 25 bp, Mus musculus
gacttagagcatactcatccggtga

SEQ ID NO: 464077 - DNA, 25 bp, Mus musculus
gacttagagcattctcatccggtga

SEQ ID NO: 464078 - DNA, 25 bp, Mus musculus
gacttagagcctatatattcatgcc

SEQ ID NO: 464079 - DNA, 25 bp, Mus musculus
gacttagagcctttatattcatgcc

SEQ ID NO: 464080 - DNA, 25 bp, Mus musculus
gacttagaggccaggatcttccatt

SEQ ID NO: 464081 - DNA, 25 bp, Mus musculus
gacttagaggcctggatcttccatt

SEQ ID NO: 464082 - DNA, 25 bp, Mus musculus
gacttagagggccaaaccaaccctg

SEQ ID NO: 464083 - DNA, 25 bp, Mus musculus
gacttagagggcgaaaccaaccctg

SEQ ID NO: 464084 - DNA, 25 bp, Mus musculus
gacttagagggtcagctcagctcaa

SEQ ID NO: 464085 - DNA, 25 bp, Mus musculus
gacttagagggtgagctcagctcaa

SEQ ID NO: 464086 - DNA, 25 bp, Mus musculus
gacttagatgatatgaacttcttta

SEQ ID NO: 464087 - DNA, 25 bp, Mus musculus
gacttagatgatttgaacttcttta

SEQ ID NO: 464088 - DNA, 25 bp, Mus musculus
gacttagatggtctctaaccttgtc

SEQ ID NO: 464089 - DNA, 25 bp, Mus musculus
gacttagatggtgtctaaccttgtc

SEQ ID NO: 464090 - DNA, 25 bp, Mus musculus
gacttagcacctatttctacacaag

SEQ ID NO: 464091 - DNA, 25 bp, Mus musculus
gacttagcacctttttctacacaag

SEQ ID NO: 464092 - DNA, 25 bp, Mus musculus
gacttagcagcacaaccttttggtt

SEQ ID NO: 464093 - DNA, 25 bp, Mus musculus
gacttagcagcagaaccttttggtt

SEQ ID NO: 464094 - DNA, 25 bp, Mus musculus
gacttagcatatacttgttaccatt

SEQ ID NO: 464095 - DNA, 25 bp, Mus musculus
gacttagcatattcttgttaccatt

SEQ ID NO: 464096 - DNA, 25 bp, Mus musculus
gacttagccacccacacaaatcatg

SEQ ID NO: 464097 - DNA, 25 bp, Mus musculus
gacttagccaccgacacaaatcatg

SEQ ID NO: 464098 - DNA, 25 bp, Mus musculus
gacttagcggccagaacaattttat

SEQ ID NO: 464099 - DNA, 25 bp, Mus musculus
gacttagcggcctgaacaattttat

SEQ ID NO: 464100 - DNA, 25 bp, Mus musculus
gacttagctacaaccatgtttgaag

SEQ ID NO: 464101 - DNA, 25 bp, Mus musculus
gacttagctacatccatgtttgaag

SEQ ID NO: 464102 - DNA, 25 bp, Mus musculus
gacttagctgtcatacttgtccagt

SEQ ID NO: 464103 - DNA, 25 bp, Mus musculus
gacttagctgtcttacttgtccagt

SEQ ID NO: 464104 - DNA, 25 bp, Mus musculus
gacttagctgtgatgatccctggca

SEQ ID NO: 464105 - DNA, 25 bp, Mus musculus
gacttagctgtgttgatccctggca

SEQ ID NO: 464106 - DNA, 25 bp, Mus musculus
gacttagctttgattcctgtgtgcg

SEQ ID NO: 464107 - DNA, 25 bp, Mus musculus
gacttagctttgtttcctgtgtgcg

SEQ ID NO: 464108 - DNA, 25 bp, Mus musculus
gacttaggaagtctcgtctctccag

SEQ ID NO: 464109 - DNA, 25 bp, Mus musculus
gacttaggaagtgtcgtctctccag

SEQ ID NO: 464110 - DNA, 25 bp, Mus musculus
gacttaggacggacattccaagaac

SEQ ID NO: 464111 - DNA, 25 bp, Mus musculus
gacttaggacggtcattccaagaac

SEQ ID NO: 464112 - DNA, 25 bp, Mus musculus
gacttaggactcatcatgggcacat

SEQ ID NO: 464113 - DNA, 25 bp, Mus musculus
gacttaggactcttcatgggcacat

SEQ ID NO: 464114 - DNA, 25 bp, Mus musculus
gacttaggctcacttggtaaccttg

SEQ ID NO: 464115 - DNA, 25 bp, Mus musculus
gacttaggctcagttggtaaccttg

SEQ ID NO: 464116 - DNA, 25 bp, Mus musculus
gacttagggctgagcctgtttggac

SEQ ID NO: 464117 - DNA, 25 bp, Mus musculus
gacttagggctgtgcctgtttggac

SEQ ID NO: 464118 - DNA, 25 bp, Mus musculus
gacttaggtcaaaccggttcacgct

SEQ ID NO: 464119 - DNA, 25 bp, Mus musculus
gacttaggtcaatccggttcacgct

SEQ ID NO: 464120 - DNA, 25 bp, Mus musculus
gacttagtagcgctaactgcaacag

SEQ ID NO: 464121 - DNA, 25 bp, Mus musculus
gacttagtagcggtaactgcaacag

SEQ ID NO: 464122 - DNA, 25 bp, Mus musculus
gacttagtagtcagtatgatgccaa

SEQ ID NO: 464123 - DNA, 25 bp, Mus musculus
gacttagtagtctgtatgatgccaa

SEQ ID NO: 464124 - DNA, 25 bp, Mus musculus
gacttagtatgtagctcactcctta

SEQ ID NO: 464125 - DNA, 25 bp, Mus musculus
gacttagtatgttgctcactcctta

SEQ ID NO: 464126 - DNA, 25 bp, Mus musculus
gacttagtattcagttccaaatgag

SEQ ID NO: 464127 - DNA, 25 bp, Mus musculus
gacttagtattccagctgtatcatt

SEQ ID NO: 464128 - DNA, 25 bp, Mus musculus
gacttagtattcgagctgtatcatt

SEQ ID NO: 464129 - DNA, 25 bp, Mus musculus
gacttagtattctgttccaaatgag

SEQ ID NO: 464130 - DNA, 25 bp, Mus musculus
gacttagtcatcactattggtcaca

SEQ ID NO: 464131 - DNA, 25 bp, Mus musculus
gacttagtcatctctattggtcaca

SEQ ID NO: 464132 - DNA, 25 bp, Mus musculus
gacttagtcattagtggctttcact

SEQ ID NO: 464133 - DNA, 25 bp, Mus musculus
gacttagtcatttgtggctttcact

SEQ ID NO: 464134 - DNA, 25 bp, Mus musculus
gacttagtctgtaatctgtcacaca

SEQ ID NO: 464135 - DNA, 25 bp, Mus musculus
gacttagtctgttatctgtcacaca

SEQ ID NO: 464136 - DNA, 25 bp, Mus musculus
gacttagtggctatgcatcatactc

SEQ ID NO: 464137 - DNA, 25 bp, Mus musculus
gacttagtggctttgcatcatactc

SEQ ID NO: 464138 - DNA, 25 bp, Mus musculus
gacttagttaccatcctgtttgact

SEQ ID NO: 464139 - DNA, 25 bp, Mus musculus
gacttagttaccttcctgtttgact

SEQ ID NO: 464140 - DNA, 25 bp, Mus musculus
gacttagttattagacgttacattc

SEQ ID NO: 464141 - DNA, 25 bp, Mus musculus
gacttagttatttgacgttacattc

SEQ ID NO: 464142 - DNA, 25 bp, Mus musculus
gacttagttttaagcgtgtcccgct

SEQ ID NO: 464143 - DNA, 25 bp, Mus musculus
gacttagttttatgcgtgtcccgct

SEQ ID NO: 464144 - DNA, 25 bp, Mus musculus
gacttataatttatcaacctccaat

SEQ ID NO: 464145 - DNA, 25 bp, Mus musculus
gacttataatttttcaacctccaat

SEQ ID NO: 464146 - DNA, 25 bp, Mus musculus
gacttataccctactgatctcatta

SEQ ID NO: 464147 - DNA, 25 bp, Mus musculus
gacttatacccttctgatctcatta

SEQ ID NO: 464148 - DNA, 25 bp, Mus musculus
gacttatagagaaacctaagggttt

SEQ ID NO: 464149 - DNA, 25 bp, Mus musculus
gacttatagagatacctaagggttt

SEQ ID NO: 464150 - DNA, 25 bp, Mus musculus
gacttatagtcaactcttcatttgg

SEQ ID NO: 464151 - DNA, 25 bp, Mus musculus
gacttatagtcatctcttcatttgg

SEQ ID NO: 464152 - DNA, 25 bp, Mus musculus
gacttatatgacacttgtgtggata

SEQ ID NO: 464153 - DNA, 25 bp, Mus musculus
gacttatatgactcttgtgtggata

SEQ ID NO: 464154 - DNA, 25 bp, Mus musculus
gacttatcctcacctaaatggcctt

SEQ ID NO: 464155 - DNA, 25 bp, Mus musculus
gacttatcctcagctaaatggcctt

SEQ ID NO: 464156 - DNA, 25 bp, Mus musculus
gacttatctcagacagtttctgtta

SEQ ID NO: 464157 - DNA, 25 bp, Mus musculus
gacttatctcagtcagtttctgtta

SEQ ID NO: 464158 - DNA, 25 bp, Mus musculus
gacttatctctgctcttggcaatga

SEQ ID NO: 464159 - DNA, 25 bp, Mus musculus
gacttatctctggtcttggcaatga

SEQ ID NO: 464160 - DNA, 25 bp, Mus musculus
gacttatctttgaaactaattagga

SEQ ID NO: 464161 - DNA, 25 bp, Mus musculus
gacttatctttgtaactaattagga

SEQ ID NO: 464162 - DNA, 25 bp, Mus musculus
gacttatgaaggactagctttagct

SEQ ID NO: 464163 - DNA, 25 bp, Mus musculus
gacttatgaaggtctagctttagct

SEQ ID NO: 464164 - DNA, 25 bp, Mus musculus
gacttatgaattacccgaatgttga

SEQ ID NO: 464165 - DNA, 25 bp, Mus musculus
gacttatgaatttcccgaatgttga

SEQ ID NO: 464166 - DNA, 25 bp, Mus musculus
gacttatgacaaataccgggccaac

SEQ ID NO: 464167 - DNA, 25 bp, Mus musculus
gacttatgacaattaccgggccaac

SEQ ID NO: 464168 - DNA, 25 bp, Mus musculus
gacttatgagaacccaaaaacatta

SEQ ID NO: 464169 - DNA, 25 bp, Mus musculus
gacttatgagaagccaaaaacatta

SEQ ID NO: 464170 - DNA, 25 bp, Mus musculus
gacttatggcagagacccccaggct

SEQ ID NO: 464171 - DNA, 25 bp, Mus musculus
gacttatggcagtgacccccaggct

SEQ ID NO: 464172 - DNA, 25 bp, Mus musculus
gacttatggcgacgcagctgcctga

SEQ ID NO: 464173 - DNA, 25 bp, Mus musculus
gacttatggcgaggcagctgcctga

SEQ ID NO: 464174 - DNA, 25 bp, Mus musculus
gacttatgggatatcttcagaaaaa

SEQ ID NO: 464175 - DNA, 25 bp, Mus musculus
gacttatgggatttcttcagaaaaa

SEQ ID NO: 464176 - DNA, 25 bp, Mus musculus
gacttatgggctaattttacagaca

SEQ ID NO: 464177 - DNA, 25 bp, Mus musculus
gacttatgggcttattttacagaca

SEQ ID NO: 464178 - DNA, 25 bp, Mus musculus
gacttatggtagatgcccaggtgcc

SEQ ID NO: 464179 - DNA, 25 bp, Mus musculus
gacttatggtagttgcccaggtgcc

SEQ ID NO: 464180 - DNA, 25 bp, Mus musculus
gacttatggtctcaggcgtacccct

SEQ ID NO: 464181 - DNA, 25 bp, Mus musculus
gacttatggtctgaggcgtacccct

SEQ ID NO: 464182 - DNA, 25 bp, Mus musculus
gacttattaagtattcctattttct

SEQ ID NO: 464183 - DNA, 25 bp, Mus musculus
gacttattaagttttcctattttct

SEQ ID NO: 464184 - DNA, 25 bp, Mus musculus
gacttattacagacaccgtgaaacg

SEQ ID NO: 464185 - DNA, 25 bp, Mus musculus
gacttattacagtcaccgtgaaacg

SEQ ID NO: 464186 - DNA, 25 bp, Mus musculus
gacttattcagccatgccaacgttg

SEQ ID NO: 464187 - DNA, 25 bp, Mus musculus
gacttattcagcgatgccaacgttg

SEQ ID NO: 464188 - DNA, 25 bp, Mus musculus
gacttattccacatctacagtcctg

SEQ ID NO: 464189 - DNA, 25 bp, Mus musculus
gacttattccacttctacagtcctg

SEQ ID NO: 464190 - DNA, 25 bp, Mus musculus
gacttattcggtaccacgtcagaaa

SEQ ID NO: 464191 - DNA, 25 bp, Mus musculus
gacttattcggttccacgtcagaaa

SEQ ID NO: 464192 - DNA, 25 bp, Mus musculus
gacttattctcaagatcaacaatag

SEQ ID NO: 464193 - DNA, 25 bp, Mus musculus
gacttattctcatgatcaacaatag

SEQ ID NO: 464194 - DNA, 25 bp, Mus musculus
gacttattctctcattcactagaag

SEQ ID NO: 464195 - DNA, 25 bp, Mus musculus
gacttattctctgattcactagaag

SEQ ID NO: 464196 - DNA, 25 bp, Mus musculus
gacttattgcttccattcagtgtga

SEQ ID NO: 464197 - DNA, 25 bp, Mus musculus
gacttattgcttgcattcagtgtga

SEQ ID NO: 464198 - DNA, 25 bp, Mus musculus
gacttatttatcaggtgctcataga

SEQ ID NO: 464199 - DNA, 25 bp, Mus musculus
gacttatttatcctgctcaaaagct

SEQ ID NO: 464200 - DNA, 25 bp, Mus musculus
gacttatttatcgtgctcaaaagct

SEQ ID NO: 464201 - DNA, 25 bp, Mus musculus
gacttatttatctggtgctcataga

SEQ ID NO: 464202 - DNA, 25 bp, Mus musculus
gacttatttatgaactgcctttatt

SEQ ID NO: 464203 - DNA, 25 bp, Mus musculus
gacttatttatgtactgcctttatt

SEQ ID NO: 464204 - DNA, 25 bp, Mus musculus
gacttatttcctatttcagacttca

SEQ ID NO: 464205 - DNA, 25 bp, Mus musculus
gacttatttcctttttcagacttca

SEQ ID NO: 464206 - DNA, 25 bp, Mus musculus
gacttcaaaaacagtttctcgccct

SEQ ID NO: 464207 - DNA, 25 bp, Mus musculus
gacttcaaaaactgtttctcgccct

SEQ ID NO: 464208 - DNA, 25 bp, Mus musculus
gacttcaaaaggactgcagaatgca

SEQ ID NO: 464209 - DNA, 25 bp, Mus musculus
gacttcaaaaggatctctccgttcc

SEQ ID NO: 464210 - DNA, 25 bp, Mus musculus
gacttcaaaaggtctgcagaatgca

SEQ ID NO: 464211 - DNA, 25 bp, Mus musculus
gacttcaaaaggttctctccgttcc

SEQ ID NO: 464212 - DNA, 25 bp, Mus musculus
gacttcaaacatctgcctttcagtg

SEQ ID NO: 464213 - DNA, 25 bp, Mus musculus
gacttcaaacatgtgcctttcagtg

SEQ ID NO: 464214 - DNA, 25 bp, Mus musculus
gacttcaaagagattcatacccaaa

SEQ ID NO: 464215 - DNA, 25 bp, Mus musculus
gacttcaaagagtttcatacccaaa

SEQ ID NO: 464216 - DNA, 25 bp, Mus musculus
gacttcaaagggaattttctctgca

SEQ ID NO: 464217 - DNA, 25 bp, Mus musculus
gacttcaaagggtattttctctgca

SEQ ID NO: 464218 - DNA, 25 bp, Mus musculus
gacttcaaatagaaactacagccta

SEQ ID NO: 464219 - DNA, 25 bp, Mus musculus
gacttcaaatagaattttccactat

SEQ ID NO: 464220 - DNA, 25 bp, Mus musculus
gacttcaaatagtaactacagccta

SEQ ID NO: 464221 - DNA, 25 bp, Mus musculus
gacttcaaatagtattttccactat

SEQ ID NO: 464222 - DNA, 25 bp, Mus musculus
gacttcaacataatactgataagct

SEQ ID NO: 464223 - DNA, 25 bp, Mus musculus
gacttcaacatacctggcaccaagg

SEQ ID NO: 464224 - DNA, 25 bp, Mus musculus
gacttcaacatagctggcaccaagg

SEQ ID NO: 464225 - DNA, 25 bp, Mus musculus
gacttcaacatattactgataagct

SEQ ID NO: 464226 - DNA, 25 bp, Mus musculus
gacttcaacgtgcagaaccagcagt

SEQ ID NO: 464227 - DNA, 25 bp, Mus musculus
gacttcaacgtggagaaccagcagt

SEQ ID NO: 464228 - DNA, 25 bp, Mus musculus
gacttcaactataactgtggccctc

SEQ ID NO: 464229 - DNA, 25 bp, Mus musculus
gacttcaactattactgtggccctc

SEQ ID NO: 464230 - DNA, 25 bp, Mus musculus
gacttcaactggcacaggaagcatc

SEQ ID NO: 464231 - DNA, 25 bp, Mus musculus
gacttcaactgggacaggaagcatc

SEQ ID NO: 464232 - DNA, 25 bp, Mus musculus
gacttcaactgtcaatcctcttgga

SEQ ID NO: 464233 - DNA, 25 bp, Mus musculus
gacttcaactgtgaatcctcttgga

SEQ ID NO: 464234 - DNA, 25 bp, Mus musculus
gacttcaagaccactctaattaaca

SEQ ID NO: 464235 - DNA, 25 bp, Mus musculus
gacttcaagacctctctaattaaca

SEQ ID NO: 464236 - DNA, 25 bp, Mus musculus
gacttcaagatccatcactctgagg

SEQ ID NO: 464237 - DNA, 25 bp, Mus musculus
gacttcaagatcgatcactctgagg

SEQ ID NO: 464238 - DNA, 25 bp, Mus musculus
gacttcaagcgccagctgcgagata

SEQ ID NO: 464239 - DNA, 25 bp, Mus musculus
gacttcaagcgcgagctgcgagata

SEQ ID NO: 464240 - DNA, 25 bp, Mus musculus
gacttcaaggagaactctgtgttcc

SEQ ID NO: 464241 - DNA, 25 bp, Mus musculus
gacttcaaggagtactctgtgttcc

SEQ ID NO: 464242 - DNA, 25 bp, Mus musculus
gacttcaagtagatgtctcctcacc

SEQ ID NO: 464243 - DNA, 25 bp, Mus musculus
gacttcaagtagttgtctcctcacc

SEQ ID NO: 464244 - DNA, 25 bp, Mus musculus
gacttcaagtgacccagttatctgc

SEQ ID NO: 464245 - DNA, 25 bp, Mus musculus
gacttcaagtgagccagttatctgc

SEQ ID NO: 464246 - DNA, 25 bp, Mus musculus
gacttcaagtttcccatgtacccgc

SEQ ID NO: 464247 - DNA, 25 bp, Mus musculus
gacttcaagtttgccatgtacccgc

SEQ ID NO: 464248 - DNA, 25 bp, Mus musculus
gacttcaatatcatcctataacaca

SEQ ID NO: 464249 - DNA, 25 bp, Mus musculus
gacttcaatatcttcctataacaca

SEQ ID NO: 464250 - DNA, 25 bp, Mus musculus
gacttcaatcacagcgtggaacatt

SEQ ID NO: 464251 - DNA, 25 bp, Mus musculus
gacttcaatcactgcgtggaacatt

SEQ ID NO: 464252 - DNA, 25 bp, Mus musculus
gacttcaattcaatcgatccgttta

SEQ ID NO: 464253 - DNA, 25 bp, Mus musculus
gacttcaattcattcgatccgttta

SEQ ID NO: 464254 - DNA, 25 bp, Mus musculus
gacttcaattttcaggtcgtctgcc

SEQ ID NO: 464255 - DNA, 25 bp, Mus musculus
gacttcaattttgaggtcgtctgcc

SEQ ID NO: 464256 - DNA, 25 bp, Mus musculus
gacttcacagacagcaagcttcttc

SEQ ID NO: 464257 - DNA, 25 bp, Mus musculus
gacttcacagacagccaactgcagg

SEQ ID NO: 464258 - DNA, 25 bp, Mus musculus
gacttcacagactgcaagcttcttc

SEQ ID NO: 464259 - DNA, 25 bp, Mus musculus
gacttcacagactgccaactgcagg

SEQ ID NO: 464260 - DNA, 25 bp, Mus musculus
gacttcacatggaataagctctttg

SEQ ID NO: 464261 - DNA, 25 bp, Mus musculus
gacttcacatggagtcattatcttg

SEQ ID NO: 464262 - DNA, 25 bp, Mus musculus
gacttcacatggtataagctctttg

SEQ ID NO: 464263 - DNA, 25 bp, Mus musculus
gacttcacatggtgtcattatcttg

SEQ ID NO: 464264 - DNA, 25 bp, Mus musculus
gacttcacattaaccatctgacaga

SEQ ID NO: 464265 - DNA, 25 bp, Mus musculus
gacttcacattatccatctgacaga

SEQ ID NO: 464266 - DNA, 25 bp, Mus musculus
gacttcacatttacctatcaccttt

SEQ ID NO: 464267 - DNA, 25 bp, Mus musculus
gacttcacattttcctatcaccttt

SEQ ID NO: 464268 - DNA, 25 bp, Mus musculus
gacttcaccaagaaaggcttcctct

SEQ ID NO: 464269 - DNA, 25 bp, Mus musculus
gacttcaccaagtaaggcttcctct

SEQ ID NO: 464270 - DNA, 25 bp, Mus musculus
gacttcacccaaaccttggtttttg

SEQ ID NO: 464271 - DNA, 25 bp, Mus musculus
gacttcacccaatccttggtttttg

SEQ ID NO: 464272 - DNA, 25 bp, Mus musculus
gacttcaccctgagactcagagata

SEQ ID NO: 464273 - DNA, 25 bp, Mus musculus
gacttcaccctgcacatttctacat

SEQ ID NO: 464274 - DNA, 25 bp, Mus musculus
gacttcaccctggacatttctacat

SEQ ID NO: 464275 - DNA, 25 bp, Mus musculus
gacttcaccctgtgactcagagata

SEQ ID NO: 464276 - DNA, 25 bp, Mus musculus
gacttcacctggcattgcttggcca

SEQ ID NO: 464277 - DNA, 25 bp, Mus musculus
gacttcacctgggattgcttggcca

SEQ ID NO: 464278 - DNA, 25 bp, Mus musculus
gacttcaccttccaaaaactagatg

SEQ ID NO: 464279 - DNA, 25 bp, Mus musculus
gacttcaccttcgaaaaactagatg

SEQ ID NO: 464280 - DNA, 25 bp, Mus musculus
gacttcacgacacgaccagtaaggt

SEQ ID NO: 464281 - DNA, 25 bp, Mus musculus
gacttcacgacaggaccagtaaggt

SEQ ID NO: 464282 - DNA, 25 bp, Mus musculus
gacttcacgactcccagccatgtta

SEQ ID NO: 464283 - DNA, 25 bp, Mus musculus
gacttcacgactgccagccatgtta

SEQ ID NO: 464284 - DNA, 25 bp, Mus musculus
gacttcacgcggatcctgcagatgg

SEQ ID NO: 464285 - DNA, 25 bp, Mus musculus
gacttcacgcggttcctgcagatgg

SEQ ID NO: 464286 - DNA, 25 bp, Mus musculus
gacttcacgggtaactcactggatc

SEQ ID NO: 464287 - DNA, 25 bp, Mus musculus
gacttcacgggttactcactggatc

SEQ ID NO: 464288 - DNA, 25 bp, Mus musculus
gacttcactcaaatgggtttctgcc

SEQ ID NO: 464289 - DNA, 25 bp, Mus musculus
gacttcactcaattgggtttctgcc

SEQ ID NO: 464290 - DNA, 25 bp, Mus musculus
gacttcactctgcatgactagccaa

SEQ ID NO: 464291 - DNA, 25 bp, Mus musculus
gacttcactctggatgactagccaa

SEQ ID NO: 464292 - DNA, 25 bp, Mus musculus
gacttcactgagacaacccgggttt

SEQ ID NO: 464293 - DNA, 25 bp, Mus musculus
gacttcactgagtcaacccgggttt

SEQ ID NO: 464294 - DNA, 25 bp, Mus musculus
gacttcactgatccactttatagca

SEQ ID NO: 464295 - DNA, 25 bp, Mus musculus
gacttcactgatgcactttatagca

SEQ ID NO: 464296 - DNA, 25 bp, Mus musculus
gacttcactgctatgttaagtaaag

SEQ ID NO: 464297 - DNA, 25 bp, Mus musculus
gacttcactgctcataaatctgcct

SEQ ID NO: 464298 - DNA, 25 bp, Mus musculus
gacttcactgctgataaatctgcct

SEQ ID NO: 464299 - DNA, 25 bp, Mus musculus
gacttcactgctttgttaagtaaag

SEQ ID NO: 464300 - DNA, 25 bp, Mus musculus
gacttcactggactctactaggatc

SEQ ID NO: 464301 - DNA, 25 bp, Mus musculus
gacttcactggagtctactaggatc

SEQ ID NO: 464302 - DNA, 25 bp, Mus musculus
gacttcacttctaattagcctgagc

SEQ ID NO: 464303 - DNA, 25 bp, Mus musculus
gacttcacttcttattagcctgagc

SEQ ID NO: 464304 - DNA, 25 bp, Mus musculus
gacttcacttgaagctggaagcatt

SEQ ID NO: 464305 - DNA, 25 bp, Mus musculus
gacttcacttgatgctggaagcatt

SEQ ID NO: 464306 - DNA, 25 bp, Mus musculus
gacttcacttgcatgtttggtttaa

SEQ ID NO: 464307 - DNA, 25 bp, Mus musculus
gacttcacttgcttgtttggtttaa

SEQ ID NO: 464308 - DNA, 25 bp, Mus musculus
gacttcactttaagacctagggtct

SEQ ID NO: 464309 - DNA, 25 bp, Mus musculus
gacttcactttacgacatacttaag

SEQ ID NO: 464310 - DNA, 25 bp, Mus musculus
gacttcactttaggacatacttaag

SEQ ID NO: 464311 - DNA, 25 bp, Mus musculus
gacttcactttatgacctagggtct

SEQ ID NO: 464312 - DNA, 25 bp, Mus musculus
gacttcactttgatgcttgtgtagt

SEQ ID NO: 464313 - DNA, 25 bp, Mus musculus
gacttcactttgttgcttgtgtagt

SEQ ID NO: 464314 - DNA, 25 bp, Mus musculus
gacttcagaataattgggcctcaga

SEQ ID NO: 464315 - DNA, 25 bp, Mus musculus
gacttcagaatatttgggcctcaga

SEQ ID NO: 464316 - DNA, 25 bp, Mus musculus
gacttcagagttagggtacgtgaac

SEQ ID NO: 464317 - DNA, 25 bp, Mus musculus
gacttcagagtttgggtacgtgaac

SEQ ID NO: 464318 - DNA, 25 bp, Mus musculus
gacttcagatccatgtctacaacac

SEQ ID NO: 464319 - DNA, 25 bp, Mus musculus
gacttcagatccttgtctacaacac

SEQ ID NO: 464320 - DNA, 25 bp, Mus musculus
gacttcagcactagcatgggaacct

SEQ ID NO: 464321 - DNA, 25 bp, Mus musculus
gacttcagcacttgcatgggaacct

SEQ ID NO: 464322 - DNA, 25 bp, Mus musculus
gacttcagcagacgactttgcagat

SEQ ID NO: 464323 - DNA, 25 bp, Mus musculus
gacttcagcagaggactttgcagat

SEQ ID NO: 464324 - DNA, 25 bp, Mus musculus
gacttcagcaggcagttgtgaccat

SEQ ID NO: 464325 - DNA, 25 bp, Mus musculus
gacttcagcagggagttgtgaccat

SEQ ID NO: 464326 - DNA, 25 bp, Mus musculus
gacttcagcagtcccttaatcatgt

SEQ ID NO: 464327 - DNA, 25 bp, Mus musculus
gacttcagcagtgccttaatcatgt

SEQ ID NO: 464328 - DNA, 25 bp, Mus musculus
gacttcagcatcatccatgtacata

SEQ ID NO: 464329 - DNA, 25 bp, Mus musculus
gacttcagcatcttccatgtacata

SEQ ID NO: 464330 - DNA, 25 bp, Mus musculus
gacttcagccataatagatcagaaa

SEQ ID NO: 464331 - DNA, 25 bp, Mus musculus
gacttcagccattatagatcagaaa

SEQ ID NO: 464332 - DNA, 25 bp, Mus musculus
gacttcagctcgatgatgcgtctgt

SEQ ID NO: 464333 - DNA, 25 bp, Mus musculus
gacttcagctcgttgatgcgtctgt

SEQ ID NO: 464334 - DNA, 25 bp, Mus musculus
gacttcagctttcaaaatccttctc

SEQ ID NO: 464335 - DNA, 25 bp, Mus musculus
gacttcagctttgaaaatccttctc

SEQ ID NO: 464336 - DNA, 25 bp, Mus musculus
gacttcaggaacatcgttgttcggt

SEQ ID NO: 464337 - DNA, 25 bp, Mus musculus
gacttcaggaacttcgttgttcggt

SEQ ID NO: 464338 - DNA, 25 bp, Mus musculus
gacttcaggcaaagtacagatactt

SEQ ID NO: 464339 - DNA, 25 bp, Mus musculus
gacttcaggcaatgtacagatactt

SEQ ID NO: 464340 - DNA, 25 bp, Mus musculus
gacttcagggaaccttgccatagag

SEQ ID NO: 464341 - DNA, 25 bp, Mus musculus
gacttcagggaagcttgccatagag

SEQ ID NO: 464342 - DNA, 25 bp, Mus musculus
gacttcagggataagcgattttgat

SEQ ID NO: 464343 - DNA, 25 bp, Mus musculus
gacttcagggattagcgattttgat

SEQ ID NO: 464344 - DNA, 25 bp, Mus musculus
gacttcagggtaatgccagggcttg

SEQ ID NO: 464345 - DNA, 25 bp, Mus musculus
gacttcagggtattgccagggcttg

SEQ ID NO: 464346 - DNA, 25 bp, Mus musculus
gacttcaggtagagtctagcctcta

SEQ ID NO: 464347 - DNA, 25 bp, Mus musculus
gacttcaggtagtgtctagcctcta

SEQ ID NO: 464348 - DNA, 25 bp, Mus musculus
gacttcaggtttattctcctgcaat

SEQ ID NO: 464349 - DNA, 25 bp, Mus musculus
gacttcaggttttttctcctgcaat

SEQ ID NO: 464350 - DNA, 25 bp, Mus musculus
gacttcagtggtactttctgtcacc

SEQ ID NO: 464351 - DNA, 25 bp, Mus musculus
gacttcagtggttctttctgtcacc

SEQ ID NO: 464352 - DNA, 25 bp, Mus musculus
gacttcagtgtgcatttctggtccc

SEQ ID NO: 464353 - DNA, 25 bp, Mus musculus
gacttcagtgtggatttctggtccc

SEQ ID NO: 464354 - DNA, 25 bp, Mus musculus
gacttcagtgttagctggtaactca

SEQ ID NO: 464355 - DNA, 25 bp, Mus musculus
gacttcagtgtttgctggtaactca

SEQ ID NO: 464356 - DNA, 25 bp, Mus musculus
gacttcagtttgctacgggtgacta

SEQ ID NO: 464357 - DNA, 25 bp, Mus musculus
gacttcagtttgctttgagatgcgc

SEQ ID NO: 464358 - DNA, 25 bp, Mus musculus
gacttcagtttggtacgggtgacta

SEQ ID NO: 464359 - DNA, 25 bp, Mus musculus
gacttcagtttggtttgagatgcgc

SEQ ID NO: 464360 - DNA, 25 bp, Mus musculus
gacttcatacatagataccattatt

SEQ ID NO: 464361 - DNA, 25 bp, Mus musculus
gacttcatacattgataccattatt

SEQ ID NO: 464362 - DNA, 25 bp, Mus musculus
gacttcatacttaggagcaagctcg

SEQ ID NO: 464363 - DNA, 25 bp, Mus musculus
gacttcatactttggagcaagctcg

SEQ ID NO: 464364 - DNA, 25 bp, Mus musculus
gacttcatcagtaacgagagtgtga

SEQ ID NO: 464365 - DNA, 25 bp, Mus musculus
gacttcatcagtatctgggaccgca

SEQ ID NO: 464366 - DNA, 25 bp, Mus musculus
gacttcatcagttacgagagtgtga

SEQ ID NO: 464367 - DNA, 25 bp, Mus musculus
gacttcatcagtttctgggaccgca

SEQ ID NO: 464368 - DNA, 25 bp, Mus musculus
gacttcatcatgataaagggctgca

SEQ ID NO: 464369 - DNA, 25 bp, Mus musculus
gacttcatcatgttaaagggctgca

SEQ ID NO: 464370 - DNA, 25 bp, Mus musculus
gacttcatccaacagggcatcagat

SEQ ID NO: 464371 - DNA, 25 bp, Mus musculus
gacttcatccaagagggcatcagat

SEQ ID NO: 464372 - DNA, 25 bp, Mus musculus
gacttcatctgaacataaaactgct

SEQ ID NO: 464373 - DNA, 25 bp, Mus musculus
gacttcatctgatcataaaactgct

SEQ ID NO: 464374 - DNA, 25 bp, Mus musculus
gacttcatcttgagagccagcaggt

SEQ ID NO: 464375 - DNA, 25 bp, Mus musculus
gacttcatcttgtgagccagcaggt

SEQ ID NO: 464376 - DNA, 25 bp, Mus musculus
gacttcatgaccatccttagttaga

SEQ ID NO: 464377 - DNA, 25 bp, Mus musculus
gacttcatgaccttccttagttaga

SEQ ID NO: 464378 - DNA, 25 bp, Mus musculus
gacttcatgggactgtccttcagtt

SEQ ID NO: 464379 - DNA, 25 bp, Mus musculus
gacttcatgggagtgtccttcagtt

SEQ ID NO: 464380 - DNA, 25 bp, Mus musculus
gacttcatgtcaacaagcaccggaa

SEQ ID NO: 464381 - DNA, 25 bp, Mus musculus
gacttcatgtcatcaagcaccggaa

SEQ ID NO: 464382 - DNA, 25 bp, Mus musculus
gacttcatgttaatcttgctagttt

SEQ ID NO: 464383 - DNA, 25 bp, Mus musculus
gacttcatgttattcttgctagttt

SEQ ID NO: 464384 - DNA, 25 bp, Mus musculus
gacttcattcaacttgtttccgagg

SEQ ID NO: 464385 - DNA, 25 bp, Mus musculus
gacttcattcaagttgtttccgagg

SEQ ID NO: 464386 - DNA, 25 bp, Mus musculus
gacttcattgggatttatagtggct

SEQ ID NO: 464387 - DNA, 25 bp, Mus musculus
gacttcattgggttttatagtggct

SEQ ID NO: 464388 - DNA, 25 bp, Mus musculus
gacttcattgttacaacccagtttg

SEQ ID NO: 464389 - DNA, 25 bp, Mus musculus
gacttcattgttcgtgctttgaaat

SEQ ID NO: 464390 - DNA, 25 bp, Mus musculus
gacttcattgttggtgctttgaaat

SEQ ID NO: 464391 - DNA, 25 bp, Mus musculus
gacttcattgtttcaacccagtttg

SEQ ID NO: 464392 - DNA, 25 bp, Mus musculus
gacttcatttctaattgcccaatag

SEQ ID NO: 464393 - DNA, 25 bp, Mus musculus
gacttcatttcttattgcccaatag

SEQ ID NO: 464394 - DNA, 25 bp, Mus musculus
gacttcatttgtccatgtccttaag

SEQ ID NO: 464395 - DNA, 25 bp, Mus musculus
gacttcatttgtgcatgtccttaag

SEQ ID NO: 464396 - DNA, 25 bp, Mus musculus
gacttccaagacagttaccatatcc

SEQ ID NO: 464397 - DNA, 25 bp, Mus musculus
gacttccaagactgttaccatatcc

SEQ ID NO: 464398 - DNA, 25 bp, Mus musculus
gacttccaaggcaaaatcaaagctt

SEQ ID NO: 464399 - DNA, 25 bp, Mus musculus
gacttccaaggctaaatcaaagctt

SEQ ID NO: 464400 - DNA, 25 bp, Mus musculus
gacttccacaaacttagctgcatgt

SEQ ID NO: 464401 - DNA, 25 bp, Mus musculus
gacttccacaaagttagctgcatgt

SEQ ID NO: 464402 - DNA, 25 bp, Mus musculus
gacttccacaggcagcatgccaggg

SEQ ID NO: 464403 - DNA, 25 bp, Mus musculus
gacttccacagggagcatgccaggg

SEQ ID NO: 464404 - DNA, 25 bp, Mus musculus
gacttccacatgaaccacacacata

SEQ ID NO: 464405 - DNA, 25 bp, Mus musculus
gacttccacatgtaccacacacata

SEQ ID NO: 464406 - DNA, 25 bp, Mus musculus
gacttccaccttagggcagatgtga

SEQ ID NO: 464407 - DNA, 25 bp, Mus musculus
gacttccacctttgggcagatgtga

SEQ ID NO: 464408 - DNA, 25 bp, Mus musculus
gacttccacttgaaccggccacagg

SEQ ID NO: 464409 - DNA, 25 bp, Mus musculus
gacttccacttgtaccggccacagg

SEQ ID NO: 464410 - DNA, 25 bp, Mus musculus
gacttccagactctgaaagtctcag

SEQ ID NO: 464411 - DNA, 25 bp, Mus musculus
gacttccagactgtgaaagtctcag

SEQ ID NO: 464412 - DNA, 25 bp, Mus musculus
gacttccagcctagaactcagacat

SEQ ID NO: 464413 - DNA, 25 bp, Mus musculus
gacttccagccttgaactcagacat

SEQ ID NO: 464414 - DNA, 25 bp, Mus musculus
gacttccagcttactctgtagtcaa

SEQ ID NO: 464415 - DNA, 25 bp, Mus musculus
gacttccagctttctctgtagtcaa

SEQ ID NO: 464416 - DNA, 25 bp, Mus musculus
gacttccaggatactgtgggagtta

SEQ ID NO: 464417 - DNA, 25 bp, Mus musculus
gacttccaggattctgtgggagtta

SEQ ID NO: 464418 - DNA, 25 bp, Mus musculus
gacttccagggacagcagttcattc

SEQ ID NO: 464419 - DNA, 25 bp, Mus musculus
gacttccagggacctgacatggctg

SEQ ID NO: 464420 - DNA, 25 bp, Mus musculus
gacttccagggagagcagttcattc

SEQ ID NO: 464421 - DNA, 25 bp, Mus musculus
gacttccagggagctgacatggctg

SEQ ID NO: 464422 - DNA, 25 bp, Mus musculus
gacttccagggcataagggctaact

SEQ ID NO: 464423 - DNA, 25 bp, Mus musculus
gacttccagggcttaagggctaact

SEQ ID NO: 464424 - DNA, 25 bp, Mus musculus
gacttccaggtgcagttatgaacca

SEQ ID NO: 464425 - DNA, 25 bp, Mus musculus
gacttccaggtggagttatgaacca

SEQ ID NO: 464426 - DNA, 25 bp, Mus musculus
gacttccaggttacctcaaatccag

SEQ ID NO: 464427 - DNA, 25 bp, Mus musculus
gacttccaggtttcctcaaatccag

SEQ ID NO: 464428 - DNA, 25 bp, Mus musculus
gacttccagtggcattggataggta

SEQ ID NO: 464429 - DNA, 25 bp, Mus musculus
gacttccagtgggattggataggta

SEQ ID NO: 464430 - DNA, 25 bp, Mus musculus
gacttccataggcttttgctcttaa

SEQ ID NO: 464431 - DNA, 25 bp, Mus musculus
gacttccatagggttttgctcttaa

SEQ ID NO: 464432 - DNA, 25 bp, Mus musculus
gacttccatctaattagcctgttca

SEQ ID NO: 464433 - DNA, 25 bp, Mus musculus
gacttccatctatttagcctgttca

SEQ ID NO: 464434 - DNA, 25 bp, Mus musculus
gacttccatgctacagtggcaactg

SEQ ID NO: 464435 - DNA, 25 bp, Mus musculus
gacttccatgcttcagtggcaactg

SEQ ID NO: 464436 - DNA, 25 bp, Mus musculus
gacttccattctcatgttagcacat

SEQ ID NO: 464437 - DNA, 25 bp, Mus musculus
gacttccattctgatgttagcacat

SEQ ID NO: 464438 - DNA, 25 bp, Mus musculus
gacttcccaaacacactggagctcg

SEQ ID NO: 464439 - DNA, 25 bp, Mus musculus
gacttcccaaactcactggagctcg

SEQ ID NO: 464440 - DNA, 25 bp, Mus musculus
gacttcccacagactgcgaggtgga

SEQ ID NO: 464441 - DNA, 25 bp, Mus musculus
gacttcccacagtctgcgaggtgga

SEQ ID NO: 464442 - DNA, 25 bp, Mus musculus
gacttcccacctactttattatgtg

SEQ ID NO: 464443 - DNA, 25 bp, Mus musculus
gacttcccaccttctttattatgtg

SEQ ID NO: 464444 - DNA, 25 bp, Mus musculus
gacttcccacgtcgcttgtgttggt

SEQ ID NO: 464445 - DNA, 25 bp, Mus musculus
gacttcccacgtggcttgtgttggt

SEQ ID NO: 464446 - DNA, 25 bp, Mus musculus
gacttcccagagatggttgccagta

SEQ ID NO: 464447 - DNA, 25 bp, Mus musculus
gacttcccagagttggttgccagta

SEQ ID NO: 464448 - DNA, 25 bp, Mus musculus
gacttcccagctctagaactacatg

SEQ ID NO: 464449 - DNA, 25 bp, Mus musculus
gacttcccagctgtagaactacatg

SEQ ID NO: 464450 - DNA, 25 bp, Mus musculus
gacttcccagtaacaatgcctagag

SEQ ID NO: 464451 - DNA, 25 bp, Mus musculus
gacttcccagtatcaatgcctagag

SEQ ID NO: 464452 - DNA, 25 bp, Mus musculus
gacttcccatggacagagcttgaga

SEQ ID NO: 464453 - DNA, 25 bp, Mus musculus
gacttcccatggcagcatttcactc

SEQ ID NO: 464454 - DNA, 25 bp, Mus musculus
gacttcccatgggagcatttcactc

SEQ ID NO: 464455 - DNA, 25 bp, Mus musculus
gacttcccatggtcagagcttgaga

SEQ ID NO: 464456 - DNA, 25 bp, Mus musculus
gacttcccattgagtcttagttctg

SEQ ID NO: 464457 - DNA, 25 bp, Mus musculus
gacttcccattgtgtcttagttctg

SEQ ID NO: 464458 - DNA, 25 bp, Mus musculus
gacttccccgagaaactgaagagct

SEQ ID NO: 464459 - DNA, 25 bp, Mus musculus
gacttccccgagtaactgaagagct

SEQ ID NO: 464460 - DNA, 25 bp, Mus musculus
gacttcccctgcaggtctaattccc

SEQ ID NO: 464461 - DNA, 25 bp, Mus musculus
gacttcccctgctggtctaattccc

SEQ ID NO: 464462 - DNA, 25 bp, Mus musculus
gacttcccgaatacgaagctgctct

SEQ ID NO: 464463 - DNA, 25 bp, Mus musculus
gacttcccgaattcgaagctgctct

SEQ ID NO: 464464 - DNA, 25 bp, Mus musculus
gacttcccgatgagaccatactatt

SEQ ID NO: 464465 - DNA, 25 bp, Mus musculus
gacttcccgatgtgaccatactatt

SEQ ID NO: 464466 - DNA, 25 bp, Mus musculus
gacttcccgcccagatgaactgtac

SEQ ID NO: 464467 - DNA, 25 bp, Mus musculus
gacttcccgccctgatgaactgtac

SEQ ID NO: 464468 - DNA, 25 bp, Mus musculus
gacttccctactaatcccatgacaa

SEQ ID NO: 464469 - DNA, 25 bp, Mus musculus
gacttccctacttatcccatgacaa

SEQ ID NO: 464470 - DNA, 25 bp, Mus musculus
gacttccctcagagacggactgtta

SEQ ID NO: 464471 - DNA, 25 bp, Mus musculus
gacttccctcagaggatatgattca

SEQ ID NO: 464472 - DNA, 25 bp, Mus musculus
gacttccctcagatgggacgtttta

SEQ ID NO: 464473 - DNA, 25 bp, Mus musculus
gacttccctcagtgacggactgtta

SEQ ID NO: 464474 - DNA, 25 bp, Mus musculus
gacttccctcagtggatatgattca

SEQ ID NO: 464475 - DNA, 25 bp, Mus musculus
gacttccctcagttgggacgtttta

SEQ ID NO: 464476 - DNA, 25 bp, Mus musculus
gacttccctggtcaagattccaaca

SEQ ID NO: 464477 - DNA, 25 bp, Mus musculus
gacttccctggtgaagattccaaca

SEQ ID NO: 464478 - DNA, 25 bp, Mus musculus
gacttcccttctagagcaggtgtag

SEQ ID NO: 464479 - DNA, 25 bp, Mus musculus
gacttcccttcttgagcaggtgtag

SEQ ID NO: 464480 - DNA, 25 bp, Mus musculus
gacttcccttgccatgtttgtgttg

SEQ ID NO: 464481 - DNA, 25 bp, Mus musculus
gacttcccttgcgatgtttgtgttg

SEQ ID NO: 464482 - DNA, 25 bp, Mus musculus
gacttccctttcagtcacaggagga

SEQ ID NO: 464483 - DNA, 25 bp, Mus musculus
gacttccctttctgtcacaggagga

SEQ ID NO: 464484 - DNA, 25 bp, Mus musculus
gacttccgacacagttttagttttg

SEQ ID NO: 464485 - DNA, 25 bp, Mus musculus
gacttccgacactgttttagttttg

SEQ ID NO: 464486 - DNA, 25 bp, Mus musculus
gacttccgacatagatttgacatta

SEQ ID NO: 464487 - DNA, 25 bp, Mus musculus
gacttccgacattgatttgacatta

SEQ ID NO: 464488 - DNA, 25 bp, Mus musculus
gacttccgcaatcaggatatcaaga

SEQ ID NO: 464489 - DNA, 25 bp, Mus musculus
gacttccgcaatgaggatatcaaga

SEQ ID NO: 464490 - DNA, 25 bp, Mus musculus
gacttccgtagactcgtcgatttta

SEQ ID NO: 464491 - DNA, 25 bp, Mus musculus
gacttccgtagagtcgtcgatttta

SEQ ID NO: 464492 - DNA, 25 bp, Mus musculus
gacttccgtggtacagcagcagggt

SEQ ID NO: 464493 - DNA, 25 bp, Mus musculus
gacttccgtggttcagcagcagggt

SEQ ID NO: 464494 - DNA, 25 bp, Mus musculus
gacttccgttatcttctccgggaat

SEQ ID NO: 464495 - DNA, 25 bp, Mus musculus
gacttccgttatgttctccgggaat

SEQ ID NO: 464496 - DNA, 25 bp, Mus musculus
gacttcctacttcacttactctgaa

SEQ ID NO: 464497 - DNA, 25 bp, Mus musculus
gacttcctacttgacttactctgaa

SEQ ID NO: 464498 - DNA, 25 bp, Mus musculus
gacttcctagcaatacaaactcggt

SEQ ID NO: 464499 - DNA, 25 bp, Mus musculus
gacttcctagcattacaaactcggt

SEQ ID NO: 464500 - DNA, 25 bp, Mus musculus
gacttcctatggcaaggacacattt

SEQ ID NO: 464501 - DNA, 25 bp, Mus musculus
gacttcctatgggaaggacacattt

SEQ ID NO: 464502 - DNA, 25 bp, Mus musculus
gacttcctattgagttctctgcaga

SEQ ID NO: 464503 - DNA, 25 bp, Mus musculus
gacttcctattgtgttctctgcaga

SEQ ID NO: 464504 - DNA, 25 bp, Mus musculus
gacttcctcagccactgcaaggtgg

SEQ ID NO: 464505 - DNA, 25 bp, Mus musculus
gacttcctcagcgactgcaaggtgg

SEQ ID NO: 464506 - DNA, 25 bp, Mus musculus
gacttcctcagtattcctggcaaag

SEQ ID NO: 464507 - DNA, 25 bp, Mus musculus
gacttcctcagttttcctggcaaag

SEQ ID NO: 464508 - DNA, 25 bp, Mus musculus
gacttcctcattcgtttccatttga

SEQ ID NO: 464509 - DNA, 25 bp, Mus musculus
gacttcctcattggtttccatttga

SEQ ID NO: 464510 - DNA, 25 bp, Mus musculus
gacttcctccaaaatatacaagtga

SEQ ID NO: 464511 - DNA, 25 bp, Mus musculus
gacttcctccaatatatacaagtga

SEQ ID NO: 464512 - DNA, 25 bp, Mus musculus
gacttcctcgagagagtgctgttag

SEQ ID NO: 464513 - DNA, 25 bp, Mus musculus
gacttcctcgagtgagtgctgttag

SEQ ID NO: 464514 - DNA, 25 bp, Mus musculus
gacttcctcgtcaatgatgtccttg

SEQ ID NO: 464515 - DNA, 25 bp, Mus musculus
gacttcctcgtctatgatgtccttg

SEQ ID NO: 464516 - DNA, 25 bp, Mus musculus
gacttcctctgacactaggcacaca

SEQ ID NO: 464517 - DNA, 25 bp, Mus musculus
gacttcctctgagactaggcacaca

SEQ ID NO: 464518 - DNA, 25 bp, Mus musculus
gacttcctcttcaagaccattaatg

SEQ ID NO: 464519 - DNA, 25 bp, Mus musculus
gacttcctcttctagaccattaatg

SEQ ID NO: 464520 - DNA, 25 bp, Mus musculus
gacttcctgaaaaggcagtcctgta

SEQ ID NO: 464521 - DNA, 25 bp, Mus musculus
gacttcctgaaacctgccacagaga

SEQ ID NO: 464522 - DNA, 25 bp, Mus musculus
gacttcctgaaactgctacagtttt

SEQ ID NO: 464523 - DNA, 25 bp, Mus musculus
gacttcctgaaagctgccacagaga

SEQ ID NO: 464524 - DNA, 25 bp, Mus musculus
gacttcctgaaagtgctacagtttt

SEQ ID NO: 464525 - DNA, 25 bp, Mus musculus
gacttcctgaaatggcagtcctgta

SEQ ID NO: 464526 - DNA, 25 bp, Mus musculus
gacttcctgagaacctgtgctctag

SEQ ID NO: 464527 - DNA, 25 bp, Mus musculus
gacttcctgagatcctgtgctctag

SEQ ID NO: 464528 - DNA, 25 bp, Mus musculus
gacttcctggaaaatgtcgctgaac

SEQ ID NO: 464529 - DNA, 25 bp, Mus musculus
gacttcctggaatatgtcgctgaac

SEQ ID NO: 464530 - DNA, 25 bp, Mus musculus
gacttcctggatagccgggtgccaa

SEQ ID NO: 464531 - DNA, 25 bp, Mus musculus
gacttcctggattgccgggtgccaa

SEQ ID NO: 464532 - DNA, 25 bp, Mus musculus
gacttcctggtaatgatatcatggt

SEQ ID NO: 464533 - DNA, 25 bp, Mus musculus
gacttcctggtattgatatcatggt

SEQ ID NO: 464534 - DNA, 25 bp, Mus musculus
gacttcctgtaaatttagcgacctt

SEQ ID NO: 464535 - DNA, 25 bp, Mus musculus
gacttcctgtaattttagcgacctt

SEQ ID NO: 464536 - DNA, 25 bp, Mus musculus
gacttcctgtgtcaggctgtcataa

SEQ ID NO: 464537 - DNA, 25 bp, Mus musculus
gacttcctgtgtgaggctgtcataa

SEQ ID NO: 464538 - DNA, 25 bp, Mus musculus
gacttcctgttaaccagtcatttga

SEQ ID NO: 464539 - DNA, 25 bp, Mus musculus
gacttcctgttatccagtcatttga

SEQ ID NO: 464540 - DNA, 25 bp, Mus musculus
gacttcctgttgctctacaatcgga

SEQ ID NO: 464541 - DNA, 25 bp, Mus musculus
gacttcctgttggtctacaatcgga

SEQ ID NO: 464542 - DNA, 25 bp, Mus musculus
gacttccttacgacctatcaattag

SEQ ID NO: 464543 - DNA, 25 bp, Mus musculus
gacttccttacgtcctatcaattag

SEQ ID NO: 464544 - DNA, 25 bp, Mus musculus
gacttccttagacttgcagtactgt

SEQ ID NO: 464545 - DNA, 25 bp, Mus musculus
gacttccttagagttgcagtactgt

SEQ ID NO: 464546 - DNA, 25 bp, Mus musculus
gacttccttctaagcagctgtcata

SEQ ID NO: 464547 - DNA, 25 bp, Mus musculus
gacttccttctatgcagctgtcata

SEQ ID NO: 464548 - DNA, 25 bp, Mus musculus
gacttccttcttaggacttttgcat

SEQ ID NO: 464549 - DNA, 25 bp, Mus musculus
gacttccttctttggacttttgcat

SEQ ID NO: 464550 - DNA, 25 bp, Mus musculus
gacttccttgacaatggaccttgtg

SEQ ID NO: 464551 - DNA, 25 bp, Mus musculus
gacttccttgactatggaccttgtg

SEQ ID NO: 464552 - DNA, 25 bp, Mus musculus
gacttccttgggaggtgatgtttgt

SEQ ID NO: 464553 - DNA, 25 bp, Mus musculus
gacttccttgggtggtgatgtttgt

SEQ ID NO: 464554 - DNA, 25 bp, Mus musculus
gacttccttggtcgcatggagtgca

SEQ ID NO: 464555 - DNA, 25 bp, Mus musculus
gacttccttggtggcatggagtgca

SEQ ID NO: 464556 - DNA, 25 bp, Mus musculus
gacttcctttatagctatattccga

SEQ ID NO: 464557 - DNA, 25 bp, Mus musculus
gacttcctttattgctatattccga

SEQ ID NO: 464558 - DNA, 25 bp, Mus musculus
gacttcctttgaaaatcaacagtgg

SEQ ID NO: 464559 - DNA, 25 bp, Mus musculus
gacttcctttgacacccagagctgg

SEQ ID NO: 464560 - DNA, 25 bp, Mus musculus
gacttcctttgagacccagagctgg

SEQ ID NO: 464561 - DNA, 25 bp, Mus musculus
gacttcctttgataatcaacagtgg

SEQ ID NO: 464562 - DNA, 25 bp, Mus musculus
gacttcgaaactcgaggtgacccct

SEQ ID NO: 464563 - DNA, 25 bp, Mus musculus
gacttcgaaactggaggtgacccct

SEQ ID NO: 464564 - DNA, 25 bp, Mus musculus
gacttcgaacctcctgccaagaagg

SEQ ID NO: 464565 - DNA, 25 bp, Mus musculus
gacttcgaacctgctgccaagaagg

SEQ ID NO: 464566 - DNA, 25 bp, Mus musculus
gacttcgaacttcacatcactgtgc

SEQ ID NO: 464567 - DNA, 25 bp, Mus musculus
gacttcgaacttgacatcactgtgc

SEQ ID NO: 464568 - DNA, 25 bp, Mus musculus
gacttcgaagtcaggattttatcta

SEQ ID NO: 464569 - DNA, 25 bp, Mus musculus
gacttcgaagtctggattttatcta

SEQ ID NO: 464570 - DNA, 25 bp, Mus musculus
gacttcgacgccaacaggggccaag

SEQ ID NO: 464571 - DNA, 25 bp, Mus musculus
gacttcgacgcctacaggggccaag

SEQ ID NO: 464572 - DNA, 25 bp, Mus musculus
gacttcgagctgaacttttgtggac

SEQ ID NO: 464573 - DNA, 25 bp, Mus musculus
gacttcgagctgtacttttgtggac

SEQ ID NO: 464574 - DNA, 25 bp, Mus musculus
gacttcgatagtacttctagctaac

SEQ ID NO: 464575 - DNA, 25 bp, Mus musculus
gacttcgatagttcttctagctaac

SEQ ID NO: 464576 - DNA, 25 bp, Mus musculus
gacttcgatcacagtgcagtctgca

SEQ ID NO: 464577 - DNA, 25 bp, Mus musculus
gacttcgatcactgtgcagtctgca

SEQ ID NO: 464578 - DNA, 25 bp, Mus musculus
gacttcgcccatcgagggcactatc

SEQ ID NO: 464579 - DNA, 25 bp, Mus musculus
gacttcgcccatggagggcactatc

SEQ ID NO: 464580 - DNA, 25 bp, Mus musculus
gacttcgcctccctaacaggttaca

SEQ ID NO: 464581 - DNA, 25 bp, Mus musculus
gacttcgcctccgtaacaggttaca

SEQ ID NO: 464582 - DNA, 25 bp, Mus musculus
gacttcgccttaaaagatttccagt

SEQ ID NO: 464583 - DNA, 25 bp, Mus musculus
gacttcgccttataagatttccagt

SEQ ID NO: 464584 - DNA, 25 bp, Mus musculus
gacttcgctcagcaacacctaatgg

SEQ ID NO: 464585 - DNA, 25 bp, Mus musculus
gacttcgctcaggaacacctaatgg

SEQ ID NO: 464586 - DNA, 25 bp, Mus musculus
gacttcgctgacaccttttgaagga

SEQ ID NO: 464587 - DNA, 25 bp, Mus musculus
gacttcgctgactccttttgaagga

SEQ ID NO: 464588 - DNA, 25 bp, Mus musculus
gacttcgctgtcacaacggtaccgg

SEQ ID NO: 464589 - DNA, 25 bp, Mus musculus
gacttcgctgtctcaacggtaccgg

SEQ ID NO: 464590 - DNA, 25 bp, Mus musculus
gacttcggaaagagaaccagatcta

SEQ ID NO: 464591 - DNA, 25 bp, Mus musculus
gacttcggaaagtgaaccagatcta

SEQ ID NO: 464592 - DNA, 25 bp, Mus musculus
gacttcggaagactttacgcacgtg

SEQ ID NO: 464593 - DNA, 25 bp, Mus musculus
gacttcggaagagtttacgcacgtg

SEQ ID NO: 464594 - DNA, 25 bp, Mus musculus
gacttcggatgcatatattcttgat

SEQ ID NO: 464595 - DNA, 25 bp, Mus musculus
gacttcggatgcttatattcttgat

SEQ ID NO: 464596 - DNA, 25 bp, Mus musculus
gacttcggatggaagacattgtgga

SEQ ID NO: 464597 - DNA, 25 bp, Mus musculus
gacttcggatggtagacattgtgga

SEQ ID NO: 464598 - DNA, 25 bp, Mus musculus
gacttcggattgctggagatacctc

SEQ ID NO: 464599 - DNA, 25 bp, Mus musculus
gacttcggattggtggagatacctc

SEQ ID NO: 464600 - DNA, 25 bp, Mus musculus
gacttcggcaatatccaaggcaaaa

SEQ ID NO: 464601 - DNA, 25 bp, Mus musculus
gacttcggcaatttccaaggcaaaa

SEQ ID NO: 464602 - DNA, 25 bp, Mus musculus
gacttcgggtggatcctagctggaa

SEQ ID NO: 464603 - DNA, 25 bp, Mus musculus
gacttcgggtggttcctagctggaa

SEQ ID NO: 464604 - DNA, 25 bp, Mus musculus
gacttcggtattagactctatttgt

SEQ ID NO: 464605 - DNA, 25 bp, Mus musculus
gacttcggtatttgactctatttgt

SEQ ID NO: 464606 - DNA, 25 bp, Mus musculus
gacttcggtgtccagggtagacctc

SEQ ID NO: 464607 - DNA, 25 bp, Mus musculus
gacttcggtgtcgagggtagacctc

SEQ ID NO: 464608 - DNA, 25 bp, Mus musculus
gacttcgtagtaatcacagagcact

SEQ ID NO: 464609 - DNA, 25 bp, Mus musculus
gacttcgtagtattcacagagcact

SEQ ID NO: 464610 - DNA, 25 bp, Mus musculus
gacttcgtgaacatcatcgcgtaca

SEQ ID NO: 464611 - DNA, 25 bp, Mus musculus
gacttcgtgaacttcatcgcgtaca

SEQ ID NO: 464612 - DNA, 25 bp, Mus musculus
gacttcgtgactcgaacaatatgat

SEQ ID NO: 464613 - DNA, 25 bp, Mus musculus
gacttcgtgactggaacaatatgat

SEQ ID NO: 464614 - DNA, 25 bp, Mus musculus
gacttcgtgcagagatggaacatgg

SEQ ID NO: 464615 - DNA, 25 bp, Mus musculus
gacttcgtgcagtgatggaacatgg

SEQ ID NO: 464616 - DNA, 25 bp, Mus musculus
gacttcgtgtacaatgctggaccaa

SEQ ID NO: 464617 - DNA, 25 bp, Mus musculus
gacttcgtgtactatgctggaccaa

SEQ ID NO: 464618 - DNA, 25 bp, Mus musculus
gacttcgttaggacaagttctttgc

SEQ ID NO: 464619 - DNA, 25 bp, Mus musculus
gacttcgttaggtcaagttctttgc

SEQ ID NO: 464620 - DNA, 25 bp, Mus musculus
gacttctaacatacaacaactgctg

SEQ ID NO: 464621 - DNA, 25 bp, Mus musculus
gacttctaacattcaacaactgctg

SEQ ID NO: 464622 - DNA, 25 bp, Mus musculus
gacttctaagatcatccgtgtgtgt

SEQ ID NO: 464623 - DNA, 25 bp, Mus musculus
gacttctaagatgatccgtgtgtgt

SEQ ID NO: 464624 - DNA, 25 bp, Mus musculus
gacttctaagcacaggcaggacccg

SEQ ID NO: 464625 - DNA, 25 bp, Mus musculus
gacttctaagcagaggcaggacccg

SEQ ID NO: 464626 - DNA, 25 bp, Mus musculus
gacttctaagtcctgttaaagttga

SEQ ID NO: 464627 - DNA, 25 bp, Mus musculus
gacttctaagtcgtgttaaagttga

SEQ ID NO: 464628 - DNA, 25 bp, Mus musculus
gacttctacacgagcgctggctgga

SEQ ID NO: 464629 - DNA, 25 bp, Mus musculus
gacttctacacgtgcgctggctgga

SEQ ID NO: 464630 - DNA, 25 bp, Mus musculus
gacttctacactaccagttttttag

SEQ ID NO: 464631 - DNA, 25 bp, Mus musculus
gacttctacacttccagttttttag

SEQ ID NO: 464632 - DNA, 25 bp, Mus musculus
gacttctacagactggttgctaagc

SEQ ID NO: 464633 - DNA, 25 bp, Mus musculus
gacttctacagagtggttgctaagc

SEQ ID NO: 464634 - DNA, 25 bp, Mus musculus
gacttctacatgcatcataagtatg

SEQ ID NO: 464635 - DNA, 25 bp, Mus musculus
gacttctacatggatcataagtatg

SEQ ID NO: 464636 - DNA, 25 bp, Mus musculus
gacttctactatcctggtgccatta

SEQ ID NO: 464637 - DNA, 25 bp, Mus musculus
gacttctactatgctggtgccatta

SEQ ID NO: 464638 - DNA, 25 bp, Mus musculus
gacttctactggattattgttctga

SEQ ID NO: 464639 - DNA, 25 bp, Mus musculus
gacttctactggcacagagcaaacc

SEQ ID NO: 464640 - DNA, 25 bp, Mus musculus
gacttctactgggacagagcaaacc

SEQ ID NO: 464641 - DNA, 25 bp, Mus musculus
gacttctactggtttattgttctga

SEQ ID NO: 464642 - DNA, 25 bp, Mus musculus
gacttctagagaacaaacgtgggtt

SEQ ID NO: 464643 - DNA, 25 bp, Mus musculus
gacttctagagatcaaacgtgggtt

SEQ ID NO: 464644 - DNA, 25 bp, Mus musculus
gacttctagtagacgatccagctga

SEQ ID NO: 464645 - DNA, 25 bp, Mus musculus
gacttctagtagtcgatccagctga

SEQ ID NO: 464646 - DNA, 25 bp, Mus musculus
gacttctagtctatttcatcacagt

SEQ ID NO: 464647 - DNA, 25 bp, Mus musculus
gacttctagtctttttcatcacagt

SEQ ID NO: 464648 - DNA, 25 bp, Mus musculus
gacttctataatctgctcttttcta

SEQ ID NO: 464649 - DNA, 25 bp, Mus musculus
gacttctataatgtgctcttttcta

SEQ ID NO: 464650 - DNA, 25 bp, Mus musculus
gacttctatatgctactggattctt

SEQ ID NO: 464651 - DNA, 25 bp, Mus musculus
gacttctatatggtactggattctt

SEQ ID NO: 464652 - DNA, 25 bp, Mus musculus
gacttctatcacaatttctacatgg

SEQ ID NO: 464653 - DNA, 25 bp, Mus musculus
gacttctatcactatttctacatgg

SEQ ID NO: 464654 - DNA, 25 bp, Mus musculus
gacttctatcccctaacaattacat

SEQ ID NO: 464655 - DNA, 25 bp, Mus musculus
gacttctatcccgtaacaattacat

SEQ ID NO: 464656 - DNA, 25 bp, Mus musculus
gacttctatctgcttgtcctaggga

SEQ ID NO: 464657 - DNA, 25 bp, Mus musculus
gacttctatctggttgtcctaggga

SEQ ID NO: 464658 - DNA, 25 bp, Mus musculus
gacttctatgtcatttcaggctaaa

SEQ ID NO: 464659 - DNA, 25 bp, Mus musculus
gacttctatgtcttttcaggctaaa

SEQ ID NO: 464660 - DNA, 25 bp, Mus musculus
gacttctatgttagccccgggcata

SEQ ID NO: 464661 - DNA, 25 bp, Mus musculus
gacttctatgtttgccccgggcata

SEQ ID NO: 464662 - DNA, 25 bp, Mus musculus
gacttctcaacactaagattcggga

SEQ ID NO: 464663 - DNA, 25 bp, Mus musculus
gacttctcaacagtaagattcggga

SEQ ID NO: 464664 - DNA, 25 bp, Mus musculus
gacttctcaagaagctaactgttgt

SEQ ID NO: 464665 - DNA, 25 bp, Mus musculus
gacttctcaagatgctaactgttgt

SEQ ID NO: 464666 - DNA, 25 bp, Mus musculus
gacttctcaattcatcaaactactg

SEQ ID NO: 464667 - DNA, 25 bp, Mus musculus
gacttctcaattgatcaaactactg

SEQ ID NO: 464668 - DNA, 25 bp, Mus musculus
gacttctcacagctcaatcagttat

SEQ ID NO: 464669 - DNA, 25 bp, Mus musculus
gacttctcacaggtcaatcagttat

SEQ ID NO: 464670 - DNA, 25 bp, Mus musculus
gacttctcagtaaatgctttgtgta

SEQ ID NO: 464671 - DNA, 25 bp, Mus musculus
gacttctcagtatatgctttgtgta

SEQ ID NO: 464672 - DNA, 25 bp, Mus musculus
gacttctcatcgattttgcagtggt

SEQ ID NO: 464673 - DNA, 25 bp, Mus musculus
gacttctcatcgtttttgcagtggt

SEQ ID NO: 464674 - DNA, 25 bp, Mus musculus
gacttctcatgcaaactcacagagg

SEQ ID NO: 464675 - DNA, 25 bp, Mus musculus
gacttctcatgctaactcacagagg

SEQ ID NO: 464676 - DNA, 25 bp, Mus musculus
gacttctccaaaacctgacaaagcc

SEQ ID NO: 464677 - DNA, 25 bp, Mus musculus
gacttctccaaatcctgacaaagcc

SEQ ID NO: 464678 - DNA, 25 bp, Mus musculus
gacttctccagacttgcggaagcaa

SEQ ID NO: 464679 - DNA, 25 bp, Mus musculus
gacttctccagagttgcggaagcaa

SEQ ID NO: 464680 - DNA, 25 bp, Mus musculus
gacttctccaggaaggaaggtctgt

SEQ ID NO: 464681 - DNA, 25 bp, Mus musculus
gacttctccaggtaggaaggtctgt

SEQ ID NO: 464682 - DNA, 25 bp, Mus musculus
gacttctcccatatcttagtagcag

SEQ ID NO: 464683 - DNA, 25 bp, Mus musculus
gacttctcccatctattgtgtggaa

SEQ ID NO: 464684 - DNA, 25 bp, Mus musculus
gacttctcccatgtattgtgtggaa

SEQ ID NO: 464685 - DNA, 25 bp, Mus musculus
gacttctcccatttcttagtagcag

SEQ ID NO: 464686 - DNA, 25 bp, Mus musculus
gacttctccctactaacgaaactat

SEQ ID NO: 464687 - DNA, 25 bp, Mus musculus
gacttctccctagtaacgaaactat

SEQ ID NO: 464688 - DNA, 25 bp, Mus musculus
gacttctccgaaacaaaccacggta

SEQ ID NO: 464689 - DNA, 25 bp, Mus musculus
gacttctccgaatcaaaccacggta

SEQ ID NO: 464690 - DNA, 25 bp, Mus musculus
gacttctcgaatatcaccaaagagg

SEQ ID NO: 464691 - DNA, 25 bp, Mus musculus
gacttctcgaatttcaccaaagagg

SEQ ID NO: 464692 - DNA, 25 bp, Mus musculus
gacttctctaaccttaagctccaag

SEQ ID NO: 464693 - DNA, 25 bp, Mus musculus
gacttctctaacgttaagctccaag

SEQ ID NO: 464694 - DNA, 25 bp, Mus musculus
gacttctctaagatgttctctaccc

SEQ ID NO: 464695 - DNA, 25 bp, Mus musculus
gacttctctaagttgttctctaccc

SEQ ID NO: 464696 - DNA, 25 bp, Mus musculus
gacttctctcacaaggttaatccat

SEQ ID NO: 464697 - DNA, 25 bp, Mus musculus
gacttctctcactaggttaatccat

SEQ ID NO: 464698 - DNA, 25 bp, Mus musculus
gacttctctccaaggtggaccatta

SEQ ID NO: 464699 - DNA, 25 bp, Mus musculus
gacttctctccacagatcatcgtca

SEQ ID NO: 464700 - DNA, 25 bp, Mus musculus
gacttctctccagagatcatcgtca

SEQ ID NO: 464701 - DNA, 25 bp, Mus musculus
gacttctctccatggtggaccatta

SEQ ID NO: 464702 - DNA, 25 bp, Mus musculus
gacttctctgctacgtggtgtggac

SEQ ID NO: 464703 - DNA, 25 bp, Mus musculus
gacttctctgcttcgtggtgtggac

SEQ ID NO: 464704 - DNA, 25 bp, Mus musculus
gacttctctggactttgtcacgtga

SEQ ID NO: 464705 - DNA, 25 bp, Mus musculus
gacttctctggagtttgtcacgtga

SEQ ID NO: 464706 - DNA, 25 bp, Mus musculus
gacttctctgtcacatatggcttgc

SEQ ID NO: 464707 - DNA, 25 bp, Mus musculus
gacttctctgtctcatatggcttgc

SEQ ID NO: 464708 - DNA, 25 bp, Mus musculus
gacttctctgtgacagatgccttga

SEQ ID NO: 464709 - DNA, 25 bp, Mus musculus
gacttctctgtgtcagatgccttga

SEQ ID NO: 464710 - DNA, 25 bp, Mus musculus
gacttctctttaactctcaaggtat

SEQ ID NO: 464711 - DNA, 25 bp, Mus musculus
gacttctctttatctctcaaggtat

SEQ ID NO: 464712 - DNA, 25 bp, Mus musculus
gacttctgaaatcttctgtgtgtgt

SEQ ID NO: 464713 - DNA, 25 bp, Mus musculus
gacttctgaaatgttctgtgtgtgt

SEQ ID NO: 464714 - DNA, 25 bp, Mus musculus
gacttctgaagtctcgtgactcctg

SEQ ID NO: 464715 - DNA, 25 bp, Mus musculus
gacttctgaagtgtcgtgactcctg

SEQ ID NO: 464716 - DNA, 25 bp, Mus musculus
gacttctgaatgctaatcatgtgct

SEQ ID NO: 464717 - DNA, 25 bp, Mus musculus
gacttctgaatggtaatcatgtgct

SEQ ID NO: 464718 - DNA, 25 bp, Mus musculus
gacttctgacagatctgaccttggt

SEQ ID NO: 464719 - DNA, 25 bp, Mus musculus
gacttctgacagttctgaccttggt

SEQ ID NO: 464720 - DNA, 25 bp, Mus musculus
gacttctgagaacactacaccacct

SEQ ID NO: 464721 - DNA, 25 bp, Mus musculus
gacttctgagaagactacaccacct

SEQ ID NO: 464722 - DNA, 25 bp, Mus musculus
gacttctgagacctttcgcatgcat

SEQ ID NO: 464723 - DNA, 25 bp, Mus musculus
gacttctgagacgtttcgcatgcat

SEQ ID NO: 464724 - DNA, 25 bp, Mus musculus
gacttctgagctaaagaccaccata

SEQ ID NO: 464725 - DNA, 25 bp, Mus musculus
gacttctgagcttaagaccaccata

SEQ ID NO: 464726 - DNA, 25 bp, Mus musculus
gacttctgagtcctgttgaaatgaa

SEQ ID NO: 464727 - DNA, 25 bp, Mus musculus
gacttctgagtcgtgttgaaatgaa

SEQ ID NO: 464728 - DNA, 25 bp, Mus musculus
gacttctgatacatccgttctcaaa

SEQ ID NO: 464729 - DNA, 25 bp, Mus musculus
gacttctgatacttccgttctcaaa

SEQ ID NO: 464730 - DNA, 25 bp, Mus musculus
gacttctgatcaacatagctcacag

SEQ ID NO: 464731 - DNA, 25 bp, Mus musculus
gacttctgatcatcatagctcacag

SEQ ID NO: 464732 - DNA, 25 bp, Mus musculus
gacttctgcaagaggtcacctggca

SEQ ID NO: 464733 - DNA, 25 bp, Mus musculus
gacttctgcaagtggtcacctggca

SEQ ID NO: 464734 - DNA, 25 bp, Mus musculus
gacttctgcacgacagcctcgactt

SEQ ID NO: 464735 - DNA, 25 bp, Mus musculus
gacttctgcacgtcagcctcgactt

SEQ ID NO: 464736 - DNA, 25 bp, Mus musculus
gacttctgcctcctaggcaagagac

SEQ ID NO: 464737 - DNA, 25 bp, Mus musculus
gacttctgcctcgtaggcaagagac

SEQ ID NO: 464738 - DNA, 25 bp, Mus musculus
gacttctgctgccatactgaggctt

SEQ ID NO: 464739 - DNA, 25 bp, Mus musculus
gacttctgctgcgatactgaggctt

SEQ ID NO: 464740 - DNA, 25 bp, Mus musculus
gacttctggaacaacgtgcaatatt

SEQ ID NO: 464741 - DNA, 25 bp, Mus musculus
gacttctggaactacgtgcaatatt

SEQ ID NO: 464742 - DNA, 25 bp, Mus musculus
gacttctggactcgccgcagggtac

SEQ ID NO: 464743 - DNA, 25 bp, Mus musculus
gacttctggactggccgcagggtac

SEQ ID NO: 464744 - DNA, 25 bp, Mus musculus
gacttctggattcgcctcaagaggc

SEQ ID NO: 464745 - DNA, 25 bp, Mus musculus
gacttctggattggcctcaagaggc

SEQ ID NO: 464746 - DNA, 25 bp, Mus musculus
gacttctggcctcttgtacttgaac

SEQ ID NO: 464747 - DNA, 25 bp, Mus musculus
gacttctggcctgttgtacttgaac

SEQ ID NO: 464748 - DNA, 25 bp, Mus musculus
gacttctgggaacagtatcagtaaa

SEQ ID NO: 464749 - DNA, 25 bp, Mus musculus
gacttctgggaagagtatcagtaaa

SEQ ID NO: 464750 - DNA, 25 bp, Mus musculus
gacttctggtatatattccttagga

SEQ ID NO: 464751 - DNA, 25 bp, Mus musculus
gacttctggtatttattccttagga

SEQ ID NO: 464752 - DNA, 25 bp, Mus musculus
gacttctggtttctactagtatcta

SEQ ID NO: 464753 - DNA, 25 bp, Mus musculus
gacttctggtttgtactagtatcta

SEQ ID NO: 464754 - DNA, 25 bp, Mus musculus
gacttctgtaccagtatgtgcacca

SEQ ID NO: 464755 - DNA, 25 bp, Mus musculus
gacttctgtacctgtatgtgcacca

SEQ ID NO: 464756 - DNA, 25 bp, Mus musculus
gacttctgtcacaatttggagctta

SEQ ID NO: 464757 - DNA, 25 bp, Mus musculus
gacttctgtcactatttggagctta

SEQ ID NO: 464758 - DNA, 25 bp, Mus musculus
gacttctgtcatcattaggttccac

SEQ ID NO: 464759 - DNA, 25 bp, Mus musculus
gacttctgtcatgattaggttccac

SEQ ID NO: 464760 - DNA, 25 bp, Mus musculus
gacttctgtctgatctgtattgagg

SEQ ID NO: 464761 - DNA, 25 bp, Mus musculus
gacttctgtctgttctgtattgagg

SEQ ID NO: 464762 - DNA, 25 bp, Mus musculus
gacttctgtgaactgacacttaccg

SEQ ID NO: 464763 - DNA, 25 bp, Mus musculus
gacttctgtgaagtgacacttaccg

SEQ ID NO: 464764 - DNA, 25 bp, Mus musculus
gacttctgtgtcaatggactgacct

SEQ ID NO: 464765 - DNA, 25 bp, Mus musculus
gacttctgtgtctatggactgacct

SEQ ID NO: 464766 - DNA, 25 bp, Mus musculus
gacttctgttgtccgaagtgccagt

SEQ ID NO: 464767 - DNA, 25 bp, Mus musculus
gacttctgttgtgcgaagtgccagt

SEQ ID NO: 464768 - DNA, 25 bp, Mus musculus
gacttctgtttaaccctaaactcaa

SEQ ID NO: 464769 - DNA, 25 bp, Mus musculus
gacttctgtttatccctaaactcaa

SEQ ID NO: 464770 - DNA, 25 bp, Mus musculus
gacttcttaacacacatcactcaat

SEQ ID NO: 464771 - DNA, 25 bp, Mus musculus
gacttcttaacagacatcactcaat

SEQ ID NO: 464772 - DNA, 25 bp, Mus musculus
gacttcttaaccatggggagagact

SEQ ID NO: 464773 - DNA, 25 bp, Mus musculus
gacttcttaaccttggggagagact

SEQ ID NO: 464774 - DNA, 25 bp, Mus musculus
gacttcttaactcttgtctcatttt

SEQ ID NO: 464775 - DNA, 25 bp, Mus musculus
gacttcttaactgttgtctcatttt

SEQ ID NO: 464776 - DNA, 25 bp, Mus musculus
gacttcttaatccattcttgctgca

SEQ ID NO: 464777 - DNA, 25 bp, Mus musculus
gacttcttaatcgattcttgctgca

SEQ ID NO: 464778 - DNA, 25 bp, Mus musculus
gacttcttagagctcttctgaacag

SEQ ID NO: 464779 - DNA, 25 bp, Mus musculus
gacttcttagaggtcttctgaacag

SEQ ID NO: 464780 - DNA, 25 bp, Mus musculus
gacttcttattcacagttttgccct

SEQ ID NO: 464781 - DNA, 25 bp, Mus musculus
gacttcttattctcagttttgccct

SEQ ID NO: 464782 - DNA, 25 bp, Mus musculus
gacttcttatttctcacatggtgta

SEQ ID NO: 464783 - DNA, 25 bp, Mus musculus
gacttcttatttgtcacatggtgta

SEQ ID NO: 464784 - DNA, 25 bp, Mus musculus
gacttcttcatacatgtgcattatt

SEQ ID NO: 464785 - DNA, 25 bp, Mus musculus
gacttcttcatagatgtgcattatt

SEQ ID NO: 464786 - DNA, 25 bp, Mus musculus
gacttcttccagagcgtatacatca

SEQ ID NO: 464787 - DNA, 25 bp, Mus musculus
gacttcttccagctatccccttggg

SEQ ID NO: 464788 - DNA, 25 bp, Mus musculus
gacttcttccaggtatccccttggg

SEQ ID NO: 464789 - DNA, 25 bp, Mus musculus
gacttcttccagtgcgtatacatca

SEQ ID NO: 464790 - DNA, 25 bp, Mus musculus
gacttcttccatagtggctagagct

SEQ ID NO: 464791 - DNA, 25 bp, Mus musculus
gacttcttccattgtggctagagct

SEQ ID NO: 464792 - DNA, 25 bp, Mus musculus
gacttcttccgacatttcattgatg

SEQ ID NO: 464793 - DNA, 25 bp, Mus musculus
gacttcttccgagatttcattgatg

SEQ ID NO: 464794 - DNA, 25 bp, Mus musculus
gacttcttcgccaagcgcaagagaa

SEQ ID NO: 464795 - DNA, 25 bp, Mus musculus
gacttcttcgcctagcgcaagagaa

SEQ ID NO: 464796 - DNA, 25 bp, Mus musculus
gacttcttcttgaacagtgtgctgt

SEQ ID NO: 464797 - DNA, 25 bp, Mus musculus
gacttcttcttgtacagtgtgctgt

SEQ ID NO: 464798 - DNA, 25 bp, Mus musculus
gacttcttgactaatattttaacgc

SEQ ID NO: 464799 - DNA, 25 bp, Mus musculus
gacttcttgactatgtgggattcca

SEQ ID NO: 464800 - DNA, 25 bp, Mus musculus
gacttcttgacttatattttaacgc

SEQ ID NO: 464801 - DNA, 25 bp, Mus musculus
gacttcttgactttgtgggattcca

SEQ ID NO: 464802 - DNA, 25 bp, Mus musculus
gacttcttgagtagtactatggttg

SEQ ID NO: 464803 - DNA, 25 bp, Mus musculus
gacttcttgagttgtactatggttg

SEQ ID NO: 464804 - DNA, 25 bp, Mus musculus
gacttcttggaaactaccgagtgct

SEQ ID NO: 464805 - DNA, 25 bp, Mus musculus
gacttcttggaatctaccgagtgct

SEQ ID NO: 464806 - DNA, 25 bp, Mus musculus
gacttcttggagactgaagcacagt

SEQ ID NO: 464807 - DNA, 25 bp, Mus musculus
gacttcttggagcatacctaccatg

SEQ ID NO: 464808 - DNA, 25 bp, Mus musculus
gacttcttggagctgaatcacaagt

SEQ ID NO: 464809 - DNA, 25 bp, Mus musculus
gacttcttggaggatacctaccatg

SEQ ID NO: 464810 - DNA, 25 bp, Mus musculus
gacttcttggaggtgaatcacaagt

SEQ ID NO: 464811 - DNA, 25 bp, Mus musculus
gacttcttggagtctgaagcacagt

SEQ ID NO: 464812 - DNA, 25 bp, Mus musculus
gacttcttggtcatagattaggcaa

SEQ ID NO: 464813 - DNA, 25 bp, Mus musculus
gacttcttggtcttagattaggcaa

SEQ ID NO: 464814 - DNA, 25 bp, Mus musculus
gacttctttaacagtatgtcttgag

SEQ ID NO: 464815 - DNA, 25 bp, Mus musculus
gacttctttaactgtatgtcttgag

SEQ ID NO: 464816 - DNA, 25 bp, Mus musculus
gacttctttagtcgtatccagcacc

SEQ ID NO: 464817 - DNA, 25 bp, Mus musculus
gacttctttagtggtatccagcacc

SEQ ID NO: 464818 - DNA, 25 bp, Mus musculus
gacttctttataagctcaggaaagc

SEQ ID NO: 464819 - DNA, 25 bp, Mus musculus
gacttctttatatgctcaggaaagc

SEQ ID NO: 464820 - DNA, 25 bp, Mus musculus
gacttctttcgcatgaccaggatga

SEQ ID NO: 464821 - DNA, 25 bp, Mus musculus
gacttctttcgcttgaccaggatga

SEQ ID NO: 464822 - DNA, 25 bp, Mus musculus
gacttctttcggctaattgtgtagt

SEQ ID NO: 464823 - DNA, 25 bp, Mus musculus
gacttctttcgggtaattgtgtagt

SEQ ID NO: 464824 - DNA, 25 bp, Mus musculus
gacttctttctcaattccctgaatt

SEQ ID NO: 464825 - DNA, 25 bp, Mus musculus
gacttctttctctattccctgaatt

SEQ ID NO: 464826 - DNA, 25 bp, Mus musculus
gacttctttctgaaaattctctgaa

SEQ ID NO: 464827 - DNA, 25 bp, Mus musculus
gacttctttctgtaaattctctgaa

SEQ ID NO: 464828 - DNA, 25 bp, Mus musculus
gacttctttgaccaccaactatatt

SEQ ID NO: 464829 - DNA, 25 bp, Mus musculus
gacttctttgacgaccaactatatt

SEQ ID NO: 464830 - DNA, 25 bp, Mus musculus
gacttctttgatagtagctctgtgc

SEQ ID NO: 464831 - DNA, 25 bp, Mus musculus
gacttctttgattgtagctctgtgc

SEQ ID NO: 464832 - DNA, 25 bp, Mus musculus
gacttctttggacgtgtggtcatca

SEQ ID NO: 464833 - DNA, 25 bp, Mus musculus
gacttctttggaggtgtggtcatca

SEQ ID NO: 464834 - DNA, 25 bp, Mus musculus
gacttcttttccagtatctgaattg

SEQ ID NO: 464835 - DNA, 25 bp, Mus musculus
gacttcttttcctgtatctgaattg

SEQ ID NO: 464836 - DNA, 25 bp, Mus musculus
gacttctttttactcatcaccaaac

SEQ ID NO: 464837 - DNA, 25 bp, Mus musculus
gacttctttttagtcatcaccaaac

SEQ ID NO: 464838 - DNA, 25 bp, Mus musculus
gacttctttttcctattttatatca

SEQ ID NO: 464839 - DNA, 25 bp, Mus musculus
gacttctttttcgtattttatatca

SEQ ID NO: 464840 - DNA, 25 bp, Mus musculus
gacttgaaaagcacctagcttcggg

SEQ ID NO: 464841 - DNA, 25 bp, Mus musculus
gacttgaaaagcagcggcagcattt

SEQ ID NO: 464842 - DNA, 25 bp, Mus musculus
gacttgaaaagctcctagcttcggg

SEQ ID NO: 464843 - DNA, 25 bp, Mus musculus
gacttgaaaagctgcggcagcattt

SEQ ID NO: 464844 - DNA, 25 bp, Mus musculus
gacttgaaagagaacagttgttgca

SEQ ID NO: 464845 - DNA, 25 bp, Mus musculus
gacttgaaagagtacagttgttgca

SEQ ID NO: 464846 - DNA, 25 bp, Mus musculus
gacttgaaagatcttgtgacacata

SEQ ID NO: 464847 - DNA, 25 bp, Mus musculus
gacttgaaagatgttgtgacacata

SEQ ID NO: 464848 - DNA, 25 bp, Mus musculus
gacttgaaaggtccacatttacttg

SEQ ID NO: 464849 - DNA, 25 bp, Mus musculus
gacttgaaaggtgcacatttacttg

SEQ ID NO: 464850 - DNA, 25 bp, Mus musculus
gacttgaaataaatgacagcagcga

SEQ ID NO: 464851 - DNA, 25 bp, Mus musculus
gacttgaaataattgacagcagcga

SEQ ID NO: 464852 - DNA, 25 bp, Mus musculus
gacttgaaatctcgttgcaccctct

SEQ ID NO: 464853 - DNA, 25 bp, Mus musculus
gacttgaaatctggttgcaccctct

SEQ ID NO: 464854 - DNA, 25 bp, Mus musculus
gacttgaaattacctctgcctagtt

SEQ ID NO: 464855 - DNA, 25 bp, Mus musculus
gacttgaaattagctctgcctagtt

SEQ ID NO: 464856 - DNA, 25 bp, Mus musculus
gacttgaacattattcgggcgctgt

SEQ ID NO: 464857 - DNA, 25 bp, Mus musculus
gacttgaacatttttcgggcgctgt

SEQ ID NO: 464858 - DNA, 25 bp, Mus musculus
gacttgaacccacggtactgacttt

SEQ ID NO: 464859 - DNA, 25 bp, Mus musculus
gacttgaacccagggtactgacttt

SEQ ID NO: 464860 - DNA, 25 bp, Mus musculus
gacttgaactgacctttgtgcttta

SEQ ID NO: 464861 - DNA, 25 bp, Mus musculus
gacttgaactgagctttgtgcttta

SEQ ID NO: 464862 - DNA, 25 bp, Mus musculus
gacttgaacttcaactgcatattgt

SEQ ID NO: 464863 - DNA, 25 bp, Mus musculus
gacttgaacttctactgcatattgt

SEQ ID NO: 464864 - DNA, 25 bp, Mus musculus
gacttgaactttaagagatccgtat

SEQ ID NO: 464865 - DNA, 25 bp, Mus musculus
gacttgaacttttagagatccgtat

SEQ ID NO: 464866 - DNA, 25 bp, Mus musculus
gacttgaagaggagttggtcccctg

SEQ ID NO: 464867 - DNA, 25 bp, Mus musculus
gacttgaagaggtgttggtcccctg

SEQ ID NO: 464868 - DNA, 25 bp, Mus musculus
gacttgaaggttcccgttttgcaat

SEQ ID NO: 464869 - DNA, 25 bp, Mus musculus
gacttgaaggttgccgttttgcaat

SEQ ID NO: 464870 - DNA, 25 bp, Mus musculus
gacttgaagtcaccttgctgtatca

SEQ ID NO: 464871 - DNA, 25 bp, Mus musculus
gacttgaagtcagcttgctgtatca

SEQ ID NO: 464872 - DNA, 25 bp, Mus musculus
gacttgaatcatcacaatacatggc

SEQ ID NO: 464873 - DNA, 25 bp, Mus musculus
gacttgaatcatgacaatacatggc

SEQ ID NO: 464874 - DNA, 25 bp, Mus musculus
gacttgaattccaacatcttttgct

SEQ ID NO: 464875 - DNA, 25 bp, Mus musculus
gacttgaattcctacatcttttgct

SEQ ID NO: 464876 - DNA, 25 bp, Mus musculus
gacttgaatttccataaaccttgga

SEQ ID NO: 464877 - DNA, 25 bp, Mus musculus
gacttgaatttcgataaaccttgga

SEQ ID NO: 464878 - DNA, 25 bp, Mus musculus
gacttgacaatacgtacctttcagt

SEQ ID NO: 464879 - DNA, 25 bp, Mus musculus
gacttgacaataggtacctttcagt

SEQ ID NO: 464880 - DNA, 25 bp, Mus musculus
gacttgacacaacgcgggacttttg

SEQ ID NO: 464881 - DNA, 25 bp, Mus musculus
gacttgacacaaggcgggacttttg

SEQ ID NO: 464882 - DNA, 25 bp, Mus musculus
gacttgacacttccactacaaatca

SEQ ID NO: 464883 - DNA, 25 bp, Mus musculus
gacttgacacttgcactacaaatca

SEQ ID NO: 464884 - DNA, 25 bp, Mus musculus
gacttgacagagctttctcctggtt

SEQ ID NO: 464885 - DNA, 25 bp, Mus musculus
gacttgacagaggtttctcctggtt

SEQ ID NO: 464886 - DNA, 25 bp, Mus musculus
gacttgaccatccaaagctcatcag

SEQ ID NO: 464887 - DNA, 25 bp, Mus musculus
gacttgaccatcgaaagctcatcag

SEQ ID NO: 464888 - DNA, 25 bp, Mus musculus
gacttgaccattactatcgtaagtt

SEQ ID NO: 464889 - DNA, 25 bp, Mus musculus
gacttgaccatttctatcgtaagtt

SEQ ID NO: 464890 - DNA, 25 bp, Mus musculus
gacttgacggttaggaggagcactt

SEQ ID NO: 464891 - DNA, 25 bp, Mus musculus
gacttgacggtttggaggagcactt

SEQ ID NO: 464892 - DNA, 25 bp, Mus musculus
gacttgactagtctctatgacgtac

SEQ ID NO: 464893 - DNA, 25 bp, Mus musculus
gacttgactagtgtctatgacgtac

SEQ ID NO: 464894 - DNA, 25 bp, Mus musculus
gacttgactatactccaatctcatg

SEQ ID NO: 464895 - DNA, 25 bp, Mus musculus
gacttgactatagtccaatctcatg

SEQ ID NO: 464896 - DNA, 25 bp, Mus musculus
gacttgactctcatcgcagctgagg

SEQ ID NO: 464897 - DNA, 25 bp, Mus musculus
gacttgactctcttcgcagctgagg

SEQ ID NO: 464898 - DNA, 25 bp, Mus musculus
gacttgactgacctgaactccatag

SEQ ID NO: 464899 - DNA, 25 bp, Mus musculus
gacttgactgacgtgaactccatag

SEQ ID NO: 464900 - DNA, 25 bp, Mus musculus
gacttgagaaaccaaatttagaata

SEQ ID NO: 464901 - DNA, 25 bp, Mus musculus
gacttgagaaacgaaatttagaata

SEQ ID NO: 464902 - DNA, 25 bp, Mus musculus
gacttgagcactcttattcctgttt

SEQ ID NO: 464903 - DNA, 25 bp, Mus musculus
gacttgagcactgttattcctgttt

SEQ ID NO: 464904 - DNA, 25 bp, Mus musculus
gacttgagcttgctttctgcacccc

SEQ ID NO: 464905 - DNA, 25 bp, Mus musculus
gacttgagcttggtttctgcacccc

SEQ ID NO: 464906 - DNA, 25 bp, Mus musculus
gacttgaggctaagagcatcaggaa

SEQ ID NO: 464907 - DNA, 25 bp, Mus musculus
gacttgaggctacgaccacccactt

SEQ ID NO: 464908 - DNA, 25 bp, Mus musculus
gacttgaggctaggaccacccactt

SEQ ID NO: 464909 - DNA, 25 bp, Mus musculus
gacttgaggctatgagcatcaggaa

SEQ ID NO: 464910 - DNA, 25 bp, Mus musculus
gacttgagggctcttgtacttagac

SEQ ID NO: 464911 - DNA, 25 bp, Mus musculus
gacttgagggctgttgtacttagac

SEQ ID NO: 464912 - DNA, 25 bp, Mus musculus
gacttgaggtctcagctttgtatga

SEQ ID NO: 464913 - DNA, 25 bp, Mus musculus
gacttgaggtctgagctttgtatga

SEQ ID NO: 464914 - DNA, 25 bp, Mus musculus
gacttgaggtttaagttgtatcaac

SEQ ID NO: 464915 - DNA, 25 bp, Mus musculus
gacttgaggttttagttgtatcaac

SEQ ID NO: 464916 - DNA, 25 bp, Mus musculus
gacttgagtcaacgttatcctaagg

SEQ ID NO: 464917 - DNA, 25 bp, Mus musculus
gacttgagtcaaggttatcctaagg

SEQ ID NO: 464918 - DNA, 25 bp, Mus musculus
gacttgagtccacctgtgatggaat

SEQ ID NO: 464919 - DNA, 25 bp, Mus musculus
gacttgagtccagctgtgatggaat

SEQ ID NO: 464920 - DNA, 25 bp, Mus musculus
gacttgagtcctcaaacgaccaaat

SEQ ID NO: 464921 - DNA, 25 bp, Mus musculus
gacttgagtcctgaaacgaccaaat

SEQ ID NO: 464922 - DNA, 25 bp, Mus musculus
gacttgagtgttcctcaggcacagt

SEQ ID NO: 464923 - DNA, 25 bp, Mus musculus
gacttgagtgttgctcaggcacagt

SEQ ID NO: 464924 - DNA, 25 bp, Mus musculus
gacttgagttcacctggagggctct

SEQ ID NO: 464925 - DNA, 25 bp, Mus musculus
gacttgagttcagctggagggctct

SEQ ID NO: 464926 - DNA, 25 bp, Mus musculus
gacttgagttctaagctctggtgaa

SEQ ID NO: 464927 - DNA, 25 bp, Mus musculus
gacttgagttcttagctctggtgaa

SEQ ID NO: 464928 - DNA, 25 bp, Mus musculus
gacttgataattcacccctttttgt

SEQ ID NO: 464929 - DNA, 25 bp, Mus musculus
gacttgataattgacccctttttgt

SEQ ID NO: 464930 - DNA, 25 bp, Mus musculus
gacttgatagacaatgttcaatgga

SEQ ID NO: 464931 - DNA, 25 bp, Mus musculus
gacttgatagactatgttcaatgga

SEQ ID NO: 464932 - DNA, 25 bp, Mus musculus
gacttgatagttaacttttgagcct

SEQ ID NO: 464933 - DNA, 25 bp, Mus musculus
gacttgatagtttacttttgagcct

SEQ ID NO: 464934 - DNA, 25 bp, Mus musculus
gacttgatcaatatttctctacttt

SEQ ID NO: 464935 - DNA, 25 bp, Mus musculus
gacttgatcaatttttctctacttt

SEQ ID NO: 464936 - DNA, 25 bp, Mus musculus
gacttgatcacacaacagcttggaa

SEQ ID NO: 464937 - DNA, 25 bp, Mus musculus
gacttgatcacagaacagcttggaa

SEQ ID NO: 464938 - DNA, 25 bp, Mus musculus
gacttgatcagtattgcacatttcc

SEQ ID NO: 464939 - DNA, 25 bp, Mus musculus
gacttgatcagttttgcacatttcc

SEQ ID NO: 464940 - DNA, 25 bp, Mus musculus
gacttgatcttcacattctacaggg

SEQ ID NO: 464941 - DNA, 25 bp, Mus musculus
gacttgatcttctcattctacaggg

SEQ ID NO: 464942 - DNA, 25 bp, Mus musculus
gacttgatgggtcaaatgcttgcca

SEQ ID NO: 464943 - DNA, 25 bp, Mus musculus
gacttgatgggtgaaatgcttgcca

SEQ ID NO: 464944 - DNA, 25 bp, Mus musculus
gacttgatgtatcccaagagggctt

SEQ ID NO: 464945 - DNA, 25 bp, Mus musculus
gacttgatgtatgccaagagggctt

SEQ ID NO: 464946 - DNA, 25 bp, Mus musculus
gacttgatgttactaacgccggcgt

SEQ ID NO: 464947 - DNA, 25 bp, Mus musculus
gacttgatgttagtaacgccggcgt

SEQ ID NO: 464948 - DNA, 25 bp, Mus musculus
gacttgatgttgatttctgagcctc

SEQ ID NO: 464949 - DNA, 25 bp, Mus musculus
gacttgatgttgttttctgagcctc

SEQ ID NO: 464950 - DNA, 25 bp, Mus musculus
gacttgattggcagttgtgttgctt

SEQ ID NO: 464951 - DNA, 25 bp, Mus musculus
gacttgattggctgttgtgttgctt

SEQ ID NO: 464952 - DNA, 25 bp, Mus musculus
gacttgatttttctcgtatgccaat

SEQ ID NO: 464953 - DNA, 25 bp, Mus musculus
gacttgatttttgtcgtatgccaat

SEQ ID NO: 464954 - DNA, 25 bp, Mus musculus
gacttgcaagtccaccaaagagcca

SEQ ID NO: 464955 - DNA, 25 bp, Mus musculus
gacttgcaagtcgaccaaagagcca

SEQ ID NO: 464956 - DNA, 25 bp, Mus musculus
gacttgcacaagagcctcatgatct

SEQ ID NO: 464957 - DNA, 25 bp, Mus musculus
gacttgcacaagtgcctcatgatct

SEQ ID NO: 464958 - DNA, 25 bp, Mus musculus
gacttgcacatacgaccttccaggg

SEQ ID NO: 464959 - DNA, 25 bp, Mus musculus
gacttgcacataggaccttccaggg

SEQ ID NO: 464960 - DNA, 25 bp, Mus musculus
gacttgcacatcctttcagtgttta

SEQ ID NO: 464961 - DNA, 25 bp, Mus musculus
gacttgcacatcgtttcagtgttta

SEQ ID NO: 464962 - DNA, 25 bp, Mus musculus
gacttgcagagcagtgctccaatat

SEQ ID NO: 464963 - DNA, 25 bp, Mus musculus
gacttgcagagctgtgctccaatat

SEQ ID NO: 464964 - DNA, 25 bp, Mus musculus
gacttgcagcctaggaactagggaa

SEQ ID NO: 464965 - DNA, 25 bp, Mus musculus
gacttgcagccttggaactagggaa

SEQ ID NO: 464966 - DNA, 25 bp, Mus musculus
gacttgcaggacaagcacttttatt

SEQ ID NO: 464967 - DNA, 25 bp, Mus musculus
gacttgcaggactagcacttttatt

SEQ ID NO: 464968 - DNA, 25 bp, Mus musculus
gacttgcagggccagctcaagttta

SEQ ID NO: 464969 - DNA, 25 bp, Mus musculus
gacttgcagggcgagctcaagttta

SEQ ID NO: 464970 - DNA, 25 bp, Mus musculus
gacttgcagtcacgcttgtgagctc

SEQ ID NO: 464971 - DNA, 25 bp, Mus musculus
gacttgcagtcactgggtcccttaa

SEQ ID NO: 464972 - DNA, 25 bp, Mus musculus
gacttgcagtcaggcttgtgagctc

SEQ ID NO: 464973 - DNA, 25 bp, Mus musculus
gacttgcagtcagtgggtcccttaa

SEQ ID NO: 464974 - DNA, 25 bp, Mus musculus
gacttgcagtggcaggaatttttaa

SEQ ID NO: 464975 - DNA, 25 bp, Mus musculus
gacttgcagtgggaggaatttttaa

SEQ ID NO: 464976 - DNA, 25 bp, Mus musculus
gacttgcagtttccctaactgtttt

SEQ ID NO: 464977 - DNA, 25 bp, Mus musculus
gacttgcagtttgcctaactgtttt

SEQ ID NO: 464978 - DNA, 25 bp, Mus musculus
gacttgcatacgatggtttccaggt

SEQ ID NO: 464979 - DNA, 25 bp, Mus musculus
gacttgcatacgttggtttccaggt

SEQ ID NO: 464980 - DNA, 25 bp, Mus musculus
gacttgcatattaaacttggctttc

SEQ ID NO: 464981 - DNA, 25 bp, Mus musculus
gacttgcatatttaacttggctttc

SEQ ID NO: 464982 - DNA, 25 bp, Mus musculus
gacttgcatcaactgaagcccttgt

SEQ ID NO: 464983 - DNA, 25 bp, Mus musculus
gacttgcatcaagtgaagcccttgt

SEQ ID NO: 464984 - DNA, 25 bp, Mus musculus
gacttgcatcagaaggtatggctca

SEQ ID NO: 464985 - DNA, 25 bp, Mus musculus
gacttgcatcagtaggtatggctca

SEQ ID NO: 464986 - DNA, 25 bp, Mus musculus
gacttgcatccacaagacccttcat

SEQ ID NO: 464987 - DNA, 25 bp, Mus musculus
gacttgcatccagaagacccttcat

SEQ ID NO: 464988 - DNA, 25 bp, Mus musculus
gacttgcatcccatcttttaaacat

SEQ ID NO: 464989 - DNA, 25 bp, Mus musculus
gacttgcatcccttcttttaaacat

SEQ ID NO: 464990 - DNA, 25 bp, Mus musculus
gacttgcatctactttgtctgctat

SEQ ID NO: 464991 - DNA, 25 bp, Mus musculus
gacttgcatctagtttgtctgctat

SEQ ID NO: 464992 - DNA, 25 bp, Mus musculus
gacttgcatggtcaatggcattcta

SEQ ID NO: 464993 - DNA, 25 bp, Mus musculus
gacttgcatggtgaatggcattcta

SEQ ID NO: 464994 - DNA, 25 bp, Mus musculus
gacttgccaaatcgcttggctggct

SEQ ID NO: 464995 - DNA, 25 bp, Mus musculus
gacttgccaaatggcttggctggct

SEQ ID NO: 464996 - DNA, 25 bp, Mus musculus
gacttgccaaccagttatatcgatg

SEQ ID NO: 464997 - DNA, 25 bp, Mus musculus
gacttgccaacctgttatatcgatg

SEQ ID NO: 464998 - DNA, 25 bp, Mus musculus
gacttgccacagacctaccaaatgg

SEQ ID NO: 464999 - DNA, 25 bp, Mus musculus
gacttgccacagtcctaccaaatgg

SEQ ID NO: 465000 - DNA, 25 bp, Mus musculus
gacttgccagcactggtcagaaaaa

SEQ ID NO: 465001 - DNA, 25 bp, Mus musculus
gacttgccagcagtggtcagaaaaa

SEQ ID NO: 465002 - DNA, 25 bp, Mus musculus
gacttgccatttcaataccatttta

SEQ ID NO: 465003 - DNA, 25 bp, Mus musculus
gacttgccatttgaataccatttta

SEQ ID NO: 465004 - DNA, 25 bp, Mus musculus
gacttgcccataactgtgtatatcc

SEQ ID NO: 465005 - DNA, 25 bp, Mus musculus
gacttgcccatatctgtgtatatcc

SEQ ID NO: 465006 - DNA, 25 bp, Mus musculus
gacttgccctgcataaactttgtta

SEQ ID NO: 465007 - DNA, 25 bp, Mus musculus
gacttgccctgcttaaactttgtta

SEQ ID NO: 465008 - DNA, 25 bp, Mus musculus
gacttgccctggaatatggccagtg

SEQ ID NO: 465009 - DNA, 25 bp, Mus musculus
gacttgccctggtatatggccagtg

SEQ ID NO: 465010 - DNA, 25 bp, Mus musculus
gacttgccctttaagcattcaagag

SEQ ID NO: 465011 - DNA, 25 bp, Mus musculus
gacttgcccttttagcattcaagag

SEQ ID NO: 465012 - DNA, 25 bp, Mus musculus
gacttgccgaaaacatgtggttttt

SEQ ID NO: 465013 - DNA, 25 bp, Mus musculus
gacttgccgaaatcatgtggttttt

SEQ ID NO: 465014 - DNA, 25 bp, Mus musculus
gacttgcctcaaacaactgagccaa

SEQ ID NO: 465015 - DNA, 25 bp, Mus musculus
gacttgcctcaatcaactgagccaa

SEQ ID NO: 465016 - DNA, 25 bp, Mus musculus
gacttgcctcagattctggatttac

SEQ ID NO: 465017 - DNA, 25 bp, Mus musculus
gacttgcctcagtttctggatttac

SEQ ID NO: 465018 - DNA, 25 bp, Mus musculus
gacttgcctctaactcagagatcta

SEQ ID NO: 465019 - DNA, 25 bp, Mus musculus
gacttgcctctatctcagagatcta

SEQ ID NO: 465020 - DNA, 25 bp, Mus musculus
gacttgccttagaactgtctcacag

SEQ ID NO: 465021 - DNA, 25 bp, Mus musculus
gacttgccttagtactgtctcacag

SEQ ID NO: 465022 - DNA, 25 bp, Mus musculus
gacttgcgctctaataaatgacatg

SEQ ID NO: 465023 - DNA, 25 bp, Mus musculus
gacttgcgctcttataaatgacatg

SEQ ID NO: 465024 - DNA, 25 bp, Mus musculus
gacttgcggtccaaagccacaatgc

SEQ ID NO: 465025 - DNA, 25 bp, Mus musculus
gacttgcggtcctaagccacaatgc

SEQ ID NO: 465026 - DNA, 25 bp, Mus musculus
gacttgcgtgctcattgttttgtaa

SEQ ID NO: 465027 - DNA, 25 bp, Mus musculus
gacttgcgtgctgattgttttgtaa

SEQ ID NO: 465028 - DNA, 25 bp, Mus musculus
gacttgcgtgtccaattgggtcctc

SEQ ID NO: 465029 - DNA, 25 bp, Mus musculus
gacttgcgtgtcgaattgggtcctc

SEQ ID NO: 465030 - DNA, 25 bp, Mus musculus
gacttgcgttgaactttttacatat

SEQ ID NO: 465031 - DNA, 25 bp, Mus musculus
gacttgcgttgatctttttacatat

SEQ ID NO: 465032 - DNA, 25 bp, Mus musculus
gacttgcgtttaagacccatggact

SEQ ID NO: 465033 - DNA, 25 bp, Mus musculus
gacttgcgtttatgacccatggact

SEQ ID NO: 465034 - DNA, 25 bp, Mus musculus
gacttgctagcaccggtgtttttca

SEQ ID NO: 465035 - DNA, 25 bp, Mus musculus
gacttgctagcagcggtgtttttca

SEQ ID NO: 465036 - DNA, 25 bp, Mus musculus
gacttgctcaatatctcttggaatc

SEQ ID NO: 465037 - DNA, 25 bp, Mus musculus
gacttgctcaatttctcttggaatc

SEQ ID NO: 465038 - DNA, 25 bp, Mus musculus
gacttgctctgccaacagtggtcat

SEQ ID NO: 465039 - DNA, 25 bp, Mus musculus
gacttgctctgcgaacagtggtcat

SEQ ID NO: 465040 - DNA, 25 bp, Mus musculus
gacttgctcttcctttgtgagtttg

SEQ ID NO: 465041 - DNA, 25 bp, Mus musculus
gacttgctcttcgtttgtgagtttg

SEQ ID NO: 465042 - DNA, 25 bp, Mus musculus
gacttgctgaataccaaaggctaat

SEQ ID NO: 465043 - DNA, 25 bp, Mus musculus
gacttgctgaatagttgttctccca

SEQ ID NO: 465044 - DNA, 25 bp, Mus musculus
gacttgctgaatatcatcactgcta

SEQ ID NO: 465045 - DNA, 25 bp, Mus musculus
gacttgctgaattccaaaggctaat

SEQ ID NO: 465046 - DNA, 25 bp, Mus musculus
gacttgctgaattgttgttctccca

SEQ ID NO: 465047 - DNA, 25 bp, Mus musculus
gacttgctgaatttcatcactgcta

SEQ ID NO: 465048 - DNA, 25 bp, Mus musculus
gacttgctgaccatctattttttct

SEQ ID NO: 465049 - DNA, 25 bp, Mus musculus
gacttgctgaccttctattttttct

SEQ ID NO: 465050 - DNA, 25 bp, Mus musculus
gacttgctgcacatttatcttgaca

SEQ ID NO: 465051 - DNA, 25 bp, Mus musculus
gacttgctgcacttttatcttgaca

SEQ ID NO: 465052 - DNA, 25 bp, Mus musculus
gacttgctggacaccctagttaatc

SEQ ID NO: 465053 - DNA, 25 bp, Mus musculus
gacttgctggactccctagttaatc

SEQ ID NO: 465054 - DNA, 25 bp, Mus musculus
gacttgctggagctcattgctgatc

SEQ ID NO: 465055 - DNA, 25 bp, Mus musculus
gacttgctggaggtcattgctgatc

SEQ ID NO: 465056 - DNA, 25 bp, Mus musculus
gacttgctggctataccattcagta

SEQ ID NO: 465057 - DNA, 25 bp, Mus musculus
gacttgctggctttaccattcagta

SEQ ID NO: 465058 - DNA, 25 bp, Mus musculus
gacttgctggtcaacaactgtgagc

SEQ ID NO: 465059 - DNA, 25 bp, Mus musculus
gacttgctggtctacaactgtgagc

SEQ ID NO: 465060 - DNA, 25 bp, Mus musculus
gacttgctggtgatgtatttctctg

SEQ ID NO: 465061 - DNA, 25 bp, Mus musculus
gacttgctggtgttgtatttctctg

SEQ ID NO: 465062 - DNA, 25 bp, Mus musculus
gacttgctgtggattcaacatcttc

SEQ ID NO: 465063 - DNA, 25 bp, Mus musculus
gacttgctgtggtttcaacatcttc

SEQ ID NO: 465064 - DNA, 25 bp, Mus musculus
gacttgcttcatctgttcggtctga

SEQ ID NO: 465065 - DNA, 25 bp, Mus musculus
gacttgcttcatgtgttcggtctga

SEQ ID NO: 465066 - DNA, 25 bp, Mus musculus
gacttgcttcctccctatcatgtga

SEQ ID NO: 465067 - DNA, 25 bp, Mus musculus
gacttgcttcctgcctatcatgtga

SEQ ID NO: 465068 - DNA, 25 bp, Mus musculus
gacttgcttgatcagtttaaaacac

SEQ ID NO: 465069 - DNA, 25 bp, Mus musculus
gacttgcttgatgagtttaaaacac

SEQ ID NO: 465070 - DNA, 25 bp, Mus musculus
gacttgcttggtcctcatctggtga

SEQ ID NO: 465071 - DNA, 25 bp, Mus musculus
gacttgcttggtgctcatctggtga

SEQ ID NO: 465072 - DNA, 25 bp, Mus musculus
gacttgctttatcaccctttttgtg

SEQ ID NO: 465073 - DNA, 25 bp, Mus musculus
gacttgctttatgaccctttttgtg

SEQ ID NO: 465074 - DNA, 25 bp, Mus musculus
gacttgctttccaacaaaaactgag

SEQ ID NO: 465075 - DNA, 25 bp, Mus musculus
gacttgctttcctacaaaaactgag

SEQ ID NO: 465076 - DNA, 25 bp, Mus musculus
gacttgcttttacaaagaacagact

SEQ ID NO: 465077 - DNA, 25 bp, Mus musculus
gacttgcttttagaaagaacagact

SEQ ID NO: 465078 - DNA, 25 bp, Mus musculus
gacttgcttttgaggtagctctgac

SEQ ID NO: 465079 - DNA, 25 bp, Mus musculus
gacttgcttttgcttattgacttaa

SEQ ID NO: 465080 - DNA, 25 bp, Mus musculus
gacttgcttttggttattgacttaa

SEQ ID NO: 465081 - DNA, 25 bp, Mus musculus
gacttgcttttgtggtagctctgac

SEQ ID NO: 465082 - DNA, 25 bp, Mus musculus
gacttggaactcatatgtcctgctt

SEQ ID NO: 465083 - DNA, 25 bp, Mus musculus
gacttggaactcttatgtcctgctt

SEQ ID NO: 465084 - DNA, 25 bp, Mus musculus
gacttggaactgagcttgcagcttc

SEQ ID NO: 465085 - DNA, 25 bp, Mus musculus
gacttggaactgtgcttgcagcttc

SEQ ID NO: 465086 - DNA, 25 bp, Mus musculus
gacttggaagaacggccaataaagc

SEQ ID NO: 465087 - DNA, 25 bp, Mus musculus
gacttggaagaagggccaataaagc

SEQ ID NO: 465088 - DNA, 25 bp, Mus musculus
gacttggaatcaagttgtgcactat

SEQ ID NO: 465089 - DNA, 25 bp, Mus musculus
gacttggaatcatgttgtgcactat

SEQ ID NO: 465090 - DNA, 25 bp, Mus musculus
gacttggaatgtccagagacctgca

SEQ ID NO: 465091 - DNA, 25 bp, Mus musculus
gacttggaatgtgcagagacctgca

SEQ ID NO: 465092 - DNA, 25 bp, Mus musculus
gacttggaatttaatggcagaaaac

SEQ ID NO: 465093 - DNA, 25 bp, Mus musculus
gacttggaatttacaatctacgatg

SEQ ID NO: 465094 - DNA, 25 bp, Mus musculus
gacttggaatttagggatgcagaac

SEQ ID NO: 465095 - DNA, 25 bp, Mus musculus
gacttggaatttattcctcccaatg

SEQ ID NO: 465096 - DNA, 25 bp, Mus musculus
gacttggaattttatggcagaaaac

SEQ ID NO: 465097 - DNA, 25 bp, Mus musculus
gacttggaattttcaatctacgatg

SEQ ID NO: 465098 - DNA, 25 bp, Mus musculus
gacttggaattttgggatgcagaac

SEQ ID NO: 465099 - DNA, 25 bp, Mus musculus
gacttggaattttttcctcccaatg

SEQ ID NO: 465100 - DNA, 25 bp, Mus musculus
gacttggacaaaagaacgtattcgt

SEQ ID NO: 465101 - DNA, 25 bp, Mus musculus
gacttggacaaatgaacgtattcgt

SEQ ID NO: 465102 - DNA, 25 bp, Mus musculus
gacttggacactcaagctgctgcat

SEQ ID NO: 465103 - DNA, 25 bp, Mus musculus
gacttggacactgaagctgctgcat

SEQ ID NO: 465104 - DNA, 25 bp, Mus musculus
gacttggacagaaaccagctttatt

SEQ ID NO: 465105 - DNA, 25 bp, Mus musculus
gacttggacagaagaggcagtgttt

SEQ ID NO: 465106 - DNA, 25 bp, Mus musculus
gacttggacagataccagctttatt

SEQ ID NO: 465107 - DNA, 25 bp, Mus musculus
gacttggacagatgaggcagtgttt

SEQ ID NO: 465108 - DNA, 25 bp, Mus musculus
gacttggaccaacattcaacctggg

SEQ ID NO: 465109 - DNA, 25 bp, Mus musculus
gacttggaccaagattcaacctggg

SEQ ID NO: 465110 - DNA, 25 bp, Mus musculus
gacttggactcccacgttgaagact

SEQ ID NO: 465111 - DNA, 25 bp, Mus musculus
gacttggactccctgtaagccagtt

SEQ ID NO: 465112 - DNA, 25 bp, Mus musculus
gacttggactccgacgttgaagact

SEQ ID NO: 465113 - DNA, 25 bp, Mus musculus
gacttggactccgtgtaagccagtt

SEQ ID NO: 465114 - DNA, 25 bp, Mus musculus
gacttggactctcgacttacaggct

SEQ ID NO: 465115 - DNA, 25 bp, Mus musculus
gacttggactctggacttacaggct

SEQ ID NO: 465116 - DNA, 25 bp, Mus musculus
gacttggactgaagactgacgactg

SEQ ID NO: 465117 - DNA, 25 bp, Mus musculus
gacttggactgatgactgacgactg

SEQ ID NO: 465118 - DNA, 25 bp, Mus musculus
gacttggacttgctacataggagtt

SEQ ID NO: 465119 - DNA, 25 bp, Mus musculus
gacttggacttggtacataggagtt

SEQ ID NO: 465120 - DNA, 25 bp, Mus musculus
gacttggagacaccctggtctgtga

SEQ ID NO: 465121 - DNA, 25 bp, Mus musculus
gacttggagacagcctggtctgtga

SEQ ID NO: 465122 - DNA, 25 bp, Mus musculus
gacttggagactactgacagttctg

SEQ ID NO: 465123 - DNA, 25 bp, Mus musculus
gacttggagacttctgacagttctg

SEQ ID NO: 465124 - DNA, 25 bp, Mus musculus
gacttggagagcatacgcacgcccc

SEQ ID NO: 465125 - DNA, 25 bp, Mus musculus
gacttggagagcttacgcacgcccc

SEQ ID NO: 465126 - DNA, 25 bp, Mus musculus
gacttggagattacttcacacacag

SEQ ID NO: 465127 - DNA, 25 bp, Mus musculus
gacttggagattctgcactaccatg

SEQ ID NO: 465128 - DNA, 25 bp, Mus musculus
gacttggagattgtgcactaccatg

SEQ ID NO: 465129 - DNA, 25 bp, Mus musculus
gacttggagatttcttcacacacag

SEQ ID NO: 465130 - DNA, 25 bp, Mus musculus
gacttggagcagattgagaacaact

SEQ ID NO: 465131 - DNA, 25 bp, Mus musculus
gacttggagcagtttgagaacaact

SEQ ID NO: 465132 - DNA, 25 bp, Mus musculus
gacttggagccaactgttacctgct

SEQ ID NO: 465133 - DNA, 25 bp, Mus musculus
gacttggagccaaggacacgtggat

SEQ ID NO: 465134 - DNA, 25 bp, Mus musculus
gacttggagccatctgttacctgct

SEQ ID NO: 465135 - DNA, 25 bp, Mus musculus
gacttggagccatggacacgtggat

SEQ ID NO: 465136 - DNA, 25 bp, Mus musculus
gacttggagcctccacggtaaaaag

SEQ ID NO: 465137 - DNA, 25 bp, Mus musculus
gacttggagcctgcacggtaaaaag

SEQ ID NO: 465138 - DNA, 25 bp, Mus musculus
gacttggagctgatagtccttgctg

SEQ ID NO: 465139 - DNA, 25 bp, Mus musculus
gacttggagctgttagtccttgctg

SEQ ID NO: 465140 - DNA, 25 bp, Mus musculus
gacttggagggaatcctttactctc

SEQ ID NO: 465141 - DNA, 25 bp, Mus musculus
gacttggagggattcctttactctc

SEQ ID NO: 465142 - DNA, 25 bp, Mus musculus
gacttggaggtcactaggcttaagc

SEQ ID NO: 465143 - DNA, 25 bp, Mus musculus
gacttggaggtctctaggcttaagc

SEQ ID NO: 465144 - DNA, 25 bp, Mus musculus
gacttggaggtgaccctaatggtac

SEQ ID NO: 465145 - DNA, 25 bp, Mus musculus
gacttggaggtgtccctaatggtac

SEQ ID NO: 465146 - DNA, 25 bp, Mus musculus
gacttggagttacctcctgtgctgt

SEQ ID NO: 465147 - DNA, 25 bp, Mus musculus
gacttggagttagctcctgtgctgt

SEQ ID NO: 465148 - DNA, 25 bp, Mus musculus
gacttggagttgctgacttttgctg

SEQ ID NO: 465149 - DNA, 25 bp, Mus musculus
gacttggagttggtgacttttgctg

SEQ ID NO: 465150 - DNA, 25 bp, Mus musculus
gacttggatagacaacccgcctcct

SEQ ID NO: 465151 - DNA, 25 bp, Mus musculus
gacttggatagagaacccgcctcct

SEQ ID NO: 465152 - DNA, 25 bp, Mus musculus
gacttggatatgacatttgtgtcaa

SEQ ID NO: 465153 - DNA, 25 bp, Mus musculus
gacttggatatgtcatttgtgtcaa

SEQ ID NO: 465154 - DNA, 25 bp, Mus musculus
gacttggatcgaattctgactctca

SEQ ID NO: 465155 - DNA, 25 bp, Mus musculus
gacttggatcgatttctgactctca

SEQ ID NO: 465156 - DNA, 25 bp, Mus musculus
gacttggatctaaagcagcgttgcg

SEQ ID NO: 465157 - DNA, 25 bp, Mus musculus
gacttggatctatagcagcgttgcg

SEQ ID NO: 465158 - DNA, 25 bp, Mus musculus
gacttggatttaagacccacaccca

SEQ ID NO: 465159 - DNA, 25 bp, Mus musculus
gacttggatttatgacccacaccca

SEQ ID NO: 465160 - DNA, 25 bp, Mus musculus
gacttggcaacaacgctcggctgga

SEQ ID NO: 465161 - DNA, 25 bp, Mus musculus
gacttggcaacatcgctcggctgga

SEQ ID NO: 465162 - DNA, 25 bp, Mus musculus
gacttggcagaaatcacatccttca

SEQ ID NO: 465163 - DNA, 25 bp, Mus musculus
gacttggcagaattcacatccttca

SEQ ID NO: 465164 - DNA, 25 bp, Mus musculus
gacttggcagagaatttctgtcagc

SEQ ID NO: 465165 - DNA, 25 bp, Mus musculus
gacttggcagagtatttctgtcagc

SEQ ID NO: 465166 - DNA, 25 bp, Mus musculus
gacttggcagcaagatattagcact

SEQ ID NO: 465167 - DNA, 25 bp, Mus musculus
gacttggcagcatgatattagcact

SEQ ID NO: 465168 - DNA, 25 bp, Mus musculus
gacttggcattacatttccttgata

SEQ ID NO: 465169 - DNA, 25 bp, Mus musculus
gacttggcattagatttccttgata

SEQ ID NO: 465170 - DNA, 25 bp, Mus musculus
gacttggccaagctagcatcttagt

SEQ ID NO: 465171 - DNA, 25 bp, Mus musculus
gacttggccaaggtagcatcttagt

SEQ ID NO: 465172 - DNA, 25 bp, Mus musculus
gacttggccctcatcagattgatat

SEQ ID NO: 465173 - DNA, 25 bp, Mus musculus
gacttggccctcttcagattgatat

SEQ ID NO: 465174 - DNA, 25 bp, Mus musculus
gacttggcctaacacaccatgtatg

SEQ ID NO: 465175 - DNA, 25 bp, Mus musculus
gacttggcctaagacaccatgtatg

SEQ ID NO: 465176 - DNA, 25 bp, Mus musculus
gacttggctattcctgtttagggac

SEQ ID NO: 465177 - DNA, 25 bp, Mus musculus
gacttggctattgctgtttagggac

SEQ ID NO: 465178 - DNA, 25 bp, Mus musculus
gacttggctgctaaagtcaatcaag

SEQ ID NO: 465179 - DNA, 25 bp, Mus musculus
gacttggctgcttaagtcaatcaag

SEQ ID NO: 465180 - DNA, 25 bp, Mus musculus
gacttggctgtaatgccagcagctt

SEQ ID NO: 465181 - DNA, 25 bp, Mus musculus
gacttggctgtattgccagcagctt

SEQ ID NO: 465182 - DNA, 25 bp, Mus musculus
gacttggctttcagactacttttct

SEQ ID NO: 465183 - DNA, 25 bp, Mus musculus
gacttggctttcagtccgagctccg

SEQ ID NO: 465184 - DNA, 25 bp, Mus musculus
gacttggctttctgactacttttct

SEQ ID NO: 465185 - DNA, 25 bp, Mus musculus
gacttggctttctgtccgagctccg

SEQ ID NO: 465186 - DNA, 25 bp, Mus musculus
gacttggcttttcagactcagttct

SEQ ID NO: 465187 - DNA, 25 bp, Mus musculus
gacttggcttttgagactcagttct

SEQ ID NO: 465188 - DNA, 25 bp, Mus musculus
gacttgggacaactactctaaccat

SEQ ID NO: 465189 - DNA, 25 bp, Mus musculus
gacttgggacaagtactctaaccat

SEQ ID NO: 465190 - DNA, 25 bp, Mus musculus
gacttgggatttacacatctgcttt

SEQ ID NO: 465191 - DNA, 25 bp, Mus musculus
gacttgggattttcacatctgcttt

SEQ ID NO: 465192 - DNA, 25 bp, Mus musculus
gacttgggcaggattttctcatgct

SEQ ID NO: 465193 - DNA, 25 bp, Mus musculus
gacttgggcaggtttttctcatgct

SEQ ID NO: 465194 - DNA, 25 bp, Mus musculus
gacttgggccacctctctctctcgc

SEQ ID NO: 465195 - DNA, 25 bp, Mus musculus
gacttgggccacgtctctctctcgc

SEQ ID NO: 465196 - DNA, 25 bp, Mus musculus
gacttgggcgctaacctgcggcagc

SEQ ID NO: 465197 - DNA, 25 bp, Mus musculus
gacttgggcgcttacctgcggcagc

SEQ ID NO: 465198 - DNA, 25 bp, Mus musculus
gacttgggctttagtcatttcaaag

SEQ ID NO: 465199 - DNA, 25 bp, Mus musculus
gacttgggcttttgtcatttcaaag

SEQ ID NO: 465200 - DNA, 25 bp, Mus musculus
gacttgggtatcatccaccgtgatg

SEQ ID NO: 465201 - DNA, 25 bp, Mus musculus
gacttgggtatcttccaccgtgatg

SEQ ID NO: 465202 - DNA, 25 bp, Mus musculus
gacttgggtcaacgcgctcagttct

SEQ ID NO: 465203 - DNA, 25 bp, Mus musculus
gacttgggtcaaggcgctcagttct

SEQ ID NO: 465204 - DNA, 25 bp, Mus musculus
gacttgggtctaaccattgaagggt

SEQ ID NO: 465205 - DNA, 25 bp, Mus musculus
gacttgggtctatccattgaagggt

SEQ ID NO: 465206 - DNA, 25 bp, Mus musculus
gacttgggtgtcaataaagagagtt

SEQ ID NO: 465207 - DNA, 25 bp, Mus musculus
gacttgggtgtctataaagagagtt

SEQ ID NO: 465208 - DNA, 25 bp, Mus musculus
gacttgggttctatacatttgcgtt

SEQ ID NO: 465209 - DNA, 25 bp, Mus musculus
gacttgggttctttacatttgcgtt

SEQ ID NO: 465210 - DNA, 25 bp, Mus musculus
gacttggtaacgcatgtagcctttt

SEQ ID NO: 465211 - DNA, 25 bp, Mus musculus
gacttggtaacggatgtagcctttt

SEQ ID NO: 465212 - DNA, 25 bp, Mus musculus
gacttggtaggtcaggactgcatta

SEQ ID NO: 465213 - DNA, 25 bp, Mus musculus
gacttggtaggtgaggactgcatta

SEQ ID NO: 465214 - DNA, 25 bp, Mus musculus
gacttggtatcaaggcttgagacac

SEQ ID NO: 465215 - DNA, 25 bp, Mus musculus
gacttggtatcatggcttgagacac

SEQ ID NO: 465216 - DNA, 25 bp, Mus musculus
gacttggtcacacttgaggttcact

SEQ ID NO: 465217 - DNA, 25 bp, Mus musculus
gacttggtcacagttgaggttcact

SEQ ID NO: 465218 - DNA, 25 bp, Mus musculus
gacttggtcagaagttcaggactat

SEQ ID NO: 465219 - DNA, 25 bp, Mus musculus
gacttggtcagatgttcaggactat

SEQ ID NO: 465220 - DNA, 25 bp, Mus musculus
gacttggtcaggaactcaggaggct

SEQ ID NO: 465221 - DNA, 25 bp, Mus musculus
gacttggtcaggtactcaggaggct

SEQ ID NO: 465222 - DNA, 25 bp, Mus musculus
gacttggtcgaactgcggcagcact

SEQ ID NO: 465223 - DNA, 25 bp, Mus musculus
gacttggtcgaagtgcggcagcact

SEQ ID NO: 465224 - DNA, 25 bp, Mus musculus
gacttggtctagaaggtacagcccc

SEQ ID NO: 465225 - DNA, 25 bp, Mus musculus
gacttggtctagtaggtacagcccc

SEQ ID NO: 465226 - DNA, 25 bp, Mus musculus
gacttggtgacactctagcgcgctg

SEQ ID NO: 465227 - DNA, 25 bp, Mus musculus
gacttggtgacagtctagcgcgctg

SEQ ID NO: 465228 - DNA, 25 bp, Mus musculus
gacttggtgagtacagtctctttcc

SEQ ID NO: 465229 - DNA, 25 bp, Mus musculus
gacttggtgagttcagtctctttcc

SEQ ID NO: 465230 - DNA, 25 bp, Mus musculus
gacttggtgcgcatgacttaagcta

SEQ ID NO: 465231 - DNA, 25 bp, Mus musculus
gacttggtgcgcttgacttaagcta

SEQ ID NO: 465232 - DNA, 25 bp, Mus musculus
gacttggtggatctgagtcttgctt

SEQ ID NO: 465233 - DNA, 25 bp, Mus musculus
gacttggtggatgtgagtcttgctt

SEQ ID NO: 465234 - DNA, 25 bp, Mus musculus
gacttggtggtcactgcggcgaaat

SEQ ID NO: 465235 - DNA, 25 bp, Mus musculus
gacttggtggtctctgcggcgaaat

SEQ ID NO: 465236 - DNA, 25 bp, Mus musculus
gacttggtgtctctcgacatcttta

SEQ ID NO: 465237 - DNA, 25 bp, Mus musculus
gacttggtgtctgtcgacatcttta

SEQ ID NO: 465238 - DNA, 25 bp, Mus musculus
gacttggttaccagttttgcatgta

SEQ ID NO: 465239 - DNA, 25 bp, Mus musculus
gacttggttacctgttttgcatgta

SEQ ID NO: 465240 - DNA, 25 bp, Mus musculus
gacttggttatcagcttctttttac

SEQ ID NO: 465241 - DNA, 25 bp, Mus musculus
gacttggttatctgcttctttttac

SEQ ID NO: 465242 - DNA, 25 bp, Mus musculus
gacttggttatgaattgcctctgtg

SEQ ID NO: 465243 - DNA, 25 bp, Mus musculus
gacttggttatgtattgcctctgtg

SEQ ID NO: 465244 - DNA, 25 bp, Mus musculus
gacttggttcgaaatgttcgccttt

SEQ ID NO: 465245 - DNA, 25 bp, Mus musculus
gacttggttcgatatgttcgccttt

SEQ ID NO: 465246 - DNA, 25 bp, Mus musculus
gacttggttctgagcatatacccac

SEQ ID NO: 465247 - DNA, 25 bp, Mus musculus
gacttggttctgtgcatatacccac

SEQ ID NO: 465248 - DNA, 25 bp, Mus musculus
gacttggttgcacccccagcaagaa

SEQ ID NO: 465249 - DNA, 25 bp, Mus musculus
gacttggttgcagccccagcaagaa

SEQ ID NO: 465250 - DNA, 25 bp, Mus musculus
gacttggttgccacatgtgcatcat

SEQ ID NO: 465251 - DNA, 25 bp, Mus musculus
gacttggttgcctcatgtgcatcat

SEQ ID NO: 465252 - DNA, 25 bp, Mus musculus
gacttggtttccctagctatggcat

SEQ ID NO: 465253 - DNA, 25 bp, Mus musculus
gacttggtttccgtagctatggcat

SEQ ID NO: 465254 - DNA, 25 bp, Mus musculus
gacttgtaaagcctgagacctgcct

SEQ ID NO: 465255 - DNA, 25 bp, Mus musculus
gacttgtaaagcgtgagacctgcct

SEQ ID NO: 465256 - DNA, 25 bp, Mus musculus
gacttgtaaatgacatgcgtgatga

SEQ ID NO: 465257 - DNA, 25 bp, Mus musculus
gacttgtaaatgcatgctgcaactt

SEQ ID NO: 465258 - DNA, 25 bp, Mus musculus
gacttgtaaatggatgctgcaactt

SEQ ID NO: 465259 - DNA, 25 bp, Mus musculus
gacttgtaaatgtcatgcgtgatga

SEQ ID NO: 465260 - DNA, 25 bp, Mus musculus
gacttgtaacaccagactgggtttt

SEQ ID NO: 465261 - DNA, 25 bp, Mus musculus
gacttgtaacacgagactgggtttt

SEQ ID NO: 465262 - DNA, 25 bp, Mus musculus
gacttgtaactcagtcacatctcct

SEQ ID NO: 465263 - DNA, 25 bp, Mus musculus
gacttgtaactctgtcacatctcct

SEQ ID NO: 465264 - DNA, 25 bp, Mus musculus
gacttgtaatcaatgtacccatggg

SEQ ID NO: 465265 - DNA, 25 bp, Mus musculus
gacttgtaatcattgtacccatggg

SEQ ID NO: 465266 - DNA, 25 bp, Mus musculus
gacttgtacaacatcaggatccttc

SEQ ID NO: 465267 - DNA, 25 bp, Mus musculus
gacttgtacaacttcaggatccttc

SEQ ID NO: 465268 - DNA, 25 bp, Mus musculus
gacttgtaccttcctgtgtactaca

SEQ ID NO: 465269 - DNA, 25 bp, Mus musculus
gacttgtaccttgctgtgtactaca

SEQ ID NO: 465270 - DNA, 25 bp, Mus musculus
gacttgtactggagagccttcttca

SEQ ID NO: 465271 - DNA, 25 bp, Mus musculus
gacttgtactggtgagccttcttca

SEQ ID NO: 465272 - DNA, 25 bp, Mus musculus
gacttgtagatacatgccttttcag

SEQ ID NO: 465273 - DNA, 25 bp, Mus musculus
gacttgtagatagatgccttttcag

SEQ ID NO: 465274 - DNA, 25 bp, Mus musculus
gacttgtagcatacatttgtggtag

SEQ ID NO: 465275 - DNA, 25 bp, Mus musculus
gacttgtagcattcatttgtggtag

SEQ ID NO: 465276 - DNA, 25 bp, Mus musculus
gacttgtatccaagcggtgttccga

SEQ ID NO: 465277 - DNA, 25 bp, Mus musculus
gacttgtatccatgcggtgttccga

SEQ ID NO: 465278 - DNA, 25 bp, Mus musculus
gacttgtatgaccaaacagggcatt

SEQ ID NO: 465279 - DNA, 25 bp, Mus musculus
gacttgtatgacgaaacagggcatt

SEQ ID NO: 465280 - DNA, 25 bp, Mus musculus
gacttgtattagatctgttgcactg

SEQ ID NO: 465281 - DNA, 25 bp, Mus musculus
gacttgtattagttctgttgcactg

SEQ ID NO: 465282 - DNA, 25 bp, Mus musculus
gacttgtcaatcattccctacagtt

SEQ ID NO: 465283 - DNA, 25 bp, Mus musculus
gacttgtcaatctttccctacagtt

SEQ ID NO: 465284 - DNA, 25 bp, Mus musculus
gacttgtcacagaaggagcacttga

SEQ ID NO: 465285 - DNA, 25 bp, Mus musculus
gacttgtcacagtaggagcacttga

SEQ ID NO: 465286 - DNA, 25 bp, Mus musculus
gacttgtcacttcgagttactgcag

SEQ ID NO: 465287 - DNA, 25 bp, Mus musculus
gacttgtcacttggagttactgcag

SEQ ID NO: 465288 - DNA, 25 bp, Mus musculus
gacttgtcagacacagtgggccgtt

SEQ ID NO: 465289 - DNA, 25 bp, Mus musculus
gacttgtcagactcagtgggccgtt

SEQ ID NO: 465290 - DNA, 25 bp, Mus musculus
gacttgtcagatatgttcaggtgga

SEQ ID NO: 465291 - DNA, 25 bp, Mus musculus
gacttgtcagatttgttcaggtgga

SEQ ID NO: 465292 - DNA, 25 bp, Mus musculus
gacttgtcatgtctgacctcttcaa

SEQ ID NO: 465293 - DNA, 25 bp, Mus musculus
gacttgtcatgtgtgacctcttcaa

SEQ ID NO: 465294 - DNA, 25 bp, Mus musculus
gacttgtcggtgctatttctattaa

SEQ ID NO: 465295 - DNA, 25 bp, Mus musculus
gacttgtcggtggtatttctattaa

SEQ ID NO: 465296 - DNA, 25 bp, Mus musculus
gacttgtctagcatggatgtgccca

SEQ ID NO: 465297 - DNA, 25 bp, Mus musculus
gacttgtctagcttggatgtgccca

SEQ ID NO: 465298 - DNA, 25 bp, Mus musculus
gacttgtctgctacttggaatgcaa

SEQ ID NO: 465299 - DNA, 25 bp, Mus musculus
gacttgtctgcttcttggaatgcaa

SEQ ID NO: 465300 - DNA, 25 bp, Mus musculus
gacttgtctggaattgtcccggatc

SEQ ID NO: 465301 - DNA, 25 bp, Mus musculus
gacttgtctggatttgtcccggatc

SEQ ID NO: 465302 - DNA, 25 bp, Mus musculus
gacttgtgaatcagtgctgactggt

SEQ ID NO: 465303 - DNA, 25 bp, Mus musculus
gacttgtgaatctgtgctgactggt

SEQ ID NO: 465304 - DNA, 25 bp, Mus musculus
gacttgtgacaaactttaacctggt

SEQ ID NO: 465305 - DNA, 25 bp, Mus musculus
gacttgtgacaatctttaacctggt

SEQ ID NO: 465306 - DNA, 25 bp, Mus musculus
gacttgtgacacctgggctgtgatc

SEQ ID NO: 465307 - DNA, 25 bp, Mus musculus
gacttgtgacacgtgggctgtgatc

SEQ ID NO: 465308 - DNA, 25 bp, Mus musculus
gacttgtgaggcacagatgctgata

SEQ ID NO: 465309 - DNA, 25 bp, Mus musculus
gacttgtgaggctcagatgctgata

SEQ ID NO: 465310 - DNA, 25 bp, Mus musculus
gacttgtgcagtaggtatttagata

SEQ ID NO: 465311 - DNA, 25 bp, Mus musculus
gacttgtgcagttggtatttagata

SEQ ID NO: 465312 - DNA, 25 bp, Mus musculus
gacttgtgctgaaggtacacccaga

SEQ ID NO: 465313 - DNA, 25 bp, Mus musculus
gacttgtgctgatggtacacccaga

SEQ ID NO: 465314 - DNA, 25 bp, Mus musculus
gacttgtggaaacaccttctcatgt

SEQ ID NO: 465315 - DNA, 25 bp, Mus musculus
gacttgtggaaagaccttctcatgt

SEQ ID NO: 465316 - DNA, 25 bp, Mus musculus
gacttgtggagaactttcttagact

SEQ ID NO: 465317 - DNA, 25 bp, Mus musculus
gacttgtggagatctttcttagact

SEQ ID NO: 465318 - DNA, 25 bp, Mus musculus
gacttgtggcgccttctcataaaag

SEQ ID NO: 465319 - DNA, 25 bp, Mus musculus
gacttgtggcgcgttctcataaaag

SEQ ID NO: 465320 - DNA, 25 bp, Mus musculus
gacttgtggtagaccatttccctct

SEQ ID NO: 465321 - DNA, 25 bp, Mus musculus
gacttgtggtagtccatttccctct

SEQ ID NO: 465322 - DNA, 25 bp, Mus musculus
gacttgtgtagtaggatgaactgat

SEQ ID NO: 465323 - DNA, 25 bp, Mus musculus
gacttgtgtagttggatgaactgat

SEQ ID NO: 465324 - DNA, 25 bp, Mus musculus
gacttgtgtcatacatatcttttat

SEQ ID NO: 465325 - DNA, 25 bp, Mus musculus
gacttgtgtcattcatatcttttat

SEQ ID NO: 465326 - DNA, 25 bp, Mus musculus
gacttgtgtcgtctggtgcgaacaa

SEQ ID NO: 465327 - DNA, 25 bp, Mus musculus
gacttgtgtcgtgtggtgcgaacaa

SEQ ID NO: 465328 - DNA, 25 bp, Mus musculus
gacttgtgtgcgacttgggacccca

SEQ ID NO: 465329 - DNA, 25 bp, Mus musculus
gacttgtgtgcgtcttgggacccca

SEQ ID NO: 465330 - DNA, 25 bp, Mus musculus
gacttgtgttagctttcaacttctt

SEQ ID NO: 465331 - DNA, 25 bp, Mus musculus
gacttgtgttaggtttcaacttctt

SEQ ID NO: 465332 - DNA, 25 bp, Mus musculus
gacttgtgttttcttaatcaccgca

SEQ ID NO: 465333 - DNA, 25 bp, Mus musculus
gacttgtgttttgttaatcaccgca

SEQ ID NO: 465334 - DNA, 25 bp, Mus musculus
gacttgttaacaagctttgagctga

SEQ ID NO: 465335 - DNA, 25 bp, Mus musculus
gacttgttaacatgctttgagctga

SEQ ID NO: 465336 - DNA, 25 bp, Mus musculus
gacttgttacatcgatttctttgct

SEQ ID NO: 465337 - DNA, 25 bp, Mus musculus
gacttgttacatggatttctttgct

SEQ ID NO: 465338 - DNA, 25 bp, Mus musculus
gacttgttacggctctgacacagag

SEQ ID NO: 465339 - DNA, 25 bp, Mus musculus
gacttgttacgggtctgacacagag

SEQ ID NO: 465340 - DNA, 25 bp, Mus musculus
gacttgttactcctcgtgtcctgca

SEQ ID NO: 465341 - DNA, 25 bp, Mus musculus
gacttgttactcgtcgtgtcctgca

SEQ ID NO: 465342 - DNA, 25 bp, Mus musculus
gacttgttagctatattcctttcgt

SEQ ID NO: 465343 - DNA, 25 bp, Mus musculus
gacttgttagctttattcctttcgt

SEQ ID NO: 465344 - DNA, 25 bp, Mus musculus
gacttgttagtcatgcaggtaatcc

SEQ ID NO: 465345 - DNA, 25 bp, Mus musculus
gacttgttagtcttgcaggtaatcc

SEQ ID NO: 465346 - DNA, 25 bp, Mus musculus
gacttgttcaagatgctcaaagtat

SEQ ID NO: 465347 - DNA, 25 bp, Mus musculus
gacttgttcaagttgctcaaagtat

SEQ ID NO: 465348 - DNA, 25 bp, Mus musculus
gacttgttccctatgtattcactat

SEQ ID NO: 465349 - DNA, 25 bp, Mus musculus
gacttgttccctttgtattcactat

SEQ ID NO: 465350 - DNA, 25 bp, Mus musculus
gacttgttcctcagcatctgtataa

SEQ ID NO: 465351 - DNA, 25 bp, Mus musculus
gacttgttcctctgcatctgtataa

SEQ ID NO: 465352 - DNA, 25 bp, Mus musculus
gacttgttctagatagagactgtca

SEQ ID NO: 465353 - DNA, 25 bp, Mus musculus
gacttgttctagttagagactgtca

SEQ ID NO: 465354 - DNA, 25 bp, Mus musculus
gacttgttcttgaacagctgtggct

SEQ ID NO: 465355 - DNA, 25 bp, Mus musculus
gacttgttcttgacttttcttcaca

SEQ ID NO: 465356 - DNA, 25 bp, Mus musculus
gacttgttcttgtacagctgtggct

SEQ ID NO: 465357 - DNA, 25 bp, Mus musculus
gacttgttcttgtcttttcttcaca

SEQ ID NO: 465358 - DNA, 25 bp, Mus musculus
gacttgttgcttacaaaggattcct

SEQ ID NO: 465359 - DNA, 25 bp, Mus musculus
gacttgttgctttcaaaggattcct

SEQ ID NO: 465360 - DNA, 25 bp, Mus musculus
gacttgttggatatggttcctgaac

SEQ ID NO: 465361 - DNA, 25 bp, Mus musculus
gacttgttggatttggttcctgaac

SEQ ID NO: 465362 - DNA, 25 bp, Mus musculus
gacttgttggctctaggcttaatgt

SEQ ID NO: 465363 - DNA, 25 bp, Mus musculus
gacttgttggctgtaggcttaatgt

SEQ ID NO: 465364 - DNA, 25 bp, Mus musculus
gacttgttgtatcttctatttccta

SEQ ID NO: 465365 - DNA, 25 bp, Mus musculus
gacttgttgtatgttctatttccta

SEQ ID NO: 465366 - DNA, 25 bp, Mus musculus
gacttgttgtcaaggactcctggtt

SEQ ID NO: 465367 - DNA, 25 bp, Mus musculus
gacttgttgtcatggactcctggtt

SEQ ID NO: 465368 - DNA, 25 bp, Mus musculus
gacttgttgtcgcaactctactgaa

SEQ ID NO: 465369 - DNA, 25 bp, Mus musculus
gacttgttgtcggaactctactgaa

SEQ ID NO: 465370 - DNA, 25 bp, Mus musculus
gacttgtttagaacccatgagctag

SEQ ID NO: 465371 - DNA, 25 bp, Mus musculus
gacttgtttagatcccatgagctag

SEQ ID NO: 465372 - DNA, 25 bp, Mus musculus
gacttgtttccaactaagaagacag

SEQ ID NO: 465373 - DNA, 25 bp, Mus musculus
gacttgtttccatctaagaagacag

SEQ ID NO: 465374 - DNA, 25 bp, Mus musculus
gacttgtttgaaatcctggtatcag

SEQ ID NO: 465375 - DNA, 25 bp, Mus musculus
gacttgtttgaattcctggtatcag

SEQ ID NO: 465376 - DNA, 25 bp, Mus musculus
gacttgtttgacagcttagaatcca

SEQ ID NO: 465377 - DNA, 25 bp, Mus musculus
gacttgtttgactgcttagaatcca

SEQ ID NO: 465378 - DNA, 25 bp, Mus musculus
gacttgtttgagagttttttcccat

SEQ ID NO: 465379 - DNA, 25 bp, Mus musculus
gacttgtttgagtgttttttcccat

SEQ ID NO: 465380 - DNA, 25 bp, Mus musculus
gacttgttttggatccctacttact

SEQ ID NO: 465381 - DNA, 25 bp, Mus musculus
gacttgttttggttccctacttact

SEQ ID NO: 465382 - DNA, 25 bp, Mus musculus
gacttgtttttcactattgtaatct

SEQ ID NO: 465383 - DNA, 25 bp, Mus musculus
gacttgtttttcctctataatcttg

SEQ ID NO: 465384 - DNA, 25 bp, Mus musculus
gacttgtttttcgtctataatcttg

SEQ ID NO: 465385 - DNA, 25 bp, Mus musculus
gacttgtttttctctattgtaatct

SEQ ID NO: 465386 - DNA, 25 bp, Mus musculus
gactttaaaatgagccctgaccttt

SEQ ID NO: 465387 - DNA, 25 bp, Mus musculus
gactttaaaatgtgccctgaccttt

SEQ ID NO: 465388 - DNA, 25 bp, Mus musculus
gactttaaagccctgcctatcacca

SEQ ID NO: 465389 - DNA, 25 bp, Mus musculus
gactttaaagccgtgcctatcacca

SEQ ID NO: 465390 - DNA, 25 bp, Mus musculus
gactttaaagtgattggcatccgcc

SEQ ID NO: 465391 - DNA, 25 bp, Mus musculus
gactttaaagtgtttggcatccgcc

SEQ ID NO: 465392 - DNA, 25 bp, Mus musculus
gactttaaatcaaatgcatcccgac

SEQ ID NO: 465393 - DNA, 25 bp, Mus musculus
gactttaaatcatatgcatcccgac

SEQ ID NO: 465394 - DNA, 25 bp, Mus musculus
gactttaaccccaattgagacattt

SEQ ID NO: 465395 - DNA, 25 bp, Mus musculus
gactttaacccctattgagacattt

SEQ ID NO: 465396 - DNA, 25 bp, Mus musculus
gactttaagcaaacctatgggcgat

SEQ ID NO: 465397 - DNA, 25 bp, Mus musculus
gactttaagcaatcctatgggcgat

SEQ ID NO: 465398 - DNA, 25 bp, Mus musculus
gactttaagccaacactcaagaccg

SEQ ID NO: 465399 - DNA, 25 bp, Mus musculus
gactttaagccatcactcaagaccg

SEQ ID NO: 465400 - DNA, 25 bp, Mus musculus
gactttaagcctcatcgtggtttca

SEQ ID NO: 465401 - DNA, 25 bp, Mus musculus
gactttaagcctgatcgtggtttca

SEQ ID NO: 465402 - DNA, 25 bp, Mus musculus
gactttaagctccacttcggcaatt

SEQ ID NO: 465403 - DNA, 25 bp, Mus musculus
gactttaagctcgacttcggcaatt

SEQ ID NO: 465404 - DNA, 25 bp, Mus musculus
gactttaaggcaagctttctccatt

SEQ ID NO: 465405 - DNA, 25 bp, Mus musculus
gactttaaggcatgctttctccatt

SEQ ID NO: 465406 - DNA, 25 bp, Mus musculus
gactttaagtttacagacctatttg

SEQ ID NO: 465407 - DNA, 25 bp, Mus musculus
gactttaagttttcagacctatttg

SEQ ID NO: 465408 - DNA, 25 bp, Mus musculus
gactttaatctcagactcttgcctc

SEQ ID NO: 465409 - DNA, 25 bp, Mus musculus
gactttaatctctgactcttgcctc

SEQ ID NO: 465410 - DNA, 25 bp, Mus musculus
gactttaatgtcattgtgtgtgcgc

SEQ ID NO: 465411 - DNA, 25 bp, Mus musculus
gactttaatgtctttgtgtgtgcgc

SEQ ID NO: 465412 - DNA, 25 bp, Mus musculus
gactttaatgtgacaattctcgatt

SEQ ID NO: 465413 - DNA, 25 bp, Mus musculus
gactttaatgtgtcaattctcgatt

SEQ ID NO: 465414 - DNA, 25 bp, Mus musculus
gactttaattagacgtctccctgga

SEQ ID NO: 465415 - DNA, 25 bp, Mus musculus
gactttaattagtcgtctccctgga

SEQ ID NO: 465416 - DNA, 25 bp, Mus musculus
gactttaattctcgaacccacatgg

SEQ ID NO: 465417 - DNA, 25 bp, Mus musculus
gactttaattctggaacccacatgg

SEQ ID NO: 465418 - DNA, 25 bp, Mus musculus
gactttaatttcacagatgactatt

SEQ ID NO: 465419 - DNA, 25 bp, Mus musculus
gactttaatttctcagatgactatt

SEQ ID NO: 465420 - DNA, 25 bp, Mus musculus
gactttacacacagccctattacag

SEQ ID NO: 465421 - DNA, 25 bp, Mus musculus
gactttacacactgccctattacag

SEQ ID NO: 465422 - DNA, 25 bp, Mus musculus
gactttacaccacctacaaggaccg

SEQ ID NO: 465423 - DNA, 25 bp, Mus musculus
gactttacaccagctacaaggaccg

SEQ ID NO: 465424 - DNA, 25 bp, Mus musculus
gactttacactaaaagccgtctttg

SEQ ID NO: 465425 - DNA, 25 bp, Mus musculus
gactttacactataagccgtctttg

SEQ ID NO: 465426 - DNA, 25 bp, Mus musculus
gactttacatacctgctcttatcca

SEQ ID NO: 465427 - DNA, 25 bp, Mus musculus
gactttacatacgtgctcttatcca

SEQ ID NO: 465428 - DNA, 25 bp, Mus musculus
gactttacatggatgctgtgtcact

SEQ ID NO: 465429 - DNA, 25 bp, Mus musculus
gactttacatggttgctgtgtcact

SEQ ID NO: 465430 - DNA, 25 bp, Mus musculus
gactttacattgactatgagccaag

SEQ ID NO: 465431 - DNA, 25 bp, Mus musculus
gactttacattgtctatgagccaag

SEQ ID NO: 465432 - DNA, 25 bp, Mus musculus
gactttaccacgaagcaaccaggaa

SEQ ID NO: 465433 - DNA, 25 bp, Mus musculus
gactttaccacgtagcaaccaggaa

SEQ ID NO: 465434 - DNA, 25 bp, Mus musculus
gactttacccagcatgaccagcaag

SEQ ID NO: 465435 - DNA, 25 bp, Mus musculus
gactttacccaggatgaccagcaag

SEQ ID NO: 465436 - DNA, 25 bp, Mus musculus
gactttacggttagtttagctctga

SEQ ID NO: 465437 - DNA, 25 bp, Mus musculus
gactttacggtttgtttagctctga

SEQ ID NO: 465438 - DNA, 25 bp, Mus musculus
gactttactacaatgaagattttaa

SEQ ID NO: 465439 - DNA, 25 bp, Mus musculus
gactttactacattgaagattttaa

SEQ ID NO: 465440 - DNA, 25 bp, Mus musculus
gactttactactaacatatgcagga

SEQ ID NO: 465441 - DNA, 25 bp, Mus musculus
gactttactacttacatatgcagga

SEQ ID NO: 465442 - DNA, 25 bp, Mus musculus
gactttactcacagacacatctttc

SEQ ID NO: 465443 - DNA, 25 bp, Mus musculus
gactttactcactgacacatctttc

SEQ ID NO: 465444 - DNA, 25 bp, Mus musculus
gactttactctcatttcaaatattg

SEQ ID NO: 465445 - DNA, 25 bp, Mus musculus
gactttactctcttttcaaatattg

SEQ ID NO: 465446 - DNA, 25 bp, Mus musculus
gactttactgtcacattggcaacta

SEQ ID NO: 465447 - DNA, 25 bp, Mus musculus
gactttactgtctcattggcaacta

SEQ ID NO: 465448 - DNA, 25 bp, Mus musculus
gactttacttttcggccttgctata

SEQ ID NO: 465449 - DNA, 25 bp, Mus musculus
gactttacttttgggccttgctata

SEQ ID NO: 465450 - DNA, 25 bp, Mus musculus
gactttagagatactgatcctggca

SEQ ID NO: 465451 - DNA, 25 bp, Mus musculus
gactttagagattctgatcctggca

SEQ ID NO: 465452 - DNA, 25 bp, Mus musculus
gactttagatgactctccaggtctt

SEQ ID NO: 465453 - DNA, 25 bp, Mus musculus
gactttagatgagtctccaggtctt

SEQ ID NO: 465454 - DNA, 25 bp, Mus musculus
gactttagcagacgccctagactgg

SEQ ID NO: 465455 - DNA, 25 bp, Mus musculus
gactttagcagaggccctagactgg

SEQ ID NO: 465456 - DNA, 25 bp, Mus musculus
gactttagctctagacagcacagat

SEQ ID NO: 465457 - DNA, 25 bp, Mus musculus
gactttagctcttgacagcacagat

SEQ ID NO: 465458 - DNA, 25 bp, Mus musculus
gactttagctgccttaatatctgca

SEQ ID NO: 465459 - DNA, 25 bp, Mus musculus
gactttagctgcgttaatatctgca

SEQ ID NO: 465460 - DNA, 25 bp, Mus musculus
gactttaggagactaggattccaga

SEQ ID NO: 465461 - DNA, 25 bp, Mus musculus
gactttaggagagtaggattccaga

SEQ ID NO: 465462 - DNA, 25 bp, Mus musculus
gactttaggatgctggttccactgt

SEQ ID NO: 465463 - DNA, 25 bp, Mus musculus
gactttaggatggtggttccactgt

SEQ ID NO: 465464 - DNA, 25 bp, Mus musculus
gactttaggcggctgtctgttggaa

SEQ ID NO: 465465 - DNA, 25 bp, Mus musculus
gactttaggcgggtgtctgttggaa

SEQ ID NO: 465466 - DNA, 25 bp, Mus musculus
gactttaggcttcatatcggttcct

SEQ ID NO: 465467 - DNA, 25 bp, Mus musculus
gactttaggcttgatatcggttcct

SEQ ID NO: 465468 - DNA, 25 bp, Mus musculus
gactttagggacatgcagcagggag

SEQ ID NO: 465469 - DNA, 25 bp, Mus musculus
gactttagggacttgcagcagggag

SEQ ID NO: 465470 - DNA, 25 bp, Mus musculus
gactttagtgagcactgaggcagct

SEQ ID NO: 465471 - DNA, 25 bp, Mus musculus
gactttagtgaggactgaggcagct

SEQ ID NO: 465472 - DNA, 25 bp, Mus musculus
gactttagtgttcaccagctgagat

SEQ ID NO: 465473 - DNA, 25 bp, Mus musculus
gactttagtgttgaccagctgagat

SEQ ID NO: 465474 - DNA, 25 bp, Mus musculus
gactttataaatagacttctccggg

SEQ ID NO: 465475 - DNA, 25 bp, Mus musculus
gactttataaattgacttctccggg

SEQ ID NO: 465476 - DNA, 25 bp, Mus musculus
gactttatagagattcatatggcta

SEQ ID NO: 465477 - DNA, 25 bp, Mus musculus
gactttatagagtttcatatggcta

SEQ ID NO: 465478 - DNA, 25 bp, Mus musculus
gactttatagccatggttctctggg

SEQ ID NO: 465479 - DNA, 25 bp, Mus musculus
gactttatagccttggttctctggg

SEQ ID NO: 465480 - DNA, 25 bp, Mus musculus
gactttatagtactcctggtttgat

SEQ ID NO: 465481 - DNA, 25 bp, Mus musculus
gactttatagtagtcctggtttgat

SEQ ID NO: 465482 - DNA, 25 bp, Mus musculus
gactttatagtgatcaattctcttt

SEQ ID NO: 465483 - DNA, 25 bp, Mus musculus
gactttatagtgttcaattctcttt

SEQ ID NO: 465484 - DNA, 25 bp, Mus musculus
gactttatattcatacttccacatg

SEQ ID NO: 465485 - DNA, 25 bp, Mus musculus
gactttatattcttacttccacatg

SEQ ID NO: 465486 - DNA, 25 bp, Mus musculus
gactttatcagtaccaaccttccct

SEQ ID NO: 465487 - DNA, 25 bp, Mus musculus
gactttatcagttccaaccttccct

SEQ ID NO: 465488 - DNA, 25 bp, Mus musculus
gactttatccatctatctctgcctg

SEQ ID NO: 465489 - DNA, 25 bp, Mus musculus
gactttatccatgtatctctgcctg

SEQ ID NO: 465490 - DNA, 25 bp, Mus musculus
gactttatccggagcacacaactga

SEQ ID NO: 465491 - DNA, 25 bp, Mus musculus
gactttatccggtgcacacaactga

SEQ ID NO: 465492 - DNA, 25 bp, Mus musculus
gactttatccttatctaagtgccat

SEQ ID NO: 465493 - DNA, 25 bp, Mus musculus
gactttatccttttctaagtgccat

SEQ ID NO: 465494 - DNA, 25 bp, Mus musculus
gactttatctcccaaatgaaaccaa

SEQ ID NO: 465495 - DNA, 25 bp, Mus musculus
gactttatctccgaaatgaaaccaa

SEQ ID NO: 465496 - DNA, 25 bp, Mus musculus
gactttatctctaatcattattcct

SEQ ID NO: 465497 - DNA, 25 bp, Mus musculus
gactttatctcttatcattattcct

SEQ ID NO: 465498 - DNA, 25 bp, Mus musculus
gactttatcttgatttgcttttggt

SEQ ID NO: 465499 - DNA, 25 bp, Mus musculus
gactttatcttgttttgcttttggt

SEQ ID NO: 465500 - DNA, 25 bp, Mus musculus
gactttatggagactttccaggtgt

SEQ ID NO: 465501 - DNA, 25 bp, Mus musculus
gactttatggagtctttccaggtgt

SEQ ID NO: 465502 - DNA, 25 bp, Mus musculus
gactttatgtgaattctgatccagc

SEQ ID NO: 465503 - DNA, 25 bp, Mus musculus
gactttatgtgatttctgatccagc

SEQ ID NO: 465504 - DNA, 25 bp, Mus musculus
gactttatgttcctttagaacaact

SEQ ID NO: 465505 - DNA, 25 bp, Mus musculus
gactttatgttcgtttagaacaact

SEQ ID NO: 465506 - DNA, 25 bp, Mus musculus
gactttattcaacactccaaatggt

SEQ ID NO: 465507 - DNA, 25 bp, Mus musculus
gactttattcaagactccaaatggt

SEQ ID NO: 465508 - DNA, 25 bp, Mus musculus
gactttattctcatgggcttttcta

SEQ ID NO: 465509 - DNA, 25 bp, Mus musculus
gactttattctcttgggcttttcta

SEQ ID NO: 465510 - DNA, 25 bp, Mus musculus
gactttattctgagctctaaccata

SEQ ID NO: 465511 - DNA, 25 bp, Mus musculus
gactttattctgtgctctaaccata

SEQ ID NO: 465512 - DNA, 25 bp, Mus musculus
gactttattgaaccacctatgggac

SEQ ID NO: 465513 - DNA, 25 bp, Mus musculus
gactttattgaagcacctatgggac

SEQ ID NO: 465514 - DNA, 25 bp, Mus musculus
gactttattgtaacttaacagttaa

SEQ ID NO: 465515 - DNA, 25 bp, Mus musculus
gactttattgtatcttaacagttaa

SEQ ID NO: 465516 - DNA, 25 bp, Mus musculus
gactttcaaaggatgctgggtgttt

SEQ ID NO: 465517 - DNA, 25 bp, Mus musculus
gactttcaaaggttgctgggtgttt

SEQ ID NO: 465518 - DNA, 25 bp, Mus musculus
gactttcaacttaactctgtactcc

SEQ ID NO: 465519 - DNA, 25 bp, Mus musculus
gactttcaactttactctgtactcc

SEQ ID NO: 465520 - DNA, 25 bp, Mus musculus
gactttcaagggcttcgtccagaag

SEQ ID NO: 465521 - DNA, 25 bp, Mus musculus
gactttcaaggggttcgtccagaag

SEQ ID NO: 465522 - DNA, 25 bp, Mus musculus
gactttcaagtcagaatcctatgag

SEQ ID NO: 465523 - DNA, 25 bp, Mus musculus
gactttcaagtctgaatcctatgag

SEQ ID NO: 465524 - DNA, 25 bp, Mus musculus
gactttcaatatcacgaggactcgg

SEQ ID NO: 465525 - DNA, 25 bp, Mus musculus
gactttcaatatgacgaggactcgg

SEQ ID NO: 465526 - DNA, 25 bp, Mus musculus
gactttcacagtcctatggagcgct

SEQ ID NO: 465527 - DNA, 25 bp, Mus musculus
gactttcacagtgctatggagcgct

SEQ ID NO: 465528 - DNA, 25 bp, Mus musculus
gactttcacatgagtgtcatgggaa

SEQ ID NO: 465529 - DNA, 25 bp, Mus musculus
gactttcacatgctacagtttacac

SEQ ID NO: 465530 - DNA, 25 bp, Mus musculus
gactttcacatggtacagtttacac

SEQ ID NO: 465531 - DNA, 25 bp, Mus musculus
gactttcacatgtgtgtcatgggaa

SEQ ID NO: 465532 - DNA, 25 bp, Mus musculus
gactttcacctacggcagctgttgc

SEQ ID NO: 465533 - DNA, 25 bp, Mus musculus
gactttcacctagggcagctgttgc

SEQ ID NO: 465534 - DNA, 25 bp, Mus musculus
gactttcagaagatcgccccgagag

SEQ ID NO: 465535 - DNA, 25 bp, Mus musculus
gactttcagaagttcgccccgagag

SEQ ID NO: 465536 - DNA, 25 bp, Mus musculus
gactttcagaatcataagcccctgg

SEQ ID NO: 465537 - DNA, 25 bp, Mus musculus
gactttcagaatgataagcccctgg

SEQ ID NO: 465538 - DNA, 25 bp, Mus musculus
gactttcagcccctgggataaggaa

SEQ ID NO: 465539 - DNA, 25 bp, Mus musculus
gactttcagcccgtgggataaggaa

SEQ ID NO: 465540 - DNA, 25 bp, Mus musculus
gactttcaggagcacggttacccag

SEQ ID NO: 465541 - DNA, 25 bp, Mus musculus
gactttcaggaggacggttacccag

SEQ ID NO: 465542 - DNA, 25 bp, Mus musculus
gactttcaggatcggaactccgggc

SEQ ID NO: 465543 - DNA, 25 bp, Mus musculus
gactttcaggatgggaactccgggc

SEQ ID NO: 465544 - DNA, 25 bp, Mus musculus
gactttcaggcaaactgaacatcat

SEQ ID NO: 465545 - DNA, 25 bp, Mus musculus
gactttcaggcatactgaacatcat

SEQ ID NO: 465546 - DNA, 25 bp, Mus musculus
gactttcaggccctctgaacataag

SEQ ID NO: 465547 - DNA, 25 bp, Mus musculus
gactttcaggccgtctgaacataag

SEQ ID NO: 465548 - DNA, 25 bp, Mus musculus
gactttcagtgaactgtgtgcatct

SEQ ID NO: 465549 - DNA, 25 bp, Mus musculus
gactttcagtgatctgtgtgcatct

SEQ ID NO: 465550 - DNA, 25 bp, Mus musculus
gactttcataacattctgatctttt

SEQ ID NO: 465551 - DNA, 25 bp, Mus musculus
gactttcataactttctgatctttt

SEQ ID NO: 465552 - DNA, 25 bp, Mus musculus
gactttcatactatgtgtgctttct

SEQ ID NO: 465553 - DNA, 25 bp, Mus musculus
gactttcatactttgtgtgctttct

SEQ ID NO: 465554 - DNA, 25 bp, Mus musculus
gactttcatatcatcttccatgata

SEQ ID NO: 465555 - DNA, 25 bp, Mus musculus
gactttcatatcttcttccatgata

SEQ ID NO: 465556 - DNA, 25 bp, Mus musculus
gactttcatgaacccatgcagttgc

SEQ ID NO: 465557 - DNA, 25 bp, Mus musculus
gactttcatgaagccatgcagttgc

SEQ ID NO: 465558 - DNA, 25 bp, Mus musculus
gactttcattgtctttcatgtattt

SEQ ID NO: 465559 - DNA, 25 bp, Mus musculus
gactttcattgtgtttcatgtattt

SEQ ID NO: 465560 - DNA, 25 bp, Mus musculus
gactttccaagaacaacactccttt

SEQ ID NO: 465561 - DNA, 25 bp, Mus musculus
gactttccaagatcaacactccttt

SEQ ID NO: 465562 - DNA, 25 bp, Mus musculus
gactttccaatcatgatactcagta

SEQ ID NO: 465563 - DNA, 25 bp, Mus musculus
gactttccaatcttgatactcagta

SEQ ID NO: 465564 - DNA, 25 bp, Mus musculus
gactttccaccaatggagggatgct

SEQ ID NO: 465565 - DNA, 25 bp, Mus musculus
gactttccaccattggagggatgct

SEQ ID NO: 465566 - DNA, 25 bp, Mus musculus
gactttccactgaagaattcacttt

SEQ ID NO: 465567 - DNA, 25 bp, Mus musculus
gactttccactgtagaattcacttt

SEQ ID NO: 465568 - DNA, 25 bp, Mus musculus
gactttccagaaagtgtggttatgt

SEQ ID NO: 465569 - DNA, 25 bp, Mus musculus
gactttccagaatgtgtggttatgt

SEQ ID NO: 465570 - DNA, 25 bp, Mus musculus
gactttccagtcctgtgcctgacaa

SEQ ID NO: 465571 - DNA, 25 bp, Mus musculus
gactttccagtcgtgtgcctgacaa

SEQ ID NO: 465572 - DNA, 25 bp, Mus musculus
gactttccatctcattttcctgtta

SEQ ID NO: 465573 - DNA, 25 bp, Mus musculus
gactttccatctgattttcctgtta

SEQ ID NO: 465574 - DNA, 25 bp, Mus musculus
gactttccatgcaatcaaggagaac

SEQ ID NO: 465575 - DNA, 25 bp, Mus musculus
gactttccatgctatcaaggagaac

SEQ ID NO: 465576 - DNA, 25 bp, Mus musculus
gactttccattactgtctatttctt

SEQ ID NO: 465577 - DNA, 25 bp, Mus musculus
gactttccattagtgtctatttctt

SEQ ID NO: 465578 - DNA, 25 bp, Mus musculus
gactttcccaagaatgtcaacttta

SEQ ID NO: 465579 - DNA, 25 bp, Mus musculus
gactttcccaagtatgtcaacttta

SEQ ID NO: 465580 - DNA, 25 bp, Mus musculus
gactttcccagtcttactgtttcaa

SEQ ID NO: 465581 - DNA, 25 bp, Mus musculus
gactttcccagtgttactgtttcaa

SEQ ID NO: 465582 - DNA, 25 bp, Mus musculus
gactttccccaaagtgactcaggca

SEQ ID NO: 465583 - DNA, 25 bp, Mus musculus
gactttccccaatgtgactcaggca

SEQ ID NO: 465584 - DNA, 25 bp, Mus musculus
gactttccctttagatagttgccca

SEQ ID NO: 465585 - DNA, 25 bp, Mus musculus
gactttcccttttgatagttgccca

SEQ ID NO: 465586 - DNA, 25 bp, Mus musculus
gactttccgtagaaagatgtctcat

SEQ ID NO: 465587 - DNA, 25 bp, Mus musculus
gactttccgtagtaagatgtctcat

SEQ ID NO: 465588 - DNA, 25 bp, Mus musculus
gactttccgttcagcctctgactca

SEQ ID NO: 465589 - DNA, 25 bp, Mus musculus
gactttccgttctgcctctgactca

SEQ ID NO: 465590 - DNA, 25 bp, Mus musculus
gactttcctgacatccgtatgcatg

SEQ ID NO: 465591 - DNA, 25 bp, Mus musculus
gactttcctgacttccgtatgcatg

SEQ ID NO: 465592 - DNA, 25 bp, Mus musculus
gactttcctgttaaattactgggtg

SEQ ID NO: 465593 - DNA, 25 bp, Mus musculus
gactttcctgtttaattactgggtg

SEQ ID NO: 465594 - DNA, 25 bp, Mus musculus
gactttccttagattcaccatcaca

SEQ ID NO: 465595 - DNA, 25 bp, Mus musculus
gactttccttagtttcaccatcaca

SEQ ID NO: 465596 - DNA, 25 bp, Mus musculus
gactttcgaattatgatcctcctgc

SEQ ID NO: 465597 - DNA, 25 bp, Mus musculus
gactttcgaattttgatcctcctgc

SEQ ID NO: 465598 - DNA, 25 bp, Mus musculus
gactttcggaagagccatctgacca

SEQ ID NO: 465599 - DNA, 25 bp, Mus musculus
gactttcggaagtgccatctgacca

SEQ ID NO: 465600 - DNA, 25 bp, Mus musculus
gactttcgtgatcagcaaattggac

SEQ ID NO: 465601 - DNA, 25 bp, Mus musculus
gactttcgtgatgagcaaattggac

SEQ ID NO: 465602 - DNA, 25 bp, Mus musculus
gactttctaactagtcttgtttgat

SEQ ID NO: 465603 - DNA, 25 bp, Mus musculus
gactttctaacttgtcttgtttgat

SEQ ID NO: 465604 - DNA, 25 bp, Mus musculus
gactttctacaacagaatgtctaaa

SEQ ID NO: 465605 - DNA, 25 bp, Mus musculus
gactttctacaagagaatgtctaaa

SEQ ID NO: 465606 - DNA, 25 bp, Mus musculus
gactttctacttactattagatttg

SEQ ID NO: 465607 - DNA, 25 bp, Mus musculus
gactttctactttctattagatttg

SEQ ID NO: 465608 - DNA, 25 bp, Mus musculus
gactttctagacatcagggctatga

SEQ ID NO: 465609 - DNA, 25 bp, Mus musculus
gactttctagacttcagggctatga

SEQ ID NO: 465610 - DNA, 25 bp, Mus musculus
gactttctagatatatcctttccga

SEQ ID NO: 465611 - DNA, 25 bp, Mus musculus
gactttctagatttatcctttccga

SEQ ID NO: 465612 - DNA, 25 bp, Mus musculus
gactttctaggactttggaacactg

SEQ ID NO: 465613 - DNA, 25 bp, Mus musculus
gactttctaggagtttggaacactg

SEQ ID NO: 465614 - DNA, 25 bp, Mus musculus
gactttctattcacacttttcttat

SEQ ID NO: 465615 - DNA, 25 bp, Mus musculus
gactttctattctcacttttcttat

SEQ ID NO: 465616 - DNA, 25 bp, Mus musculus
gactttctccaaccactaattgcaa

SEQ ID NO: 465617 - DNA, 25 bp, Mus musculus
gactttctccaagcactaattgcaa

SEQ ID NO: 465618 - DNA, 25 bp, Mus musculus
gactttctcccaagacttcacattt

SEQ ID NO: 465619 - DNA, 25 bp, Mus musculus
gactttctcccatgacttcacattt

SEQ ID NO: 465620 - DNA, 25 bp, Mus musculus
gactttctcctcatcataggtcttt

SEQ ID NO: 465621 - DNA, 25 bp, Mus musculus
gactttctcctcttcataggtcttt

SEQ ID NO: 465622 - DNA, 25 bp, Mus musculus
gactttctcgaacagtcgaagacga

SEQ ID NO: 465623 - DNA, 25 bp, Mus musculus
gactttctcgaagagtcgaagacga

SEQ ID NO: 465624 - DNA, 25 bp, Mus musculus
gactttctctctaagaatttccata

SEQ ID NO: 465625 - DNA, 25 bp, Mus musculus
gactttctctcttagaatttccata

SEQ ID NO: 465626 - DNA, 25 bp, Mus musculus
gactttctcttgactttaactggac

SEQ ID NO: 465627 - DNA, 25 bp, Mus musculus
gactttctcttgtctttaactggac

SEQ ID NO: 465628 - DNA, 25 bp, Mus musculus
gactttctgaccagatgacttctgc

SEQ ID NO: 465629 - DNA, 25 bp, Mus musculus
gactttctgacctgatgacttctgc

SEQ ID NO: 465630 - DNA, 25 bp, Mus musculus
gactttctgactccagagtaccgat

SEQ ID NO: 465631 - DNA, 25 bp, Mus musculus
gactttctgactgcagagtaccgat

SEQ ID NO: 465632 - DNA, 25 bp, Mus musculus
gactttctgcatcatggcttcctgt

SEQ ID NO: 465633 - DNA, 25 bp, Mus musculus
gactttctgcatgatggcttcctgt

SEQ ID NO: 465634 - DNA, 25 bp, Mus musculus
gactttctgctacaataaggtcact

SEQ ID NO: 465635 - DNA, 25 bp, Mus musculus
gactttctgctagaataaggtcact

SEQ ID NO: 465636 - DNA, 25 bp, Mus musculus
gactttctgctgaccagtcagactt

SEQ ID NO: 465637 - DNA, 25 bp, Mus musculus
gactttctgctgtccagtcagactt

SEQ ID NO: 465638 - DNA, 25 bp, Mus musculus
gactttctggtcctgatgctagaat

SEQ ID NO: 465639 - DNA, 25 bp, Mus musculus
gactttctggtcgtgatgctagaat

SEQ ID NO: 465640 - DNA, 25 bp, Mus musculus
gactttctggtgcacacagctctgg

SEQ ID NO: 465641 - DNA, 25 bp, Mus musculus
gactttctggtgcatgacggtacaa

SEQ ID NO: 465642 - DNA, 25 bp, Mus musculus
gactttctggtggacacagctctgg

SEQ ID NO: 465643 - DNA, 25 bp, Mus musculus
gactttctggtggatgacggtacaa

SEQ ID NO: 465644 - DNA, 25 bp, Mus musculus
gactttctgtaactttatatctgtc

SEQ ID NO: 465645 - DNA, 25 bp, Mus musculus
gactttctgtaagtttatatctgtc

SEQ ID NO: 465646 - DNA, 25 bp, Mus musculus
gactttctgtccaattcatggttaa

SEQ ID NO: 465647 - DNA, 25 bp, Mus musculus
gactttctgtcctattcatggttaa

SEQ ID NO: 465648 - DNA, 25 bp, Mus musculus
gactttctgtctacatacttaatga

SEQ ID NO: 465649 - DNA, 25 bp, Mus musculus
gactttctgtcttcatacttaatga

SEQ ID NO: 465650 - DNA, 25 bp, Mus musculus
gactttctgtgcatacagtccagcc

SEQ ID NO: 465651 - DNA, 25 bp, Mus musculus
gactttctgtgcttacagtccagcc

SEQ ID NO: 465652 - DNA, 25 bp, Mus musculus
gactttcttcctactttatatttgt

SEQ ID NO: 465653 - DNA, 25 bp, Mus musculus
gactttcttccttctttatatttgt

SEQ ID NO: 465654 - DNA, 25 bp, Mus musculus
gactttcttggacatctggcatttc

SEQ ID NO: 465655 - DNA, 25 bp, Mus musculus
gactttcttggagatctggcatttc

SEQ ID NO: 465656 - DNA, 25 bp, Mus musculus
gactttcttggcccgcaggcactca

SEQ ID NO: 465657 - DNA, 25 bp, Mus musculus
gactttcttggcgcgcaggcactca

SEQ ID NO: 465658 - DNA, 25 bp, Mus musculus
gactttcttggtcattcctgagctt

SEQ ID NO: 465659 - DNA, 25 bp, Mus musculus
gactttcttggtgattcctgagctt

SEQ ID NO: 465660 - DNA, 25 bp, Mus musculus
gactttctttaaacagggagccact

SEQ ID NO: 465661 - DNA, 25 bp, Mus musculus
gactttctttaatcagggagccact

SEQ ID NO: 465662 - DNA, 25 bp, Mus musculus
gactttctttcaccactgtttgtat

SEQ ID NO: 465663 - DNA, 25 bp, Mus musculus
gactttctttcagcactgtttgtat

SEQ ID NO: 465664 - DNA, 25 bp, Mus musculus
gactttctttgtcaatatttccatg

SEQ ID NO: 465665 - DNA, 25 bp, Mus musculus
gactttctttgtgaatatttccatg

SEQ ID NO: 465666 - DNA, 25 bp, Mus musculus
gactttgaaacgatcttcctggatt

SEQ ID NO: 465667 - DNA, 25 bp, Mus musculus
gactttgaaacgttcttcctggatt

SEQ ID NO: 465668 - DNA, 25 bp, Mus musculus
gactttgaaagcattttagccacag

SEQ ID NO: 465669 - DNA, 25 bp, Mus musculus
gactttgaaagctttttagccacag

SEQ ID NO: 465670 - DNA, 25 bp, Mus musculus
gactttgaaatcatatccctctgaa

SEQ ID NO: 465671 - DNA, 25 bp, Mus musculus
gactttgaaatcttatccctctgaa

SEQ ID NO: 465672 - DNA, 25 bp, Mus musculus
gactttgaaattcttaagcatctcc

SEQ ID NO: 465673 - DNA, 25 bp, Mus musculus
gactttgaaattgttaagcatctcc

SEQ ID NO: 465674 - DNA, 25 bp, Mus musculus
gactttgaacaaactatgctcttat

SEQ ID NO: 465675 - DNA, 25 bp, Mus musculus
gactttgaacaatctatgctcttat

SEQ ID NO: 465676 - DNA, 25 bp, Mus musculus
gactttgaagagcacaatgcggcca

SEQ ID NO: 465677 - DNA, 25 bp, Mus musculus
gactttgaagaggacaatgcggcca

SEQ ID NO: 465678 - DNA, 25 bp, Mus musculus
gactttgaagccaggattccacgtt

SEQ ID NO: 465679 - DNA, 25 bp, Mus musculus
gactttgaagcctggattccacgtt

SEQ ID NO: 465680 - DNA, 25 bp, Mus musculus
gactttgaagctagctcctctttat

SEQ ID NO: 465681 - DNA, 25 bp, Mus musculus
gactttgaagcttgctcctctttat

SEQ ID NO: 465682 - DNA, 25 bp, Mus musculus
gactttgaaggtattcgtaccagtg

SEQ ID NO: 465683 - DNA, 25 bp, Mus musculus
gactttgaaggttttcgtaccagtg

SEQ ID NO: 465684 - DNA, 25 bp, Mus musculus
gactttgacagaaacagttatcatt

SEQ ID NO: 465685 - DNA, 25 bp, Mus musculus
gactttgacagactgcaggccagca

SEQ ID NO: 465686 - DNA, 25 bp, Mus musculus
gactttgacagagtgcaggccagca

SEQ ID NO: 465687 - DNA, 25 bp, Mus musculus
gactttgacagatacagttatcatt

SEQ ID NO: 465688 - DNA, 25 bp, Mus musculus
gactttgacatcctaaacttcttcc

SEQ ID NO: 465689 - DNA, 25 bp, Mus musculus
gactttgacatcgtaaacttcttcc

SEQ ID NO: 465690 - DNA, 25 bp, Mus musculus
gactttgaccctcagcagagacatg

SEQ ID NO: 465691 - DNA, 25 bp, Mus musculus
gactttgaccctgagcagagacatg

SEQ ID NO: 465692 - DNA, 25 bp, Mus musculus
gactttgactcccaaatcaatgtgc

SEQ ID NO: 465693 - DNA, 25 bp, Mus musculus
gactttgactccgaaatcaatgtgc

SEQ ID NO: 465694 - DNA, 25 bp, Mus musculus
gactttgacttgaaatgccccactg

SEQ ID NO: 465695 - DNA, 25 bp, Mus musculus
gactttgacttgtaatgccccactg

SEQ ID NO: 465696 - DNA, 25 bp, Mus musculus
gactttgagaacacatgtgcctgcc

SEQ ID NO: 465697 - DNA, 25 bp, Mus musculus
gactttgagaactcatgtgcctgcc

SEQ ID NO: 465698 - DNA, 25 bp, Mus musculus
gactttgagaccattgatgcgggct

SEQ ID NO: 465699 - DNA, 25 bp, Mus musculus
gactttgagacctttgatgcgggct

SEQ ID NO: 465700 - DNA, 25 bp, Mus musculus
gactttgagactatttcaaatgtac

SEQ ID NO: 465701 - DNA, 25 bp, Mus musculus
gactttgagactttttcaaatgtac

SEQ ID NO: 465702 - DNA, 25 bp, Mus musculus
gactttgagagtctgaccccagatt

SEQ ID NO: 465703 - DNA, 25 bp, Mus musculus
gactttgagagtgtgaccccagatt

SEQ ID NO: 465704 - DNA, 25 bp, Mus musculus
gactttgagcagaaaagttctgaga

SEQ ID NO: 465705 - DNA, 25 bp, Mus musculus
gactttgagcagaagcctattttgt

SEQ ID NO: 465706 - DNA, 25 bp, Mus musculus
gactttgagcagtaaagttctgaga

SEQ ID NO: 465707 - DNA, 25 bp, Mus musculus
gactttgagcagtagcctattttgt

SEQ ID NO: 465708 - DNA, 25 bp, Mus musculus
gactttgagcgaacccagcatggct

SEQ ID NO: 465709 - DNA, 25 bp, Mus musculus
gactttgagcgatcccagcatggct

SEQ ID NO: 465710 - DNA, 25 bp, Mus musculus
gactttgagcgcacagggctgctgc

SEQ ID NO: 465711 - DNA, 25 bp, Mus musculus
gactttgagcgctcagggctgctgc

SEQ ID NO: 465712 - DNA, 25 bp, Mus musculus
gactttgaggataacccagaagtgc

SEQ ID NO: 465713 - DNA, 25 bp, Mus musculus
gactttgaggattacccagaagtgc

SEQ ID NO: 465714 - DNA, 25 bp, Mus musculus
gactttgaggttacctatactcagg

SEQ ID NO: 465715 - DNA, 25 bp, Mus musculus
gactttgaggtttcctatactcagg

SEQ ID NO: 465716 - DNA, 25 bp, Mus musculus
gactttgagtctcatgcgagcccta

SEQ ID NO: 465717 - DNA, 25 bp, Mus musculus
gactttgagtctcgaattgacattc

SEQ ID NO: 465718 - DNA, 25 bp, Mus musculus
gactttgagtctgatgcgagcccta

SEQ ID NO: 465719 - DNA, 25 bp, Mus musculus
gactttgagtctggaattgacattc

SEQ ID NO: 465720 - DNA, 25 bp, Mus musculus
gactttgagtttcagctattaaaat

SEQ ID NO: 465721 - DNA, 25 bp, Mus musculus
gactttgagtttgagctattaaaat

SEQ ID NO: 465722 - DNA, 25 bp, Mus musculus
gactttgataatctctaatctgttt

SEQ ID NO: 465723 - DNA, 25 bp, Mus musculus
gactttgataatgtctaatctgttt

SEQ ID NO: 465724 - DNA, 25 bp, Mus musculus
gactttgatagccattcccaggaat

SEQ ID NO: 465725 - DNA, 25 bp, Mus musculus
gactttgatagcgattcccaggaat

SEQ ID NO: 465726 - DNA, 25 bp, Mus musculus
gactttgatgatcactctatagctt

SEQ ID NO: 465727 - DNA, 25 bp, Mus musculus
gactttgatgatgactctatagctt

SEQ ID NO: 465728 - DNA, 25 bp, Mus musculus
gactttgattatcacggacgctatg

SEQ ID NO: 465729 - DNA, 25 bp, Mus musculus
gactttgattatgacggacgctatg

SEQ ID NO: 465730 - DNA, 25 bp, Mus musculus
gactttgatttcacttccagttgca

SEQ ID NO: 465731 - DNA, 25 bp, Mus musculus
gactttgatttctcttccagttgca

SEQ ID NO: 465732 - DNA, 25 bp, Mus musculus
gactttgattttccttgcctcggtt

SEQ ID NO: 465733 - DNA, 25 bp, Mus musculus
gactttgattttgcttgcctcggtt

SEQ ID NO: 465734 - DNA, 25 bp, Mus musculus
gactttgcaaacacattttgtgata

SEQ ID NO: 465735 - DNA, 25 bp, Mus musculus
gactttgcaaactcattttgtgata

SEQ ID NO: 465736 - DNA, 25 bp, Mus musculus
gactttgcacacaagacttctgaaa

SEQ ID NO: 465737 - DNA, 25 bp, Mus musculus
gactttgcacacagcacattcaagg

SEQ ID NO: 465738 - DNA, 25 bp, Mus musculus
gactttgcacactagacttctgaaa

SEQ ID NO: 465739 - DNA, 25 bp, Mus musculus
gactttgcacactgcacattcaagg

SEQ ID NO: 465740 - DNA, 25 bp, Mus musculus
gactttgcaggccttcttataaaca

SEQ ID NO: 465741 - DNA, 25 bp, Mus musculus
gactttgcaggcgttcttataaaca

SEQ ID NO: 465742 - DNA, 25 bp, Mus musculus
gactttgcagtgacatgtagcgatg

SEQ ID NO: 465743 - DNA, 25 bp, Mus musculus
gactttgcagtgtcatgtagcgatg

SEQ ID NO: 465744 - DNA, 25 bp, Mus musculus
gactttgcataaaatccctggctgt

SEQ ID NO: 465745 - DNA, 25 bp, Mus musculus
gactttgcataatatccctggctgt

SEQ ID NO: 465746 - DNA, 25 bp, Mus musculus
gactttgccaccaataggttaccca

SEQ ID NO: 465747 - DNA, 25 bp, Mus musculus
gactttgccacctataggttaccca

SEQ ID NO: 465748 - DNA, 25 bp, Mus musculus
gactttgccagaaggtgcatttgac

SEQ ID NO: 465749 - DNA, 25 bp, Mus musculus
gactttgccagatggtgcatttgac

SEQ ID NO: 465750 - DNA, 25 bp, Mus musculus
gactttgccgagagaaatggctttt

SEQ ID NO: 465751 - DNA, 25 bp, Mus musculus
gactttgccgagtgaaatggctttt

SEQ ID NO: 465752 - DNA, 25 bp, Mus musculus
gactttgcctccacatgaagtacta

SEQ ID NO: 465753 - DNA, 25 bp, Mus musculus
gactttgcctcctcatgaagtacta

SEQ ID NO: 465754 - DNA, 25 bp, Mus musculus
gactttgccttgaacgtagccgcag

SEQ ID NO: 465755 - DNA, 25 bp, Mus musculus
gactttgccttgtacgtagccgcag

SEQ ID NO: 465756 - DNA, 25 bp, Mus musculus
gactttgcctttctgccaatttgta

SEQ ID NO: 465757 - DNA, 25 bp, Mus musculus
gactttgcctttgtgccaatttgta

SEQ ID NO: 465758 - DNA, 25 bp, Mus musculus
gactttgctagcaacataggaactt

SEQ ID NO: 465759 - DNA, 25 bp, Mus musculus
gactttgctagctacataggaactt

SEQ ID NO: 465760 - DNA, 25 bp, Mus musculus
gactttgctagtccctatgctgagc

SEQ ID NO: 465761 - DNA, 25 bp, Mus musculus
gactttgctagtgcctatgctgagc

SEQ ID NO: 465762 - DNA, 25 bp, Mus musculus
gactttgctatgactagattaaata

SEQ ID NO: 465763 - DNA, 25 bp, Mus musculus
gactttgctatgtctagattaaata

SEQ ID NO: 465764 - DNA, 25 bp, Mus musculus
gactttgctcctatcaattttcctt

SEQ ID NO: 465765 - DNA, 25 bp, Mus musculus
gactttgctcctttcaattttcctt

SEQ ID NO: 465766 - DNA, 25 bp, Mus musculus
gactttgctgctattagacttctgt

SEQ ID NO: 465767 - DNA, 25 bp, Mus musculus
gactttgctgcttttagacttctgt

SEQ ID NO: 465768 - DNA, 25 bp, Mus musculus
gactttgctgggacatttcaaggac

SEQ ID NO: 465769 - DNA, 25 bp, Mus musculus
gactttgctgggtcatttcaaggac

SEQ ID NO: 465770 - DNA, 25 bp, Mus musculus
gactttgctgtcattaagggtttca

SEQ ID NO: 465771 - DNA, 25 bp, Mus musculus
gactttgctgtctttaagggtttca

SEQ ID NO: 465772 - DNA, 25 bp, Mus musculus
gactttgctgtgctgtcacttagac

SEQ ID NO: 465773 - DNA, 25 bp, Mus musculus
gactttgctgtggtgtcacttagac

SEQ ID NO: 465774 - DNA, 25 bp, Mus musculus
gactttgctgttacctgtatgataa

SEQ ID NO: 465775 - DNA, 25 bp, Mus musculus
gactttgctgtttcctgtatgataa

SEQ ID NO: 465776 - DNA, 25 bp, Mus musculus
gactttgctttcatggcccaaggtt

SEQ ID NO: 465777 - DNA, 25 bp, Mus musculus
gactttgctttcttggcccaaggtt

SEQ ID NO: 465778 - DNA, 25 bp, Mus musculus
gactttgcttttaaagccccataat

SEQ ID NO: 465779 - DNA, 25 bp, Mus musculus
gactttgcttttccaggtctttcac

SEQ ID NO: 465780 - DNA, 25 bp, Mus musculus
gactttgcttttgcaggtctttcac

SEQ ID NO: 465781 - DNA, 25 bp, Mus musculus
gactttgctttttaagccccataat

SEQ ID NO: 465782 - DNA, 25 bp, Mus musculus
gactttggaaccatactgtatcaga

SEQ ID NO: 465783 - DNA, 25 bp, Mus musculus
gactttggaaccttactgtatcaga

SEQ ID NO: 465784 - DNA, 25 bp, Mus musculus
gactttggaactctgcgtaacaact

SEQ ID NO: 465785 - DNA, 25 bp, Mus musculus
gactttggaactgtgcgtaacaact

SEQ ID NO: 465786 - DNA, 25 bp, Mus musculus
gactttggacaacaaggctttattt

SEQ ID NO: 465787 - DNA, 25 bp, Mus musculus
gactttggacaagaaggctttattt

SEQ ID NO: 465788 - DNA, 25 bp, Mus musculus
gactttggactaagctttgcaatcc

SEQ ID NO: 465789 - DNA, 25 bp, Mus musculus
gactttggactatgctttgcaatcc

SEQ ID NO: 465790 - DNA, 25 bp, Mus musculus
gactttggactgatacgacccaact

SEQ ID NO: 465791 - DNA, 25 bp, Mus musculus
gactttggactgttacgacccaact

SEQ ID NO: 465792 - DNA, 25 bp, Mus musculus
gactttggagaaatgtggacctgtg

SEQ ID NO: 465793 - DNA, 25 bp, Mus musculus
gactttggagaattgtggacctgtg

SEQ ID NO: 465794 - DNA, 25 bp, Mus musculus
gactttggagacatttagcaatggc

SEQ ID NO: 465795 - DNA, 25 bp, Mus musculus
gactttggagacttttagcaatggc

SEQ ID NO: 465796 - DNA, 25 bp, Mus musculus
gactttggagtgataacttttccac

SEQ ID NO: 465797 - DNA, 25 bp, Mus musculus
gactttggagtgttaacttttccac

SEQ ID NO: 465798 - DNA, 25 bp, Mus musculus
gactttggatagcagccacgggcaa

SEQ ID NO: 465799 - DNA, 25 bp, Mus musculus
gactttggataggagccacgggcaa

SEQ ID NO: 465800 - DNA, 25 bp, Mus musculus
gactttggatcaaggtctccatgca

SEQ ID NO: 465801 - DNA, 25 bp, Mus musculus
gactttggatcatggtctccatgca

SEQ ID NO: 465802 - DNA, 25 bp, Mus musculus
gactttggatgcctgtggaagaaat

SEQ ID NO: 465803 - DNA, 25 bp, Mus musculus
gactttggatgcgtgtggaagaaat

SEQ ID NO: 465804 - DNA, 25 bp, Mus musculus
gactttggatgtaagaataatctcc

SEQ ID NO: 465805 - DNA, 25 bp, Mus musculus
gactttggatgttagaataatctcc

SEQ ID NO: 465806 - DNA, 25 bp, Mus musculus
gactttggattcaatcaggttacca

SEQ ID NO: 465807 - DNA, 25 bp, Mus musculus
gactttggattctatcaggttacca

SEQ ID NO: 465808 - DNA, 25 bp, Mus musculus
gactttggcagaatctggactggcc

SEQ ID NO: 465809 - DNA, 25 bp, Mus musculus
gactttggcagacctcattcctgag

SEQ ID NO: 465810 - DNA, 25 bp, Mus musculus
gactttggcagagctcattcctgag

SEQ ID NO: 465811 - DNA, 25 bp, Mus musculus
gactttggcagattctggactggcc

SEQ ID NO: 465812 - DNA, 25 bp, Mus musculus
gactttggcatcaacagatctgacg

SEQ ID NO: 465813 - DNA, 25 bp, Mus musculus
gactttggcatcctagttgggctgt

SEQ ID NO: 465814 - DNA, 25 bp, Mus musculus
gactttggcatcgtagttgggctgt

SEQ ID NO: 465815 - DNA, 25 bp, Mus musculus
gactttggcatctacagatctgacg

SEQ ID NO: 465816 - DNA, 25 bp, Mus musculus
gactttggccacaacatattgcaca

SEQ ID NO: 465817 - DNA, 25 bp, Mus musculus
gactttggccactacatattgcaca

SEQ ID NO: 465818 - DNA, 25 bp, Mus musculus
gactttggcgttcaggcttacaata

SEQ ID NO: 465819 - DNA, 25 bp, Mus musculus
gactttggcgttcgctgagattcag

SEQ ID NO: 465820 - DNA, 25 bp, Mus musculus
gactttggcgttgaggcttacaata

SEQ ID NO: 465821 - DNA, 25 bp, Mus musculus
gactttggcgttggctgagattcag

SEQ ID NO: 465822 - DNA, 25 bp, Mus musculus
gactttggctgacaagcgggtacat

SEQ ID NO: 465823 - DNA, 25 bp, Mus musculus
gactttggctgagaagcgggtacat

SEQ ID NO: 465824 - DNA, 25 bp, Mus musculus
gactttggcttcagccttaaggttt

SEQ ID NO: 465825 - DNA, 25 bp, Mus musculus
gactttggcttctgccttaaggttt

SEQ ID NO: 465826 - DNA, 25 bp, Mus musculus
gactttggcttgcttgtagttgatc

SEQ ID NO: 465827 - DNA, 25 bp, Mus musculus
gactttggcttggttgtagttgatc

SEQ ID NO: 465828 - DNA, 25 bp, Mus musculus
gactttgggagcacatacatcacaa

SEQ ID NO: 465829 - DNA, 25 bp, Mus musculus
gactttgggagctcatacatcacaa

SEQ ID NO: 465830 - DNA, 25 bp, Mus musculus
gactttgggctgaccatatttgtct

SEQ ID NO: 465831 - DNA, 25 bp, Mus musculus
gactttgggctgagctttgtctcag

SEQ ID NO: 465832 - DNA, 25 bp, Mus musculus
gactttgggctgtccatatttgtct

SEQ ID NO: 465833 - DNA, 25 bp, Mus musculus
gactttgggctgtgctttgtctcag

SEQ ID NO: 465834 - DNA, 25 bp, Mus musculus
gactttgggtgcagatgtcaacgct

SEQ ID NO: 465835 - DNA, 25 bp, Mus musculus
gactttgggtgctgatgtcaacgct

SEQ ID NO: 465836 - DNA, 25 bp, Mus musculus
gactttgggtggaggcctccttgta

SEQ ID NO: 465837 - DNA, 25 bp, Mus musculus
gactttgggtggtggcctccttgta

SEQ ID NO: 465838 - DNA, 25 bp, Mus musculus
gactttggtactctgcatggagctg

SEQ ID NO: 465839 - DNA, 25 bp, Mus musculus
gactttggtactgtgcatggagctg

SEQ ID NO: 465840 - DNA, 25 bp, Mus musculus
gactttggtcataactgtgcctaca

SEQ ID NO: 465841 - DNA, 25 bp, Mus musculus
gactttggtcattactgtgcctaca

SEQ ID NO: 465842 - DNA, 25 bp, Mus musculus
gactttggtccaaatgacctcctgt

SEQ ID NO: 465843 - DNA, 25 bp, Mus musculus
gactttggtccaacttgtaagctgc

SEQ ID NO: 465844 - DNA, 25 bp, Mus musculus
gactttggtccatatgacctcctgt

SEQ ID NO: 465845 - DNA, 25 bp, Mus musculus
gactttggtccatcttgtaagctgc

SEQ ID NO: 465846 - DNA, 25 bp, Mus musculus
gactttggtcctaatgtactttctg

SEQ ID NO: 465847 - DNA, 25 bp, Mus musculus
gactttggtccttatgtactttctg

SEQ ID NO: 465848 - DNA, 25 bp, Mus musculus
gactttggtgtcaggcagatcccga

SEQ ID NO: 465849 - DNA, 25 bp, Mus musculus
gactttggtgtctggcagatcccga

SEQ ID NO: 465850 - DNA, 25 bp, Mus musculus
gactttggttcaaggcattgcatca

SEQ ID NO: 465851 - DNA, 25 bp, Mus musculus
gactttggttcatggcattgcatca

SEQ ID NO: 465852 - DNA, 25 bp, Mus musculus
gactttggttccatgagcgccagga

SEQ ID NO: 465853 - DNA, 25 bp, Mus musculus
gactttggttccttgagcgccagga

SEQ ID NO: 465854 - DNA, 25 bp, Mus musculus
gactttggttttagtaagactgttg

SEQ ID NO: 465855 - DNA, 25 bp, Mus musculus
gactttggtttttgtaagactgttg

SEQ ID NO: 465856 - DNA, 25 bp, Mus musculus
gactttgtaagtctacagcacgtag

SEQ ID NO: 465857 - DNA, 25 bp, Mus musculus
gactttgtaagtgtacagcacgtag

SEQ ID NO: 465858 - DNA, 25 bp, Mus musculus
gactttgtacttaccgtttatctca

SEQ ID NO: 465859 - DNA, 25 bp, Mus musculus
gactttgtactttccgtttatctca

SEQ ID NO: 465860 - DNA, 25 bp, Mus musculus
gactttgtagaccaatctttcccct

SEQ ID NO: 465861 - DNA, 25 bp, Mus musculus
gactttgtagacgaatctttcccct

SEQ ID NO: 465862 - DNA, 25 bp, Mus musculus
gactttgtagataagcagtagctag

SEQ ID NO: 465863 - DNA, 25 bp, Mus musculus
gactttgtagattagcagtagctag

SEQ ID NO: 465864 - DNA, 25 bp, Mus musculus
gactttgtagccctattgctggtca

SEQ ID NO: 465865 - DNA, 25 bp, Mus musculus
gactttgtagccgtattgctggtca

SEQ ID NO: 465866 - DNA, 25 bp, Mus musculus
gactttgtagtaatttctgcttata

SEQ ID NO: 465867 - DNA, 25 bp, Mus musculus
gactttgtagtattttctgcttata

SEQ ID NO: 465868 - DNA, 25 bp, Mus musculus
gactttgtatctagcaacttgagta

SEQ ID NO: 465869 - DNA, 25 bp, Mus musculus
gactttgtatctctgtttggcatca

SEQ ID NO: 465870 - DNA, 25 bp, Mus musculus
gactttgtatctgtgtttggcatca

SEQ ID NO: 465871 - DNA, 25 bp, Mus musculus
gactttgtatcttgcaacttgagta

SEQ ID NO: 465872 - DNA, 25 bp, Mus musculus
gactttgtattcatagtgtgaactc

SEQ ID NO: 465873 - DNA, 25 bp, Mus musculus
gactttgtattcttagtgtgaactc

SEQ ID NO: 465874 - DNA, 25 bp, Mus musculus
gactttgtcagtcagaggacagtct

SEQ ID NO: 465875 - DNA, 25 bp, Mus musculus
gactttgtcagtgagaggacagtct

SEQ ID NO: 465876 - DNA, 25 bp, Mus musculus
gactttgtccttcgatatggcctaa

SEQ ID NO: 465877 - DNA, 25 bp, Mus musculus
gactttgtccttggatatggcctaa

SEQ ID NO: 465878 - DNA, 25 bp, Mus musculus
gactttgtgaatccaatccgcagcg

SEQ ID NO: 465879 - DNA, 25 bp, Mus musculus
gactttgtgaatgcaatccgcagcg

SEQ ID NO: 465880 - DNA, 25 bp, Mus musculus
gactttgtgacacagctcttgccta

SEQ ID NO: 465881 - DNA, 25 bp, Mus musculus
gactttgtgacagagctcttgccta

SEQ ID NO: 465882 - DNA, 25 bp, Mus musculus
gactttgtgacccagaaaatgacca

SEQ ID NO: 465883 - DNA, 25 bp, Mus musculus
gactttgtgaccgagaaaatgacca

SEQ ID NO: 465884 - DNA, 25 bp, Mus musculus
gactttgtgacgagccacgggaaca

SEQ ID NO: 465885 - DNA, 25 bp, Mus musculus
gactttgtgacgtgccacgggaaca

SEQ ID NO: 465886 - DNA, 25 bp, Mus musculus
gactttgtgcacattggaggtactg

SEQ ID NO: 465887 - DNA, 25 bp, Mus musculus
gactttgtgcactttggaggtactg

SEQ ID NO: 465888 - DNA, 25 bp, Mus musculus
gactttgtgcatcgacagcctgtga

SEQ ID NO: 465889 - DNA, 25 bp, Mus musculus
gactttgtgcatggacagcctgtga

SEQ ID NO: 465890 - DNA, 25 bp, Mus musculus
gactttgtgcttctgaagttttgtc

SEQ ID NO: 465891 - DNA, 25 bp, Mus musculus
gactttgtgcttgtgaagttttgtc

SEQ ID NO: 465892 - DNA, 25 bp, Mus musculus
gactttgtggaaattgcacgccctc

SEQ ID NO: 465893 - DNA, 25 bp, Mus musculus
gactttgtggaatttgcacgccctc

SEQ ID NO: 465894 - DNA, 25 bp, Mus musculus
gactttgtggacatgttctctgtgc

SEQ ID NO: 465895 - DNA, 25 bp, Mus musculus
gactttgtggacttgttctctgtgc

SEQ ID NO: 465896 - DNA, 25 bp, Mus musculus
gactttgtgggtccagttttgcctt

SEQ ID NO: 465897 - DNA, 25 bp, Mus musculus
gactttgtgggtgcagttttgcctt

SEQ ID NO: 465898 - DNA, 25 bp, Mus musculus
gactttgtggtcaagatgcgcatta

SEQ ID NO: 465899 - DNA, 25 bp, Mus musculus
gactttgtggtctagatgcgcatta

SEQ ID NO: 465900 - DNA, 25 bp, Mus musculus
gactttgtgtttcgtgatttcagct

SEQ ID NO: 465901 - DNA, 25 bp, Mus musculus
gactttgtgtttggtgatttcagct

SEQ ID NO: 465902 - DNA, 25 bp, Mus musculus
gactttgttgatactgcataatgct

SEQ ID NO: 465903 - DNA, 25 bp, Mus musculus
gactttgttgattctgcataatgct

SEQ ID NO: 465904 - DNA, 25 bp, Mus musculus
gactttgtttcgcacaaggtccaga

SEQ ID NO: 465905 - DNA, 25 bp, Mus musculus
gactttgtttcggacaaggtccaga

SEQ ID NO: 465906 - DNA, 25 bp, Mus musculus
gactttgttttgcaagcatgcccat

SEQ ID NO: 465907 - DNA, 25 bp, Mus musculus
gactttgttttggaagcatgcccat

SEQ ID NO: 465908 - DNA, 25 bp, Mus musculus
gactttgtttttcctggcggtgaac

SEQ ID NO: 465909 - DNA, 25 bp, Mus musculus
gactttgtttttgctggcggtgaac

SEQ ID NO: 465910 - DNA, 25 bp, Mus musculus
gacttttaaaacctctgtgtgcttg

SEQ ID NO: 465911 - DNA, 25 bp, Mus musculus
gacttttaaaacgtctgtgtgcttg

SEQ ID NO: 465912 - DNA, 25 bp, Mus musculus
gacttttaaatgagatcctggcttg

SEQ ID NO: 465913 - DNA, 25 bp, Mus musculus
gacttttaaatgtgatcctggcttg

SEQ ID NO: 465914 - DNA, 25 bp, Mus musculus
gacttttaaggtacacgaatccata

SEQ ID NO: 465915 - DNA, 25 bp, Mus musculus
gacttttaaggttcacgaatccata

SEQ ID NO: 465916 - DNA, 25 bp, Mus musculus
gacttttaagtacttctgagaccca

SEQ ID NO: 465917 - DNA, 25 bp, Mus musculus
gacttttaagtagttctgagaccca

SEQ ID NO: 465918 - DNA, 25 bp, Mus musculus
gacttttacaccatttatgatgact

SEQ ID NO: 465919 - DNA, 25 bp, Mus musculus
gacttttacaccttttatgatgact

SEQ ID NO: 465920 - DNA, 25 bp, Mus musculus
gacttttacactctaggaagccatt

SEQ ID NO: 465921 - DNA, 25 bp, Mus musculus
gacttttacactgtaggaagccatt

SEQ ID NO: 465922 - DNA, 25 bp, Mus musculus
gacttttaccttacatttggtcaca

SEQ ID NO: 465923 - DNA, 25 bp, Mus musculus
gacttttacctttcatttggtcaca

SEQ ID NO: 465924 - DNA, 25 bp, Mus musculus
gacttttactttactgcttcattaa

SEQ ID NO: 465925 - DNA, 25 bp, Mus musculus
gacttttacttttctgcttcattaa

SEQ ID NO: 465926 - DNA, 25 bp, Mus musculus
gacttttagcagcttcttttcatta

SEQ ID NO: 465927 - DNA, 25 bp, Mus musculus
gacttttagcaggttcttttcatta

SEQ ID NO: 465928 - DNA, 25 bp, Mus musculus
gacttttagccaattctattttcta

SEQ ID NO: 465929 - DNA, 25 bp, Mus musculus
gacttttagccatttctattttcta

SEQ ID NO: 465930 - DNA, 25 bp, Mus musculus
gacttttaggctcttgctagcttct

SEQ ID NO: 465931 - DNA, 25 bp, Mus musculus
gacttttaggctgttgctagcttct

SEQ ID NO: 465932 - DNA, 25 bp, Mus musculus
gacttttagtagcatttctggtaca

SEQ ID NO: 465933 - DNA, 25 bp, Mus musculus
gacttttagtaggatttctggtaca

SEQ ID NO: 465934 - DNA, 25 bp, Mus musculus
gacttttagtctacatctctgcatc

SEQ ID NO: 465935 - DNA, 25 bp, Mus musculus
gacttttagtcttcatctctgcatc

SEQ ID NO: 465936 - DNA, 25 bp, Mus musculus
gacttttagtttagcctcacgtgac

SEQ ID NO: 465937 - DNA, 25 bp, Mus musculus
gacttttagttttgcctcacgtgac

SEQ ID NO: 465938 - DNA, 25 bp, Mus musculus
gacttttatgtaatgctacactgga

SEQ ID NO: 465939 - DNA, 25 bp, Mus musculus
gacttttatgtacctgtcccagaaa

SEQ ID NO: 465940 - DNA, 25 bp, Mus musculus
gacttttatgtagctgtcccagaaa

SEQ ID NO: 465941 - DNA, 25 bp, Mus musculus
gacttttatgtattgctacactgga

SEQ ID NO: 465942 - DNA, 25 bp, Mus musculus
gacttttatgtccaagccctaagat

SEQ ID NO: 465943 - DNA, 25 bp, Mus musculus
gacttttatgtcgaagccctaagat

SEQ ID NO: 465944 - DNA, 25 bp, Mus musculus
gacttttattagctggcacatggta

SEQ ID NO: 465945 - DNA, 25 bp, Mus musculus
gacttttattaggtggcacatggta

SEQ ID NO: 465946 - DNA, 25 bp, Mus musculus
gacttttattttcttagctcggaca

SEQ ID NO: 465947 - DNA, 25 bp, Mus musculus
gacttttattttgttagctcggaca

SEQ ID NO: 465948 - DNA, 25 bp, Mus musculus
gacttttcaactaagatgcttcaga

SEQ ID NO: 465949 - DNA, 25 bp, Mus musculus
gacttttcaacttagatgcttcaga

SEQ ID NO: 465950 - DNA, 25 bp, Mus musculus
gacttttcacacattcctagagtgg

SEQ ID NO: 465951 - DNA, 25 bp, Mus musculus
gacttttcacactttcctagagtgg

SEQ ID NO: 465952 - DNA, 25 bp, Mus musculus
gacttttcacatcatttatcttggc

SEQ ID NO: 465953 - DNA, 25 bp, Mus musculus
gacttttcacatgatttatcttggc

SEQ ID NO: 465954 - DNA, 25 bp, Mus musculus
gacttttcacctatggctaaagaag

SEQ ID NO: 465955 - DNA, 25 bp, Mus musculus
gacttttcacctttggctaaagaag

SEQ ID NO: 465956 - DNA, 25 bp, Mus musculus
gacttttcagccagttttacacacc

SEQ ID NO: 465957 - DNA, 25 bp, Mus musculus
gacttttcagcctgttttacacacc

SEQ ID NO: 465958 - DNA, 25 bp, Mus musculus
gacttttcaggcactcactttagaa

SEQ ID NO: 465959 - DNA, 25 bp, Mus musculus
gacttttcaggctctcactttagaa

SEQ ID NO: 465960 - DNA, 25 bp, Mus musculus
gacttttcagtaactagccaggttt

SEQ ID NO: 465961 - DNA, 25 bp, Mus musculus
gacttttcagtaagggtgatgtcaa

SEQ ID NO: 465962 - DNA, 25 bp, Mus musculus
gacttttcagtatctagccaggttt

SEQ ID NO: 465963 - DNA, 25 bp, Mus musculus
gacttttcagtatgggtgatgtcaa

SEQ ID NO: 465964 - DNA, 25 bp, Mus musculus
gacttttcagtcagctttctattaa

SEQ ID NO: 465965 - DNA, 25 bp, Mus musculus
gacttttcagtctgctttctattaa

SEQ ID NO: 465966 - DNA, 25 bp, Mus musculus
gacttttccagcctgtcctgaatca

SEQ ID NO: 465967 - DNA, 25 bp, Mus musculus
gacttttccagcgtgtcctgaatca

SEQ ID NO: 465968 - DNA, 25 bp, Mus musculus
gacttttcccgtcggacctgcacaa

SEQ ID NO: 465969 - DNA, 25 bp, Mus musculus
gacttttcccgtgggacctgcacaa

SEQ ID NO: 465970 - DNA, 25 bp, Mus musculus
gacttttcgctgcttctcactataa

SEQ ID NO: 465971 - DNA, 25 bp, Mus musculus
gacttttcgctggttctcactataa

SEQ ID NO: 465972 - DNA, 25 bp, Mus musculus
gacttttctatgagcagtgactgca

SEQ ID NO: 465973 - DNA, 25 bp, Mus musculus
gacttttctatgtgcagtgactgca

SEQ ID NO: 465974 - DNA, 25 bp, Mus musculus
gacttttctgagagacgcctctgac

SEQ ID NO: 465975 - DNA, 25 bp, Mus musculus
gacttttctgagtgacgcctctgac

SEQ ID NO: 465976 - DNA, 25 bp, Mus musculus
gacttttctgcaatttgtgtccagc

SEQ ID NO: 465977 - DNA, 25 bp, Mus musculus
gacttttctgcacctgtcagtgtga

SEQ ID NO: 465978 - DNA, 25 bp, Mus musculus
gacttttctgcagctgtcagtgtga

SEQ ID NO: 465979 - DNA, 25 bp, Mus musculus
gacttttctgcattttgtgtccagc

SEQ ID NO: 465980 - DNA, 25 bp, Mus musculus
gacttttctgggataatgcagtatc

SEQ ID NO: 465981 - DNA, 25 bp, Mus musculus
gacttttctgggttaatgcagtatc

SEQ ID NO: 465982 - DNA, 25 bp, Mus musculus
gacttttcttatctcctatgtatga

SEQ ID NO: 465983 - DNA, 25 bp, Mus musculus
gacttttcttatgtcctatgtatga

SEQ ID NO: 465984 - DNA, 25 bp, Mus musculus
gacttttcttgtcacattgtagcca

SEQ ID NO: 465985 - DNA, 25 bp, Mus musculus
gacttttcttgtgacattgtagcca

SEQ ID NO: 465986 - DNA, 25 bp, Mus musculus
gacttttgacatcgagagcctcaga

SEQ ID NO: 465987 - DNA, 25 bp, Mus musculus
gacttttgacatggagagcctcaga

SEQ ID NO: 465988 - DNA, 25 bp, Mus musculus
gacttttgagtcactttcccataaa

SEQ ID NO: 465989 - DNA, 25 bp, Mus musculus
gacttttgagtctctttcccataaa

SEQ ID NO: 465990 - DNA, 25 bp, Mus musculus
gacttttgattgctctgtagactta

SEQ ID NO: 465991 - DNA, 25 bp, Mus musculus
gacttttgattggtctgtagactta

SEQ ID NO: 465992 - DNA, 25 bp, Mus musculus
gacttttgcctgaaattccagaata

SEQ ID NO: 465993 - DNA, 25 bp, Mus musculus
gacttttgcctgtaattccagaata

SEQ ID NO: 465994 - DNA, 25 bp, Mus musculus
gacttttgctggcaaattgggctca

SEQ ID NO: 465995 - DNA, 25 bp, Mus musculus
gacttttgctgggaaattgggctca

SEQ ID NO: 465996 - DNA, 25 bp, Mus musculus
gacttttgctttactattctttcct

SEQ ID NO: 465997 - DNA, 25 bp, Mus musculus
gacttttgcttttctattctttcct

SEQ ID NO: 465998 - DNA, 25 bp, Mus musculus
gacttttgtaaaaatatcctcgtag

SEQ ID NO: 465999 - DNA, 25 bp, Mus musculus
gacttttgtaaatatatcctcgtag

SEQ ID NO: 466000 - DNA, 25 bp, Mus musculus
gacttttgtaatatgccaataggag

SEQ ID NO: 466001 - DNA, 25 bp, Mus musculus
gacttttgtaatttgccaataggag

SEQ ID NO: 466002 - DNA, 25 bp, Mus musculus
gacttttgtagacattccctgtata

SEQ ID NO: 466003 - DNA, 25 bp, Mus musculus
gacttttgtagagattccctgtata

SEQ ID NO: 466004 - DNA, 25 bp, Mus musculus
gacttttgtattatgtgctgctaac

SEQ ID NO: 466005 - DNA, 25 bp, Mus musculus
gacttttgtattttgtgctgctaac

SEQ ID NO: 466006 - DNA, 25 bp, Mus musculus
gacttttgtcataacgccttctgta

SEQ ID NO: 466007 - DNA, 25 bp, Mus musculus
gacttttgtcattacgccttctgta

SEQ ID NO: 466008 - DNA, 25 bp, Mus musculus
gacttttgtcttctattcgtgtaaa

SEQ ID NO: 466009 - DNA, 25 bp, Mus musculus
gacttttgtcttgtattcgtgtaaa

SEQ ID NO: 466010 - DNA, 25 bp, Mus musculus
gacttttgtgctatccctaaccata

SEQ ID NO: 466011 - DNA, 25 bp, Mus musculus
gacttttgtgctttccctaaccata

SEQ ID NO: 466012 - DNA, 25 bp, Mus musculus
gacttttgtgttagtgcaaccgtca

SEQ ID NO: 466013 - DNA, 25 bp, Mus musculus
gacttttgtgtttgtgcaaccgtca

SEQ ID NO: 466014 - DNA, 25 bp, Mus musculus
gacttttgttcccacagcctgagga

SEQ ID NO: 466015 - DNA, 25 bp, Mus musculus
gacttttgttcccacccagctaact

SEQ ID NO: 466016 - DNA, 25 bp, Mus musculus
gacttttgttccgacagcctgagga

SEQ ID NO: 466017 - DNA, 25 bp, Mus musculus
gacttttgttccgacccagctaact

SEQ ID NO: 466018 - DNA, 25 bp, Mus musculus
gacttttgttctcctggttgatcaa

SEQ ID NO: 466019 - DNA, 25 bp, Mus musculus
gacttttgttctgctggttgatcaa

SEQ ID NO: 466020 - DNA, 25 bp, Mus musculus
gacttttgttttcttgtccacattg

SEQ ID NO: 466021 - DNA, 25 bp, Mus musculus
gacttttgttttgttgtccacattg

SEQ ID NO: 466022 - DNA, 25 bp, Mus musculus
gactttttaacaaacttgcatccat

SEQ ID NO: 466023 - DNA, 25 bp, Mus musculus
gactttttaacatacttgcatccat

SEQ ID NO: 466024 - DNA, 25 bp, Mus musculus
gactttttacatataacctgactgc

SEQ ID NO: 466025 - DNA, 25 bp, Mus musculus
gactttttacatttaacctgactgc

SEQ ID NO: 466026 - DNA, 25 bp, Mus musculus
gactttttatcaagattgttgtgca

SEQ ID NO: 466027 - DNA, 25 bp, Mus musculus
gactttttatcatgattgttgtgca

SEQ ID NO: 466028 - DNA, 25 bp, Mus musculus
gactttttcaagcaacacctacagt

SEQ ID NO: 466029 - DNA, 25 bp, Mus musculus
gactttttcaaggaacacctacagt

SEQ ID NO: 466030 - DNA, 25 bp, Mus musculus
gactttttcattatccacagacctc

SEQ ID NO: 466031 - DNA, 25 bp, Mus musculus
gactttttcattttccacagacctc

SEQ ID NO: 466032 - DNA, 25 bp, Mus musculus
gactttttccaacttgtattttcat

SEQ ID NO: 466033 - DNA, 25 bp, Mus musculus
gactttttccaagttgtattttcat

SEQ ID NO: 466034 - DNA, 25 bp, Mus musculus
gactttttcccaaaactattattag

SEQ ID NO: 466035 - DNA, 25 bp, Mus musculus
gactttttcccataactattattag

SEQ ID NO: 466036 - DNA, 25 bp, Mus musculus
gactttttctgaatggcgtgtagac

SEQ ID NO: 466037 - DNA, 25 bp, Mus musculus
gactttttctgattggcgtgtagac

SEQ ID NO: 466038 - DNA, 25 bp, Mus musculus
gactttttctttagaatcgcactga

SEQ ID NO: 466039 - DNA, 25 bp, Mus musculus
gactttttcttttgaatcgcactga

SEQ ID NO: 466040 - DNA, 25 bp, Mus musculus
gactttttgacaatcaactttctgt

SEQ ID NO: 466041 - DNA, 25 bp, Mus musculus
gactttttgacattcaactttctgt

SEQ ID NO: 466042 - DNA, 25 bp, Mus musculus
gactttttgactattccttttgcag

SEQ ID NO: 466043 - DNA, 25 bp, Mus musculus
gactttttgacttttccttttgcag

SEQ ID NO: 466044 - DNA, 25 bp, Mus musculus
gactttttgctaccttttttcatct

SEQ ID NO: 466045 - DNA, 25 bp, Mus musculus
gactttttgctagcttttttcatct

SEQ ID NO: 466046 - DNA, 25 bp, Mus musculus
gactttttgtacctgcccatgaata

SEQ ID NO: 466047 - DNA, 25 bp, Mus musculus
gactttttgtacgtgcccatgaata

SEQ ID NO: 466048 - DNA, 25 bp, Mus musculus
gactttttgtgtcagtgccatgtat

SEQ ID NO: 466049 - DNA, 25 bp, Mus musculus
gactttttgtgtgagtgccatgtat

SEQ ID NO: 466050 - DNA, 25 bp, Mus musculus
gactttttgttgaacaggattcaga

SEQ ID NO: 466051 - DNA, 25 bp, Mus musculus
gactttttgttgtacaggattcaga

SEQ ID NO: 466052 - DNA, 25 bp, Mus musculus
gactttttgtttccaatgaagctgc

SEQ ID NO: 466053 - DNA, 25 bp, Mus musculus
gactttttgtttgcaatgaagctgc

SEQ ID NO: 466054 - DNA, 25 bp, Mus musculus
gacttttttatcatagcagaactat

SEQ ID NO: 466055 - DNA, 25 bp, Mus musculus
gacttttttatcttagcagaactat

SEQ ID NO: 466056 - DNA, 25 bp, Mus musculus
gacttttttatgagctctgtacaaa

SEQ ID NO: 466057 - DNA, 25 bp, Mus musculus
gacttttttatgtgctctgtacaaa

SEQ ID NO: 466058 - DNA, 25 bp, Mus musculus
gacttttttccaattggacagatct

SEQ ID NO: 466059 - DNA, 25 bp, Mus musculus
gacttttttccatttggacagatct

SEQ ID NO: 466060 - DNA, 25 bp, Mus musculus
gactttttttccacagtagcatgaa

SEQ ID NO: 466061 - DNA, 25 bp, Mus musculus
gactttttttcctcagtagcatgaa

SEQ ID NO: 466062 - DNA, 25 bp, Mus musculus
gactttttttctacggatatttcat

SEQ ID NO: 466063 - DNA, 25 bp, Mus musculus
gactttttttcttcggatatttcat

SEQ ID NO: 466064 - DNA, 25 bp, Mus musculus
gagaaaaaagtcaccattctgcatt

SEQ ID NO: 466065 - DNA, 25 bp, Mus musculus
gagaaaaaagtctccattctgcatt

SEQ ID NO: 466066 - DNA, 25 bp, Mus musculus
gagaaaaaccccagcatccgggagg

SEQ ID NO: 466067 - DNA, 25 bp, Mus musculus
gagaaaaacccctgcatccgggagg

SEQ ID NO: 466068 - DNA, 25 bp, Mus musculus
gagaaaaacctcactactccagctg

SEQ ID NO: 466069 - DNA, 25 bp, Mus musculus
gagaaaaacctctctactccagctg

SEQ ID NO: 466070 - DNA, 25 bp, Mus musculus
gagaaaaacgccacccaggaattct

SEQ ID NO: 466071 - DNA, 25 bp, Mus musculus
gagaaaaacgcctcccaggaattct

SEQ ID NO: 466072 - DNA, 25 bp, Mus musculus
gagaaaaacgtgctgctgacttccc

SEQ ID NO: 466073 - DNA, 25 bp, Mus musculus
gagaaaaacgtggtgctgacttccc

SEQ ID NO: 466074 - DNA, 25 bp, Mus musculus
gagaaaaactagatgccctcaacct

SEQ ID NO: 466075 - DNA, 25 bp, Mus musculus
gagaaaaactagttgccctcaacct

SEQ ID NO: 466076 - DNA, 25 bp, Mus musculus
gagaaaaactcacgtattaggcttt

SEQ ID NO: 466077 - DNA, 25 bp, Mus musculus
gagaaaaactcaggtattaggcttt

SEQ ID NO: 466078 - DNA, 25 bp, Mus musculus
gagaaaaactccaccattgtcttcc

SEQ ID NO: 466079 - DNA, 25 bp, Mus musculus
gagaaaaactcctccattgtcttcc

SEQ ID NO: 466080 - DNA, 25 bp, Mus musculus
gagaaaaactgcagccctcaggagg

SEQ ID NO: 466081 - DNA, 25 bp, Mus musculus
gagaaaaactgcctgtgctccagtt

SEQ ID NO: 466082 - DNA, 25 bp, Mus musculus
gagaaaaactgcgtgtgctccagtt

SEQ ID NO: 466083 - DNA, 25 bp, Mus musculus
gagaaaaactgctgccctcaggagg

SEQ ID NO: 466084 - DNA, 25 bp, Mus musculus
gagaaaaacttcagccagccacggt

SEQ ID NO: 466085 - DNA, 25 bp, Mus musculus
gagaaaaacttctgccagccacggt

SEQ ID NO: 466086 - DNA, 25 bp, Mus musculus
gagaaaaagacacggctctgaacca

SEQ ID NO: 466087 - DNA, 25 bp, Mus musculus
gagaaaaagacagggctctgaacca

SEQ ID NO: 466088 - DNA, 25 bp, Mus musculus
gagaaaaagatacacactaccttag

SEQ ID NO: 466089 - DNA, 25 bp, Mus musculus
gagaaaaagatagacactaccttag

SEQ ID NO: 466090 - DNA, 25 bp, Mus musculus
gagaaaaagatcaaccccttcgctc

SEQ ID NO: 466091 - DNA, 25 bp, Mus musculus
gagaaaaagatctaccccttcgctc

SEQ ID NO: 466092 - DNA, 25 bp, Mus musculus
gagaaaaagccccagtcagatccca

SEQ ID NO: 466093 - DNA, 25 bp, Mus musculus
gagaaaaagcccgagtcagatccca

SEQ ID NO: 466094 - DNA, 25 bp, Mus musculus
gagaaaaagccgctccactgcacca

SEQ ID NO: 466095 - DNA, 25 bp, Mus musculus
gagaaaaagccggtccactgcacca

SEQ ID NO: 466096 - DNA, 25 bp, Mus musculus
gagaaaaagttcagtggcaagcacg

SEQ ID NO: 466097 - DNA, 25 bp, Mus musculus
gagaaaaagttctgtggcaagcacg

SEQ ID NO: 466098 - DNA, 25 bp, Mus musculus
gagaaaaataacaaccactccgtct

SEQ ID NO: 466099 - DNA, 25 bp, Mus musculus
gagaaaaataactaccactccgtct

SEQ ID NO: 466100 - DNA, 25 bp, Mus musculus
gagaaaaatggaatccctgtcccct

SEQ ID NO: 466101 - DNA, 25 bp, Mus musculus
gagaaaaatggattccctgtcccct

SEQ ID NO: 466102 - DNA, 25 bp, Mus musculus
gagaaaaatgggacccttctgcgct

SEQ ID NO: 466103 - DNA, 25 bp, Mus musculus
gagaaaaatgggtcccttctgcgct

SEQ ID NO: 466104 - DNA, 25 bp, Mus musculus
gagaaaacaattccctcgttgctgt

SEQ ID NO: 466105 - DNA, 25 bp, Mus musculus
gagaaaacaattgcctcgttgctgt

SEQ ID NO: 466106 - DNA, 25 bp, Mus musculus
gagaaaacacacaagtgtcttttta

SEQ ID NO: 466107 - DNA, 25 bp, Mus musculus
gagaaaacacactagtgtcttttta

SEQ ID NO: 466108 - DNA, 25 bp, Mus musculus
gagaaaacactgacaacctttttga

SEQ ID NO: 466109 - DNA, 25 bp, Mus musculus
gagaaaacactgaccataaagaaaa

SEQ ID NO: 466110 - DNA, 25 bp, Mus musculus
gagaaaacactgtcaacctttttga

SEQ ID NO: 466111 - DNA, 25 bp, Mus musculus
gagaaaacactgtccataaagaaaa

SEQ ID NO: 466112 - DNA, 25 bp, Mus musculus
gagaaaacacttcctcttcatcgct

SEQ ID NO: 466113 - DNA, 25 bp, Mus musculus
gagaaaacacttgctcttcatcgct

SEQ ID NO: 466114 - DNA, 25 bp, Mus musculus
gagaaaacagccctcccatgggaga

SEQ ID NO: 466115 - DNA, 25 bp, Mus musculus
gagaaaacagccgtcccatgggaga

SEQ ID NO: 466116 - DNA, 25 bp, Mus musculus
gagaaaacaggcatacctgccctcc

SEQ ID NO: 466117 - DNA, 25 bp, Mus musculus
gagaaaacaggcttacctgccctcc

SEQ ID NO: 466118 - DNA, 25 bp, Mus musculus
gagaaaaccaacactctgcctgagg

SEQ ID NO: 466119 - DNA, 25 bp, Mus musculus
gagaaaaccaactctctgcctgagg

SEQ ID NO: 466120 - DNA, 25 bp, Mus musculus
gagaaaaccctcacacgtacattac

SEQ ID NO: 466121 - DNA, 25 bp, Mus musculus
gagaaaaccctctcacgtacattac

SEQ ID NO: 466122 - DNA, 25 bp, Mus musculus
gagaaaacctacaaggtagcattac

SEQ ID NO: 466123 - DNA, 25 bp, Mus musculus
gagaaaacctactaggtagcattac

SEQ ID NO: 466124 - DNA, 25 bp, Mus musculus
gagaaaacctctctgcctatagttt

SEQ ID NO: 466125 - DNA, 25 bp, Mus musculus
gagaaaacctctgtgcctatagttt

SEQ ID NO: 466126 - DNA, 25 bp, Mus musculus
gagaaaacctgaccccaacgacaat

SEQ ID NO: 466127 - DNA, 25 bp, Mus musculus
gagaaaacctgagcccaacgacaat

SEQ ID NO: 466128 - DNA, 25 bp, Mus musculus
gagaaaacctgcagatccttcagaa

SEQ ID NO: 466129 - DNA, 25 bp, Mus musculus
gagaaaacctgctgatccttcagaa

SEQ ID NO: 466130 - DNA, 25 bp, Mus musculus
gagaaaaccttgactgcttcctcta

SEQ ID NO: 466131 - DNA, 25 bp, Mus musculus
gagaaaaccttgtctgcttcctcta

SEQ ID NO: 466132 - DNA, 25 bp, Mus musculus
gagaaaacgaacacctgccagcctt

SEQ ID NO: 466133 - DNA, 25 bp, Mus musculus
gagaaaacgaactcctgccagcctt

SEQ ID NO: 466134 - DNA, 25 bp, Mus musculus
gagaaaacggccctgtgctgacccc

SEQ ID NO: 466135 - DNA, 25 bp, Mus musculus
gagaaaacggccgtgtgctgacccc

SEQ ID NO: 466136 - DNA, 25 bp, Mus musculus
gagaaaactaacacctgcgcgtcaa

SEQ ID NO: 466137 - DNA, 25 bp, Mus musculus
gagaaaactaactcctgcgcgtcaa

SEQ ID NO: 466138 - DNA, 25 bp, Mus musculus
gagaaaactaggaacatttgaaatg

SEQ ID NO: 466139 - DNA, 25 bp, Mus musculus
gagaaaactaggtacatttgaaatg

SEQ ID NO: 466140 - DNA, 25 bp, Mus musculus
gagaaaactccaatgcttgttagca

SEQ ID NO: 466141 - DNA, 25 bp, Mus musculus
gagaaaactccattgcttgttagca

SEQ ID NO: 466142 - DNA, 25 bp, Mus musculus
gagaaaactcccaacagcatcagca

SEQ ID NO: 466143 - DNA, 25 bp, Mus musculus
gagaaaactccctacagcatcagca

SEQ ID NO: 466144 - DNA, 25 bp, Mus musculus
gagaaaactccgcaccctgatgcac

SEQ ID NO: 466145 - DNA, 25 bp, Mus musculus
gagaaaactccggaccctgatgcac

SEQ ID NO: 466146 - DNA, 25 bp, Mus musculus
gagaaaactcgccagagttgcccct

SEQ ID NO: 466147 - DNA, 25 bp, Mus musculus
gagaaaactcgcgagagttgcccct

SEQ ID NO: 466148 - DNA, 25 bp, Mus musculus
gagaaaactgaaacgcagcatcctt

SEQ ID NO: 466149 - DNA, 25 bp, Mus musculus
gagaaaactgaatcgcagcatcctt

SEQ ID NO: 466150 - DNA, 25 bp, Mus musculus
gagaaaactgcaccccacgcgggcg

SEQ ID NO: 466151 - DNA, 25 bp, Mus musculus
gagaaaactgcagcccacgcgggcg

SEQ ID NO: 466152 - DNA, 25 bp, Mus musculus
gagaaaactgctatatgtcactaaa

SEQ ID NO: 466153 - DNA, 25 bp, Mus musculus
gagaaaactgctttatgtcactaaa

SEQ ID NO: 466154 - DNA, 25 bp, Mus musculus
gagaaaagaaaaatgtccctgtagg

SEQ ID NO: 466155 - DNA, 25 bp, Mus musculus
gagaaaagaaaattgtccctgtagg

SEQ ID NO: 466156 - DNA, 25 bp, Mus musculus
gagaaaagaagtagctgccaataac

SEQ ID NO: 466157 - DNA, 25 bp, Mus musculus
gagaaaagaagttgctgccaataac

SEQ ID NO: 466158 - DNA, 25 bp, Mus musculus
gagaaaagaccactgtgaggaccaa

SEQ ID NO: 466159 - DNA, 25 bp, Mus musculus
gagaaaagaccagtgtgaggaccaa

SEQ ID NO: 466160 - DNA, 25 bp, Mus musculus
gagaaaagacgtcactctgtctcaa

SEQ ID NO: 466161 - DNA, 25 bp, Mus musculus
gagaaaagacgtgactctgtctcaa

SEQ ID NO: 466162 - DNA, 25 bp, Mus musculus
gagaaaagagcaccacacctgtacc

SEQ ID NO: 466163 - DNA, 25 bp, Mus musculus
gagaaaagagcagcacacctgtacc

SEQ ID NO: 466164 - DNA, 25 bp, Mus musculus
gagaaaagagttagcccgcccgact

SEQ ID NO: 466165 - DNA, 25 bp, Mus musculus
gagaaaagagtttgcccgcccgact

SEQ ID NO: 466166 - DNA, 25 bp, Mus musculus
gagaaaagccacagtaccacgtact

SEQ ID NO: 466167 - DNA, 25 bp, Mus musculus
gagaaaagccactgtaccacgtact

SEQ ID NO: 466168 - DNA, 25 bp, Mus musculus
gagaaaagcccaacaccagctacat

SEQ ID NO: 466169 - DNA, 25 bp, Mus musculus
gagaaaagcccatcaccagctacat

SEQ ID NO: 466170 - DNA, 25 bp, Mus musculus
gagaaaagccctaccacaggatgcg

SEQ ID NO: 466171 - DNA, 25 bp, Mus musculus
gagaaaagccctatccaaactgatt

SEQ ID NO: 466172 - DNA, 25 bp, Mus musculus
gagaaaagcccttccacaggatgcg

SEQ ID NO: 466173 - DNA, 25 bp, Mus musculus
gagaaaagccctttccaaactgatt

SEQ ID NO: 466174 - DNA, 25 bp, Mus musculus
gagaaaagcctcaaagtgaccagag

SEQ ID NO: 466175 - DNA, 25 bp, Mus musculus
gagaaaagcctctaagtgaccagag

SEQ ID NO: 466176 - DNA, 25 bp, Mus musculus
gagaaaagccttcggcagagccctg

SEQ ID NO: 466177 - DNA, 25 bp, Mus musculus
gagaaaagccttgggcagagccctg

SEQ ID NO: 466178 - DNA, 25 bp, Mus musculus
gagaaaagcggtcgcgctccatgtc

SEQ ID NO: 466179 - DNA, 25 bp, Mus musculus
gagaaaagcggtggcgctccatgtc

SEQ ID NO: 466180 - DNA, 25 bp, Mus musculus
gagaaaagcgtaccccagacatctt

SEQ ID NO: 466181 - DNA, 25 bp, Mus musculus
gagaaaagcgtagcccagacatctt

SEQ ID NO: 466182 - DNA, 25 bp, Mus musculus
gagaaaaggaaaacccgccaactgt

SEQ ID NO: 466183 - DNA, 25 bp, Mus musculus
gagaaaaggaaatcccgccaactgt

SEQ ID NO: 466184 - DNA, 25 bp, Mus musculus
gagaaaaggatgacccctcccggag

SEQ ID NO: 466185 - DNA, 25 bp, Mus musculus
gagaaaaggatgtcccctcccggag

SEQ ID NO: 466186 - DNA, 25 bp, Mus musculus
gagaaaaggccccacagcttgttct

SEQ ID NO: 466187 - DNA, 25 bp, Mus musculus
gagaaaaggcccgacagcttgttct

SEQ ID NO: 466188 - DNA, 25 bp, Mus musculus
gagaaaaggctgcaaaccacttgga

SEQ ID NO: 466189 - DNA, 25 bp, Mus musculus
gagaaaaggctggaaaccacttgga

SEQ ID NO: 466190 - DNA, 25 bp, Mus musculus
gagaaaagtaaacctgcaacatgaa

SEQ ID NO: 466191 - DNA, 25 bp, Mus musculus
gagaaaagtaaagctgcaacatgaa

SEQ ID NO: 466192 - DNA, 25 bp, Mus musculus
gagaaaagtatgaatggctcacact

SEQ ID NO: 466193 - DNA, 25 bp, Mus musculus
gagaaaagtatgtatggctcacact

SEQ ID NO: 466194 - DNA, 25 bp, Mus musculus
gagaaaagtcttcccctatagatag

SEQ ID NO: 466195 - DNA, 25 bp, Mus musculus
gagaaaagtcttgccctatagatag

SEQ ID NO: 466196 - DNA, 25 bp, Mus musculus
gagaaaagtgaaaccctccttcagt

SEQ ID NO: 466197 - DNA, 25 bp, Mus musculus
gagaaaagtgaatccctccttcagt

SEQ ID NO: 466198 - DNA, 25 bp, Mus musculus
gagaaaagtgccataggagaccagc

SEQ ID NO: 466199 - DNA, 25 bp, Mus musculus
gagaaaagtgccttaggagaccagc

SEQ ID NO: 466200 - DNA, 25 bp, Mus musculus
gagaaaagtgtcactgccaacagag

SEQ ID NO: 466201 - DNA, 25 bp, Mus musculus
gagaaaagtgtctctgccaacagag

SEQ ID NO: 466202 - DNA, 25 bp, Mus musculus
gagaaaagtttcaggttgccctgga

SEQ ID NO: 466203 - DNA, 25 bp, Mus musculus
gagaaaagtttctggttgccctgga

SEQ ID NO: 466204 - DNA, 25 bp, Mus musculus
gagaaaataataacccctgtcctgc

SEQ ID NO: 466205 - DNA, 25 bp, Mus musculus
gagaaaataatatcccctgtcctgc

SEQ ID NO: 466206 - DNA, 25 bp, Mus musculus
gagaaaatacccagcatgtcagtac

SEQ ID NO: 466207 - DNA, 25 bp, Mus musculus
gagaaaataccctgcatgtcagtac

SEQ ID NO: 466208 - DNA, 25 bp, Mus musculus
gagaaaatatacacccagcctgatg

SEQ ID NO: 466209 - DNA, 25 bp, Mus musculus
gagaaaatatactcccagcctgatg

SEQ ID NO: 466210 - DNA, 25 bp, Mus musculus
gagaaaatcaagctggtgaccttta

SEQ ID NO: 466211 - DNA, 25 bp, Mus musculus
gagaaaatcaaggtggtgaccttta

SEQ ID NO: 466212 - DNA, 25 bp, Mus musculus
gagaaaatcatcagctcagactgca

SEQ ID NO: 466213 - DNA, 25 bp, Mus musculus
gagaaaatcatctgctcagactgca

SEQ ID NO: 466214 - DNA, 25 bp, Mus musculus
gagaaaatcattccattcatgacat

SEQ ID NO: 466215 - DNA, 25 bp, Mus musculus
gagaaaatcattgcattcatgacat

SEQ ID NO: 466216 - DNA, 25 bp, Mus musculus
gagaaaatctatccataatatgctt

SEQ ID NO: 466217 - DNA, 25 bp, Mus musculus
gagaaaatctatgcataatatgctt

SEQ ID NO: 466218 - DNA, 25 bp, Mus musculus
gagaaaatgaccagcccactcttta

SEQ ID NO: 466219 - DNA, 25 bp, Mus musculus
gagaaaatgacctgcccactcttta

SEQ ID NO: 466220 - DNA, 25 bp, Mus musculus
gagaaaatgcagatccctaaaagcc

SEQ ID NO: 466221 - DNA, 25 bp, Mus musculus
gagaaaatgcagttccctaaaagcc

SEQ ID NO: 466222 - DNA, 25 bp, Mus musculus
gagaaaattaagattcttccacttg

SEQ ID NO: 466223 - DNA, 25 bp, Mus musculus
gagaaaattaagtttcttccacttg

SEQ ID NO: 466224 - DNA, 25 bp, Mus musculus
gagaaaattccacagccctgtccag

SEQ ID NO: 466225 - DNA, 25 bp, Mus musculus
gagaaaattccagagccctgtccag

SEQ ID NO: 466226 - DNA, 25 bp, Mus musculus
gagaaaattcttaattaacttgtga

SEQ ID NO: 466227 - DNA, 25 bp, Mus musculus
gagaaaattctttattaacttgtga

SEQ ID NO: 466228 - DNA, 25 bp, Mus musculus
gagaaaatttccacgctgggctcaa

SEQ ID NO: 466229 - DNA, 25 bp, Mus musculus
gagaaaatttcctcgctgggctcaa

SEQ ID NO: 466230 - DNA, 25 bp, Mus musculus
gagaaacaaacaacagccttacctt

SEQ ID NO: 466231 - DNA, 25 bp, Mus musculus
gagaaacaaacatcagccttacctt

SEQ ID NO: 466232 - DNA, 25 bp, Mus musculus
gagaaacaacatactctgaagagat

SEQ ID NO: 466233 - DNA, 25 bp, Mus musculus
gagaaacaacattctctgaagagat

SEQ ID NO: 466234 - DNA, 25 bp, Mus musculus
gagaaacaaccactcagtcctgctt

SEQ ID NO: 466235 - DNA, 25 bp, Mus musculus
gagaaacaaccagtcagtcctgctt

SEQ ID NO: 466236 - DNA, 25 bp, Mus musculus
gagaaacaacctagggcagaccctg

SEQ ID NO: 466237 - DNA, 25 bp, Mus musculus
gagaaacaaccttgggcagaccctg

SEQ ID NO: 466238 - DNA, 25 bp, Mus musculus
gagaaacaactcatcataatcctaa

SEQ ID NO: 466239 - DNA, 25 bp, Mus musculus
gagaaacaactcttcataatcctaa

SEQ ID NO: 466240 - DNA, 25 bp, Mus musculus
gagaaacaagcacaccactacatta

SEQ ID NO: 466241 - DNA, 25 bp, Mus musculus
gagaaacaagcagaccactacatta

SEQ ID NO: 466242 - DNA, 25 bp, Mus musculus
gagaaacacaacatcctgcatatat

SEQ ID NO: 466243 - DNA, 25 bp, Mus musculus
gagaaacacaacttcctgcatatat

SEQ ID NO: 466244 - DNA, 25 bp, Mus musculus
gagaaacacaagcacctgctggaga

SEQ ID NO: 466245 - DNA, 25 bp, Mus musculus
gagaaacacaaggacctgctggaga

SEQ ID NO: 466246 - DNA, 25 bp, Mus musculus
gagaaacacacactgcccttggacc

SEQ ID NO: 466247 - DNA, 25 bp, Mus musculus
gagaaacacacagtgcccttggacc

SEQ ID NO: 466248 - DNA, 25 bp, Mus musculus
gagaaacacagaattttacactaat

SEQ ID NO: 466249 - DNA, 25 bp, Mus musculus
gagaaacacagatttttacactaat

SEQ ID NO: 466250 - DNA, 25 bp, Mus musculus
gagaaacacccacaccatttagttg

SEQ ID NO: 466251 - DNA, 25 bp, Mus musculus
gagaaacacccagaccatttagttg

SEQ ID NO: 466252 - DNA, 25 bp, Mus musculus
gagaaacaccttctttcaagagcaa

SEQ ID NO: 466253 - DNA, 25 bp, Mus musculus
gagaaacaccttgtttcaagagcaa

SEQ ID NO: 466254 - DNA, 25 bp, Mus musculus
gagaaacacgcccacgaggaggact

SEQ ID NO: 466255 - DNA, 25 bp, Mus musculus
gagaaacacgccgacgaggaggact

SEQ ID NO: 466256 - DNA, 25 bp, Mus musculus
gagaaacactccaacttcacagaaa

SEQ ID NO: 466257 - DNA, 25 bp, Mus musculus
gagaaacactcctacttcacagaaa

SEQ ID NO: 466258 - DNA, 25 bp, Mus musculus
gagaaacactgcacacatttttcaa

SEQ ID NO: 466259 - DNA, 25 bp, Mus musculus
gagaaacactgctcacatttttcaa

SEQ ID NO: 466260 - DNA, 25 bp, Mus musculus
gagaaacagaagcacacttttccac

SEQ ID NO: 466261 - DNA, 25 bp, Mus musculus
gagaaacagaaggacacttttccac

SEQ ID NO: 466262 - DNA, 25 bp, Mus musculus
gagaaacagcaccattgtaaagatg

SEQ ID NO: 466263 - DNA, 25 bp, Mus musculus
gagaaacagcacgattgtaaagatg

SEQ ID NO: 466264 - DNA, 25 bp, Mus musculus
gagaaacagcctcctctcagaatcg

SEQ ID NO: 466265 - DNA, 25 bp, Mus musculus
gagaaacagcctgctctcagaatcg

SEQ ID NO: 466266 - DNA, 25 bp, Mus musculus
gagaaacagctcagaagcggtttgc

SEQ ID NO: 466267 - DNA, 25 bp, Mus musculus
gagaaacagctctgaagcggtttgc

SEQ ID NO: 466268 - DNA, 25 bp, Mus musculus
gagaaacagctgaacctgggcatgt

SEQ ID NO: 466269 - DNA, 25 bp, Mus musculus
gagaaacagctgtacctgggcatgt

SEQ ID NO: 466270 - DNA, 25 bp, Mus musculus
gagaaacagtttactatatatcaaa

SEQ ID NO: 466271 - DNA, 25 bp, Mus musculus
gagaaacagttttctatatatcaaa

SEQ ID NO: 466272 - DNA, 25 bp, Mus musculus
gagaaacatccaagattgctcctag

SEQ ID NO: 466273 - DNA, 25 bp, Mus musculus
gagaaacatccatgattgctcctag

SEQ ID NO: 466274 - DNA, 25 bp, Mus musculus
gagaaacatctcacttcatcaggaa

SEQ ID NO: 466275 - DNA, 25 bp, Mus musculus
gagaaacatctctcttcatcaggaa

SEQ ID NO: 466276 - DNA, 25 bp, Mus musculus
gagaaacatgccctattacttttta

SEQ ID NO: 466277 - DNA, 25 bp, Mus musculus
gagaaacatgccgtattacttttta

SEQ ID NO: 466278 - DNA, 25 bp, Mus musculus
gagaaacatggcaagcccagcccat

SEQ ID NO: 466279 - DNA, 25 bp, Mus musculus
gagaaacatggctagcccagcccat

SEQ ID NO: 466280 - DNA, 25 bp, Mus musculus
gagaaaccaaccacaaggcaactca

SEQ ID NO: 466281 - DNA, 25 bp, Mus musculus
gagaaaccaacctcaaggcaactca

SEQ ID NO: 466282 - DNA, 25 bp, Mus musculus
gagaaaccaccccacggctggagag

SEQ ID NO: 466283 - DNA, 25 bp, Mus musculus
gagaaaccacccgacggctggagag

SEQ ID NO: 466284 - DNA, 25 bp, Mus musculus
gagaaaccagccaaccaagtcaaaa

SEQ ID NO: 466285 - DNA, 25 bp, Mus musculus
gagaaaccagcctaccaagtcaaaa

SEQ ID NO: 466286 - DNA, 25 bp, Mus musculus
gagaaaccaggcatatccagcccca

SEQ ID NO: 466287 - DNA, 25 bp, Mus musculus
gagaaaccaggcttatccagcccca

SEQ ID NO: 466288 - DNA, 25 bp, Mus musculus
gagaaaccagtccatcttgaaagca

SEQ ID NO: 466289 - DNA, 25 bp, Mus musculus
gagaaaccagtcgatcttgaaagca

SEQ ID NO: 466290 - DNA, 25 bp, Mus musculus
gagaaaccatacaactctgtttaga

SEQ ID NO: 466291 - DNA, 25 bp, Mus musculus
gagaaaccatactactctgtttaga

SEQ ID NO: 466292 - DNA, 25 bp, Mus musculus
gagaaaccatcactttcagcaaaat

SEQ ID NO: 466293 - DNA, 25 bp, Mus musculus
gagaaaccatcagtttcagcaaaat

SEQ ID NO: 466294 - DNA, 25 bp, Mus musculus
gagaaaccatttcaaactcacattc

SEQ ID NO: 466295 - DNA, 25 bp, Mus musculus
gagaaaccatttgaaactcacattc

SEQ ID NO: 466296 - DNA, 25 bp, Mus musculus
gagaaacccaagcaccgacctgaga

SEQ ID NO: 466297 - DNA, 25 bp, Mus musculus
gagaaacccaaggaccgacctgaga

SEQ ID NO: 466298 - DNA, 25 bp, Mus musculus
gagaaacccaccaacgacgacagcg

SEQ ID NO: 466299 - DNA, 25 bp, Mus musculus
gagaaacccacctacgacgacagcg

SEQ ID NO: 466300 - DNA, 25 bp, Mus musculus
gagaaacccagaaggaggtcacttt

SEQ ID NO: 466301 - DNA, 25 bp, Mus musculus
gagaaacccagatggaggtcacttt

SEQ ID NO: 466302 - DNA, 25 bp, Mus musculus
gagaaaccccacacgaatgctgatg

SEQ ID NO: 466303 - DNA, 25 bp, Mus musculus
gagaaaccccactcgaatgctgatg

SEQ ID NO: 466304 - DNA, 25 bp, Mus musculus
gagaaaccctacaaacgtgattagt

SEQ ID NO: 466305 - DNA, 25 bp, Mus musculus
gagaaaccctactaacgtgattagt

SEQ ID NO: 466306 - DNA, 25 bp, Mus musculus
gagaaacccttcaacagccgactgg

SEQ ID NO: 466307 - DNA, 25 bp, Mus musculus
gagaaacccttctacagccgactgg

SEQ ID NO: 466308 - DNA, 25 bp, Mus musculus
gagaaaccctttagactttgatcag

SEQ ID NO: 466309 - DNA, 25 bp, Mus musculus
gagaaacccttttgactttgatcag

SEQ ID NO: 466310 - DNA, 25 bp, Mus musculus
gagaaaccgacacaaagctttttag

SEQ ID NO: 466311 - DNA, 25 bp, Mus musculus
gagaaaccgacagaaagctttttag

SEQ ID NO: 466312 - DNA, 25 bp, Mus musculus
gagaaaccgcatcggaattggagat

SEQ ID NO: 466313 - DNA, 25 bp, Mus musculus
gagaaaccgcatgggaattggagat

SEQ ID NO: 466314 - DNA, 25 bp, Mus musculus
gagaaaccgtacattatggacccag

SEQ ID NO: 466315 - DNA, 25 bp, Mus musculus
gagaaaccgtactttatggacccag

SEQ ID NO: 466316 - DNA, 25 bp, Mus musculus
gagaaacctccaaagggcactgcac

SEQ ID NO: 466317 - DNA, 25 bp, Mus musculus
gagaaacctccatagggcactgcac

SEQ ID NO: 466318 - DNA, 25 bp, Mus musculus
gagaaacctcggaagcagctaagct

SEQ ID NO: 466319 - DNA, 25 bp, Mus musculus
gagaaacctcggtagcagctaagct

SEQ ID NO: 466320 - DNA, 25 bp, Mus musculus
gagaaacctgacatgtgacgcctca

SEQ ID NO: 466321 - DNA, 25 bp, Mus musculus
gagaaacctgacttgtgacgcctca

SEQ ID NO: 466322 - DNA, 25 bp, Mus musculus
gagaaacctgccaagtatgatgaca

SEQ ID NO: 466323 - DNA, 25 bp, Mus musculus
gagaaacctgccagcaagtgagaat

SEQ ID NO: 466324 - DNA, 25 bp, Mus musculus
gagaaacctgcctagtatgatgaca

SEQ ID NO: 466325 - DNA, 25 bp, Mus musculus
gagaaacctgcctgcaagtgagaat

SEQ ID NO: 466326 - DNA, 25 bp, Mus musculus
gagaaacctgtcagcattggactat

SEQ ID NO: 466327 - DNA, 25 bp, Mus musculus
gagaaacctgtctgcattggactat

SEQ ID NO: 466328 - DNA, 25 bp, Mus musculus
gagaaaccttacaactctgagtgcc

SEQ ID NO: 466329 - DNA, 25 bp, Mus musculus
gagaaaccttactactctgagtgcc

SEQ ID NO: 466330 - DNA, 25 bp, Mus musculus
gagaaaccttcaactccaactgggc

SEQ ID NO: 466331 - DNA, 25 bp, Mus musculus
gagaaaccttcatctccaactgggc

SEQ ID NO: 466332 - DNA, 25 bp, Mus musculus
gagaaaccttggacagcttcagcct

SEQ ID NO: 466333 - DNA, 25 bp, Mus musculus
gagaaaccttggcacgttatctctc

SEQ ID NO: 466334 - DNA, 25 bp, Mus musculus
gagaaaccttgggacgttatctctc

SEQ ID NO: 466335 - DNA, 25 bp, Mus musculus
gagaaaccttggtcagcttcagcct

SEQ ID NO: 466336 - DNA, 25 bp, Mus musculus
gagaaacctttcctgcatatattca

SEQ ID NO: 466337 - DNA, 25 bp, Mus musculus
gagaaacctttcgtgcatatattca

SEQ ID NO: 466338 - DNA, 25 bp, Mus musculus
gagaaacgagctacttgggaaaatt

SEQ ID NO: 466339 - DNA, 25 bp, Mus musculus
gagaaacgagcttcttgggaaaatt

SEQ ID NO: 466340 - DNA, 25 bp, Mus musculus
gagaaacgcctaattggattccttt

SEQ ID NO: 466341 - DNA, 25 bp, Mus musculus
gagaaacgcctatttggattccttt

SEQ ID NO: 466342 - DNA, 25 bp, Mus musculus
gagaaacgctgaattccatgaattg

SEQ ID NO: 466343 - DNA, 25 bp, Mus musculus
gagaaacgctgatttccatgaattg

SEQ ID NO: 466344 - DNA, 25 bp, Mus musculus
gagaaacgctgcaaacccctagacc

SEQ ID NO: 466345 - DNA, 25 bp, Mus musculus
gagaaacgctgctaacccctagacc

SEQ ID NO: 466346 - DNA, 25 bp, Mus musculus
gagaaacggacccatctgcgtacag

SEQ ID NO: 466347 - DNA, 25 bp, Mus musculus
gagaaacggaccgatctgcgtacag

SEQ ID NO: 466348 - DNA, 25 bp, Mus musculus
gagaaacggctaccacatccaagga

SEQ ID NO: 466349 - DNA, 25 bp, Mus musculus
gagaaacggctagcacatccaagga

SEQ ID NO: 466350 - DNA, 25 bp, Mus musculus
gagaaacgggttccttgagccctga

SEQ ID NO: 466351 - DNA, 25 bp, Mus musculus
gagaaacgggttgcttgagccctga

SEQ ID NO: 466352 - DNA, 25 bp, Mus musculus
gagaaacggtttcttaccagcaatt

SEQ ID NO: 466353 - DNA, 25 bp, Mus musculus
gagaaacggtttgttaccagcaatt

SEQ ID NO: 466354 - DNA, 25 bp, Mus musculus
gagaaacgttgcagtctaactcctt

SEQ ID NO: 466355 - DNA, 25 bp, Mus musculus
gagaaacgttgctgtctaactcctt

SEQ ID NO: 466356 - DNA, 25 bp, Mus musculus
gagaaactacccatgtttggcacaa

SEQ ID NO: 466357 - DNA, 25 bp, Mus musculus
gagaaactacccttgtttggcacaa

SEQ ID NO: 466358 - DNA, 25 bp, Mus musculus
gagaaactactgctcttgtaatcta

SEQ ID NO: 466359 - DNA, 25 bp, Mus musculus
gagaaactactggtcttgtaatcta

SEQ ID NO: 466360 - DNA, 25 bp, Mus musculus
gagaaactagcccactgtgcccagc

SEQ ID NO: 466361 - DNA, 25 bp, Mus musculus
gagaaactagccgactgtgcccagc

SEQ ID NO: 466362 - DNA, 25 bp, Mus musculus
gagaaactaggcactgattggaaca

SEQ ID NO: 466363 - DNA, 25 bp, Mus musculus
gagaaactaggctctgattggaaca

SEQ ID NO: 466364 - DNA, 25 bp, Mus musculus
gagaaactagtaacggttctgcact

SEQ ID NO: 466365 - DNA, 25 bp, Mus musculus
gagaaactagtatcggttctgcact

SEQ ID NO: 466366 - DNA, 25 bp, Mus musculus
gagaaactagtcactggccattgcc

SEQ ID NO: 466367 - DNA, 25 bp, Mus musculus
gagaaactagtctctggccattgcc

SEQ ID NO: 466368 - DNA, 25 bp, Mus musculus
gagaaactattcaggtagaatcctt

SEQ ID NO: 466369 - DNA, 25 bp, Mus musculus
gagaaactattctggtagaatcctt

SEQ ID NO: 466370 - DNA, 25 bp, Mus musculus
gagaaactcaagcacacctctttcc

SEQ ID NO: 466371 - DNA, 25 bp, Mus musculus
gagaaactcaaggacacctctttcc

SEQ ID NO: 466372 - DNA, 25 bp, Mus musculus
gagaaactcacccatattgtcatta

SEQ ID NO: 466373 - DNA, 25 bp, Mus musculus
gagaaactcaccgatattgtcatta

SEQ ID NO: 466374 - DNA, 25 bp, Mus musculus
gagaaactcagcacagctcagtcca

SEQ ID NO: 466375 - DNA, 25 bp, Mus musculus
gagaaactcagcagactgtgctact

SEQ ID NO: 466376 - DNA, 25 bp, Mus musculus
gagaaactcagctcagctcagtcca

SEQ ID NO: 466377 - DNA, 25 bp, Mus musculus
gagaaactcagctgactgtgctact

SEQ ID NO: 466378 - DNA, 25 bp, Mus musculus
gagaaactccacagtgaccttccaa

SEQ ID NO: 466379 - DNA, 25 bp, Mus musculus
gagaaactccactgtgaccttccaa

SEQ ID NO: 466380 - DNA, 25 bp, Mus musculus
gagaaactctaactcctgttgatga

SEQ ID NO: 466381 - DNA, 25 bp, Mus musculus
gagaaactctaagtcctgttgatga

SEQ ID NO: 466382 - DNA, 25 bp, Mus musculus
gagaaactctataccgatgtatcag

SEQ ID NO: 466383 - DNA, 25 bp, Mus musculus
gagaaactctattccgatgtatcag

SEQ ID NO: 466384 - DNA, 25 bp, Mus musculus
gagaaactcttcctgaggctgaaca

SEQ ID NO: 466385 - DNA, 25 bp, Mus musculus
gagaaactcttcgtgaggctgaaca

SEQ ID NO: 466386 - DNA, 25 bp, Mus musculus
gagaaactgaccaggcatcactttg

SEQ ID NO: 466387 - DNA, 25 bp, Mus musculus
gagaaactgacctggcatcactttg

SEQ ID NO: 466388 - DNA, 25 bp, Mus musculus
gagaaactgcctatcctggtgaagc

SEQ ID NO: 466389 - DNA, 25 bp, Mus musculus
gagaaactgcctatctttcaaggaa

SEQ ID NO: 466390 - DNA, 25 bp, Mus musculus
gagaaactgcctttcctggtgaagc

SEQ ID NO: 466391 - DNA, 25 bp, Mus musculus
gagaaactgcctttctttcaaggaa

SEQ ID NO: 466392 - DNA, 25 bp, Mus musculus
gagaaacttacaagccgtcatcttc

SEQ ID NO: 466393 - DNA, 25 bp, Mus musculus
gagaaacttacatgccgtcatcttc

SEQ ID NO: 466394 - DNA, 25 bp, Mus musculus
gagaaacttcggctttgcatggaga

SEQ ID NO: 466395 - DNA, 25 bp, Mus musculus
gagaaacttcgggtttgcatggaga

SEQ ID NO: 466396 - DNA, 25 bp, Mus musculus
gagaaacttctaacaacattaccat

SEQ ID NO: 466397 - DNA, 25 bp, Mus musculus
gagaaacttctatcaacattaccat

SEQ ID NO: 466398 - DNA, 25 bp, Mus musculus
gagaaacttctcactgcaacaggat

SEQ ID NO: 466399 - DNA, 25 bp, Mus musculus
gagaaacttctctctgcaacaggat

SEQ ID NO: 466400 - DNA, 25 bp, Mus musculus
gagaaacttcttaccagcgagagta

SEQ ID NO: 466401 - DNA, 25 bp, Mus musculus
gagaaacttcttccgtagactcttc

SEQ ID NO: 466402 - DNA, 25 bp, Mus musculus
gagaaacttcttgcgtagactcttc

SEQ ID NO: 466403 - DNA, 25 bp, Mus musculus
gagaaacttctttccagcgagagta

SEQ ID NO: 466404 - DNA, 25 bp, Mus musculus
gagaaacttgagatctaggtctttg

SEQ ID NO: 466405 - DNA, 25 bp, Mus musculus
gagaaacttgagttctaggtctttg

SEQ ID NO: 466406 - DNA, 25 bp, Mus musculus
gagaaacttgatccaaaaccacaga

SEQ ID NO: 466407 - DNA, 25 bp, Mus musculus
gagaaacttgatgcaaaaccacaga

SEQ ID NO: 466408 - DNA, 25 bp, Mus musculus
gagaaacttgccatgaaattagtga

SEQ ID NO: 466409 - DNA, 25 bp, Mus musculus
gagaaacttgcccaactgtggagga

SEQ ID NO: 466410 - DNA, 25 bp, Mus musculus
gagaaacttgccgaactgtggagga

SEQ ID NO: 466411 - DNA, 25 bp, Mus musculus
gagaaacttgccttgaaattagtga

SEQ ID NO: 466412 - DNA, 25 bp, Mus musculus
gagaaacttgcgagacttcctgttg

SEQ ID NO: 466413 - DNA, 25 bp, Mus musculus
gagaaacttgcgtgacttcctgttg

SEQ ID NO: 466414 - DNA, 25 bp, Mus musculus
gagaaacttgctaagccattcagaa

SEQ ID NO: 466415 - DNA, 25 bp, Mus musculus
gagaaacttgcttagccattcagaa

SEQ ID NO: 466416 - DNA, 25 bp, Mus musculus
gagaaacttggtctcccagtctcaa

SEQ ID NO: 466417 - DNA, 25 bp, Mus musculus
gagaaacttggtgtcccagtctcaa

SEQ ID NO: 466418 - DNA, 25 bp, Mus musculus
gagaaagaactcattacctcctcat

SEQ ID NO: 466419 - DNA, 25 bp, Mus musculus
gagaaagaactctttacctcctcat

SEQ ID NO: 466420 - DNA, 25 bp, Mus musculus
gagaaagaagatccctgttaacaca

SEQ ID NO: 466421 - DNA, 25 bp, Mus musculus
gagaaagaagatgcctgttaacaca

SEQ ID NO: 466422 - DNA, 25 bp, Mus musculus
gagaaagaaggacgtcctcactttt

SEQ ID NO: 466423 - DNA, 25 bp, Mus musculus
gagaaagaaggaggtcctcactttt

SEQ ID NO: 466424 - DNA, 25 bp, Mus musculus
gagaaagaatgcacactgctccatt

SEQ ID NO: 466425 - DNA, 25 bp, Mus musculus
gagaaagaatgctcactgctccatt

SEQ ID NO: 466426 - DNA, 25 bp, Mus musculus
gagaaagacaacatctgagatagat

SEQ ID NO: 466427 - DNA, 25 bp, Mus musculus
gagaaagacaacttctgagatagat

SEQ ID NO: 466428 - DNA, 25 bp, Mus musculus
gagaaagacaagatcaccaccagga

SEQ ID NO: 466429 - DNA, 25 bp, Mus musculus
gagaaagacaagttcaccaccagga

SEQ ID NO: 466430 - DNA, 25 bp, Mus musculus
gagaaagaccgtattcagggacgct

SEQ ID NO: 466431 - DNA, 25 bp, Mus musculus
gagaaagaccgttttcagggacgct

SEQ ID NO: 466432 - DNA, 25 bp, Mus musculus
gagaaagactacagctgtgccctct

SEQ ID NO: 466433 - DNA, 25 bp, Mus musculus
gagaaagactactgctgtgccctct

SEQ ID NO: 466434 - DNA, 25 bp, Mus musculus
gagaaagactcaataatcccatctg

SEQ ID NO: 466435 - DNA, 25 bp, Mus musculus
gagaaagactcattaatcccatctg

SEQ ID NO: 466436 - DNA, 25 bp, Mus musculus
gagaaagacttgataccctgtatta

SEQ ID NO: 466437 - DNA, 25 bp, Mus musculus
gagaaagacttgttaccctgtatta

SEQ ID NO: 466438 - DNA, 25 bp, Mus musculus
gagaaagagacacctaaccccgcca

SEQ ID NO: 466439 - DNA, 25 bp, Mus musculus
gagaaagagacagctaaccccgcca

SEQ ID NO: 466440 - DNA, 25 bp, Mus musculus
gagaaagagcttatcccttttgtga

SEQ ID NO: 466441 - DNA, 25 bp, Mus musculus
gagaaagagcttttcccttttgtga

SEQ ID NO: 466442 - DNA, 25 bp, Mus musculus
gagaaagagtctcccatccttcaaa

SEQ ID NO: 466443 - DNA, 25 bp, Mus musculus
gagaaagagtctgccatccttcaaa

SEQ ID NO: 466444 - DNA, 25 bp, Mus musculus
gagaaagataacagagaccaggcct

SEQ ID NO: 466445 - DNA, 25 bp, Mus musculus
gagaaagataactgagaccaggcct

SEQ ID NO: 466446 - DNA, 25 bp, Mus musculus
gagaaagatccgctgttgtgataca

SEQ ID NO: 466447 - DNA, 25 bp, Mus musculus
gagaaagatccggtgttgtgataca

SEQ ID NO: 466448 - DNA, 25 bp, Mus musculus
gagaaagatcctacaagtatgatag

SEQ ID NO: 466449 - DNA, 25 bp, Mus musculus
gagaaagatccttcaagtatgatag

SEQ ID NO: 466450 - DNA, 25 bp, Mus musculus
gagaaagatcgaatgccatcccttc

SEQ ID NO: 466451 - DNA, 25 bp, Mus musculus
gagaaagatcgattgccatcccttc

SEQ ID NO: 466452 - DNA, 25 bp, Mus musculus
gagaaagatctgaacccagggcctc

SEQ ID NO: 466453 - DNA, 25 bp, Mus musculus
gagaaagatctgtacccagggcctc

SEQ ID NO: 466454 - DNA, 25 bp, Mus musculus
gagaaagatgacacccccttatcac

SEQ ID NO: 466455 - DNA, 25 bp, Mus musculus
gagaaagatgactcccccttatcac

SEQ ID NO: 466456 - DNA, 25 bp, Mus musculus
gagaaagatgcccttttgcgacacc

SEQ ID NO: 466457 - DNA, 25 bp, Mus musculus
gagaaagatgccgttttgcgacacc

SEQ ID NO: 466458 - DNA, 25 bp, Mus musculus
gagaaagatggcctgtgtttatgaa

SEQ ID NO: 466459 - DNA, 25 bp, Mus musculus
gagaaagatggcgtgtgtttatgaa

SEQ ID NO: 466460 - DNA, 25 bp, Mus musculus
gagaaagatttccacactatatgag

SEQ ID NO: 466461 - DNA, 25 bp, Mus musculus
gagaaagatttcgacactatatgag

SEQ ID NO: 466462 - DNA, 25 bp, Mus musculus
gagaaagcaaatcttccagccacca

SEQ ID NO: 466463 - DNA, 25 bp, Mus musculus
gagaaagcaaatgttccagccacca

SEQ ID NO: 466464 - DNA, 25 bp, Mus musculus
gagaaagcaacgctggccgcacaga

SEQ ID NO: 466465 - DNA, 25 bp, Mus musculus
gagaaagcaacggtggccgcacaga

SEQ ID NO: 466466 - DNA, 25 bp, Mus musculus
gagaaagcaatcaacaccgtctgta

SEQ ID NO: 466467 - DNA, 25 bp, Mus musculus
gagaaagcaatcactcctgtctgac

SEQ ID NO: 466468 - DNA, 25 bp, Mus musculus
gagaaagcaatctacaccgtctgta

SEQ ID NO: 466469 - DNA, 25 bp, Mus musculus
gagaaagcaatctctcctgtctgac

SEQ ID NO: 466470 - DNA, 25 bp, Mus musculus
gagaaagcacctcccagaaagctgt

SEQ ID NO: 466471 - DNA, 25 bp, Mus musculus
gagaaagcacctgccagaaagctgt

SEQ ID NO: 466472 - DNA, 25 bp, Mus musculus
gagaaagcactacttgccatctgtg

SEQ ID NO: 466473 - DNA, 25 bp, Mus musculus
gagaaagcactagttgccatctgtg

SEQ ID NO: 466474 - DNA, 25 bp, Mus musculus
gagaaagcacttagtttccagggtg

SEQ ID NO: 466475 - DNA, 25 bp, Mus musculus
gagaaagcactttgtttccagggtg

SEQ ID NO: 466476 - DNA, 25 bp, Mus musculus
gagaaagcagaacaggctccgactg

SEQ ID NO: 466477 - DNA, 25 bp, Mus musculus
gagaaagcagaagaggctccgactg

SEQ ID NO: 466478 - DNA, 25 bp, Mus musculus
gagaaagcagcgctgatatatttga

SEQ ID NO: 466479 - DNA, 25 bp, Mus musculus
gagaaagcagcggtgatatatttga

SEQ ID NO: 466480 - DNA, 25 bp, Mus musculus
gagaaagcagttaaaagatacaatt

SEQ ID NO: 466481 - DNA, 25 bp, Mus musculus
gagaaagcagtttaaagatacaatt

SEQ ID NO: 466482 - DNA, 25 bp, Mus musculus
gagaaagcatacaagaccgtgatca

SEQ ID NO: 466483 - DNA, 25 bp, Mus musculus
gagaaagcatactagaccgtgatca

SEQ ID NO: 466484 - DNA, 25 bp, Mus musculus
gagaaagccacaaaattaccccaat

SEQ ID NO: 466485 - DNA, 25 bp, Mus musculus
gagaaagccacataattaccccaat

SEQ ID NO: 466486 - DNA, 25 bp, Mus musculus
gagaaagccagaacccggtatagaa

SEQ ID NO: 466487 - DNA, 25 bp, Mus musculus
gagaaagccagatcccggtatagaa

SEQ ID NO: 466488 - DNA, 25 bp, Mus musculus
gagaaagccaggacccgacatgctg

SEQ ID NO: 466489 - DNA, 25 bp, Mus musculus
gagaaagccaggtcccgacatgctg

SEQ ID NO: 466490 - DNA, 25 bp, Mus musculus
gagaaagcccagcacttagctgaag

SEQ ID NO: 466491 - DNA, 25 bp, Mus musculus
gagaaagcccaggacttagctgaag

SEQ ID NO: 466492 - DNA, 25 bp, Mus musculus
gagaaagccccgctgcggaaagctt

SEQ ID NO: 466493 - DNA, 25 bp, Mus musculus
gagaaagccccggtgcggaaagctt

SEQ ID NO: 466494 - DNA, 25 bp, Mus musculus
gagaaagcccggctggaaacaccct

SEQ ID NO: 466495 - DNA, 25 bp, Mus musculus
gagaaagcccgggtggaaacaccct

SEQ ID NO: 466496 - DNA, 25 bp, Mus musculus
gagaaagccctcacagtagatgata

SEQ ID NO: 466497 - DNA, 25 bp, Mus musculus
gagaaagccctctcagtagatgata

SEQ ID NO: 466498 - DNA, 25 bp, Mus musculus
gagaaagccctgaggtgtcgattcc

SEQ ID NO: 466499 - DNA, 25 bp, Mus musculus
gagaaagccctgtggtgtcgattcc

SEQ ID NO: 466500 - DNA, 25 bp, Mus musculus
gagaaagcccttaccaagacagata

SEQ ID NO: 466501 - DNA, 25 bp, Mus musculus
gagaaagccctttccaagacagata

SEQ ID NO: 466502 - DNA, 25 bp, Mus musculus
gagaaagcctcacatagcccgggat

SEQ ID NO: 466503 - DNA, 25 bp, Mus musculus
gagaaagcctcagatagcccgggat

SEQ ID NO: 466504 - DNA, 25 bp, Mus musculus
gagaaagcctccaggctgcttttgg

SEQ ID NO: 466505 - DNA, 25 bp, Mus musculus
gagaaagcctcctggctgcttttgg

SEQ ID NO: 466506 - DNA, 25 bp, Mus musculus
gagaaagcctctacacatggctgtg

SEQ ID NO: 466507 - DNA, 25 bp, Mus musculus
gagaaagcctctcatggtcctcagt

SEQ ID NO: 466508 - DNA, 25 bp, Mus musculus
gagaaagcctctgatggtcctcagt

SEQ ID NO: 466509 - DNA, 25 bp, Mus musculus
gagaaagcctcttcacatggctgtg

SEQ ID NO: 466510 - DNA, 25 bp, Mus musculus
gagaaagccttgattgcagtcccta

SEQ ID NO: 466511 - DNA, 25 bp, Mus musculus
gagaaagccttgtttgcagtcccta

SEQ ID NO: 466512 - DNA, 25 bp, Mus musculus
gagaaagcctttccatatttttgat

SEQ ID NO: 466513 - DNA, 25 bp, Mus musculus
gagaaagcctttgcatatttttgat

SEQ ID NO: 466514 - DNA, 25 bp, Mus musculus
gagaaagcgaggacacaagcgtcta

SEQ ID NO: 466515 - DNA, 25 bp, Mus musculus
gagaaagcgaggtcacaagcgtcta

SEQ ID NO: 466516 - DNA, 25 bp, Mus musculus
gagaaagcgcccacatttgtccaag

SEQ ID NO: 466517 - DNA, 25 bp, Mus musculus
gagaaagcgccctcatttgtccaag

SEQ ID NO: 466518 - DNA, 25 bp, Mus musculus
gagaaagcggccagtttccatcaac

SEQ ID NO: 466519 - DNA, 25 bp, Mus musculus
gagaaagcggcctgtttccatcaac

SEQ ID NO: 466520 - DNA, 25 bp, Mus musculus
gagaaagctaccatttcccaaggca

SEQ ID NO: 466521 - DNA, 25 bp, Mus musculus
gagaaagctaccctcctgtgtattc

SEQ ID NO: 466522 - DNA, 25 bp, Mus musculus
gagaaagctaccgtcctgtgtattc

SEQ ID NO: 466523 - DNA, 25 bp, Mus musculus
gagaaagctaccttttcccaaggca

SEQ ID NO: 466524 - DNA, 25 bp, Mus musculus
gagaaagctccactggtgaacaata

SEQ ID NO: 466525 - DNA, 25 bp, Mus musculus
gagaaagctccagtggtgaacaata

SEQ ID NO: 466526 - DNA, 25 bp, Mus musculus
gagaaagctcggattctggcagaaa

SEQ ID NO: 466527 - DNA, 25 bp, Mus musculus
gagaaagctcggtttctggcagaaa

SEQ ID NO: 466528 - DNA, 25 bp, Mus musculus
gagaaagctctgattcatttagagt

SEQ ID NO: 466529 - DNA, 25 bp, Mus musculus
gagaaagctctgtttcatttagagt

SEQ ID NO: 466530 - DNA, 25 bp, Mus musculus
gagaaagctgacctaccagttcagc

SEQ ID NO: 466531 - DNA, 25 bp, Mus musculus
gagaaagctgacgtaccagttcagc

SEQ ID NO: 466532 - DNA, 25 bp, Mus musculus
gagaaagctgcaattacaagtccca

SEQ ID NO: 466533 - DNA, 25 bp, Mus musculus
gagaaagctgcatttacaagtccca

SEQ ID NO: 466534 - DNA, 25 bp, Mus musculus
gagaaagctgctctgatagccagtg

SEQ ID NO: 466535 - DNA, 25 bp, Mus musculus
gagaaagctgctgtgatagccagtg

SEQ ID NO: 466536 - DNA, 25 bp, Mus musculus
gagaaagctggcacaagcagggaaa

SEQ ID NO: 466537 - DNA, 25 bp, Mus musculus
gagaaagctggctcaagcagggaaa

SEQ ID NO: 466538 - DNA, 25 bp, Mus musculus
gagaaagctgtaattgttgtttcaa

SEQ ID NO: 466539 - DNA, 25 bp, Mus musculus
gagaaagctgtatttgttgtttcaa

SEQ ID NO: 466540 - DNA, 25 bp, Mus musculus
gagaaagctgtgaatccgccatcat

SEQ ID NO: 466541 - DNA, 25 bp, Mus musculus
gagaaagctgtgtatccgccatcat

SEQ ID NO: 466542 - DNA, 25 bp, Mus musculus
gagaaagcttctctagtgcagtgtg

SEQ ID NO: 466543 - DNA, 25 bp, Mus musculus
gagaaagcttctgtagtgcagtgtg

SEQ ID NO: 466544 - DNA, 25 bp, Mus musculus
gagaaagcttttctgctagcaccca

SEQ ID NO: 466545 - DNA, 25 bp, Mus musculus
gagaaagcttttgtgctagcaccca

SEQ ID NO: 466546 - DNA, 25 bp, Mus musculus
gagaaaggacaaacaccttccaatt

SEQ ID NO: 466547 - DNA, 25 bp, Mus musculus
gagaaaggacaatcaccttccaatt

SEQ ID NO: 466548 - DNA, 25 bp, Mus musculus
gagaaaggaccacacacccaaggat

SEQ ID NO: 466549 - DNA, 25 bp, Mus musculus
gagaaaggaccacccgcattctgca

SEQ ID NO: 466550 - DNA, 25 bp, Mus musculus
gagaaaggaccagacacccaaggat

SEQ ID NO: 466551 - DNA, 25 bp, Mus musculus
gagaaaggaccagccgcattctgca

SEQ ID NO: 466552 - DNA, 25 bp, Mus musculus
gagaaaggactgcatcttgcaacct

SEQ ID NO: 466553 - DNA, 25 bp, Mus musculus
gagaaaggactggatcttgcaacct

SEQ ID NO: 466554 - DNA, 25 bp, Mus musculus
gagaaaggccatatccttggaactg

SEQ ID NO: 466555 - DNA, 25 bp, Mus musculus
gagaaaggccatccggagtcctcag

SEQ ID NO: 466556 - DNA, 25 bp, Mus musculus
gagaaaggccatgcggagtcctcag

SEQ ID NO: 466557 - DNA, 25 bp, Mus musculus
gagaaaggccatttccttggaactg

SEQ ID NO: 466558 - DNA, 25 bp, Mus musculus
gagaaaggcgccagtggaactcttt

SEQ ID NO: 466559 - DNA, 25 bp, Mus musculus
gagaaaggcgcctgtggaactcttt

SEQ ID NO: 466560 - DNA, 25 bp, Mus musculus
gagaaaggctggctgctcctcttac

SEQ ID NO: 466561 - DNA, 25 bp, Mus musculus
gagaaaggctgggtgctcctcttac

SEQ ID NO: 466562 - DNA, 25 bp, Mus musculus
gagaaagggaccatccgccttctta

SEQ ID NO: 466563 - DNA, 25 bp, Mus musculus
gagaaagggaccttccgccttctta

SEQ ID NO: 466564 - DNA, 25 bp, Mus musculus
gagaaagggcaccttatcccttatt

SEQ ID NO: 466565 - DNA, 25 bp, Mus musculus
gagaaagggcacgttatcccttatt

SEQ ID NO: 466566 - DNA, 25 bp, Mus musculus
gagaaagggccaatcttcatttccc

SEQ ID NO: 466567 - DNA, 25 bp, Mus musculus
gagaaagggccattcttcatttccc

SEQ ID NO: 466568 - DNA, 25 bp, Mus musculus
gagaaaggtccacctgctggtccct

SEQ ID NO: 466569 - DNA, 25 bp, Mus musculus
gagaaaggtccagctgctggtccct

SEQ ID NO: 466570 - DNA, 25 bp, Mus musculus
gagaaaggtgcacgccaagtccatc

SEQ ID NO: 466571 - DNA, 25 bp, Mus musculus
gagaaaggtgcaggccaagtccatc

SEQ ID NO: 466572 - DNA, 25 bp, Mus musculus
gagaaaggttacacccaggacaata

SEQ ID NO: 466573 - DNA, 25 bp, Mus musculus
gagaaaggttactcccaggacaata

SEQ ID NO: 466574 - DNA, 25 bp, Mus musculus
gagaaagtaaacacaaagaggtcct

SEQ ID NO: 466575 - DNA, 25 bp, Mus musculus
gagaaagtaaactcaaagaggtcct

SEQ ID NO: 466576 - DNA, 25 bp, Mus musculus
gagaaagtacagaccctcactcagc

SEQ ID NO: 466577 - DNA, 25 bp, Mus musculus
gagaaagtacagtccctcactcagc

SEQ ID NO: 466578 - DNA, 25 bp, Mus musculus
gagaaagtccacacccaaagagctg

SEQ ID NO: 466579 - DNA, 25 bp, Mus musculus
gagaaagtccactcccaaagagctg

SEQ ID NO: 466580 - DNA, 25 bp, Mus musculus
gagaaagtccctatagcaggtctgt

SEQ ID NO: 466581 - DNA, 25 bp, Mus musculus
gagaaagtccctttagcaggtctgt

SEQ ID NO: 466582 - DNA, 25 bp, Mus musculus
gagaaagtccttcgctctgtatgaa

SEQ ID NO: 466583 - DNA, 25 bp, Mus musculus
gagaaagtccttggctctgtatgaa

SEQ ID NO: 466584 - DNA, 25 bp, Mus musculus
gagaaagtcttcatcgatgagtcta

SEQ ID NO: 466585 - DNA, 25 bp, Mus musculus
gagaaagtcttcttcgatgagtcta

SEQ ID NO: 466586 - DNA, 25 bp, Mus musculus
gagaaagtgatcatttttaccttat

SEQ ID NO: 466587 - DNA, 25 bp, Mus musculus
gagaaagtgatcttttttaccttat

SEQ ID NO: 466588 - DNA, 25 bp, Mus musculus
gagaaagtggagattctggcccctc

SEQ ID NO: 466589 - DNA, 25 bp, Mus musculus
gagaaagtggagtttctggcccctc

SEQ ID NO: 466590 - DNA, 25 bp, Mus musculus
gagaaagtggatcggctcccctgca

SEQ ID NO: 466591 - DNA, 25 bp, Mus musculus
gagaaagtggatgggctcccctgca

SEQ ID NO: 466592 - DNA, 25 bp, Mus musculus
gagaaagtgggcacagctctatcca

SEQ ID NO: 466593 - DNA, 25 bp, Mus musculus
gagaaagtgggctcagctctatcca

SEQ ID NO: 466594 - DNA, 25 bp, Mus musculus
gagaaagtgtctctgtcagcaagat

SEQ ID NO: 466595 - DNA, 25 bp, Mus musculus
gagaaagtgtctgtgtcagcaagat

SEQ ID NO: 466596 - DNA, 25 bp, Mus musculus
gagaaagttagtcctgtcagcatcc

SEQ ID NO: 466597 - DNA, 25 bp, Mus musculus
gagaaagttagtgctgtcagcatcc

SEQ ID NO: 466598 - DNA, 25 bp, Mus musculus
gagaaagttatgacagaccacaata

SEQ ID NO: 466599 - DNA, 25 bp, Mus musculus
gagaaagttatgtcagaccacaata

SEQ ID NO: 466600 - DNA, 25 bp, Mus musculus
gagaaagttcacagctcatgacaca

SEQ ID NO: 466601 - DNA, 25 bp, Mus musculus
gagaaagttcactgctcatgacaca

SEQ ID NO: 466602 - DNA, 25 bp, Mus musculus
gagaaagttgaaagctgtgctcagc

SEQ ID NO: 466603 - DNA, 25 bp, Mus musculus
gagaaagttgaatgctgtgctcagc

SEQ ID NO: 466604 - DNA, 25 bp, Mus musculus
gagaaagtttggacagccgcatcct

SEQ ID NO: 466605 - DNA, 25 bp, Mus musculus
gagaaagtttggtcagccgcatcct

SEQ ID NO: 466606 - DNA, 25 bp, Mus musculus
gagaaataaaatcctggtcacaaaa

SEQ ID NO: 466607 - DNA, 25 bp, Mus musculus
gagaaataaaatgctggtcacaaaa

SEQ ID NO: 466608 - DNA, 25 bp, Mus musculus
gagaaatacaccctgaaacctggga

SEQ ID NO: 466609 - DNA, 25 bp, Mus musculus
gagaaatacaccgtgaaacctggga

SEQ ID NO: 466610 - DNA, 25 bp, Mus musculus
gagaaataccctccaggttctgctc

SEQ ID NO: 466611 - DNA, 25 bp, Mus musculus
gagaaataccctgcaggttctgctc

SEQ ID NO: 466612 - DNA, 25 bp, Mus musculus
gagaaatacggcatcgagcccacac

SEQ ID NO: 466613 - DNA, 25 bp, Mus musculus
gagaaatacggcttcgagcccacac

SEQ ID NO: 466614 - DNA, 25 bp, Mus musculus
gagaaatactacctccttacctagt

SEQ ID NO: 466615 - DNA, 25 bp, Mus musculus
gagaaatactacgtccttacctagt

SEQ ID NO: 466616 - DNA, 25 bp, Mus musculus
gagaaatactatataaccacagaga

SEQ ID NO: 466617 - DNA, 25 bp, Mus musculus
gagaaatactatttaaccacagaga

SEQ ID NO: 466618 - DNA, 25 bp, Mus musculus
gagaaatagaccagtctctcccggt

SEQ ID NO: 466619 - DNA, 25 bp, Mus musculus
gagaaatagacctgtctctcccggt

SEQ ID NO: 466620 - DNA, 25 bp, Mus musculus
gagaaatatttcaccagcagccatg

SEQ ID NO: 466621 - DNA, 25 bp, Mus musculus
gagaaatatttctccagcagccatg

SEQ ID NO: 466622 - DNA, 25 bp, Mus musculus
gagaaatcacaaacgaccgtcttcc

SEQ ID NO: 466623 - DNA, 25 bp, Mus musculus
gagaaatcacaatcgaccgtcttcc

SEQ ID NO: 466624 - DNA, 25 bp, Mus musculus
gagaaatcagaccaggaccagagcc

SEQ ID NO: 466625 - DNA, 25 bp, Mus musculus
gagaaatcagacgaggaccagagcc

SEQ ID NO: 466626 - DNA, 25 bp, Mus musculus
gagaaatcaggaatcctccaggctc

SEQ ID NO: 466627 - DNA, 25 bp, Mus musculus
gagaaatcaggattcctccaggctc

SEQ ID NO: 466628 - DNA, 25 bp, Mus musculus
gagaaatcatctatgcttatgtaaa

SEQ ID NO: 466629 - DNA, 25 bp, Mus musculus
gagaaatcatctttgcttatgtaaa

SEQ ID NO: 466630 - DNA, 25 bp, Mus musculus
gagaaatccaaaacccattcctagg

SEQ ID NO: 466631 - DNA, 25 bp, Mus musculus
gagaaatccaaatcccattcctagg

SEQ ID NO: 466632 - DNA, 25 bp, Mus musculus
gagaaatccaagctcccaacgaaga

SEQ ID NO: 466633 - DNA, 25 bp, Mus musculus
gagaaatccaaggtcccaacgaaga

SEQ ID NO: 466634 - DNA, 25 bp, Mus musculus
gagaaatccaccaaagtcaacaaga

SEQ ID NO: 466635 - DNA, 25 bp, Mus musculus
gagaaatccacctaagtcaacaaga

SEQ ID NO: 466636 - DNA, 25 bp, Mus musculus
gagaaatccagcatgatccgcaagt

SEQ ID NO: 466637 - DNA, 25 bp, Mus musculus
gagaaatccagcttgatccgcaagt

SEQ ID NO: 466638 - DNA, 25 bp, Mus musculus
gagaaatcccaacctattctgtggt

SEQ ID NO: 466639 - DNA, 25 bp, Mus musculus
gagaaatcccaagctattctgtggt

SEQ ID NO: 466640 - DNA, 25 bp, Mus musculus
gagaaatcccatcagcccgtggttc

SEQ ID NO: 466641 - DNA, 25 bp, Mus musculus
gagaaatcccatgagcccgtggttc

SEQ ID NO: 466642 - DNA, 25 bp, Mus musculus
gagaaatccctcaagcgatgaccaa

SEQ ID NO: 466643 - DNA, 25 bp, Mus musculus
gagaaatccctctagcgatgaccaa

SEQ ID NO: 466644 - DNA, 25 bp, Mus musculus
gagaaatccggcactggccgctcca

SEQ ID NO: 466645 - DNA, 25 bp, Mus musculus
gagaaatccggctctggccgctcca

SEQ ID NO: 466646 - DNA, 25 bp, Mus musculus
gagaaatcctacatggtccctagat

SEQ ID NO: 466647 - DNA, 25 bp, Mus musculus
gagaaatcctacttggtccctagat

SEQ ID NO: 466648 - DNA, 25 bp, Mus musculus
gagaaatcctcaccatctaatcttt

SEQ ID NO: 466649 - DNA, 25 bp, Mus musculus
gagaaatcctcagcatctaatcttt

SEQ ID NO: 466650 - DNA, 25 bp, Mus musculus
gagaaatcctccaggacttaggttt

SEQ ID NO: 466651 - DNA, 25 bp, Mus musculus
gagaaatcctcctggacttaggttt

SEQ ID NO: 466652 - DNA, 25 bp, Mus musculus
gagaaatcctgaagctgccagtgtt

SEQ ID NO: 466653 - DNA, 25 bp, Mus musculus
gagaaatcctgatgctgccagtgtt

SEQ ID NO: 466654 - DNA, 25 bp, Mus musculus
gagaaatcctttcttacatttttga

SEQ ID NO: 466655 - DNA, 25 bp, Mus musculus
gagaaatcctttgttacatttttga

SEQ ID NO: 466656 - DNA, 25 bp, Mus musculus
gagaaatcgcacagctgtaaccttc

SEQ ID NO: 466657 - DNA, 25 bp, Mus musculus
gagaaatcgcactgctgtaaccttc

SEQ ID NO: 466658 - DNA, 25 bp, Mus musculus
gagaaatcgccacccctgaccttaa

SEQ ID NO: 466659 - DNA, 25 bp, Mus musculus
gagaaatcgccagccctgaccttaa

SEQ ID NO: 466660 - DNA, 25 bp, Mus musculus
gagaaatcggtcactgtcttagaag

SEQ ID NO: 466661 - DNA, 25 bp, Mus musculus
gagaaatcggtctctgtcttagaag

SEQ ID NO: 466662 - DNA, 25 bp, Mus musculus
gagaaatctaacactttgtccaagg

SEQ ID NO: 466663 - DNA, 25 bp, Mus musculus
gagaaatctaactctttgtccaagg

SEQ ID NO: 466664 - DNA, 25 bp, Mus musculus
gagaaatctatgacgacatcgctga

SEQ ID NO: 466665 - DNA, 25 bp, Mus musculus
gagaaatctatgtcgacatcgctga

SEQ ID NO: 466666 - DNA, 25 bp, Mus musculus
gagaaatctcaaaggtctggtaaga

SEQ ID NO: 466667 - DNA, 25 bp, Mus musculus
gagaaatctcaatggtctggtaaga

SEQ ID NO: 466668 - DNA, 25 bp, Mus musculus
gagaaatctctgaaccatatctatg

SEQ ID NO: 466669 - DNA, 25 bp, Mus musculus
gagaaatctctgtaccatatctatg

SEQ ID NO: 466670 - DNA, 25 bp, Mus musculus
gagaaatctcttaactgacactgcc

SEQ ID NO: 466671 - DNA, 25 bp, Mus musculus
gagaaatctctttactgacactgcc

SEQ ID NO: 466672 - DNA, 25 bp, Mus musculus
gagaaatctgctaagcttcctccac

SEQ ID NO: 466673 - DNA, 25 bp, Mus musculus
gagaaatctgcttagcttcctccac

SEQ ID NO: 466674 - DNA, 25 bp, Mus musculus
gagaaatctggcatccatcatcttc

SEQ ID NO: 466675 - DNA, 25 bp, Mus musculus
gagaaatctggcttccatcatcttc

SEQ ID NO: 466676 - DNA, 25 bp, Mus musculus
gagaaatctggtcttcctcatattc

SEQ ID NO: 466677 - DNA, 25 bp, Mus musculus
gagaaatctggtgttcctcatattc

SEQ ID NO: 466678 - DNA, 25 bp, Mus musculus
gagaaatcttataaatccagttgta

SEQ ID NO: 466679 - DNA, 25 bp, Mus musculus
gagaaatcttattaatccagttgta

SEQ ID NO: 466680 - DNA, 25 bp, Mus musculus
gagaaatcttccacgaccaggacaa

SEQ ID NO: 466681 - DNA, 25 bp, Mus musculus
gagaaatcttcctcgaccaggacaa

SEQ ID NO: 466682 - DNA, 25 bp, Mus musculus
gagaaatcttctacttagcccaatc

SEQ ID NO: 466683 - DNA, 25 bp, Mus musculus
gagaaatcttcttcttagcccaatc

SEQ ID NO: 466684 - DNA, 25 bp, Mus musculus
gagaaatcttgacaactctacagac

SEQ ID NO: 466685 - DNA, 25 bp, Mus musculus
gagaaatcttgagaactctacagac

SEQ ID NO: 466686 - DNA, 25 bp, Mus musculus
gagaaatgcactatagggtactact

SEQ ID NO: 466687 - DNA, 25 bp, Mus musculus
gagaaatgcactttagggtactact

SEQ ID NO: 466688 - DNA, 25 bp, Mus musculus
gagaaatgctctcacttttgccaag

SEQ ID NO: 466689 - DNA, 25 bp, Mus musculus
gagaaatgctctgacttttgccaag

SEQ ID NO: 466690 - DNA, 25 bp, Mus musculus
gagaaatgcttacttcaatcatatt

SEQ ID NO: 466691 - DNA, 25 bp, Mus musculus
gagaaatgcttagttcaatcatatt

SEQ ID NO: 466692 - DNA, 25 bp, Mus musculus
gagaaatggcaaaaccttcatggta

SEQ ID NO: 466693 - DNA, 25 bp, Mus musculus
gagaaatggcaacttctatccagaa

SEQ ID NO: 466694 - DNA, 25 bp, Mus musculus
gagaaatggcaagttctatccagaa

SEQ ID NO: 466695 - DNA, 25 bp, Mus musculus
gagaaatggcaataccttcatggta

SEQ ID NO: 466696 - DNA, 25 bp, Mus musculus
gagaaatggccgcacgctgttgcac

SEQ ID NO: 466697 - DNA, 25 bp, Mus musculus
gagaaatggccggacgctgttgcac

SEQ ID NO: 466698 - DNA, 25 bp, Mus musculus
gagaaatggctcctgatttgcctga

SEQ ID NO: 466699 - DNA, 25 bp, Mus musculus
gagaaatggctcgtgatttgcctga

SEQ ID NO: 466700 - DNA, 25 bp, Mus musculus
gagaaatgggatcaacgccttgtga

SEQ ID NO: 466701 - DNA, 25 bp, Mus musculus
gagaaatgggatgaacgccttgtga

SEQ ID NO: 466702 - DNA, 25 bp, Mus musculus
gagaaatgggtcacttctgcgtctt

SEQ ID NO: 466703 - DNA, 25 bp, Mus musculus
gagaaatgggtctcttctgcgtctt

SEQ ID NO: 466704 - DNA, 25 bp, Mus musculus
gagaaatgtctcaaggcttccatct

SEQ ID NO: 466705 - DNA, 25 bp, Mus musculus
gagaaatgtctctaggcttccatct

SEQ ID NO: 466706 - DNA, 25 bp, Mus musculus
gagaaatgtcttcgccgtgctgtaa

SEQ ID NO: 466707 - DNA, 25 bp, Mus musculus
gagaaatgtcttggccgtgctgtaa

SEQ ID NO: 466708 - DNA, 25 bp, Mus musculus
gagaaatgtggacatcagacgcatg

SEQ ID NO: 466709 - DNA, 25 bp, Mus musculus
gagaaatgtggagatcagacgcatg

SEQ ID NO: 466710 - DNA, 25 bp, Mus musculus
gagaaatgtgtaagaccttacaagc

SEQ ID NO: 466711 - DNA, 25 bp, Mus musculus
gagaaatgtgtatgaccttacaagc

SEQ ID NO: 466712 - DNA, 25 bp, Mus musculus
gagaaatgtttgattgtgcatccaa

SEQ ID NO: 466713 - DNA, 25 bp, Mus musculus
gagaaatgtttgtttgtgcatccaa

SEQ ID NO: 466714 - DNA, 25 bp, Mus musculus
gagaaattaaacaccctcattgaaa

SEQ ID NO: 466715 - DNA, 25 bp, Mus musculus
gagaaattaaactccctcattgaaa

SEQ ID NO: 466716 - DNA, 25 bp, Mus musculus
gagaaattaccaagttattcctagg

SEQ ID NO: 466717 - DNA, 25 bp, Mus musculus
gagaaattaccatgttattcctagg

SEQ ID NO: 466718 - DNA, 25 bp, Mus musculus
gagaaattaccgaaacagctctttt

SEQ ID NO: 466719 - DNA, 25 bp, Mus musculus
gagaaattaccgtaacagctctttt

SEQ ID NO: 466720 - DNA, 25 bp, Mus musculus
gagaaattagaccttccatggtcag

SEQ ID NO: 466721 - DNA, 25 bp, Mus musculus
gagaaattagacgttccatggtcag

SEQ ID NO: 466722 - DNA, 25 bp, Mus musculus
gagaaattagctacaccactttggt

SEQ ID NO: 466723 - DNA, 25 bp, Mus musculus
gagaaattagctccatcagattggc

SEQ ID NO: 466724 - DNA, 25 bp, Mus musculus
gagaaattagctgcatcagattggc

SEQ ID NO: 466725 - DNA, 25 bp, Mus musculus
gagaaattagcttcaccactttggt

SEQ ID NO: 466726 - DNA, 25 bp, Mus musculus
gagaaattagttccctgccttttca

SEQ ID NO: 466727 - DNA, 25 bp, Mus musculus
gagaaattagttgcctgccttttca

SEQ ID NO: 466728 - DNA, 25 bp, Mus musculus
gagaaattcatcagccagctcctga

SEQ ID NO: 466729 - DNA, 25 bp, Mus musculus
gagaaattcatctgccagctcctga

SEQ ID NO: 466730 - DNA, 25 bp, Mus musculus
gagaaattccaacctgtgttgatta

SEQ ID NO: 466731 - DNA, 25 bp, Mus musculus
gagaaattccaagctgtgttgatta

SEQ ID NO: 466732 - DNA, 25 bp, Mus musculus
gagaaattccataccagactgaggc

SEQ ID NO: 466733 - DNA, 25 bp, Mus musculus
gagaaattccattccagactgaggc

SEQ ID NO: 466734 - DNA, 25 bp, Mus musculus
gagaaattccctaatattaactgct

SEQ ID NO: 466735 - DNA, 25 bp, Mus musculus
gagaaattcccttatattaactgct

SEQ ID NO: 466736 - DNA, 25 bp, Mus musculus
gagaaattcctgaggtctcttccca

SEQ ID NO: 466737 - DNA, 25 bp, Mus musculus
gagaaattcctgtggtctcttccca

SEQ ID NO: 466738 - DNA, 25 bp, Mus musculus
gagaaattccttactcgtggagccc

SEQ ID NO: 466739 - DNA, 25 bp, Mus musculus
gagaaattcctttctcgtggagccc

SEQ ID NO: 466740 - DNA, 25 bp, Mus musculus
gagaaattcgtcctctggcttttga

SEQ ID NO: 466741 - DNA, 25 bp, Mus musculus
gagaaattcgtcgtctggcttttga

SEQ ID NO: 466742 - DNA, 25 bp, Mus musculus
gagaaattctcaaatggcagcatgc

SEQ ID NO: 466743 - DNA, 25 bp, Mus musculus
gagaaattctcatatggcagcatgc

SEQ ID NO: 466744 - DNA, 25 bp, Mus musculus
gagaaattctgtcagtgggagcctt

SEQ ID NO: 466745 - DNA, 25 bp, Mus musculus
gagaaattctgtgagtgggagcctt

SEQ ID NO: 466746 - DNA, 25 bp, Mus musculus
gagaaattcttcagcgacttcagta

SEQ ID NO: 466747 - DNA, 25 bp, Mus musculus
gagaaattcttctgcgacttcagta

SEQ ID NO: 466748 - DNA, 25 bp, Mus musculus
gagaaattgagtaaataaaccttga

SEQ ID NO: 466749 - DNA, 25 bp, Mus musculus
gagaaattgagttaataaaccttga

SEQ ID NO: 466750 - DNA, 25 bp, Mus musculus
gagaaattggtaaccatttaatgtt

SEQ ID NO: 466751 - DNA, 25 bp, Mus musculus
gagaaattggtaacccagccacttt

SEQ ID NO: 466752 - DNA, 25 bp, Mus musculus
gagaaattggtatccatttaatgtt

SEQ ID NO: 466753 - DNA, 25 bp, Mus musculus
gagaaattggtatcccagccacttt

SEQ ID NO: 466754 - DNA, 25 bp, Mus musculus
gagaaattggtgaatcccgacagca

SEQ ID NO: 466755 - DNA, 25 bp, Mus musculus
gagaaattggtgtatcccgacagca

SEQ ID NO: 466756 - DNA, 25 bp, Mus musculus
gagaaattgtctacgcatccttatg

SEQ ID NO: 466757 - DNA, 25 bp, Mus musculus
gagaaattgtctatttcccacatat

SEQ ID NO: 466758 - DNA, 25 bp, Mus musculus
gagaaattgtcttcgcatccttatg

SEQ ID NO: 466759 - DNA, 25 bp, Mus musculus
gagaaattgtctttttcccacatat

SEQ ID NO: 466760 - DNA, 25 bp, Mus musculus
gagaaattgtgaaccaccctgtgtc

SEQ ID NO: 466761 - DNA, 25 bp, Mus musculus
gagaaattgtgatccaccctgtgtc

SEQ ID NO: 466762 - DNA, 25 bp, Mus musculus
gagaaattgtgcattgccctctaaa

SEQ ID NO: 466763 - DNA, 25 bp, Mus musculus
gagaaattgtgctttgccctctaaa

SEQ ID NO: 466764 - DNA, 25 bp, Mus musculus
gagaaatttacaattagtcatttgt

SEQ ID NO: 466765 - DNA, 25 bp, Mus musculus
gagaaatttacacctctaatcttgg

SEQ ID NO: 466766 - DNA, 25 bp, Mus musculus
gagaaatttacagctctaatcttgg

SEQ ID NO: 466767 - DNA, 25 bp, Mus musculus
gagaaatttacatttagtcatttgt

SEQ ID NO: 466768 - DNA, 25 bp, Mus musculus
gagaaatttggacttcctccaaaat

SEQ ID NO: 466769 - DNA, 25 bp, Mus musculus
gagaaatttggagttcctccaaaat

SEQ ID NO: 466770 - DNA, 25 bp, Mus musculus
gagaaattttcaaagcaggtagttt

SEQ ID NO: 466771 - DNA, 25 bp, Mus musculus
gagaaattttcatagcaggtagttt

SEQ ID NO: 466772 - DNA, 25 bp, Mus musculus
gagaaatttttacctgctccgtggt

SEQ ID NO: 466773 - DNA, 25 bp, Mus musculus
gagaaatttttagctgctccgtggt

SEQ ID NO: 466774 - DNA, 25 bp, Mus musculus
gagaacaaactcagggtgcttttga

SEQ ID NO: 466775 - DNA, 25 bp, Mus musculus
gagaacaaactctgggtgcttttga

SEQ ID NO: 466776 - DNA, 25 bp, Mus musculus
gagaacaacaatagccgcccaaact

SEQ ID NO: 466777 - DNA, 25 bp, Mus musculus
gagaacaacaattgccgcccaaact

SEQ ID NO: 466778 - DNA, 25 bp, Mus musculus
gagaacaaccacaatccagataaac

SEQ ID NO: 466779 - DNA, 25 bp, Mus musculus
gagaacaaccactatccagataaac

SEQ ID NO: 466780 - DNA, 25 bp, Mus musculus
gagaacaaccagcagctccaagaag

SEQ ID NO: 466781 - DNA, 25 bp, Mus musculus
gagaacaaccaggagctccaagaag

SEQ ID NO: 466782 - DNA, 25 bp, Mus musculus
gagaacaaccatcagcaattcctct

SEQ ID NO: 466783 - DNA, 25 bp, Mus musculus
gagaacaaccatgagcaattcctct

SEQ ID NO: 466784 - DNA, 25 bp, Mus musculus
gagaacaaccctcgctaggataaca

SEQ ID NO: 466785 - DNA, 25 bp, Mus musculus
gagaacaaccctggctaggataaca

SEQ ID NO: 466786 - DNA, 25 bp, Mus musculus
gagaacaacctgagctactggaaca

SEQ ID NO: 466787 - DNA, 25 bp, Mus musculus
gagaacaacctgtgctactggaaca

SEQ ID NO: 466788 - DNA, 25 bp, Mus musculus
gagaacaactctacacacaaaaggg

SEQ ID NO: 466789 - DNA, 25 bp, Mus musculus
gagaacaactcttcacacaaaaggg

SEQ ID NO: 466790 - DNA, 25 bp, Mus musculus
gagaacaactgcatggctcccatga

SEQ ID NO: 466791 - DNA, 25 bp, Mus musculus
gagaacaactgcttggctcccatga

SEQ ID NO: 466792 - DNA, 25 bp, Mus musculus
gagaacaactttatctcagacagat

SEQ ID NO: 466793 - DNA, 25 bp, Mus musculus
gagaacaactttttctcagacagat

SEQ ID NO: 466794 - DNA, 25 bp, Mus musculus
gagaacaagacacagcagagcccct

SEQ ID NO: 466795 - DNA, 25 bp, Mus musculus
gagaacaagacagagcagagcccct

SEQ ID NO: 466796 - DNA, 25 bp, Mus musculus
gagaacaagattcactgcacacaga

SEQ ID NO: 466797 - DNA, 25 bp, Mus musculus
gagaacaagattctggccagctttc

SEQ ID NO: 466798 - DNA, 25 bp, Mus musculus
gagaacaagattgactgcacacaga

SEQ ID NO: 466799 - DNA, 25 bp, Mus musculus
gagaacaagattgtggccagctttc

SEQ ID NO: 466800 - DNA, 25 bp, Mus musculus
gagaacaaggagaaacaccctgccc

SEQ ID NO: 466801 - DNA, 25 bp, Mus musculus
gagaacaaggagtaacaccctgccc

SEQ ID NO: 466802 - DNA, 25 bp, Mus musculus
gagaacaagtagctttcgcgtattt

SEQ ID NO: 466803 - DNA, 25 bp, Mus musculus
gagaacaagtaggtttcgcgtattt

SEQ ID NO: 466804 - DNA, 25 bp, Mus musculus
gagaacaatacccacagcatctgaa

SEQ ID NO: 466805 - DNA, 25 bp, Mus musculus
gagaacaataccgacagcatctgaa

SEQ ID NO: 466806 - DNA, 25 bp, Mus musculus
gagaacaatcacagctaagggacat

SEQ ID NO: 466807 - DNA, 25 bp, Mus musculus
gagaacaatcactgctaagggacat

SEQ ID NO: 466808 - DNA, 25 bp, Mus musculus
gagaacaatctcaatccatgactga

SEQ ID NO: 466809 - DNA, 25 bp, Mus musculus
gagaacaatctctatccatgactga

SEQ ID NO: 466810 - DNA, 25 bp, Mus musculus
gagaacaatgacatctgggctctct

SEQ ID NO: 466811 - DNA, 25 bp, Mus musculus
gagaacaatgacttctgggctctct

SEQ ID NO: 466812 - DNA, 25 bp, Mus musculus
gagaacaatgtcaattatccttcga

SEQ ID NO: 466813 - DNA, 25 bp, Mus musculus
gagaacaatgtctattatccttcga

SEQ ID NO: 466814 - DNA, 25 bp, Mus musculus
gagaacacaattccacactgtaaac

SEQ ID NO: 466815 - DNA, 25 bp, Mus musculus
gagaacacaattgcacactgtaaac

SEQ ID NO: 466816 - DNA, 25 bp, Mus musculus
gagaacacacagcaggctcctactc

SEQ ID NO: 466817 - DNA, 25 bp, Mus musculus
gagaacacacaggaggctcctactc

SEQ ID NO: 466818 - DNA, 25 bp, Mus musculus
gagaacacagaacgacagtcacact

SEQ ID NO: 466819 - DNA, 25 bp, Mus musculus
gagaacacagaaggacagtcacact

SEQ ID NO: 466820 - DNA, 25 bp, Mus musculus
gagaacacagggatccttctgagga

SEQ ID NO: 466821 - DNA, 25 bp, Mus musculus
gagaacacagggttccttctgagga

SEQ ID NO: 466822 - DNA, 25 bp, Mus musculus
gagaacacaggtatatttcccatga

SEQ ID NO: 466823 - DNA, 25 bp, Mus musculus
gagaacacaggtttatttcccatga

SEQ ID NO: 466824 - DNA, 25 bp, Mus musculus
gagaacacatcacacttccgtgctg

SEQ ID NO: 466825 - DNA, 25 bp, Mus musculus
gagaacacatcagacttccgtgctg

SEQ ID NO: 466826 - DNA, 25 bp, Mus musculus
gagaacacatggacctcaccacctg

SEQ ID NO: 466827 - DNA, 25 bp, Mus musculus
gagaacacatggtcctcaccacctg

SEQ ID NO: 466828 - DNA, 25 bp, Mus musculus
gagaacacatgtacacagcccacag

SEQ ID NO: 466829 - DNA, 25 bp, Mus musculus
gagaacacatgttcacagcccacag

SEQ ID NO: 466830 - DNA, 25 bp, Mus musculus
gagaacacattccagcagacctagg

SEQ ID NO: 466831 - DNA, 25 bp, Mus musculus
gagaacacattcgagcagacctagg

SEQ ID NO: 466832 - DNA, 25 bp, Mus musculus
gagaacaccaccattaacaatactg

SEQ ID NO: 466833 - DNA, 25 bp, Mus musculus
gagaacaccacctttaacaatactg

SEQ ID NO: 466834 - DNA, 25 bp, Mus musculus
gagaacaccagaagggccggcccac

SEQ ID NO: 466835 - DNA, 25 bp, Mus musculus
gagaacaccagatgggccggcccac

SEQ ID NO: 466836 - DNA, 25 bp, Mus musculus
gagaacacccagatctagccagata

SEQ ID NO: 466837 - DNA, 25 bp, Mus musculus
gagaacacccagattgacgcggcca

SEQ ID NO: 466838 - DNA, 25 bp, Mus musculus
gagaacacccagattgcagaacccg

SEQ ID NO: 466839 - DNA, 25 bp, Mus musculus
gagaacacccagttctagccagata

SEQ ID NO: 466840 - DNA, 25 bp, Mus musculus
gagaacacccagtttgacgcggcca

SEQ ID NO: 466841 - DNA, 25 bp, Mus musculus
gagaacacccagtttgcagaacccg

SEQ ID NO: 466842 - DNA, 25 bp, Mus musculus
gagaacaccgaaaccacccagtagt

SEQ ID NO: 466843 - DNA, 25 bp, Mus musculus
gagaacaccgaatccacccagtagt

SEQ ID NO: 466844 - DNA, 25 bp, Mus musculus
gagaacaccgagatgtagctagaac

SEQ ID NO: 466845 - DNA, 25 bp, Mus musculus
gagaacaccgagttgtagctagaac

SEQ ID NO: 466846 - DNA, 25 bp, Mus musculus
gagaacacctacaccagctatttgg

SEQ ID NO: 466847 - DNA, 25 bp, Mus musculus
gagaacacctacctcttgttggaaa

SEQ ID NO: 466848 - DNA, 25 bp, Mus musculus
gagaacacctacgtcttgttggaaa

SEQ ID NO: 466849 - DNA, 25 bp, Mus musculus
gagaacacctactccagctatttgg

SEQ ID NO: 466850 - DNA, 25 bp, Mus musculus
gagaacacctgactcagaacaccgg

SEQ ID NO: 466851 - DNA, 25 bp, Mus musculus
gagaacacctgacttttctaacaga

SEQ ID NO: 466852 - DNA, 25 bp, Mus musculus
gagaacacctgagtcagaacaccgg

SEQ ID NO: 466853 - DNA, 25 bp, Mus musculus
gagaacacctgagttttctaacaga

SEQ ID NO: 466854 - DNA, 25 bp, Mus musculus
gagaacacggcgagcacagtcctgt

SEQ ID NO: 466855 - DNA, 25 bp, Mus musculus
gagaacacggcgtgcacagtcctgt

SEQ ID NO: 466856 - DNA, 25 bp, Mus musculus
gagaacacggtacacaggcttcctg

SEQ ID NO: 466857 - DNA, 25 bp, Mus musculus
gagaacacggtagacaggcttcctg

SEQ ID NO: 466858 - DNA, 25 bp, Mus musculus
gagaacacgtgcactcagtgtgtga

SEQ ID NO: 466859 - DNA, 25 bp, Mus musculus
gagaacacgtgctctcagtgtgtga

SEQ ID NO: 466860 - DNA, 25 bp, Mus musculus
gagaacactaacaaatgccgttttt

SEQ ID NO: 466861 - DNA, 25 bp, Mus musculus
gagaacactaactaatgccgttttt

SEQ ID NO: 466862 - DNA, 25 bp, Mus musculus
gagaacactagaatgcaatccacag

SEQ ID NO: 466863 - DNA, 25 bp, Mus musculus
gagaacactagattgcaatccacag

SEQ ID NO: 466864 - DNA, 25 bp, Mus musculus
gagaacactatgaactgcacctgct

SEQ ID NO: 466865 - DNA, 25 bp, Mus musculus
gagaacactatgtactgcacctgct

SEQ ID NO: 466866 - DNA, 25 bp, Mus musculus
gagaacactccaagtgctcgagaat

SEQ ID NO: 466867 - DNA, 25 bp, Mus musculus
gagaacactccatgtgctcgagaat

SEQ ID NO: 466868 - DNA, 25 bp, Mus musculus
gagaacactctgaaccatgtgcaag

SEQ ID NO: 466869 - DNA, 25 bp, Mus musculus
gagaacactctgtaccatgtgcaag

SEQ ID NO: 466870 - DNA, 25 bp, Mus musculus
gagaacactgatctagattcttaat

SEQ ID NO: 466871 - DNA, 25 bp, Mus musculus
gagaacactgatgtagattcttaat

SEQ ID NO: 466872 - DNA, 25 bp, Mus musculus
gagaacactgctaaactaatgggat

SEQ ID NO: 466873 - DNA, 25 bp, Mus musculus
gagaacactgcttaactaatgggat

SEQ ID NO: 466874 - DNA, 25 bp, Mus musculus
gagaacactggtcaccgatggcctt

SEQ ID NO: 466875 - DNA, 25 bp, Mus musculus
gagaacactggtgaccgatggcctt

SEQ ID NO: 466876 - DNA, 25 bp, Mus musculus
gagaacactgtgaacgaatcctgcc

SEQ ID NO: 466877 - DNA, 25 bp, Mus musculus
gagaacactgtgtacgaatcctgcc

SEQ ID NO: 466878 - DNA, 25 bp, Mus musculus
gagaacacttccctgatacattgca

SEQ ID NO: 466879 - DNA, 25 bp, Mus musculus
gagaacacttccgtgatacattgca

SEQ ID NO: 466880 - DNA, 25 bp, Mus musculus
gagaacacttgtacgttttggcatt

SEQ ID NO: 466881 - DNA, 25 bp, Mus musculus
gagaacacttgttcgttttggcatt

SEQ ID NO: 466882 - DNA, 25 bp, Mus musculus
gagaacagaaccactttgagagcct

SEQ ID NO: 466883 - DNA, 25 bp, Mus musculus
gagaacagaacctctttgagagcct

SEQ ID NO: 466884 - DNA, 25 bp, Mus musculus
gagaacagacacacctcaagtagaa

SEQ ID NO: 466885 - DNA, 25 bp, Mus musculus
gagaacagacaccaggtttcatgta

SEQ ID NO: 466886 - DNA, 25 bp, Mus musculus
gagaacagacacgaggtttcatgta

SEQ ID NO: 466887 - DNA, 25 bp, Mus musculus
gagaacagacactcctcaagtagaa

SEQ ID NO: 466888 - DNA, 25 bp, Mus musculus
gagaacagacatcacctgggttcag

SEQ ID NO: 466889 - DNA, 25 bp, Mus musculus
gagaacagacatgacctgggttcag

SEQ ID NO: 466890 - DNA, 25 bp, Mus musculus
gagaacagacctcagcaaagccttc

SEQ ID NO: 466891 - DNA, 25 bp, Mus musculus
gagaacagacctgagcaaagccttc

SEQ ID NO: 466892 - DNA, 25 bp, Mus musculus
gagaacagactcctattctaatctg

SEQ ID NO: 466893 - DNA, 25 bp, Mus musculus
gagaacagactcgtattctaatctg

SEQ ID NO: 466894 - DNA, 25 bp, Mus musculus
gagaacagagacagttaccccaggg

SEQ ID NO: 466895 - DNA, 25 bp, Mus musculus
gagaacagagactgttaccccaggg

SEQ ID NO: 466896 - DNA, 25 bp, Mus musculus
gagaacagagagatggatgatcctt

SEQ ID NO: 466897 - DNA, 25 bp, Mus musculus
gagaacagagagttggatgatcctt

SEQ ID NO: 466898 - DNA, 25 bp, Mus musculus
gagaacagattcctgccttctgcac

SEQ ID NO: 466899 - DNA, 25 bp, Mus musculus
gagaacagattcgtgccttctgcac

SEQ ID NO: 466900 - DNA, 25 bp, Mus musculus
gagaacagcataacattgtggacat

SEQ ID NO: 466901 - DNA, 25 bp, Mus musculus
gagaacagcatatcattgtggacat

SEQ ID NO: 466902 - DNA, 25 bp, Mus musculus
gagaacagccccagaaatagccctg

SEQ ID NO: 466903 - DNA, 25 bp, Mus musculus
gagaacagcccctgaaatagccctg

SEQ ID NO: 466904 - DNA, 25 bp, Mus musculus
gagaacagcgagagctccccaaaga

SEQ ID NO: 466905 - DNA, 25 bp, Mus musculus
gagaacagcgagtgctccccaaaga

SEQ ID NO: 466906 - DNA, 25 bp, Mus musculus
gagaacagcgctctgctaagtgcac

SEQ ID NO: 466907 - DNA, 25 bp, Mus musculus
gagaacagcgctgtgctaagtgcac

SEQ ID NO: 466908 - DNA, 25 bp, Mus musculus
gagaacagcgtgagcagcgacacaa

SEQ ID NO: 466909 - DNA, 25 bp, Mus musculus
gagaacagcgtgtgcagcgacacaa

SEQ ID NO: 466910 - DNA, 25 bp, Mus musculus
gagaacagctttctccgagtcacgg

SEQ ID NO: 466911 - DNA, 25 bp, Mus musculus
gagaacagctttgtccgagtcacgg

SEQ ID NO: 466912 - DNA, 25 bp, Mus musculus
gagaacaggctaatgtccttccagg

SEQ ID NO: 466913 - DNA, 25 bp, Mus musculus
gagaacaggctattgtccttccagg

SEQ ID NO: 466914 - DNA, 25 bp, Mus musculus
gagaacaggctcaagtgtgtactca

SEQ ID NO: 466915 - DNA, 25 bp, Mus musculus
gagaacaggctctagtgtgtactca

SEQ ID NO: 466916 - DNA, 25 bp, Mus musculus
gagaacaggctgattgagtcctcaa

SEQ ID NO: 466917 - DNA, 25 bp, Mus musculus
gagaacaggctgtttgagtcctcaa

SEQ ID NO: 466918 - DNA, 25 bp, Mus musculus
gagaacagggagatccaaccaccat

SEQ ID NO: 466919 - DNA, 25 bp, Mus musculus
gagaacagggagttccaaccaccat

SEQ ID NO: 466920 - DNA, 25 bp, Mus musculus
gagaacagggctcggacctagctct

SEQ ID NO: 466921 - DNA, 25 bp, Mus musculus
gagaacagggctgggacctagctct

SEQ ID NO: 466922 - DNA, 25 bp, Mus musculus
gagaacaggtcccagccagagcact

SEQ ID NO: 466923 - DNA, 25 bp, Mus musculus
gagaacaggtccgagccagagcact

SEQ ID NO: 466924 - DNA, 25 bp, Mus musculus
gagaacaggtctaggtccaaagaga

SEQ ID NO: 466925 - DNA, 25 bp, Mus musculus
gagaacaggtcttggtccaaagaga

SEQ ID NO: 466926 - DNA, 25 bp, Mus musculus
gagaacagtaagattagaacaagct

SEQ ID NO: 466927 - DNA, 25 bp, Mus musculus
gagaacagtaagtttagaacaagct

SEQ ID NO: 466928 - DNA, 25 bp, Mus musculus
gagaacagtcatcgtcctcctcaat

SEQ ID NO: 466929 - DNA, 25 bp, Mus musculus
gagaacagtcatggtcctcctcaat

SEQ ID NO: 466930 - DNA, 25 bp, Mus musculus
gagaacagtgaactaactctactct

SEQ ID NO: 466931 - DNA, 25 bp, Mus musculus
gagaacagtgaagtaactctactct

SEQ ID NO: 466932 - DNA, 25 bp, Mus musculus
gagaacagtgatatttccccagaaa

SEQ ID NO: 466933 - DNA, 25 bp, Mus musculus
gagaacagtgatttttccccagaaa

SEQ ID NO: 466934 - DNA, 25 bp, Mus musculus
gagaacagtgttaaccttgatcttt

SEQ ID NO: 466935 - DNA, 25 bp, Mus musculus
gagaacagtgtttaccttgatcttt

SEQ ID NO: 466936 - DNA, 25 bp, Mus musculus
gagaacagttcaccggtgtttagtt

SEQ ID NO: 466937 - DNA, 25 bp, Mus musculus
gagaacagttcagcggtgtttagtt

SEQ ID NO: 466938 - DNA, 25 bp, Mus musculus
gagaacagttccacgggtcttcata

SEQ ID NO: 466939 - DNA, 25 bp, Mus musculus
gagaacagttcctcgggtcttcata

SEQ ID NO: 466940 - DNA, 25 bp, Mus musculus
gagaacagttttctgcagcctgaga

SEQ ID NO: 466941 - DNA, 25 bp, Mus musculus
gagaacagttttgtgcagcctgaga

SEQ ID NO: 466942 - DNA, 25 bp, Mus musculus
gagaacatagacagcagctgacaat

SEQ ID NO: 466943 - DNA, 25 bp, Mus musculus
gagaacatagaccagcttgcaggat

SEQ ID NO: 466944 - DNA, 25 bp, Mus musculus
gagaacatagacgagcttgcaggat

SEQ ID NO: 466945 - DNA, 25 bp, Mus musculus
gagaacatagactgcagctgacaat

SEQ ID NO: 466946 - DNA, 25 bp, Mus musculus
gagaacatagctctaagcttacctt

SEQ ID NO: 466947 - DNA, 25 bp, Mus musculus
gagaacatagctgtaagcttacctt

SEQ ID NO: 466948 - DNA, 25 bp, Mus musculus
gagaacatcaaaccttttaccacct

SEQ ID NO: 466949 - DNA, 25 bp, Mus musculus
gagaacatcaaagcttttaccacct

SEQ ID NO: 466950 - DNA, 25 bp, Mus musculus
gagaacatcagaacagcccgagagc

SEQ ID NO: 466951 - DNA, 25 bp, Mus musculus
gagaacatcagatcagcccgagagc

SEQ ID NO: 466952 - DNA, 25 bp, Mus musculus
gagaacatcaggcaggcagcatctt

SEQ ID NO: 466953 - DNA, 25 bp, Mus musculus
gagaacatcagggaggcagcatctt

SEQ ID NO: 466954 - DNA, 25 bp, Mus musculus
gagaacatcatcagcactttgtttt

SEQ ID NO: 466955 - DNA, 25 bp, Mus musculus
gagaacatcatctgcactttgtttt

SEQ ID NO: 466956 - DNA, 25 bp, Mus musculus
gagaacatcattccctcagcagcgt

SEQ ID NO: 466957 - DNA, 25 bp, Mus musculus
gagaacatcattgcctcagcagcgt

SEQ ID NO: 466958 - DNA, 25 bp, Mus musculus
gagaacatccctccaaatatatttc

SEQ ID NO: 466959 - DNA, 25 bp, Mus musculus
gagaacatccctgcaaatatatttc

SEQ ID NO: 466960 - DNA, 25 bp, Mus musculus
gagaacatccgcatcaatggctgtg

SEQ ID NO: 466961 - DNA, 25 bp, Mus musculus
gagaacatccgccacaaatttggga

SEQ ID NO: 466962 - DNA, 25 bp, Mus musculus
gagaacatccgcgacaaatttggga

SEQ ID NO: 466963 - DNA, 25 bp, Mus musculus
gagaacatccgcttcaatggctgtg

SEQ ID NO: 466964 - DNA, 25 bp, Mus musculus
gagaacatctagacagtagactata

SEQ ID NO: 466965 - DNA, 25 bp, Mus musculus
gagaacatctagaggcctagctctt

SEQ ID NO: 466966 - DNA, 25 bp, Mus musculus
gagaacatctagtcagtagactata

SEQ ID NO: 466967 - DNA, 25 bp, Mus musculus
gagaacatctagtggcctagctctt

SEQ ID NO: 466968 - DNA, 25 bp, Mus musculus
gagaacatctcactggtaggcctct

SEQ ID NO: 466969 - DNA, 25 bp, Mus musculus
gagaacatctcagtggtaggcctct

SEQ ID NO: 466970 - DNA, 25 bp, Mus musculus
gagaacatctttcatccagcgtgtg

SEQ ID NO: 466971 - DNA, 25 bp, Mus musculus
gagaacatctttgatccagcgtgtg

SEQ ID NO: 466972 - DNA, 25 bp, Mus musculus
gagaacatgacacctgtgactcaaa

SEQ ID NO: 466973 - DNA, 25 bp, Mus musculus
gagaacatgacagctgtgactcaaa

SEQ ID NO: 466974 - DNA, 25 bp, Mus musculus
gagaacatgaccatgatgcagctat

SEQ ID NO: 466975 - DNA, 25 bp, Mus musculus
gagaacatgaccttgatgcagctat

SEQ ID NO: 466976 - DNA, 25 bp, Mus musculus
gagaacatgactccgtcagattggc

SEQ ID NO: 466977 - DNA, 25 bp, Mus musculus
gagaacatgactgcgtcagattggc

SEQ ID NO: 466978 - DNA, 25 bp, Mus musculus
gagaacatgatgaaggcccgacaag

SEQ ID NO: 466979 - DNA, 25 bp, Mus musculus
gagaacatgatgtaggcccgacaag

SEQ ID NO: 466980 - DNA, 25 bp, Mus musculus
gagaacatgcaaatgctcgactcct

SEQ ID NO: 466981 - DNA, 25 bp, Mus musculus
gagaacatgcaattgctcgactcct

SEQ ID NO: 466982 - DNA, 25 bp, Mus musculus
gagaacatgcacaaacatcaggaac

SEQ ID NO: 466983 - DNA, 25 bp, Mus musculus
gagaacatgcactaacatcaggaac

SEQ ID NO: 466984 - DNA, 25 bp, Mus musculus
gagaacatgctccatccatcatctt

SEQ ID NO: 466985 - DNA, 25 bp, Mus musculus
gagaacatgctcgatccatcatctt

SEQ ID NO: 466986 - DNA, 25 bp, Mus musculus
gagaacatgggtcattacttgcagc

SEQ ID NO: 466987 - DNA, 25 bp, Mus musculus
gagaacatgggtgattacttgcagc

SEQ ID NO: 466988 - DNA, 25 bp, Mus musculus
gagaacatgttacgtacttctacta

SEQ ID NO: 466989 - DNA, 25 bp, Mus musculus
gagaacatgttaggtacttctacta

SEQ ID NO: 466990 - DNA, 25 bp, Mus musculus
gagaacattaacatcctgacagaac

SEQ ID NO: 466991 - DNA, 25 bp, Mus musculus
gagaacattaacttcctgacagaac

SEQ ID NO: 466992 - DNA, 25 bp, Mus musculus
gagaacattatgagtgattttcctt

SEQ ID NO: 466993 - DNA, 25 bp, Mus musculus
gagaacattatgtgtgattttcctt

SEQ ID NO: 466994 - DNA, 25 bp, Mus musculus
gagaacattccactacctaacaaga

SEQ ID NO: 466995 - DNA, 25 bp, Mus musculus
gagaacattccagtacctaacaaga

SEQ ID NO: 466996 - DNA, 25 bp, Mus musculus
gagaacattgataaaactgcctagt

SEQ ID NO: 466997 - DNA, 25 bp, Mus musculus
gagaacattgatcgcctaatagctt

SEQ ID NO: 466998 - DNA, 25 bp, Mus musculus
gagaacattgatggcctaatagctt

SEQ ID NO: 466999 - DNA, 25 bp, Mus musculus
gagaacattgattaaactgcctagt

SEQ ID NO: 467000 - DNA, 25 bp, Mus musculus
gagaacattggcacatttccgaccc

SEQ ID NO: 467001 - DNA, 25 bp, Mus musculus
gagaacattggctcatttccgaccc

SEQ ID NO: 467002 - DNA, 25 bp, Mus musculus
gagaacatttacaactcagagatga

SEQ ID NO: 467003 - DNA, 25 bp, Mus musculus
gagaacatttactactcagagatga

SEQ ID NO: 467004 - DNA, 25 bp, Mus musculus
gagaacatttccataatgactctgt

SEQ ID NO: 467005 - DNA, 25 bp, Mus musculus
gagaacatttccttaatgactctgt

SEQ ID NO: 467006 - DNA, 25 bp, Mus musculus
gagaacatttctcaggctaggagta

SEQ ID NO: 467007 - DNA, 25 bp, Mus musculus
gagaacatttctgaggctaggagta

SEQ ID NO: 467008 - DNA, 25 bp, Mus musculus
gagaacatttgcactgtttccaaga

SEQ ID NO: 467009 - DNA, 25 bp, Mus musculus
gagaacatttgctctgtttccaaga

SEQ ID NO: 467010 - DNA, 25 bp, Mus musculus
gagaacatttgtcatcttcatgaaa

SEQ ID NO: 467011 - DNA, 25 bp, Mus musculus
gagaacatttgtgatcttcatgaaa

SEQ ID NO: 467012 - DNA, 25 bp, Mus musculus
gagaacattttccaactcctcttct

SEQ ID NO: 467013 - DNA, 25 bp, Mus musculus
gagaacattttcgaactcctcttct

SEQ ID NO: 467014 - DNA, 25 bp, Mus musculus
gagaaccaaagtattagactgtagt

SEQ ID NO: 467015 - DNA, 25 bp, Mus musculus
gagaaccaaagttttagactgtagt

SEQ ID NO: 467016 - DNA, 25 bp, Mus musculus
gagaaccaacacactgcctatagtt

SEQ ID NO: 467017 - DNA, 25 bp, Mus musculus
gagaaccaacactctgcctatagtt

SEQ ID NO: 467018 - DNA, 25 bp, Mus musculus
gagaaccaaccccaaggaacagagg

SEQ ID NO: 467019 - DNA, 25 bp, Mus musculus
gagaaccaacccgaaggaacagagg

SEQ ID NO: 467020 - DNA, 25 bp, Mus musculus
gagaaccaactgaaagcacctctga

SEQ ID NO: 467021 - DNA, 25 bp, Mus musculus
gagaaccaactgtaagcacctctga

SEQ ID NO: 467022 - DNA, 25 bp, Mus musculus
gagaaccaaggtcacagcttcacca

SEQ ID NO: 467023 - DNA, 25 bp, Mus musculus
gagaaccaaggtgacagcttcacca

SEQ ID NO: 467024 - DNA, 25 bp, Mus musculus
gagaaccaagtacctcccttaacct

SEQ ID NO: 467025 - DNA, 25 bp, Mus musculus
gagaaccaagtagctcccttaacct

SEQ ID NO: 467026 - DNA, 25 bp, Mus musculus
gagaaccaagtgaaggacctccggg

SEQ ID NO: 467027 - DNA, 25 bp, Mus musculus
gagaaccaagtgcattgtagcccct

SEQ ID NO: 467028 - DNA, 25 bp, Mus musculus
gagaaccaagtggattgtagcccct

SEQ ID NO: 467029 - DNA, 25 bp, Mus musculus
gagaaccaagtgtaggacctccggg

SEQ ID NO: 467030 - DNA, 25 bp, Mus musculus
gagaaccaagttaccaatatcctag

SEQ ID NO: 467031 - DNA, 25 bp, Mus musculus
gagaaccaagtttccaatatcctag

SEQ ID NO: 467032 - DNA, 25 bp, Mus musculus
gagaaccaattgattctgtccttac

SEQ ID NO: 467033 - DNA, 25 bp, Mus musculus
gagaaccaattgtttctgtccttac

SEQ ID NO: 467034 - DNA, 25 bp, Mus musculus
gagaaccaatttatacttagtgcct

SEQ ID NO: 467035 - DNA, 25 bp, Mus musculus
gagaaccaatttttacttagtgcct

SEQ ID NO: 467036 - DNA, 25 bp, Mus musculus
gagaaccacagacgacttgtacttg

SEQ ID NO: 467037 - DNA, 25 bp, Mus musculus
gagaaccacagactctatcgatctt

SEQ ID NO: 467038 - DNA, 25 bp, Mus musculus
gagaaccacagaggacttgtacttg

SEQ ID NO: 467039 - DNA, 25 bp, Mus musculus
gagaaccacagagtctatcgatctt

SEQ ID NO: 467040 - DNA, 25 bp, Mus musculus
gagaaccacaggagctccataacta

SEQ ID NO: 467041 - DNA, 25 bp, Mus musculus
gagaaccacaggtgctccataacta

SEQ ID NO: 467042 - DNA, 25 bp, Mus musculus
gagaaccaccaaatctgcatgtgtt

SEQ ID NO: 467043 - DNA, 25 bp, Mus musculus
gagaaccaccaattctgcatgtgtt

SEQ ID NO: 467044 - DNA, 25 bp, Mus musculus
gagaaccaccagactatccaggagt

SEQ ID NO: 467045 - DNA, 25 bp, Mus musculus
gagaaccaccagtctatccaggagt

SEQ ID NO: 467046 - DNA, 25 bp, Mus musculus
gagaaccaccatcctgggaattctg

SEQ ID NO: 467047 - DNA, 25 bp, Mus musculus
gagaaccaccatgctgggaattctg

SEQ ID NO: 467048 - DNA, 25 bp, Mus musculus
gagaaccacctccaagcacaagctg

SEQ ID NO: 467049 - DNA, 25 bp, Mus musculus
gagaaccacctcgaagcacaagctg

SEQ ID NO: 467050 - DNA, 25 bp, Mus musculus
gagaaccacctgatggctaatggat

SEQ ID NO: 467051 - DNA, 25 bp, Mus musculus
gagaaccacctgttggctaatggat

SEQ ID NO: 467052 - DNA, 25 bp, Mus musculus
gagaaccacgctataaaccttgcta

SEQ ID NO: 467053 - DNA, 25 bp, Mus musculus
gagaaccacgctttaaaccttgcta

SEQ ID NO: 467054 - DNA, 25 bp, Mus musculus
gagaaccacggacttaactacacgc

SEQ ID NO: 467055 - DNA, 25 bp, Mus musculus
gagaaccacggagttaactacacgc

SEQ ID NO: 467056 - DNA, 25 bp, Mus musculus
gagaaccacgggatgttccagccct

SEQ ID NO: 467057 - DNA, 25 bp, Mus musculus
gagaaccacgggttgttccagccct

SEQ ID NO: 467058 - DNA, 25 bp, Mus musculus
gagaaccacgtaaccagctacatga

SEQ ID NO: 467059 - DNA, 25 bp, Mus musculus
gagaaccacgtatccagctacatga

SEQ ID NO: 467060 - DNA, 25 bp, Mus musculus
gagaaccactaacggcttctcagct

SEQ ID NO: 467061 - DNA, 25 bp, Mus musculus
gagaaccactaagggcttctcagct

SEQ ID NO: 467062 - DNA, 25 bp, Mus musculus
gagaaccactacatgcaactcacgc

SEQ ID NO: 467063 - DNA, 25 bp, Mus musculus
gagaaccactacctaagttgtccct

SEQ ID NO: 467064 - DNA, 25 bp, Mus musculus
gagaaccactacgtaagttgtccct

SEQ ID NO: 467065 - DNA, 25 bp, Mus musculus
gagaaccactacttgcaactcacgc

SEQ ID NO: 467066 - DNA, 25 bp, Mus musculus
gagaaccactctcatgcctatgggt

SEQ ID NO: 467067 - DNA, 25 bp, Mus musculus
gagaaccactctgatgcctatgggt

SEQ ID NO: 467068 - DNA, 25 bp, Mus musculus
gagaaccactgcagcacatatataa

SEQ ID NO: 467069 - DNA, 25 bp, Mus musculus
gagaaccactgcattggtagcagag

SEQ ID NO: 467070 - DNA, 25 bp, Mus musculus
gagaaccactgctgcacatatataa

SEQ ID NO: 467071 - DNA, 25 bp, Mus musculus
gagaaccactgctttggtagcagag

SEQ ID NO: 467072 - DNA, 25 bp, Mus musculus
gagaaccactggaaagaggtctgta

SEQ ID NO: 467073 - DNA, 25 bp, Mus musculus
gagaaccactggatttgtcctggtg

SEQ ID NO: 467074 - DNA, 25 bp, Mus musculus
gagaaccactggtaagaggtctgta

SEQ ID NO: 467075 - DNA, 25 bp, Mus musculus
gagaaccactggttttgtcctggtg

SEQ ID NO: 467076 - DNA, 25 bp, Mus musculus
gagaaccacttcattcagagggaga

SEQ ID NO: 467077 - DNA, 25 bp, Mus musculus
gagaaccacttctttcagagggaga

SEQ ID NO: 467078 - DNA, 25 bp, Mus musculus
gagaaccagacacaccggcagcgtg

SEQ ID NO: 467079 - DNA, 25 bp, Mus musculus
gagaaccagacagaccggcagcgtg

SEQ ID NO: 467080 - DNA, 25 bp, Mus musculus
gagaaccagaggctgtctgcacttc

SEQ ID NO: 467081 - DNA, 25 bp, Mus musculus
gagaaccagagggtgtctgcacttc

SEQ ID NO: 467082 - DNA, 25 bp, Mus musculus
gagaaccaggaaataggtcctttca

SEQ ID NO: 467083 - DNA, 25 bp, Mus musculus
gagaaccaggaattaggtcctttca

SEQ ID NO: 467084 - DNA, 25 bp, Mus musculus
gagaaccaggacactggctcgtgta

SEQ ID NO: 467085 - DNA, 25 bp, Mus musculus
gagaaccaggactctggctcgtgta

SEQ ID NO: 467086 - DNA, 25 bp, Mus musculus
gagaaccaggcaccccagtagcagc

SEQ ID NO: 467087 - DNA, 25 bp, Mus musculus
gagaaccaggcagcccagtagcagc

SEQ ID NO: 467088 - DNA, 25 bp, Mus musculus
gagaaccaggtactgacccgagatg

SEQ ID NO: 467089 - DNA, 25 bp, Mus musculus
gagaaccaggtagtgacccgagatg

SEQ ID NO: 467090 - DNA, 25 bp, Mus musculus
gagaaccaggtcctaaggaagctgt

SEQ ID NO: 467091 - DNA, 25 bp, Mus musculus
gagaaccaggtcgtaaggaagctgt

SEQ ID NO: 467092 - DNA, 25 bp, Mus musculus
gagaaccagtgcacgctcttaagag

SEQ ID NO: 467093 - DNA, 25 bp, Mus musculus
gagaaccagtgctcgctcttaagag

SEQ ID NO: 467094 - DNA, 25 bp, Mus musculus
gagaaccagttcaattacctcttcg

SEQ ID NO: 467095 - DNA, 25 bp, Mus musculus
gagaaccagttctattacctcttcg

SEQ ID NO: 467096 - DNA, 25 bp, Mus musculus
gagaaccatacaaaagcaaccgaag

SEQ ID NO: 467097 - DNA, 25 bp, Mus musculus
gagaaccatacataagcaaccgaag

SEQ ID NO: 467098 - DNA, 25 bp, Mus musculus
gagaaccatctcactcagagacatt

SEQ ID NO: 467099 - DNA, 25 bp, Mus musculus
gagaaccatctctctcagagacatt

SEQ ID NO: 467100 - DNA, 25 bp, Mus musculus
gagaaccatttcaattcacaccacc

SEQ ID NO: 467101 - DNA, 25 bp, Mus musculus
gagaaccatttctattcacaccacc

SEQ ID NO: 467102 - DNA, 25 bp, Mus musculus
gagaacccaagactaataatgaaat

SEQ ID NO: 467103 - DNA, 25 bp, Mus musculus
gagaacccaagagtaataatgaaat

SEQ ID NO: 467104 - DNA, 25 bp, Mus musculus
gagaacccaaggagatcattaaact

SEQ ID NO: 467105 - DNA, 25 bp, Mus musculus
gagaacccaaggtgatcattaaact

SEQ ID NO: 467106 - DNA, 25 bp, Mus musculus
gagaacccaatgaggacagccctgg

SEQ ID NO: 467107 - DNA, 25 bp, Mus musculus
gagaacccaatgtggacagccctgg

SEQ ID NO: 467108 - DNA, 25 bp, Mus musculus
gagaacccacatatggctcgtatgt

SEQ ID NO: 467109 - DNA, 25 bp, Mus musculus
gagaacccacatcgctttggacatt

SEQ ID NO: 467110 - DNA, 25 bp, Mus musculus
gagaacccacatggctttggacatt

SEQ ID NO: 467111 - DNA, 25 bp, Mus musculus
gagaacccacatttggctcgtatgt

SEQ ID NO: 467112 - DNA, 25 bp, Mus musculus
gagaacccacttcccacagtggaga

SEQ ID NO: 467113 - DNA, 25 bp, Mus musculus
gagaacccacttgccacagtggaga

SEQ ID NO: 467114 - DNA, 25 bp, Mus musculus
gagaacccagagaatcctcagctaa

SEQ ID NO: 467115 - DNA, 25 bp, Mus musculus
gagaacccagagtatcctcagctaa

SEQ ID NO: 467116 - DNA, 25 bp, Mus musculus
gagaacccagcaatattaggttgaa

SEQ ID NO: 467117 - DNA, 25 bp, Mus musculus
gagaacccagcattattaggttgaa

SEQ ID NO: 467118 - DNA, 25 bp, Mus musculus
gagaacccagctatagggcttgaga

SEQ ID NO: 467119 - DNA, 25 bp, Mus musculus
gagaacccagctcttgtgtgcctat

SEQ ID NO: 467120 - DNA, 25 bp, Mus musculus
gagaacccagctgttgtgtgcctat

SEQ ID NO: 467121 - DNA, 25 bp, Mus musculus
gagaacccagctttagggcttgaga

SEQ ID NO: 467122 - DNA, 25 bp, Mus musculus
gagaacccagtaaagctgttttcag

SEQ ID NO: 467123 - DNA, 25 bp, Mus musculus
gagaacccagtacactttacccatc

SEQ ID NO: 467124 - DNA, 25 bp, Mus musculus
gagaacccagtagactttacccatc

SEQ ID NO: 467125 - DNA, 25 bp, Mus musculus
gagaacccagtatagctgttttcag

SEQ ID NO: 467126 - DNA, 25 bp, Mus musculus
gagaacccagtgattcggaagcaga

SEQ ID NO: 467127 - DNA, 25 bp, Mus musculus
gagaacccagtgtttcggaagcaga

SEQ ID NO: 467128 - DNA, 25 bp, Mus musculus
gagaacccatctactcagtattgga

SEQ ID NO: 467129 - DNA, 25 bp, Mus musculus
gagaacccatcttctcagtattgga

SEQ ID NO: 467130 - DNA, 25 bp, Mus musculus
gagaacccatgaaccttatttgaat

SEQ ID NO: 467131 - DNA, 25 bp, Mus musculus
gagaacccatgatccttatttgaat

SEQ ID NO: 467132 - DNA, 25 bp, Mus musculus
gagaacccatgcagtctacttaatg

SEQ ID NO: 467133 - DNA, 25 bp, Mus musculus
gagaacccatgctgtctacttaatg

SEQ ID NO: 467134 - DNA, 25 bp, Mus musculus
gagaacccattaacaaatatctgta

SEQ ID NO: 467135 - DNA, 25 bp, Mus musculus
gagaacccattatcaaatatctgta

SEQ ID NO: 467136 - DNA, 25 bp, Mus musculus
gagaaccccaacattactggcaaga

SEQ ID NO: 467137 - DNA, 25 bp, Mus musculus
gagaaccccaactttactggcaaga

SEQ ID NO: 467138 - DNA, 25 bp, Mus musculus
gagaaccccaatacatcagccggaa

SEQ ID NO: 467139 - DNA, 25 bp, Mus musculus
gagaaccccaattcatcagccggaa

SEQ ID NO: 467140 - DNA, 25 bp, Mus musculus
gagaaccccacaatgactctgtagt

SEQ ID NO: 467141 - DNA, 25 bp, Mus musculus
gagaaccccacattgactctgtagt

SEQ ID NO: 467142 - DNA, 25 bp, Mus musculus
gagaaccccaccatgaacataggta

SEQ ID NO: 467143 - DNA, 25 bp, Mus musculus
gagaaccccaccttgaacataggta

SEQ ID NO: 467144 - DNA, 25 bp, Mus musculus
gagaaccccagacaccaagataaga

SEQ ID NO: 467145 - DNA, 25 bp, Mus musculus
gagaaccccagagaccaagataaga

SEQ ID NO: 467146 - DNA, 25 bp, Mus musculus
gagaacccctacaaggagcctctta

SEQ ID NO: 467147 - DNA, 25 bp, Mus musculus
gagaacccctactaggagcctctta

SEQ ID NO: 467148 - DNA, 25 bp, Mus musculus
gagaacccgagactagcgtttcttt

SEQ ID NO: 467149 - DNA, 25 bp, Mus musculus
gagaacccgagagtagcgtttcttt

SEQ ID NO: 467150 - DNA, 25 bp, Mus musculus
gagaaccctactacagtttctgaca

SEQ ID NO: 467151 - DNA, 25 bp, Mus musculus
gagaaccctacttcagtttctgaca

SEQ ID NO: 467152 - DNA, 25 bp, Mus musculus
gagaaccctcctattagtatatgaa

SEQ ID NO: 467153 - DNA, 25 bp, Mus musculus
gagaaccctccttttagtatatgaa

SEQ ID NO: 467154 - DNA, 25 bp, Mus musculus
gagaaccctgctaagaaccttgaac

SEQ ID NO: 467155 - DNA, 25 bp, Mus musculus
gagaaccctgctcgagactttgaac

SEQ ID NO: 467156 - DNA, 25 bp, Mus musculus
gagaaccctgctggagactttgaac

SEQ ID NO: 467157 - DNA, 25 bp, Mus musculus
gagaaccctgcttagaaccttgaac

SEQ ID NO: 467158 - DNA, 25 bp, Mus musculus
gagaaccctggcatcaaggctgctc

SEQ ID NO: 467159 - DNA, 25 bp, Mus musculus
gagaaccctggcttcaaggctgctc

SEQ ID NO: 467160 - DNA, 25 bp, Mus musculus
gagaacccttagaatgctctttcac

SEQ ID NO: 467161 - DNA, 25 bp, Mus musculus
gagaacccttagtatgctctttcac

SEQ ID NO: 467162 - DNA, 25 bp, Mus musculus
gagaaccgatttatacttagaagag

SEQ ID NO: 467163 - DNA, 25 bp, Mus musculus
gagaaccgatttttacttagaagag

SEQ ID NO: 467164 - DNA, 25 bp, Mus musculus
gagaaccgctctcttgagcactgag

SEQ ID NO: 467165 - DNA, 25 bp, Mus musculus
gagaaccgctctgttgagcactgag

SEQ ID NO: 467166 - DNA, 25 bp, Mus musculus
gagaaccggcgcatcgtaggcagaa

SEQ ID NO: 467167 - DNA, 25 bp, Mus musculus
gagaaccggcgcttcgtaggcagaa

SEQ ID NO: 467168 - DNA, 25 bp, Mus musculus
gagaaccgtgcactgctaccaggga

SEQ ID NO: 467169 - DNA, 25 bp, Mus musculus
gagaaccgtgcagtgctaccaggga

SEQ ID NO: 467170 - DNA, 25 bp, Mus musculus
gagaaccgtgtgcttacccatgtaa

SEQ ID NO: 467171 - DNA, 25 bp, Mus musculus
gagaaccgtgtggttacccatgtaa

SEQ ID NO: 467172 - DNA, 25 bp, Mus musculus
gagaacctaatgcaagtgtgccctt

SEQ ID NO: 467173 - DNA, 25 bp, Mus musculus
gagaacctaatggaagtgtgccctt

SEQ ID NO: 467174 - DNA, 25 bp, Mus musculus
gagaacctagatactatagctgtat

SEQ ID NO: 467175 - DNA, 25 bp, Mus musculus
gagaacctagattctatagctgtat

SEQ ID NO: 467176 - DNA, 25 bp, Mus musculus
gagaacctagccatctactggatcc

SEQ ID NO: 467177 - DNA, 25 bp, Mus musculus
gagaacctagccttctactggatcc

SEQ ID NO: 467178 - DNA, 25 bp, Mus musculus
gagaacctaggcaactgtacaacaa

SEQ ID NO: 467179 - DNA, 25 bp, Mus musculus
gagaacctaggcagtcatttttatg

SEQ ID NO: 467180 - DNA, 25 bp, Mus musculus
gagaacctaggctactgtacaacaa

SEQ ID NO: 467181 - DNA, 25 bp, Mus musculus
gagaacctaggctgtcatttttatg

SEQ ID NO: 467182 - DNA, 25 bp, Mus musculus
gagaacctattgcagtttgcattgt

SEQ ID NO: 467183 - DNA, 25 bp, Mus musculus
gagaacctattggagtttgcattgt

SEQ ID NO: 467184 - DNA, 25 bp, Mus musculus
gagaacctcaaaacccacagggatg

SEQ ID NO: 467185 - DNA, 25 bp, Mus musculus
gagaacctcaaatcccacagggatg

SEQ ID NO: 467186 - DNA, 25 bp, Mus musculus
gagaacctcaagactatcaggagaa

SEQ ID NO: 467187 - DNA, 25 bp, Mus musculus
gagaacctcaagtctatcaggagaa

SEQ ID NO: 467188 - DNA, 25 bp, Mus musculus
gagaacctccctagtggttggtcct

SEQ ID NO: 467189 - DNA, 25 bp, Mus musculus
gagaacctcccttgtggttggtcct

SEQ ID NO: 467190 - DNA, 25 bp, Mus musculus
gagaacctccggaacaaatcctgag

SEQ ID NO: 467191 - DNA, 25 bp, Mus musculus
gagaacctccggtacaaatcctgag

SEQ ID NO: 467192 - DNA, 25 bp, Mus musculus
gagaacctcctaagacagctggctt

SEQ ID NO: 467193 - DNA, 25 bp, Mus musculus
gagaacctcctatgacagctggctt

SEQ ID NO: 467194 - DNA, 25 bp, Mus musculus
gagaacctctgaatcagcgcgagga

SEQ ID NO: 467195 - DNA, 25 bp, Mus musculus
gagaacctctgaccttcagaggact

SEQ ID NO: 467196 - DNA, 25 bp, Mus musculus
gagaacctctgagcttcagaggact

SEQ ID NO: 467197 - DNA, 25 bp, Mus musculus
gagaacctctgattcagcgcgagga

SEQ ID NO: 467198 - DNA, 25 bp, Mus musculus
gagaacctctgcattacggttgaca

SEQ ID NO: 467199 - DNA, 25 bp, Mus musculus
gagaacctctgctttacggttgaca

SEQ ID NO: 467200 - DNA, 25 bp, Mus musculus
gagaacctctgtcgtccccggagga

SEQ ID NO: 467201 - DNA, 25 bp, Mus musculus
gagaacctctgtggtccccggagga

SEQ ID NO: 467202 - DNA, 25 bp, Mus musculus
gagaacctgagtatccgagaagtgg

SEQ ID NO: 467203 - DNA, 25 bp, Mus musculus
gagaacctgagtttccgagaagtgg

SEQ ID NO: 467204 - DNA, 25 bp, Mus musculus
gagaacctgatgagtgaccccacca

SEQ ID NO: 467205 - DNA, 25 bp, Mus musculus
gagaacctgatgtgtgaccccacca

SEQ ID NO: 467206 - DNA, 25 bp, Mus musculus
gagaacctgcaacgcccagggatcc

SEQ ID NO: 467207 - DNA, 25 bp, Mus musculus
gagaacctgcaaggcccagggatcc

SEQ ID NO: 467208 - DNA, 25 bp, Mus musculus
gagaacctgccacacatttgatgaa

SEQ ID NO: 467209 - DNA, 25 bp, Mus musculus
gagaacctgccagacatttgatgaa

SEQ ID NO: 467210 - DNA, 25 bp, Mus musculus
gagaacctgcccacctaaggtgtga

SEQ ID NO: 467211 - DNA, 25 bp, Mus musculus
gagaacctgccctcctaaggtgtga

SEQ ID NO: 467212 - DNA, 25 bp, Mus musculus
gagaacctgcctcgactaagtagtt

SEQ ID NO: 467213 - DNA, 25 bp, Mus musculus
gagaacctgcctggactaagtagtt

SEQ ID NO: 467214 - DNA, 25 bp, Mus musculus
gagaacctgctcaaaatctgtgtct

SEQ ID NO: 467215 - DNA, 25 bp, Mus musculus
gagaacctgctctaaatctgtgtct

SEQ ID NO: 467216 - DNA, 25 bp, Mus musculus
gagaacctggacataattcctagta

SEQ ID NO: 467217 - DNA, 25 bp, Mus musculus
gagaacctggaccagtcggtcagaa

SEQ ID NO: 467218 - DNA, 25 bp, Mus musculus
gagaacctggacgagtcggtcagaa

SEQ ID NO: 467219 - DNA, 25 bp, Mus musculus
gagaacctggacttaattcctagta

SEQ ID NO: 467220 - DNA, 25 bp, Mus musculus
gagaacctggagatttggctcgctt

SEQ ID NO: 467221 - DNA, 25 bp, Mus musculus
gagaacctggagttttggctcgctt

SEQ ID NO: 467222 - DNA, 25 bp, Mus musculus
gagaacctgggcctgctacagaagt

SEQ ID NO: 467223 - DNA, 25 bp, Mus musculus
gagaacctgggcgtgctacagaagt

SEQ ID NO: 467224 - DNA, 25 bp, Mus musculus
gagaacctggtcatacttgagcaga

SEQ ID NO: 467225 - DNA, 25 bp, Mus musculus
gagaacctggtcttacttgagcaga

SEQ ID NO: 467226 - DNA, 25 bp, Mus musculus
gagaaccttagaagctaaacccaga

SEQ ID NO: 467227 - DNA, 25 bp, Mus musculus
gagaaccttagatgctaaacccaga

SEQ ID NO: 467228 - DNA, 25 bp, Mus musculus
gagaaccttaggataactaggtggt

SEQ ID NO: 467229 - DNA, 25 bp, Mus musculus
gagaaccttaggcaggcaagctccc

SEQ ID NO: 467230 - DNA, 25 bp, Mus musculus
gagaaccttagggaggcaagctccc

SEQ ID NO: 467231 - DNA, 25 bp, Mus musculus
gagaaccttaggttaactaggtggt

SEQ ID NO: 467232 - DNA, 25 bp, Mus musculus
gagaaccttattctgcaggcttctg

SEQ ID NO: 467233 - DNA, 25 bp, Mus musculus
gagaaccttattgtgcaggcttctg

SEQ ID NO: 467234 - DNA, 25 bp, Mus musculus
gagaaccttcatccactgtgagaat

SEQ ID NO: 467235 - DNA, 25 bp, Mus musculus
gagaaccttcatgcactgtgagaat

SEQ ID NO: 467236 - DNA, 25 bp, Mus musculus
gagaaccttctaaagaggcaccaga

SEQ ID NO: 467237 - DNA, 25 bp, Mus musculus
gagaaccttctatagaggcaccaga

SEQ ID NO: 467238 - DNA, 25 bp, Mus musculus
gagaaccttgagcataaagacacag

SEQ ID NO: 467239 - DNA, 25 bp, Mus musculus
gagaaccttgaggataaagacacag

SEQ ID NO: 467240 - DNA, 25 bp, Mus musculus
gagaaccttgatcacctggtaaatc

SEQ ID NO: 467241 - DNA, 25 bp, Mus musculus
gagaaccttgatgacctggtaaatc

SEQ ID NO: 467242 - DNA, 25 bp, Mus musculus
gagaaccttgctatcacagagactt

SEQ ID NO: 467243 - DNA, 25 bp, Mus musculus
gagaaccttgctttcacagagactt

SEQ ID NO: 467244 - DNA, 25 bp, Mus musculus
gagaaccttgggatcgtgtttggac

SEQ ID NO: 467245 - DNA, 25 bp, Mus musculus
gagaaccttgggttcgtgtttggac

SEQ ID NO: 467246 - DNA, 25 bp, Mus musculus
gagaaccttttacttgagtacacca

SEQ ID NO: 467247 - DNA, 25 bp, Mus musculus
gagaaccttttagttgagtacacca

SEQ ID NO: 467248 - DNA, 25 bp, Mus musculus
gagaaccttttcagcgtaaatatat

SEQ ID NO: 467249 - DNA, 25 bp, Mus musculus
gagaaccttttctgcgtaaatatat

SEQ ID NO: 467250 - DNA, 25 bp, Mus musculus
gagaacgaaacccaacaacagacaa

SEQ ID NO: 467251 - DNA, 25 bp, Mus musculus
gagaacgaaaccgaacaacagacaa

SEQ ID NO: 467252 - DNA, 25 bp, Mus musculus
gagaacgaactcactagtctagcag

SEQ ID NO: 467253 - DNA, 25 bp, Mus musculus
gagaacgaactctctagtctagcag

SEQ ID NO: 467254 - DNA, 25 bp, Mus musculus
gagaacgaatgacactccagtgaat

SEQ ID NO: 467255 - DNA, 25 bp, Mus musculus
gagaacgaatgagactccagtgaat

SEQ ID NO: 467256 - DNA, 25 bp, Mus musculus
gagaacgaattgagagaccccttgt

SEQ ID NO: 467257 - DNA, 25 bp, Mus musculus
gagaacgaattgtgagaccccttgt

SEQ ID NO: 467258 - DNA, 25 bp, Mus musculus
gagaacgaccgtattcctaatgtga

SEQ ID NO: 467259 - DNA, 25 bp, Mus musculus
gagaacgaccgttttcctaatgtga

SEQ ID NO: 467260 - DNA, 25 bp, Mus musculus
gagaacgaccttcggtgacataaat

SEQ ID NO: 467261 - DNA, 25 bp, Mus musculus
gagaacgaccttgggtgacataaat

SEQ ID NO: 467262 - DNA, 25 bp, Mus musculus
gagaacgactaaattatgataaaga

SEQ ID NO: 467263 - DNA, 25 bp, Mus musculus
gagaacgactaatttatgataaaga

SEQ ID NO: 467264 - DNA, 25 bp, Mus musculus
gagaacgactacatgcgctccatga

SEQ ID NO: 467265 - DNA, 25 bp, Mus musculus
gagaacgactacttgcgctccatga

SEQ ID NO: 467266 - DNA, 25 bp, Mus musculus
gagaacgagaagacgcagctcattc

SEQ ID NO: 467267 - DNA, 25 bp, Mus musculus
gagaacgagaagtcgcagctcattc

SEQ ID NO: 467268 - DNA, 25 bp, Mus musculus
gagaacgagcgcacggcagcggctc

SEQ ID NO: 467269 - DNA, 25 bp, Mus musculus
gagaacgagcgctcggcagcggctc

SEQ ID NO: 467270 - DNA, 25 bp, Mus musculus
gagaacgaggtgatgatctttgtac

SEQ ID NO: 467271 - DNA, 25 bp, Mus musculus
gagaacgaggtgttgatctttgtac

SEQ ID NO: 467272 - DNA, 25 bp, Mus musculus
gagaacgatcagagctttttgaagt

SEQ ID NO: 467273 - DNA, 25 bp, Mus musculus
gagaacgatcagtgctttttgaagt

SEQ ID NO: 467274 - DNA, 25 bp, Mus musculus
gagaacgatgagctttcagccaaac

SEQ ID NO: 467275 - DNA, 25 bp, Mus musculus
gagaacgatgaggtttcagccaaac

SEQ ID NO: 467276 - DNA, 25 bp, Mus musculus
gagaacgcattcacagctgttgcac

SEQ ID NO: 467277 - DNA, 25 bp, Mus musculus
gagaacgcattctcagctgttgcac

SEQ ID NO: 467278 - DNA, 25 bp, Mus musculus
gagaacgccaagactgggttcccgc

SEQ ID NO: 467279 - DNA, 25 bp, Mus musculus
gagaacgccaagtctgggttcccgc

SEQ ID NO: 467280 - DNA, 25 bp, Mus musculus
gagaacgcccccaataatacttgtt

SEQ ID NO: 467281 - DNA, 25 bp, Mus musculus
gagaacgccccctataatacttgtt

SEQ ID NO: 467282 - DNA, 25 bp, Mus musculus
gagaacgcctgtcgatgttatcttg

SEQ ID NO: 467283 - DNA, 25 bp, Mus musculus
gagaacgcctgtggatgttatcttg

SEQ ID NO: 467284 - DNA, 25 bp, Mus musculus
gagaacgcgctcagctcaaggacca

SEQ ID NO: 467285 - DNA, 25 bp, Mus musculus
gagaacgcgctctgctcaaggacca

SEQ ID NO: 467286 - DNA, 25 bp, Mus musculus
gagaacgctacgacaaccagctgaa

SEQ ID NO: 467287 - DNA, 25 bp, Mus musculus
gagaacgctacgtcaaccagctgaa

SEQ ID NO: 467288 - DNA, 25 bp, Mus musculus
gagaacgctagtctcttcaaactga

SEQ ID NO: 467289 - DNA, 25 bp, Mus musculus
gagaacgctagtgtcttcaaactga

SEQ ID NO: 467290 - DNA, 25 bp, Mus musculus
gagaacgctggcatttctgccgaga

SEQ ID NO: 467291 - DNA, 25 bp, Mus musculus
gagaacgctggcttttctgccgaga

SEQ ID NO: 467292 - DNA, 25 bp, Mus musculus
gagaacgctgtgcaaatccacaaag

SEQ ID NO: 467293 - DNA, 25 bp, Mus musculus
gagaacgctgtggaaatccacaaag

SEQ ID NO: 467294 - DNA, 25 bp, Mus musculus
gagaacgcttcgatcagcggcgcaa

SEQ ID NO: 467295 - DNA, 25 bp, Mus musculus
gagaacgcttcgttcagcggcgcaa

SEQ ID NO: 467296 - DNA, 25 bp, Mus musculus
gagaacgctttcacgtgagccaaat

SEQ ID NO: 467297 - DNA, 25 bp, Mus musculus
gagaacgctttctcgtgagccaaat

SEQ ID NO: 467298 - DNA, 25 bp, Mus musculus
gagaacggagaactggctgccactc

SEQ ID NO: 467299 - DNA, 25 bp, Mus musculus
gagaacggagaagtggctgccactc

SEQ ID NO: 467300 - DNA, 25 bp, Mus musculus
gagaacggaggcagatccctgacca

SEQ ID NO: 467301 - DNA, 25 bp, Mus musculus
gagaacggaggctgatccctgacca

SEQ ID NO: 467302 - DNA, 25 bp, Mus musculus
gagaacggatggagaagccgaacca

SEQ ID NO: 467303 - DNA, 25 bp, Mus musculus
gagaacggatggtgaagccgaacca

SEQ ID NO: 467304 - DNA, 25 bp, Mus musculus
gagaacggattcaattgaccaattt

SEQ ID NO: 467305 - DNA, 25 bp, Mus musculus
gagaacggattctattgaccaattt

SEQ ID NO: 467306 - DNA, 25 bp, Mus musculus
gagaacggcaggagctcttgaccac

SEQ ID NO: 467307 - DNA, 25 bp, Mus musculus
gagaacggcaggctcatcatcacag

SEQ ID NO: 467308 - DNA, 25 bp, Mus musculus
gagaacggcagggtcatcatcacag

SEQ ID NO: 467309 - DNA, 25 bp, Mus musculus
gagaacggcaggtgctcttgaccac

SEQ ID NO: 467310 - DNA, 25 bp, Mus musculus
gagaacggctcacgtgtatgacaca

SEQ ID NO: 467311 - DNA, 25 bp, Mus musculus
gagaacggctcaggtgtatgacaca

SEQ ID NO: 467312 - DNA, 25 bp, Mus musculus
gagaacggctccaggctctgcaaac

SEQ ID NO: 467313 - DNA, 25 bp, Mus musculus
gagaacggctcctggctctgcaaac

SEQ ID NO: 467314 - DNA, 25 bp, Mus musculus
gagaacgggagtctccgattccgcc

SEQ ID NO: 467315 - DNA, 25 bp, Mus musculus
gagaacgggagtgtccgattccgcc

SEQ ID NO: 467316 - DNA, 25 bp, Mus musculus
gagaacggtacgaacattatcagaa

SEQ ID NO: 467317 - DNA, 25 bp, Mus musculus
gagaacggtacgtacattatcagaa

SEQ ID NO: 467318 - DNA, 25 bp, Mus musculus
gagaacggttacattcacccagtca

SEQ ID NO: 467319 - DNA, 25 bp, Mus musculus
gagaacggttactttcacccagtca

SEQ ID NO: 467320 - DNA, 25 bp, Mus musculus
gagaacgtaccacaaagcaacctgc

SEQ ID NO: 467321 - DNA, 25 bp, Mus musculus
gagaacgtaccagaaagcaacctgc

SEQ ID NO: 467322 - DNA, 25 bp, Mus musculus
gagaacgtaggcacccacatagggt

SEQ ID NO: 467323 - DNA, 25 bp, Mus musculus
gagaacgtaggctcccacatagggt

SEQ ID NO: 467324 - DNA, 25 bp, Mus musculus
gagaacgtatcacccgcctggagga

SEQ ID NO: 467325 - DNA, 25 bp, Mus musculus
gagaacgtatcagccgcctggagga

SEQ ID NO: 467326 - DNA, 25 bp, Mus musculus
gagaacgtcactagggtctgtccag

SEQ ID NO: 467327 - DNA, 25 bp, Mus musculus
gagaacgtcacttgggtctgtccag

SEQ ID NO: 467328 - DNA, 25 bp, Mus musculus
gagaacgtccagaattcatctgtga

SEQ ID NO: 467329 - DNA, 25 bp, Mus musculus
gagaacgtccagtattcatctgtga

SEQ ID NO: 467330 - DNA, 25 bp, Mus musculus
gagaacgtcctaacaagccacgata

SEQ ID NO: 467331 - DNA, 25 bp, Mus musculus
gagaacgtcctatcaagccacgata

SEQ ID NO: 467332 - DNA, 25 bp, Mus musculus
gagaacgtcctcacccaataaagaa

SEQ ID NO: 467333 - DNA, 25 bp, Mus musculus
gagaacgtcctctcccaataaagaa

SEQ ID NO: 467334 - DNA, 25 bp, Mus musculus
gagaacgtcctgcaagggtgccact

SEQ ID NO: 467335 - DNA, 25 bp, Mus musculus
gagaacgtcctggaagggtgccact

SEQ ID NO: 467336 - DNA, 25 bp, Mus musculus
gagaacgtgacaagaccatgtgaaa

SEQ ID NO: 467337 - DNA, 25 bp, Mus musculus
gagaacgtgacatgaccatgtgaaa

SEQ ID NO: 467338 - DNA, 25 bp, Mus musculus
gagaacgtgcttaagagtccactat

SEQ ID NO: 467339 - DNA, 25 bp, Mus musculus
gagaacgtgctttagagtccactat

SEQ ID NO: 467340 - DNA, 25 bp, Mus musculus
gagaacgtggagatacaccagacct

SEQ ID NO: 467341 - DNA, 25 bp, Mus musculus
gagaacgtggagttacaccagacct

SEQ ID NO: 467342 - DNA, 25 bp, Mus musculus
gagaacgtgtacagtctgacattaa

SEQ ID NO: 467343 - DNA, 25 bp, Mus musculus
gagaacgtgtactgtctgacattaa

SEQ ID NO: 467344 - DNA, 25 bp, Mus musculus
gagaacgtgttcaggtgggagactg

SEQ ID NO: 467345 - DNA, 25 bp, Mus musculus
gagaacgtgttctggtgggagactg

SEQ ID NO: 467346 - DNA, 25 bp, Mus musculus
gagaacgttccaacatcgtggacct

SEQ ID NO: 467347 - DNA, 25 bp, Mus musculus
gagaacgttccatcatcgtggacct

SEQ ID NO: 467348 - DNA, 25 bp, Mus musculus
gagaacgttgccatatactcacttc

SEQ ID NO: 467349 - DNA, 25 bp, Mus musculus
gagaacgttgccttatactcacttc

SEQ ID NO: 467350 - DNA, 25 bp, Mus musculus
gagaacgtttccatatgcgtgcata

SEQ ID NO: 467351 - DNA, 25 bp, Mus musculus
gagaacgtttccttatgcgtgcata

SEQ ID NO: 467352 - DNA, 25 bp, Mus musculus
gagaactaaatgctcctgcttattt

SEQ ID NO: 467353 - DNA, 25 bp, Mus musculus
gagaactaaatggtcctgcttattt

SEQ ID NO: 467354 - DNA, 25 bp, Mus musculus
gagaactaaattagaagtctgtaca

SEQ ID NO: 467355 - DNA, 25 bp, Mus musculus
gagaactaaatttgaagtctgtaca

SEQ ID NO: 467356 - DNA, 25 bp, Mus musculus
gagaactaaccccactctggtcttt

SEQ ID NO: 467357 - DNA, 25 bp, Mus musculus
gagaactaacccgactctggtcttt

SEQ ID NO: 467358 - DNA, 25 bp, Mus musculus
gagaactaactcctacacttgggtt

SEQ ID NO: 467359 - DNA, 25 bp, Mus musculus
gagaactaactccttccaagttgcc

SEQ ID NO: 467360 - DNA, 25 bp, Mus musculus
gagaactaactcgtacacttgggtt

SEQ ID NO: 467361 - DNA, 25 bp, Mus musculus
gagaactaactcgttccaagttgcc

SEQ ID NO: 467362 - DNA, 25 bp, Mus musculus
gagaactaagtcctaccctctgcat

SEQ ID NO: 467363 - DNA, 25 bp, Mus musculus
gagaactaagtcgtaccctctgcat

SEQ ID NO: 467364 - DNA, 25 bp, Mus musculus
gagaactaattcaggagagtcctcc

SEQ ID NO: 467365 - DNA, 25 bp, Mus musculus
gagaactaattctggagagtcctcc

SEQ ID NO: 467366 - DNA, 25 bp, Mus musculus
gagaactaatttatccatttgcata

SEQ ID NO: 467367 - DNA, 25 bp, Mus musculus
gagaactaatttttccatttgcata

SEQ ID NO: 467368 - DNA, 25 bp, Mus musculus
gagaactacaagcacaccgcaccag

SEQ ID NO: 467369 - DNA, 25 bp, Mus musculus
gagaactacaaggacaccgcaccag

SEQ ID NO: 467370 - DNA, 25 bp, Mus musculus
gagaactacagtatctgcttatcat

SEQ ID NO: 467371 - DNA, 25 bp, Mus musculus
gagaactacagtctgtgttccacaa

SEQ ID NO: 467372 - DNA, 25 bp, Mus musculus
gagaactacagtgtgtgttccacaa

SEQ ID NO: 467373 - DNA, 25 bp, Mus musculus
gagaactacagtttctgcttatcat

SEQ ID NO: 467374 - DNA, 25 bp, Mus musculus
gagaactacataaccctctttaggg

SEQ ID NO: 467375 - DNA, 25 bp, Mus musculus
gagaactacatatccctctttaggg

SEQ ID NO: 467376 - DNA, 25 bp, Mus musculus
gagaactacccaatatggctccctg

SEQ ID NO: 467377 - DNA, 25 bp, Mus musculus
gagaactacccattatggctccctg

SEQ ID NO: 467378 - DNA, 25 bp, Mus musculus
gagaactaccgcctacaccttgagg

SEQ ID NO: 467379 - DNA, 25 bp, Mus musculus
gagaactaccgcgtacaccttgagg

SEQ ID NO: 467380 - DNA, 25 bp, Mus musculus
gagaactacgtgactcccattgaag

SEQ ID NO: 467381 - DNA, 25 bp, Mus musculus
gagaactacgtgtctcccattgaag

SEQ ID NO: 467382 - DNA, 25 bp, Mus musculus
gagaactactccagcagaagcaact

SEQ ID NO: 467383 - DNA, 25 bp, Mus musculus
gagaactactccatacaattttgct

SEQ ID NO: 467384 - DNA, 25 bp, Mus musculus
gagaactactcctgcagaagcaact

SEQ ID NO: 467385 - DNA, 25 bp, Mus musculus
gagaactactccttacaattttgct

SEQ ID NO: 467386 - DNA, 25 bp, Mus musculus
gagaactactggatcattccctcta

SEQ ID NO: 467387 - DNA, 25 bp, Mus musculus
gagaactactggttcattccctcta

SEQ ID NO: 467388 - DNA, 25 bp, Mus musculus
gagaactacttcatcaaccagtaaa

SEQ ID NO: 467389 - DNA, 25 bp, Mus musculus
gagaactacttcttcaaccagtaaa

SEQ ID NO: 467390 - DNA, 25 bp, Mus musculus
gagaactactttatgttttactgta

SEQ ID NO: 467391 - DNA, 25 bp, Mus musculus
gagaactactttcttagcctgctta

SEQ ID NO: 467392 - DNA, 25 bp, Mus musculus
gagaactactttgttagcctgctta

SEQ ID NO: 467393 - DNA, 25 bp, Mus musculus
gagaactactttttgttttactgta

SEQ ID NO: 467394 - DNA, 25 bp, Mus musculus
gagaactagaggcttcctctgcctt

SEQ ID NO: 467395 - DNA, 25 bp, Mus musculus
gagaactagagggttcctctgcctt

SEQ ID NO: 467396 - DNA, 25 bp, Mus musculus
gagaactagatccttatttcttctt

SEQ ID NO: 467397 - DNA, 25 bp, Mus musculus
gagaactagatcgttatttcttctt

SEQ ID NO: 467398 - DNA, 25 bp, Mus musculus
gagaactagtggctccgtgtcacag

SEQ ID NO: 467399 - DNA, 25 bp, Mus musculus
gagaactagtgggtccgtgtcacag

SEQ ID NO: 467400 - DNA, 25 bp, Mus musculus
gagaactataggaccatggcaagca

SEQ ID NO: 467401 - DNA, 25 bp, Mus musculus
gagaactataggtccatggcaagca

SEQ ID NO: 467402 - DNA, 25 bp, Mus musculus
gagaactatggccaggactacgtcc

SEQ ID NO: 467403 - DNA, 25 bp, Mus musculus
gagaactatggcgaggactacgtcc

SEQ ID NO: 467404 - DNA, 25 bp, Mus musculus
gagaactattctatgtactgtcgga

SEQ ID NO: 467405 - DNA, 25 bp, Mus musculus
gagaactattctttgtactgtcgga

SEQ ID NO: 467406 - DNA, 25 bp, Mus musculus
gagaactcaactactctttttagga

SEQ ID NO: 467407 - DNA, 25 bp, Mus musculus
gagaactcaacttctctttttagga

SEQ ID NO: 467408 - DNA, 25 bp, Mus musculus
gagaactcaatgctactatgttttc

SEQ ID NO: 467409 - DNA, 25 bp, Mus musculus
gagaactcaatggtactatgttttc

SEQ ID NO: 467410 - DNA, 25 bp, Mus musculus
gagaactcactacgcttcagtgcct

SEQ ID NO: 467411 - DNA, 25 bp, Mus musculus
gagaactcactaggcttcagtgcct

SEQ ID NO: 467412 - DNA, 25 bp, Mus musculus
gagaactcagaacccagtacagtga

SEQ ID NO: 467413 - DNA, 25 bp, Mus musculus
gagaactcagaagccagtacagtga

SEQ ID NO: 467414 - DNA, 25 bp, Mus musculus
gagaactcagatcccgaaccaaatt

SEQ ID NO: 467415 - DNA, 25 bp, Mus musculus
gagaactcagatgccgaaccaaatt

SEQ ID NO: 467416 - DNA, 25 bp, Mus musculus
gagaactcagtactccatcatcttt

SEQ ID NO: 467417 - DNA, 25 bp, Mus musculus
gagaactcagtagtccatcatcttt

SEQ ID NO: 467418 - DNA, 25 bp, Mus musculus
gagaactcatgaaggaccccgtcat

SEQ ID NO: 467419 - DNA, 25 bp, Mus musculus
gagaactcatgatggaccccgtcat

SEQ ID NO: 467420 - DNA, 25 bp, Mus musculus
gagaactcatgcatgtgcaaataca

SEQ ID NO: 467421 - DNA, 25 bp, Mus musculus
gagaactcatgcttgtgcaaataca

SEQ ID NO: 467422 - DNA, 25 bp, Mus musculus
gagaactcatttctacccctaatag

SEQ ID NO: 467423 - DNA, 25 bp, Mus musculus
gagaactcatttgtacccctaatag

SEQ ID NO: 467424 - DNA, 25 bp, Mus musculus
gagaactccacgattcatgttaaaa

SEQ ID NO: 467425 - DNA, 25 bp, Mus musculus
gagaactccacgtttcatgttaaaa

SEQ ID NO: 467426 - DNA, 25 bp, Mus musculus
gagaactccaggctatagtctcctg

SEQ ID NO: 467427 - DNA, 25 bp, Mus musculus
gagaactccagggtatagtctcctg

SEQ ID NO: 467428 - DNA, 25 bp, Mus musculus
gagaactcccacaggaaagccctat

SEQ ID NO: 467429 - DNA, 25 bp, Mus musculus
gagaactcccactggaaagccctat

SEQ ID NO: 467430 - DNA, 25 bp, Mus musculus
gagaactcccttaagcggtgcacct

SEQ ID NO: 467431 - DNA, 25 bp, Mus musculus
gagaactcccttcagcggtgcacct

SEQ ID NO: 467432 - DNA, 25 bp, Mus musculus
gagaactcccttgagcggtgcacct

SEQ ID NO: 467433 - DNA, 25 bp, Mus musculus
gagaactccctttagcggtgcacct

SEQ ID NO: 467434 - DNA, 25 bp, Mus musculus
gagaactccgtgactgtagaagctg

SEQ ID NO: 467435 - DNA, 25 bp, Mus musculus
gagaactccgtgtctgtagaagctg

SEQ ID NO: 467436 - DNA, 25 bp, Mus musculus
gagaactcctacagatgatgaacaa

SEQ ID NO: 467437 - DNA, 25 bp, Mus musculus
gagaactcctactgatgatgaacaa

SEQ ID NO: 467438 - DNA, 25 bp, Mus musculus
gagaactcctcacatttctatttat

SEQ ID NO: 467439 - DNA, 25 bp, Mus musculus
gagaactcctcagatttctatttat

SEQ ID NO: 467440 - DNA, 25 bp, Mus musculus
gagaactcctttcagggctcatcct

SEQ ID NO: 467441 - DNA, 25 bp, Mus musculus
gagaactcctttgagggctcatcct

SEQ ID NO: 467442 - DNA, 25 bp, Mus musculus
gagaactcgccaccctgtggaagaa

SEQ ID NO: 467443 - DNA, 25 bp, Mus musculus
gagaactcgccagcctgtggaagaa

SEQ ID NO: 467444 - DNA, 25 bp, Mus musculus
gagaactcggaaatacacacggaat

SEQ ID NO: 467445 - DNA, 25 bp, Mus musculus
gagaactcggaattacacacggaat

SEQ ID NO: 467446 - DNA, 25 bp, Mus musculus
gagaactcgtagatccatacaccag

SEQ ID NO: 467447 - DNA, 25 bp, Mus musculus
gagaactcgtagttccatacaccag

SEQ ID NO: 467448 - DNA, 25 bp, Mus musculus
gagaactctaaccagtctctctaca

SEQ ID NO: 467449 - DNA, 25 bp, Mus musculus
gagaactctaacgagtctctctaca

SEQ ID NO: 467450 - DNA, 25 bp, Mus musculus
gagaactctatgctctgttttacct

SEQ ID NO: 467451 - DNA, 25 bp, Mus musculus
gagaactctatggtctgttttacct

SEQ ID NO: 467452 - DNA, 25 bp, Mus musculus
gagaactctcatactagggtacttg

SEQ ID NO: 467453 - DNA, 25 bp, Mus musculus
gagaactctcattctagggtacttg

SEQ ID NO: 467454 - DNA, 25 bp, Mus musculus
gagaactctctaaacaagtacccaa

SEQ ID NO: 467455 - DNA, 25 bp, Mus musculus
gagaactctctatacaagtacccaa

SEQ ID NO: 467456 - DNA, 25 bp, Mus musculus
gagaactctgcacctttttgggtcc

SEQ ID NO: 467457 - DNA, 25 bp, Mus musculus
gagaactctgcagctttttgggtcc

SEQ ID NO: 467458 - DNA, 25 bp, Mus musculus
gagaactctgggatccttctttcta

SEQ ID NO: 467459 - DNA, 25 bp, Mus musculus
gagaactctgggttccttctttcta

SEQ ID NO: 467460 - DNA, 25 bp, Mus musculus
gagaactctgttccgacgtcaggcc

SEQ ID NO: 467461 - DNA, 25 bp, Mus musculus
gagaactctgttgcgacgtcaggcc

SEQ ID NO: 467462 - DNA, 25 bp, Mus musculus
gagaactcttctctaatgaatgtag

SEQ ID NO: 467463 - DNA, 25 bp, Mus musculus
gagaactcttctgtaatgaatgtag

SEQ ID NO: 467464 - DNA, 25 bp, Mus musculus
gagaactcttgtataaagtacctgt

SEQ ID NO: 467465 - DNA, 25 bp, Mus musculus
gagaactcttgtttaaagtacctgt

SEQ ID NO: 467466 - DNA, 25 bp, Mus musculus
gagaactgaaccaaagtgctctgta

SEQ ID NO: 467467 - DNA, 25 bp, Mus musculus
gagaactgaacctaagtgctctgta

SEQ ID NO: 467468 - DNA, 25 bp, Mus musculus
gagaactgaatcatttagtttccat

SEQ ID NO: 467469 - DNA, 25 bp, Mus musculus
gagaactgaatcttttagtttccat

SEQ ID NO: 467470 - DNA, 25 bp, Mus musculus
gagaactgacatagtacctgggtac

SEQ ID NO: 467471 - DNA, 25 bp, Mus musculus
gagaactgacattgtacctgggtac

SEQ ID NO: 467472 - DNA, 25 bp, Mus musculus
gagaactgaccccaagctgtaggtc

SEQ ID NO: 467473 - DNA, 25 bp, Mus musculus
gagaactgacccgaagctgtaggtc

SEQ ID NO: 467474 - DNA, 25 bp, Mus musculus
gagaactgactccactcaagtgatc

SEQ ID NO: 467475 - DNA, 25 bp, Mus musculus
gagaactgactcgactcaagtgatc

SEQ ID NO: 467476 - DNA, 25 bp, Mus musculus
gagaactgagaccatctttggcctc

SEQ ID NO: 467477 - DNA, 25 bp, Mus musculus
gagaactgagacgatctttggcctc

SEQ ID NO: 467478 - DNA, 25 bp, Mus musculus
gagaactgaggccgctgcactgcta

SEQ ID NO: 467479 - DNA, 25 bp, Mus musculus
gagaactgaggcggctgcactgcta

SEQ ID NO: 467480 - DNA, 25 bp, Mus musculus
gagaactgaggtaattgcactgcca

SEQ ID NO: 467481 - DNA, 25 bp, Mus musculus
gagaactgaggttattgcactgcca

SEQ ID NO: 467482 - DNA, 25 bp, Mus musculus
gagaactgagtaacttcctgcacat

SEQ ID NO: 467483 - DNA, 25 bp, Mus musculus
gagaactgagtatcttcctgcacat

SEQ ID NO: 467484 - DNA, 25 bp, Mus musculus
gagaactgagtgaggttgcccgccc

SEQ ID NO: 467485 - DNA, 25 bp, Mus musculus
gagaactgagtgtggttgcccgccc

SEQ ID NO: 467486 - DNA, 25 bp, Mus musculus
gagaactgataacccaacatattag

SEQ ID NO: 467487 - DNA, 25 bp, Mus musculus
gagaactgataacggtcagccagtc

SEQ ID NO: 467488 - DNA, 25 bp, Mus musculus
gagaactgataagccaacatattag

SEQ ID NO: 467489 - DNA, 25 bp, Mus musculus
gagaactgataagggtcagccagtc

SEQ ID NO: 467490 - DNA, 25 bp, Mus musculus
gagaactgatcccacaacttgtcct

SEQ ID NO: 467491 - DNA, 25 bp, Mus musculus
gagaactgatcccagtctggttctg

SEQ ID NO: 467492 - DNA, 25 bp, Mus musculus
gagaactgatccgacaacttgtcct

SEQ ID NO: 467493 - DNA, 25 bp, Mus musculus
gagaactgatccgagtctggttctg

SEQ ID NO: 467494 - DNA, 25 bp, Mus musculus
gagaactgcatcacattttgacctg

SEQ ID NO: 467495 - DNA, 25 bp, Mus musculus
gagaactgcatctcattttgacctg

SEQ ID NO: 467496 - DNA, 25 bp, Mus musculus
gagaactgcctaaagcgtattttat

SEQ ID NO: 467497 - DNA, 25 bp, Mus musculus
gagaactgcctatagcgtattttat

SEQ ID NO: 467498 - DNA, 25 bp, Mus musculus
gagaactgcctcatgtttgaaacca

SEQ ID NO: 467499 - DNA, 25 bp, Mus musculus
gagaactgcctcttgtttgaaacca

SEQ ID NO: 467500 - DNA, 25 bp, Mus musculus
gagaactgcgcgctttatcacttgt

SEQ ID NO: 467501 - DNA, 25 bp, Mus musculus
gagaactgcgcggtttatcacttgt

SEQ ID NO: 467502 - DNA, 25 bp, Mus musculus
gagaactgctcactttcaaaactgg

SEQ ID NO: 467503 - DNA, 25 bp, Mus musculus
gagaactgctcagtttcaaaactgg

SEQ ID NO: 467504 - DNA, 25 bp, Mus musculus
gagaactgctctactcagagctcat

SEQ ID NO: 467505 - DNA, 25 bp, Mus musculus
gagaactgctcttctcagagctcat

SEQ ID NO: 467506 - DNA, 25 bp, Mus musculus
gagaactggaggacccacagacttc

SEQ ID NO: 467507 - DNA, 25 bp, Mus musculus
gagaactggaggtcccacagacttc

SEQ ID NO: 467508 - DNA, 25 bp, Mus musculus
gagaactggcaaacaaagagcggaa

SEQ ID NO: 467509 - DNA, 25 bp, Mus musculus
gagaactggcaatcaaagagcggaa

SEQ ID NO: 467510 - DNA, 25 bp, Mus musculus
gagaactggcagctataccgtttgc

SEQ ID NO: 467511 - DNA, 25 bp, Mus musculus
gagaactggcagctttattcccaac

SEQ ID NO: 467512 - DNA, 25 bp, Mus musculus
gagaactggcaggtataccgtttgc

SEQ ID NO: 467513 - DNA, 25 bp, Mus musculus
gagaactggcaggtttattcccaac

SEQ ID NO: 467514 - DNA, 25 bp, Mus musculus
gagaactggccaagctacgaagaca

SEQ ID NO: 467515 - DNA, 25 bp, Mus musculus
gagaactggccatgctacgaagaca

SEQ ID NO: 467516 - DNA, 25 bp, Mus musculus
gagaactgggcccaggtccgctcat

SEQ ID NO: 467517 - DNA, 25 bp, Mus musculus
gagaactgggccgaggtccgctcat

SEQ ID NO: 467518 - DNA, 25 bp, Mus musculus
gagaactgggctcggtgtcctacat

SEQ ID NO: 467519 - DNA, 25 bp, Mus musculus
gagaactgggctgggtgtcctacat

SEQ ID NO: 467520 - DNA, 25 bp, Mus musculus
gagaactggtctattagtggaccaa

SEQ ID NO: 467521 - DNA, 25 bp, Mus musculus
gagaactggtcttttagtggaccaa

SEQ ID NO: 467522 - DNA, 25 bp, Mus musculus
gagaactgtaaaaccgtgtaccaag

SEQ ID NO: 467523 - DNA, 25 bp, Mus musculus
gagaactgtaaatccgtgtaccaag

SEQ ID NO: 467524 - DNA, 25 bp, Mus musculus
gagaactgtaacactaatccctgta

SEQ ID NO: 467525 - DNA, 25 bp, Mus musculus
gagaactgtaactctaatccctgta

SEQ ID NO: 467526 - DNA, 25 bp, Mus musculus
gagaactgtactcaggtaagcatat

SEQ ID NO: 467527 - DNA, 25 bp, Mus musculus
gagaactgtactgaggtaagcatat

SEQ ID NO: 467528 - DNA, 25 bp, Mus musculus
gagaactgtcacaaaccgttgtctt

SEQ ID NO: 467529 - DNA, 25 bp, Mus musculus
gagaactgtcactaaccgttgtctt

SEQ ID NO: 467530 - DNA, 25 bp, Mus musculus
gagaactgtcatcgtaggctttttt

SEQ ID NO: 467531 - DNA, 25 bp, Mus musculus
gagaactgtcatggtaggctttttt

SEQ ID NO: 467532 - DNA, 25 bp, Mus musculus
gagaactgtcccattggataacaga

SEQ ID NO: 467533 - DNA, 25 bp, Mus musculus
gagaactgtccctttggataacaga

SEQ ID NO: 467534 - DNA, 25 bp, Mus musculus
gagaactgtcctagttcatctactg

SEQ ID NO: 467535 - DNA, 25 bp, Mus musculus
gagaactgtcctcgaatcctgttaa

SEQ ID NO: 467536 - DNA, 25 bp, Mus musculus
gagaactgtcctggaatcctgttaa

SEQ ID NO: 467537 - DNA, 25 bp, Mus musculus
gagaactgtccttgttcatctactg

SEQ ID NO: 467538 - DNA, 25 bp, Mus musculus
gagaactgtctcaacaaacccacac

SEQ ID NO: 467539 - DNA, 25 bp, Mus musculus
gagaactgtctctacaaacccacac

SEQ ID NO: 467540 - DNA, 25 bp, Mus musculus
gagaactgtgataaactagtccaat

SEQ ID NO: 467541 - DNA, 25 bp, Mus musculus
gagaactgtgattaactagtccaat

SEQ ID NO: 467542 - DNA, 25 bp, Mus musculus
gagaactgtgctcctggcatatacg

SEQ ID NO: 467543 - DNA, 25 bp, Mus musculus
gagaactgtgctgctggcatatacg

SEQ ID NO: 467544 - DNA, 25 bp, Mus musculus
gagaactgtgggacgcctaggcttt

SEQ ID NO: 467545 - DNA, 25 bp, Mus musculus
gagaactgtgggtcgcctaggcttt

SEQ ID NO: 467546 - DNA, 25 bp, Mus musculus
gagaactgtgtaaacaccccgctgt

SEQ ID NO: 467547 - DNA, 25 bp, Mus musculus
gagaactgtgtaacaacttttaaac

SEQ ID NO: 467548 - DNA, 25 bp, Mus musculus
gagaactgtgtatacaccccgctgt

SEQ ID NO: 467549 - DNA, 25 bp, Mus musculus
gagaactgtgtatcaacttttaaac

SEQ ID NO: 467550 - DNA, 25 bp, Mus musculus
gagaactgtgttcactttgctagct

SEQ ID NO: 467551 - DNA, 25 bp, Mus musculus
gagaactgtgttgactttgctagct

SEQ ID NO: 467552 - DNA, 25 bp, Mus musculus
gagaactgttacaccctgagaacca

SEQ ID NO: 467553 - DNA, 25 bp, Mus musculus
gagaactgttactccctgagaacca

SEQ ID NO: 467554 - DNA, 25 bp, Mus musculus
gagaacttaatcagctctagccagg

SEQ ID NO: 467555 - DNA, 25 bp, Mus musculus
gagaacttaatctgctctagccagg

SEQ ID NO: 467556 - DNA, 25 bp, Mus musculus
gagaacttaccaattcctatggatt

SEQ ID NO: 467557 - DNA, 25 bp, Mus musculus
gagaacttaccatttcctatggatt

SEQ ID NO: 467558 - DNA, 25 bp, Mus musculus
gagaacttacccaatgaaacatccc

SEQ ID NO: 467559 - DNA, 25 bp, Mus musculus
gagaacttaccctatgaaacatccc

SEQ ID NO: 467560 - DNA, 25 bp, Mus musculus
gagaacttagatccaagggcacttt

SEQ ID NO: 467561 - DNA, 25 bp, Mus musculus
gagaacttagatcttccagggaact

SEQ ID NO: 467562 - DNA, 25 bp, Mus musculus
gagaacttagatgcaagggcacttt

SEQ ID NO: 467563 - DNA, 25 bp, Mus musculus
gagaacttagatgttccagggaact

SEQ ID NO: 467564 - DNA, 25 bp, Mus musculus
gagaacttagcacgactcagtcact

SEQ ID NO: 467565 - DNA, 25 bp, Mus musculus
gagaacttagcaggactcagtcact

SEQ ID NO: 467566 - DNA, 25 bp, Mus musculus
gagaacttagtgaagtgtcacacag

SEQ ID NO: 467567 - DNA, 25 bp, Mus musculus
gagaacttagtgtagtgtcacacag

SEQ ID NO: 467568 - DNA, 25 bp, Mus musculus
gagaacttattcctgcaaactggtc

SEQ ID NO: 467569 - DNA, 25 bp, Mus musculus
gagaacttattcgtgcaaactggtc

SEQ ID NO: 467570 - DNA, 25 bp, Mus musculus
gagaacttcaagcagcattacattg

SEQ ID NO: 467571 - DNA, 25 bp, Mus musculus
gagaacttcaaggagcattacattg

SEQ ID NO: 467572 - DNA, 25 bp, Mus musculus
gagaacttcaatacttagtcttgta

SEQ ID NO: 467573 - DNA, 25 bp, Mus musculus
gagaacttcaattcttagtcttgta

SEQ ID NO: 467574 - DNA, 25 bp, Mus musculus
gagaacttcaccatcaggaacctct

SEQ ID NO: 467575 - DNA, 25 bp, Mus musculus
gagaacttcaccatcgtctccttca

SEQ ID NO: 467576 - DNA, 25 bp, Mus musculus
gagaacttcaccttcaggaacctct

SEQ ID NO: 467577 - DNA, 25 bp, Mus musculus
gagaacttcaccttcgtctccttca

SEQ ID NO: 467578 - DNA, 25 bp, Mus musculus
gagaacttcagacgtcaggcagctt

SEQ ID NO: 467579 - DNA, 25 bp, Mus musculus
gagaacttcagaggtcaggcagctt

SEQ ID NO: 467580 - DNA, 25 bp, Mus musculus
gagaacttcaggcacttgttacaga

SEQ ID NO: 467581 - DNA, 25 bp, Mus musculus
gagaacttcagggacttgttacaga

SEQ ID NO: 467582 - DNA, 25 bp, Mus musculus
gagaacttcagtagcccaggctggg

SEQ ID NO: 467583 - DNA, 25 bp, Mus musculus
gagaacttcagttgcccaggctggg

SEQ ID NO: 467584 - DNA, 25 bp, Mus musculus
gagaacttccagctgcagctcgcgc

SEQ ID NO: 467585 - DNA, 25 bp, Mus musculus
gagaacttccaggtgcagctcgcgc

SEQ ID NO: 467586 - DNA, 25 bp, Mus musculus
gagaacttccatatgggtagcgtgt

SEQ ID NO: 467587 - DNA, 25 bp, Mus musculus
gagaacttccatttgggtagcgtgt

SEQ ID NO: 467588 - DNA, 25 bp, Mus musculus
gagaacttcctaattgtgtcacatt

SEQ ID NO: 467589 - DNA, 25 bp, Mus musculus
gagaacttcctatttgtgtcacatt

SEQ ID NO: 467590 - DNA, 25 bp, Mus musculus
gagaacttcctgagtaccatggaga

SEQ ID NO: 467591 - DNA, 25 bp, Mus musculus
gagaacttcctgagtggtttgcaca

SEQ ID NO: 467592 - DNA, 25 bp, Mus musculus
gagaacttcctgattatcacctatg

SEQ ID NO: 467593 - DNA, 25 bp, Mus musculus
gagaacttcctgtgtaccatggaga

SEQ ID NO: 467594 - DNA, 25 bp, Mus musculus
gagaacttcctgtgtggtttgcaca

SEQ ID NO: 467595 - DNA, 25 bp, Mus musculus
gagaacttcctgtttatcacctatg

SEQ ID NO: 467596 - DNA, 25 bp, Mus musculus
gagaacttccttcggctcttcatta

SEQ ID NO: 467597 - DNA, 25 bp, Mus musculus
gagaacttccttgggctcttcatta

SEQ ID NO: 467598 - DNA, 25 bp, Mus musculus
gagaacttcgtgaatgccatgtcag

SEQ ID NO: 467599 - DNA, 25 bp, Mus musculus
gagaacttcgtgtatgccatgtcag

SEQ ID NO: 467600 - DNA, 25 bp, Mus musculus
gagaacttctacatgctcttggtaa

SEQ ID NO: 467601 - DNA, 25 bp, Mus musculus
gagaacttctacattggttccctga

SEQ ID NO: 467602 - DNA, 25 bp, Mus musculus
gagaacttctacttgctcttggtaa

SEQ ID NO: 467603 - DNA, 25 bp, Mus musculus
gagaacttctactttggttccctga

SEQ ID NO: 467604 - DNA, 25 bp, Mus musculus
gagaacttctcaaatcaacgaaatc

SEQ ID NO: 467605 - DNA, 25 bp, Mus musculus
gagaacttctcatatcaacgaaatc

SEQ ID NO: 467606 - DNA, 25 bp, Mus musculus
gagaacttctccaccatcttcaaca

SEQ ID NO: 467607 - DNA, 25 bp, Mus musculus
gagaacttctcctccatcttcaaca

SEQ ID NO: 467608 - DNA, 25 bp, Mus musculus
gagaacttcttcagctatgttacaa

SEQ ID NO: 467609 - DNA, 25 bp, Mus musculus
gagaacttcttcagggtaggcattg

SEQ ID NO: 467610 - DNA, 25 bp, Mus musculus
gagaacttcttctgctatgttacaa

SEQ ID NO: 467611 - DNA, 25 bp, Mus musculus
gagaacttcttctgggtaggcattg

SEQ ID NO: 467612 - DNA, 25 bp, Mus musculus
gagaacttgagtattcattgtggtt

SEQ ID NO: 467613 - DNA, 25 bp, Mus musculus
gagaacttgagttttcattgtggtt

SEQ ID NO: 467614 - DNA, 25 bp, Mus musculus
gagaacttggaaagtttgaaccaca

SEQ ID NO: 467615 - DNA, 25 bp, Mus musculus
gagaacttggaaccactagagttta

SEQ ID NO: 467616 - DNA, 25 bp, Mus musculus
gagaacttggaagcactagagttta

SEQ ID NO: 467617 - DNA, 25 bp, Mus musculus
gagaacttggaatgtttgaaccaca

SEQ ID NO: 467618 - DNA, 25 bp, Mus musculus
gagaacttggagaaggccaatcaca

SEQ ID NO: 467619 - DNA, 25 bp, Mus musculus
gagaacttggagtaggccaatcaca

SEQ ID NO: 467620 - DNA, 25 bp, Mus musculus
gagaacttgggcaactaacacacaa

SEQ ID NO: 467621 - DNA, 25 bp, Mus musculus
gagaacttgggcactgtcatagatg

SEQ ID NO: 467622 - DNA, 25 bp, Mus musculus
gagaacttgggctactaacacacaa

SEQ ID NO: 467623 - DNA, 25 bp, Mus musculus
gagaacttgggctctgtcatagatg

SEQ ID NO: 467624 - DNA, 25 bp, Mus musculus
gagaacttgttaccatttgtgggat

SEQ ID NO: 467625 - DNA, 25 bp, Mus musculus
gagaacttgttagcatttgtgggat

SEQ ID NO: 467626 - DNA, 25 bp, Mus musculus
gagaacttgttcctgcaagttgtcc

SEQ ID NO: 467627 - DNA, 25 bp, Mus musculus
gagaacttgttcgtgcaagttgtcc

SEQ ID NO: 467628 - DNA, 25 bp, Mus musculus
gagaactttacaaccacatccacag

SEQ ID NO: 467629 - DNA, 25 bp, Mus musculus
gagaactttacatccacatccacag

SEQ ID NO: 467630 - DNA, 25 bp, Mus musculus
gagaactttaggatgacaacccctc

SEQ ID NO: 467631 - DNA, 25 bp, Mus musculus
gagaactttaggttgacaacccctc

SEQ ID NO: 467632 - DNA, 25 bp, Mus musculus
gagaactttatccttctctggttca

SEQ ID NO: 467633 - DNA, 25 bp, Mus musculus
gagaactttatcgttctctggttca

SEQ ID NO: 467634 - DNA, 25 bp, Mus musculus
gagaactttcacacactcagcaagt

SEQ ID NO: 467635 - DNA, 25 bp, Mus musculus
gagaactttcactcactcagcaagt

SEQ ID NO: 467636 - DNA, 25 bp, Mus musculus
gagaactttggaatgacctcaagac

SEQ ID NO: 467637 - DNA, 25 bp, Mus musculus
gagaactttggattgacctcaagac

SEQ ID NO: 467638 - DNA, 25 bp, Mus musculus
gagaacttttgtccaattccaaatg

SEQ ID NO: 467639 - DNA, 25 bp, Mus musculus
gagaacttttgtgcaattccaaatg

SEQ ID NO: 467640 - DNA, 25 bp, Mus musculus
gagaactttttgacataactgaact

SEQ ID NO: 467641 - DNA, 25 bp, Mus musculus
gagaactttttgtcataactgaact

SEQ ID NO: 467642 - DNA, 25 bp, Mus musculus
gagaagaaaatgagccatcccctgc

SEQ ID NO: 467643 - DNA, 25 bp, Mus musculus
gagaagaaaatgtgccatcccctgc

SEQ ID NO: 467644 - DNA, 25 bp, Mus musculus
gagaagaaacaactgggtaccaaag

SEQ ID NO: 467645 - DNA, 25 bp, Mus musculus
gagaagaaacaagtgggtaccaaag

SEQ ID NO: 467646 - DNA, 25 bp, Mus musculus
gagaagaaaccgctgcaggagcccc

SEQ ID NO: 467647 - DNA, 25 bp, Mus musculus
gagaagaaaccggtgcaggagcccc

SEQ ID NO: 467648 - DNA, 25 bp, Mus musculus
gagaagaaaggtcctggcactccct

SEQ ID NO: 467649 - DNA, 25 bp, Mus musculus
gagaagaaaggtgctggcactccct

SEQ ID NO: 467650 - DNA, 25 bp, Mus musculus
gagaagaaatgactgcctccgcctt

SEQ ID NO: 467651 - DNA, 25 bp, Mus musculus
gagaagaaatgagtgcctccgcctt

SEQ ID NO: 467652 - DNA, 25 bp, Mus musculus
gagaagaaatgtatccatgccagca

SEQ ID NO: 467653 - DNA, 25 bp, Mus musculus
gagaagaaatgtttccatgccagca

SEQ ID NO: 467654 - DNA, 25 bp, Mus musculus
gagaagaaattccaccaaacattaa

SEQ ID NO: 467655 - DNA, 25 bp, Mus musculus
gagaagaaattcgaccaaacattaa

SEQ ID NO: 467656 - DNA, 25 bp, Mus musculus
gagaagaacaccctgccgaccaaag

SEQ ID NO: 467657 - DNA, 25 bp, Mus musculus
gagaagaacaccgtgccgaccaaag

SEQ ID NO: 467658 - DNA, 25 bp, Mus musculus
gagaagaacacgacaggccagggct

SEQ ID NO: 467659 - DNA, 25 bp, Mus musculus
gagaagaacacgtcaggccagggct

SEQ ID NO: 467660 - DNA, 25 bp, Mus musculus
gagaagaacagcaactcctcgggct

SEQ ID NO: 467661 - DNA, 25 bp, Mus musculus
gagaagaacagctactcctcgggct

SEQ ID NO: 467662 - DNA, 25 bp, Mus musculus
gagaagaaccacattcctgtcaccg

SEQ ID NO: 467663 - DNA, 25 bp, Mus musculus
gagaagaaccactttcctgtcaccg

SEQ ID NO: 467664 - DNA, 25 bp, Mus musculus
gagaagaacccgcaagaactgacgg

SEQ ID NO: 467665 - DNA, 25 bp, Mus musculus
gagaagaacccggaagaactgacgg

SEQ ID NO: 467666 - DNA, 25 bp, Mus musculus
gagaagaacctcagcgatctgatcg

SEQ ID NO: 467667 - DNA, 25 bp, Mus musculus
gagaagaacctctgcgatctgatcg

SEQ ID NO: 467668 - DNA, 25 bp, Mus musculus
gagaagaaccttcctatccatagtt

SEQ ID NO: 467669 - DNA, 25 bp, Mus musculus
gagaagaaccttgctatccatagtt

SEQ ID NO: 467670 - DNA, 25 bp, Mus musculus
gagaagaacgttatcccactcgagc

SEQ ID NO: 467671 - DNA, 25 bp, Mus musculus
gagaagaacgttttcccactcgagc

SEQ ID NO: 467672 - DNA, 25 bp, Mus musculus
gagaagaactccaagagctgcccct

SEQ ID NO: 467673 - DNA, 25 bp, Mus musculus
gagaagaactcctagagctgcccct

SEQ ID NO: 467674 - DNA, 25 bp, Mus musculus
gagaagaagagcaacggataccatc

SEQ ID NO: 467675 - DNA, 25 bp, Mus musculus
gagaagaagagctacggataccatc

SEQ ID NO: 467676 - DNA, 25 bp, Mus musculus
gagaagaagcacaatcctcctttcc

SEQ ID NO: 467677 - DNA, 25 bp, Mus musculus
gagaagaagcactatcctcctttcc

SEQ ID NO: 467678 - DNA, 25 bp, Mus musculus
gagaagaagcagcaccggcactcag

SEQ ID NO: 467679 - DNA, 25 bp, Mus musculus
gagaagaagcaggaccggcactcag

SEQ ID NO: 467680 - DNA, 25 bp, Mus musculus
gagaagaagcgcaccgtggtaccca

SEQ ID NO: 467681 - DNA, 25 bp, Mus musculus
gagaagaagcgctccgtggtaccca

SEQ ID NO: 467682 - DNA, 25 bp, Mus musculus
gagaagaaggagagcaccccgtcca

SEQ ID NO: 467683 - DNA, 25 bp, Mus musculus
gagaagaaggagtgcaccccgtcca

SEQ ID NO: 467684 - DNA, 25 bp, Mus musculus
gagaagaataaacgccccagtcccg

SEQ ID NO: 467685 - DNA, 25 bp, Mus musculus
gagaagaataaaggccccagtcccg

SEQ ID NO: 467686 - DNA, 25 bp, Mus musculus
gagaagaattgcactgtcacatttt

SEQ ID NO: 467687 - DNA, 25 bp, Mus musculus
gagaagaattgctctgtcacatttt

SEQ ID NO: 467688 - DNA, 25 bp, Mus musculus
gagaagaattgtaccccaaagctat

SEQ ID NO: 467689 - DNA, 25 bp, Mus musculus
gagaagaattgttccccaaagctat

SEQ ID NO: 467690 - DNA, 25 bp, Mus musculus
gagaagaattttcgatgcccaggct

SEQ ID NO: 467691 - DNA, 25 bp, Mus musculus
gagaagaattttggatgcccaggct

SEQ ID NO: 467692 - DNA, 25 bp, Mus musculus
gagaagacacaaacccgcagaccag

SEQ ID NO: 467693 - DNA, 25 bp, Mus musculus
gagaagacacaatcccgcagaccag

SEQ ID NO: 467694 - DNA, 25 bp, Mus musculus
gagaagacacaccagcagctgacac

SEQ ID NO: 467695 - DNA, 25 bp, Mus musculus
gagaagacacacgagcagctgacac

SEQ ID NO: 467696 - DNA, 25 bp, Mus musculus
gagaagacacccaagttgtttagaa

SEQ ID NO: 467697 - DNA, 25 bp, Mus musculus
gagaagacaccctagttgtttagaa

SEQ ID NO: 467698 - DNA, 25 bp, Mus musculus
gagaagacacctctcctttttattt

SEQ ID NO: 467699 - DNA, 25 bp, Mus musculus
gagaagacacctgtcctttttattt

SEQ ID NO: 467700 - DNA, 25 bp, Mus musculus
gagaagacactcagggactcttaac

SEQ ID NO: 467701 - DNA, 25 bp, Mus musculus
gagaagacactctgggactcttaac

SEQ ID NO: 467702 - DNA, 25 bp, Mus musculus
gagaagacactgcaggagaacgaag

SEQ ID NO: 467703 - DNA, 25 bp, Mus musculus
gagaagacactggaggagaacgaag

SEQ ID NO: 467704 - DNA, 25 bp, Mus musculus
gagaagacaggcattcaacttagca

SEQ ID NO: 467705 - DNA, 25 bp, Mus musculus
gagaagacaggctttcaacttagca

SEQ ID NO: 467706 - DNA, 25 bp, Mus musculus
gagaagacagtcaaccacacaagta

SEQ ID NO: 467707 - DNA, 25 bp, Mus musculus
gagaagacagtctaccacacaagta

SEQ ID NO: 467708 - DNA, 25 bp, Mus musculus
gagaagaccaagatcccgttaaaca

SEQ ID NO: 467709 - DNA, 25 bp, Mus musculus
gagaagaccaagttcccgttaaaca

SEQ ID NO: 467710 - DNA, 25 bp, Mus musculus
gagaagaccactataataccattta

SEQ ID NO: 467711 - DNA, 25 bp, Mus musculus
gagaagaccactttaataccattta

SEQ ID NO: 467712 - DNA, 25 bp, Mus musculus
gagaagaccataaacttttgaattg

SEQ ID NO: 467713 - DNA, 25 bp, Mus musculus
gagaagaccatatacttttgaattg

SEQ ID NO: 467714 - DNA, 25 bp, Mus musculus
gagaagaccggacagcacagccgat

SEQ ID NO: 467715 - DNA, 25 bp, Mus musculus
gagaagaccggagagcacagccgat

SEQ ID NO: 467716 - DNA, 25 bp, Mus musculus
gagaagacctatctacctagtactt

SEQ ID NO: 467717 - DNA, 25 bp, Mus musculus
gagaagacctatgtacctagtactt

SEQ ID NO: 467718 - DNA, 25 bp, Mus musculus
gagaagacggcaatcctctcatgca

SEQ ID NO: 467719 - DNA, 25 bp, Mus musculus
gagaagacggcattcctctcatgca

SEQ ID NO: 467720 - DNA, 25 bp, Mus musculus
gagaagacgtacacctgtaagttgt

SEQ ID NO: 467721 - DNA, 25 bp, Mus musculus
gagaagacgtacctctacctgtgtt

SEQ ID NO: 467722 - DNA, 25 bp, Mus musculus
gagaagacgtacgtctacctgtgtt

SEQ ID NO: 467723 - DNA, 25 bp, Mus musculus
gagaagacgtactcctgtaagttgt

SEQ ID NO: 467724 - DNA, 25 bp, Mus musculus
gagaagactactaggtagcacttgg

SEQ ID NO: 467725 - DNA, 25 bp, Mus musculus
gagaagactacttggtagcacttgg

SEQ ID NO: 467726 - DNA, 25 bp, Mus musculus
gagaagactagaaggctgccagcca

SEQ ID NO: 467727 - DNA, 25 bp, Mus musculus
gagaagactagatggctgccagcca

SEQ ID NO: 467728 - DNA, 25 bp, Mus musculus
gagaagactatgatgagtccccgaa

SEQ ID NO: 467729 - DNA, 25 bp, Mus musculus
gagaagactatgttgagtccccgaa

SEQ ID NO: 467730 - DNA, 25 bp, Mus musculus
gagaagactcggatgaagctcagat

SEQ ID NO: 467731 - DNA, 25 bp, Mus musculus
gagaagactcggttgaagctcagat

SEQ ID NO: 467732 - DNA, 25 bp, Mus musculus
gagaagactctgagcagcttcacaa

SEQ ID NO: 467733 - DNA, 25 bp, Mus musculus
gagaagactctgtgcagcttcacaa

SEQ ID NO: 467734 - DNA, 25 bp, Mus musculus
gagaagactgaccacccagatcagg

SEQ ID NO: 467735 - DNA, 25 bp, Mus musculus
gagaagactgacgacccagatcagg

SEQ ID NO: 467736 - DNA, 25 bp, Mus musculus
gagaagactgtaccttcagtagcta

SEQ ID NO: 467737 - DNA, 25 bp, Mus musculus
gagaagactgtagcttcagtagcta

SEQ ID NO: 467738 - DNA, 25 bp, Mus musculus
gagaagactgttcggcttgagcctt

SEQ ID NO: 467739 - DNA, 25 bp, Mus musculus
gagaagactgttgggcttgagcctt

SEQ ID NO: 467740 - DNA, 25 bp, Mus musculus
gagaagacttgtcaccgggtccctc

SEQ ID NO: 467741 - DNA, 25 bp, Mus musculus
gagaagacttgtgaccgggtccctc

SEQ ID NO: 467742 - DNA, 25 bp, Mus musculus
gagaagagaaatccctcacactcaa

SEQ ID NO: 467743 - DNA, 25 bp, Mus musculus
gagaagagaaatgcctcacactcaa

SEQ ID NO: 467744 - DNA, 25 bp, Mus musculus
gagaagagactcaggaaaactttcc

SEQ ID NO: 467745 - DNA, 25 bp, Mus musculus
gagaagagactctggaaaactttcc

SEQ ID NO: 467746 - DNA, 25 bp, Mus musculus
gagaagagagtcaaccccagtgccc

SEQ ID NO: 467747 - DNA, 25 bp, Mus musculus
gagaagagagtctaccccagtgccc

SEQ ID NO: 467748 - DNA, 25 bp, Mus musculus
gagaagagagttaccaatcctataa

SEQ ID NO: 467749 - DNA, 25 bp, Mus musculus
gagaagagagtttccaatcctataa

SEQ ID NO: 467750 - DNA, 25 bp, Mus musculus
gagaagagcacaacagcccaggtgg

SEQ ID NO: 467751 - DNA, 25 bp, Mus musculus
gagaagagcacatcagcccaggtgg

SEQ ID NO: 467752 - DNA, 25 bp, Mus musculus
gagaagagccctccgctgaaatcta

SEQ ID NO: 467753 - DNA, 25 bp, Mus musculus
gagaagagccctgcgctgaaatcta

SEQ ID NO: 467754 - DNA, 25 bp, Mus musculus
gagaagagcctcctgcctgaaccac

SEQ ID NO: 467755 - DNA, 25 bp, Mus musculus
gagaagagcctcgtgcctgaaccac

SEQ ID NO: 467756 - DNA, 25 bp, Mus musculus
gagaagagcggtaggctcctaacct

SEQ ID NO: 467757 - DNA, 25 bp, Mus musculus
gagaagagcggttggctcctaacct

SEQ ID NO: 467758 - DNA, 25 bp, Mus musculus
gagaagaggaccactctggtgctgt

SEQ ID NO: 467759 - DNA, 25 bp, Mus musculus
gagaagaggacctctctggtgctgt

SEQ ID NO: 467760 - DNA, 25 bp, Mus musculus
gagaagaggccacatcagcacccgg

SEQ ID NO: 467761 - DNA, 25 bp, Mus musculus
gagaagaggccagatcagcacccgg

SEQ ID NO: 467762 - DNA, 25 bp, Mus musculus
gagaagaggctcaaaggctctacaa

SEQ ID NO: 467763 - DNA, 25 bp, Mus musculus
gagaagaggctctaaggctctacaa

SEQ ID NO: 467764 - DNA, 25 bp, Mus musculus
gagaagagggccatcatgggtcccc

SEQ ID NO: 467765 - DNA, 25 bp, Mus musculus
gagaagagggccttcatgggtcccc

SEQ ID NO: 467766 - DNA, 25 bp, Mus musculus
gagaagagtctcagtcagtcacaag

SEQ ID NO: 467767 - DNA, 25 bp, Mus musculus
gagaagagtctctgtcagtcacaag

SEQ ID NO: 467768 - DNA, 25 bp, Mus musculus
gagaagagtctgactcctgcagaat

SEQ ID NO: 467769 - DNA, 25 bp, Mus musculus
gagaagagtctgtctcctgcagaat

SEQ ID NO: 467770 - DNA, 25 bp, Mus musculus
gagaagagtcttccatgcctgacaa

SEQ ID NO: 467771 - DNA, 25 bp, Mus musculus
gagaagagtcttgcatgcctgacaa

SEQ ID NO: 467772 - DNA, 25 bp, Mus musculus
gagaagataaccctgagccttgtcc

SEQ ID NO: 467773 - DNA, 25 bp, Mus musculus
gagaagataaccgtgagccttgtcc

SEQ ID NO: 467774 - DNA, 25 bp, Mus musculus
gagaagatacagcacctgacgtcag

SEQ ID NO: 467775 - DNA, 25 bp, Mus musculus
gagaagatacaggacctgacgtcag

SEQ ID NO: 467776 - DNA, 25 bp, Mus musculus
gagaagatccagcagcaccgtgctt

SEQ ID NO: 467777 - DNA, 25 bp, Mus musculus
gagaagatccaggagcaccgtgctt

SEQ ID NO: 467778 - DNA, 25 bp, Mus musculus
gagaagatcggcacaggacccctgg

SEQ ID NO: 467779 - DNA, 25 bp, Mus musculus
gagaagatcggctcaggacccctgg

SEQ ID NO: 467780 - DNA, 25 bp, Mus musculus
gagaagatctacctgctcctccgtc

SEQ ID NO: 467781 - DNA, 25 bp, Mus musculus
gagaagatctacgtgctcctccgtc

SEQ ID NO: 467782 - DNA, 25 bp, Mus musculus
gagaagatctccacacaacaggtga

SEQ ID NO: 467783 - DNA, 25 bp, Mus musculus
gagaagatctcctcacaacaggtga

SEQ ID NO: 467784 - DNA, 25 bp, Mus musculus
gagaagatctgaccttccacatcag

SEQ ID NO: 467785 - DNA, 25 bp, Mus musculus
gagaagatctgagcttccacatcag

SEQ ID NO: 467786 - DNA, 25 bp, Mus musculus
gagaagatgaagacccctaccgacc

SEQ ID NO: 467787 - DNA, 25 bp, Mus musculus
gagaagatgaagtcccctaccgacc

SEQ ID NO: 467788 - DNA, 25 bp, Mus musculus
gagaagatgaatcaccacccggaat

SEQ ID NO: 467789 - DNA, 25 bp, Mus musculus
gagaagatgaatgaccacccggaat

SEQ ID NO: 467790 - DNA, 25 bp, Mus musculus
gagaagatgaccctcctccagaact

SEQ ID NO: 467791 - DNA, 25 bp, Mus musculus
gagaagatgaccgtcctccagaact

SEQ ID NO: 467792 - DNA, 25 bp, Mus musculus
gagaagatgacgagcttggcgccat

SEQ ID NO: 467793 - DNA, 25 bp, Mus musculus
gagaagatgacgtgcttggcgccat

SEQ ID NO: 467794 - DNA, 25 bp, Mus musculus
gagaagatgcctcttaatttataat

SEQ ID NO: 467795 - DNA, 25 bp, Mus musculus
gagaagatgcctgttaatttataat

SEQ ID NO: 467796 - DNA, 25 bp, Mus musculus
gagaagatggctaaccagtccaagg

SEQ ID NO: 467797 - DNA, 25 bp, Mus musculus
gagaagatggcttaccagtccaagg

SEQ ID NO: 467798 - DNA, 25 bp, Mus musculus
gagaagatgttcactagagttgctt

SEQ ID NO: 467799 - DNA, 25 bp, Mus musculus
gagaagatgttctctagagttgctt

SEQ ID NO: 467800 - DNA, 25 bp, Mus musculus
gagaagattagtatggcccctgcat

SEQ ID NO: 467801 - DNA, 25 bp, Mus musculus
gagaagattagtttggcccctgcat

SEQ ID NO: 467802 - DNA, 25 bp, Mus musculus
gagaagattctcagcacataaatgc

SEQ ID NO: 467803 - DNA, 25 bp, Mus musculus
gagaagattctctgcacataaatgc

SEQ ID NO: 467804 - DNA, 25 bp, Mus musculus
gagaagatttaaatcagattctttt

SEQ ID NO: 467805 - DNA, 25 bp, Mus musculus
gagaagatttaattcagattctttt

SEQ ID NO: 467806 - DNA, 25 bp, Mus musculus
gagaagatttttcaacgaactagat

SEQ ID NO: 467807 - DNA, 25 bp, Mus musculus
gagaagatttttgaacgaactagat

SEQ ID NO: 467808 - DNA, 25 bp, Mus musculus
gagaagcaaaacatttaatccaggt

SEQ ID NO: 467809 - DNA, 25 bp, Mus musculus
gagaagcaaaacttttaatccaggt

SEQ ID NO: 467810 - DNA, 25 bp, Mus musculus
gagaagcaactcaagcgccgttttg

SEQ ID NO: 467811 - DNA, 25 bp, Mus musculus
gagaagcaactctagcgccgttttg

SEQ ID NO: 467812 - DNA, 25 bp, Mus musculus
gagaagcaagctcgcgaatcgtaat

SEQ ID NO: 467813 - DNA, 25 bp, Mus musculus
gagaagcaagctggcgaatcgtaat

SEQ ID NO: 467814 - DNA, 25 bp, Mus musculus
gagaagcaagtgattatcactgctg

SEQ ID NO: 467815 - DNA, 25 bp, Mus musculus
gagaagcaagtgtttatcactgctg

SEQ ID NO: 467816 - DNA, 25 bp, Mus musculus
gagaagcaagttaagccccgggcct

SEQ ID NO: 467817 - DNA, 25 bp, Mus musculus
gagaagcaagtttagccccgggcct

SEQ ID NO: 467818 - DNA, 25 bp, Mus musculus
gagaagcaatcgaactcgctctggc

SEQ ID NO: 467819 - DNA, 25 bp, Mus musculus
gagaagcaatcgtactcgctctggc

SEQ ID NO: 467820 - DNA, 25 bp, Mus musculus
gagaagcaatctctttccttacctg

SEQ ID NO: 467821 - DNA, 25 bp, Mus musculus
gagaagcaatctgtttccttacctg

SEQ ID NO: 467822 - DNA, 25 bp, Mus musculus
gagaagcaattccttttccctagaa

SEQ ID NO: 467823 - DNA, 25 bp, Mus musculus
gagaagcaattcgttttccctagaa

SEQ ID NO: 467824 - DNA, 25 bp, Mus musculus
gagaagcaccaaagacctaaaattt

SEQ ID NO: 467825 - DNA, 25 bp, Mus musculus
gagaagcaccaatgacctaaaattt

SEQ ID NO: 467826 - DNA, 25 bp, Mus musculus
gagaagcaccagctatggctactca

SEQ ID NO: 467827 - DNA, 25 bp, Mus musculus
gagaagcaccaggtatggctactca

SEQ ID NO: 467828 - DNA, 25 bp, Mus musculus
gagaagcacctaaccgttccagaaa

SEQ ID NO: 467829 - DNA, 25 bp, Mus musculus
gagaagcacctatccgttccagaaa

SEQ ID NO: 467830 - DNA, 25 bp, Mus musculus
gagaagcactcaattgacatttgta

SEQ ID NO: 467831 - DNA, 25 bp, Mus musculus
gagaagcactcatttgacatttgta

SEQ ID NO: 467832 - DNA, 25 bp, Mus musculus
gagaagcactgtattagtcctgtgt

SEQ ID NO: 467833 - DNA, 25 bp, Mus musculus
gagaagcactgttttagtcctgtgt

SEQ ID NO: 467834 - DNA, 25 bp, Mus musculus
gagaagcagaacacacaccaagttg

SEQ ID NO: 467835 - DNA, 25 bp, Mus musculus
gagaagcagaaccacgaggcccaca

SEQ ID NO: 467836 - DNA, 25 bp, Mus musculus
gagaagcagaacgacgaggcccaca

SEQ ID NO: 467837 - DNA, 25 bp, Mus musculus
gagaagcagaactcacaccaagttg

SEQ ID NO: 467838 - DNA, 25 bp, Mus musculus
gagaagcagaatcccctagatctag

SEQ ID NO: 467839 - DNA, 25 bp, Mus musculus
gagaagcagaatgccctagatctag

SEQ ID NO: 467840 - DNA, 25 bp, Mus musculus
gagaagcagcccaagatagcgcctg

SEQ ID NO: 467841 - DNA, 25 bp, Mus musculus
gagaagcagccctagatagcgcctg

SEQ ID NO: 467842 - DNA, 25 bp, Mus musculus
gagaagcagcttaaccaggacagtt

SEQ ID NO: 467843 - DNA, 25 bp, Mus musculus
gagaagcagcttaattccaacatct

SEQ ID NO: 467844 - DNA, 25 bp, Mus musculus
gagaagcagcttcaggctgaacgta

SEQ ID NO: 467845 - DNA, 25 bp, Mus musculus
gagaagcagcttccacatcgtgtga

SEQ ID NO: 467846 - DNA, 25 bp, Mus musculus
gagaagcagcttgaggctgaacgta

SEQ ID NO: 467847 - DNA, 25 bp, Mus musculus
gagaagcagcttgcacatcgtgtga

SEQ ID NO: 467848 - DNA, 25 bp, Mus musculus
gagaagcagctttaccaggacagtt

SEQ ID NO: 467849 - DNA, 25 bp, Mus musculus
gagaagcagctttattccaacatct

SEQ ID NO: 467850 - DNA, 25 bp, Mus musculus
gagaagcaggatcccctggtgtctc

SEQ ID NO: 467851 - DNA, 25 bp, Mus musculus
gagaagcaggatgccctggtgtctc

SEQ ID NO: 467852 - DNA, 25 bp, Mus musculus
gagaagcaggctcctcttctgcagt

SEQ ID NO: 467853 - DNA, 25 bp, Mus musculus
gagaagcaggctgctcttctgcagt

SEQ ID NO: 467854 - DNA, 25 bp, Mus musculus
gagaagcaggtactcatgaggacaa

SEQ ID NO: 467855 - DNA, 25 bp, Mus musculus
gagaagcaggtagtcatgaggacaa

SEQ ID NO: 467856 - DNA, 25 bp, Mus musculus
gagaagcagtaacgtctttccagct

SEQ ID NO: 467857 - DNA, 25 bp, Mus musculus
gagaagcagtaaggtctttccagct

SEQ ID NO: 467858 - DNA, 25 bp, Mus musculus
gagaagcagtgacccctggagacac

SEQ ID NO: 467859 - DNA, 25 bp, Mus musculus
gagaagcagtgagccctggagacac

SEQ ID NO: 467860 - DNA, 25 bp, Mus musculus
gagaagcagtgcaaccttagccagc

SEQ ID NO: 467861 - DNA, 25 bp, Mus musculus
gagaagcagtgctaccttagccagc

SEQ ID NO: 467862 - DNA, 25 bp, Mus musculus
gagaagcagtttccagaaattcgaa

SEQ ID NO: 467863 - DNA, 25 bp, Mus musculus
gagaagcagtttgcagaaattcgaa

SEQ ID NO: 467864 - DNA, 25 bp, Mus musculus
gagaagcatcctccacagacaggta

SEQ ID NO: 467865 - DNA, 25 bp, Mus musculus
gagaagcatcctcgagagtcggact

SEQ ID NO: 467866 - DNA, 25 bp, Mus musculus
gagaagcatcctcttcagttctttg

SEQ ID NO: 467867 - DNA, 25 bp, Mus musculus
gagaagcatcctgcacagacaggta

SEQ ID NO: 467868 - DNA, 25 bp, Mus musculus
gagaagcatcctggagagtcggact

SEQ ID NO: 467869 - DNA, 25 bp, Mus musculus
gagaagcatcctgttcagttctttg

SEQ ID NO: 467870 - DNA, 25 bp, Mus musculus
gagaagcatctcattgtgctgaaac

SEQ ID NO: 467871 - DNA, 25 bp, Mus musculus
gagaagcatctctttgtgctgaaac

SEQ ID NO: 467872 - DNA, 25 bp, Mus musculus
gagaagcatgtgacaggcctgccac

SEQ ID NO: 467873 - DNA, 25 bp, Mus musculus
gagaagcatgtgtcaggcctgccac

SEQ ID NO: 467874 - DNA, 25 bp, Mus musculus
gagaagcattccctgtgtttgataa

SEQ ID NO: 467875 - DNA, 25 bp, Mus musculus
gagaagcattccgtgtgtttgataa

SEQ ID NO: 467876 - DNA, 25 bp, Mus musculus
gagaagccaacacctttcagttgtt

SEQ ID NO: 467877 - DNA, 25 bp, Mus musculus
gagaagccaacagctttcagttgtt

SEQ ID NO: 467878 - DNA, 25 bp, Mus musculus
gagaagccaattacactgtgtcgtc

SEQ ID NO: 467879 - DNA, 25 bp, Mus musculus
gagaagccaatttcactgtgtcgtc

SEQ ID NO: 467880 - DNA, 25 bp, Mus musculus
gagaagccacgaaatgcctgaaaac

SEQ ID NO: 467881 - DNA, 25 bp, Mus musculus
gagaagccacgatatgcctgaaaac

SEQ ID NO: 467882 - DNA, 25 bp, Mus musculus
gagaagccacgtctgcagacaagct

SEQ ID NO: 467883 - DNA, 25 bp, Mus musculus
gagaagccacgtgtgcagacaagct

SEQ ID NO: 467884 - DNA, 25 bp, Mus musculus
gagaagccactaaggagaccagcat

SEQ ID NO: 467885 - DNA, 25 bp, Mus musculus
gagaagccactatggagaccagcat

SEQ ID NO: 467886 - DNA, 25 bp, Mus musculus
gagaagccagagctcagctttctaa

SEQ ID NO: 467887 - DNA, 25 bp, Mus musculus
gagaagccagaggtcagctttctaa

SEQ ID NO: 467888 - DNA, 25 bp, Mus musculus
gagaagccagcacctactgatgtgg

SEQ ID NO: 467889 - DNA, 25 bp, Mus musculus
gagaagccagcagctactgatgtgg

SEQ ID NO: 467890 - DNA, 25 bp, Mus musculus
gagaagccagggaactccaactaag

SEQ ID NO: 467891 - DNA, 25 bp, Mus musculus
gagaagccagggtactccaactaag

SEQ ID NO: 467892 - DNA, 25 bp, Mus musculus
gagaagccatttctggtcacagcac

SEQ ID NO: 467893 - DNA, 25 bp, Mus musculus
gagaagccatttgtggtcacagcac

SEQ ID NO: 467894 - DNA, 25 bp, Mus musculus
gagaagcccagtcttgagaggcaat

SEQ ID NO: 467895 - DNA, 25 bp, Mus musculus
gagaagcccagtgttgagaggcaat

SEQ ID NO: 467896 - DNA, 25 bp, Mus musculus
gagaagccccatccagggcagcagt

SEQ ID NO: 467897 - DNA, 25 bp, Mus musculus
gagaagccccatgcagggcagcagt

SEQ ID NO: 467898 - DNA, 25 bp, Mus musculus
gagaagcccctactgaacacaaata

SEQ ID NO: 467899 - DNA, 25 bp, Mus musculus
gagaagcccctagtgaacacaaata

SEQ ID NO: 467900 - DNA, 25 bp, Mus musculus
gagaagcccgtcaaggaccaagaaa

SEQ ID NO: 467901 - DNA, 25 bp, Mus musculus
gagaagcccgtctaggaccaagaaa

SEQ ID NO: 467902 - DNA, 25 bp, Mus musculus
gagaagccctgtcaggagatcctcc

SEQ ID NO: 467903 - DNA, 25 bp, Mus musculus
gagaagccctgtgaggagatcctcc

SEQ ID NO: 467904 - DNA, 25 bp, Mus musculus
gagaagcccttcagcaaacactgtg

SEQ ID NO: 467905 - DNA, 25 bp, Mus musculus
gagaagcccttcaggcggacggtca

SEQ ID NO: 467906 - DNA, 25 bp, Mus musculus
gagaagcccttctgcaaacactgtg

SEQ ID NO: 467907 - DNA, 25 bp, Mus musculus
gagaagcccttctggcggacggtca

SEQ ID NO: 467908 - DNA, 25 bp, Mus musculus
gagaagcccttgctgcggttttttt

SEQ ID NO: 467909 - DNA, 25 bp, Mus musculus
gagaagcccttggtgcggttttttt

SEQ ID NO: 467910 - DNA, 25 bp, Mus musculus
gagaagccgataacaaacacgtgac

SEQ ID NO: 467911 - DNA, 25 bp, Mus musculus
gagaagccgatatcaaacacgtgac

SEQ ID NO: 467912 - DNA, 25 bp, Mus musculus
gagaagccggcgaagcgctctgctt

SEQ ID NO: 467913 - DNA, 25 bp, Mus musculus
gagaagccggcgtagcgctctgctt

SEQ ID NO: 467914 - DNA, 25 bp, Mus musculus
gagaagccgtgaccccgtaggaaca

SEQ ID NO: 467915 - DNA, 25 bp, Mus musculus
gagaagccgtgagcccgtaggaaca

SEQ ID NO: 467916 - DNA, 25 bp, Mus musculus
gagaagccgttcaaatgcgatgcct

SEQ ID NO: 467917 - DNA, 25 bp, Mus musculus
gagaagccgttctaatgcgatgcct

SEQ ID NO: 467918 - DNA, 25 bp, Mus musculus
gagaagcctaggagctctgcattcc

SEQ ID NO: 467919 - DNA, 25 bp, Mus musculus
gagaagcctaggattgatgaactaa

SEQ ID NO: 467920 - DNA, 25 bp, Mus musculus
gagaagcctaggtgctctgcattcc

SEQ ID NO: 467921 - DNA, 25 bp, Mus musculus
gagaagcctaggtttgatgaactaa

SEQ ID NO: 467922 - DNA, 25 bp, Mus musculus
gagaagcctagtagaactcccagcc

SEQ ID NO: 467923 - DNA, 25 bp, Mus musculus
gagaagcctagtcgaatcttctgtt

SEQ ID NO: 467924 - DNA, 25 bp, Mus musculus
gagaagcctagtggaatcttctgtt

SEQ ID NO: 467925 - DNA, 25 bp, Mus musculus
gagaagcctagttgaactcccagcc

SEQ ID NO: 467926 - DNA, 25 bp, Mus musculus
gagaagcctcaaacctgacaggaga

SEQ ID NO: 467927 - DNA, 25 bp, Mus musculus
gagaagcctcaatcctgacaggaga

SEQ ID NO: 467928 - DNA, 25 bp, Mus musculus
gagaagcctccaactccattttcag

SEQ ID NO: 467929 - DNA, 25 bp, Mus musculus
gagaagcctccatctccattttcag

SEQ ID NO: 467930 - DNA, 25 bp, Mus musculus
gagaagcctcctcttgtgatgaagc

SEQ ID NO: 467931 - DNA, 25 bp, Mus musculus
gagaagcctcctgttgtgatgaagc

SEQ ID NO: 467932 - DNA, 25 bp, Mus musculus
gagaagcctctacgccgcagccaga

SEQ ID NO: 467933 - DNA, 25 bp, Mus musculus
gagaagcctctaggccgcagccaga

SEQ ID NO: 467934 - DNA, 25 bp, Mus musculus
gagaagcctgtccttggctagagaa

SEQ ID NO: 467935 - DNA, 25 bp, Mus musculus
gagaagcctgtcgttggctagagaa

SEQ ID NO: 467936 - DNA, 25 bp, Mus musculus
gagaagccttagatcttggtgcgaa

SEQ ID NO: 467937 - DNA, 25 bp, Mus musculus
gagaagccttagttcttggtgcgaa

SEQ ID NO: 467938 - DNA, 25 bp, Mus musculus
gagaagccttggaggcaggtattta

SEQ ID NO: 467939 - DNA, 25 bp, Mus musculus
gagaagccttggtggcaggtattta

SEQ ID NO: 467940 - DNA, 25 bp, Mus musculus
gagaagccttgtcatagccctgcgt

SEQ ID NO: 467941 - DNA, 25 bp, Mus musculus
gagaagccttgtgatagccctgcgt

SEQ ID NO: 467942 - DNA, 25 bp, Mus musculus
gagaagcctttcagtatcattacca

SEQ ID NO: 467943 - DNA, 25 bp, Mus musculus
gagaagcctttctgtatcattacca

SEQ ID NO: 467944 - DNA, 25 bp, Mus musculus
gagaagcgacctacggtaaggaaat

SEQ ID NO: 467945 - DNA, 25 bp, Mus musculus
gagaagcgaccttcggtaaggaaat

SEQ ID NO: 467946 - DNA, 25 bp, Mus musculus
gagaagcgagccaatatctgtgccc

SEQ ID NO: 467947 - DNA, 25 bp, Mus musculus
gagaagcgagcctatatctgtgccc

SEQ ID NO: 467948 - DNA, 25 bp, Mus musculus
gagaagcgcaggctctacgaagaat

SEQ ID NO: 467949 - DNA, 25 bp, Mus musculus
gagaagcgcagggtctacgaagaat

SEQ ID NO: 467950 - DNA, 25 bp, Mus musculus
gagaagcgcttcaccttcgtgttgg

SEQ ID NO: 467951 - DNA, 25 bp, Mus musculus
gagaagcgcttcatgcggagcgacc

SEQ ID NO: 467952 - DNA, 25 bp, Mus musculus
gagaagcgcttctccttcgtgttgg

SEQ ID NO: 467953 - DNA, 25 bp, Mus musculus
gagaagcgcttcttgcggagcgacc

SEQ ID NO: 467954 - DNA, 25 bp, Mus musculus
gagaagcgctttcgtgacgctgctt

SEQ ID NO: 467955 - DNA, 25 bp, Mus musculus
gagaagcgctttggtgacgctgctt

SEQ ID NO: 467956 - DNA, 25 bp, Mus musculus
gagaagcgggtgaatgcctccacca

SEQ ID NO: 467957 - DNA, 25 bp, Mus musculus
gagaagcgggtgtatgcctccacca

SEQ ID NO: 467958 - DNA, 25 bp, Mus musculus
gagaagcgttagaaccctgctccag

SEQ ID NO: 467959 - DNA, 25 bp, Mus musculus
gagaagcgttagtaccctgctccag

SEQ ID NO: 467960 - DNA, 25 bp, Mus musculus
gagaagctaattctctctggattag

SEQ ID NO: 467961 - DNA, 25 bp, Mus musculus
gagaagctaattgtctctggattag

SEQ ID NO: 467962 - DNA, 25 bp, Mus musculus
gagaagctacatcctaacccaacaa

SEQ ID NO: 467963 - DNA, 25 bp, Mus musculus
gagaagctacatgctaacccaacaa

SEQ ID NO: 467964 - DNA, 25 bp, Mus musculus
gagaagctaccaaccacgatggaac

SEQ ID NO: 467965 - DNA, 25 bp, Mus musculus
gagaagctaccatccacgatggaac

SEQ ID NO: 467966 - DNA, 25 bp, Mus musculus
gagaagctacccctgaaaatgaccc

SEQ ID NO: 467967 - DNA, 25 bp, Mus musculus
gagaagctacccgtgaaaatgaccc

SEQ ID NO: 467968 - DNA, 25 bp, Mus musculus
gagaagctatataaatctttcccct

SEQ ID NO: 467969 - DNA, 25 bp, Mus musculus
gagaagctatatacatctacaccag

SEQ ID NO: 467970 - DNA, 25 bp, Mus musculus
gagaagctatataccctcgggagct

SEQ ID NO: 467971 - DNA, 25 bp, Mus musculus
gagaagctatattaatctttcccct

SEQ ID NO: 467972 - DNA, 25 bp, Mus musculus
gagaagctatattcatctacaccag

SEQ ID NO: 467973 - DNA, 25 bp, Mus musculus
gagaagctatattccctcgggagct

SEQ ID NO: 467974 - DNA, 25 bp, Mus musculus
gagaagctcaggaacttgaaatgct

SEQ ID NO: 467975 - DNA, 25 bp, Mus musculus
gagaagctcaggtacttgaaatgct

SEQ ID NO: 467976 - DNA, 25 bp, Mus musculus
gagaagctcagtccagagacacaat

SEQ ID NO: 467977 - DNA, 25 bp, Mus musculus
gagaagctcagtgcagagacacaat

SEQ ID NO: 467978 - DNA, 25 bp, Mus musculus
gagaagctcgaaaatcatcaataga

SEQ ID NO: 467979 - DNA, 25 bp, Mus musculus
gagaagctcgaacgttgcgttaatc

SEQ ID NO: 467980 - DNA, 25 bp, Mus musculus
gagaagctcgaaggttgcgttaatc

SEQ ID NO: 467981 - DNA, 25 bp, Mus musculus
gagaagctcgaatatcatcaataga

SEQ ID NO: 467982 - DNA, 25 bp, Mus musculus
gagaagctcgatacagtcattgagt

SEQ ID NO: 467983 - DNA, 25 bp, Mus musculus
gagaagctcgatcaacctcatgaga

SEQ ID NO: 467984 - DNA, 25 bp, Mus musculus
gagaagctcgatgaacctcatgaga

SEQ ID NO: 467985 - DNA, 25 bp, Mus musculus
gagaagctcgattcagtcattgagt

SEQ ID NO: 467986 - DNA, 25 bp, Mus musculus
gagaagctcttgatgcagcagggaa

SEQ ID NO: 467987 - DNA, 25 bp, Mus musculus
gagaagctcttgttgcagcagggaa

SEQ ID NO: 467988 - DNA, 25 bp, Mus musculus
gagaagctgactagtgagttgcata

SEQ ID NO: 467989 - DNA, 25 bp, Mus musculus
gagaagctgacttgtgagttgcata

SEQ ID NO: 467990 - DNA, 25 bp, Mus musculus
gagaagctgccccttgaatccggca

SEQ ID NO: 467991 - DNA, 25 bp, Mus musculus
gagaagctgcccgttgaatccggca

SEQ ID NO: 467992 - DNA, 25 bp, Mus musculus
gagaagctgctactcgaaacatgga

SEQ ID NO: 467993 - DNA, 25 bp, Mus musculus
gagaagctgctagtcgaaacatgga

SEQ ID NO: 467994 - DNA, 25 bp, Mus musculus
gagaagctggaacacctggagaacc

SEQ ID NO: 467995 - DNA, 25 bp, Mus musculus
gagaagctggaagacctggagaacc

SEQ ID NO: 467996 - DNA, 25 bp, Mus musculus
gagaagctggacaaaattacctagt

SEQ ID NO: 467997 - DNA, 25 bp, Mus musculus
gagaagctggactaaattacctagt

SEQ ID NO: 467998 - DNA, 25 bp, Mus musculus
gagaagctgggaaccttggtgacca

SEQ ID NO: 467999 - DNA, 25 bp, Mus musculus
gagaagctgggatccttggtgacca

SEQ ID NO: 468000 - DNA, 25 bp, Mus musculus
gagaagctggtcaggaactgccatc

SEQ ID NO: 468001 - DNA, 25 bp, Mus musculus
gagaagctggtctggaactgccatc

SEQ ID NO: 468002 - DNA, 25 bp, Mus musculus
gagaagctgtagacaacctgtttta

SEQ ID NO: 468003 - DNA, 25 bp, Mus musculus
gagaagctgtagtcaacctgtttta

SEQ ID NO: 468004 - DNA, 25 bp, Mus musculus
gagaagctgtcaagcacacatggac

SEQ ID NO: 468005 - DNA, 25 bp, Mus musculus
gagaagctgtcatgcacacatggac

SEQ ID NO: 468006 - DNA, 25 bp, Mus musculus
gagaagctgttcaatgtagccttat

SEQ ID NO: 468007 - DNA, 25 bp, Mus musculus
gagaagctgttctatgtagccttat

SEQ ID NO: 468008 - DNA, 25 bp, Mus musculus
gagaagcttcacacagtgctcagac

SEQ ID NO: 468009 - DNA, 25 bp, Mus musculus
gagaagcttcactcagtgctcagac

SEQ ID NO: 468010 - DNA, 25 bp, Mus musculus
gagaagcttccgagatgcacagtat

SEQ ID NO: 468011 - DNA, 25 bp, Mus musculus
gagaagcttccgtgatgcacagtat

SEQ ID NO: 468012 - DNA, 25 bp, Mus musculus
gagaagcttcctcaaacatgcatgg

SEQ ID NO: 468013 - DNA, 25 bp, Mus musculus
gagaagcttcctgaaacatgcatgg

SEQ ID NO: 468014 - DNA, 25 bp, Mus musculus
gagaagcttctcagaggggctcgct

SEQ ID NO: 468015 - DNA, 25 bp, Mus musculus
gagaagcttctctgaggggctcgct

SEQ ID NO: 468016 - DNA, 25 bp, Mus musculus
gagaagcttgatcacctggtatcca

SEQ ID NO: 468017 - DNA, 25 bp, Mus musculus
gagaagcttgatgacctggtatcca

SEQ ID NO: 468018 - DNA, 25 bp, Mus musculus
gagaagcttgcacaggtcctcagca

SEQ ID NO: 468019 - DNA, 25 bp, Mus musculus
gagaagcttgcagaggtcctcagca

SEQ ID NO: 468020 - DNA, 25 bp, Mus musculus
gagaagcttggccaaggtgtccacc

SEQ ID NO: 468021 - DNA, 25 bp, Mus musculus
gagaagcttggcgaaggtgtccacc

SEQ ID NO: 468022 - DNA, 25 bp, Mus musculus
gagaagctttacagttttgcctaat

SEQ ID NO: 468023 - DNA, 25 bp, Mus musculus
gagaagctttactgttttgcctaat

SEQ ID NO: 468024 - DNA, 25 bp, Mus musculus
gagaagctttcaaccaaggcagtta

SEQ ID NO: 468025 - DNA, 25 bp, Mus musculus
gagaagctttcatccaaggcagtta

SEQ ID NO: 468026 - DNA, 25 bp, Mus musculus
gagaagctttctctccctaattaac

SEQ ID NO: 468027 - DNA, 25 bp, Mus musculus
gagaagctttctgtccctaattaac

SEQ ID NO: 468028 - DNA, 25 bp, Mus musculus
gagaaggaacccctatgcattgccc

SEQ ID NO: 468029 - DNA, 25 bp, Mus musculus
gagaaggaacccgtatgcattgccc

SEQ ID NO: 468030 - DNA, 25 bp, Mus musculus
gagaaggaatggctgctggtggctc

SEQ ID NO: 468031 - DNA, 25 bp, Mus musculus
gagaaggaatgggtgctggtggctc

SEQ ID NO: 468032 - DNA, 25 bp, Mus musculus
gagaaggacagaatctctgtgaatc

SEQ ID NO: 468033 - DNA, 25 bp, Mus musculus
gagaaggacagattctctgtgaatc

SEQ ID NO: 468034 - DNA, 25 bp, Mus musculus
gagaaggacagtcccattcctagcc

SEQ ID NO: 468035 - DNA, 25 bp, Mus musculus
gagaaggacagtgccattcctagcc

SEQ ID NO: 468036 - DNA, 25 bp, Mus musculus
gagaaggacccaaggcgctgcctga

SEQ ID NO: 468037 - DNA, 25 bp, Mus musculus
gagaaggacccatggcgctgcctga

SEQ ID NO: 468038 - DNA, 25 bp, Mus musculus
gagaaggaccccatttagggacatg

SEQ ID NO: 468039 - DNA, 25 bp, Mus musculus
gagaaggaccccttttagggacatg

SEQ ID NO: 468040 - DNA, 25 bp, Mus musculus
gagaaggaccctaggtcatttgtaa

SEQ ID NO: 468041 - DNA, 25 bp, Mus musculus
gagaaggacccttggtcatttgtaa

SEQ ID NO: 468042 - DNA, 25 bp, Mus musculus
gagaaggacctgcagtacggtatcc

SEQ ID NO: 468043 - DNA, 25 bp, Mus musculus
gagaaggacctggagtacggtatcc

SEQ ID NO: 468044 - DNA, 25 bp, Mus musculus
gagaaggacgataaagtggttccca

SEQ ID NO: 468045 - DNA, 25 bp, Mus musculus
gagaaggacgattaagtggttccca

SEQ ID NO: 468046 - DNA, 25 bp, Mus musculus
gagaaggacgcacctgagcactgac

SEQ ID NO: 468047 - DNA, 25 bp, Mus musculus
gagaaggacgcagctgagcactgac

SEQ ID NO: 468048 - DNA, 25 bp, Mus musculus
gagaaggacggcctgatcctcacca

SEQ ID NO: 468049 - DNA, 25 bp, Mus musculus
gagaaggacggcgtgatcctcacca

SEQ ID NO: 468050 - DNA, 25 bp, Mus musculus
gagaaggacttccaaccaatccctc

SEQ ID NO: 468051 - DNA, 25 bp, Mus musculus
gagaaggacttcgaaccaatccctc

SEQ ID NO: 468052 - DNA, 25 bp, Mus musculus
gagaaggagacaccccactgcatga

SEQ ID NO: 468053 - DNA, 25 bp, Mus musculus
gagaaggagacagcccactgcatga

SEQ ID NO: 468054 - DNA, 25 bp, Mus musculus
gagaaggagatccagagttcgaatc

SEQ ID NO: 468055 - DNA, 25 bp, Mus musculus
gagaaggagatcgagagttcgaatc

SEQ ID NO: 468056 - DNA, 25 bp, Mus musculus
gagaaggagcacacgcctgacatcg

SEQ ID NO: 468057 - DNA, 25 bp, Mus musculus
gagaaggagcactcgcctgacatcg

SEQ ID NO: 468058 - DNA, 25 bp, Mus musculus
gagaaggagctaagggttctgcccc

SEQ ID NO: 468059 - DNA, 25 bp, Mus musculus
gagaaggagctatgggttctgcccc

SEQ ID NO: 468060 - DNA, 25 bp, Mus musculus
gagaaggagtcactttgcttcagac

SEQ ID NO: 468061 - DNA, 25 bp, Mus musculus
gagaaggagtcagtttgcttcagac

SEQ ID NO: 468062 - DNA, 25 bp, Mus musculus
gagaaggagttgaggaccccacctg

SEQ ID NO: 468063 - DNA, 25 bp, Mus musculus
gagaaggagttgtggaccccacctg

SEQ ID NO: 468064 - DNA, 25 bp, Mus musculus
gagaaggataccaccatcaatgaga

SEQ ID NO: 468065 - DNA, 25 bp, Mus musculus
gagaaggatacctccatcaatgaga

SEQ ID NO: 468066 - DNA, 25 bp, Mus musculus
gagaaggattcaactgcgtgaattc

SEQ ID NO: 468067 - DNA, 25 bp, Mus musculus
gagaaggattcatctgcgtgaattc

SEQ ID NO: 468068 - DNA, 25 bp, Mus musculus
gagaaggattctcccttccgaggca

SEQ ID NO: 468069 - DNA, 25 bp, Mus musculus
gagaaggattctgccttccgaggca

SEQ ID NO: 468070 - DNA, 25 bp, Mus musculus
gagaaggcaaatcccgtttccagat

SEQ ID NO: 468071 - DNA, 25 bp, Mus musculus
gagaaggcaaatgccgtttccagat

SEQ ID NO: 468072 - DNA, 25 bp, Mus musculus
gagaaggcaactagatcgccatctt

SEQ ID NO: 468073 - DNA, 25 bp, Mus musculus
gagaaggcaacttgatcgccatctt

SEQ ID NO: 468074 - DNA, 25 bp, Mus musculus
gagaaggcacagacccggtgattgc

SEQ ID NO: 468075 - DNA, 25 bp, Mus musculus
gagaaggcacagtcccggtgattgc

SEQ ID NO: 468076 - DNA, 25 bp, Mus musculus
gagaaggcactcagtcagccttagg

SEQ ID NO: 468077 - DNA, 25 bp, Mus musculus
gagaaggcactctgtcagccttagg

SEQ ID NO: 468078 - DNA, 25 bp, Mus musculus
gagaaggcagcaagttctcctcctc

SEQ ID NO: 468079 - DNA, 25 bp, Mus musculus
gagaaggcagcatgttctcctcctc

SEQ ID NO: 468080 - DNA, 25 bp, Mus musculus
gagaaggcaggcatcccagtaccag

SEQ ID NO: 468081 - DNA, 25 bp, Mus musculus
gagaaggcaggcttcccagtaccag

SEQ ID NO: 468082 - DNA, 25 bp, Mus musculus
gagaaggcagtcaaccagggtccag

SEQ ID NO: 468083 - DNA, 25 bp, Mus musculus
gagaaggcagtctaccagggtccag

SEQ ID NO: 468084 - DNA, 25 bp, Mus musculus
gagaaggcatcaagtcagacaacga

SEQ ID NO: 468085 - DNA, 25 bp, Mus musculus
gagaaggcatcatgtcagacaacga

SEQ ID NO: 468086 - DNA, 25 bp, Mus musculus
gagaaggcatctcctgaatacaatc

SEQ ID NO: 468087 - DNA, 25 bp, Mus musculus
gagaaggcatctgctgaatacaatc

SEQ ID NO: 468088 - DNA, 25 bp, Mus musculus
gagaaggccaacagtcgttccatct

SEQ ID NO: 468089 - DNA, 25 bp, Mus musculus
gagaaggccaactgtcgttccatct

SEQ ID NO: 468090 - DNA, 25 bp, Mus musculus
gagaaggccaagacctcagagattc

SEQ ID NO: 468091 - DNA, 25 bp, Mus musculus
gagaaggccaagtcctcagagattc

SEQ ID NO: 468092 - DNA, 25 bp, Mus musculus
gagaaggccagcactgggacctaaa

SEQ ID NO: 468093 - DNA, 25 bp, Mus musculus
gagaaggccagctctgggacctaaa

SEQ ID NO: 468094 - DNA, 25 bp, Mus musculus
gagaaggccccaaatatggcagcat

SEQ ID NO: 468095 - DNA, 25 bp, Mus musculus
gagaaggccccatatatggcagcat

SEQ ID NO: 468096 - DNA, 25 bp, Mus musculus
gagaaggccgatatcctggagctga

SEQ ID NO: 468097 - DNA, 25 bp, Mus musculus
gagaaggccgatttcctggagctga

SEQ ID NO: 468098 - DNA, 25 bp, Mus musculus
gagaaggccgttcatgcagactttt

SEQ ID NO: 468099 - DNA, 25 bp, Mus musculus
gagaaggccgttgatgcagactttt

SEQ ID NO: 468100 - DNA, 25 bp, Mus musculus
gagaaggcctaacgaaccctggaga

SEQ ID NO: 468101 - DNA, 25 bp, Mus musculus
gagaaggcctaaggaaccctggaga

SEQ ID NO: 468102 - DNA, 25 bp, Mus musculus
gagaaggcgcaaaactctccagctc

SEQ ID NO: 468103 - DNA, 25 bp, Mus musculus
gagaaggcgcaatactctccagctc

SEQ ID NO: 468104 - DNA, 25 bp, Mus musculus
gagaaggcgccaacagttagcattt

SEQ ID NO: 468105 - DNA, 25 bp, Mus musculus
gagaaggcgccatcagttagcattt

SEQ ID NO: 468106 - DNA, 25 bp, Mus musculus
gagaaggcggatatcaatacgaaat

SEQ ID NO: 468107 - DNA, 25 bp, Mus musculus
gagaaggcggatttcaatacgaaat

SEQ ID NO: 468108 - DNA, 25 bp, Mus musculus
gagaaggcgttgattactgcaaaat

SEQ ID NO: 468109 - DNA, 25 bp, Mus musculus
gagaaggcgttgtttactgcaaaat

SEQ ID NO: 468110 - DNA, 25 bp, Mus musculus
gagaaggctaatcgcacaaccgtcc

SEQ ID NO: 468111 - DNA, 25 bp, Mus musculus
gagaaggctaatggcacaaccgtcc

SEQ ID NO: 468112 - DNA, 25 bp, Mus musculus
gagaaggctacaaaggagttcctat

SEQ ID NO: 468113 - DNA, 25 bp, Mus musculus
gagaaggctacataggagttcctat

SEQ ID NO: 468114 - DNA, 25 bp, Mus musculus
gagaaggctagtcggctcctctgta

SEQ ID NO: 468115 - DNA, 25 bp, Mus musculus
gagaaggctagtgggctcctctgta

SEQ ID NO: 468116 - DNA, 25 bp, Mus musculus
gagaaggctcagaatccgtagttaa

SEQ ID NO: 468117 - DNA, 25 bp, Mus musculus
gagaaggctcagtatccgtagttaa

SEQ ID NO: 468118 - DNA, 25 bp, Mus musculus
gagaaggctccactgatttgacttt

SEQ ID NO: 468119 - DNA, 25 bp, Mus musculus
gagaaggctccagtgatttgacttt

SEQ ID NO: 468120 - DNA, 25 bp, Mus musculus
gagaaggctcctaaagcagcttcaa

SEQ ID NO: 468121 - DNA, 25 bp, Mus musculus
gagaaggctccttaagcagcttcaa

SEQ ID NO: 468122 - DNA, 25 bp, Mus musculus
gagaaggctcgaacaagtcacccgc

SEQ ID NO: 468123 - DNA, 25 bp, Mus musculus
gagaaggctcgatcaagtcacccgc

SEQ ID NO: 468124 - DNA, 25 bp, Mus musculus
gagaaggctctacaggcatttacaa

SEQ ID NO: 468125 - DNA, 25 bp, Mus musculus
gagaaggctctagaggcatttacaa

SEQ ID NO: 468126 - DNA, 25 bp, Mus musculus
gagaaggctctccaagtcctgagga

SEQ ID NO: 468127 - DNA, 25 bp, Mus musculus
gagaaggctctcgaagtcctgagga

SEQ ID NO: 468128 - DNA, 25 bp, Mus musculus
gagaaggctgatattcctggaccca

SEQ ID NO: 468129 - DNA, 25 bp, Mus musculus
gagaaggctgattttcctggaccca

SEQ ID NO: 468130 - DNA, 25 bp, Mus musculus
gagaaggctgcaccgaagaaaaaca

SEQ ID NO: 468131 - DNA, 25 bp, Mus musculus
gagaaggctgcagcgaagaaaaaca

SEQ ID NO: 468132 - DNA, 25 bp, Mus musculus
gagaaggctggtaattcacttaatt

SEQ ID NO: 468133 - DNA, 25 bp, Mus musculus
gagaaggctggttattcacttaatt

SEQ ID NO: 468134 - DNA, 25 bp, Mus musculus
gagaaggctttcacggtgcccatca

SEQ ID NO: 468135 - DNA, 25 bp, Mus musculus
gagaaggctttctcggtgcccatca

SEQ ID NO: 468136 - DNA, 25 bp, Mus musculus
gagaagggaactaaccgaagccacg

SEQ ID NO: 468137 - DNA, 25 bp, Mus musculus
gagaagggaacttaccgaagccacg

SEQ ID NO: 468138 - DNA, 25 bp, Mus musculus
gagaagggacacctattttatccat

SEQ ID NO: 468139 - DNA, 25 bp, Mus musculus
gagaagggacacgtattttatccat

SEQ ID NO: 468140 - DNA, 25 bp, Mus musculus
gagaagggacagcaccctgcattgt

SEQ ID NO: 468141 - DNA, 25 bp, Mus musculus
gagaagggacaggaccctgcattgt

SEQ ID NO: 468142 - DNA, 25 bp, Mus musculus
gagaagggacccacagcctgaataa

SEQ ID NO: 468143 - DNA, 25 bp, Mus musculus
gagaagggaccctcagcctgaataa

SEQ ID NO: 468144 - DNA, 25 bp, Mus musculus
gagaagggaggcaggctgtagcttt

SEQ ID NO: 468145 - DNA, 25 bp, Mus musculus
gagaagggaggctggctgtagcttt

SEQ ID NO: 468146 - DNA, 25 bp, Mus musculus
gagaagggccaaaactcctgtcatc

SEQ ID NO: 468147 - DNA, 25 bp, Mus musculus
gagaagggccaatactcctgtcatc

SEQ ID NO: 468148 - DNA, 25 bp, Mus musculus
gagaagggccagacctaagatggaa

SEQ ID NO: 468149 - DNA, 25 bp, Mus musculus
gagaagggccagtcctaagatggaa

SEQ ID NO: 468150 - DNA, 25 bp, Mus musculus
gagaagggctcacctctgagttccc

SEQ ID NO: 468151 - DNA, 25 bp, Mus musculus
gagaagggctcactttgaacagact

SEQ ID NO: 468152 - DNA, 25 bp, Mus musculus
gagaagggctcagctctgagttccc

SEQ ID NO: 468153 - DNA, 25 bp, Mus musculus
gagaagggctcagtttgaacagact

SEQ ID NO: 468154 - DNA, 25 bp, Mus musculus
gagaagggtgaaccccatctaacta

SEQ ID NO: 468155 - DNA, 25 bp, Mus musculus
gagaagggtgaagcccatctaacta

SEQ ID NO: 468156 - DNA, 25 bp, Mus musculus
gagaagggtgtgactcttctcgcat

SEQ ID NO: 468157 - DNA, 25 bp, Mus musculus
gagaagggtgtgtctcttctcgcat

SEQ ID NO: 468158 - DNA, 25 bp, Mus musculus
gagaagggtttacccgtcgccagcc

SEQ ID NO: 468159 - DNA, 25 bp, Mus musculus
gagaagggtttagccgtcgccagcc

SEQ ID NO: 468160 - DNA, 25 bp, Mus musculus
gagaagggttttcacatccagacaa

SEQ ID NO: 468161 - DNA, 25 bp, Mus musculus
gagaagggttttgacatccagacaa

SEQ ID NO: 468162 - DNA, 25 bp, Mus musculus
gagaaggtaactaatggcctccctt

SEQ ID NO: 468163 - DNA, 25 bp, Mus musculus
gagaaggtaacttatggcctccctt

SEQ ID NO: 468164 - DNA, 25 bp, Mus musculus
gagaaggtacataatgctatttgaa

SEQ ID NO: 468165 - DNA, 25 bp, Mus musculus
gagaaggtacattatgctatttgaa

SEQ ID NO: 468166 - DNA, 25 bp, Mus musculus
gagaaggtattcatggatgccggac

SEQ ID NO: 468167 - DNA, 25 bp, Mus musculus
gagaaggtattcttggatgccggac

SEQ ID NO: 468168 - DNA, 25 bp, Mus musculus
gagaaggtcaccactacaagctata

SEQ ID NO: 468169 - DNA, 25 bp, Mus musculus
gagaaggtcacctctacaagctata

SEQ ID NO: 468170 - DNA, 25 bp, Mus musculus
gagaaggtcactcattcatcatcat

SEQ ID NO: 468171 - DNA, 25 bp, Mus musculus
gagaaggtcactgattcatcatcat

SEQ ID NO: 468172 - DNA, 25 bp, Mus musculus
gagaaggtcagcaaaatggttcatc

SEQ ID NO: 468173 - DNA, 25 bp, Mus musculus
gagaaggtcagctaaatggttcatc

SEQ ID NO: 468174 - DNA, 25 bp, Mus musculus
gagaaggtcaggacgctagcccagc

SEQ ID NO: 468175 - DNA, 25 bp, Mus musculus
gagaaggtcaggtcgctagcccagc

SEQ ID NO: 468176 - DNA, 25 bp, Mus musculus
gagaaggtcattaattaagggccct

SEQ ID NO: 468177 - DNA, 25 bp, Mus musculus
gagaaggtcatttattaagggccct

SEQ ID NO: 468178 - DNA, 25 bp, Mus musculus
gagaaggtcctcaggccacatgaca

SEQ ID NO: 468179 - DNA, 25 bp, Mus musculus
gagaaggtcctctggccacatgaca

SEQ ID NO: 468180 - DNA, 25 bp, Mus musculus
gagaaggtccttctgcagtcaacct

SEQ ID NO: 468181 - DNA, 25 bp, Mus musculus
gagaaggtccttgtgcagtcaacct

SEQ ID NO: 468182 - DNA, 25 bp, Mus musculus
gagaaggtctctcccaaggacgaga

SEQ ID NO: 468183 - DNA, 25 bp, Mus musculus
gagaaggtctctcgacttgacaccc

SEQ ID NO: 468184 - DNA, 25 bp, Mus musculus
gagaaggtctctgccaaggacgaga

SEQ ID NO: 468185 - DNA, 25 bp, Mus musculus
gagaaggtctctggacttgacaccc

SEQ ID NO: 468186 - DNA, 25 bp, Mus musculus
gagaaggtctgcattagctttttgt

SEQ ID NO: 468187 - DNA, 25 bp, Mus musculus
gagaaggtctgctttagctttttgt

SEQ ID NO: 468188 - DNA, 25 bp, Mus musculus
gagaaggtcttcaagagggcattat

SEQ ID NO: 468189 - DNA, 25 bp, Mus musculus
gagaaggtcttctagagggcattat

SEQ ID NO: 468190 - DNA, 25 bp, Mus musculus
gagaaggtgaaaccctgctggtaaa

SEQ ID NO: 468191 - DNA, 25 bp, Mus musculus
gagaaggtgaaagcctgctggtaaa

SEQ ID NO: 468192 - DNA, 25 bp, Mus musculus
gagaaggtggccactatgggcctct

SEQ ID NO: 468193 - DNA, 25 bp, Mus musculus
gagaaggtggcctctatgggcctct

SEQ ID NO: 468194 - DNA, 25 bp, Mus musculus
gagaaggtgtggaccctcagcttta

SEQ ID NO: 468195 - DNA, 25 bp, Mus musculus
gagaaggtgtggtccctcagcttta

SEQ ID NO: 468196 - DNA, 25 bp, Mus musculus
gagaaggttaccactacccatcaga

SEQ ID NO: 468197 - DNA, 25 bp, Mus musculus
gagaaggttacctctacccatcaga

SEQ ID NO: 468198 - DNA, 25 bp, Mus musculus
gagaaggttcaactctatatcaagt

SEQ ID NO: 468199 - DNA, 25 bp, Mus musculus
gagaaggttcaagtctatatcaagt

SEQ ID NO: 468200 - DNA, 25 bp, Mus musculus
gagaaggttccactgccagctgtaa

SEQ ID NO: 468201 - DNA, 25 bp, Mus musculus
gagaaggttccagtgccagctgtaa

SEQ ID NO: 468202 - DNA, 25 bp, Mus musculus
gagaaggttcctacaagccttgagt

SEQ ID NO: 468203 - DNA, 25 bp, Mus musculus
gagaaggttccttcaagccttgagt

SEQ ID NO: 468204 - DNA, 25 bp, Mus musculus
gagaaggtttatcccaccctggagg

SEQ ID NO: 468205 - DNA, 25 bp, Mus musculus
gagaaggtttatgccaccctggagg

SEQ ID NO: 468206 - DNA, 25 bp, Mus musculus
gagaaggttttccatgaactaggtt

SEQ ID NO: 468207 - DNA, 25 bp, Mus musculus
gagaaggttttcgatgaactaggtt

SEQ ID NO: 468208 - DNA, 25 bp, Mus musculus
gagaagtaaaagatctgaaaggcta

SEQ ID NO: 468209 - DNA, 25 bp, Mus musculus
gagaagtaaaagttctgaaaggcta

SEQ ID NO: 468210 - DNA, 25 bp, Mus musculus
gagaagtaacccctgatcatcttat

SEQ ID NO: 468211 - DNA, 25 bp, Mus musculus
gagaagtaacccgtgatcatcttat

SEQ ID NO: 468212 - DNA, 25 bp, Mus musculus
gagaagtaactcagccagcatttgg

SEQ ID NO: 468213 - DNA, 25 bp, Mus musculus
gagaagtaactctgccagcatttgg

SEQ ID NO: 468214 - DNA, 25 bp, Mus musculus
gagaagtaagtgactgtccgttttc

SEQ ID NO: 468215 - DNA, 25 bp, Mus musculus
gagaagtaagtgtctgtccgttttc

SEQ ID NO: 468216 - DNA, 25 bp, Mus musculus
gagaagtacatgctgacccaccagg

SEQ ID NO: 468217 - DNA, 25 bp, Mus musculus
gagaagtacatggtgacccaccagg

SEQ ID NO: 468218 - DNA, 25 bp, Mus musculus
gagaagtaccaaagcgtctgccacc

SEQ ID NO: 468219 - DNA, 25 bp, Mus musculus
gagaagtaccaatgcgtctgccacc

SEQ ID NO: 468220 - DNA, 25 bp, Mus musculus
gagaagtactacacgcgtctgggta

SEQ ID NO: 468221 - DNA, 25 bp, Mus musculus
gagaagtactactcgcgtctgggta

SEQ ID NO: 468222 - DNA, 25 bp, Mus musculus
gagaagtactgtccttgtatttaaa

SEQ ID NO: 468223 - DNA, 25 bp, Mus musculus
gagaagtactgtgcttgtatttaaa

SEQ ID NO: 468224 - DNA, 25 bp, Mus musculus
gagaagtagaatagtcccagggaat

SEQ ID NO: 468225 - DNA, 25 bp, Mus musculus
gagaagtagaattgtcccagggaat

SEQ ID NO: 468226 - DNA, 25 bp, Mus musculus
gagaagtaggctccattccaaagtg

SEQ ID NO: 468227 - DNA, 25 bp, Mus musculus
gagaagtaggctgcattccaaagtg

SEQ ID NO: 468228 - DNA, 25 bp, Mus musculus
gagaagtatgccaagtacctgcccc

SEQ ID NO: 468229 - DNA, 25 bp, Mus musculus
gagaagtatgcctagtacctgcccc

SEQ ID NO: 468230 - DNA, 25 bp, Mus musculus
gagaagtcaaatcaagtagccggag

SEQ ID NO: 468231 - DNA, 25 bp, Mus musculus
gagaagtcaaatgaagtagccggag

SEQ ID NO: 468232 - DNA, 25 bp, Mus musculus
gagaagtcaacaacactgtcataga

SEQ ID NO: 468233 - DNA, 25 bp, Mus musculus
gagaagtcaacatcactgtcataga

SEQ ID NO: 468234 - DNA, 25 bp, Mus musculus
gagaagtcaaccatccaaaactctg

SEQ ID NO: 468235 - DNA, 25 bp, Mus musculus
gagaagtcaaccttccaaaactctg

SEQ ID NO: 468236 - DNA, 25 bp, Mus musculus
gagaagtcacagacttggtccactc

SEQ ID NO: 468237 - DNA, 25 bp, Mus musculus
gagaagtcacagtcttggtccactc

SEQ ID NO: 468238 - DNA, 25 bp, Mus musculus
gagaagtcaccacactgaaagccag

SEQ ID NO: 468239 - DNA, 25 bp, Mus musculus
gagaagtcaccagactgaaagccag

SEQ ID NO: 468240 - DNA, 25 bp, Mus musculus
gagaagtcactgataccatcataag

SEQ ID NO: 468241 - DNA, 25 bp, Mus musculus
gagaagtcactgttaccatcataag

SEQ ID NO: 468242 - DNA, 25 bp, Mus musculus
gagaagtcacttaagttcctgatat

SEQ ID NO: 468243 - DNA, 25 bp, Mus musculus
gagaagtcactttagttcctgatat

SEQ ID NO: 468244 - DNA, 25 bp, Mus musculus
gagaagtcagtgatggcctccttat

SEQ ID NO: 468245 - DNA, 25 bp, Mus musculus
gagaagtcagtgttggcctccttat

SEQ ID NO: 468246 - DNA, 25 bp, Mus musculus
gagaagtccacgctgaacttacaat

SEQ ID NO: 468247 - DNA, 25 bp, Mus musculus
gagaagtccacggtgaacttacaat

SEQ ID NO: 468248 - DNA, 25 bp, Mus musculus
gagaagtccatgctcgagtgcccat

SEQ ID NO: 468249 - DNA, 25 bp, Mus musculus
gagaagtccatggtcgagtgcccat

SEQ ID NO: 468250 - DNA, 25 bp, Mus musculus
gagaagtcccttctcagaaacacta

SEQ ID NO: 468251 - DNA, 25 bp, Mus musculus
gagaagtcccttgtcagaaacacta

SEQ ID NO: 468252 - DNA, 25 bp, Mus musculus
gagaagtccttaatgatctgggcga

SEQ ID NO: 468253 - DNA, 25 bp, Mus musculus
gagaagtccttattgatctgggcga

SEQ ID NO: 468254 - DNA, 25 bp, Mus musculus
gagaagtcgaagctgggaatcttat

SEQ ID NO: 468255 - DNA, 25 bp, Mus musculus
gagaagtcgaaggtgggaatcttat

SEQ ID NO: 468256 - DNA, 25 bp, Mus musculus
gagaagtcggcaatacccaaaggag

SEQ ID NO: 468257 - DNA, 25 bp, Mus musculus
gagaagtcggcattacccaaaggag

SEQ ID NO: 468258 - DNA, 25 bp, Mus musculus
gagaagtctaggctatctcttacca

SEQ ID NO: 468259 - DNA, 25 bp, Mus musculus
gagaagtctagggtatctcttacca

SEQ ID NO: 468260 - DNA, 25 bp, Mus musculus
gagaagtctgctaccaggcgggacc

SEQ ID NO: 468261 - DNA, 25 bp, Mus musculus
gagaagtctgcttccaggcgggacc

SEQ ID NO: 468262 - DNA, 25 bp, Mus musculus
gagaagtgacacaacccagaacaca

SEQ ID NO: 468263 - DNA, 25 bp, Mus musculus
gagaagtgacaccactcagtataaa

SEQ ID NO: 468264 - DNA, 25 bp, Mus musculus
gagaagtgacacgactcagtataaa

SEQ ID NO: 468265 - DNA, 25 bp, Mus musculus
gagaagtgacactacccagaacaca

SEQ ID NO: 468266 - DNA, 25 bp, Mus musculus
gagaagtgcagcagagtcgtcaaaa

SEQ ID NO: 468267 - DNA, 25 bp, Mus musculus
gagaagtgcagctgagtcgtcaaaa

SEQ ID NO: 468268 - DNA, 25 bp, Mus musculus
gagaagtgcatcacctgaagtggta

SEQ ID NO: 468269 - DNA, 25 bp, Mus musculus
gagaagtgcatctcctgaagtggta

SEQ ID NO: 468270 - DNA, 25 bp, Mus musculus
gagaagtgccaaagccatatcattt

SEQ ID NO: 468271 - DNA, 25 bp, Mus musculus
gagaagtgccaatgccatatcattt

SEQ ID NO: 468272 - DNA, 25 bp, Mus musculus
gagaagtgcctgcaaccactgttcc

SEQ ID NO: 468273 - DNA, 25 bp, Mus musculus
gagaagtgcctggaaccactgttcc

SEQ ID NO: 468274 - DNA, 25 bp, Mus musculus
gagaagtggataccgccacagctgc

SEQ ID NO: 468275 - DNA, 25 bp, Mus musculus
gagaagtggatagcgccacagctgc

SEQ ID NO: 468276 - DNA, 25 bp, Mus musculus
gagaagtggatcctgcctttggccc

SEQ ID NO: 468277 - DNA, 25 bp, Mus musculus
gagaagtggatcgtgcctttggccc

SEQ ID NO: 468278 - DNA, 25 bp, Mus musculus
gagaagtggcataaactcgccctca

SEQ ID NO: 468279 - DNA, 25 bp, Mus musculus
gagaagtggcattaactcgccctca

SEQ ID NO: 468280 - DNA, 25 bp, Mus musculus
gagaagtggccgagatgttcagtta

SEQ ID NO: 468281 - DNA, 25 bp, Mus musculus
gagaagtggccgtgatgttcagtta

SEQ ID NO: 468282 - DNA, 25 bp, Mus musculus
gagaagtggcttcgcccatgtgcta

SEQ ID NO: 468283 - DNA, 25 bp, Mus musculus
gagaagtggcttggcccatgtgcta

SEQ ID NO: 468284 - DNA, 25 bp, Mus musculus
gagaagtgggaaatgcttgcttcga

SEQ ID NO: 468285 - DNA, 25 bp, Mus musculus
gagaagtgggaattgcttgcttcga

SEQ ID NO: 468286 - DNA, 25 bp, Mus musculus
gagaagtggtctctttctcctccaa

SEQ ID NO: 468287 - DNA, 25 bp, Mus musculus
gagaagtggtctgtttctcctccaa

SEQ ID NO: 468288 - DNA, 25 bp, Mus musculus
gagaagtgtattctccatctcctgc

SEQ ID NO: 468289 - DNA, 25 bp, Mus musculus
gagaagtgtattgtccatctcctgc

SEQ ID NO: 468290 - DNA, 25 bp, Mus musculus
gagaagtgtctcactttcaatgcca

SEQ ID NO: 468291 - DNA, 25 bp, Mus musculus
gagaagtgtctctctttcaatgcca

SEQ ID NO: 468292 - DNA, 25 bp, Mus musculus
gagaagtgtgctatatgacccagta

SEQ ID NO: 468293 - DNA, 25 bp, Mus musculus
gagaagtgtgctcttgaccgtcccc

SEQ ID NO: 468294 - DNA, 25 bp, Mus musculus
gagaagtgtgctgttgaccgtcccc

SEQ ID NO: 468295 - DNA, 25 bp, Mus musculus
gagaagtgtgctttatgacccagta

SEQ ID NO: 468296 - DNA, 25 bp, Mus musculus
gagaagtgtggccatacctacaacc

SEQ ID NO: 468297 - DNA, 25 bp, Mus musculus
gagaagtgtggcgatacctacaacc

SEQ ID NO: 468298 - DNA, 25 bp, Mus musculus
gagaagtgttcacatagccctacgc

SEQ ID NO: 468299 - DNA, 25 bp, Mus musculus
gagaagtgttcagatagccctacgc

SEQ ID NO: 468300 - DNA, 25 bp, Mus musculus
gagaagtgttttcgactcaggcgtt

SEQ ID NO: 468301 - DNA, 25 bp, Mus musculus
gagaagtgttttggactcaggcgtt

SEQ ID NO: 468302 - DNA, 25 bp, Mus musculus
gagaagttacatagccttaagcgag

SEQ ID NO: 468303 - DNA, 25 bp, Mus musculus
gagaagttacatatataaacccaac

SEQ ID NO: 468304 - DNA, 25 bp, Mus musculus
gagaagttacattgccttaagcgag

SEQ ID NO: 468305 - DNA, 25 bp, Mus musculus
gagaagttacatttataaacccaac

SEQ ID NO: 468306 - DNA, 25 bp, Mus musculus
gagaagttacctaagcataagagca

SEQ ID NO: 468307 - DNA, 25 bp, Mus musculus
gagaagttaccttagcataagagca

SEQ ID NO: 468308 - DNA, 25 bp, Mus musculus
gagaagttccatcgcactgactttg

SEQ ID NO: 468309 - DNA, 25 bp, Mus musculus
gagaagttccatggcactgactttg

SEQ ID NO: 468310 - DNA, 25 bp, Mus musculus
gagaagttcgacctgcaggaaaagt

SEQ ID NO: 468311 - DNA, 25 bp, Mus musculus
gagaagttcgacgtgcaggaaaagt

SEQ ID NO: 468312 - DNA, 25 bp, Mus musculus
gagaagttctggaaagggaccttca

SEQ ID NO: 468313 - DNA, 25 bp, Mus musculus
gagaagttctggtaagggaccttca

SEQ ID NO: 468314 - DNA, 25 bp, Mus musculus
gagaagttgactcttggcccctggc

SEQ ID NO: 468315 - DNA, 25 bp, Mus musculus
gagaagttgactgttggcccctggc

SEQ ID NO: 468316 - DNA, 25 bp, Mus musculus
gagaagttgagtatgacattgagga

SEQ ID NO: 468317 - DNA, 25 bp, Mus musculus
gagaagttgagtttgacattgagga

SEQ ID NO: 468318 - DNA, 25 bp, Mus musculus
gagaagttgatgcagtttcggaaca

SEQ ID NO: 468319 - DNA, 25 bp, Mus musculus
gagaagttgatggagtttcggaaca

SEQ ID NO: 468320 - DNA, 25 bp, Mus musculus
gagaagttgctgcagattcctctgg

SEQ ID NO: 468321 - DNA, 25 bp, Mus musculus
gagaagttgctggagattcctctgg

SEQ ID NO: 468322 - DNA, 25 bp, Mus musculus
gagaagttggcaccactcttgttga

SEQ ID NO: 468323 - DNA, 25 bp, Mus musculus
gagaagttggcagcactcttgttga

SEQ ID NO: 468324 - DNA, 25 bp, Mus musculus
gagaagttggtcattgagctcccct

SEQ ID NO: 468325 - DNA, 25 bp, Mus musculus
gagaagttggtctttgagctcccct

SEQ ID NO: 468326 - DNA, 25 bp, Mus musculus
gagaagttgtctaagacccaccttg

SEQ ID NO: 468327 - DNA, 25 bp, Mus musculus
gagaagttgtcttagacccaccttg

SEQ ID NO: 468328 - DNA, 25 bp, Mus musculus
gagaagtttcctatggcagccattt

SEQ ID NO: 468329 - DNA, 25 bp, Mus musculus
gagaagtttcctttggcagccattt

SEQ ID NO: 468330 - DNA, 25 bp, Mus musculus
gagaagtttgctccacgatacatag

SEQ ID NO: 468331 - DNA, 25 bp, Mus musculus
gagaagtttgctgcacgatacatag

SEQ ID NO: 468332 - DNA, 25 bp, Mus musculus
gagaagtttgttcccacaccttcag

SEQ ID NO: 468333 - DNA, 25 bp, Mus musculus
gagaagtttgttgccacaccttcag

SEQ ID NO: 468334 - DNA, 25 bp, Mus musculus
gagaagttttccaacaaagcagctg

SEQ ID NO: 468335 - DNA, 25 bp, Mus musculus
gagaagttttcctacaaagcagctg

SEQ ID NO: 468336 - DNA, 25 bp, Mus musculus
gagaataaaatgcatgcaaggtttt

SEQ ID NO: 468337 - DNA, 25 bp, Mus musculus
gagaataaaatggatgcaaggtttt

SEQ ID NO: 468338 - DNA, 25 bp, Mus musculus
gagaataagtctccccatgcaggca

SEQ ID NO: 468339 - DNA, 25 bp, Mus musculus
gagaataagtctgcccatgcaggca

SEQ ID NO: 468340 - DNA, 25 bp, Mus musculus
gagaataatccaagcctggtctcct

SEQ ID NO: 468341 - DNA, 25 bp, Mus musculus
gagaataatccatgcctggtctcct

SEQ ID NO: 468342 - DNA, 25 bp, Mus musculus
gagaatacaaagacacttccctttt

SEQ ID NO: 468343 - DNA, 25 bp, Mus musculus
gagaatacaaagtcacttccctttt

SEQ ID NO: 468344 - DNA, 25 bp, Mus musculus
gagaatacaatcatctgcgccagtc

SEQ ID NO: 468345 - DNA, 25 bp, Mus musculus
gagaatacaatcttctgcgccagtc

SEQ ID NO: 468346 - DNA, 25 bp, Mus musculus
gagaatacagccctctttatcttct

SEQ ID NO: 468347 - DNA, 25 bp, Mus musculus
gagaatacagccgtctttatcttct

SEQ ID NO: 468348 - DNA, 25 bp, Mus musculus
gagaatacagttcttggccttgacc

SEQ ID NO: 468349 - DNA, 25 bp, Mus musculus
gagaatacagttgttggccttgacc

SEQ ID NO: 468350 - DNA, 25 bp, Mus musculus
gagaatacatgtactatgttgggaa

SEQ ID NO: 468351 - DNA, 25 bp, Mus musculus
gagaatacatgttctatgttgggaa

SEQ ID NO: 468352 - DNA, 25 bp, Mus musculus
gagaataccacaaggccgttcggga

SEQ ID NO: 468353 - DNA, 25 bp, Mus musculus
gagaataccacatggccgttcggga

SEQ ID NO: 468354 - DNA, 25 bp, Mus musculus
gagaatacccagaacaccccttatt

SEQ ID NO: 468355 - DNA, 25 bp, Mus musculus
gagaatacccagtacaccccttatt

SEQ ID NO: 468356 - DNA, 25 bp, Mus musculus
gagaataccctccatgggatgcctg

SEQ ID NO: 468357 - DNA, 25 bp, Mus musculus
gagaataccctcgatgggatgcctg

SEQ ID NO: 468358 - DNA, 25 bp, Mus musculus
gagaataccggcagttatacaagaa

SEQ ID NO: 468359 - DNA, 25 bp, Mus musculus
gagaataccggctgttatacaagaa

SEQ ID NO: 468360 - DNA, 25 bp, Mus musculus
gagaatacgatcacctactcacttc

SEQ ID NO: 468361 - DNA, 25 bp, Mus musculus
gagaatacgatctcctactcacttc

SEQ ID NO: 468362 - DNA, 25 bp, Mus musculus
gagaatacgcctactgacccagcag

SEQ ID NO: 468363 - DNA, 25 bp, Mus musculus
gagaatacgccttctgacccagcag

SEQ ID NO: 468364 - DNA, 25 bp, Mus musculus
gagaatactaccacagtctatagaa

SEQ ID NO: 468365 - DNA, 25 bp, Mus musculus
gagaatactacctcagtctatagaa

SEQ ID NO: 468366 - DNA, 25 bp, Mus musculus
gagaatactattactttcagattat

SEQ ID NO: 468367 - DNA, 25 bp, Mus musculus
gagaatactatttctttcagattat

SEQ ID NO: 468368 - DNA, 25 bp, Mus musculus
gagaatactggccactactttccat

SEQ ID NO: 468369 - DNA, 25 bp, Mus musculus
gagaatactggcgactactttccat

SEQ ID NO: 468370 - DNA, 25 bp, Mus musculus
gagaatacttgtcgcctctacagtc

SEQ ID NO: 468371 - DNA, 25 bp, Mus musculus
gagaatacttgtggcctctacagtc

SEQ ID NO: 468372 - DNA, 25 bp, Mus musculus
gagaatagacttcctgaccacagct

SEQ ID NO: 468373 - DNA, 25 bp, Mus musculus
gagaatagacttgctgaccacagct

SEQ ID NO: 468374 - DNA, 25 bp, Mus musculus
gagaataggaacctgcctgtctcct

SEQ ID NO: 468375 - DNA, 25 bp, Mus musculus
gagaataggaacgtgcctgtctcct

SEQ ID NO: 468376 - DNA, 25 bp, Mus musculus
gagaataggcagacacatcccctct

SEQ ID NO: 468377 - DNA, 25 bp, Mus musculus
gagaataggcagtcacatcccctct

SEQ ID NO: 468378 - DNA, 25 bp, Mus musculus
gagaataggtccatgtctgtaaaaa

SEQ ID NO: 468379 - DNA, 25 bp, Mus musculus
gagaataggtccttgtctgtaaaaa

SEQ ID NO: 468380 - DNA, 25 bp, Mus musculus
gagaatatagtacttcattgtgtgg

SEQ ID NO: 468381 - DNA, 25 bp, Mus musculus
gagaatatagtagttcattgtgtgg

SEQ ID NO: 468382 - DNA, 25 bp, Mus musculus
gagaatatgaacatttaaccaaagt

SEQ ID NO: 468383 - DNA, 25 bp, Mus musculus
gagaatatgaacttttaaccaaagt

SEQ ID NO: 468384 - DNA, 25 bp, Mus musculus
gagaatatgctaccacacaccgctg

SEQ ID NO: 468385 - DNA, 25 bp, Mus musculus
gagaatatgctagcacacaccgctg

SEQ ID NO: 468386 - DNA, 25 bp, Mus musculus
gagaatatggacagctatcctcccc

SEQ ID NO: 468387 - DNA, 25 bp, Mus musculus
gagaatatggactgctatcctcccc

SEQ ID NO: 468388 - DNA, 25 bp, Mus musculus
gagaatattattcctcttaccttgg

SEQ ID NO: 468389 - DNA, 25 bp, Mus musculus
gagaatattattgctcttaccttgg

SEQ ID NO: 468390 - DNA, 25 bp, Mus musculus
gagaatattcttcattggtcagcat

SEQ ID NO: 468391 - DNA, 25 bp, Mus musculus
gagaatattcttgattggtcagcat

SEQ ID NO: 468392 - DNA, 25 bp, Mus musculus
gagaatattggcagctcctccgagc

SEQ ID NO: 468393 - DNA, 25 bp, Mus musculus
gagaatattggctgctcctccgagc

SEQ ID NO: 468394 - DNA, 25 bp, Mus musculus
gagaatatttcaccttcgatgtata

SEQ ID NO: 468395 - DNA, 25 bp, Mus musculus
gagaatatttcagcttcgatgtata

SEQ ID NO: 468396 - DNA, 25 bp, Mus musculus
gagaatattttcataaactcctagg

SEQ ID NO: 468397 - DNA, 25 bp, Mus musculus
gagaatattttcttaaactcctagg

SEQ ID NO: 468398 - DNA, 25 bp, Mus musculus
gagaatcaaagcatcagtagactct

SEQ ID NO: 468399 - DNA, 25 bp, Mus musculus
gagaatcaaagcttcagtagactct

SEQ ID NO: 468400 - DNA, 25 bp, Mus musculus
gagaatcaactcaactgtcagtact

SEQ ID NO: 468401 - DNA, 25 bp, Mus musculus
gagaatcaactctactgtcagtact

SEQ ID NO: 468402 - DNA, 25 bp, Mus musculus
gagaatcacaggagctaccactgac

SEQ ID NO: 468403 - DNA, 25 bp, Mus musculus
gagaatcacaggtgctaccactgac

SEQ ID NO: 468404 - DNA, 25 bp, Mus musculus
gagaatcacccaacagtacttcgct

SEQ ID NO: 468405 - DNA, 25 bp, Mus musculus
gagaatcacccatcagtacttcgct

SEQ ID NO: 468406 - DNA, 25 bp, Mus musculus
gagaatcacccgactcctaatttta

SEQ ID NO: 468407 - DNA, 25 bp, Mus musculus
gagaatcacccgtctcctaatttta

SEQ ID NO: 468408 - DNA, 25 bp, Mus musculus
gagaatcaccggacagagtttcccc

SEQ ID NO: 468409 - DNA, 25 bp, Mus musculus
gagaatcaccggtcagagtttcccc

SEQ ID NO: 468410 - DNA, 25 bp, Mus musculus
gagaatcactaacgatttactgata

SEQ ID NO: 468411 - DNA, 25 bp, Mus musculus
gagaatcactaaggatttactgata

SEQ ID NO: 468412 - DNA, 25 bp, Mus musculus
gagaatcactaccagaaaaacacct

SEQ ID NO: 468413 - DNA, 25 bp, Mus musculus
gagaatcactacgagaaaaacacct

SEQ ID NO: 468414 - DNA, 25 bp, Mus musculus
gagaatcagactctgggtcccaggc

SEQ ID NO: 468415 - DNA, 25 bp, Mus musculus
gagaatcagactgtgggtcccaggc

SEQ ID NO: 468416 - DNA, 25 bp, Mus musculus
gagaatcagaggagccacaatcata

SEQ ID NO: 468417 - DNA, 25 bp, Mus musculus
gagaatcagaggatccacagtagca

SEQ ID NO: 468418 - DNA, 25 bp, Mus musculus
gagaatcagaggtgccacaatcata

SEQ ID NO: 468419 - DNA, 25 bp, Mus musculus
gagaatcagaggttccacagtagca

SEQ ID NO: 468420 - DNA, 25 bp, Mus musculus
gagaatcagcctatagagccaaagc

SEQ ID NO: 468421 - DNA, 25 bp, Mus musculus
gagaatcagcctttagagccaaagc

SEQ ID NO: 468422 - DNA, 25 bp, Mus musculus
gagaatcagcttatacaccatttgg

SEQ ID NO: 468423 - DNA, 25 bp, Mus musculus
gagaatcagcttttacaccatttgg

SEQ ID NO: 468424 - DNA, 25 bp, Mus musculus
gagaatcagggacgagccccatgat

SEQ ID NO: 468425 - DNA, 25 bp, Mus musculus
gagaatcagggaggagccccatgat

SEQ ID NO: 468426 - DNA, 25 bp, Mus musculus
gagaatcagtttagaccttgggttg

SEQ ID NO: 468427 - DNA, 25 bp, Mus musculus
gagaatcagttttgaccttgggttg

SEQ ID NO: 468428 - DNA, 25 bp, Mus musculus
gagaatcataagcttaaggctagcc

SEQ ID NO: 468429 - DNA, 25 bp, Mus musculus
gagaatcataaggttaaggctagcc

SEQ ID NO: 468430 - DNA, 25 bp, Mus musculus
gagaatcatcatagctcttccatcg

SEQ ID NO: 468431 - DNA, 25 bp, Mus musculus
gagaatcatcattgctcttccatcg

SEQ ID NO: 468432 - DNA, 25 bp, Mus musculus
gagaatcatccgaagcagcaacaga

SEQ ID NO: 468433 - DNA, 25 bp, Mus musculus
gagaatcatccgctaagcaaacaga

SEQ ID NO: 468434 - DNA, 25 bp, Mus musculus
gagaatcatccggtaagcaaacaga

SEQ ID NO: 468435 - DNA, 25 bp, Mus musculus
gagaatcatccgtagcagcaacaga

SEQ ID NO: 468436 - DNA, 25 bp, Mus musculus
gagaatcatctaaacaccaaacact

SEQ ID NO: 468437 - DNA, 25 bp, Mus musculus
gagaatcatctatacaccaaacact

SEQ ID NO: 468438 - DNA, 25 bp, Mus musculus
gagaatcattccaagagaccgagtt

SEQ ID NO: 468439 - DNA, 25 bp, Mus musculus
gagaatcattcctagagaccgagtt

SEQ ID NO: 468440 - DNA, 25 bp, Mus musculus
gagaatcatttacactgtaccgtaa

SEQ ID NO: 468441 - DNA, 25 bp, Mus musculus
gagaatcatttagactgtaccgtaa

SEQ ID NO: 468442 - DNA, 25 bp, Mus musculus
gagaatccaaagaatctgctccatg

SEQ ID NO: 468443 - DNA, 25 bp, Mus musculus
gagaatccaaagtatctgctccatg

SEQ ID NO: 468444 - DNA, 25 bp, Mus musculus
gagaatccacacagcatggaatctt

SEQ ID NO: 468445 - DNA, 25 bp, Mus musculus
gagaatccacactgcatggaatctt

SEQ ID NO: 468446 - DNA, 25 bp, Mus musculus
gagaatccacgacttgtaagaaaat

SEQ ID NO: 468447 - DNA, 25 bp, Mus musculus
gagaatccacgagttgtaagaaaat

SEQ ID NO: 468448 - DNA, 25 bp, Mus musculus
gagaatccagacaactaccagctaa

SEQ ID NO: 468449 - DNA, 25 bp, Mus musculus
gagaatccagactactaccagctaa

SEQ ID NO: 468450 - DNA, 25 bp, Mus musculus
gagaatccagctatgacctttattc

SEQ ID NO: 468451 - DNA, 25 bp, Mus musculus
gagaatccagctttgacctttattc

SEQ ID NO: 468452 - DNA, 25 bp, Mus musculus
gagaatccaggaccacagtgacaca

SEQ ID NO: 468453 - DNA, 25 bp, Mus musculus
gagaatccaggagcacagtgacaca

SEQ ID NO: 468454 - DNA, 25 bp, Mus musculus
gagaatccaggcactgctgaaagaa

SEQ ID NO: 468455 - DNA, 25 bp, Mus musculus
gagaatccaggctctgctgaaagaa

SEQ ID NO: 468456 - DNA, 25 bp, Mus musculus
gagaatccatctacatggccaactc

SEQ ID NO: 468457 - DNA, 25 bp, Mus musculus
gagaatccatctatgatcatggtca

SEQ ID NO: 468458 - DNA, 25 bp, Mus musculus
gagaatccatcttcatggccaactc

SEQ ID NO: 468459 - DNA, 25 bp, Mus musculus
gagaatccatctttgatcatggtca

SEQ ID NO: 468460 - DNA, 25 bp, Mus musculus
gagaatccatgcctacagccagctg

SEQ ID NO: 468461 - DNA, 25 bp, Mus musculus
gagaatccatgcgtacagccagctg

SEQ ID NO: 468462 - DNA, 25 bp, Mus musculus
gagaatcccaaaaagtacatccctg

SEQ ID NO: 468463 - DNA, 25 bp, Mus musculus
gagaatcccaaatagtacatccctg

SEQ ID NO: 468464 - DNA, 25 bp, Mus musculus
gagaatcccacccttcaagaataat

SEQ ID NO: 468465 - DNA, 25 bp, Mus musculus
gagaatcccaccgttcaagaataat

SEQ ID NO: 468466 - DNA, 25 bp, Mus musculus
gagaatcccacgagtcagatttcta

SEQ ID NO: 468467 - DNA, 25 bp, Mus musculus
gagaatcccacgtgtcagatttcta

SEQ ID NO: 468468 - DNA, 25 bp, Mus musculus
gagaatcccaggatgttgatcaagt

SEQ ID NO: 468469 - DNA, 25 bp, Mus musculus
gagaatcccaggttgttgatcaagt

SEQ ID NO: 468470 - DNA, 25 bp, Mus musculus
gagaatcccagtcaggctgcaagtg

SEQ ID NO: 468471 - DNA, 25 bp, Mus musculus
gagaatcccagtgaggctgcaagtg

SEQ ID NO: 468472 - DNA, 25 bp, Mus musculus
gagaatcccatgctctgtcctgaat

SEQ ID NO: 468473 - DNA, 25 bp, Mus musculus
gagaatcccatggtctgtcctgaat

SEQ ID NO: 468474 - DNA, 25 bp, Mus musculus
gagaatcccattaaagctttatgaa

SEQ ID NO: 468475 - DNA, 25 bp, Mus musculus
gagaatcccatttaagctttatgaa

SEQ ID NO: 468476 - DNA, 25 bp, Mus musculus
gagaatcccgtcatgaattagtcac

SEQ ID NO: 468477 - DNA, 25 bp, Mus musculus
gagaatcccgtcttgaattagtcac

SEQ ID NO: 468478 - DNA, 25 bp, Mus musculus
gagaatccgtttatactgctgttca

SEQ ID NO: 468479 - DNA, 25 bp, Mus musculus
gagaatccgtttttactgctgttca

SEQ ID NO: 468480 - DNA, 25 bp, Mus musculus
gagaatcctggactgattgccacat

SEQ ID NO: 468481 - DNA, 25 bp, Mus musculus
gagaatcctggagtgattgccacat

SEQ ID NO: 468482 - DNA, 25 bp, Mus musculus
gagaatcctgggaagtgtgaaatat

SEQ ID NO: 468483 - DNA, 25 bp, Mus musculus
gagaatcctgggtagtgtgaaatat

SEQ ID NO: 468484 - DNA, 25 bp, Mus musculus
gagaatcctgtacgcacctggacat

SEQ ID NO: 468485 - DNA, 25 bp, Mus musculus
gagaatcctgtaggcacctggacat

SEQ ID NO: 468486 - DNA, 25 bp, Mus musculus
gagaatccttgtatgtcttgggccc

SEQ ID NO: 468487 - DNA, 25 bp, Mus musculus
gagaatccttgtattcaccatcctt

SEQ ID NO: 468488 - DNA, 25 bp, Mus musculus
gagaatccttgtttgtcttgggccc

SEQ ID NO: 468489 - DNA, 25 bp, Mus musculus
gagaatccttgttttcaccatcctt

SEQ ID NO: 468490 - DNA, 25 bp, Mus musculus
gagaatcctttactggctctaccaa

SEQ ID NO: 468491 - DNA, 25 bp, Mus musculus
gagaatcctttagtggctctaccaa

SEQ ID NO: 468492 - DNA, 25 bp, Mus musculus
gagaatcgacgacgagccaaaattt

SEQ ID NO: 468493 - DNA, 25 bp, Mus musculus
gagaatcgacgaggagccaaaattt

SEQ ID NO: 468494 - DNA, 25 bp, Mus musculus
gagaatcgcgaaccttctagaagcc

SEQ ID NO: 468495 - DNA, 25 bp, Mus musculus
gagaatcgcgaagcttctagaagcc

SEQ ID NO: 468496 - DNA, 25 bp, Mus musculus
gagaatcgctgtccattggaaacca

SEQ ID NO: 468497 - DNA, 25 bp, Mus musculus
gagaatcgctgtgcattggaaacca

SEQ ID NO: 468498 - DNA, 25 bp, Mus musculus
gagaatcgcttgacagtgcagtcaa

SEQ ID NO: 468499 - DNA, 25 bp, Mus musculus
gagaatcgcttgtcagtgcagtcaa

SEQ ID NO: 468500 - DNA, 25 bp, Mus musculus
gagaatcggaacattccatccacct

SEQ ID NO: 468501 - DNA, 25 bp, Mus musculus
gagaatcggaactttccatccacct

SEQ ID NO: 468502 - DNA, 25 bp, Mus musculus
gagaatcggcatctaagtcttcaaa

SEQ ID NO: 468503 - DNA, 25 bp, Mus musculus
gagaatcggcatgtaagtcttcaaa

SEQ ID NO: 468504 - DNA, 25 bp, Mus musculus
gagaatcgtccacactcttcaagtc

SEQ ID NO: 468505 - DNA, 25 bp, Mus musculus
gagaatcgtccagactcttcaagtc

SEQ ID NO: 468506 - DNA, 25 bp, Mus musculus
gagaatctagagatctgacactccc

SEQ ID NO: 468507 - DNA, 25 bp, Mus musculus
gagaatctagagttctgacactccc

SEQ ID NO: 468508 - DNA, 25 bp, Mus musculus
gagaatctagtccaccagtcagtct

SEQ ID NO: 468509 - DNA, 25 bp, Mus musculus
gagaatctagtcgaccagtcagtct

SEQ ID NO: 468510 - DNA, 25 bp, Mus musculus
gagaatctatacactatggctcatt

SEQ ID NO: 468511 - DNA, 25 bp, Mus musculus
gagaatctatactctatggctcatt

SEQ ID NO: 468512 - DNA, 25 bp, Mus musculus
gagaatctcaaactggaatccaaaa

SEQ ID NO: 468513 - DNA, 25 bp, Mus musculus
gagaatctcaaagtggaatccaaaa

SEQ ID NO: 468514 - DNA, 25 bp, Mus musculus
gagaatctcaagagctgtgtcttgc

SEQ ID NO: 468515 - DNA, 25 bp, Mus musculus
gagaatctcaagtgctgtgtcttgc

SEQ ID NO: 468516 - DNA, 25 bp, Mus musculus
gagaatctccaaattgcctagtgaa

SEQ ID NO: 468517 - DNA, 25 bp, Mus musculus
gagaatctccaatttgcctagtgaa

SEQ ID NO: 468518 - DNA, 25 bp, Mus musculus
gagaatctccataaccaaactgcag

SEQ ID NO: 468519 - DNA, 25 bp, Mus musculus
gagaatctccatcagctttctattt

SEQ ID NO: 468520 - DNA, 25 bp, Mus musculus
gagaatctccatgagctttctattt

SEQ ID NO: 468521 - DNA, 25 bp, Mus musculus
gagaatctccattaccaaactgcag

SEQ ID NO: 468522 - DNA, 25 bp, Mus musculus
gagaatctccgcagttgcaagaaca

SEQ ID NO: 468523 - DNA, 25 bp, Mus musculus
gagaatctccgctgttgcaagaaca

SEQ ID NO: 468524 - DNA, 25 bp, Mus musculus
gagaatctcctgaatatccagaaga

SEQ ID NO: 468525 - DNA, 25 bp, Mus musculus
gagaatctcctgtatatccagaaga

SEQ ID NO: 468526 - DNA, 25 bp, Mus musculus
gagaatctcgaaccgttttgttgta

SEQ ID NO: 468527 - DNA, 25 bp, Mus musculus
gagaatctcgaagcgttttgttgta

SEQ ID NO: 468528 - DNA, 25 bp, Mus musculus
gagaatctgacccagttacctaaat

SEQ ID NO: 468529 - DNA, 25 bp, Mus musculus
gagaatctgaccgagttacctaaat

SEQ ID NO: 468530 - DNA, 25 bp, Mus musculus
gagaatctgcctcaattggccaaca

SEQ ID NO: 468531 - DNA, 25 bp, Mus musculus
gagaatctgcctgaattggccaaca

SEQ ID NO: 468532 - DNA, 25 bp, Mus musculus
gagaatctggagaacgcagcttaaa

SEQ ID NO: 468533 - DNA, 25 bp, Mus musculus
gagaatctggagaccatttgttaat

SEQ ID NO: 468534 - DNA, 25 bp, Mus musculus
gagaatctggagtacgcagcttaaa

SEQ ID NO: 468535 - DNA, 25 bp, Mus musculus
gagaatctggagtccatttgttaat

SEQ ID NO: 468536 - DNA, 25 bp, Mus musculus
gagaatctggccaggattgacctct

SEQ ID NO: 468537 - DNA, 25 bp, Mus musculus
gagaatctggcctggattgacctct

SEQ ID NO: 468538 - DNA, 25 bp, Mus musculus
gagaatctgggaagtatgctcctac

SEQ ID NO: 468539 - DNA, 25 bp, Mus musculus
gagaatctgggatgtatgctcctac

SEQ ID NO: 468540 - DNA, 25 bp, Mus musculus
gagaatctgttactgaagacaatgt

SEQ ID NO: 468541 - DNA, 25 bp, Mus musculus
gagaatctgttagtgaagacaatgt

SEQ ID NO: 468542 - DNA, 25 bp, Mus musculus
gagaatcttcaacgccgagctgtgg

SEQ ID NO: 468543 - DNA, 25 bp, Mus musculus
gagaatcttcaaggccgagctgtgg

SEQ ID NO: 468544 - DNA, 25 bp, Mus musculus
gagaatcttcacagtgaccgtggaa

SEQ ID NO: 468545 - DNA, 25 bp, Mus musculus
gagaatcttcactgtgaccgtggaa

SEQ ID NO: 468546 - DNA, 25 bp, Mus musculus
gagaatcttcatccatggcctttaa

SEQ ID NO: 468547 - DNA, 25 bp, Mus musculus
gagaatcttcatgcatggcctttaa

SEQ ID NO: 468548 - DNA, 25 bp, Mus musculus
gagaatcttcctagcctggctttat

SEQ ID NO: 468549 - DNA, 25 bp, Mus musculus
gagaatcttccttgcctggctttat

SEQ ID NO: 468550 - DNA, 25 bp, Mus musculus
gagaatcttctactccaaactctgg

SEQ ID NO: 468551 - DNA, 25 bp, Mus musculus
gagaatcttctagtccaaactctgg

SEQ ID NO: 468552 - DNA, 25 bp, Mus musculus
gagaatcttctgattagtccgtgct

SEQ ID NO: 468553 - DNA, 25 bp, Mus musculus
gagaatcttctgtttagtccgtgct

SEQ ID NO: 468554 - DNA, 25 bp, Mus musculus
gagaatcttgagatggaggttagcc

SEQ ID NO: 468555 - DNA, 25 bp, Mus musculus
gagaatcttgagttggaggttagcc

SEQ ID NO: 468556 - DNA, 25 bp, Mus musculus
gagaatcttgatatggtccacttta

SEQ ID NO: 468557 - DNA, 25 bp, Mus musculus
gagaatcttgatttggtccacttta

SEQ ID NO: 468558 - DNA, 25 bp, Mus musculus
gagaatcttgcacacaatgttgaaa

SEQ ID NO: 468559 - DNA, 25 bp, Mus musculus
gagaatcttgcagacaatgttgaaa

SEQ ID NO: 468560 - DNA, 25 bp, Mus musculus
gagaatcttgggattgctgcaaacc

SEQ ID NO: 468561 - DNA, 25 bp, Mus musculus
gagaatcttgggtttgctgcaaacc

SEQ ID NO: 468562 - DNA, 25 bp, Mus musculus
gagaatcttgtgaacagtccctgga

SEQ ID NO: 468563 - DNA, 25 bp, Mus musculus
gagaatcttgtgtacagtccctgga

SEQ ID NO: 468564 - DNA, 25 bp, Mus musculus
gagaatctttttaatgtcatgtgct

SEQ ID NO: 468565 - DNA, 25 bp, Mus musculus
gagaatcttttttatgtcatgtgct

SEQ ID NO: 468566 - DNA, 25 bp, Mus musculus
gagaatgaagaaacctttatcctgg

SEQ ID NO: 468567 - DNA, 25 bp, Mus musculus
gagaatgaagaatcctttatcctgg

SEQ ID NO: 468568 - DNA, 25 bp, Mus musculus
gagaatgaagctcacggtgccccga

SEQ ID NO: 468569 - DNA, 25 bp, Mus musculus
gagaatgaagctgacggtgccccga

SEQ ID NO: 468570 - DNA, 25 bp, Mus musculus
gagaatgaatccctctggaaacact

SEQ ID NO: 468571 - DNA, 25 bp, Mus musculus
gagaatgaatccgtctggaaacact

SEQ ID NO: 468572 - DNA, 25 bp, Mus musculus
gagaatgacaacatccaggatgacc

SEQ ID NO: 468573 - DNA, 25 bp, Mus musculus
gagaatgacaacttccaggatgacc

SEQ ID NO: 468574 - DNA, 25 bp, Mus musculus
gagaatgacaccatgacggagatca

SEQ ID NO: 468575 - DNA, 25 bp, Mus musculus
gagaatgacaccttgacggagatca

SEQ ID NO: 468576 - DNA, 25 bp, Mus musculus
gagaatgacagaactccttgccctc

SEQ ID NO: 468577 - DNA, 25 bp, Mus musculus
gagaatgacagatctccttgccctc

SEQ ID NO: 468578 - DNA, 25 bp, Mus musculus
gagaatgacatcaccagccgctcgg

SEQ ID NO: 468579 - DNA, 25 bp, Mus musculus
gagaatgacatctccagccgctcgg

SEQ ID NO: 468580 - DNA, 25 bp, Mus musculus
gagaatgacatgcttgacctggctt

SEQ ID NO: 468581 - DNA, 25 bp, Mus musculus
gagaatgacatggttgacctggctt

SEQ ID NO: 468582 - DNA, 25 bp, Mus musculus
gagaatgacattcctaggcactctt

SEQ ID NO: 468583 - DNA, 25 bp, Mus musculus
gagaatgacattgctaggcactctt

SEQ ID NO: 468584 - DNA, 25 bp, Mus musculus
gagaatgaccacattgacacctacg

SEQ ID NO: 468585 - DNA, 25 bp, Mus musculus
gagaatgaccactttgacacctacg

SEQ ID NO: 468586 - DNA, 25 bp, Mus musculus
gagaatgacccaagaccctgatgat

SEQ ID NO: 468587 - DNA, 25 bp, Mus musculus
gagaatgacccatgaccctgatgat

SEQ ID NO: 468588 - DNA, 25 bp, Mus musculus
gagaatgacgatctgcaccttagac

SEQ ID NO: 468589 - DNA, 25 bp, Mus musculus
gagaatgacgatgtgcaccttagac

SEQ ID NO: 468590 - DNA, 25 bp, Mus musculus
gagaatgacgtgagctgcgagccac

SEQ ID NO: 468591 - DNA, 25 bp, Mus musculus
gagaatgacgtgtgctgcgagccac

SEQ ID NO: 468592 - DNA, 25 bp, Mus musculus
gagaatgacttcctgttatgacaca

SEQ ID NO: 468593 - DNA, 25 bp, Mus musculus
gagaatgacttcgtgttatgacaca

SEQ ID NO: 468594 - DNA, 25 bp, Mus musculus
gagaatgagcaaatggccccagtga

SEQ ID NO: 468595 - DNA, 25 bp, Mus musculus
gagaatgagcaattggccccagtga

SEQ ID NO: 468596 - DNA, 25 bp, Mus musculus
gagaatgagccccagatacgctgcc

SEQ ID NO: 468597 - DNA, 25 bp, Mus musculus
gagaatgagcccgagatacgctgcc

SEQ ID NO: 468598 - DNA, 25 bp, Mus musculus
gagaatgagtcccatcagttgatat

SEQ ID NO: 468599 - DNA, 25 bp, Mus musculus
gagaatgagtccgatcagttgatat

SEQ ID NO: 468600 - DNA, 25 bp, Mus musculus
gagaatgataggaccccatttctat

SEQ ID NO: 468601 - DNA, 25 bp, Mus musculus
gagaatgataggtccccatttctat

SEQ ID NO: 468602 - DNA, 25 bp, Mus musculus
gagaatgatagtcttctgtctacac

SEQ ID NO: 468603 - DNA, 25 bp, Mus musculus
gagaatgatagtgttctgtctacac

SEQ ID NO: 468604 - DNA, 25 bp, Mus musculus
gagaatgatctgcaactcccgatcc

SEQ ID NO: 468605 - DNA, 25 bp, Mus musculus
gagaatgatctggaactcccgatcc

SEQ ID NO: 468606 - DNA, 25 bp, Mus musculus
gagaatgatcttcttctgtaagaca

SEQ ID NO: 468607 - DNA, 25 bp, Mus musculus
gagaatgatcttgttctgtaagaca

SEQ ID NO: 468608 - DNA, 25 bp, Mus musculus
gagaatgatgggaacgcccctgatg

SEQ ID NO: 468609 - DNA, 25 bp, Mus musculus
gagaatgatgggtacgcccctgatg

SEQ ID NO: 468610 - DNA, 25 bp, Mus musculus
gagaatgcaggcatagctgcccaaa

SEQ ID NO: 468611 - DNA, 25 bp, Mus musculus
gagaatgcaggcttagctgcccaaa

SEQ ID NO: 468612 - DNA, 25 bp, Mus musculus
gagaatgcatatcccgtggctcagc

SEQ ID NO: 468613 - DNA, 25 bp, Mus musculus
gagaatgcatatgccgtggctcagc

SEQ ID NO: 468614 - DNA, 25 bp, Mus musculus
gagaatgcatcacaaaactgcagct

SEQ ID NO: 468615 - DNA, 25 bp, Mus musculus
gagaatgcatcagaaaactgcagct

SEQ ID NO: 468616 - DNA, 25 bp, Mus musculus
gagaatgcatctaccaagaccatga

SEQ ID NO: 468617 - DNA, 25 bp, Mus musculus
gagaatgcatcttccaagaccatga

SEQ ID NO: 468618 - DNA, 25 bp, Mus musculus
gagaatgccacactacatgtaactt

SEQ ID NO: 468619 - DNA, 25 bp, Mus musculus
gagaatgccacagtacatgtaactt

SEQ ID NO: 468620 - DNA, 25 bp, Mus musculus
gagaatgccactcacaatcatgttt

SEQ ID NO: 468621 - DNA, 25 bp, Mus musculus
gagaatgccactgacaatcatgttt

SEQ ID NO: 468622 - DNA, 25 bp, Mus musculus
gagaatgccagaactcattcccaag

SEQ ID NO: 468623 - DNA, 25 bp, Mus musculus
gagaatgccagatctcattcccaag

SEQ ID NO: 468624 - DNA, 25 bp, Mus musculus
gagaatgccagtcctctcatgagca

SEQ ID NO: 468625 - DNA, 25 bp, Mus musculus
gagaatgccagtgctctcatgagca

SEQ ID NO: 468626 - DNA, 25 bp, Mus musculus
gagaatgccattctgaggctcccaa

SEQ ID NO: 468627 - DNA, 25 bp, Mus musculus
gagaatgccattgtgaggctcccaa

SEQ ID NO: 468628 - DNA, 25 bp, Mus musculus
gagaatgcctaaaaccacagatggt

SEQ ID NO: 468629 - DNA, 25 bp, Mus musculus
gagaatgcctaaattacatacgaaa

SEQ ID NO: 468630 - DNA, 25 bp, Mus musculus
gagaatgcctaataccacagatggt

SEQ ID NO: 468631 - DNA, 25 bp, Mus musculus
gagaatgcctaatttacatacgaaa

SEQ ID NO: 468632 - DNA, 25 bp, Mus musculus
gagaatgcgcagctacgtttaattt

SEQ ID NO: 468633 - DNA, 25 bp, Mus musculus
gagaatgcgcaggtacgtttaattt

SEQ ID NO: 468634 - DNA, 25 bp, Mus musculus
gagaatgcgcttaggctgtgctgat

SEQ ID NO: 468635 - DNA, 25 bp, Mus musculus
gagaatgcgctttggctgtgctgat

SEQ ID NO: 468636 - DNA, 25 bp, Mus musculus
gagaatgctcggcaggactttcagc

SEQ ID NO: 468637 - DNA, 25 bp, Mus musculus
gagaatgctcgggaggactttcagc

SEQ ID NO: 468638 - DNA, 25 bp, Mus musculus
gagaatgctcgtctgctagactgga

SEQ ID NO: 468639 - DNA, 25 bp, Mus musculus
gagaatgctcgtgtgctagactgga

SEQ ID NO: 468640 - DNA, 25 bp, Mus musculus
gagaatgctctgagatcccaagcca

SEQ ID NO: 468641 - DNA, 25 bp, Mus musculus
gagaatgctctgtgatcccaagcca

SEQ ID NO: 468642 - DNA, 25 bp, Mus musculus
gagaatgctcttccctttgagctct

SEQ ID NO: 468643 - DNA, 25 bp, Mus musculus
gagaatgctcttgcctttgagctct

SEQ ID NO: 468644 - DNA, 25 bp, Mus musculus
gagaatgctgacaagtccaggagac

SEQ ID NO: 468645 - DNA, 25 bp, Mus musculus
gagaatgctgactagtccaggagac

SEQ ID NO: 468646 - DNA, 25 bp, Mus musculus
gagaatgctgcactctgcaccttag

SEQ ID NO: 468647 - DNA, 25 bp, Mus musculus
gagaatgctgcagtctgcaccttag

SEQ ID NO: 468648 - DNA, 25 bp, Mus musculus
gagaatgctgctctggatacgccat

SEQ ID NO: 468649 - DNA, 25 bp, Mus musculus
gagaatgctgctgtggatacgccat

SEQ ID NO: 468650 - DNA, 25 bp, Mus musculus
gagaatgctgttaccctcatagttt

SEQ ID NO: 468651 - DNA, 25 bp, Mus musculus
gagaatgctgtttccctcatagttt

SEQ ID NO: 468652 - DNA, 25 bp, Mus musculus
gagaatgctttaacaaggatattat

SEQ ID NO: 468653 - DNA, 25 bp, Mus musculus
gagaatgctttatcaaggatattat

SEQ ID NO: 468654 - DNA, 25 bp, Mus musculus
gagaatgcttttatagcacatgcta

SEQ ID NO: 468655 - DNA, 25 bp, Mus musculus
gagaatgcttttttagcacatgcta

SEQ ID NO: 468656 - DNA, 25 bp, Mus musculus
gagaatggatacagcttgaaatgaa

SEQ ID NO: 468657 - DNA, 25 bp, Mus musculus
gagaatggatactgcttgaaatgaa

SEQ ID NO: 468658 - DNA, 25 bp, Mus musculus
gagaatggcaacaacctggacatca

SEQ ID NO: 468659 - DNA, 25 bp, Mus musculus
gagaatggcaactacctggacatca

SEQ ID NO: 468660 - DNA, 25 bp, Mus musculus
gagaatggcacaatcctggcctggg

SEQ ID NO: 468661 - DNA, 25 bp, Mus musculus
gagaatggcacattcctggcctggg

SEQ ID NO: 468662 - DNA, 25 bp, Mus musculus
gagaatggcactcatccggaaaaca

SEQ ID NO: 468663 - DNA, 25 bp, Mus musculus
gagaatggcactgatccggaaaaca

SEQ ID NO: 468664 - DNA, 25 bp, Mus musculus
gagaatggccacaatttgtaccgca

SEQ ID NO: 468665 - DNA, 25 bp, Mus musculus
gagaatggccactatttgtaccgca

SEQ ID NO: 468666 - DNA, 25 bp, Mus musculus
gagaatggccccaatatttgaatat

SEQ ID NO: 468667 - DNA, 25 bp, Mus musculus
gagaatggcccctatatttgaatat

SEQ ID NO: 468668 - DNA, 25 bp, Mus musculus
gagaatggccgccagtcacaccagt

SEQ ID NO: 468669 - DNA, 25 bp, Mus musculus
gagaatggccgcgagtcacaccagt

SEQ ID NO: 468670 - DNA, 25 bp, Mus musculus
gagaatggcgctctcattacaggcc

SEQ ID NO: 468671 - DNA, 25 bp, Mus musculus
gagaatggcgctgtcattacaggcc

SEQ ID NO: 468672 - DNA, 25 bp, Mus musculus
gagaatggctagcactgtacagact

SEQ ID NO: 468673 - DNA, 25 bp, Mus musculus
gagaatggctaggactgtacagact

SEQ ID NO: 468674 - DNA, 25 bp, Mus musculus
gagaatggctgtacttcttcaggaa

SEQ ID NO: 468675 - DNA, 25 bp, Mus musculus
gagaatggctgttcttcttcaggaa

SEQ ID NO: 468676 - DNA, 25 bp, Mus musculus
gagaatggcttcacaggttggacag

SEQ ID NO: 468677 - DNA, 25 bp, Mus musculus
gagaatggcttctcaggttggacag

SEQ ID NO: 468678 - DNA, 25 bp, Mus musculus
gagaatgggctaataaaaaacacct

SEQ ID NO: 468679 - DNA, 25 bp, Mus musculus
gagaatgggctattaaaaaacacct

SEQ ID NO: 468680 - DNA, 25 bp, Mus musculus
gagaatgggcttaaactctggtggc

SEQ ID NO: 468681 - DNA, 25 bp, Mus musculus
gagaatgggctttaactctggtggc

SEQ ID NO: 468682 - DNA, 25 bp, Mus musculus
gagaatggtaccctcctgcaaggca

SEQ ID NO: 468683 - DNA, 25 bp, Mus musculus
gagaatggtaccgtcctgcaaggca

SEQ ID NO: 468684 - DNA, 25 bp, Mus musculus
gagaatggtagcatccacctcaacc

SEQ ID NO: 468685 - DNA, 25 bp, Mus musculus
gagaatggtagcttccacctcaacc

SEQ ID NO: 468686 - DNA, 25 bp, Mus musculus
gagaatggtatcacccaatcctgac

SEQ ID NO: 468687 - DNA, 25 bp, Mus musculus
gagaatggtatctcccaatcctgac

SEQ ID NO: 468688 - DNA, 25 bp, Mus musculus
gagaatggtcttaatctacaagtta

SEQ ID NO: 468689 - DNA, 25 bp, Mus musculus
gagaatggtctttatctacaagtta

SEQ ID NO: 468690 - DNA, 25 bp, Mus musculus
gagaatggtgctctaaagcttctac

SEQ ID NO: 468691 - DNA, 25 bp, Mus musculus
gagaatggtgctgtaaagcttctac

SEQ ID NO: 468692 - DNA, 25 bp, Mus musculus
gagaatggtgttcctggtcagaatc

SEQ ID NO: 468693 - DNA, 25 bp, Mus musculus
gagaatggtgttgctggtcagaatc

SEQ ID NO: 468694 - DNA, 25 bp, Mus musculus
gagaatgtacctataatcactgaac

SEQ ID NO: 468695 - DNA, 25 bp, Mus musculus
gagaatgtacctttaatcactgaac

SEQ ID NO: 468696 - DNA, 25 bp, Mus musculus
gagaatgtagcactggtccccagag

SEQ ID NO: 468697 - DNA, 25 bp, Mus musculus
gagaatgtagcagtggtccccagag

SEQ ID NO: 468698 - DNA, 25 bp, Mus musculus
gagaatgtagtgacccagaagtgaa

SEQ ID NO: 468699 - DNA, 25 bp, Mus musculus
gagaatgtagtgtcccagaagtgaa

SEQ ID NO: 468700 - DNA, 25 bp, Mus musculus
gagaatgtatctagtgtcctgtgat

SEQ ID NO: 468701 - DNA, 25 bp, Mus musculus
gagaatgtatcttgtgtcctgtgat

SEQ ID NO: 468702 - DNA, 25 bp, Mus musculus
gagaatgtcaaacacttctgaattt

SEQ ID NO: 468703 - DNA, 25 bp, Mus musculus
gagaatgtcaaagacttctgaattt

SEQ ID NO: 468704 - DNA, 25 bp, Mus musculus
gagaatgtcatgatcgtgctgcctc

SEQ ID NO: 468705 - DNA, 25 bp, Mus musculus
gagaatgtcatgttcgtgctgcctc

SEQ ID NO: 468706 - DNA, 25 bp, Mus musculus
gagaatgtcccgatggatcgttcct

SEQ ID NO: 468707 - DNA, 25 bp, Mus musculus
gagaatgtcccgttggatcgttcct

SEQ ID NO: 468708 - DNA, 25 bp, Mus musculus
gagaatgtccttcttggttgtcaaa

SEQ ID NO: 468709 - DNA, 25 bp, Mus musculus
gagaatgtccttgttggttgtcaaa

SEQ ID NO: 468710 - DNA, 25 bp, Mus musculus
gagaatgtcttgctcatgtcttcat

SEQ ID NO: 468711 - DNA, 25 bp, Mus musculus
gagaatgtcttggtcatgtcttcat

SEQ ID NO: 468712 - DNA, 25 bp, Mus musculus
gagaatgtgaccacaataccgcctt

SEQ ID NO: 468713 - DNA, 25 bp, Mus musculus
gagaatgtgacctcaataccgcctt

SEQ ID NO: 468714 - DNA, 25 bp, Mus musculus
gagaatgtgctcctctgcaagccca

SEQ ID NO: 468715 - DNA, 25 bp, Mus musculus
gagaatgtgctcgtctgcaagccca

SEQ ID NO: 468716 - DNA, 25 bp, Mus musculus
gagaatgtgctgaccctcaagggcc

SEQ ID NO: 468717 - DNA, 25 bp, Mus musculus
gagaatgtgctgtccctcaagggcc

SEQ ID NO: 468718 - DNA, 25 bp, Mus musculus
gagaatgtggtgactctgtttagac

SEQ ID NO: 468719 - DNA, 25 bp, Mus musculus
gagaatgtggtgtctctgtttagac

SEQ ID NO: 468720 - DNA, 25 bp, Mus musculus
gagaatgtgttccattactgccaat

SEQ ID NO: 468721 - DNA, 25 bp, Mus musculus
gagaatgtgttcgattactgccaat

SEQ ID NO: 468722 - DNA, 25 bp, Mus musculus
gagaatgttactccagatccctttt

SEQ ID NO: 468723 - DNA, 25 bp, Mus musculus
gagaatgttactccctttgtttgat

SEQ ID NO: 468724 - DNA, 25 bp, Mus musculus
gagaatgttactgcagatccctttt

SEQ ID NO: 468725 - DNA, 25 bp, Mus musculus
gagaatgttactgcctttgtttgat

SEQ ID NO: 468726 - DNA, 25 bp, Mus musculus
gagaatgttcacagggtttatttcc

SEQ ID NO: 468727 - DNA, 25 bp, Mus musculus
gagaatgttcactgggtttatttcc

SEQ ID NO: 468728 - DNA, 25 bp, Mus musculus
gagaatgttcagaaggttgagttac

SEQ ID NO: 468729 - DNA, 25 bp, Mus musculus
gagaatgttcagtaggttgagttac

SEQ ID NO: 468730 - DNA, 25 bp, Mus musculus
gagaatgttcatagtcctctttgta

SEQ ID NO: 468731 - DNA, 25 bp, Mus musculus
gagaatgttcatcataccagagcaa

SEQ ID NO: 468732 - DNA, 25 bp, Mus musculus
gagaatgttcatgataccagagcaa

SEQ ID NO: 468733 - DNA, 25 bp, Mus musculus
gagaatgttcattgtcctctttgta

SEQ ID NO: 468734 - DNA, 25 bp, Mus musculus
gagaatgttctaacccacaatccat

SEQ ID NO: 468735 - DNA, 25 bp, Mus musculus
gagaatgttctacggcactctggga

SEQ ID NO: 468736 - DNA, 25 bp, Mus musculus
gagaatgttctagggcactctggga

SEQ ID NO: 468737 - DNA, 25 bp, Mus musculus
gagaatgttctatcccacaatccat

SEQ ID NO: 468738 - DNA, 25 bp, Mus musculus
gagaatgttctgagtgacaaccaac

SEQ ID NO: 468739 - DNA, 25 bp, Mus musculus
gagaatgttctgtgtgacaaccaac

SEQ ID NO: 468740 - DNA, 25 bp, Mus musculus
gagaatgttgccatgtggcctaggt

SEQ ID NO: 468741 - DNA, 25 bp, Mus musculus
gagaatgttgcccaccatcatagcc

SEQ ID NO: 468742 - DNA, 25 bp, Mus musculus
gagaatgttgccgaccatcatagcc

SEQ ID NO: 468743 - DNA, 25 bp, Mus musculus
gagaatgttgccttgtggcctaggt

SEQ ID NO: 468744 - DNA, 25 bp, Mus musculus
gagaatgttgttcctgcttttcctt

SEQ ID NO: 468745 - DNA, 25 bp, Mus musculus
gagaatgttgttgctgcttttcctt

SEQ ID NO: 468746 - DNA, 25 bp, Mus musculus
gagaatgtttaaagcccatgtggaa

SEQ ID NO: 468747 - DNA, 25 bp, Mus musculus
gagaatgtttaatgcccatgtggaa

SEQ ID NO: 468748 - DNA, 25 bp, Mus musculus
gagaatgtttgcagcagacatttct

SEQ ID NO: 468749 - DNA, 25 bp, Mus musculus
gagaatgtttgctgcagacatttct

SEQ ID NO: 468750 - DNA, 25 bp, Mus musculus
gagaatgttttcaggctgacttcca

SEQ ID NO: 468751 - DNA, 25 bp, Mus musculus
gagaatgttttctggctgacttcca

SEQ ID NO: 468752 - DNA, 25 bp, Mus musculus
gagaattaaaataactgcaaccggt

SEQ ID NO: 468753 - DNA, 25 bp, Mus musculus
gagaattaaaattactgcaaccggt

SEQ ID NO: 468754 - DNA, 25 bp, Mus musculus
gagaattaactgcacgactacatga

SEQ ID NO: 468755 - DNA, 25 bp, Mus musculus
gagaattaactggacgactacatga

SEQ ID NO: 468756 - DNA, 25 bp, Mus musculus
gagaattaagcacctgccctaactg

SEQ ID NO: 468757 - DNA, 25 bp, Mus musculus
gagaattaagcagctgccctaactg

SEQ ID NO: 468758 - DNA, 25 bp, Mus musculus
gagaattaagccattctctccacac

SEQ ID NO: 468759 - DNA, 25 bp, Mus musculus
gagaattaagcctttctctccacac

SEQ ID NO: 468760 - DNA, 25 bp, Mus musculus
gagaattaagtgagtgcaaccaagc

SEQ ID NO: 468761 - DNA, 25 bp, Mus musculus
gagaattaagtgtgtgcaaccaagc

SEQ ID NO: 468762 - DNA, 25 bp, Mus musculus
gagaattaatccaccaacatttgtc

SEQ ID NO: 468763 - DNA, 25 bp, Mus musculus
gagaattaatcctccaacatttgtc

SEQ ID NO: 468764 - DNA, 25 bp, Mus musculus
gagaattaattaagaagtacccaaa

SEQ ID NO: 468765 - DNA, 25 bp, Mus musculus
gagaattaattatgaagtacccaaa

SEQ ID NO: 468766 - DNA, 25 bp, Mus musculus
gagaattaatttaccatacaaatga

SEQ ID NO: 468767 - DNA, 25 bp, Mus musculus
gagaattaattttccatacaaatga

SEQ ID NO: 468768 - DNA, 25 bp, Mus musculus
gagaattacaagacacttattgaag

SEQ ID NO: 468769 - DNA, 25 bp, Mus musculus
gagaattacaagtcacttattgaag

SEQ ID NO: 468770 - DNA, 25 bp, Mus musculus
gagaattaccatagctcactgggac

SEQ ID NO: 468771 - DNA, 25 bp, Mus musculus
gagaattaccattgctcactgggac

SEQ ID NO: 468772 - DNA, 25 bp, Mus musculus
gagaattactctcgcatctgtgcat

SEQ ID NO: 468773 - DNA, 25 bp, Mus musculus
gagaattactctggcatctgtgcat

SEQ ID NO: 468774 - DNA, 25 bp, Mus musculus
gagaattacttcagatctgagccaa

SEQ ID NO: 468775 - DNA, 25 bp, Mus musculus
gagaattacttctgatctgagccaa

SEQ ID NO: 468776 - DNA, 25 bp, Mus musculus
gagaattagataatgatttccacct

SEQ ID NO: 468777 - DNA, 25 bp, Mus musculus
gagaattagatattgatttccacct

SEQ ID NO: 468778 - DNA, 25 bp, Mus musculus
gagaattagttgcagcacggcttat

SEQ ID NO: 468779 - DNA, 25 bp, Mus musculus
gagaattagttggagcacggcttat

SEQ ID NO: 468780 - DNA, 25 bp, Mus musculus
gagaattatcctattgtttgatgtg

SEQ ID NO: 468781 - DNA, 25 bp, Mus musculus
gagaattatccttttgtttgatgtg

SEQ ID NO: 468782 - DNA, 25 bp, Mus musculus
gagaattatgttatcaccatgtgga

SEQ ID NO: 468783 - DNA, 25 bp, Mus musculus
gagaattatgttttcaccatgtgga

SEQ ID NO: 468784 - DNA, 25 bp, Mus musculus
gagaattcaaaaatacccattgtgt

SEQ ID NO: 468785 - DNA, 25 bp, Mus musculus
gagaattcaaaattacccattgtgt

SEQ ID NO: 468786 - DNA, 25 bp, Mus musculus
gagaattcagataccatctattcat

SEQ ID NO: 468787 - DNA, 25 bp, Mus musculus
gagaattcagattccatctattcat

SEQ ID NO: 468788 - DNA, 25 bp, Mus musculus
gagaattcaggactcagcgtgcttt

SEQ ID NO: 468789 - DNA, 25 bp, Mus musculus
gagaattcaggagtcagcgtgcttt

SEQ ID NO: 468790 - DNA, 25 bp, Mus musculus
gagaattcattccaggtatgtgtct

SEQ ID NO: 468791 - DNA, 25 bp, Mus musculus
gagaattcattcgaggtatgtgtct

SEQ ID NO: 468792 - DNA, 25 bp, Mus musculus
gagaattccaatattagggattctt

SEQ ID NO: 468793 - DNA, 25 bp, Mus musculus
gagaattccaattttagggattctt

SEQ ID NO: 468794 - DNA, 25 bp, Mus musculus
gagaattccatcaggcaaagctgtg

SEQ ID NO: 468795 - DNA, 25 bp, Mus musculus
gagaattccatctggcaaagctgtg

SEQ ID NO: 468796 - DNA, 25 bp, Mus musculus
gagaattccccacatgtgttaagca

SEQ ID NO: 468797 - DNA, 25 bp, Mus musculus
gagaattccccagatgtgttaagca

SEQ ID NO: 468798 - DNA, 25 bp, Mus musculus
gagaattccctcactttgaaggtac

SEQ ID NO: 468799 - DNA, 25 bp, Mus musculus
gagaattccctctctttgaaggtac

SEQ ID NO: 468800 - DNA, 25 bp, Mus musculus
gagaattccgcaaagagacttactg

SEQ ID NO: 468801 - DNA, 25 bp, Mus musculus
gagaattccgcatagagacttactg

SEQ ID NO: 468802 - DNA, 25 bp, Mus musculus
gagaattccgctacggtggagcagc

SEQ ID NO: 468803 - DNA, 25 bp, Mus musculus
gagaattccgcttcggtggagcagc

SEQ ID NO: 468804 - DNA, 25 bp, Mus musculus
gagaattccggtctgtaactttttg

SEQ ID NO: 468805 - DNA, 25 bp, Mus musculus
gagaattccggtgtgtaactttttg

SEQ ID NO: 468806 - DNA, 25 bp, Mus musculus
gagaattcctaaagccatgcagaaa

SEQ ID NO: 468807 - DNA, 25 bp, Mus musculus
gagaattcctaatgccatgcagaaa

SEQ ID NO: 468808 - DNA, 25 bp, Mus musculus
gagaattccttacttatgcatttat

SEQ ID NO: 468809 - DNA, 25 bp, Mus musculus
gagaattccttagttatgcatttat

SEQ ID NO: 468810 - DNA, 25 bp, Mus musculus
gagaattccttgaaaggtttgccaa

SEQ ID NO: 468811 - DNA, 25 bp, Mus musculus
gagaattccttgtaaggtttgccaa

SEQ ID NO: 468812 - DNA, 25 bp, Mus musculus
gagaattctaatactggaaaccagt

SEQ ID NO: 468813 - DNA, 25 bp, Mus musculus
gagaattctaatatttgtctgatcc

SEQ ID NO: 468814 - DNA, 25 bp, Mus musculus
gagaattctaattctggaaaccagt

SEQ ID NO: 468815 - DNA, 25 bp, Mus musculus
gagaattctaatttttgtctgatcc

SEQ ID NO: 468816 - DNA, 25 bp, Mus musculus
gagaattctattaattgttcacact

SEQ ID NO: 468817 - DNA, 25 bp, Mus musculus
gagaattctatttattgttcacact

SEQ ID NO: 468818 - DNA, 25 bp, Mus musculus
gagaattctcttctggccatggatt

SEQ ID NO: 468819 - DNA, 25 bp, Mus musculus
gagaattctcttgtggccatggatt

SEQ ID NO: 468820 - DNA, 25 bp, Mus musculus
gagaattctgcaacttaatccaagg

SEQ ID NO: 468821 - DNA, 25 bp, Mus musculus
gagaattctgcatcttaatccaagg

SEQ ID NO: 468822 - DNA, 25 bp, Mus musculus
gagaattcttataacatctgtaatg

SEQ ID NO: 468823 - DNA, 25 bp, Mus musculus
gagaattcttattacatctgtaatg

SEQ ID NO: 468824 - DNA, 25 bp, Mus musculus
gagaattgaccaatttgtgttgtaa

SEQ ID NO: 468825 - DNA, 25 bp, Mus musculus
gagaattgaccattttgtgttgtaa

SEQ ID NO: 468826 - DNA, 25 bp, Mus musculus
gagaattgagaacgcctgcctccct

SEQ ID NO: 468827 - DNA, 25 bp, Mus musculus
gagaattgagaaggcctgcctccct

SEQ ID NO: 468828 - DNA, 25 bp, Mus musculus
gagaattgaggactgccccattaac

SEQ ID NO: 468829 - DNA, 25 bp, Mus musculus
gagaattgaggagtgccccattaac

SEQ ID NO: 468830 - DNA, 25 bp, Mus musculus
gagaattgattacccagcgagagct

SEQ ID NO: 468831 - DNA, 25 bp, Mus musculus
gagaattgattagccagcgagagct

SEQ ID NO: 468832 - DNA, 25 bp, Mus musculus
gagaattgcactctacccaaccaag

SEQ ID NO: 468833 - DNA, 25 bp, Mus musculus
gagaattgcactgtacccaaccaag

SEQ ID NO: 468834 - DNA, 25 bp, Mus musculus
gagaattgcagtcagctcatccaga

SEQ ID NO: 468835 - DNA, 25 bp, Mus musculus
gagaattgcagtgagctcatccaga

SEQ ID NO: 468836 - DNA, 25 bp, Mus musculus
gagaattgcattcgtatcatcattg

SEQ ID NO: 468837 - DNA, 25 bp, Mus musculus
gagaattgcattggtatcatcattg

SEQ ID NO: 468838 - DNA, 25 bp, Mus musculus
gagaattgccacataattggagcat

SEQ ID NO: 468839 - DNA, 25 bp, Mus musculus
gagaattgccacttaattggagcat

SEQ ID NO: 468840 - DNA, 25 bp, Mus musculus
gagaattgctcacgctcctatgaat

SEQ ID NO: 468841 - DNA, 25 bp, Mus musculus
gagaattgctcaggctcctatgaat

SEQ ID NO: 468842 - DNA, 25 bp, Mus musculus
gagaattggaaaagcacgtgcttaa

SEQ ID NO: 468843 - DNA, 25 bp, Mus musculus
gagaattggaaatgcacgtgcttaa

SEQ ID NO: 468844 - DNA, 25 bp, Mus musculus
gagaattggccaacttagcatgaag

SEQ ID NO: 468845 - DNA, 25 bp, Mus musculus
gagaattggccatcttagcatgaag

SEQ ID NO: 468846 - DNA, 25 bp, Mus musculus
gagaattggcgaaaacctgtaatat

SEQ ID NO: 468847 - DNA, 25 bp, Mus musculus
gagaattggcgataacctgtaatat

SEQ ID NO: 468848 - DNA, 25 bp, Mus musculus
gagaattgtaggcattccccattcc

SEQ ID NO: 468849 - DNA, 25 bp, Mus musculus
gagaattgtagggattccccattcc

SEQ ID NO: 468850 - DNA, 25 bp, Mus musculus
gagaattgtttgcaatccctccttg

SEQ ID NO: 468851 - DNA, 25 bp, Mus musculus
gagaattgtttggaatccctccttg

SEQ ID NO: 468852 - DNA, 25 bp, Mus musculus
gagaatttacacagcttggtaacta

SEQ ID NO: 468853 - DNA, 25 bp, Mus musculus
gagaatttacactgcttggtaacta

SEQ ID NO: 468854 - DNA, 25 bp, Mus musculus
gagaatttacttcccagaaactgac

SEQ ID NO: 468855 - DNA, 25 bp, Mus musculus
gagaatttacttgccagaaactgac

SEQ ID NO: 468856 - DNA, 25 bp, Mus musculus
gagaatttagctatcaaccagattg

SEQ ID NO: 468857 - DNA, 25 bp, Mus musculus
gagaatttagctttcaaccagattg

SEQ ID NO: 468858 - DNA, 25 bp, Mus musculus
gagaatttatggacacaggctagcc

SEQ ID NO: 468859 - DNA, 25 bp, Mus musculus
gagaatttatggtcacaggctagcc

SEQ ID NO: 468860 - DNA, 25 bp, Mus musculus
gagaatttcacactcactccttaat

SEQ ID NO: 468861 - DNA, 25 bp, Mus musculus
gagaatttcacagtcactccttaat

SEQ ID NO: 468862 - DNA, 25 bp, Mus musculus
gagaatttccaacttattttactat

SEQ ID NO: 468863 - DNA, 25 bp, Mus musculus
gagaatttccaagttattttactat

SEQ ID NO: 468864 - DNA, 25 bp, Mus musculus
gagaatttccacattggtgtttaag

SEQ ID NO: 468865 - DNA, 25 bp, Mus musculus
gagaatttccactttggtgtttaag

SEQ ID NO: 468866 - DNA, 25 bp, Mus musculus
gagaatttccctcaggtaacaacag

SEQ ID NO: 468867 - DNA, 25 bp, Mus musculus
gagaatttccctgaggtaacaacag

SEQ ID NO: 468868 - DNA, 25 bp, Mus musculus
gagaatttcctaatgtagtttattt

SEQ ID NO: 468869 - DNA, 25 bp, Mus musculus
gagaatttcctattgtagtttattt

SEQ ID NO: 468870 - DNA, 25 bp, Mus musculus
gagaatttccttactcatccttcaa

SEQ ID NO: 468871 - DNA, 25 bp, Mus musculus
gagaatttcctttctcatccttcaa

SEQ ID NO: 468872 - DNA, 25 bp, Mus musculus
gagaatttcttgcacatatataata

SEQ ID NO: 468873 - DNA, 25 bp, Mus musculus
gagaatttcttggacatatataata

SEQ ID NO: 468874 - DNA, 25 bp, Mus musculus
gagaatttgacacctgggaccaaca

SEQ ID NO: 468875 - DNA, 25 bp, Mus musculus
gagaatttgacagctgggaccaaca

SEQ ID NO: 468876 - DNA, 25 bp, Mus musculus
gagaatttgatactcactctgcagg

SEQ ID NO: 468877 - DNA, 25 bp, Mus musculus
gagaatttgatagtcactctgcagg

SEQ ID NO: 468878 - DNA, 25 bp, Mus musculus
gagaatttgcacactgtatgtcccc

SEQ ID NO: 468879 - DNA, 25 bp, Mus musculus
gagaatttgcactctgtatgtcccc

SEQ ID NO: 468880 - DNA, 25 bp, Mus musculus
gagaatttgcccattaacttcctca

SEQ ID NO: 468881 - DNA, 25 bp, Mus musculus
gagaatttgccctttaacttcctca

SEQ ID NO: 468882 - DNA, 25 bp, Mus musculus
gagaatttggatcagcgccatctgc

SEQ ID NO: 468883 - DNA, 25 bp, Mus musculus
gagaatttggatgagcgccatctgc

SEQ ID NO: 468884 - DNA, 25 bp, Mus musculus
gagaatttggtactctgattttcct

SEQ ID NO: 468885 - DNA, 25 bp, Mus musculus
gagaatttggtagtctgattttcct

SEQ ID NO: 468886 - DNA, 25 bp, Mus musculus
gagaatttgtagagcgtcgcccatc

SEQ ID NO: 468887 - DNA, 25 bp, Mus musculus
gagaatttgtagtgcgtcgcccatc

SEQ ID NO: 468888 - DNA, 25 bp, Mus musculus
gagaattttaccagacttcaagagc

SEQ ID NO: 468889 - DNA, 25 bp, Mus musculus
gagaattttacctgacttcaagagc

SEQ ID NO: 468890 - DNA, 25 bp, Mus musculus
gagaattttcctaagtttacactgc

SEQ ID NO: 468891 - DNA, 25 bp, Mus musculus
gagaattttccttagtttacactgc

SEQ ID NO: 468892 - DNA, 25 bp, Mus musculus
gagaattttctacttctcccaatta

SEQ ID NO: 468893 - DNA, 25 bp, Mus musculus
gagaattttctagttctcccaatta

SEQ ID NO: 468894 - DNA, 25 bp, Mus musculus
gagaattttcttcctacttatgtga

SEQ ID NO: 468895 - DNA, 25 bp, Mus musculus
gagaattttcttgctacttatgtga

SEQ ID NO: 468896 - DNA, 25 bp, Mus musculus
gagaattttgcaattgttgtacatt

SEQ ID NO: 468897 - DNA, 25 bp, Mus musculus
gagaattttgcatttgttgtacatt

SEQ ID NO: 468898 - DNA, 25 bp, Mus musculus
gagaattttgcccttgaagctgcta

SEQ ID NO: 468899 - DNA, 25 bp, Mus musculus
gagaattttgccgttgaagctgcta

SEQ ID NO: 468900 - DNA, 25 bp, Mus musculus
gagaatttttgtccaagctcacttc

SEQ ID NO: 468901 - DNA, 25 bp, Mus musculus
gagaatttttgtgcaagctcacttc

SEQ ID NO: 468902 - DNA, 25 bp, Mus musculus
gagacaaaaagtcgctcctcattgt

SEQ ID NO: 468903 - DNA, 25 bp, Mus musculus
gagacaaaaagtggctcctcattgt

SEQ ID NO: 468904 - DNA, 25 bp, Mus musculus
gagacaaaaattaggcatcctgatt

SEQ ID NO: 468905 - DNA, 25 bp, Mus musculus
gagacaaaaatttggcatcctgatt

SEQ ID NO: 468906 - DNA, 25 bp, Mus musculus
gagacaaaaccaacatgttcagcaa

SEQ ID NO: 468907 - DNA, 25 bp, Mus musculus
gagacaaaaccatcatgttcagcaa

SEQ ID NO: 468908 - DNA, 25 bp, Mus musculus
gagacaaaagaactggagccagaac

SEQ ID NO: 468909 - DNA, 25 bp, Mus musculus
gagacaaaagaagtggagccagaac

SEQ ID NO: 468910 - DNA, 25 bp, Mus musculus
gagacaaaagttaggtccggctaga

SEQ ID NO: 468911 - DNA, 25 bp, Mus musculus
gagacaaaagtttggtccggctaga

SEQ ID NO: 468912 - DNA, 25 bp, Mus musculus
gagacaaaatctagcttaggtagcc

SEQ ID NO: 468913 - DNA, 25 bp, Mus musculus
gagacaaaatcttgcttaggtagcc

SEQ ID NO: 468914 - DNA, 25 bp, Mus musculus
gagacaaacatgatccatagcttct

SEQ ID NO: 468915 - DNA, 25 bp, Mus musculus
gagacaaacatgttccatagcttct

SEQ ID NO: 468916 - DNA, 25 bp, Mus musculus
gagacaaaccaacgcggtttcctgt

SEQ ID NO: 468917 - DNA, 25 bp, Mus musculus
gagacaaaccaaggcggtttcctgt

SEQ ID NO: 468918 - DNA, 25 bp, Mus musculus
gagacaaacccaaaattgtggaggt

SEQ ID NO: 468919 - DNA, 25 bp, Mus musculus
gagacaaacccacaccatggatggt

SEQ ID NO: 468920 - DNA, 25 bp, Mus musculus
gagacaaacccagaccatggatggt

SEQ ID NO: 468921 - DNA, 25 bp, Mus musculus
gagacaaacccataattgtggaggt

SEQ ID NO: 468922 - DNA, 25 bp, Mus musculus
gagacaaacctaaaaatactatatt

SEQ ID NO: 468923 - DNA, 25 bp, Mus musculus
gagacaaacctataaatactatatt

SEQ ID NO: 468924 - DNA, 25 bp, Mus musculus
gagacaaaccttaattactttggag

SEQ ID NO: 468925 - DNA, 25 bp, Mus musculus
gagacaaacctttattactttggag

SEQ ID NO: 468926 - DNA, 25 bp, Mus musculus
gagacaaactgcatttggcacctcc

SEQ ID NO: 468927 - DNA, 25 bp, Mus musculus
gagacaaactgcttttggcacctcc

SEQ ID NO: 468928 - DNA, 25 bp, Mus musculus
gagacaaaggccacatctgtatgtt

SEQ ID NO: 468929 - DNA, 25 bp, Mus musculus
gagacaaaggcctcatctgtatgtt

SEQ ID NO: 468930 - DNA, 25 bp, Mus musculus
gagacaaatccacggcacatgcaaa

SEQ ID NO: 468931 - DNA, 25 bp, Mus musculus
gagacaaatccagggcacatgcaaa

SEQ ID NO: 468932 - DNA, 25 bp, Mus musculus
gagacaaatcttcctttagtgccgt

SEQ ID NO: 468933 - DNA, 25 bp, Mus musculus
gagacaaatcttgctttagtgccgt

SEQ ID NO: 468934 - DNA, 25 bp, Mus musculus
gagacaaattctcctgtcctagtgt

SEQ ID NO: 468935 - DNA, 25 bp, Mus musculus
gagacaaattctgctgtcctagtgt

SEQ ID NO: 468936 - DNA, 25 bp, Mus musculus
gagacaacagccattgaactattgt

SEQ ID NO: 468937 - DNA, 25 bp, Mus musculus
gagacaacagcccagcagcgaggat

SEQ ID NO: 468938 - DNA, 25 bp, Mus musculus
gagacaacagccgagcagcgaggat

SEQ ID NO: 468939 - DNA, 25 bp, Mus musculus
gagacaacagcctttgaactattgt

SEQ ID NO: 468940 - DNA, 25 bp, Mus musculus
gagacaacatcactcctgtattcag

SEQ ID NO: 468941 - DNA, 25 bp, Mus musculus
gagacaacatcagtcctgtattcag

SEQ ID NO: 468942 - DNA, 25 bp, Mus musculus
gagacaacatctactgtgctggtag

SEQ ID NO: 468943 - DNA, 25 bp, Mus musculus
gagacaacatcttctgtgctggtag

SEQ ID NO: 468944 - DNA, 25 bp, Mus musculus
gagacaaccaagaacagccaggcct

SEQ ID NO: 468945 - DNA, 25 bp, Mus musculus
gagacaaccaagtacagccaggcct

SEQ ID NO: 468946 - DNA, 25 bp, Mus musculus
gagacaaccaccaaacatgaccaaa

SEQ ID NO: 468947 - DNA, 25 bp, Mus musculus
gagacaaccacctaacatgaccaaa

SEQ ID NO: 468948 - DNA, 25 bp, Mus musculus
gagacaaccctcaggatccaggcag

SEQ ID NO: 468949 - DNA, 25 bp, Mus musculus
gagacaaccctctggatccaggcag

SEQ ID NO: 468950 - DNA, 25 bp, Mus musculus
gagacaaccgccaccaaatggacaa

SEQ ID NO: 468951 - DNA, 25 bp, Mus musculus
gagacaaccgcctccaaatggacaa

SEQ ID NO: 468952 - DNA, 25 bp, Mus musculus
gagacaaccgggatatccaaggctt

SEQ ID NO: 468953 - DNA, 25 bp, Mus musculus
gagacaaccgggttatccaaggctt

SEQ ID NO: 468954 - DNA, 25 bp, Mus musculus
gagacaaccgttaatttgtgcagga

SEQ ID NO: 468955 - DNA, 25 bp, Mus musculus
gagacaaccgtttatttgtgcagga

SEQ ID NO: 468956 - DNA, 25 bp, Mus musculus
gagacaacctgactttcccatttct

SEQ ID NO: 468957 - DNA, 25 bp, Mus musculus
gagacaacctgagtttcccatttct

SEQ ID NO: 468958 - DNA, 25 bp, Mus musculus
gagacaacgccaaaaatacgctgta

SEQ ID NO: 468959 - DNA, 25 bp, Mus musculus
gagacaacgccataaatacgctgta

SEQ ID NO: 468960 - DNA, 25 bp, Mus musculus
gagacaacgtacacccttatttctt

SEQ ID NO: 468961 - DNA, 25 bp, Mus musculus
gagacaacgtactcccttatttctt

SEQ ID NO: 468962 - DNA, 25 bp, Mus musculus
gagacaacgtcgcagctttgatgga

SEQ ID NO: 468963 - DNA, 25 bp, Mus musculus
gagacaacgtcggagctttgatgga

SEQ ID NO: 468964 - DNA, 25 bp, Mus musculus
gagacaactataccatggaacttgc

SEQ ID NO: 468965 - DNA, 25 bp, Mus musculus
gagacaactatagcatggaacttgc

SEQ ID NO: 468966 - DNA, 25 bp, Mus musculus
gagacaactcagcacttcatggaca

SEQ ID NO: 468967 - DNA, 25 bp, Mus musculus
gagacaactcaggacttcatggaca

SEQ ID NO: 468968 - DNA, 25 bp, Mus musculus
gagacaactctgcatttcagggctt

SEQ ID NO: 468969 - DNA, 25 bp, Mus musculus
gagacaactctggatttcagggctt

SEQ ID NO: 468970 - DNA, 25 bp, Mus musculus
gagacaactgcacctcaggcactaa

SEQ ID NO: 468971 - DNA, 25 bp, Mus musculus
gagacaactgcagctcaggcactaa

SEQ ID NO: 468972 - DNA, 25 bp, Mus musculus
gagacaactggtagcgcctgacgcc

SEQ ID NO: 468973 - DNA, 25 bp, Mus musculus
gagacaactggttgcgcctgacgcc

SEQ ID NO: 468974 - DNA, 25 bp, Mus musculus
gagacaacttctagaaatcgctgag

SEQ ID NO: 468975 - DNA, 25 bp, Mus musculus
gagacaacttcttgaaatcgctgag

SEQ ID NO: 468976 - DNA, 25 bp, Mus musculus
gagacaacttgaccattaacaccag

SEQ ID NO: 468977 - DNA, 25 bp, Mus musculus
gagacaacttgagcattaacaccag

SEQ ID NO: 468978 - DNA, 25 bp, Mus musculus
gagacaagaactctcgctgagtcat

SEQ ID NO: 468979 - DNA, 25 bp, Mus musculus
gagacaagaactgtcgctgagtcat

SEQ ID NO: 468980 - DNA, 25 bp, Mus musculus
gagacaagactccttctgcttaaaa

SEQ ID NO: 468981 - DNA, 25 bp, Mus musculus
gagacaagactcgttctgcttaaaa

SEQ ID NO: 468982 - DNA, 25 bp, Mus musculus
gagacaagaggcagggaatcccagc

SEQ ID NO: 468983 - DNA, 25 bp, Mus musculus
gagacaagaggctgggaatcccagc

SEQ ID NO: 468984 - DNA, 25 bp, Mus musculus
gagacaagatgcaacttaccggaga

SEQ ID NO: 468985 - DNA, 25 bp, Mus musculus
gagacaagatgcatcatagcccttc

SEQ ID NO: 468986 - DNA, 25 bp, Mus musculus
gagacaagatgctacttaccggaga

SEQ ID NO: 468987 - DNA, 25 bp, Mus musculus
gagacaagatgcttcatagcccttc

SEQ ID NO: 468988 - DNA, 25 bp, Mus musculus
gagacaagccttacacagcaatggt

SEQ ID NO: 468989 - DNA, 25 bp, Mus musculus
gagacaagcctttcacagcaatggt

SEQ ID NO: 468990 - DNA, 25 bp, Mus musculus
gagacaagctctaccatccggagtg

SEQ ID NO: 468991 - DNA, 25 bp, Mus musculus
gagacaagctcttccatccggagtg

SEQ ID NO: 468992 - DNA, 25 bp, Mus musculus
gagacaaggcctcactgtatcctca

SEQ ID NO: 468993 - DNA, 25 bp, Mus musculus
gagacaaggcctgactgtatcctca

SEQ ID NO: 468994 - DNA, 25 bp, Mus musculus
gagacaaggctgctttctaccacat

SEQ ID NO: 468995 - DNA, 25 bp, Mus musculus
gagacaaggctggtttctaccacat

SEQ ID NO: 468996 - DNA, 25 bp, Mus musculus
gagacaagggcacagttatttaatt

SEQ ID NO: 468997 - DNA, 25 bp, Mus musculus
gagacaagggcagagttatttaatt

SEQ ID NO: 468998 - DNA, 25 bp, Mus musculus
gagacaagggtgctgccttcaagaa

SEQ ID NO: 468999 - DNA, 25 bp, Mus musculus
gagacaagggtggtgccttcaagaa

SEQ ID NO: 469000 - DNA, 25 bp, Mus musculus
gagacaagggttacgtcccctctgt

SEQ ID NO: 469001 - DNA, 25 bp, Mus musculus
gagacaagggtttcgtcccctctgt

SEQ ID NO: 469002 - DNA, 25 bp, Mus musculus
gagacaaggttgacctgcaacttac

SEQ ID NO: 469003 - DNA, 25 bp, Mus musculus
gagacaaggttgtcctgcaacttac

SEQ ID NO: 469004 - DNA, 25 bp, Mus musculus
gagacaaggtttaccacagtgacct

SEQ ID NO: 469005 - DNA, 25 bp, Mus musculus
gagacaaggttttccacagtgacct

SEQ ID NO: 469006 - DNA, 25 bp, Mus musculus
gagacaagtacacaccttgactctc

SEQ ID NO: 469007 - DNA, 25 bp, Mus musculus
gagacaagtacagaccttgactctc

SEQ ID NO: 469008 - DNA, 25 bp, Mus musculus
gagacaagtagtcctaccaccagtc

SEQ ID NO: 469009 - DNA, 25 bp, Mus musculus
gagacaagtagtgctaccaccagtc

SEQ ID NO: 469010 - DNA, 25 bp, Mus musculus
gagacaagtccgagacagggcacca

SEQ ID NO: 469011 - DNA, 25 bp, Mus musculus
gagacaagtccgtgacagggcacca

SEQ ID NO: 469012 - DNA, 25 bp, Mus musculus
gagacaagtctgaactgtagtgtga

SEQ ID NO: 469013 - DNA, 25 bp, Mus musculus
gagacaagtctgtactgtagtgtga

SEQ ID NO: 469014 - DNA, 25 bp, Mus musculus
gagacaagtgccagacctgagctct

SEQ ID NO: 469015 - DNA, 25 bp, Mus musculus
gagacaagtgcctgacctgagctct

SEQ ID NO: 469016 - DNA, 25 bp, Mus musculus
gagacaagtgctctggagtccaaat

SEQ ID NO: 469017 - DNA, 25 bp, Mus musculus
gagacaagtgctgtggagtccaaat

SEQ ID NO: 469018 - DNA, 25 bp, Mus musculus
gagacaagttgtagcagggcccaga

SEQ ID NO: 469019 - DNA, 25 bp, Mus musculus
gagacaagttgttgcagggcccaga

SEQ ID NO: 469020 - DNA, 25 bp, Mus musculus
gagacaataggtcccttcatcacag

SEQ ID NO: 469021 - DNA, 25 bp, Mus musculus
gagacaataggtgccttcatcacag

SEQ ID NO: 469022 - DNA, 25 bp, Mus musculus
gagacaatatgcatccatgtataaa

SEQ ID NO: 469023 - DNA, 25 bp, Mus musculus
gagacaatatgcttccatgtataaa

SEQ ID NO: 469024 - DNA, 25 bp, Mus musculus
gagacaatcaaaaccctggtcctta

SEQ ID NO: 469025 - DNA, 25 bp, Mus musculus
gagacaatcaaacttagcggctgtg

SEQ ID NO: 469026 - DNA, 25 bp, Mus musculus
gagacaatcaaagttagcggctgtg

SEQ ID NO: 469027 - DNA, 25 bp, Mus musculus
gagacaatcaaatccctggtcctta

SEQ ID NO: 469028 - DNA, 25 bp, Mus musculus
gagacaatcaagaaactgttccctt

SEQ ID NO: 469029 - DNA, 25 bp, Mus musculus
gagacaatcaagtaactgttccctt

SEQ ID NO: 469030 - DNA, 25 bp, Mus musculus
gagacaatccatctgtgctcatttc

SEQ ID NO: 469031 - DNA, 25 bp, Mus musculus
gagacaatccatgtgtgctcatttc

SEQ ID NO: 469032 - DNA, 25 bp, Mus musculus
gagacaatgacaagtgacactgagg

SEQ ID NO: 469033 - DNA, 25 bp, Mus musculus
gagacaatgacatgtgacactgagg

SEQ ID NO: 469034 - DNA, 25 bp, Mus musculus
gagacaatgagcagttcccttaaca

SEQ ID NO: 469035 - DNA, 25 bp, Mus musculus
gagacaatgagctgttcccttaaca

SEQ ID NO: 469036 - DNA, 25 bp, Mus musculus
gagacaatggaaagtcctggctgcc

SEQ ID NO: 469037 - DNA, 25 bp, Mus musculus
gagacaatggaatgtcctggctgcc

SEQ ID NO: 469038 - DNA, 25 bp, Mus musculus
gagacaatgggcactctcattttgt

SEQ ID NO: 469039 - DNA, 25 bp, Mus musculus
gagacaatgggctctctcattttgt

SEQ ID NO: 469040 - DNA, 25 bp, Mus musculus
gagacaatgtcaaaacctagtagtt

SEQ ID NO: 469041 - DNA, 25 bp, Mus musculus
gagacaatgtcataacctagtagtt

SEQ ID NO: 469042 - DNA, 25 bp, Mus musculus
gagacaatgtctcctgtaacccaga

SEQ ID NO: 469043 - DNA, 25 bp, Mus musculus
gagacaatgtctgctgtaacccaga

SEQ ID NO: 469044 - DNA, 25 bp, Mus musculus
gagacaattataactttctgaatgg

SEQ ID NO: 469045 - DNA, 25 bp, Mus musculus
gagacaattatatctttctgaatgg

SEQ ID NO: 469046 - DNA, 25 bp, Mus musculus
gagacaattattagttccactttga

SEQ ID NO: 469047 - DNA, 25 bp, Mus musculus
gagacaattatttgttccactttga

SEQ ID NO: 469048 - DNA, 25 bp, Mus musculus
gagacaattcacactggctgtttga

SEQ ID NO: 469049 - DNA, 25 bp, Mus musculus
gagacaattcactctggctgtttga

SEQ ID NO: 469050 - DNA, 25 bp, Mus musculus
gagacaattcatcctgactctgtat

SEQ ID NO: 469051 - DNA, 25 bp, Mus musculus
gagacaattcatgctgactctgtat

SEQ ID NO: 469052 - DNA, 25 bp, Mus musculus
gagacaattcctcttgtggtagctt

SEQ ID NO: 469053 - DNA, 25 bp, Mus musculus
gagacaattcctgttgtggtagctt

SEQ ID NO: 469054 - DNA, 25 bp, Mus musculus
gagacaattgtcagccatcccgcag

SEQ ID NO: 469055 - DNA, 25 bp, Mus musculus
gagacaattgtctgccatcccgcag

SEQ ID NO: 469056 - DNA, 25 bp, Mus musculus
gagacaatttttacagtgtggacaa

SEQ ID NO: 469057 - DNA, 25 bp, Mus musculus
gagacaattttttcagtgtggacaa

SEQ ID NO: 469058 - DNA, 25 bp, Mus musculus
gagacacaaagaacagtatccagaa

SEQ ID NO: 469059 - DNA, 25 bp, Mus musculus
gagacacaaagatcagtatccagaa

SEQ ID NO: 469060 - DNA, 25 bp, Mus musculus
gagacacaaccacagtgaccacctg

SEQ ID NO: 469061 - DNA, 25 bp, Mus musculus
gagacacaaccagagtgaccacctg

SEQ ID NO: 469062 - DNA, 25 bp, Mus musculus
gagacacaacttaaggtgccagatt

SEQ ID NO: 469063 - DNA, 25 bp, Mus musculus
gagacacaactttaggtgccagatt

SEQ ID NO: 469064 - DNA, 25 bp, Mus musculus
gagacacaagatccccttcatactg

SEQ ID NO: 469065 - DNA, 25 bp, Mus musculus
gagacacaagatgcccttcatactg

SEQ ID NO: 469066 - DNA, 25 bp, Mus musculus
gagacacaattaccatcacttgcca

SEQ ID NO: 469067 - DNA, 25 bp, Mus musculus
gagacacaattagcatcacttgcca

SEQ ID NO: 469068 - DNA, 25 bp, Mus musculus
gagacacacatcaagtacacataaa

SEQ ID NO: 469069 - DNA, 25 bp, Mus musculus
gagacacacatctagtacacataaa

SEQ ID NO: 469070 - DNA, 25 bp, Mus musculus
gagacacacccactattcatatgaa

SEQ ID NO: 469071 - DNA, 25 bp, Mus musculus
gagacacacccagtattcatatgaa

SEQ ID NO: 469072 - DNA, 25 bp, Mus musculus
gagacacaccttcaagacacagcag

SEQ ID NO: 469073 - DNA, 25 bp, Mus musculus
gagacacaccttgaagacacagcag

SEQ ID NO: 469074 - DNA, 25 bp, Mus musculus
gagacacacggtcctcatcattgca

SEQ ID NO: 469075 - DNA, 25 bp, Mus musculus
gagacacacggtgctcatcattgca

SEQ ID NO: 469076 - DNA, 25 bp, Mus musculus
gagacacacgtgcaagctaaaattt

SEQ ID NO: 469077 - DNA, 25 bp, Mus musculus
gagacacacgtggaagctaaaattt

SEQ ID NO: 469078 - DNA, 25 bp, Mus musculus
gagacacactagcactctatggacg

SEQ ID NO: 469079 - DNA, 25 bp, Mus musculus
gagacacactaggactctatggacg

SEQ ID NO: 469080 - DNA, 25 bp, Mus musculus
gagacacactctcagcatctgagct

SEQ ID NO: 469081 - DNA, 25 bp, Mus musculus
gagacacactctcatctaattctgt

SEQ ID NO: 469082 - DNA, 25 bp, Mus musculus
gagacacactctgagcatctgagct

SEQ ID NO: 469083 - DNA, 25 bp, Mus musculus
gagacacactctgatctaattctgt

SEQ ID NO: 469084 - DNA, 25 bp, Mus musculus
gagacacagacccaagcccaagaaa

SEQ ID NO: 469085 - DNA, 25 bp, Mus musculus
gagacacagaccgaagcccaagaaa

SEQ ID NO: 469086 - DNA, 25 bp, Mus musculus
gagacacagataagcttctgtgaga

SEQ ID NO: 469087 - DNA, 25 bp, Mus musculus
gagacacagatatgcttctgtgaga

SEQ ID NO: 469088 - DNA, 25 bp, Mus musculus
gagacacagatgcagaactacgaca

SEQ ID NO: 469089 - DNA, 25 bp, Mus musculus
gagacacagatggagaactacgaca

SEQ ID NO: 469090 - DNA, 25 bp, Mus musculus
gagacacagcacctttgggatgatt

SEQ ID NO: 469091 - DNA, 25 bp, Mus musculus
gagacacagcacgtttgggatgatt

SEQ ID NO: 469092 - DNA, 25 bp, Mus musculus
gagacacagctactgaagcttcctg

SEQ ID NO: 469093 - DNA, 25 bp, Mus musculus
gagacacagctagtgaagcttcctg

SEQ ID NO: 469094 - DNA, 25 bp, Mus musculus
gagacacaggagaagcatctttaac

SEQ ID NO: 469095 - DNA, 25 bp, Mus musculus
gagacacaggagacgcaggaactgc

SEQ ID NO: 469096 - DNA, 25 bp, Mus musculus
gagacacaggagtagcatctttaac

SEQ ID NO: 469097 - DNA, 25 bp, Mus musculus
gagacacaggagtcgcaggaactgc

SEQ ID NO: 469098 - DNA, 25 bp, Mus musculus
gagacacaggctatccttaggaagt

SEQ ID NO: 469099 - DNA, 25 bp, Mus musculus
gagacacaggctttccttaggaagt

SEQ ID NO: 469100 - DNA, 25 bp, Mus musculus
gagacacagggcaaggctctccttt

SEQ ID NO: 469101 - DNA, 25 bp, Mus musculus
gagacacagggctaggctctccttt

SEQ ID NO: 469102 - DNA, 25 bp, Mus musculus
gagacacagtctctcatgctgggaa

SEQ ID NO: 469103 - DNA, 25 bp, Mus musculus
gagacacagtctgtcatgctgggaa

SEQ ID NO: 469104 - DNA, 25 bp, Mus musculus
gagacacagttaaagctcttttagc

SEQ ID NO: 469105 - DNA, 25 bp, Mus musculus
gagacacagttaactcacttaataa

SEQ ID NO: 469106 - DNA, 25 bp, Mus musculus
gagacacagttatagctcttttagc

SEQ ID NO: 469107 - DNA, 25 bp, Mus musculus
gagacacagttatctcacttaataa

SEQ ID NO: 469108 - DNA, 25 bp, Mus musculus
gagacacataaccaagtggccttgt

SEQ ID NO: 469109 - DNA, 25 bp, Mus musculus
gagacacataacgaagtggccttgt

SEQ ID NO: 469110 - DNA, 25 bp, Mus musculus
gagacacatacgatggcgactgcac

SEQ ID NO: 469111 - DNA, 25 bp, Mus musculus
gagacacatacgttggcgactgcac

SEQ ID NO: 469112 - DNA, 25 bp, Mus musculus
gagacacatagcagtattccatcgg

SEQ ID NO: 469113 - DNA, 25 bp, Mus musculus
gagacacatagctgtattccatcgg

SEQ ID NO: 469114 - DNA, 25 bp, Mus musculus
gagacacatccaatgaccctgaaca

SEQ ID NO: 469115 - DNA, 25 bp, Mus musculus
gagacacatccattgaccctgaaca

SEQ ID NO: 469116 - DNA, 25 bp, Mus musculus
gagacacatctcctggaaggctatt

SEQ ID NO: 469117 - DNA, 25 bp, Mus musculus
gagacacatctcgtggaaggctatt

SEQ ID NO: 469118 - DNA, 25 bp, Mus musculus
gagacacatctgaatggctatcctg

SEQ ID NO: 469119 - DNA, 25 bp, Mus musculus
gagacacatctgtatggctatcctg

SEQ ID NO: 469120 - DNA, 25 bp, Mus musculus
gagacacatgccacaggtcgggctt

SEQ ID NO: 469121 - DNA, 25 bp, Mus musculus
gagacacatgcctcaggtcgggctt

SEQ ID NO: 469122 - DNA, 25 bp, Mus musculus
gagacacatgctcagcttacaaatt

SEQ ID NO: 469123 - DNA, 25 bp, Mus musculus
gagacacatgctctatcttcaggtt

SEQ ID NO: 469124 - DNA, 25 bp, Mus musculus
gagacacatgctgagcttacaaatt

SEQ ID NO: 469125 - DNA, 25 bp, Mus musculus
gagacacatgctgtatcttcaggtt

SEQ ID NO: 469126 - DNA, 25 bp, Mus musculus
gagacacatgtccaccagatgtgct

SEQ ID NO: 469127 - DNA, 25 bp, Mus musculus
gagacacatgtcgaccagatgtgct

SEQ ID NO: 469128 - DNA, 25 bp, Mus musculus
gagacacattatccatctgtccttg

SEQ ID NO: 469129 - DNA, 25 bp, Mus musculus
gagacacattatgcatctgtccttg

SEQ ID NO: 469130 - DNA, 25 bp, Mus musculus
gagacacattcacagcacaccaagt

SEQ ID NO: 469131 - DNA, 25 bp, Mus musculus
gagacacattcagagcacaccaagt

SEQ ID NO: 469132 - DNA, 25 bp, Mus musculus
gagacacattctctgctatactaat

SEQ ID NO: 469133 - DNA, 25 bp, Mus musculus
gagacacattctgtgctatactaat

SEQ ID NO: 469134 - DNA, 25 bp, Mus musculus
gagacacatttacctggagcgcctt

SEQ ID NO: 469135 - DNA, 25 bp, Mus musculus
gagacacatttagctggagcgcctt

SEQ ID NO: 469136 - DNA, 25 bp, Mus musculus
gagacaccaagactcctgtcttgat

SEQ ID NO: 469137 - DNA, 25 bp, Mus musculus
gagacaccaagagtcctgtcttgat

SEQ ID NO: 469138 - DNA, 25 bp, Mus musculus
gagacaccacacaacagtccaggga

SEQ ID NO: 469139 - DNA, 25 bp, Mus musculus
gagacaccacactacagtccaggga

SEQ ID NO: 469140 - DNA, 25 bp, Mus musculus
gagacaccaccacgtactgcgagaa

SEQ ID NO: 469141 - DNA, 25 bp, Mus musculus
gagacaccaccaggtactgcgagaa

SEQ ID NO: 469142 - DNA, 25 bp, Mus musculus
gagacaccactgacaatgtagttgt

SEQ ID NO: 469143 - DNA, 25 bp, Mus musculus
gagacaccactgtcaatgtagttgt

SEQ ID NO: 469144 - DNA, 25 bp, Mus musculus
gagacaccagaacacctgtgaggga

SEQ ID NO: 469145 - DNA, 25 bp, Mus musculus
gagacaccagaagacctgtgaggga

SEQ ID NO: 469146 - DNA, 25 bp, Mus musculus
gagacaccagcacaaaatgtattgc

SEQ ID NO: 469147 - DNA, 25 bp, Mus musculus
gagacaccagcagaaaatgtattgc

SEQ ID NO: 469148 - DNA, 25 bp, Mus musculus
gagacaccaggaagccatgactcca

SEQ ID NO: 469149 - DNA, 25 bp, Mus musculus
gagacaccaggatgccatgactcca

SEQ ID NO: 469150 - DNA, 25 bp, Mus musculus
gagacaccagtcaaagagtgctgtg

SEQ ID NO: 469151 - DNA, 25 bp, Mus musculus
gagacaccagtctaagagtgctgtg

SEQ ID NO: 469152 - DNA, 25 bp, Mus musculus
gagacaccattacatgtagaactgt

SEQ ID NO: 469153 - DNA, 25 bp, Mus musculus
gagacaccattagatgtagaactgt

SEQ ID NO: 469154 - DNA, 25 bp, Mus musculus
gagacacccaacaggcagctagaat

SEQ ID NO: 469155 - DNA, 25 bp, Mus musculus
gagacacccaactggcagctagaat

SEQ ID NO: 469156 - DNA, 25 bp, Mus musculus
gagacaccccaaatagttatccagt

SEQ ID NO: 469157 - DNA, 25 bp, Mus musculus
gagacaccccaattagttatccagt

SEQ ID NO: 469158 - DNA, 25 bp, Mus musculus
gagacaccctatacatgagggccca

SEQ ID NO: 469159 - DNA, 25 bp, Mus musculus
gagacaccctattcatgagggccca

SEQ ID NO: 469160 - DNA, 25 bp, Mus musculus
gagacaccctgtaataccaaactgt

SEQ ID NO: 469161 - DNA, 25 bp, Mus musculus
gagacaccctgttataccaaactgt

SEQ ID NO: 469162 - DNA, 25 bp, Mus musculus
gagacacccttgacctccaagagga

SEQ ID NO: 469163 - DNA, 25 bp, Mus musculus
gagacacccttgtcctccaagagga

SEQ ID NO: 469164 - DNA, 25 bp, Mus musculus
gagacaccctttctagcatagcctg

SEQ ID NO: 469165 - DNA, 25 bp, Mus musculus
gagacaccctttgtagcatagcctg

SEQ ID NO: 469166 - DNA, 25 bp, Mus musculus
gagacaccgcttctcagaggaggaa

SEQ ID NO: 469167 - DNA, 25 bp, Mus musculus
gagacaccgcttgtcagaggaggaa

SEQ ID NO: 469168 - DNA, 25 bp, Mus musculus
gagacacctacacaaggagcgctgt

SEQ ID NO: 469169 - DNA, 25 bp, Mus musculus
gagacacctacagaaggagcgctgt

SEQ ID NO: 469170 - DNA, 25 bp, Mus musculus
gagacacctaccatgtggtggtgat

SEQ ID NO: 469171 - DNA, 25 bp, Mus musculus
gagacacctaccttgtggtggtgat

SEQ ID NO: 469172 - DNA, 25 bp, Mus musculus
gagacacctaggatacggtttgtaa

SEQ ID NO: 469173 - DNA, 25 bp, Mus musculus
gagacacctaggttacggtttgtaa

SEQ ID NO: 469174 - DNA, 25 bp, Mus musculus
gagacacctcgcattgcagttgcag

SEQ ID NO: 469175 - DNA, 25 bp, Mus musculus
gagacacctcgctttgcagttgcag

SEQ ID NO: 469176 - DNA, 25 bp, Mus musculus
gagacacctgatcctgtagactgaa

SEQ ID NO: 469177 - DNA, 25 bp, Mus musculus
gagacacctgatgctgtagactgaa

SEQ ID NO: 469178 - DNA, 25 bp, Mus musculus
gagacacctgcgcttacttggttac

SEQ ID NO: 469179 - DNA, 25 bp, Mus musculus
gagacacctgcggttacttggttac

SEQ ID NO: 469180 - DNA, 25 bp, Mus musculus
gagacacctggccttggcaagctgc

SEQ ID NO: 469181 - DNA, 25 bp, Mus musculus
gagacacctggcgttggcaagctgc

SEQ ID NO: 469182 - DNA, 25 bp, Mus musculus
gagacacctggtaattagaatgaaa

SEQ ID NO: 469183 - DNA, 25 bp, Mus musculus
gagacacctggttattagaatgaaa

SEQ ID NO: 469184 - DNA, 25 bp, Mus musculus
gagacacctgtgacaagtaccatga

SEQ ID NO: 469185 - DNA, 25 bp, Mus musculus
gagacacctgtgattgatcactgca

SEQ ID NO: 469186 - DNA, 25 bp, Mus musculus
gagacacctgtgtcaagtaccatga

SEQ ID NO: 469187 - DNA, 25 bp, Mus musculus
gagacacctgtgtttgatcactgca

SEQ ID NO: 469188 - DNA, 25 bp, Mus musculus
gagacaccttctctctttgtttcaa

SEQ ID NO: 469189 - DNA, 25 bp, Mus musculus
gagacaccttctgtctttgtttcaa

SEQ ID NO: 469190 - DNA, 25 bp, Mus musculus
gagacacctttgataaactggataa

SEQ ID NO: 469191 - DNA, 25 bp, Mus musculus
gagacacctttgttaaactggataa

SEQ ID NO: 469192 - DNA, 25 bp, Mus musculus
gagacacgcagtatgtgttcagttt

SEQ ID NO: 469193 - DNA, 25 bp, Mus musculus
gagacacgcagtttgtgttcagttt

SEQ ID NO: 469194 - DNA, 25 bp, Mus musculus
gagacacgcattccttttggtttga

SEQ ID NO: 469195 - DNA, 25 bp, Mus musculus
gagacacgcattgcttttggtttga

SEQ ID NO: 469196 - DNA, 25 bp, Mus musculus
gagacacgctggagcttcatggcaa

SEQ ID NO: 469197 - DNA, 25 bp, Mus musculus
gagacacgctggtgcttcatggcaa

SEQ ID NO: 469198 - DNA, 25 bp, Mus musculus
gagacacggagcatcccttgttatt

SEQ ID NO: 469199 - DNA, 25 bp, Mus musculus
gagacacggagcttcccttgttatt

SEQ ID NO: 469200 - DNA, 25 bp, Mus musculus
gagacacggctgaggcttacggaca

SEQ ID NO: 469201 - DNA, 25 bp, Mus musculus
gagacacggctgtggcttacggaca

SEQ ID NO: 469202 - DNA, 25 bp, Mus musculus
gagacacgggctcaaggaacccaag

SEQ ID NO: 469203 - DNA, 25 bp, Mus musculus
gagacacgggctgaaggaacccaag

SEQ ID NO: 469204 - DNA, 25 bp, Mus musculus
gagacacgtgctatggttcatttaa

SEQ ID NO: 469205 - DNA, 25 bp, Mus musculus
gagacacgtgctttggttcatttaa

SEQ ID NO: 469206 - DNA, 25 bp, Mus musculus
gagacacgtggtccttataaatcgt

SEQ ID NO: 469207 - DNA, 25 bp, Mus musculus
gagacacgtggtgcttataaatcgt

SEQ ID NO: 469208 - DNA, 25 bp, Mus musculus
gagacactaatgaggatgcaagctt

SEQ ID NO: 469209 - DNA, 25 bp, Mus musculus
gagacactaatgtggatgcaagctt

SEQ ID NO: 469210 - DNA, 25 bp, Mus musculus
gagacactacagaactccttcatat

SEQ ID NO: 469211 - DNA, 25 bp, Mus musculus
gagacactacagtactccttcatat

SEQ ID NO: 469212 - DNA, 25 bp, Mus musculus
gagacactacatcctttcatcattc

SEQ ID NO: 469213 - DNA, 25 bp, Mus musculus
gagacactacatgctttcatcattc

SEQ ID NO: 469214 - DNA, 25 bp, Mus musculus
gagacactactcacatcagatacgg

SEQ ID NO: 469215 - DNA, 25 bp, Mus musculus
gagacactactctcatcagatacgg

SEQ ID NO: 469216 - DNA, 25 bp, Mus musculus
gagacactagatactttgcttttca

SEQ ID NO: 469217 - DNA, 25 bp, Mus musculus
gagacactagattctttgcttttca

SEQ ID NO: 469218 - DNA, 25 bp, Mus musculus
gagacactaggcatggatggctact

SEQ ID NO: 469219 - DNA, 25 bp, Mus musculus
gagacactaggcttggatggctact

SEQ ID NO: 469220 - DNA, 25 bp, Mus musculus
gagacactagttctggagtagaaaa

SEQ ID NO: 469221 - DNA, 25 bp, Mus musculus
gagacactagttgtggagtagaaaa

SEQ ID NO: 469222 - DNA, 25 bp, Mus musculus
gagacactatggaacactcggtcct

SEQ ID NO: 469223 - DNA, 25 bp, Mus musculus
gagacactatggtacactcggtcct

SEQ ID NO: 469224 - DNA, 25 bp, Mus musculus
gagacactcacaatgaaaccattgc

SEQ ID NO: 469225 - DNA, 25 bp, Mus musculus
gagacactcacattgaaaccattgc

SEQ ID NO: 469226 - DNA, 25 bp, Mus musculus
gagacactcaccaaggatctatggt

SEQ ID NO: 469227 - DNA, 25 bp, Mus musculus
gagacactcacctaggatctatggt

SEQ ID NO: 469228 - DNA, 25 bp, Mus musculus
gagacactcagcaatcacttgagat

SEQ ID NO: 469229 - DNA, 25 bp, Mus musculus
gagacactcagctatcacttgagat

SEQ ID NO: 469230 - DNA, 25 bp, Mus musculus
gagacactcctaatgtcaaggcaaa

SEQ ID NO: 469231 - DNA, 25 bp, Mus musculus
gagacactcctattgtcaaggcaaa

SEQ ID NO: 469232 - DNA, 25 bp, Mus musculus
gagacactcgtaacagaattgccct

SEQ ID NO: 469233 - DNA, 25 bp, Mus musculus
gagacactcgtatcagaattgccct

SEQ ID NO: 469234 - DNA, 25 bp, Mus musculus
gagacactctcgcaaaaacgctaag

SEQ ID NO: 469235 - DNA, 25 bp, Mus musculus
gagacactctcggaaaaacgctaag

SEQ ID NO: 469236 - DNA, 25 bp, Mus musculus
gagacactcttacatgatggcccag

SEQ ID NO: 469237 - DNA, 25 bp, Mus musculus
gagacactcttagatgatggcccag

SEQ ID NO: 469238 - DNA, 25 bp, Mus musculus
gagacactgattacagacctcttaa

SEQ ID NO: 469239 - DNA, 25 bp, Mus musculus
gagacactgatttcagacctcttaa

SEQ ID NO: 469240 - DNA, 25 bp, Mus musculus
gagacactgcatccgattttactgt

SEQ ID NO: 469241 - DNA, 25 bp, Mus musculus
gagacactgcatgcgattttactgt

SEQ ID NO: 469242 - DNA, 25 bp, Mus musculus
gagacactgcccacgatggctggct

SEQ ID NO: 469243 - DNA, 25 bp, Mus musculus
gagacactgccctcgatggctggct

SEQ ID NO: 469244 - DNA, 25 bp, Mus musculus
gagacactgccgacgatgagaacag

SEQ ID NO: 469245 - DNA, 25 bp, Mus musculus
gagacactgccgtcgatgagaacag

SEQ ID NO: 469246 - DNA, 25 bp, Mus musculus
gagacactgcgtatggttcaagcct

SEQ ID NO: 469247 - DNA, 25 bp, Mus musculus
gagacactgcgtttggttcaagcct

SEQ ID NO: 469248 - DNA, 25 bp, Mus musculus
gagacactgggaaggtcctcgtgaa

SEQ ID NO: 469249 - DNA, 25 bp, Mus musculus
gagacactgggatggtcctcgtgaa

SEQ ID NO: 469250 - DNA, 25 bp, Mus musculus
gagacactggtcaaatcctggtgta

SEQ ID NO: 469251 - DNA, 25 bp, Mus musculus
gagacactggtcacttaacctcttg

SEQ ID NO: 469252 - DNA, 25 bp, Mus musculus
gagacactggtctaatcctggtgta

SEQ ID NO: 469253 - DNA, 25 bp, Mus musculus
gagacactggtctcttaacctcttg

SEQ ID NO: 469254 - DNA, 25 bp, Mus musculus
gagacactgtaaccccagattcagg

SEQ ID NO: 469255 - DNA, 25 bp, Mus musculus
gagacactgtaagcccagattcagg

SEQ ID NO: 469256 - DNA, 25 bp, Mus musculus
gagacactgtccatataacttctgg

SEQ ID NO: 469257 - DNA, 25 bp, Mus musculus
gagacactgtccttataacttctgg

SEQ ID NO: 469258 - DNA, 25 bp, Mus musculus
gagacactgtcgcaacgcattttct

SEQ ID NO: 469259 - DNA, 25 bp, Mus musculus
gagacactgtcggaacgcattttct

SEQ ID NO: 469260 - DNA, 25 bp, Mus musculus
gagacactgtctccatcgacctggt

SEQ ID NO: 469261 - DNA, 25 bp, Mus musculus
gagacactgtctgcatcgacctggt

SEQ ID NO: 469262 - DNA, 25 bp, Mus musculus
gagacactgtggatacttggccttg

SEQ ID NO: 469263 - DNA, 25 bp, Mus musculus
gagacactgtggttacttggccttg

SEQ ID NO: 469264 - DNA, 25 bp, Mus musculus
gagacactgttcagcaacactcagg

SEQ ID NO: 469265 - DNA, 25 bp, Mus musculus
gagacactgttctgcaacactcagg

SEQ ID NO: 469266 - DNA, 25 bp, Mus musculus
gagacacttagaccactgtgacaaa

SEQ ID NO: 469267 - DNA, 25 bp, Mus musculus
gagacacttagagcactgtgacaaa

SEQ ID NO: 469268 - DNA, 25 bp, Mus musculus
gagacacttcatacagtccccagaa

SEQ ID NO: 469269 - DNA, 25 bp, Mus musculus
gagacacttcatcttgcgtagctgc

SEQ ID NO: 469270 - DNA, 25 bp, Mus musculus
gagacacttcatgttgcgtagctgc

SEQ ID NO: 469271 - DNA, 25 bp, Mus musculus
gagacacttcattcagtccccagaa

SEQ ID NO: 469272 - DNA, 25 bp, Mus musculus
gagacacttcctcttatgtactgtg

SEQ ID NO: 469273 - DNA, 25 bp, Mus musculus
gagacacttcctgttatgtactgtg

SEQ ID NO: 469274 - DNA, 25 bp, Mus musculus
gagacacttctgatacaacttccac

SEQ ID NO: 469275 - DNA, 25 bp, Mus musculus
gagacacttctgttacaacttccac

SEQ ID NO: 469276 - DNA, 25 bp, Mus musculus
gagacacttgatatacttggtgctg

SEQ ID NO: 469277 - DNA, 25 bp, Mus musculus
gagacacttgatttacttggtgctg

SEQ ID NO: 469278 - DNA, 25 bp, Mus musculus
gagacacttgcccaacatgtgattt

SEQ ID NO: 469279 - DNA, 25 bp, Mus musculus
gagacacttgccgaacatgtgattt

SEQ ID NO: 469280 - DNA, 25 bp, Mus musculus
gagacacttggacgtcacgtgtgaa

SEQ ID NO: 469281 - DNA, 25 bp, Mus musculus
gagacacttggaggtcacgtgtgaa

SEQ ID NO: 469282 - DNA, 25 bp, Mus musculus
gagacactttctctgtgtagatttg

SEQ ID NO: 469283 - DNA, 25 bp, Mus musculus
gagacactttctgtgtgtagatttg

SEQ ID NO: 469284 - DNA, 25 bp, Mus musculus
gagacactttgacatttcctacctt

SEQ ID NO: 469285 - DNA, 25 bp, Mus musculus
gagacactttgagatttcctacctt

SEQ ID NO: 469286 - DNA, 25 bp, Mus musculus
gagacactttgtatcagcaaagagc

SEQ ID NO: 469287 - DNA, 25 bp, Mus musculus
gagacactttgtttcagcaaagagc

SEQ ID NO: 469288 - DNA, 25 bp, Mus musculus
gagacagaacagatgcaggccgcag

SEQ ID NO: 469289 - DNA, 25 bp, Mus musculus
gagacagaacagttgcaggccgcag

SEQ ID NO: 469290 - DNA, 25 bp, Mus musculus
gagacagaagagcttgtaccagcca

SEQ ID NO: 469291 - DNA, 25 bp, Mus musculus
gagacagaagaggttgtaccagcca

SEQ ID NO: 469292 - DNA, 25 bp, Mus musculus
gagacagaagccaccaaagtgaaag

SEQ ID NO: 469293 - DNA, 25 bp, Mus musculus
gagacagaagcctccaaagtgaaag

SEQ ID NO: 469294 - DNA, 25 bp, Mus musculus
gagacagaagttacactacgactag

SEQ ID NO: 469295 - DNA, 25 bp, Mus musculus
gagacagaagtttcactacgactag

SEQ ID NO: 469296 - DNA, 25 bp, Mus musculus
gagacagacacacaaagccgacacc

SEQ ID NO: 469297 - DNA, 25 bp, Mus musculus
gagacagacacagaaagccgacacc

SEQ ID NO: 469298 - DNA, 25 bp, Mus musculus
gagacagacagtaccaccgtagagc

SEQ ID NO: 469299 - DNA, 25 bp, Mus musculus
gagacagacagttccaccgtagagc

SEQ ID NO: 469300 - DNA, 25 bp, Mus musculus
gagacagacataataatcaatggaa

SEQ ID NO: 469301 - DNA, 25 bp, Mus musculus
gagacagacatacatttagaagaac

SEQ ID NO: 469302 - DNA, 25 bp, Mus musculus
gagacagacatagatttagaagaac

SEQ ID NO: 469303 - DNA, 25 bp, Mus musculus
gagacagacatattaatcaatggaa

SEQ ID NO: 469304 - DNA, 25 bp, Mus musculus
gagacagacattaaagataagtttt

SEQ ID NO: 469305 - DNA, 25 bp, Mus musculus
gagacagacatttaagataagtttt

SEQ ID NO: 469306 - DNA, 25 bp, Mus musculus
gagacagaccagagttttttcctaa

SEQ ID NO: 469307 - DNA, 25 bp, Mus musculus
gagacagaccagtgttttttcctaa

SEQ ID NO: 469308 - DNA, 25 bp, Mus musculus
gagacagaccctacgggaccgtggt

SEQ ID NO: 469309 - DNA, 25 bp, Mus musculus
gagacagaccctactgaacacacag

SEQ ID NO: 469310 - DNA, 25 bp, Mus musculus
gagacagacccttcgggaccgtggt

SEQ ID NO: 469311 - DNA, 25 bp, Mus musculus
gagacagacccttctgaacacacag

SEQ ID NO: 469312 - DNA, 25 bp, Mus musculus
gagacagacgtgcttcaaagttcta

SEQ ID NO: 469313 - DNA, 25 bp, Mus musculus
gagacagacgtggttcaaagttcta

SEQ ID NO: 469314 - DNA, 25 bp, Mus musculus
gagacagactacaacggctttcctg

SEQ ID NO: 469315 - DNA, 25 bp, Mus musculus
gagacagactactacggctttcctg

SEQ ID NO: 469316 - DNA, 25 bp, Mus musculus
gagacagactgccacttggataaga

SEQ ID NO: 469317 - DNA, 25 bp, Mus musculus
gagacagactgcgacttggataaga

SEQ ID NO: 469318 - DNA, 25 bp, Mus musculus
gagacagacttactgcagaactcag

SEQ ID NO: 469319 - DNA, 25 bp, Mus musculus
gagacagacttagtgcagaactcag

SEQ ID NO: 469320 - DNA, 25 bp, Mus musculus
gagacagagactcaatctccatcaa

SEQ ID NO: 469321 - DNA, 25 bp, Mus musculus
gagacagagactcacactgtagttc

SEQ ID NO: 469322 - DNA, 25 bp, Mus musculus
gagacagagactgaatctccatcaa

SEQ ID NO: 469323 - DNA, 25 bp, Mus musculus
gagacagagactgacactgtagttc

SEQ ID NO: 469324 - DNA, 25 bp, Mus musculus
gagacagagcgtactggtcccagtt

SEQ ID NO: 469325 - DNA, 25 bp, Mus musculus
gagacagagcgttctggtcccagtt

SEQ ID NO: 469326 - DNA, 25 bp, Mus musculus
gagacagagctcatatttactgtaa

SEQ ID NO: 469327 - DNA, 25 bp, Mus musculus
gagacagagctcttatttactgtaa

SEQ ID NO: 469328 - DNA, 25 bp, Mus musculus
gagacagagctgagccaacgcatca

SEQ ID NO: 469329 - DNA, 25 bp, Mus musculus
gagacagagctgtgccaacgcatca

SEQ ID NO: 469330 - DNA, 25 bp, Mus musculus
gagacagaggcccagacatttttcc

SEQ ID NO: 469331 - DNA, 25 bp, Mus musculus
gagacagaggccgagacatttttcc

SEQ ID NO: 469332 - DNA, 25 bp, Mus musculus
gagacagaggctaccctttataaag

SEQ ID NO: 469333 - DNA, 25 bp, Mus musculus
gagacagaggcttccctttataaag

SEQ ID NO: 469334 - DNA, 25 bp, Mus musculus
gagacagagggcatactggacaaac

SEQ ID NO: 469335 - DNA, 25 bp, Mus musculus
gagacagagggcttactggacaaac

SEQ ID NO: 469336 - DNA, 25 bp, Mus musculus
gagacagagtaaccaggccctccta

SEQ ID NO: 469337 - DNA, 25 bp, Mus musculus
gagacagagtaagcaggccctccta

SEQ ID NO: 469338 - DNA, 25 bp, Mus musculus
gagacagagttcacacggtctgtgc

SEQ ID NO: 469339 - DNA, 25 bp, Mus musculus
gagacagagttctcacggtctgtgc

SEQ ID NO: 469340 - DNA, 25 bp, Mus musculus
gagacagatactcgctcatctctgg

SEQ ID NO: 469341 - DNA, 25 bp, Mus musculus
gagacagatactggctcatctctgg

SEQ ID NO: 469342 - DNA, 25 bp, Mus musculus
gagacagatcttctgaaccttagag

SEQ ID NO: 469343 - DNA, 25 bp, Mus musculus
gagacagatcttgtgaaccttagag

SEQ ID NO: 469344 - DNA, 25 bp, Mus musculus
gagacagatggcactgatgtcagcc

SEQ ID NO: 469345 - DNA, 25 bp, Mus musculus
gagacagatggctctgatgtcagcc

SEQ ID NO: 469346 - DNA, 25 bp, Mus musculus
gagacagatgggatgttgttttttg

SEQ ID NO: 469347 - DNA, 25 bp, Mus musculus
gagacagatgggttgttgttttttg

SEQ ID NO: 469348 - DNA, 25 bp, Mus musculus
gagacagcaaaaccagctaacacta

SEQ ID NO: 469349 - DNA, 25 bp, Mus musculus
gagacagcaaaagcagctaacacta

SEQ ID NO: 469350 - DNA, 25 bp, Mus musculus
gagacagcaagacacacggagacag

SEQ ID NO: 469351 - DNA, 25 bp, Mus musculus
gagacagcaagagacacggagacag

SEQ ID NO: 469352 - DNA, 25 bp, Mus musculus
gagacagcaagcaaccatgccgttc

SEQ ID NO: 469353 - DNA, 25 bp, Mus musculus
gagacagcaagctaccatgccgttc

SEQ ID NO: 469354 - DNA, 25 bp, Mus musculus
gagacagcactactctgacatcttc

SEQ ID NO: 469355 - DNA, 25 bp, Mus musculus
gagacagcactagtctgacatcttc

SEQ ID NO: 469356 - DNA, 25 bp, Mus musculus
gagacagcagagcaggcgcttacca

SEQ ID NO: 469357 - DNA, 25 bp, Mus musculus
gagacagcagaggaggcgcttacca

SEQ ID NO: 469358 - DNA, 25 bp, Mus musculus
gagacagcagatagcccaggtcatg

SEQ ID NO: 469359 - DNA, 25 bp, Mus musculus
gagacagcagattgcccaggtcatg

SEQ ID NO: 469360 - DNA, 25 bp, Mus musculus
gagacagcagccagtgaagcaacct

SEQ ID NO: 469361 - DNA, 25 bp, Mus musculus
gagacagcagcctgtgaagcaacct

SEQ ID NO: 469362 - DNA, 25 bp, Mus musculus
gagacagcagctattatttggtgta

SEQ ID NO: 469363 - DNA, 25 bp, Mus musculus
gagacagcagcttttatttggtgta

SEQ ID NO: 469364 - DNA, 25 bp, Mus musculus
gagacagcagtcacaatctgcattg

SEQ ID NO: 469365 - DNA, 25 bp, Mus musculus
gagacagcagtctcaatctgcattg

SEQ ID NO: 469366 - DNA, 25 bp, Mus musculus
gagacagcagtgattctattggagc

SEQ ID NO: 469367 - DNA, 25 bp, Mus musculus
gagacagcagtgtttctattggagc

SEQ ID NO: 469368 - DNA, 25 bp, Mus musculus
gagacagcataaaacattccaccag

SEQ ID NO: 469369 - DNA, 25 bp, Mus musculus
gagacagcataatacattccaccag

SEQ ID NO: 469370 - DNA, 25 bp, Mus musculus
gagacagcatgtccgtttttctgaa

SEQ ID NO: 469371 - DNA, 25 bp, Mus musculus
gagacagcatgtgcgtttttctgaa

SEQ ID NO: 469372 - DNA, 25 bp, Mus musculus
gagacagcatttcattgtgttaccc

SEQ ID NO: 469373 - DNA, 25 bp, Mus musculus
gagacagcatttgattgtgttaccc

SEQ ID NO: 469374 - DNA, 25 bp, Mus musculus
gagacagccaatatgattttagatc

SEQ ID NO: 469375 - DNA, 25 bp, Mus musculus
gagacagccaatttgattttagatc

SEQ ID NO: 469376 - DNA, 25 bp, Mus musculus
gagacagcccacacccgcggtggag

SEQ ID NO: 469377 - DNA, 25 bp, Mus musculus
gagacagcccactcccgcggtggag

SEQ ID NO: 469378 - DNA, 25 bp, Mus musculus
gagacagccgagagcaattgctttg

SEQ ID NO: 469379 - DNA, 25 bp, Mus musculus
gagacagccgagtgcaattgctttg

SEQ ID NO: 469380 - DNA, 25 bp, Mus musculus
gagacagcctacatctgacagactc

SEQ ID NO: 469381 - DNA, 25 bp, Mus musculus
gagacagcctacttctgacagactc

SEQ ID NO: 469382 - DNA, 25 bp, Mus musculus
gagacagcctagctaatttggtaga

SEQ ID NO: 469383 - DNA, 25 bp, Mus musculus
gagacagcctaggtaatttggtaga

SEQ ID NO: 469384 - DNA, 25 bp, Mus musculus
gagacagcctgacaagagtcctggt

SEQ ID NO: 469385 - DNA, 25 bp, Mus musculus
gagacagcctgagaagagtcctggt

SEQ ID NO: 469386 - DNA, 25 bp, Mus musculus
gagacagcgatgcacatcatggcct

SEQ ID NO: 469387 - DNA, 25 bp, Mus musculus
gagacagcgatggacatcatggcct

SEQ ID NO: 469388 - DNA, 25 bp, Mus musculus
gagacagcggatattcctccgggtt

SEQ ID NO: 469389 - DNA, 25 bp, Mus musculus
gagacagcggattttcctccgggtt

SEQ ID NO: 469390 - DNA, 25 bp, Mus musculus
gagacagcggttcccaactggagta

SEQ ID NO: 469391 - DNA, 25 bp, Mus musculus
gagacagcggttgccaactggagta

SEQ ID NO: 469392 - DNA, 25 bp, Mus musculus
gagacagctatacaccaacacaggt

SEQ ID NO: 469393 - DNA, 25 bp, Mus musculus
gagacagctatagaccaacacaggt

SEQ ID NO: 469394 - DNA, 25 bp, Mus musculus
gagacagctattatgcctggctcca

SEQ ID NO: 469395 - DNA, 25 bp, Mus musculus
gagacagctattttgcctggctcca

SEQ ID NO: 469396 - DNA, 25 bp, Mus musculus
gagacagctcagaggcttggtgact

SEQ ID NO: 469397 - DNA, 25 bp, Mus musculus
gagacagctcagtggcttggtgact

SEQ ID NO: 469398 - DNA, 25 bp, Mus musculus
gagacagctccccagtgactaatgc

SEQ ID NO: 469399 - DNA, 25 bp, Mus musculus
gagacagctcccgagtgactaatgc

SEQ ID NO: 469400 - DNA, 25 bp, Mus musculus
gagacagctctgactgcgtgcagca

SEQ ID NO: 469401 - DNA, 25 bp, Mus musculus
gagacagctctgtctgcgtgcagca

SEQ ID NO: 469402 - DNA, 25 bp, Mus musculus
gagacagctggaacatcttacaccc

SEQ ID NO: 469403 - DNA, 25 bp, Mus musculus
gagacagctggatcatcttacaccc

SEQ ID NO: 469404 - DNA, 25 bp, Mus musculus
gagacagctggccagaatcgtatat

SEQ ID NO: 469405 - DNA, 25 bp, Mus musculus
gagacagctggcgagaatcgtatat

SEQ ID NO: 469406 - DNA, 25 bp, Mus musculus
gagacagctttacaagtgttgccta

SEQ ID NO: 469407 - DNA, 25 bp, Mus musculus
gagacagctttagaagtgttgccta

SEQ ID NO: 469408 - DNA, 25 bp, Mus musculus
gagacagcttttctagcctcactgc

SEQ ID NO: 469409 - DNA, 25 bp, Mus musculus
gagacagcttttgtagcctcactgc

SEQ ID NO: 469410 - DNA, 25 bp, Mus musculus
gagacaggaccaactccaaatgaca

SEQ ID NO: 469411 - DNA, 25 bp, Mus musculus
gagacaggaccaatttccgaggcaa

SEQ ID NO: 469412 - DNA, 25 bp, Mus musculus
gagacaggaccatctccaaatgaca

SEQ ID NO: 469413 - DNA, 25 bp, Mus musculus
gagacaggaccattttccgaggcaa

SEQ ID NO: 469414 - DNA, 25 bp, Mus musculus
gagacaggacctatatctacaccct

SEQ ID NO: 469415 - DNA, 25 bp, Mus musculus
gagacaggacctttatctacaccct

SEQ ID NO: 469416 - DNA, 25 bp, Mus musculus
gagacaggactgctgttgcttcttc

SEQ ID NO: 469417 - DNA, 25 bp, Mus musculus
gagacaggactggtgttgcttcttc

SEQ ID NO: 469418 - DNA, 25 bp, Mus musculus
gagacaggagccaccatcaagctgt

SEQ ID NO: 469419 - DNA, 25 bp, Mus musculus
gagacaggagcctccatcaagctgt

SEQ ID NO: 469420 - DNA, 25 bp, Mus musculus
gagacaggatcaaacatctatggat

SEQ ID NO: 469421 - DNA, 25 bp, Mus musculus
gagacaggatcatacatctatggat

SEQ ID NO: 469422 - DNA, 25 bp, Mus musculus
gagacaggatggatttgacactagt

SEQ ID NO: 469423 - DNA, 25 bp, Mus musculus
gagacaggatggttttgacactagt

SEQ ID NO: 469424 - DNA, 25 bp, Mus musculus
gagacaggcagactcttttgatctg

SEQ ID NO: 469425 - DNA, 25 bp, Mus musculus
gagacaggcagagtcttttgatctg

SEQ ID NO: 469426 - DNA, 25 bp, Mus musculus
gagacaggcagcatgcttgcacaca

SEQ ID NO: 469427 - DNA, 25 bp, Mus musculus
gagacaggcagcttgcttgcacaca

SEQ ID NO: 469428 - DNA, 25 bp, Mus musculus
gagacaggcgataatttttcccata

SEQ ID NO: 469429 - DNA, 25 bp, Mus musculus
gagacaggcgattatttttcccata

SEQ ID NO: 469430 - DNA, 25 bp, Mus musculus
gagacaggcgtgaacgatctcgctc

SEQ ID NO: 469431 - DNA, 25 bp, Mus musculus
gagacaggcgtgtacgatctcgctc

SEQ ID NO: 469432 - DNA, 25 bp, Mus musculus
gagacaggctaaagacacctcctca

SEQ ID NO: 469433 - DNA, 25 bp, Mus musculus
gagacaggctaatgacacctcctca

SEQ ID NO: 469434 - DNA, 25 bp, Mus musculus
gagacaggcttcaatttctaccacc

SEQ ID NO: 469435 - DNA, 25 bp, Mus musculus
gagacaggcttctatttctaccacc

SEQ ID NO: 469436 - DNA, 25 bp, Mus musculus
gagacagggagccaaccagtatagt

SEQ ID NO: 469437 - DNA, 25 bp, Mus musculus
gagacagggagcgaaccagtatagt

SEQ ID NO: 469438 - DNA, 25 bp, Mus musculus
gagacagggctgatatatacaataa

SEQ ID NO: 469439 - DNA, 25 bp, Mus musculus
gagacagggctgttatatacaataa

SEQ ID NO: 469440 - DNA, 25 bp, Mus musculus
gagacaggtattaggccagacagat

SEQ ID NO: 469441 - DNA, 25 bp, Mus musculus
gagacaggtatttggccagacagat

SEQ ID NO: 469442 - DNA, 25 bp, Mus musculus
gagacaggtcataacaaacttggct

SEQ ID NO: 469443 - DNA, 25 bp, Mus musculus
gagacaggtcattacaaacttggct

SEQ ID NO: 469444 - DNA, 25 bp, Mus musculus
gagacaggtctcaacatctgcatga

SEQ ID NO: 469445 - DNA, 25 bp, Mus musculus
gagacaggtctccatcgaagcatga

SEQ ID NO: 469446 - DNA, 25 bp, Mus musculus
gagacaggtctcgatcgaagcatga

SEQ ID NO: 469447 - DNA, 25 bp, Mus musculus
gagacaggtctctacatctgcatga

SEQ ID NO: 469448 - DNA, 25 bp, Mus musculus
gagacaggtcttagggccagtcttt

SEQ ID NO: 469449 - DNA, 25 bp, Mus musculus
gagacaggtctttgggccagtcttt

SEQ ID NO: 469450 - DNA, 25 bp, Mus musculus
gagacaggtgacacactaagctcca

SEQ ID NO: 469451 - DNA, 25 bp, Mus musculus
gagacaggtgactcactaagctcca

SEQ ID NO: 469452 - DNA, 25 bp, Mus musculus
gagacaggtggtccatccacccaga

SEQ ID NO: 469453 - DNA, 25 bp, Mus musculus
gagacaggtggtgcatccacccaga

SEQ ID NO: 469454 - DNA, 25 bp, Mus musculus
gagacaggttcaaaacagccgtgtt

SEQ ID NO: 469455 - DNA, 25 bp, Mus musculus
gagacaggttcataacagccgtgtt

SEQ ID NO: 469456 - DNA, 25 bp, Mus musculus
gagacaggtttaattaccacacagt

SEQ ID NO: 469457 - DNA, 25 bp, Mus musculus
gagacaggtttatttaccacacagt

SEQ ID NO: 469458 - DNA, 25 bp, Mus musculus
gagacagtaaatacctcagctgccc

SEQ ID NO: 469459 - DNA, 25 bp, Mus musculus
gagacagtaaattcctcagctgccc

SEQ ID NO: 469460 - DNA, 25 bp, Mus musculus
gagacagtacaaaggtgcctctttg

SEQ ID NO: 469461 - DNA, 25 bp, Mus musculus
gagacagtacaatggtgcctctttg

SEQ ID NO: 469462 - DNA, 25 bp, Mus musculus
gagacagtacagatgcatgcgggtt

SEQ ID NO: 469463 - DNA, 25 bp, Mus musculus
gagacagtacagttgcatgcgggtt

SEQ ID NO: 469464 - DNA, 25 bp, Mus musculus
gagacagtactgaccaagccttgga

SEQ ID NO: 469465 - DNA, 25 bp, Mus musculus
gagacagtactgtccaagccttgga

SEQ ID NO: 469466 - DNA, 25 bp, Mus musculus
gagacagtagagagccctgtcctct

SEQ ID NO: 469467 - DNA, 25 bp, Mus musculus
gagacagtagagtgccctgtcctct

SEQ ID NO: 469468 - DNA, 25 bp, Mus musculus
gagacagtatccatagactctgctt

SEQ ID NO: 469469 - DNA, 25 bp, Mus musculus
gagacagtatccttagactctgctt

SEQ ID NO: 469470 - DNA, 25 bp, Mus musculus
gagacagtatgaagcccacctggat

SEQ ID NO: 469471 - DNA, 25 bp, Mus musculus
gagacagtatgatgcccacctggat

SEQ ID NO: 469472 - DNA, 25 bp, Mus musculus
gagacagtcagcaccgactatgata

SEQ ID NO: 469473 - DNA, 25 bp, Mus musculus
gagacagtcagctccgactatgata

SEQ ID NO: 469474 - DNA, 25 bp, Mus musculus
gagacagtccaccttggagctgact

SEQ ID NO: 469475 - DNA, 25 bp, Mus musculus
gagacagtccacgttggagctgact

SEQ ID NO: 469476 - DNA, 25 bp, Mus musculus
gagacagtccctcaagataagatct

SEQ ID NO: 469477 - DNA, 25 bp, Mus musculus
gagacagtccctgaagataagatct

SEQ ID NO: 469478 - DNA, 25 bp, Mus musculus
gagacagtcctgacagtcctactga

SEQ ID NO: 469479 - DNA, 25 bp, Mus musculus
gagacagtcctgtcagtcctactga

SEQ ID NO: 469480 - DNA, 25 bp, Mus musculus
gagacagtctcaatatataatccct

SEQ ID NO: 469481 - DNA, 25 bp, Mus musculus
gagacagtctcaccaggcggcttga

SEQ ID NO: 469482 - DNA, 25 bp, Mus musculus
gagacagtctcagcaggcggcttga

SEQ ID NO: 469483 - DNA, 25 bp, Mus musculus
gagacagtctcattatataatccct

SEQ ID NO: 469484 - DNA, 25 bp, Mus musculus
gagacagtcttgatatggagcctag

SEQ ID NO: 469485 - DNA, 25 bp, Mus musculus
gagacagtcttgttatggagcctag

SEQ ID NO: 469486 - DNA, 25 bp, Mus musculus
gagacagtgaccagagtcccttggc

SEQ ID NO: 469487 - DNA, 25 bp, Mus musculus
gagacagtgacccagtaccaccttt

SEQ ID NO: 469488 - DNA, 25 bp, Mus musculus
gagacagtgaccctcagtggacaaa

SEQ ID NO: 469489 - DNA, 25 bp, Mus musculus
gagacagtgaccgagtaccaccttt

SEQ ID NO: 469490 - DNA, 25 bp, Mus musculus
gagacagtgaccgtcagtggacaaa

SEQ ID NO: 469491 - DNA, 25 bp, Mus musculus
gagacagtgacctgagtcccttggc

SEQ ID NO: 469492 - DNA, 25 bp, Mus musculus
gagacagtgattagcaactggaaag

SEQ ID NO: 469493 - DNA, 25 bp, Mus musculus
gagacagtgatttgcaactggaaag

SEQ ID NO: 469494 - DNA, 25 bp, Mus musculus
gagacagtgcagagtagctttagat

SEQ ID NO: 469495 - DNA, 25 bp, Mus musculus
gagacagtgcagtgtagctttagat

SEQ ID NO: 469496 - DNA, 25 bp, Mus musculus
gagacagtgctcagagaactgggaa

SEQ ID NO: 469497 - DNA, 25 bp, Mus musculus
gagacagtgctctgagaactgggaa

SEQ ID NO: 469498 - DNA, 25 bp, Mus musculus
gagacagtgctgactatctagtggg

SEQ ID NO: 469499 - DNA, 25 bp, Mus musculus
gagacagtgctgtctatctagtggg

SEQ ID NO: 469500 - DNA, 25 bp, Mus musculus
gagacagtggaaccagcgttcccct

SEQ ID NO: 469501 - DNA, 25 bp, Mus musculus
gagacagtggaagcagcgttcccct

SEQ ID NO: 469502 - DNA, 25 bp, Mus musculus
gagacagtggcaacccagactcgga

SEQ ID NO: 469503 - DNA, 25 bp, Mus musculus
gagacagtggcatcccagactcgga

SEQ ID NO: 469504 - DNA, 25 bp, Mus musculus
gagacagtgtacctatccagggtat

SEQ ID NO: 469505 - DNA, 25 bp, Mus musculus
gagacagtgtacgtatccagggtat

SEQ ID NO: 469506 - DNA, 25 bp, Mus musculus
gagacagtgtgaacaaccttttctt

SEQ ID NO: 469507 - DNA, 25 bp, Mus musculus
gagacagtgtgatcaaccttttctt

SEQ ID NO: 469508 - DNA, 25 bp, Mus musculus
gagacagttaaaccaccggatgaat

SEQ ID NO: 469509 - DNA, 25 bp, Mus musculus
gagacagttaaagcaccggatgaat

SEQ ID NO: 469510 - DNA, 25 bp, Mus musculus
gagacagttccaagtgaccggctga

SEQ ID NO: 469511 - DNA, 25 bp, Mus musculus
gagacagttccatgtgaccggctga

SEQ ID NO: 469512 - DNA, 25 bp, Mus musculus
gagacagttctgatctaggctgaca

SEQ ID NO: 469513 - DNA, 25 bp, Mus musculus
gagacagttctgttctaggctgaca

SEQ ID NO: 469514 - DNA, 25 bp, Mus musculus
gagacagttcttctctgagttcccc

SEQ ID NO: 469515 - DNA, 25 bp, Mus musculus
gagacagttcttgtctgagttcccc

SEQ ID NO: 469516 - DNA, 25 bp, Mus musculus
gagacagttggcactttgtcctttc

SEQ ID NO: 469517 - DNA, 25 bp, Mus musculus
gagacagttggctctttgtcctttc

SEQ ID NO: 469518 - DNA, 25 bp, Mus musculus
gagacagttgtaacctgtcagctaa

SEQ ID NO: 469519 - DNA, 25 bp, Mus musculus
gagacagttgtatcctgtcagctaa

SEQ ID NO: 469520 - DNA, 25 bp, Mus musculus
gagacagtttaccagaaccttgatg

SEQ ID NO: 469521 - DNA, 25 bp, Mus musculus
gagacagtttacgagaaccttgatg

SEQ ID NO: 469522 - DNA, 25 bp, Mus musculus
gagacagttttcatggaatgccagg

SEQ ID NO: 469523 - DNA, 25 bp, Mus musculus
gagacagttttcctctgctgaggtt

SEQ ID NO: 469524 - DNA, 25 bp, Mus musculus
gagacagttttcgtctgctgaggtt

SEQ ID NO: 469525 - DNA, 25 bp, Mus musculus
gagacagttttcttggaatgccagg

SEQ ID NO: 469526 - DNA, 25 bp, Mus musculus
gagacagtttttaatatagcacagg

SEQ ID NO: 469527 - DNA, 25 bp, Mus musculus
gagacagttttttatatagcacagg

SEQ ID NO: 469528 - DNA, 25 bp, Mus musculus
gagacataaaatcctctatagttaa

SEQ ID NO: 469529 - DNA, 25 bp, Mus musculus
gagacataaaatgctctatagttaa

SEQ ID NO: 469530 - DNA, 25 bp, Mus musculus
gagacataaaccaggactcctatat

SEQ ID NO: 469531 - DNA, 25 bp, Mus musculus
gagacataaacctggactcctatat

SEQ ID NO: 469532 - DNA, 25 bp, Mus musculus
gagacatacaagctggacggcccag

SEQ ID NO: 469533 - DNA, 25 bp, Mus musculus
gagacatacaaggtggacggcccag

SEQ ID NO: 469534 - DNA, 25 bp, Mus musculus
gagacatacagtcacctggcagctt

SEQ ID NO: 469535 - DNA, 25 bp, Mus musculus
gagacatacagtgacctggcagctt

SEQ ID NO: 469536 - DNA, 25 bp, Mus musculus
gagacataccttccttgcttccaaa

SEQ ID NO: 469537 - DNA, 25 bp, Mus musculus
gagacataccttgcttgcttccaaa

SEQ ID NO: 469538 - DNA, 25 bp, Mus musculus
gagacatactgcatacagccgagga

SEQ ID NO: 469539 - DNA, 25 bp, Mus musculus
gagacatactgcttacagccgagga

SEQ ID NO: 469540 - DNA, 25 bp, Mus musculus
gagacatacttccttcctagtcatc

SEQ ID NO: 469541 - DNA, 25 bp, Mus musculus
gagacatacttcgttcctagtcatc

SEQ ID NO: 469542 - DNA, 25 bp, Mus musculus
gagacatagagaacagcctgccaat

SEQ ID NO: 469543 - DNA, 25 bp, Mus musculus
gagacatagagatcagcctgccaat

SEQ ID NO: 469544 - DNA, 25 bp, Mus musculus
gagacatagcccaccgtctgaccgt

SEQ ID NO: 469545 - DNA, 25 bp, Mus musculus
gagacatagccctccgtctgaccgt

SEQ ID NO: 469546 - DNA, 25 bp, Mus musculus
gagacatagtctcatgtattccaga

SEQ ID NO: 469547 - DNA, 25 bp, Mus musculus
gagacatagtctgatgtattccaga

SEQ ID NO: 469548 - DNA, 25 bp, Mus musculus
gagacatagttcctcttcctgtgga

SEQ ID NO: 469549 - DNA, 25 bp, Mus musculus
gagacatagttcgtcttcctgtgga

SEQ ID NO: 469550 - DNA, 25 bp, Mus musculus
gagacatataatagcctgctgtcac

SEQ ID NO: 469551 - DNA, 25 bp, Mus musculus
gagacatataattgcctgctgtcac

SEQ ID NO: 469552 - DNA, 25 bp, Mus musculus
gagacatatgctcagcgcttccaca

SEQ ID NO: 469553 - DNA, 25 bp, Mus musculus
gagacatatgctgagcgcttccaca

SEQ ID NO: 469554 - DNA, 25 bp, Mus musculus
gagacatatgttagacaccacggga

SEQ ID NO: 469555 - DNA, 25 bp, Mus musculus
gagacatatgttctgtaataagttg

SEQ ID NO: 469556 - DNA, 25 bp, Mus musculus
gagacatatgttgtgtaataagttg

SEQ ID NO: 469557 - DNA, 25 bp, Mus musculus
gagacatatgtttgacaccacggga

SEQ ID NO: 469558 - DNA, 25 bp, Mus musculus
gagacatcactcagggctcttgtga

SEQ ID NO: 469559 - DNA, 25 bp, Mus musculus
gagacatcactctgggctcttgtga

SEQ ID NO: 469560 - DNA, 25 bp, Mus musculus
gagacatcagacattgtgcttgtta

SEQ ID NO: 469561 - DNA, 25 bp, Mus musculus
gagacatcagactttgtgcttgtta

SEQ ID NO: 469562 - DNA, 25 bp, Mus musculus
gagacatcagagcacttacgggtct

SEQ ID NO: 469563 - DNA, 25 bp, Mus musculus
gagacatcagaggacttacgggtct

SEQ ID NO: 469564 - DNA, 25 bp, Mus musculus
gagacatcagttacaggatccaccg

SEQ ID NO: 469565 - DNA, 25 bp, Mus musculus
gagacatcagtttcaggatccaccg

SEQ ID NO: 469566 - DNA, 25 bp, Mus musculus
gagacatcatagacaacccagccag

SEQ ID NO: 469567 - DNA, 25 bp, Mus musculus
gagacatcatagtcaacccagccag

SEQ ID NO: 469568 - DNA, 25 bp, Mus musculus
gagacatcattaacagagaccaagt

SEQ ID NO: 469569 - DNA, 25 bp, Mus musculus
gagacatcattatcagagaccaagt

SEQ ID NO: 469570 - DNA, 25 bp, Mus musculus
gagacatccagaagatccatcccaa

SEQ ID NO: 469571 - DNA, 25 bp, Mus musculus
gagacatccagatgatccatcccaa

SEQ ID NO: 469572 - DNA, 25 bp, Mus musculus
gagacatccagcaaatacaggcctg

SEQ ID NO: 469573 - DNA, 25 bp, Mus musculus
gagacatccagctaatacaggcctg

SEQ ID NO: 469574 - DNA, 25 bp, Mus musculus
gagacatcccacagaaagctgtgtt

SEQ ID NO: 469575 - DNA, 25 bp, Mus musculus
gagacatcccactgaaagctgtgtt

SEQ ID NO: 469576 - DNA, 25 bp, Mus musculus
gagacatcccatccctgacattggg

SEQ ID NO: 469577 - DNA, 25 bp, Mus musculus
gagacatcccatccggcaaagaaat

SEQ ID NO: 469578 - DNA, 25 bp, Mus musculus
gagacatcccatgcctgacattggg

SEQ ID NO: 469579 - DNA, 25 bp, Mus musculus
gagacatcccatgcggcaaagaaat

SEQ ID NO: 469580 - DNA, 25 bp, Mus musculus
gagacatcctctccacatctcttgg

SEQ ID NO: 469581 - DNA, 25 bp, Mus musculus
gagacatcctctgcacatctcttgg

SEQ ID NO: 469582 - DNA, 25 bp, Mus musculus
gagacatcgactctccgcgtggaga

SEQ ID NO: 469583 - DNA, 25 bp, Mus musculus
gagacatcgactgtccgcgtggaga

SEQ ID NO: 469584 - DNA, 25 bp, Mus musculus
gagacatcgcctccaagtgtcccaa

SEQ ID NO: 469585 - DNA, 25 bp, Mus musculus
gagacatcgcctgcaagtgtcccaa

SEQ ID NO: 469586 - DNA, 25 bp, Mus musculus
gagacatcgcttcccagaacatgat

SEQ ID NO: 469587 - DNA, 25 bp, Mus musculus
gagacatcgcttgccagaacatgat

SEQ ID NO: 469588 - DNA, 25 bp, Mus musculus
gagacatcgtcccaggtccagactt

SEQ ID NO: 469589 - DNA, 25 bp, Mus musculus
gagacatcgtccgaggtccagactt

SEQ ID NO: 469590 - DNA, 25 bp, Mus musculus
gagacatctaataaacccagcccca

SEQ ID NO: 469591 - DNA, 25 bp, Mus musculus
gagacatctaattaacccagcccca

SEQ ID NO: 469592 - DNA, 25 bp, Mus musculus
gagacatctagactcacagactgaa

SEQ ID NO: 469593 - DNA, 25 bp, Mus musculus
gagacatctagagtcacagactgaa

SEQ ID NO: 469594 - DNA, 25 bp, Mus musculus
gagacatctattcctgggtctgtac

SEQ ID NO: 469595 - DNA, 25 bp, Mus musculus
gagacatctattgctgggtctgtac

SEQ ID NO: 469596 - DNA, 25 bp, Mus musculus
gagacatctcagacctttcctgatg

SEQ ID NO: 469597 - DNA, 25 bp, Mus musculus
gagacatctcagtcctttcctgatg

SEQ ID NO: 469598 - DNA, 25 bp, Mus musculus
gagacatctcgcattggtggcccaa

SEQ ID NO: 469599 - DNA, 25 bp, Mus musculus
gagacatctcgctttggtggcccaa

SEQ ID NO: 469600 - DNA, 25 bp, Mus musculus
gagacatctgcactgtactctgtaa

SEQ ID NO: 469601 - DNA, 25 bp, Mus musculus
gagacatctgcagtgtactctgtaa

SEQ ID NO: 469602 - DNA, 25 bp, Mus musculus
gagacatctgctctagattctacaa

SEQ ID NO: 469603 - DNA, 25 bp, Mus musculus
gagacatctgctgtagattctacaa

SEQ ID NO: 469604 - DNA, 25 bp, Mus musculus
gagacatctgtaatcacatccctga

SEQ ID NO: 469605 - DNA, 25 bp, Mus musculus
gagacatctgtattcacatccctga

SEQ ID NO: 469606 - DNA, 25 bp, Mus musculus
gagacatctgtcaataacccacctt

SEQ ID NO: 469607 - DNA, 25 bp, Mus musculus
gagacatctgtcaccgagaggcttc

SEQ ID NO: 469608 - DNA, 25 bp, Mus musculus
gagacatctgtctataacccacctt

SEQ ID NO: 469609 - DNA, 25 bp, Mus musculus
gagacatctgtctccgagaggcttc

SEQ ID NO: 469610 - DNA, 25 bp, Mus musculus
gagacatcttcaaatcttccacgga

SEQ ID NO: 469611 - DNA, 25 bp, Mus musculus
gagacatcttcatatcttccacgga

SEQ ID NO: 469612 - DNA, 25 bp, Mus musculus
gagacatcttgaacttttggtgtat

SEQ ID NO: 469613 - DNA, 25 bp, Mus musculus
gagacatcttgatcttttggtgtat

SEQ ID NO: 469614 - DNA, 25 bp, Mus musculus
gagacatgaaaaacccacttcttta

SEQ ID NO: 469615 - DNA, 25 bp, Mus musculus
gagacatgaaaatcccacttcttta

SEQ ID NO: 469616 - DNA, 25 bp, Mus musculus
gagacatgagttctggtttcactga

SEQ ID NO: 469617 - DNA, 25 bp, Mus musculus
gagacatgagttgtggtttcactga

SEQ ID NO: 469618 - DNA, 25 bp, Mus musculus
gagacatgcacaactgttaccatgg

SEQ ID NO: 469619 - DNA, 25 bp, Mus musculus
gagacatgcacatctgttaccatgg

SEQ ID NO: 469620 - DNA, 25 bp, Mus musculus
gagacatgcaggactctgagttcga

SEQ ID NO: 469621 - DNA, 25 bp, Mus musculus
gagacatgcaggtctctgagttcga

SEQ ID NO: 469622 - DNA, 25 bp, Mus musculus
gagacatgcccaattctatgagttt

SEQ ID NO: 469623 - DNA, 25 bp, Mus musculus
gagacatgcccatttctatgagttt

SEQ ID NO: 469624 - DNA, 25 bp, Mus musculus
gagacatgccccagaaagaacgaga

SEQ ID NO: 469625 - DNA, 25 bp, Mus musculus
gagacatgcccctgaaagaacgaga

SEQ ID NO: 469626 - DNA, 25 bp, Mus musculus
gagacatgcctcatagcagccgcta

SEQ ID NO: 469627 - DNA, 25 bp, Mus musculus
gagacatgcctcttagcagccgcta

SEQ ID NO: 469628 - DNA, 25 bp, Mus musculus
gagacatgcgagcattgctttgaag

SEQ ID NO: 469629 - DNA, 25 bp, Mus musculus
gagacatgcgaggattgctttgaag

SEQ ID NO: 469630 - DNA, 25 bp, Mus musculus
gagacatgcttgaactttcagctat

SEQ ID NO: 469631 - DNA, 25 bp, Mus musculus
gagacatgcttgatcaccttcctga

SEQ ID NO: 469632 - DNA, 25 bp, Mus musculus
gagacatgcttgtactttcagctat

SEQ ID NO: 469633 - DNA, 25 bp, Mus musculus
gagacatgcttgttcaccttcctga

SEQ ID NO: 469634 - DNA, 25 bp, Mus musculus
gagacatggacaactgaaatacaga

SEQ ID NO: 469635 - DNA, 25 bp, Mus musculus
gagacatggacatctgaaatacaga

SEQ ID NO: 469636 - DNA, 25 bp, Mus musculus
gagacatggatgagccaactgggct

SEQ ID NO: 469637 - DNA, 25 bp, Mus musculus
gagacatggatgtgccaactgggct

SEQ ID NO: 469638 - DNA, 25 bp, Mus musculus
gagacatggcaacatcaggctggtt

SEQ ID NO: 469639 - DNA, 25 bp, Mus musculus
gagacatggcaagatcaggctggtt

SEQ ID NO: 469640 - DNA, 25 bp, Mus musculus
gagacatggctgaacctgcaaagga

SEQ ID NO: 469641 - DNA, 25 bp, Mus musculus
gagacatggctgtacctgcaaagga

SEQ ID NO: 469642 - DNA, 25 bp, Mus musculus
gagacatgggaaaaactcctctttt

SEQ ID NO: 469643 - DNA, 25 bp, Mus musculus
gagacatgggaataactcctctttt

SEQ ID NO: 469644 - DNA, 25 bp, Mus musculus
gagacatgggcaacaacagtgtgaa

SEQ ID NO: 469645 - DNA, 25 bp, Mus musculus
gagacatgggcatcaacagtgtgaa

SEQ ID NO: 469646 - DNA, 25 bp, Mus musculus
gagacatggtgtagaagcattggaa

SEQ ID NO: 469647 - DNA, 25 bp, Mus musculus
gagacatggtgttgaagcattggaa

SEQ ID NO: 469648 - DNA, 25 bp, Mus musculus
gagacatgtactcatctttcctgag

SEQ ID NO: 469649 - DNA, 25 bp, Mus musculus
gagacatgtactgatctttcctgag

SEQ ID NO: 469650 - DNA, 25 bp, Mus musculus
gagacatgtcagagggcgcaatagt

SEQ ID NO: 469651 - DNA, 25 bp, Mus musculus
gagacatgtcagtgggcgcaatagt

SEQ ID NO: 469652 - DNA, 25 bp, Mus musculus
gagacatgtcctatgttgtacacac

SEQ ID NO: 469653 - DNA, 25 bp, Mus musculus
gagacatgtcctttgttgtacacac

SEQ ID NO: 469654 - DNA, 25 bp, Mus musculus
gagacatgtctacaagcccagagca

SEQ ID NO: 469655 - DNA, 25 bp, Mus musculus
gagacatgtctagaagcccagagca

SEQ ID NO: 469656 - DNA, 25 bp, Mus musculus
gagacatgtctcaaagcaagcaggc

SEQ ID NO: 469657 - DNA, 25 bp, Mus musculus
gagacatgtctctaagcaagcaggc

SEQ ID NO: 469658 - DNA, 25 bp, Mus musculus
gagacatgtttcaatactccagaga

SEQ ID NO: 469659 - DNA, 25 bp, Mus musculus
gagacatgtttctatactccagaga

SEQ ID NO: 469660 - DNA, 25 bp, Mus musculus
gagacattaaacctgcacttgatgg

SEQ ID NO: 469661 - DNA, 25 bp, Mus musculus
gagacattaaacgtgcacttgatgg

SEQ ID NO: 469662 - DNA, 25 bp, Mus musculus
gagacattaactctcgccagttatt

SEQ ID NO: 469663 - DNA, 25 bp, Mus musculus
gagacattaactgtcgccagttatt

SEQ ID NO: 469664 - DNA, 25 bp, Mus musculus
gagacattaaggatccatacagtgc

SEQ ID NO: 469665 - DNA, 25 bp, Mus musculus
gagacattaaggttccatacagtgc

SEQ ID NO: 469666 - DNA, 25 bp, Mus musculus
gagacattaagtctccctcaggcag

SEQ ID NO: 469667 - DNA, 25 bp, Mus musculus
gagacattaagtgtccctcaggcag

SEQ ID NO: 469668 - DNA, 25 bp, Mus musculus
gagacattagcaagtacgcctttgt

SEQ ID NO: 469669 - DNA, 25 bp, Mus musculus
gagacattagcacggcctctggagt

SEQ ID NO: 469670 - DNA, 25 bp, Mus musculus
gagacattagcagggcctctggagt

SEQ ID NO: 469671 - DNA, 25 bp, Mus musculus
gagacattagcatgtacgcctttgt

SEQ ID NO: 469672 - DNA, 25 bp, Mus musculus
gagacattagttagaggcagtacat

SEQ ID NO: 469673 - DNA, 25 bp, Mus musculus
gagacattagtttgaggcagtacat

SEQ ID NO: 469674 - DNA, 25 bp, Mus musculus
gagacattatgtcactcatcctgcc

SEQ ID NO: 469675 - DNA, 25 bp, Mus musculus
gagacattatgtgactcatcctgcc

SEQ ID NO: 469676 - DNA, 25 bp, Mus musculus
gagacattcaacctggtcaacacat

SEQ ID NO: 469677 - DNA, 25 bp, Mus musculus
gagacattcaacgtggtcaacacat

SEQ ID NO: 469678 - DNA, 25 bp, Mus musculus
gagacattcacaaattcggctcaat

SEQ ID NO: 469679 - DNA, 25 bp, Mus musculus
gagacattcacatattcggctcaat

SEQ ID NO: 469680 - DNA, 25 bp, Mus musculus
gagacattcagaacatgagccagtg

SEQ ID NO: 469681 - DNA, 25 bp, Mus musculus
gagacattcagatcatgagccagtg

SEQ ID NO: 469682 - DNA, 25 bp, Mus musculus
gagacattcctgattcatgatacaa

SEQ ID NO: 469683 - DNA, 25 bp, Mus musculus
gagacattcctgtttcatgatacaa

SEQ ID NO: 469684 - DNA, 25 bp, Mus musculus
gagacattcgggacagcaatggctg

SEQ ID NO: 469685 - DNA, 25 bp, Mus musculus
gagacattcgggtcagcaatggctg

SEQ ID NO: 469686 - DNA, 25 bp, Mus musculus
gagacattctagcacagctctgtga

SEQ ID NO: 469687 - DNA, 25 bp, Mus musculus
gagacattctaggacagctctgtga

SEQ ID NO: 469688 - DNA, 25 bp, Mus musculus
gagacattctccaagttcctggaca

SEQ ID NO: 469689 - DNA, 25 bp, Mus musculus
gagacattctccaccggcagaagaa

SEQ ID NO: 469690 - DNA, 25 bp, Mus musculus
gagacattctcctagttcctggaca

SEQ ID NO: 469691 - DNA, 25 bp, Mus musculus
gagacattctcctccggcagaagaa

SEQ ID NO: 469692 - DNA, 25 bp, Mus musculus
gagacattctgtacttcacttggga

SEQ ID NO: 469693 - DNA, 25 bp, Mus musculus
gagacattctgttcttcacttggga

SEQ ID NO: 469694 - DNA, 25 bp, Mus musculus
gagacattcttcaggtcaatgggaa

SEQ ID NO: 469695 - DNA, 25 bp, Mus musculus
gagacattcttctggtcaatgggaa

SEQ ID NO: 469696 - DNA, 25 bp, Mus musculus
gagacattgaagcattagacactat

SEQ ID NO: 469697 - DNA, 25 bp, Mus musculus
gagacattgaaggattagacactat

SEQ ID NO: 469698 - DNA, 25 bp, Mus musculus
gagacattgatactgctgccaaatt

SEQ ID NO: 469699 - DNA, 25 bp, Mus musculus
gagacattgatagtgctgccaaatt

SEQ ID NO: 469700 - DNA, 25 bp, Mus musculus
gagacattgctgattgtgctaagat

SEQ ID NO: 469701 - DNA, 25 bp, Mus musculus
gagacattgctgtttgtgctaagat

SEQ ID NO: 469702 - DNA, 25 bp, Mus musculus
gagacattggtcattaggtggttgt

SEQ ID NO: 469703 - DNA, 25 bp, Mus musculus
gagacattggtctttaggtggttgt

SEQ ID NO: 469704 - DNA, 25 bp, Mus musculus
gagacattgttaatctggccattac

SEQ ID NO: 469705 - DNA, 25 bp, Mus musculus
gagacattgttattctggccattac

SEQ ID NO: 469706 - DNA, 25 bp, Mus musculus
gagacatttcctcaggtgaggtttc

SEQ ID NO: 469707 - DNA, 25 bp, Mus musculus
gagacatttcctgaggtgaggtttc

SEQ ID NO: 469708 - DNA, 25 bp, Mus musculus
gagacatttctactggtaccttacg

SEQ ID NO: 469709 - DNA, 25 bp, Mus musculus
gagacatttctagtggtaccttacg

SEQ ID NO: 469710 - DNA, 25 bp, Mus musculus
gagacatttctcatctacaatttta

SEQ ID NO: 469711 - DNA, 25 bp, Mus musculus
gagacatttctcttctacaatttta

SEQ ID NO: 469712 - DNA, 25 bp, Mus musculus
gagacatttgacacttgtgtttgta

SEQ ID NO: 469713 - DNA, 25 bp, Mus musculus
gagacatttgactcttgtgtttgta

SEQ ID NO: 469714 - DNA, 25 bp, Mus musculus
gagacatttgatcagccttttgtag

SEQ ID NO: 469715 - DNA, 25 bp, Mus musculus
gagacatttgatgagccttttgtag

SEQ ID NO: 469716 - DNA, 25 bp, Mus musculus
gagacatttgcaaaacatccagttt

SEQ ID NO: 469717 - DNA, 25 bp, Mus musculus
gagacatttgcataacatccagttt

SEQ ID NO: 469718 - DNA, 25 bp, Mus musculus
gagacattttccaatcatcaacgtg

SEQ ID NO: 469719 - DNA, 25 bp, Mus musculus
gagacattttcctatcatcaacgtg

SEQ ID NO: 469720 - DNA, 25 bp, Mus musculus
gagacattttctctggcagtttagg

SEQ ID NO: 469721 - DNA, 25 bp, Mus musculus
gagacattttctgtggcagtttagg

SEQ ID NO: 469722 - DNA, 25 bp, Mus musculus
gagacattttgtcaggatgcccatc

SEQ ID NO: 469723 - DNA, 25 bp, Mus musculus
gagacattttgtgaggatgcccatc

SEQ ID NO: 469724 - DNA, 25 bp, Mus musculus
gagaccaaacatatttcgaagagaa

SEQ ID NO: 469725 - DNA, 25 bp, Mus musculus
gagaccaaacatttttcgaagagaa

SEQ ID NO: 469726 - DNA, 25 bp, Mus musculus
gagaccaaacttctttcctcatttc

SEQ ID NO: 469727 - DNA, 25 bp, Mus musculus
gagaccaaacttgtttcctcatttc

SEQ ID NO: 469728 - DNA, 25 bp, Mus musculus
gagaccaaagaccatcaagaataca

SEQ ID NO: 469729 - DNA, 25 bp, Mus musculus
gagaccaaagacgatcaagaataca

SEQ ID NO: 469730 - DNA, 25 bp, Mus musculus
gagaccaaagctcccattttattgc

SEQ ID NO: 469731 - DNA, 25 bp, Mus musculus
gagaccaaagctgccattttattgc

SEQ ID NO: 469732 - DNA, 25 bp, Mus musculus
gagaccaacagaatttgattttcag

SEQ ID NO: 469733 - DNA, 25 bp, Mus musculus
gagaccaacagacagatgcctcaag

SEQ ID NO: 469734 - DNA, 25 bp, Mus musculus
gagaccaacagagagatgcctcaag

SEQ ID NO: 469735 - DNA, 25 bp, Mus musculus
gagaccaacagattttgattttcag

SEQ ID NO: 469736 - DNA, 25 bp, Mus musculus
gagaccaacatcatagcttttaatt

SEQ ID NO: 469737 - DNA, 25 bp, Mus musculus
gagaccaacatcttagcttttaatt

SEQ ID NO: 469738 - DNA, 25 bp, Mus musculus
gagaccaactcaaggaaccactcag

SEQ ID NO: 469739 - DNA, 25 bp, Mus musculus
gagaccaactcatggaaccactcag

SEQ ID NO: 469740 - DNA, 25 bp, Mus musculus
gagaccaacttactgaaatttatca

SEQ ID NO: 469741 - DNA, 25 bp, Mus musculus
gagaccaacttagtgaaatttatca

SEQ ID NO: 469742 - DNA, 25 bp, Mus musculus
gagaccaacttgctatctttctcaa

SEQ ID NO: 469743 - DNA, 25 bp, Mus musculus
gagaccaacttggtatctttctcaa

SEQ ID NO: 469744 - DNA, 25 bp, Mus musculus
gagaccaagaccatcacctatgaag

SEQ ID NO: 469745 - DNA, 25 bp, Mus musculus
gagaccaagaccttcacctatgaag

SEQ ID NO: 469746 - DNA, 25 bp, Mus musculus
gagaccaagcagctgaaagtcacta

SEQ ID NO: 469747 - DNA, 25 bp, Mus musculus
gagaccaagcaggtgaaagtcacta

SEQ ID NO: 469748 - DNA, 25 bp, Mus musculus
gagaccaagctgagtgaccagctgt

SEQ ID NO: 469749 - DNA, 25 bp, Mus musculus
gagaccaagctgtgtgaccagctgt

SEQ ID NO: 469750 - DNA, 25 bp, Mus musculus
gagaccaaggataccctctggaaat

SEQ ID NO: 469751 - DNA, 25 bp, Mus musculus
gagaccaaggattccctctggaaat

SEQ ID NO: 469752 - DNA, 25 bp, Mus musculus
gagaccaagggcagcagctcgccag

SEQ ID NO: 469753 - DNA, 25 bp, Mus musculus
gagaccaagggctgcagctcgccag

SEQ ID NO: 469754 - DNA, 25 bp, Mus musculus
gagaccaagggtaccatttcctaag

SEQ ID NO: 469755 - DNA, 25 bp, Mus musculus
gagaccaagggttccatttcctaag

SEQ ID NO: 469756 - DNA, 25 bp, Mus musculus
gagaccaagtatcacagccaatctt

SEQ ID NO: 469757 - DNA, 25 bp, Mus musculus
gagaccaagtatgacagccaatctt

SEQ ID NO: 469758 - DNA, 25 bp, Mus musculus
gagaccaagtctcgctccaggtgta

SEQ ID NO: 469759 - DNA, 25 bp, Mus musculus
gagaccaagtctggctccaggtgta

SEQ ID NO: 469760 - DNA, 25 bp, Mus musculus
gagaccaatattccttaacggttat

SEQ ID NO: 469761 - DNA, 25 bp, Mus musculus
gagaccaatattgcttaacggttat

SEQ ID NO: 469762 - DNA, 25 bp, Mus musculus
gagaccaattctcccactgtattta

SEQ ID NO: 469763 - DNA, 25 bp, Mus musculus
gagaccaattctgccactgtattta

SEQ ID NO: 469764 - DNA, 25 bp, Mus musculus
gagaccaatttaaattactcaatct

SEQ ID NO: 469765 - DNA, 25 bp, Mus musculus
gagaccaatttatattactcaatct

SEQ ID NO: 469766 - DNA, 25 bp, Mus musculus
gagaccacaatgaagacgcagcaca

SEQ ID NO: 469767 - DNA, 25 bp, Mus musculus
gagaccacaatgtagacgcagcaca

SEQ ID NO: 469768 - DNA, 25 bp, Mus musculus
gagaccacacaaacttcctgtataa

SEQ ID NO: 469769 - DNA, 25 bp, Mus musculus
gagaccacacaatcttcctgtataa

SEQ ID NO: 469770 - DNA, 25 bp, Mus musculus
gagaccacacggcacgtaggaccag

SEQ ID NO: 469771 - DNA, 25 bp, Mus musculus
gagaccacacgggacgtaggaccag

SEQ ID NO: 469772 - DNA, 25 bp, Mus musculus
gagaccacagcgcagaatgaccaga

SEQ ID NO: 469773 - DNA, 25 bp, Mus musculus
gagaccacagcggagaatgaccaga

SEQ ID NO: 469774 - DNA, 25 bp, Mus musculus
gagaccacagtgacccatcaagaag

SEQ ID NO: 469775 - DNA, 25 bp, Mus musculus
gagaccacagtgtcccatcaagaag

SEQ ID NO: 469776 - DNA, 25 bp, Mus musculus
gagaccacataccttcgggctcggg

SEQ ID NO: 469777 - DNA, 25 bp, Mus musculus
gagaccacatacgttcgggctcggg

SEQ ID NO: 469778 - DNA, 25 bp, Mus musculus
gagaccaccattcctgtaaccgcat

SEQ ID NO: 469779 - DNA, 25 bp, Mus musculus
gagaccaccattgctgtaaccgcat

SEQ ID NO: 469780 - DNA, 25 bp, Mus musculus
gagaccaccccaagaagtgcctttc

SEQ ID NO: 469781 - DNA, 25 bp, Mus musculus
gagaccaccccatgaagtgcctttc

SEQ ID NO: 469782 - DNA, 25 bp, Mus musculus
gagaccacctgaatccaagtttcca

SEQ ID NO: 469783 - DNA, 25 bp, Mus musculus
gagaccacctgattccaagtttcca

SEQ ID NO: 469784 - DNA, 25 bp, Mus musculus
gagaccacctgtacatcgcaggaag

SEQ ID NO: 469785 - DNA, 25 bp, Mus musculus
gagaccacctgttcatcgcaggaag

SEQ ID NO: 469786 - DNA, 25 bp, Mus musculus
gagaccaccttaaaccagcgttata

SEQ ID NO: 469787 - DNA, 25 bp, Mus musculus
gagaccaccttactttatgataaag

SEQ ID NO: 469788 - DNA, 25 bp, Mus musculus
gagaccaccttagtttatgataaag

SEQ ID NO: 469789 - DNA, 25 bp, Mus musculus
gagaccaccttataccagcgttata

SEQ ID NO: 469790 - DNA, 25 bp, Mus musculus
gagaccacgctcactggtggcttct

SEQ ID NO: 469791 - DNA, 25 bp, Mus musculus
gagaccacgctctctggtggcttct

SEQ ID NO: 469792 - DNA, 25 bp, Mus musculus
gagaccacggctcacttgacagagt

SEQ ID NO: 469793 - DNA, 25 bp, Mus musculus
gagaccacggctgacttgacagagt

SEQ ID NO: 469794 - DNA, 25 bp, Mus musculus
gagaccacgtttagtaatttacctg

SEQ ID NO: 469795 - DNA, 25 bp, Mus musculus
gagaccacgttttgtaatttacctg

SEQ ID NO: 469796 - DNA, 25 bp, Mus musculus
gagaccactaagagtcaaccactgt

SEQ ID NO: 469797 - DNA, 25 bp, Mus musculus
gagaccactaagtgtcaaccactgt

SEQ ID NO: 469798 - DNA, 25 bp, Mus musculus
gagaccactcggaaagagatcccct

SEQ ID NO: 469799 - DNA, 25 bp, Mus musculus
gagaccactcggtaagagatcccct

SEQ ID NO: 469800 - DNA, 25 bp, Mus musculus
gagaccactgcactttgggctaaca

SEQ ID NO: 469801 - DNA, 25 bp, Mus musculus
gagaccactgcagtttgggctaaca

SEQ ID NO: 469802 - DNA, 25 bp, Mus musculus
gagaccactgtgaacttaggatata

SEQ ID NO: 469803 - DNA, 25 bp, Mus musculus
gagaccactgtgtacttaggatata

SEQ ID NO: 469804 - DNA, 25 bp, Mus musculus
gagaccactgttcaagtaccacaaa

SEQ ID NO: 469805 - DNA, 25 bp, Mus musculus
gagaccactgttctgaattgcttca

SEQ ID NO: 469806 - DNA, 25 bp, Mus musculus
gagaccactgttgaagtaccacaaa

SEQ ID NO: 469807 - DNA, 25 bp, Mus musculus
gagaccactgttgtgaattgcttca

SEQ ID NO: 469808 - DNA, 25 bp, Mus musculus
gagaccacttaaactaacctcctct

SEQ ID NO: 469809 - DNA, 25 bp, Mus musculus
gagaccacttaatctaacctcctct

SEQ ID NO: 469810 - DNA, 25 bp, Mus musculus
gagaccagaagaatgtcggccccgt

SEQ ID NO: 469811 - DNA, 25 bp, Mus musculus
gagaccagaagattgtcggccccgt

SEQ ID NO: 469812 - DNA, 25 bp, Mus musculus
gagaccagaataactgagtcttgag

SEQ ID NO: 469813 - DNA, 25 bp, Mus musculus
gagaccagaatatctgagtcttgag

SEQ ID NO: 469814 - DNA, 25 bp, Mus musculus
gagaccagacccaggccatcgaggg

SEQ ID NO: 469815 - DNA, 25 bp, Mus musculus
gagaccagaccctggccatcgaggg

SEQ ID NO: 469816 - DNA, 25 bp, Mus musculus
gagaccagagaacgctgtcagcagc

SEQ ID NO: 469817 - DNA, 25 bp, Mus musculus
gagaccagagaaggctgtcagcagc

SEQ ID NO: 469818 - DNA, 25 bp, Mus musculus
gagaccagagagagcgcacatcccc

SEQ ID NO: 469819 - DNA, 25 bp, Mus musculus
gagaccagagagtgcgcacatcccc

SEQ ID NO: 469820 - DNA, 25 bp, Mus musculus
gagaccagagcaacttctgagccat

SEQ ID NO: 469821 - DNA, 25 bp, Mus musculus
gagaccagagcatcttctgagccat

SEQ ID NO: 469822 - DNA, 25 bp, Mus musculus
gagaccagagccctactatcaacaa

SEQ ID NO: 469823 - DNA, 25 bp, Mus musculus
gagaccagagccgtactatcaacaa

SEQ ID NO: 469824 - DNA, 25 bp, Mus musculus
gagaccagaggacgttctcctacag

SEQ ID NO: 469825 - DNA, 25 bp, Mus musculus
gagaccagaggaggttctcctacag

SEQ ID NO: 469826 - DNA, 25 bp, Mus musculus
gagaccagaggtcacagttgtcctt

SEQ ID NO: 469827 - DNA, 25 bp, Mus musculus
gagaccagaggtgacagttgtcctt

SEQ ID NO: 469828 - DNA, 25 bp, Mus musculus
gagaccagatggcttgccccaggat

SEQ ID NO: 469829 - DNA, 25 bp, Mus musculus
gagaccagatgggttgccccaggat

SEQ ID NO: 469830 - DNA, 25 bp, Mus musculus
gagaccagatttcttaatgtgtccc

SEQ ID NO: 469831 - DNA, 25 bp, Mus musculus
gagaccagatttgttaatgtgtccc

SEQ ID NO: 469832 - DNA, 25 bp, Mus musculus
gagaccagcaagcagctcagtttaa

SEQ ID NO: 469833 - DNA, 25 bp, Mus musculus
gagaccagcaaggagctcagtttaa

SEQ ID NO: 469834 - DNA, 25 bp, Mus musculus
gagaccagcactaggtcttgttttg

SEQ ID NO: 469835 - DNA, 25 bp, Mus musculus
gagaccagcacttggtcttgttttg

SEQ ID NO: 469836 - DNA, 25 bp, Mus musculus
gagaccagcatgcaccacatactga

SEQ ID NO: 469837 - DNA, 25 bp, Mus musculus
gagaccagcatggaccacatactga

SEQ ID NO: 469838 - DNA, 25 bp, Mus musculus
gagaccagcattcccattttagtgt

SEQ ID NO: 469839 - DNA, 25 bp, Mus musculus
gagaccagcattgccattttagtgt

SEQ ID NO: 469840 - DNA, 25 bp, Mus musculus
gagaccagccctatcagaggctttc

SEQ ID NO: 469841 - DNA, 25 bp, Mus musculus
gagaccagccctttcagaggctttc

SEQ ID NO: 469842 - DNA, 25 bp, Mus musculus
gagaccagccttatttatgggcact

SEQ ID NO: 469843 - DNA, 25 bp, Mus musculus
gagaccagccttttttatgggcact

SEQ ID NO: 469844 - DNA, 25 bp, Mus musculus
gagaccagctatataggtgcttctt

SEQ ID NO: 469845 - DNA, 25 bp, Mus musculus
gagaccagctatttaggtgcttctt

SEQ ID NO: 469846 - DNA, 25 bp, Mus musculus
gagaccagctctagaatgacatccg

SEQ ID NO: 469847 - DNA, 25 bp, Mus musculus
gagaccagctctcctttcaagatgg

SEQ ID NO: 469848 - DNA, 25 bp, Mus musculus
gagaccagctctgctttcaagatgg

SEQ ID NO: 469849 - DNA, 25 bp, Mus musculus
gagaccagctcttgaatgacatccg

SEQ ID NO: 469850 - DNA, 25 bp, Mus musculus
gagaccagctgcaacgcattacaca

SEQ ID NO: 469851 - DNA, 25 bp, Mus musculus
gagaccagctgctacgcattacaca

SEQ ID NO: 469852 - DNA, 25 bp, Mus musculus
gagaccagcttcacttgtgctctaa

SEQ ID NO: 469853 - DNA, 25 bp, Mus musculus
gagaccagcttctcttgtgctctaa

SEQ ID NO: 469854 - DNA, 25 bp, Mus musculus
gagaccaggcacctgtgccctgtgt

SEQ ID NO: 469855 - DNA, 25 bp, Mus musculus
gagaccaggcacgtgtgccctgtgt

SEQ ID NO: 469856 - DNA, 25 bp, Mus musculus
gagaccaggctgactttgcttcatt

SEQ ID NO: 469857 - DNA, 25 bp, Mus musculus
gagaccaggctgtctttgcttcatt

SEQ ID NO: 469858 - DNA, 25 bp, Mus musculus
gagaccaggttcctcagattgccat

SEQ ID NO: 469859 - DNA, 25 bp, Mus musculus
gagaccaggttcgtcagattgccat

SEQ ID NO: 469860 - DNA, 25 bp, Mus musculus
gagaccagtagcaatattctgcaaa

SEQ ID NO: 469861 - DNA, 25 bp, Mus musculus
gagaccagtagctatattctgcaaa

SEQ ID NO: 469862 - DNA, 25 bp, Mus musculus
gagaccagtcctcgcgggaatgact

SEQ ID NO: 469863 - DNA, 25 bp, Mus musculus
gagaccagtcctggcgggaatgact

SEQ ID NO: 469864 - DNA, 25 bp, Mus musculus
gagaccagtcgaagaattacctcgt

SEQ ID NO: 469865 - DNA, 25 bp, Mus musculus
gagaccagtcgatgaattacctcgt

SEQ ID NO: 469866 - DNA, 25 bp, Mus musculus
gagaccagtgctatgcacagcataa

SEQ ID NO: 469867 - DNA, 25 bp, Mus musculus
gagaccagtgctttgcacagcataa

SEQ ID NO: 469868 - DNA, 25 bp, Mus musculus
gagaccagttacaacatcatagcag

SEQ ID NO: 469869 - DNA, 25 bp, Mus musculus
gagaccagttactacatcatagcag

SEQ ID NO: 469870 - DNA, 25 bp, Mus musculus
gagaccagttctcgcaagacccggt

SEQ ID NO: 469871 - DNA, 25 bp, Mus musculus
gagaccagttctctcctagaggaat

SEQ ID NO: 469872 - DNA, 25 bp, Mus musculus
gagaccagttctggcaagacccggt

SEQ ID NO: 469873 - DNA, 25 bp, Mus musculus
gagaccagttctgtcctagaggaat

SEQ ID NO: 469874 - DNA, 25 bp, Mus musculus
gagaccagttgaccacagtctgtga

SEQ ID NO: 469875 - DNA, 25 bp, Mus musculus
gagaccagttgagcacagtctgtga

SEQ ID NO: 469876 - DNA, 25 bp, Mus musculus
gagaccagttggaattgttccacag

SEQ ID NO: 469877 - DNA, 25 bp, Mus musculus
gagaccagttggtattgttccacag

SEQ ID NO: 469878 - DNA, 25 bp, Mus musculus
gagaccagtttgatcctgcatcata

SEQ ID NO: 469879 - DNA, 25 bp, Mus musculus
gagaccagtttgttcctgcatcata

SEQ ID NO: 469880 - DNA, 25 bp, Mus musculus
gagaccatagatccagccttttcct

SEQ ID NO: 469881 - DNA, 25 bp, Mus musculus
gagaccatagatgcagccttttcct

SEQ ID NO: 469882 - DNA, 25 bp, Mus musculus
gagaccatagctatctgcatttcag

SEQ ID NO: 469883 - DNA, 25 bp, Mus musculus
gagaccatagctcatctattccagg

SEQ ID NO: 469884 - DNA, 25 bp, Mus musculus
gagaccatagctgatctattccagg

SEQ ID NO: 469885 - DNA, 25 bp, Mus musculus
gagaccatagctttctgcatttcag

SEQ ID NO: 469886 - DNA, 25 bp, Mus musculus
gagaccataggtcattaccctatag

SEQ ID NO: 469887 - DNA, 25 bp, Mus musculus
gagaccataggtgattaccctatag

SEQ ID NO: 469888 - DNA, 25 bp, Mus musculus
gagaccatatctcaaagtttcagga

SEQ ID NO: 469889 - DNA, 25 bp, Mus musculus
gagaccatatctgaaagtttcagga

SEQ ID NO: 469890 - DNA, 25 bp, Mus musculus
gagaccatattgaagaatgtgtgtt

SEQ ID NO: 469891 - DNA, 25 bp, Mus musculus
gagaccatattgacatcctagtgca

SEQ ID NO: 469892 - DNA, 25 bp, Mus musculus
gagaccatattgtagaatgtgtgtt

SEQ ID NO: 469893 - DNA, 25 bp, Mus musculus
gagaccatattgtcatcctagtgca

SEQ ID NO: 469894 - DNA, 25 bp, Mus musculus
gagaccatcactctttttatccttg

SEQ ID NO: 469895 - DNA, 25 bp, Mus musculus
gagaccatcactgtttttatccttg

SEQ ID NO: 469896 - DNA, 25 bp, Mus musculus
gagaccatctgccagcaatcataca

SEQ ID NO: 469897 - DNA, 25 bp, Mus musculus
gagaccatctgcgagcaatcataca

SEQ ID NO: 469898 - DNA, 25 bp, Mus musculus
gagaccatctggcagttgtaggcct

SEQ ID NO: 469899 - DNA, 25 bp, Mus musculus
gagaccatctgggagttgtaggcct

SEQ ID NO: 469900 - DNA, 25 bp, Mus musculus
gagaccatcttgcttactacaattg

SEQ ID NO: 469901 - DNA, 25 bp, Mus musculus
gagaccatcttggttactacaattg

SEQ ID NO: 469902 - DNA, 25 bp, Mus musculus
gagaccatctttcaggaaccacggg

SEQ ID NO: 469903 - DNA, 25 bp, Mus musculus
gagaccatctttgaggaaccacggg

SEQ ID NO: 469904 - DNA, 25 bp, Mus musculus
gagaccatgacacactgtgctccta

SEQ ID NO: 469905 - DNA, 25 bp, Mus musculus
gagaccatgacagactgtgctccta

SEQ ID NO: 469906 - DNA, 25 bp, Mus musculus
gagaccatgcaaaactcgtggagat

SEQ ID NO: 469907 - DNA, 25 bp, Mus musculus
gagaccatgcaatactcgtggagat

SEQ ID NO: 469908 - DNA, 25 bp, Mus musculus
gagaccatggtactcacctgcattt

SEQ ID NO: 469909 - DNA, 25 bp, Mus musculus
gagaccatggtagtcacctgcattt

SEQ ID NO: 469910 - DNA, 25 bp, Mus musculus
gagaccatgtaaccctggatcctaa

SEQ ID NO: 469911 - DNA, 25 bp, Mus musculus
gagaccatgtaagcctggatcctaa

SEQ ID NO: 469912 - DNA, 25 bp, Mus musculus
gagaccatgtgtcccttgtgcaaga

SEQ ID NO: 469913 - DNA, 25 bp, Mus musculus
gagaccatgtgtgccttgtgcaaga

SEQ ID NO: 469914 - DNA, 25 bp, Mus musculus
gagaccatgttgattgagttaagct

SEQ ID NO: 469915 - DNA, 25 bp, Mus musculus
gagaccatgttgtttgagttaagct

SEQ ID NO: 469916 - DNA, 25 bp, Mus musculus
gagaccattacaaatccggaaaagg

SEQ ID NO: 469917 - DNA, 25 bp, Mus musculus
gagaccattacatatccggaaaagg

SEQ ID NO: 469918 - DNA, 25 bp, Mus musculus
gagaccattagcaacatcctttaac

SEQ ID NO: 469919 - DNA, 25 bp, Mus musculus
gagaccattagctacatcctttaac

SEQ ID NO: 469920 - DNA, 25 bp, Mus musculus
gagaccattctcaacgcattcaagg

SEQ ID NO: 469921 - DNA, 25 bp, Mus musculus
gagaccattctctacgcattcaagg

SEQ ID NO: 469922 - DNA, 25 bp, Mus musculus
gagaccattgaacaggaaaagagga

SEQ ID NO: 469923 - DNA, 25 bp, Mus musculus
gagaccattgaagaggaaaagagga

SEQ ID NO: 469924 - DNA, 25 bp, Mus musculus
gagaccattgccaacaactagatcc

SEQ ID NO: 469925 - DNA, 25 bp, Mus musculus
gagaccattgcctacaactagatcc

SEQ ID NO: 469926 - DNA, 25 bp, Mus musculus
gagaccattggtattgaggatattc

SEQ ID NO: 469927 - DNA, 25 bp, Mus musculus
gagaccattggttttgaggatattc

SEQ ID NO: 469928 - DNA, 25 bp, Mus musculus
gagaccatttatacattcagctgat

SEQ ID NO: 469929 - DNA, 25 bp, Mus musculus
gagaccatttattcattcagctgat

SEQ ID NO: 469930 - DNA, 25 bp, Mus musculus
gagaccatttccacttttgtaaaat

SEQ ID NO: 469931 - DNA, 25 bp, Mus musculus
gagaccatttcctcttttgtaaaat

SEQ ID NO: 469932 - DNA, 25 bp, Mus musculus
gagaccattttactcttcagtttgt

SEQ ID NO: 469933 - DNA, 25 bp, Mus musculus
gagaccattttagtcttcagtttgt

SEQ ID NO: 469934 - DNA, 25 bp, Mus musculus
gagaccattttcacatggtgatgct

SEQ ID NO: 469935 - DNA, 25 bp, Mus musculus
gagaccattttctcatggtgatgct

SEQ ID NO: 469936 - DNA, 25 bp, Mus musculus
gagacccaaaggaaagctttcttgt

SEQ ID NO: 469937 - DNA, 25 bp, Mus musculus
gagacccaaaggcaagttgacctca

SEQ ID NO: 469938 - DNA, 25 bp, Mus musculus
gagacccaaagggaagttgacctca

SEQ ID NO: 469939 - DNA, 25 bp, Mus musculus
gagacccaaaggtaagctttcttgt

SEQ ID NO: 469940 - DNA, 25 bp, Mus musculus
gagacccaacgaaaaaccccacgag

SEQ ID NO: 469941 - DNA, 25 bp, Mus musculus
gagacccaacgataaaccccacgag

SEQ ID NO: 469942 - DNA, 25 bp, Mus musculus
gagacccaacgtagataccaggagt

SEQ ID NO: 469943 - DNA, 25 bp, Mus musculus
gagacccaacgttgataccaggagt

SEQ ID NO: 469944 - DNA, 25 bp, Mus musculus
gagacccaagagatctggcagctgt

SEQ ID NO: 469945 - DNA, 25 bp, Mus musculus
gagacccaagagttctggcagctgt

SEQ ID NO: 469946 - DNA, 25 bp, Mus musculus
gagacccaaggtcctcaatgtcggg

SEQ ID NO: 469947 - DNA, 25 bp, Mus musculus
gagacccaaggtgctcaatgtcggg

SEQ ID NO: 469948 - DNA, 25 bp, Mus musculus
gagacccaagtacaaggtcccacat

SEQ ID NO: 469949 - DNA, 25 bp, Mus musculus
gagacccaagtagaaggtcccacat

SEQ ID NO: 469950 - DNA, 25 bp, Mus musculus
gagacccaagtgcaccccagacatg

SEQ ID NO: 469951 - DNA, 25 bp, Mus musculus
gagacccaagtggaccccagacatg

SEQ ID NO: 469952 - DNA, 25 bp, Mus musculus
gagacccaagttagatcatcagtat

SEQ ID NO: 469953 - DNA, 25 bp, Mus musculus
gagacccaagttctagggttcgtgt

SEQ ID NO: 469954 - DNA, 25 bp, Mus musculus
gagacccaagttgtagggttcgtgt

SEQ ID NO: 469955 - DNA, 25 bp, Mus musculus
gagacccaagtttgatcatcagtat

SEQ ID NO: 469956 - DNA, 25 bp, Mus musculus
gagacccaatagattaatgttgacg

SEQ ID NO: 469957 - DNA, 25 bp, Mus musculus
gagacccaatagtttaatgttgacg

SEQ ID NO: 469958 - DNA, 25 bp, Mus musculus
gagacccaatcgagttttcagcctg

SEQ ID NO: 469959 - DNA, 25 bp, Mus musculus
gagacccaatcgtgttttcagcctg

SEQ ID NO: 469960 - DNA, 25 bp, Mus musculus
gagacccaattgaacaaatcgccta

SEQ ID NO: 469961 - DNA, 25 bp, Mus musculus
gagacccaattgtacaaatcgccta

SEQ ID NO: 469962 - DNA, 25 bp, Mus musculus
gagacccacaagagttgcatggcta

SEQ ID NO: 469963 - DNA, 25 bp, Mus musculus
gagacccacaagtgttgcatggcta

SEQ ID NO: 469964 - DNA, 25 bp, Mus musculus
gagacccacaatctggtctgccatt

SEQ ID NO: 469965 - DNA, 25 bp, Mus musculus
gagacccacaatgtggtctgccatt

SEQ ID NO: 469966 - DNA, 25 bp, Mus musculus
gagacccaccttacttaagagctag

SEQ ID NO: 469967 - DNA, 25 bp, Mus musculus
gagacccacctttcttaagagctag

SEQ ID NO: 469968 - DNA, 25 bp, Mus musculus
gagacccacgagaagaagtccatgg

SEQ ID NO: 469969 - DNA, 25 bp, Mus musculus
gagacccacgagtagaagtccatgg

SEQ ID NO: 469970 - DNA, 25 bp, Mus musculus
gagacccacttcacttaaactggta

SEQ ID NO: 469971 - DNA, 25 bp, Mus musculus
gagacccacttctcttaaactggta

SEQ ID NO: 469972 - DNA, 25 bp, Mus musculus
gagacccagaaaagcttggccctga

SEQ ID NO: 469973 - DNA, 25 bp, Mus musculus
gagacccagaaatgcttggccctga

SEQ ID NO: 469974 - DNA, 25 bp, Mus musculus
gagacccagaatccacggtcctgga

SEQ ID NO: 469975 - DNA, 25 bp, Mus musculus
gagacccagaatgcacggtcctgga

SEQ ID NO: 469976 - DNA, 25 bp, Mus musculus
gagacccagcacctgtatatttaaa

SEQ ID NO: 469977 - DNA, 25 bp, Mus musculus
gagacccagcacgtgtatatttaaa

SEQ ID NO: 469978 - DNA, 25 bp, Mus musculus
gagacccagctcagataagttgtcc

SEQ ID NO: 469979 - DNA, 25 bp, Mus musculus
gagacccagctctgataagttgtcc

SEQ ID NO: 469980 - DNA, 25 bp, Mus musculus
gagacccagggacgctgaactcaga

SEQ ID NO: 469981 - DNA, 25 bp, Mus musculus
gagacccagggaggctgaactcaga

SEQ ID NO: 469982 - DNA, 25 bp, Mus musculus
gagacccagggcacgaactctctac

SEQ ID NO: 469983 - DNA, 25 bp, Mus musculus
gagacccagggctcgaactctctac

SEQ ID NO: 469984 - DNA, 25 bp, Mus musculus
gagacccaggtgagatggaccatcc

SEQ ID NO: 469985 - DNA, 25 bp, Mus musculus
gagacccaggtgtgatggaccatcc

SEQ ID NO: 469986 - DNA, 25 bp, Mus musculus
gagacccagtctcacacatacaaat

SEQ ID NO: 469987 - DNA, 25 bp, Mus musculus
gagacccagtctgacacatacaaat

SEQ ID NO: 469988 - DNA, 25 bp, Mus musculus
gagacccagtgcactgactttgatg

SEQ ID NO: 469989 - DNA, 25 bp, Mus musculus
gagacccagtgctctgactttgatg

SEQ ID NO: 469990 - DNA, 25 bp, Mus musculus
gagacccagtttacaagttctattt

SEQ ID NO: 469991 - DNA, 25 bp, Mus musculus
gagacccagttttcaagttctattt

SEQ ID NO: 469992 - DNA, 25 bp, Mus musculus
gagacccataagaggcgtggccacc

SEQ ID NO: 469993 - DNA, 25 bp, Mus musculus
gagacccataagtggcgtggccacc

SEQ ID NO: 469994 - DNA, 25 bp, Mus musculus
gagacccatattattaggtccaata

SEQ ID NO: 469995 - DNA, 25 bp, Mus musculus
gagacccatatttttaggtccaata

SEQ ID NO: 469996 - DNA, 25 bp, Mus musculus
gagacccatctccaggaatcggtag

SEQ ID NO: 469997 - DNA, 25 bp, Mus musculus
gagacccatctcgaggaatcggtag

SEQ ID NO: 469998 - DNA, 25 bp, Mus musculus
gagacccatgtccatgctgtattac

SEQ ID NO: 469999 - DNA, 25 bp, Mus musculus
gagacccatgtcgatgctgtattac

SEQ ID NO: 470000 - DNA, 25 bp, Mus musculus
gagacccatgtgatatcagtggttg

SEQ ID NO: 470001 - DNA, 25 bp, Mus musculus
gagacccatgtgttatcagtggttg

SEQ ID NO: 470002 - DNA, 25 bp, Mus musculus
gagacccatgttccacttacatgaa

SEQ ID NO: 470003 - DNA, 25 bp, Mus musculus
gagacccatgttgcacttacatgaa

SEQ ID NO: 470004 - DNA, 25 bp, Mus musculus
gagacccattccacagtttaaagag

SEQ ID NO: 470005 - DNA, 25 bp, Mus musculus
gagacccattcctcagtttaaagag

SEQ ID NO: 470006 - DNA, 25 bp, Mus musculus
gagaccccaaagcagagacccgaaa

SEQ ID NO: 470007 - DNA, 25 bp, Mus musculus
gagaccccaaaggagagacccgaaa

SEQ ID NO: 470008 - DNA, 25 bp, Mus musculus
gagaccccaaatcacctctaggaaa

SEQ ID NO: 470009 - DNA, 25 bp, Mus musculus
gagaccccaaatgacctctaggaaa

SEQ ID NO: 470010 - DNA, 25 bp, Mus musculus
gagaccccaatgcaactttctagct

SEQ ID NO: 470011 - DNA, 25 bp, Mus musculus
gagaccccaatggaactttctagct

SEQ ID NO: 470012 - DNA, 25 bp, Mus musculus
gagaccccactcaagagcgatcagt

SEQ ID NO: 470013 - DNA, 25 bp, Mus musculus
gagaccccactctagagcgatcagt

SEQ ID NO: 470014 - DNA, 25 bp, Mus musculus
gagaccccagaacaggttaagcaag

SEQ ID NO: 470015 - DNA, 25 bp, Mus musculus
gagaccccagaagaggttaagcaag

SEQ ID NO: 470016 - DNA, 25 bp, Mus musculus
gagaccccagctcagggtgctgtaa

SEQ ID NO: 470017 - DNA, 25 bp, Mus musculus
gagaccccagctgagggtgctgtaa

SEQ ID NO: 470018 - DNA, 25 bp, Mus musculus
gagaccccaggcacaacagggatca

SEQ ID NO: 470019 - DNA, 25 bp, Mus musculus
gagaccccaggctcaacagggatca

SEQ ID NO: 470020 - DNA, 25 bp, Mus musculus
gagaccccatctaaaaacacaacat

SEQ ID NO: 470021 - DNA, 25 bp, Mus musculus
gagaccccatcttaaaacacaacat

SEQ ID NO: 470022 - DNA, 25 bp, Mus musculus
gagacccctgaactcattgagctga

SEQ ID NO: 470023 - DNA, 25 bp, Mus musculus
gagacccctgaagtcattgagctga

SEQ ID NO: 470024 - DNA, 25 bp, Mus musculus
gagacccctgggaacccatcatgct

SEQ ID NO: 470025 - DNA, 25 bp, Mus musculus
gagacccctgggagggcccttgcct

SEQ ID NO: 470026 - DNA, 25 bp, Mus musculus
gagacccctgggtacccatcatgct

SEQ ID NO: 470027 - DNA, 25 bp, Mus musculus
gagacccctgggtgggcccttgcct

SEQ ID NO: 470028 - DNA, 25 bp, Mus musculus
gagacccctgtgagaaggcctggct

SEQ ID NO: 470029 - DNA, 25 bp, Mus musculus
gagacccctgtgtgaaggcctggct

SEQ ID NO: 470030 - DNA, 25 bp, Mus musculus
gagacccgagaactgaccaagacaa

SEQ ID NO: 470031 - DNA, 25 bp, Mus musculus
gagacccgagaagtgaccaagacaa

SEQ ID NO: 470032 - DNA, 25 bp, Mus musculus
gagacccgcctgagctgtgtgagac

SEQ ID NO: 470033 - DNA, 25 bp, Mus musculus
gagacccgcctgtgctgtgtgagac

SEQ ID NO: 470034 - DNA, 25 bp, Mus musculus
gagacccgcgacagcgagtttggcc

SEQ ID NO: 470035 - DNA, 25 bp, Mus musculus
gagacccgcgactgcgagtttggcc

SEQ ID NO: 470036 - DNA, 25 bp, Mus musculus
gagacccgcggcagacccctaagaa

SEQ ID NO: 470037 - DNA, 25 bp, Mus musculus
gagacccgcggctgacccctaagaa

SEQ ID NO: 470038 - DNA, 25 bp, Mus musculus
gagacccgctgtatacactaacgtt

SEQ ID NO: 470039 - DNA, 25 bp, Mus musculus
gagacccgctgtttacactaacgtt

SEQ ID NO: 470040 - DNA, 25 bp, Mus musculus
gagacccggaagatctttagctgga

SEQ ID NO: 470041 - DNA, 25 bp, Mus musculus
gagacccggaagttctttagctgga

SEQ ID NO: 470042 - DNA, 25 bp, Mus musculus
gagacccgtaatagttacagctgag

SEQ ID NO: 470043 - DNA, 25 bp, Mus musculus
gagacccgtaattgttacagctgag

SEQ ID NO: 470044 - DNA, 25 bp, Mus musculus
gagacccgtccgaggatcagcccta

SEQ ID NO: 470045 - DNA, 25 bp, Mus musculus
gagacccgtccgtggatcagcccta

SEQ ID NO: 470046 - DNA, 25 bp, Mus musculus
gagacccgtcggaaagacctgggca

SEQ ID NO: 470047 - DNA, 25 bp, Mus musculus
gagacccgtcggtaagacctgggca

SEQ ID NO: 470048 - DNA, 25 bp, Mus musculus
gagacccgtctaatgttctgtttgt

SEQ ID NO: 470049 - DNA, 25 bp, Mus musculus
gagacccgtctattgttctgtttgt

SEQ ID NO: 470050 - DNA, 25 bp, Mus musculus
gagacccgtggaagcaaaccattcc

SEQ ID NO: 470051 - DNA, 25 bp, Mus musculus
gagacccgtggatgcaaaccattcc

SEQ ID NO: 470052 - DNA, 25 bp, Mus musculus
gagaccctaaagagctgccagtttt

SEQ ID NO: 470053 - DNA, 25 bp, Mus musculus
gagaccctaaagtgctgccagtttt

SEQ ID NO: 470054 - DNA, 25 bp, Mus musculus
gagaccctaaccattgctacttcat

SEQ ID NO: 470055 - DNA, 25 bp, Mus musculus
gagaccctaacctttgctacttcat

SEQ ID NO: 470056 - DNA, 25 bp, Mus musculus
gagaccctaactattcaccaattat

SEQ ID NO: 470057 - DNA, 25 bp, Mus musculus
gagaccctaactcacactcaaatag

SEQ ID NO: 470058 - DNA, 25 bp, Mus musculus
gagaccctaactgacactcaaatag

SEQ ID NO: 470059 - DNA, 25 bp, Mus musculus
gagaccctaacttttcaccaattat

SEQ ID NO: 470060 - DNA, 25 bp, Mus musculus
gagaccctagatatgagccttaaca

SEQ ID NO: 470061 - DNA, 25 bp, Mus musculus
gagaccctagatttgagccttaaca

SEQ ID NO: 470062 - DNA, 25 bp, Mus musculus
gagaccctaggtcttaaagtgaagt

SEQ ID NO: 470063 - DNA, 25 bp, Mus musculus
gagaccctaggtgttaaagtgaagt

SEQ ID NO: 470064 - DNA, 25 bp, Mus musculus
gagaccctatctcgaatgaatgaat

SEQ ID NO: 470065 - DNA, 25 bp, Mus musculus
gagaccctatctggaatgaatgaat

SEQ ID NO: 470066 - DNA, 25 bp, Mus musculus
gagaccctcagacactgcaaaggac

SEQ ID NO: 470067 - DNA, 25 bp, Mus musculus
gagaccctcagagactgcaaaggac

SEQ ID NO: 470068 - DNA, 25 bp, Mus musculus
gagaccctcagcacttaccattgta

SEQ ID NO: 470069 - DNA, 25 bp, Mus musculus
gagaccctcagcagtcttagtcggg

SEQ ID NO: 470070 - DNA, 25 bp, Mus musculus
gagaccctcagctcttaccattgta

SEQ ID NO: 470071 - DNA, 25 bp, Mus musculus
gagaccctcagctgtcttagtcggg

SEQ ID NO: 470072 - DNA, 25 bp, Mus musculus
gagaccctcagtcaggccactgtcg

SEQ ID NO: 470073 - DNA, 25 bp, Mus musculus
gagaccctcagtgaggccactgtcg

SEQ ID NO: 470074 - DNA, 25 bp, Mus musculus
gagaccctcccgagtagatatgctt

SEQ ID NO: 470075 - DNA, 25 bp, Mus musculus
gagaccctcccgtgtagatatgctt

SEQ ID NO: 470076 - DNA, 25 bp, Mus musculus
gagaccctcctaagatcagtgaata

SEQ ID NO: 470077 - DNA, 25 bp, Mus musculus
gagaccctcctatgatcagtgaata

SEQ ID NO: 470078 - DNA, 25 bp, Mus musculus
gagaccctcctcattaataaagtag

SEQ ID NO: 470079 - DNA, 25 bp, Mus musculus
gagaccctcctctttaataaagtag

SEQ ID NO: 470080 - DNA, 25 bp, Mus musculus
gagaccctctcacaaagttaatttt

SEQ ID NO: 470081 - DNA, 25 bp, Mus musculus
gagaccctctcagaaagttaatttt

SEQ ID NO: 470082 - DNA, 25 bp, Mus musculus
gagaccctgactacggagaatcctt

SEQ ID NO: 470083 - DNA, 25 bp, Mus musculus
gagaccctgacttcggagaatcctt

SEQ ID NO: 470084 - DNA, 25 bp, Mus musculus
gagaccctgaggacaccagcaactg

SEQ ID NO: 470085 - DNA, 25 bp, Mus musculus
gagaccctgaggtcaccagcaactg

SEQ ID NO: 470086 - DNA, 25 bp, Mus musculus
gagaccctgatccacaaaaccaata

SEQ ID NO: 470087 - DNA, 25 bp, Mus musculus
gagaccctgatcgacaaaaccaata

SEQ ID NO: 470088 - DNA, 25 bp, Mus musculus
gagaccctgcaaccacagttcagag

SEQ ID NO: 470089 - DNA, 25 bp, Mus musculus
gagaccctgcaagcacagttcagag

SEQ ID NO: 470090 - DNA, 25 bp, Mus musculus
gagaccctgcccatgatttcagagt

SEQ ID NO: 470091 - DNA, 25 bp, Mus musculus
gagaccctgcccattgaactggcgt

SEQ ID NO: 470092 - DNA, 25 bp, Mus musculus
gagaccctgcccttgatttcagagt

SEQ ID NO: 470093 - DNA, 25 bp, Mus musculus
gagaccctgccctttgaactggcgt

SEQ ID NO: 470094 - DNA, 25 bp, Mus musculus
gagaccctgctgatgtggaaggcaa

SEQ ID NO: 470095 - DNA, 25 bp, Mus musculus
gagaccctgctgttgtggaaggcaa

SEQ ID NO: 470096 - DNA, 25 bp, Mus musculus
gagaccctggacatccttcaggagg

SEQ ID NO: 470097 - DNA, 25 bp, Mus musculus
gagaccctggacttccttcaggagg

SEQ ID NO: 470098 - DNA, 25 bp, Mus musculus
gagaccctggatcatctcatcaaag

SEQ ID NO: 470099 - DNA, 25 bp, Mus musculus
gagaccctggatgatctcatcaaag

SEQ ID NO: 470100 - DNA, 25 bp, Mus musculus
gagaccctggcacaaacgccgtgtc

SEQ ID NO: 470101 - DNA, 25 bp, Mus musculus
gagaccctggcagaaacgccgtgtc

SEQ ID NO: 470102 - DNA, 25 bp, Mus musculus
gagaccctgggaatcctcaatatgg

SEQ ID NO: 470103 - DNA, 25 bp, Mus musculus
gagaccctgggattcctcaatatgg

SEQ ID NO: 470104 - DNA, 25 bp, Mus musculus
gagaccctgggcatcggtgtagcca

SEQ ID NO: 470105 - DNA, 25 bp, Mus musculus
gagaccctgggcttcggtgtagcca

SEQ ID NO: 470106 - DNA, 25 bp, Mus musculus
gagaccctggtgagagtgaagacat

SEQ ID NO: 470107 - DNA, 25 bp, Mus musculus
gagaccctggtgtgagtgaagacat

SEQ ID NO: 470108 - DNA, 25 bp, Mus musculus
gagaccctgtacaggtgctgtctga

SEQ ID NO: 470109 - DNA, 25 bp, Mus musculus
gagaccctgtactggtgctgtctga

SEQ ID NO: 470110 - DNA, 25 bp, Mus musculus
gagaccctgtctcagtgagtaaggt

SEQ ID NO: 470111 - DNA, 25 bp, Mus musculus
gagaccctgtctgagtgagtaaggt

SEQ ID NO: 470112 - DNA, 25 bp, Mus musculus
gagaccctgtttcagaggagtttca

SEQ ID NO: 470113 - DNA, 25 bp, Mus musculus
gagaccctgtttgagaggagtttca

SEQ ID NO: 470114 - DNA, 25 bp, Mus musculus
gagacccttaccaaaagacattcag

SEQ ID NO: 470115 - DNA, 25 bp, Mus musculus
gagacccttacctaaagacattcag

SEQ ID NO: 470116 - DNA, 25 bp, Mus musculus
gagacccttccaaatgagcatcgac

SEQ ID NO: 470117 - DNA, 25 bp, Mus musculus
gagacccttccatatgagcatcgac

SEQ ID NO: 470118 - DNA, 25 bp, Mus musculus
gagacccttgagacattccagagac

SEQ ID NO: 470119 - DNA, 25 bp, Mus musculus
gagacccttgagagtatttcatgaa

SEQ ID NO: 470120 - DNA, 25 bp, Mus musculus
gagacccttgagtcattccagagac

SEQ ID NO: 470121 - DNA, 25 bp, Mus musculus
gagacccttgagtgtatttcatgaa

SEQ ID NO: 470122 - DNA, 25 bp, Mus musculus
gagacccttgcgagaggaagttcct

SEQ ID NO: 470123 - DNA, 25 bp, Mus musculus
gagacccttgcgtgaggaagttcct

SEQ ID NO: 470124 - DNA, 25 bp, Mus musculus
gagaccctttcacgctgcattttat

SEQ ID NO: 470125 - DNA, 25 bp, Mus musculus
gagaccctttcaggctgcattttat

SEQ ID NO: 470126 - DNA, 25 bp, Mus musculus
gagaccctttccctgagatccagaa

SEQ ID NO: 470127 - DNA, 25 bp, Mus musculus
gagaccctttccgtgagatccagaa

SEQ ID NO: 470128 - DNA, 25 bp, Mus musculus
gagaccctttctaggaatgatagca

SEQ ID NO: 470129 - DNA, 25 bp, Mus musculus
gagaccctttcttggaatgatagca

SEQ ID NO: 470130 - DNA, 25 bp, Mus musculus
gagaccctttgcagtagcccagaaa

SEQ ID NO: 470131 - DNA, 25 bp, Mus musculus
gagaccctttgctgtagcccagaaa

SEQ ID NO: 470132 - DNA, 25 bp, Mus musculus
gagaccctttgtccttaactgttat

SEQ ID NO: 470133 - DNA, 25 bp, Mus musculus
gagaccctttgtgcttaactgttat

SEQ ID NO: 470134 - DNA, 25 bp, Mus musculus
gagaccgaagacactttcatcgctg

SEQ ID NO: 470135 - DNA, 25 bp, Mus musculus
gagaccgaagactctttcatcgctg

SEQ ID NO: 470136 - DNA, 25 bp, Mus musculus
gagaccgaatctctcgtatcactga

SEQ ID NO: 470137 - DNA, 25 bp, Mus musculus
gagaccgaatctgtcgtatcactga

SEQ ID NO: 470138 - DNA, 25 bp, Mus musculus
gagaccgaattcaggtgcacaccct

SEQ ID NO: 470139 - DNA, 25 bp, Mus musculus
gagaccgaattctggtgcacaccct

SEQ ID NO: 470140 - DNA, 25 bp, Mus musculus
gagaccgaccatacatagcatctaa

SEQ ID NO: 470141 - DNA, 25 bp, Mus musculus
gagaccgaccattcatagcatctaa

SEQ ID NO: 470142 - DNA, 25 bp, Mus musculus
gagaccgagactattgacatggaga

SEQ ID NO: 470143 - DNA, 25 bp, Mus musculus
gagaccgagacttttgacatggaga

SEQ ID NO: 470144 - DNA, 25 bp, Mus musculus
gagaccgaggacactaagggccacg

SEQ ID NO: 470145 - DNA, 25 bp, Mus musculus
gagaccgaggactctaagggccacg

SEQ ID NO: 470146 - DNA, 25 bp, Mus musculus
gagaccgagggcagccatagcaact

SEQ ID NO: 470147 - DNA, 25 bp, Mus musculus
gagaccgagggcctctgcaaccaga

SEQ ID NO: 470148 - DNA, 25 bp, Mus musculus
gagaccgagggcgtctgcaaccaga

SEQ ID NO: 470149 - DNA, 25 bp, Mus musculus
gagaccgagggctgccatagcaact

SEQ ID NO: 470150 - DNA, 25 bp, Mus musculus
gagaccgaggtactttatcttggac

SEQ ID NO: 470151 - DNA, 25 bp, Mus musculus
gagaccgaggtagtttatcttggac

SEQ ID NO: 470152 - DNA, 25 bp, Mus musculus
gagaccgaggtcaacatctatgagc

SEQ ID NO: 470153 - DNA, 25 bp, Mus musculus
gagaccgaggtctacatctatgagc

SEQ ID NO: 470154 - DNA, 25 bp, Mus musculus
gagaccgagttgcaagctgctaata

SEQ ID NO: 470155 - DNA, 25 bp, Mus musculus
gagaccgagttggaagctgctaata

SEQ ID NO: 470156 - DNA, 25 bp, Mus musculus
gagaccgatttaagttagaacttaa

SEQ ID NO: 470157 - DNA, 25 bp, Mus musculus
gagaccgatttatgttagaacttaa

SEQ ID NO: 470158 - DNA, 25 bp, Mus musculus
gagaccgcacaccatttattaggca

SEQ ID NO: 470159 - DNA, 25 bp, Mus musculus
gagaccgcacacgatttattaggca

SEQ ID NO: 470160 - DNA, 25 bp, Mus musculus
gagaccgccctgcatggtgacagtt

SEQ ID NO: 470161 - DNA, 25 bp, Mus musculus
gagaccgccctggatggtgacagtt

SEQ ID NO: 470162 - DNA, 25 bp, Mus musculus
gagaccgcgaggagatgctcatcat

SEQ ID NO: 470163 - DNA, 25 bp, Mus musculus
gagaccgcgaggtgatgctcatcat

SEQ ID NO: 470164 - DNA, 25 bp, Mus musculus
gagaccgctccactgaatggtccaa

SEQ ID NO: 470165 - DNA, 25 bp, Mus musculus
gagaccgctccagtgaatggtccaa

SEQ ID NO: 470166 - DNA, 25 bp, Mus musculus
gagaccgctgtgaccttacgtaaaa

SEQ ID NO: 470167 - DNA, 25 bp, Mus musculus
gagaccgctgtgtccttacgtaaaa

SEQ ID NO: 470168 - DNA, 25 bp, Mus musculus
gagaccgcttcacaaaaggatttgt

SEQ ID NO: 470169 - DNA, 25 bp, Mus musculus
gagaccgcttcagaaaaggatttgt

SEQ ID NO: 470170 - DNA, 25 bp, Mus musculus
gagaccgggatccagacagagacaa

SEQ ID NO: 470171 - DNA, 25 bp, Mus musculus
gagaccgggatcgagacagagacaa

SEQ ID NO: 470172 - DNA, 25 bp, Mus musculus
gagaccgtataaatgtgctgagggc

SEQ ID NO: 470173 - DNA, 25 bp, Mus musculus
gagaccgtataattgtgctgagggc

SEQ ID NO: 470174 - DNA, 25 bp, Mus musculus
gagaccgtcgggaatacacggctta

SEQ ID NO: 470175 - DNA, 25 bp, Mus musculus
gagaccgtcgggtatacacggctta

SEQ ID NO: 470176 - DNA, 25 bp, Mus musculus
gagaccgtctgtccgtggattgatt

SEQ ID NO: 470177 - DNA, 25 bp, Mus musculus
gagaccgtctgtgcgtggattgatt

SEQ ID NO: 470178 - DNA, 25 bp, Mus musculus
gagaccgtgagtatacaatgcttgt

SEQ ID NO: 470179 - DNA, 25 bp, Mus musculus
gagaccgtgagtttacaatgcttgt

SEQ ID NO: 470180 - DNA, 25 bp, Mus musculus
gagaccgtggagctcaagggcagtt

SEQ ID NO: 470181 - DNA, 25 bp, Mus musculus
gagaccgtggaggtcaagggcagtt

SEQ ID NO: 470182 - DNA, 25 bp, Mus musculus
gagaccgtgtatcaactcaccaaaa

SEQ ID NO: 470183 - DNA, 25 bp, Mus musculus
gagaccgtgtatgaactcaccaaaa

SEQ ID NO: 470184 - DNA, 25 bp, Mus musculus
gagaccgttctaaagtccactggaa

SEQ ID NO: 470185 - DNA, 25 bp, Mus musculus
gagaccgttctatagtccactggaa

SEQ ID NO: 470186 - DNA, 25 bp, Mus musculus
gagaccgttttgactaaggcaaaat

SEQ ID NO: 470187 - DNA, 25 bp, Mus musculus
gagaccgttttgtctaaggcaaaat

SEQ ID NO: 470188 - DNA, 25 bp, Mus musculus
gagacctaaaatccttacctgctgt

SEQ ID NO: 470189 - DNA, 25 bp, Mus musculus
gagacctaaaatgcttacctgctgt

SEQ ID NO: 470190 - DNA, 25 bp, Mus musculus
gagacctaaaccagcagactgtgta

SEQ ID NO: 470191 - DNA, 25 bp, Mus musculus
gagacctaaacctgcagactgtgta

SEQ ID NO: 470192 - DNA, 25 bp, Mus musculus
gagacctaaatccaagcctacacca

SEQ ID NO: 470193 - DNA, 25 bp, Mus musculus
gagacctaaatcgaagcctacacca

SEQ ID NO: 470194 - DNA, 25 bp, Mus musculus
gagacctaaggaagccaacaggcct

SEQ ID NO: 470195 - DNA, 25 bp, Mus musculus
gagacctaaggatgccaacaggcct

SEQ ID NO: 470196 - DNA, 25 bp, Mus musculus
gagacctaaggcaggtgctgtttgc

SEQ ID NO: 470197 - DNA, 25 bp, Mus musculus
gagacctaaggcattgactacttta

SEQ ID NO: 470198 - DNA, 25 bp, Mus musculus
gagacctaaggctggtgctgtttgc

SEQ ID NO: 470199 - DNA, 25 bp, Mus musculus
gagacctaaggctttgactacttta

SEQ ID NO: 470200 - DNA, 25 bp, Mus musculus
gagacctaaggtcactgcctgtgac

SEQ ID NO: 470201 - DNA, 25 bp, Mus musculus
gagacctaaggtgactgcctgtgac

SEQ ID NO: 470202 - DNA, 25 bp, Mus musculus
gagacctaagtaaagagtcctctgt

SEQ ID NO: 470203 - DNA, 25 bp, Mus musculus
gagacctaagtatagagtcctctgt

SEQ ID NO: 470204 - DNA, 25 bp, Mus musculus
gagacctacactaacaggcttctat

SEQ ID NO: 470205 - DNA, 25 bp, Mus musculus
gagacctacacttacaggcttctat

SEQ ID NO: 470206 - DNA, 25 bp, Mus musculus
gagacctacgtacagcttctggtgg

SEQ ID NO: 470207 - DNA, 25 bp, Mus musculus
gagacctacgtacccaccgagtttg

SEQ ID NO: 470208 - DNA, 25 bp, Mus musculus
gagacctacgtagagcttctggtgg

SEQ ID NO: 470209 - DNA, 25 bp, Mus musculus
gagacctacgtagccaccgagtttg

SEQ ID NO: 470210 - DNA, 25 bp, Mus musculus
gagacctactatagacctcagccac

SEQ ID NO: 470211 - DNA, 25 bp, Mus musculus
gagacctactattgacctcagccac

SEQ ID NO: 470212 - DNA, 25 bp, Mus musculus
gagacctacttaaatttctcttgta

SEQ ID NO: 470213 - DNA, 25 bp, Mus musculus
gagacctacttatatttctcttgta

SEQ ID NO: 470214 - DNA, 25 bp, Mus musculus
gagacctactttaaattctcttgta

SEQ ID NO: 470215 - DNA, 25 bp, Mus musculus
gagacctactttcaagtcgccaaaa

SEQ ID NO: 470216 - DNA, 25 bp, Mus musculus
gagacctactttgaagtcgccaaaa

SEQ ID NO: 470217 - DNA, 25 bp, Mus musculus
gagacctacttttaattctcttgta

SEQ ID NO: 470218 - DNA, 25 bp, Mus musculus
gagacctagagcaaatcttataagt

SEQ ID NO: 470219 - DNA, 25 bp, Mus musculus
gagacctagagctaatcttataagt

SEQ ID NO: 470220 - DNA, 25 bp, Mus musculus
gagacctagagtaaggtcgacagtt

SEQ ID NO: 470221 - DNA, 25 bp, Mus musculus
gagacctagagttaggtcgacagtt

SEQ ID NO: 470222 - DNA, 25 bp, Mus musculus
gagacctagatgcaatgaatccagc

SEQ ID NO: 470223 - DNA, 25 bp, Mus musculus
gagacctagatggaatgaatccagc

SEQ ID NO: 470224 - DNA, 25 bp, Mus musculus
gagacctagcaaatgcaagctggac

SEQ ID NO: 470225 - DNA, 25 bp, Mus musculus
gagacctagcaattgcaagctggac

SEQ ID NO: 470226 - DNA, 25 bp, Mus musculus
gagacctagcacctcacagtatatc

SEQ ID NO: 470227 - DNA, 25 bp, Mus musculus
gagacctagcacgtcacagtatatc

SEQ ID NO: 470228 - DNA, 25 bp, Mus musculus
gagacctagcctcgttttcccttag

SEQ ID NO: 470229 - DNA, 25 bp, Mus musculus
gagacctagcctggttttcccttag

SEQ ID NO: 470230 - DNA, 25 bp, Mus musculus
gagacctaggagaaaacgcaactat

SEQ ID NO: 470231 - DNA, 25 bp, Mus musculus
gagacctaggagtaaacgcaactat

SEQ ID NO: 470232 - DNA, 25 bp, Mus musculus
gagacctagtgcaatttccctgcag

SEQ ID NO: 470233 - DNA, 25 bp, Mus musculus
gagacctagtgctatttccctgcag

SEQ ID NO: 470234 - DNA, 25 bp, Mus musculus
gagacctatctgcagagatttggct

SEQ ID NO: 470235 - DNA, 25 bp, Mus musculus
gagacctatctggagagatttggct

SEQ ID NO: 470236 - DNA, 25 bp, Mus musculus
gagacctattaaatcgctcctattt

SEQ ID NO: 470237 - DNA, 25 bp, Mus musculus
gagacctattaattcgctcctattt

SEQ ID NO: 470238 - DNA, 25 bp, Mus musculus
gagacctcaaataccactgccagat

SEQ ID NO: 470239 - DNA, 25 bp, Mus musculus
gagacctcaaattccactgccagat

SEQ ID NO: 470240 - DNA, 25 bp, Mus musculus
gagacctcaacaacacaggcaagcg

SEQ ID NO: 470241 - DNA, 25 bp, Mus musculus
gagacctcaacaattcagcagcagt

SEQ ID NO: 470242 - DNA, 25 bp, Mus musculus
gagacctcaacacgagactccaaga

SEQ ID NO: 470243 - DNA, 25 bp, Mus musculus
gagacctcaacaggagactccaaga

SEQ ID NO: 470244 - DNA, 25 bp, Mus musculus
gagacctcaacatcacaggcaagcg

SEQ ID NO: 470245 - DNA, 25 bp, Mus musculus
gagacctcaacatttcagcagcagt

SEQ ID NO: 470246 - DNA, 25 bp, Mus musculus
gagacctcactgcaggctggagtaa

SEQ ID NO: 470247 - DNA, 25 bp, Mus musculus
gagacctcactggaggctggagtaa

SEQ ID NO: 470248 - DNA, 25 bp, Mus musculus
gagacctcagcccagtcaacaggaa

SEQ ID NO: 470249 - DNA, 25 bp, Mus musculus
gagacctcagccgagtcaacaggaa

SEQ ID NO: 470250 - DNA, 25 bp, Mus musculus
gagacctcagtgctctgcaccaact

SEQ ID NO: 470251 - DNA, 25 bp, Mus musculus
gagacctcagtggtctgcaccaact

SEQ ID NO: 470252 - DNA, 25 bp, Mus musculus
gagacctcatcactcaagtttgaaa

SEQ ID NO: 470253 - DNA, 25 bp, Mus musculus
gagacctcatcagtcaagtttgaaa

SEQ ID NO: 470254 - DNA, 25 bp, Mus musculus
gagacctcatcccattggagaacgg

SEQ ID NO: 470255 - DNA, 25 bp, Mus musculus
gagacctcatccgattggagaacgg

SEQ ID NO: 470256 - DNA, 25 bp, Mus musculus
gagacctccacacttattacaggca

SEQ ID NO: 470257 - DNA, 25 bp, Mus musculus
gagacctccacagttattacaggca

SEQ ID NO: 470258 - DNA, 25 bp, Mus musculus
gagacctccactatgttaagggcag

SEQ ID NO: 470259 - DNA, 25 bp, Mus musculus
gagacctccactttgttaagggcag

SEQ ID NO: 470260 - DNA, 25 bp, Mus musculus
gagacctccaggaaagcccaaccct

SEQ ID NO: 470261 - DNA, 25 bp, Mus musculus
gagacctccaggtaagcccaaccct

SEQ ID NO: 470262 - DNA, 25 bp, Mus musculus
gagacctcccttcgactagaaactg

SEQ ID NO: 470263 - DNA, 25 bp, Mus musculus
gagacctcccttggactagaaactg

SEQ ID NO: 470264 - DNA, 25 bp, Mus musculus
gagacctccggccttaggaagttgc

SEQ ID NO: 470265 - DNA, 25 bp, Mus musculus
gagacctccggcgttaggaagttgc

SEQ ID NO: 470266 - DNA, 25 bp, Mus musculus
gagacctcctggatctagagttgga

SEQ ID NO: 470267 - DNA, 25 bp, Mus musculus
gagacctcctggttctagagttgga

SEQ ID NO: 470268 - DNA, 25 bp, Mus musculus
gagacctcgagcacccgagaggaga

SEQ ID NO: 470269 - DNA, 25 bp, Mus musculus
gagacctcgagctcccgagaggaga

SEQ ID NO: 470270 - DNA, 25 bp, Mus musculus
gagacctcggaacctgagtgtgtca

SEQ ID NO: 470271 - DNA, 25 bp, Mus musculus
gagacctcggaagctgagtgtgtca

SEQ ID NO: 470272 - DNA, 25 bp, Mus musculus
gagacctcgttacagtagcagacgt

SEQ ID NO: 470273 - DNA, 25 bp, Mus musculus
gagacctcgttagagtagcagacgt

SEQ ID NO: 470274 - DNA, 25 bp, Mus musculus
gagacctcgttgaagtgcggagcac

SEQ ID NO: 470275 - DNA, 25 bp, Mus musculus
gagacctcgttgtagtgcggagcac

SEQ ID NO: 470276 - DNA, 25 bp, Mus musculus
gagacctctaatccgccttccgttt

SEQ ID NO: 470277 - DNA, 25 bp, Mus musculus
gagacctctaatgcgccttccgttt

SEQ ID NO: 470278 - DNA, 25 bp, Mus musculus
gagacctctacgacttgtttgtaaa

SEQ ID NO: 470279 - DNA, 25 bp, Mus musculus
gagacctctacgtcttgtttgtaaa

SEQ ID NO: 470280 - DNA, 25 bp, Mus musculus
gagacctctgatactgactaactgt

SEQ ID NO: 470281 - DNA, 25 bp, Mus musculus
gagacctctgattctgactaactgt

SEQ ID NO: 470282 - DNA, 25 bp, Mus musculus
gagacctctggaacaggcattggag

SEQ ID NO: 470283 - DNA, 25 bp, Mus musculus
gagacctctggatcaggcattggag

SEQ ID NO: 470284 - DNA, 25 bp, Mus musculus
gagacctcttaacattcccaatgta

SEQ ID NO: 470285 - DNA, 25 bp, Mus musculus
gagacctcttaagattcccaatgta

SEQ ID NO: 470286 - DNA, 25 bp, Mus musculus
gagacctcttcaccttagactcaga

SEQ ID NO: 470287 - DNA, 25 bp, Mus musculus
gagacctcttcagcttagactcaga

SEQ ID NO: 470288 - DNA, 25 bp, Mus musculus
gagacctcttgtattcatctgtgaa

SEQ ID NO: 470289 - DNA, 25 bp, Mus musculus
gagacctcttgttttcatctgtgaa

SEQ ID NO: 470290 - DNA, 25 bp, Mus musculus
gagacctctttcaggaatgtaacat

SEQ ID NO: 470291 - DNA, 25 bp, Mus musculus
gagacctctttctggaatgtaacat

SEQ ID NO: 470292 - DNA, 25 bp, Mus musculus
gagacctgaaacacaggctgaaaaa

SEQ ID NO: 470293 - DNA, 25 bp, Mus musculus
gagacctgaaactcaggctgaaaaa

SEQ ID NO: 470294 - DNA, 25 bp, Mus musculus
gagacctgaaccacgcttcagactc

SEQ ID NO: 470295 - DNA, 25 bp, Mus musculus
gagacctgaacctcgcttcagactc

SEQ ID NO: 470296 - DNA, 25 bp, Mus musculus
gagacctgacagacctagaaatagt

SEQ ID NO: 470297 - DNA, 25 bp, Mus musculus
gagacctgacagcaagcaaccttta

SEQ ID NO: 470298 - DNA, 25 bp, Mus musculus
gagacctgacaggaagcaaccttta

SEQ ID NO: 470299 - DNA, 25 bp, Mus musculus
gagacctgacagtcctagaaatagt

SEQ ID NO: 470300 - DNA, 25 bp, Mus musculus
gagacctgactgagaagtaccgcta

SEQ ID NO: 470301 - DNA, 25 bp, Mus musculus
gagacctgactgtgaagtaccgcta

SEQ ID NO: 470302 - DNA, 25 bp, Mus musculus
gagacctgagctccagactggaatg

SEQ ID NO: 470303 - DNA, 25 bp, Mus musculus
gagacctgagctgcagactggaatg

SEQ ID NO: 470304 - DNA, 25 bp, Mus musculus
gagacctgagtaagtttggtttttc

SEQ ID NO: 470305 - DNA, 25 bp, Mus musculus
gagacctgagtatgtttggtttttc

SEQ ID NO: 470306 - DNA, 25 bp, Mus musculus
gagacctgagtcaatactgagacct

SEQ ID NO: 470307 - DNA, 25 bp, Mus musculus
gagacctgagtctatactgagacct

SEQ ID NO: 470308 - DNA, 25 bp, Mus musculus
gagacctgagtgaggcctaagtgac

SEQ ID NO: 470309 - DNA, 25 bp, Mus musculus
gagacctgagtgtggcctaagtgac

SEQ ID NO: 470310 - DNA, 25 bp, Mus musculus
gagacctgagttctgctggcagcaa

SEQ ID NO: 470311 - DNA, 25 bp, Mus musculus
gagacctgagttgtgctggcagcaa

SEQ ID NO: 470312 - DNA, 25 bp, Mus musculus
gagacctgcagacaccgatagtgaa

SEQ ID NO: 470313 - DNA, 25 bp, Mus musculus
gagacctgcagaccattgaacaaag

SEQ ID NO: 470314 - DNA, 25 bp, Mus musculus
gagacctgcagagaccgatagtgaa

SEQ ID NO: 470315 - DNA, 25 bp, Mus musculus
gagacctgcagagcattgaacaaag

SEQ ID NO: 470316 - DNA, 25 bp, Mus musculus
gagacctgcagtacgtggagaagat

SEQ ID NO: 470317 - DNA, 25 bp, Mus musculus
gagacctgcagtccaaacttgacac

SEQ ID NO: 470318 - DNA, 25 bp, Mus musculus
gagacctgcagtgcaaacttgacac

SEQ ID NO: 470319 - DNA, 25 bp, Mus musculus
gagacctgcagttcgtggagaagat

SEQ ID NO: 470320 - DNA, 25 bp, Mus musculus
gagacctgccaaagaccaaataaca

SEQ ID NO: 470321 - DNA, 25 bp, Mus musculus
gagacctgccaatgaccaaataaca

SEQ ID NO: 470322 - DNA, 25 bp, Mus musculus
gagacctgcccaatgtgtcgtaaag

SEQ ID NO: 470323 - DNA, 25 bp, Mus musculus
gagacctgcccattgtgtcgtaaag

SEQ ID NO: 470324 - DNA, 25 bp, Mus musculus
gagacctgctctattatttgaaggg

SEQ ID NO: 470325 - DNA, 25 bp, Mus musculus
gagacctgctcttttatttgaaggg

SEQ ID NO: 470326 - DNA, 25 bp, Mus musculus
gagacctgctgcatataaagttaga

SEQ ID NO: 470327 - DNA, 25 bp, Mus musculus
gagacctgctgcttataaagttaga

SEQ ID NO: 470328 - DNA, 25 bp, Mus musculus
gagacctgctttcaagtgtggttgt

SEQ ID NO: 470329 - DNA, 25 bp, Mus musculus
gagacctgctttgaagtgtggttgt

SEQ ID NO: 470330 - DNA, 25 bp, Mus musculus
gagacctggcagactgtcctcaaca

SEQ ID NO: 470331 - DNA, 25 bp, Mus musculus
gagacctggcagtctgtcctcaaca

SEQ ID NO: 470332 - DNA, 25 bp, Mus musculus
gagacctggcctcacactttgggtg

SEQ ID NO: 470333 - DNA, 25 bp, Mus musculus
gagacctggcctgacactttgggtg

SEQ ID NO: 470334 - DNA, 25 bp, Mus musculus
gagacctggctgctctattgtaagc

SEQ ID NO: 470335 - DNA, 25 bp, Mus musculus
gagacctggctggtctattgtaagc

SEQ ID NO: 470336 - DNA, 25 bp, Mus musculus
gagacctggcttaggagaaaagacc

SEQ ID NO: 470337 - DNA, 25 bp, Mus musculus
gagacctggctttggagaaaagacc

SEQ ID NO: 470338 - DNA, 25 bp, Mus musculus
gagacctgggctacagggaaccctt

SEQ ID NO: 470339 - DNA, 25 bp, Mus musculus
gagacctgggcttcagggaaccctt

SEQ ID NO: 470340 - DNA, 25 bp, Mus musculus
gagacctggttaatccacgtttgta

SEQ ID NO: 470341 - DNA, 25 bp, Mus musculus
gagacctggttattccacgtttgta

SEQ ID NO: 470342 - DNA, 25 bp, Mus musculus
gagacctggtttctgagaccaaaga

SEQ ID NO: 470343 - DNA, 25 bp, Mus musculus
gagacctggtttgtgagaccaaaga

SEQ ID NO: 470344 - DNA, 25 bp, Mus musculus
gagacctgtattcccctcagagcaa

SEQ ID NO: 470345 - DNA, 25 bp, Mus musculus
gagacctgtattgccctcagagcaa

SEQ ID NO: 470346 - DNA, 25 bp, Mus musculus
gagacctgtctcaacagaaggctaa

SEQ ID NO: 470347 - DNA, 25 bp, Mus musculus
gagacctgtctctacagaaggctaa

SEQ ID NO: 470348 - DNA, 25 bp, Mus musculus
gagacctgtgacctagacaacgaca

SEQ ID NO: 470349 - DNA, 25 bp, Mus musculus
gagacctgtgacgtagacaacgaca

SEQ ID NO: 470350 - DNA, 25 bp, Mus musculus
gagacctgtgccactgtaacacaaa

SEQ ID NO: 470351 - DNA, 25 bp, Mus musculus
gagacctgtgccagcgagtcggcct

SEQ ID NO: 470352 - DNA, 25 bp, Mus musculus
gagacctgtgcctctgtaacacaaa

SEQ ID NO: 470353 - DNA, 25 bp, Mus musculus
gagacctgtgcctgcgagtcggcct

SEQ ID NO: 470354 - DNA, 25 bp, Mus musculus
gagacctgtggaaatatgtgcatct

SEQ ID NO: 470355 - DNA, 25 bp, Mus musculus
gagacctgtggatatatgtgcatct

SEQ ID NO: 470356 - DNA, 25 bp, Mus musculus
gagacctgtgtaattacttagcata

SEQ ID NO: 470357 - DNA, 25 bp, Mus musculus
gagacctgtgtatttacttagcata

SEQ ID NO: 470358 - DNA, 25 bp, Mus musculus
gagacctgtgttaagaattccgaag

SEQ ID NO: 470359 - DNA, 25 bp, Mus musculus
gagacctgtgtttagaattccgaag

SEQ ID NO: 470360 - DNA, 25 bp, Mus musculus
gagacctgttaacttatacactcat

SEQ ID NO: 470361 - DNA, 25 bp, Mus musculus
gagacctgttaagttatacactcat

SEQ ID NO: 470362 - DNA, 25 bp, Mus musculus
gagacctgtttcaaacaaccactgc

SEQ ID NO: 470363 - DNA, 25 bp, Mus musculus
gagacctgtttctaacaaccactgc

SEQ ID NO: 470364 - DNA, 25 bp, Mus musculus
gagaccttaaaacctgatcccacag

SEQ ID NO: 470365 - DNA, 25 bp, Mus musculus
gagaccttaaaagctgatcccacag

SEQ ID NO: 470366 - DNA, 25 bp, Mus musculus
gagaccttaagtacgatgtttttgt

SEQ ID NO: 470367 - DNA, 25 bp, Mus musculus
gagaccttaagttcgatgtttttgt

SEQ ID NO: 470368 - DNA, 25 bp, Mus musculus
gagaccttaatcagcccgtgtcaat

SEQ ID NO: 470369 - DNA, 25 bp, Mus musculus
gagaccttaatctgcccgtgtcaat

SEQ ID NO: 470370 - DNA, 25 bp, Mus musculus
gagaccttagagcaaccctacgtgg

SEQ ID NO: 470371 - DNA, 25 bp, Mus musculus
gagaccttagaggaaccctacgtgg

SEQ ID NO: 470372 - DNA, 25 bp, Mus musculus
gagaccttaggtccccagatccgga

SEQ ID NO: 470373 - DNA, 25 bp, Mus musculus
gagaccttaggtgcccagatccgga

SEQ ID NO: 470374 - DNA, 25 bp, Mus musculus
gagaccttagttaactcccttagca

SEQ ID NO: 470375 - DNA, 25 bp, Mus musculus
gagaccttagtttactcccttagca

SEQ ID NO: 470376 - DNA, 25 bp, Mus musculus
gagaccttatcacaacacaatcatt

SEQ ID NO: 470377 - DNA, 25 bp, Mus musculus
gagaccttatcagaacacaatcatt

SEQ ID NO: 470378 - DNA, 25 bp, Mus musculus
gagaccttatggagcaaacaacatc

SEQ ID NO: 470379 - DNA, 25 bp, Mus musculus
gagaccttatggtgcaaacaacatc

SEQ ID NO: 470380 - DNA, 25 bp, Mus musculus
gagaccttatgtctgcactcattgt

SEQ ID NO: 470381 - DNA, 25 bp, Mus musculus
gagaccttatgtgtgcactcattgt

SEQ ID NO: 470382 - DNA, 25 bp, Mus musculus
gagaccttattcagcactctaattg

SEQ ID NO: 470383 - DNA, 25 bp, Mus musculus
gagaccttattctgcactctaattg

SEQ ID NO: 470384 - DNA, 25 bp, Mus musculus
gagaccttcaccagtacagagcatt

SEQ ID NO: 470385 - DNA, 25 bp, Mus musculus
gagaccttcacctgtacagagcatt

SEQ ID NO: 470386 - DNA, 25 bp, Mus musculus
gagaccttcagcctaggagtctgcc

SEQ ID NO: 470387 - DNA, 25 bp, Mus musculus
gagaccttcagcgtaggagtctgcc

SEQ ID NO: 470388 - DNA, 25 bp, Mus musculus
gagaccttcatgatctactcagtga

SEQ ID NO: 470389 - DNA, 25 bp, Mus musculus
gagaccttcatgttctactcagtga

SEQ ID NO: 470390 - DNA, 25 bp, Mus musculus
gagaccttccagatcacagtctatc

SEQ ID NO: 470391 - DNA, 25 bp, Mus musculus
gagaccttccagttcacagtctatc

SEQ ID NO: 470392 - DNA, 25 bp, Mus musculus
gagaccttccctagcatgcataaag

SEQ ID NO: 470393 - DNA, 25 bp, Mus musculus
gagaccttcccttgcatgcataaag

SEQ ID NO: 470394 - DNA, 25 bp, Mus musculus
gagaccttcgacagccttttcgagc

SEQ ID NO: 470395 - DNA, 25 bp, Mus musculus
gagaccttcgactgccttttcgagc

SEQ ID NO: 470396 - DNA, 25 bp, Mus musculus
gagaccttctctcgccaggaaacac

SEQ ID NO: 470397 - DNA, 25 bp, Mus musculus
gagaccttctctggccaggaaacac

SEQ ID NO: 470398 - DNA, 25 bp, Mus musculus
gagaccttgaaaaaatccgcagaca

SEQ ID NO: 470399 - DNA, 25 bp, Mus musculus
gagaccttgaaataatccgcagaca

SEQ ID NO: 470400 - DNA, 25 bp, Mus musculus
gagaccttgaagcagctttacaagt

SEQ ID NO: 470401 - DNA, 25 bp, Mus musculus
gagaccttgaaggagctttacaagt

SEQ ID NO: 470402 - DNA, 25 bp, Mus musculus
gagaccttgctaagctgtataagtt

SEQ ID NO: 470403 - DNA, 25 bp, Mus musculus
gagaccttgctatgctgtataagtt

SEQ ID NO: 470404 - DNA, 25 bp, Mus musculus
gagaccttggaaatccttgcaactg

SEQ ID NO: 470405 - DNA, 25 bp, Mus musculus
gagaccttggaattccttgcaactg

SEQ ID NO: 470406 - DNA, 25 bp, Mus musculus
gagaccttggcactatctgatttca

SEQ ID NO: 470407 - DNA, 25 bp, Mus musculus
gagaccttggcagtatctgatttca

SEQ ID NO: 470408 - DNA, 25 bp, Mus musculus
gagaccttggcgatcagagacccta

SEQ ID NO: 470409 - DNA, 25 bp, Mus musculus
gagaccttggcgttcagagacccta

SEQ ID NO: 470410 - DNA, 25 bp, Mus musculus
gagaccttgtcacccaaacagcaaa

SEQ ID NO: 470411 - DNA, 25 bp, Mus musculus
gagaccttgtcagccaaacagcaaa

SEQ ID NO: 470412 - DNA, 25 bp, Mus musculus
gagaccttgtctcagtgacgtggaa

SEQ ID NO: 470413 - DNA, 25 bp, Mus musculus
gagaccttgtctgagtgacgtggaa

SEQ ID NO: 470414 - DNA, 25 bp, Mus musculus
gagaccttgtttcaataacgaaccg

SEQ ID NO: 470415 - DNA, 25 bp, Mus musculus
gagaccttgtttgaataacgaaccg

SEQ ID NO: 470416 - DNA, 25 bp, Mus musculus
gagacctttaggatggtagcgccac

SEQ ID NO: 470417 - DNA, 25 bp, Mus musculus
gagacctttaggttggtagcgccac

SEQ ID NO: 470418 - DNA, 25 bp, Mus musculus
gagacctttcagcatgatacccgct

SEQ ID NO: 470419 - DNA, 25 bp, Mus musculus
gagacctttcaggatgatacccgct

SEQ ID NO: 470420 - DNA, 25 bp, Mus musculus
gagacctttcccatgaagttgaagc

SEQ ID NO: 470421 - DNA, 25 bp, Mus musculus
gagacctttcccttgaagttgaagc

SEQ ID NO: 470422 - DNA, 25 bp, Mus musculus
gagacctttcttaggccttatttgg

SEQ ID NO: 470423 - DNA, 25 bp, Mus musculus
gagacctttctttggccttatttgg

SEQ ID NO: 470424 - DNA, 25 bp, Mus musculus
gagaccttttgtaacaatgtgtaaa

SEQ ID NO: 470425 - DNA, 25 bp, Mus musculus
gagaccttttgttacaatgtgtaaa

SEQ ID NO: 470426 - DNA, 25 bp, Mus musculus
gagacgaacgtgagcagtcctcgtt

SEQ ID NO: 470427 - DNA, 25 bp, Mus musculus
gagacgaacgtgtgcagtcctcgtt

SEQ ID NO: 470428 - DNA, 25 bp, Mus musculus
gagacgaagccaatgcacatgtgaa

SEQ ID NO: 470429 - DNA, 25 bp, Mus musculus
gagacgaagccattgcacatgtgaa

SEQ ID NO: 470430 - DNA, 25 bp, Mus musculus
gagacgaatcaaccgtgctactgaa

SEQ ID NO: 470431 - DNA, 25 bp, Mus musculus
gagacgaatcaagcgtgctactgaa

SEQ ID NO: 470432 - DNA, 25 bp, Mus musculus
gagacgaatgttctgaagccttgaa

SEQ ID NO: 470433 - DNA, 25 bp, Mus musculus
gagacgaatgttgtgaagccttgaa

SEQ ID NO: 470434 - DNA, 25 bp, Mus musculus
gagacgaatttgctcctgcagagac

SEQ ID NO: 470435 - DNA, 25 bp, Mus musculus
gagacgaatttggtcctgcagagac

SEQ ID NO: 470436 - DNA, 25 bp, Mus musculus
gagacgacaactctgaagcaacata

SEQ ID NO: 470437 - DNA, 25 bp, Mus musculus
gagacgacaactgtgaagcaacata

SEQ ID NO: 470438 - DNA, 25 bp, Mus musculus
gagacgacatctctgcagcagtaca

SEQ ID NO: 470439 - DNA, 25 bp, Mus musculus
gagacgacatctgtgcagcagtaca

SEQ ID NO: 470440 - DNA, 25 bp, Mus musculus
gagacgaccgtgcaactctgtatag

SEQ ID NO: 470441 - DNA, 25 bp, Mus musculus
gagacgaccgtggaactctgtatag

SEQ ID NO: 470442 - DNA, 25 bp, Mus musculus
gagacgacctaactttgttcttgag

SEQ ID NO: 470443 - DNA, 25 bp, Mus musculus
gagacgacctaagtttgttcttgag

SEQ ID NO: 470444 - DNA, 25 bp, Mus musculus
gagacgacggtgacactgcttagtg

SEQ ID NO: 470445 - DNA, 25 bp, Mus musculus
gagacgacggtgtcactgcttagtg

SEQ ID NO: 470446 - DNA, 25 bp, Mus musculus
gagacgacgtttctagatttgctga

SEQ ID NO: 470447 - DNA, 25 bp, Mus musculus
gagacgacgtttgtagatttgctga

SEQ ID NO: 470448 - DNA, 25 bp, Mus musculus
gagacgactgaactgtgggaacctt

SEQ ID NO: 470449 - DNA, 25 bp, Mus musculus
gagacgactgaagtgtgggaacctt

SEQ ID NO: 470450 - DNA, 25 bp, Mus musculus
gagacgactgctactagtggacatt

SEQ ID NO: 470451 - DNA, 25 bp, Mus musculus
gagacgactgcttctagtggacatt

SEQ ID NO: 470452 - DNA, 25 bp, Mus musculus
gagacgactgtaatacccaagggaa

SEQ ID NO: 470453 - DNA, 25 bp, Mus musculus
gagacgactgtattacccaagggaa

SEQ ID NO: 470454 - DNA, 25 bp, Mus musculus
gagacgacttcacagaggaacgcct

SEQ ID NO: 470455 - DNA, 25 bp, Mus musculus
gagacgacttcagagaggaacgcct

SEQ ID NO: 470456 - DNA, 25 bp, Mus musculus
gagacgactttgaataaacttttgt

SEQ ID NO: 470457 - DNA, 25 bp, Mus musculus
gagacgactttgtataaacttttgt

SEQ ID NO: 470458 - DNA, 25 bp, Mus musculus
gagacgagacatacttcggaagaag

SEQ ID NO: 470459 - DNA, 25 bp, Mus musculus
gagacgagacattcttcggaagaag

SEQ ID NO: 470460 - DNA, 25 bp, Mus musculus
gagacgagacggcaccggtcattac

SEQ ID NO: 470461 - DNA, 25 bp, Mus musculus
gagacgagacgggaccggtcattac

SEQ ID NO: 470462 - DNA, 25 bp, Mus musculus
gagacgagagttccacaatcaatgt

SEQ ID NO: 470463 - DNA, 25 bp, Mus musculus
gagacgagagttgcacaatcaatgt

SEQ ID NO: 470464 - DNA, 25 bp, Mus musculus
gagacgagcatacactgttattcat

SEQ ID NO: 470465 - DNA, 25 bp, Mus musculus
gagacgagcatagactgttattcat

SEQ ID NO: 470466 - DNA, 25 bp, Mus musculus
gagacgagcggcatcgtactggtac

SEQ ID NO: 470467 - DNA, 25 bp, Mus musculus
gagacgagcggcttcgtactggtac

SEQ ID NO: 470468 - DNA, 25 bp, Mus musculus
gagacgagcgtgacgttctcgccgc

SEQ ID NO: 470469 - DNA, 25 bp, Mus musculus
gagacgagcgtgtcgttctcgccgc

SEQ ID NO: 470470 - DNA, 25 bp, Mus musculus
gagacgaggaacaacatcagcaact

SEQ ID NO: 470471 - DNA, 25 bp, Mus musculus
gagacgaggaactacatcagcaact

SEQ ID NO: 470472 - DNA, 25 bp, Mus musculus
gagacgaggctcattcacgaggatg

SEQ ID NO: 470473 - DNA, 25 bp, Mus musculus
gagacgaggctctttcacgaggatg

SEQ ID NO: 470474 - DNA, 25 bp, Mus musculus
gagacgagttaaaaagaaggcgacc

SEQ ID NO: 470475 - DNA, 25 bp, Mus musculus
gagacgagttaataagaaggcgacc

SEQ ID NO: 470476 - DNA, 25 bp, Mus musculus
gagacgagtttgcatcatccacgtg

SEQ ID NO: 470477 - DNA, 25 bp, Mus musculus
gagacgagtttggatcatccacgtg

SEQ ID NO: 470478 - DNA, 25 bp, Mus musculus
gagacgcaaaagcttgaccccagct

SEQ ID NO: 470479 - DNA, 25 bp, Mus musculus
gagacgcaaaaggttgaccccagct

SEQ ID NO: 470480 - DNA, 25 bp, Mus musculus
gagacgcacacgcaacaccgggtgt

SEQ ID NO: 470481 - DNA, 25 bp, Mus musculus
gagacgcacacggaacaccgggtgt

SEQ ID NO: 470482 - DNA, 25 bp, Mus musculus
gagacgcacagacattctgagccca

SEQ ID NO: 470483 - DNA, 25 bp, Mus musculus
gagacgcacagagattctgagccca

SEQ ID NO: 470484 - DNA, 25 bp, Mus musculus
gagacgcacgcgagagcccgcacga

SEQ ID NO: 470485 - DNA, 25 bp, Mus musculus
gagacgcacgcgtgagcccgcacga

SEQ ID NO: 470486 - DNA, 25 bp, Mus musculus
gagacgcactacagggttcacacag

SEQ ID NO: 470487 - DNA, 25 bp, Mus musculus
gagacgcactactgggttcacacag

SEQ ID NO: 470488 - DNA, 25 bp, Mus musculus
gagacgcagatgaagctgtttggac

SEQ ID NO: 470489 - DNA, 25 bp, Mus musculus
gagacgcagatgtagctgtttggac

SEQ ID NO: 470490 - DNA, 25 bp, Mus musculus
gagacgcagcaaacctgggaaagca

SEQ ID NO: 470491 - DNA, 25 bp, Mus musculus
gagacgcagcaatcctgggaaagca

SEQ ID NO: 470492 - DNA, 25 bp, Mus musculus
gagacgcagcgaatcacatgggaca

SEQ ID NO: 470493 - DNA, 25 bp, Mus musculus
gagacgcagcgattcacatgggaca

SEQ ID NO: 470494 - DNA, 25 bp, Mus musculus
gagacgcaggcacaactctttatac

SEQ ID NO: 470495 - DNA, 25 bp, Mus musculus
gagacgcaggcagaactctttatac

SEQ ID NO: 470496 - DNA, 25 bp, Mus musculus
gagacgccacttcgacagacggact

SEQ ID NO: 470497 - DNA, 25 bp, Mus musculus
gagacgccacttggacagacggact

SEQ ID NO: 470498 - DNA, 25 bp, Mus musculus
gagacgccataaatctgctgtggta

SEQ ID NO: 470499 - DNA, 25 bp, Mus musculus
gagacgccataattctgctgtggta

SEQ ID NO: 470500 - DNA, 25 bp, Mus musculus
gagacgcccagtcccgagtagatga

SEQ ID NO: 470501 - DNA, 25 bp, Mus musculus
gagacgcccagtgccgagtagatga

SEQ ID NO: 470502 - DNA, 25 bp, Mus musculus
gagacgccgttgattgcaaatccca

SEQ ID NO: 470503 - DNA, 25 bp, Mus musculus
gagacgccgttgtttgcaaatccca

SEQ ID NO: 470504 - DNA, 25 bp, Mus musculus
gagacgcctgcacaacaaggagcat

SEQ ID NO: 470505 - DNA, 25 bp, Mus musculus
gagacgcctgcagaacaaggagcat

SEQ ID NO: 470506 - DNA, 25 bp, Mus musculus
gagacgcctggcatggtctccgtgt

SEQ ID NO: 470507 - DNA, 25 bp, Mus musculus
gagacgcctggcttggtctccgtgt

SEQ ID NO: 470508 - DNA, 25 bp, Mus musculus
gagacgcctgtaatggaagacgcta

SEQ ID NO: 470509 - DNA, 25 bp, Mus musculus
gagacgcctgtattggaagacgcta

SEQ ID NO: 470510 - DNA, 25 bp, Mus musculus
gagacgccttccaatcagcagttgt

SEQ ID NO: 470511 - DNA, 25 bp, Mus musculus
gagacgccttcctatcagcagttgt

SEQ ID NO: 470512 - DNA, 25 bp, Mus musculus
gagacgcgagcgcaacaagctagca

SEQ ID NO: 470513 - DNA, 25 bp, Mus musculus
gagacgcgagcggaacaagctagca

SEQ ID NO: 470514 - DNA, 25 bp, Mus musculus
gagacgcgtttgagaaacttgccat

SEQ ID NO: 470515 - DNA, 25 bp, Mus musculus
gagacgcgtttgtgaaacttgccat

SEQ ID NO: 470516 - DNA, 25 bp, Mus musculus
gagacgctactgaatattcctgtaa

SEQ ID NO: 470517 - DNA, 25 bp, Mus musculus
gagacgctactgtatattcctgtaa

SEQ ID NO: 470518 - DNA, 25 bp, Mus musculus
gagacgctcaggctttgaaccccac

SEQ ID NO: 470519 - DNA, 25 bp, Mus musculus
gagacgctcagggtttgaaccccac

SEQ ID NO: 470520 - DNA, 25 bp, Mus musculus
gagacgctctctactgtgtagaaca

SEQ ID NO: 470521 - DNA, 25 bp, Mus musculus
gagacgctctcttctgtgtagaaca

SEQ ID NO: 470522 - DNA, 25 bp, Mus musculus
gagacgctgaagatgggacacccct

SEQ ID NO: 470523 - DNA, 25 bp, Mus musculus
gagacgctgaagttgggacacccct

SEQ ID NO: 470524 - DNA, 25 bp, Mus musculus
gagacgctgagccacagagtgaaca

SEQ ID NO: 470525 - DNA, 25 bp, Mus musculus
gagacgctgagcgacagagtgaaca

SEQ ID NO: 470526 - DNA, 25 bp, Mus musculus
gagacgctgctcacttagcgatgag

SEQ ID NO: 470527 - DNA, 25 bp, Mus musculus
gagacgctgctctcttagcgatgag

SEQ ID NO: 470528 - DNA, 25 bp, Mus musculus
gagacgcttaagacccaagtccaga

SEQ ID NO: 470529 - DNA, 25 bp, Mus musculus
gagacgcttaagtcccaagtccaga

SEQ ID NO: 470530 - DNA, 25 bp, Mus musculus
gagacgcttagaaccaagcacagag

SEQ ID NO: 470531 - DNA, 25 bp, Mus musculus
gagacgcttagatccaagcacagag

SEQ ID NO: 470532 - DNA, 25 bp, Mus musculus
gagacgctttgcaccaagatatcag

SEQ ID NO: 470533 - DNA, 25 bp, Mus musculus
gagacgctttgccttccggaaagtc

SEQ ID NO: 470534 - DNA, 25 bp, Mus musculus
gagacgctttgcgttccggaaagtc

SEQ ID NO: 470535 - DNA, 25 bp, Mus musculus
gagacgctttgctccaagatatcag

SEQ ID NO: 470536 - DNA, 25 bp, Mus musculus
gagacgcttttgaaatttctactga

SEQ ID NO: 470537 - DNA, 25 bp, Mus musculus
gagacgcttttgtaatttctactga

SEQ ID NO: 470538 - DNA, 25 bp, Mus musculus
gagacggaaagcagaagtttcattt

SEQ ID NO: 470539 - DNA, 25 bp, Mus musculus
gagacggaaagctgaagtttcattt

SEQ ID NO: 470540 - DNA, 25 bp, Mus musculus
gagacggaacatcacccactaggag

SEQ ID NO: 470541 - DNA, 25 bp, Mus musculus
gagacggaacatgacccactaggag

SEQ ID NO: 470542 - DNA, 25 bp, Mus musculus
gagacggaactcagatccagacaac

SEQ ID NO: 470543 - DNA, 25 bp, Mus musculus
gagacggaactctgatccagacaac

SEQ ID NO: 470544 - DNA, 25 bp, Mus musculus
gagacggaagtaatcatcaaggaca

SEQ ID NO: 470545 - DNA, 25 bp, Mus musculus
gagacggaagtattcatcaaggaca

SEQ ID NO: 470546 - DNA, 25 bp, Mus musculus
gagacggacaccaggaagctcagcc

SEQ ID NO: 470547 - DNA, 25 bp, Mus musculus
gagacggacacctggaagctcagcc

SEQ ID NO: 470548 - DNA, 25 bp, Mus musculus
gagacggaccctcaagtttaacact

SEQ ID NO: 470549 - DNA, 25 bp, Mus musculus
gagacggaccctgaagtttaacact

SEQ ID NO: 470550 - DNA, 25 bp, Mus musculus
gagacggcaagactccgcttttctt

SEQ ID NO: 470551 - DNA, 25 bp, Mus musculus
gagacggcaagagtccgcttttctt

SEQ ID NO: 470552 - DNA, 25 bp, Mus musculus
gagacggcacttctgagattcatgt

SEQ ID NO: 470553 - DNA, 25 bp, Mus musculus
gagacggcacttgtgagattcatgt

SEQ ID NO: 470554 - DNA, 25 bp, Mus musculus
gagacggcagagaatgccatgcaga

SEQ ID NO: 470555 - DNA, 25 bp, Mus musculus
gagacggcagagtatgccatgcaga

SEQ ID NO: 470556 - DNA, 25 bp, Mus musculus
gagacggcatctacgcatgcgctga

SEQ ID NO: 470557 - DNA, 25 bp, Mus musculus
gagacggcatcttcgcatgcgctga

SEQ ID NO: 470558 - DNA, 25 bp, Mus musculus
gagacggcctccactgatggaacta

SEQ ID NO: 470559 - DNA, 25 bp, Mus musculus
gagacggcctcctctgatggaacta

SEQ ID NO: 470560 - DNA, 25 bp, Mus musculus
gagacggcggccactgtacagatat

SEQ ID NO: 470561 - DNA, 25 bp, Mus musculus
gagacggcggcctctgtacagatat

SEQ ID NO: 470562 - DNA, 25 bp, Mus musculus
gagacggctctgagacgacctctgg

SEQ ID NO: 470563 - DNA, 25 bp, Mus musculus
gagacggctctgtgacgacctctgg

SEQ ID NO: 470564 - DNA, 25 bp, Mus musculus
gagacggcttagagtaggatcctct

SEQ ID NO: 470565 - DNA, 25 bp, Mus musculus
gagacggcttagtgtaggatcctct

SEQ ID NO: 470566 - DNA, 25 bp, Mus musculus
gagacggcttctattatgtgcagtg

SEQ ID NO: 470567 - DNA, 25 bp, Mus musculus
gagacggcttctctgcagtaaacac

SEQ ID NO: 470568 - DNA, 25 bp, Mus musculus
gagacggcttctgtgcagtaaacac

SEQ ID NO: 470569 - DNA, 25 bp, Mus musculus
gagacggcttcttttatgtgcagtg

SEQ ID NO: 470570 - DNA, 25 bp, Mus musculus
gagacgggaatcctgacacgccgtt

SEQ ID NO: 470571 - DNA, 25 bp, Mus musculus
gagacgggaatcgtgacacgccgtt

SEQ ID NO: 470572 - DNA, 25 bp, Mus musculus
gagacgggactgaggatccttcctt

SEQ ID NO: 470573 - DNA, 25 bp, Mus musculus
gagacgggactgtggatccttcctt

SEQ ID NO: 470574 - DNA, 25 bp, Mus musculus
gagacggtaggccttaccactcaga

SEQ ID NO: 470575 - DNA, 25 bp, Mus musculus
gagacggtaggcgttaccactcaga

SEQ ID NO: 470576 - DNA, 25 bp, Mus musculus
gagacggtcctccagctatgaaagg

SEQ ID NO: 470577 - DNA, 25 bp, Mus musculus
gagacggtcctcgagctatgaaagg

SEQ ID NO: 470578 - DNA, 25 bp, Mus musculus
gagacggtcgcccagatcaaagatc

SEQ ID NO: 470579 - DNA, 25 bp, Mus musculus
gagacggtcgccgagatcaaagatc

SEQ ID NO: 470580 - DNA, 25 bp, Mus musculus
gagacggtctgtcttcatggattac

SEQ ID NO: 470581 - DNA, 25 bp, Mus musculus
gagacggtctgtgttcatggattac

SEQ ID NO: 470582 - DNA, 25 bp, Mus musculus
gagacggtcttaaaacagccacaca

SEQ ID NO: 470583 - DNA, 25 bp, Mus musculus
gagacggtcttataacagccacaca

SEQ ID NO: 470584 - DNA, 25 bp, Mus musculus
gagacggtggccagttaatctgctg

SEQ ID NO: 470585 - DNA, 25 bp, Mus musculus
gagacggtggcctgttaatctgctg

SEQ ID NO: 470586 - DNA, 25 bp, Mus musculus
gagacggtgggaacgtcaccacagt

SEQ ID NO: 470587 - DNA, 25 bp, Mus musculus
gagacggtgggatcgtcaccacagt

SEQ ID NO: 470588 - DNA, 25 bp, Mus musculus
gagacggtgtatcaaaaagtgcaaa

SEQ ID NO: 470589 - DNA, 25 bp, Mus musculus
gagacggtgtatgaaaaagtgcaaa

SEQ ID NO: 470590 - DNA, 25 bp, Mus musculus
gagacggttcagattgccaggagat

SEQ ID NO: 470591 - DNA, 25 bp, Mus musculus
gagacggttcagtttgccaggagat

SEQ ID NO: 470592 - DNA, 25 bp, Mus musculus
gagacggttccgcaggcaagacata

SEQ ID NO: 470593 - DNA, 25 bp, Mus musculus
gagacggttccggaggcaagacata

SEQ ID NO: 470594 - DNA, 25 bp, Mus musculus
gagacgtaacttcctcagtgtaccg

SEQ ID NO: 470595 - DNA, 25 bp, Mus musculus
gagacgtaacttgctcagtgtaccg

SEQ ID NO: 470596 - DNA, 25 bp, Mus musculus
gagacgtaccgcaccacgttgcgca

SEQ ID NO: 470597 - DNA, 25 bp, Mus musculus
gagacgtaccgctccacgttgcgca

SEQ ID NO: 470598 - DNA, 25 bp, Mus musculus
gagacgtattgcaaccccagaagaa

SEQ ID NO: 470599 - DNA, 25 bp, Mus musculus
gagacgtattgctaccccagaagaa

SEQ ID NO: 470600 - DNA, 25 bp, Mus musculus
gagacgtcagcccttacggaatgag

SEQ ID NO: 470601 - DNA, 25 bp, Mus musculus
gagacgtcagccgttacggaatgag

SEQ ID NO: 470602 - DNA, 25 bp, Mus musculus
gagacgtcctaacgtgcactttcct

SEQ ID NO: 470603 - DNA, 25 bp, Mus musculus
gagacgtcctaaggtgcactttcct

SEQ ID NO: 470604 - DNA, 25 bp, Mus musculus
gagacgtcctacaaggcagattcag

SEQ ID NO: 470605 - DNA, 25 bp, Mus musculus
gagacgtcctactaggcagattcag

SEQ ID NO: 470606 - DNA, 25 bp, Mus musculus
gagacgtcctgccttgatctcggct

SEQ ID NO: 470607 - DNA, 25 bp, Mus musculus
gagacgtcctgcgttgatctcggct

SEQ ID NO: 470608 - DNA, 25 bp, Mus musculus
gagacgtcgtcccaccgcgaggaaa

SEQ ID NO: 470609 - DNA, 25 bp, Mus musculus
gagacgtcgtccgaccgcgaggaaa

SEQ ID NO: 470610 - DNA, 25 bp, Mus musculus
gagacgtctatgacagaccacagca

SEQ ID NO: 470611 - DNA, 25 bp, Mus musculus
gagacgtctatgtcagaccacagca

SEQ ID NO: 470612 - DNA, 25 bp, Mus musculus
gagacgtctgcaccgggatgcccat

SEQ ID NO: 470613 - DNA, 25 bp, Mus musculus
gagacgtctgcagcgggatgcccat

SEQ ID NO: 470614 - DNA, 25 bp, Mus musculus
gagacgtcttgacggtatgtccaaa

SEQ ID NO: 470615 - DNA, 25 bp, Mus musculus
gagacgtcttgagggtatgtccaaa

SEQ ID NO: 470616 - DNA, 25 bp, Mus musculus
gagacgtgctggagatcaaagccaa

SEQ ID NO: 470617 - DNA, 25 bp, Mus musculus
gagacgtgctggtgatcaaagccaa

SEQ ID NO: 470618 - DNA, 25 bp, Mus musculus
gagacgtggagactaccctgactac

SEQ ID NO: 470619 - DNA, 25 bp, Mus musculus
gagacgtggagagtaccctgactac

SEQ ID NO: 470620 - DNA, 25 bp, Mus musculus
gagacgtggctccatggcagaccaa

SEQ ID NO: 470621 - DNA, 25 bp, Mus musculus
gagacgtggctcgatggcagaccaa

SEQ ID NO: 470622 - DNA, 25 bp, Mus musculus
gagacgttattcatcagcttggttt

SEQ ID NO: 470623 - DNA, 25 bp, Mus musculus
gagacgttattcttcagcttggttt

SEQ ID NO: 470624 - DNA, 25 bp, Mus musculus
gagacgttcctcagagctggctgaa

SEQ ID NO: 470625 - DNA, 25 bp, Mus musculus
gagacgttcctctgagctggctgaa

SEQ ID NO: 470626 - DNA, 25 bp, Mus musculus
gagacgttgtctcagaaaaccagaa

SEQ ID NO: 470627 - DNA, 25 bp, Mus musculus
gagacgttgtctgagaaaaccagaa

SEQ ID NO: 470628 - DNA, 25 bp, Mus musculus
gagacgtttaagaacaacagtaact

SEQ ID NO: 470629 - DNA, 25 bp, Mus musculus
gagacgtttaagtacaacagtaact

SEQ ID NO: 470630 - DNA, 25 bp, Mus musculus
gagacgtttcataccttcgttcaag

SEQ ID NO: 470631 - DNA, 25 bp, Mus musculus
gagacgtttcattccttcgttcaag

SEQ ID NO: 470632 - DNA, 25 bp, Mus musculus
gagactaaacacacccacctattta

SEQ ID NO: 470633 - DNA, 25 bp, Mus musculus
gagactaaacactcccacctattta

SEQ ID NO: 470634 - DNA, 25 bp, Mus musculus
gagactaaacggcaagcgcagccca

SEQ ID NO: 470635 - DNA, 25 bp, Mus musculus
gagactaaacgggaagcgcagccca

SEQ ID NO: 470636 - DNA, 25 bp, Mus musculus
gagactaacatgaacgaaggtgtag

SEQ ID NO: 470637 - DNA, 25 bp, Mus musculus
gagactaacatgtacgaaggtgtag

SEQ ID NO: 470638 - DNA, 25 bp, Mus musculus
gagactaaccgcctgttatgttttc

SEQ ID NO: 470639 - DNA, 25 bp, Mus musculus
gagactaaccgcgtgttatgttttc

SEQ ID NO: 470640 - DNA, 25 bp, Mus musculus
gagactaaggctacacagctcattg

SEQ ID NO: 470641 - DNA, 25 bp, Mus musculus
gagactaaggcttcacagctcattg

SEQ ID NO: 470642 - DNA, 25 bp, Mus musculus
gagactaagtctcagttcacagtgg

SEQ ID NO: 470643 - DNA, 25 bp, Mus musculus
gagactaagtctcgaagcccccagc

SEQ ID NO: 470644 - DNA, 25 bp, Mus musculus
gagactaagtctgagttcacagtgg

SEQ ID NO: 470645 - DNA, 25 bp, Mus musculus
gagactaagtctggaagcccccagc

SEQ ID NO: 470646 - DNA, 25 bp, Mus musculus
gagactaattatctccgtgacactg

SEQ ID NO: 470647 - DNA, 25 bp, Mus musculus
gagactaattatgtccgtgacactg

SEQ ID NO: 470648 - DNA, 25 bp, Mus musculus
gagactacaaccctatcctacacat

SEQ ID NO: 470649 - DNA, 25 bp, Mus musculus
gagactacaaccgtatcctacacat

SEQ ID NO: 470650 - DNA, 25 bp, Mus musculus
gagactacacctcagaagccggctg

SEQ ID NO: 470651 - DNA, 25 bp, Mus musculus
gagactacacctgagaagccggctg

SEQ ID NO: 470652 - DNA, 25 bp, Mus musculus
gagactacactacgaagttgacctt

SEQ ID NO: 470653 - DNA, 25 bp, Mus musculus
gagactacactaggaagttgacctt

SEQ ID NO: 470654 - DNA, 25 bp, Mus musculus
gagactacagacatagccccaatta

SEQ ID NO: 470655 - DNA, 25 bp, Mus musculus
gagactacagacttagccccaatta

SEQ ID NO: 470656 - DNA, 25 bp, Mus musculus
gagactacagcaacttgggaaccct

SEQ ID NO: 470657 - DNA, 25 bp, Mus musculus
gagactacagcatcttgggaaccct

SEQ ID NO: 470658 - DNA, 25 bp, Mus musculus
gagactacaggtagcctgccctgga

SEQ ID NO: 470659 - DNA, 25 bp, Mus musculus
gagactacaggtctgggtccaccgc

SEQ ID NO: 470660 - DNA, 25 bp, Mus musculus
gagactacaggtgtgggtccaccgc

SEQ ID NO: 470661 - DNA, 25 bp, Mus musculus
gagactacaggttgcctgccctgga

SEQ ID NO: 470662 - DNA, 25 bp, Mus musculus
gagactaccagaatgctatgcgggt

SEQ ID NO: 470663 - DNA, 25 bp, Mus musculus
gagactaccagattgctatgcgggt

SEQ ID NO: 470664 - DNA, 25 bp, Mus musculus
gagactacctatctaactgggacat

SEQ ID NO: 470665 - DNA, 25 bp, Mus musculus
gagactacctatgtaactgggacat

SEQ ID NO: 470666 - DNA, 25 bp, Mus musculus
gagactacctgtctgtgcagtggtt

SEQ ID NO: 470667 - DNA, 25 bp, Mus musculus
gagactacctgtgtgtgcagtggtt

SEQ ID NO: 470668 - DNA, 25 bp, Mus musculus
gagactacggcacgatctaatattc

SEQ ID NO: 470669 - DNA, 25 bp, Mus musculus
gagactacggcaggatctaatattc

SEQ ID NO: 470670 - DNA, 25 bp, Mus musculus
gagactacgttcagtcttggtgact

SEQ ID NO: 470671 - DNA, 25 bp, Mus musculus
gagactacgttctgtcttggtgact

SEQ ID NO: 470672 - DNA, 25 bp, Mus musculus
gagactactcatattctgttgacag

SEQ ID NO: 470673 - DNA, 25 bp, Mus musculus
gagactactcattttctgttgacag

SEQ ID NO: 470674 - DNA, 25 bp, Mus musculus
gagactactctgcattactgtaaat

SEQ ID NO: 470675 - DNA, 25 bp, Mus musculus
gagactactctggattactgtaaat

SEQ ID NO: 470676 - DNA, 25 bp, Mus musculus
gagactactgtccatactgaacttt

SEQ ID NO: 470677 - DNA, 25 bp, Mus musculus
gagactactgtcgatactgaacttt

SEQ ID NO: 470678 - DNA, 25 bp, Mus musculus
gagactactgttagcccttgtatct

SEQ ID NO: 470679 - DNA, 25 bp, Mus musculus
gagactactgtttgcccttgtatct

SEQ ID NO: 470680 - DNA, 25 bp, Mus musculus
gagactactttacgtatctttctga

SEQ ID NO: 470681 - DNA, 25 bp, Mus musculus
gagactactttaggtatctttctga

SEQ ID NO: 470682 - DNA, 25 bp, Mus musculus
gagactagagtcagtcgcctcttga

SEQ ID NO: 470683 - DNA, 25 bp, Mus musculus
gagactagagtctgtcgcctcttga

SEQ ID NO: 470684 - DNA, 25 bp, Mus musculus
gagactagatgacttgaaacggatt

SEQ ID NO: 470685 - DNA, 25 bp, Mus musculus
gagactagatgagttgaaacggatt

SEQ ID NO: 470686 - DNA, 25 bp, Mus musculus
gagactagcaacagcaatggctgga

SEQ ID NO: 470687 - DNA, 25 bp, Mus musculus
gagactagcaactgcaatggctgga

SEQ ID NO: 470688 - DNA, 25 bp, Mus musculus
gagactagcctcagaaaacctattg

SEQ ID NO: 470689 - DNA, 25 bp, Mus musculus
gagactagcctctgaaaacctattg

SEQ ID NO: 470690 - DNA, 25 bp, Mus musculus
gagactagctggcttgctcctgcac

SEQ ID NO: 470691 - DNA, 25 bp, Mus musculus
gagactagctgggttgctcctgcac

SEQ ID NO: 470692 - DNA, 25 bp, Mus musculus
gagactaggacgagctgttttttaa

SEQ ID NO: 470693 - DNA, 25 bp, Mus musculus
gagactaggacgtgctgttttttaa

SEQ ID NO: 470694 - DNA, 25 bp, Mus musculus
gagactaggcagctcattgagaatc

SEQ ID NO: 470695 - DNA, 25 bp, Mus musculus
gagactaggcaggtcattgagaatc

SEQ ID NO: 470696 - DNA, 25 bp, Mus musculus
gagactaggcctcaactgtgtcata

SEQ ID NO: 470697 - DNA, 25 bp, Mus musculus
gagactaggcctgaactgtgtcata

SEQ ID NO: 470698 - DNA, 25 bp, Mus musculus
gagactaggtttcttctatgtagcc

SEQ ID NO: 470699 - DNA, 25 bp, Mus musculus
gagactaggtttgttctatgtagcc

SEQ ID NO: 470700 - DNA, 25 bp, Mus musculus
gagactagtccacattcagagctga

SEQ ID NO: 470701 - DNA, 25 bp, Mus musculus
gagactagtccagattcagagctga

SEQ ID NO: 470702 - DNA, 25 bp, Mus musculus
gagactagttacctgttttctcaaa

SEQ ID NO: 470703 - DNA, 25 bp, Mus musculus
gagactagttacgtgttttctcaaa

SEQ ID NO: 470704 - DNA, 25 bp, Mus musculus
gagactataatcatgctgctgtaaa

SEQ ID NO: 470705 - DNA, 25 bp, Mus musculus
gagactataatcttgctgctgtaaa

SEQ ID NO: 470706 - DNA, 25 bp, Mus musculus
gagactatccttatcctttgggtca

SEQ ID NO: 470707 - DNA, 25 bp, Mus musculus
gagactatccttcctggagtgcctg

SEQ ID NO: 470708 - DNA, 25 bp, Mus musculus
gagactatccttgctggagtgcctg

SEQ ID NO: 470709 - DNA, 25 bp, Mus musculus
gagactatccttttcctttgggtca

SEQ ID NO: 470710 - DNA, 25 bp, Mus musculus
gagactatcgcaacttcaacaagac

SEQ ID NO: 470711 - DNA, 25 bp, Mus musculus
gagactatcgcatcttcaacaagac

SEQ ID NO: 470712 - DNA, 25 bp, Mus musculus
gagactatctagattctgtaggtta

SEQ ID NO: 470713 - DNA, 25 bp, Mus musculus
gagactatctagtttctgtaggtta

SEQ ID NO: 470714 - DNA, 25 bp, Mus musculus
gagactatgcctatacttacacatg

SEQ ID NO: 470715 - DNA, 25 bp, Mus musculus
gagactatgcctttacttacacatg

SEQ ID NO: 470716 - DNA, 25 bp, Mus musculus
gagactatgctaccaagactgctta

SEQ ID NO: 470717 - DNA, 25 bp, Mus musculus
gagactatgctagcaagactgctta

SEQ ID NO: 470718 - DNA, 25 bp, Mus musculus
gagactatgctcaatccttgaatca

SEQ ID NO: 470719 - DNA, 25 bp, Mus musculus
gagactatgctctatccttgaatca

SEQ ID NO: 470720 - DNA, 25 bp, Mus musculus
gagactatggcaatccaaggtccaa

SEQ ID NO: 470721 - DNA, 25 bp, Mus musculus
gagactatggcattccaaggtccaa

SEQ ID NO: 470722 - DNA, 25 bp, Mus musculus
gagactatgggtctgtttcacacca

SEQ ID NO: 470723 - DNA, 25 bp, Mus musculus
gagactatgggtgtgtttcacacca

SEQ ID NO: 470724 - DNA, 25 bp, Mus musculus
gagactatgtatctaaagtatctag

SEQ ID NO: 470725 - DNA, 25 bp, Mus musculus
gagactatgtatgtaaagtatctag

SEQ ID NO: 470726 - DNA, 25 bp, Mus musculus
gagactattactccgatgggacatt

SEQ ID NO: 470727 - DNA, 25 bp, Mus musculus
gagactattactgcgatgggacatt

SEQ ID NO: 470728 - DNA, 25 bp, Mus musculus
gagactattagcatgggagatgttc

SEQ ID NO: 470729 - DNA, 25 bp, Mus musculus
gagactattagcttgggagatgttc

SEQ ID NO: 470730 - DNA, 25 bp, Mus musculus
gagactattattacttaccacctag

SEQ ID NO: 470731 - DNA, 25 bp, Mus musculus
gagactattatttcttaccacctag

SEQ ID NO: 470732 - DNA, 25 bp, Mus musculus
gagactattctgcagctataaaatt

SEQ ID NO: 470733 - DNA, 25 bp, Mus musculus
gagactattctggagctataaaatt

SEQ ID NO: 470734 - DNA, 25 bp, Mus musculus
gagactatttgcagtatgtacacca

SEQ ID NO: 470735 - DNA, 25 bp, Mus musculus
gagactatttgctgtatgtacacca

SEQ ID NO: 470736 - DNA, 25 bp, Mus musculus
gagactattttcactgctactggag

SEQ ID NO: 470737 - DNA, 25 bp, Mus musculus
gagactattttctctgctactggag

SEQ ID NO: 470738 - DNA, 25 bp, Mus musculus
gagactatttttctatccacatggg

SEQ ID NO: 470739 - DNA, 25 bp, Mus musculus
gagactatttttgtatccacatggg

SEQ ID NO: 470740 - DNA, 25 bp, Mus musculus
gagactcaaagcagctcggaaactt

SEQ ID NO: 470741 - DNA, 25 bp, Mus musculus
gagactcaaagctgctcggaaactt

SEQ ID NO: 470742 - DNA, 25 bp, Mus musculus
gagactcaacaaagtggccatggtg

SEQ ID NO: 470743 - DNA, 25 bp, Mus musculus
gagactcaacaatgtggccatggtg

SEQ ID NO: 470744 - DNA, 25 bp, Mus musculus
gagactcaagccatggttctgcaga

SEQ ID NO: 470745 - DNA, 25 bp, Mus musculus
gagactcaagccttggttctgcaga

SEQ ID NO: 470746 - DNA, 25 bp, Mus musculus
gagactcaaggccagtcaacccatg

SEQ ID NO: 470747 - DNA, 25 bp, Mus musculus
gagactcaaggcgagtcaacccatg

SEQ ID NO: 470748 - DNA, 25 bp, Mus musculus
gagactcacaataggcactgttttc

SEQ ID NO: 470749 - DNA, 25 bp, Mus musculus
gagactcacaattggcactgttttc

SEQ ID NO: 470750 - DNA, 25 bp, Mus musculus
gagactcacattataaatatgccag

SEQ ID NO: 470751 - DNA, 25 bp, Mus musculus
gagactcacattttaaatatgccag

SEQ ID NO: 470752 - DNA, 25 bp, Mus musculus
gagactcacgtgagcatctcagcca

SEQ ID NO: 470753 - DNA, 25 bp, Mus musculus
gagactcacgtgtgcatctcagcca

SEQ ID NO: 470754 - DNA, 25 bp, Mus musculus
gagactcactaactggcttttggac

SEQ ID NO: 470755 - DNA, 25 bp, Mus musculus
gagactcactaagtggcttttggac

SEQ ID NO: 470756 - DNA, 25 bp, Mus musculus
gagactcacttcatggccatgacat

SEQ ID NO: 470757 - DNA, 25 bp, Mus musculus
gagactcacttcttggccatgacat

SEQ ID NO: 470758 - DNA, 25 bp, Mus musculus
gagactcactttccagacatgtatt

SEQ ID NO: 470759 - DNA, 25 bp, Mus musculus
gagactcactttgcagacatgtatt

SEQ ID NO: 470760 - DNA, 25 bp, Mus musculus
gagactcagagtaaccacaacggca

SEQ ID NO: 470761 - DNA, 25 bp, Mus musculus
gagactcagagttaccacaacggca

SEQ ID NO: 470762 - DNA, 25 bp, Mus musculus
gagactcagcaacaggttcttctat

SEQ ID NO: 470763 - DNA, 25 bp, Mus musculus
gagactcagcaagaggttcttctat

SEQ ID NO: 470764 - DNA, 25 bp, Mus musculus
gagactcagccccaggaaatcgcag

SEQ ID NO: 470765 - DNA, 25 bp, Mus musculus
gagactcagcccgaggaaatcgcag

SEQ ID NO: 470766 - DNA, 25 bp, Mus musculus
gagactcagctcatcctagatcaac

SEQ ID NO: 470767 - DNA, 25 bp, Mus musculus
gagactcagctcttcctagatcaac

SEQ ID NO: 470768 - DNA, 25 bp, Mus musculus
gagactcagctgagtgagctccgct

SEQ ID NO: 470769 - DNA, 25 bp, Mus musculus
gagactcagctgtgtgagctccgct

SEQ ID NO: 470770 - DNA, 25 bp, Mus musculus
gagactcaggagccccactgatctg

SEQ ID NO: 470771 - DNA, 25 bp, Mus musculus
gagactcaggaggcccactgatctg

SEQ ID NO: 470772 - DNA, 25 bp, Mus musculus
gagactcaggcaacaagcagcacct

SEQ ID NO: 470773 - DNA, 25 bp, Mus musculus
gagactcaggcaatccccgaatcgt

SEQ ID NO: 470774 - DNA, 25 bp, Mus musculus
gagactcaggcatcaagcagcacct

SEQ ID NO: 470775 - DNA, 25 bp, Mus musculus
gagactcaggcattccccgaatcgt

SEQ ID NO: 470776 - DNA, 25 bp, Mus musculus
gagactcaggccacagtttctttat

SEQ ID NO: 470777 - DNA, 25 bp, Mus musculus
gagactcaggcctcagtttctttat

SEQ ID NO: 470778 - DNA, 25 bp, Mus musculus
gagactcagtatctacaacaaaaag

SEQ ID NO: 470779 - DNA, 25 bp, Mus musculus
gagactcagtatgtacaacaaaaag

SEQ ID NO: 470780 - DNA, 25 bp, Mus musculus
gagactcagtcaaggtcatcatttt

SEQ ID NO: 470781 - DNA, 25 bp, Mus musculus
gagactcagtcatggtcatcatttt

SEQ ID NO: 470782 - DNA, 25 bp, Mus musculus
gagactcagtctagcgaagaagcca

SEQ ID NO: 470783 - DNA, 25 bp, Mus musculus
gagactcagtcttgcgaagaagcca

SEQ ID NO: 470784 - DNA, 25 bp, Mus musculus
gagactcagtttaccttagtgcctt

SEQ ID NO: 470785 - DNA, 25 bp, Mus musculus
gagactcagttttccttagtgcctt

SEQ ID NO: 470786 - DNA, 25 bp, Mus musculus
gagactcatataatcagggttacat

SEQ ID NO: 470787 - DNA, 25 bp, Mus musculus
gagactcatatattcagggttacat

SEQ ID NO: 470788 - DNA, 25 bp, Mus musculus
gagactcatcctcaacacagctgaa

SEQ ID NO: 470789 - DNA, 25 bp, Mus musculus
gagactcatcctgaacacagctgaa

SEQ ID NO: 470790 - DNA, 25 bp, Mus musculus
gagactcatctaactctcttacata

SEQ ID NO: 470791 - DNA, 25 bp, Mus musculus
gagactcatctaatcaacctcactg

SEQ ID NO: 470792 - DNA, 25 bp, Mus musculus
gagactcatctatctctcttacata

SEQ ID NO: 470793 - DNA, 25 bp, Mus musculus
gagactcatctattcaacctcactg

SEQ ID NO: 470794 - DNA, 25 bp, Mus musculus
gagactcatgaaactcaactgtgac

SEQ ID NO: 470795 - DNA, 25 bp, Mus musculus
gagactcatgaatctcaactgtgac

SEQ ID NO: 470796 - DNA, 25 bp, Mus musculus
gagactcattatctgcagtgctgat

SEQ ID NO: 470797 - DNA, 25 bp, Mus musculus
gagactcattatgtgcagtgctgat

SEQ ID NO: 470798 - DNA, 25 bp, Mus musculus
gagactccaatcaaaactcctcttt

SEQ ID NO: 470799 - DNA, 25 bp, Mus musculus
gagactccaatctaaactcctcttt

SEQ ID NO: 470800 - DNA, 25 bp, Mus musculus
gagactccaatgaagtacctcacta

SEQ ID NO: 470801 - DNA, 25 bp, Mus musculus
gagactccaatgtagtacctcacta

SEQ ID NO: 470802 - DNA, 25 bp, Mus musculus
gagactccactgaaaccaaggtatg

SEQ ID NO: 470803 - DNA, 25 bp, Mus musculus
gagactccactgtaaccaaggtatg

SEQ ID NO: 470804 - DNA, 25 bp, Mus musculus
gagactccagctactgtgggaacat

SEQ ID NO: 470805 - DNA, 25 bp, Mus musculus
gagactccagcttctgtgggaacat

SEQ ID NO: 470806 - DNA, 25 bp, Mus musculus
gagactccaggaagctacaagacac

SEQ ID NO: 470807 - DNA, 25 bp, Mus musculus
gagactccaggatgctacaagacac

SEQ ID NO: 470808 - DNA, 25 bp, Mus musculus
gagactccagttccagcagcctatg

SEQ ID NO: 470809 - DNA, 25 bp, Mus musculus
gagactccagttgcagcagcctatg

SEQ ID NO: 470810 - DNA, 25 bp, Mus musculus
gagactccatacaggcgagcagctt

SEQ ID NO: 470811 - DNA, 25 bp, Mus musculus
gagactccatactggcgagcagctt

SEQ ID NO: 470812 - DNA, 25 bp, Mus musculus
gagactcccatacttcctggtgagt

SEQ ID NO: 470813 - DNA, 25 bp, Mus musculus
gagactcccatagttcctggtgagt

SEQ ID NO: 470814 - DNA, 25 bp, Mus musculus
gagactcccattcggctagtaccaa

SEQ ID NO: 470815 - DNA, 25 bp, Mus musculus
gagactcccattgggctagtaccaa

SEQ ID NO: 470816 - DNA, 25 bp, Mus musculus
gagactccccatccaatctgaatga

SEQ ID NO: 470817 - DNA, 25 bp, Mus musculus
gagactccccatgcaatctgaatga

SEQ ID NO: 470818 - DNA, 25 bp, Mus musculus
gagactccctagcagggtttcatag

SEQ ID NO: 470819 - DNA, 25 bp, Mus musculus
gagactccctaggagggtttcatag

SEQ ID NO: 470820 - DNA, 25 bp, Mus musculus
gagactccctctctgaatgtaattc

SEQ ID NO: 470821 - DNA, 25 bp, Mus musculus
gagactccctctgtgaatgtaattc

SEQ ID NO: 470822 - DNA, 25 bp, Mus musculus
gagactccctgaaatggttcaccta

SEQ ID NO: 470823 - DNA, 25 bp, Mus musculus
gagactccctgaatgctttactatc

SEQ ID NO: 470824 - DNA, 25 bp, Mus musculus
gagactccctgacaaagcacaacaa

SEQ ID NO: 470825 - DNA, 25 bp, Mus musculus
gagactccctgagaaagcacaacaa

SEQ ID NO: 470826 - DNA, 25 bp, Mus musculus
gagactccctgatatggttcaccta

SEQ ID NO: 470827 - DNA, 25 bp, Mus musculus
gagactccctgattgctttactatc

SEQ ID NO: 470828 - DNA, 25 bp, Mus musculus
gagactccgagaatgggcaccagac

SEQ ID NO: 470829 - DNA, 25 bp, Mus musculus
gagactccgagattgggcaccagac

SEQ ID NO: 470830 - DNA, 25 bp, Mus musculus
gagactccgatcatggaacagaagg

SEQ ID NO: 470831 - DNA, 25 bp, Mus musculus
gagactccgatcttggaacagaagg

SEQ ID NO: 470832 - DNA, 25 bp, Mus musculus
gagactccggagaggctcttccgca

SEQ ID NO: 470833 - DNA, 25 bp, Mus musculus
gagactccggagtggctcttccgca

SEQ ID NO: 470834 - DNA, 25 bp, Mus musculus
gagactccggctccaaggacttttt

SEQ ID NO: 470835 - DNA, 25 bp, Mus musculus
gagactccggctgcaaggacttttt

SEQ ID NO: 470836 - DNA, 25 bp, Mus musculus
gagactccgtagattttctgagaga

SEQ ID NO: 470837 - DNA, 25 bp, Mus musculus
gagactccgtagtttttctgagaga

SEQ ID NO: 470838 - DNA, 25 bp, Mus musculus
gagactcctccacactttgaattag

SEQ ID NO: 470839 - DNA, 25 bp, Mus musculus
gagactcctccagactttgaattag

SEQ ID NO: 470840 - DNA, 25 bp, Mus musculus
gagactcctcttacagaactacact

SEQ ID NO: 470841 - DNA, 25 bp, Mus musculus
gagactcctctttcagaactacact

SEQ ID NO: 470842 - DNA, 25 bp, Mus musculus
gagactcctgacctggaccctgagc

SEQ ID NO: 470843 - DNA, 25 bp, Mus musculus
gagactcctgacgtggaccctgagc

SEQ ID NO: 470844 - DNA, 25 bp, Mus musculus
gagactcctgtcatgtgctgtaggt

SEQ ID NO: 470845 - DNA, 25 bp, Mus musculus
gagactcctgtcttgtgctgtaggt

SEQ ID NO: 470846 - DNA, 25 bp, Mus musculus
gagactccttagatattgttccata

SEQ ID NO: 470847 - DNA, 25 bp, Mus musculus
gagactccttagttattgttccata

SEQ ID NO: 470848 - DNA, 25 bp, Mus musculus
gagactccttatatagtccagacta

SEQ ID NO: 470849 - DNA, 25 bp, Mus musculus
gagactccttatttagtccagacta

SEQ ID NO: 470850 - DNA, 25 bp, Mus musculus
gagactccttgcattccgtcagata

SEQ ID NO: 470851 - DNA, 25 bp, Mus musculus
gagactccttgctttccgtcagata

SEQ ID NO: 470852 - DNA, 25 bp, Mus musculus
gagactcgaaacatgattctaccct

SEQ ID NO: 470853 - DNA, 25 bp, Mus musculus
gagactcgaaacttgattctaccct

SEQ ID NO: 470854 - DNA, 25 bp, Mus musculus
gagactcgaaatccggcctggagaa

SEQ ID NO: 470855 - DNA, 25 bp, Mus musculus
gagactcgaaatgcggcctggagaa

SEQ ID NO: 470856 - DNA, 25 bp, Mus musculus
gagactcgagaccaccttactttat

SEQ ID NO: 470857 - DNA, 25 bp, Mus musculus
gagactcgagacgaccttactttat

SEQ ID NO: 470858 - DNA, 25 bp, Mus musculus
gagactcgcacacccatagagctca

SEQ ID NO: 470859 - DNA, 25 bp, Mus musculus
gagactcgcacagccatagagctca

SEQ ID NO: 470860 - DNA, 25 bp, Mus musculus
gagactcgccatattgtgcggcggc

SEQ ID NO: 470861 - DNA, 25 bp, Mus musculus
gagactcgccattttgtgcggcggc

SEQ ID NO: 470862 - DNA, 25 bp, Mus musculus
gagactcgcctgatcaggacatcga

SEQ ID NO: 470863 - DNA, 25 bp, Mus musculus
gagactcgcctgttcaggacatcga

SEQ ID NO: 470864 - DNA, 25 bp, Mus musculus
gagactcggcagattatcctgctga

SEQ ID NO: 470865 - DNA, 25 bp, Mus musculus
gagactcggcagtttatcctgctga

SEQ ID NO: 470866 - DNA, 25 bp, Mus musculus
gagactcgggcgacggcaaaacctg

SEQ ID NO: 470867 - DNA, 25 bp, Mus musculus
gagactcgggcgtcggcaaaacctg

SEQ ID NO: 470868 - DNA, 25 bp, Mus musculus
gagactcggtcaaaatggaactgca

SEQ ID NO: 470869 - DNA, 25 bp, Mus musculus
gagactcggtcataatggaactgca

SEQ ID NO: 470870 - DNA, 25 bp, Mus musculus
gagactcggtgaaagctggttcata

SEQ ID NO: 470871 - DNA, 25 bp, Mus musculus
gagactcggtgatagctggttcata

SEQ ID NO: 470872 - DNA, 25 bp, Mus musculus
gagactcggtgtaagataacggact

SEQ ID NO: 470873 - DNA, 25 bp, Mus musculus
gagactcggtgttagataacggact

SEQ ID NO: 470874 - DNA, 25 bp, Mus musculus
gagactcgttctcttgaagcttggg

SEQ ID NO: 470875 - DNA, 25 bp, Mus musculus
gagactcgttctgttgaagcttggg

SEQ ID NO: 470876 - DNA, 25 bp, Mus musculus
gagactctagagaggctcttctgca

SEQ ID NO: 470877 - DNA, 25 bp, Mus musculus
gagactctagagtggctcttctgca

SEQ ID NO: 470878 - DNA, 25 bp, Mus musculus
gagactctatctcttgtaagctctc

SEQ ID NO: 470879 - DNA, 25 bp, Mus musculus
gagactctatctgttgtaagctctc

SEQ ID NO: 470880 - DNA, 25 bp, Mus musculus
gagactctcaaacttaaccctattc

SEQ ID NO: 470881 - DNA, 25 bp, Mus musculus
gagactctcaaagttaaccctattc

SEQ ID NO: 470882 - DNA, 25 bp, Mus musculus
gagactctcaagacaccgtaataga

SEQ ID NO: 470883 - DNA, 25 bp, Mus musculus
gagactctcaagtcaccgtaataga

SEQ ID NO: 470884 - DNA, 25 bp, Mus musculus
gagactctcacaatgcagcaacagc

SEQ ID NO: 470885 - DNA, 25 bp, Mus musculus
gagactctcacattgcagcaacagc

SEQ ID NO: 470886 - DNA, 25 bp, Mus musculus
gagactctcatactccctttctgac

SEQ ID NO: 470887 - DNA, 25 bp, Mus musculus
gagactctcatagtccctttctgac

SEQ ID NO: 470888 - DNA, 25 bp, Mus musculus
gagactctccagaacgacatgggta

SEQ ID NO: 470889 - DNA, 25 bp, Mus musculus
gagactctccagtacgacatgggta

SEQ ID NO: 470890 - DNA, 25 bp, Mus musculus
gagactctcttgattccccacttga

SEQ ID NO: 470891 - DNA, 25 bp, Mus musculus
gagactctcttgtttccccacttga

SEQ ID NO: 470892 - DNA, 25 bp, Mus musculus
gagactctgaaaaccttttctggta

SEQ ID NO: 470893 - DNA, 25 bp, Mus musculus
gagactctgaaaagcactaaattgt

SEQ ID NO: 470894 - DNA, 25 bp, Mus musculus
gagactctgaaatccttttctggta

SEQ ID NO: 470895 - DNA, 25 bp, Mus musculus
gagactctgaaatgcactaaattgt

SEQ ID NO: 470896 - DNA, 25 bp, Mus musculus
gagactctgagtatccatgttaatg

SEQ ID NO: 470897 - DNA, 25 bp, Mus musculus
gagactctgagtatgtggctatcct

SEQ ID NO: 470898 - DNA, 25 bp, Mus musculus
gagactctgagtttccatgttaatg

SEQ ID NO: 470899 - DNA, 25 bp, Mus musculus
gagactctgagtttgtggctatcct

SEQ ID NO: 470900 - DNA, 25 bp, Mus musculus
gagactctgcctacgtggagccaaa

SEQ ID NO: 470901 - DNA, 25 bp, Mus musculus
gagactctgccttcgtggagccaaa

SEQ ID NO: 470902 - DNA, 25 bp, Mus musculus
gagactctgctcatatcctgaggac

SEQ ID NO: 470903 - DNA, 25 bp, Mus musculus
gagactctgctcttatcctgaggac

SEQ ID NO: 470904 - DNA, 25 bp, Mus musculus
gagactctggaaactctgatgtcca

SEQ ID NO: 470905 - DNA, 25 bp, Mus musculus
gagactctggaacactcgaagttca

SEQ ID NO: 470906 - DNA, 25 bp, Mus musculus
gagactctggaagactcgaagttca

SEQ ID NO: 470907 - DNA, 25 bp, Mus musculus
gagactctggaatctctgatgtcca

SEQ ID NO: 470908 - DNA, 25 bp, Mus musculus
gagactctggagaactctatcctaa

SEQ ID NO: 470909 - DNA, 25 bp, Mus musculus
gagactctggagtactctatcctaa

SEQ ID NO: 470910 - DNA, 25 bp, Mus musculus
gagactctggcaagctaactagtta

SEQ ID NO: 470911 - DNA, 25 bp, Mus musculus
gagactctggcatgctaactagtta

SEQ ID NO: 470912 - DNA, 25 bp, Mus musculus
gagactctggccacagatctcaggc

SEQ ID NO: 470913 - DNA, 25 bp, Mus musculus
gagactctggcctcagatctcaggc

SEQ ID NO: 470914 - DNA, 25 bp, Mus musculus
gagactctgtgcaaaccaagtgact

SEQ ID NO: 470915 - DNA, 25 bp, Mus musculus
gagactctgtgctaaccaagtgact

SEQ ID NO: 470916 - DNA, 25 bp, Mus musculus
gagactcttaagattgatacccagc

SEQ ID NO: 470917 - DNA, 25 bp, Mus musculus
gagactcttaagtttgatacccagc

SEQ ID NO: 470918 - DNA, 25 bp, Mus musculus
gagactcttacaatcagaaggtgca

SEQ ID NO: 470919 - DNA, 25 bp, Mus musculus
gagactcttacattcagaaggtgca

SEQ ID NO: 470920 - DNA, 25 bp, Mus musculus
gagactcttacgaaggtgtgttcta

SEQ ID NO: 470921 - DNA, 25 bp, Mus musculus
gagactcttacgtaggtgtgttcta

SEQ ID NO: 470922 - DNA, 25 bp, Mus musculus
gagactcttcatatggatggtccac

SEQ ID NO: 470923 - DNA, 25 bp, Mus musculus
gagactcttcatttggatggtccac

SEQ ID NO: 470924 - DNA, 25 bp, Mus musculus
gagactcttctgacctaggctttaa

SEQ ID NO: 470925 - DNA, 25 bp, Mus musculus
gagactcttctgtcctaggctttaa

SEQ ID NO: 470926 - DNA, 25 bp, Mus musculus
gagactcttcttaaatgctgctaaa

SEQ ID NO: 470927 - DNA, 25 bp, Mus musculus
gagactcttctttaatgctgctaaa

SEQ ID NO: 470928 - DNA, 25 bp, Mus musculus
gagactcttgagaggttgctctgaa

SEQ ID NO: 470929 - DNA, 25 bp, Mus musculus
gagactcttgagtggttgctctgaa

SEQ ID NO: 470930 - DNA, 25 bp, Mus musculus
gagactcttgccaggtctaggtcat

SEQ ID NO: 470931 - DNA, 25 bp, Mus musculus
gagactcttgcctggtctaggtcat

SEQ ID NO: 470932 - DNA, 25 bp, Mus musculus
gagactctttctccatgaacaatgt

SEQ ID NO: 470933 - DNA, 25 bp, Mus musculus
gagactctttctgcatgaacaatgt

SEQ ID NO: 470934 - DNA, 25 bp, Mus musculus
gagactctttgtcagtcattccaaa

SEQ ID NO: 470935 - DNA, 25 bp, Mus musculus
gagactctttgtgagtcattccaaa

SEQ ID NO: 470936 - DNA, 25 bp, Mus musculus
gagactgaaacaatccatttgagag

SEQ ID NO: 470937 - DNA, 25 bp, Mus musculus
gagactgaaacattccatttgagag

SEQ ID NO: 470938 - DNA, 25 bp, Mus musculus
gagactgaaagcattcgctcccatt

SEQ ID NO: 470939 - DNA, 25 bp, Mus musculus
gagactgaaagctttcgctcccatt

SEQ ID NO: 470940 - DNA, 25 bp, Mus musculus
gagactgaacacacttatcagctta

SEQ ID NO: 470941 - DNA, 25 bp, Mus musculus
gagactgaacactcttatcagctta

SEQ ID NO: 470942 - DNA, 25 bp, Mus musculus
gagactgaactccactgtatgaaag

SEQ ID NO: 470943 - DNA, 25 bp, Mus musculus
gagactgaactcgactgtatgaaag

SEQ ID NO: 470944 - DNA, 25 bp, Mus musculus
gagactgaagagagacgtccgcttt

SEQ ID NO: 470945 - DNA, 25 bp, Mus musculus
gagactgaagagtgacgtccgcttt

SEQ ID NO: 470946 - DNA, 25 bp, Mus musculus
gagactgaagctagtgtccataaca

SEQ ID NO: 470947 - DNA, 25 bp, Mus musculus
gagactgaagcttgtgtccataaca

SEQ ID NO: 470948 - DNA, 25 bp, Mus musculus
gagactgaagtcacttgtccctctt

SEQ ID NO: 470949 - DNA, 25 bp, Mus musculus
gagactgaagtctcttgtccctctt

SEQ ID NO: 470950 - DNA, 25 bp, Mus musculus
gagactgaagttattaacctcaaca

SEQ ID NO: 470951 - DNA, 25 bp, Mus musculus
gagactgaagtttttaacctcaaca

SEQ ID NO: 470952 - DNA, 25 bp, Mus musculus
gagactgaatacaatcctggcgagg

SEQ ID NO: 470953 - DNA, 25 bp, Mus musculus
gagactgaatactatcctggcgagg

SEQ ID NO: 470954 - DNA, 25 bp, Mus musculus
gagactgaatatacgtaacagtttt

SEQ ID NO: 470955 - DNA, 25 bp, Mus musculus
gagactgaatattcgtaacagtttt

SEQ ID NO: 470956 - DNA, 25 bp, Mus musculus
gagactgaatctccatcctgggtag

SEQ ID NO: 470957 - DNA, 25 bp, Mus musculus
gagactgaatctgcatcctgggtag

SEQ ID NO: 470958 - DNA, 25 bp, Mus musculus
gagactgaatttagaatgtaacaca

SEQ ID NO: 470959 - DNA, 25 bp, Mus musculus
gagactgaattttgaatgtaacaca

SEQ ID NO: 470960 - DNA, 25 bp, Mus musculus
gagactgacacccatagatgcttcc

SEQ ID NO: 470961 - DNA, 25 bp, Mus musculus
gagactgacaccgatagatgcttcc

SEQ ID NO: 470962 - DNA, 25 bp, Mus musculus
gagactgacaggcttcgggaccttc

SEQ ID NO: 470963 - DNA, 25 bp, Mus musculus
gagactgacagggttcgggaccttc

SEQ ID NO: 470964 - DNA, 25 bp, Mus musculus
gagactgacattacaggatccatat

SEQ ID NO: 470965 - DNA, 25 bp, Mus musculus
gagactgacatttcaggatccatat

SEQ ID NO: 470966 - DNA, 25 bp, Mus musculus
gagactgaccaccaaatacctacta

SEQ ID NO: 470967 - DNA, 25 bp, Mus musculus
gagactgaccaccacatgtgagttt

SEQ ID NO: 470968 - DNA, 25 bp, Mus musculus
gagactgaccacgaaatacctacta

SEQ ID NO: 470969 - DNA, 25 bp, Mus musculus
gagactgaccacgacatgtgagttt

SEQ ID NO: 470970 - DNA, 25 bp, Mus musculus
gagactgacctactacttgtgggcc

SEQ ID NO: 470971 - DNA, 25 bp, Mus musculus
gagactgacctagtacttgtgggcc

SEQ ID NO: 470972 - DNA, 25 bp, Mus musculus
gagactgacgacaggctgaggactt

SEQ ID NO: 470973 - DNA, 25 bp, Mus musculus
gagactgacgactggctgaggactt

SEQ ID NO: 470974 - DNA, 25 bp, Mus musculus
gagactgacgccatgatcaagcaga

SEQ ID NO: 470975 - DNA, 25 bp, Mus musculus
gagactgacgccttgatcaagcaga

SEQ ID NO: 470976 - DNA, 25 bp, Mus musculus
gagactgacgctcgtattttcctga

SEQ ID NO: 470977 - DNA, 25 bp, Mus musculus
gagactgacgctggtattttcctga

SEQ ID NO: 470978 - DNA, 25 bp, Mus musculus
gagactgactctaaaccaagaccct

SEQ ID NO: 470979 - DNA, 25 bp, Mus musculus
gagactgactcttaaccaagaccct

SEQ ID NO: 470980 - DNA, 25 bp, Mus musculus
gagactgagacactgttaatcatta

SEQ ID NO: 470981 - DNA, 25 bp, Mus musculus
gagactgagacagtgttaatcatta

SEQ ID NO: 470982 - DNA, 25 bp, Mus musculus
gagactgagactagagcagtggttc

SEQ ID NO: 470983 - DNA, 25 bp, Mus musculus
gagactgagacttgagcagtggttc

SEQ ID NO: 470984 - DNA, 25 bp, Mus musculus
gagactgagagactgtgtcctcccc

SEQ ID NO: 470985 - DNA, 25 bp, Mus musculus
gagactgagagagtgtgtcctcccc

SEQ ID NO: 470986 - DNA, 25 bp, Mus musculus
gagactgagcccaggctctcttaca

SEQ ID NO: 470987 - DNA, 25 bp, Mus musculus
gagactgagccctggctctcttaca

SEQ ID NO: 470988 - DNA, 25 bp, Mus musculus
gagactgagctcaagctttaggcgt

SEQ ID NO: 470989 - DNA, 25 bp, Mus musculus
gagactgagctctagctttaggcgt

SEQ ID NO: 470990 - DNA, 25 bp, Mus musculus
gagactgagctgaactgaagcccac

SEQ ID NO: 470991 - DNA, 25 bp, Mus musculus
gagactgagctgcagtccacaccca

SEQ ID NO: 470992 - DNA, 25 bp, Mus musculus
gagactgagctggagtccacaccca

SEQ ID NO: 470993 - DNA, 25 bp, Mus musculus
gagactgagctgtactgaagcccac

SEQ ID NO: 470994 - DNA, 25 bp, Mus musculus
gagactgagggcattcctttgctgc

SEQ ID NO: 470995 - DNA, 25 bp, Mus musculus
gagactgagggctttcctttgctgc

SEQ ID NO: 470996 - DNA, 25 bp, Mus musculus
gagactgaggtgaccttgaagtcat

SEQ ID NO: 470997 - DNA, 25 bp, Mus musculus
gagactgaggtgtccttgaagtcat

SEQ ID NO: 470998 - DNA, 25 bp, Mus musculus
gagactgagtcacatgccatgagtt

SEQ ID NO: 470999 - DNA, 25 bp, Mus musculus
gagactgagtcagatgccatgagtt

SEQ ID NO: 471000 - DNA, 25 bp, Mus musculus
gagactgagtctacacactggaatt

SEQ ID NO: 471001 - DNA, 25 bp, Mus musculus
gagactgagtcttcacactggaatt

SEQ ID NO: 471002 - DNA, 25 bp, Mus musculus
gagactgagtttaatctccagagga

SEQ ID NO: 471003 - DNA, 25 bp, Mus musculus
gagactgagttttatctccagagga

SEQ ID NO: 471004 - DNA, 25 bp, Mus musculus
gagactgatactaaggcccaggaaa

SEQ ID NO: 471005 - DNA, 25 bp, Mus musculus
gagactgatacttaggcccaggaaa

SEQ ID NO: 471006 - DNA, 25 bp, Mus musculus
gagactgatagcacagctttccctg

SEQ ID NO: 471007 - DNA, 25 bp, Mus musculus
gagactgatagctcagctttccctg

SEQ ID NO: 471008 - DNA, 25 bp, Mus musculus
gagactgatctcacacgaactagaa

SEQ ID NO: 471009 - DNA, 25 bp, Mus musculus
gagactgatctctcacgaactagaa

SEQ ID NO: 471010 - DNA, 25 bp, Mus musculus
gagactgatctgaggtcagttccct

SEQ ID NO: 471011 - DNA, 25 bp, Mus musculus
gagactgatctgtggtcagttccct

SEQ ID NO: 471012 - DNA, 25 bp, Mus musculus
gagactgatgttatttgtgtgacta

SEQ ID NO: 471013 - DNA, 25 bp, Mus musculus
gagactgatgttttttgtgtgacta

SEQ ID NO: 471014 - DNA, 25 bp, Mus musculus
gagactgcaacaacttaaatgactg

SEQ ID NO: 471015 - DNA, 25 bp, Mus musculus
gagactgcaacatcttaaatgactg

SEQ ID NO: 471016 - DNA, 25 bp, Mus musculus
gagactgcaactatcttgtcctaag

SEQ ID NO: 471017 - DNA, 25 bp, Mus musculus
gagactgcaactttcttgtcctaag

SEQ ID NO: 471018 - DNA, 25 bp, Mus musculus
gagactgcaattccgagatatacca

SEQ ID NO: 471019 - DNA, 25 bp, Mus musculus
gagactgcaattgcgagatatacca

SEQ ID NO: 471020 - DNA, 25 bp, Mus musculus
gagactgcacaaatatcctgtaaag

SEQ ID NO: 471021 - DNA, 25 bp, Mus musculus
gagactgcacaacacaatagccctg

SEQ ID NO: 471022 - DNA, 25 bp, Mus musculus
gagactgcacaagacaatagccctg

SEQ ID NO: 471023 - DNA, 25 bp, Mus musculus
gagactgcacaattatcctgtaaag

SEQ ID NO: 471024 - DNA, 25 bp, Mus musculus
gagactgcacctatgtctctctgct

SEQ ID NO: 471025 - DNA, 25 bp, Mus musculus
gagactgcacctttgtctctctgct

SEQ ID NO: 471026 - DNA, 25 bp, Mus musculus
gagactgcagacaagtcagcaccca

SEQ ID NO: 471027 - DNA, 25 bp, Mus musculus
gagactgcagactagtcagcaccca

SEQ ID NO: 471028 - DNA, 25 bp, Mus musculus
gagactgcaggcagactgactcaac

SEQ ID NO: 471029 - DNA, 25 bp, Mus musculus
gagactgcaggcatcaagtttccag

SEQ ID NO: 471030 - DNA, 25 bp, Mus musculus
gagactgcaggctgactgactcaac

SEQ ID NO: 471031 - DNA, 25 bp, Mus musculus
gagactgcaggcttcaagtttccag

SEQ ID NO: 471032 - DNA, 25 bp, Mus musculus
gagactgcagggagcagacaccaat

SEQ ID NO: 471033 - DNA, 25 bp, Mus musculus
gagactgcagggtgcagacaccaat

SEQ ID NO: 471034 - DNA, 25 bp, Mus musculus
gagactgcagtacccattctgcgct

SEQ ID NO: 471035 - DNA, 25 bp, Mus musculus
gagactgcagtagccattctgcgct

SEQ ID NO: 471036 - DNA, 25 bp, Mus musculus
gagactgcagtcaggctcacgtgtg

SEQ ID NO: 471037 - DNA, 25 bp, Mus musculus
gagactgcagtctggctcacgtgtg

SEQ ID NO: 471038 - DNA, 25 bp, Mus musculus
gagactgcatatacacgctgtcact

SEQ ID NO: 471039 - DNA, 25 bp, Mus musculus
gagactgcatattcacgctgtcact

SEQ ID NO: 471040 - DNA, 25 bp, Mus musculus
gagactgcatggctagttccctctg

SEQ ID NO: 471041 - DNA, 25 bp, Mus musculus
gagactgcatgggtagttccctctg

SEQ ID NO: 471042 - DNA, 25 bp, Mus musculus
gagactgccactatactgggcacag

SEQ ID NO: 471043 - DNA, 25 bp, Mus musculus
gagactgccactttactgggcacag

SEQ ID NO: 471044 - DNA, 25 bp, Mus musculus
gagactgccagcagacacctgacca

SEQ ID NO: 471045 - DNA, 25 bp, Mus musculus
gagactgccagctgacacctgacca

SEQ ID NO: 471046 - DNA, 25 bp, Mus musculus
gagactgcccagcactgaagtccat

SEQ ID NO: 471047 - DNA, 25 bp, Mus musculus
gagactgcccagctttgcctgggaa

SEQ ID NO: 471048 - DNA, 25 bp, Mus musculus
gagactgcccaggactgaagtccat

SEQ ID NO: 471049 - DNA, 25 bp, Mus musculus
gagactgcccaggtttgcctgggaa

SEQ ID NO: 471050 - DNA, 25 bp, Mus musculus
gagactgcctcaaatcacaaaagca

SEQ ID NO: 471051 - DNA, 25 bp, Mus musculus
gagactgcctcatatcacaaaagca

SEQ ID NO: 471052 - DNA, 25 bp, Mus musculus
gagactgcctctagggttgtaagat

SEQ ID NO: 471053 - DNA, 25 bp, Mus musculus
gagactgcctcttgggttgtaagat

SEQ ID NO: 471054 - DNA, 25 bp, Mus musculus
gagactgcctggactccatacacag

SEQ ID NO: 471055 - DNA, 25 bp, Mus musculus
gagactgcctggtctccatacacag

SEQ ID NO: 471056 - DNA, 25 bp, Mus musculus
gagactgccttgagtggaagactat

SEQ ID NO: 471057 - DNA, 25 bp, Mus musculus
gagactgccttgtgtggaagactat

SEQ ID NO: 471058 - DNA, 25 bp, Mus musculus
gagactgcgcatcctttttatattc

SEQ ID NO: 471059 - DNA, 25 bp, Mus musculus
gagactgcgcatgctttttatattc

SEQ ID NO: 471060 - DNA, 25 bp, Mus musculus
gagactgcgttcactggaacctggt

SEQ ID NO: 471061 - DNA, 25 bp, Mus musculus
gagactgcgttctctggaacctggt

SEQ ID NO: 471062 - DNA, 25 bp, Mus musculus
gagactgctacgacaacacagagaa

SEQ ID NO: 471063 - DNA, 25 bp, Mus musculus
gagactgctacgtcaacacagagaa

SEQ ID NO: 471064 - DNA, 25 bp, Mus musculus
gagactgctatgatcttaagcaggc

SEQ ID NO: 471065 - DNA, 25 bp, Mus musculus
gagactgctatgttcttaagcaggc

SEQ ID NO: 471066 - DNA, 25 bp, Mus musculus
gagactgctattctaagagcatcag

SEQ ID NO: 471067 - DNA, 25 bp, Mus musculus
gagactgctattgtaagagcatcag

SEQ ID NO: 471068 - DNA, 25 bp, Mus musculus
gagactgctcaactctgggacttta

SEQ ID NO: 471069 - DNA, 25 bp, Mus musculus
gagactgctcaagtctgggacttta

SEQ ID NO: 471070 - DNA, 25 bp, Mus musculus
gagactgctcagcagagcacggact

SEQ ID NO: 471071 - DNA, 25 bp, Mus musculus
gagactgctcaggagagcacggact

SEQ ID NO: 471072 - DNA, 25 bp, Mus musculus
gagactgctctacaaaatccaaggc

SEQ ID NO: 471073 - DNA, 25 bp, Mus musculus
gagactgctctagaaaatccaaggc

SEQ ID NO: 471074 - DNA, 25 bp, Mus musculus
gagactgctgctcaactggataatg

SEQ ID NO: 471075 - DNA, 25 bp, Mus musculus
gagactgctgctgaactggataatg

SEQ ID NO: 471076 - DNA, 25 bp, Mus musculus
gagactgctggaaacatttttgcaa

SEQ ID NO: 471077 - DNA, 25 bp, Mus musculus
gagactgctggatacatttttgcaa

SEQ ID NO: 471078 - DNA, 25 bp, Mus musculus
gagactgctgttccacagagttaca

SEQ ID NO: 471079 - DNA, 25 bp, Mus musculus
gagactgctgttgcacagagttaca

SEQ ID NO: 471080 - DNA, 25 bp, Mus musculus
gagactgcttcgcagcaggtgacta

SEQ ID NO: 471081 - DNA, 25 bp, Mus musculus
gagactgcttcggagcaggtgacta

SEQ ID NO: 471082 - DNA, 25 bp, Mus musculus
gagactgcttctcacctgggaaatg

SEQ ID NO: 471083 - DNA, 25 bp, Mus musculus
gagactgcttctgacctgggaaatg

SEQ ID NO: 471084 - DNA, 25 bp, Mus musculus
gagactgcttgcaaggatttgattc

SEQ ID NO: 471085 - DNA, 25 bp, Mus musculus
gagactgcttgctaggatttgattc

SEQ ID NO: 471086 - DNA, 25 bp, Mus musculus
gagactgctttacccgaagtcaatt

SEQ ID NO: 471087 - DNA, 25 bp, Mus musculus
gagactgctttagccgaagtcaatt

SEQ ID NO: 471088 - DNA, 25 bp, Mus musculus
gagactgcttttcctcatctgattc

SEQ ID NO: 471089 - DNA, 25 bp, Mus musculus
gagactgcttttgctcatctgattc

SEQ ID NO: 471090 - DNA, 25 bp, Mus musculus
gagactggaaaccatcctactgctg

SEQ ID NO: 471091 - DNA, 25 bp, Mus musculus
gagactggaaacgatcctactgctg

SEQ ID NO: 471092 - DNA, 25 bp, Mus musculus
gagactggaaatagcacctcctttc

SEQ ID NO: 471093 - DNA, 25 bp, Mus musculus
gagactggaaattgcacctcctttc

SEQ ID NO: 471094 - DNA, 25 bp, Mus musculus
gagactggaagtctcctaatcctac

SEQ ID NO: 471095 - DNA, 25 bp, Mus musculus
gagactggaagtgtcctaatcctac

SEQ ID NO: 471096 - DNA, 25 bp, Mus musculus
gagactggacatcggtcctcttcaa

SEQ ID NO: 471097 - DNA, 25 bp, Mus musculus
gagactggacatctagcacagccct

SEQ ID NO: 471098 - DNA, 25 bp, Mus musculus
gagactggacatgggtcctcttcaa

SEQ ID NO: 471099 - DNA, 25 bp, Mus musculus
gagactggacatgtagcacagccct

SEQ ID NO: 471100 - DNA, 25 bp, Mus musculus
gagactggactcactaatgctatta

SEQ ID NO: 471101 - DNA, 25 bp, Mus musculus
gagactggactctctaatgctatta

SEQ ID NO: 471102 - DNA, 25 bp, Mus musculus
gagactggagaaacgccctgagttt

SEQ ID NO: 471103 - DNA, 25 bp, Mus musculus
gagactggagaactaattccaccaa

SEQ ID NO: 471104 - DNA, 25 bp, Mus musculus
gagactggagaagtaattccaccaa

SEQ ID NO: 471105 - DNA, 25 bp, Mus musculus
gagactggagaatcgccctgagttt

SEQ ID NO: 471106 - DNA, 25 bp, Mus musculus
gagactggaggtagggcacagcctg

SEQ ID NO: 471107 - DNA, 25 bp, Mus musculus
gagactggaggttgggcacagcctg

SEQ ID NO: 471108 - DNA, 25 bp, Mus musculus
gagactggatacaccttttctggac

SEQ ID NO: 471109 - DNA, 25 bp, Mus musculus
gagactggatactccttttctggac

SEQ ID NO: 471110 - DNA, 25 bp, Mus musculus
gagactggatatagtagtgcatacc

SEQ ID NO: 471111 - DNA, 25 bp, Mus musculus
gagactggatattgtagtgcatacc

SEQ ID NO: 471112 - DNA, 25 bp, Mus musculus
gagactggcaggatcttccaatgaa

SEQ ID NO: 471113 - DNA, 25 bp, Mus musculus
gagactggcaggttcttccaatgaa

SEQ ID NO: 471114 - DNA, 25 bp, Mus musculus
gagactggcagtctcccaatccggg

SEQ ID NO: 471115 - DNA, 25 bp, Mus musculus
gagactggcagtgtcccaatccggg

SEQ ID NO: 471116 - DNA, 25 bp, Mus musculus
gagactggcatacctggacatccaa

SEQ ID NO: 471117 - DNA, 25 bp, Mus musculus
gagactggcatagctggacatccaa

SEQ ID NO: 471118 - DNA, 25 bp, Mus musculus
gagactggccctccataaaatgaac

SEQ ID NO: 471119 - DNA, 25 bp, Mus musculus
gagactggccctcgatacatctgag

SEQ ID NO: 471120 - DNA, 25 bp, Mus musculus
gagactggccctgcataaaatgaac

SEQ ID NO: 471121 - DNA, 25 bp, Mus musculus
gagactggccctggatacatctgag

SEQ ID NO: 471122 - DNA, 25 bp, Mus musculus
gagactggcctaaccttgtctacag

SEQ ID NO: 471123 - DNA, 25 bp, Mus musculus
gagactggcctatccttgtctacag

SEQ ID NO: 471124 - DNA, 25 bp, Mus musculus
gagactggcgtcactgagccagttg

SEQ ID NO: 471125 - DNA, 25 bp, Mus musculus
gagactggcgtctctgagccagttg

SEQ ID NO: 471126 - DNA, 25 bp, Mus musculus
gagactggctacaactccacaaggc

SEQ ID NO: 471127 - DNA, 25 bp, Mus musculus
gagactggctactactccacaaggc

SEQ ID NO: 471128 - DNA, 25 bp, Mus musculus
gagactggctctcaatgaccactga

SEQ ID NO: 471129 - DNA, 25 bp, Mus musculus
gagactggctctcagacgaccagaa

SEQ ID NO: 471130 - DNA, 25 bp, Mus musculus
gagactggctctgaatgaccactga

SEQ ID NO: 471131 - DNA, 25 bp, Mus musculus
gagactggctctgagacgaccagaa

SEQ ID NO: 471132 - DNA, 25 bp, Mus musculus
gagactggcttcaggactgtttcaa

SEQ ID NO: 471133 - DNA, 25 bp, Mus musculus
gagactggcttctggactgtttcaa

SEQ ID NO: 471134 - DNA, 25 bp, Mus musculus
gagactggcttgaaaacttgtgata

SEQ ID NO: 471135 - DNA, 25 bp, Mus musculus
gagactggcttgtaaacttgtgata

SEQ ID NO: 471136 - DNA, 25 bp, Mus musculus
gagactgggagcagccggtcacggt

SEQ ID NO: 471137 - DNA, 25 bp, Mus musculus
gagactgggagctgccggtcacggt

SEQ ID NO: 471138 - DNA, 25 bp, Mus musculus
gagactgggcctcaaaggactcttt

SEQ ID NO: 471139 - DNA, 25 bp, Mus musculus
gagactgggcctgaaaggactcttt

SEQ ID NO: 471140 - DNA, 25 bp, Mus musculus
gagactgggctcacagcaagaccaa

SEQ ID NO: 471141 - DNA, 25 bp, Mus musculus
gagactgggctctcagcaagaccaa

SEQ ID NO: 471142 - DNA, 25 bp, Mus musculus
gagactgggtataagctccaaggca

SEQ ID NO: 471143 - DNA, 25 bp, Mus musculus
gagactgggtattagctccaaggca

SEQ ID NO: 471144 - DNA, 25 bp, Mus musculus
gagactgggtctctacaacaaccaa

SEQ ID NO: 471145 - DNA, 25 bp, Mus musculus
gagactgggtctgtacaacaaccaa

SEQ ID NO: 471146 - DNA, 25 bp, Mus musculus
gagactgggtgcactggcttttaga

SEQ ID NO: 471147 - DNA, 25 bp, Mus musculus
gagactgggtgctctggcttttaga

SEQ ID NO: 471148 - DNA, 25 bp, Mus musculus
gagactgggttaccactatttccaa

SEQ ID NO: 471149 - DNA, 25 bp, Mus musculus
gagactgggttagcactatttccaa

SEQ ID NO: 471150 - DNA, 25 bp, Mus musculus
gagactggtcgaagcaaggaataac

SEQ ID NO: 471151 - DNA, 25 bp, Mus musculus
gagactggtcgatgcaaggaataac

SEQ ID NO: 471152 - DNA, 25 bp, Mus musculus
gagactggtgaaatggcttagacat

SEQ ID NO: 471153 - DNA, 25 bp, Mus musculus
gagactggtgaattggcttagacat

SEQ ID NO: 471154 - DNA, 25 bp, Mus musculus
gagactggtgacattcctgtgtcct

SEQ ID NO: 471155 - DNA, 25 bp, Mus musculus
gagactggtgactttcctgtgtcct

SEQ ID NO: 471156 - DNA, 25 bp, Mus musculus
gagactggtggaattctataagttt

SEQ ID NO: 471157 - DNA, 25 bp, Mus musculus
gagactggtggatttctataagttt

SEQ ID NO: 471158 - DNA, 25 bp, Mus musculus
gagactgtaaaacttgtcagattca

SEQ ID NO: 471159 - DNA, 25 bp, Mus musculus
gagactgtaaaagttgtcagattca

SEQ ID NO: 471160 - DNA, 25 bp, Mus musculus
gagactgtaactcgaaatcctcccg

SEQ ID NO: 471161 - DNA, 25 bp, Mus musculus
gagactgtaactggaaatcctcccg

SEQ ID NO: 471162 - DNA, 25 bp, Mus musculus
gagactgtaatcatgaactaggcaa

SEQ ID NO: 471163 - DNA, 25 bp, Mus musculus
gagactgtaatcttgaactaggcaa

SEQ ID NO: 471164 - DNA, 25 bp, Mus musculus
gagactgtaattaccttaggatcct

SEQ ID NO: 471165 - DNA, 25 bp, Mus musculus
gagactgtaatttccttaggatcct

SEQ ID NO: 471166 - DNA, 25 bp, Mus musculus
gagactgtacgacgctctgaccccg

SEQ ID NO: 471167 - DNA, 25 bp, Mus musculus
gagactgtacgaggctctgaccccg

SEQ ID NO: 471168 - DNA, 25 bp, Mus musculus
gagactgtactgatagtccctgtcc

SEQ ID NO: 471169 - DNA, 25 bp, Mus musculus
gagactgtactgttagtccctgtcc

SEQ ID NO: 471170 - DNA, 25 bp, Mus musculus
gagactgtagacacctggtatccta

SEQ ID NO: 471171 - DNA, 25 bp, Mus musculus
gagactgtagactcctggtatccta

SEQ ID NO: 471172 - DNA, 25 bp, Mus musculus
gagactgtatgcacactttgtgtgc

SEQ ID NO: 471173 - DNA, 25 bp, Mus musculus
gagactgtatgctcactttgtgtgc

SEQ ID NO: 471174 - DNA, 25 bp, Mus musculus
gagactgtatttcctactcctactg

SEQ ID NO: 471175 - DNA, 25 bp, Mus musculus
gagactgtatttcgctcgggttact

SEQ ID NO: 471176 - DNA, 25 bp, Mus musculus
gagactgtatttgctactcctactg

SEQ ID NO: 471177 - DNA, 25 bp, Mus musculus
gagactgtatttggctcgggttact

SEQ ID NO: 471178 - DNA, 25 bp, Mus musculus
gagactgtcacaaatggtccagttg

SEQ ID NO: 471179 - DNA, 25 bp, Mus musculus
gagactgtcacatatggtccagttg

SEQ ID NO: 471180 - DNA, 25 bp, Mus musculus
gagactgtcagaaatcagctgccaa

SEQ ID NO: 471181 - DNA, 25 bp, Mus musculus
gagactgtcagatatcagctgccaa

SEQ ID NO: 471182 - DNA, 25 bp, Mus musculus
gagactgtcccaaatacagagactg

SEQ ID NO: 471183 - DNA, 25 bp, Mus musculus
gagactgtcccatatacagagactg

SEQ ID NO: 471184 - DNA, 25 bp, Mus musculus
gagactgtccgtaagttctgcgact

SEQ ID NO: 471185 - DNA, 25 bp, Mus musculus
gagactgtccgttagttctgcgact

SEQ ID NO: 471186 - DNA, 25 bp, Mus musculus
gagactgtcgagcatcgagaccctc

SEQ ID NO: 471187 - DNA, 25 bp, Mus musculus
gagactgtcgaggatcgagaccctc

SEQ ID NO: 471188 - DNA, 25 bp, Mus musculus
gagactgtcgttagagccaaagctg

SEQ ID NO: 471189 - DNA, 25 bp, Mus musculus
gagactgtcgtttgagccaaagctg

SEQ ID NO: 471190 - DNA, 25 bp, Mus musculus
gagactgtctgcatgcctcactggg

SEQ ID NO: 471191 - DNA, 25 bp, Mus musculus
gagactgtctgcttgcctcactggg

SEQ ID NO: 471192 - DNA, 25 bp, Mus musculus
gagactgtctgtaacaccagcatgg

SEQ ID NO: 471193 - DNA, 25 bp, Mus musculus
gagactgtctgttacaccagcatgg

SEQ ID NO: 471194 - DNA, 25 bp, Mus musculus
gagactgtcttgagtttgtctcttc

SEQ ID NO: 471195 - DNA, 25 bp, Mus musculus
gagactgtcttgtgtttgtctcttc

SEQ ID NO: 471196 - DNA, 25 bp, Mus musculus
gagactgtctttcataccatcaatg

SEQ ID NO: 471197 - DNA, 25 bp, Mus musculus
gagactgtctttgataccatcaatg

SEQ ID NO: 471198 - DNA, 25 bp, Mus musculus
gagactgtgaagcactcagcgctaa

SEQ ID NO: 471199 - DNA, 25 bp, Mus musculus
gagactgtgaaggactcagcgctaa

SEQ ID NO: 471200 - DNA, 25 bp, Mus musculus
gagactgtgaatacacattgtatac

SEQ ID NO: 471201 - DNA, 25 bp, Mus musculus
gagactgtgaattcacattgtatac

SEQ ID NO: 471202 - DNA, 25 bp, Mus musculus
gagactgtgagcacattcctcttct

SEQ ID NO: 471203 - DNA, 25 bp, Mus musculus
gagactgtgagcaggttgctgcatt

SEQ ID NO: 471204 - DNA, 25 bp, Mus musculus
gagactgtgagctcattcctcttct

SEQ ID NO: 471205 - DNA, 25 bp, Mus musculus
gagactgtgagctggttgctgcatt

SEQ ID NO: 471206 - DNA, 25 bp, Mus musculus
gagactgtgcacactgatgtttaca

SEQ ID NO: 471207 - DNA, 25 bp, Mus musculus
gagactgtgcactctgatgtttaca

SEQ ID NO: 471208 - DNA, 25 bp, Mus musculus
gagactgtgcagaactgtcagctat

SEQ ID NO: 471209 - DNA, 25 bp, Mus musculus
gagactgtgcagtactgtcagctat

SEQ ID NO: 471210 - DNA, 25 bp, Mus musculus
gagactgtgctcacgacctgttcat

SEQ ID NO: 471211 - DNA, 25 bp, Mus musculus
gagactgtgctctcgacctgttcat

SEQ ID NO: 471212 - DNA, 25 bp, Mus musculus
gagactgtggagaatggactttgcc

SEQ ID NO: 471213 - DNA, 25 bp, Mus musculus
gagactgtggagcagtaacctgaca

SEQ ID NO: 471214 - DNA, 25 bp, Mus musculus
gagactgtggaggagtaacctgaca

SEQ ID NO: 471215 - DNA, 25 bp, Mus musculus
gagactgtggagtatggactttgcc

SEQ ID NO: 471216 - DNA, 25 bp, Mus musculus
gagactgtggatataattgttcacc

SEQ ID NO: 471217 - DNA, 25 bp, Mus musculus
gagactgtggatttaattgttcacc

SEQ ID NO: 471218 - DNA, 25 bp, Mus musculus
gagactgtgggacacttcttccata

SEQ ID NO: 471219 - DNA, 25 bp, Mus musculus
gagactgtgggagacttcttccata

SEQ ID NO: 471220 - DNA, 25 bp, Mus musculus
gagactgtggtcactactttcttca

SEQ ID NO: 471221 - DNA, 25 bp, Mus musculus
gagactgtggtctctactttcttca

SEQ ID NO: 471222 - DNA, 25 bp, Mus musculus
gagactgtgtccacagaaacaaaaa

SEQ ID NO: 471223 - DNA, 25 bp, Mus musculus
gagactgtgtcctcagaaacaaaaa

SEQ ID NO: 471224 - DNA, 25 bp, Mus musculus
gagactgtgtctcccgtgtgtctgc

SEQ ID NO: 471225 - DNA, 25 bp, Mus musculus
gagactgtgtctgccgtgtgtctgc

SEQ ID NO: 471226 - DNA, 25 bp, Mus musculus
gagactgtgtgaactgttctaaggc

SEQ ID NO: 471227 - DNA, 25 bp, Mus musculus
gagactgtgtgatctgttctaaggc

SEQ ID NO: 471228 - DNA, 25 bp, Mus musculus
gagactgttataacagactcccatc

SEQ ID NO: 471229 - DNA, 25 bp, Mus musculus
gagactgttatatcagactcccatc

SEQ ID NO: 471230 - DNA, 25 bp, Mus musculus
gagactgttccacacttctcagagt

SEQ ID NO: 471231 - DNA, 25 bp, Mus musculus
gagactgttccagacttctcagagt

SEQ ID NO: 471232 - DNA, 25 bp, Mus musculus
gagactgttctacactatgggactt

SEQ ID NO: 471233 - DNA, 25 bp, Mus musculus
gagactgttctagactatgggactt

SEQ ID NO: 471234 - DNA, 25 bp, Mus musculus
gagactgttctcagatacagcattt

SEQ ID NO: 471235 - DNA, 25 bp, Mus musculus
gagactgttctcaggatagaaactc

SEQ ID NO: 471236 - DNA, 25 bp, Mus musculus
gagactgttctcagttgcaactggc

SEQ ID NO: 471237 - DNA, 25 bp, Mus musculus
gagactgttctcattatactgtatt

SEQ ID NO: 471238 - DNA, 25 bp, Mus musculus
gagactgttctctgatacagcattt

SEQ ID NO: 471239 - DNA, 25 bp, Mus musculus
gagactgttctctggatagaaactc

SEQ ID NO: 471240 - DNA, 25 bp, Mus musculus
gagactgttctctgttgcaactggc

SEQ ID NO: 471241 - DNA, 25 bp, Mus musculus
gagactgttctctttatactgtatt

SEQ ID NO: 471242 - DNA, 25 bp, Mus musculus
gagactgtttaactgcactgcttgt

SEQ ID NO: 471243 - DNA, 25 bp, Mus musculus
gagactgtttaagtgcactgcttgt

SEQ ID NO: 471244 - DNA, 25 bp, Mus musculus
gagactgtttatcccagagacatcg

SEQ ID NO: 471245 - DNA, 25 bp, Mus musculus
gagactgtttatgccagagacatcg

SEQ ID NO: 471246 - DNA, 25 bp, Mus musculus
gagactgtttcgcatcagacttcct

SEQ ID NO: 471247 - DNA, 25 bp, Mus musculus
gagactgtttcggatcagacttcct

SEQ ID NO: 471248 - DNA, 25 bp, Mus musculus
gagacttaaacgagatcgtctttca

SEQ ID NO: 471249 - DNA, 25 bp, Mus musculus
gagacttaaacgtgatcgtctttca

SEQ ID NO: 471250 - DNA, 25 bp, Mus musculus
gagacttaaagtacttgctatacag

SEQ ID NO: 471251 - DNA, 25 bp, Mus musculus
gagacttaaagttcttgctatacag

SEQ ID NO: 471252 - DNA, 25 bp, Mus musculus
gagacttaaatcacgtttgaaaaca

SEQ ID NO: 471253 - DNA, 25 bp, Mus musculus
gagacttaaatctcgtttgaaaaca

SEQ ID NO: 471254 - DNA, 25 bp, Mus musculus
gagacttaaggaagccacccggatt

SEQ ID NO: 471255 - DNA, 25 bp, Mus musculus
gagacttaaggatgccacccggatt

SEQ ID NO: 471256 - DNA, 25 bp, Mus musculus
gagacttaatatctgcctgccaatg

SEQ ID NO: 471257 - DNA, 25 bp, Mus musculus
gagacttaatatgtgcctgccaatg

SEQ ID NO: 471258 - DNA, 25 bp, Mus musculus
gagacttacaagctagagtatccca

SEQ ID NO: 471259 - DNA, 25 bp, Mus musculus
gagacttacaaggtagagtatccca

SEQ ID NO: 471260 - DNA, 25 bp, Mus musculus
gagacttacagacgttctggtataa

SEQ ID NO: 471261 - DNA, 25 bp, Mus musculus
gagacttacagaggttctggtataa

SEQ ID NO: 471262 - DNA, 25 bp, Mus musculus
gagacttacagtcacattcagtata

SEQ ID NO: 471263 - DNA, 25 bp, Mus musculus
gagacttacagtgacattcagtata

SEQ ID NO: 471264 - DNA, 25 bp, Mus musculus
gagacttaccgcaatgacagtggcc

SEQ ID NO: 471265 - DNA, 25 bp, Mus musculus
gagacttaccgctatgacagtggcc

SEQ ID NO: 471266 - DNA, 25 bp, Mus musculus
gagacttactaaacactttaggcgc

SEQ ID NO: 471267 - DNA, 25 bp, Mus musculus
gagacttactaatcactttaggcgc

SEQ ID NO: 471268 - DNA, 25 bp, Mus musculus
gagacttactgcaaagcattttgta

SEQ ID NO: 471269 - DNA, 25 bp, Mus musculus
gagacttactgctaagcattttgta

SEQ ID NO: 471270 - DNA, 25 bp, Mus musculus
gagacttactggacatgccgggtgt

SEQ ID NO: 471271 - DNA, 25 bp, Mus musculus
gagacttactggtcatgccgggtgt

SEQ ID NO: 471272 - DNA, 25 bp, Mus musculus
gagacttagagcctttatattcatg

SEQ ID NO: 471273 - DNA, 25 bp, Mus musculus
gagacttagagcgtttatattcatg

SEQ ID NO: 471274 - DNA, 25 bp, Mus musculus
gagacttagcacatcagttcacaga

SEQ ID NO: 471275 - DNA, 25 bp, Mus musculus
gagacttagcacttcagttcacaga

SEQ ID NO: 471276 - DNA, 25 bp, Mus musculus
gagacttagcatcctcgcgggatga

SEQ ID NO: 471277 - DNA, 25 bp, Mus musculus
gagacttagcatgctcgcgggatga

SEQ ID NO: 471278 - DNA, 25 bp, Mus musculus
gagacttagcccaaggtctttttgt

SEQ ID NO: 471279 - DNA, 25 bp, Mus musculus
gagacttagccctaggtctttttgt

SEQ ID NO: 471280 - DNA, 25 bp, Mus musculus
gagacttaggacagtatccacccac

SEQ ID NO: 471281 - DNA, 25 bp, Mus musculus
gagacttaggactgtatccacccac

SEQ ID NO: 471282 - DNA, 25 bp, Mus musculus
gagacttaggtgagtgatcccggca

SEQ ID NO: 471283 - DNA, 25 bp, Mus musculus
gagacttaggtgtgtgatcccggca

SEQ ID NO: 471284 - DNA, 25 bp, Mus musculus
gagacttagtcgcattgtcttccgc

SEQ ID NO: 471285 - DNA, 25 bp, Mus musculus
gagacttagtcggattgtcttccgc

SEQ ID NO: 471286 - DNA, 25 bp, Mus musculus
gagacttagtttacaaagatgctgt

SEQ ID NO: 471287 - DNA, 25 bp, Mus musculus
gagacttagttttcaaagatgctgt

SEQ ID NO: 471288 - DNA, 25 bp, Mus musculus
gagacttatggcagctcacagtaca

SEQ ID NO: 471289 - DNA, 25 bp, Mus musculus
gagacttatggctgctcacagtaca

SEQ ID NO: 471290 - DNA, 25 bp, Mus musculus
gagacttatgtaattactggatagc

SEQ ID NO: 471291 - DNA, 25 bp, Mus musculus
gagacttatgtatttactggatagc

SEQ ID NO: 471292 - DNA, 25 bp, Mus musculus
gagacttattctccagcttgcctgg

SEQ ID NO: 471293 - DNA, 25 bp, Mus musculus
gagacttattctgcagcttgcctgg

SEQ ID NO: 471294 - DNA, 25 bp, Mus musculus
gagacttatttcattcaagcagttg

SEQ ID NO: 471295 - DNA, 25 bp, Mus musculus
gagacttatttctttcaagcagttg

SEQ ID NO: 471296 - DNA, 25 bp, Mus musculus
gagacttcaaacaagtacgtcctta

SEQ ID NO: 471297 - DNA, 25 bp, Mus musculus
gagacttcaaactagtacgtcctta

SEQ ID NO: 471298 - DNA, 25 bp, Mus musculus
gagacttcaactcattgtgcgtgac

SEQ ID NO: 471299 - DNA, 25 bp, Mus musculus
gagacttcaactgattgtgcgtgac

SEQ ID NO: 471300 - DNA, 25 bp, Mus musculus
gagacttcaagcaacctctcatggt

SEQ ID NO: 471301 - DNA, 25 bp, Mus musculus
gagacttcaagctacctctcatggt

SEQ ID NO: 471302 - DNA, 25 bp, Mus musculus
gagacttcaaggactccaagcctac

SEQ ID NO: 471303 - DNA, 25 bp, Mus musculus
gagacttcaaggatccagttttgtt

SEQ ID NO: 471304 - DNA, 25 bp, Mus musculus
gagacttcaaggtctccaagcctac

SEQ ID NO: 471305 - DNA, 25 bp, Mus musculus
gagacttcaaggttccagttttgtt

SEQ ID NO: 471306 - DNA, 25 bp, Mus musculus
gagacttcaccccaatgcaggacat

SEQ ID NO: 471307 - DNA, 25 bp, Mus musculus
gagacttcacccgaatgcaggacat

SEQ ID NO: 471308 - DNA, 25 bp, Mus musculus
gagacttcaccgactgcagttgcag

SEQ ID NO: 471309 - DNA, 25 bp, Mus musculus
gagacttcaccgtctgcagttgcag

SEQ ID NO: 471310 - DNA, 25 bp, Mus musculus
gagacttcacttagccatcatatgt

SEQ ID NO: 471311 - DNA, 25 bp, Mus musculus
gagacttcactttgccatcatatgt

SEQ ID NO: 471312 - DNA, 25 bp, Mus musculus
gagacttcagctcagaatgccctgc

SEQ ID NO: 471313 - DNA, 25 bp, Mus musculus
gagacttcagctgagaatgccctgc

SEQ ID NO: 471314 - DNA, 25 bp, Mus musculus
gagacttcaggcacacattgcacgt

SEQ ID NO: 471315 - DNA, 25 bp, Mus musculus
gagacttcaggcagaatcctatcca

SEQ ID NO: 471316 - DNA, 25 bp, Mus musculus
gagacttcaggctcacattgcacgt

SEQ ID NO: 471317 - DNA, 25 bp, Mus musculus
gagacttcaggctgaatcctatcca

SEQ ID NO: 471318 - DNA, 25 bp, Mus musculus
gagacttcatctacagaacggtgga

SEQ ID NO: 471319 - DNA, 25 bp, Mus musculus
gagacttcatcttcagaacggtgga

SEQ ID NO: 471320 - DNA, 25 bp, Mus musculus
gagacttccagtatgtttctcgttt

SEQ ID NO: 471321 - DNA, 25 bp, Mus musculus
gagacttccagtttgtttctcgttt

SEQ ID NO: 471322 - DNA, 25 bp, Mus musculus
gagacttccggtaccattgtaacta

SEQ ID NO: 471323 - DNA, 25 bp, Mus musculus
gagacttccggttccattgtaacta

SEQ ID NO: 471324 - DNA, 25 bp, Mus musculus
gagacttcctcccttattaatatat

SEQ ID NO: 471325 - DNA, 25 bp, Mus musculus
gagacttcctccgttattaatatat

SEQ ID NO: 471326 - DNA, 25 bp, Mus musculus
gagacttcctgccatgttaatatgc

SEQ ID NO: 471327 - DNA, 25 bp, Mus musculus
gagacttcctgcgatgttaatatgc

SEQ ID NO: 471328 - DNA, 25 bp, Mus musculus
gagacttcgtggcagagcccatggg

SEQ ID NO: 471329 - DNA, 25 bp, Mus musculus
gagacttcgtgggagagcccatggg

SEQ ID NO: 471330 - DNA, 25 bp, Mus musculus
gagacttcgtgtatacaacctggtt

SEQ ID NO: 471331 - DNA, 25 bp, Mus musculus
gagacttcgtgtttacaacctggtt

SEQ ID NO: 471332 - DNA, 25 bp, Mus musculus
gagacttctaaaatattccatcatg

SEQ ID NO: 471333 - DNA, 25 bp, Mus musculus
gagacttctaaattattccatcatg

SEQ ID NO: 471334 - DNA, 25 bp, Mus musculus
gagacttctcgcagctgttgaaaaa

SEQ ID NO: 471335 - DNA, 25 bp, Mus musculus
gagacttctcgctgctgttgaaaaa

SEQ ID NO: 471336 - DNA, 25 bp, Mus musculus
gagacttctgacagttctgaccttg

SEQ ID NO: 471337 - DNA, 25 bp, Mus musculus
gagacttctgactgttctgaccttg

SEQ ID NO: 471338 - DNA, 25 bp, Mus musculus
gagacttcttccaggtcttttgtat

SEQ ID NO: 471339 - DNA, 25 bp, Mus musculus
gagacttcttcctggtcttttgtat

SEQ ID NO: 471340 - DNA, 25 bp, Mus musculus
gagacttcttctagaacagtgtgct

SEQ ID NO: 471341 - DNA, 25 bp, Mus musculus
gagacttcttcttgaacagtgtgct

SEQ ID NO: 471342 - DNA, 25 bp, Mus musculus
gagacttcttttcatgtgtatgtag

SEQ ID NO: 471343 - DNA, 25 bp, Mus musculus
gagacttcttttgatgtgtatgtag

SEQ ID NO: 471344 - DNA, 25 bp, Mus musculus
gagacttgaaggagctgcaagagca

SEQ ID NO: 471345 - DNA, 25 bp, Mus musculus
gagacttgaaggtgctgcaagagca

SEQ ID NO: 471346 - DNA, 25 bp, Mus musculus
gagacttgacaaccagcaaccggat

SEQ ID NO: 471347 - DNA, 25 bp, Mus musculus
gagacttgacaagcagcaaccggat

SEQ ID NO: 471348 - DNA, 25 bp, Mus musculus
gagacttgacataaatctgttgttc

SEQ ID NO: 471349 - DNA, 25 bp, Mus musculus
gagacttgacattaatctgttgttc

SEQ ID NO: 471350 - DNA, 25 bp, Mus musculus
gagacttgataaacaggcccttaga

SEQ ID NO: 471351 - DNA, 25 bp, Mus musculus
gagacttgataatcaggcccttaga

SEQ ID NO: 471352 - DNA, 25 bp, Mus musculus
gagacttgatctacaggttctgctt

SEQ ID NO: 471353 - DNA, 25 bp, Mus musculus
gagacttgatcttcaggttctgctt

SEQ ID NO: 471354 - DNA, 25 bp, Mus musculus
gagacttgattacttaaccaccaaa

SEQ ID NO: 471355 - DNA, 25 bp, Mus musculus
gagacttgattagttaaccaccaaa

SEQ ID NO: 471356 - DNA, 25 bp, Mus musculus
gagacttgcatcattgaagccatgt

SEQ ID NO: 471357 - DNA, 25 bp, Mus musculus
gagacttgcatctttgaagccatgt

SEQ ID NO: 471358 - DNA, 25 bp, Mus musculus
gagacttgctttctttccgcaaaat

SEQ ID NO: 471359 - DNA, 25 bp, Mus musculus
gagacttgctttgtttccgcaaaat

SEQ ID NO: 471360 - DNA, 25 bp, Mus musculus
gagacttggaagcactctgtcttct

SEQ ID NO: 471361 - DNA, 25 bp, Mus musculus
gagacttggaaggactctgtcttct

SEQ ID NO: 471362 - DNA, 25 bp, Mus musculus
gagacttggatgagctcctgggatc

SEQ ID NO: 471363 - DNA, 25 bp, Mus musculus
gagacttggatgtgctcctgggatc

SEQ ID NO: 471364 - DNA, 25 bp, Mus musculus
gagacttggcagatgggactactat

SEQ ID NO: 471365 - DNA, 25 bp, Mus musculus
gagacttggcagatttcagttacaa

SEQ ID NO: 471366 - DNA, 25 bp, Mus musculus
gagacttggcagttgggactactat

SEQ ID NO: 471367 - DNA, 25 bp, Mus musculus
gagacttggcagttttcagttacaa

SEQ ID NO: 471368 - DNA, 25 bp, Mus musculus
gagacttggtatcacctcattagca

SEQ ID NO: 471369 - DNA, 25 bp, Mus musculus
gagacttggtatgacctcattagca

SEQ ID NO: 471370 - DNA, 25 bp, Mus musculus
gagacttgtagcattcatttgtggt

SEQ ID NO: 471371 - DNA, 25 bp, Mus musculus
gagacttgtagctttcatttgtggt

SEQ ID NO: 471372 - DNA, 25 bp, Mus musculus
gagacttgtagtagctcacattagc

SEQ ID NO: 471373 - DNA, 25 bp, Mus musculus
gagacttgtagtcgtatcatttgag

SEQ ID NO: 471374 - DNA, 25 bp, Mus musculus
gagacttgtagtggtatcatttgag

SEQ ID NO: 471375 - DNA, 25 bp, Mus musculus
gagacttgtagttgctcacattagc

SEQ ID NO: 471376 - DNA, 25 bp, Mus musculus
gagacttgtatactgggcctgtttt

SEQ ID NO: 471377 - DNA, 25 bp, Mus musculus
gagacttgtatagtgggcctgtttt

SEQ ID NO: 471378 - DNA, 25 bp, Mus musculus
gagacttgtattaccaaatgtgagt

SEQ ID NO: 471379 - DNA, 25 bp, Mus musculus
gagacttgtatttccaaatgtgagt

SEQ ID NO: 471380 - DNA, 25 bp, Mus musculus
gagacttgtcccctgacagagacac

SEQ ID NO: 471381 - DNA, 25 bp, Mus musculus
gagacttgtcccgtgacagagacac

SEQ ID NO: 471382 - DNA, 25 bp, Mus musculus
gagactttaatgagatccccaatgt

SEQ ID NO: 471383 - DNA, 25 bp, Mus musculus
gagactttaatgtgatccccaatgt

SEQ ID NO: 471384 - DNA, 25 bp, Mus musculus
gagactttagccacaggactcctaa

SEQ ID NO: 471385 - DNA, 25 bp, Mus musculus
gagactttagcctcaggactcctaa

SEQ ID NO: 471386 - DNA, 25 bp, Mus musculus
gagactttaggtctaattcacaaag

SEQ ID NO: 471387 - DNA, 25 bp, Mus musculus
gagactttaggtgtaattcacaaag

SEQ ID NO: 471388 - DNA, 25 bp, Mus musculus
gagactttagtacactctgttagat

SEQ ID NO: 471389 - DNA, 25 bp, Mus musculus
gagactttagtagactctgttagat

SEQ ID NO: 471390 - DNA, 25 bp, Mus musculus
gagactttatagctggcctctctgc

SEQ ID NO: 471391 - DNA, 25 bp, Mus musculus
gagactttataggtggcctctctgc

SEQ ID NO: 471392 - DNA, 25 bp, Mus musculus
gagactttcaaaatcgtggactatg

SEQ ID NO: 471393 - DNA, 25 bp, Mus musculus
gagactttcaaattcgtggactatg

SEQ ID NO: 471394 - DNA, 25 bp, Mus musculus
gagactttcagaaggaagctcttct

SEQ ID NO: 471395 - DNA, 25 bp, Mus musculus
gagactttcagatggaagctcttct

SEQ ID NO: 471396 - DNA, 25 bp, Mus musculus
gagactttcgccacacctaaaaaga

SEQ ID NO: 471397 - DNA, 25 bp, Mus musculus
gagactttcgcctcacctaaaaaga

SEQ ID NO: 471398 - DNA, 25 bp, Mus musculus
gagactttctataacccagtgactg

SEQ ID NO: 471399 - DNA, 25 bp, Mus musculus
gagactttctattacccagtgactg

SEQ ID NO: 471400 - DNA, 25 bp, Mus musculus
gagactttctctcagttgagctaaa

SEQ ID NO: 471401 - DNA, 25 bp, Mus musculus
gagactttctctgagttgagctaaa

SEQ ID NO: 471402 - DNA, 25 bp, Mus musculus
gagactttctgacttctaagaggca

SEQ ID NO: 471403 - DNA, 25 bp, Mus musculus
gagactttctgagttctaagaggca

SEQ ID NO: 471404 - DNA, 25 bp, Mus musculus
gagactttcttccagatggttctag

SEQ ID NO: 471405 - DNA, 25 bp, Mus musculus
gagactttcttcgagatggttctag

SEQ ID NO: 471406 - DNA, 25 bp, Mus musculus
gagactttctttactagaaccgaag

SEQ ID NO: 471407 - DNA, 25 bp, Mus musculus
gagactttcttttctagaaccgaag

SEQ ID NO: 471408 - DNA, 25 bp, Mus musculus
gagactttgaccagaatgttcatta

SEQ ID NO: 471409 - DNA, 25 bp, Mus musculus
gagactttgacctgaatgttcatta

SEQ ID NO: 471410 - DNA, 25 bp, Mus musculus
gagactttgagacatacagtagcaa

SEQ ID NO: 471411 - DNA, 25 bp, Mus musculus
gagactttgagagatacagtagcaa

SEQ ID NO: 471412 - DNA, 25 bp, Mus musculus
gagactttgagtattatgagatgct

SEQ ID NO: 471413 - DNA, 25 bp, Mus musculus
gagactttgagttttatgagatgct

SEQ ID NO: 471414 - DNA, 25 bp, Mus musculus
gagactttgcctatcctgatgagtt

SEQ ID NO: 471415 - DNA, 25 bp, Mus musculus
gagactttgcctcttgagatgtaca

SEQ ID NO: 471416 - DNA, 25 bp, Mus musculus
gagactttgcctgttgagatgtaca

SEQ ID NO: 471417 - DNA, 25 bp, Mus musculus
gagactttgcctttcctgatgagtt

SEQ ID NO: 471418 - DNA, 25 bp, Mus musculus
gagactttgcttaatgtgcgtgaat

SEQ ID NO: 471419 - DNA, 25 bp, Mus musculus
gagactttgctttatgtgcgtgaat

SEQ ID NO: 471420 - DNA, 25 bp, Mus musculus
gagactttggatcctttggaaccgg

SEQ ID NO: 471421 - DNA, 25 bp, Mus musculus
gagactttggatcgtggacttttaa

SEQ ID NO: 471422 - DNA, 25 bp, Mus musculus
gagactttggatgctttggaaccgg

SEQ ID NO: 471423 - DNA, 25 bp, Mus musculus
gagactttggatggtggacttttaa

SEQ ID NO: 471424 - DNA, 25 bp, Mus musculus
gagactttgggcctcttagaactgg

SEQ ID NO: 471425 - DNA, 25 bp, Mus musculus
gagactttgggcgtcttagaactgg

SEQ ID NO: 471426 - DNA, 25 bp, Mus musculus
gagactttggttaactacacctcga

SEQ ID NO: 471427 - DNA, 25 bp, Mus musculus
gagactttggtttactacacctcga

SEQ ID NO: 471428 - DNA, 25 bp, Mus musculus
gagactttgtcacctgtaacaccct

SEQ ID NO: 471429 - DNA, 25 bp, Mus musculus
gagactttgtcagctgtaacaccct

SEQ ID NO: 471430 - DNA, 25 bp, Mus musculus
gagactttgtctatataccaatgta

SEQ ID NO: 471431 - DNA, 25 bp, Mus musculus
gagactttgtctttataccaatgta

SEQ ID NO: 471432 - DNA, 25 bp, Mus musculus
gagacttttaagatgcatgcactgc

SEQ ID NO: 471433 - DNA, 25 bp, Mus musculus
gagacttttaagttgcatgcactgc

SEQ ID NO: 471434 - DNA, 25 bp, Mus musculus
gagacttttaccaagcacttaaaat

SEQ ID NO: 471435 - DNA, 25 bp, Mus musculus
gagacttttaccctctgtttccagc

SEQ ID NO: 471436 - DNA, 25 bp, Mus musculus
gagacttttaccgtctgtttccagc

SEQ ID NO: 471437 - DNA, 25 bp, Mus musculus
gagacttttacctagcacttaaaat

SEQ ID NO: 471438 - DNA, 25 bp, Mus musculus
gagacttttcgactgaggtccctaa

SEQ ID NO: 471439 - DNA, 25 bp, Mus musculus
gagacttttcgagtgaggtccctaa

SEQ ID NO: 471440 - DNA, 25 bp, Mus musculus
gagacttttgcaacccacaatggga

SEQ ID NO: 471441 - DNA, 25 bp, Mus musculus
gagacttttgcatcccacaatggga

SEQ ID NO: 471442 - DNA, 25 bp, Mus musculus
gagacttttgtaaagcccaggccag

SEQ ID NO: 471443 - DNA, 25 bp, Mus musculus
gagacttttgtatagcccaggccag

SEQ ID NO: 471444 - DNA, 25 bp, Mus musculus
gagacttttgtgacattggttttcc

SEQ ID NO: 471445 - DNA, 25 bp, Mus musculus
gagacttttgtgtcattggttttcc

SEQ ID NO: 471446 - DNA, 25 bp, Mus musculus
gagactttttatctaacactttatc

SEQ ID NO: 471447 - DNA, 25 bp, Mus musculus
gagactttttatgtaacactttatc

SEQ ID NO: 471448 - DNA, 25 bp, Mus musculus
gagactttttcaacgagcctgttaa

SEQ ID NO: 471449 - DNA, 25 bp, Mus musculus
gagactttttcaactttccagggaa

SEQ ID NO: 471450 - DNA, 25 bp, Mus musculus
gagactttttcacaatcgtactggg

SEQ ID NO: 471451 - DNA, 25 bp, Mus musculus
gagactttttcagaatcgtactggg

SEQ ID NO: 471452 - DNA, 25 bp, Mus musculus
gagactttttcatcgagcctgttaa

SEQ ID NO: 471453 - DNA, 25 bp, Mus musculus
gagactttttcatctttccagggaa

SEQ ID NO: 471454 - DNA, 25 bp, Mus musculus
gagactttttcccataactattatt

SEQ ID NO: 471455 - DNA, 25 bp, Mus musculus
gagactttttccgataactattatt

SEQ ID NO: 471456 - DNA, 25 bp, Mus musculus
gagagaaaaccacctgtccacctgt

SEQ ID NO: 471457 - DNA, 25 bp, Mus musculus
gagagaaaaccagctgtccacctgt

SEQ ID NO: 471458 - DNA, 25 bp, Mus musculus
gagagaaaagctacggtcttccatg

SEQ ID NO: 471459 - DNA, 25 bp, Mus musculus
gagagaaaagcttcggtcttccatg

SEQ ID NO: 471460 - DNA, 25 bp, Mus musculus
gagagaaacaatctattctaacata

SEQ ID NO: 471461 - DNA, 25 bp, Mus musculus
gagagaaacaatgtattctaacata

SEQ ID NO: 471462 - DNA, 25 bp, Mus musculus
gagagaaacacacacgcattcacgt

SEQ ID NO: 471463 - DNA, 25 bp, Mus musculus
gagagaaacacagacgcattcacgt

SEQ ID NO: 471464 - DNA, 25 bp, Mus musculus
gagagaaacaggagatttcccctaa

SEQ ID NO: 471465 - DNA, 25 bp, Mus musculus
gagagaaacaggatacccaccagta

SEQ ID NO: 471466 - DNA, 25 bp, Mus musculus
gagagaaacaggtgatttcccctaa

SEQ ID NO: 471467 - DNA, 25 bp, Mus musculus
gagagaaacaggttacccaccagta

SEQ ID NO: 471468 - DNA, 25 bp, Mus musculus
gagagaaaccccagcagtgtgagat

SEQ ID NO: 471469 - DNA, 25 bp, Mus musculus
gagagaaacccctgcagtgtgagat

SEQ ID NO: 471470 - DNA, 25 bp, Mus musculus
gagagaaaccctctagctacaagct

SEQ ID NO: 471471 - DNA, 25 bp, Mus musculus
gagagaaaccctgtagctacaagct

SEQ ID NO: 471472 - DNA, 25 bp, Mus musculus
gagagaaacggaaccctgcgtagcc

SEQ ID NO: 471473 - DNA, 25 bp, Mus musculus
gagagaaacggatccctgcgtagcc

SEQ ID NO: 471474 - DNA, 25 bp, Mus musculus
gagagaaacgtcctttcctcagcgt

SEQ ID NO: 471475 - DNA, 25 bp, Mus musculus
gagagaaacgtcgtttcctcagcgt

SEQ ID NO: 471476 - DNA, 25 bp, Mus musculus
gagagaaactgtatttgagtgctta

SEQ ID NO: 471477 - DNA, 25 bp, Mus musculus
gagagaaactgtttttgagtgctta

SEQ ID NO: 471478 - DNA, 25 bp, Mus musculus
gagagaaactttcgagttatgtgaa

SEQ ID NO: 471479 - DNA, 25 bp, Mus musculus
gagagaaactttggagttatgtgaa

SEQ ID NO: 471480 - DNA, 25 bp, Mus musculus
gagagaaagctccacgtgacacata

SEQ ID NO: 471481 - DNA, 25 bp, Mus musculus
gagagaaagctcgacgtgacacata

SEQ ID NO: 471482 - DNA, 25 bp, Mus musculus
gagagaaagctgacttgggtagaat

SEQ ID NO: 471483 - DNA, 25 bp, Mus musculus
gagagaaagctgtcttgggtagaat

SEQ ID NO: 471484 - DNA, 25 bp, Mus musculus
gagagaaagcttcctgggtctagaa

SEQ ID NO: 471485 - DNA, 25 bp, Mus musculus
gagagaaagcttgctgggtctagaa

SEQ ID NO: 471486 - DNA, 25 bp, Mus musculus
gagagaaaggccactgccccaggtt

SEQ ID NO: 471487 - DNA, 25 bp, Mus musculus
gagagaaaggcctctgccccaggtt

SEQ ID NO: 471488 - DNA, 25 bp, Mus musculus
gagagaaaggttacacccaggacaa

SEQ ID NO: 471489 - DNA, 25 bp, Mus musculus
gagagaaaggtttcacccaggacaa

SEQ ID NO: 471490 - DNA, 25 bp, Mus musculus
gagagaaagtcgcattcttccctcc

SEQ ID NO: 471491 - DNA, 25 bp, Mus musculus
gagagaaagtcggattcttccctcc

SEQ ID NO: 471492 - DNA, 25 bp, Mus musculus
gagagaaagttaccctggtgcccac

SEQ ID NO: 471493 - DNA, 25 bp, Mus musculus
gagagaaagttagcctggtgcccac

SEQ ID NO: 471494 - DNA, 25 bp, Mus musculus
gagagaaagtttccagagccaattt

SEQ ID NO: 471495 - DNA, 25 bp, Mus musculus
gagagaaagtttgcagagccaattt

SEQ ID NO: 471496 - DNA, 25 bp, Mus musculus
gagagaaataacctttcattccaag

SEQ ID NO: 471497 - DNA, 25 bp, Mus musculus
gagagaaataacgtttcattccaag

SEQ ID NO: 471498 - DNA, 25 bp, Mus musculus
gagagaaatatgagaccttgttttt

SEQ ID NO: 471499 - DNA, 25 bp, Mus musculus
gagagaaatatgtgaccttgttttt

SEQ ID NO: 471500 - DNA, 25 bp, Mus musculus
gagagaacaccacaccagacacttt

SEQ ID NO: 471501 - DNA, 25 bp, Mus musculus
gagagaacaccagaccagacacttt

SEQ ID NO: 471502 - DNA, 25 bp, Mus musculus
gagagaacacttaaagacattcatg

SEQ ID NO: 471503 - DNA, 25 bp, Mus musculus
gagagaacactttaagacattcatg

SEQ ID NO: 471504 - DNA, 25 bp, Mus musculus
gagagaacaggaagtacatacacag

SEQ ID NO: 471505 - DNA, 25 bp, Mus musculus
gagagaacaggatgtacatacacag

SEQ ID NO: 471506 - DNA, 25 bp, Mus musculus
gagagaacatcactaatgcccctga

SEQ ID NO: 471507 - DNA, 25 bp, Mus musculus
gagagaacatcagtaatgcccctga

SEQ ID NO: 471508 - DNA, 25 bp, Mus musculus
gagagaacatctccggtcagtttca

SEQ ID NO: 471509 - DNA, 25 bp, Mus musculus
gagagaacatctgcggtcagtttca

SEQ ID NO: 471510 - DNA, 25 bp, Mus musculus
gagagaaccaaacaccagtagttgt

SEQ ID NO: 471511 - DNA, 25 bp, Mus musculus
gagagaaccaaagaccagtagttgt

SEQ ID NO: 471512 - DNA, 25 bp, Mus musculus
gagagaaccaacctccagtaattgt

SEQ ID NO: 471513 - DNA, 25 bp, Mus musculus
gagagaaccaacgtccagtaattgt

SEQ ID NO: 471514 - DNA, 25 bp, Mus musculus
gagagaacccgactccctgtgaaga

SEQ ID NO: 471515 - DNA, 25 bp, Mus musculus
gagagaacccgagtccctgtgaaga

SEQ ID NO: 471516 - DNA, 25 bp, Mus musculus
gagagaacccttaccatgctattag

SEQ ID NO: 471517 - DNA, 25 bp, Mus musculus
gagagaacccttcgtcctgaatagt

SEQ ID NO: 471518 - DNA, 25 bp, Mus musculus
gagagaacccttggtcctgaatagt

SEQ ID NO: 471519 - DNA, 25 bp, Mus musculus
gagagaaccctttccatgctattag

SEQ ID NO: 471520 - DNA, 25 bp, Mus musculus
gagagaaccgaaacagttgaccttt

SEQ ID NO: 471521 - DNA, 25 bp, Mus musculus
gagagaaccgaatcagttgaccttt

SEQ ID NO: 471522 - DNA, 25 bp, Mus musculus
gagagaaccgacatcttcaagtgcc

SEQ ID NO: 471523 - DNA, 25 bp, Mus musculus
gagagaaccgacttcttcaagtgcc

SEQ ID NO: 471524 - DNA, 25 bp, Mus musculus
gagagaaccggacgcccgcataccg

SEQ ID NO: 471525 - DNA, 25 bp, Mus musculus
gagagaaccggaggcccgcataccg

SEQ ID NO: 471526 - DNA, 25 bp, Mus musculus
gagagaaccgtcaggcagtaccact

SEQ ID NO: 471527 - DNA, 25 bp, Mus musculus
gagagaaccgtctggcagtaccact

SEQ ID NO: 471528 - DNA, 25 bp, Mus musculus
gagagaaccgttccaagccactcta

SEQ ID NO: 471529 - DNA, 25 bp, Mus musculus
gagagaaccgttgcaagccactcta

SEQ ID NO: 471530 - DNA, 25 bp, Mus musculus
gagagaacctgcatttagtatccat

SEQ ID NO: 471531 - DNA, 25 bp, Mus musculus
gagagaacctgcttttagtatccat

SEQ ID NO: 471532 - DNA, 25 bp, Mus musculus
gagagaaccttgcatttcacagcta

SEQ ID NO: 471533 - DNA, 25 bp, Mus musculus
gagagaaccttggatttcacagcta

SEQ ID NO: 471534 - DNA, 25 bp, Mus musculus
gagagaacctttctggtcacttttc

SEQ ID NO: 471535 - DNA, 25 bp, Mus musculus
gagagaacctttgtggtcacttttc

SEQ ID NO: 471536 - DNA, 25 bp, Mus musculus
gagagaactcttcattatacggcag

SEQ ID NO: 471537 - DNA, 25 bp, Mus musculus
gagagaactcttccagcatgttcat

SEQ ID NO: 471538 - DNA, 25 bp, Mus musculus
gagagaactcttgattatacggcag

SEQ ID NO: 471539 - DNA, 25 bp, Mus musculus
gagagaactcttgcagcatgttcat

SEQ ID NO: 471540 - DNA, 25 bp, Mus musculus
gagagaactgaacctactcctgttt

SEQ ID NO: 471541 - DNA, 25 bp, Mus musculus
gagagaactgaagctactcctgttt

SEQ ID NO: 471542 - DNA, 25 bp, Mus musculus
gagagaactgacaccaaggtgtcct

SEQ ID NO: 471543 - DNA, 25 bp, Mus musculus
gagagaactgactccaaggtgtcct

SEQ ID NO: 471544 - DNA, 25 bp, Mus musculus
gagagaactgcaagctgtcacctct

SEQ ID NO: 471545 - DNA, 25 bp, Mus musculus
gagagaactgcaaggatcaattggc

SEQ ID NO: 471546 - DNA, 25 bp, Mus musculus
gagagaactgcatgctgtcacctct

SEQ ID NO: 471547 - DNA, 25 bp, Mus musculus
gagagaactgcatggatcaattggc

SEQ ID NO: 471548 - DNA, 25 bp, Mus musculus
gagagaactgtcctgttactccagc

SEQ ID NO: 471549 - DNA, 25 bp, Mus musculus
gagagaactgtcgtgttactccagc

SEQ ID NO: 471550 - DNA, 25 bp, Mus musculus
gagagaacttccaaattgtgtcaca

SEQ ID NO: 471551 - DNA, 25 bp, Mus musculus
gagagaacttcctaattgtgtcaca

SEQ ID NO: 471552 - DNA, 25 bp, Mus musculus
gagagaagaaagattgtaccctgtt

SEQ ID NO: 471553 - DNA, 25 bp, Mus musculus
gagagaagaaagtttgtaccctgtt

SEQ ID NO: 471554 - DNA, 25 bp, Mus musculus
gagagaagacatccctcgacctgct

SEQ ID NO: 471555 - DNA, 25 bp, Mus musculus
gagagaagacatgcctcgacctgct

SEQ ID NO: 471556 - DNA, 25 bp, Mus musculus
gagagaagacggactgtccccaaca

SEQ ID NO: 471557 - DNA, 25 bp, Mus musculus
gagagaagacggtctgtccccaaca

SEQ ID NO: 471558 - DNA, 25 bp, Mus musculus
gagagaagagatactttttctgaaa

SEQ ID NO: 471559 - DNA, 25 bp, Mus musculus
gagagaagagattctttttctgaaa

SEQ ID NO: 471560 - DNA, 25 bp, Mus musculus
gagagaagccgtacccctgtgaaat

SEQ ID NO: 471561 - DNA, 25 bp, Mus musculus
gagagaagccgttcccctgtgaaat

SEQ ID NO: 471562 - DNA, 25 bp, Mus musculus
gagagaagcctaaaacgttcgttaa

SEQ ID NO: 471563 - DNA, 25 bp, Mus musculus
gagagaagcctataacgttcgttaa

SEQ ID NO: 471564 - DNA, 25 bp, Mus musculus
gagagaagctacaccgagaccaata

SEQ ID NO: 471565 - DNA, 25 bp, Mus musculus
gagagaagctactccgagaccaata

SEQ ID NO: 471566 - DNA, 25 bp, Mus musculus
gagagaagctggatatccatcccca

SEQ ID NO: 471567 - DNA, 25 bp, Mus musculus
gagagaagctggttatccatcccca

SEQ ID NO: 471568 - DNA, 25 bp, Mus musculus
gagagaagcttcaaccgacagtcgt

SEQ ID NO: 471569 - DNA, 25 bp, Mus musculus
gagagaagcttctaccgacagtcgt

SEQ ID NO: 471570 - DNA, 25 bp, Mus musculus
gagagaagctttaagtaccactttc

SEQ ID NO: 471571 - DNA, 25 bp, Mus musculus
gagagaagcttttagtaccactttc

SEQ ID NO: 471572 - DNA, 25 bp, Mus musculus
gagagaaggactcacttttccttga

SEQ ID NO: 471573 - DNA, 25 bp, Mus musculus
gagagaaggactgacttttccttga

SEQ ID NO: 471574 - DNA, 25 bp, Mus musculus
gagagaaggctcatgtgtcctcctg

SEQ ID NO: 471575 - DNA, 25 bp, Mus musculus
gagagaaggctcttgtgtcctcctg

SEQ ID NO: 471576 - DNA, 25 bp, Mus musculus
gagagaaggctgacaacacttcggt

SEQ ID NO: 471577 - DNA, 25 bp, Mus musculus
gagagaaggctgtcaacacttcggt

SEQ ID NO: 471578 - DNA, 25 bp, Mus musculus
gagagaaggcttagcactccacaaa

SEQ ID NO: 471579 - DNA, 25 bp, Mus musculus
gagagaaggctttgcactccacaaa

SEQ ID NO: 471580 - DNA, 25 bp, Mus musculus
gagagaagtcgcagccaataggttg

SEQ ID NO: 471581 - DNA, 25 bp, Mus musculus
gagagaagtcgctgccaataggttg

SEQ ID NO: 471582 - DNA, 25 bp, Mus musculus
gagagaagtctcagcgccaccaaat

SEQ ID NO: 471583 - DNA, 25 bp, Mus musculus
gagagaagtctctgcgccaccaaat

SEQ ID NO: 471584 - DNA, 25 bp, Mus musculus
gagagaagtgacctccacattcaca

SEQ ID NO: 471585 - DNA, 25 bp, Mus musculus
gagagaagtgacgtccacattcaca

SEQ ID NO: 471586 - DNA, 25 bp, Mus musculus
gagagaagtgctatgttaaaggaca

SEQ ID NO: 471587 - DNA, 25 bp, Mus musculus
gagagaagtgctttgttaaaggaca

SEQ ID NO: 471588 - DNA, 25 bp, Mus musculus
gagagaagtgggacttttcctccgg

SEQ ID NO: 471589 - DNA, 25 bp, Mus musculus
gagagaagtgggtcttttcctccgg

SEQ ID NO: 471590 - DNA, 25 bp, Mus musculus
gagagaagttctcactctcggccat

SEQ ID NO: 471591 - DNA, 25 bp, Mus musculus
gagagaagttctgactctcggccat

SEQ ID NO: 471592 - DNA, 25 bp, Mus musculus
gagagaataacccacttctctttgg

SEQ ID NO: 471593 - DNA, 25 bp, Mus musculus
gagagaataaccgacttctctttgg

SEQ ID NO: 471594 - DNA, 25 bp, Mus musculus
gagagaatacttctctcggctgccc

SEQ ID NO: 471595 - DNA, 25 bp, Mus musculus
gagagaatacttgtctcggctgccc

SEQ ID NO: 471596 - DNA, 25 bp, Mus musculus
gagagaatatccaatagaccaagct

SEQ ID NO: 471597 - DNA, 25 bp, Mus musculus
gagagaatatcctatagaccaagct

SEQ ID NO: 471598 - DNA, 25 bp, Mus musculus
gagagaatatctactgacccaaatt

SEQ ID NO: 471599 - DNA, 25 bp, Mus musculus
gagagaatatcttctgacccaaatt

SEQ ID NO: 471600 - DNA, 25 bp, Mus musculus
gagagaatattcagtagtcaacatt

SEQ ID NO: 471601 - DNA, 25 bp, Mus musculus
gagagaatattctgtagtcaacatt

SEQ ID NO: 471602 - DNA, 25 bp, Mus musculus
gagagaatatttatgctgaagcaga

SEQ ID NO: 471603 - DNA, 25 bp, Mus musculus
gagagaatatttttgctgaagcaga

SEQ ID NO: 471604 - DNA, 25 bp, Mus musculus
gagagaatcaagacttcctccatct

SEQ ID NO: 471605 - DNA, 25 bp, Mus musculus
gagagaatcaagtcttcctccatct

SEQ ID NO: 471606 - DNA, 25 bp, Mus musculus
gagagaatcatcagcccaaagacat

SEQ ID NO: 471607 - DNA, 25 bp, Mus musculus
gagagaatcatcctggtctgagaca

SEQ ID NO: 471608 - DNA, 25 bp, Mus musculus
gagagaatcatcgtggtctgagaca

SEQ ID NO: 471609 - DNA, 25 bp, Mus musculus
gagagaatcatctgcccaaagacat

SEQ ID NO: 471610 - DNA, 25 bp, Mus musculus
gagagaatccagctgttaaaagcta

SEQ ID NO: 471611 - DNA, 25 bp, Mus musculus
gagagaatccaggtgttaaaagcta

SEQ ID NO: 471612 - DNA, 25 bp, Mus musculus
gagagaatccatagtgtactgtgtg

SEQ ID NO: 471613 - DNA, 25 bp, Mus musculus
gagagaatccattgtgtactgtgtg

SEQ ID NO: 471614 - DNA, 25 bp, Mus musculus
gagagaatgatcactgccaggtgct

SEQ ID NO: 471615 - DNA, 25 bp, Mus musculus
gagagaatgatcagtacatctatat

SEQ ID NO: 471616 - DNA, 25 bp, Mus musculus
gagagaatgatctctgccaggtgct

SEQ ID NO: 471617 - DNA, 25 bp, Mus musculus
gagagaatgatctgtacatctatat

SEQ ID NO: 471618 - DNA, 25 bp, Mus musculus
gagagaatgcacacctttcattttt

SEQ ID NO: 471619 - DNA, 25 bp, Mus musculus
gagagaatgcactcctttcattttt

SEQ ID NO: 471620 - DNA, 25 bp, Mus musculus
gagagaatgcccctgccatgcctgg

SEQ ID NO: 471621 - DNA, 25 bp, Mus musculus
gagagaatgcccgtgccatgcctgg

SEQ ID NO: 471622 - DNA, 25 bp, Mus musculus
gagagaatggacaccggccagctgt

SEQ ID NO: 471623 - DNA, 25 bp, Mus musculus
gagagaatggactccggccagctgt

SEQ ID NO: 471624 - DNA, 25 bp, Mus musculus
gagagaatggcacaatcctggcctg

SEQ ID NO: 471625 - DNA, 25 bp, Mus musculus
gagagaatggcagaatcctggcctg

SEQ ID NO: 471626 - DNA, 25 bp, Mus musculus
gagagaatggttaccctggtcagat

SEQ ID NO: 471627 - DNA, 25 bp, Mus musculus
gagagaatggtttccctggtcagat

SEQ ID NO: 471628 - DNA, 25 bp, Mus musculus
gagagaatgtcaagccaccctctat

SEQ ID NO: 471629 - DNA, 25 bp, Mus musculus
gagagaatgtcatgccaccctctat

SEQ ID NO: 471630 - DNA, 25 bp, Mus musculus
gagagaatgtgcacagccttgtccc

SEQ ID NO: 471631 - DNA, 25 bp, Mus musculus
gagagaatgtgctcagccttgtccc

SEQ ID NO: 471632 - DNA, 25 bp, Mus musculus
gagagaatgtggacagctgccaaca

SEQ ID NO: 471633 - DNA, 25 bp, Mus musculus
gagagaatgtggtcagctgccaaca

SEQ ID NO: 471634 - DNA, 25 bp, Mus musculus
gagagaattaatatgccagaagtca

SEQ ID NO: 471635 - DNA, 25 bp, Mus musculus
gagagaattaatttgccagaagtca

SEQ ID NO: 471636 - DNA, 25 bp, Mus musculus
gagagaattcttattcccaacagtg

SEQ ID NO: 471637 - DNA, 25 bp, Mus musculus
gagagaattctttttcccaacagtg

SEQ ID NO: 471638 - DNA, 25 bp, Mus musculus
gagagaatttccattcttcataccc

SEQ ID NO: 471639 - DNA, 25 bp, Mus musculus
gagagaatttcctttcttcataccc

SEQ ID NO: 471640 - DNA, 25 bp, Mus musculus
gagagacaaaaaacctagctggaac

SEQ ID NO: 471641 - DNA, 25 bp, Mus musculus
gagagacaaaaatcctagctggaac

SEQ ID NO: 471642 - DNA, 25 bp, Mus musculus
gagagacaaactatccaaggcttat

SEQ ID NO: 471643 - DNA, 25 bp, Mus musculus
gagagacaaactattcccatgacta

SEQ ID NO: 471644 - DNA, 25 bp, Mus musculus
gagagacaaactttccaaggcttat

SEQ ID NO: 471645 - DNA, 25 bp, Mus musculus
gagagacaaacttttcccatgacta

SEQ ID NO: 471646 - DNA, 25 bp, Mus musculus
gagagacaaagaagtcctccttccc

SEQ ID NO: 471647 - DNA, 25 bp, Mus musculus
gagagacaaagacctcctaaaggct

SEQ ID NO: 471648 - DNA, 25 bp, Mus musculus
gagagacaaagagctcctaaaggct

SEQ ID NO: 471649 - DNA, 25 bp, Mus musculus
gagagacaaagatgtcctccttccc

SEQ ID NO: 471650 - DNA, 25 bp, Mus musculus
gagagacaacctatgagcttttcag

SEQ ID NO: 471651 - DNA, 25 bp, Mus musculus
gagagacaacctttgagcttttcag

SEQ ID NO: 471652 - DNA, 25 bp, Mus musculus
gagagacaacgcagactctgatcca

SEQ ID NO: 471653 - DNA, 25 bp, Mus musculus
gagagacaacgctgactctgatcca

SEQ ID NO: 471654 - DNA, 25 bp, Mus musculus
gagagacaactgcaagacttactta

SEQ ID NO: 471655 - DNA, 25 bp, Mus musculus
gagagacaactggaagacttactta

SEQ ID NO: 471656 - DNA, 25 bp, Mus musculus
gagagacaagacaccatcaatgcat

SEQ ID NO: 471657 - DNA, 25 bp, Mus musculus
gagagacaagactccatcaatgcat

SEQ ID NO: 471658 - DNA, 25 bp, Mus musculus
gagagacaagcactcactccaccag

SEQ ID NO: 471659 - DNA, 25 bp, Mus musculus
gagagacaagcagtcactccaccag

SEQ ID NO: 471660 - DNA, 25 bp, Mus musculus
gagagacaagcgagtctgaccccag

SEQ ID NO: 471661 - DNA, 25 bp, Mus musculus
gagagacaagcgtgtctgaccccag

SEQ ID NO: 471662 - DNA, 25 bp, Mus musculus
gagagacaagctactgagcactccc

SEQ ID NO: 471663 - DNA, 25 bp, Mus musculus
gagagacaagctaggtcacattctt

SEQ ID NO: 471664 - DNA, 25 bp, Mus musculus
gagagacaagcttctgagcactccc

SEQ ID NO: 471665 - DNA, 25 bp, Mus musculus
gagagacaagcttggtcacattctt

SEQ ID NO: 471666 - DNA, 25 bp, Mus musculus
gagagacaatccaaagcccagaacc

SEQ ID NO: 471667 - DNA, 25 bp, Mus musculus
gagagacaatcctaagcccagaacc

SEQ ID NO: 471668 - DNA, 25 bp, Mus musculus
gagagacaatctctgatgagacgtt

SEQ ID NO: 471669 - DNA, 25 bp, Mus musculus
gagagacaatctgtgatgagacgtt

SEQ ID NO: 471670 - DNA, 25 bp, Mus musculus
gagagacacaccctgagccgtcggc

SEQ ID NO: 471671 - DNA, 25 bp, Mus musculus
gagagacacaccgtgagccgtcggc

SEQ ID NO: 471672 - DNA, 25 bp, Mus musculus
gagagacacactcctgcactggaag

SEQ ID NO: 471673 - DNA, 25 bp, Mus musculus
gagagacacactgctgcactggaag

SEQ ID NO: 471674 - DNA, 25 bp, Mus musculus
gagagacacagaccggccagtagca

SEQ ID NO: 471675 - DNA, 25 bp, Mus musculus
gagagacacagagcggccagtagca

SEQ ID NO: 471676 - DNA, 25 bp, Mus musculus
gagagacacatgcacaattcaagac

SEQ ID NO: 471677 - DNA, 25 bp, Mus musculus
gagagacacatggacaattcaagac

SEQ ID NO: 471678 - DNA, 25 bp, Mus musculus
gagagacaccatcccagtgttctat

SEQ ID NO: 471679 - DNA, 25 bp, Mus musculus
gagagacaccatgccagtgttctat

SEQ ID NO: 471680 - DNA, 25 bp, Mus musculus
gagagacacctcaccatggatgacc

SEQ ID NO: 471681 - DNA, 25 bp, Mus musculus
gagagacacctctccatggatgacc

SEQ ID NO: 471682 - DNA, 25 bp, Mus musculus
gagagacacggaacctggccgctga

SEQ ID NO: 471683 - DNA, 25 bp, Mus musculus
gagagacacggatcctggccgctga

SEQ ID NO: 471684 - DNA, 25 bp, Mus musculus
gagagacacgttaccaaagattgcg

SEQ ID NO: 471685 - DNA, 25 bp, Mus musculus
gagagacacgtttccaaagattgcg

SEQ ID NO: 471686 - DNA, 25 bp, Mus musculus
gagagacactccctgagctgctgag

SEQ ID NO: 471687 - DNA, 25 bp, Mus musculus
gagagacactccgtgagctgctgag

SEQ ID NO: 471688 - DNA, 25 bp, Mus musculus
gagagacactgaatgcgtctgcaag

SEQ ID NO: 471689 - DNA, 25 bp, Mus musculus
gagagacactgattgcgtctgcaag

SEQ ID NO: 471690 - DNA, 25 bp, Mus musculus
gagagacactgcagagcttggctgt

SEQ ID NO: 471691 - DNA, 25 bp, Mus musculus
gagagacactgctgagcttggctgt

SEQ ID NO: 471692 - DNA, 25 bp, Mus musculus
gagagacagaacaccagagccacaa

SEQ ID NO: 471693 - DNA, 25 bp, Mus musculus
gagagacagaactccagagccacaa

SEQ ID NO: 471694 - DNA, 25 bp, Mus musculus
gagagacagacgattcatcccaaca

SEQ ID NO: 471695 - DNA, 25 bp, Mus musculus
gagagacagacgtttcatcccaaca

SEQ ID NO: 471696 - DNA, 25 bp, Mus musculus
gagagacagagaaaccgccacgttc

SEQ ID NO: 471697 - DNA, 25 bp, Mus musculus
gagagacagagataccgccacgttc

SEQ ID NO: 471698 - DNA, 25 bp, Mus musculus
gagagacagcatccatcaaccaaag

SEQ ID NO: 471699 - DNA, 25 bp, Mus musculus
gagagacagcatgcatcaaccaaag

SEQ ID NO: 471700 - DNA, 25 bp, Mus musculus
gagagacagcctcggagggcggcac

SEQ ID NO: 471701 - DNA, 25 bp, Mus musculus
gagagacagcctgggagggcggcac

SEQ ID NO: 471702 - DNA, 25 bp, Mus musculus
gagagacaggaaccccatgttaaat

SEQ ID NO: 471703 - DNA, 25 bp, Mus musculus
gagagacaggaagcccatgttaaat

SEQ ID NO: 471704 - DNA, 25 bp, Mus musculus
gagagacaggcactcgccccagata

SEQ ID NO: 471705 - DNA, 25 bp, Mus musculus
gagagacaggcagtcgccccagata

SEQ ID NO: 471706 - DNA, 25 bp, Mus musculus
gagagacaggtcaggccccacagct

SEQ ID NO: 471707 - DNA, 25 bp, Mus musculus
gagagacaggtctggccccacagct

SEQ ID NO: 471708 - DNA, 25 bp, Mus musculus
gagagacagtacaggcatcacagtt

SEQ ID NO: 471709 - DNA, 25 bp, Mus musculus
gagagacagtactggcatcacagtt

SEQ ID NO: 471710 - DNA, 25 bp, Mus musculus
gagagacagtagactccatgcctgt

SEQ ID NO: 471711 - DNA, 25 bp, Mus musculus
gagagacagtagtctccatgcctgt

SEQ ID NO: 471712 - DNA, 25 bp, Mus musculus
gagagacatcttagactcctcagaa

SEQ ID NO: 471713 - DNA, 25 bp, Mus musculus
gagagacatctttgactcctcagaa

SEQ ID NO: 471714 - DNA, 25 bp, Mus musculus
gagagacatgctacttttcctaggc

SEQ ID NO: 471715 - DNA, 25 bp, Mus musculus
gagagacatgctatcatcttcaaat

SEQ ID NO: 471716 - DNA, 25 bp, Mus musculus
gagagacatgcttcttttcctaggc

SEQ ID NO: 471717 - DNA, 25 bp, Mus musculus
gagagacatgctttcatcttcaaat

SEQ ID NO: 471718 - DNA, 25 bp, Mus musculus
gagagacattttactgccaccatcc

SEQ ID NO: 471719 - DNA, 25 bp, Mus musculus
gagagacatttttctgccaccatcc

SEQ ID NO: 471720 - DNA, 25 bp, Mus musculus
gagagaccaaatccattctgagatg

SEQ ID NO: 471721 - DNA, 25 bp, Mus musculus
gagagaccaaatgcattctgagatg

SEQ ID NO: 471722 - DNA, 25 bp, Mus musculus
gagagaccaacactgtgactcccag

SEQ ID NO: 471723 - DNA, 25 bp, Mus musculus
gagagaccaacagtgtgactcccag

SEQ ID NO: 471724 - DNA, 25 bp, Mus musculus
gagagaccaactaaatgcagacctg

SEQ ID NO: 471725 - DNA, 25 bp, Mus musculus
gagagaccaacttaatgcagacctg

SEQ ID NO: 471726 - DNA, 25 bp, Mus musculus
gagagaccaagaccagtgcacagct

SEQ ID NO: 471727 - DNA, 25 bp, Mus musculus
gagagaccaagagcagtgcacagct

SEQ ID NO: 471728 - DNA, 25 bp, Mus musculus
gagagaccaatgatgtcctcatctg

SEQ ID NO: 471729 - DNA, 25 bp, Mus musculus
gagagaccaatgttgtcctcatctg

SEQ ID NO: 471730 - DNA, 25 bp, Mus musculus
gagagaccacccacaagaggtggga

SEQ ID NO: 471731 - DNA, 25 bp, Mus musculus
gagagaccaccctcaagaggtggga

SEQ ID NO: 471732 - DNA, 25 bp, Mus musculus
gagagaccacgacgctatacgtcca

SEQ ID NO: 471733 - DNA, 25 bp, Mus musculus
gagagaccacgaggctatacgtcca

SEQ ID NO: 471734 - DNA, 25 bp, Mus musculus
gagagaccagagactgcgctggctt

SEQ ID NO: 471735 - DNA, 25 bp, Mus musculus
gagagaccagagtctgcgctggctt

SEQ ID NO: 471736 - DNA, 25 bp, Mus musculus
gagagaccagatcgagccactatgt

SEQ ID NO: 471737 - DNA, 25 bp, Mus musculus
gagagaccagatggagccactatgt

SEQ ID NO: 471738 - DNA, 25 bp, Mus musculus
gagagaccagccagcgtcctaaagt

SEQ ID NO: 471739 - DNA, 25 bp, Mus musculus
gagagaccagcctgcgtcctaaagt

SEQ ID NO: 471740 - DNA, 25 bp, Mus musculus
gagagaccataaaggctgttgctac

SEQ ID NO: 471741 - DNA, 25 bp, Mus musculus
gagagaccataatggctgttgctac

SEQ ID NO: 471742 - DNA, 25 bp, Mus musculus
gagagacccaataactgctatgcgg

SEQ ID NO: 471743 - DNA, 25 bp, Mus musculus
gagagacccaattactgctatgcgg

SEQ ID NO: 471744 - DNA, 25 bp, Mus musculus
gagagacccagaacaagcttggcta

SEQ ID NO: 471745 - DNA, 25 bp, Mus musculus
gagagacccagactctgccctaaag

SEQ ID NO: 471746 - DNA, 25 bp, Mus musculus
gagagacccagagtctgccctaaag

SEQ ID NO: 471747 - DNA, 25 bp, Mus musculus
gagagacccagatcaagcttggcta

SEQ ID NO: 471748 - DNA, 25 bp, Mus musculus
gagagacccattacaagtacacctg

SEQ ID NO: 471749 - DNA, 25 bp, Mus musculus
gagagacccatttcaagtacacctg

SEQ ID NO: 471750 - DNA, 25 bp, Mus musculus
gagagaccctccacatgggaggcaa

SEQ ID NO: 471751 - DNA, 25 bp, Mus musculus
gagagaccctccagcaagaataagc

SEQ ID NO: 471752 - DNA, 25 bp, Mus musculus
gagagaccctcctcatgggaggcaa

SEQ ID NO: 471753 - DNA, 25 bp, Mus musculus
gagagaccctcctgcaagaataagc

SEQ ID NO: 471754 - DNA, 25 bp, Mus musculus
gagagaccctgtcaatgctgtgact

SEQ ID NO: 471755 - DNA, 25 bp, Mus musculus
gagagaccctgtgaatgctgtgact

SEQ ID NO: 471756 - DNA, 25 bp, Mus musculus
gagagacccttcacactcttgtggt

SEQ ID NO: 471757 - DNA, 25 bp, Mus musculus
gagagacccttctcactcttgtggt

SEQ ID NO: 471758 - DNA, 25 bp, Mus musculus
gagagaccgaaacgatgtggattct

SEQ ID NO: 471759 - DNA, 25 bp, Mus musculus
gagagaccgaaaggatgtggattct

SEQ ID NO: 471760 - DNA, 25 bp, Mus musculus
gagagaccgctgcaatggctacaat

SEQ ID NO: 471761 - DNA, 25 bp, Mus musculus
gagagaccgctggaatggctacaat

SEQ ID NO: 471762 - DNA, 25 bp, Mus musculus
gagagaccggtgatgactcatctgt

SEQ ID NO: 471763 - DNA, 25 bp, Mus musculus
gagagaccggtgttgactcatctgt

SEQ ID NO: 471764 - DNA, 25 bp, Mus musculus
gagagaccgttaagattccagattc

SEQ ID NO: 471765 - DNA, 25 bp, Mus musculus
gagagaccgttatgattccagattc

SEQ ID NO: 471766 - DNA, 25 bp, Mus musculus
gagagacctaagagccaggtagagc

SEQ ID NO: 471767 - DNA, 25 bp, Mus musculus
gagagacctaagtgccaggtagagc

SEQ ID NO: 471768 - DNA, 25 bp, Mus musculus
gagagacctagaaccattgcacatc

SEQ ID NO: 471769 - DNA, 25 bp, Mus musculus
gagagacctagatccattgcacatc

SEQ ID NO: 471770 - DNA, 25 bp, Mus musculus
gagagacctatcctcacatctacga

SEQ ID NO: 471771 - DNA, 25 bp, Mus musculus
gagagacctatcgtcacatctacga

SEQ ID NO: 471772 - DNA, 25 bp, Mus musculus
gagagacctcaactgatcacgaagt

SEQ ID NO: 471773 - DNA, 25 bp, Mus musculus
gagagacctcaagtgatcacgaagt

SEQ ID NO: 471774 - DNA, 25 bp, Mus musculus
gagagacctcagagcctactaagat

SEQ ID NO: 471775 - DNA, 25 bp, Mus musculus
gagagacctcagtgcctactaagat

SEQ ID NO: 471776 - DNA, 25 bp, Mus musculus
gagagacctctaagccaaacattta

SEQ ID NO: 471777 - DNA, 25 bp, Mus musculus
gagagacctctatgccaaacattta

SEQ ID NO: 471778 - DNA, 25 bp, Mus musculus
gagagacctcttcactgttcaggaa

SEQ ID NO: 471779 - DNA, 25 bp, Mus musculus
gagagacctcttcagcttagactca

SEQ ID NO: 471780 - DNA, 25 bp, Mus musculus
gagagacctcttgactgttcaggaa

SEQ ID NO: 471781 - DNA, 25 bp, Mus musculus
gagagacctcttgagcttagactca

SEQ ID NO: 471782 - DNA, 25 bp, Mus musculus
gagagacctgctcgaaatcagtact

SEQ ID NO: 471783 - DNA, 25 bp, Mus musculus
gagagacctgctggaaatcagtact

SEQ ID NO: 471784 - DNA, 25 bp, Mus musculus
gagagaccttccaaatggcacacga

SEQ ID NO: 471785 - DNA, 25 bp, Mus musculus
gagagaccttcctaatggcacacga

SEQ ID NO: 471786 - DNA, 25 bp, Mus musculus
gagagaccttgtcagctctctgggc

SEQ ID NO: 471787 - DNA, 25 bp, Mus musculus
gagagaccttgtgagctctctgggc

SEQ ID NO: 471788 - DNA, 25 bp, Mus musculus
gagagacctttacttttcctcacgg

SEQ ID NO: 471789 - DNA, 25 bp, Mus musculus
gagagacctttagttttcctcacgg

SEQ ID NO: 471790 - DNA, 25 bp, Mus musculus
gagagacctttcagatgtacagaat

SEQ ID NO: 471791 - DNA, 25 bp, Mus musculus
gagagacctttctgatgtacagaat

SEQ ID NO: 471792 - DNA, 25 bp, Mus musculus
gagagacctttgactcaatccccaa

SEQ ID NO: 471793 - DNA, 25 bp, Mus musculus
gagagacctttgtctcaatccccaa

SEQ ID NO: 471794 - DNA, 25 bp, Mus musculus
gagagacgcacaagggattctccca

SEQ ID NO: 471795 - DNA, 25 bp, Mus musculus
gagagacgcacatgggattctccca

SEQ ID NO: 471796 - DNA, 25 bp, Mus musculus
gagagacgcctcagcggaaatgctt

SEQ ID NO: 471797 - DNA, 25 bp, Mus musculus
gagagacgcctctgcggaaatgctt

SEQ ID NO: 471798 - DNA, 25 bp, Mus musculus
gagagacggacaccatggacacctt

SEQ ID NO: 471799 - DNA, 25 bp, Mus musculus
gagagacggacagcatggacacctt

SEQ ID NO: 471800 - DNA, 25 bp, Mus musculus
gagagacggcatccacagggtccca

SEQ ID NO: 471801 - DNA, 25 bp, Mus musculus
gagagacggcatgcacagggtccca

SEQ ID NO: 471802 - DNA, 25 bp, Mus musculus
gagagacgtactcagcttcccaagg

SEQ ID NO: 471803 - DNA, 25 bp, Mus musculus
gagagacgtactgagcttcccaagg

SEQ ID NO: 471804 - DNA, 25 bp, Mus musculus
gagagactaacacaactataccatt

SEQ ID NO: 471805 - DNA, 25 bp, Mus musculus
gagagactaacagaactataccatt

SEQ ID NO: 471806 - DNA, 25 bp, Mus musculus
gagagactaagacccagttacagct

SEQ ID NO: 471807 - DNA, 25 bp, Mus musculus
gagagactaagagccagttacagct

SEQ ID NO: 471808 - DNA, 25 bp, Mus musculus
gagagactagacaaaccctgtccgc

SEQ ID NO: 471809 - DNA, 25 bp, Mus musculus
gagagactagactaaccctgtccgc

SEQ ID NO: 471810 - DNA, 25 bp, Mus musculus
gagagactagagagcaccccagctg

SEQ ID NO: 471811 - DNA, 25 bp, Mus musculus
gagagactagagtgcaccccagctg

SEQ ID NO: 471812 - DNA, 25 bp, Mus musculus
gagagactagataaacagggagtgt

SEQ ID NO: 471813 - DNA, 25 bp, Mus musculus
gagagactagattaacagggagtgt

SEQ ID NO: 471814 - DNA, 25 bp, Mus musculus
gagagactccgaaggacacttactt

SEQ ID NO: 471815 - DNA, 25 bp, Mus musculus
gagagactccgatggacacttactt

SEQ ID NO: 471816 - DNA, 25 bp, Mus musculus
gagagactcctgcatcccgagtaga

SEQ ID NO: 471817 - DNA, 25 bp, Mus musculus
gagagactcctggatcccgagtaga

SEQ ID NO: 471818 - DNA, 25 bp, Mus musculus
gagagactcgagatctttggaaatc

SEQ ID NO: 471819 - DNA, 25 bp, Mus musculus
gagagactcgagttctttggaaatc

SEQ ID NO: 471820 - DNA, 25 bp, Mus musculus
gagagactctacaacgccatgaagg

SEQ ID NO: 471821 - DNA, 25 bp, Mus musculus
gagagactctacatcaacccacgag

SEQ ID NO: 471822 - DNA, 25 bp, Mus musculus
gagagactctactacgccatgaagg

SEQ ID NO: 471823 - DNA, 25 bp, Mus musculus
gagagactctacttcaacccacgag

SEQ ID NO: 471824 - DNA, 25 bp, Mus musculus
gagagactctcaacaatagcaacaa

SEQ ID NO: 471825 - DNA, 25 bp, Mus musculus
gagagactctcatcaatagcaacaa

SEQ ID NO: 471826 - DNA, 25 bp, Mus musculus
gagagactctgcaacagggacagat

SEQ ID NO: 471827 - DNA, 25 bp, Mus musculus
gagagactctgctacagggacagat

SEQ ID NO: 471828 - DNA, 25 bp, Mus musculus
gagagactctggagccctaaaactg

SEQ ID NO: 471829 - DNA, 25 bp, Mus musculus
gagagactctggtgccctaaaactg

SEQ ID NO: 471830 - DNA, 25 bp, Mus musculus
gagagactcttgctttcggagtaga

SEQ ID NO: 471831 - DNA, 25 bp, Mus musculus
gagagactcttggtttcggagtaga

SEQ ID NO: 471832 - DNA, 25 bp, Mus musculus
gagagactgcagcatgaagcccctc

SEQ ID NO: 471833 - DNA, 25 bp, Mus musculus
gagagactgcaggatgaagcccctc

SEQ ID NO: 471834 - DNA, 25 bp, Mus musculus
gagagactgcctcttttgcttctat

SEQ ID NO: 471835 - DNA, 25 bp, Mus musculus
gagagactgcctgttttgcttctat

SEQ ID NO: 471836 - DNA, 25 bp, Mus musculus
gagagactgctgaggaatgtattta

SEQ ID NO: 471837 - DNA, 25 bp, Mus musculus
gagagactgctgtggaatgtattta

SEQ ID NO: 471838 - DNA, 25 bp, Mus musculus
gagagactggcaagttgactagctt

SEQ ID NO: 471839 - DNA, 25 bp, Mus musculus
gagagactggcatgttgactagctt

SEQ ID NO: 471840 - DNA, 25 bp, Mus musculus
gagagactgggcagtcttgcctttt

SEQ ID NO: 471841 - DNA, 25 bp, Mus musculus
gagagactgggctgtcttgcctttt

SEQ ID NO: 471842 - DNA, 25 bp, Mus musculus
gagagactgtggcaatgcccttcaa

SEQ ID NO: 471843 - DNA, 25 bp, Mus musculus
gagagactgtgggaatgcccttcaa

SEQ ID NO: 471844 - DNA, 25 bp, Mus musculus
gagagacttaccatccaattttatc

SEQ ID NO: 471845 - DNA, 25 bp, Mus musculus
gagagacttaccttccaattttatc

SEQ ID NO: 471846 - DNA, 25 bp, Mus musculus
gagagacttagacctgctgttctta

SEQ ID NO: 471847 - DNA, 25 bp, Mus musculus
gagagacttagagctgctgttctta

SEQ ID NO: 471848 - DNA, 25 bp, Mus musculus
gagagacttcagaacttcctaagca

SEQ ID NO: 471849 - DNA, 25 bp, Mus musculus
gagagacttcagtacttcctaagca

SEQ ID NO: 471850 - DNA, 25 bp, Mus musculus
gagagacttctacttcggaaagcta

SEQ ID NO: 471851 - DNA, 25 bp, Mus musculus
gagagacttctagttcggaaagcta

SEQ ID NO: 471852 - DNA, 25 bp, Mus musculus
gagagacttctgcaccgatataaga

SEQ ID NO: 471853 - DNA, 25 bp, Mus musculus
gagagacttctggaccgatataaga

SEQ ID NO: 471854 - DNA, 25 bp, Mus musculus
gagagacttgaaccttttgcattgc

SEQ ID NO: 471855 - DNA, 25 bp, Mus musculus
gagagacttgaagcttttgcattgc

SEQ ID NO: 471856 - DNA, 25 bp, Mus musculus
gagagacttgatcagcatcagcatc

SEQ ID NO: 471857 - DNA, 25 bp, Mus musculus
gagagacttgatgagcatcagcatc

SEQ ID NO: 471858 - DNA, 25 bp, Mus musculus
gagagacttggcacaaggctctagt

SEQ ID NO: 471859 - DNA, 25 bp, Mus musculus
gagagacttggctcaaggctctagt

SEQ ID NO: 471860 - DNA, 25 bp, Mus musculus
gagagactttaacttcatctgttaa

SEQ ID NO: 471861 - DNA, 25 bp, Mus musculus
gagagactttaagttcatctgttaa

SEQ ID NO: 471862 - DNA, 25 bp, Mus musculus
gagagactttacatactttccctaa

SEQ ID NO: 471863 - DNA, 25 bp, Mus musculus
gagagactttacttactttccctaa

SEQ ID NO: 471864 - DNA, 25 bp, Mus musculus
gagagactttccagttttcacatgt

SEQ ID NO: 471865 - DNA, 25 bp, Mus musculus
gagagactttcctgttttcacatgt

SEQ ID NO: 471866 - DNA, 25 bp, Mus musculus
gagagagaaacccaccacagtaaag

SEQ ID NO: 471867 - DNA, 25 bp, Mus musculus
gagagagaaaccgaccacagtaaag

SEQ ID NO: 471868 - DNA, 25 bp, Mus musculus
gagagagaaccaactgacctgcctg

SEQ ID NO: 471869 - DNA, 25 bp, Mus musculus
gagagagaaccatctgacctgcctg

SEQ ID NO: 471870 - DNA, 25 bp, Mus musculus
gagagagaacttcacagaacatctg

SEQ ID NO: 471871 - DNA, 25 bp, Mus musculus
gagagagaacttgacagaacatctg

SEQ ID NO: 471872 - DNA, 25 bp, Mus musculus
gagagagaagacatcctaactcccc

SEQ ID NO: 471873 - DNA, 25 bp, Mus musculus
gagagagaagacttcctaactcccc

SEQ ID NO: 471874 - DNA, 25 bp, Mus musculus
gagagagaaggactgacttttcctt

SEQ ID NO: 471875 - DNA, 25 bp, Mus musculus
gagagagaaggagtgacttttcctt

SEQ ID NO: 471876 - DNA, 25 bp, Mus musculus
gagagagaagtcaccctcacaaacc

SEQ ID NO: 471877 - DNA, 25 bp, Mus musculus
gagagagaagtctccctcacaaacc

SEQ ID NO: 471878 - DNA, 25 bp, Mus musculus
gagagagacactaatcctcgcaagt

SEQ ID NO: 471879 - DNA, 25 bp, Mus musculus
gagagagacactctgcgctccgtcg

SEQ ID NO: 471880 - DNA, 25 bp, Mus musculus
gagagagacactgtgcgctccgtcg

SEQ ID NO: 471881 - DNA, 25 bp, Mus musculus
gagagagacacttatcctcgcaagt

SEQ ID NO: 471882 - DNA, 25 bp, Mus musculus
gagagagacataacctcagcctgag

SEQ ID NO: 471883 - DNA, 25 bp, Mus musculus
gagagagacatatcctcagcctgag

SEQ ID NO: 471884 - DNA, 25 bp, Mus musculus
gagagagaccagagtccagctgtac

SEQ ID NO: 471885 - DNA, 25 bp, Mus musculus
gagagagaccagtgtccagctgtac

SEQ ID NO: 471886 - DNA, 25 bp, Mus musculus
gagagagaccctacaagtgcatctt

SEQ ID NO: 471887 - DNA, 25 bp, Mus musculus
gagagagacccttcaagtgcatctt

SEQ ID NO: 471888 - DNA, 25 bp, Mus musculus
gagagagacctcatcaatgattttt

SEQ ID NO: 471889 - DNA, 25 bp, Mus musculus
gagagagacctcttcaatgattttt

SEQ ID NO: 471890 - DNA, 25 bp, Mus musculus
gagagagacgccaacaaggtcaagt

SEQ ID NO: 471891 - DNA, 25 bp, Mus musculus
gagagagacgcctacaaggtcaagt

SEQ ID NO: 471892 - DNA, 25 bp, Mus musculus
gagagagactccctcacagaaggat

SEQ ID NO: 471893 - DNA, 25 bp, Mus musculus
gagagagactccgtcacagaaggat

SEQ ID NO: 471894 - DNA, 25 bp, Mus musculus
gagagagactcgagactttctgcgt

SEQ ID NO: 471895 - DNA, 25 bp, Mus musculus
gagagagactcgtgactttctgcgt

SEQ ID NO: 471896 - DNA, 25 bp, Mus musculus
gagagagactctcattcctgccctg

SEQ ID NO: 471897 - DNA, 25 bp, Mus musculus
gagagagactctgattcctgccctg

SEQ ID NO: 471898 - DNA, 25 bp, Mus musculus
gagagagactgcacctggcatcgtt

SEQ ID NO: 471899 - DNA, 25 bp, Mus musculus
gagagagactgctcctggcatcgtt

SEQ ID NO: 471900 - DNA, 25 bp, Mus musculus
gagagagactttcctacagaggaat

SEQ ID NO: 471901 - DNA, 25 bp, Mus musculus
gagagagactttgctacagaggaat

SEQ ID NO: 471902 - DNA, 25 bp, Mus musculus
gagagagatgaccaaacaccccact

SEQ ID NO: 471903 - DNA, 25 bp, Mus musculus
gagagagatgacgaaacaccccact

SEQ ID NO: 471904 - DNA, 25 bp, Mus musculus
gagagagatggacctccctcacctg

SEQ ID NO: 471905 - DNA, 25 bp, Mus musculus
gagagagatggagctccctcacctg

SEQ ID NO: 471906 - DNA, 25 bp, Mus musculus
gagagagatgtcacttggccctgga

SEQ ID NO: 471907 - DNA, 25 bp, Mus musculus
gagagagatgtctcttggccctgga

SEQ ID NO: 471908 - DNA, 25 bp, Mus musculus
gagagagatgttccgatgcactcat

SEQ ID NO: 471909 - DNA, 25 bp, Mus musculus
gagagagatgttgcgatgcactcat

SEQ ID NO: 471910 - DNA, 25 bp, Mus musculus
gagagagatttcatgcttcaggcat

SEQ ID NO: 471911 - DNA, 25 bp, Mus musculus
gagagagatttcttgcttcaggcat

SEQ ID NO: 471912 - DNA, 25 bp, Mus musculus
gagagagattttatgcgatacttac

SEQ ID NO: 471913 - DNA, 25 bp, Mus musculus
gagagagattttttgcgatacttac

SEQ ID NO: 471914 - DNA, 25 bp, Mus musculus
gagagagcaaccacagtcacatcat

SEQ ID NO: 471915 - DNA, 25 bp, Mus musculus
gagagagcaacctcagtcacatcat

SEQ ID NO: 471916 - DNA, 25 bp, Mus musculus
gagagagcacacacttgcttacaga

SEQ ID NO: 471917 - DNA, 25 bp, Mus musculus
gagagagcacacattcctggaaagg

SEQ ID NO: 471918 - DNA, 25 bp, Mus musculus
gagagagcacactcttgcttacaga

SEQ ID NO: 471919 - DNA, 25 bp, Mus musculus
gagagagcacactttcctggaaagg

SEQ ID NO: 471920 - DNA, 25 bp, Mus musculus
gagagagcacatatcttatgcccct

SEQ ID NO: 471921 - DNA, 25 bp, Mus musculus
gagagagcacatttcttatgcccct

SEQ ID NO: 471922 - DNA, 25 bp, Mus musculus
gagagagcagacatactcccctaac

SEQ ID NO: 471923 - DNA, 25 bp, Mus musculus
gagagagcagacttactcccctaac

SEQ ID NO: 471924 - DNA, 25 bp, Mus musculus
gagagagcagcaccccttagaacta

SEQ ID NO: 471925 - DNA, 25 bp, Mus musculus
gagagagcagcagcccttagaacta

SEQ ID NO: 471926 - DNA, 25 bp, Mus musculus
gagagagcagctagccccagtacaa

SEQ ID NO: 471927 - DNA, 25 bp, Mus musculus
gagagagcagcttgccccagtacaa

SEQ ID NO: 471928 - DNA, 25 bp, Mus musculus
gagagagcatccaagtcctgaaatt

SEQ ID NO: 471929 - DNA, 25 bp, Mus musculus
gagagagcatcctagtcctgaaatt

SEQ ID NO: 471930 - DNA, 25 bp, Mus musculus
gagagagcatgccacagggcatcta

SEQ ID NO: 471931 - DNA, 25 bp, Mus musculus
gagagagcatgcgacagggcatcta

SEQ ID NO: 471932 - DNA, 25 bp, Mus musculus
gagagagccacactgcctcctgcag

SEQ ID NO: 471933 - DNA, 25 bp, Mus musculus
gagagagccacagtgcctcctgcag

SEQ ID NO: 471934 - DNA, 25 bp, Mus musculus
gagagagccagaatggatattattt

SEQ ID NO: 471935 - DNA, 25 bp, Mus musculus
gagagagccagattggatattattt

SEQ ID NO: 471936 - DNA, 25 bp, Mus musculus
gagagagcccacacagatggatttt

SEQ ID NO: 471937 - DNA, 25 bp, Mus musculus
gagagagcccactcagatggatttt

SEQ ID NO: 471938 - DNA, 25 bp, Mus musculus
gagagagccgacatgttgcctaact

SEQ ID NO: 471939 - DNA, 25 bp, Mus musculus
gagagagccgacttgttgcctaact

SEQ ID NO: 471940 - DNA, 25 bp, Mus musculus
gagagagccgctactattttcgtgg

SEQ ID NO: 471941 - DNA, 25 bp, Mus musculus
gagagagccgctctgctgttcatgt

SEQ ID NO: 471942 - DNA, 25 bp, Mus musculus
gagagagccgctgtgctgttcatgt

SEQ ID NO: 471943 - DNA, 25 bp, Mus musculus
gagagagccgcttctattttcgtgg

SEQ ID NO: 471944 - DNA, 25 bp, Mus musculus
gagagagcctctaggtatctgaatt

SEQ ID NO: 471945 - DNA, 25 bp, Mus musculus
gagagagcctcttggtatctgaatt

SEQ ID NO: 471946 - DNA, 25 bp, Mus musculus
gagagagcctgacagtcgtcctata

SEQ ID NO: 471947 - DNA, 25 bp, Mus musculus
gagagagcctgagagtcgtcctata

SEQ ID NO: 471948 - DNA, 25 bp, Mus musculus
gagagagcctggatgcgaaacttct

SEQ ID NO: 471949 - DNA, 25 bp, Mus musculus
gagagagcctggttgcgaaacttct

SEQ ID NO: 471950 - DNA, 25 bp, Mus musculus
gagagagcgagcatcgggaccctaa

SEQ ID NO: 471951 - DNA, 25 bp, Mus musculus
gagagagcgagcttcgggaccctaa

SEQ ID NO: 471952 - DNA, 25 bp, Mus musculus
gagagagcgtacatcttttcaaagt

SEQ ID NO: 471953 - DNA, 25 bp, Mus musculus
gagagagcgtacttcttttcaaagt

SEQ ID NO: 471954 - DNA, 25 bp, Mus musculus
gagagagctacccagattctgtgaa

SEQ ID NO: 471955 - DNA, 25 bp, Mus musculus
gagagagctaccgagattctgtgaa

SEQ ID NO: 471956 - DNA, 25 bp, Mus musculus
gagagagctagaacaaagccagcaa

SEQ ID NO: 471957 - DNA, 25 bp, Mus musculus
gagagagctagatcaaagccagcaa

SEQ ID NO: 471958 - DNA, 25 bp, Mus musculus
gagagagctcataccagggccttta

SEQ ID NO: 471959 - DNA, 25 bp, Mus musculus
gagagagctcattccagggccttta

SEQ ID NO: 471960 - DNA, 25 bp, Mus musculus
gagagagctccacgaaaatacttgg

SEQ ID NO: 471961 - DNA, 25 bp, Mus musculus
gagagagctccaggaaaatacttgg

SEQ ID NO: 471962 - DNA, 25 bp, Mus musculus
gagagagctgtgaatctctactgtt

SEQ ID NO: 471963 - DNA, 25 bp, Mus musculus
gagagagctgtgtatctctactgtt

SEQ ID NO: 471964 - DNA, 25 bp, Mus musculus
gagagagctgttctgtactggttaa

SEQ ID NO: 471965 - DNA, 25 bp, Mus musculus
gagagagctgttgtgtactggttaa

SEQ ID NO: 471966 - DNA, 25 bp, Mus musculus
gagagagctttactgtcccattgaa

SEQ ID NO: 471967 - DNA, 25 bp, Mus musculus
gagagagctttagtgtcccattgaa

SEQ ID NO: 471968 - DNA, 25 bp, Mus musculus
gagagaggaaaaaaccaatagaatt

SEQ ID NO: 471969 - DNA, 25 bp, Mus musculus
gagagaggaaaataccaatagaatt

SEQ ID NO: 471970 - DNA, 25 bp, Mus musculus
gagagaggacccatttagatcccct

SEQ ID NO: 471971 - DNA, 25 bp, Mus musculus
gagagaggacccttttagatcccct

SEQ ID NO: 471972 - DNA, 25 bp, Mus musculus
gagagaggactcacaagcacttgct

SEQ ID NO: 471973 - DNA, 25 bp, Mus musculus
gagagaggactctcaagcacttgct

SEQ ID NO: 471974 - DNA, 25 bp, Mus musculus
gagagaggactgactatcttccatg

SEQ ID NO: 471975 - DNA, 25 bp, Mus musculus
gagagaggactgcacttaagcccct

SEQ ID NO: 471976 - DNA, 25 bp, Mus musculus
gagagaggactggacttaagcccct

SEQ ID NO: 471977 - DNA, 25 bp, Mus musculus
gagagaggactgtctatcttccatg

SEQ ID NO: 471978 - DNA, 25 bp, Mus musculus
gagagaggaggcagctcccctggaa

SEQ ID NO: 471979 - DNA, 25 bp, Mus musculus
gagagaggaggctgctcccctggaa

SEQ ID NO: 471980 - DNA, 25 bp, Mus musculus
gagagaggagggacttccatcctct

SEQ ID NO: 471981 - DNA, 25 bp, Mus musculus
gagagaggagggtcttccatcctct

SEQ ID NO: 471982 - DNA, 25 bp, Mus musculus
gagagaggaggtcagcttttcctta

SEQ ID NO: 471983 - DNA, 25 bp, Mus musculus
gagagaggaggtgagcttttcctta

SEQ ID NO: 471984 - DNA, 25 bp, Mus musculus
gagagaggagtgcttctgtttctcc

SEQ ID NO: 471985 - DNA, 25 bp, Mus musculus
gagagaggagtggttctgtttctcc

SEQ ID NO: 471986 - DNA, 25 bp, Mus musculus
gagagaggcacaaagcttcattaca

SEQ ID NO: 471987 - DNA, 25 bp, Mus musculus
gagagaggcacatagcttcattaca

SEQ ID NO: 471988 - DNA, 25 bp, Mus musculus
gagagaggcactacctgtgcccgtc

SEQ ID NO: 471989 - DNA, 25 bp, Mus musculus
gagagaggcacttcctgtgcccgtc

SEQ ID NO: 471990 - DNA, 25 bp, Mus musculus
gagagaggcagacacaactcccatc

SEQ ID NO: 471991 - DNA, 25 bp, Mus musculus
gagagaggcagagacaactcccatc

SEQ ID NO: 471992 - DNA, 25 bp, Mus musculus
gagagaggcgacaccacaggactta

SEQ ID NO: 471993 - DNA, 25 bp, Mus musculus
gagagaggcgactccacaggactta

SEQ ID NO: 471994 - DNA, 25 bp, Mus musculus
gagagaggctgtctttgctccactg

SEQ ID NO: 471995 - DNA, 25 bp, Mus musculus
gagagaggctgtgtttgctccactg

SEQ ID NO: 471996 - DNA, 25 bp, Mus musculus
gagagaggcttgaccccaatttggg

SEQ ID NO: 471997 - DNA, 25 bp, Mus musculus
gagagaggcttgtccccaatttggg

SEQ ID NO: 471998 - DNA, 25 bp, Mus musculus
gagagaggctttatacattcagaag

SEQ ID NO: 471999 - DNA, 25 bp, Mus musculus
gagagaggctttttacattcagaag

SEQ ID NO: 472000 - DNA, 25 bp, Mus musculus
gagagagggatccacattgctgtcc

SEQ ID NO: 472001 - DNA, 25 bp, Mus musculus
gagagagggatcgacattgctgtcc

SEQ ID NO: 472002 - DNA, 25 bp, Mus musculus
gagagagggtcaccttgacctgcaa

SEQ ID NO: 472003 - DNA, 25 bp, Mus musculus
gagagagggtcagcttgacctgcaa

SEQ ID NO: 472004 - DNA, 25 bp, Mus musculus
gagagaggtagacagatttctctga

SEQ ID NO: 472005 - DNA, 25 bp, Mus musculus
gagagaggtagagagatttctctga

SEQ ID NO: 472006 - DNA, 25 bp, Mus musculus
gagagaggtagtaatcccaggaagc

SEQ ID NO: 472007 - DNA, 25 bp, Mus musculus
gagagaggtagttatcccaggaagc

SEQ ID NO: 472008 - DNA, 25 bp, Mus musculus
gagagaggtatactgttgccaacac

SEQ ID NO: 472009 - DNA, 25 bp, Mus musculus
gagagaggtatagtgttgccaacac

SEQ ID NO: 472010 - DNA, 25 bp, Mus musculus
gagagaggtccgactaatgaagaac

SEQ ID NO: 472011 - DNA, 25 bp, Mus musculus
gagagaggtccgtctaatgaagaac

SEQ ID NO: 472012 - DNA, 25 bp, Mus musculus
gagagaggtctccttccttggttcc

SEQ ID NO: 472013 - DNA, 25 bp, Mus musculus
gagagaggtctcgttccttggttcc

SEQ ID NO: 472014 - DNA, 25 bp, Mus musculus
gagagaggttacatcccaatggaga

SEQ ID NO: 472015 - DNA, 25 bp, Mus musculus
gagagaggttacttcccaatggaga

SEQ ID NO: 472016 - DNA, 25 bp, Mus musculus
gagagaggttcgacctgacgtccat

SEQ ID NO: 472017 - DNA, 25 bp, Mus musculus
gagagaggttcgtcctgacgtccat

SEQ ID NO: 472018 - DNA, 25 bp, Mus musculus
gagagagtaccacatcagatccgct

SEQ ID NO: 472019 - DNA, 25 bp, Mus musculus
gagagagtaccagatcagatccgct

SEQ ID NO: 472020 - DNA, 25 bp, Mus musculus
gagagagtacccaagatcctgagac

SEQ ID NO: 472021 - DNA, 25 bp, Mus musculus
gagagagtacccaaggtgctaaagg

SEQ ID NO: 472022 - DNA, 25 bp, Mus musculus
gagagagtaccctagatcctgagac

SEQ ID NO: 472023 - DNA, 25 bp, Mus musculus
gagagagtaccctaggtgctaaagg

SEQ ID NO: 472024 - DNA, 25 bp, Mus musculus
gagagagtacctccagactagtttt

SEQ ID NO: 472025 - DNA, 25 bp, Mus musculus
gagagagtacctgcagactagtttt

SEQ ID NO: 472026 - DNA, 25 bp, Mus musculus
gagagagtactaacacacacgacga

SEQ ID NO: 472027 - DNA, 25 bp, Mus musculus
gagagagtactatcacacacgacga

SEQ ID NO: 472028 - DNA, 25 bp, Mus musculus
gagagagtatcaactcctgccgggt

SEQ ID NO: 472029 - DNA, 25 bp, Mus musculus
gagagagtatcatctcctgccgggt

SEQ ID NO: 472030 - DNA, 25 bp, Mus musculus
gagagagtatccatgacacgctatt

SEQ ID NO: 472031 - DNA, 25 bp, Mus musculus
gagagagtatccttgacacgctatt

SEQ ID NO: 472032 - DNA, 25 bp, Mus musculus
gagagagtatgactcttccttcttc

SEQ ID NO: 472033 - DNA, 25 bp, Mus musculus
gagagagtatgagtcttccttcttc

SEQ ID NO: 472034 - DNA, 25 bp, Mus musculus
gagagagtcacaagcccagacagac

SEQ ID NO: 472035 - DNA, 25 bp, Mus musculus
gagagagtcacatgcccagacagac

SEQ ID NO: 472036 - DNA, 25 bp, Mus musculus
gagagagtccctcgagttgccacac

SEQ ID NO: 472037 - DNA, 25 bp, Mus musculus
gagagagtccctggagttgccacac

SEQ ID NO: 472038 - DNA, 25 bp, Mus musculus
gagagagtctatcaccaggttgtag

SEQ ID NO: 472039 - DNA, 25 bp, Mus musculus
gagagagtctatgaccaggttgtag

SEQ ID NO: 472040 - DNA, 25 bp, Mus musculus
gagagagtctcaccacatggctagg

SEQ ID NO: 472041 - DNA, 25 bp, Mus musculus
gagagagtctcagcacatggctagg

SEQ ID NO: 472042 - DNA, 25 bp, Mus musculus
gagagagtgaccacccagtcaggat

SEQ ID NO: 472043 - DNA, 25 bp, Mus musculus
gagagagtgacctcccagtcaggat

SEQ ID NO: 472044 - DNA, 25 bp, Mus musculus
gagagagtgcagaccctgtatcccg

SEQ ID NO: 472045 - DNA, 25 bp, Mus musculus
gagagagtgcagtccctgtatcccg

SEQ ID NO: 472046 - DNA, 25 bp, Mus musculus
gagagagtgcttccctatcgtgtgc

SEQ ID NO: 472047 - DNA, 25 bp, Mus musculus
gagagagtgcttgcctatcgtgtgc

SEQ ID NO: 472048 - DNA, 25 bp, Mus musculus
gagagagtggccaacggaatcaccc

SEQ ID NO: 472049 - DNA, 25 bp, Mus musculus
gagagagtggcctacggaatcaccc

SEQ ID NO: 472050 - DNA, 25 bp, Mus musculus
gagagagtgtgcaaccccatcatca

SEQ ID NO: 472051 - DNA, 25 bp, Mus musculus
gagagagtgtgcctactgcctgacc

SEQ ID NO: 472052 - DNA, 25 bp, Mus musculus
gagagagtgtgcgtactgcctgacc

SEQ ID NO: 472053 - DNA, 25 bp, Mus musculus
gagagagtgtgctaccccatcatca

SEQ ID NO: 472054 - DNA, 25 bp, Mus musculus
gagagagttaggacctcttggaaca

SEQ ID NO: 472055 - DNA, 25 bp, Mus musculus
gagagagttaggtcctcttggaaca

SEQ ID NO: 472056 - DNA, 25 bp, Mus musculus
gagagagttcacactcagtgtcttt

SEQ ID NO: 472057 - DNA, 25 bp, Mus musculus
gagagagttcactctcagtgtcttt

SEQ ID NO: 472058 - DNA, 25 bp, Mus musculus
gagagagttcccaccacagaatgtc

SEQ ID NO: 472059 - DNA, 25 bp, Mus musculus
gagagagttccctccacagaatgtc

SEQ ID NO: 472060 - DNA, 25 bp, Mus musculus
gagagagttcctaggttatgctaat

SEQ ID NO: 472061 - DNA, 25 bp, Mus musculus
gagagagttccttggttatgctaat

SEQ ID NO: 472062 - DNA, 25 bp, Mus musculus
gagagagttctccactacattttta

SEQ ID NO: 472063 - DNA, 25 bp, Mus musculus
gagagagttctcgactacattttta

SEQ ID NO: 472064 - DNA, 25 bp, Mus musculus
gagagagttgccattgctacatccc

SEQ ID NO: 472065 - DNA, 25 bp, Mus musculus
gagagagttgcctttgctacatccc

SEQ ID NO: 472066 - DNA, 25 bp, Mus musculus
gagagagttggcacccactgtgatt

SEQ ID NO: 472067 - DNA, 25 bp, Mus musculus
gagagagttggctcccactgtgatt

SEQ ID NO: 472068 - DNA, 25 bp, Mus musculus
gagagagtttccacttatcatcaac

SEQ ID NO: 472069 - DNA, 25 bp, Mus musculus
gagagagtttcctcttatcatcaac

SEQ ID NO: 472070 - DNA, 25 bp, Mus musculus
gagagagtttctatcctaagtgtct

SEQ ID NO: 472071 - DNA, 25 bp, Mus musculus
gagagagtttctttcctaagtgtct

SEQ ID NO: 472072 - DNA, 25 bp, Mus musculus
gagagataatcaccaacgccgttag

SEQ ID NO: 472073 - DNA, 25 bp, Mus musculus
gagagataatcagcaacgccgttag

SEQ ID NO: 472074 - DNA, 25 bp, Mus musculus
gagagatacatacataccctgtgaa

SEQ ID NO: 472075 - DNA, 25 bp, Mus musculus
gagagatacatagataccctgtgaa

SEQ ID NO: 472076 - DNA, 25 bp, Mus musculus
gagagatacatcaaacccacttgtg

SEQ ID NO: 472077 - DNA, 25 bp, Mus musculus
gagagatacatctaacccacttgtg

SEQ ID NO: 472078 - DNA, 25 bp, Mus musculus
gagagataccaacttcattgttact

SEQ ID NO: 472079 - DNA, 25 bp, Mus musculus
gagagataccaagttcattgttact

SEQ ID NO: 472080 - DNA, 25 bp, Mus musculus
gagagataccagaggtggcttcagt

SEQ ID NO: 472081 - DNA, 25 bp, Mus musculus
gagagataccagtggtggcttcagt

SEQ ID NO: 472082 - DNA, 25 bp, Mus musculus
gagagatacctcaagccaactgaaa

SEQ ID NO: 472083 - DNA, 25 bp, Mus musculus
gagagatacctctagccaactgaaa

SEQ ID NO: 472084 - DNA, 25 bp, Mus musculus
gagagatacgacaagttcaaccaga

SEQ ID NO: 472085 - DNA, 25 bp, Mus musculus
gagagatacgactagttcaaccaga

SEQ ID NO: 472086 - DNA, 25 bp, Mus musculus
gagagatagtgtcgttcttagaacc

SEQ ID NO: 472087 - DNA, 25 bp, Mus musculus
gagagatagtgtggttcttagaacc

SEQ ID NO: 472088 - DNA, 25 bp, Mus musculus
gagagatatattcattcagtactac

SEQ ID NO: 472089 - DNA, 25 bp, Mus musculus
gagagatatattgattcagtactac

SEQ ID NO: 472090 - DNA, 25 bp, Mus musculus
gagagatatcgacagcctcgcacag

SEQ ID NO: 472091 - DNA, 25 bp, Mus musculus
gagagatatcgagagcctcgcacag

SEQ ID NO: 472092 - DNA, 25 bp, Mus musculus
gagagatatctcatatagctttatg

SEQ ID NO: 472093 - DNA, 25 bp, Mus musculus
gagagatatctcttatagctttatg

SEQ ID NO: 472094 - DNA, 25 bp, Mus musculus
gagagatatgccactggtcaccatt

SEQ ID NO: 472095 - DNA, 25 bp, Mus musculus
gagagatatgcctctggtcaccatt

SEQ ID NO: 472096 - DNA, 25 bp, Mus musculus
gagagatcacatctagctcattgat

SEQ ID NO: 472097 - DNA, 25 bp, Mus musculus
gagagatcacatgtagctcattgat

SEQ ID NO: 472098 - DNA, 25 bp, Mus musculus
gagagatcactcatatacctatatg

SEQ ID NO: 472099 - DNA, 25 bp, Mus musculus
gagagatcactcttatacctatatg

SEQ ID NO: 472100 - DNA, 25 bp, Mus musculus
gagagatcagagacgcctgcactgc

SEQ ID NO: 472101 - DNA, 25 bp, Mus musculus
gagagatcagagtcgcctgcactgc

SEQ ID NO: 472102 - DNA, 25 bp, Mus musculus
gagagatcagcaagatttcccaaga

SEQ ID NO: 472103 - DNA, 25 bp, Mus musculus
gagagatcagcatgatttcccaaga

SEQ ID NO: 472104 - DNA, 25 bp, Mus musculus
gagagatcatacattaatccagcca

SEQ ID NO: 472105 - DNA, 25 bp, Mus musculus
gagagatcatactttaatccagcca

SEQ ID NO: 472106 - DNA, 25 bp, Mus musculus
gagagatcatccagcctactgtggt

SEQ ID NO: 472107 - DNA, 25 bp, Mus musculus
gagagatcatcctgcctactgtggt

SEQ ID NO: 472108 - DNA, 25 bp, Mus musculus
gagagatcatgtactccctctgcta

SEQ ID NO: 472109 - DNA, 25 bp, Mus musculus
gagagatcatgttctccctctgcta

SEQ ID NO: 472110 - DNA, 25 bp, Mus musculus
gagagatcattgagacctattaagt

SEQ ID NO: 472111 - DNA, 25 bp, Mus musculus
gagagatcattgtgacctattaagt

SEQ ID NO: 472112 - DNA, 25 bp, Mus musculus
gagagatccatgacacagctccaag

SEQ ID NO: 472113 - DNA, 25 bp, Mus musculus
gagagatccatgtcacagctccaag

SEQ ID NO: 472114 - DNA, 25 bp, Mus musculus
gagagatcccaacttctttcagatt

SEQ ID NO: 472115 - DNA, 25 bp, Mus musculus
gagagatcccaagttctttcagatt

SEQ ID NO: 472116 - DNA, 25 bp, Mus musculus
gagagatcccgtattgtacatgtat

SEQ ID NO: 472117 - DNA, 25 bp, Mus musculus
gagagatcccgttttgtacatgtat

SEQ ID NO: 472118 - DNA, 25 bp, Mus musculus
gagagatcctaccagaacagtccca

SEQ ID NO: 472119 - DNA, 25 bp, Mus musculus
gagagatcctacgagaacagtccca

SEQ ID NO: 472120 - DNA, 25 bp, Mus musculus
gagagatcgctcagtcacctgtgaa

SEQ ID NO: 472121 - DNA, 25 bp, Mus musculus
gagagatcgctctgtcacctgtgaa

SEQ ID NO: 472122 - DNA, 25 bp, Mus musculus
gagagatctacaaggcgcttccagc

SEQ ID NO: 472123 - DNA, 25 bp, Mus musculus
gagagatctacatggcgcttccagc

SEQ ID NO: 472124 - DNA, 25 bp, Mus musculus
gagagatctccgcatatccatgtag

SEQ ID NO: 472125 - DNA, 25 bp, Mus musculus
gagagatctccggatatccatgtag

SEQ ID NO: 472126 - DNA, 25 bp, Mus musculus
gagagatctcctagggctgtgttca

SEQ ID NO: 472127 - DNA, 25 bp, Mus musculus
gagagatctcctctttcaaccagtg

SEQ ID NO: 472128 - DNA, 25 bp, Mus musculus
gagagatctcctgtttcaaccagtg

SEQ ID NO: 472129 - DNA, 25 bp, Mus musculus
gagagatctccttgggctgtgttca

SEQ ID NO: 472130 - DNA, 25 bp, Mus musculus
gagagatctgcgacagctgtatttt

SEQ ID NO: 472131 - DNA, 25 bp, Mus musculus
gagagatctgcgtcagctgtatttt

SEQ ID NO: 472132 - DNA, 25 bp, Mus musculus
gagagatctggtcatttccccaaac

SEQ ID NO: 472133 - DNA, 25 bp, Mus musculus
gagagatctggtgatttccccaaac

SEQ ID NO: 472134 - DNA, 25 bp, Mus musculus
gagagatcttctaatgttgggacta

SEQ ID NO: 472135 - DNA, 25 bp, Mus musculus
gagagatcttcttatgttgggacta

SEQ ID NO: 472136 - DNA, 25 bp, Mus musculus
gagagatgaaatcctcccactgcca

SEQ ID NO: 472137 - DNA, 25 bp, Mus musculus
gagagatgaaatgctcccactgcca

SEQ ID NO: 472138 - DNA, 25 bp, Mus musculus
gagagatgaagacggcttcctgtac

SEQ ID NO: 472139 - DNA, 25 bp, Mus musculus
gagagatgaagagggcttcctgtac

SEQ ID NO: 472140 - DNA, 25 bp, Mus musculus
gagagatgaccaaacaagcatgagc

SEQ ID NO: 472141 - DNA, 25 bp, Mus musculus
gagagatgaccatacaagcatgagc

SEQ ID NO: 472142 - DNA, 25 bp, Mus musculus
gagagatgactgctctggttcagat

SEQ ID NO: 472143 - DNA, 25 bp, Mus musculus
gagagatgactggtctggttcagat

SEQ ID NO: 472144 - DNA, 25 bp, Mus musculus
gagagatgagcacttagactataca

SEQ ID NO: 472145 - DNA, 25 bp, Mus musculus
gagagatgagcagttagactataca

SEQ ID NO: 472146 - DNA, 25 bp, Mus musculus
gagagatgatccactcactgcacaa

SEQ ID NO: 472147 - DNA, 25 bp, Mus musculus
gagagatgatcctctcactgcacaa

SEQ ID NO: 472148 - DNA, 25 bp, Mus musculus
gagagatgatggcacctgattgtaa

SEQ ID NO: 472149 - DNA, 25 bp, Mus musculus
gagagatgatgggacctgattgtaa

SEQ ID NO: 472150 - DNA, 25 bp, Mus musculus
gagagatgattccagccatctccca

SEQ ID NO: 472151 - DNA, 25 bp, Mus musculus
gagagatgattcgagccatctccca

SEQ ID NO: 472152 - DNA, 25 bp, Mus musculus
gagagatgattgattctccatgcct

SEQ ID NO: 472153 - DNA, 25 bp, Mus musculus
gagagatgattgtttctccatgcct

SEQ ID NO: 472154 - DNA, 25 bp, Mus musculus
gagagatgatttattccagataagc

SEQ ID NO: 472155 - DNA, 25 bp, Mus musculus
gagagatgattttttccagataagc

SEQ ID NO: 472156 - DNA, 25 bp, Mus musculus
gagagatgcacacaacagctcttcc

SEQ ID NO: 472157 - DNA, 25 bp, Mus musculus
gagagatgcacagaacagctcttcc

SEQ ID NO: 472158 - DNA, 25 bp, Mus musculus
gagagatgccatacctttactttct

SEQ ID NO: 472159 - DNA, 25 bp, Mus musculus
gagagatgccattcctttactttct

SEQ ID NO: 472160 - DNA, 25 bp, Mus musculus
gagagatgcctactattggtgcaga

SEQ ID NO: 472161 - DNA, 25 bp, Mus musculus
gagagatgcctagtattggtgcaga

SEQ ID NO: 472162 - DNA, 25 bp, Mus musculus
gagagatgcgtgcatttctgtgact

SEQ ID NO: 472163 - DNA, 25 bp, Mus musculus
gagagatgcgtggatttctgtgact

SEQ ID NO: 472164 - DNA, 25 bp, Mus musculus
gagagatgctccaggcagaagccca

SEQ ID NO: 472165 - DNA, 25 bp, Mus musculus
gagagatgctcctggcagaagccca

SEQ ID NO: 472166 - DNA, 25 bp, Mus musculus
gagagatggcatctcccagaagctg

SEQ ID NO: 472167 - DNA, 25 bp, Mus musculus
gagagatggcatgtcccagaagctg

SEQ ID NO: 472168 - DNA, 25 bp, Mus musculus
gagagatggctaaacagggatgcta

SEQ ID NO: 472169 - DNA, 25 bp, Mus musculus
gagagatggctatacagggatgcta

SEQ ID NO: 472170 - DNA, 25 bp, Mus musculus
gagagatggttcagcacacttctcg

SEQ ID NO: 472171 - DNA, 25 bp, Mus musculus
gagagatggttctgcacacttctcg

SEQ ID NO: 472172 - DNA, 25 bp, Mus musculus
gagagatgtagccatgttcgtcctg

SEQ ID NO: 472173 - DNA, 25 bp, Mus musculus
gagagatgtagcgatgttcgtcctg

SEQ ID NO: 472174 - DNA, 25 bp, Mus musculus
gagagatgtcagctacccctaatgg

SEQ ID NO: 472175 - DNA, 25 bp, Mus musculus
gagagatgtcaggtacccctaatgg

SEQ ID NO: 472176 - DNA, 25 bp, Mus musculus
gagagatgtccccattagtgaagta

SEQ ID NO: 472177 - DNA, 25 bp, Mus musculus
gagagatgtcccgattagtgaagta

SEQ ID NO: 472178 - DNA, 25 bp, Mus musculus
gagagatgtgacagcgctggcttct

SEQ ID NO: 472179 - DNA, 25 bp, Mus musculus
gagagatgtgactgcgctggcttct

SEQ ID NO: 472180 - DNA, 25 bp, Mus musculus
gagagatgtgcaccctcactttgtt

SEQ ID NO: 472181 - DNA, 25 bp, Mus musculus
gagagatgtgcagcctcactttgtt

SEQ ID NO: 472182 - DNA, 25 bp, Mus musculus
gagagatgtgtcctaaaaccccgtg

SEQ ID NO: 472183 - DNA, 25 bp, Mus musculus
gagagatgtgtcgtaaaaccccgtg

SEQ ID NO: 472184 - DNA, 25 bp, Mus musculus
gagagatgttctcgtgcatgcacac

SEQ ID NO: 472185 - DNA, 25 bp, Mus musculus
gagagatgttctggtgcatgcacac

SEQ ID NO: 472186 - DNA, 25 bp, Mus musculus
gagagatgtttgatgctgtcagtgt

SEQ ID NO: 472187 - DNA, 25 bp, Mus musculus
gagagatgtttgttgctgtcagtgt

SEQ ID NO: 472188 - DNA, 25 bp, Mus musculus
gagagattaaaaatcaacatgactg

SEQ ID NO: 472189 - DNA, 25 bp, Mus musculus
gagagattaaaattcaacatgactg

SEQ ID NO: 472190 - DNA, 25 bp, Mus musculus
gagagattaacaccactcctgttga

SEQ ID NO: 472191 - DNA, 25 bp, Mus musculus
gagagattaacagcactcctgttga

SEQ ID NO: 472192 - DNA, 25 bp, Mus musculus
gagagattaatcagatggccttggg

SEQ ID NO: 472193 - DNA, 25 bp, Mus musculus
gagagattaatctgatggccttggg

SEQ ID NO: 472194 - DNA, 25 bp, Mus musculus
gagagattactgcaggtcaaagaat

SEQ ID NO: 472195 - DNA, 25 bp, Mus musculus
gagagattactggaggtcaaagaat

SEQ ID NO: 472196 - DNA, 25 bp, Mus musculus
gagagattacttcagctggtgagct

SEQ ID NO: 472197 - DNA, 25 bp, Mus musculus
gagagattacttgagctggtgagct

SEQ ID NO: 472198 - DNA, 25 bp, Mus musculus
gagagattatcaatcacacagtaag

SEQ ID NO: 472199 - DNA, 25 bp, Mus musculus
gagagattatcattcacacagtaag

SEQ ID NO: 472200 - DNA, 25 bp, Mus musculus
gagagattattgaggacttcatgac

SEQ ID NO: 472201 - DNA, 25 bp, Mus musculus
gagagattattgtggacttcatgac

SEQ ID NO: 472202 - DNA, 25 bp, Mus musculus
gagagattatttcagtgccatcaaa

SEQ ID NO: 472203 - DNA, 25 bp, Mus musculus
gagagattatttgagtgccatcaaa

SEQ ID NO: 472204 - DNA, 25 bp, Mus musculus
gagagattcaatatattcttgaggt

SEQ ID NO: 472205 - DNA, 25 bp, Mus musculus
gagagattcaatatgctgtgtcagt

SEQ ID NO: 472206 - DNA, 25 bp, Mus musculus
gagagattcaatttattcttgaggt

SEQ ID NO: 472207 - DNA, 25 bp, Mus musculus
gagagattcaatttgctgtgtcagt

SEQ ID NO: 472208 - DNA, 25 bp, Mus musculus
gagagattcatgctcaaattcaaac

SEQ ID NO: 472209 - DNA, 25 bp, Mus musculus
gagagattcatggtcaaattcaaac

SEQ ID NO: 472210 - DNA, 25 bp, Mus musculus
gagagattcccaaactgcaggtttt

SEQ ID NO: 472211 - DNA, 25 bp, Mus musculus
gagagattcccatactgcaggtttt

SEQ ID NO: 472212 - DNA, 25 bp, Mus musculus
gagagattcgcccagctgattgagc

SEQ ID NO: 472213 - DNA, 25 bp, Mus musculus
gagagattcgccgagctgattgagc

SEQ ID NO: 472214 - DNA, 25 bp, Mus musculus
gagagattctccactaaattcctat

SEQ ID NO: 472215 - DNA, 25 bp, Mus musculus
gagagattctcctctaaattcctat

SEQ ID NO: 472216 - DNA, 25 bp, Mus musculus
gagagattctctcggcagtaaaacc

SEQ ID NO: 472217 - DNA, 25 bp, Mus musculus
gagagattctctgggcagtaaaacc

SEQ ID NO: 472218 - DNA, 25 bp, Mus musculus
gagagattctgcctgacctagaact

SEQ ID NO: 472219 - DNA, 25 bp, Mus musculus
gagagattctgcgtgacctagaact

SEQ ID NO: 472220 - DNA, 25 bp, Mus musculus
gagagattgactccatccagccact

SEQ ID NO: 472221 - DNA, 25 bp, Mus musculus
gagagattgactgcatccagccact

SEQ ID NO: 472222 - DNA, 25 bp, Mus musculus
gagagattgatgaactttgtctaaa

SEQ ID NO: 472223 - DNA, 25 bp, Mus musculus
gagagattgatgtactttgtctaaa

SEQ ID NO: 472224 - DNA, 25 bp, Mus musculus
gagagattgttgaaggccatcacat

SEQ ID NO: 472225 - DNA, 25 bp, Mus musculus
gagagattgttgtaggccatcacat

SEQ ID NO: 472226 - DNA, 25 bp, Mus musculus
gagagatttaccatccagtctgaca

SEQ ID NO: 472227 - DNA, 25 bp, Mus musculus
gagagatttaccttccagtctgaca

SEQ ID NO: 472228 - DNA, 25 bp, Mus musculus
gagagatttactcctatcccaggat

SEQ ID NO: 472229 - DNA, 25 bp, Mus musculus
gagagatttactgctatcccaggat

SEQ ID NO: 472230 - DNA, 25 bp, Mus musculus
gagagatttctcaagctggcattaa

SEQ ID NO: 472231 - DNA, 25 bp, Mus musculus
gagagatttctctagctggcattaa

SEQ ID NO: 472232 - DNA, 25 bp, Mus musculus
gagagatttcttacacgtgcaacat

SEQ ID NO: 472233 - DNA, 25 bp, Mus musculus
gagagatttcttatttgcatccagt

SEQ ID NO: 472234 - DNA, 25 bp, Mus musculus
gagagatttctttcacgtgcaacat

SEQ ID NO: 472235 - DNA, 25 bp, Mus musculus
gagagatttcttttttgcatccagt

SEQ ID NO: 472236 - DNA, 25 bp, Mus musculus
gagagatttgacattcctgagaggt

SEQ ID NO: 472237 - DNA, 25 bp, Mus musculus
gagagatttgactttcctgagaggt

SEQ ID NO: 472238 - DNA, 25 bp, Mus musculus
gagagatttgcccaagatcgtataa

SEQ ID NO: 472239 - DNA, 25 bp, Mus musculus
gagagatttgccgaagatcgtataa

SEQ ID NO: 472240 - DNA, 25 bp, Mus musculus
gagagatttgttctaggaccctgca

SEQ ID NO: 472241 - DNA, 25 bp, Mus musculus
gagagatttgttgtaggaccctgca

SEQ ID NO: 472242 - DNA, 25 bp, Mus musculus
gagagattttagattgtggtcaagg

SEQ ID NO: 472243 - DNA, 25 bp, Mus musculus
gagagattttagtttgtggtcaagg

SEQ ID NO: 472244 - DNA, 25 bp, Mus musculus
gagagattttccagatcaacatcat

SEQ ID NO: 472245 - DNA, 25 bp, Mus musculus
gagagattttcctgatcaacatcat

SEQ ID NO: 472246 - DNA, 25 bp, Mus musculus
gagagcaaaaacatactacttcctg

SEQ ID NO: 472247 - DNA, 25 bp, Mus musculus
gagagcaaaaacttactacttcctg

SEQ ID NO: 472248 - DNA, 25 bp, Mus musculus
gagagcaaaacccacaagacataaa

SEQ ID NO: 472249 - DNA, 25 bp, Mus musculus
gagagcaaaaccgacaagacataaa

SEQ ID NO: 472250 - DNA, 25 bp, Mus musculus
gagagcaaaatcaaaccgcggtgga

SEQ ID NO: 472251 - DNA, 25 bp, Mus musculus
gagagcaaaatctaaccgcggtgga

SEQ ID NO: 472252 - DNA, 25 bp, Mus musculus
gagagcaaagctacaggcctttagg

SEQ ID NO: 472253 - DNA, 25 bp, Mus musculus
gagagcaaagcttcaggcctttagg

SEQ ID NO: 472254 - DNA, 25 bp, Mus musculus
gagagcaaatcgaacttccctccta

SEQ ID NO: 472255 - DNA, 25 bp, Mus musculus
gagagcaaatcgcagaatcccacgt

SEQ ID NO: 472256 - DNA, 25 bp, Mus musculus
gagagcaaatcggagaatcccacgt

SEQ ID NO: 472257 - DNA, 25 bp, Mus musculus
gagagcaaatcgtacttccctccta

SEQ ID NO: 472258 - DNA, 25 bp, Mus musculus
gagagcaacaccagcaagactggca

SEQ ID NO: 472259 - DNA, 25 bp, Mus musculus
gagagcaacacctgcaagactggca

SEQ ID NO: 472260 - DNA, 25 bp, Mus musculus
gagagcaacagtcagcgctgctctg

SEQ ID NO: 472261 - DNA, 25 bp, Mus musculus
gagagcaacagtgagcgctgctctg

SEQ ID NO: 472262 - DNA, 25 bp, Mus musculus
gagagcaacattctccgcactataa

SEQ ID NO: 472263 - DNA, 25 bp, Mus musculus
gagagcaacattgtccgcactataa

SEQ ID NO: 472264 - DNA, 25 bp, Mus musculus
gagagcaaccatcttctttattctt

SEQ ID NO: 472265 - DNA, 25 bp, Mus musculus
gagagcaaccatgttctttattctt

SEQ ID NO: 472266 - DNA, 25 bp, Mus musculus
gagagcaaccgcagggacacttgca

SEQ ID NO: 472267 - DNA, 25 bp, Mus musculus
gagagcaaccgctgggacacttgca

SEQ ID NO: 472268 - DNA, 25 bp, Mus musculus
gagagcaacggcagcatccacagat

SEQ ID NO: 472269 - DNA, 25 bp, Mus musculus
gagagcaacggctgcatccacagat

SEQ ID NO: 472270 - DNA, 25 bp, Mus musculus
gagagcaactctatggttcaggcac

SEQ ID NO: 472271 - DNA, 25 bp, Mus musculus
gagagcaactctttggttcaggcac

SEQ ID NO: 472272 - DNA, 25 bp, Mus musculus
gagagcaaggcaaaagccaggaaca

SEQ ID NO: 472273 - DNA, 25 bp, Mus musculus
gagagcaaggcataagccaggaaca

SEQ ID NO: 472274 - DNA, 25 bp, Mus musculus
gagagcaaggctatggcatctttga

SEQ ID NO: 472275 - DNA, 25 bp, Mus musculus
gagagcaaggctttggcatctttga

SEQ ID NO: 472276 - DNA, 25 bp, Mus musculus
gagagcaaggtgacttctctgcctg

SEQ ID NO: 472277 - DNA, 25 bp, Mus musculus
gagagcaaggtgtcttctctgcctg

SEQ ID NO: 472278 - DNA, 25 bp, Mus musculus
gagagcaagtctctgtcgcatgtcc

SEQ ID NO: 472279 - DNA, 25 bp, Mus musculus
gagagcaagtctgtgtcgcatgtcc

SEQ ID NO: 472280 - DNA, 25 bp, Mus musculus
gagagcaagttgagactaggtttca

SEQ ID NO: 472281 - DNA, 25 bp, Mus musculus
gagagcaagttgtgactaggtttca

SEQ ID NO: 472282 - DNA, 25 bp, Mus musculus
gagagcaatgacatattccataatt

SEQ ID NO: 472283 - DNA, 25 bp, Mus musculus
gagagcaatgacttattccataatt

SEQ ID NO: 472284 - DNA, 25 bp, Mus musculus
gagagcaatgccatcatccagtcta

SEQ ID NO: 472285 - DNA, 25 bp, Mus musculus
gagagcaatgccttcatccagtcta

SEQ ID NO: 472286 - DNA, 25 bp, Mus musculus
gagagcacaataaagccccgcagag

SEQ ID NO: 472287 - DNA, 25 bp, Mus musculus
gagagcacaatatagccccgcagag

SEQ ID NO: 472288 - DNA, 25 bp, Mus musculus
gagagcacacaacgtcagagtcaga

SEQ ID NO: 472289 - DNA, 25 bp, Mus musculus
gagagcacacaaggtcagagtcaga

SEQ ID NO: 472290 - DNA, 25 bp, Mus musculus
gagagcacacacaataagcaggcaa

SEQ ID NO: 472291 - DNA, 25 bp, Mus musculus
gagagcacacactataagcaggcaa

SEQ ID NO: 472292 - DNA, 25 bp, Mus musculus
gagagcacagaccacggcagcctga

SEQ ID NO: 472293 - DNA, 25 bp, Mus musculus
gagagcacagacgacggcagcctga

SEQ ID NO: 472294 - DNA, 25 bp, Mus musculus
gagagcacagatatctttgactttg

SEQ ID NO: 472295 - DNA, 25 bp, Mus musculus
gagagcacagatttctttgactttg

SEQ ID NO: 472296 - DNA, 25 bp, Mus musculus
gagagcacagcacgcggcgttcaca

SEQ ID NO: 472297 - DNA, 25 bp, Mus musculus
gagagcacagcaggcggcgttcaca

SEQ ID NO: 472298 - DNA, 25 bp, Mus musculus
gagagcacagctatgtatgtggcaa

SEQ ID NO: 472299 - DNA, 25 bp, Mus musculus
gagagcacagctttgtatgtggcaa

SEQ ID NO: 472300 - DNA, 25 bp, Mus musculus
gagagcacagggaaccaggagtcct

SEQ ID NO: 472301 - DNA, 25 bp, Mus musculus
gagagcacagggtaccaggagtcct

SEQ ID NO: 472302 - DNA, 25 bp, Mus musculus
gagagcacatgtacatatagcaatg

SEQ ID NO: 472303 - DNA, 25 bp, Mus musculus
gagagcacatgttcatatagcaatg

SEQ ID NO: 472304 - DNA, 25 bp, Mus musculus
gagagcacatttacatctgttggaa

SEQ ID NO: 472305 - DNA, 25 bp, Mus musculus
gagagcacatttcccctgcagtcaa

SEQ ID NO: 472306 - DNA, 25 bp, Mus musculus
gagagcacatttgccctgcagtcaa

SEQ ID NO: 472307 - DNA, 25 bp, Mus musculus
gagagcacattttcatctgttggaa

SEQ ID NO: 472308 - DNA, 25 bp, Mus musculus
gagagcaccaacaatgacgaagaca

SEQ ID NO: 472309 - DNA, 25 bp, Mus musculus
gagagcaccaactatgacgaagaca

SEQ ID NO: 472310 - DNA, 25 bp, Mus musculus
gagagcaccaagactggccagagta

SEQ ID NO: 472311 - DNA, 25 bp, Mus musculus
gagagcaccaagtctggccagagta

SEQ ID NO: 472312 - DNA, 25 bp, Mus musculus
gagagcaccacacttaacttccttc

SEQ ID NO: 472313 - DNA, 25 bp, Mus musculus
gagagcaccacagttaacttccttc

SEQ ID NO: 472314 - DNA, 25 bp, Mus musculus
gagagcaccagcaggactgaaccaa

SEQ ID NO: 472315 - DNA, 25 bp, Mus musculus
gagagcaccagctggactgaaccaa

SEQ ID NO: 472316 - DNA, 25 bp, Mus musculus
gagagcaccccaaagttatttgtaa

SEQ ID NO: 472317 - DNA, 25 bp, Mus musculus
gagagcaccccatagttatttgtaa

SEQ ID NO: 472318 - DNA, 25 bp, Mus musculus
gagagcaccccgctctgctgtggtc

SEQ ID NO: 472319 - DNA, 25 bp, Mus musculus
gagagcaccccggtctgctgtggtc

SEQ ID NO: 472320 - DNA, 25 bp, Mus musculus
gagagcacccttatagggactttct

SEQ ID NO: 472321 - DNA, 25 bp, Mus musculus
gagagcacccttttagggactttct

SEQ ID NO: 472322 - DNA, 25 bp, Mus musculus
gagagcacgatgctccttaagggaa

SEQ ID NO: 472323 - DNA, 25 bp, Mus musculus
gagagcacgatggtccttaagggaa

SEQ ID NO: 472324 - DNA, 25 bp, Mus musculus
gagagcacgcttcgcctattctctg

SEQ ID NO: 472325 - DNA, 25 bp, Mus musculus
gagagcacgcttggcctattctctg

SEQ ID NO: 472326 - DNA, 25 bp, Mus musculus
gagagcacggcaacttgacaggtaa

SEQ ID NO: 472327 - DNA, 25 bp, Mus musculus
gagagcacggcatcttgacaggtaa

SEQ ID NO: 472328 - DNA, 25 bp, Mus musculus
gagagcactaatcccctagggtcct

SEQ ID NO: 472329 - DNA, 25 bp, Mus musculus
gagagcactaatgccctagggtcct

SEQ ID NO: 472330 - DNA, 25 bp, Mus musculus
gagagcactcacagtacgttggaaa

SEQ ID NO: 472331 - DNA, 25 bp, Mus musculus
gagagcactcactgtacgttggaaa

SEQ ID NO: 472332 - DNA, 25 bp, Mus musculus
gagagcactcgaagatggttctttc

SEQ ID NO: 472333 - DNA, 25 bp, Mus musculus
gagagcactcgatgatggttctttc

SEQ ID NO: 472334 - DNA, 25 bp, Mus musculus
gagagcactgcgcatctacgcggtt

SEQ ID NO: 472335 - DNA, 25 bp, Mus musculus
gagagcactgcggatctacgcggtt

SEQ ID NO: 472336 - DNA, 25 bp, Mus musculus
gagagcactgggaacgcacctggct

SEQ ID NO: 472337 - DNA, 25 bp, Mus musculus
gagagcactgggtacgcacctggct

SEQ ID NO: 472338 - DNA, 25 bp, Mus musculus
gagagcactgtacaggtcttagctg

SEQ ID NO: 472339 - DNA, 25 bp, Mus musculus
gagagcactgtagaggtcttagctg

SEQ ID NO: 472340 - DNA, 25 bp, Mus musculus
gagagcactgtgactccatctggaa

SEQ ID NO: 472341 - DNA, 25 bp, Mus musculus
gagagcactgtgcacttctggcctc

SEQ ID NO: 472342 - DNA, 25 bp, Mus musculus
gagagcactgtggacttctggcctc

SEQ ID NO: 472343 - DNA, 25 bp, Mus musculus
gagagcactgtgtctccatctggaa

SEQ ID NO: 472344 - DNA, 25 bp, Mus musculus
gagagcactttcctagatcaccagt

SEQ ID NO: 472345 - DNA, 25 bp, Mus musculus
gagagcactttcgtagatcaccagt

SEQ ID NO: 472346 - DNA, 25 bp, Mus musculus
gagagcagacacctgcagacagaca

SEQ ID NO: 472347 - DNA, 25 bp, Mus musculus
gagagcagacacgtgcagacagaca

SEQ ID NO: 472348 - DNA, 25 bp, Mus musculus
gagagcagactcctgacttacatac

SEQ ID NO: 472349 - DNA, 25 bp, Mus musculus
gagagcagactcgtgacttacatac

SEQ ID NO: 472350 - DNA, 25 bp, Mus musculus
gagagcagagcaagctagccactta

SEQ ID NO: 472351 - DNA, 25 bp, Mus musculus
gagagcagagcatgctagccactta

SEQ ID NO: 472352 - DNA, 25 bp, Mus musculus
gagagcagagctatgaccccttagg

SEQ ID NO: 472353 - DNA, 25 bp, Mus musculus
gagagcagagctttgaccccttagg

SEQ ID NO: 472354 - DNA, 25 bp, Mus musculus
gagagcagagtcatactttagtcaa

SEQ ID NO: 472355 - DNA, 25 bp, Mus musculus
gagagcagagtcttactttagtcaa

SEQ ID NO: 472356 - DNA, 25 bp, Mus musculus
gagagcagatctctttctatgtaaa

SEQ ID NO: 472357 - DNA, 25 bp, Mus musculus
gagagcagatctgtttctatgtaaa

SEQ ID NO: 472358 - DNA, 25 bp, Mus musculus
gagagcagatgacagtccagcccca

SEQ ID NO: 472359 - DNA, 25 bp, Mus musculus
gagagcagatgagagtccagcccca

SEQ ID NO: 472360 - DNA, 25 bp, Mus musculus
gagagcagcaccattaaaaacccac

SEQ ID NO: 472361 - DNA, 25 bp, Mus musculus
gagagcagcacctttaaaaacccac

SEQ ID NO: 472362 - DNA, 25 bp, Mus musculus
gagagcagcaggacatcgtgtccta

SEQ ID NO: 472363 - DNA, 25 bp, Mus musculus
gagagcagcaggtcatcgtgtccta

SEQ ID NO: 472364 - DNA, 25 bp, Mus musculus
gagagcagcagtccggtgcccctct

SEQ ID NO: 472365 - DNA, 25 bp, Mus musculus
gagagcagcagtgcggtgcccctct

SEQ ID NO: 472366 - DNA, 25 bp, Mus musculus
gagagcagccctaatggtcgtcatt

SEQ ID NO: 472367 - DNA, 25 bp, Mus musculus
gagagcagcccttatggtcgtcatt

SEQ ID NO: 472368 - DNA, 25 bp, Mus musculus
gagagcagcgataaaccaaaagtta

SEQ ID NO: 472369 - DNA, 25 bp, Mus musculus
gagagcagcgattaaccaaaagtta

SEQ ID NO: 472370 - DNA, 25 bp, Mus musculus
gagagcagcgccatgttatctgtga

SEQ ID NO: 472371 - DNA, 25 bp, Mus musculus
gagagcagcgccttgttatctgtga

SEQ ID NO: 472372 - DNA, 25 bp, Mus musculus
gagagcagcgctagcccagagtgca

SEQ ID NO: 472373 - DNA, 25 bp, Mus musculus
gagagcagcgcttgcccagagtgca

SEQ ID NO: 472374 - DNA, 25 bp, Mus musculus
gagagcagcggcctcaagtgacctt

SEQ ID NO: 472375 - DNA, 25 bp, Mus musculus
gagagcagcggcgtcaagtgacctt

SEQ ID NO: 472376 - DNA, 25 bp, Mus musculus
gagagcagctttagcagcatcaacg

SEQ ID NO: 472377 - DNA, 25 bp, Mus musculus
gagagcagcttttgcagcatcaacg

SEQ ID NO: 472378 - DNA, 25 bp, Mus musculus
gagagcaggctccaacaagttgtcc

SEQ ID NO: 472379 - DNA, 25 bp, Mus musculus
gagagcaggctcgaacaagttgtcc

SEQ ID NO: 472380 - DNA, 25 bp, Mus musculus
gagagcagggctatggaccctcagc

SEQ ID NO: 472381 - DNA, 25 bp, Mus musculus
gagagcagggctttggaccctcagc

SEQ ID NO: 472382 - DNA, 25 bp, Mus musculus
gagagcaggttcaccagagcggctc

SEQ ID NO: 472383 - DNA, 25 bp, Mus musculus
gagagcaggttctccagagcggctc

SEQ ID NO: 472384 - DNA, 25 bp, Mus musculus
gagagcagtacgatttcatggaaag

SEQ ID NO: 472385 - DNA, 25 bp, Mus musculus
gagagcagtacgttttcatggaaag

SEQ ID NO: 472386 - DNA, 25 bp, Mus musculus
gagagcagtactacttcctactttc

SEQ ID NO: 472387 - DNA, 25 bp, Mus musculus
gagagcagtacttcttcctactttc

SEQ ID NO: 472388 - DNA, 25 bp, Mus musculus
gagagcagtagtaattttgtttttt

SEQ ID NO: 472389 - DNA, 25 bp, Mus musculus
gagagcagtagttattttgtttttt

SEQ ID NO: 472390 - DNA, 25 bp, Mus musculus
gagagcagtcatattcaaacccata

SEQ ID NO: 472391 - DNA, 25 bp, Mus musculus
gagagcagtcattttcaaacccata

SEQ ID NO: 472392 - DNA, 25 bp, Mus musculus
gagagcagtgtacgtcagacaacat

SEQ ID NO: 472393 - DNA, 25 bp, Mus musculus
gagagcagtgtaggtcagacaacat

SEQ ID NO: 472394 - DNA, 25 bp, Mus musculus
gagagcagtgtccatcactgggctc

SEQ ID NO: 472395 - DNA, 25 bp, Mus musculus
gagagcagtgtcgatcactgggctc

SEQ ID NO: 472396 - DNA, 25 bp, Mus musculus
gagagcagtgtgacccttttatgaa

SEQ ID NO: 472397 - DNA, 25 bp, Mus musculus
gagagcagtgtgtcccttttatgaa

SEQ ID NO: 472398 - DNA, 25 bp, Mus musculus
gagagcataaccacatacaccttta

SEQ ID NO: 472399 - DNA, 25 bp, Mus musculus
gagagcataacctcatacaccttta

SEQ ID NO: 472400 - DNA, 25 bp, Mus musculus
gagagcataagtatactggtttctg

SEQ ID NO: 472401 - DNA, 25 bp, Mus musculus
gagagcataagtttactggtttctg

SEQ ID NO: 472402 - DNA, 25 bp, Mus musculus
gagagcatacaaccactactttgat

SEQ ID NO: 472403 - DNA, 25 bp, Mus musculus
gagagcatacaagcactactttgat

SEQ ID NO: 472404 - DNA, 25 bp, Mus musculus
gagagcatacgtacattcatataat

SEQ ID NO: 472405 - DNA, 25 bp, Mus musculus
gagagcatacgttcattcatataat

SEQ ID NO: 472406 - DNA, 25 bp, Mus musculus
gagagcatactgatctctcccaaag

SEQ ID NO: 472407 - DNA, 25 bp, Mus musculus
gagagcatactgttctctcccaaag

SEQ ID NO: 472408 - DNA, 25 bp, Mus musculus
gagagcatacttacagactcctgtg

SEQ ID NO: 472409 - DNA, 25 bp, Mus musculus
gagagcatactttcagactcctgtg

SEQ ID NO: 472410 - DNA, 25 bp, Mus musculus
gagagcatagaaattcccctacaca

SEQ ID NO: 472411 - DNA, 25 bp, Mus musculus
gagagcatagaatttcccctacaca

SEQ ID NO: 472412 - DNA, 25 bp, Mus musculus
gagagcatagttcctgcttcctgtc

SEQ ID NO: 472413 - DNA, 25 bp, Mus musculus
gagagcatagttgctgcttcctgtc

SEQ ID NO: 472414 - DNA, 25 bp, Mus musculus
gagagcatccataactcagagctgg

SEQ ID NO: 472415 - DNA, 25 bp, Mus musculus
gagagcatccatcttcaggacggat

SEQ ID NO: 472416 - DNA, 25 bp, Mus musculus
gagagcatccatgttcaggacggat

SEQ ID NO: 472417 - DNA, 25 bp, Mus musculus
gagagcatccattactcagagctgg

SEQ ID NO: 472418 - DNA, 25 bp, Mus musculus
gagagcatccctcagaaaactcgga

SEQ ID NO: 472419 - DNA, 25 bp, Mus musculus
gagagcatccctgagaaaactcgga

SEQ ID NO: 472420 - DNA, 25 bp, Mus musculus
gagagcatccgcagtgacctggaga

SEQ ID NO: 472421 - DNA, 25 bp, Mus musculus
gagagcatccgctgtgacctggaga

SEQ ID NO: 472422 - DNA, 25 bp, Mus musculus
gagagcatcctaactacgttgattg

SEQ ID NO: 472423 - DNA, 25 bp, Mus musculus
gagagcatcctatctacgttgattg

SEQ ID NO: 472424 - DNA, 25 bp, Mus musculus
gagagcatcctgaagtgatctaagt

SEQ ID NO: 472425 - DNA, 25 bp, Mus musculus
gagagcatcctgtagtgatctaagt

SEQ ID NO: 472426 - DNA, 25 bp, Mus musculus
gagagcatcgataaaaaggccattg

SEQ ID NO: 472427 - DNA, 25 bp, Mus musculus
gagagcatcgattaaaaggccattg

SEQ ID NO: 472428 - DNA, 25 bp, Mus musculus
gagagcatcgtcaggcagcactcag

SEQ ID NO: 472429 - DNA, 25 bp, Mus musculus
gagagcatcgtctggcagcactcag

SEQ ID NO: 472430 - DNA, 25 bp, Mus musculus
gagagcatctggacctttgtaacat

SEQ ID NO: 472431 - DNA, 25 bp, Mus musculus
gagagcatctggtcctttgtaacat

SEQ ID NO: 472432 - DNA, 25 bp, Mus musculus
gagagcatctgtcttctgacatgca

SEQ ID NO: 472433 - DNA, 25 bp, Mus musculus
gagagcatctgtgttctgacatgca

SEQ ID NO: 472434 - DNA, 25 bp, Mus musculus
gagagcatcttccagtgcaatcact

SEQ ID NO: 472435 - DNA, 25 bp, Mus musculus
gagagcatcttcgagtgcaatcact

SEQ ID NO: 472436 - DNA, 25 bp, Mus musculus
gagagcatgagacttccacgggaac

SEQ ID NO: 472437 - DNA, 25 bp, Mus musculus
gagagcatgagagttccacgggaac

SEQ ID NO: 472438 - DNA, 25 bp, Mus musculus
gagagcatgcctacactgctgtaag

SEQ ID NO: 472439 - DNA, 25 bp, Mus musculus
gagagcatgcctacattaattcaaa

SEQ ID NO: 472440 - DNA, 25 bp, Mus musculus
gagagcatgccttcactgctgtaag

SEQ ID NO: 472441 - DNA, 25 bp, Mus musculus
gagagcatgccttcattaattcaaa

SEQ ID NO: 472442 - DNA, 25 bp, Mus musculus
gagagcatgcggcaacacctcaagt

SEQ ID NO: 472443 - DNA, 25 bp, Mus musculus
gagagcatgcgggaacacctcaagt

SEQ ID NO: 472444 - DNA, 25 bp, Mus musculus
gagagcatgctgaccttgctattat

SEQ ID NO: 472445 - DNA, 25 bp, Mus musculus
gagagcatgctgcactgttagacta

SEQ ID NO: 472446 - DNA, 25 bp, Mus musculus
gagagcatgctggactgttagacta

SEQ ID NO: 472447 - DNA, 25 bp, Mus musculus
gagagcatgctgtccttgctattat

SEQ ID NO: 472448 - DNA, 25 bp, Mus musculus
gagagcatgcttcagatcccacggc

SEQ ID NO: 472449 - DNA, 25 bp, Mus musculus
gagagcatgcttgagatcccacggc

SEQ ID NO: 472450 - DNA, 25 bp, Mus musculus
gagagcatggagcaattctctgtga

SEQ ID NO: 472451 - DNA, 25 bp, Mus musculus
gagagcatggaggaattctctgtga

SEQ ID NO: 472452 - DNA, 25 bp, Mus musculus
gagagcatggtgaatgcatggacat

SEQ ID NO: 472453 - DNA, 25 bp, Mus musculus
gagagcatggtgtatgcatggacat

SEQ ID NO: 472454 - DNA, 25 bp, Mus musculus
gagagcattaaaccagtcaagttat

SEQ ID NO: 472455 - DNA, 25 bp, Mus musculus
gagagcattaaacgaagacacctga

SEQ ID NO: 472456 - DNA, 25 bp, Mus musculus
gagagcattaaagcagtcaagttat

SEQ ID NO: 472457 - DNA, 25 bp, Mus musculus
gagagcattaaaggaagacacctga

SEQ ID NO: 472458 - DNA, 25 bp, Mus musculus
gagagcattaacagcgcgttcgcgg

SEQ ID NO: 472459 - DNA, 25 bp, Mus musculus
gagagcattaactgcgcgttcgcgg

SEQ ID NO: 472460 - DNA, 25 bp, Mus musculus
gagagcattaggacccattgacacg

SEQ ID NO: 472461 - DNA, 25 bp, Mus musculus
gagagcattaggtcccattgacacg

SEQ ID NO: 472462 - DNA, 25 bp, Mus musculus
gagagcattatgatcatcccagagg

SEQ ID NO: 472463 - DNA, 25 bp, Mus musculus
gagagcattatgttcatcccagagg

SEQ ID NO: 472464 - DNA, 25 bp, Mus musculus
gagagcattcatagcccaggcaata

SEQ ID NO: 472465 - DNA, 25 bp, Mus musculus
gagagcattcattgcccaggcaata

SEQ ID NO: 472466 - DNA, 25 bp, Mus musculus
gagagcattgtgctcttcttcttcc

SEQ ID NO: 472467 - DNA, 25 bp, Mus musculus
gagagcattgtggtcttcttcttcc

SEQ ID NO: 472468 - DNA, 25 bp, Mus musculus
gagagcatttctaggtatctctggg

SEQ ID NO: 472469 - DNA, 25 bp, Mus musculus
gagagcatttcttggtatctctggg

SEQ ID NO: 472470 - DNA, 25 bp, Mus musculus
gagagcatttgtacaactccaaagt

SEQ ID NO: 472471 - DNA, 25 bp, Mus musculus
gagagcatttgtcctttgtgtagct

SEQ ID NO: 472472 - DNA, 25 bp, Mus musculus
gagagcatttgtgctttgtgtagct

SEQ ID NO: 472473 - DNA, 25 bp, Mus musculus
gagagcatttgttcaactccaaagt

SEQ ID NO: 472474 - DNA, 25 bp, Mus musculus
gagagcattttcaaacgagttacgt

SEQ ID NO: 472475 - DNA, 25 bp, Mus musculus
gagagcattttctaacgagttacgt

SEQ ID NO: 472476 - DNA, 25 bp, Mus musculus
gagagcattttgcttgctgattcta

SEQ ID NO: 472477 - DNA, 25 bp, Mus musculus
gagagcattttggttgctgattcta

SEQ ID NO: 472478 - DNA, 25 bp, Mus musculus
gagagcatttttcatgacatgttgt

SEQ ID NO: 472479 - DNA, 25 bp, Mus musculus
gagagcatttttgatgacatgttgt

SEQ ID NO: 472480 - DNA, 25 bp, Mus musculus
gagagccaaaatcagcctgtctgca

SEQ ID NO: 472481 - DNA, 25 bp, Mus musculus
gagagccaaaatgagcctgtctgca

SEQ ID NO: 472482 - DNA, 25 bp, Mus musculus
gagagccaaactataccaaggaatt

SEQ ID NO: 472483 - DNA, 25 bp, Mus musculus
gagagccaaactttaccaaggaatt

SEQ ID NO: 472484 - DNA, 25 bp, Mus musculus
gagagccaacatactaggccttgaa

SEQ ID NO: 472485 - DNA, 25 bp, Mus musculus
gagagccaacattctaggccttgaa

SEQ ID NO: 472486 - DNA, 25 bp, Mus musculus
gagagccaacctagtaccaatgcaa

SEQ ID NO: 472487 - DNA, 25 bp, Mus musculus
gagagccaaccttgtaccaatgcaa

SEQ ID NO: 472488 - DNA, 25 bp, Mus musculus
gagagccaactaataacactgcctt

SEQ ID NO: 472489 - DNA, 25 bp, Mus musculus
gagagccaactattaacactgcctt

SEQ ID NO: 472490 - DNA, 25 bp, Mus musculus
gagagccaaggtatacacaaaccct

SEQ ID NO: 472491 - DNA, 25 bp, Mus musculus
gagagccaaggtttacacaaaccct

SEQ ID NO: 472492 - DNA, 25 bp, Mus musculus
gagagccaagtacagaaccccacca

SEQ ID NO: 472493 - DNA, 25 bp, Mus musculus
gagagccaagtagagaaccccacca

SEQ ID NO: 472494 - DNA, 25 bp, Mus musculus
gagagccaatagcaaacagagtttt

SEQ ID NO: 472495 - DNA, 25 bp, Mus musculus
gagagccaataggaaacagagtttt

SEQ ID NO: 472496 - DNA, 25 bp, Mus musculus
gagagccacattcttcaggtgctta

SEQ ID NO: 472497 - DNA, 25 bp, Mus musculus
gagagccacattgttcaggtgctta

SEQ ID NO: 472498 - DNA, 25 bp, Mus musculus
gagagccaccctagtatgcaaaaac

SEQ ID NO: 472499 - DNA, 25 bp, Mus musculus
gagagccacccttgtatgcaaaaac

SEQ ID NO: 472500 - DNA, 25 bp, Mus musculus
gagagccacctcaacaaatacttcc

SEQ ID NO: 472501 - DNA, 25 bp, Mus musculus
gagagccacctctacaaatacttcc

SEQ ID NO: 472502 - DNA, 25 bp, Mus musculus
gagagccacgatagatgctacccgc

SEQ ID NO: 472503 - DNA, 25 bp, Mus musculus
gagagccacgattgatgctacccgc

SEQ ID NO: 472504 - DNA, 25 bp, Mus musculus
gagagccactacaagggtccagcta

SEQ ID NO: 472505 - DNA, 25 bp, Mus musculus
gagagccactactagggtccagcta

SEQ ID NO: 472506 - DNA, 25 bp, Mus musculus
gagagccagacaaattgctacccta

SEQ ID NO: 472507 - DNA, 25 bp, Mus musculus
gagagccagacatattgctacccta

SEQ ID NO: 472508 - DNA, 25 bp, Mus musculus
gagagccagacccagcaagctagag

SEQ ID NO: 472509 - DNA, 25 bp, Mus musculus
gagagccagaccgagcaagctagag

SEQ ID NO: 472510 - DNA, 25 bp, Mus musculus
gagagccagcaaatccagcaagcac

SEQ ID NO: 472511 - DNA, 25 bp, Mus musculus
gagagccagcaattccagcaagcac

SEQ ID NO: 472512 - DNA, 25 bp, Mus musculus
gagagccagcttccatgagttgtcc

SEQ ID NO: 472513 - DNA, 25 bp, Mus musculus
gagagccagcttgcatgagttgtcc

SEQ ID NO: 472514 - DNA, 25 bp, Mus musculus
gagagccaggacagtccctaggaaa

SEQ ID NO: 472515 - DNA, 25 bp, Mus musculus
gagagccaggactgtccctaggaaa

SEQ ID NO: 472516 - DNA, 25 bp, Mus musculus
gagagccaggctccgaagtcctcca

SEQ ID NO: 472517 - DNA, 25 bp, Mus musculus
gagagccaggctgcgaagtcctcca

SEQ ID NO: 472518 - DNA, 25 bp, Mus musculus
gagagccagggaattaccaagaaac

SEQ ID NO: 472519 - DNA, 25 bp, Mus musculus
gagagccagggatttaccaagaaac

SEQ ID NO: 472520 - DNA, 25 bp, Mus musculus
gagagccaggtccagcatccggtaa

SEQ ID NO: 472521 - DNA, 25 bp, Mus musculus
gagagccaggtcgagcatccggtaa

SEQ ID NO: 472522 - DNA, 25 bp, Mus musculus
gagagccagtctcagtgaagccact

SEQ ID NO: 472523 - DNA, 25 bp, Mus musculus
gagagccagtctgagtgaagccact

SEQ ID NO: 472524 - DNA, 25 bp, Mus musculus
gagagccagtgtcccgtcagtcaaa

SEQ ID NO: 472525 - DNA, 25 bp, Mus musculus
gagagccagtgtgccgtcagtcaaa

SEQ ID NO: 472526 - DNA, 25 bp, Mus musculus
gagagccataatacctttcaacata

SEQ ID NO: 472527 - DNA, 25 bp, Mus musculus
gagagccataattcctttcaacata

SEQ ID NO: 472528 - DNA, 25 bp, Mus musculus
gagagccatattaacaccttccaac

SEQ ID NO: 472529 - DNA, 25 bp, Mus musculus
gagagccatatttacaccttccaac

SEQ ID NO: 472530 - DNA, 25 bp, Mus musculus
gagagccatcagatagctatcagaa

SEQ ID NO: 472531 - DNA, 25 bp, Mus musculus
gagagccatcagatctggcaggaga

SEQ ID NO: 472532 - DNA, 25 bp, Mus musculus
gagagccatcagttagctatcagaa

SEQ ID NO: 472533 - DNA, 25 bp, Mus musculus
gagagccatcagttctggcaggaga

SEQ ID NO: 472534 - DNA, 25 bp, Mus musculus
gagagccatccacgtaattacccct

SEQ ID NO: 472535 - DNA, 25 bp, Mus musculus
gagagccatccaggtaattacccct

SEQ ID NO: 472536 - DNA, 25 bp, Mus musculus
gagagccatcctcgtttcacaggaa

SEQ ID NO: 472537 - DNA, 25 bp, Mus musculus
gagagccatcctggtttcacaggaa

SEQ ID NO: 472538 - DNA, 25 bp, Mus musculus
gagagccatctgacagtaccagctg

SEQ ID NO: 472539 - DNA, 25 bp, Mus musculus
gagagccatctgtcagtaccagctg

SEQ ID NO: 472540 - DNA, 25 bp, Mus musculus
gagagccatcttatcaatgacagga

SEQ ID NO: 472541 - DNA, 25 bp, Mus musculus
gagagccatcttttcaatgacagga

SEQ ID NO: 472542 - DNA, 25 bp, Mus musculus
gagagccatgaacgctttctaagga

SEQ ID NO: 472543 - DNA, 25 bp, Mus musculus
gagagccatgaaggctttctaagga

SEQ ID NO: 472544 - DNA, 25 bp, Mus musculus
gagagccatgcacagaccagtacat

SEQ ID NO: 472545 - DNA, 25 bp, Mus musculus
gagagccatgcagagaccagtacat

SEQ ID NO: 472546 - DNA, 25 bp, Mus musculus
gagagccatggcactcaaggtccta

SEQ ID NO: 472547 - DNA, 25 bp, Mus musculus
gagagccatggctctcaaggtccta

SEQ ID NO: 472548 - DNA, 25 bp, Mus musculus
gagagccatgtcactcaatatgctg

SEQ ID NO: 472549 - DNA, 25 bp, Mus musculus
gagagccatgtctctcaatatgctg

SEQ ID NO: 472550 - DNA, 25 bp, Mus musculus
gagagccattaactgtggtccaaga

SEQ ID NO: 472551 - DNA, 25 bp, Mus musculus
gagagccattaagtgtggtccaaga

SEQ ID NO: 472552 - DNA, 25 bp, Mus musculus
gagagccattataaaactttcacaa

SEQ ID NO: 472553 - DNA, 25 bp, Mus musculus
gagagccattattaaactttcacaa

SEQ ID NO: 472554 - DNA, 25 bp, Mus musculus
gagagcccaatgattagcaaagttt

SEQ ID NO: 472555 - DNA, 25 bp, Mus musculus
gagagcccaatgtttagcaaagttt

SEQ ID NO: 472556 - DNA, 25 bp, Mus musculus
gagagcccagacatattgaaacccc

SEQ ID NO: 472557 - DNA, 25 bp, Mus musculus
gagagcccagacttattgaaacccc

SEQ ID NO: 472558 - DNA, 25 bp, Mus musculus
gagagcccagagctaacagaacagc

SEQ ID NO: 472559 - DNA, 25 bp, Mus musculus
gagagcccagaggtaacagaacagc

SEQ ID NO: 472560 - DNA, 25 bp, Mus musculus
gagagcccagcacacatggtgaaaa

SEQ ID NO: 472561 - DNA, 25 bp, Mus musculus
gagagcccagcagacatggtgaaaa

SEQ ID NO: 472562 - DNA, 25 bp, Mus musculus
gagagcccagttaacttttttacag

SEQ ID NO: 472563 - DNA, 25 bp, Mus musculus
gagagcccagtttacttttttacag

SEQ ID NO: 472564 - DNA, 25 bp, Mus musculus
gagagcccatcgatgcaccttgtga

SEQ ID NO: 472565 - DNA, 25 bp, Mus musculus
gagagcccatcgttgcaccttgtga

SEQ ID NO: 472566 - DNA, 25 bp, Mus musculus
gagagcccatggatatttataaact

SEQ ID NO: 472567 - DNA, 25 bp, Mus musculus
gagagcccatggttatttataaact

SEQ ID NO: 472568 - DNA, 25 bp, Mus musculus
gagagcccctacaccaggaggaata

SEQ ID NO: 472569 - DNA, 25 bp, Mus musculus
gagagcccctactccaggaggaata

SEQ ID NO: 472570 - DNA, 25 bp, Mus musculus
gagagcccctctcagacaggacaag

SEQ ID NO: 472571 - DNA, 25 bp, Mus musculus
gagagcccctctgagacaggacaag

SEQ ID NO: 472572 - DNA, 25 bp, Mus musculus
gagagcccgcttaaggtagaaggtt

SEQ ID NO: 472573 - DNA, 25 bp, Mus musculus
gagagcccgctttaggtagaaggtt

SEQ ID NO: 472574 - DNA, 25 bp, Mus musculus
gagagccctaccatagcccgattgt

SEQ ID NO: 472575 - DNA, 25 bp, Mus musculus
gagagccctaccttagcccgattgt

SEQ ID NO: 472576 - DNA, 25 bp, Mus musculus
gagagccctactcagccacctgggt

SEQ ID NO: 472577 - DNA, 25 bp, Mus musculus
gagagccctactgagccacctgggt

SEQ ID NO: 472578 - DNA, 25 bp, Mus musculus
gagagccctaggagctgtgtctact

SEQ ID NO: 472579 - DNA, 25 bp, Mus musculus
gagagccctaggtgctgtgtctact

SEQ ID NO: 472580 - DNA, 25 bp, Mus musculus
gagagccctggaacattgagtgaat

SEQ ID NO: 472581 - DNA, 25 bp, Mus musculus
gagagccctggatcattgagtgaat

SEQ ID NO: 472582 - DNA, 25 bp, Mus musculus
gagagcccttacaggaagaatgcct

SEQ ID NO: 472583 - DNA, 25 bp, Mus musculus
gagagcccttactggaagaatgcct

SEQ ID NO: 472584 - DNA, 25 bp, Mus musculus
gagagcccttagacacaatcagaac

SEQ ID NO: 472585 - DNA, 25 bp, Mus musculus
gagagcccttagtcacaatcagaac

SEQ ID NO: 472586 - DNA, 25 bp, Mus musculus
gagagcccttccatgaagtttatct

SEQ ID NO: 472587 - DNA, 25 bp, Mus musculus
gagagcccttccttgaagtttatct

SEQ ID NO: 472588 - DNA, 25 bp, Mus musculus
gagagcccttctagtatataattgc

SEQ ID NO: 472589 - DNA, 25 bp, Mus musculus
gagagcccttcttgtatataattgc

SEQ ID NO: 472590 - DNA, 25 bp, Mus musculus
gagagcccttgcatagtgtgcacaa

SEQ ID NO: 472591 - DNA, 25 bp, Mus musculus
gagagcccttgcttagtgtgcacaa

SEQ ID NO: 472592 - DNA, 25 bp, Mus musculus
gagagcccttggaaacgtcgtttct

SEQ ID NO: 472593 - DNA, 25 bp, Mus musculus
gagagcccttggtaacgtcgtttct

SEQ ID NO: 472594 - DNA, 25 bp, Mus musculus
gagagccgaaaactctggtcctttc

SEQ ID NO: 472595 - DNA, 25 bp, Mus musculus
gagagccgaaaagtctggtcctttc

SEQ ID NO: 472596 - DNA, 25 bp, Mus musculus
gagagccgaagacagccaagcctca

SEQ ID NO: 472597 - DNA, 25 bp, Mus musculus
gagagccgaagagagccaagcctca

SEQ ID NO: 472598 - DNA, 25 bp, Mus musculus
gagagccgacacagttgacttctgt

SEQ ID NO: 472599 - DNA, 25 bp, Mus musculus
gagagccgacactgttgacttctgt

SEQ ID NO: 472600 - DNA, 25 bp, Mus musculus
gagagccgacgccacttgccagcct

SEQ ID NO: 472601 - DNA, 25 bp, Mus musculus
gagagccgacgcgacttgccagcct

SEQ ID NO: 472602 - DNA, 25 bp, Mus musculus
gagagccgagcacacaacagatcat

SEQ ID NO: 472603 - DNA, 25 bp, Mus musculus
gagagccgagcagacaacagatcat

SEQ ID NO: 472604 - DNA, 25 bp, Mus musculus
gagagccggaaacccacgatacgcc

SEQ ID NO: 472605 - DNA, 25 bp, Mus musculus
gagagccggaaagccacgatacgcc

SEQ ID NO: 472606 - DNA, 25 bp, Mus musculus
gagagccggtatccagttatcctgc

SEQ ID NO: 472607 - DNA, 25 bp, Mus musculus
gagagccggtatgcagttatcctgc

SEQ ID NO: 472608 - DNA, 25 bp, Mus musculus
gagagccgttcacactggcagatct

SEQ ID NO: 472609 - DNA, 25 bp, Mus musculus
gagagccgttcagactggcagatct

SEQ ID NO: 472610 - DNA, 25 bp, Mus musculus
gagagcctaaaactctccaagttct

SEQ ID NO: 472611 - DNA, 25 bp, Mus musculus
gagagcctaaaagtctccaagttct

SEQ ID NO: 472612 - DNA, 25 bp, Mus musculus
gagagcctaatcagaagccctggca

SEQ ID NO: 472613 - DNA, 25 bp, Mus musculus
gagagcctaatctgaagccctggca

SEQ ID NO: 472614 - DNA, 25 bp, Mus musculus
gagagcctaattctttgggattcca

SEQ ID NO: 472615 - DNA, 25 bp, Mus musculus
gagagcctaattgtttgggattcca

SEQ ID NO: 472616 - DNA, 25 bp, Mus musculus
gagagcctacctcttatgaggataa

SEQ ID NO: 472617 - DNA, 25 bp, Mus musculus
gagagcctacctgttatgaggataa

SEQ ID NO: 472618 - DNA, 25 bp, Mus musculus
gagagcctactcatgattgggtgag

SEQ ID NO: 472619 - DNA, 25 bp, Mus musculus
gagagcctactcttgattgggtgag

SEQ ID NO: 472620 - DNA, 25 bp, Mus musculus
gagagcctagatagcatgtcactgt

SEQ ID NO: 472621 - DNA, 25 bp, Mus musculus
gagagcctagattgcatgtcactgt

SEQ ID NO: 472622 - DNA, 25 bp, Mus musculus
gagagcctcacacggcctctgtatt

SEQ ID NO: 472623 - DNA, 25 bp, Mus musculus
gagagcctcacagggcctctgtatt

SEQ ID NO: 472624 - DNA, 25 bp, Mus musculus
gagagcctcaggattctgtgcatta

SEQ ID NO: 472625 - DNA, 25 bp, Mus musculus
gagagcctcaggtttctgtgcatta

SEQ ID NO: 472626 - DNA, 25 bp, Mus musculus
gagagcctcatgcacaactaaactg

SEQ ID NO: 472627 - DNA, 25 bp, Mus musculus
gagagcctcatggacaactaaactg

SEQ ID NO: 472628 - DNA, 25 bp, Mus musculus
gagagcctccacaattgaaatgcct

SEQ ID NO: 472629 - DNA, 25 bp, Mus musculus
gagagcctccactattgaaatgcct

SEQ ID NO: 472630 - DNA, 25 bp, Mus musculus
gagagcctccagactatgtgtaggt

SEQ ID NO: 472631 - DNA, 25 bp, Mus musculus
gagagcctccagtctatgtgtaggt

SEQ ID NO: 472632 - DNA, 25 bp, Mus musculus
gagagcctccctcaggtaatggtct

SEQ ID NO: 472633 - DNA, 25 bp, Mus musculus
gagagcctccctgaggtaatggtct

SEQ ID NO: 472634 - DNA, 25 bp, Mus musculus
gagagcctcctaagtaatgtgggtt

SEQ ID NO: 472635 - DNA, 25 bp, Mus musculus
gagagcctcctatgtaatgtgggtt

SEQ ID NO: 472636 - DNA, 25 bp, Mus musculus
gagagcctcgagaatctgcttttaa

SEQ ID NO: 472637 - DNA, 25 bp, Mus musculus
gagagcctcgagtatctgcttttaa

SEQ ID NO: 472638 - DNA, 25 bp, Mus musculus
gagagcctctaaccatggaaactga

SEQ ID NO: 472639 - DNA, 25 bp, Mus musculus
gagagcctctaagcatggaaactga

SEQ ID NO: 472640 - DNA, 25 bp, Mus musculus
gagagcctctccctgaacgctgaga

SEQ ID NO: 472641 - DNA, 25 bp, Mus musculus
gagagcctctccgtgaacgctgaga

SEQ ID NO: 472642 - DNA, 25 bp, Mus musculus
gagagcctgagtatactggatctgt

SEQ ID NO: 472643 - DNA, 25 bp, Mus musculus
gagagcctgagtcctgacagcctgt

SEQ ID NO: 472644 - DNA, 25 bp, Mus musculus
gagagcctgagtgctgacagcctgt

SEQ ID NO: 472645 - DNA, 25 bp, Mus musculus
gagagcctgagtttactggatctgt

SEQ ID NO: 472646 - DNA, 25 bp, Mus musculus
gagagcctgcttatgtggttgctca

SEQ ID NO: 472647 - DNA, 25 bp, Mus musculus
gagagcctgcttttgtggttgctca

SEQ ID NO: 472648 - DNA, 25 bp, Mus musculus
gagagcctggatccgaaacttctcc

SEQ ID NO: 472649 - DNA, 25 bp, Mus musculus
gagagcctggatgcgaaacttctcc

SEQ ID NO: 472650 - DNA, 25 bp, Mus musculus
gagagcctggtacacgtggcttaaa

SEQ ID NO: 472651 - DNA, 25 bp, Mus musculus
gagagcctggtagacgtggcttaaa

SEQ ID NO: 472652 - DNA, 25 bp, Mus musculus
gagagcctgtacattgggctccctg

SEQ ID NO: 472653 - DNA, 25 bp, Mus musculus
gagagcctgtactttgggctccctg

SEQ ID NO: 472654 - DNA, 25 bp, Mus musculus
gagagcctgtatagtactaaaaaca

SEQ ID NO: 472655 - DNA, 25 bp, Mus musculus
gagagcctgtattgtactaaaaaca

SEQ ID NO: 472656 - DNA, 25 bp, Mus musculus
gagagcctgttcacgattcagaaga

SEQ ID NO: 472657 - DNA, 25 bp, Mus musculus
gagagcctgttctcgattcagaaga

SEQ ID NO: 472658 - DNA, 25 bp, Mus musculus
gagagcctgttgaacttagttgcca

SEQ ID NO: 472659 - DNA, 25 bp, Mus musculus
gagagcctgttgtacttagttgcca

SEQ ID NO: 472660 - DNA, 25 bp, Mus musculus
gagagccttattcgattcagtgtag

SEQ ID NO: 472661 - DNA, 25 bp, Mus musculus
gagagccttattggattcagtgtag

SEQ ID NO: 472662 - DNA, 25 bp, Mus musculus
gagagccttcagcaactggacattg

SEQ ID NO: 472663 - DNA, 25 bp, Mus musculus
gagagccttcaggaactggacattg

SEQ ID NO: 472664 - DNA, 25 bp, Mus musculus
gagagccttctaacgtaggcaacat

SEQ ID NO: 472665 - DNA, 25 bp, Mus musculus
gagagccttctatcgtaggcaacat

SEQ ID NO: 472666 - DNA, 25 bp, Mus musculus
gagagccttgacaacatggccacct

SEQ ID NO: 472667 - DNA, 25 bp, Mus musculus
gagagccttgactacatggccacct

SEQ ID NO: 472668 - DNA, 25 bp, Mus musculus
gagagcctttacctacagcactgtg

SEQ ID NO: 472669 - DNA, 25 bp, Mus musculus
gagagcctttacgtacagcactgtg

SEQ ID NO: 472670 - DNA, 25 bp, Mus musculus
gagagcgaacttctggtacctatct

SEQ ID NO: 472671 - DNA, 25 bp, Mus musculus
gagagcgaacttgtggtacctatct

SEQ ID NO: 472672 - DNA, 25 bp, Mus musculus
gagagcgacaacactgtccttgaaa

SEQ ID NO: 472673 - DNA, 25 bp, Mus musculus
gagagcgacaactctgtccttgaaa

SEQ ID NO: 472674 - DNA, 25 bp, Mus musculus
gagagcgacacaccagaactctgca

SEQ ID NO: 472675 - DNA, 25 bp, Mus musculus
gagagcgacacagcagaactctgca

SEQ ID NO: 472676 - DNA, 25 bp, Mus musculus
gagagcgaccacatccacatcatag

SEQ ID NO: 472677 - DNA, 25 bp, Mus musculus
gagagcgaccacttccacatcatag

SEQ ID NO: 472678 - DNA, 25 bp, Mus musculus
gagagcgactgcagagcggtaccac

SEQ ID NO: 472679 - DNA, 25 bp, Mus musculus
gagagcgactgctgagcggtaccac

SEQ ID NO: 472680 - DNA, 25 bp, Mus musculus
gagagcgagaataccgtcatcgtta

SEQ ID NO: 472681 - DNA, 25 bp, Mus musculus
gagagcgagaattccgtcatcgtta

SEQ ID NO: 472682 - DNA, 25 bp, Mus musculus
gagagcgagagaccctttacctaca

SEQ ID NO: 472683 - DNA, 25 bp, Mus musculus
gagagcgagagagcctttacctaca

SEQ ID NO: 472684 - DNA, 25 bp, Mus musculus
gagagcgagctaagaatgaatgtga

SEQ ID NO: 472685 - DNA, 25 bp, Mus musculus
gagagcgagctatgaatgaatgtga

SEQ ID NO: 472686 - DNA, 25 bp, Mus musculus
gagagcgagtggaccgtttctttag

SEQ ID NO: 472687 - DNA, 25 bp, Mus musculus
gagagcgagtggtccgtttctttag

SEQ ID NO: 472688 - DNA, 25 bp, Mus musculus
gagagcgattccagcaatcctgacc

SEQ ID NO: 472689 - DNA, 25 bp, Mus musculus
gagagcgattcctgcaatcctgacc

SEQ ID NO: 472690 - DNA, 25 bp, Mus musculus
gagagcgcaagaactacctggccat

SEQ ID NO: 472691 - DNA, 25 bp, Mus musculus
gagagcgcaagatctacctggccat

SEQ ID NO: 472692 - DNA, 25 bp, Mus musculus
gagagcgcaccgcaaaatgaggtca

SEQ ID NO: 472693 - DNA, 25 bp, Mus musculus
gagagcgcaccggaaaatgaggtca

SEQ ID NO: 472694 - DNA, 25 bp, Mus musculus
gagagcgcaggaccacattcaatca

SEQ ID NO: 472695 - DNA, 25 bp, Mus musculus
gagagcgcaggagcacattcaatca

SEQ ID NO: 472696 - DNA, 25 bp, Mus musculus
gagagcgcagtgacccagcattcag

SEQ ID NO: 472697 - DNA, 25 bp, Mus musculus
gagagcgcagtgtcccagcattcag

SEQ ID NO: 472698 - DNA, 25 bp, Mus musculus
gagagcgcatcacggatgttgctta

SEQ ID NO: 472699 - DNA, 25 bp, Mus musculus
gagagcgcatcagggatgttgctta

SEQ ID NO: 472700 - DNA, 25 bp, Mus musculus
gagagcgcatggagcccacctacca

SEQ ID NO: 472701 - DNA, 25 bp, Mus musculus
gagagcgcatggtgcccacctacca

SEQ ID NO: 472702 - DNA, 25 bp, Mus musculus
gagagcgccaagcttccaagccaag

SEQ ID NO: 472703 - DNA, 25 bp, Mus musculus
gagagcgccaaggttccaagccaag

SEQ ID NO: 472704 - DNA, 25 bp, Mus musculus
gagagcgccggcaaagctgcagtat

SEQ ID NO: 472705 - DNA, 25 bp, Mus musculus
gagagcgccggctaagctgcagtat

SEQ ID NO: 472706 - DNA, 25 bp, Mus musculus
gagagcgcgggcaagcttgctttca

SEQ ID NO: 472707 - DNA, 25 bp, Mus musculus
gagagcgcgggctagcttgctttca

SEQ ID NO: 472708 - DNA, 25 bp, Mus musculus
gagagcgctcctagctggaaaggac

SEQ ID NO: 472709 - DNA, 25 bp, Mus musculus
gagagcgctccttgctggaaaggac

SEQ ID NO: 472710 - DNA, 25 bp, Mus musculus
gagagcggaaaccaagtagaagcaa

SEQ ID NO: 472711 - DNA, 25 bp, Mus musculus
gagagcggaaacgaagtagaagcaa

SEQ ID NO: 472712 - DNA, 25 bp, Mus musculus
gagagcggacacaacagtcacccag

SEQ ID NO: 472713 - DNA, 25 bp, Mus musculus
gagagcggacactacagtcacccag

SEQ ID NO: 472714 - DNA, 25 bp, Mus musculus
gagagcggatttcaatggttcagta

SEQ ID NO: 472715 - DNA, 25 bp, Mus musculus
gagagcggatttgaatggttcagta

SEQ ID NO: 472716 - DNA, 25 bp, Mus musculus
gagagcggcaccagtacaacacttg

SEQ ID NO: 472717 - DNA, 25 bp, Mus musculus
gagagcggcacctgtacaacacttg

SEQ ID NO: 472718 - DNA, 25 bp, Mus musculus
gagagcggcatcagcatggactccg

SEQ ID NO: 472719 - DNA, 25 bp, Mus musculus
gagagcggcatctgcatggactccg

SEQ ID NO: 472720 - DNA, 25 bp, Mus musculus
gagagcggcttccacaaccacacgg

SEQ ID NO: 472721 - DNA, 25 bp, Mus musculus
gagagcggcttcgacaaccacacgg

SEQ ID NO: 472722 - DNA, 25 bp, Mus musculus
gagagcgggctgagatccagatcct

SEQ ID NO: 472723 - DNA, 25 bp, Mus musculus
gagagcgggctgtgatccagatcct

SEQ ID NO: 472724 - DNA, 25 bp, Mus musculus
gagagcggtcatcactttctgtgga

SEQ ID NO: 472725 - DNA, 25 bp, Mus musculus
gagagcggtcatgactttctgtgga

SEQ ID NO: 472726 - DNA, 25 bp, Mus musculus
gagagcggttacctccccgagtaga

SEQ ID NO: 472727 - DNA, 25 bp, Mus musculus
gagagcggttacgtccccgagtaga

SEQ ID NO: 472728 - DNA, 25 bp, Mus musculus
gagagcgtagccatggacagcccag

SEQ ID NO: 472729 - DNA, 25 bp, Mus musculus
gagagcgtagccttggacagcccag

SEQ ID NO: 472730 - DNA, 25 bp, Mus musculus
gagagcgtaggtcatccttgtaaac

SEQ ID NO: 472731 - DNA, 25 bp, Mus musculus
gagagcgtaggtgatccttgtaaac

SEQ ID NO: 472732 - DNA, 25 bp, Mus musculus
gagagcgtatcaatgtgaacttcac

SEQ ID NO: 472733 - DNA, 25 bp, Mus musculus
gagagcgtatcattgtgaacttcac

SEQ ID NO: 472734 - DNA, 25 bp, Mus musculus
gagagcgtcactcccagtgggctca

SEQ ID NO: 472735 - DNA, 25 bp, Mus musculus
gagagcgtcactgccagtgggctca

SEQ ID NO: 472736 - DNA, 25 bp, Mus musculus
gagagcgtcagcaacacagaacgtc

SEQ ID NO: 472737 - DNA, 25 bp, Mus musculus
gagagcgtcagctacacagaacgtc

SEQ ID NO: 472738 - DNA, 25 bp, Mus musculus
gagagcgtccctcgcattcgagaga

SEQ ID NO: 472739 - DNA, 25 bp, Mus musculus
gagagcgtccctggcattcgagaga

SEQ ID NO: 472740 - DNA, 25 bp, Mus musculus
gagagcgtgatgctagttcccaccc

SEQ ID NO: 472741 - DNA, 25 bp, Mus musculus
gagagcgtgatggtagttcccaccc

SEQ ID NO: 472742 - DNA, 25 bp, Mus musculus
gagagcgtgctcatcaacctgacca

SEQ ID NO: 472743 - DNA, 25 bp, Mus musculus
gagagcgtgctcttcaacctgacca

SEQ ID NO: 472744 - DNA, 25 bp, Mus musculus
gagagcgtgttaatgcaatttcagc

SEQ ID NO: 472745 - DNA, 25 bp, Mus musculus
gagagcgtgttattgcaatttcagc

SEQ ID NO: 472746 - DNA, 25 bp, Mus musculus
gagagctaaactaccctttgctgaa

SEQ ID NO: 472747 - DNA, 25 bp, Mus musculus
gagagctaaacttccctttgctgaa

SEQ ID NO: 472748 - DNA, 25 bp, Mus musculus
gagagctaaatgctttcaagtcaat

SEQ ID NO: 472749 - DNA, 25 bp, Mus musculus
gagagctaaatggtttcaagtcaat

SEQ ID NO: 472750 - DNA, 25 bp, Mus musculus
gagagctacacactgatagagcaga

SEQ ID NO: 472751 - DNA, 25 bp, Mus musculus
gagagctacacagtgatagagcaga

SEQ ID NO: 472752 - DNA, 25 bp, Mus musculus
gagagctacagtccatcatctaggg

SEQ ID NO: 472753 - DNA, 25 bp, Mus musculus
gagagctacagtccttttgtacagt

SEQ ID NO: 472754 - DNA, 25 bp, Mus musculus
gagagctacagtgcatcatctaggg

SEQ ID NO: 472755 - DNA, 25 bp, Mus musculus
gagagctacagtgcttttgtacagt

SEQ ID NO: 472756 - DNA, 25 bp, Mus musculus
gagagctacctccacaccaaataaa

SEQ ID NO: 472757 - DNA, 25 bp, Mus musculus
gagagctacctcgacaccaaataaa

SEQ ID NO: 472758 - DNA, 25 bp, Mus musculus
gagagctactcgctgtacgtgtaca

SEQ ID NO: 472759 - DNA, 25 bp, Mus musculus
gagagctactcggtgtacgtgtaca

SEQ ID NO: 472760 - DNA, 25 bp, Mus musculus
gagagctactttagggcacttgtgc

SEQ ID NO: 472761 - DNA, 25 bp, Mus musculus
gagagctacttttgggcacttgtgc

SEQ ID NO: 472762 - DNA, 25 bp, Mus musculus
gagagctagaagatggtcccggtcc

SEQ ID NO: 472763 - DNA, 25 bp, Mus musculus
gagagctagaagttggtcccggtcc

SEQ ID NO: 472764 - DNA, 25 bp, Mus musculus
gagagctagagtccctgcttaatta

SEQ ID NO: 472765 - DNA, 25 bp, Mus musculus
gagagctagagtgcctgcttaatta

SEQ ID NO: 472766 - DNA, 25 bp, Mus musculus
gagagctagcatccagtctccctgt

SEQ ID NO: 472767 - DNA, 25 bp, Mus musculus
gagagctagcatgcagtctccctgt

SEQ ID NO: 472768 - DNA, 25 bp, Mus musculus
gagagctagctgctcatgcgccaag

SEQ ID NO: 472769 - DNA, 25 bp, Mus musculus
gagagctagctggtcatgcgccaag

SEQ ID NO: 472770 - DNA, 25 bp, Mus musculus
gagagctaggctccaatctcatgga

SEQ ID NO: 472771 - DNA, 25 bp, Mus musculus
gagagctaggctgcaatctcatgga

SEQ ID NO: 472772 - DNA, 25 bp, Mus musculus
gagagctagtaacaatcaccatgga

SEQ ID NO: 472773 - DNA, 25 bp, Mus musculus
gagagctagtaagaatcaccatgga

SEQ ID NO: 472774 - DNA, 25 bp, Mus musculus
gagagctagtgtccctctcttgcta

SEQ ID NO: 472775 - DNA, 25 bp, Mus musculus
gagagctagtgtgcctctcttgcta

SEQ ID NO: 472776 - DNA, 25 bp, Mus musculus
gagagctataacacctttattggac

SEQ ID NO: 472777 - DNA, 25 bp, Mus musculus
gagagctataactcctttattggac

SEQ ID NO: 472778 - DNA, 25 bp, Mus musculus
gagagctatacaacggtttttgttt

SEQ ID NO: 472779 - DNA, 25 bp, Mus musculus
gagagctatacatcggtttttgttt

SEQ ID NO: 472780 - DNA, 25 bp, Mus musculus
gagagctataccctggtgcaatgac

SEQ ID NO: 472781 - DNA, 25 bp, Mus musculus
gagagctataccgtggtgcaatgac

SEQ ID NO: 472782 - DNA, 25 bp, Mus musculus
gagagctatactagctgggtttcca

SEQ ID NO: 472783 - DNA, 25 bp, Mus musculus
gagagctatacttgctgggtttcca

SEQ ID NO: 472784 - DNA, 25 bp, Mus musculus
gagagctatagcctgctgtgcagac

SEQ ID NO: 472785 - DNA, 25 bp, Mus musculus
gagagctatagcgtgctgtgcagac

SEQ ID NO: 472786 - DNA, 25 bp, Mus musculus
gagagctatatacggctgttgcagc

SEQ ID NO: 472787 - DNA, 25 bp, Mus musculus
gagagctatatagggctgttgcagc

SEQ ID NO: 472788 - DNA, 25 bp, Mus musculus
gagagctatcacaagccgactaccg

SEQ ID NO: 472789 - DNA, 25 bp, Mus musculus
gagagctatcactagccgactaccg

SEQ ID NO: 472790 - DNA, 25 bp, Mus musculus
gagagctatcatcatgtccatgtgg

SEQ ID NO: 472791 - DNA, 25 bp, Mus musculus
gagagctatcatgatgtccatgtgg

SEQ ID NO: 472792 - DNA, 25 bp, Mus musculus
gagagctatccacaatgacattgta

SEQ ID NO: 472793 - DNA, 25 bp, Mus musculus
gagagctatccagaatgacattgta

SEQ ID NO: 472794 - DNA, 25 bp, Mus musculus
gagagctatgacaccagagcaactg

SEQ ID NO: 472795 - DNA, 25 bp, Mus musculus
gagagctatgactccagagcaactg

SEQ ID NO: 472796 - DNA, 25 bp, Mus musculus
gagagctatggtatttaatttattg

SEQ ID NO: 472797 - DNA, 25 bp, Mus musculus
gagagctatggtttttaatttattg

SEQ ID NO: 472798 - DNA, 25 bp, Mus musculus
gagagctattaactcacgtgccatg

SEQ ID NO: 472799 - DNA, 25 bp, Mus musculus
gagagctattaagtcacgtgccatg

SEQ ID NO: 472800 - DNA, 25 bp, Mus musculus
gagagctattacaacatcctttgct

SEQ ID NO: 472801 - DNA, 25 bp, Mus musculus
gagagctattactacatcctttgct

SEQ ID NO: 472802 - DNA, 25 bp, Mus musculus
gagagctattgtctattttccaaac

SEQ ID NO: 472803 - DNA, 25 bp, Mus musculus
gagagctattgtgtattttccaaac

SEQ ID NO: 472804 - DNA, 25 bp, Mus musculus
gagagctcaaccctgggatcatgtg

SEQ ID NO: 472805 - DNA, 25 bp, Mus musculus
gagagctcaaccgtgggatcatgtg

SEQ ID NO: 472806 - DNA, 25 bp, Mus musculus
gagagctcaactcctcaaagattga

SEQ ID NO: 472807 - DNA, 25 bp, Mus musculus
gagagctcaactgctcaaagattga

SEQ ID NO: 472808 - DNA, 25 bp, Mus musculus
gagagctcacataggaggtcagcct

SEQ ID NO: 472809 - DNA, 25 bp, Mus musculus
gagagctcacatctccaggtgttcc

SEQ ID NO: 472810 - DNA, 25 bp, Mus musculus
gagagctcacatgtccaggtgttcc

SEQ ID NO: 472811 - DNA, 25 bp, Mus musculus
gagagctcacattggaggtcagcct

SEQ ID NO: 472812 - DNA, 25 bp, Mus musculus
gagagctcaccacttaaaagaccag

SEQ ID NO: 472813 - DNA, 25 bp, Mus musculus
gagagctcaccagttaaaagaccag

SEQ ID NO: 472814 - DNA, 25 bp, Mus musculus
gagagctcacttaggacaaggtact

SEQ ID NO: 472815 - DNA, 25 bp, Mus musculus
gagagctcacttcttatttgactat

SEQ ID NO: 472816 - DNA, 25 bp, Mus musculus
gagagctcacttgttatttgactat

SEQ ID NO: 472817 - DNA, 25 bp, Mus musculus
gagagctcactttggacaaggtact

SEQ ID NO: 472818 - DNA, 25 bp, Mus musculus
gagagctcagaaaacgttcccagcc

SEQ ID NO: 472819 - DNA, 25 bp, Mus musculus
gagagctcagaatacgttcccagcc

SEQ ID NO: 472820 - DNA, 25 bp, Mus musculus
gagagctcagagcataacagcacat

SEQ ID NO: 472821 - DNA, 25 bp, Mus musculus
gagagctcagaggataacagcacat

SEQ ID NO: 472822 - DNA, 25 bp, Mus musculus
gagagctcagatactgtcaccagaa

SEQ ID NO: 472823 - DNA, 25 bp, Mus musculus
gagagctcagattctgtcaccagaa

SEQ ID NO: 472824 - DNA, 25 bp, Mus musculus
gagagctcagcaccctgcggaactt

SEQ ID NO: 472825 - DNA, 25 bp, Mus musculus
gagagctcagcagcctgcggaactt

SEQ ID NO: 472826 - DNA, 25 bp, Mus musculus
gagagctcaggcaagtcccgacatg

SEQ ID NO: 472827 - DNA, 25 bp, Mus musculus
gagagctcaggctagtcccgacatg

SEQ ID NO: 472828 - DNA, 25 bp, Mus musculus
gagagctcagttactcatgaaacgt

SEQ ID NO: 472829 - DNA, 25 bp, Mus musculus
gagagctcagtttctcatgaaacgt

SEQ ID NO: 472830 - DNA, 25 bp, Mus musculus
gagagctccaataggctgtttatga

SEQ ID NO: 472831 - DNA, 25 bp, Mus musculus
gagagctccaattggctgtttatga

SEQ ID NO: 472832 - DNA, 25 bp, Mus musculus
gagagctccacacattttgctacaa

SEQ ID NO: 472833 - DNA, 25 bp, Mus musculus
gagagctccacagattttgctacaa

SEQ ID NO: 472834 - DNA, 25 bp, Mus musculus
gagagctccccaatgtcagggcaag

SEQ ID NO: 472835 - DNA, 25 bp, Mus musculus
gagagctccccattgtcagggcaag

SEQ ID NO: 472836 - DNA, 25 bp, Mus musculus
gagagctcccggagggcacctccat

SEQ ID NO: 472837 - DNA, 25 bp, Mus musculus
gagagctcccggtgggcacctccat

SEQ ID NO: 472838 - DNA, 25 bp, Mus musculus
gagagctccgttctttctaagtgaa

SEQ ID NO: 472839 - DNA, 25 bp, Mus musculus
gagagctccgttgtttctaagtgaa

SEQ ID NO: 472840 - DNA, 25 bp, Mus musculus
gagagctcctcacaatatacgcagc

SEQ ID NO: 472841 - DNA, 25 bp, Mus musculus
gagagctcctcacataaactgtcat

SEQ ID NO: 472842 - DNA, 25 bp, Mus musculus
gagagctcctcagaatatacgcagc

SEQ ID NO: 472843 - DNA, 25 bp, Mus musculus
gagagctcctcagataaactgtcat

SEQ ID NO: 472844 - DNA, 25 bp, Mus musculus
gagagctcctcccaaagctaaagtg

SEQ ID NO: 472845 - DNA, 25 bp, Mus musculus
gagagctcctccgaaagctaaagtg

SEQ ID NO: 472846 - DNA, 25 bp, Mus musculus
gagagctcctggataactgtgcagt

SEQ ID NO: 472847 - DNA, 25 bp, Mus musculus
gagagctcctggttaactgtgcagt

SEQ ID NO: 472848 - DNA, 25 bp, Mus musculus
gagagctcgggcaatctatgaatta

SEQ ID NO: 472849 - DNA, 25 bp, Mus musculus
gagagctcgggctatctatgaatta

SEQ ID NO: 472850 - DNA, 25 bp, Mus musculus
gagagctcggttatcctaggtggaa

SEQ ID NO: 472851 - DNA, 25 bp, Mus musculus
gagagctcggttttcctaggtggaa

SEQ ID NO: 472852 - DNA, 25 bp, Mus musculus
gagagctcgtaaccagctcgtggct

SEQ ID NO: 472853 - DNA, 25 bp, Mus musculus
gagagctcgtaacggccgcagcttc

SEQ ID NO: 472854 - DNA, 25 bp, Mus musculus
gagagctcgtaagcagctcgtggct

SEQ ID NO: 472855 - DNA, 25 bp, Mus musculus
gagagctcgtaagggccgcagcttc

SEQ ID NO: 472856 - DNA, 25 bp, Mus musculus
gagagctcgtgcacgcatgagtgta

SEQ ID NO: 472857 - DNA, 25 bp, Mus musculus
gagagctcgtgctcgcatgagtgta

SEQ ID NO: 472858 - DNA, 25 bp, Mus musculus
gagagctcgtttagagcctgtacat

SEQ ID NO: 472859 - DNA, 25 bp, Mus musculus
gagagctcgttttgagcctgtacat

SEQ ID NO: 472860 - DNA, 25 bp, Mus musculus
gagagctctactaacttggcattga

SEQ ID NO: 472861 - DNA, 25 bp, Mus musculus
gagagctctacttacttggcattga

SEQ ID NO: 472862 - DNA, 25 bp, Mus musculus
gagagctctaggacaccacaacacc

SEQ ID NO: 472863 - DNA, 25 bp, Mus musculus
gagagctctaggtcaccacaacacc

SEQ ID NO: 472864 - DNA, 25 bp, Mus musculus
gagagctctcaaattcctttgctta

SEQ ID NO: 472865 - DNA, 25 bp, Mus musculus
gagagctctcaatttcctttgctta

SEQ ID NO: 472866 - DNA, 25 bp, Mus musculus
gagagctctccacaaattaattaat

SEQ ID NO: 472867 - DNA, 25 bp, Mus musculus
gagagctctccactgaaagtgttca

SEQ ID NO: 472868 - DNA, 25 bp, Mus musculus
gagagctctccagaaattaattaat

SEQ ID NO: 472869 - DNA, 25 bp, Mus musculus
gagagctctccagtgaaagtgttca

SEQ ID NO: 472870 - DNA, 25 bp, Mus musculus
gagagctctccgcacaaccaatttg

SEQ ID NO: 472871 - DNA, 25 bp, Mus musculus
gagagctctccggacaaccaatttg

SEQ ID NO: 472872 - DNA, 25 bp, Mus musculus
gagagctctcctcatagcaacactt

SEQ ID NO: 472873 - DNA, 25 bp, Mus musculus
gagagctctcctgatagcaacactt

SEQ ID NO: 472874 - DNA, 25 bp, Mus musculus
gagagctctcttccaagctggtgac

SEQ ID NO: 472875 - DNA, 25 bp, Mus musculus
gagagctctcttgcaagctggtgac

SEQ ID NO: 472876 - DNA, 25 bp, Mus musculus
gagagctctgaccaggatagtcatt

SEQ ID NO: 472877 - DNA, 25 bp, Mus musculus
gagagctctgacgaggatagtcatt

SEQ ID NO: 472878 - DNA, 25 bp, Mus musculus
gagagctctgcgagaagccccggaa

SEQ ID NO: 472879 - DNA, 25 bp, Mus musculus
gagagctctgcgtgaagccccggaa

SEQ ID NO: 472880 - DNA, 25 bp, Mus musculus
gagagctctggaaggactcagttga

SEQ ID NO: 472881 - DNA, 25 bp, Mus musculus
gagagctctggatggactcagttga

SEQ ID NO: 472882 - DNA, 25 bp, Mus musculus
gagagctctgtaagatccaaggaca

SEQ ID NO: 472883 - DNA, 25 bp, Mus musculus
gagagctctgtatgatccaaggaca

SEQ ID NO: 472884 - DNA, 25 bp, Mus musculus
gagagctctgtcattgggattgtta

SEQ ID NO: 472885 - DNA, 25 bp, Mus musculus
gagagctctgtctttgggattgtta

SEQ ID NO: 472886 - DNA, 25 bp, Mus musculus
gagagctcttcgcacagctcagatt

SEQ ID NO: 472887 - DNA, 25 bp, Mus musculus
gagagctcttcggacagctcagatt

SEQ ID NO: 472888 - DNA, 25 bp, Mus musculus
gagagctcttggcaccatctacttc

SEQ ID NO: 472889 - DNA, 25 bp, Mus musculus
gagagctcttgggaccatctacttc

SEQ ID NO: 472890 - DNA, 25 bp, Mus musculus
gagagctctttgctgtccacaacct

SEQ ID NO: 472891 - DNA, 25 bp, Mus musculus
gagagctctttggtgtccacaacct

SEQ ID NO: 472892 - DNA, 25 bp, Mus musculus
gagagctgaagcacagtctggctac

SEQ ID NO: 472893 - DNA, 25 bp, Mus musculus
gagagctgaagctcagtctggctac

SEQ ID NO: 472894 - DNA, 25 bp, Mus musculus
gagagctgagcaacagcgcttcaga

SEQ ID NO: 472895 - DNA, 25 bp, Mus musculus
gagagctgagcatcagcgcttcaga

SEQ ID NO: 472896 - DNA, 25 bp, Mus musculus
gagagctgagctacaatttcctgtt

SEQ ID NO: 472897 - DNA, 25 bp, Mus musculus
gagagctgagctatagtgatcccag

SEQ ID NO: 472898 - DNA, 25 bp, Mus musculus
gagagctgagctatccaaagatatc

SEQ ID NO: 472899 - DNA, 25 bp, Mus musculus
gagagctgagcttcaatttcctgtt

SEQ ID NO: 472900 - DNA, 25 bp, Mus musculus
gagagctgagctttagtgatcccag

SEQ ID NO: 472901 - DNA, 25 bp, Mus musculus
gagagctgagctttccaaagatatc

SEQ ID NO: 472902 - DNA, 25 bp, Mus musculus
gagagctgaggaattacacatcaga

SEQ ID NO: 472903 - DNA, 25 bp, Mus musculus
gagagctgaggatttacacatcaga

SEQ ID NO: 472904 - DNA, 25 bp, Mus musculus
gagagctgattaagacctggagtgc

SEQ ID NO: 472905 - DNA, 25 bp, Mus musculus
gagagctgattatgacctggagtgc

SEQ ID NO: 472906 - DNA, 25 bp, Mus musculus
gagagctgatttaactggcattaat

SEQ ID NO: 472907 - DNA, 25 bp, Mus musculus
gagagctgatttctgcgtctagatt

SEQ ID NO: 472908 - DNA, 25 bp, Mus musculus
gagagctgatttgtgcgtctagatt

SEQ ID NO: 472909 - DNA, 25 bp, Mus musculus
gagagctgattttactggcattaat

SEQ ID NO: 472910 - DNA, 25 bp, Mus musculus
gagagctgcacccttctgtaaacac

SEQ ID NO: 472911 - DNA, 25 bp, Mus musculus
gagagctgcaccgttctgtaaacac

SEQ ID NO: 472912 - DNA, 25 bp, Mus musculus
gagagctgcatcagtgcttctgtag

SEQ ID NO: 472913 - DNA, 25 bp, Mus musculus
gagagctgcatctgtgcttctgtag

SEQ ID NO: 472914 - DNA, 25 bp, Mus musculus
gagagctgcatgaggtacctgcaca

SEQ ID NO: 472915 - DNA, 25 bp, Mus musculus
gagagctgcatgtggtacctgcaca

SEQ ID NO: 472916 - DNA, 25 bp, Mus musculus
gagagctgcattcgtctgcgtttat

SEQ ID NO: 472917 - DNA, 25 bp, Mus musculus
gagagctgcattggtctgcgtttat

SEQ ID NO: 472918 - DNA, 25 bp, Mus musculus
gagagctgccacactaggtaagcct

SEQ ID NO: 472919 - DNA, 25 bp, Mus musculus
gagagctgccacagccagggtcttt

SEQ ID NO: 472920 - DNA, 25 bp, Mus musculus
gagagctgccactctaggtaagcct

SEQ ID NO: 472921 - DNA, 25 bp, Mus musculus
gagagctgccactgccagggtcttt

SEQ ID NO: 472922 - DNA, 25 bp, Mus musculus
gagagctgccagatcagtagccaga

SEQ ID NO: 472923 - DNA, 25 bp, Mus musculus
gagagctgccagttcagtagccaga

SEQ ID NO: 472924 - DNA, 25 bp, Mus musculus
gagagctgctgcatagactgtgctt

SEQ ID NO: 472925 - DNA, 25 bp, Mus musculus
gagagctgctgcttagactgtgctt

SEQ ID NO: 472926 - DNA, 25 bp, Mus musculus
gagagctgctggaacgcggccatca

SEQ ID NO: 472927 - DNA, 25 bp, Mus musculus
gagagctgctggtacgcggccatca

SEQ ID NO: 472928 - DNA, 25 bp, Mus musculus
gagagctggagcattcgcacatcct

SEQ ID NO: 472929 - DNA, 25 bp, Mus musculus
gagagctggagctttcgcacatcct

SEQ ID NO: 472930 - DNA, 25 bp, Mus musculus
gagagctggatgacactgtatcttt

SEQ ID NO: 472931 - DNA, 25 bp, Mus musculus
gagagctggatgtcactgtatcttt

SEQ ID NO: 472932 - DNA, 25 bp, Mus musculus
gagagctggcaaatggaatacgttt

SEQ ID NO: 472933 - DNA, 25 bp, Mus musculus
gagagctggcaattggaatacgttt

SEQ ID NO: 472934 - DNA, 25 bp, Mus musculus
gagagctggctaaagccccattccc

SEQ ID NO: 472935 - DNA, 25 bp, Mus musculus
gagagctggctatagccccattccc

SEQ ID NO: 472936 - DNA, 25 bp, Mus musculus
gagagctgggacaggtcctgctcca

SEQ ID NO: 472937 - DNA, 25 bp, Mus musculus
gagagctgggactggtcctgctcca

SEQ ID NO: 472938 - DNA, 25 bp, Mus musculus
gagagctgggagactttccttttta

SEQ ID NO: 472939 - DNA, 25 bp, Mus musculus
gagagctgggagtctttccttttta

SEQ ID NO: 472940 - DNA, 25 bp, Mus musculus
gagagctgtaccaggtggcttttca

SEQ ID NO: 472941 - DNA, 25 bp, Mus musculus
gagagctgtacctggtggcttttca

SEQ ID NO: 472942 - DNA, 25 bp, Mus musculus
gagagctgtagcatgaacaactcca

SEQ ID NO: 472943 - DNA, 25 bp, Mus musculus
gagagctgtagcttgaacaactcca

SEQ ID NO: 472944 - DNA, 25 bp, Mus musculus
gagagctgtatgatgccctggtgaa

SEQ ID NO: 472945 - DNA, 25 bp, Mus musculus
gagagctgtatgttgccctggtgaa

SEQ ID NO: 472946 - DNA, 25 bp, Mus musculus
gagagctgtattatccacagaggat

SEQ ID NO: 472947 - DNA, 25 bp, Mus musculus
gagagctgtattttccacagaggat

SEQ ID NO: 472948 - DNA, 25 bp, Mus musculus
gagagctgtcaaagtcttcctgttg

SEQ ID NO: 472949 - DNA, 25 bp, Mus musculus
gagagctgtcaatgtcttcctgttg

SEQ ID NO: 472950 - DNA, 25 bp, Mus musculus
gagagctgtccgacaagcatacgct

SEQ ID NO: 472951 - DNA, 25 bp, Mus musculus
gagagctgtccgtcaagcatacgct

SEQ ID NO: 472952 - DNA, 25 bp, Mus musculus
gagagctgtcctagccattgtttca

SEQ ID NO: 472953 - DNA, 25 bp, Mus musculus
gagagctgtccttgccattgtttca

SEQ ID NO: 472954 - DNA, 25 bp, Mus musculus
gagagctgttaaaccaccaaatgca

SEQ ID NO: 472955 - DNA, 25 bp, Mus musculus
gagagctgttaatccaccaaatgca

SEQ ID NO: 472956 - DNA, 25 bp, Mus musculus
gagagcttacatagtggctcataag

SEQ ID NO: 472957 - DNA, 25 bp, Mus musculus
gagagcttacattgtggctcataag

SEQ ID NO: 472958 - DNA, 25 bp, Mus musculus
gagagcttaccaacaactggactcc

SEQ ID NO: 472959 - DNA, 25 bp, Mus musculus
gagagcttaccatcaactggactcc

SEQ ID NO: 472960 - DNA, 25 bp, Mus musculus
gagagcttactactggagaaagaca

SEQ ID NO: 472961 - DNA, 25 bp, Mus musculus
gagagcttactagtggagaaagaca

SEQ ID NO: 472962 - DNA, 25 bp, Mus musculus
gagagcttagcacaatatttgtaga

SEQ ID NO: 472963 - DNA, 25 bp, Mus musculus
gagagcttagcagaatatttgtaga

SEQ ID NO: 472964 - DNA, 25 bp, Mus musculus
gagagcttagctatcagttgtcatt

SEQ ID NO: 472965 - DNA, 25 bp, Mus musculus
gagagcttagctttcagttgtcatt

SEQ ID NO: 472966 - DNA, 25 bp, Mus musculus
gagagcttagtactctggctaccta

SEQ ID NO: 472967 - DNA, 25 bp, Mus musculus
gagagcttagtagtctggctaccta

SEQ ID NO: 472968 - DNA, 25 bp, Mus musculus
gagagcttcagtctatctgtttatg

SEQ ID NO: 472969 - DNA, 25 bp, Mus musculus
gagagcttcagtgtatctgtttatg

SEQ ID NO: 472970 - DNA, 25 bp, Mus musculus
gagagcttctcaaacactgtgggtt

SEQ ID NO: 472971 - DNA, 25 bp, Mus musculus
gagagcttctcatacactgtgggtt

SEQ ID NO: 472972 - DNA, 25 bp, Mus musculus
gagagcttctcccttggcccttcag

SEQ ID NO: 472973 - DNA, 25 bp, Mus musculus
gagagcttctccgttggcccttcag

SEQ ID NO: 472974 - DNA, 25 bp, Mus musculus
gagagcttcttgatgtgaccttctg

SEQ ID NO: 472975 - DNA, 25 bp, Mus musculus
gagagcttcttgttgtgaccttctg

SEQ ID NO: 472976 - DNA, 25 bp, Mus musculus
gagagcttgaaaattcctgatacct

SEQ ID NO: 472977 - DNA, 25 bp, Mus musculus
gagagcttgaaatttcctgatacct

SEQ ID NO: 472978 - DNA, 25 bp, Mus musculus
gagagcttgcacacaatcgaccaaa

SEQ ID NO: 472979 - DNA, 25 bp, Mus musculus
gagagcttgcactcaatcgaccaaa

SEQ ID NO: 472980 - DNA, 25 bp, Mus musculus
gagagcttgcatatgccttggtcaa

SEQ ID NO: 472981 - DNA, 25 bp, Mus musculus
gagagcttgcatttgccttggtcaa

SEQ ID NO: 472982 - DNA, 25 bp, Mus musculus
gagagcttgcccctgctcttccgaa

SEQ ID NO: 472983 - DNA, 25 bp, Mus musculus
gagagcttgcccgtgctcttccgaa

SEQ ID NO: 472984 - DNA, 25 bp, Mus musculus
gagagcttggacaaaagcaccgaca

SEQ ID NO: 472985 - DNA, 25 bp, Mus musculus
gagagcttggactaaagcaccgaca

SEQ ID NO: 472986 - DNA, 25 bp, Mus musculus
gagagcttggccaaatttaagaaac

SEQ ID NO: 472987 - DNA, 25 bp, Mus musculus
gagagcttggcctaatttaagaaac

SEQ ID NO: 472988 - DNA, 25 bp, Mus musculus
gagagcttgggcacagtcattgcat

SEQ ID NO: 472989 - DNA, 25 bp, Mus musculus
gagagcttgggctcagtcattgcat

SEQ ID NO: 472990 - DNA, 25 bp, Mus musculus
gagagcttgtaacccttgtgcttca

SEQ ID NO: 472991 - DNA, 25 bp, Mus musculus
gagagcttgtaagccttgtgcttca

SEQ ID NO: 472992 - DNA, 25 bp, Mus musculus
gagagcttgtcacaaccttgggttt

SEQ ID NO: 472993 - DNA, 25 bp, Mus musculus
gagagcttgtcagaaccttgggttt

SEQ ID NO: 472994 - DNA, 25 bp, Mus musculus
gagagcttgtctccatcagactatg

SEQ ID NO: 472995 - DNA, 25 bp, Mus musculus
gagagcttgtctgcatcagactatg

SEQ ID NO: 472996 - DNA, 25 bp, Mus musculus
gagagctttactacagggaaattaa

SEQ ID NO: 472997 - DNA, 25 bp, Mus musculus
gagagctttacttcagggaaattaa

SEQ ID NO: 472998 - DNA, 25 bp, Mus musculus
gagagctttaggctgggcccactat

SEQ ID NO: 472999 - DNA, 25 bp, Mus musculus
gagagctttagggtgggcccactat

SEQ ID NO: 473000 - DNA, 25 bp, Mus musculus
gagagctttcccattataatatttc

SEQ ID NO: 473001 - DNA, 25 bp, Mus musculus
gagagctttccctttataatatttc

SEQ ID NO: 473002 - DNA, 25 bp, Mus musculus
gagagctttctacttctttgggtgg

SEQ ID NO: 473003 - DNA, 25 bp, Mus musculus
gagagctttctagttctttgggtgg

SEQ ID NO: 473004 - DNA, 25 bp, Mus musculus
gagagctttctccagttgttggatc

SEQ ID NO: 473005 - DNA, 25 bp, Mus musculus
gagagctttctcgagttgttggatc

SEQ ID NO: 473006 - DNA, 25 bp, Mus musculus
gagagctttcttcagggaacgcaac

SEQ ID NO: 473007 - DNA, 25 bp, Mus musculus
gagagctttcttgagggaacgcaac

SEQ ID NO: 473008 - DNA, 25 bp, Mus musculus
gagagctttgacacatggctcagcc

SEQ ID NO: 473009 - DNA, 25 bp, Mus musculus
gagagctttgactcatggctcagcc

SEQ ID NO: 473010 - DNA, 25 bp, Mus musculus
gagagctttgcaacagtcagagacg

SEQ ID NO: 473011 - DNA, 25 bp, Mus musculus
gagagctttgcacaagtacccagtt

SEQ ID NO: 473012 - DNA, 25 bp, Mus musculus
gagagctttgcagaagtacccagtt

SEQ ID NO: 473013 - DNA, 25 bp, Mus musculus
gagagctttgcatcagtcagagacg

SEQ ID NO: 473014 - DNA, 25 bp, Mus musculus
gagagctttgccagcgcctggtacg

SEQ ID NO: 473015 - DNA, 25 bp, Mus musculus
gagagctttgcctgcgcctggtacg

SEQ ID NO: 473016 - DNA, 25 bp, Mus musculus
gagagctttgggagtccagataaca

SEQ ID NO: 473017 - DNA, 25 bp, Mus musculus
gagagctttgggtgtccagataaca

SEQ ID NO: 473018 - DNA, 25 bp, Mus musculus
gagagctttgtcacgtcaggtgtgt

SEQ ID NO: 473019 - DNA, 25 bp, Mus musculus
gagagctttgtcctgttaatttttc

SEQ ID NO: 473020 - DNA, 25 bp, Mus musculus
gagagctttgtcgtgttaatttttc

SEQ ID NO: 473021 - DNA, 25 bp, Mus musculus
gagagctttgtctcgtcaggtgtgt

SEQ ID NO: 473022 - DNA, 25 bp, Mus musculus
gagagcttttccaaagttgctaccc

SEQ ID NO: 473023 - DNA, 25 bp, Mus musculus
gagagcttttcctaagttgctaccc

SEQ ID NO: 473024 - DNA, 25 bp, Mus musculus
gagagcttttttcagaatccagtac

SEQ ID NO: 473025 - DNA, 25 bp, Mus musculus
gagagcttttttgagaatccagtac

SEQ ID NO: 473026 - DNA, 25 bp, Mus musculus
gagaggaaactacatgccacaccta

SEQ ID NO: 473027 - DNA, 25 bp, Mus musculus
gagaggaaactagatgccacaccta

SEQ ID NO: 473028 - DNA, 25 bp, Mus musculus
gagaggaaactcaccagccatgtgg

SEQ ID NO: 473029 - DNA, 25 bp, Mus musculus
gagaggaaactctccagccatgtgg

SEQ ID NO: 473030 - DNA, 25 bp, Mus musculus
gagaggaaagtcatccttgtgtgga

SEQ ID NO: 473031 - DNA, 25 bp, Mus musculus
gagaggaaagtcttccttgtgtgga

SEQ ID NO: 473032 - DNA, 25 bp, Mus musculus
gagaggaaatctcaatatggcggat

SEQ ID NO: 473033 - DNA, 25 bp, Mus musculus
gagaggaaatctgaatatggcggat

SEQ ID NO: 473034 - DNA, 25 bp, Mus musculus
gagaggaaccaacatgacccttcac

SEQ ID NO: 473035 - DNA, 25 bp, Mus musculus
gagaggaaccaagatgacccttcac

SEQ ID NO: 473036 - DNA, 25 bp, Mus musculus
gagaggaaccagctaaacaagaaac

SEQ ID NO: 473037 - DNA, 25 bp, Mus musculus
gagaggaaccaggtaaacaagaaac

SEQ ID NO: 473038 - DNA, 25 bp, Mus musculus
gagaggaacccaagtgattagaacc

SEQ ID NO: 473039 - DNA, 25 bp, Mus musculus
gagaggaacccatgtgattagaacc

SEQ ID NO: 473040 - DNA, 25 bp, Mus musculus
gagaggaacgctatccagcattaag

SEQ ID NO: 473041 - DNA, 25 bp, Mus musculus
gagaggaacgctttccagcattaag

SEQ ID NO: 473042 - DNA, 25 bp, Mus musculus
gagaggaactggattcctccctcct

SEQ ID NO: 473043 - DNA, 25 bp, Mus musculus
gagaggaactggcaggcatctcctc

SEQ ID NO: 473044 - DNA, 25 bp, Mus musculus
gagaggaactgggaggcatctcctc

SEQ ID NO: 473045 - DNA, 25 bp, Mus musculus
gagaggaactggtttcctccctcct

SEQ ID NO: 473046 - DNA, 25 bp, Mus musculus
gagaggaacttaacctcacatccct

SEQ ID NO: 473047 - DNA, 25 bp, Mus musculus
gagaggaacttacccatctgctcta

SEQ ID NO: 473048 - DNA, 25 bp, Mus musculus
gagaggaacttagccatctgctcta

SEQ ID NO: 473049 - DNA, 25 bp, Mus musculus
gagaggaacttatcctcacatccct

SEQ ID NO: 473050 - DNA, 25 bp, Mus musculus
gagaggaagctgaccctttgcagac

SEQ ID NO: 473051 - DNA, 25 bp, Mus musculus
gagaggaagctgtccctttgcagac

SEQ ID NO: 473052 - DNA, 25 bp, Mus musculus
gagaggaaggtactgcaccatctgc

SEQ ID NO: 473053 - DNA, 25 bp, Mus musculus
gagaggaaggtagtgcaccatctgc

SEQ ID NO: 473054 - DNA, 25 bp, Mus musculus
gagaggaatgtgaggccttcctttt

SEQ ID NO: 473055 - DNA, 25 bp, Mus musculus
gagaggaatgtgtggccttcctttt

SEQ ID NO: 473056 - DNA, 25 bp, Mus musculus
gagaggacaaatctactcaggtgaa

SEQ ID NO: 473057 - DNA, 25 bp, Mus musculus
gagaggacaaatgtactcaggtgaa

SEQ ID NO: 473058 - DNA, 25 bp, Mus musculus
gagaggacacccagacggagtgttt

SEQ ID NO: 473059 - DNA, 25 bp, Mus musculus
gagaggacaccctgacggagtgttt

SEQ ID NO: 473060 - DNA, 25 bp, Mus musculus
gagaggacacctctggttttccagt

SEQ ID NO: 473061 - DNA, 25 bp, Mus musculus
gagaggacacctgtggttttccagt

SEQ ID NO: 473062 - DNA, 25 bp, Mus musculus
gagaggacagagctcacactttgta

SEQ ID NO: 473063 - DNA, 25 bp, Mus musculus
gagaggacagaggtcacactttgta

SEQ ID NO: 473064 - DNA, 25 bp, Mus musculus
gagaggacagccaggatgcccatag

SEQ ID NO: 473065 - DNA, 25 bp, Mus musculus
gagaggacagcctggatgcccatag

SEQ ID NO: 473066 - DNA, 25 bp, Mus musculus
gagaggacaggtattgccccacaga

SEQ ID NO: 473067 - DNA, 25 bp, Mus musculus
gagaggacaggttttgccccacaga

SEQ ID NO: 473068 - DNA, 25 bp, Mus musculus
gagaggaccaggactctgaccaggt

SEQ ID NO: 473069 - DNA, 25 bp, Mus musculus
gagaggaccaggtctctgaccaggt

SEQ ID NO: 473070 - DNA, 25 bp, Mus musculus
gagaggacccaacactgccacagag

SEQ ID NO: 473071 - DNA, 25 bp, Mus musculus
gagaggacccaagactgccacagag

SEQ ID NO: 473072 - DNA, 25 bp, Mus musculus
gagaggacccataatccagatgtgt

SEQ ID NO: 473073 - DNA, 25 bp, Mus musculus
gagaggacccattatccagatgtgt

SEQ ID NO: 473074 - DNA, 25 bp, Mus musculus
gagaggaccctaaacaaggcactcc

SEQ ID NO: 473075 - DNA, 25 bp, Mus musculus
gagaggaccctatacaaggcactcc

SEQ ID NO: 473076 - DNA, 25 bp, Mus musculus
gagaggacctctctggcctgcttca

SEQ ID NO: 473077 - DNA, 25 bp, Mus musculus
gagaggacctctgtggcctgcttca

SEQ ID NO: 473078 - DNA, 25 bp, Mus musculus
gagaggaccttcatgaaagcgtgta

SEQ ID NO: 473079 - DNA, 25 bp, Mus musculus
gagaggaccttcttgaaagcgtgta

SEQ ID NO: 473080 - DNA, 25 bp, Mus musculus
gagaggacgcccacctttcatcttc

SEQ ID NO: 473081 - DNA, 25 bp, Mus musculus
gagaggacgccctcctttcatcttc

SEQ ID NO: 473082 - DNA, 25 bp, Mus musculus
gagaggacgggaactccatcaaggt

SEQ ID NO: 473083 - DNA, 25 bp, Mus musculus
gagaggacgggatctccatcaaggt

SEQ ID NO: 473084 - DNA, 25 bp, Mus musculus
gagaggactcaacctgcctgttgcc

SEQ ID NO: 473085 - DNA, 25 bp, Mus musculus
gagaggactcaagctgcctgttgcc

SEQ ID NO: 473086 - DNA, 25 bp, Mus musculus
gagaggactctacctcactcaagca

SEQ ID NO: 473087 - DNA, 25 bp, Mus musculus
gagaggactctagctcactcaagca

SEQ ID NO: 473088 - DNA, 25 bp, Mus musculus
gagaggactggtatcctttgctcca

SEQ ID NO: 473089 - DNA, 25 bp, Mus musculus
gagaggactggtttcctttgctcca

SEQ ID NO: 473090 - DNA, 25 bp, Mus musculus
gagaggactgtcagctgctgcattt

SEQ ID NO: 473091 - DNA, 25 bp, Mus musculus
gagaggactgtctgctgctgcattt

SEQ ID NO: 473092 - DNA, 25 bp, Mus musculus
gagaggacttctacctaacacatag

SEQ ID NO: 473093 - DNA, 25 bp, Mus musculus
gagaggacttcttcctaacacatag

SEQ ID NO: 473094 - DNA, 25 bp, Mus musculus
gagaggactttgaacgcgctgtgta

SEQ ID NO: 473095 - DNA, 25 bp, Mus musculus
gagaggactttgtacgcgctgtgta

SEQ ID NO: 473096 - DNA, 25 bp, Mus musculus
gagaggacttttatccagattatga

SEQ ID NO: 473097 - DNA, 25 bp, Mus musculus
gagaggacttttttccagattatga

SEQ ID NO: 473098 - DNA, 25 bp, Mus musculus
gagaggagaaaccattccttctttt

SEQ ID NO: 473099 - DNA, 25 bp, Mus musculus
gagaggagaaacgattccttctttt

SEQ ID NO: 473100 - DNA, 25 bp, Mus musculus
gagaggagatcacctcgacgccaat

SEQ ID NO: 473101 - DNA, 25 bp, Mus musculus
gagaggagatcagctcgacgccaat

SEQ ID NO: 473102 - DNA, 25 bp, Mus musculus
gagaggagccccacatcaaggaaga

SEQ ID NO: 473103 - DNA, 25 bp, Mus musculus
gagaggagcccctcatcaaggaaga

SEQ ID NO: 473104 - DNA, 25 bp, Mus musculus
gagaggagctcactactgcatgctg

SEQ ID NO: 473105 - DNA, 25 bp, Mus musculus
gagaggagctcagtactgcatgctg

SEQ ID NO: 473106 - DNA, 25 bp, Mus musculus
gagaggaggccaaaagacatataat

SEQ ID NO: 473107 - DNA, 25 bp, Mus musculus
gagaggaggccataagacatataat

SEQ ID NO: 473108 - DNA, 25 bp, Mus musculus
gagaggagtaaccatttttaaatag

SEQ ID NO: 473109 - DNA, 25 bp, Mus musculus
gagaggagtaacgatttttaaatag

SEQ ID NO: 473110 - DNA, 25 bp, Mus musculus
gagaggagtcatatgcagaagttta

SEQ ID NO: 473111 - DNA, 25 bp, Mus musculus
gagaggagtcatttgcagaagttta

SEQ ID NO: 473112 - DNA, 25 bp, Mus musculus
gagaggatacccagatggagtattt

SEQ ID NO: 473113 - DNA, 25 bp, Mus musculus
gagaggataccctgatggagtattt

SEQ ID NO: 473114 - DNA, 25 bp, Mus musculus
gagaggatcacacattttgaccaaa

SEQ ID NO: 473115 - DNA, 25 bp, Mus musculus
gagaggatcacagattttgaccaaa

SEQ ID NO: 473116 - DNA, 25 bp, Mus musculus
gagaggatccaaccacatccagaat

SEQ ID NO: 473117 - DNA, 25 bp, Mus musculus
gagaggatccaagcacatccagaat

SEQ ID NO: 473118 - DNA, 25 bp, Mus musculus
gagaggatcccgatatgctattgtc

SEQ ID NO: 473119 - DNA, 25 bp, Mus musculus
gagaggatcccgttatgctattgtc

SEQ ID NO: 473120 - DNA, 25 bp, Mus musculus
gagaggatccggaaggcacaccaca

SEQ ID NO: 473121 - DNA, 25 bp, Mus musculus
gagaggatccggtaggcacaccaca

SEQ ID NO: 473122 - DNA, 25 bp, Mus musculus
gagaggatcgacagagccttggcct

SEQ ID NO: 473123 - DNA, 25 bp, Mus musculus
gagaggatcgactgagccttggcct

SEQ ID NO: 473124 - DNA, 25 bp, Mus musculus
gagaggatctttcctcagcgactta

SEQ ID NO: 473125 - DNA, 25 bp, Mus musculus
gagaggatctttgctcagcgactta

SEQ ID NO: 473126 - DNA, 25 bp, Mus musculus
gagaggatgaacatagtcccctact

SEQ ID NO: 473127 - DNA, 25 bp, Mus musculus
gagaggatgaacttagtcccctact

SEQ ID NO: 473128 - DNA, 25 bp, Mus musculus
gagaggatgcccacctgactcagta

SEQ ID NO: 473129 - DNA, 25 bp, Mus musculus
gagaggatgccctcctgactcagta

SEQ ID NO: 473130 - DNA, 25 bp, Mus musculus
gagaggatgtccaagatcttatcta

SEQ ID NO: 473131 - DNA, 25 bp, Mus musculus
gagaggatgtcctagatcttatcta

SEQ ID NO: 473132 - DNA, 25 bp, Mus musculus
gagaggatgtggaatttcttttatc

SEQ ID NO: 473133 - DNA, 25 bp, Mus musculus
gagaggatgtggtatttcttttatc

SEQ ID NO: 473134 - DNA, 25 bp, Mus musculus
gagaggattcaccttcaggaataca

SEQ ID NO: 473135 - DNA, 25 bp, Mus musculus
gagaggattcacgttcaggaataca

SEQ ID NO: 473136 - DNA, 25 bp, Mus musculus
gagaggattccccaatgtaaggtag

SEQ ID NO: 473137 - DNA, 25 bp, Mus musculus
gagaggattcccgaatgtaaggtag

SEQ ID NO: 473138 - DNA, 25 bp, Mus musculus
gagaggattctgatgtgataccaca

SEQ ID NO: 473139 - DNA, 25 bp, Mus musculus
gagaggattctgctggtgaacatta

SEQ ID NO: 473140 - DNA, 25 bp, Mus musculus
gagaggattctggtggtgaacatta

SEQ ID NO: 473141 - DNA, 25 bp, Mus musculus
gagaggattctgttgtgataccaca

SEQ ID NO: 473142 - DNA, 25 bp, Mus musculus
gagaggcaaaccatgtgacatttca

SEQ ID NO: 473143 - DNA, 25 bp, Mus musculus
gagaggcaaaccttgtgacatttca

SEQ ID NO: 473144 - DNA, 25 bp, Mus musculus
gagaggcaacataggcactccattt

SEQ ID NO: 473145 - DNA, 25 bp, Mus musculus
gagaggcaacattggcactccattt

SEQ ID NO: 473146 - DNA, 25 bp, Mus musculus
gagaggcaagcactcagcttaccag

SEQ ID NO: 473147 - DNA, 25 bp, Mus musculus
gagaggcaagcagtcagcttaccag

SEQ ID NO: 473148 - DNA, 25 bp, Mus musculus
gagaggcaaggaatccataggaact

SEQ ID NO: 473149 - DNA, 25 bp, Mus musculus
gagaggcaaggattccataggaact

SEQ ID NO: 473150 - DNA, 25 bp, Mus musculus
gagaggcaatgtcctcctgtactta

SEQ ID NO: 473151 - DNA, 25 bp, Mus musculus
gagaggcaatgtgctcctgtactta

SEQ ID NO: 473152 - DNA, 25 bp, Mus musculus
gagaggcacactcacagatcacata

SEQ ID NO: 473153 - DNA, 25 bp, Mus musculus
gagaggcacactctttccaaatgcc

SEQ ID NO: 473154 - DNA, 25 bp, Mus musculus
gagaggcacactgacagatcacata

SEQ ID NO: 473155 - DNA, 25 bp, Mus musculus
gagaggcacactgtttccaaatgcc

SEQ ID NO: 473156 - DNA, 25 bp, Mus musculus
gagaggcacagccccagagacttca

SEQ ID NO: 473157 - DNA, 25 bp, Mus musculus
gagaggcacagcgccagagacttca

SEQ ID NO: 473158 - DNA, 25 bp, Mus musculus
gagaggcacatcatcaggactcgga

SEQ ID NO: 473159 - DNA, 25 bp, Mus musculus
gagaggcacatcttcaggactcgga

SEQ ID NO: 473160 - DNA, 25 bp, Mus musculus
gagaggcacgccaccgtggtcagat

SEQ ID NO: 473161 - DNA, 25 bp, Mus musculus
gagaggcacgcctccgtggtcagat

SEQ ID NO: 473162 - DNA, 25 bp, Mus musculus
gagaggcagacgaaggccacactct

SEQ ID NO: 473163 - DNA, 25 bp, Mus musculus
gagaggcagacgtaggccacactct

SEQ ID NO: 473164 - DNA, 25 bp, Mus musculus
gagaggcagcaacttatacacagaa

SEQ ID NO: 473165 - DNA, 25 bp, Mus musculus
gagaggcagcaagttatacacagaa

SEQ ID NO: 473166 - DNA, 25 bp, Mus musculus
gagaggcagccaagcatcttgtctg

SEQ ID NO: 473167 - DNA, 25 bp, Mus musculus
gagaggcagccatgcatcttgtctg

SEQ ID NO: 473168 - DNA, 25 bp, Mus musculus
gagaggcagctcaatcggttacccc

SEQ ID NO: 473169 - DNA, 25 bp, Mus musculus
gagaggcagctctatcggttacccc

SEQ ID NO: 473170 - DNA, 25 bp, Mus musculus
gagaggcagctgagcccttgcatga

SEQ ID NO: 473171 - DNA, 25 bp, Mus musculus
gagaggcagctgtgcccttgcatga

SEQ ID NO: 473172 - DNA, 25 bp, Mus musculus
gagaggcataaacaaggccccttct

SEQ ID NO: 473173 - DNA, 25 bp, Mus musculus
gagaggcataaagaaggccccttct

SEQ ID NO: 473174 - DNA, 25 bp, Mus musculus
gagaggcatctcaatcaagttgcag

SEQ ID NO: 473175 - DNA, 25 bp, Mus musculus
gagaggcatctcacttgaccggtga

SEQ ID NO: 473176 - DNA, 25 bp, Mus musculus
gagaggcatctcaggaccatggaaa

SEQ ID NO: 473177 - DNA, 25 bp, Mus musculus
gagaggcatctctatcaagttgcag

SEQ ID NO: 473178 - DNA, 25 bp, Mus musculus
gagaggcatctctcttgaccggtga

SEQ ID NO: 473179 - DNA, 25 bp, Mus musculus
gagaggcatctctggaccatggaaa

SEQ ID NO: 473180 - DNA, 25 bp, Mus musculus
gagaggcatgagagcatttgctatg

SEQ ID NO: 473181 - DNA, 25 bp, Mus musculus
gagaggcatgagtgcatttgctatg

SEQ ID NO: 473182 - DNA, 25 bp, Mus musculus
gagaggcatgccaactactccaaaa

SEQ ID NO: 473183 - DNA, 25 bp, Mus musculus
gagaggcatgcctactactccaaaa

SEQ ID NO: 473184 - DNA, 25 bp, Mus musculus
gagaggcatgctaaaatcagttatt

SEQ ID NO: 473185 - DNA, 25 bp, Mus musculus
gagaggcatgcttaaatcagttatt

SEQ ID NO: 473186 - DNA, 25 bp, Mus musculus
gagaggccaatcaccttggttttta

SEQ ID NO: 473187 - DNA, 25 bp, Mus musculus
gagaggccaatctccttggttttta

SEQ ID NO: 473188 - DNA, 25 bp, Mus musculus
gagaggccacaaaatgcatgagcat

SEQ ID NO: 473189 - DNA, 25 bp, Mus musculus
gagaggccacaaagctgtttgctga

SEQ ID NO: 473190 - DNA, 25 bp, Mus musculus
gagaggccacaatatgcatgagcat

SEQ ID NO: 473191 - DNA, 25 bp, Mus musculus
gagaggccacaatgctgtttgctga

SEQ ID NO: 473192 - DNA, 25 bp, Mus musculus
gagaggccacagagtgcacttggaa

SEQ ID NO: 473193 - DNA, 25 bp, Mus musculus
gagaggccacagtgtgcacttggaa

SEQ ID NO: 473194 - DNA, 25 bp, Mus musculus
gagaggccacctacctgctctgcag

SEQ ID NO: 473195 - DNA, 25 bp, Mus musculus
gagaggccaccttcctgctctgcag

SEQ ID NO: 473196 - DNA, 25 bp, Mus musculus
gagaggccactgaagtcagggacta

SEQ ID NO: 473197 - DNA, 25 bp, Mus musculus
gagaggccactgtagtcagggacta

SEQ ID NO: 473198 - DNA, 25 bp, Mus musculus
gagaggccagtgaccgcttccagca

SEQ ID NO: 473199 - DNA, 25 bp, Mus musculus
gagaggccagtgtccgcttccagca

SEQ ID NO: 473200 - DNA, 25 bp, Mus musculus
gagaggccatcacgtttacacagct

SEQ ID NO: 473201 - DNA, 25 bp, Mus musculus
gagaggccatcaggtttacacagct

SEQ ID NO: 473202 - DNA, 25 bp, Mus musculus
gagaggccattcaatctccagggca

SEQ ID NO: 473203 - DNA, 25 bp, Mus musculus
gagaggccattctatctccagggca

SEQ ID NO: 473204 - DNA, 25 bp, Mus musculus
gagaggcccataagtgaggtttccc

SEQ ID NO: 473205 - DNA, 25 bp, Mus musculus
gagaggcccatatgtgaggtttccc

SEQ ID NO: 473206 - DNA, 25 bp, Mus musculus
gagaggcccatgaccatagtcatct

SEQ ID NO: 473207 - DNA, 25 bp, Mus musculus
gagaggcccatgtccatagtcatct

SEQ ID NO: 473208 - DNA, 25 bp, Mus musculus
gagaggccccttaaaatgcaaatga

SEQ ID NO: 473209 - DNA, 25 bp, Mus musculus
gagaggcccctttaaatgcaaatga

SEQ ID NO: 473210 - DNA, 25 bp, Mus musculus
gagaggcccgagcacctaaatctgc

SEQ ID NO: 473211 - DNA, 25 bp, Mus musculus
gagaggcccgaggacctaaatctgc

SEQ ID NO: 473212 - DNA, 25 bp, Mus musculus
gagaggccctaaccagcaagactag

SEQ ID NO: 473213 - DNA, 25 bp, Mus musculus
gagaggccctaagcagcaagactag

SEQ ID NO: 473214 - DNA, 25 bp, Mus musculus
gagaggccctacatatgtaatttct

SEQ ID NO: 473215 - DNA, 25 bp, Mus musculus
gagaggccctacttatgtaatttct

SEQ ID NO: 473216 - DNA, 25 bp, Mus musculus
gagaggcccttcccaaagtattaat

SEQ ID NO: 473217 - DNA, 25 bp, Mus musculus
gagaggcccttcgcaaagtattaat

SEQ ID NO: 473218 - DNA, 25 bp, Mus musculus
gagaggcccttgaatcaaaagattc

SEQ ID NO: 473219 - DNA, 25 bp, Mus musculus
gagaggcccttgctactctggataa

SEQ ID NO: 473220 - DNA, 25 bp, Mus musculus
gagaggcccttggtactctggataa

SEQ ID NO: 473221 - DNA, 25 bp, Mus musculus
gagaggcccttgtatcaaaagattc

SEQ ID NO: 473222 - DNA, 25 bp, Mus musculus
gagaggccgatacgcaagcctttaa

SEQ ID NO: 473223 - DNA, 25 bp, Mus musculus
gagaggccgataggcaagcctttaa

SEQ ID NO: 473224 - DNA, 25 bp, Mus musculus
gagaggccggttactactggagaac

SEQ ID NO: 473225 - DNA, 25 bp, Mus musculus
gagaggccggtttctactggagaac

SEQ ID NO: 473226 - DNA, 25 bp, Mus musculus
gagaggcctccaagaggaacctgac

SEQ ID NO: 473227 - DNA, 25 bp, Mus musculus
gagaggcctccatgaggaacctgac

SEQ ID NO: 473228 - DNA, 25 bp, Mus musculus
gagaggcctgcactttgctttgcta

SEQ ID NO: 473229 - DNA, 25 bp, Mus musculus
gagaggcctgcagtttgctttgcta

SEQ ID NO: 473230 - DNA, 25 bp, Mus musculus
gagaggcctgctccagctattcaca

SEQ ID NO: 473231 - DNA, 25 bp, Mus musculus
gagaggcctgctgcagctattcaca

SEQ ID NO: 473232 - DNA, 25 bp, Mus musculus
gagaggcctggacacaaggttcata

SEQ ID NO: 473233 - DNA, 25 bp, Mus musculus
gagaggcctggagacaaggttcata

SEQ ID NO: 473234 - DNA, 25 bp, Mus musculus
gagaggccttcaaagctagctgcag

SEQ ID NO: 473235 - DNA, 25 bp, Mus musculus
gagaggccttcatagctagctgcag

SEQ ID NO: 473236 - DNA, 25 bp, Mus musculus
gagaggccttgaaagttgctaactt

SEQ ID NO: 473237 - DNA, 25 bp, Mus musculus
gagaggccttgatagttgctaactt

SEQ ID NO: 473238 - DNA, 25 bp, Mus musculus
gagaggccttgcattgatctaagtc

SEQ ID NO: 473239 - DNA, 25 bp, Mus musculus
gagaggccttgctttgatctaagtc

SEQ ID NO: 473240 - DNA, 25 bp, Mus musculus
gagaggcctttaacttgtacatgat

SEQ ID NO: 473241 - DNA, 25 bp, Mus musculus
gagaggcctttacctatgagcgccg

SEQ ID NO: 473242 - DNA, 25 bp, Mus musculus
gagaggcctttagctatgagcgccg

SEQ ID NO: 473243 - DNA, 25 bp, Mus musculus
gagaggcctttatcttgtacatgat

SEQ ID NO: 473244 - DNA, 25 bp, Mus musculus
gagaggcgaggtaacagtgtttata

SEQ ID NO: 473245 - DNA, 25 bp, Mus musculus
gagaggcgaggttacagtgtttata

SEQ ID NO: 473246 - DNA, 25 bp, Mus musculus
gagaggcgcaaaacaccgctgtaag

SEQ ID NO: 473247 - DNA, 25 bp, Mus musculus
gagaggcgcaaatcaccgctgtaag

SEQ ID NO: 473248 - DNA, 25 bp, Mus musculus
gagaggcgcagtctgacctgaacaa

SEQ ID NO: 473249 - DNA, 25 bp, Mus musculus
gagaggcgcagtgtgacctgaacaa

SEQ ID NO: 473250 - DNA, 25 bp, Mus musculus
gagaggcgctcaagtctctgacaac

SEQ ID NO: 473251 - DNA, 25 bp, Mus musculus
gagaggcgctcatgtctctgacaac

SEQ ID NO: 473252 - DNA, 25 bp, Mus musculus
gagaggcggcccatgacaacagctc

SEQ ID NO: 473253 - DNA, 25 bp, Mus musculus
gagaggcggcccttgacaacagctc

SEQ ID NO: 473254 - DNA, 25 bp, Mus musculus
gagaggcggtatcgaccctctacta

SEQ ID NO: 473255 - DNA, 25 bp, Mus musculus
gagaggcggtatggaccctctacta

SEQ ID NO: 473256 - DNA, 25 bp, Mus musculus
gagaggcggtccctccaggtccttt

SEQ ID NO: 473257 - DNA, 25 bp, Mus musculus
gagaggcggtccgtccaggtccttt

SEQ ID NO: 473258 - DNA, 25 bp, Mus musculus
gagaggcgtaagaactcttatttat

SEQ ID NO: 473259 - DNA, 25 bp, Mus musculus
gagaggcgtaagtactcttatttat

SEQ ID NO: 473260 - DNA, 25 bp, Mus musculus
gagaggctacagaccttttttacag

SEQ ID NO: 473261 - DNA, 25 bp, Mus musculus
gagaggctacagtccttttttacag

SEQ ID NO: 473262 - DNA, 25 bp, Mus musculus
gagaggctactaatcggtcaacatg

SEQ ID NO: 473263 - DNA, 25 bp, Mus musculus
gagaggctactattcggtcaacatg

SEQ ID NO: 473264 - DNA, 25 bp, Mus musculus
gagaggctagacagacgtcctaccc

SEQ ID NO: 473265 - DNA, 25 bp, Mus musculus
gagaggctagactgacgtcctaccc

SEQ ID NO: 473266 - DNA, 25 bp, Mus musculus
gagaggctagcaaaccaccactgaa

SEQ ID NO: 473267 - DNA, 25 bp, Mus musculus
gagaggctagcataccaccactgaa

SEQ ID NO: 473268 - DNA, 25 bp, Mus musculus
gagaggctagctatttatcattgac

SEQ ID NO: 473269 - DNA, 25 bp, Mus musculus
gagaggctagctttttatcattgac

SEQ ID NO: 473270 - DNA, 25 bp, Mus musculus
gagaggctatgaccgccatagagct

SEQ ID NO: 473271 - DNA, 25 bp, Mus musculus
gagaggctatgagcgccatagagct

SEQ ID NO: 473272 - DNA, 25 bp, Mus musculus
gagaggctcaagcaacctcgtcttc

SEQ ID NO: 473273 - DNA, 25 bp, Mus musculus
gagaggctcaaggaacctcgtcttc

SEQ ID NO: 473274 - DNA, 25 bp, Mus musculus
gagaggctcacacgcgtcagcatct

SEQ ID NO: 473275 - DNA, 25 bp, Mus musculus
gagaggctcacaggcgtcagcatct

SEQ ID NO: 473276 - DNA, 25 bp, Mus musculus
gagaggctcagaacacataaaactt

SEQ ID NO: 473277 - DNA, 25 bp, Mus musculus
gagaggctcagatcacataaaactt

SEQ ID NO: 473278 - DNA, 25 bp, Mus musculus
gagaggctcagcaaaccaagtttct

SEQ ID NO: 473279 - DNA, 25 bp, Mus musculus
gagaggctcagctaaccaagtttct

SEQ ID NO: 473280 - DNA, 25 bp, Mus musculus
gagaggctcaggcaatctgtaacaa

SEQ ID NO: 473281 - DNA, 25 bp, Mus musculus
gagaggctcaggctactatgaccaa

SEQ ID NO: 473282 - DNA, 25 bp, Mus musculus
gagaggctcagggaatctgtaacaa

SEQ ID NO: 473283 - DNA, 25 bp, Mus musculus
gagaggctcagggtactatgaccaa

SEQ ID NO: 473284 - DNA, 25 bp, Mus musculus
gagaggctccttcctctgcctagga

SEQ ID NO: 473285 - DNA, 25 bp, Mus musculus
gagaggctccttgctctgcctagga

SEQ ID NO: 473286 - DNA, 25 bp, Mus musculus
gagaggctctatccagcagttgact

SEQ ID NO: 473287 - DNA, 25 bp, Mus musculus
gagaggctctatgcagcagttgact

SEQ ID NO: 473288 - DNA, 25 bp, Mus musculus
gagaggctctctcggtatcagcagt

SEQ ID NO: 473289 - DNA, 25 bp, Mus musculus
gagaggctctctgggtatcagcagt

SEQ ID NO: 473290 - DNA, 25 bp, Mus musculus
gagaggctgaccagcttaataacgc

SEQ ID NO: 473291 - DNA, 25 bp, Mus musculus
gagaggctgacctgcttaataacgc

SEQ ID NO: 473292 - DNA, 25 bp, Mus musculus
gagaggctgctgagaacactcctgt

SEQ ID NO: 473293 - DNA, 25 bp, Mus musculus
gagaggctgctgtgaacactcctgt

SEQ ID NO: 473294 - DNA, 25 bp, Mus musculus
gagaggctgtctatcttgcaaagca

SEQ ID NO: 473295 - DNA, 25 bp, Mus musculus
gagaggctgtctttcttgcaaagca

SEQ ID NO: 473296 - DNA, 25 bp, Mus musculus
gagaggctgtgcagctttaggcaat

SEQ ID NO: 473297 - DNA, 25 bp, Mus musculus
gagaggctgtgctgctttaggcaat

SEQ ID NO: 473298 - DNA, 25 bp, Mus musculus
gagaggctgttcagccagcaaggca

SEQ ID NO: 473299 - DNA, 25 bp, Mus musculus
gagaggctgttctgccagcaaggca

SEQ ID NO: 473300 - DNA, 25 bp, Mus musculus
gagaggctgttgatcactcaaccta

SEQ ID NO: 473301 - DNA, 25 bp, Mus musculus
gagaggctgttgttcactcaaccta

SEQ ID NO: 473302 - DNA, 25 bp, Mus musculus
gagaggcttaagcacaaggtcttta

SEQ ID NO: 473303 - DNA, 25 bp, Mus musculus
gagaggcttaaggacaaggtcttta

SEQ ID NO: 473304 - DNA, 25 bp, Mus musculus
gagaggctttccacgcaaagctact

SEQ ID NO: 473305 - DNA, 25 bp, Mus musculus
gagaggctttcctcgcaaagctact

SEQ ID NO: 473306 - DNA, 25 bp, Mus musculus
gagaggcttttcacactacgtgcca

SEQ ID NO: 473307 - DNA, 25 bp, Mus musculus
gagaggcttttctcactacgtgcca

SEQ ID NO: 473308 - DNA, 25 bp, Mus musculus
gagaggctttttacattcagaagat

SEQ ID NO: 473309 - DNA, 25 bp, Mus musculus
gagaggcttttttcattcagaagat

SEQ ID NO: 473310 - DNA, 25 bp, Mus musculus
gagagggaaactctacctgcttcgt

SEQ ID NO: 473311 - DNA, 25 bp, Mus musculus
gagagggaaactgtacctgcttcgt

SEQ ID NO: 473312 - DNA, 25 bp, Mus musculus
gagagggaagcaaatccagccgacc

SEQ ID NO: 473313 - DNA, 25 bp, Mus musculus
gagagggaagcatatccagccgacc

SEQ ID NO: 473314 - DNA, 25 bp, Mus musculus
gagagggaatcaccctgcttgtctt

SEQ ID NO: 473315 - DNA, 25 bp, Mus musculus
gagagggaatcagcctgcttgtctt

SEQ ID NO: 473316 - DNA, 25 bp, Mus musculus
gagagggacaagatccccagaccat

SEQ ID NO: 473317 - DNA, 25 bp, Mus musculus
gagagggacaagttccccagaccat

SEQ ID NO: 473318 - DNA, 25 bp, Mus musculus
gagagggacagaattactcagccca

SEQ ID NO: 473319 - DNA, 25 bp, Mus musculus
gagagggacagatttactcagccca

SEQ ID NO: 473320 - DNA, 25 bp, Mus musculus
gagagggaccgcaacatgagcccca

SEQ ID NO: 473321 - DNA, 25 bp, Mus musculus
gagagggaccgctacatgagcccca

SEQ ID NO: 473322 - DNA, 25 bp, Mus musculus
gagagggacctccaaagcaccgcat

SEQ ID NO: 473323 - DNA, 25 bp, Mus musculus
gagagggacctcgaaagcaccgcat

SEQ ID NO: 473324 - DNA, 25 bp, Mus musculus
gagagggaccttagtaccagggaca

SEQ ID NO: 473325 - DNA, 25 bp, Mus musculus
gagagggacctttgtaccagggaca

SEQ ID NO: 473326 - DNA, 25 bp, Mus musculus
gagagggactcaatgcctacatgat

SEQ ID NO: 473327 - DNA, 25 bp, Mus musculus
gagagggactcattgcctacatgat

SEQ ID NO: 473328 - DNA, 25 bp, Mus musculus
gagagggactgcctctactcaggca

SEQ ID NO: 473329 - DNA, 25 bp, Mus musculus
gagagggactgcgtctactcaggca

SEQ ID NO: 473330 - DNA, 25 bp, Mus musculus
gagagggagagtctatacgtggtaa

SEQ ID NO: 473331 - DNA, 25 bp, Mus musculus
gagagggagagtgtatacgtggtaa

SEQ ID NO: 473332 - DNA, 25 bp, Mus musculus
gagagggatattagtcatctttttt

SEQ ID NO: 473333 - DNA, 25 bp, Mus musculus
gagagggatatttgtcatctttttt

SEQ ID NO: 473334 - DNA, 25 bp, Mus musculus
gagagggatcatcttgtcactcctt

SEQ ID NO: 473335 - DNA, 25 bp, Mus musculus
gagagggatcatgttgtcactcctt

SEQ ID NO: 473336 - DNA, 25 bp, Mus musculus
gagagggatcctagcatcggttacc

SEQ ID NO: 473337 - DNA, 25 bp, Mus musculus
gagagggatccttgcatcggttacc

SEQ ID NO: 473338 - DNA, 25 bp, Mus musculus
gagagggattaccactgttgataac

SEQ ID NO: 473339 - DNA, 25 bp, Mus musculus
gagagggattacgactgttgataac

SEQ ID NO: 473340 - DNA, 25 bp, Mus musculus
gagagggcagacaattcgagagaaa

SEQ ID NO: 473341 - DNA, 25 bp, Mus musculus
gagagggcagactattcgagagaaa

SEQ ID NO: 473342 - DNA, 25 bp, Mus musculus
gagagggcagagaccccattctggt

SEQ ID NO: 473343 - DNA, 25 bp, Mus musculus
gagagggcagagtccccattctggt

SEQ ID NO: 473344 - DNA, 25 bp, Mus musculus
gagagggcccttaccgcaggtcaga

SEQ ID NO: 473345 - DNA, 25 bp, Mus musculus
gagagggccctttccgcaggtcaga

SEQ ID NO: 473346 - DNA, 25 bp, Mus musculus
gagagggccggaaaacatcactttt

SEQ ID NO: 473347 - DNA, 25 bp, Mus musculus
gagagggccggataacatcactttt

SEQ ID NO: 473348 - DNA, 25 bp, Mus musculus
gagagggcgtcacaactcattacag

SEQ ID NO: 473349 - DNA, 25 bp, Mus musculus
gagagggcgtcagaactcattacag

SEQ ID NO: 473350 - DNA, 25 bp, Mus musculus
gagagggctgcactacatccagaac

SEQ ID NO: 473351 - DNA, 25 bp, Mus musculus
gagagggctgcagtacatccagaac

SEQ ID NO: 473352 - DNA, 25 bp, Mus musculus
gagagggctgccctacaaagcaacg

SEQ ID NO: 473353 - DNA, 25 bp, Mus musculus
gagagggctgccgtacaaagcaacg

SEQ ID NO: 473354 - DNA, 25 bp, Mus musculus
gagagggctgtgaaccgagatatca

SEQ ID NO: 473355 - DNA, 25 bp, Mus musculus
gagagggctgtgtaccgagatatca

SEQ ID NO: 473356 - DNA, 25 bp, Mus musculus
gagagggcttgccaccagattctcc

SEQ ID NO: 473357 - DNA, 25 bp, Mus musculus
gagagggcttgcgaccagattctcc

SEQ ID NO: 473358 - DNA, 25 bp, Mus musculus
gagagggcttgtctccacatgagaa

SEQ ID NO: 473359 - DNA, 25 bp, Mus musculus
gagagggcttgtgtccacatgagaa

SEQ ID NO: 473360 - DNA, 25 bp, Mus musculus
gagagggctttgaaccagtgagtat

SEQ ID NO: 473361 - DNA, 25 bp, Mus musculus
gagagggctttgactctagagcaga

SEQ ID NO: 473362 - DNA, 25 bp, Mus musculus
gagagggctttgtaccagtgagtat

SEQ ID NO: 473363 - DNA, 25 bp, Mus musculus
gagagggctttgtctctagagcaga

SEQ ID NO: 473364 - DNA, 25 bp, Mus musculus
gagagggtaattcctgccaagcgcc

SEQ ID NO: 473365 - DNA, 25 bp, Mus musculus
gagagggtaattgctgccaagcgcc

SEQ ID NO: 473366 - DNA, 25 bp, Mus musculus
gagagggtacctcatgggcccatat

SEQ ID NO: 473367 - DNA, 25 bp, Mus musculus
gagagggtacctgatgggcccatat

SEQ ID NO: 473368 - DNA, 25 bp, Mus musculus
gagagggtatgaccggtattacaac

SEQ ID NO: 473369 - DNA, 25 bp, Mus musculus
gagagggtatgagcggtattacaac

SEQ ID NO: 473370 - DNA, 25 bp, Mus musculus
gagagggtattaagcctaaccaaga

SEQ ID NO: 473371 - DNA, 25 bp, Mus musculus
gagagggtattatgcctaaccaaga

SEQ ID NO: 473372 - DNA, 25 bp, Mus musculus
gagagggtattcaggccttcagcaa

SEQ ID NO: 473373 - DNA, 25 bp, Mus musculus
gagagggtattctggccttcagcaa

SEQ ID NO: 473374 - DNA, 25 bp, Mus musculus
gagagggtcagcagcaagtcccaga

SEQ ID NO: 473375 - DNA, 25 bp, Mus musculus
gagagggtcagctgcaagtcccaga

SEQ ID NO: 473376 - DNA, 25 bp, Mus musculus
gagagggtccagagacgctttgcct

SEQ ID NO: 473377 - DNA, 25 bp, Mus musculus
gagagggtccagtgacgctttgcct

SEQ ID NO: 473378 - DNA, 25 bp, Mus musculus
gagagggtccatccagtcacaggcc

SEQ ID NO: 473379 - DNA, 25 bp, Mus musculus
gagagggtccatgcagtcacaggcc

SEQ ID NO: 473380 - DNA, 25 bp, Mus musculus
gagagggtgcccagagatgtcctac

SEQ ID NO: 473381 - DNA, 25 bp, Mus musculus
gagagggtgccctgagatgtcctac

SEQ ID NO: 473382 - DNA, 25 bp, Mus musculus
gagagggtggttacttagtacatca

SEQ ID NO: 473383 - DNA, 25 bp, Mus musculus
gagagggtggtttcttagtacatca

SEQ ID NO: 473384 - DNA, 25 bp, Mus musculus
gagagggtgtcaattcttgctagtc

SEQ ID NO: 473385 - DNA, 25 bp, Mus musculus
gagagggtgtcatttcttgctagtc

SEQ ID NO: 473386 - DNA, 25 bp, Mus musculus
gagagggttacacactagaggctaa

SEQ ID NO: 473387 - DNA, 25 bp, Mus musculus
gagagggttacagactagaggctaa

SEQ ID NO: 473388 - DNA, 25 bp, Mus musculus
gagagggttcacattttaatcatac

SEQ ID NO: 473389 - DNA, 25 bp, Mus musculus
gagagggttcactttttaatcatac

SEQ ID NO: 473390 - DNA, 25 bp, Mus musculus
gagagggttccaagtaatttgttta

SEQ ID NO: 473391 - DNA, 25 bp, Mus musculus
gagagggttccatgtaatttgttta

SEQ ID NO: 473392 - DNA, 25 bp, Mus musculus
gagagggtttccagaggctcacaag

SEQ ID NO: 473393 - DNA, 25 bp, Mus musculus
gagagggtttcctgaggctcacaag

SEQ ID NO: 473394 - DNA, 25 bp, Mus musculus
gagaggtaataaataaactcctatt

SEQ ID NO: 473395 - DNA, 25 bp, Mus musculus
gagaggtaataattaaactcctatt

SEQ ID NO: 473396 - DNA, 25 bp, Mus musculus
gagaggtacatcagatgcgcctgcc

SEQ ID NO: 473397 - DNA, 25 bp, Mus musculus
gagaggtacatctgatgcgcctgcc

SEQ ID NO: 473398 - DNA, 25 bp, Mus musculus
gagaggtacccgaccatcatctata

SEQ ID NO: 473399 - DNA, 25 bp, Mus musculus
gagaggtacccgtccatcatctata

SEQ ID NO: 473400 - DNA, 25 bp, Mus musculus
gagaggtacggaagcctacgtgcat

SEQ ID NO: 473401 - DNA, 25 bp, Mus musculus
gagaggtacggatgcctacgtgcat

SEQ ID NO: 473402 - DNA, 25 bp, Mus musculus
gagaggtagcatactgagcttgtgc

SEQ ID NO: 473403 - DNA, 25 bp, Mus musculus
gagaggtagcattctgagcttgtgc

SEQ ID NO: 473404 - DNA, 25 bp, Mus musculus
gagaggtagctcctaaacccttgtg

SEQ ID NO: 473405 - DNA, 25 bp, Mus musculus
gagaggtagctcgtaaacccttgtg

SEQ ID NO: 473406 - DNA, 25 bp, Mus musculus
gagaggtagtacaggctcccttgct

SEQ ID NO: 473407 - DNA, 25 bp, Mus musculus
gagaggtagtactggctcccttgct

SEQ ID NO: 473408 - DNA, 25 bp, Mus musculus
gagaggtagtccagagcagcaacac

SEQ ID NO: 473409 - DNA, 25 bp, Mus musculus
gagaggtagtcctgagcagcaacac

SEQ ID NO: 473410 - DNA, 25 bp, Mus musculus
gagaggtatcctcaccctgaagtac

SEQ ID NO: 473411 - DNA, 25 bp, Mus musculus
gagaggtatcctgaccctgaagtac

SEQ ID NO: 473412 - DNA, 25 bp, Mus musculus
gagaggtatctcaacctcgaggagc

SEQ ID NO: 473413 - DNA, 25 bp, Mus musculus
gagaggtatctctacctcgaggagc

SEQ ID NO: 473414 - DNA, 25 bp, Mus musculus
gagaggtcagacaaagtgccagaaa

SEQ ID NO: 473415 - DNA, 25 bp, Mus musculus
gagaggtcagactaagtgccagaaa

SEQ ID NO: 473416 - DNA, 25 bp, Mus musculus
gagaggtcagagaaatgcagaatgc

SEQ ID NO: 473417 - DNA, 25 bp, Mus musculus
gagaggtcagagtaatgcagaatgc

SEQ ID NO: 473418 - DNA, 25 bp, Mus musculus
gagaggtcataaccccacaagatca

SEQ ID NO: 473419 - DNA, 25 bp, Mus musculus
gagaggtcataagcccacaagatca

SEQ ID NO: 473420 - DNA, 25 bp, Mus musculus
gagaggtccaacactgttctcgagt

SEQ ID NO: 473421 - DNA, 25 bp, Mus musculus
gagaggtccaactctgttctcgagt

SEQ ID NO: 473422 - DNA, 25 bp, Mus musculus
gagaggtccagtatcttggcaggta

SEQ ID NO: 473423 - DNA, 25 bp, Mus musculus
gagaggtccagtttcttggcaggta

SEQ ID NO: 473424 - DNA, 25 bp, Mus musculus
gagaggtcccggactgcctgcagat

SEQ ID NO: 473425 - DNA, 25 bp, Mus musculus
gagaggtcccggtctgcctgcagat

SEQ ID NO: 473426 - DNA, 25 bp, Mus musculus
gagaggtcctgtccactaaaggtac

SEQ ID NO: 473427 - DNA, 25 bp, Mus musculus
gagaggtcctgtgcactaaaggtac

SEQ ID NO: 473428 - DNA, 25 bp, Mus musculus
gagaggtctactcaggagctgttta

SEQ ID NO: 473429 - DNA, 25 bp, Mus musculus
gagaggtctactgaggagctgttta

SEQ ID NO: 473430 - DNA, 25 bp, Mus musculus
gagaggtctatcctagcctggcaaa

SEQ ID NO: 473431 - DNA, 25 bp, Mus musculus
gagaggtctatcgtagcctggcaaa

SEQ ID NO: 473432 - DNA, 25 bp, Mus musculus
gagaggtctcagaagcctacagctt

SEQ ID NO: 473433 - DNA, 25 bp, Mus musculus
gagaggtctcagtagcctacagctt

SEQ ID NO: 473434 - DNA, 25 bp, Mus musculus
gagaggtctctacccgggattgtca

SEQ ID NO: 473435 - DNA, 25 bp, Mus musculus
gagaggtctctagccgggattgtca

SEQ ID NO: 473436 - DNA, 25 bp, Mus musculus
gagaggtctgaacctatcctttgat

SEQ ID NO: 473437 - DNA, 25 bp, Mus musculus
gagaggtctgaagctatcctttgat

SEQ ID NO: 473438 - DNA, 25 bp, Mus musculus
gagaggtctgatctgtttggacaaa

SEQ ID NO: 473439 - DNA, 25 bp, Mus musculus
gagaggtctgatgtgtttggacaaa

SEQ ID NO: 473440 - DNA, 25 bp, Mus musculus
gagaggtctgcgagagtccccgcaa

SEQ ID NO: 473441 - DNA, 25 bp, Mus musculus
gagaggtctgcgtgagtccccgcaa

SEQ ID NO: 473442 - DNA, 25 bp, Mus musculus
gagaggtcttccacttgtagaccag

SEQ ID NO: 473443 - DNA, 25 bp, Mus musculus
gagaggtcttcctcttgtagaccag

SEQ ID NO: 473444 - DNA, 25 bp, Mus musculus
gagaggtgaatgaccggctgaccct

SEQ ID NO: 473445 - DNA, 25 bp, Mus musculus
gagaggtgaatgtccggctgaccct

SEQ ID NO: 473446 - DNA, 25 bp, Mus musculus
gagaggtgacatcaacccacgactc

SEQ ID NO: 473447 - DNA, 25 bp, Mus musculus
gagaggtgacatgaacccacgactc

SEQ ID NO: 473448 - DNA, 25 bp, Mus musculus
gagaggtgatataatacattcacat

SEQ ID NO: 473449 - DNA, 25 bp, Mus musculus
gagaggtgatattatacattcacat

SEQ ID NO: 473450 - DNA, 25 bp, Mus musculus
gagaggtgccaacatccattagttt

SEQ ID NO: 473451 - DNA, 25 bp, Mus musculus
gagaggtgccaagatccattagttt

SEQ ID NO: 473452 - DNA, 25 bp, Mus musculus
gagaggtgcctacaccactttagag

SEQ ID NO: 473453 - DNA, 25 bp, Mus musculus
gagaggtgcctagaccactttagag

SEQ ID NO: 473454 - DNA, 25 bp, Mus musculus
gagaggtgcgtaccggccgaggcct

SEQ ID NO: 473455 - DNA, 25 bp, Mus musculus
gagaggtgcgtagcggccgaggcct

SEQ ID NO: 473456 - DNA, 25 bp, Mus musculus
gagaggtgctggaccaggctttcat

SEQ ID NO: 473457 - DNA, 25 bp, Mus musculus
gagaggtgctggtccaggctttcat

SEQ ID NO: 473458 - DNA, 25 bp, Mus musculus
gagaggtgcttacattttgttatga

SEQ ID NO: 473459 - DNA, 25 bp, Mus musculus
gagaggtgcttagattttgttatga

SEQ ID NO: 473460 - DNA, 25 bp, Mus musculus
gagaggtggcctcacctatgatcgt

SEQ ID NO: 473461 - DNA, 25 bp, Mus musculus
gagaggtggcctgacctatgatcgt

SEQ ID NO: 473462 - DNA, 25 bp, Mus musculus
gagaggtggcgaagtctacaccgta

SEQ ID NO: 473463 - DNA, 25 bp, Mus musculus
gagaggtggcgatgtctacaccgta

SEQ ID NO: 473464 - DNA, 25 bp, Mus musculus
gagaggtgtgaccatccagccgctt

SEQ ID NO: 473465 - DNA, 25 bp, Mus musculus
gagaggtgtgacgatccagccgctt

SEQ ID NO: 473466 - DNA, 25 bp, Mus musculus
gagaggtgtgctacctctgactcta

SEQ ID NO: 473467 - DNA, 25 bp, Mus musculus
gagaggtgtgcttcctctgactcta

SEQ ID NO: 473468 - DNA, 25 bp, Mus musculus
gagaggtgtgtaaccatacctccac

SEQ ID NO: 473469 - DNA, 25 bp, Mus musculus
gagaggtgtgtatccatacctccac

SEQ ID NO: 473470 - DNA, 25 bp, Mus musculus
gagaggttacagatgctatgttcaa

SEQ ID NO: 473471 - DNA, 25 bp, Mus musculus
gagaggttacagttgctatgttcaa

SEQ ID NO: 473472 - DNA, 25 bp, Mus musculus
gagaggttacatatgttcccgatga

SEQ ID NO: 473473 - DNA, 25 bp, Mus musculus
gagaggttacatttgttcccgatga

SEQ ID NO: 473474 - DNA, 25 bp, Mus musculus
gagaggttacgtaggcctttgatcc

SEQ ID NO: 473475 - DNA, 25 bp, Mus musculus
gagaggttacgttggcctttgatcc

SEQ ID NO: 473476 - DNA, 25 bp, Mus musculus
gagaggttcaaacgcatccgcagct

SEQ ID NO: 473477 - DNA, 25 bp, Mus musculus
gagaggttcaaaggcatccgcagct

SEQ ID NO: 473478 - DNA, 25 bp, Mus musculus
gagaggttcagaactctgctcccta

SEQ ID NO: 473479 - DNA, 25 bp, Mus musculus
gagaggttcagatctctgctcccta

SEQ ID NO: 473480 - DNA, 25 bp, Mus musculus
gagaggttcctcactgtgcataagc

SEQ ID NO: 473481 - DNA, 25 bp, Mus musculus
gagaggttcctcagctcggagatgt

SEQ ID NO: 473482 - DNA, 25 bp, Mus musculus
gagaggttcctctctgtgcataagc

SEQ ID NO: 473483 - DNA, 25 bp, Mus musculus
gagaggttcctctgctcggagatgt

SEQ ID NO: 473484 - DNA, 25 bp, Mus musculus
gagaggttcctgcaagtcctaaaac

SEQ ID NO: 473485 - DNA, 25 bp, Mus musculus
gagaggttcctggaagtcctaaaac

SEQ ID NO: 473486 - DNA, 25 bp, Mus musculus
gagaggttcttcaattacatagaca

SEQ ID NO: 473487 - DNA, 25 bp, Mus musculus
gagaggttcttcatgaggtcagcaa

SEQ ID NO: 473488 - DNA, 25 bp, Mus musculus
gagaggttcttctattacatagaca

SEQ ID NO: 473489 - DNA, 25 bp, Mus musculus
gagaggttcttcttgaggtcagcaa

SEQ ID NO: 473490 - DNA, 25 bp, Mus musculus
gagaggttcttgctcagtcccgctg

SEQ ID NO: 473491 - DNA, 25 bp, Mus musculus
gagaggttcttggtcagtcccgctg

SEQ ID NO: 473492 - DNA, 25 bp, Mus musculus
gagaggttgacgacgagcagcacac

SEQ ID NO: 473493 - DNA, 25 bp, Mus musculus
gagaggttgacgatcgaagcagcca

SEQ ID NO: 473494 - DNA, 25 bp, Mus musculus
gagaggttgacgtcgagcagcacac

SEQ ID NO: 473495 - DNA, 25 bp, Mus musculus
gagaggttgacgttcgaagcagcca

SEQ ID NO: 473496 - DNA, 25 bp, Mus musculus
gagaggttgcccacccgagaatgga

SEQ ID NO: 473497 - DNA, 25 bp, Mus musculus
gagaggttgcccctttatgtagctt

SEQ ID NO: 473498 - DNA, 25 bp, Mus musculus
gagaggttgcccgtttatgtagctt

SEQ ID NO: 473499 - DNA, 25 bp, Mus musculus
gagaggttgccctcccgagaatgga

SEQ ID NO: 473500 - DNA, 25 bp, Mus musculus
gagaggttgctcattttcttgaact

SEQ ID NO: 473501 - DNA, 25 bp, Mus musculus
gagaggttgctctttttcttgaact

SEQ ID NO: 473502 - DNA, 25 bp, Mus musculus
gagaggttgcttattagccctactg

SEQ ID NO: 473503 - DNA, 25 bp, Mus musculus
gagaggttgcttctttaatttctaa

SEQ ID NO: 473504 - DNA, 25 bp, Mus musculus
gagaggttgcttgtttaatttctaa

SEQ ID NO: 473505 - DNA, 25 bp, Mus musculus
gagaggttgctttttagccctactg

SEQ ID NO: 473506 - DNA, 25 bp, Mus musculus
gagaggttgtctctactttccgttc

SEQ ID NO: 473507 - DNA, 25 bp, Mus musculus
gagaggttgtctgtactttccgttc

SEQ ID NO: 473508 - DNA, 25 bp, Mus musculus
gagaggttgtttcagtcacccaagg

SEQ ID NO: 473509 - DNA, 25 bp, Mus musculus
gagaggttgtttgagtcacccaagg

SEQ ID NO: 473510 - DNA, 25 bp, Mus musculus
gagaggtttactccaaggtcattat

SEQ ID NO: 473511 - DNA, 25 bp, Mus musculus
gagaggtttactgcaaggtcattat

SEQ ID NO: 473512 - DNA, 25 bp, Mus musculus
gagaggtttatgctaccacttcgca

SEQ ID NO: 473513 - DNA, 25 bp, Mus musculus
gagaggtttatggtaccacttcgca

SEQ ID NO: 473514 - DNA, 25 bp, Mus musculus
gagaggtttcccatcaggcaaatct

SEQ ID NO: 473515 - DNA, 25 bp, Mus musculus
gagaggtttcccttcaggcaaatct

SEQ ID NO: 473516 - DNA, 25 bp, Mus musculus
gagaggtttgaaagtgctgttctac

SEQ ID NO: 473517 - DNA, 25 bp, Mus musculus
gagaggtttgaatgtgctgttctac

SEQ ID NO: 473518 - DNA, 25 bp, Mus musculus
gagaggttttccctatacgacagga

SEQ ID NO: 473519 - DNA, 25 bp, Mus musculus
gagaggttttccgtatacgacagga

SEQ ID NO: 473520 - DNA, 25 bp, Mus musculus
gagagtaaacctctccaaattcgtg

SEQ ID NO: 473521 - DNA, 25 bp, Mus musculus
gagagtaaacctgtccaaattcgtg

SEQ ID NO: 473522 - DNA, 25 bp, Mus musculus
gagagtaaactgaccgtgaaaccca

SEQ ID NO: 473523 - DNA, 25 bp, Mus musculus
gagagtaaactgtccgtgaaaccca

SEQ ID NO: 473524 - DNA, 25 bp, Mus musculus
gagagtaaagttcccacactcactc

SEQ ID NO: 473525 - DNA, 25 bp, Mus musculus
gagagtaaagttgccacactcactc

SEQ ID NO: 473526 - DNA, 25 bp, Mus musculus
gagagtaacactatccgatgcaaat

SEQ ID NO: 473527 - DNA, 25 bp, Mus musculus
gagagtaacactttccgatgcaaat

SEQ ID NO: 473528 - DNA, 25 bp, Mus musculus
gagagtaacttaaatcctatcagat

SEQ ID NO: 473529 - DNA, 25 bp, Mus musculus
gagagtaacttatatcctatcagat

SEQ ID NO: 473530 - DNA, 25 bp, Mus musculus
gagagtaactttagaccttcctgtc

SEQ ID NO: 473531 - DNA, 25 bp, Mus musculus
gagagtaacttttgaccttcctgtc

SEQ ID NO: 473532 - DNA, 25 bp, Mus musculus
gagagtaagaggacccagacccact

SEQ ID NO: 473533 - DNA, 25 bp, Mus musculus
gagagtaagaggtcccagacccact

SEQ ID NO: 473534 - DNA, 25 bp, Mus musculus
gagagtaagcaccactcccttggag

SEQ ID NO: 473535 - DNA, 25 bp, Mus musculus
gagagtaagcacgactcccttggag

SEQ ID NO: 473536 - DNA, 25 bp, Mus musculus
gagagtaagcttcccattatttcat

SEQ ID NO: 473537 - DNA, 25 bp, Mus musculus
gagagtaagcttgccattatttcat

SEQ ID NO: 473538 - DNA, 25 bp, Mus musculus
gagagtaaggtcatctatctgaaaa

SEQ ID NO: 473539 - DNA, 25 bp, Mus musculus
gagagtaaggtcttctatctgaaaa

SEQ ID NO: 473540 - DNA, 25 bp, Mus musculus
gagagtaagtacactgggcttggca

SEQ ID NO: 473541 - DNA, 25 bp, Mus musculus
gagagtaagtactctgggcttggca

SEQ ID NO: 473542 - DNA, 25 bp, Mus musculus
gagagtaatggcatctcctctgtac

SEQ ID NO: 473543 - DNA, 25 bp, Mus musculus
gagagtaatggcttctcctctgtac

SEQ ID NO: 473544 - DNA, 25 bp, Mus musculus
gagagtacaaacagcccgacgggaa

SEQ ID NO: 473545 - DNA, 25 bp, Mus musculus
gagagtacaaactgcccgacgggaa

SEQ ID NO: 473546 - DNA, 25 bp, Mus musculus
gagagtacaataaattcacctaatt

SEQ ID NO: 473547 - DNA, 25 bp, Mus musculus
gagagtacaatatattcacctaatt

SEQ ID NO: 473548 - DNA, 25 bp, Mus musculus
gagagtacaccaccaaaaggctcaa

SEQ ID NO: 473549 - DNA, 25 bp, Mus musculus
gagagtacaccagcaaaaggctcaa

SEQ ID NO: 473550 - DNA, 25 bp, Mus musculus
gagagtacacttcctaatgcactgg

SEQ ID NO: 473551 - DNA, 25 bp, Mus musculus
gagagtacacttgctaatgcactgg

SEQ ID NO: 473552 - DNA, 25 bp, Mus musculus
gagagtacagatacccaaaacccac

SEQ ID NO: 473553 - DNA, 25 bp, Mus musculus
gagagtacagattcccaaaacccac

SEQ ID NO: 473554 - DNA, 25 bp, Mus musculus
gagagtacagctacccacagattgt

SEQ ID NO: 473555 - DNA, 25 bp, Mus musculus
gagagtacagctctgagtcgcaaga

SEQ ID NO: 473556 - DNA, 25 bp, Mus musculus
gagagtacagctgtgagtcgcaaga

SEQ ID NO: 473557 - DNA, 25 bp, Mus musculus
gagagtacagcttcccacagattgt

SEQ ID NO: 473558 - DNA, 25 bp, Mus musculus
gagagtacagtcagtgcttcgctgg

SEQ ID NO: 473559 - DNA, 25 bp, Mus musculus
gagagtacagtctgtgcttcgctgg

SEQ ID NO: 473560 - DNA, 25 bp, Mus musculus
gagagtacctaactgctatcctagt

SEQ ID NO: 473561 - DNA, 25 bp, Mus musculus
gagagtacctaagtgctatcctagt

SEQ ID NO: 473562 - DNA, 25 bp, Mus musculus
gagagtactaaaccaccactggttt

SEQ ID NO: 473563 - DNA, 25 bp, Mus musculus
gagagtactaaagcaccactggttt

SEQ ID NO: 473564 - DNA, 25 bp, Mus musculus
gagagtactctgagggtagattcat

SEQ ID NO: 473565 - DNA, 25 bp, Mus musculus
gagagtactctgtgggtagattcat

SEQ ID NO: 473566 - DNA, 25 bp, Mus musculus
gagagtactcttcttttcgttaggt

SEQ ID NO: 473567 - DNA, 25 bp, Mus musculus
gagagtactcttgttttcgttaggt

SEQ ID NO: 473568 - DNA, 25 bp, Mus musculus
gagagtactgtcattgtttcaccat

SEQ ID NO: 473569 - DNA, 25 bp, Mus musculus
gagagtactgtccatttatttaaaa

SEQ ID NO: 473570 - DNA, 25 bp, Mus musculus
gagagtactgtcgatttatttaaaa

SEQ ID NO: 473571 - DNA, 25 bp, Mus musculus
gagagtactgtctttgtttcaccat

SEQ ID NO: 473572 - DNA, 25 bp, Mus musculus
gagagtacttgacctgagggcaaat

SEQ ID NO: 473573 - DNA, 25 bp, Mus musculus
gagagtacttgagctgagggcaaat

SEQ ID NO: 473574 - DNA, 25 bp, Mus musculus
gagagtacttgcatagtatgtgtga

SEQ ID NO: 473575 - DNA, 25 bp, Mus musculus
gagagtacttgcttagtatgtgtga

SEQ ID NO: 473576 - DNA, 25 bp, Mus musculus
gagagtagagacatcatccatgaga

SEQ ID NO: 473577 - DNA, 25 bp, Mus musculus
gagagtagagacttcatccatgaga

SEQ ID NO: 473578 - DNA, 25 bp, Mus musculus
gagagtagatacaggatttccagga

SEQ ID NO: 473579 - DNA, 25 bp, Mus musculus
gagagtagatactggatttccagga

SEQ ID NO: 473580 - DNA, 25 bp, Mus musculus
gagagtagcaggaatattcttttaa

SEQ ID NO: 473581 - DNA, 25 bp, Mus musculus
gagagtagcaggtatattcttttaa

SEQ ID NO: 473582 - DNA, 25 bp, Mus musculus
gagagtagccaaaaccaatccgtga

SEQ ID NO: 473583 - DNA, 25 bp, Mus musculus
gagagtagccaataccaatccgtga

SEQ ID NO: 473584 - DNA, 25 bp, Mus musculus
gagagtagccttataaatgcaatgt

SEQ ID NO: 473585 - DNA, 25 bp, Mus musculus
gagagtagccttttaaatgcaatgt

SEQ ID NO: 473586 - DNA, 25 bp, Mus musculus
gagagtagcgtcactgagctaggac

SEQ ID NO: 473587 - DNA, 25 bp, Mus musculus
gagagtagcgtctctgagctaggac

SEQ ID NO: 473588 - DNA, 25 bp, Mus musculus
gagagtaggcctatggtgcctgtct

SEQ ID NO: 473589 - DNA, 25 bp, Mus musculus
gagagtaggcctttggtgcctgtct

SEQ ID NO: 473590 - DNA, 25 bp, Mus musculus
gagagtagttttcatttctgactga

SEQ ID NO: 473591 - DNA, 25 bp, Mus musculus
gagagtagttttgatttctgactga

SEQ ID NO: 473592 - DNA, 25 bp, Mus musculus
gagagtataacccattggcaagtta

SEQ ID NO: 473593 - DNA, 25 bp, Mus musculus
gagagtataaccgattggcaagtta

SEQ ID NO: 473594 - DNA, 25 bp, Mus musculus
gagagtatacgtcggcacatagctg

SEQ ID NO: 473595 - DNA, 25 bp, Mus musculus
gagagtatacgtgggcacatagctg

SEQ ID NO: 473596 - DNA, 25 bp, Mus musculus
gagagtatccagagtcgtacaaact

SEQ ID NO: 473597 - DNA, 25 bp, Mus musculus
gagagtatccagtgtcgtacaaact

SEQ ID NO: 473598 - DNA, 25 bp, Mus musculus
gagagtatcctcacacagactgtca

SEQ ID NO: 473599 - DNA, 25 bp, Mus musculus
gagagtatcctctcacagactgtca

SEQ ID NO: 473600 - DNA, 25 bp, Mus musculus
gagagtatctgtaatcttgcagtat

SEQ ID NO: 473601 - DNA, 25 bp, Mus musculus
gagagtatctgttatcttgcagtat

SEQ ID NO: 473602 - DNA, 25 bp, Mus musculus
gagagtatgacacctacctcacagg

SEQ ID NO: 473603 - DNA, 25 bp, Mus musculus
gagagtatgacagctacctcacagg

SEQ ID NO: 473604 - DNA, 25 bp, Mus musculus
gagagtatgagtcccacgcatccaa

SEQ ID NO: 473605 - DNA, 25 bp, Mus musculus
gagagtatgagtgccacgcatccaa

SEQ ID NO: 473606 - DNA, 25 bp, Mus musculus
gagagtatgtgccacttccaggcaa

SEQ ID NO: 473607 - DNA, 25 bp, Mus musculus
gagagtatgtgcgacttccaggcaa

SEQ ID NO: 473608 - DNA, 25 bp, Mus musculus
gagagtattcaaaccagggctccct

SEQ ID NO: 473609 - DNA, 25 bp, Mus musculus
gagagtattcaatccagggctccct

SEQ ID NO: 473610 - DNA, 25 bp, Mus musculus
gagagtattcataatggcaggtgtc

SEQ ID NO: 473611 - DNA, 25 bp, Mus musculus
gagagtattcattatggcaggtgtc

SEQ ID NO: 473612 - DNA, 25 bp, Mus musculus
gagagtattgggacgcttgtgcaaa

SEQ ID NO: 473613 - DNA, 25 bp, Mus musculus
gagagtattgggtcgcttgtgcaaa

SEQ ID NO: 473614 - DNA, 25 bp, Mus musculus
gagagtatttcacattttggaatta

SEQ ID NO: 473615 - DNA, 25 bp, Mus musculus
gagagtatttcagattttggaatta

SEQ ID NO: 473616 - DNA, 25 bp, Mus musculus
gagagtatttctacatctcctctgc

SEQ ID NO: 473617 - DNA, 25 bp, Mus musculus
gagagtatttcttcatctcctctgc

SEQ ID NO: 473618 - DNA, 25 bp, Mus musculus
gagagtatttgacccgtttcctgca

SEQ ID NO: 473619 - DNA, 25 bp, Mus musculus
gagagtatttgagccgtttcctgca

SEQ ID NO: 473620 - DNA, 25 bp, Mus musculus
gagagtcaactcattacttgtttca

SEQ ID NO: 473621 - DNA, 25 bp, Mus musculus
gagagtcaactctttacttgtttca

SEQ ID NO: 473622 - DNA, 25 bp, Mus musculus
gagagtcaagtacctggtgaactgt

SEQ ID NO: 473623 - DNA, 25 bp, Mus musculus
gagagtcaagtagctggtgaactgt

SEQ ID NO: 473624 - DNA, 25 bp, Mus musculus
gagagtcaatgcagtccttgtccag

SEQ ID NO: 473625 - DNA, 25 bp, Mus musculus
gagagtcaatgctgtccttgtccag

SEQ ID NO: 473626 - DNA, 25 bp, Mus musculus
gagagtcaatggaaatactgtttta

SEQ ID NO: 473627 - DNA, 25 bp, Mus musculus
gagagtcaatggtaatactgtttta

SEQ ID NO: 473628 - DNA, 25 bp, Mus musculus
gagagtcactatccgaaaatctaaa

SEQ ID NO: 473629 - DNA, 25 bp, Mus musculus
gagagtcactatgcgaaaatctaaa

SEQ ID NO: 473630 - DNA, 25 bp, Mus musculus
gagagtcacttcatggattccattt

SEQ ID NO: 473631 - DNA, 25 bp, Mus musculus
gagagtcacttcttggattccattt

SEQ ID NO: 473632 - DNA, 25 bp, Mus musculus
gagagtcagctgatgaccctgtctg

SEQ ID NO: 473633 - DNA, 25 bp, Mus musculus
gagagtcagctgttgaccctgtctg

SEQ ID NO: 473634 - DNA, 25 bp, Mus musculus
gagagtcaggccattctactggtat

SEQ ID NO: 473635 - DNA, 25 bp, Mus musculus
gagagtcaggcctttctactggtat

SEQ ID NO: 473636 - DNA, 25 bp, Mus musculus
gagagtcagtggatcagctcagcct

SEQ ID NO: 473637 - DNA, 25 bp, Mus musculus
gagagtcagtggttcagctcagcct

SEQ ID NO: 473638 - DNA, 25 bp, Mus musculus
gagagtcagtttcgccagttttttg

SEQ ID NO: 473639 - DNA, 25 bp, Mus musculus
gagagtcagtttggccagttttttg

SEQ ID NO: 473640 - DNA, 25 bp, Mus musculus
gagagtcatactagggtttccatcc

SEQ ID NO: 473641 - DNA, 25 bp, Mus musculus
gagagtcatacttgggtttccatcc

SEQ ID NO: 473642 - DNA, 25 bp, Mus musculus
gagagtcatagtaacgcggccgcaa

SEQ ID NO: 473643 - DNA, 25 bp, Mus musculus
gagagtcatagttacgcggccgcaa

SEQ ID NO: 473644 - DNA, 25 bp, Mus musculus
gagagtcatctccaaactttccagg

SEQ ID NO: 473645 - DNA, 25 bp, Mus musculus
gagagtcatctcgaaactttccagg

SEQ ID NO: 473646 - DNA, 25 bp, Mus musculus
gagagtcatggcaggacaagctttt

SEQ ID NO: 473647 - DNA, 25 bp, Mus musculus
gagagtcatggctggacaagctttt

SEQ ID NO: 473648 - DNA, 25 bp, Mus musculus
gagagtcatgtgaactttacagcat

SEQ ID NO: 473649 - DNA, 25 bp, Mus musculus
gagagtcatgtgtactttacagcat

SEQ ID NO: 473650 - DNA, 25 bp, Mus musculus
gagagtcattgtacttggcttggaa

SEQ ID NO: 473651 - DNA, 25 bp, Mus musculus
gagagtcattgttcttggcttggaa

SEQ ID NO: 473652 - DNA, 25 bp, Mus musculus
gagagtccaagaatcttgctcatta

SEQ ID NO: 473653 - DNA, 25 bp, Mus musculus
gagagtccaagattcttgctcatta

SEQ ID NO: 473654 - DNA, 25 bp, Mus musculus
gagagtccaagcaccacctgatcta

SEQ ID NO: 473655 - DNA, 25 bp, Mus musculus
gagagtccaagctccacctgatcta

SEQ ID NO: 473656 - DNA, 25 bp, Mus musculus
gagagtccacagatgagtccacggt

SEQ ID NO: 473657 - DNA, 25 bp, Mus musculus
gagagtccacagttgagtccacggt

SEQ ID NO: 473658 - DNA, 25 bp, Mus musculus
gagagtccacttcgtcacttacagt

SEQ ID NO: 473659 - DNA, 25 bp, Mus musculus
gagagtccacttggtcacttacagt

SEQ ID NO: 473660 - DNA, 25 bp, Mus musculus
gagagtccagctcttaggacaggaa

SEQ ID NO: 473661 - DNA, 25 bp, Mus musculus
gagagtccagctgttaggacaggaa

SEQ ID NO: 473662 - DNA, 25 bp, Mus musculus
gagagtccaggaacgcaacaagcct

SEQ ID NO: 473663 - DNA, 25 bp, Mus musculus
gagagtccaggatcgcaacaagcct

SEQ ID NO: 473664 - DNA, 25 bp, Mus musculus
gagagtccagtacatgatgtgttct

SEQ ID NO: 473665 - DNA, 25 bp, Mus musculus
gagagtccagtagatgatgtgttct

SEQ ID NO: 473666 - DNA, 25 bp, Mus musculus
gagagtccagtgacccaagctggag

SEQ ID NO: 473667 - DNA, 25 bp, Mus musculus
gagagtccagtgctcattggccagc

SEQ ID NO: 473668 - DNA, 25 bp, Mus musculus
gagagtccagtggtcattggccagc

SEQ ID NO: 473669 - DNA, 25 bp, Mus musculus
gagagtccagtgtcccaagctggag

SEQ ID NO: 473670 - DNA, 25 bp, Mus musculus
gagagtccagttctgacaacatccc

SEQ ID NO: 473671 - DNA, 25 bp, Mus musculus
gagagtccagttgtgacaacatccc

SEQ ID NO: 473672 - DNA, 25 bp, Mus musculus
gagagtccatggattgtctgttaga

SEQ ID NO: 473673 - DNA, 25 bp, Mus musculus
gagagtccatggtttgtctgttaga

SEQ ID NO: 473674 - DNA, 25 bp, Mus musculus
gagagtcccacactgcaagtgtaga

SEQ ID NO: 473675 - DNA, 25 bp, Mus musculus
gagagtcccacagtgcaagtgtaga

SEQ ID NO: 473676 - DNA, 25 bp, Mus musculus
gagagtcccagcacttgtcgccttt

SEQ ID NO: 473677 - DNA, 25 bp, Mus musculus
gagagtcccagctcttgtcgccttt

SEQ ID NO: 473678 - DNA, 25 bp, Mus musculus
gagagtcccaggctaggaccagact

SEQ ID NO: 473679 - DNA, 25 bp, Mus musculus
gagagtcccaggcttactagacatt

SEQ ID NO: 473680 - DNA, 25 bp, Mus musculus
gagagtcccagggtaggaccagact

SEQ ID NO: 473681 - DNA, 25 bp, Mus musculus
gagagtcccagggttactagacatt

SEQ ID NO: 473682 - DNA, 25 bp, Mus musculus
gagagtccccggaaggatgatgcaa

SEQ ID NO: 473683 - DNA, 25 bp, Mus musculus
gagagtccccggtaggatgatgcaa

SEQ ID NO: 473684 - DNA, 25 bp, Mus musculus
gagagtcccggacccagagtcgctt

SEQ ID NO: 473685 - DNA, 25 bp, Mus musculus
gagagtcccggagccagagtcgctt

SEQ ID NO: 473686 - DNA, 25 bp, Mus musculus
gagagtcccgtgctcactttgtgac

SEQ ID NO: 473687 - DNA, 25 bp, Mus musculus
gagagtcccgtggtcactttgtgac

SEQ ID NO: 473688 - DNA, 25 bp, Mus musculus
gagagtccctgcctcagtaaataga

SEQ ID NO: 473689 - DNA, 25 bp, Mus musculus
gagagtccctgcgtcagtaaataga

SEQ ID NO: 473690 - DNA, 25 bp, Mus musculus
gagagtccgtccatttaagggtgtg

SEQ ID NO: 473691 - DNA, 25 bp, Mus musculus
gagagtccgtccttttaagggtgtg

SEQ ID NO: 473692 - DNA, 25 bp, Mus musculus
gagagtcctcagaactcacaagaaa

SEQ ID NO: 473693 - DNA, 25 bp, Mus musculus
gagagtcctcagctacgtaactatg

SEQ ID NO: 473694 - DNA, 25 bp, Mus musculus
gagagtcctcaggtacgtaactatg

SEQ ID NO: 473695 - DNA, 25 bp, Mus musculus
gagagtcctcagtactcacaagaaa

SEQ ID NO: 473696 - DNA, 25 bp, Mus musculus
gagagtcctctcatcagtatctcca

SEQ ID NO: 473697 - DNA, 25 bp, Mus musculus
gagagtcctctcttcagtatctcca

SEQ ID NO: 473698 - DNA, 25 bp, Mus musculus
gagagtcctgagaattatccacacg

SEQ ID NO: 473699 - DNA, 25 bp, Mus musculus
gagagtcctgagtattatccacacg

SEQ ID NO: 473700 - DNA, 25 bp, Mus musculus
gagagtcctggtacatggctttgcc

SEQ ID NO: 473701 - DNA, 25 bp, Mus musculus
gagagtcctggttcatggctttgcc

SEQ ID NO: 473702 - DNA, 25 bp, Mus musculus
gagagtccttatactgaacatccag

SEQ ID NO: 473703 - DNA, 25 bp, Mus musculus
gagagtccttattctgaacatccag

SEQ ID NO: 473704 - DNA, 25 bp, Mus musculus
gagagtcctttacctgttttacagt

SEQ ID NO: 473705 - DNA, 25 bp, Mus musculus
gagagtcctttagctgttttacagt

SEQ ID NO: 473706 - DNA, 25 bp, Mus musculus
gagagtcgagtcaatcactgtaaac

SEQ ID NO: 473707 - DNA, 25 bp, Mus musculus
gagagtcgagtctatcactgtaaac

SEQ ID NO: 473708 - DNA, 25 bp, Mus musculus
gagagtcgccgtcggatgcagcgca

SEQ ID NO: 473709 - DNA, 25 bp, Mus musculus
gagagtcgccgtgggatgcagcgca

SEQ ID NO: 473710 - DNA, 25 bp, Mus musculus
gagagtcgcggcagtcagacctaag

SEQ ID NO: 473711 - DNA, 25 bp, Mus musculus
gagagtcgcggctgtcagacctaag

SEQ ID NO: 473712 - DNA, 25 bp, Mus musculus
gagagtcgctctctaatcctggtgg

SEQ ID NO: 473713 - DNA, 25 bp, Mus musculus
gagagtcgctctgtaatcctggtgg

SEQ ID NO: 473714 - DNA, 25 bp, Mus musculus
gagagtcgggtgctaacatgtttaa

SEQ ID NO: 473715 - DNA, 25 bp, Mus musculus
gagagtcgggtggtaacatgtttaa

SEQ ID NO: 473716 - DNA, 25 bp, Mus musculus
gagagtcgtgtaaggacacagcatc

SEQ ID NO: 473717 - DNA, 25 bp, Mus musculus
gagagtcgtgtatggacacagcatc

SEQ ID NO: 473718 - DNA, 25 bp, Mus musculus
gagagtcgttgtcgttccgcaatca

SEQ ID NO: 473719 - DNA, 25 bp, Mus musculus
gagagtcgttgtggttccgcaatca

SEQ ID NO: 473720 - DNA, 25 bp, Mus musculus
gagagtctaactagatcaggctttg

SEQ ID NO: 473721 - DNA, 25 bp, Mus musculus
gagagtctaacttgatcaggctttg

SEQ ID NO: 473722 - DNA, 25 bp, Mus musculus
gagagtctactaatcatcaagtcct

SEQ ID NO: 473723 - DNA, 25 bp, Mus musculus
gagagtctactattcatcaagtcct

SEQ ID NO: 473724 - DNA, 25 bp, Mus musculus
gagagtctatacacggatgaagtcc

SEQ ID NO: 473725 - DNA, 25 bp, Mus musculus
gagagtctatacagagccgccggcg

SEQ ID NO: 473726 - DNA, 25 bp, Mus musculus
gagagtctatacaggcttgaaacat

SEQ ID NO: 473727 - DNA, 25 bp, Mus musculus
gagagtctatactcggatgaagtcc

SEQ ID NO: 473728 - DNA, 25 bp, Mus musculus
gagagtctatactgagccgccggcg

SEQ ID NO: 473729 - DNA, 25 bp, Mus musculus
gagagtctatactggcttgaaacat

SEQ ID NO: 473730 - DNA, 25 bp, Mus musculus
gagagtctcagcaaagtaactccca

SEQ ID NO: 473731 - DNA, 25 bp, Mus musculus
gagagtctcagccagcgctcaacat

SEQ ID NO: 473732 - DNA, 25 bp, Mus musculus
gagagtctcagcgagcgctcaacat

SEQ ID NO: 473733 - DNA, 25 bp, Mus musculus
gagagtctcagctaagtaactccca

SEQ ID NO: 473734 - DNA, 25 bp, Mus musculus
gagagtctcataacatgaagtcatg

SEQ ID NO: 473735 - DNA, 25 bp, Mus musculus
gagagtctcatatcatgaagtcatg

SEQ ID NO: 473736 - DNA, 25 bp, Mus musculus
gagagtctcatgaacctgtgggtct

SEQ ID NO: 473737 - DNA, 25 bp, Mus musculus
gagagtctcatgtacctgtgggtct

SEQ ID NO: 473738 - DNA, 25 bp, Mus musculus
gagagtctcccacatagtaaactgt

SEQ ID NO: 473739 - DNA, 25 bp, Mus musculus
gagagtctcccagatagtaaactgt

SEQ ID NO: 473740 - DNA, 25 bp, Mus musculus
gagagtctccgtacaaggagcagca

SEQ ID NO: 473741 - DNA, 25 bp, Mus musculus
gagagtctccgttcaaggagcagca

SEQ ID NO: 473742 - DNA, 25 bp, Mus musculus
gagagtctgcaaaaaacagtatttg

SEQ ID NO: 473743 - DNA, 25 bp, Mus musculus
gagagtctgcaataaacagtatttg

SEQ ID NO: 473744 - DNA, 25 bp, Mus musculus
gagagtctgcagatgaaagcccact

SEQ ID NO: 473745 - DNA, 25 bp, Mus musculus
gagagtctgcagttgaaagcccact

SEQ ID NO: 473746 - DNA, 25 bp, Mus musculus
gagagtctgcccatgtcacttgctg

SEQ ID NO: 473747 - DNA, 25 bp, Mus musculus
gagagtctgccccatggaggccact

SEQ ID NO: 473748 - DNA, 25 bp, Mus musculus
gagagtctgcccgatggaggccact

SEQ ID NO: 473749 - DNA, 25 bp, Mus musculus
gagagtctgcccttgtcacttgctg

SEQ ID NO: 473750 - DNA, 25 bp, Mus musculus
gagagtctggaaccttgttgtgaaa

SEQ ID NO: 473751 - DNA, 25 bp, Mus musculus
gagagtctggaagcttgttgtgaaa

SEQ ID NO: 473752 - DNA, 25 bp, Mus musculus
gagagtctgggtatttcctgaagga

SEQ ID NO: 473753 - DNA, 25 bp, Mus musculus
gagagtctgggtttttcctgaagga

SEQ ID NO: 473754 - DNA, 25 bp, Mus musculus
gagagtctgtcccaacaatagcact

SEQ ID NO: 473755 - DNA, 25 bp, Mus musculus
gagagtctgtccgaacaatagcact

SEQ ID NO: 473756 - DNA, 25 bp, Mus musculus
gagagtcttactctataacctggca

SEQ ID NO: 473757 - DNA, 25 bp, Mus musculus
gagagtcttactgtataacctggca

SEQ ID NO: 473758 - DNA, 25 bp, Mus musculus
gagagtcttcaaaaatccgatgtgc

SEQ ID NO: 473759 - DNA, 25 bp, Mus musculus
gagagtcttcaaaaccccagttgtg

SEQ ID NO: 473760 - DNA, 25 bp, Mus musculus
gagagtcttcaataatccgatgtgc

SEQ ID NO: 473761 - DNA, 25 bp, Mus musculus
gagagtcttcaataccccagttgtg

SEQ ID NO: 473762 - DNA, 25 bp, Mus musculus
gagagtcttcagagggtgccaacta

SEQ ID NO: 473763 - DNA, 25 bp, Mus musculus
gagagtcttcagtgggtgccaacta

SEQ ID NO: 473764 - DNA, 25 bp, Mus musculus
gagagtcttctcatagaccggatga

SEQ ID NO: 473765 - DNA, 25 bp, Mus musculus
gagagtcttctcttagaccggatga

SEQ ID NO: 473766 - DNA, 25 bp, Mus musculus
gagagtcttcttctcattcttcctg

SEQ ID NO: 473767 - DNA, 25 bp, Mus musculus
gagagtcttcttgtcattcttcctg

SEQ ID NO: 473768 - DNA, 25 bp, Mus musculus
gagagtcttggcctatgaacttttt

SEQ ID NO: 473769 - DNA, 25 bp, Mus musculus
gagagtcttggcgtatgaacttttt

SEQ ID NO: 473770 - DNA, 25 bp, Mus musculus
gagagtgaaagccaccatcatctgt

SEQ ID NO: 473771 - DNA, 25 bp, Mus musculus
gagagtgaaagcgaccatcatctgt

SEQ ID NO: 473772 - DNA, 25 bp, Mus musculus
gagagtgaaataccacaccctttcc

SEQ ID NO: 473773 - DNA, 25 bp, Mus musculus
gagagtgaaatagcacaccctttcc

SEQ ID NO: 473774 - DNA, 25 bp, Mus musculus
gagagtgaacacaaggagcctaggc

SEQ ID NO: 473775 - DNA, 25 bp, Mus musculus
gagagtgaacaccaagcacaacata

SEQ ID NO: 473776 - DNA, 25 bp, Mus musculus
gagagtgaacacgaagcacaacata

SEQ ID NO: 473777 - DNA, 25 bp, Mus musculus
gagagtgaacactaggagcctaggc

SEQ ID NO: 473778 - DNA, 25 bp, Mus musculus
gagagtgaacggagcatcggcttcc

SEQ ID NO: 473779 - DNA, 25 bp, Mus musculus
gagagtgaacggtgcatcggcttcc

SEQ ID NO: 473780 - DNA, 25 bp, Mus musculus
gagagtgaagcaaccctatacaaat

SEQ ID NO: 473781 - DNA, 25 bp, Mus musculus
gagagtgaagcatccctatacaaat

SEQ ID NO: 473782 - DNA, 25 bp, Mus musculus
gagagtgaatgcagtcaagaccaaa

SEQ ID NO: 473783 - DNA, 25 bp, Mus musculus
gagagtgaatgctgtcaagaccaaa

SEQ ID NO: 473784 - DNA, 25 bp, Mus musculus
gagagtgacactcaaccaaagccca

SEQ ID NO: 473785 - DNA, 25 bp, Mus musculus
gagagtgacactgaaccaaagccca

SEQ ID NO: 473786 - DNA, 25 bp, Mus musculus
gagagtgacagcatttcagatagca

SEQ ID NO: 473787 - DNA, 25 bp, Mus musculus
gagagtgacagcttttcagatagca

SEQ ID NO: 473788 - DNA, 25 bp, Mus musculus
gagagtgacatcagaagctcagcat

SEQ ID NO: 473789 - DNA, 25 bp, Mus musculus
gagagtgacatctgaagctcagcat

SEQ ID NO: 473790 - DNA, 25 bp, Mus musculus
gagagtgacatgaccctcgttttct

SEQ ID NO: 473791 - DNA, 25 bp, Mus musculus
gagagtgacatgtccctcgttttct

SEQ ID NO: 473792 - DNA, 25 bp, Mus musculus
gagagtgacccacctagcaggtgtt

SEQ ID NO: 473793 - DNA, 25 bp, Mus musculus
gagagtgacccagctagcaggtgtt

SEQ ID NO: 473794 - DNA, 25 bp, Mus musculus
gagagtgacctcaaacaaagatcca

SEQ ID NO: 473795 - DNA, 25 bp, Mus musculus
gagagtgacctctaacaaagatcca

SEQ ID NO: 473796 - DNA, 25 bp, Mus musculus
gagagtgacgacaattcccaaccat

SEQ ID NO: 473797 - DNA, 25 bp, Mus musculus
gagagtgacgactattcccaaccat

SEQ ID NO: 473798 - DNA, 25 bp, Mus musculus
gagagtgactccaccataataaaag

SEQ ID NO: 473799 - DNA, 25 bp, Mus musculus
gagagtgactcctccataataaaag

SEQ ID NO: 473800 - DNA, 25 bp, Mus musculus
gagagtgactctccgcaatgagcac

SEQ ID NO: 473801 - DNA, 25 bp, Mus musculus
gagagtgactctgcgcaatgagcac

SEQ ID NO: 473802 - DNA, 25 bp, Mus musculus
gagagtgagacccatgttacaggaa

SEQ ID NO: 473803 - DNA, 25 bp, Mus musculus
gagagtgagaccgatgttacaggaa

SEQ ID NO: 473804 - DNA, 25 bp, Mus musculus
gagagtgagcacctaataatggaga

SEQ ID NO: 473805 - DNA, 25 bp, Mus musculus
gagagtgagcacgtaataatggaga

SEQ ID NO: 473806 - DNA, 25 bp, Mus musculus
gagagtgagctcaaccgaattggtc

SEQ ID NO: 473807 - DNA, 25 bp, Mus musculus
gagagtgagctcaagcacatgtcaa

SEQ ID NO: 473808 - DNA, 25 bp, Mus musculus
gagagtgagctctaccgaattggtc

SEQ ID NO: 473809 - DNA, 25 bp, Mus musculus
gagagtgagctctagcacatgtcaa

SEQ ID NO: 473810 - DNA, 25 bp, Mus musculus
gagagtgagtatactgcttccagct

SEQ ID NO: 473811 - DNA, 25 bp, Mus musculus
gagagtgagtattctgcttccagct

SEQ ID NO: 473812 - DNA, 25 bp, Mus musculus
gagagtgagtttctcttcctgaaaa

SEQ ID NO: 473813 - DNA, 25 bp, Mus musculus
gagagtgagtttgtcttcctgaaaa

SEQ ID NO: 473814 - DNA, 25 bp, Mus musculus
gagagtgatcacctccagctctttt

SEQ ID NO: 473815 - DNA, 25 bp, Mus musculus
gagagtgatcacgtccagctctttt

SEQ ID NO: 473816 - DNA, 25 bp, Mus musculus
gagagtgatgatacccgggctgcta

SEQ ID NO: 473817 - DNA, 25 bp, Mus musculus
gagagtgatgattcccgggctgcta

SEQ ID NO: 473818 - DNA, 25 bp, Mus musculus
gagagtgatggtacaagtatcccta

SEQ ID NO: 473819 - DNA, 25 bp, Mus musculus
gagagtgatggttcaagtatcccta

SEQ ID NO: 473820 - DNA, 25 bp, Mus musculus
gagagtgattgaccccgttcctaca

SEQ ID NO: 473821 - DNA, 25 bp, Mus musculus
gagagtgattgagcccgttcctaca

SEQ ID NO: 473822 - DNA, 25 bp, Mus musculus
gagagtgcaaatctacttggccaaa

SEQ ID NO: 473823 - DNA, 25 bp, Mus musculus
gagagtgcaaatgtacttggccaaa

SEQ ID NO: 473824 - DNA, 25 bp, Mus musculus
gagagtgcaactccttgactgatcc

SEQ ID NO: 473825 - DNA, 25 bp, Mus musculus
gagagtgcaactgcttgactgatcc

SEQ ID NO: 473826 - DNA, 25 bp, Mus musculus
gagagtgcacaccagcggtttttgc

SEQ ID NO: 473827 - DNA, 25 bp, Mus musculus
gagagtgcacacgagcggtttttgc

SEQ ID NO: 473828 - DNA, 25 bp, Mus musculus
gagagtgcactgcagaaatgaagca

SEQ ID NO: 473829 - DNA, 25 bp, Mus musculus
gagagtgcactggagaaatgaagca

SEQ ID NO: 473830 - DNA, 25 bp, Mus musculus
gagagtgccaaactgctgttaaaac

SEQ ID NO: 473831 - DNA, 25 bp, Mus musculus
gagagtgccaaagtgctgttaaaac

SEQ ID NO: 473832 - DNA, 25 bp, Mus musculus
gagagtgccaagatcccagattgaa

SEQ ID NO: 473833 - DNA, 25 bp, Mus musculus
gagagtgccaagttcccagattgaa

SEQ ID NO: 473834 - DNA, 25 bp, Mus musculus
gagagtgcccaacatctagtgcagg

SEQ ID NO: 473835 - DNA, 25 bp, Mus musculus
gagagtgcccaagatctagtgcagg

SEQ ID NO: 473836 - DNA, 25 bp, Mus musculus
gagagtgcctacagctagaagctga

SEQ ID NO: 473837 - DNA, 25 bp, Mus musculus
gagagtgcctactgctagaagctga

SEQ ID NO: 473838 - DNA, 25 bp, Mus musculus
gagagtgcctcacctatgaccaata

SEQ ID NO: 473839 - DNA, 25 bp, Mus musculus
gagagtgcctcagctatgaccaata

SEQ ID NO: 473840 - DNA, 25 bp, Mus musculus
gagagtgcctgcataaaattcataa

SEQ ID NO: 473841 - DNA, 25 bp, Mus musculus
gagagtgcctgcttaaaattcataa

SEQ ID NO: 473842 - DNA, 25 bp, Mus musculus
gagagtgccttgcttttgtttcaaa

SEQ ID NO: 473843 - DNA, 25 bp, Mus musculus
gagagtgccttggttttgtttcaaa

SEQ ID NO: 473844 - DNA, 25 bp, Mus musculus
gagagtgcctttcttgacaacatcc

SEQ ID NO: 473845 - DNA, 25 bp, Mus musculus
gagagtgcctttgttgacaacatcc

SEQ ID NO: 473846 - DNA, 25 bp, Mus musculus
gagagtgcgtagactgaagccattt

SEQ ID NO: 473847 - DNA, 25 bp, Mus musculus
gagagtgcgtagtctgaagccattt

SEQ ID NO: 473848 - DNA, 25 bp, Mus musculus
gagagtgctaatcaccagtgaaaca

SEQ ID NO: 473849 - DNA, 25 bp, Mus musculus
gagagtgctaatgaccagtgaaaca

SEQ ID NO: 473850 - DNA, 25 bp, Mus musculus
gagagtgctcaacagaagtgcaaac

SEQ ID NO: 473851 - DNA, 25 bp, Mus musculus
gagagtgctcaagagaagtgcaaac

SEQ ID NO: 473852 - DNA, 25 bp, Mus musculus
gagagtgctctgacataagctacat

SEQ ID NO: 473853 - DNA, 25 bp, Mus musculus
gagagtgctctgtcataagctacat

SEQ ID NO: 473854 - DNA, 25 bp, Mus musculus
gagagtgctgtcctcttaaacacag

SEQ ID NO: 473855 - DNA, 25 bp, Mus musculus
gagagtgctgtcgtcttaaacacag

SEQ ID NO: 473856 - DNA, 25 bp, Mus musculus
gagagtgctgtgcagcccagcctcc

SEQ ID NO: 473857 - DNA, 25 bp, Mus musculus
gagagtgctgtggagcccagcctcc

SEQ ID NO: 473858 - DNA, 25 bp, Mus musculus
gagagtgcttccagatgagtcatga

SEQ ID NO: 473859 - DNA, 25 bp, Mus musculus
gagagtgcttcctgatgagtcatga

SEQ ID NO: 473860 - DNA, 25 bp, Mus musculus
gagagtgcttctatgaatgtaaaca

SEQ ID NO: 473861 - DNA, 25 bp, Mus musculus
gagagtgcttctttgaatgtaaaca

SEQ ID NO: 473862 - DNA, 25 bp, Mus musculus
gagagtgcttgtcggttcacaccca

SEQ ID NO: 473863 - DNA, 25 bp, Mus musculus
gagagtgcttgtcgtgcttcacctc

SEQ ID NO: 473864 - DNA, 25 bp, Mus musculus
gagagtgcttgtgggttcacaccca

SEQ ID NO: 473865 - DNA, 25 bp, Mus musculus
gagagtgcttgtggtgcttcacctc

SEQ ID NO: 473866 - DNA, 25 bp, Mus musculus
gagagtggaaacctcaagatcagag

SEQ ID NO: 473867 - DNA, 25 bp, Mus musculus
gagagtggaaacgtcaagatcagag

SEQ ID NO: 473868 - DNA, 25 bp, Mus musculus
gagagtggaagacctacaaaacaaa

SEQ ID NO: 473869 - DNA, 25 bp, Mus musculus
gagagtggaagagctacaaaacaaa

SEQ ID NO: 473870 - DNA, 25 bp, Mus musculus
gagagtggaagcaacagaaggctat

SEQ ID NO: 473871 - DNA, 25 bp, Mus musculus
gagagtggaagctacagaaggctat

SEQ ID NO: 473872 - DNA, 25 bp, Mus musculus
gagagtggcagcatcaggctcaaca

SEQ ID NO: 473873 - DNA, 25 bp, Mus musculus
gagagtggcagcttcaggctcaaca

SEQ ID NO: 473874 - DNA, 25 bp, Mus musculus
gagagtggcattacctatagaggct

SEQ ID NO: 473875 - DNA, 25 bp, Mus musculus
gagagtggcatttcctatagaggct

SEQ ID NO: 473876 - DNA, 25 bp, Mus musculus
gagagtggccaaactagcaattaac

SEQ ID NO: 473877 - DNA, 25 bp, Mus musculus
gagagtggccaatctagcaattaac

SEQ ID NO: 473878 - DNA, 25 bp, Mus musculus
gagagtggcgccatcaagtctagga

SEQ ID NO: 473879 - DNA, 25 bp, Mus musculus
gagagtggcgccttcaagtctagga

SEQ ID NO: 473880 - DNA, 25 bp, Mus musculus
gagagtggctaaaccttgtgtgaac

SEQ ID NO: 473881 - DNA, 25 bp, Mus musculus
gagagtggctaatccttgtgtgaac

SEQ ID NO: 473882 - DNA, 25 bp, Mus musculus
gagagtggctacatccgtatccgca

SEQ ID NO: 473883 - DNA, 25 bp, Mus musculus
gagagtggctacttccgtatccgca

SEQ ID NO: 473884 - DNA, 25 bp, Mus musculus
gagagtggctatcacatacctctgt

SEQ ID NO: 473885 - DNA, 25 bp, Mus musculus
gagagtggctatgacatacctctgt

SEQ ID NO: 473886 - DNA, 25 bp, Mus musculus
gagagtggctctccattaagctgaa

SEQ ID NO: 473887 - DNA, 25 bp, Mus musculus
gagagtggctctgcattaagctgaa

SEQ ID NO: 473888 - DNA, 25 bp, Mus musculus
gagagtgggatgctacccaagccca

SEQ ID NO: 473889 - DNA, 25 bp, Mus musculus
gagagtgggatgctacccctcatca

SEQ ID NO: 473890 - DNA, 25 bp, Mus musculus
gagagtgggatggtacccaagccca

SEQ ID NO: 473891 - DNA, 25 bp, Mus musculus
gagagtgggatggtacccctcatca

SEQ ID NO: 473892 - DNA, 25 bp, Mus musculus
gagagtgggcataaccttcgatcct

SEQ ID NO: 473893 - DNA, 25 bp, Mus musculus
gagagtgggcattaccttcgatcct

SEQ ID NO: 473894 - DNA, 25 bp, Mus musculus
gagagtgggttcacactacacccgg

SEQ ID NO: 473895 - DNA, 25 bp, Mus musculus
gagagtgggttctcactacacccgg

SEQ ID NO: 473896 - DNA, 25 bp, Mus musculus
gagagtggtctgaaagctccatcag

SEQ ID NO: 473897 - DNA, 25 bp, Mus musculus
gagagtggtctgtaagctccatcag

SEQ ID NO: 473898 - DNA, 25 bp, Mus musculus
gagagtgtaatccacctaactccca

SEQ ID NO: 473899 - DNA, 25 bp, Mus musculus
gagagtgtaatcgacctaactccca

SEQ ID NO: 473900 - DNA, 25 bp, Mus musculus
gagagtgtacaaatgctaaggccat

SEQ ID NO: 473901 - DNA, 25 bp, Mus musculus
gagagtgtacaattgctaaggccat

SEQ ID NO: 473902 - DNA, 25 bp, Mus musculus
gagagtgtaccaaaaacccatcaaa

SEQ ID NO: 473903 - DNA, 25 bp, Mus musculus
gagagtgtaccaagctaactgtaga

SEQ ID NO: 473904 - DNA, 25 bp, Mus musculus
gagagtgtaccataaacccatcaaa

SEQ ID NO: 473905 - DNA, 25 bp, Mus musculus
gagagtgtaccatgctaactgtaga

SEQ ID NO: 473906 - DNA, 25 bp, Mus musculus
gagagtgtactcctgaagacctgtg

SEQ ID NO: 473907 - DNA, 25 bp, Mus musculus
gagagtgtactcgtgaagacctgtg

SEQ ID NO: 473908 - DNA, 25 bp, Mus musculus
gagagtgtcacaccagtaccagcta

SEQ ID NO: 473909 - DNA, 25 bp, Mus musculus
gagagtgtcacagcagtaccagcta

SEQ ID NO: 473910 - DNA, 25 bp, Mus musculus
gagagtgtcagcatacccaactggc

SEQ ID NO: 473911 - DNA, 25 bp, Mus musculus
gagagtgtcagcttacccaactggc

SEQ ID NO: 473912 - DNA, 25 bp, Mus musculus
gagagtgtcagtcacctgatcagct

SEQ ID NO: 473913 - DNA, 25 bp, Mus musculus
gagagtgtcagtgacctgatcagct

SEQ ID NO: 473914 - DNA, 25 bp, Mus musculus
gagagtgtcattcctttacctaatt

SEQ ID NO: 473915 - DNA, 25 bp, Mus musculus
gagagtgtcattgctttacctaatt

SEQ ID NO: 473916 - DNA, 25 bp, Mus musculus
gagagtgtcccaaagctggtgtctg

SEQ ID NO: 473917 - DNA, 25 bp, Mus musculus
gagagtgtcccatagctggtgtctg

SEQ ID NO: 473918 - DNA, 25 bp, Mus musculus
gagagtgtcctactaaatcccacat

SEQ ID NO: 473919 - DNA, 25 bp, Mus musculus
gagagtgtcctagtaaatcccacat

SEQ ID NO: 473920 - DNA, 25 bp, Mus musculus
gagagtgtccttcctatgtcctagg

SEQ ID NO: 473921 - DNA, 25 bp, Mus musculus
gagagtgtccttctacctaggattt

SEQ ID NO: 473922 - DNA, 25 bp, Mus musculus
gagagtgtccttgctatgtcctagg

SEQ ID NO: 473923 - DNA, 25 bp, Mus musculus
gagagtgtccttgtacctaggattt

SEQ ID NO: 473924 - DNA, 25 bp, Mus musculus
gagagtgtctaaccagctgtcaaag

SEQ ID NO: 473925 - DNA, 25 bp, Mus musculus
gagagtgtctaagcagctgtcaaag

SEQ ID NO: 473926 - DNA, 25 bp, Mus musculus
gagagtgtgaagacatctgattgaa

SEQ ID NO: 473927 - DNA, 25 bp, Mus musculus
gagagtgtgaagtcatctgattgaa

SEQ ID NO: 473928 - DNA, 25 bp, Mus musculus
gagagtgtgtctacagaactggctg

SEQ ID NO: 473929 - DNA, 25 bp, Mus musculus
gagagtgtgtcttcagaactggctg

SEQ ID NO: 473930 - DNA, 25 bp, Mus musculus
gagagtgtgtgtaccgtgtctaccc

SEQ ID NO: 473931 - DNA, 25 bp, Mus musculus
gagagtgtgtgttccgtgtctaccc

SEQ ID NO: 473932 - DNA, 25 bp, Mus musculus
gagagtgttcacaatttcaccttgc

SEQ ID NO: 473933 - DNA, 25 bp, Mus musculus
gagagtgttcactatttcaccttgc

SEQ ID NO: 473934 - DNA, 25 bp, Mus musculus
gagagtgttcccagaacactcctga

SEQ ID NO: 473935 - DNA, 25 bp, Mus musculus
gagagtgttccctgaacactcctga

SEQ ID NO: 473936 - DNA, 25 bp, Mus musculus
gagagtgttggtccccgaattccgc

SEQ ID NO: 473937 - DNA, 25 bp, Mus musculus
gagagtgttggtgcccgaattccgc

SEQ ID NO: 473938 - DNA, 25 bp, Mus musculus
gagagtgttgtgatgagcccattca

SEQ ID NO: 473939 - DNA, 25 bp, Mus musculus
gagagtgttgtgttgagcccattca

SEQ ID NO: 473940 - DNA, 25 bp, Mus musculus
gagagtgtttggaaccggcgcccat

SEQ ID NO: 473941 - DNA, 25 bp, Mus musculus
gagagtgtttggtaccggcgcccat

SEQ ID NO: 473942 - DNA, 25 bp, Mus musculus
gagagttaacacatttgcttattgc

SEQ ID NO: 473943 - DNA, 25 bp, Mus musculus
gagagttaacacttttgcttattgc

SEQ ID NO: 473944 - DNA, 25 bp, Mus musculus
gagagttacaacaccaactaccggt

SEQ ID NO: 473945 - DNA, 25 bp, Mus musculus
gagagttacaactccaactaccggt

SEQ ID NO: 473946 - DNA, 25 bp, Mus musculus
gagagttacgacctggaaactgtac

SEQ ID NO: 473947 - DNA, 25 bp, Mus musculus
gagagttacgacgtggaaactgtac

SEQ ID NO: 473948 - DNA, 25 bp, Mus musculus
gagagttagccaatttttaggtgtt

SEQ ID NO: 473949 - DNA, 25 bp, Mus musculus
gagagttagccattttttaggtgtt

SEQ ID NO: 473950 - DNA, 25 bp, Mus musculus
gagagttagtctcattgttgtataa

SEQ ID NO: 473951 - DNA, 25 bp, Mus musculus
gagagttagtctgattgttgtataa

SEQ ID NO: 473952 - DNA, 25 bp, Mus musculus
gagagttagtgcctcagctatggat

SEQ ID NO: 473953 - DNA, 25 bp, Mus musculus
gagagttagtgcgtcagctatggat

SEQ ID NO: 473954 - DNA, 25 bp, Mus musculus
gagagttatccacagagccagtgct

SEQ ID NO: 473955 - DNA, 25 bp, Mus musculus
gagagttatccagagagccagtgct

SEQ ID NO: 473956 - DNA, 25 bp, Mus musculus
gagagttatgctcgttacctcgctc

SEQ ID NO: 473957 - DNA, 25 bp, Mus musculus
gagagttatgctggttacctcgctc

SEQ ID NO: 473958 - DNA, 25 bp, Mus musculus
gagagttatggcacgcttttccaat

SEQ ID NO: 473959 - DNA, 25 bp, Mus musculus
gagagttatggctcgcttttccaat

SEQ ID NO: 473960 - DNA, 25 bp, Mus musculus
gagagttattctccaacacacgtga

SEQ ID NO: 473961 - DNA, 25 bp, Mus musculus
gagagttattctgcaacacacgtga

SEQ ID NO: 473962 - DNA, 25 bp, Mus musculus
gagagttcaaagactcccaccattc

SEQ ID NO: 473963 - DNA, 25 bp, Mus musculus
gagagttcaaagtctcccaccattc

SEQ ID NO: 473964 - DNA, 25 bp, Mus musculus
gagagttcaagcatggacccattca

SEQ ID NO: 473965 - DNA, 25 bp, Mus musculus
gagagttcaagcttggacccattca

SEQ ID NO: 473966 - DNA, 25 bp, Mus musculus
gagagttcacagatgaagaccttga

SEQ ID NO: 473967 - DNA, 25 bp, Mus musculus
gagagttcacagttgaagaccttga

SEQ ID NO: 473968 - DNA, 25 bp, Mus musculus
gagagttcactgcatatcgcacaga

SEQ ID NO: 473969 - DNA, 25 bp, Mus musculus
gagagttcactggatatcgcacaga

SEQ ID NO: 473970 - DNA, 25 bp, Mus musculus
gagagttcagaaaattacagggtca

SEQ ID NO: 473971 - DNA, 25 bp, Mus musculus
gagagttcagaatattacagggtca

SEQ ID NO: 473972 - DNA, 25 bp, Mus musculus
gagagttcagttaacaatgccagat

SEQ ID NO: 473973 - DNA, 25 bp, Mus musculus
gagagttcagtttacaatgccagat

SEQ ID NO: 473974 - DNA, 25 bp, Mus musculus
gagagttccaaaccagcgctctaga

SEQ ID NO: 473975 - DNA, 25 bp, Mus musculus
gagagttccaaagcagcgctctaga

SEQ ID NO: 473976 - DNA, 25 bp, Mus musculus
gagagttcccagagctgatagctga

SEQ ID NO: 473977 - DNA, 25 bp, Mus musculus
gagagttcccagtgctgatagctga

SEQ ID NO: 473978 - DNA, 25 bp, Mus musculus
gagagttccgcaacgcagcaaaaga

SEQ ID NO: 473979 - DNA, 25 bp, Mus musculus
gagagttccgcatcgcagcaaaaga

SEQ ID NO: 473980 - DNA, 25 bp, Mus musculus
gagagttcctggacttgagttatgg

SEQ ID NO: 473981 - DNA, 25 bp, Mus musculus
gagagttcctggtcttgagttatgg

SEQ ID NO: 473982 - DNA, 25 bp, Mus musculus
gagagttctcacacagtgatcactt

SEQ ID NO: 473983 - DNA, 25 bp, Mus musculus
gagagttctcactcagtgatcactt

SEQ ID NO: 473984 - DNA, 25 bp, Mus musculus
gagagttctcagctcttttgggaca

SEQ ID NO: 473985 - DNA, 25 bp, Mus musculus
gagagttctcaggtcttttgggaca

SEQ ID NO: 473986 - DNA, 25 bp, Mus musculus
gagagttctcccaacatgattgtct

SEQ ID NO: 473987 - DNA, 25 bp, Mus musculus
gagagttctccctacatgattgtct

SEQ ID NO: 473988 - DNA, 25 bp, Mus musculus
gagagttctcggagccgtttgtaca

SEQ ID NO: 473989 - DNA, 25 bp, Mus musculus
gagagttctcggtgccgtttgtaca

SEQ ID NO: 473990 - DNA, 25 bp, Mus musculus
gagagttctgtaagttttgaaaaga

SEQ ID NO: 473991 - DNA, 25 bp, Mus musculus
gagagttctgtatgttttgaaaaga

SEQ ID NO: 473992 - DNA, 25 bp, Mus musculus
gagagttctgtgatatgtgctgact

SEQ ID NO: 473993 - DNA, 25 bp, Mus musculus
gagagttctgtgttatgtgctgact

SEQ ID NO: 473994 - DNA, 25 bp, Mus musculus
gagagttcttacacatcacctggag

SEQ ID NO: 473995 - DNA, 25 bp, Mus musculus
gagagttcttactcatcacctggag

SEQ ID NO: 473996 - DNA, 25 bp, Mus musculus
gagagttcttggatattgctaaggt

SEQ ID NO: 473997 - DNA, 25 bp, Mus musculus
gagagttcttggttattgctaaggt

SEQ ID NO: 473998 - DNA, 25 bp, Mus musculus
gagagttctttaatcctggtacccg

SEQ ID NO: 473999 - DNA, 25 bp, Mus musculus
gagagttctttattcctggtacccg

SEQ ID NO: 474000 - DNA, 25 bp, Mus musculus
gagagttgaaagatccagccaggca

SEQ ID NO: 474001 - DNA, 25 bp, Mus musculus
gagagttgaaagttccagccaggca

SEQ ID NO: 474002 - DNA, 25 bp, Mus musculus
gagagttgaattctacttgccaaga

SEQ ID NO: 474003 - DNA, 25 bp, Mus musculus
gagagttgaattgtacttgccaaga

SEQ ID NO: 474004 - DNA, 25 bp, Mus musculus
gagagttgagtaactttccactgag

SEQ ID NO: 474005 - DNA, 25 bp, Mus musculus
gagagttgagtatctttccactgag

SEQ ID NO: 474006 - DNA, 25 bp, Mus musculus
gagagttgatacattttccttggcc

SEQ ID NO: 474007 - DNA, 25 bp, Mus musculus
gagagttgatactttttccttggcc

SEQ ID NO: 474008 - DNA, 25 bp, Mus musculus
gagagttgcaaaatttaggccagct

SEQ ID NO: 474009 - DNA, 25 bp, Mus musculus
gagagttgcaaattttaggccagct

SEQ ID NO: 474010 - DNA, 25 bp, Mus musculus
gagagttgcactaaacatactgcca

SEQ ID NO: 474011 - DNA, 25 bp, Mus musculus
gagagttgcactatctatgtaccag

SEQ ID NO: 474012 - DNA, 25 bp, Mus musculus
gagagttgcacttaacatactgcca

SEQ ID NO: 474013 - DNA, 25 bp, Mus musculus
gagagttgcactttctatgtaccag

SEQ ID NO: 474014 - DNA, 25 bp, Mus musculus
gagagttgccacattacagggacag

SEQ ID NO: 474015 - DNA, 25 bp, Mus musculus
gagagttgccactttacagggacag

SEQ ID NO: 474016 - DNA, 25 bp, Mus musculus
gagagttgcccacccgaccttcttt

SEQ ID NO: 474017 - DNA, 25 bp, Mus musculus
gagagttgcccagccgaccttcttt

SEQ ID NO: 474018 - DNA, 25 bp, Mus musculus
gagagttgccttaaccaaaatggaa

SEQ ID NO: 474019 - DNA, 25 bp, Mus musculus
gagagttgcctttaccaaaatggaa

SEQ ID NO: 474020 - DNA, 25 bp, Mus musculus
gagagttggaccatgttctttggta

SEQ ID NO: 474021 - DNA, 25 bp, Mus musculus
gagagttggaccttgttctttggta

SEQ ID NO: 474022 - DNA, 25 bp, Mus musculus
gagagttggtctcaaaacaacaccc

SEQ ID NO: 474023 - DNA, 25 bp, Mus musculus
gagagttggtctgaaaacaacaccc

SEQ ID NO: 474024 - DNA, 25 bp, Mus musculus
gagagttgtaccatgtatgttggaa

SEQ ID NO: 474025 - DNA, 25 bp, Mus musculus
gagagttgtaccttgtatgttggaa

SEQ ID NO: 474026 - DNA, 25 bp, Mus musculus
gagagttgtagtccaagtgctctac

SEQ ID NO: 474027 - DNA, 25 bp, Mus musculus
gagagttgtagtgcaagtgctctac

SEQ ID NO: 474028 - DNA, 25 bp, Mus musculus
gagagttgtctgcttcccttaacat

SEQ ID NO: 474029 - DNA, 25 bp, Mus musculus
gagagttgtctggttcccttaacat

SEQ ID NO: 474030 - DNA, 25 bp, Mus musculus
gagagttgtcttaacacctgggcag

SEQ ID NO: 474031 - DNA, 25 bp, Mus musculus
gagagttgtctttacacctgggcag

SEQ ID NO: 474032 - DNA, 25 bp, Mus musculus
gagagttgtgacatgtcacctacaa

SEQ ID NO: 474033 - DNA, 25 bp, Mus musculus
gagagttgtgacttgtcacctacaa

SEQ ID NO: 474034 - DNA, 25 bp, Mus musculus
gagagttgtgtcagcatcaagcaaa

SEQ ID NO: 474035 - DNA, 25 bp, Mus musculus
gagagttgtgtctgcatcaagcaaa

SEQ ID NO: 474036 - DNA, 25 bp, Mus musculus
gagagttgttcacccattatggagc

SEQ ID NO: 474037 - DNA, 25 bp, Mus musculus
gagagttgttcagccattatggagc

SEQ ID NO: 474038 - DNA, 25 bp, Mus musculus
gagagtttacaactgtgccccattt

SEQ ID NO: 474039 - DNA, 25 bp, Mus musculus
gagagtttacaagtgtgccccattt

SEQ ID NO: 474040 - DNA, 25 bp, Mus musculus
gagagtttacagaaggagatccgca

SEQ ID NO: 474041 - DNA, 25 bp, Mus musculus
gagagtttacagtaggagatccgca

SEQ ID NO: 474042 - DNA, 25 bp, Mus musculus
gagagtttagcccttgtctttgttt

SEQ ID NO: 474043 - DNA, 25 bp, Mus musculus
gagagtttagccgttgtctttgttt

SEQ ID NO: 474044 - DNA, 25 bp, Mus musculus
gagagtttatatcctcatctataag

SEQ ID NO: 474045 - DNA, 25 bp, Mus musculus
gagagtttatatgctcatctataag

SEQ ID NO: 474046 - DNA, 25 bp, Mus musculus
gagagtttccacagctacagggact

SEQ ID NO: 474047 - DNA, 25 bp, Mus musculus
gagagtttccactgctacagggact

SEQ ID NO: 474048 - DNA, 25 bp, Mus musculus
gagagtttcccaaatagacatttta

SEQ ID NO: 474049 - DNA, 25 bp, Mus musculus
gagagtttcccatatagacatttta

SEQ ID NO: 474050 - DNA, 25 bp, Mus musculus
gagagtttccctaaaggaccaacag

SEQ ID NO: 474051 - DNA, 25 bp, Mus musculus
gagagtttcccttaaggaccaacag

SEQ ID NO: 474052 - DNA, 25 bp, Mus musculus
gagagtttcggccattgttgagcaa

SEQ ID NO: 474053 - DNA, 25 bp, Mus musculus
gagagtttcggcgattgttgagcaa

SEQ ID NO: 474054 - DNA, 25 bp, Mus musculus
gagagtttctccactgtgtccagaa

SEQ ID NO: 474055 - DNA, 25 bp, Mus musculus
gagagtttctcctctgtgtccagaa

SEQ ID NO: 474056 - DNA, 25 bp, Mus musculus
gagagtttctgcagatgaccctcca

SEQ ID NO: 474057 - DNA, 25 bp, Mus musculus
gagagtttctgctgatgaccctcca

SEQ ID NO: 474058 - DNA, 25 bp, Mus musculus
gagagtttctgtcttttgcttctga

SEQ ID NO: 474059 - DNA, 25 bp, Mus musculus
gagagtttctgtgttttgcttctga

SEQ ID NO: 474060 - DNA, 25 bp, Mus musculus
gagagtttctttcttgagagttcag

SEQ ID NO: 474061 - DNA, 25 bp, Mus musculus
gagagtttctttgttgagagttcag

SEQ ID NO: 474062 - DNA, 25 bp, Mus musculus
gagagtttgagacttcgctttgttc

SEQ ID NO: 474063 - DNA, 25 bp, Mus musculus
gagagtttgagagttcgctttgttc

SEQ ID NO: 474064 - DNA, 25 bp, Mus musculus
gagagtttggaacgatactaaccca

SEQ ID NO: 474065 - DNA, 25 bp, Mus musculus
gagagtttggaaggatactaaccca

SEQ ID NO: 474066 - DNA, 25 bp, Mus musculus
gagagtttggccatgagcgatatga

SEQ ID NO: 474067 - DNA, 25 bp, Mus musculus
gagagtttggccttgagcgatatga

SEQ ID NO: 474068 - DNA, 25 bp, Mus musculus
gagagtttgggacaagactgtgtat

SEQ ID NO: 474069 - DNA, 25 bp, Mus musculus
gagagtttgggagaagactgtgtat

SEQ ID NO: 474070 - DNA, 25 bp, Mus musculus
gagagtttgtcaccttcttcatatc

SEQ ID NO: 474071 - DNA, 25 bp, Mus musculus
gagagtttgtcagcttcttcatatc

SEQ ID NO: 474072 - DNA, 25 bp, Mus musculus
gagagtttgtctcatgtgctgagca

SEQ ID NO: 474073 - DNA, 25 bp, Mus musculus
gagagtttgtctgatgtgctgagca

SEQ ID NO: 474074 - DNA, 25 bp, Mus musculus
gagagtttgttgaactatcttttgt

SEQ ID NO: 474075 - DNA, 25 bp, Mus musculus
gagagtttgttgtactatcttttgt

SEQ ID NO: 474076 - DNA, 25 bp, Mus musculus
gagagttttaacaactggaaatcct

SEQ ID NO: 474077 - DNA, 25 bp, Mus musculus
gagagttttaactactggaaatcct

SEQ ID NO: 474078 - DNA, 25 bp, Mus musculus
gagagttttataatttcccggtgat

SEQ ID NO: 474079 - DNA, 25 bp, Mus musculus
gagagttttatattttcccggtgat

SEQ ID NO: 474080 - DNA, 25 bp, Mus musculus
gagagttttctcagccataatactt

SEQ ID NO: 474081 - DNA, 25 bp, Mus musculus
gagagttttctctgccataatactt

SEQ ID NO: 474082 - DNA, 25 bp, Mus musculus
gagagttttgagaaacagcatctta

SEQ ID NO: 474083 - DNA, 25 bp, Mus musculus
gagagttttgagtaacagcatctta

SEQ ID NO: 474084 - DNA, 25 bp, Mus musculus
gagagttttgctacagtttatacag

SEQ ID NO: 474085 - DNA, 25 bp, Mus musculus
gagagttttgcttcagtttatacag

SEQ ID NO: 474086 - DNA, 25 bp, Mus musculus
gagagtttttccatctttctccctt

SEQ ID NO: 474087 - DNA, 25 bp, Mus musculus
gagagtttttccttctttctccctt

SEQ ID NO: 474088 - DNA, 25 bp, Mus musculus
gagataaacccactcacctattgcc

SEQ ID NO: 474089 - DNA, 25 bp, Mus musculus
gagataaacccagtcacctattgcc

SEQ ID NO: 474090 - DNA, 25 bp, Mus musculus
gagataaacctgacacttgtagcaa

SEQ ID NO: 474091 - DNA, 25 bp, Mus musculus
gagataaacctgtcacttgtagcaa

SEQ ID NO: 474092 - DNA, 25 bp, Mus musculus
gagataaagaccatcctcagcttcc

SEQ ID NO: 474093 - DNA, 25 bp, Mus musculus
gagataaagaccttcctcagcttcc

SEQ ID NO: 474094 - DNA, 25 bp, Mus musculus
gagataaagcttccacatatttcta

SEQ ID NO: 474095 - DNA, 25 bp, Mus musculus
gagataaagcttgcacatatttcta

SEQ ID NO: 474096 - DNA, 25 bp, Mus musculus
gagataaatatgagccctgggccat

SEQ ID NO: 474097 - DNA, 25 bp, Mus musculus
gagataaatatgtgccctgggccat

SEQ ID NO: 474098 - DNA, 25 bp, Mus musculus
gagataaatgacaattcctcctctt

SEQ ID NO: 474099 - DNA, 25 bp, Mus musculus
gagataaatgactattcctcctctt

SEQ ID NO: 474100 - DNA, 25 bp, Mus musculus
gagataaatgctctccccaaagtca

SEQ ID NO: 474101 - DNA, 25 bp, Mus musculus
gagataaatgctgtccccaaagtca

SEQ ID NO: 474102 - DNA, 25 bp, Mus musculus
gagataaatgtcacccgtaagatag

SEQ ID NO: 474103 - DNA, 25 bp, Mus musculus
gagataaatgtctcccgtaagatag

SEQ ID NO: 474104 - DNA, 25 bp, Mus musculus
gagataacagcaatagcctttcaat

SEQ ID NO: 474105 - DNA, 25 bp, Mus musculus
gagataacagcattagcctttcaat

SEQ ID NO: 474106 - DNA, 25 bp, Mus musculus
gagataacatgaaggcttatttaaa

SEQ ID NO: 474107 - DNA, 25 bp, Mus musculus
gagataacatgatggcttatttaaa

SEQ ID NO: 474108 - DNA, 25 bp, Mus musculus
gagataaccacaccattaagcactt

SEQ ID NO: 474109 - DNA, 25 bp, Mus musculus
gagataaccacagcattaagcactt

SEQ ID NO: 474110 - DNA, 25 bp, Mus musculus
gagataacccacatttagacaccgg

SEQ ID NO: 474111 - DNA, 25 bp, Mus musculus
gagataacccacttttagacaccgg

SEQ ID NO: 474112 - DNA, 25 bp, Mus musculus
gagataacccagcaggcttgtcttc

SEQ ID NO: 474113 - DNA, 25 bp, Mus musculus
gagataacccaggaggcttgtcttc

SEQ ID NO: 474114 - DNA, 25 bp, Mus musculus
gagataacccatacctgaaagtgtc

SEQ ID NO: 474115 - DNA, 25 bp, Mus musculus
gagataacccattcctgaaagtgtc

SEQ ID NO: 474116 - DNA, 25 bp, Mus musculus
gagataactccccaaactactgaac

SEQ ID NO: 474117 - DNA, 25 bp, Mus musculus
gagataactcccgaaactactgaac

SEQ ID NO: 474118 - DNA, 25 bp, Mus musculus
gagataactctaatcctgctgcaca

SEQ ID NO: 474119 - DNA, 25 bp, Mus musculus
gagataactctattcctgctgcaca

SEQ ID NO: 474120 - DNA, 25 bp, Mus musculus
gagataagaactccaccctctgtag

SEQ ID NO: 474121 - DNA, 25 bp, Mus musculus
gagataagaactgcaccctctgtag

SEQ ID NO: 474122 - DNA, 25 bp, Mus musculus
gagataagacacatcagtttatgga

SEQ ID NO: 474123 - DNA, 25 bp, Mus musculus
gagataagacacttcagtttatgga

SEQ ID NO: 474124 - DNA, 25 bp, Mus musculus
gagataagaccacagccacagacat

SEQ ID NO: 474125 - DNA, 25 bp, Mus musculus
gagataagaccagagccacagacat

SEQ ID NO: 474126 - DNA, 25 bp, Mus musculus
gagataagacctcttgctgttttgc

SEQ ID NO: 474127 - DNA, 25 bp, Mus musculus
gagataagacctgttgctgttttgc

SEQ ID NO: 474128 - DNA, 25 bp, Mus musculus
gagataagagctagcctggtttcta

SEQ ID NO: 474129 - DNA, 25 bp, Mus musculus
gagataagagcttgcctggtttcta

SEQ ID NO: 474130 - DNA, 25 bp, Mus musculus
gagataagcctccaagcagccttgc

SEQ ID NO: 474131 - DNA, 25 bp, Mus musculus
gagataagcctcgaagcagccttgc

SEQ ID NO: 474132 - DNA, 25 bp, Mus musculus
gagataagctaacgatcctcccctg

SEQ ID NO: 474133 - DNA, 25 bp, Mus musculus
gagataagctaaggatcctcccctg

SEQ ID NO: 474134 - DNA, 25 bp, Mus musculus
gagataaggatcctagcctctcact

SEQ ID NO: 474135 - DNA, 25 bp, Mus musculus
gagataaggatcgtagcctctcact

SEQ ID NO: 474136 - DNA, 25 bp, Mus musculus
gagataagtcataactgcctccttc

SEQ ID NO: 474137 - DNA, 25 bp, Mus musculus
gagataagtcattactgcctccttc

SEQ ID NO: 474138 - DNA, 25 bp, Mus musculus
gagataatcgtaaagttccttccta

SEQ ID NO: 474139 - DNA, 25 bp, Mus musculus
gagataatcgtatagttccttccta

SEQ ID NO: 474140 - DNA, 25 bp, Mus musculus
gagataatctccaagttacataatt

SEQ ID NO: 474141 - DNA, 25 bp, Mus musculus
gagataatctcctagttacataatt

SEQ ID NO: 474142 - DNA, 25 bp, Mus musculus
gagataatgagcagactgtctattt

SEQ ID NO: 474143 - DNA, 25 bp, Mus musculus
gagataatgagctgactgtctattt

SEQ ID NO: 474144 - DNA, 25 bp, Mus musculus
gagataatgattaggccccactcct

SEQ ID NO: 474145 - DNA, 25 bp, Mus musculus
gagataatgatttggccccactcct

SEQ ID NO: 474146 - DNA, 25 bp, Mus musculus
gagataatgcatctgggtgacttcc

SEQ ID NO: 474147 - DNA, 25 bp, Mus musculus
gagataatgcatgtgggtgacttcc

SEQ ID NO: 474148 - DNA, 25 bp, Mus musculus
gagataatgtaaagttcttttccag

SEQ ID NO: 474149 - DNA, 25 bp, Mus musculus
gagataatgtaatgttcttttccag

SEQ ID NO: 474150 - DNA, 25 bp, Mus musculus
gagataattcaccaggagctccagc

SEQ ID NO: 474151 - DNA, 25 bp, Mus musculus
gagataattcacgaggagctccagc

SEQ ID NO: 474152 - DNA, 25 bp, Mus musculus
gagataatttctcccttttgccttc

SEQ ID NO: 474153 - DNA, 25 bp, Mus musculus
gagataatttctgccttttgccttc

SEQ ID NO: 474154 - DNA, 25 bp, Mus musculus
gagatacaaagtcctgaatgcaagt

SEQ ID NO: 474155 - DNA, 25 bp, Mus musculus
gagatacaaagtgctgaatgcaagt

SEQ ID NO: 474156 - DNA, 25 bp, Mus musculus
gagatacaaatgcatcagtttcatg

SEQ ID NO: 474157 - DNA, 25 bp, Mus musculus
gagatacaaatggatcagtttcatg

SEQ ID NO: 474158 - DNA, 25 bp, Mus musculus
gagatacaacacagaggccctggcg

SEQ ID NO: 474159 - DNA, 25 bp, Mus musculus
gagatacaacactgaggccctggcg

SEQ ID NO: 474160 - DNA, 25 bp, Mus musculus
gagatacaaggtctaccccatcttc

SEQ ID NO: 474161 - DNA, 25 bp, Mus musculus
gagatacaaggtgtaccccatcttc

SEQ ID NO: 474162 - DNA, 25 bp, Mus musculus
gagatacaattacgccccggtagct

SEQ ID NO: 474163 - DNA, 25 bp, Mus musculus
gagatacaattaggccccggtagct

SEQ ID NO: 474164 - DNA, 25 bp, Mus musculus
gagatacaatttctccactcttcaa

SEQ ID NO: 474165 - DNA, 25 bp, Mus musculus
gagatacaatttgtccactcttcaa

SEQ ID NO: 474166 - DNA, 25 bp, Mus musculus
gagatacacacacagataccaagca

SEQ ID NO: 474167 - DNA, 25 bp, Mus musculus
gagatacacacagagataccaagca

SEQ ID NO: 474168 - DNA, 25 bp, Mus musculus
gagatacacactcgacccatcactt

SEQ ID NO: 474169 - DNA, 25 bp, Mus musculus
gagatacacactggacccatcactt

SEQ ID NO: 474170 - DNA, 25 bp, Mus musculus
gagatacacagcagagtcctccggc

SEQ ID NO: 474171 - DNA, 25 bp, Mus musculus
gagatacacagctgagtcctccggc

SEQ ID NO: 474172 - DNA, 25 bp, Mus musculus
gagatacacgtacacttaccaagtg

SEQ ID NO: 474173 - DNA, 25 bp, Mus musculus
gagatacacgtagacttaccaagtg

SEQ ID NO: 474174 - DNA, 25 bp, Mus musculus
gagatacactctctttgaagattat

SEQ ID NO: 474175 - DNA, 25 bp, Mus musculus
gagatacactctgtttgaagattat

SEQ ID NO: 474176 - DNA, 25 bp, Mus musculus
gagatacagagccaccagacagttg

SEQ ID NO: 474177 - DNA, 25 bp, Mus musculus
gagatacagagcgaccagacagttg

SEQ ID NO: 474178 - DNA, 25 bp, Mus musculus
gagatacagagtactctgcctgctc

SEQ ID NO: 474179 - DNA, 25 bp, Mus musculus
gagatacagagttctctgcctgctc

SEQ ID NO: 474180 - DNA, 25 bp, Mus musculus
gagatacagcacaactgcacaccaa

SEQ ID NO: 474181 - DNA, 25 bp, Mus musculus
gagatacagcactactgcacaccaa

SEQ ID NO: 474182 - DNA, 25 bp, Mus musculus
gagatacaggccaggcccgtgaaat

SEQ ID NO: 474183 - DNA, 25 bp, Mus musculus
gagatacaggcctggcccgtgaaat

SEQ ID NO: 474184 - DNA, 25 bp, Mus musculus
gagatacagtacactgctaacacat

SEQ ID NO: 474185 - DNA, 25 bp, Mus musculus
gagatacagtactctgctaacacat

SEQ ID NO: 474186 - DNA, 25 bp, Mus musculus
gagatacatggcagaatcccctata

SEQ ID NO: 474187 - DNA, 25 bp, Mus musculus
gagatacatggctgaatcccctata

SEQ ID NO: 474188 - DNA, 25 bp, Mus musculus
gagatacattatccgaccctcagct

SEQ ID NO: 474189 - DNA, 25 bp, Mus musculus
gagatacattatgcgaccctcagct

SEQ ID NO: 474190 - DNA, 25 bp, Mus musculus
gagataccagaactctcattgtctg

SEQ ID NO: 474191 - DNA, 25 bp, Mus musculus
gagataccagaagtctcattgtctg

SEQ ID NO: 474192 - DNA, 25 bp, Mus musculus
gagataccagatcaggcccagagga

SEQ ID NO: 474193 - DNA, 25 bp, Mus musculus
gagataccagatgaggcccagagga

SEQ ID NO: 474194 - DNA, 25 bp, Mus musculus
gagataccaggaccatcggatccct

SEQ ID NO: 474195 - DNA, 25 bp, Mus musculus
gagataccaggagcatcggatccct

SEQ ID NO: 474196 - DNA, 25 bp, Mus musculus
gagataccagtaaaggacctagaaa

SEQ ID NO: 474197 - DNA, 25 bp, Mus musculus
gagataccagtataggacctagaaa

SEQ ID NO: 474198 - DNA, 25 bp, Mus musculus
gagataccagtccatgctttacatt

SEQ ID NO: 474199 - DNA, 25 bp, Mus musculus
gagataccagtcgatgctttacatt

SEQ ID NO: 474200 - DNA, 25 bp, Mus musculus
gagataccatctccatggctcaaac

SEQ ID NO: 474201 - DNA, 25 bp, Mus musculus
gagataccatctgcatggctcaaac

SEQ ID NO: 474202 - DNA, 25 bp, Mus musculus
gagatacccacaaatcaaggcagag

SEQ ID NO: 474203 - DNA, 25 bp, Mus musculus
gagatacccacatatcaaggcagag

SEQ ID NO: 474204 - DNA, 25 bp, Mus musculus
gagataccccatccctcaaaattta

SEQ ID NO: 474205 - DNA, 25 bp, Mus musculus
gagataccccatgcctcaaaattta

SEQ ID NO: 474206 - DNA, 25 bp, Mus musculus
gagatacccgtcaattggtgcaggc

SEQ ID NO: 474207 - DNA, 25 bp, Mus musculus
gagatacccgtctattggtgcaggc

SEQ ID NO: 474208 - DNA, 25 bp, Mus musculus
gagataccctgacagctggagagat

SEQ ID NO: 474209 - DNA, 25 bp, Mus musculus
gagataccctgagagctggagagat

SEQ ID NO: 474210 - DNA, 25 bp, Mus musculus
gagataccgctcacttcagagtaac

SEQ ID NO: 474211 - DNA, 25 bp, Mus musculus
gagataccgctctcttcagagtaac

SEQ ID NO: 474212 - DNA, 25 bp, Mus musculus
gagataccgttgaatcacacactat

SEQ ID NO: 474213 - DNA, 25 bp, Mus musculus
gagataccgttgtatcacacactat

SEQ ID NO: 474214 - DNA, 25 bp, Mus musculus
gagatacctaatcacctaagaagtc

SEQ ID NO: 474215 - DNA, 25 bp, Mus musculus
gagatacctaatgacctaagaagtc

SEQ ID NO: 474216 - DNA, 25 bp, Mus musculus
gagatacctccaaagcactgtttta

SEQ ID NO: 474217 - DNA, 25 bp, Mus musculus
gagatacctccacatattgtgaaag

SEQ ID NO: 474218 - DNA, 25 bp, Mus musculus
gagatacctccagatattgtgaaag

SEQ ID NO: 474219 - DNA, 25 bp, Mus musculus
gagatacctccatagcactgtttta

SEQ ID NO: 474220 - DNA, 25 bp, Mus musculus
gagatacctcccatgatgtgtttgt

SEQ ID NO: 474221 - DNA, 25 bp, Mus musculus
gagatacctcccttgatgtgtttgt

SEQ ID NO: 474222 - DNA, 25 bp, Mus musculus
gagatacctcggagccaggtggacc

SEQ ID NO: 474223 - DNA, 25 bp, Mus musculus
gagatacctcggtgccaggtggacc

SEQ ID NO: 474224 - DNA, 25 bp, Mus musculus
gagatacctgatatgtaccacaaca

SEQ ID NO: 474225 - DNA, 25 bp, Mus musculus
gagatacctgatttgtaccacaaca

SEQ ID NO: 474226 - DNA, 25 bp, Mus musculus
gagatacctgctcgttacccataag

SEQ ID NO: 474227 - DNA, 25 bp, Mus musculus
gagatacctgctggttacccataag

SEQ ID NO: 474228 - DNA, 25 bp, Mus musculus
gagatacctgtaaactcatctttca

SEQ ID NO: 474229 - DNA, 25 bp, Mus musculus
gagatacctgtatactcatctttca

SEQ ID NO: 474230 - DNA, 25 bp, Mus musculus
gagatacgcaagagtctgatcctga

SEQ ID NO: 474231 - DNA, 25 bp, Mus musculus
gagatacgcaagtgtctgatcctga

SEQ ID NO: 474232 - DNA, 25 bp, Mus musculus
gagatacgctgcactcaacctggct

SEQ ID NO: 474233 - DNA, 25 bp, Mus musculus
gagatacgctgctctcaacctggct

SEQ ID NO: 474234 - DNA, 25 bp, Mus musculus
gagatacggcagcatccacttggtt

SEQ ID NO: 474235 - DNA, 25 bp, Mus musculus
gagatacggcaggatccacttggtt

SEQ ID NO: 474236 - DNA, 25 bp, Mus musculus
gagatacgggttcagactgcataaa

SEQ ID NO: 474237 - DNA, 25 bp, Mus musculus
gagatacgggttgagactgcataaa

SEQ ID NO: 474238 - DNA, 25 bp, Mus musculus
gagatactacctcgatcaagcccat

SEQ ID NO: 474239 - DNA, 25 bp, Mus musculus
gagatactacctggatcaagcccat

SEQ ID NO: 474240 - DNA, 25 bp, Mus musculus
gagatactcagtattgtcctccaca

SEQ ID NO: 474241 - DNA, 25 bp, Mus musculus
gagatactcagttttgtcctccaca

SEQ ID NO: 474242 - DNA, 25 bp, Mus musculus
gagatactccgcctgtagtgttggt

SEQ ID NO: 474243 - DNA, 25 bp, Mus musculus
gagatactccgcgtgtagtgttggt

SEQ ID NO: 474244 - DNA, 25 bp, Mus musculus
gagatactgacgatgttcccagttt

SEQ ID NO: 474245 - DNA, 25 bp, Mus musculus
gagatactgacgttgttcccagttt

SEQ ID NO: 474246 - DNA, 25 bp, Mus musculus
gagatactgactcgcagactgctta

SEQ ID NO: 474247 - DNA, 25 bp, Mus musculus
gagatactgactggcagactgctta

SEQ ID NO: 474248 - DNA, 25 bp, Mus musculus
gagatactgagacttatgaccttgt

SEQ ID NO: 474249 - DNA, 25 bp, Mus musculus
gagatactgagagttatgaccttgt

SEQ ID NO: 474250 - DNA, 25 bp, Mus musculus
gagatactgatgctctgcacggtgt

SEQ ID NO: 474251 - DNA, 25 bp, Mus musculus
gagatactgatggtctgcacggtgt

SEQ ID NO: 474252 - DNA, 25 bp, Mus musculus
gagatactgcgaagaaactgggtga

SEQ ID NO: 474253 - DNA, 25 bp, Mus musculus
gagatactgcgatgaaactgggtga

SEQ ID NO: 474254 - DNA, 25 bp, Mus musculus
gagatactgctacttgctgcgccaa

SEQ ID NO: 474255 - DNA, 25 bp, Mus musculus
gagatactgctagttgctgcgccaa

SEQ ID NO: 474256 - DNA, 25 bp, Mus musculus
gagatactggagacccgaggatgat

SEQ ID NO: 474257 - DNA, 25 bp, Mus musculus
gagatactggagtcccgaggatgat

SEQ ID NO: 474258 - DNA, 25 bp, Mus musculus
gagatactgggaccccagatttcaa

SEQ ID NO: 474259 - DNA, 25 bp, Mus musculus
gagatactgggagcccagatttcaa

SEQ ID NO: 474260 - DNA, 25 bp, Mus musculus
gagatactgggtcatctcctggagc

SEQ ID NO: 474261 - DNA, 25 bp, Mus musculus
gagatactgggtgatctcctggagc

SEQ ID NO: 474262 - DNA, 25 bp, Mus musculus
gagatactgtttactgggtcggttg

SEQ ID NO: 474263 - DNA, 25 bp, Mus musculus
gagatactgttttctgggtcggttg

SEQ ID NO: 474264 - DNA, 25 bp, Mus musculus
gagatacttccaacttagcttccaa

SEQ ID NO: 474265 - DNA, 25 bp, Mus musculus
gagatacttccacgcagagtctacc

SEQ ID NO: 474266 - DNA, 25 bp, Mus musculus
gagatacttccaggcagagtctacc

SEQ ID NO: 474267 - DNA, 25 bp, Mus musculus
gagatacttccatcttagcttccaa

SEQ ID NO: 474268 - DNA, 25 bp, Mus musculus
gagatacttctcacactcagacaag

SEQ ID NO: 474269 - DNA, 25 bp, Mus musculus
gagatacttctctcactcagacaag

SEQ ID NO: 474270 - DNA, 25 bp, Mus musculus
gagatagaatctccatcaccctgag

SEQ ID NO: 474271 - DNA, 25 bp, Mus musculus
gagatagaatctgcatcaccctgag

SEQ ID NO: 474272 - DNA, 25 bp, Mus musculus
gagatagacaagactctgtcctccc

SEQ ID NO: 474273 - DNA, 25 bp, Mus musculus
gagatagacaagtctctgtcctccc

SEQ ID NO: 474274 - DNA, 25 bp, Mus musculus
gagatagaccagcacaccaagaaat

SEQ ID NO: 474275 - DNA, 25 bp, Mus musculus
gagatagaccaggacaccaagaaat

SEQ ID NO: 474276 - DNA, 25 bp, Mus musculus
gagatagaccgtcattttcctggaa

SEQ ID NO: 474277 - DNA, 25 bp, Mus musculus
gagatagaccgtgattttcctggaa

SEQ ID NO: 474278 - DNA, 25 bp, Mus musculus
gagatagaccttcagtttcatccta

SEQ ID NO: 474279 - DNA, 25 bp, Mus musculus
gagatagaccttgagtttcatccta

SEQ ID NO: 474280 - DNA, 25 bp, Mus musculus
gagatagacttcctggcttgatagc

SEQ ID NO: 474281 - DNA, 25 bp, Mus musculus
gagatagacttcgtggcttgatagc

SEQ ID NO: 474282 - DNA, 25 bp, Mus musculus
gagatagacttgagtatacaccctt

SEQ ID NO: 474283 - DNA, 25 bp, Mus musculus
gagatagacttgtgtatacaccctt

SEQ ID NO: 474284 - DNA, 25 bp, Mus musculus
gagatagatacacgcgccatcgcag

SEQ ID NO: 474285 - DNA, 25 bp, Mus musculus
gagatagatacaggcgccatcgcag

SEQ ID NO: 474286 - DNA, 25 bp, Mus musculus
gagatagatagcatcttcctgcaag

SEQ ID NO: 474287 - DNA, 25 bp, Mus musculus
gagatagatagcttcttcctgcaag

SEQ ID NO: 474288 - DNA, 25 bp, Mus musculus
gagatagatcctcagtgggtctgaa

SEQ ID NO: 474289 - DNA, 25 bp, Mus musculus
gagatagatcctgagtgggtctgaa

SEQ ID NO: 474290 - DNA, 25 bp, Mus musculus
gagatagatctgctcaacatccgga

SEQ ID NO: 474291 - DNA, 25 bp, Mus musculus
gagatagatctggtcaacatccgga

SEQ ID NO: 474292 - DNA, 25 bp, Mus musculus
gagatagatgacacactgctttggt

SEQ ID NO: 474293 - DNA, 25 bp, Mus musculus
gagatagatgactcactgctttggt

SEQ ID NO: 474294 - DNA, 25 bp, Mus musculus
gagatagatggtaagccatagcaag

SEQ ID NO: 474295 - DNA, 25 bp, Mus musculus
gagatagatggttagccatagcaag

SEQ ID NO: 474296 - DNA, 25 bp, Mus musculus
gagatagcaaatacctcctttgccc

SEQ ID NO: 474297 - DNA, 25 bp, Mus musculus
gagatagcaaattcctcctttgccc

SEQ ID NO: 474298 - DNA, 25 bp, Mus musculus
gagatagcatctctgactgggacat

SEQ ID NO: 474299 - DNA, 25 bp, Mus musculus
gagatagcatctgtgactgggacat

SEQ ID NO: 474300 - DNA, 25 bp, Mus musculus
gagatagccatgactgttaccttcc

SEQ ID NO: 474301 - DNA, 25 bp, Mus musculus
gagatagccatgtctgttaccttcc

SEQ ID NO: 474302 - DNA, 25 bp, Mus musculus
gagatagccgtgcttactgacctgg

SEQ ID NO: 474303 - DNA, 25 bp, Mus musculus
gagatagccgtggttactgacctgg

SEQ ID NO: 474304 - DNA, 25 bp, Mus musculus
gagatagcctaaaccagcctagact

SEQ ID NO: 474305 - DNA, 25 bp, Mus musculus
gagatagcctaatccagcctagact

SEQ ID NO: 474306 - DNA, 25 bp, Mus musculus
gagatagcctctcactaggttgccc

SEQ ID NO: 474307 - DNA, 25 bp, Mus musculus
gagatagcctctgactaggttgccc

SEQ ID NO: 474308 - DNA, 25 bp, Mus musculus
gagatagctcagaattcacaatttt

SEQ ID NO: 474309 - DNA, 25 bp, Mus musculus
gagatagctcagtattcacaatttt

SEQ ID NO: 474310 - DNA, 25 bp, Mus musculus
gagatagctcgaaacctcagggttc

SEQ ID NO: 474311 - DNA, 25 bp, Mus musculus
gagatagctcgatacctcagggttc

SEQ ID NO: 474312 - DNA, 25 bp, Mus musculus
gagatagctgacataactccagaca

SEQ ID NO: 474313 - DNA, 25 bp, Mus musculus
gagatagctgacttaactccagaca

SEQ ID NO: 474314 - DNA, 25 bp, Mus musculus
gagatagctgccagttttagatatt

SEQ ID NO: 474315 - DNA, 25 bp, Mus musculus
gagatagctgcctgttttagatatt

SEQ ID NO: 474316 - DNA, 25 bp, Mus musculus
gagatagcttatcccacaaggttgt

SEQ ID NO: 474317 - DNA, 25 bp, Mus musculus
gagatagcttatgccacaaggttgt

SEQ ID NO: 474318 - DNA, 25 bp, Mus musculus
gagataggaaaccactgaccgttca

SEQ ID NO: 474319 - DNA, 25 bp, Mus musculus
gagataggaaacgactgaccgttca

SEQ ID NO: 474320 - DNA, 25 bp, Mus musculus
gagataggaggcaccatatccctct

SEQ ID NO: 474321 - DNA, 25 bp, Mus musculus
gagataggaggctccatatccctct

SEQ ID NO: 474322 - DNA, 25 bp, Mus musculus
gagataggcccaaagctgctaaagt

SEQ ID NO: 474323 - DNA, 25 bp, Mus musculus
gagataggcccatagctgctaaagt

SEQ ID NO: 474324 - DNA, 25 bp, Mus musculus
gagataggctgaactttgagtttaa

SEQ ID NO: 474325 - DNA, 25 bp, Mus musculus
gagataggctgatctttgagtttaa

SEQ ID NO: 474326 - DNA, 25 bp, Mus musculus
gagataggtaccactggatggcctg

SEQ ID NO: 474327 - DNA, 25 bp, Mus musculus
gagataggtacctctggatggcctg

SEQ ID NO: 474328 - DNA, 25 bp, Mus musculus
gagataggtctcactacatggccca

SEQ ID NO: 474329 - DNA, 25 bp, Mus musculus
gagataggtctctctacatggccca

SEQ ID NO: 474330 - DNA, 25 bp, Mus musculus
gagataggttccatccctgatacat

SEQ ID NO: 474331 - DNA, 25 bp, Mus musculus
gagataggttccttccctgatacat

SEQ ID NO: 474332 - DNA, 25 bp, Mus musculus
gagatagtcacaagagcaccattga

SEQ ID NO: 474333 - DNA, 25 bp, Mus musculus
gagatagtcacatgagcaccattga

SEQ ID NO: 474334 - DNA, 25 bp, Mus musculus
gagatagtcagtcccaaatcttctg

SEQ ID NO: 474335 - DNA, 25 bp, Mus musculus
gagatagtcagtgccaaatcttctg

SEQ ID NO: 474336 - DNA, 25 bp, Mus musculus
gagatagtcccccacattttaataa

SEQ ID NO: 474337 - DNA, 25 bp, Mus musculus
gagatagtccccgacattttaataa

SEQ ID NO: 474338 - DNA, 25 bp, Mus musculus
gagatagtcctccaaaatgcccctt

SEQ ID NO: 474339 - DNA, 25 bp, Mus musculus
gagatagtcctcgaaaatgcccctt

SEQ ID NO: 474340 - DNA, 25 bp, Mus musculus
gagatagtctctacgggtgaccctt

SEQ ID NO: 474341 - DNA, 25 bp, Mus musculus
gagatagtctcttcgggtgaccctt

SEQ ID NO: 474342 - DNA, 25 bp, Mus musculus
gagatagtctttaaatcatgcttat

SEQ ID NO: 474343 - DNA, 25 bp, Mus musculus
gagatagtcttttaatcatgcttat

SEQ ID NO: 474344 - DNA, 25 bp, Mus musculus
gagatagtgactcactgtgctggcc

SEQ ID NO: 474345 - DNA, 25 bp, Mus musculus
gagatagtgactgactgtgctggcc

SEQ ID NO: 474346 - DNA, 25 bp, Mus musculus
gagatagtgcaaatggctccaacca

SEQ ID NO: 474347 - DNA, 25 bp, Mus musculus
gagatagtgcaattggctccaacca

SEQ ID NO: 474348 - DNA, 25 bp, Mus musculus
gagatagtgcctctacttatcagtg

SEQ ID NO: 474349 - DNA, 25 bp, Mus musculus
gagatagtgcctgtacttatcagtg

SEQ ID NO: 474350 - DNA, 25 bp, Mus musculus
gagatagttatcactgactggtact

SEQ ID NO: 474351 - DNA, 25 bp, Mus musculus
gagatagttatctctgactggtact

SEQ ID NO: 474352 - DNA, 25 bp, Mus musculus
gagatagttcatccaaatgctgtgc

SEQ ID NO: 474353 - DNA, 25 bp, Mus musculus
gagatagttcatgcaaatgctgtgc

SEQ ID NO: 474354 - DNA, 25 bp, Mus musculus
gagatagttccaaatcatgcagtga

SEQ ID NO: 474355 - DNA, 25 bp, Mus musculus
gagatagttccatatcatgcagtga

SEQ ID NO: 474356 - DNA, 25 bp, Mus musculus
gagatagttcgccatttctcattcc

SEQ ID NO: 474357 - DNA, 25 bp, Mus musculus
gagatagttcgcgatttctcattcc

SEQ ID NO: 474358 - DNA, 25 bp, Mus musculus
gagatagttgcgattttaacccaga

SEQ ID NO: 474359 - DNA, 25 bp, Mus musculus
gagatagttgcgtttttaacccaga

SEQ ID NO: 474360 - DNA, 25 bp, Mus musculus
gagatagttgctacgggttcttcag

SEQ ID NO: 474361 - DNA, 25 bp, Mus musculus
gagatagttgcttcgggttcttcag

SEQ ID NO: 474362 - DNA, 25 bp, Mus musculus
gagatagtttcccatgccaacagag

SEQ ID NO: 474363 - DNA, 25 bp, Mus musculus
gagatagtttccgatgccaacagag

SEQ ID NO: 474364 - DNA, 25 bp, Mus musculus
gagatataagacctaaatcctgcta

SEQ ID NO: 474365 - DNA, 25 bp, Mus musculus
gagatataagacgtaaatcctgcta

SEQ ID NO: 474366 - DNA, 25 bp, Mus musculus
gagatataatctcctgacttactgc

SEQ ID NO: 474367 - DNA, 25 bp, Mus musculus
gagatataatctgctgacttactgc

SEQ ID NO: 474368 - DNA, 25 bp, Mus musculus
gagatatacatgaattagagcgaac

SEQ ID NO: 474369 - DNA, 25 bp, Mus musculus
gagatatacatgtattagagcgaac

SEQ ID NO: 474370 - DNA, 25 bp, Mus musculus
gagatataccaaccgcactggtgca

SEQ ID NO: 474371 - DNA, 25 bp, Mus musculus
gagatataccaagcgcactggtgca

SEQ ID NO: 474372 - DNA, 25 bp, Mus musculus
gagatatagcacaaccatccctata

SEQ ID NO: 474373 - DNA, 25 bp, Mus musculus
gagatatagcactaccatccctata

SEQ ID NO: 474374 - DNA, 25 bp, Mus musculus
gagatatagcccaatggctctgcta

SEQ ID NO: 474375 - DNA, 25 bp, Mus musculus
gagatatagccctatggctctgcta

SEQ ID NO: 474376 - DNA, 25 bp, Mus musculus
gagatatagcttagtggcagcctaa

SEQ ID NO: 474377 - DNA, 25 bp, Mus musculus
gagatatagctttgtggcagcctaa

SEQ ID NO: 474378 - DNA, 25 bp, Mus musculus
gagatatattctctttgaagactat

SEQ ID NO: 474379 - DNA, 25 bp, Mus musculus
gagatatattctgtttgaagactat

SEQ ID NO: 474380 - DNA, 25 bp, Mus musculus
gagatatcagttacaaacaccccat

SEQ ID NO: 474381 - DNA, 25 bp, Mus musculus
gagatatcagtttcaaacaccccat

SEQ ID NO: 474382 - DNA, 25 bp, Mus musculus
gagatatcatcgctaccctgagcgg

SEQ ID NO: 474383 - DNA, 25 bp, Mus musculus
gagatatcatcggtaccctgagcgg

SEQ ID NO: 474384 - DNA, 25 bp, Mus musculus
gagatatcccatcgccagaaggcga

SEQ ID NO: 474385 - DNA, 25 bp, Mus musculus
gagatatcccatggccagaaggcga

SEQ ID NO: 474386 - DNA, 25 bp, Mus musculus
gagatatcctatcaaccagctattt

SEQ ID NO: 474387 - DNA, 25 bp, Mus musculus
gagatatcctatgaaccagctattt

SEQ ID NO: 474388 - DNA, 25 bp, Mus musculus
gagatatcgcaaagatggcatccat

SEQ ID NO: 474389 - DNA, 25 bp, Mus musculus
gagatatcgcaatgatggcatccat

SEQ ID NO: 474390 - DNA, 25 bp, Mus musculus
gagatatcgtgcagttcgtgccctt

SEQ ID NO: 474391 - DNA, 25 bp, Mus musculus
gagatatcgtgctgttcgtgccctt

SEQ ID NO: 474392 - DNA, 25 bp, Mus musculus
gagatatctattcgagacaggctct

SEQ ID NO: 474393 - DNA, 25 bp, Mus musculus
gagatatctattggagacaggctct

SEQ ID NO: 474394 - DNA, 25 bp, Mus musculus
gagatatctcctctacagaagggtt

SEQ ID NO: 474395 - DNA, 25 bp, Mus musculus
gagatatctcctgtacagaagggtt

SEQ ID NO: 474396 - DNA, 25 bp, Mus musculus
gagatatctgccaccgtccagggag

SEQ ID NO: 474397 - DNA, 25 bp, Mus musculus
gagatatctgcctccgtccagggag

SEQ ID NO: 474398 - DNA, 25 bp, Mus musculus
gagatatctgctaccgtccagcttc

SEQ ID NO: 474399 - DNA, 25 bp, Mus musculus
gagatatctgcttccgtccagcttc

SEQ ID NO: 474400 - DNA, 25 bp, Mus musculus
gagatatcttggagcctagccttca

SEQ ID NO: 474401 - DNA, 25 bp, Mus musculus
gagatatcttggtgcctagccttca

SEQ ID NO: 474402 - DNA, 25 bp, Mus musculus
gagatatgaatcatcccctatggtt

SEQ ID NO: 474403 - DNA, 25 bp, Mus musculus
gagatatgaatcttcccctatggtt

SEQ ID NO: 474404 - DNA, 25 bp, Mus musculus
gagatatggcctctaaacccaaaga

SEQ ID NO: 474405 - DNA, 25 bp, Mus musculus
gagatatggcctgtaaacccaaaga

SEQ ID NO: 474406 - DNA, 25 bp, Mus musculus
gagatatggtctatgtgaagcttat

SEQ ID NO: 474407 - DNA, 25 bp, Mus musculus
gagatatggtctttgtgaagcttat

SEQ ID NO: 474408 - DNA, 25 bp, Mus musculus
gagatatgtatgagctaggcccaca

SEQ ID NO: 474409 - DNA, 25 bp, Mus musculus
gagatatgtatgtgctaggcccaca

SEQ ID NO: 474410 - DNA, 25 bp, Mus musculus
gagatatgtcagagttcgggacttc

SEQ ID NO: 474411 - DNA, 25 bp, Mus musculus
gagatatgtcagtgttcgggacttc

SEQ ID NO: 474412 - DNA, 25 bp, Mus musculus
gagatatgtcttccagttgtgtttc

SEQ ID NO: 474413 - DNA, 25 bp, Mus musculus
gagatatgtcttgcagttgtgtttc

SEQ ID NO: 474414 - DNA, 25 bp, Mus musculus
gagatattcagcaaccacggtcaaa

SEQ ID NO: 474415 - DNA, 25 bp, Mus musculus
gagatattcagctaccacggtcaaa

SEQ ID NO: 474416 - DNA, 25 bp, Mus musculus
gagatattcttgagtctggttactt

SEQ ID NO: 474417 - DNA, 25 bp, Mus musculus
gagatattcttgtgtctggttactt

SEQ ID NO: 474418 - DNA, 25 bp, Mus musculus
gagatattgcccctacagcagagga

SEQ ID NO: 474419 - DNA, 25 bp, Mus musculus
gagatattgcccgtacagcagagga

SEQ ID NO: 474420 - DNA, 25 bp, Mus musculus
gagatattggacagaccttaaattt

SEQ ID NO: 474421 - DNA, 25 bp, Mus musculus
gagatattggactgaccttaaattt

SEQ ID NO: 474422 - DNA, 25 bp, Mus musculus
gagatatttaccatcctcgatagtt

SEQ ID NO: 474423 - DNA, 25 bp, Mus musculus
gagatatttaccttcctcgatagtt

SEQ ID NO: 474424 - DNA, 25 bp, Mus musculus
gagatatttctgaagctgatgctga

SEQ ID NO: 474425 - DNA, 25 bp, Mus musculus
gagatatttctgacggctgttggca

SEQ ID NO: 474426 - DNA, 25 bp, Mus musculus
gagatatttctgtagctgatgctga

SEQ ID NO: 474427 - DNA, 25 bp, Mus musculus
gagatatttctgtcggctgttggca

SEQ ID NO: 474428 - DNA, 25 bp, Mus musculus
gagatatttgatagtttcctggaaa

SEQ ID NO: 474429 - DNA, 25 bp, Mus musculus
gagatatttgattgtttcctggaaa

SEQ ID NO: 474430 - DNA, 25 bp, Mus musculus
gagatcaaaacacgcgagtctgctg

SEQ ID NO: 474431 - DNA, 25 bp, Mus musculus
gagatcaaaacaggcgagtctgctg

SEQ ID NO: 474432 - DNA, 25 bp, Mus musculus
gagatcaaacacctattggcttttt

SEQ ID NO: 474433 - DNA, 25 bp, Mus musculus
gagatcaaacacgtattggcttttt

SEQ ID NO: 474434 - DNA, 25 bp, Mus musculus
gagatcaaacagctcaccgaggagc

SEQ ID NO: 474435 - DNA, 25 bp, Mus musculus
gagatcaaacaggtcaccgaggagc

SEQ ID NO: 474436 - DNA, 25 bp, Mus musculus
gagatcaaactgagtctgaaggctt

SEQ ID NO: 474437 - DNA, 25 bp, Mus musculus
gagatcaaactgtgtctgaaggctt

SEQ ID NO: 474438 - DNA, 25 bp, Mus musculus
gagatcaaacttcttagcccatcac

SEQ ID NO: 474439 - DNA, 25 bp, Mus musculus
gagatcaaacttgttagcccatcac

SEQ ID NO: 474440 - DNA, 25 bp, Mus musculus
gagatcaaagatcacgcagccacaa

SEQ ID NO: 474441 - DNA, 25 bp, Mus musculus
gagatcaaagatgacgcagccacaa

SEQ ID NO: 474442 - DNA, 25 bp, Mus musculus
gagatcaaagctccagtttcattcc

SEQ ID NO: 474443 - DNA, 25 bp, Mus musculus
gagatcaaagctgcagtttcattcc

SEQ ID NO: 474444 - DNA, 25 bp, Mus musculus
gagatcaaatgcatgcacctccaga

SEQ ID NO: 474445 - DNA, 25 bp, Mus musculus
gagatcaaatgcttgcacctccaga

SEQ ID NO: 474446 - DNA, 25 bp, Mus musculus
gagatcaacaacaccaagttgctct

SEQ ID NO: 474447 - DNA, 25 bp, Mus musculus
gagatcaacaactccaagttgctct

SEQ ID NO: 474448 - DNA, 25 bp, Mus musculus
gagatcaacagcattctgatctaaa

SEQ ID NO: 474449 - DNA, 25 bp, Mus musculus
gagatcaacagctttctgatctaaa

SEQ ID NO: 474450 - DNA, 25 bp, Mus musculus
gagatcaacccaccaaatgcccatg

SEQ ID NO: 474451 - DNA, 25 bp, Mus musculus
gagatcaacccagcaaatgcccatg

SEQ ID NO: 474452 - DNA, 25 bp, Mus musculus
gagatcaacgaaaagggagccataa

SEQ ID NO: 474453 - DNA, 25 bp, Mus musculus
gagatcaacgaatagggagccataa

SEQ ID NO: 474454 - DNA, 25 bp, Mus musculus
gagatcaactagacagctccttgaa

SEQ ID NO: 474455 - DNA, 25 bp, Mus musculus
gagatcaactagtcagctccttgaa

SEQ ID NO: 474456 - DNA, 25 bp, Mus musculus
gagatcaactttcagctgggaatag

SEQ ID NO: 474457 - DNA, 25 bp, Mus musculus
gagatcaactttgagctgggaatag

SEQ ID NO: 474458 - DNA, 25 bp, Mus musculus
gagatcaagctaaatccgcgaattg

SEQ ID NO: 474459 - DNA, 25 bp, Mus musculus
gagatcaagctatatccgcgaattg

SEQ ID NO: 474460 - DNA, 25 bp, Mus musculus
gagatcaagggcatgcacggccttc

SEQ ID NO: 474461 - DNA, 25 bp, Mus musculus
gagatcaagggcttgcacggccttc

SEQ ID NO: 474462 - DNA, 25 bp, Mus musculus
gagatcaagtcccagttttctgaga

SEQ ID NO: 474463 - DNA, 25 bp, Mus musculus
gagatcaagtccgagttttctgaga

SEQ ID NO: 474464 - DNA, 25 bp, Mus musculus
gagatcaataccagcttccgagagg

SEQ ID NO: 474465 - DNA, 25 bp, Mus musculus
gagatcaatacctgcttccgagagg

SEQ ID NO: 474466 - DNA, 25 bp, Mus musculus
gagatcaatctgacctttgacagca

SEQ ID NO: 474467 - DNA, 25 bp, Mus musculus
gagatcaatctgatcgtgagttcca

SEQ ID NO: 474468 - DNA, 25 bp, Mus musculus
gagatcaatctgtcctttgacagca

SEQ ID NO: 474469 - DNA, 25 bp, Mus musculus
gagatcaatctgttcgtgagttcca

SEQ ID NO: 474470 - DNA, 25 bp, Mus musculus
gagatcaatgcaattagcctagctt

SEQ ID NO: 474471 - DNA, 25 bp, Mus musculus
gagatcaatgcatttagcctagctt

SEQ ID NO: 474472 - DNA, 25 bp, Mus musculus
gagatcaatgccactggaatacatt

SEQ ID NO: 474473 - DNA, 25 bp, Mus musculus
gagatcaatgcctctggaatacatt

SEQ ID NO: 474474 - DNA, 25 bp, Mus musculus
gagatcacaaatattaaccattctt

SEQ ID NO: 474475 - DNA, 25 bp, Mus musculus
gagatcacaaattttaaccattctt

SEQ ID NO: 474476 - DNA, 25 bp, Mus musculus
gagatcacacatattttctcaaatg

SEQ ID NO: 474477 - DNA, 25 bp, Mus musculus
gagatcacacattttttctcaaatg

SEQ ID NO: 474478 - DNA, 25 bp, Mus musculus
gagatcacaggtatctttaaagcta

SEQ ID NO: 474479 - DNA, 25 bp, Mus musculus
gagatcacaggtttctttaaagcta

SEQ ID NO: 474480 - DNA, 25 bp, Mus musculus
gagatcacatccaaagaccttctag

SEQ ID NO: 474481 - DNA, 25 bp, Mus musculus
gagatcacatcctaagaccttctag

SEQ ID NO: 474482 - DNA, 25 bp, Mus musculus
gagatcacattaaagaggctcttca

SEQ ID NO: 474483 - DNA, 25 bp, Mus musculus
gagatcacattatagaggctcttca

SEQ ID NO: 474484 - DNA, 25 bp, Mus musculus
gagatcaccaaaattgaggagcatg

SEQ ID NO: 474485 - DNA, 25 bp, Mus musculus
gagatcaccaaatttgaggagcatg

SEQ ID NO: 474486 - DNA, 25 bp, Mus musculus
gagatcaccaacctgctgcatggag

SEQ ID NO: 474487 - DNA, 25 bp, Mus musculus
gagatcaccaacgtgctgcatggag

SEQ ID NO: 474488 - DNA, 25 bp, Mus musculus
gagatcaccattaattccccagaaa

SEQ ID NO: 474489 - DNA, 25 bp, Mus musculus
gagatcaccatttattccccagaaa

SEQ ID NO: 474490 - DNA, 25 bp, Mus musculus
gagatcacccacaggttgtcagtca

SEQ ID NO: 474491 - DNA, 25 bp, Mus musculus
gagatcacccactggttgtcagtca

SEQ ID NO: 474492 - DNA, 25 bp, Mus musculus
gagatcaccgctcccgttatggaag

SEQ ID NO: 474493 - DNA, 25 bp, Mus musculus
gagatcaccgctgccgttatggaag

SEQ ID NO: 474494 - DNA, 25 bp, Mus musculus
gagatcacctcacccttaaacagaa

SEQ ID NO: 474495 - DNA, 25 bp, Mus musculus
gagatcacctcagccttaaacagaa

SEQ ID NO: 474496 - DNA, 25 bp, Mus musculus
gagatcacctgaaagctttcaaaga

SEQ ID NO: 474497 - DNA, 25 bp, Mus musculus
gagatcacctgatagctttcaaaga

SEQ ID NO: 474498 - DNA, 25 bp, Mus musculus
gagatcacgcagatagctgggttat

SEQ ID NO: 474499 - DNA, 25 bp, Mus musculus
gagatcacgcagttagctgggttat

SEQ ID NO: 474500 - DNA, 25 bp, Mus musculus
gagatcacgttcatcttttgcctca

SEQ ID NO: 474501 - DNA, 25 bp, Mus musculus
gagatcacgttcttcttttgcctca

SEQ ID NO: 474502 - DNA, 25 bp, Mus musculus
gagatcactcaacaaactggttttt

SEQ ID NO: 474503 - DNA, 25 bp, Mus musculus
gagatcactcaagaaactggttttt

SEQ ID NO: 474504 - DNA, 25 bp, Mus musculus
gagatcactggcaagcacgaagaaa

SEQ ID NO: 474505 - DNA, 25 bp, Mus musculus
gagatcactggcatcagagaacctg

SEQ ID NO: 474506 - DNA, 25 bp, Mus musculus
gagatcactggctagcacgaagaaa

SEQ ID NO: 474507 - DNA, 25 bp, Mus musculus
gagatcactggcttcagagaacctg

SEQ ID NO: 474508 - DNA, 25 bp, Mus musculus
gagatcacttagataacctgccctg

SEQ ID NO: 474509 - DNA, 25 bp, Mus musculus
gagatcacttagttaacctgccctg

SEQ ID NO: 474510 - DNA, 25 bp, Mus musculus
gagatcacttcacgacatttgtaaa

SEQ ID NO: 474511 - DNA, 25 bp, Mus musculus
gagatcacttcaggacatttgtaaa

SEQ ID NO: 474512 - DNA, 25 bp, Mus musculus
gagatcagaacaattcatggtatat

SEQ ID NO: 474513 - DNA, 25 bp, Mus musculus
gagatcagaacatttcatggtatat

SEQ ID NO: 474514 - DNA, 25 bp, Mus musculus
gagatcagaactattccctataggt

SEQ ID NO: 474515 - DNA, 25 bp, Mus musculus
gagatcagaacttttccctataggt

SEQ ID NO: 474516 - DNA, 25 bp, Mus musculus
gagatcagaccgaagtccttgaaga

SEQ ID NO: 474517 - DNA, 25 bp, Mus musculus
gagatcagaccgtagtccttgaaga

SEQ ID NO: 474518 - DNA, 25 bp, Mus musculus
gagatcagactcctatatgggcttg

SEQ ID NO: 474519 - DNA, 25 bp, Mus musculus
gagatcagactcgtatatgggcttg

SEQ ID NO: 474520 - DNA, 25 bp, Mus musculus
gagatcagaggtcgcattagacccc

SEQ ID NO: 474521 - DNA, 25 bp, Mus musculus
gagatcagaggtggcattagacccc

SEQ ID NO: 474522 - DNA, 25 bp, Mus musculus
gagatcagccaaaccgatttctccc

SEQ ID NO: 474523 - DNA, 25 bp, Mus musculus
gagatcagccaatccgatttctccc

SEQ ID NO: 474524 - DNA, 25 bp, Mus musculus
gagatcagccttctttatttcaaca

SEQ ID NO: 474525 - DNA, 25 bp, Mus musculus
gagatcagccttgtttatttcaaca

SEQ ID NO: 474526 - DNA, 25 bp, Mus musculus
gagatcagctgcatgctgtgacaaa

SEQ ID NO: 474527 - DNA, 25 bp, Mus musculus
gagatcagctgcttgctgtgacaaa

SEQ ID NO: 474528 - DNA, 25 bp, Mus musculus
gagatcagggctcttacctatgata

SEQ ID NO: 474529 - DNA, 25 bp, Mus musculus
gagatcagggctgttacctatgata

SEQ ID NO: 474530 - DNA, 25 bp, Mus musculus
gagatcagtagcaacatagttttct

SEQ ID NO: 474531 - DNA, 25 bp, Mus musculus
gagatcagtagctacatagttttct

SEQ ID NO: 474532 - DNA, 25 bp, Mus musculus
gagatcagtcagcagagagcgctat

SEQ ID NO: 474533 - DNA, 25 bp, Mus musculus
gagatcagtcaggagagagcgctat

SEQ ID NO: 474534 - DNA, 25 bp, Mus musculus
gagatcagtctcaggtcattaggcc

SEQ ID NO: 474535 - DNA, 25 bp, Mus musculus
gagatcagtctctggtcattaggcc

SEQ ID NO: 474536 - DNA, 25 bp, Mus musculus
gagatcagtttcatatactcccagc

SEQ ID NO: 474537 - DNA, 25 bp, Mus musculus
gagatcagtttcttatactcccagc

SEQ ID NO: 474538 - DNA, 25 bp, Mus musculus
gagatcataaaaatccggagaaagc

SEQ ID NO: 474539 - DNA, 25 bp, Mus musculus
gagatcataaaattccggagaaagc

SEQ ID NO: 474540 - DNA, 25 bp, Mus musculus
gagatcataattcggtaacacgtac

SEQ ID NO: 474541 - DNA, 25 bp, Mus musculus
gagatcataattgggtaacacgtac

SEQ ID NO: 474542 - DNA, 25 bp, Mus musculus
gagatcatacaaacccagaagggcc

SEQ ID NO: 474543 - DNA, 25 bp, Mus musculus
gagatcatacaatcccagaagggcc

SEQ ID NO: 474544 - DNA, 25 bp, Mus musculus
gagatcatagctaggatcctagtga

SEQ ID NO: 474545 - DNA, 25 bp, Mus musculus
gagatcatagcttggatcctagtga

SEQ ID NO: 474546 - DNA, 25 bp, Mus musculus
gagatcatatgaatgagagacctgg

SEQ ID NO: 474547 - DNA, 25 bp, Mus musculus
gagatcatatgattgagagacctgg

SEQ ID NO: 474548 - DNA, 25 bp, Mus musculus
gagatcatattgcaaatccagctgt

SEQ ID NO: 474549 - DNA, 25 bp, Mus musculus
gagatcatattggaaatccagctgt

SEQ ID NO: 474550 - DNA, 25 bp, Mus musculus
gagatcatcaacatcgccaactgct

SEQ ID NO: 474551 - DNA, 25 bp, Mus musculus
gagatcatcaacttcgccaactgct

SEQ ID NO: 474552 - DNA, 25 bp, Mus musculus
gagatcatcaagacagttgccttct

SEQ ID NO: 474553 - DNA, 25 bp, Mus musculus
gagatcatcaagactctgtccaagg

SEQ ID NO: 474554 - DNA, 25 bp, Mus musculus
gagatcatcaagtcagttgccttct

SEQ ID NO: 474555 - DNA, 25 bp, Mus musculus
gagatcatcaagtctctgtccaagg

SEQ ID NO: 474556 - DNA, 25 bp, Mus musculus
gagatcatccatcgcttgctggaca

SEQ ID NO: 474557 - DNA, 25 bp, Mus musculus
gagatcatccatggcttgctggaca

SEQ ID NO: 474558 - DNA, 25 bp, Mus musculus
gagatcatcccaataaccatgccgt

SEQ ID NO: 474559 - DNA, 25 bp, Mus musculus
gagatcatcccattaaccatgccgt

SEQ ID NO: 474560 - DNA, 25 bp, Mus musculus
gagatcatccctatagatttagtgg

SEQ ID NO: 474561 - DNA, 25 bp, Mus musculus
gagatcatccctttagatttagtgg

SEQ ID NO: 474562 - DNA, 25 bp, Mus musculus
gagatcatctccattggaagcggat

SEQ ID NO: 474563 - DNA, 25 bp, Mus musculus
gagatcatctcctttggaagcggat

SEQ ID NO: 474564 - DNA, 25 bp, Mus musculus
gagatcatgcttagagcctgtgctg

SEQ ID NO: 474565 - DNA, 25 bp, Mus musculus
gagatcatgctttgagcctgtgctg

SEQ ID NO: 474566 - DNA, 25 bp, Mus musculus
gagatcatggaccacatcctgagga

SEQ ID NO: 474567 - DNA, 25 bp, Mus musculus
gagatcatggacgacatcctgagga

SEQ ID NO: 474568 - DNA, 25 bp, Mus musculus
gagatcatggccagacatccaagaa

SEQ ID NO: 474569 - DNA, 25 bp, Mus musculus
gagatcatggcctgacatccaagaa

SEQ ID NO: 474570 - DNA, 25 bp, Mus musculus
gagatcattaaaagaggccaacaag

SEQ ID NO: 474571 - DNA, 25 bp, Mus musculus
gagatcattaaatgaggccaacaag

SEQ ID NO: 474572 - DNA, 25 bp, Mus musculus
gagatcattaatcccaccactggga

SEQ ID NO: 474573 - DNA, 25 bp, Mus musculus
gagatcattaatgccaccactggga

SEQ ID NO: 474574 - DNA, 25 bp, Mus musculus
gagatcattatccacatctactgtg

SEQ ID NO: 474575 - DNA, 25 bp, Mus musculus
gagatcattatcgacatctactgtg

SEQ ID NO: 474576 - DNA, 25 bp, Mus musculus
gagatcattctgacccgaattcagg

SEQ ID NO: 474577 - DNA, 25 bp, Mus musculus
gagatcattctgtcccgaattcagg

SEQ ID NO: 474578 - DNA, 25 bp, Mus musculus
gagatcattgcaacatctcctctgt

SEQ ID NO: 474579 - DNA, 25 bp, Mus musculus
gagatcattgcatcatctcctctgt

SEQ ID NO: 474580 - DNA, 25 bp, Mus musculus
gagatcattgctagtggactgccaa

SEQ ID NO: 474581 - DNA, 25 bp, Mus musculus
gagatcattgcttgtggactgccaa

SEQ ID NO: 474582 - DNA, 25 bp, Mus musculus
gagatcattgtcatctgtcttcttc

SEQ ID NO: 474583 - DNA, 25 bp, Mus musculus
gagatcattgtcttctgtcttcttc

SEQ ID NO: 474584 - DNA, 25 bp, Mus musculus
gagatcattttcctcatattcaccc

SEQ ID NO: 474585 - DNA, 25 bp, Mus musculus
gagatcattttcgtcatattcaccc

SEQ ID NO: 474586 - DNA, 25 bp, Mus musculus
gagatccaacaaactggattgttat

SEQ ID NO: 474587 - DNA, 25 bp, Mus musculus
gagatccaacaatctggattgttat

SEQ ID NO: 474588 - DNA, 25 bp, Mus musculus
gagatccaacagagcaaccctacaa

SEQ ID NO: 474589 - DNA, 25 bp, Mus musculus
gagatccaacagtgcaaccctacaa

SEQ ID NO: 474590 - DNA, 25 bp, Mus musculus
gagatccaactaattttgcctcccg

SEQ ID NO: 474591 - DNA, 25 bp, Mus musculus
gagatccaactatttttgcctcccg

SEQ ID NO: 474592 - DNA, 25 bp, Mus musculus
gagatccaagacaggcctggctatt

SEQ ID NO: 474593 - DNA, 25 bp, Mus musculus
gagatccaagactggcctggctatt

SEQ ID NO: 474594 - DNA, 25 bp, Mus musculus
gagatccaagccaacaagcctgaaa

SEQ ID NO: 474595 - DNA, 25 bp, Mus musculus
gagatccaagcctacaagcctgaaa

SEQ ID NO: 474596 - DNA, 25 bp, Mus musculus
gagatccaatacagccagcgcctgg

SEQ ID NO: 474597 - DNA, 25 bp, Mus musculus
gagatccaatactgccagcgcctgg

SEQ ID NO: 474598 - DNA, 25 bp, Mus musculus
gagatccaatttcatcgctgcagtc

SEQ ID NO: 474599 - DNA, 25 bp, Mus musculus
gagatccaatttgatcgctgcagtc

SEQ ID NO: 474600 - DNA, 25 bp, Mus musculus
gagatccacaagactagccaagctt

SEQ ID NO: 474601 - DNA, 25 bp, Mus musculus
gagatccacaagtctagccaagctt

SEQ ID NO: 474602 - DNA, 25 bp, Mus musculus
gagatccacaatataatcctgtctg

SEQ ID NO: 474603 - DNA, 25 bp, Mus musculus
gagatccacaatttaatcctgtctg

SEQ ID NO: 474604 - DNA, 25 bp, Mus musculus
gagatccacactatgaattcctttt

SEQ ID NO: 474605 - DNA, 25 bp, Mus musculus
gagatccacactttgaattcctttt

SEQ ID NO: 474606 - DNA, 25 bp, Mus musculus
gagatccacagtctcctgcagaagc

SEQ ID NO: 474607 - DNA, 25 bp, Mus musculus
gagatccacagtgtcctgcagaagc

SEQ ID NO: 474608 - DNA, 25 bp, Mus musculus
gagatccacatgaaccatcaactac

SEQ ID NO: 474609 - DNA, 25 bp, Mus musculus
gagatccacatgtaccatcaactac

SEQ ID NO: 474610 - DNA, 25 bp, Mus musculus
gagatccaccagatagcggttgtca

SEQ ID NO: 474611 - DNA, 25 bp, Mus musculus
gagatccaccagttagcggttgtca

SEQ ID NO: 474612 - DNA, 25 bp, Mus musculus
gagatccaccttaaaacctgaggaa

SEQ ID NO: 474613 - DNA, 25 bp, Mus musculus
gagatccacctttaaacctgaggaa

SEQ ID NO: 474614 - DNA, 25 bp, Mus musculus
gagatccacgatcgatcattcccca

SEQ ID NO: 474615 - DNA, 25 bp, Mus musculus
gagatccacgatggatcattcccca

SEQ ID NO: 474616 - DNA, 25 bp, Mus musculus
gagatccacgtgacacagacagtga

SEQ ID NO: 474617 - DNA, 25 bp, Mus musculus
gagatccacgtgctggacacggact

SEQ ID NO: 474618 - DNA, 25 bp, Mus musculus
gagatccacgtggtggacacggact

SEQ ID NO: 474619 - DNA, 25 bp, Mus musculus
gagatccacgtgtcacagacagtga

SEQ ID NO: 474620 - DNA, 25 bp, Mus musculus
gagatccagagcatgctaaccaact

SEQ ID NO: 474621 - DNA, 25 bp, Mus musculus
gagatccagagcatgctggcacagt

SEQ ID NO: 474622 - DNA, 25 bp, Mus musculus
gagatccagagcttgctaaccaact

SEQ ID NO: 474623 - DNA, 25 bp, Mus musculus
gagatccagagcttgctggcacagt

SEQ ID NO: 474624 - DNA, 25 bp, Mus musculus
gagatccagcagctcttcaaagaca

SEQ ID NO: 474625 - DNA, 25 bp, Mus musculus
gagatccagcaggtcttcaaagaca

SEQ ID NO: 474626 - DNA, 25 bp, Mus musculus
gagatccagcataaatcccttaaag

SEQ ID NO: 474627 - DNA, 25 bp, Mus musculus
gagatccagcattaatcccttaaag

SEQ ID NO: 474628 - DNA, 25 bp, Mus musculus
gagatccagcggcagattggcatca

SEQ ID NO: 474629 - DNA, 25 bp, Mus musculus
gagatccagcgggagattggcatca

SEQ ID NO: 474630 - DNA, 25 bp, Mus musculus
gagatccagggcaagtaccagttcc

SEQ ID NO: 474631 - DNA, 25 bp, Mus musculus
gagatccagggctagtaccagttcc

SEQ ID NO: 474632 - DNA, 25 bp, Mus musculus
gagatccagtacataagttgcccaa

SEQ ID NO: 474633 - DNA, 25 bp, Mus musculus
gagatccagtacttaagttgcccaa

SEQ ID NO: 474634 - DNA, 25 bp, Mus musculus
gagatccagtcaagcaacacaaatg

SEQ ID NO: 474635 - DNA, 25 bp, Mus musculus
gagatccagtcacttcgacgtcata

SEQ ID NO: 474636 - DNA, 25 bp, Mus musculus
gagatccagtcagttcgacgtcata

SEQ ID NO: 474637 - DNA, 25 bp, Mus musculus
gagatccagtcatgcaacacaaatg

SEQ ID NO: 474638 - DNA, 25 bp, Mus musculus
gagatccagtggcaggttcaaattg

SEQ ID NO: 474639 - DNA, 25 bp, Mus musculus
gagatccagtgggaggttcaaattg

SEQ ID NO: 474640 - DNA, 25 bp, Mus musculus
gagatccatcatacttatgtcagct

SEQ ID NO: 474641 - DNA, 25 bp, Mus musculus
gagatccatcattcttatgtcagct

SEQ ID NO: 474642 - DNA, 25 bp, Mus musculus
gagatccatcccctagactgactga

SEQ ID NO: 474643 - DNA, 25 bp, Mus musculus
gagatccatcccgtagactgactga

SEQ ID NO: 474644 - DNA, 25 bp, Mus musculus
gagatccatctcaaagcacgaaaag

SEQ ID NO: 474645 - DNA, 25 bp, Mus musculus
gagatccatctctaagcacgaaaag

SEQ ID NO: 474646 - DNA, 25 bp, Mus musculus
gagatccatctgagctcatcgaaga

SEQ ID NO: 474647 - DNA, 25 bp, Mus musculus
gagatccatctgtgctcatcgaaga

SEQ ID NO: 474648 - DNA, 25 bp, Mus musculus
gagatccatggtagggagttcccac

SEQ ID NO: 474649 - DNA, 25 bp, Mus musculus
gagatccatggtagtaattccagca

SEQ ID NO: 474650 - DNA, 25 bp, Mus musculus
gagatccatggttgggagttcccac

SEQ ID NO: 474651 - DNA, 25 bp, Mus musculus
gagatccatggttgtaattccagca

SEQ ID NO: 474652 - DNA, 25 bp, Mus musculus
gagatccatttgagccacatgctta

SEQ ID NO: 474653 - DNA, 25 bp, Mus musculus
gagatccatttgtgccacatgctta

SEQ ID NO: 474654 - DNA, 25 bp, Mus musculus
gagatcccaagccaagaaacacaga

SEQ ID NO: 474655 - DNA, 25 bp, Mus musculus
gagatcccaagcgaagaaacacaga

SEQ ID NO: 474656 - DNA, 25 bp, Mus musculus
gagatcccagaacatcccaagctct

SEQ ID NO: 474657 - DNA, 25 bp, Mus musculus
gagatcccagaagatcccaagctct

SEQ ID NO: 474658 - DNA, 25 bp, Mus musculus
gagatcccagacattttagactcta

SEQ ID NO: 474659 - DNA, 25 bp, Mus musculus
gagatcccagactttttagactcta

SEQ ID NO: 474660 - DNA, 25 bp, Mus musculus
gagatcccagagaaggtgccgcact

SEQ ID NO: 474661 - DNA, 25 bp, Mus musculus
gagatcccagagtaggtgccgcact

SEQ ID NO: 474662 - DNA, 25 bp, Mus musculus
gagatcccaggcacaagcagtcttt

SEQ ID NO: 474663 - DNA, 25 bp, Mus musculus
gagatcccaggctcaagcagtcttt

SEQ ID NO: 474664 - DNA, 25 bp, Mus musculus
gagatcccatagagagatgacctga

SEQ ID NO: 474665 - DNA, 25 bp, Mus musculus
gagatcccatagtgagatgacctga

SEQ ID NO: 474666 - DNA, 25 bp, Mus musculus
gagatcccatctatcaattcagttt

SEQ ID NO: 474667 - DNA, 25 bp, Mus musculus
gagatcccatctccagatataacta

SEQ ID NO: 474668 - DNA, 25 bp, Mus musculus
gagatcccatctgcagatataacta

SEQ ID NO: 474669 - DNA, 25 bp, Mus musculus
gagatcccatctttcaattcagttt

SEQ ID NO: 474670 - DNA, 25 bp, Mus musculus
gagatccccatgacagaagcggtcg

SEQ ID NO: 474671 - DNA, 25 bp, Mus musculus
gagatccccatgtcagaagcggtcg

SEQ ID NO: 474672 - DNA, 25 bp, Mus musculus
gagatcccctgcatttagcatttta

SEQ ID NO: 474673 - DNA, 25 bp, Mus musculus
gagatcccctgcttttagcatttta

SEQ ID NO: 474674 - DNA, 25 bp, Mus musculus
gagatcccctggcttgcagaaaatc

SEQ ID NO: 474675 - DNA, 25 bp, Mus musculus
gagatcccctgggttgcagaaaatc

SEQ ID NO: 474676 - DNA, 25 bp, Mus musculus
gagatcccgcttaactggacaaaca

SEQ ID NO: 474677 - DNA, 25 bp, Mus musculus
gagatcccgctttactggacaaaca

SEQ ID NO: 474678 - DNA, 25 bp, Mus musculus
gagatcccggagaatgaccccattt

SEQ ID NO: 474679 - DNA, 25 bp, Mus musculus
gagatcccggagtatgaccccattt

SEQ ID NO: 474680 - DNA, 25 bp, Mus musculus
gagatcccgtatattagttatgtaa

SEQ ID NO: 474681 - DNA, 25 bp, Mus musculus
gagatcccgtattttagttatgtaa

SEQ ID NO: 474682 - DNA, 25 bp, Mus musculus
gagatccctcgcaacaagcagatgg

SEQ ID NO: 474683 - DNA, 25 bp, Mus musculus
gagatccctcgctacaagcagatgg

SEQ ID NO: 474684 - DNA, 25 bp, Mus musculus
gagatccctgccaatcaagtgttga

SEQ ID NO: 474685 - DNA, 25 bp, Mus musculus
gagatccctgcctatcaagtgttga

SEQ ID NO: 474686 - DNA, 25 bp, Mus musculus
gagatccctggtattctatggtgat

SEQ ID NO: 474687 - DNA, 25 bp, Mus musculus
gagatccctggttttctatggtgat

SEQ ID NO: 474688 - DNA, 25 bp, Mus musculus
gagatccgacttagttttggaagca

SEQ ID NO: 474689 - DNA, 25 bp, Mus musculus
gagatccgactttgttttggaagca

SEQ ID NO: 474690 - DNA, 25 bp, Mus musculus
gagatccgaggcaatgtacttgtat

SEQ ID NO: 474691 - DNA, 25 bp, Mus musculus
gagatccgaggctatgtacttgtat

SEQ ID NO: 474692 - DNA, 25 bp, Mus musculus
gagatccgcaatcacacgggcaagt

SEQ ID NO: 474693 - DNA, 25 bp, Mus musculus
gagatccgcaatgacacgggcaagt

SEQ ID NO: 474694 - DNA, 25 bp, Mus musculus
gagatccgcagtaccagacagccag

SEQ ID NO: 474695 - DNA, 25 bp, Mus musculus
gagatccgcagttccagacagccag

SEQ ID NO: 474696 - DNA, 25 bp, Mus musculus
gagatccggagcagcaacctatcat

SEQ ID NO: 474697 - DNA, 25 bp, Mus musculus
gagatccggagctgcaacctatcat

SEQ ID NO: 474698 - DNA, 25 bp, Mus musculus
gagatccggcgcaaccagaagtcga

SEQ ID NO: 474699 - DNA, 25 bp, Mus musculus
gagatccggcgctaccagaagtcga

SEQ ID NO: 474700 - DNA, 25 bp, Mus musculus
gagatccgggagattgctaagaatt

SEQ ID NO: 474701 - DNA, 25 bp, Mus musculus
gagatccgggagtttgctaagaatt

SEQ ID NO: 474702 - DNA, 25 bp, Mus musculus
gagatccgtgcaaaggttgctctcc

SEQ ID NO: 474703 - DNA, 25 bp, Mus musculus
gagatccgtgcaagatagattcctt

SEQ ID NO: 474704 - DNA, 25 bp, Mus musculus
gagatccgtgcataggttgctctcc

SEQ ID NO: 474705 - DNA, 25 bp, Mus musculus
gagatccgtgcatgatagattcctt

SEQ ID NO: 474706 - DNA, 25 bp, Mus musculus
gagatcctaccgcagattgaattct

SEQ ID NO: 474707 - DNA, 25 bp, Mus musculus
gagatcctaccggagattgaattct

SEQ ID NO: 474708 - DNA, 25 bp, Mus musculus
gagatcctagacactggctttgaat

SEQ ID NO: 474709 - DNA, 25 bp, Mus musculus
gagatcctagactctggctttgaat

SEQ ID NO: 474710 - DNA, 25 bp, Mus musculus
gagatcctagatccggtggccaatg

SEQ ID NO: 474711 - DNA, 25 bp, Mus musculus
gagatcctagatgcggtggccaatg

SEQ ID NO: 474712 - DNA, 25 bp, Mus musculus
gagatcctaggtcaaccaaaccatt

SEQ ID NO: 474713 - DNA, 25 bp, Mus musculus
gagatcctaggtgaaccaaaccatt

SEQ ID NO: 474714 - DNA, 25 bp, Mus musculus
gagatcctatcccagagggacactg

SEQ ID NO: 474715 - DNA, 25 bp, Mus musculus
gagatcctatccgagagggacactg

SEQ ID NO: 474716 - DNA, 25 bp, Mus musculus
gagatcctattccttttattgagag

SEQ ID NO: 474717 - DNA, 25 bp, Mus musculus
gagatcctattcgttttattgagag

SEQ ID NO: 474718 - DNA, 25 bp, Mus musculus
gagatcctcaaacagacattgtctt

SEQ ID NO: 474719 - DNA, 25 bp, Mus musculus
gagatcctcaaagagacattgtctt

SEQ ID NO: 474720 - DNA, 25 bp, Mus musculus
gagatcctcactaatagctagcatg

SEQ ID NO: 474721 - DNA, 25 bp, Mus musculus
gagatcctcacttatagctagcatg

SEQ ID NO: 474722 - DNA, 25 bp, Mus musculus
gagatcctcagcagtctgtggacct

SEQ ID NO: 474723 - DNA, 25 bp, Mus musculus
gagatcctcagctgtctgtggacct

SEQ ID NO: 474724 - DNA, 25 bp, Mus musculus
gagatcctccagatctgggccccag

SEQ ID NO: 474725 - DNA, 25 bp, Mus musculus
gagatcctccagttctgggccccag

SEQ ID NO: 474726 - DNA, 25 bp, Mus musculus
gagatcctccgactagtctttgaga

SEQ ID NO: 474727 - DNA, 25 bp, Mus musculus
gagatcctccgagtagtctttgaga

SEQ ID NO: 474728 - DNA, 25 bp, Mus musculus
gagatcctccgcataggctataagt

SEQ ID NO: 474729 - DNA, 25 bp, Mus musculus
gagatcctccgcttaggctataagt

SEQ ID NO: 474730 - DNA, 25 bp, Mus musculus
gagatcctcctgatttggtctcctg

SEQ ID NO: 474731 - DNA, 25 bp, Mus musculus
gagatcctcctgttttggtctcctg

SEQ ID NO: 474732 - DNA, 25 bp, Mus musculus
gagatcctctaccatgtgtactggc

SEQ ID NO: 474733 - DNA, 25 bp, Mus musculus
gagatcctctacgatgtgtactggc

SEQ ID NO: 474734 - DNA, 25 bp, Mus musculus
gagatcctgaccacatgaacaattt

SEQ ID NO: 474735 - DNA, 25 bp, Mus musculus
gagatcctgacctcatgaacaattt

SEQ ID NO: 474736 - DNA, 25 bp, Mus musculus
gagatcctgagaccacacatttgat

SEQ ID NO: 474737 - DNA, 25 bp, Mus musculus
gagatcctgagagcacacatttgat

SEQ ID NO: 474738 - DNA, 25 bp, Mus musculus
gagatcctgcaacagtcccggatga

SEQ ID NO: 474739 - DNA, 25 bp, Mus musculus
gagatcctgcaagagtcccggatga

SEQ ID NO: 474740 - DNA, 25 bp, Mus musculus
gagatcctgcccagcttcgaagaga

SEQ ID NO: 474741 - DNA, 25 bp, Mus musculus
gagatcctgccctgcttcgaagaga

SEQ ID NO: 474742 - DNA, 25 bp, Mus musculus
gagatcctgctcctggagtaggaaa

SEQ ID NO: 474743 - DNA, 25 bp, Mus musculus
gagatcctgctcgtggagtaggaaa

SEQ ID NO: 474744 - DNA, 25 bp, Mus musculus
gagatcctgcttcgagatttcttaa

SEQ ID NO: 474745 - DNA, 25 bp, Mus musculus
gagatcctgcttggagatttcttaa

SEQ ID NO: 474746 - DNA, 25 bp, Mus musculus
gagatcctggacctgatgaccgaga

SEQ ID NO: 474747 - DNA, 25 bp, Mus musculus
gagatcctggacgtgatgaccgaga

SEQ ID NO: 474748 - DNA, 25 bp, Mus musculus
gagatcctggagaaacctaaccgaa

SEQ ID NO: 474749 - DNA, 25 bp, Mus musculus
gagatcctggagaacaacttcaaca

SEQ ID NO: 474750 - DNA, 25 bp, Mus musculus
gagatcctggagtaacctaaccgaa

SEQ ID NO: 474751 - DNA, 25 bp, Mus musculus
gagatcctggagtacaacttcaaca

SEQ ID NO: 474752 - DNA, 25 bp, Mus musculus
gagatcctggccaagcacccgagtg

SEQ ID NO: 474753 - DNA, 25 bp, Mus musculus
gagatcctggcctagcacccgagtg

SEQ ID NO: 474754 - DNA, 25 bp, Mus musculus
gagatcctgggcataacacaggctt

SEQ ID NO: 474755 - DNA, 25 bp, Mus musculus
gagatcctgggccaagtcctttcat

SEQ ID NO: 474756 - DNA, 25 bp, Mus musculus
gagatcctgggccagacatacaaag

SEQ ID NO: 474757 - DNA, 25 bp, Mus musculus
gagatcctgggcgaagtcctttcat

SEQ ID NO: 474758 - DNA, 25 bp, Mus musculus
gagatcctgggcgagacatacaaag

SEQ ID NO: 474759 - DNA, 25 bp, Mus musculus
gagatcctgggcttaacacaggctt

SEQ ID NO: 474760 - DNA, 25 bp, Mus musculus
gagatcctggtaattgttgacgtaa

SEQ ID NO: 474761 - DNA, 25 bp, Mus musculus
gagatcctggtatttgttgacgtaa

SEQ ID NO: 474762 - DNA, 25 bp, Mus musculus
gagatcctggtcatttctggacagt

SEQ ID NO: 474763 - DNA, 25 bp, Mus musculus
gagatcctggtcttttctggacagt

SEQ ID NO: 474764 - DNA, 25 bp, Mus musculus
gagatcctggtgctcagcctttgga

SEQ ID NO: 474765 - DNA, 25 bp, Mus musculus
gagatcctggtggtcagcctttgga

SEQ ID NO: 474766 - DNA, 25 bp, Mus musculus
gagatccttaagacatttccccaac

SEQ ID NO: 474767 - DNA, 25 bp, Mus musculus
gagatccttaagtcatttccccaac

SEQ ID NO: 474768 - DNA, 25 bp, Mus musculus
gagatccttagccatgctgcttgcc

SEQ ID NO: 474769 - DNA, 25 bp, Mus musculus
gagatccttagcgatgctgcttgcc

SEQ ID NO: 474770 - DNA, 25 bp, Mus musculus
gagatccttgagctcaacggcattg

SEQ ID NO: 474771 - DNA, 25 bp, Mus musculus
gagatccttgaggtcaacggcattg

SEQ ID NO: 474772 - DNA, 25 bp, Mus musculus
gagatccttgcaatccttttttgtg

SEQ ID NO: 474773 - DNA, 25 bp, Mus musculus
gagatccttgcattccttttttgtg

SEQ ID NO: 474774 - DNA, 25 bp, Mus musculus
gagatccttgctaatggtgtctatg

SEQ ID NO: 474775 - DNA, 25 bp, Mus musculus
gagatccttgcttatggtgtctatg

SEQ ID NO: 474776 - DNA, 25 bp, Mus musculus
gagatccttgtaagtttatcactag

SEQ ID NO: 474777 - DNA, 25 bp, Mus musculus
gagatccttgtatgtttatcactag

SEQ ID NO: 474778 - DNA, 25 bp, Mus musculus
gagatcctttaaatccttcagcttt

SEQ ID NO: 474779 - DNA, 25 bp, Mus musculus
gagatcctttaattccttcagcttt

SEQ ID NO: 474780 - DNA, 25 bp, Mus musculus
gagatccttttgcaacacatgtcca

SEQ ID NO: 474781 - DNA, 25 bp, Mus musculus
gagatccttttggaacacatgtcca

SEQ ID NO: 474782 - DNA, 25 bp, Mus musculus
gagatcgaagacactttcaggcaat

SEQ ID NO: 474783 - DNA, 25 bp, Mus musculus
gagatcgaagactctttcaggcaat

SEQ ID NO: 474784 - DNA, 25 bp, Mus musculus
gagatcgaccaccttttacctgaaa

SEQ ID NO: 474785 - DNA, 25 bp, Mus musculus
gagatcgaccacgttttacctgaaa

SEQ ID NO: 474786 - DNA, 25 bp, Mus musculus
gagatcgactttaccgggctcggaa

SEQ ID NO: 474787 - DNA, 25 bp, Mus musculus
gagatcgacttttccgggctcggaa

SEQ ID NO: 474788 - DNA, 25 bp, Mus musculus
gagatcgagagcctgtcccgctacg

SEQ ID NO: 474789 - DNA, 25 bp, Mus musculus
gagatcgagagcgtgtcccgctacg

SEQ ID NO: 474790 - DNA, 25 bp, Mus musculus
gagatcgaggccatgaaactcaaag

SEQ ID NO: 474791 - DNA, 25 bp, Mus musculus
gagatcgaggccttgaaactcaaag

SEQ ID NO: 474792 - DNA, 25 bp, Mus musculus
gagatcgagttgctggtttcctact

SEQ ID NO: 474793 - DNA, 25 bp, Mus musculus
gagatcgagttggtggtttcctact

SEQ ID NO: 474794 - DNA, 25 bp, Mus musculus
gagatcgatgatcgaacttcagctt

SEQ ID NO: 474795 - DNA, 25 bp, Mus musculus
gagatcgatgatggaacttcagctt

SEQ ID NO: 474796 - DNA, 25 bp, Mus musculus
gagatcgatgtgaatgataccctga

SEQ ID NO: 474797 - DNA, 25 bp, Mus musculus
gagatcgatgtgtatgataccctga

SEQ ID NO: 474798 - DNA, 25 bp, Mus musculus
gagatcgcaccaacctgacctagaa

SEQ ID NO: 474799 - DNA, 25 bp, Mus musculus
gagatcgcaccatcctgacctagaa

SEQ ID NO: 474800 - DNA, 25 bp, Mus musculus
gagatcgcagaacgtcacgctcccg

SEQ ID NO: 474801 - DNA, 25 bp, Mus musculus
gagatcgcagaaggtcacgctcccg

SEQ ID NO: 474802 - DNA, 25 bp, Mus musculus
gagatcgcagctagtggtggtcaaa

SEQ ID NO: 474803 - DNA, 25 bp, Mus musculus
gagatcgcagcttgtggtggtcaaa

SEQ ID NO: 474804 - DNA, 25 bp, Mus musculus
gagatcgcatcaattgaatgttccg

SEQ ID NO: 474805 - DNA, 25 bp, Mus musculus
gagatcgcatcatttgaatgttccg

SEQ ID NO: 474806 - DNA, 25 bp, Mus musculus
gagatcgccacaagttcagcatttt

SEQ ID NO: 474807 - DNA, 25 bp, Mus musculus
gagatcgccacatgttcagcatttt

SEQ ID NO: 474808 - DNA, 25 bp, Mus musculus
gagatcgccactaaccggaacctgc

SEQ ID NO: 474809 - DNA, 25 bp, Mus musculus
gagatcgccacttaccggaacctgc

SEQ ID NO: 474810 - DNA, 25 bp, Mus musculus
gagatcgccattatccccagcaaga

SEQ ID NO: 474811 - DNA, 25 bp, Mus musculus
gagatcgccattttccccagcaaga

SEQ ID NO: 474812 - DNA, 25 bp, Mus musculus
gagatcgctcttacttcaaaaggaa

SEQ ID NO: 474813 - DNA, 25 bp, Mus musculus
gagatcgctctttcttcaaaaggaa

SEQ ID NO: 474814 - DNA, 25 bp, Mus musculus
gagatcgctggcaaacctcaattca

SEQ ID NO: 474815 - DNA, 25 bp, Mus musculus
gagatcgctggctaacctcaattca

SEQ ID NO: 474816 - DNA, 25 bp, Mus musculus
gagatcggccttaccgaaaacccat

SEQ ID NO: 474817 - DNA, 25 bp, Mus musculus
gagatcggcctttccgaaaacccat

SEQ ID NO: 474818 - DNA, 25 bp, Mus musculus
gagatcgggcatctagagtcagggt

SEQ ID NO: 474819 - DNA, 25 bp, Mus musculus
gagatcgggcatgtagagtcagggt

SEQ ID NO: 474820 - DNA, 25 bp, Mus musculus
gagatcgtcaaaacacggtttgcca

SEQ ID NO: 474821 - DNA, 25 bp, Mus musculus
gagatcgtcaaatcacggtttgcca

SEQ ID NO: 474822 - DNA, 25 bp, Mus musculus
gagatcgtcagactccaattgcaag

SEQ ID NO: 474823 - DNA, 25 bp, Mus musculus
gagatcgtcagagtccaattgcaag

SEQ ID NO: 474824 - DNA, 25 bp, Mus musculus
gagatcgtccctctgacaaatctga

SEQ ID NO: 474825 - DNA, 25 bp, Mus musculus
gagatcgtccctgtgacaaatctga

SEQ ID NO: 474826 - DNA, 25 bp, Mus musculus
gagatcgtctctaatgctttttcct

SEQ ID NO: 474827 - DNA, 25 bp, Mus musculus
gagatcgtctctcgtcaacttacag

SEQ ID NO: 474828 - DNA, 25 bp, Mus musculus
gagatcgtctctggtcaacttacag

SEQ ID NO: 474829 - DNA, 25 bp, Mus musculus
gagatcgtctcttatgctttttcct

SEQ ID NO: 474830 - DNA, 25 bp, Mus musculus
gagatcgtctgtagtcacggattcc

SEQ ID NO: 474831 - DNA, 25 bp, Mus musculus
gagatcgtctgttgtcacggattcc

SEQ ID NO: 474832 - DNA, 25 bp, Mus musculus
gagatcgtgcagcatggcgaccaca

SEQ ID NO: 474833 - DNA, 25 bp, Mus musculus
gagatcgtgcaggatggcgaccaca

SEQ ID NO: 474834 - DNA, 25 bp, Mus musculus
gagatcgtgctcaaggttaactaca

SEQ ID NO: 474835 - DNA, 25 bp, Mus musculus
gagatcgtgctctaggttaactaca

SEQ ID NO: 474836 - DNA, 25 bp, Mus musculus
gagatcgtgtgcatttccaagtgcc

SEQ ID NO: 474837 - DNA, 25 bp, Mus musculus
gagatcgtgtgcttttccaagtgcc

SEQ ID NO: 474838 - DNA, 25 bp, Mus musculus
gagatcgttcggcatggacgcaata

SEQ ID NO: 474839 - DNA, 25 bp, Mus musculus
gagatcgttcgggatggacgcaata

SEQ ID NO: 474840 - DNA, 25 bp, Mus musculus
gagatcgttggcattacagaccaca

SEQ ID NO: 474841 - DNA, 25 bp, Mus musculus
gagatcgttggctttacagaccaca

SEQ ID NO: 474842 - DNA, 25 bp, Mus musculus
gagatctaaagtctgtatgttgtac

SEQ ID NO: 474843 - DNA, 25 bp, Mus musculus
gagatctaaagtgtgtatgttgtac

SEQ ID NO: 474844 - DNA, 25 bp, Mus musculus
gagatctaagaactcactgatccat

SEQ ID NO: 474845 - DNA, 25 bp, Mus musculus
gagatctaagaagtcactgatccat

SEQ ID NO: 474846 - DNA, 25 bp, Mus musculus
gagatctaattcaggtacctaggtt

SEQ ID NO: 474847 - DNA, 25 bp, Mus musculus
gagatctaattctggtacctaggtt

SEQ ID NO: 474848 - DNA, 25 bp, Mus musculus
gagatctaattgacatggcttcatt

SEQ ID NO: 474849 - DNA, 25 bp, Mus musculus
gagatctaattgtcatggcttcatt

SEQ ID NO: 474850 - DNA, 25 bp, Mus musculus
gagatctacaagatgacccgtaaag

SEQ ID NO: 474851 - DNA, 25 bp, Mus musculus
gagatctacaagcacaatcggaacc

SEQ ID NO: 474852 - DNA, 25 bp, Mus musculus
gagatctacaaggacaatcggaacc

SEQ ID NO: 474853 - DNA, 25 bp, Mus musculus
gagatctacaagttgacccgtaaag

SEQ ID NO: 474854 - DNA, 25 bp, Mus musculus
gagatctacaggaccttcctggaga

SEQ ID NO: 474855 - DNA, 25 bp, Mus musculus
gagatctacaggtccttcctggaga

SEQ ID NO: 474856 - DNA, 25 bp, Mus musculus
gagatctacatgattctatcatcca

SEQ ID NO: 474857 - DNA, 25 bp, Mus musculus
gagatctacatgtttctatcatcca

SEQ ID NO: 474858 - DNA, 25 bp, Mus musculus
gagatctaccatctctacagctttg

SEQ ID NO: 474859 - DNA, 25 bp, Mus musculus
gagatctaccatgtctacagctttg

SEQ ID NO: 474860 - DNA, 25 bp, Mus musculus
gagatctacgtcaatctggacaagg

SEQ ID NO: 474861 - DNA, 25 bp, Mus musculus
gagatctacgtctatctggacaagg

SEQ ID NO: 474862 - DNA, 25 bp, Mus musculus
gagatctactctaggccattatagc

SEQ ID NO: 474863 - DNA, 25 bp, Mus musculus
gagatctactcttggccattatagc

SEQ ID NO: 474864 - DNA, 25 bp, Mus musculus
gagatctagttcagtggtaacatag

SEQ ID NO: 474865 - DNA, 25 bp, Mus musculus
gagatctagttctgtggtaacatag

SEQ ID NO: 474866 - DNA, 25 bp, Mus musculus
gagatctatgccagtgtggcccagc

SEQ ID NO: 474867 - DNA, 25 bp, Mus musculus
gagatctatgcctgtgtggcccagc

SEQ ID NO: 474868 - DNA, 25 bp, Mus musculus
gagatctatggtcttgttcagcgct

SEQ ID NO: 474869 - DNA, 25 bp, Mus musculus
gagatctatggtgttgttcagcgct

SEQ ID NO: 474870 - DNA, 25 bp, Mus musculus
gagatctattcaagcttatgcaaat

SEQ ID NO: 474871 - DNA, 25 bp, Mus musculus
gagatctattcatgcttatgcaaat

SEQ ID NO: 474872 - DNA, 25 bp, Mus musculus
gagatctcacccactggtgctgctg

SEQ ID NO: 474873 - DNA, 25 bp, Mus musculus
gagatctcaccctctggtgctgctg

SEQ ID NO: 474874 - DNA, 25 bp, Mus musculus
gagatctcacggcttagtcagttag

SEQ ID NO: 474875 - DNA, 25 bp, Mus musculus
gagatctcacgggttagtcagttag

SEQ ID NO: 474876 - DNA, 25 bp, Mus musculus
gagatctcacgtcaaccattacata

SEQ ID NO: 474877 - DNA, 25 bp, Mus musculus
gagatctcacgtgaaccattacata

SEQ ID NO: 474878 - DNA, 25 bp, Mus musculus
gagatctcacttcatttcacacaac

SEQ ID NO: 474879 - DNA, 25 bp, Mus musculus
gagatctcacttgatttcacacaac

SEQ ID NO: 474880 - DNA, 25 bp, Mus musculus
gagatctcagacatctatctgcatg

SEQ ID NO: 474881 - DNA, 25 bp, Mus musculus
gagatctcagacttctatctgcatg

SEQ ID NO: 474882 - DNA, 25 bp, Mus musculus
gagatctcagccattaagacttgtc

SEQ ID NO: 474883 - DNA, 25 bp, Mus musculus
gagatctcagcctttaagacttgtc

SEQ ID NO: 474884 - DNA, 25 bp, Mus musculus
gagatctcatctataacatattcac

SEQ ID NO: 474885 - DNA, 25 bp, Mus musculus
gagatctcatctttaacatattcac

SEQ ID NO: 474886 - DNA, 25 bp, Mus musculus
gagatctccaaaactaagccttcaa

SEQ ID NO: 474887 - DNA, 25 bp, Mus musculus
gagatctccaaatctaagccttcaa

SEQ ID NO: 474888 - DNA, 25 bp, Mus musculus
gagatctccaagctcaaggtttctt

SEQ ID NO: 474889 - DNA, 25 bp, Mus musculus
gagatctccaaggtcaaggtttctt

SEQ ID NO: 474890 - DNA, 25 bp, Mus musculus
gagatctccctcagttaagctgata

SEQ ID NO: 474891 - DNA, 25 bp, Mus musculus
gagatctccctctgttaagctgata

SEQ ID NO: 474892 - DNA, 25 bp, Mus musculus
gagatctcgcagagttttctacaga

SEQ ID NO: 474893 - DNA, 25 bp, Mus musculus
gagatctcgcagtgttttctacaga

SEQ ID NO: 474894 - DNA, 25 bp, Mus musculus
gagatctcgttgcataagatccctt

SEQ ID NO: 474895 - DNA, 25 bp, Mus musculus
gagatctcgttggataagatccctt

SEQ ID NO: 474896 - DNA, 25 bp, Mus musculus
gagatctctagaaaagtcgtttgaa

SEQ ID NO: 474897 - DNA, 25 bp, Mus musculus
gagatctctagataagtcgtttgaa

SEQ ID NO: 474898 - DNA, 25 bp, Mus musculus
gagatctctatgcaaaaactttctg

SEQ ID NO: 474899 - DNA, 25 bp, Mus musculus
gagatctctatggaaaaactttctg

SEQ ID NO: 474900 - DNA, 25 bp, Mus musculus
gagatctcttaaaggccatcttttt

SEQ ID NO: 474901 - DNA, 25 bp, Mus musculus
gagatctcttaatggccatcttttt

SEQ ID NO: 474902 - DNA, 25 bp, Mus musculus
gagatctcttgacagttttaaccct

SEQ ID NO: 474903 - DNA, 25 bp, Mus musculus
gagatctcttgagagttttaaccct

SEQ ID NO: 474904 - DNA, 25 bp, Mus musculus
gagatctgaacactgtgctgccttt

SEQ ID NO: 474905 - DNA, 25 bp, Mus musculus
gagatctgaacagtgtgctgccttt

SEQ ID NO: 474906 - DNA, 25 bp, Mus musculus
gagatctgaatcaacttgtgaagtt

SEQ ID NO: 474907 - DNA, 25 bp, Mus musculus
gagatctgaatctacttgtgaagtt

SEQ ID NO: 474908 - DNA, 25 bp, Mus musculus
gagatctgacaactcctgaggcaag

SEQ ID NO: 474909 - DNA, 25 bp, Mus musculus
gagatctgacaagtcctgaggcaag

SEQ ID NO: 474910 - DNA, 25 bp, Mus musculus
gagatctgactgattttccttcaca

SEQ ID NO: 474911 - DNA, 25 bp, Mus musculus
gagatctgactgtttttccttcaca

SEQ ID NO: 474912 - DNA, 25 bp, Mus musculus
gagatctgagagcagttcattcatt

SEQ ID NO: 474913 - DNA, 25 bp, Mus musculus
gagatctgagaggagttcattcatt

SEQ ID NO: 474914 - DNA, 25 bp, Mus musculus
gagatctgagccctgggtgtcccct

SEQ ID NO: 474915 - DNA, 25 bp, Mus musculus
gagatctgagccgtgggtgtcccct

SEQ ID NO: 474916 - DNA, 25 bp, Mus musculus
gagatctgaggacacagccctttat

SEQ ID NO: 474917 - DNA, 25 bp, Mus musculus
gagatctgaggagacagccctttat

SEQ ID NO: 474918 - DNA, 25 bp, Mus musculus
gagatctgattcagagctgtagctc

SEQ ID NO: 474919 - DNA, 25 bp, Mus musculus
gagatctgattctgagctgtagctc

SEQ ID NO: 474920 - DNA, 25 bp, Mus musculus
gagatctgatttcatctcctcacct

SEQ ID NO: 474921 - DNA, 25 bp, Mus musculus
gagatctgatttgatctcctcacct

SEQ ID NO: 474922 - DNA, 25 bp, Mus musculus
gagatctgcacacgactctctgtaa

SEQ ID NO: 474923 - DNA, 25 bp, Mus musculus
gagatctgcacaggactctctgtaa

SEQ ID NO: 474924 - DNA, 25 bp, Mus musculus
gagatctgccccatctactggaatt

SEQ ID NO: 474925 - DNA, 25 bp, Mus musculus
gagatctgccccatgtcatagagaa

SEQ ID NO: 474926 - DNA, 25 bp, Mus musculus
gagatctgccccttctactggaatt

SEQ ID NO: 474927 - DNA, 25 bp, Mus musculus
gagatctgccccttgtcatagagaa

SEQ ID NO: 474928 - DNA, 25 bp, Mus musculus
gagatctgcgtcagctgtatttttg

SEQ ID NO: 474929 - DNA, 25 bp, Mus musculus
gagatctgcgtctgctgtatttttg

SEQ ID NO: 474930 - DNA, 25 bp, Mus musculus
gagatctgctaaatgatggctatta

SEQ ID NO: 474931 - DNA, 25 bp, Mus musculus
gagatctgctaattgatggctatta

SEQ ID NO: 474932 - DNA, 25 bp, Mus musculus
gagatctgctatcgcctgaagccct

SEQ ID NO: 474933 - DNA, 25 bp, Mus musculus
gagatctgctatggcctgaagccct

SEQ ID NO: 474934 - DNA, 25 bp, Mus musculus
gagatctgcttgacggaggccttac

SEQ ID NO: 474935 - DNA, 25 bp, Mus musculus
gagatctgcttgtcggaggccttac

SEQ ID NO: 474936 - DNA, 25 bp, Mus musculus
gagatctggaaccatctttgataac

SEQ ID NO: 474937 - DNA, 25 bp, Mus musculus
gagatctggaacgatctttgataac

SEQ ID NO: 474938 - DNA, 25 bp, Mus musculus
gagatctggatcagctttgtatagc

SEQ ID NO: 474939 - DNA, 25 bp, Mus musculus
gagatctggatctgctttgtatagc

SEQ ID NO: 474940 - DNA, 25 bp, Mus musculus
gagatctggtgtccttgtcagtcta

SEQ ID NO: 474941 - DNA, 25 bp, Mus musculus
gagatctggtgtgcttgtcagtcta

SEQ ID NO: 474942 - DNA, 25 bp, Mus musculus
gagatctgtattattctacccggga

SEQ ID NO: 474943 - DNA, 25 bp, Mus musculus
gagatctgtattccgtgtacttttc

SEQ ID NO: 474944 - DNA, 25 bp, Mus musculus
gagatctgtattgcgtgtacttttc

SEQ ID NO: 474945 - DNA, 25 bp, Mus musculus
gagatctgtatttttctacccggga

SEQ ID NO: 474946 - DNA, 25 bp, Mus musculus
gagatctgtgatcaggtgaacctgc

SEQ ID NO: 474947 - DNA, 25 bp, Mus musculus
gagatctgtgatgaggtgaacctgc

SEQ ID NO: 474948 - DNA, 25 bp, Mus musculus
gagatctgtgtcaatgtgctcaaga

SEQ ID NO: 474949 - DNA, 25 bp, Mus musculus
gagatctgtgtctatgtgctcaaga

SEQ ID NO: 474950 - DNA, 25 bp, Mus musculus
gagatcttaacactctgatgggtaa

SEQ ID NO: 474951 - DNA, 25 bp, Mus musculus
gagatcttaacagtctgatgggtaa

SEQ ID NO: 474952 - DNA, 25 bp, Mus musculus
gagatcttagtgagggtaaaggcac

SEQ ID NO: 474953 - DNA, 25 bp, Mus musculus
gagatcttagtgtgggtaaaggcac

SEQ ID NO: 474954 - DNA, 25 bp, Mus musculus
gagatcttcacactctttactttgt

SEQ ID NO: 474955 - DNA, 25 bp, Mus musculus
gagatcttcacagtctttactttgt

SEQ ID NO: 474956 - DNA, 25 bp, Mus musculus
gagatcttccgcagagcagcaagga

SEQ ID NO: 474957 - DNA, 25 bp, Mus musculus
gagatcttccgctgagcagcaagga

SEQ ID NO: 474958 - DNA, 25 bp, Mus musculus
gagatcttctacaatgctactggct

SEQ ID NO: 474959 - DNA, 25 bp, Mus musculus
gagatcttctacacactgtctcctg

SEQ ID NO: 474960 - DNA, 25 bp, Mus musculus
gagatcttctactatgctactggct

SEQ ID NO: 474961 - DNA, 25 bp, Mus musculus
gagatcttctactcactgtctcctg

SEQ ID NO: 474962 - DNA, 25 bp, Mus musculus
gagatcttctccagttaaaacgcac

SEQ ID NO: 474963 - DNA, 25 bp, Mus musculus
gagatcttctcctgttaaaacgcac

SEQ ID NO: 474964 - DNA, 25 bp, Mus musculus
gagatcttcttgacgctccagttcg

SEQ ID NO: 474965 - DNA, 25 bp, Mus musculus
gagatcttcttgtcgctccagttcg

SEQ ID NO: 474966 - DNA, 25 bp, Mus musculus
gagatcttctttacaggcctccatc

SEQ ID NO: 474967 - DNA, 25 bp, Mus musculus
gagatcttcttttcaggcctccatc

SEQ ID NO: 474968 - DNA, 25 bp, Mus musculus
gagatcttgaacagtattgcttgaa

SEQ ID NO: 474969 - DNA, 25 bp, Mus musculus
gagatcttgaactgtattgcttgaa

SEQ ID NO: 474970 - DNA, 25 bp, Mus musculus
gagatcttgaccattgatttccaca

SEQ ID NO: 474971 - DNA, 25 bp, Mus musculus
gagatcttgacctttgatttccaca

SEQ ID NO: 474972 - DNA, 25 bp, Mus musculus
gagatcttgactatcagtgtccaga

SEQ ID NO: 474973 - DNA, 25 bp, Mus musculus
gagatcttgactttcagtgtccaga

SEQ ID NO: 474974 - DNA, 25 bp, Mus musculus
gagatcttgatgatcaggatggtga

SEQ ID NO: 474975 - DNA, 25 bp, Mus musculus
gagatcttgatgttcaggatggtga

SEQ ID NO: 474976 - DNA, 25 bp, Mus musculus
gagatcttgccaagtcttgttagca

SEQ ID NO: 474977 - DNA, 25 bp, Mus musculus
gagatcttgccatgtcttgttagca

SEQ ID NO: 474978 - DNA, 25 bp, Mus musculus
gagatcttgcttctctaaagtgaga

SEQ ID NO: 474979 - DNA, 25 bp, Mus musculus
gagatcttgcttgtctaaagtgaga

SEQ ID NO: 474980 - DNA, 25 bp, Mus musculus
gagatcttgtaacctgttctgtaat

SEQ ID NO: 474981 - DNA, 25 bp, Mus musculus
gagatcttgtaagctgttctgtaat

SEQ ID NO: 474982 - DNA, 25 bp, Mus musculus
gagatcttgtctcaccctgaatatc

SEQ ID NO: 474983 - DNA, 25 bp, Mus musculus
gagatcttgtctgaccctgaatatc

SEQ ID NO: 474984 - DNA, 25 bp, Mus musculus
gagatctttgatctttttaccgaca

SEQ ID NO: 474985 - DNA, 25 bp, Mus musculus
gagatctttgatgtttttaccgaca

SEQ ID NO: 474986 - DNA, 25 bp, Mus musculus
gagatctttgcaaaggtgtccaagc

SEQ ID NO: 474987 - DNA, 25 bp, Mus musculus
gagatctttgcataggtgtccaagc

SEQ ID NO: 474988 - DNA, 25 bp, Mus musculus
gagatcttttctcatcagtgccctt

SEQ ID NO: 474989 - DNA, 25 bp, Mus musculus
gagatcttttctgatcagtgccctt

SEQ ID NO: 474990 - DNA, 25 bp, Mus musculus
gagatgaaacacaaccaggaccaga

SEQ ID NO: 474991 - DNA, 25 bp, Mus musculus
gagatgaaacacaccagctattttt

SEQ ID NO: 474992 - DNA, 25 bp, Mus musculus
gagatgaaacactaccaggaccaga

SEQ ID NO: 474993 - DNA, 25 bp, Mus musculus
gagatgaaacactccagctattttt

SEQ ID NO: 474994 - DNA, 25 bp, Mus musculus
gagatgaaacctattaaaacagagc

SEQ ID NO: 474995 - DNA, 25 bp, Mus musculus
gagatgaaaccttttaaaacagagc

SEQ ID NO: 474996 - DNA, 25 bp, Mus musculus
gagatgaaactgctccgtacaggaa

SEQ ID NO: 474997 - DNA, 25 bp, Mus musculus
gagatgaaactggtccgtacaggaa

SEQ ID NO: 474998 - DNA, 25 bp, Mus musculus
gagatgaaagccaccagtcctggcg

SEQ ID NO: 474999 - DNA, 25 bp, Mus musculus
gagatgaaagcctccagtcctggcg

SEQ ID NO: 475000 - DNA, 25 bp, Mus musculus
gagatgaaatatcaacaactgttta

SEQ ID NO: 475001 - DNA, 25 bp, Mus musculus
gagatgaaatatgaacaactgttta

SEQ ID NO: 475002 - DNA, 25 bp, Mus musculus
gagatgaaccaaccctggacttcct

SEQ ID NO: 475003 - DNA, 25 bp, Mus musculus
gagatgaaccaagcctggacttcct

SEQ ID NO: 475004 - DNA, 25 bp, Mus musculus
gagatgaaccagaagcatgtaatgc

SEQ ID NO: 475005 - DNA, 25 bp, Mus musculus
gagatgaaccagtagcatgtaatgc

SEQ ID NO: 475006 - DNA, 25 bp, Mus musculus
gagatgaaccatcgctccaacgaat

SEQ ID NO: 475007 - DNA, 25 bp, Mus musculus
gagatgaaccatggctccaacgaat

SEQ ID NO: 475008 - DNA, 25 bp, Mus musculus
gagatgaacctactacattgtgaat

SEQ ID NO: 475009 - DNA, 25 bp, Mus musculus
gagatgaacctagtacattgtgaat

SEQ ID NO: 475010 - DNA, 25 bp, Mus musculus
gagatgaacctgcagatagtggaca

SEQ ID NO: 475011 - DNA, 25 bp, Mus musculus
gagatgaacctggagatagtggaca

SEQ ID NO: 475012 - DNA, 25 bp, Mus musculus
gagatgaagaccattgtccttctta

SEQ ID NO: 475013 - DNA, 25 bp, Mus musculus
gagatgaagacctttgtccttctta

SEQ ID NO: 475014 - DNA, 25 bp, Mus musculus
gagatgaagccaagcagcctcctac

SEQ ID NO: 475015 - DNA, 25 bp, Mus musculus
gagatgaagccatgcagcctcctac

SEQ ID NO: 475016 - DNA, 25 bp, Mus musculus
gagatgaagcgaatgcagcctgcag

SEQ ID NO: 475017 - DNA, 25 bp, Mus musculus
gagatgaagcgattgcagcctgcag

SEQ ID NO: 475018 - DNA, 25 bp, Mus musculus
gagatgaaggcaatgctgtcctact

SEQ ID NO: 475019 - DNA, 25 bp, Mus musculus
gagatgaaggcattgctgtcctact

SEQ ID NO: 475020 - DNA, 25 bp, Mus musculus
gagatgaaggtcaactgctctgagg

SEQ ID NO: 475021 - DNA, 25 bp, Mus musculus
gagatgaaggtctactgctctgagg

SEQ ID NO: 475022 - DNA, 25 bp, Mus musculus
gagatgaagttccaaaaggcacctt

SEQ ID NO: 475023 - DNA, 25 bp, Mus musculus
gagatgaagttcgaaaaggcacctt

SEQ ID NO: 475024 - DNA, 25 bp, Mus musculus
gagatgaatacaaagggtgtcctaa

SEQ ID NO: 475025 - DNA, 25 bp, Mus musculus
gagatgaatacatagggtgtcctaa

SEQ ID NO: 475026 - DNA, 25 bp, Mus musculus
gagatgaatatgacgtctgtgccat

SEQ ID NO: 475027 - DNA, 25 bp, Mus musculus
gagatgaatatgtcgtctgtgccat

SEQ ID NO: 475028 - DNA, 25 bp, Mus musculus
gagatgaatggcatttagtttacct

SEQ ID NO: 475029 - DNA, 25 bp, Mus musculus
gagatgaatggcttttagtttacct

SEQ ID NO: 475030 - DNA, 25 bp, Mus musculus
gagatgaattctccacagatcctta

SEQ ID NO: 475031 - DNA, 25 bp, Mus musculus
gagatgaattctgcacagatcctta

SEQ ID NO: 475032 - DNA, 25 bp, Mus musculus
gagatgacaggacgttcaattccaa

SEQ ID NO: 475033 - DNA, 25 bp, Mus musculus
gagatgacaggaggttcaattccaa

SEQ ID NO: 475034 - DNA, 25 bp, Mus musculus
gagatgacatcaacccatacacttc

SEQ ID NO: 475035 - DNA, 25 bp, Mus musculus
gagatgacatcatcccatacacttc

SEQ ID NO: 475036 - DNA, 25 bp, Mus musculus
gagatgacatgcacaacttgtaaat

SEQ ID NO: 475037 - DNA, 25 bp, Mus musculus
gagatgacatgctcaacttgtaaat

SEQ ID NO: 475038 - DNA, 25 bp, Mus musculus
gagatgacatttcgttttttacacg

SEQ ID NO: 475039 - DNA, 25 bp, Mus musculus
gagatgacatttggttttttacacg

SEQ ID NO: 475040 - DNA, 25 bp, Mus musculus
gagatgaccaacacaatgcgtgggt

SEQ ID NO: 475041 - DNA, 25 bp, Mus musculus
gagatgaccaactcaatgcgtgggt

SEQ ID NO: 475042 - DNA, 25 bp, Mus musculus
gagatgaccatcaggaacgcctcca

SEQ ID NO: 475043 - DNA, 25 bp, Mus musculus
gagatgaccatctggaacgcctcca

SEQ ID NO: 475044 - DNA, 25 bp, Mus musculus
gagatgacccatcccaggtccagca

SEQ ID NO: 475045 - DNA, 25 bp, Mus musculus
gagatgacccatgccaggtccagca

SEQ ID NO: 475046 - DNA, 25 bp, Mus musculus
gagatgaccccaagtgtaaagccct

SEQ ID NO: 475047 - DNA, 25 bp, Mus musculus
gagatgaccccatgtgtaaagccct

SEQ ID NO: 475048 - DNA, 25 bp, Mus musculus
gagatgacccctctactattgagaa

SEQ ID NO: 475049 - DNA, 25 bp, Mus musculus
gagatgacccctgtactattgagaa

SEQ ID NO: 475050 - DNA, 25 bp, Mus musculus
gagatgaccctcagcaacatgtgga

SEQ ID NO: 475051 - DNA, 25 bp, Mus musculus
gagatgaccctctgcaacatgtgga

SEQ ID NO: 475052 - DNA, 25 bp, Mus musculus
gagatgactacacttgacctctccc

SEQ ID NO: 475053 - DNA, 25 bp, Mus musculus
gagatgactacagttgacctctccc

SEQ ID NO: 475054 - DNA, 25 bp, Mus musculus
gagatgactactacagaatcctatt

SEQ ID NO: 475055 - DNA, 25 bp, Mus musculus
gagatgactacttcagaatcctatt

SEQ ID NO: 475056 - DNA, 25 bp, Mus musculus
gagatgactattctaatttcgtcta

SEQ ID NO: 475057 - DNA, 25 bp, Mus musculus
gagatgactattgtaatttcgtcta

SEQ ID NO: 475058 - DNA, 25 bp, Mus musculus
gagatgactcaacctctgttctaag

SEQ ID NO: 475059 - DNA, 25 bp, Mus musculus
gagatgactcaagctctgttctaag

SEQ ID NO: 475060 - DNA, 25 bp, Mus musculus
gagatgactcacaattaaagatact

SEQ ID NO: 475061 - DNA, 25 bp, Mus musculus
gagatgactcacatttacagttgat

SEQ ID NO: 475062 - DNA, 25 bp, Mus musculus
gagatgactcactattaaagatact

SEQ ID NO: 475063 - DNA, 25 bp, Mus musculus
gagatgactcacttttacagttgat

SEQ ID NO: 475064 - DNA, 25 bp, Mus musculus
gagatgactcggagttcacccatga

SEQ ID NO: 475065 - DNA, 25 bp, Mus musculus
gagatgactcggtgttcacccatga

SEQ ID NO: 475066 - DNA, 25 bp, Mus musculus
gagatgactggaacccatgctgtgg

SEQ ID NO: 475067 - DNA, 25 bp, Mus musculus
gagatgactggatcccatgctgtgg

SEQ ID NO: 475068 - DNA, 25 bp, Mus musculus
gagatgactgtgatgccatttgata

SEQ ID NO: 475069 - DNA, 25 bp, Mus musculus
gagatgactgtgttgccatttgata

SEQ ID NO: 475070 - DNA, 25 bp, Mus musculus
gagatgactttcaggaaccttttat

SEQ ID NO: 475071 - DNA, 25 bp, Mus musculus
gagatgactttctggaaccttttat

SEQ ID NO: 475072 - DNA, 25 bp, Mus musculus
gagatgagaaatagcccctacacac

SEQ ID NO: 475073 - DNA, 25 bp, Mus musculus
gagatgagaaattgcccctacacac

SEQ ID NO: 475074 - DNA, 25 bp, Mus musculus
gagatgagaaccctgctgttaccca

SEQ ID NO: 475075 - DNA, 25 bp, Mus musculus
gagatgagaaccgtgctgttaccca

SEQ ID NO: 475076 - DNA, 25 bp, Mus musculus
gagatgagactgcacaaatatcctg

SEQ ID NO: 475077 - DNA, 25 bp, Mus musculus
gagatgagactggacaaatatcctg

SEQ ID NO: 475078 - DNA, 25 bp, Mus musculus
gagatgagatctacggtagcccaaa

SEQ ID NO: 475079 - DNA, 25 bp, Mus musculus
gagatgagatcttcggtagcccaaa

SEQ ID NO: 475080 - DNA, 25 bp, Mus musculus
gagatgagatgtacacggctccctt

SEQ ID NO: 475081 - DNA, 25 bp, Mus musculus
gagatgagatgttcacggctccctt

SEQ ID NO: 475082 - DNA, 25 bp, Mus musculus
gagatgagcaaacagcccctcctat

SEQ ID NO: 475083 - DNA, 25 bp, Mus musculus
gagatgagcaaagagcccctcctat

SEQ ID NO: 475084 - DNA, 25 bp, Mus musculus
gagatgagccagaagtgaccctcct

SEQ ID NO: 475085 - DNA, 25 bp, Mus musculus
gagatgagccagagtgaggctttaa

SEQ ID NO: 475086 - DNA, 25 bp, Mus musculus
gagatgagccagtagtgaccctcct

SEQ ID NO: 475087 - DNA, 25 bp, Mus musculus
gagatgagccagtgtgaggctttaa

SEQ ID NO: 475088 - DNA, 25 bp, Mus musculus
gagatgagccgtccctaaagcaagg

SEQ ID NO: 475089 - DNA, 25 bp, Mus musculus
gagatgagccgtgcctaaagcaagg

SEQ ID NO: 475090 - DNA, 25 bp, Mus musculus
gagatgagctctatggatccacaga

SEQ ID NO: 475091 - DNA, 25 bp, Mus musculus
gagatgagctctttggatccacaga

SEQ ID NO: 475092 - DNA, 25 bp, Mus musculus
gagatgagctgcacgccccccaagg

SEQ ID NO: 475093 - DNA, 25 bp, Mus musculus
gagatgagctgctcgccccccaagg

SEQ ID NO: 475094 - DNA, 25 bp, Mus musculus
gagatgagctttctttccagtttag

SEQ ID NO: 475095 - DNA, 25 bp, Mus musculus
gagatgagctttgtttccagtttag

SEQ ID NO: 475096 - DNA, 25 bp, Mus musculus
gagatgaggacactcctgtacttaa

SEQ ID NO: 475097 - DNA, 25 bp, Mus musculus
gagatgaggacagtcctgtacttaa

SEQ ID NO: 475098 - DNA, 25 bp, Mus musculus
gagatgaggcataccgggcatttgt

SEQ ID NO: 475099 - DNA, 25 bp, Mus musculus
gagatgaggcatcggtttagacaac

SEQ ID NO: 475100 - DNA, 25 bp, Mus musculus
gagatgaggcatgggtttagacaac

SEQ ID NO: 475101 - DNA, 25 bp, Mus musculus
gagatgaggcattccgggcatttgt

SEQ ID NO: 475102 - DNA, 25 bp, Mus musculus
gagatgaggcgaacaaggacaagaa

SEQ ID NO: 475103 - DNA, 25 bp, Mus musculus
gagatgaggcgatcaaggacaagaa

SEQ ID NO: 475104 - DNA, 25 bp, Mus musculus
gagatgagggatctctgctccaacc

SEQ ID NO: 475105 - DNA, 25 bp, Mus musculus
gagatgagggatgtctgctccaacc

SEQ ID NO: 475106 - DNA, 25 bp, Mus musculus
gagatgagggtaagaccattgcaat

SEQ ID NO: 475107 - DNA, 25 bp, Mus musculus
gagatgagggtatgaccattgcaat

SEQ ID NO: 475108 - DNA, 25 bp, Mus musculus
gagatgagtcagagcaccacttggg

SEQ ID NO: 475109 - DNA, 25 bp, Mus musculus
gagatgagtcagtgcaccacttggg

SEQ ID NO: 475110 - DNA, 25 bp, Mus musculus
gagatgagtggacgcaaaaacattt

SEQ ID NO: 475111 - DNA, 25 bp, Mus musculus
gagatgagtggaggcaaaaacattt

SEQ ID NO: 475112 - DNA, 25 bp, Mus musculus
gagatgagtgtcctcttctcagttc

SEQ ID NO: 475113 - DNA, 25 bp, Mus musculus
gagatgagtgtcgtcttctcagttc

SEQ ID NO: 475114 - DNA, 25 bp, Mus musculus
gagatgataaacacttcttccatga

SEQ ID NO: 475115 - DNA, 25 bp, Mus musculus
gagatgataaactcttcttccatga

SEQ ID NO: 475116 - DNA, 25 bp, Mus musculus
gagatgataatcctgctgctgtaaa

SEQ ID NO: 475117 - DNA, 25 bp, Mus musculus
gagatgataatcgtgctgctgtaaa

SEQ ID NO: 475118 - DNA, 25 bp, Mus musculus
gagatgatacatatggatgaaacca

SEQ ID NO: 475119 - DNA, 25 bp, Mus musculus
gagatgatacatttggatgaaacca

SEQ ID NO: 475120 - DNA, 25 bp, Mus musculus
gagatgatacgtcagtgcaagctct

SEQ ID NO: 475121 - DNA, 25 bp, Mus musculus
gagatgatacgtgagtgcaagctct

SEQ ID NO: 475122 - DNA, 25 bp, Mus musculus
gagatgatagcacctcactgactgc

SEQ ID NO: 475123 - DNA, 25 bp, Mus musculus
gagatgatagcagctcactgactgc

SEQ ID NO: 475124 - DNA, 25 bp, Mus musculus
gagatgatagttccagatccctggg

SEQ ID NO: 475125 - DNA, 25 bp, Mus musculus
gagatgatagttgcagatccctggg

SEQ ID NO: 475126 - DNA, 25 bp, Mus musculus
gagatgatatcaagctccagctgga

SEQ ID NO: 475127 - DNA, 25 bp, Mus musculus
gagatgatatcatgctccagctgga

SEQ ID NO: 475128 - DNA, 25 bp, Mus musculus
gagatgatattaaccggcgctacga

SEQ ID NO: 475129 - DNA, 25 bp, Mus musculus
gagatgatattatccggcgctacga

SEQ ID NO: 475130 - DNA, 25 bp, Mus musculus
gagatgatcagcactgaagctaaac

SEQ ID NO: 475131 - DNA, 25 bp, Mus musculus
gagatgatcagcatggccacacagc

SEQ ID NO: 475132 - DNA, 25 bp, Mus musculus
gagatgatcagctctgaagctaaac

SEQ ID NO: 475133 - DNA, 25 bp, Mus musculus
gagatgatcagcttggccacacagc

SEQ ID NO: 475134 - DNA, 25 bp, Mus musculus
gagatgatcctgatggcatgagaac

SEQ ID NO: 475135 - DNA, 25 bp, Mus musculus
gagatgatcctgttggcatgagaac

SEQ ID NO: 475136 - DNA, 25 bp, Mus musculus
gagatgatcgggacagtgagccaaa

SEQ ID NO: 475137 - DNA, 25 bp, Mus musculus
gagatgatcgggtcagtgagccaaa

SEQ ID NO: 475138 - DNA, 25 bp, Mus musculus
gagatgatctagacccagagagacc

SEQ ID NO: 475139 - DNA, 25 bp, Mus musculus
gagatgatctagtcccagagagacc

SEQ ID NO: 475140 - DNA, 25 bp, Mus musculus
gagatgatgattcgccaacgtgaga

SEQ ID NO: 475141 - DNA, 25 bp, Mus musculus
gagatgatgattggccaacgtgaga

SEQ ID NO: 475142 - DNA, 25 bp, Mus musculus
gagatgatgtccacgtctggtgtgt

SEQ ID NO: 475143 - DNA, 25 bp, Mus musculus
gagatgatgtcctcgtctggtgtgt

SEQ ID NO: 475144 - DNA, 25 bp, Mus musculus
gagatgattctacctcccgcttgga

SEQ ID NO: 475145 - DNA, 25 bp, Mus musculus
gagatgattctagctcccgcttgga

SEQ ID NO: 475146 - DNA, 25 bp, Mus musculus
gagatgattctgaagccttcacatg

SEQ ID NO: 475147 - DNA, 25 bp, Mus musculus
gagatgattctgctgctaatttctt

SEQ ID NO: 475148 - DNA, 25 bp, Mus musculus
gagatgattctggtgctaatttctt

SEQ ID NO: 475149 - DNA, 25 bp, Mus musculus
gagatgattctgtagccttcacatg

SEQ ID NO: 475150 - DNA, 25 bp, Mus musculus
gagatgattgcaaattcttcctctt

SEQ ID NO: 475151 - DNA, 25 bp, Mus musculus
gagatgattgcatattcttcctctt

SEQ ID NO: 475152 - DNA, 25 bp, Mus musculus
gagatgattgtcaggctctgtcccc

SEQ ID NO: 475153 - DNA, 25 bp, Mus musculus
gagatgattgtctggctctgtcccc

SEQ ID NO: 475154 - DNA, 25 bp, Mus musculus
gagatgcaaaacctgcttcaagcaa

SEQ ID NO: 475155 - DNA, 25 bp, Mus musculus
gagatgcaaaacgtgcttcaagcaa

SEQ ID NO: 475156 - DNA, 25 bp, Mus musculus
gagatgcaacacacaggctccagtt

SEQ ID NO: 475157 - DNA, 25 bp, Mus musculus
gagatgcaacactcaggctccagtt

SEQ ID NO: 475158 - DNA, 25 bp, Mus musculus
gagatgcaacatatgtgactctgtt

SEQ ID NO: 475159 - DNA, 25 bp, Mus musculus
gagatgcaacatccactacacaggt

SEQ ID NO: 475160 - DNA, 25 bp, Mus musculus
gagatgcaacatgcactacacaggt

SEQ ID NO: 475161 - DNA, 25 bp, Mus musculus
gagatgcaacatttgtgactctgtt

SEQ ID NO: 475162 - DNA, 25 bp, Mus musculus
gagatgcaagtgaggcctcctaggc

SEQ ID NO: 475163 - DNA, 25 bp, Mus musculus
gagatgcaagtgtggcctcctaggc

SEQ ID NO: 475164 - DNA, 25 bp, Mus musculus
gagatgcacaagatctctcggtcca

SEQ ID NO: 475165 - DNA, 25 bp, Mus musculus
gagatgcacaagttctctcggtcca

SEQ ID NO: 475166 - DNA, 25 bp, Mus musculus
gagatgcacacaagccacagtaccc

SEQ ID NO: 475167 - DNA, 25 bp, Mus musculus
gagatgcacacatgccacagtaccc

SEQ ID NO: 475168 - DNA, 25 bp, Mus musculus
gagatgcacacgagccggtgaccat

SEQ ID NO: 475169 - DNA, 25 bp, Mus musculus
gagatgcacacgtgccggtgaccat

SEQ ID NO: 475170 - DNA, 25 bp, Mus musculus
gagatgcacaggagtaagccagcac

SEQ ID NO: 475171 - DNA, 25 bp, Mus musculus
gagatgcacaggtgtaagccagcac

SEQ ID NO: 475172 - DNA, 25 bp, Mus musculus
gagatgcactagagggacacagctg

SEQ ID NO: 475173 - DNA, 25 bp, Mus musculus
gagatgcactagtgggacacagctg

SEQ ID NO: 475174 - DNA, 25 bp, Mus musculus
gagatgcactctcaaccggaagcct

SEQ ID NO: 475175 - DNA, 25 bp, Mus musculus
gagatgcactctgaaccggaagcct

SEQ ID NO: 475176 - DNA, 25 bp, Mus musculus
gagatgcacttgaaagagatccaat

SEQ ID NO: 475177 - DNA, 25 bp, Mus musculus
gagatgcacttgtaagagatccaat

SEQ ID NO: 475178 - DNA, 25 bp, Mus musculus
gagatgcagcatcaggctcttcccc

SEQ ID NO: 475179 - DNA, 25 bp, Mus musculus
gagatgcagcatgaggctcttcccc

SEQ ID NO: 475180 - DNA, 25 bp, Mus musculus
gagatgcagccaattcaccatagaa

SEQ ID NO: 475181 - DNA, 25 bp, Mus musculus
gagatgcagccatttcaccatagaa

SEQ ID NO: 475182 - DNA, 25 bp, Mus musculus
gagatgcagcctattgtcacagaca

SEQ ID NO: 475183 - DNA, 25 bp, Mus musculus
gagatgcagccttttgtcacagaca

SEQ ID NO: 475184 - DNA, 25 bp, Mus musculus
gagatgcaggttccgtgcagacttc

SEQ ID NO: 475185 - DNA, 25 bp, Mus musculus
gagatgcaggttgcgtgcagacttc

SEQ ID NO: 475186 - DNA, 25 bp, Mus musculus
gagatgcagttgctgcccaaggtgc

SEQ ID NO: 475187 - DNA, 25 bp, Mus musculus
gagatgcagttggtgcccaaggtgc

SEQ ID NO: 475188 - DNA, 25 bp, Mus musculus
gagatgcataagcatcgagccaaga

SEQ ID NO: 475189 - DNA, 25 bp, Mus musculus
gagatgcataaggatcgagccaaga

SEQ ID NO: 475190 - DNA, 25 bp, Mus musculus
gagatgcatagccatgttgatccat

SEQ ID NO: 475191 - DNA, 25 bp, Mus musculus
gagatgcatagcgatgttgatccat

SEQ ID NO: 475192 - DNA, 25 bp, Mus musculus
gagatgcatattcttacctaaaaac

SEQ ID NO: 475193 - DNA, 25 bp, Mus musculus
gagatgcatattgttacctaaaaac

SEQ ID NO: 475194 - DNA, 25 bp, Mus musculus
gagatgcatctccacaaacagcaga

SEQ ID NO: 475195 - DNA, 25 bp, Mus musculus
gagatgcatctcgacaaacagcaga

SEQ ID NO: 475196 - DNA, 25 bp, Mus musculus
gagatgcatcttcgcctggcatgca

SEQ ID NO: 475197 - DNA, 25 bp, Mus musculus
gagatgcatcttggcctggcatgca

SEQ ID NO: 475198 - DNA, 25 bp, Mus musculus
gagatgcatttgcttatgtccaaga

SEQ ID NO: 475199 - DNA, 25 bp, Mus musculus
gagatgcatttggttatgtccaaga

SEQ ID NO: 475200 - DNA, 25 bp, Mus musculus
gagatgccaaaaaagaaatgtcacc

SEQ ID NO: 475201 - DNA, 25 bp, Mus musculus
gagatgccaaaatagaaatgtcacc

SEQ ID NO: 475202 - DNA, 25 bp, Mus musculus
gagatgccagacaatcacgtctaaa

SEQ ID NO: 475203 - DNA, 25 bp, Mus musculus
gagatgccagacagataccttaccc

SEQ ID NO: 475204 - DNA, 25 bp, Mus musculus
gagatgccagactatcacgtctaaa

SEQ ID NO: 475205 - DNA, 25 bp, Mus musculus
gagatgccagactgataccttaccc

SEQ ID NO: 475206 - DNA, 25 bp, Mus musculus
gagatgccagcacctcaatgggtgt

SEQ ID NO: 475207 - DNA, 25 bp, Mus musculus
gagatgccagcagctcaatgggtgt

SEQ ID NO: 475208 - DNA, 25 bp, Mus musculus
gagatgccaggcatttattagtaaa

SEQ ID NO: 475209 - DNA, 25 bp, Mus musculus
gagatgccaggcttttattagtaaa

SEQ ID NO: 475210 - DNA, 25 bp, Mus musculus
gagatgccagtgataaacaacaggg

SEQ ID NO: 475211 - DNA, 25 bp, Mus musculus
gagatgccagtgttaaacaacaggg

SEQ ID NO: 475212 - DNA, 25 bp, Mus musculus
gagatgccatacagagatcgcatag

SEQ ID NO: 475213 - DNA, 25 bp, Mus musculus
gagatgccatactgagatcgcatag

SEQ ID NO: 475214 - DNA, 25 bp, Mus musculus
gagatgccattaatacttccttcat

SEQ ID NO: 475215 - DNA, 25 bp, Mus musculus
gagatgccattattacttccttcat

SEQ ID NO: 475216 - DNA, 25 bp, Mus musculus
gagatgcccaatctgcaaatgcaat

SEQ ID NO: 475217 - DNA, 25 bp, Mus musculus
gagatgcccaatgtgcaaatgcaat

SEQ ID NO: 475218 - DNA, 25 bp, Mus musculus
gagatgcccactcgagcgaggacca

SEQ ID NO: 475219 - DNA, 25 bp, Mus musculus
gagatgcccactggagcgaggacca

SEQ ID NO: 475220 - DNA, 25 bp, Mus musculus
gagatgcccagaccgctatccagga

SEQ ID NO: 475221 - DNA, 25 bp, Mus musculus
gagatgcccagagcgctatccagga

SEQ ID NO: 475222 - DNA, 25 bp, Mus musculus
gagatgcccagcaggaaaagccatg

SEQ ID NO: 475223 - DNA, 25 bp, Mus musculus
gagatgcccagctggaaaagccatg

SEQ ID NO: 475224 - DNA, 25 bp, Mus musculus
gagatgccccttaataagacattac

SEQ ID NO: 475225 - DNA, 25 bp, Mus musculus
gagatgcccctttataagacattac

SEQ ID NO: 475226 - DNA, 25 bp, Mus musculus
gagatgccctccatatagcaccatg

SEQ ID NO: 475227 - DNA, 25 bp, Mus musculus
gagatgccctccttatagcaccatg

SEQ ID NO: 475228 - DNA, 25 bp, Mus musculus
gagatgcctcaaagggctattccct

SEQ ID NO: 475229 - DNA, 25 bp, Mus musculus
gagatgcctcaatgggctattccct

SEQ ID NO: 475230 - DNA, 25 bp, Mus musculus
gagatgcctcagatcaaacaacggt

SEQ ID NO: 475231 - DNA, 25 bp, Mus musculus
gagatgcctcagttcaaacaacggt

SEQ ID NO: 475232 - DNA, 25 bp, Mus musculus
gagatgcctcataagcgtgtggaga

SEQ ID NO: 475233 - DNA, 25 bp, Mus musculus
gagatgcctcattagcgtgtggaga

SEQ ID NO: 475234 - DNA, 25 bp, Mus musculus
gagatgcctctcctttctgacgata

SEQ ID NO: 475235 - DNA, 25 bp, Mus musculus
gagatgcctctcgtttctgacgata

SEQ ID NO: 475236 - DNA, 25 bp, Mus musculus
gagatgcctgaacttctggcagtct

SEQ ID NO: 475237 - DNA, 25 bp, Mus musculus
gagatgcctgaagttctggcagtct

SEQ ID NO: 475238 - DNA, 25 bp, Mus musculus
gagatgcctgcaaagatgggagccc

SEQ ID NO: 475239 - DNA, 25 bp, Mus musculus
gagatgcctgcatagatgggagccc

SEQ ID NO: 475240 - DNA, 25 bp, Mus musculus
gagatgcctgctagaatgtgttcac

SEQ ID NO: 475241 - DNA, 25 bp, Mus musculus
gagatgcctgcttgaatgtgttcac

SEQ ID NO: 475242 - DNA, 25 bp, Mus musculus
gagatgcctgtaaagtactctggag

SEQ ID NO: 475243 - DNA, 25 bp, Mus musculus
gagatgcctgtatagtactctggag

SEQ ID NO: 475244 - DNA, 25 bp, Mus musculus
gagatgcctgtcaagagcgtccagc

SEQ ID NO: 475245 - DNA, 25 bp, Mus musculus
gagatgcctgtctagagcgtccagc

SEQ ID NO: 475246 - DNA, 25 bp, Mus musculus
gagatgcgacagatcttcactgtgg

SEQ ID NO: 475247 - DNA, 25 bp, Mus musculus
gagatgcgacagttcttcactgtgg

SEQ ID NO: 475248 - DNA, 25 bp, Mus musculus
gagatgcgagttaactcccttcttt

SEQ ID NO: 475249 - DNA, 25 bp, Mus musculus
gagatgcgagtttactcccttcttt

SEQ ID NO: 475250 - DNA, 25 bp, Mus musculus
gagatgcgccatccagtgcatgagt

SEQ ID NO: 475251 - DNA, 25 bp, Mus musculus
gagatgcgccatgcagtgcatgagt

SEQ ID NO: 475252 - DNA, 25 bp, Mus musculus
gagatgcgctcaaaccgaatgtcaa

SEQ ID NO: 475253 - DNA, 25 bp, Mus musculus
gagatgcgctcataccgaatgtcaa

SEQ ID NO: 475254 - DNA, 25 bp, Mus musculus
gagatgctaacacaaaggaccccag

SEQ ID NO: 475255 - DNA, 25 bp, Mus musculus
gagatgctaacagaaaggaccccag

SEQ ID NO: 475256 - DNA, 25 bp, Mus musculus
gagatgctacatacaaacttcgctg

SEQ ID NO: 475257 - DNA, 25 bp, Mus musculus
gagatgctacattcaaacttcgctg

SEQ ID NO: 475258 - DNA, 25 bp, Mus musculus
gagatgctagatcctcttgattcct

SEQ ID NO: 475259 - DNA, 25 bp, Mus musculus
gagatgctagatgctcttgattcct

SEQ ID NO: 475260 - DNA, 25 bp, Mus musculus
gagatgctagcaccagtaagtctga

SEQ ID NO: 475261 - DNA, 25 bp, Mus musculus
gagatgctagcagcagtaagtctga

SEQ ID NO: 475262 - DNA, 25 bp, Mus musculus
gagatgctagctctacaccctgtca

SEQ ID NO: 475263 - DNA, 25 bp, Mus musculus
gagatgctagctgtacaccctgtca

SEQ ID NO: 475264 - DNA, 25 bp, Mus musculus
gagatgctaggcactcggtttagag

SEQ ID NO: 475265 - DNA, 25 bp, Mus musculus
gagatgctaggctctcggtttagag

SEQ ID NO: 475266 - DNA, 25 bp, Mus musculus
gagatgctcaagaaccagcggagac

SEQ ID NO: 475267 - DNA, 25 bp, Mus musculus
gagatgctcaagtaccagcggagac

SEQ ID NO: 475268 - DNA, 25 bp, Mus musculus
gagatgctcactatagtaaaccaat

SEQ ID NO: 475269 - DNA, 25 bp, Mus musculus
gagatgctcactttagtaaaccaat

SEQ ID NO: 475270 - DNA, 25 bp, Mus musculus
gagatgctcagcactgatgcatgct

SEQ ID NO: 475271 - DNA, 25 bp, Mus musculus
gagatgctcagccagctggctttct

SEQ ID NO: 475272 - DNA, 25 bp, Mus musculus
gagatgctcagcgagctggctttct

SEQ ID NO: 475273 - DNA, 25 bp, Mus musculus
gagatgctcagctctgatgcatgct

SEQ ID NO: 475274 - DNA, 25 bp, Mus musculus
gagatgctcagtaacaagccatgga

SEQ ID NO: 475275 - DNA, 25 bp, Mus musculus
gagatgctcagttacaagccatgga

SEQ ID NO: 475276 - DNA, 25 bp, Mus musculus
gagatgctcatcatcacctagtgtc

SEQ ID NO: 475277 - DNA, 25 bp, Mus musculus
gagatgctcatccaaagagccacca

SEQ ID NO: 475278 - DNA, 25 bp, Mus musculus
gagatgctcatcgaaagagccacca

SEQ ID NO: 475279 - DNA, 25 bp, Mus musculus
gagatgctcatcttcacctagtgtc

SEQ ID NO: 475280 - DNA, 25 bp, Mus musculus
gagatgctcattctgtcccaggtgt

SEQ ID NO: 475281 - DNA, 25 bp, Mus musculus
gagatgctcattgtgtcccaggtgt

SEQ ID NO: 475282 - DNA, 25 bp, Mus musculus
gagatgctccagaatgtctttcttg

SEQ ID NO: 475283 - DNA, 25 bp, Mus musculus
gagatgctccagtatgtctttcttg

SEQ ID NO: 475284 - DNA, 25 bp, Mus musculus
gagatgctccccaaagtagaagaca

SEQ ID NO: 475285 - DNA, 25 bp, Mus musculus
gagatgctcccctaagtagaagaca

SEQ ID NO: 475286 - DNA, 25 bp, Mus musculus
gagatgctccgaatgtaccaagccc

SEQ ID NO: 475287 - DNA, 25 bp, Mus musculus
gagatgctccgattgtaccaagccc

SEQ ID NO: 475288 - DNA, 25 bp, Mus musculus
gagatgctcctcaaacatgccatga

SEQ ID NO: 475289 - DNA, 25 bp, Mus musculus
gagatgctcctctaacatgccatga

SEQ ID NO: 475290 - DNA, 25 bp, Mus musculus
gagatgctcctgatgtgtttgttag

SEQ ID NO: 475291 - DNA, 25 bp, Mus musculus
gagatgctcctgttgtgtttgttag

SEQ ID NO: 475292 - DNA, 25 bp, Mus musculus
gagatgctccttaagctaattttta

SEQ ID NO: 475293 - DNA, 25 bp, Mus musculus
gagatgctccttcaagtcctagggt

SEQ ID NO: 475294 - DNA, 25 bp, Mus musculus
gagatgctccttgaagtcctagggt

SEQ ID NO: 475295 - DNA, 25 bp, Mus musculus
gagatgctcctttagctaattttta

SEQ ID NO: 475296 - DNA, 25 bp, Mus musculus
gagatgctcgctatgaatgttccat

SEQ ID NO: 475297 - DNA, 25 bp, Mus musculus
gagatgctcgctatttacgatggct

SEQ ID NO: 475298 - DNA, 25 bp, Mus musculus
gagatgctcgctttgaatgttccat

SEQ ID NO: 475299 - DNA, 25 bp, Mus musculus
gagatgctcgctttttacgatggct

SEQ ID NO: 475300 - DNA, 25 bp, Mus musculus
gagatgctcggacctctatcacggg

SEQ ID NO: 475301 - DNA, 25 bp, Mus musculus
gagatgctcggagctctatcacggg

SEQ ID NO: 475302 - DNA, 25 bp, Mus musculus
gagatgctcggtcgcctgtatctta

SEQ ID NO: 475303 - DNA, 25 bp, Mus musculus
gagatgctcggtggcctgtatctta

SEQ ID NO: 475304 - DNA, 25 bp, Mus musculus
gagatgctctgaactgtcctctgct

SEQ ID NO: 475305 - DNA, 25 bp, Mus musculus
gagatgctctgatctgtcctctgct

SEQ ID NO: 475306 - DNA, 25 bp, Mus musculus
gagatgctctgtccaaagctgtgaa

SEQ ID NO: 475307 - DNA, 25 bp, Mus musculus
gagatgctctgtgcaaagctgtgaa

SEQ ID NO: 475308 - DNA, 25 bp, Mus musculus
gagatgctgactagcaccatgcggc

SEQ ID NO: 475309 - DNA, 25 bp, Mus musculus
gagatgctgacttgcaccatgcggc

SEQ ID NO: 475310 - DNA, 25 bp, Mus musculus
gagatgctgctaagtcaccaggact

SEQ ID NO: 475311 - DNA, 25 bp, Mus musculus
gagatgctgctacagatcgctgatg

SEQ ID NO: 475312 - DNA, 25 bp, Mus musculus
gagatgctgctagagatcgctgatg

SEQ ID NO: 475313 - DNA, 25 bp, Mus musculus
gagatgctgctatgtcaccaggact

SEQ ID NO: 475314 - DNA, 25 bp, Mus musculus
gagatgctgctgctccatgagaaaa

SEQ ID NO: 475315 - DNA, 25 bp, Mus musculus
gagatgctgctggtccatgagaaaa

SEQ ID NO: 475316 - DNA, 25 bp, Mus musculus
gagatgctggcaaagatgtgcagaa

SEQ ID NO: 475317 - DNA, 25 bp, Mus musculus
gagatgctggcatagatgtgcagaa

SEQ ID NO: 475318 - DNA, 25 bp, Mus musculus
gagatgctggcgatctccttcatct

SEQ ID NO: 475319 - DNA, 25 bp, Mus musculus
gagatgctggcgttctccttcatct

SEQ ID NO: 475320 - DNA, 25 bp, Mus musculus
gagatgctggtgaaaaccaccacag

SEQ ID NO: 475321 - DNA, 25 bp, Mus musculus
gagatgctggtgtaaaccaccacag

SEQ ID NO: 475322 - DNA, 25 bp, Mus musculus
gagatgctgtccacagagcctaaag

SEQ ID NO: 475323 - DNA, 25 bp, Mus musculus
gagatgctgtcctcagagcctaaag

SEQ ID NO: 475324 - DNA, 25 bp, Mus musculus
gagatgctgttgagatatcctgtgc

SEQ ID NO: 475325 - DNA, 25 bp, Mus musculus
gagatgctgttgtgatatcctgtgc

SEQ ID NO: 475326 - DNA, 25 bp, Mus musculus
gagatgcttaagaatgtcacaccaa

SEQ ID NO: 475327 - DNA, 25 bp, Mus musculus
gagatgcttaagtatgtcacaccaa

SEQ ID NO: 475328 - DNA, 25 bp, Mus musculus
gagatgcttagccttggctccttgt

SEQ ID NO: 475329 - DNA, 25 bp, Mus musculus
gagatgcttagcgttggctccttgt

SEQ ID NO: 475330 - DNA, 25 bp, Mus musculus
gagatgcttcaaaatgtcatttgct

SEQ ID NO: 475331 - DNA, 25 bp, Mus musculus
gagatgcttcaaagctccatggcca

SEQ ID NO: 475332 - DNA, 25 bp, Mus musculus
gagatgcttcaatatgtcatttgct

SEQ ID NO: 475333 - DNA, 25 bp, Mus musculus
gagatgcttcaatgctccatggcca

SEQ ID NO: 475334 - DNA, 25 bp, Mus musculus
gagatgcttcagagtccttcacaga

SEQ ID NO: 475335 - DNA, 25 bp, Mus musculus
gagatgcttcagtgtccttcacaga

SEQ ID NO: 475336 - DNA, 25 bp, Mus musculus
gagatgcttgaacactgtacataac

SEQ ID NO: 475337 - DNA, 25 bp, Mus musculus
gagatgcttgaagactgtacataac

SEQ ID NO: 475338 - DNA, 25 bp, Mus musculus
gagatgcttgctatgacaaattggt

SEQ ID NO: 475339 - DNA, 25 bp, Mus musculus
gagatgcttgctttgacaaattggt

SEQ ID NO: 475340 - DNA, 25 bp, Mus musculus
gagatgcttgtcagtcgttacagtt

SEQ ID NO: 475341 - DNA, 25 bp, Mus musculus
gagatgcttgtctgtcgttacagtt

SEQ ID NO: 475342 - DNA, 25 bp, Mus musculus
gagatgcttgtgattgcctgaagac

SEQ ID NO: 475343 - DNA, 25 bp, Mus musculus
gagatgcttgtgtttgcctgaagac

SEQ ID NO: 475344 - DNA, 25 bp, Mus musculus
gagatgctttacatccatatattaa

SEQ ID NO: 475345 - DNA, 25 bp, Mus musculus
gagatgctttacttccatatattaa

SEQ ID NO: 475346 - DNA, 25 bp, Mus musculus
gagatgctttcacgttcatacttgt

SEQ ID NO: 475347 - DNA, 25 bp, Mus musculus
gagatgctttcaggttcatacttgt

SEQ ID NO: 475348 - DNA, 25 bp, Mus musculus
gagatgctttgactgactctaagac

SEQ ID NO: 475349 - DNA, 25 bp, Mus musculus
gagatgctttgagtgactctaagac

SEQ ID NO: 475350 - DNA, 25 bp, Mus musculus
gagatggaaagaatatgttcactgt

SEQ ID NO: 475351 - DNA, 25 bp, Mus musculus
gagatggaaagattatgttcactgt

SEQ ID NO: 475352 - DNA, 25 bp, Mus musculus
gagatggaacacacagaccttccta

SEQ ID NO: 475353 - DNA, 25 bp, Mus musculus
gagatggaacactcagaccttccta

SEQ ID NO: 475354 - DNA, 25 bp, Mus musculus
gagatggaacttaggcctcctttac

SEQ ID NO: 475355 - DNA, 25 bp, Mus musculus
gagatggaactttggcctcctttac

SEQ ID NO: 475356 - DNA, 25 bp, Mus musculus
gagatggaatagctctgactgctcc

SEQ ID NO: 475357 - DNA, 25 bp, Mus musculus
gagatggaataggtctgactgctcc

SEQ ID NO: 475358 - DNA, 25 bp, Mus musculus
gagatggaatcaatacagttaactt

SEQ ID NO: 475359 - DNA, 25 bp, Mus musculus
gagatggaatcattacagttaactt

SEQ ID NO: 475360 - DNA, 25 bp, Mus musculus
gagatggaatttaccctttctctag

SEQ ID NO: 475361 - DNA, 25 bp, Mus musculus
gagatggaattttccctttctctag

SEQ ID NO: 475362 - DNA, 25 bp, Mus musculus
gagatggacacacgccttacatttc

SEQ ID NO: 475363 - DNA, 25 bp, Mus musculus
gagatggacacactgtaaacccctg

SEQ ID NO: 475364 - DNA, 25 bp, Mus musculus
gagatggacacaggccttacatttc

SEQ ID NO: 475365 - DNA, 25 bp, Mus musculus
gagatggacacagtgtaaacccctg

SEQ ID NO: 475366 - DNA, 25 bp, Mus musculus
gagatggacactccctttgtgtcct

SEQ ID NO: 475367 - DNA, 25 bp, Mus musculus
gagatggacactgcctttgtgtcct

SEQ ID NO: 475368 - DNA, 25 bp, Mus musculus
gagatggacccactgcaggccagcc

SEQ ID NO: 475369 - DNA, 25 bp, Mus musculus
gagatggacccagtgcaggccagcc

SEQ ID NO: 475370 - DNA, 25 bp, Mus musculus
gagatggaccccattggagcctgct

SEQ ID NO: 475371 - DNA, 25 bp, Mus musculus
gagatggacccctttggagcctgct

SEQ ID NO: 475372 - DNA, 25 bp, Mus musculus
gagatggaccctccccttcggcgtg

SEQ ID NO: 475373 - DNA, 25 bp, Mus musculus
gagatggaccctgcccttcggcgtg

SEQ ID NO: 475374 - DNA, 25 bp, Mus musculus
gagatggacctgcagctttttgaaa

SEQ ID NO: 475375 - DNA, 25 bp, Mus musculus
gagatggacctggagctttttgaaa

SEQ ID NO: 475376 - DNA, 25 bp, Mus musculus
gagatggactgacgagcccgcacaa

SEQ ID NO: 475377 - DNA, 25 bp, Mus musculus
gagatggactgaggagcccgcacaa

SEQ ID NO: 475378 - DNA, 25 bp, Mus musculus
gagatggacttgcattcccgagcct

SEQ ID NO: 475379 - DNA, 25 bp, Mus musculus
gagatggacttggattcccgagcct

SEQ ID NO: 475380 - DNA, 25 bp, Mus musculus
gagatggagacacctaatatttacg

SEQ ID NO: 475381 - DNA, 25 bp, Mus musculus
gagatggagacagctaatatttacg

SEQ ID NO: 475382 - DNA, 25 bp, Mus musculus
gagatggagactcagtgacccagac

SEQ ID NO: 475383 - DNA, 25 bp, Mus musculus
gagatggagactgagtgacccagac

SEQ ID NO: 475384 - DNA, 25 bp, Mus musculus
gagatggagcctccaccggcagcaa

SEQ ID NO: 475385 - DNA, 25 bp, Mus musculus
gagatggagcctgcaccggcagcaa

SEQ ID NO: 475386 - DNA, 25 bp, Mus musculus
gagatggagcgtaaccgctcctttg

SEQ ID NO: 475387 - DNA, 25 bp, Mus musculus
gagatggagcgttaccgctcctttg

SEQ ID NO: 475388 - DNA, 25 bp, Mus musculus
gagatggagctactgaccttacagt

SEQ ID NO: 475389 - DNA, 25 bp, Mus musculus
gagatggagctagtgaccttacagt

SEQ ID NO: 475390 - DNA, 25 bp, Mus musculus
gagatggagctcaccgccagacgcg

SEQ ID NO: 475391 - DNA, 25 bp, Mus musculus
gagatggagctctccgccagacgcg

SEQ ID NO: 475392 - DNA, 25 bp, Mus musculus
gagatggagtccctagtgacgacat

SEQ ID NO: 475393 - DNA, 25 bp, Mus musculus
gagatggagtccgtagtgacgacat

SEQ ID NO: 475394 - DNA, 25 bp, Mus musculus
gagatggagttaactggtacatttt

SEQ ID NO: 475395 - DNA, 25 bp, Mus musculus
gagatggagttatctggtacatttt

SEQ ID NO: 475396 - DNA, 25 bp, Mus musculus
gagatggatacaccctcacagtgct

SEQ ID NO: 475397 - DNA, 25 bp, Mus musculus
gagatggatacagcctcacagtgct

SEQ ID NO: 475398 - DNA, 25 bp, Mus musculus
gagatggatcacatgcagggctgct

SEQ ID NO: 475399 - DNA, 25 bp, Mus musculus
gagatggatcacttgcagggctgct

SEQ ID NO: 475400 - DNA, 25 bp, Mus musculus
gagatggatccgaaatcccaggagt

SEQ ID NO: 475401 - DNA, 25 bp, Mus musculus
gagatggatccgtaatcccaggagt

SEQ ID NO: 475402 - DNA, 25 bp, Mus musculus
gagatggatgcactatgtccacata

SEQ ID NO: 475403 - DNA, 25 bp, Mus musculus
gagatggatgcagtatgtccacata

SEQ ID NO: 475404 - DNA, 25 bp, Mus musculus
gagatggatgggatcgccctttcct

SEQ ID NO: 475405 - DNA, 25 bp, Mus musculus
gagatggatgggttcgccctttcct

SEQ ID NO: 475406 - DNA, 25 bp, Mus musculus
gagatggattgcagtcacttttatg

SEQ ID NO: 475407 - DNA, 25 bp, Mus musculus
gagatggattgctgtcacttttatg

SEQ ID NO: 475408 - DNA, 25 bp, Mus musculus
gagatggcaactacggccctggtcc

SEQ ID NO: 475409 - DNA, 25 bp, Mus musculus
gagatggcaacttcggccctggtcc

SEQ ID NO: 475410 - DNA, 25 bp, Mus musculus
gagatggcaccaacgtgctctacag

SEQ ID NO: 475411 - DNA, 25 bp, Mus musculus
gagatggcaccaataccaccaagga

SEQ ID NO: 475412 - DNA, 25 bp, Mus musculus
gagatggcaccatcgtgctctacag

SEQ ID NO: 475413 - DNA, 25 bp, Mus musculus
gagatggcaccattaccaccaagga

SEQ ID NO: 475414 - DNA, 25 bp, Mus musculus
gagatggcagtcaccagaagcccac

SEQ ID NO: 475415 - DNA, 25 bp, Mus musculus
gagatggcagtctccagaagcccac

SEQ ID NO: 475416 - DNA, 25 bp, Mus musculus
gagatggccaccctttgagcttaag

SEQ ID NO: 475417 - DNA, 25 bp, Mus musculus
gagatggccaccgtttgagcttaag

SEQ ID NO: 475418 - DNA, 25 bp, Mus musculus
gagatggccattaacctagccaaaa

SEQ ID NO: 475419 - DNA, 25 bp, Mus musculus
gagatggccatttacctagccaaaa

SEQ ID NO: 475420 - DNA, 25 bp, Mus musculus
gagatggcccaccaagggatgatct

SEQ ID NO: 475421 - DNA, 25 bp, Mus musculus
gagatggcccacgaagggatgatct

SEQ ID NO: 475422 - DNA, 25 bp, Mus musculus
gagatggcccagagatttagagcat

SEQ ID NO: 475423 - DNA, 25 bp, Mus musculus
gagatggcccagtgatttagagcat

SEQ ID NO: 475424 - DNA, 25 bp, Mus musculus
gagatggcccatattaatactcatg

SEQ ID NO: 475425 - DNA, 25 bp, Mus musculus
gagatggcccattttaatactcatg

SEQ ID NO: 475426 - DNA, 25 bp, Mus musculus
gagatggcccctcatcgatttttat

SEQ ID NO: 475427 - DNA, 25 bp, Mus musculus
gagatggcccctgatcgatttttat

SEQ ID NO: 475428 - DNA, 25 bp, Mus musculus
gagatggccctaaagcatgctgcat

SEQ ID NO: 475429 - DNA, 25 bp, Mus musculus
gagatggccctatagcatgctgcat

SEQ ID NO: 475430 - DNA, 25 bp, Mus musculus
gagatggccgagacggaccccaaga

SEQ ID NO: 475431 - DNA, 25 bp, Mus musculus
gagatggccgagtcggaccccaaga

SEQ ID NO: 475432 - DNA, 25 bp, Mus musculus
gagatggccgccctagcggtcacca

SEQ ID NO: 475433 - DNA, 25 bp, Mus musculus
gagatggccgccgtagcggtcacca

SEQ ID NO: 475434 - DNA, 25 bp, Mus musculus
gagatggcgagacgctaacgaccaa

SEQ ID NO: 475435 - DNA, 25 bp, Mus musculus
gagatggcgagaggctaacgaccaa

SEQ ID NO: 475436 - DNA, 25 bp, Mus musculus
gagatggcgccaccgagtcacttcg

SEQ ID NO: 475437 - DNA, 25 bp, Mus musculus
gagatggcgccagcgagtcacttcg

SEQ ID NO: 475438 - DNA, 25 bp, Mus musculus
gagatggctcaacaattaagattgc

SEQ ID NO: 475439 - DNA, 25 bp, Mus musculus
gagatggctcaagaattaagattgc

SEQ ID NO: 475440 - DNA, 25 bp, Mus musculus
gagatggctcagagggtaagagcac

SEQ ID NO: 475441 - DNA, 25 bp, Mus musculus
gagatggctcagtgggtaagagcac

SEQ ID NO: 475442 - DNA, 25 bp, Mus musculus
gagatggctcctatggtagaaccct

SEQ ID NO: 475443 - DNA, 25 bp, Mus musculus
gagatggctcctttggtagaaccct

SEQ ID NO: 475444 - DNA, 25 bp, Mus musculus
gagatggctctcaggtgggacaacc

SEQ ID NO: 475445 - DNA, 25 bp, Mus musculus
gagatggctctctggtgggacaacc

SEQ ID NO: 475446 - DNA, 25 bp, Mus musculus
gagatggctctgatatgtgagaaca

SEQ ID NO: 475447 - DNA, 25 bp, Mus musculus
gagatggctctgttatgtgagaaca

SEQ ID NO: 475448 - DNA, 25 bp, Mus musculus
gagatggctgagagtcaaccgcgtt

SEQ ID NO: 475449 - DNA, 25 bp, Mus musculus
gagatggctgagtgtcaaccgcgtt

SEQ ID NO: 475450 - DNA, 25 bp, Mus musculus
gagatggctgcaacccagatgggat

SEQ ID NO: 475451 - DNA, 25 bp, Mus musculus
gagatggctgcatcccagatgggat

SEQ ID NO: 475452 - DNA, 25 bp, Mus musculus
gagatggctgctacattttttaatt

SEQ ID NO: 475453 - DNA, 25 bp, Mus musculus
gagatggctgcttcattttttaatt

SEQ ID NO: 475454 - DNA, 25 bp, Mus musculus
gagatggcttcgccggtaagagcac

SEQ ID NO: 475455 - DNA, 25 bp, Mus musculus
gagatggcttcggcggtaagagcac

SEQ ID NO: 475456 - DNA, 25 bp, Mus musculus
gagatggcttttatgactatgttga

SEQ ID NO: 475457 - DNA, 25 bp, Mus musculus
gagatggcttttttgactatgttga

SEQ ID NO: 475458 - DNA, 25 bp, Mus musculus
gagatgggaaacataggagcacaaa

SEQ ID NO: 475459 - DNA, 25 bp, Mus musculus
gagatgggaaacttaggagcacaaa

SEQ ID NO: 475460 - DNA, 25 bp, Mus musculus
gagatgggacagcacattcggctct

SEQ ID NO: 475461 - DNA, 25 bp, Mus musculus
gagatgggacaggacattcggctct

SEQ ID NO: 475462 - DNA, 25 bp, Mus musculus
gagatgggaccaacactggacctgg

SEQ ID NO: 475463 - DNA, 25 bp, Mus musculus
gagatgggaccatcactggacctgg

SEQ ID NO: 475464 - DNA, 25 bp, Mus musculus
gagatgggagataatcacctgacaa

SEQ ID NO: 475465 - DNA, 25 bp, Mus musculus
gagatgggagattatcacctgacaa

SEQ ID NO: 475466 - DNA, 25 bp, Mus musculus
gagatgggagggaacagaaactact

SEQ ID NO: 475467 - DNA, 25 bp, Mus musculus
gagatgggagggtacagaaactact

SEQ ID NO: 475468 - DNA, 25 bp, Mus musculus
gagatgggatcaccacctccagaaa

SEQ ID NO: 475469 - DNA, 25 bp, Mus musculus
gagatgggatcagcacctccagaaa

SEQ ID NO: 475470 - DNA, 25 bp, Mus musculus
gagatgggatttccaccaaagaacc

SEQ ID NO: 475471 - DNA, 25 bp, Mus musculus
gagatgggatttgcaccaaagaacc

SEQ ID NO: 475472 - DNA, 25 bp, Mus musculus
gagatgggcatgagaggctcttcaa

SEQ ID NO: 475473 - DNA, 25 bp, Mus musculus
gagatgggcatgtgaggctcttcaa

SEQ ID NO: 475474 - DNA, 25 bp, Mus musculus
gagatgggccaacccacccgctatt

SEQ ID NO: 475475 - DNA, 25 bp, Mus musculus
gagatgggccaagccacccgctatt

SEQ ID NO: 475476 - DNA, 25 bp, Mus musculus
gagatgggccccaaattaactgcca

SEQ ID NO: 475477 - DNA, 25 bp, Mus musculus
gagatgggcccctaattaactgcca

SEQ ID NO: 475478 - DNA, 25 bp, Mus musculus
gagatgggcccgctcatctgcaagc

SEQ ID NO: 475479 - DNA, 25 bp, Mus musculus
gagatgggcccggtcatctgcaagc

SEQ ID NO: 475480 - DNA, 25 bp, Mus musculus
gagatgggccgcacaatttgtaaga

SEQ ID NO: 475481 - DNA, 25 bp, Mus musculus
gagatgggccgctcaatttgtaaga

SEQ ID NO: 475482 - DNA, 25 bp, Mus musculus
gagatgggctctctatagatcctaa

SEQ ID NO: 475483 - DNA, 25 bp, Mus musculus
gagatgggctctgtatagatcctaa

SEQ ID NO: 475484 - DNA, 25 bp, Mus musculus
gagatgggctgaacttttctcagta

SEQ ID NO: 475485 - DNA, 25 bp, Mus musculus
gagatgggctgatcttttctcagta

SEQ ID NO: 475486 - DNA, 25 bp, Mus musculus
gagatgggttcacctggttaccggg

SEQ ID NO: 475487 - DNA, 25 bp, Mus musculus
gagatgggttcagctggttaccggg

SEQ ID NO: 475488 - DNA, 25 bp, Mus musculus
gagatggtaaatatgggtcctgcct

SEQ ID NO: 475489 - DNA, 25 bp, Mus musculus
gagatggtaaatttgggtcctgcct

SEQ ID NO: 475490 - DNA, 25 bp, Mus musculus
gagatggtatctctacatagcccta

SEQ ID NO: 475491 - DNA, 25 bp, Mus musculus
gagatggtatctgtacatagcccta

SEQ ID NO: 475492 - DNA, 25 bp, Mus musculus
gagatggtattcctgttctgcatta

SEQ ID NO: 475493 - DNA, 25 bp, Mus musculus
gagatggtattcgtgttctgcatta

SEQ ID NO: 475494 - DNA, 25 bp, Mus musculus
gagatggtatttctgttctgttcat

SEQ ID NO: 475495 - DNA, 25 bp, Mus musculus
gagatggtatttcttagcgcccagc

SEQ ID NO: 475496 - DNA, 25 bp, Mus musculus
gagatggtatttgtgttctgttcat

SEQ ID NO: 475497 - DNA, 25 bp, Mus musculus
gagatggtatttgttagcgcccagc

SEQ ID NO: 475498 - DNA, 25 bp, Mus musculus
gagatggtcaaacgaggccacacct

SEQ ID NO: 475499 - DNA, 25 bp, Mus musculus
gagatggtcaaaggaggccacacct

SEQ ID NO: 475500 - DNA, 25 bp, Mus musculus
gagatggtcactatctaactaccag

SEQ ID NO: 475501 - DNA, 25 bp, Mus musculus
gagatggtcactttctaactaccag

SEQ ID NO: 475502 - DNA, 25 bp, Mus musculus
gagatggtcagtatagctttgtaac

SEQ ID NO: 475503 - DNA, 25 bp, Mus musculus
gagatggtcagtttagctttgtaac

SEQ ID NO: 475504 - DNA, 25 bp, Mus musculus
gagatggtccaaattgtctagtgct

SEQ ID NO: 475505 - DNA, 25 bp, Mus musculus
gagatggtccaatttgtctagtgct

SEQ ID NO: 475506 - DNA, 25 bp, Mus musculus
gagatggtctatatctcggacctca

SEQ ID NO: 475507 - DNA, 25 bp, Mus musculus
gagatggtctatttctcggacctca

SEQ ID NO: 475508 - DNA, 25 bp, Mus musculus
gagatggtctgcatgcaaccagatt

SEQ ID NO: 475509 - DNA, 25 bp, Mus musculus
gagatggtctgcttgcaaccagatt

SEQ ID NO: 475510 - DNA, 25 bp, Mus musculus
gagatggtcttccacgacataggcc

SEQ ID NO: 475511 - DNA, 25 bp, Mus musculus
gagatggtcttcctgggtatgaaac

SEQ ID NO: 475512 - DNA, 25 bp, Mus musculus
gagatggtcttcgacgacataggcc

SEQ ID NO: 475513 - DNA, 25 bp, Mus musculus
gagatggtcttcgtgggtatgaaac

SEQ ID NO: 475514 - DNA, 25 bp, Mus musculus
gagatggtgagcaatctgtatgttg

SEQ ID NO: 475515 - DNA, 25 bp, Mus musculus
gagatggtgagctatctgtatgttg

SEQ ID NO: 475516 - DNA, 25 bp, Mus musculus
gagatggtgatgaaccccagaggct

SEQ ID NO: 475517 - DNA, 25 bp, Mus musculus
gagatggtgatgtaccccagaggct

SEQ ID NO: 475518 - DNA, 25 bp, Mus musculus
gagatggtgctacaaaaggttacag

SEQ ID NO: 475519 - DNA, 25 bp, Mus musculus
gagatggtgctactggtcccttttc

SEQ ID NO: 475520 - DNA, 25 bp, Mus musculus
gagatggtgctagaaaaggttacag

SEQ ID NO: 475521 - DNA, 25 bp, Mus musculus
gagatggtgctagtggtcccttttc

SEQ ID NO: 475522 - DNA, 25 bp, Mus musculus
gagatggtgctgaactggaacccag

SEQ ID NO: 475523 - DNA, 25 bp, Mus musculus
gagatggtgctgtactggaacccag

SEQ ID NO: 475524 - DNA, 25 bp, Mus musculus
gagatggtgcttacctacagcgacc

SEQ ID NO: 475525 - DNA, 25 bp, Mus musculus
gagatggtgctttcctacagcgacc

SEQ ID NO: 475526 - DNA, 25 bp, Mus musculus
gagatggtggccactttgagaagaa

SEQ ID NO: 475527 - DNA, 25 bp, Mus musculus
gagatggtggcctctttgagaagaa

SEQ ID NO: 475528 - DNA, 25 bp, Mus musculus
gagatggtgtcccttggaatttgct

SEQ ID NO: 475529 - DNA, 25 bp, Mus musculus
gagatggtgtccgttggaatttgct

SEQ ID NO: 475530 - DNA, 25 bp, Mus musculus
gagatggttactacgggtacttcga

SEQ ID NO: 475531 - DNA, 25 bp, Mus musculus
gagatggttacttcgggtacttcga

SEQ ID NO: 475532 - DNA, 25 bp, Mus musculus
gagatggttcctaatcagctctgca

SEQ ID NO: 475533 - DNA, 25 bp, Mus musculus
gagatggttccttatcagctctgca

SEQ ID NO: 475534 - DNA, 25 bp, Mus musculus
gagatggttcttacgttcaaactgt

SEQ ID NO: 475535 - DNA, 25 bp, Mus musculus
gagatggttctttcgttcaaactgt

SEQ ID NO: 475536 - DNA, 25 bp, Mus musculus
gagatggttgcgaagagcagcccac

SEQ ID NO: 475537 - DNA, 25 bp, Mus musculus
gagatggttgcgtagagcagcccac

SEQ ID NO: 475538 - DNA, 25 bp, Mus musculus
gagatgtaaacaccgccgtgagccc

SEQ ID NO: 475539 - DNA, 25 bp, Mus musculus
gagatgtaaacagcgccgtgagccc

SEQ ID NO: 475540 - DNA, 25 bp, Mus musculus
gagatgtaactcagctagaccccaa

SEQ ID NO: 475541 - DNA, 25 bp, Mus musculus
gagatgtaactctgctagaccccaa

SEQ ID NO: 475542 - DNA, 25 bp, Mus musculus
gagatgtaaggcctcacacgggctc

SEQ ID NO: 475543 - DNA, 25 bp, Mus musculus
gagatgtaaggcgtcacacgggctc

SEQ ID NO: 475544 - DNA, 25 bp, Mus musculus
gagatgtaatccacaacctacaaga

SEQ ID NO: 475545 - DNA, 25 bp, Mus musculus
gagatgtaatcctcaacctacaaga

SEQ ID NO: 475546 - DNA, 25 bp, Mus musculus
gagatgtacacactgtttcatattg

SEQ ID NO: 475547 - DNA, 25 bp, Mus musculus
gagatgtacacagtgtttcatattg

SEQ ID NO: 475548 - DNA, 25 bp, Mus musculus
gagatgtacaggacactcccagaga

SEQ ID NO: 475549 - DNA, 25 bp, Mus musculus
gagatgtacaggtcactcccagaga

SEQ ID NO: 475550 - DNA, 25 bp, Mus musculus
gagatgtacatacactgggaaccag

SEQ ID NO: 475551 - DNA, 25 bp, Mus musculus
gagatgtacatagactgggaaccag

SEQ ID NO: 475552 - DNA, 25 bp, Mus musculus
gagatgtaccatccagtcactgagt

SEQ ID NO: 475553 - DNA, 25 bp, Mus musculus
gagatgtaccatgcagtcactgagt

SEQ ID NO: 475554 - DNA, 25 bp, Mus musculus
gagatgtactacacgcaaggatcgg

SEQ ID NO: 475555 - DNA, 25 bp, Mus musculus
gagatgtactactcgcaaggatcgg

SEQ ID NO: 475556 - DNA, 25 bp, Mus musculus
gagatgtactcacgacgtagataac

SEQ ID NO: 475557 - DNA, 25 bp, Mus musculus
gagatgtactcaggacgtagataac

SEQ ID NO: 475558 - DNA, 25 bp, Mus musculus
gagatgtactcgctgtcctacgaca

SEQ ID NO: 475559 - DNA, 25 bp, Mus musculus
gagatgtactcggtgtcctacgaca

SEQ ID NO: 475560 - DNA, 25 bp, Mus musculus
gagatgtagcagagccctctcctgt

SEQ ID NO: 475561 - DNA, 25 bp, Mus musculus
gagatgtagcagtgccctctcctgt

SEQ ID NO: 475562 - DNA, 25 bp, Mus musculus
gagatgtagccaagttcgtcctgcc

SEQ ID NO: 475563 - DNA, 25 bp, Mus musculus
gagatgtagccatgttcgtcctgcc

SEQ ID NO: 475564 - DNA, 25 bp, Mus musculus
gagatgtagcgcactggatgcttaa

SEQ ID NO: 475565 - DNA, 25 bp, Mus musculus
gagatgtagcgctctggatgcttaa

SEQ ID NO: 475566 - DNA, 25 bp, Mus musculus
gagatgtagctccacgtgagcatat

SEQ ID NO: 475567 - DNA, 25 bp, Mus musculus
gagatgtagctcgacgtgagcatat

SEQ ID NO: 475568 - DNA, 25 bp, Mus musculus
gagatgtagctgataccatgccaac

SEQ ID NO: 475569 - DNA, 25 bp, Mus musculus
gagatgtagctgttaccatgccaac

SEQ ID NO: 475570 - DNA, 25 bp, Mus musculus
gagatgtaggctactaccactgctt

SEQ ID NO: 475571 - DNA, 25 bp, Mus musculus
gagatgtaggcttctaccactgctt

SEQ ID NO: 475572 - DNA, 25 bp, Mus musculus
gagatgtatcgccagtccgtcattg

SEQ ID NO: 475573 - DNA, 25 bp, Mus musculus
gagatgtatcgcgagtccgtcattg

SEQ ID NO: 475574 - DNA, 25 bp, Mus musculus
gagatgtatctgaactgccgatcct

SEQ ID NO: 475575 - DNA, 25 bp, Mus musculus
gagatgtatctgtactgccgatcct

SEQ ID NO: 475576 - DNA, 25 bp, Mus musculus
gagatgtatgttaccccgaattcca

SEQ ID NO: 475577 - DNA, 25 bp, Mus musculus
gagatgtatgtttccccgaattcca

SEQ ID NO: 475578 - DNA, 25 bp, Mus musculus
gagatgtatttcaataagctgtgta

SEQ ID NO: 475579 - DNA, 25 bp, Mus musculus
gagatgtatttctataagctgtgta

SEQ ID NO: 475580 - DNA, 25 bp, Mus musculus
gagatgtcaactattctgctttaga

SEQ ID NO: 475581 - DNA, 25 bp, Mus musculus
gagatgtcaacttttctgctttaga

SEQ ID NO: 475582 - DNA, 25 bp, Mus musculus
gagatgtcaagtactatgtccaaat

SEQ ID NO: 475583 - DNA, 25 bp, Mus musculus
gagatgtcaagttctatgtccaaat

SEQ ID NO: 475584 - DNA, 25 bp, Mus musculus
gagatgtcaattatatttcaaggta

SEQ ID NO: 475585 - DNA, 25 bp, Mus musculus
gagatgtcaattttatttcaaggta

SEQ ID NO: 475586 - DNA, 25 bp, Mus musculus
gagatgtcaccacttattccgggag

SEQ ID NO: 475587 - DNA, 25 bp, Mus musculus
gagatgtcaccagttattccgggag

SEQ ID NO: 475588 - DNA, 25 bp, Mus musculus
gagatgtcagtccaacccagatgca

SEQ ID NO: 475589 - DNA, 25 bp, Mus musculus
gagatgtcagtcgaacccagatgca

SEQ ID NO: 475590 - DNA, 25 bp, Mus musculus
gagatgtcatccctggaaaagccaa

SEQ ID NO: 475591 - DNA, 25 bp, Mus musculus
gagatgtcatccgtggaaaagccaa

SEQ ID NO: 475592 - DNA, 25 bp, Mus musculus
gagatgtcatctcaccatgcaaagt

SEQ ID NO: 475593 - DNA, 25 bp, Mus musculus
gagatgtcatctgaccatgcaaagt

SEQ ID NO: 475594 - DNA, 25 bp, Mus musculus
gagatgtccaggaggcctttgcaca

SEQ ID NO: 475595 - DNA, 25 bp, Mus musculus
gagatgtccaggatgctcctatttc

SEQ ID NO: 475596 - DNA, 25 bp, Mus musculus
gagatgtccaggtggcctttgcaca

SEQ ID NO: 475597 - DNA, 25 bp, Mus musculus
gagatgtccaggttgctcctatttc

SEQ ID NO: 475598 - DNA, 25 bp, Mus musculus
gagatgtccatcactgactggacct

SEQ ID NO: 475599 - DNA, 25 bp, Mus musculus
gagatgtccatcctttagctttaga

SEQ ID NO: 475600 - DNA, 25 bp, Mus musculus
gagatgtccatcgtttagctttaga

SEQ ID NO: 475601 - DNA, 25 bp, Mus musculus
gagatgtccatctctgactggacct

SEQ ID NO: 475602 - DNA, 25 bp, Mus musculus
gagatgtcccaaacttgtggttttt

SEQ ID NO: 475603 - DNA, 25 bp, Mus musculus
gagatgtcccaatcttgtggttttt

SEQ ID NO: 475604 - DNA, 25 bp, Mus musculus
gagatgtccctgagtccttttttag

SEQ ID NO: 475605 - DNA, 25 bp, Mus musculus
gagatgtccctgtgtccttttttag

SEQ ID NO: 475606 - DNA, 25 bp, Mus musculus
gagatgtcctacagcagtggcgtta

SEQ ID NO: 475607 - DNA, 25 bp, Mus musculus
gagatgtcctactgcagtggcgtta

SEQ ID NO: 475608 - DNA, 25 bp, Mus musculus
gagatgtcgcggagatgtttttcac

SEQ ID NO: 475609 - DNA, 25 bp, Mus musculus
gagatgtcgcggtgatgtttttcac

SEQ ID NO: 475610 - DNA, 25 bp, Mus musculus
gagatgtctaagacactacccaaaa

SEQ ID NO: 475611 - DNA, 25 bp, Mus musculus
gagatgtctaagtcactacccaaaa

SEQ ID NO: 475612 - DNA, 25 bp, Mus musculus
gagatgtctgacctctattagatat

SEQ ID NO: 475613 - DNA, 25 bp, Mus musculus
gagatgtctgacgtctattagatat

SEQ ID NO: 475614 - DNA, 25 bp, Mus musculus
gagatgtctgcaaggagctgctccc

SEQ ID NO: 475615 - DNA, 25 bp, Mus musculus
gagatgtctgcatggagctgctccc

SEQ ID NO: 475616 - DNA, 25 bp, Mus musculus
gagatgtctggaaagttcaggcctt

SEQ ID NO: 475617 - DNA, 25 bp, Mus musculus
gagatgtctggatagttcaggcctt

SEQ ID NO: 475618 - DNA, 25 bp, Mus musculus
gagatgtctgtgacaaatccttccc

SEQ ID NO: 475619 - DNA, 25 bp, Mus musculus
gagatgtctgtgtcaaatccttccc

SEQ ID NO: 475620 - DNA, 25 bp, Mus musculus
gagatgtctttgctcttgaaggcat

SEQ ID NO: 475621 - DNA, 25 bp, Mus musculus
gagatgtctttggtcttgaaggcat

SEQ ID NO: 475622 - DNA, 25 bp, Mus musculus
gagatgtgacatcctcccactgcca

SEQ ID NO: 475623 - DNA, 25 bp, Mus musculus
gagatgtgacatgctcccactgcca

SEQ ID NO: 475624 - DNA, 25 bp, Mus musculus
gagatgtgacggatgccatgaatgc

SEQ ID NO: 475625 - DNA, 25 bp, Mus musculus
gagatgtgacggttgccatgaatgc

SEQ ID NO: 475626 - DNA, 25 bp, Mus musculus
gagatgtgactcaccgcttggactt

SEQ ID NO: 475627 - DNA, 25 bp, Mus musculus
gagatgtgactctccgcttggactt

SEQ ID NO: 475628 - DNA, 25 bp, Mus musculus
gagatgtgaggacccacccttgcaa

SEQ ID NO: 475629 - DNA, 25 bp, Mus musculus
gagatgtgaggagccacccttgcaa

SEQ ID NO: 475630 - DNA, 25 bp, Mus musculus
gagatgtgagtaaatgtccctgtat

SEQ ID NO: 475631 - DNA, 25 bp, Mus musculus
gagatgtgagtatatgtccctgtat

SEQ ID NO: 475632 - DNA, 25 bp, Mus musculus
gagatgtgcaaacgctgtgcagaaa

SEQ ID NO: 475633 - DNA, 25 bp, Mus musculus
gagatgtgcaaaggctgtgcagaaa

SEQ ID NO: 475634 - DNA, 25 bp, Mus musculus
gagatgtgcacaacctggactacta

SEQ ID NO: 475635 - DNA, 25 bp, Mus musculus
gagatgtgcacatcctggactacta

SEQ ID NO: 475636 - DNA, 25 bp, Mus musculus
gagatgtgcagaaccagctcacctg

SEQ ID NO: 475637 - DNA, 25 bp, Mus musculus
gagatgtgcagatccagctcacctg

SEQ ID NO: 475638 - DNA, 25 bp, Mus musculus
gagatgtgcccaagcataagctgct

SEQ ID NO: 475639 - DNA, 25 bp, Mus musculus
gagatgtgcccatgcataagctgct

SEQ ID NO: 475640 - DNA, 25 bp, Mus musculus
gagatgtggaggagccaacaatgat

SEQ ID NO: 475641 - DNA, 25 bp, Mus musculus
gagatgtggaggtgccaacaatgat

SEQ ID NO: 475642 - DNA, 25 bp, Mus musculus
gagatgtggctgacaaagtggctca

SEQ ID NO: 475643 - DNA, 25 bp, Mus musculus
gagatgtggctgacctgggtaccaa

SEQ ID NO: 475644 - DNA, 25 bp, Mus musculus
gagatgtggctgtcaaagtggctca

SEQ ID NO: 475645 - DNA, 25 bp, Mus musculus
gagatgtggctgtcctgggtaccaa

SEQ ID NO: 475646 - DNA, 25 bp, Mus musculus
gagatgtgtagaccagatgagcaat

SEQ ID NO: 475647 - DNA, 25 bp, Mus musculus
gagatgtgtagagcagatgagcaat

SEQ ID NO: 475648 - DNA, 25 bp, Mus musculus
gagatgtgtagcacccaaaggccct

SEQ ID NO: 475649 - DNA, 25 bp, Mus musculus
gagatgtgtagctcccaaaggccct

SEQ ID NO: 475650 - DNA, 25 bp, Mus musculus
gagatgtgtccccaggaccacgaaa

SEQ ID NO: 475651 - DNA, 25 bp, Mus musculus
gagatgtgtcccgaggaccacgaaa

SEQ ID NO: 475652 - DNA, 25 bp, Mus musculus
gagatgtgtgagaatacctggactt

SEQ ID NO: 475653 - DNA, 25 bp, Mus musculus
gagatgtgtgagtatacctggactt

SEQ ID NO: 475654 - DNA, 25 bp, Mus musculus
gagatgtgtggacggaggttcaaca

SEQ ID NO: 475655 - DNA, 25 bp, Mus musculus
gagatgtgtggagggaggttcaaca

SEQ ID NO: 475656 - DNA, 25 bp, Mus musculus
gagatgttacgtctacactgtacta

SEQ ID NO: 475657 - DNA, 25 bp, Mus musculus
gagatgttacgtgtacactgtacta

SEQ ID NO: 475658 - DNA, 25 bp, Mus musculus
gagatgttatacaaccagccagacc

SEQ ID NO: 475659 - DNA, 25 bp, Mus musculus
gagatgttatactaccagccagacc

SEQ ID NO: 475660 - DNA, 25 bp, Mus musculus
gagatgttatcaccacagtggcgta

SEQ ID NO: 475661 - DNA, 25 bp, Mus musculus
gagatgttatcagcacagtggcgta

SEQ ID NO: 475662 - DNA, 25 bp, Mus musculus
gagatgttcaagaagcccacgccat

SEQ ID NO: 475663 - DNA, 25 bp, Mus musculus
gagatgttcaagtagcccacgccat

SEQ ID NO: 475664 - DNA, 25 bp, Mus musculus
gagatgttcactatgggcaatccca

SEQ ID NO: 475665 - DNA, 25 bp, Mus musculus
gagatgttcactttgggcaatccca

SEQ ID NO: 475666 - DNA, 25 bp, Mus musculus
gagatgttccaccacaacccaagat

SEQ ID NO: 475667 - DNA, 25 bp, Mus musculus
gagatgttccacgacaacccaagat

SEQ ID NO: 475668 - DNA, 25 bp, Mus musculus
gagatgttccatcccaatcatctat

SEQ ID NO: 475669 - DNA, 25 bp, Mus musculus
gagatgttccatgccaatcatctat

SEQ ID NO: 475670 - DNA, 25 bp, Mus musculus
gagatgttccgaagcactcattaaa

SEQ ID NO: 475671 - DNA, 25 bp, Mus musculus
gagatgttccgatgcactcattaaa

SEQ ID NO: 475672 - DNA, 25 bp, Mus musculus
gagatgttcgacacacagacacaaa

SEQ ID NO: 475673 - DNA, 25 bp, Mus musculus
gagatgttcgactcacagacacaaa

SEQ ID NO: 475674 - DNA, 25 bp, Mus musculus
gagatgttcgatcgctccttgtacc

SEQ ID NO: 475675 - DNA, 25 bp, Mus musculus
gagatgttcgatggctccttgtacc

SEQ ID NO: 475676 - DNA, 25 bp, Mus musculus
gagatgttcggcacagggacagcct

SEQ ID NO: 475677 - DNA, 25 bp, Mus musculus
gagatgttcggctcagggacagcct

SEQ ID NO: 475678 - DNA, 25 bp, Mus musculus
gagatgttctgaaggtgtttccaat

SEQ ID NO: 475679 - DNA, 25 bp, Mus musculus
gagatgttctgatggtgtttccaat

SEQ ID NO: 475680 - DNA, 25 bp, Mus musculus
gagatgttgcacacgtttggatggc

SEQ ID NO: 475681 - DNA, 25 bp, Mus musculus
gagatgttgcactcgtttggatggc

SEQ ID NO: 475682 - DNA, 25 bp, Mus musculus
gagatgttgcggatatgactttgtt

SEQ ID NO: 475683 - DNA, 25 bp, Mus musculus
gagatgttgcggttatgactttgtt

SEQ ID NO: 475684 - DNA, 25 bp, Mus musculus
gagatgttgcgtatgttacacattt

SEQ ID NO: 475685 - DNA, 25 bp, Mus musculus
gagatgttgcgtttgttacacattt

SEQ ID NO: 475686 - DNA, 25 bp, Mus musculus
gagatgttggagaccccactgcaga

SEQ ID NO: 475687 - DNA, 25 bp, Mus musculus
gagatgttggagtccccactgcaga

SEQ ID NO: 475688 - DNA, 25 bp, Mus musculus
gagatgttggcaccagttgtttgat

SEQ ID NO: 475689 - DNA, 25 bp, Mus musculus
gagatgttggcagcagttgtttgat

SEQ ID NO: 475690 - DNA, 25 bp, Mus musculus
gagatgttggcgaacccacgaaagc

SEQ ID NO: 475691 - DNA, 25 bp, Mus musculus
gagatgttggcgtacccacgaaagc

SEQ ID NO: 475692 - DNA, 25 bp, Mus musculus
gagatgttgtgaaggagcccacaga

SEQ ID NO: 475693 - DNA, 25 bp, Mus musculus
gagatgttgtgactggaagaaatca

SEQ ID NO: 475694 - DNA, 25 bp, Mus musculus
gagatgttgtgagtggaagaaatca

SEQ ID NO: 475695 - DNA, 25 bp, Mus musculus
gagatgttgtgatggagcccacaga

SEQ ID NO: 475696 - DNA, 25 bp, Mus musculus
gagatgtttcataccactgtcacaa

SEQ ID NO: 475697 - DNA, 25 bp, Mus musculus
gagatgtttcattccactgtcacaa

SEQ ID NO: 475698 - DNA, 25 bp, Mus musculus
gagatgtttccgatcctaaagtgaa

SEQ ID NO: 475699 - DNA, 25 bp, Mus musculus
gagatgtttccgttcctaaagtgaa

SEQ ID NO: 475700 - DNA, 25 bp, Mus musculus
gagatgtttcctcaccattataagc

SEQ ID NO: 475701 - DNA, 25 bp, Mus musculus
gagatgtttcctgaccattataagc

SEQ ID NO: 475702 - DNA, 25 bp, Mus musculus
gagatgtttcgaagtgtgcgacaca

SEQ ID NO: 475703 - DNA, 25 bp, Mus musculus
gagatgtttcgatgtgtgcgacaca

SEQ ID NO: 475704 - DNA, 25 bp, Mus musculus
gagatgtttctaaggtccctaggca

SEQ ID NO: 475705 - DNA, 25 bp, Mus musculus
gagatgtttctatggtccctaggca

SEQ ID NO: 475706 - DNA, 25 bp, Mus musculus
gagatgtttctcaagagtgcctagt

SEQ ID NO: 475707 - DNA, 25 bp, Mus musculus
gagatgtttctcattcccatttagt

SEQ ID NO: 475708 - DNA, 25 bp, Mus musculus
gagatgtttctccaattggcctcga

SEQ ID NO: 475709 - DNA, 25 bp, Mus musculus
gagatgtttctcgaattggcctcga

SEQ ID NO: 475710 - DNA, 25 bp, Mus musculus
gagatgtttctctagagtgcctagt

SEQ ID NO: 475711 - DNA, 25 bp, Mus musculus
gagatgtttctctttcccatttagt

SEQ ID NO: 475712 - DNA, 25 bp, Mus musculus
gagatgtttgatagaaccctcgccc

SEQ ID NO: 475713 - DNA, 25 bp, Mus musculus
gagatgtttgattgaaccctcgccc

SEQ ID NO: 475714 - DNA, 25 bp, Mus musculus
gagattaaacacacagctaccaaac

SEQ ID NO: 475715 - DNA, 25 bp, Mus musculus
gagattaaacactcagctaccaaac

SEQ ID NO: 475716 - DNA, 25 bp, Mus musculus
gagattaaacgtcactaacttgcaa

SEQ ID NO: 475717 - DNA, 25 bp, Mus musculus
gagattaaacgtgactaacttgcaa

SEQ ID NO: 475718 - DNA, 25 bp, Mus musculus
gagattaaactaaattcccttcatg

SEQ ID NO: 475719 - DNA, 25 bp, Mus musculus
gagattaaactatattcccttcatg

SEQ ID NO: 475720 - DNA, 25 bp, Mus musculus
gagattaaactgcttttccgggtgt

SEQ ID NO: 475721 - DNA, 25 bp, Mus musculus
gagattaaactggttttccgggtgt

SEQ ID NO: 475722 - DNA, 25 bp, Mus musculus
gagattaaaggcacattgatggact

SEQ ID NO: 475723 - DNA, 25 bp, Mus musculus
gagattaaaggctcattgatggact

SEQ ID NO: 475724 - DNA, 25 bp, Mus musculus
gagattaaatacagtgactcactgc

SEQ ID NO: 475725 - DNA, 25 bp, Mus musculus
gagattaaatactgtgactcactgc

SEQ ID NO: 475726 - DNA, 25 bp, Mus musculus
gagattaaccatagtgtccacatga

SEQ ID NO: 475727 - DNA, 25 bp, Mus musculus
gagattaaccattgtgtccacatga

SEQ ID NO: 475728 - DNA, 25 bp, Mus musculus
gagattaacttgagctcctggttta

SEQ ID NO: 475729 - DNA, 25 bp, Mus musculus
gagattaacttgtgctcctggttta

SEQ ID NO: 475730 - DNA, 25 bp, Mus musculus
gagattaagacaccgtcctcattaa

SEQ ID NO: 475731 - DNA, 25 bp, Mus musculus
gagattaagacagcgtcctcattaa

SEQ ID NO: 475732 - DNA, 25 bp, Mus musculus
gagattaagttcagccacatggccc

SEQ ID NO: 475733 - DNA, 25 bp, Mus musculus
gagattaagttctgccacatggccc

SEQ ID NO: 475734 - DNA, 25 bp, Mus musculus
gagattaataatcccctgtgcttta

SEQ ID NO: 475735 - DNA, 25 bp, Mus musculus
gagattaataatgccctgtgcttta

SEQ ID NO: 475736 - DNA, 25 bp, Mus musculus
gagattaatggtctgtgctacaact

SEQ ID NO: 475737 - DNA, 25 bp, Mus musculus
gagattaatggtgtgtgctacaact

SEQ ID NO: 475738 - DNA, 25 bp, Mus musculus
gagattacaagacagagtttccact

SEQ ID NO: 475739 - DNA, 25 bp, Mus musculus
gagattacaagagagagtttccact

SEQ ID NO: 475740 - DNA, 25 bp, Mus musculus
gagattacaatcacataacactatg

SEQ ID NO: 475741 - DNA, 25 bp, Mus musculus
gagattacaatctcataacactatg

SEQ ID NO: 475742 - DNA, 25 bp, Mus musculus
gagattacacagcacccgactgtcg

SEQ ID NO: 475743 - DNA, 25 bp, Mus musculus
gagattacacaggacccgactgtcg

SEQ ID NO: 475744 - DNA, 25 bp, Mus musculus
gagattacacataactggctcacac

SEQ ID NO: 475745 - DNA, 25 bp, Mus musculus
gagattacacattactggctcacac

SEQ ID NO: 475746 - DNA, 25 bp, Mus musculus
gagattacacgtccactagcagttt

SEQ ID NO: 475747 - DNA, 25 bp, Mus musculus
gagattacacgtgcactagcagttt

SEQ ID NO: 475748 - DNA, 25 bp, Mus musculus
gagattacaggcctgtcttaccatc

SEQ ID NO: 475749 - DNA, 25 bp, Mus musculus
gagattacaggcgtgtcttaccatc

SEQ ID NO: 475750 - DNA, 25 bp, Mus musculus
gagattacccagagaggccttattc

SEQ ID NO: 475751 - DNA, 25 bp, Mus musculus
gagattacccagtgaggccttattc

SEQ ID NO: 475752 - DNA, 25 bp, Mus musculus
gagattaccgatcagtacccattaa

SEQ ID NO: 475753 - DNA, 25 bp, Mus musculus
gagattaccgatgagtacccattaa

SEQ ID NO: 475754 - DNA, 25 bp, Mus musculus
gagattaccttgatttagaccactt

SEQ ID NO: 475755 - DNA, 25 bp, Mus musculus
gagattaccttgttttagaccactt

SEQ ID NO: 475756 - DNA, 25 bp, Mus musculus
gagattactcacatcaccgtttttg

SEQ ID NO: 475757 - DNA, 25 bp, Mus musculus
gagattactcacttcaccgtttttg

SEQ ID NO: 475758 - DNA, 25 bp, Mus musculus
gagattactgtcagctggtcctaga

SEQ ID NO: 475759 - DNA, 25 bp, Mus musculus
gagattactgtctgctggtcctaga

SEQ ID NO: 475760 - DNA, 25 bp, Mus musculus
gagattactttcctacttagttgtt

SEQ ID NO: 475761 - DNA, 25 bp, Mus musculus
gagattactttcgtacttagttgtt

SEQ ID NO: 475762 - DNA, 25 bp, Mus musculus
gagattagcgtgcacagtttggact

SEQ ID NO: 475763 - DNA, 25 bp, Mus musculus
gagattagcgtggacagtttggact

SEQ ID NO: 475764 - DNA, 25 bp, Mus musculus
gagattaggagcactctcctgctta

SEQ ID NO: 475765 - DNA, 25 bp, Mus musculus
gagattaggagctctctcctgctta

SEQ ID NO: 475766 - DNA, 25 bp, Mus musculus
gagattaggctccatccttgtggac

SEQ ID NO: 475767 - DNA, 25 bp, Mus musculus
gagattaggctcgatccttgtggac

SEQ ID NO: 475768 - DNA, 25 bp, Mus musculus
gagattagtcaactcccagagggag

SEQ ID NO: 475769 - DNA, 25 bp, Mus musculus
gagattagtcaagtcccagagggag

SEQ ID NO: 475770 - DNA, 25 bp, Mus musculus
gagattagttatccatcatcacaat

SEQ ID NO: 475771 - DNA, 25 bp, Mus musculus
gagattagttatgcatcatcacaat

SEQ ID NO: 475772 - DNA, 25 bp, Mus musculus
gagattataacgagtgcattttaca

SEQ ID NO: 475773 - DNA, 25 bp, Mus musculus
gagattataacgtgtgcattttaca

SEQ ID NO: 475774 - DNA, 25 bp, Mus musculus
gagattatacaactggcctcccatt

SEQ ID NO: 475775 - DNA, 25 bp, Mus musculus
gagattatacaagtggcctcccatt

SEQ ID NO: 475776 - DNA, 25 bp, Mus musculus
gagattatacgtcagggcccggatc

SEQ ID NO: 475777 - DNA, 25 bp, Mus musculus
gagattatacgtgagggcccggatc

SEQ ID NO: 475778 - DNA, 25 bp, Mus musculus
gagattatactgctaatactgtatc

SEQ ID NO: 475779 - DNA, 25 bp, Mus musculus
gagattatactggtaatactgtatc

SEQ ID NO: 475780 - DNA, 25 bp, Mus musculus
gagattatattcactcccttaggaa

SEQ ID NO: 475781 - DNA, 25 bp, Mus musculus
gagattatattctctcccttaggaa

SEQ ID NO: 475782 - DNA, 25 bp, Mus musculus
gagattatatttcatccctttgagg

SEQ ID NO: 475783 - DNA, 25 bp, Mus musculus
gagattatatttgatccctttgagg

SEQ ID NO: 475784 - DNA, 25 bp, Mus musculus
gagattatcaccagcttgacatcat

SEQ ID NO: 475785 - DNA, 25 bp, Mus musculus
gagattatcacctgcttgacatcat

SEQ ID NO: 475786 - DNA, 25 bp, Mus musculus
gagattatcccaccgatttttaaat

SEQ ID NO: 475787 - DNA, 25 bp, Mus musculus
gagattatcccagcgatttttaaat

SEQ ID NO: 475788 - DNA, 25 bp, Mus musculus
gagattatctttcagttgtggactt

SEQ ID NO: 475789 - DNA, 25 bp, Mus musculus
gagattatctttgagttgtggactt

SEQ ID NO: 475790 - DNA, 25 bp, Mus musculus
gagattatgactacaccaaatctga

SEQ ID NO: 475791 - DNA, 25 bp, Mus musculus
gagattatgacttcaccaaatctga

SEQ ID NO: 475792 - DNA, 25 bp, Mus musculus
gagattatgcatagcattgtaccaa

SEQ ID NO: 475793 - DNA, 25 bp, Mus musculus
gagattatgcattgcattgtaccaa

SEQ ID NO: 475794 - DNA, 25 bp, Mus musculus
gagattatgccaaagatgacccact

SEQ ID NO: 475795 - DNA, 25 bp, Mus musculus
gagattatgccatagatgacccact

SEQ ID NO: 475796 - DNA, 25 bp, Mus musculus
gagattatggtgctaaagtccccac

SEQ ID NO: 475797 - DNA, 25 bp, Mus musculus
gagattatggtggtaaagtccccac

SEQ ID NO: 475798 - DNA, 25 bp, Mus musculus
gagattatgtacagtatgctgccat

SEQ ID NO: 475799 - DNA, 25 bp, Mus musculus
gagattatgtactgtatgctgccat

SEQ ID NO: 475800 - DNA, 25 bp, Mus musculus
gagattattctacctgcaactacca

SEQ ID NO: 475801 - DNA, 25 bp, Mus musculus
gagattattctagctgcaactacca

SEQ ID NO: 475802 - DNA, 25 bp, Mus musculus
gagattattgagcttcatcatgacc

SEQ ID NO: 475803 - DNA, 25 bp, Mus musculus
gagattattgaggttcatcatgacc

SEQ ID NO: 475804 - DNA, 25 bp, Mus musculus
gagattattgttagcctttcacaga

SEQ ID NO: 475805 - DNA, 25 bp, Mus musculus
gagattattgtttgcctttcacaga

SEQ ID NO: 475806 - DNA, 25 bp, Mus musculus
gagattattttccaccaagggactt

SEQ ID NO: 475807 - DNA, 25 bp, Mus musculus
gagattattttcgaccaagggactt

SEQ ID NO: 475808 - DNA, 25 bp, Mus musculus
gagattcaaactcaggtccacggag

SEQ ID NO: 475809 - DNA, 25 bp, Mus musculus
gagattcaaactgaggtccacggag

SEQ ID NO: 475810 - DNA, 25 bp, Mus musculus
gagattcaagacatccgtaccaagt

SEQ ID NO: 475811 - DNA, 25 bp, Mus musculus
gagattcaagacttccgtaccaagt

SEQ ID NO: 475812 - DNA, 25 bp, Mus musculus
gagattcacaaaccaggctatctgg

SEQ ID NO: 475813 - DNA, 25 bp, Mus musculus
gagattcacaaagcaggctatctgg

SEQ ID NO: 475814 - DNA, 25 bp, Mus musculus
gagattcacaacataaaggtccatt

SEQ ID NO: 475815 - DNA, 25 bp, Mus musculus
gagattcacaacttaaaggtccatt

SEQ ID NO: 475816 - DNA, 25 bp, Mus musculus
gagattcacagccagacagtatgca

SEQ ID NO: 475817 - DNA, 25 bp, Mus musculus
gagattcacagcgagacagtatgca

SEQ ID NO: 475818 - DNA, 25 bp, Mus musculus
gagattcaccctcgacttggaggaa

SEQ ID NO: 475819 - DNA, 25 bp, Mus musculus
gagattcaccctggacttggaggaa

SEQ ID NO: 475820 - DNA, 25 bp, Mus musculus
gagattcaccgccatttcgtacaaa

SEQ ID NO: 475821 - DNA, 25 bp, Mus musculus
gagattcaccgcgatttcgtacaaa

SEQ ID NO: 475822 - DNA, 25 bp, Mus musculus
gagattcacctacttatgtctctta

SEQ ID NO: 475823 - DNA, 25 bp, Mus musculus
gagattcacctagttatgtctctta

SEQ ID NO: 475824 - DNA, 25 bp, Mus musculus
gagattcacgagcagttggtcactt

SEQ ID NO: 475825 - DNA, 25 bp, Mus musculus
gagattcacgaggagttggtcactt

SEQ ID NO: 475826 - DNA, 25 bp, Mus musculus
gagattcacggaatcaccgcttaag

SEQ ID NO: 475827 - DNA, 25 bp, Mus musculus
gagattcacggacgtagagccctat

SEQ ID NO: 475828 - DNA, 25 bp, Mus musculus
gagattcacggaggtagagccctat

SEQ ID NO: 475829 - DNA, 25 bp, Mus musculus
gagattcacggattcaccgcttaag

SEQ ID NO: 475830 - DNA, 25 bp, Mus musculus
gagattcacggcaaacacaacgaga

SEQ ID NO: 475831 - DNA, 25 bp, Mus musculus
gagattcacggctaacacaacgaga

SEQ ID NO: 475832 - DNA, 25 bp, Mus musculus
gagattcacgtgaccatgactcccg

SEQ ID NO: 475833 - DNA, 25 bp, Mus musculus
gagattcacgtgtccatgactcccg

SEQ ID NO: 475834 - DNA, 25 bp, Mus musculus
gagattcagagccagactgagctac

SEQ ID NO: 475835 - DNA, 25 bp, Mus musculus
gagattcagagccagtgcttctttt

SEQ ID NO: 475836 - DNA, 25 bp, Mus musculus
gagattcagagcgagactgagctac

SEQ ID NO: 475837 - DNA, 25 bp, Mus musculus
gagattcagagcgagtgcttctttt

SEQ ID NO: 475838 - DNA, 25 bp, Mus musculus
gagattcaggacatctgcctcaaat

SEQ ID NO: 475839 - DNA, 25 bp, Mus musculus
gagattcaggacttctgcctcaaat

SEQ ID NO: 475840 - DNA, 25 bp, Mus musculus
gagattcaggatcacaggtttcccc

SEQ ID NO: 475841 - DNA, 25 bp, Mus musculus
gagattcaggatgacaggtttcccc

SEQ ID NO: 475842 - DNA, 25 bp, Mus musculus
gagattcaggtgaaacctctcttct

SEQ ID NO: 475843 - DNA, 25 bp, Mus musculus
gagattcaggtgtaacctctcttct

SEQ ID NO: 475844 - DNA, 25 bp, Mus musculus
gagattcaggttcttcctcaatctg

SEQ ID NO: 475845 - DNA, 25 bp, Mus musculus
gagattcaggttgttcctcaatctg

SEQ ID NO: 475846 - DNA, 25 bp, Mus musculus
gagattcagttactgcctttcttgc

SEQ ID NO: 475847 - DNA, 25 bp, Mus musculus
gagattcagttagtgcctttcttgc

SEQ ID NO: 475848 - DNA, 25 bp, Mus musculus
gagattcatagccacacaaccgatc

SEQ ID NO: 475849 - DNA, 25 bp, Mus musculus
gagattcatagcgacacaaccgatc

SEQ ID NO: 475850 - DNA, 25 bp, Mus musculus
gagattcatcctctaaaagtgacaa

SEQ ID NO: 475851 - DNA, 25 bp, Mus musculus
gagattcatcctgtaaaagtgacaa

SEQ ID NO: 475852 - DNA, 25 bp, Mus musculus
gagattcatctgagacattcatcgt

SEQ ID NO: 475853 - DNA, 25 bp, Mus musculus
gagattcatctgtgacattcatcgt

SEQ ID NO: 475854 - DNA, 25 bp, Mus musculus
gagattcattcaagcctggcagtct

SEQ ID NO: 475855 - DNA, 25 bp, Mus musculus
gagattcattcatgcctggcagtct

SEQ ID NO: 475856 - DNA, 25 bp, Mus musculus
gagattcattgcaatcctaaaacta

SEQ ID NO: 475857 - DNA, 25 bp, Mus musculus
gagattcattgctatcctaaaacta

SEQ ID NO: 475858 - DNA, 25 bp, Mus musculus
gagattccaaacagaaataaattca

SEQ ID NO: 475859 - DNA, 25 bp, Mus musculus
gagattccaaactgaaataaattca

SEQ ID NO: 475860 - DNA, 25 bp, Mus musculus
gagattccagctctgctcatacaaa

SEQ ID NO: 475861 - DNA, 25 bp, Mus musculus
gagattccagctgtgctcatacaaa

SEQ ID NO: 475862 - DNA, 25 bp, Mus musculus
gagattccatttaagtgcttgaccg

SEQ ID NO: 475863 - DNA, 25 bp, Mus musculus
gagattccatttatgcagcacttgc

SEQ ID NO: 475864 - DNA, 25 bp, Mus musculus
gagattccattttagtgcttgaccg

SEQ ID NO: 475865 - DNA, 25 bp, Mus musculus
gagattccatttttgcagcacttgc

SEQ ID NO: 475866 - DNA, 25 bp, Mus musculus
gagattcccaggacaggaattccca

SEQ ID NO: 475867 - DNA, 25 bp, Mus musculus
gagattcccaggtcaggaattccca

SEQ ID NO: 475868 - DNA, 25 bp, Mus musculus
gagattccccatatgcagattcaac

SEQ ID NO: 475869 - DNA, 25 bp, Mus musculus
gagattccccatttgcagattcaac

SEQ ID NO: 475870 - DNA, 25 bp, Mus musculus
gagattccctcgagcttcaaggagc

SEQ ID NO: 475871 - DNA, 25 bp, Mus musculus
gagattccctcgtgcttcaaggagc

SEQ ID NO: 475872 - DNA, 25 bp, Mus musculus
gagattcccttgaggttctaggagc

SEQ ID NO: 475873 - DNA, 25 bp, Mus musculus
gagattcccttgtggttctaggagc

SEQ ID NO: 475874 - DNA, 25 bp, Mus musculus
gagattccgcatcgactctagattt

SEQ ID NO: 475875 - DNA, 25 bp, Mus musculus
gagattccgcatggactctagattt

SEQ ID NO: 475876 - DNA, 25 bp, Mus musculus
gagattcctaatctggatccagttg

SEQ ID NO: 475877 - DNA, 25 bp, Mus musculus
gagattcctaatgtggatccagttg

SEQ ID NO: 475878 - DNA, 25 bp, Mus musculus
gagattcctatactgcaccgagtcc

SEQ ID NO: 475879 - DNA, 25 bp, Mus musculus
gagattcctatagtgcaccgagtcc

SEQ ID NO: 475880 - DNA, 25 bp, Mus musculus
gagattcctcttctaaacagccaat

SEQ ID NO: 475881 - DNA, 25 bp, Mus musculus
gagattcctcttgtaaacagccaat

SEQ ID NO: 475882 - DNA, 25 bp, Mus musculus
gagattcctggaatacaacctatca

SEQ ID NO: 475883 - DNA, 25 bp, Mus musculus
gagattcctggattacaacctatca

SEQ ID NO: 475884 - DNA, 25 bp, Mus musculus
gagattccttcaagacttccttgaa

SEQ ID NO: 475885 - DNA, 25 bp, Mus musculus
gagattccttcacccgaatgagcct

SEQ ID NO: 475886 - DNA, 25 bp, Mus musculus
gagattccttcactggctcaaagga

SEQ ID NO: 475887 - DNA, 25 bp, Mus musculus
gagattccttcagccgaatgagcct

SEQ ID NO: 475888 - DNA, 25 bp, Mus musculus
gagattccttcagtggctcaaagga

SEQ ID NO: 475889 - DNA, 25 bp, Mus musculus
gagattccttcatgacttccttgaa

SEQ ID NO: 475890 - DNA, 25 bp, Mus musculus
gagattcgatttactgtgattacac

SEQ ID NO: 475891 - DNA, 25 bp, Mus musculus
gagattcgattttctgtgattacac

SEQ ID NO: 475892 - DNA, 25 bp, Mus musculus
gagattcgcctcagtcatgagctcg

SEQ ID NO: 475893 - DNA, 25 bp, Mus musculus
gagattcgcctctgtcatgagctcg

SEQ ID NO: 475894 - DNA, 25 bp, Mus musculus
gagattcggtctccaaaaatgaggt

SEQ ID NO: 475895 - DNA, 25 bp, Mus musculus
gagattcggtctgcaaaaatgaggt

SEQ ID NO: 475896 - DNA, 25 bp, Mus musculus
gagattcgtataatgccacgtgtta

SEQ ID NO: 475897 - DNA, 25 bp, Mus musculus
gagattcgtatattgccacgtgtta

SEQ ID NO: 475898 - DNA, 25 bp, Mus musculus
gagattcgtggactttccattcaca

SEQ ID NO: 475899 - DNA, 25 bp, Mus musculus
gagattcgtggagtttccattcaca

SEQ ID NO: 475900 - DNA, 25 bp, Mus musculus
gagattctaactaataccttttaag

SEQ ID NO: 475901 - DNA, 25 bp, Mus musculus
gagattctaacttataccttttaag

SEQ ID NO: 475902 - DNA, 25 bp, Mus musculus
gagattctaatcatagcccctgtca

SEQ ID NO: 475903 - DNA, 25 bp, Mus musculus
gagattctaatcttagcccctgtca

SEQ ID NO: 475904 - DNA, 25 bp, Mus musculus
gagattctacacaccatgaaaaact

SEQ ID NO: 475905 - DNA, 25 bp, Mus musculus
gagattctacactccatgaaaaact

SEQ ID NO: 475906 - DNA, 25 bp, Mus musculus
gagattctacatacaaacgcctctg

SEQ ID NO: 475907 - DNA, 25 bp, Mus musculus
gagattctacattcaaacgcctctg

SEQ ID NO: 475908 - DNA, 25 bp, Mus musculus
gagattctactaagattcctaaaat

SEQ ID NO: 475909 - DNA, 25 bp, Mus musculus
gagattctactatgattcctaaaat

SEQ ID NO: 475910 - DNA, 25 bp, Mus musculus
gagattctcaagaacatcagcacat

SEQ ID NO: 475911 - DNA, 25 bp, Mus musculus
gagattctcaagagcaaacactgct

SEQ ID NO: 475912 - DNA, 25 bp, Mus musculus
gagattctcaagtacatcagcacat

SEQ ID NO: 475913 - DNA, 25 bp, Mus musculus
gagattctcaagtgcaaacactgct

SEQ ID NO: 475914 - DNA, 25 bp, Mus musculus
gagattctcacaatcaccagttggt

SEQ ID NO: 475915 - DNA, 25 bp, Mus musculus
gagattctcacattcaccagttggt

SEQ ID NO: 475916 - DNA, 25 bp, Mus musculus
gagattctcagactaatgagttcaa

SEQ ID NO: 475917 - DNA, 25 bp, Mus musculus
gagattctcagagtaatgagttcaa

SEQ ID NO: 475918 - DNA, 25 bp, Mus musculus
gagattctcagtacatctgaggttt

SEQ ID NO: 475919 - DNA, 25 bp, Mus musculus
gagattctcagttcatctgaggttt

SEQ ID NO: 475920 - DNA, 25 bp, Mus musculus
gagattctccacagaacagcgtctt

SEQ ID NO: 475921 - DNA, 25 bp, Mus musculus
gagattctccactgaacagcgtctt

SEQ ID NO: 475922 - DNA, 25 bp, Mus musculus
gagattctcccaactggtgagcgac

SEQ ID NO: 475923 - DNA, 25 bp, Mus musculus
gagattctcccatctggtgagcgac

SEQ ID NO: 475924 - DNA, 25 bp, Mus musculus
gagattctccctatggattgagttc

SEQ ID NO: 475925 - DNA, 25 bp, Mus musculus
gagattctccctttggattgagttc

SEQ ID NO: 475926 - DNA, 25 bp, Mus musculus
gagattctcctaaagtcgctacatg

SEQ ID NO: 475927 - DNA, 25 bp, Mus musculus
gagattctcctatagtcgctacatg

SEQ ID NO: 475928 - DNA, 25 bp, Mus musculus
gagattctcgttattggttccaaga

SEQ ID NO: 475929 - DNA, 25 bp, Mus musculus
gagattctcgtttttggttccaaga

SEQ ID NO: 475930 - DNA, 25 bp, Mus musculus
gagattctctctcaccatagctaga

SEQ ID NO: 475931 - DNA, 25 bp, Mus musculus
gagattctctctgaccatagctaga

SEQ ID NO: 475932 - DNA, 25 bp, Mus musculus
gagattctgacacatgccaagtact

SEQ ID NO: 475933 - DNA, 25 bp, Mus musculus
gagattctgacagatgccaagtact

SEQ ID NO: 475934 - DNA, 25 bp, Mus musculus
gagattctgagaagcctccatactt

SEQ ID NO: 475935 - DNA, 25 bp, Mus musculus
gagattctgagatgcctccatactt

SEQ ID NO: 475936 - DNA, 25 bp, Mus musculus
gagattctgaggcactcaatgcctt

SEQ ID NO: 475937 - DNA, 25 bp, Mus musculus
gagattctgagggactcaatgcctt

SEQ ID NO: 475938 - DNA, 25 bp, Mus musculus
gagattctgctcaccagatctgact

SEQ ID NO: 475939 - DNA, 25 bp, Mus musculus
gagattctgctctccagatctgact

SEQ ID NO: 475940 - DNA, 25 bp, Mus musculus
gagattcttaccatgtattctgttt

SEQ ID NO: 475941 - DNA, 25 bp, Mus musculus
gagattcttaccttgtattctgttt

SEQ ID NO: 475942 - DNA, 25 bp, Mus musculus
gagattcttcaacttttatcttttc

SEQ ID NO: 475943 - DNA, 25 bp, Mus musculus
gagattcttcaagttttatcttttc

SEQ ID NO: 475944 - DNA, 25 bp, Mus musculus
gagattcttcacattacagagcaca

SEQ ID NO: 475945 - DNA, 25 bp, Mus musculus
gagattcttcactttacagagcaca

SEQ ID NO: 475946 - DNA, 25 bp, Mus musculus
gagattcttccaagaaaggttaact

SEQ ID NO: 475947 - DNA, 25 bp, Mus musculus
gagattcttccatgaaaggttaact

SEQ ID NO: 475948 - DNA, 25 bp, Mus musculus
gagattcttctccttatctctaaaa

SEQ ID NO: 475949 - DNA, 25 bp, Mus musculus
gagattcttctcgttatctctaaaa

SEQ ID NO: 475950 - DNA, 25 bp, Mus musculus
gagattcttgccaattcctagtgtg

SEQ ID NO: 475951 - DNA, 25 bp, Mus musculus
gagattcttgcctattcctagtgtg

SEQ ID NO: 475952 - DNA, 25 bp, Mus musculus
gagattctttttctagttccttcct

SEQ ID NO: 475953 - DNA, 25 bp, Mus musculus
gagattctttttgtagttccttcct

SEQ ID NO: 475954 - DNA, 25 bp, Mus musculus
gagattgaaatcatcctccaacagt

SEQ ID NO: 475955 - DNA, 25 bp, Mus musculus
gagattgaaatcttcctccaacagt

SEQ ID NO: 475956 - DNA, 25 bp, Mus musculus
gagattgaacctagagccgtgtgca

SEQ ID NO: 475957 - DNA, 25 bp, Mus musculus
gagattgaacctaggttcttgttaa

SEQ ID NO: 475958 - DNA, 25 bp, Mus musculus
gagattgaacctagtttcctgccaa

SEQ ID NO: 475959 - DNA, 25 bp, Mus musculus
gagattgaaccttgagccgtgtgca

SEQ ID NO: 475960 - DNA, 25 bp, Mus musculus
gagattgaaccttggttcttgttaa

SEQ ID NO: 475961 - DNA, 25 bp, Mus musculus
gagattgaaccttgtttcctgccaa

SEQ ID NO: 475962 - DNA, 25 bp, Mus musculus
gagattgaacgtaggtctttcccca

SEQ ID NO: 475963 - DNA, 25 bp, Mus musculus
gagattgaacgttggtctttcccca

SEQ ID NO: 475964 - DNA, 25 bp, Mus musculus
gagattgaacttaatgctgtgacca

SEQ ID NO: 475965 - DNA, 25 bp, Mus musculus
gagattgaactttatgctgtgacca

SEQ ID NO: 475966 - DNA, 25 bp, Mus musculus
gagattgaagcaatacccaccctgt

SEQ ID NO: 475967 - DNA, 25 bp, Mus musculus
gagattgaagcattacccaccctgt

SEQ ID NO: 475968 - DNA, 25 bp, Mus musculus
gagattgaatataacctctgcccct

SEQ ID NO: 475969 - DNA, 25 bp, Mus musculus
gagattgaatattacctctgcccct

SEQ ID NO: 475970 - DNA, 25 bp, Mus musculus
gagattgaatcaagctaactaaaat

SEQ ID NO: 475971 - DNA, 25 bp, Mus musculus
gagattgaatcatgctaactaaaat

SEQ ID NO: 475972 - DNA, 25 bp, Mus musculus
gagattgaatgcctggtgtttctga

SEQ ID NO: 475973 - DNA, 25 bp, Mus musculus
gagattgaatgcgtggtgtttctga

SEQ ID NO: 475974 - DNA, 25 bp, Mus musculus
gagattgacacaatggtcctaccag

SEQ ID NO: 475975 - DNA, 25 bp, Mus musculus
gagattgacacacgatttattttca

SEQ ID NO: 475976 - DNA, 25 bp, Mus musculus
gagattgacacaggatttattttca

SEQ ID NO: 475977 - DNA, 25 bp, Mus musculus
gagattgacacattggtcctaccag

SEQ ID NO: 475978 - DNA, 25 bp, Mus musculus
gagattgacactatcatcaagctga

SEQ ID NO: 475979 - DNA, 25 bp, Mus musculus
gagattgacactttcatcaagctga

SEQ ID NO: 475980 - DNA, 25 bp, Mus musculus
gagattgacagccacaactttgtaa

SEQ ID NO: 475981 - DNA, 25 bp, Mus musculus
gagattgacagcgacaactttgtaa

SEQ ID NO: 475982 - DNA, 25 bp, Mus musculus
gagattgacatcagctgtgaagcca

SEQ ID NO: 475983 - DNA, 25 bp, Mus musculus
gagattgacatctgctgtgaagcca

SEQ ID NO: 475984 - DNA, 25 bp, Mus musculus
gagattgaccaccattcgaaggaga

SEQ ID NO: 475985 - DNA, 25 bp, Mus musculus
gagattgaccacgattcgaaggaga

SEQ ID NO: 475986 - DNA, 25 bp, Mus musculus
gagattgaccgcaacacggcaattg

SEQ ID NO: 475987 - DNA, 25 bp, Mus musculus
gagattgaccgctacacggcaattg

SEQ ID NO: 475988 - DNA, 25 bp, Mus musculus
gagattgactctattggctcctcac

SEQ ID NO: 475989 - DNA, 25 bp, Mus musculus
gagattgactcttttggctcctcac

SEQ ID NO: 475990 - DNA, 25 bp, Mus musculus
gagattgacttaaccaaacactaac

SEQ ID NO: 475991 - DNA, 25 bp, Mus musculus
gagattgacttatccaaacactaac

SEQ ID NO: 475992 - DNA, 25 bp, Mus musculus
gagattgagcggacgattgtccagc

SEQ ID NO: 475993 - DNA, 25 bp, Mus musculus
gagattgagcggtcgattgtccagc

SEQ ID NO: 475994 - DNA, 25 bp, Mus musculus
gagattgaggccattgagcttccaa

SEQ ID NO: 475995 - DNA, 25 bp, Mus musculus
gagattgaggcctttgagcttccaa

SEQ ID NO: 475996 - DNA, 25 bp, Mus musculus
gagattgagtttccttttggtccaa

SEQ ID NO: 475997 - DNA, 25 bp, Mus musculus
gagattgagtttgcttttggtccaa

SEQ ID NO: 475998 - DNA, 25 bp, Mus musculus
gagattgatcacagctccaggacag

SEQ ID NO: 475999 - DNA, 25 bp, Mus musculus
gagattgatcactgctccaggacag

SEQ ID NO: 476000 - DNA, 25 bp, Mus musculus
gagattgatgctctttcattcccct

SEQ ID NO: 476001 - DNA, 25 bp, Mus musculus
gagattgatgctgtttcattcccct

SEQ ID NO: 476002 - DNA, 25 bp, Mus musculus
gagattgattggacttcactgccta

SEQ ID NO: 476003 - DNA, 25 bp, Mus musculus
gagattgattggtcttcactgccta

SEQ ID NO: 476004 - DNA, 25 bp, Mus musculus
gagattgcaacgctcttttgaatgt

SEQ ID NO: 476005 - DNA, 25 bp, Mus musculus
gagattgcaacggtcttttgaatgt

SEQ ID NO: 476006 - DNA, 25 bp, Mus musculus
gagattgcatgccatcatttgtttc

SEQ ID NO: 476007 - DNA, 25 bp, Mus musculus
gagattgcatgcgatcatttgtttc

SEQ ID NO: 476008 - DNA, 25 bp, Mus musculus
gagattgccaacatgtcactggaca

SEQ ID NO: 476009 - DNA, 25 bp, Mus musculus
gagattgccaacttgtcactggaca

SEQ ID NO: 476010 - DNA, 25 bp, Mus musculus
gagattgccagaatctataagcttc

SEQ ID NO: 476011 - DNA, 25 bp, Mus musculus
gagattgccagactgtaaccttcag

SEQ ID NO: 476012 - DNA, 25 bp, Mus musculus
gagattgccagagtgtaaccttcag

SEQ ID NO: 476013 - DNA, 25 bp, Mus musculus
gagattgccagattctataagcttc

SEQ ID NO: 476014 - DNA, 25 bp, Mus musculus
gagattgcctctccgcttaattaaa

SEQ ID NO: 476015 - DNA, 25 bp, Mus musculus
gagattgcctctgcgcttaattaaa

SEQ ID NO: 476016 - DNA, 25 bp, Mus musculus
gagattgcctgcaccagactaagac

SEQ ID NO: 476017 - DNA, 25 bp, Mus musculus
gagattgcctgcatggtgcttggct

SEQ ID NO: 476018 - DNA, 25 bp, Mus musculus
gagattgcctgctccagactaagac

SEQ ID NO: 476019 - DNA, 25 bp, Mus musculus
gagattgcctgcttggtgcttggct

SEQ ID NO: 476020 - DNA, 25 bp, Mus musculus
gagattgctcacacagtgaccacct

SEQ ID NO: 476021 - DNA, 25 bp, Mus musculus
gagattgctcactcagtgaccacct

SEQ ID NO: 476022 - DNA, 25 bp, Mus musculus
gagattgctgagaagtccctccact

SEQ ID NO: 476023 - DNA, 25 bp, Mus musculus
gagattgctgagtagtccctccact

SEQ ID NO: 476024 - DNA, 25 bp, Mus musculus
gagattgctggcagagaagtcctct

SEQ ID NO: 476025 - DNA, 25 bp, Mus musculus
gagattgctggctgagaagtcctct

SEQ ID NO: 476026 - DNA, 25 bp, Mus musculus
gagattgctgtgagcgagacatgca

SEQ ID NO: 476027 - DNA, 25 bp, Mus musculus
gagattgctgtgtgcgagacatgca

SEQ ID NO: 476028 - DNA, 25 bp, Mus musculus
gagattgcttttagatagcccaggc

SEQ ID NO: 476029 - DNA, 25 bp, Mus musculus
gagattgctttttgatagcccaggc

SEQ ID NO: 476030 - DNA, 25 bp, Mus musculus
gagattggaaacagactcgtctctg

SEQ ID NO: 476031 - DNA, 25 bp, Mus musculus
gagattggaaactgactcgtctctg

SEQ ID NO: 476032 - DNA, 25 bp, Mus musculus
gagattggatacagccaaaggagta

SEQ ID NO: 476033 - DNA, 25 bp, Mus musculus
gagattggatactgccaaaggagta

SEQ ID NO: 476034 - DNA, 25 bp, Mus musculus
gagattggatggagccttcactcaa

SEQ ID NO: 476035 - DNA, 25 bp, Mus musculus
gagattggatggtgccttcactcaa

SEQ ID NO: 476036 - DNA, 25 bp, Mus musculus
gagattggcatgcacacagattcag

SEQ ID NO: 476037 - DNA, 25 bp, Mus musculus
gagattggcatggacacagattcag

SEQ ID NO: 476038 - DNA, 25 bp, Mus musculus
gagattggctagagttctttggtca

SEQ ID NO: 476039 - DNA, 25 bp, Mus musculus
gagattggctagtgttctttggtca

SEQ ID NO: 476040 - DNA, 25 bp, Mus musculus
gagattgggcctcactgtgtatcca

SEQ ID NO: 476041 - DNA, 25 bp, Mus musculus
gagattgggcctgactgtgtatcca

SEQ ID NO: 476042 - DNA, 25 bp, Mus musculus
gagattgggctgaagcttcctttgt

SEQ ID NO: 476043 - DNA, 25 bp, Mus musculus
gagattgggctgtagcttcctttgt

SEQ ID NO: 476044 - DNA, 25 bp, Mus musculus
gagattggtcccaaaaaacaagaag

SEQ ID NO: 476045 - DNA, 25 bp, Mus musculus
gagattggtccctaaaaacaagaag

SEQ ID NO: 476046 - DNA, 25 bp, Mus musculus
gagattggtgctactgtaaagtgat

SEQ ID NO: 476047 - DNA, 25 bp, Mus musculus
gagattggtgcttctgtaaagtgat

SEQ ID NO: 476048 - DNA, 25 bp, Mus musculus
gagattggtttgactgcttgcaggc

SEQ ID NO: 476049 - DNA, 25 bp, Mus musculus
gagattggtttgtctgcttgcaggc

SEQ ID NO: 476050 - DNA, 25 bp, Mus musculus
gagattgtcatacaggaacgcccca

SEQ ID NO: 476051 - DNA, 25 bp, Mus musculus
gagattgtcatagaggaacgcccca

SEQ ID NO: 476052 - DNA, 25 bp, Mus musculus
gagattgtccagctgtttaaggcaa

SEQ ID NO: 476053 - DNA, 25 bp, Mus musculus
gagattgtccaggtgtttaaggcaa

SEQ ID NO: 476054 - DNA, 25 bp, Mus musculus
gagattgtcctcattgcatgtgccc

SEQ ID NO: 476055 - DNA, 25 bp, Mus musculus
gagattgtcctctttgcatgtgccc

SEQ ID NO: 476056 - DNA, 25 bp, Mus musculus
gagattgtctcgctttctactatcc

SEQ ID NO: 476057 - DNA, 25 bp, Mus musculus
gagattgtctcggtttctactatcc

SEQ ID NO: 476058 - DNA, 25 bp, Mus musculus
gagattgtgaacctgctgagcctga

SEQ ID NO: 476059 - DNA, 25 bp, Mus musculus
gagattgtgaacgtgctgagcctga

SEQ ID NO: 476060 - DNA, 25 bp, Mus musculus
gagattgtgcttactggaggtacca

SEQ ID NO: 476061 - DNA, 25 bp, Mus musculus
gagattgtgctttctggaggtacca

SEQ ID NO: 476062 - DNA, 25 bp, Mus musculus
gagattgtggcaattgtccagctat

SEQ ID NO: 476063 - DNA, 25 bp, Mus musculus
gagattgtggcatttgtccagctat

SEQ ID NO: 476064 - DNA, 25 bp, Mus musculus
gagattgtggctcgctagttgtata

SEQ ID NO: 476065 - DNA, 25 bp, Mus musculus
gagattgtggctggctagttgtata

SEQ ID NO: 476066 - DNA, 25 bp, Mus musculus
gagattgtgttaacccctgatgggc

SEQ ID NO: 476067 - DNA, 25 bp, Mus musculus
gagattgtgttatcccctgatgggc

SEQ ID NO: 476068 - DNA, 25 bp, Mus musculus
gagattgtgtttaaatcaggtttta

SEQ ID NO: 476069 - DNA, 25 bp, Mus musculus
gagattgtgttttaatcaggtttta

SEQ ID NO: 476070 - DNA, 25 bp, Mus musculus
gagattgttagtattgcctctggca

SEQ ID NO: 476071 - DNA, 25 bp, Mus musculus
gagattgttagttttgcctctggca

SEQ ID NO: 476072 - DNA, 25 bp, Mus musculus
gagattgttcccattatcattcata

SEQ ID NO: 476073 - DNA, 25 bp, Mus musculus
gagattgttccctttatcattcata

SEQ ID NO: 476074 - DNA, 25 bp, Mus musculus
gagattgttttcataccgtcgtttg

SEQ ID NO: 476075 - DNA, 25 bp, Mus musculus
gagattgttttcttaccgtcgtttg

SEQ ID NO: 476076 - DNA, 25 bp, Mus musculus
gagatttaacaaaacctgtccctga

SEQ ID NO: 476077 - DNA, 25 bp, Mus musculus
gagatttaacaatacctgtccctga

SEQ ID NO: 476078 - DNA, 25 bp, Mus musculus
gagatttaactaccattttccaaat

SEQ ID NO: 476079 - DNA, 25 bp, Mus musculus
gagatttaactagcattttccaaat

SEQ ID NO: 476080 - DNA, 25 bp, Mus musculus
gagatttaagagaactggtgcctgc

SEQ ID NO: 476081 - DNA, 25 bp, Mus musculus
gagatttaagagtactggtgcctgc

SEQ ID NO: 476082 - DNA, 25 bp, Mus musculus
gagatttaataccttgacactaaca

SEQ ID NO: 476083 - DNA, 25 bp, Mus musculus
gagatttaatacgttgacactaaca

SEQ ID NO: 476084 - DNA, 25 bp, Mus musculus
gagatttacacactataaattgctt

SEQ ID NO: 476085 - DNA, 25 bp, Mus musculus
gagatttacacagtataaattgctt

SEQ ID NO: 476086 - DNA, 25 bp, Mus musculus
gagatttacagaccttcctttcaag

SEQ ID NO: 476087 - DNA, 25 bp, Mus musculus
gagatttacagagcttcctttcaag

SEQ ID NO: 476088 - DNA, 25 bp, Mus musculus
gagatttacatgatgctgtccgcat

SEQ ID NO: 476089 - DNA, 25 bp, Mus musculus
gagatttacatgttgctgtccgcat

SEQ ID NO: 476090 - DNA, 25 bp, Mus musculus
gagatttagatccatgttcggctga

SEQ ID NO: 476091 - DNA, 25 bp, Mus musculus
gagatttagatcgatgttcggctga

SEQ ID NO: 476092 - DNA, 25 bp, Mus musculus
gagatttagctcagttttagagatg

SEQ ID NO: 476093 - DNA, 25 bp, Mus musculus
gagatttagctctgttttagagatg

SEQ ID NO: 476094 - DNA, 25 bp, Mus musculus
gagatttagtcactttccgtacaca

SEQ ID NO: 476095 - DNA, 25 bp, Mus musculus
gagatttagtcagtttccgtacaca

SEQ ID NO: 476096 - DNA, 25 bp, Mus musculus
gagatttatccgaggtccccagcag

SEQ ID NO: 476097 - DNA, 25 bp, Mus musculus
gagatttatccgtggtccccagcag

SEQ ID NO: 476098 - DNA, 25 bp, Mus musculus
gagatttatggccttttcccttcat

SEQ ID NO: 476099 - DNA, 25 bp, Mus musculus
gagatttatggcgttttcccttcat

SEQ ID NO: 476100 - DNA, 25 bp, Mus musculus
gagatttattccacagtatccatgt

SEQ ID NO: 476101 - DNA, 25 bp, Mus musculus
gagatttattcctcagtatccatgt

SEQ ID NO: 476102 - DNA, 25 bp, Mus musculus
gagatttcaccacttcaggaagctg

SEQ ID NO: 476103 - DNA, 25 bp, Mus musculus
gagatttcaccagttcaggaagctg

SEQ ID NO: 476104 - DNA, 25 bp, Mus musculus
gagatttcactgacctgcaagaaca

SEQ ID NO: 476105 - DNA, 25 bp, Mus musculus
gagatttcactgtcctgcaagaaca

SEQ ID NO: 476106 - DNA, 25 bp, Mus musculus
gagatttcagaaccacctgcaggtg

SEQ ID NO: 476107 - DNA, 25 bp, Mus musculus
gagatttcagaagcacctgcaggtg

SEQ ID NO: 476108 - DNA, 25 bp, Mus musculus
gagatttcagacagcagcccattta

SEQ ID NO: 476109 - DNA, 25 bp, Mus musculus
gagatttcagactgcagcccattta

SEQ ID NO: 476110 - DNA, 25 bp, Mus musculus
gagatttcagctacccatcaaaact

SEQ ID NO: 476111 - DNA, 25 bp, Mus musculus
gagatttcagcttcccatcaaaact

SEQ ID NO: 476112 - DNA, 25 bp, Mus musculus
gagatttcagtgactcttccagcag

SEQ ID NO: 476113 - DNA, 25 bp, Mus musculus
gagatttcagtgtctcttccagcag

SEQ ID NO: 476114 - DNA, 25 bp, Mus musculus
gagatttcagttctattaaaggctt

SEQ ID NO: 476115 - DNA, 25 bp, Mus musculus
gagatttcagttgtattaaaggctt

SEQ ID NO: 476116 - DNA, 25 bp, Mus musculus
gagatttcatctcctctccttcctg

SEQ ID NO: 476117 - DNA, 25 bp, Mus musculus
gagatttcatctgctctccttcctg

SEQ ID NO: 476118 - DNA, 25 bp, Mus musculus
gagatttcattgcaaccaaaggtca

SEQ ID NO: 476119 - DNA, 25 bp, Mus musculus
gagatttcattggaaccaaaggtca

SEQ ID NO: 476120 - DNA, 25 bp, Mus musculus
gagatttccaagctctacttttcat

SEQ ID NO: 476121 - DNA, 25 bp, Mus musculus
gagatttccaaggtctacttttcat

SEQ ID NO: 476122 - DNA, 25 bp, Mus musculus
gagatttccaatcaattgctttgac

SEQ ID NO: 476123 - DNA, 25 bp, Mus musculus
gagatttccaatgaattgctttgac

SEQ ID NO: 476124 - DNA, 25 bp, Mus musculus
gagatttccagaaggctccggagca

SEQ ID NO: 476125 - DNA, 25 bp, Mus musculus
gagatttccagatggctccggagca

SEQ ID NO: 476126 - DNA, 25 bp, Mus musculus
gagatttccatccaccttactgaaa

SEQ ID NO: 476127 - DNA, 25 bp, Mus musculus
gagatttccatcgaccttactgaaa

SEQ ID NO: 476128 - DNA, 25 bp, Mus musculus
gagatttccattccaaagccaacag

SEQ ID NO: 476129 - DNA, 25 bp, Mus musculus
gagatttccattgcaaagccaacag

SEQ ID NO: 476130 - DNA, 25 bp, Mus musculus
gagatttcccagaagcctcaggaac

SEQ ID NO: 476131 - DNA, 25 bp, Mus musculus
gagatttcccagaaggaggtccctt

SEQ ID NO: 476132 - DNA, 25 bp, Mus musculus
gagatttcccagtagcctcaggaac

SEQ ID NO: 476133 - DNA, 25 bp, Mus musculus
gagatttcccagtaggaggtccctt

SEQ ID NO: 476134 - DNA, 25 bp, Mus musculus
gagatttccctccaaagaggcactt

SEQ ID NO: 476135 - DNA, 25 bp, Mus musculus
gagatttccctcgaaagaggcactt

SEQ ID NO: 476136 - DNA, 25 bp, Mus musculus
gagatttcctgaagaccaccctcag

SEQ ID NO: 476137 - DNA, 25 bp, Mus musculus
gagatttcctgatgaccaccctcag

SEQ ID NO: 476138 - DNA, 25 bp, Mus musculus
gagatttccttcaaactgggcgtgg

SEQ ID NO: 476139 - DNA, 25 bp, Mus musculus
gagatttccttcatgttcgtttggg

SEQ ID NO: 476140 - DNA, 25 bp, Mus musculus
gagatttccttctaactgggcgtgg

SEQ ID NO: 476141 - DNA, 25 bp, Mus musculus
gagatttccttcttgttcgtttggg

SEQ ID NO: 476142 - DNA, 25 bp, Mus musculus
gagatttccttgagtctcatttgac

SEQ ID NO: 476143 - DNA, 25 bp, Mus musculus
gagatttccttgtgtctcatttgac

SEQ ID NO: 476144 - DNA, 25 bp, Mus musculus
gagatttctcaaacaatagcacagt

SEQ ID NO: 476145 - DNA, 25 bp, Mus musculus
gagatttctcaactgacaaccattg

SEQ ID NO: 476146 - DNA, 25 bp, Mus musculus
gagatttctcaagtgacaaccattg

SEQ ID NO: 476147 - DNA, 25 bp, Mus musculus
gagatttctcaatcaatagcacagt

SEQ ID NO: 476148 - DNA, 25 bp, Mus musculus
gagatttctctcagtagctctgtgt

SEQ ID NO: 476149 - DNA, 25 bp, Mus musculus
gagatttctctctgtagctctgtgt

SEQ ID NO: 476150 - DNA, 25 bp, Mus musculus
gagatttctggcctaatgtgttgga

SEQ ID NO: 476151 - DNA, 25 bp, Mus musculus
gagatttctggcgtaatgtgttgga

SEQ ID NO: 476152 - DNA, 25 bp, Mus musculus
gagatttcttagacctcaagggaga

SEQ ID NO: 476153 - DNA, 25 bp, Mus musculus
gagatttcttagtcctcaagggaga

SEQ ID NO: 476154 - DNA, 25 bp, Mus musculus
gagatttcttggctgattctaatac

SEQ ID NO: 476155 - DNA, 25 bp, Mus musculus
gagatttcttgggtgattctaatac

SEQ ID NO: 476156 - DNA, 25 bp, Mus musculus
gagatttctttcataaccttcccag

SEQ ID NO: 476157 - DNA, 25 bp, Mus musculus
gagatttctttcttaaccttcccag

SEQ ID NO: 476158 - DNA, 25 bp, Mus musculus
gagatttgaaaaagctgccatgtat

SEQ ID NO: 476159 - DNA, 25 bp, Mus musculus
gagatttgaaaatgctgccatgtat

SEQ ID NO: 476160 - DNA, 25 bp, Mus musculus
gagatttgaaccacggctggatgaa

SEQ ID NO: 476161 - DNA, 25 bp, Mus musculus
gagatttgaacctcggctggatgaa

SEQ ID NO: 476162 - DNA, 25 bp, Mus musculus
gagatttgacacaggtcctctaagg

SEQ ID NO: 476163 - DNA, 25 bp, Mus musculus
gagatttgacactggtcctctaagg

SEQ ID NO: 476164 - DNA, 25 bp, Mus musculus
gagatttgattgatccacatcatgt

SEQ ID NO: 476165 - DNA, 25 bp, Mus musculus
gagatttgattgttccacatcatgt

SEQ ID NO: 476166 - DNA, 25 bp, Mus musculus
gagatttgcaaaacctgcccagcaa

SEQ ID NO: 476167 - DNA, 25 bp, Mus musculus
gagatttgcaaatcctgcccagcaa

SEQ ID NO: 476168 - DNA, 25 bp, Mus musculus
gagatttgcagccacggtcattgct

SEQ ID NO: 476169 - DNA, 25 bp, Mus musculus
gagatttgcagcgacggtcattgct

SEQ ID NO: 476170 - DNA, 25 bp, Mus musculus
gagatttgcatgcttcatcggtgaa

SEQ ID NO: 476171 - DNA, 25 bp, Mus musculus
gagatttgcatggttcatcggtgaa

SEQ ID NO: 476172 - DNA, 25 bp, Mus musculus
gagatttgccaaagaggattcccaa

SEQ ID NO: 476173 - DNA, 25 bp, Mus musculus
gagatttgccaatgaggattcccaa

SEQ ID NO: 476174 - DNA, 25 bp, Mus musculus
gagatttgccctatactcttagttt

SEQ ID NO: 476175 - DNA, 25 bp, Mus musculus
gagatttgccctttactcttagttt

SEQ ID NO: 476176 - DNA, 25 bp, Mus musculus
gagatttgctacctgactttcttca

SEQ ID NO: 476177 - DNA, 25 bp, Mus musculus
gagatttgctacgtgactttcttca

SEQ ID NO: 476178 - DNA, 25 bp, Mus musculus
gagatttggcctatgaagaacacat

SEQ ID NO: 476179 - DNA, 25 bp, Mus musculus
gagatttggcctttgaagaacacat

SEQ ID NO: 476180 - DNA, 25 bp, Mus musculus
gagatttggcttcactttagtttgt

SEQ ID NO: 476181 - DNA, 25 bp, Mus musculus
gagatttggcttgactttagtttgt

SEQ ID NO: 476182 - DNA, 25 bp, Mus musculus
gagatttggttcagggaaagctgca

SEQ ID NO: 476183 - DNA, 25 bp, Mus musculus
gagatttggttctgggaaagctgca

SEQ ID NO: 476184 - DNA, 25 bp, Mus musculus
gagatttgtaatccctcttgtaggc

SEQ ID NO: 476185 - DNA, 25 bp, Mus musculus
gagatttgtaatgcctcttgtaggc

SEQ ID NO: 476186 - DNA, 25 bp, Mus musculus
gagatttgtagtctagacccctcag

SEQ ID NO: 476187 - DNA, 25 bp, Mus musculus
gagatttgtagtgtagacccctcag

SEQ ID NO: 476188 - DNA, 25 bp, Mus musculus
gagatttgtcagctctctgcgaaat

SEQ ID NO: 476189 - DNA, 25 bp, Mus musculus
gagatttgtcaggtctctgcgaaat

SEQ ID NO: 476190 - DNA, 25 bp, Mus musculus
gagatttgtctaacttgttcagagc

SEQ ID NO: 476191 - DNA, 25 bp, Mus musculus
gagatttgtctatcttgttcagagc

SEQ ID NO: 476192 - DNA, 25 bp, Mus musculus
gagatttgtcttaaagcctgggttt

SEQ ID NO: 476193 - DNA, 25 bp, Mus musculus
gagatttgtctttaagcctgggttt

SEQ ID NO: 476194 - DNA, 25 bp, Mus musculus
gagatttgtgccctggaattgtcac

SEQ ID NO: 476195 - DNA, 25 bp, Mus musculus
gagatttgtgccgtggaattgtcac

SEQ ID NO: 476196 - DNA, 25 bp, Mus musculus
gagatttgtgggagtagctaccagt

SEQ ID NO: 476197 - DNA, 25 bp, Mus musculus
gagatttgtgggtgtagctaccagt

SEQ ID NO: 476198 - DNA, 25 bp, Mus musculus
gagatttgttcaagtcctccctcca

SEQ ID NO: 476199 - DNA, 25 bp, Mus musculus
gagatttgttcatgtcctccctcca

SEQ ID NO: 476200 - DNA, 25 bp, Mus musculus
gagattttaacacgccacgcagtga

SEQ ID NO: 476201 - DNA, 25 bp, Mus musculus
gagattttaacaggccacgcagtga

SEQ ID NO: 476202 - DNA, 25 bp, Mus musculus
gagattttacagagattcgcaccac

SEQ ID NO: 476203 - DNA, 25 bp, Mus musculus
gagattttacagtgattcgcaccac

SEQ ID NO: 476204 - DNA, 25 bp, Mus musculus
gagattttagagatctcgttttcat

SEQ ID NO: 476205 - DNA, 25 bp, Mus musculus
gagattttagagttctcgttttcat

SEQ ID NO: 476206 - DNA, 25 bp, Mus musculus
gagattttagtaagggctggaactt

SEQ ID NO: 476207 - DNA, 25 bp, Mus musculus
gagattttagtatgggctggaactt

SEQ ID NO: 476208 - DNA, 25 bp, Mus musculus
gagattttagtcatcttcctatcat

SEQ ID NO: 476209 - DNA, 25 bp, Mus musculus
gagattttagtcttcttcctatcat

SEQ ID NO: 476210 - DNA, 25 bp, Mus musculus
gagattttatgaatccaggttcagg

SEQ ID NO: 476211 - DNA, 25 bp, Mus musculus
gagattttatgattccaggttcagg

SEQ ID NO: 476212 - DNA, 25 bp, Mus musculus
gagattttcaaaacccctaactgcc

SEQ ID NO: 476213 - DNA, 25 bp, Mus musculus
gagattttcaaatcccctaactgcc

SEQ ID NO: 476214 - DNA, 25 bp, Mus musculus
gagattttcacaacctccaacagaa

SEQ ID NO: 476215 - DNA, 25 bp, Mus musculus
gagattttcacatcctccaacagaa

SEQ ID NO: 476216 - DNA, 25 bp, Mus musculus
gagattttcactcagctgctcatga

SEQ ID NO: 476217 - DNA, 25 bp, Mus musculus
gagattttcactgagctgctcatga

SEQ ID NO: 476218 - DNA, 25 bp, Mus musculus
gagattttcagcattccgtaggcct

SEQ ID NO: 476219 - DNA, 25 bp, Mus musculus
gagattttcagctttccgtaggcct

SEQ ID NO: 476220 - DNA, 25 bp, Mus musculus
gagattttccccactcggagtggca

SEQ ID NO: 476221 - DNA, 25 bp, Mus musculus
gagattttcccctctcggagtggca

SEQ ID NO: 476222 - DNA, 25 bp, Mus musculus
gagattttcctcaacatgaattcct

SEQ ID NO: 476223 - DNA, 25 bp, Mus musculus
gagattttcctctacatgaattcct

SEQ ID NO: 476224 - DNA, 25 bp, Mus musculus
gagattttcgctctatgtaattaga

SEQ ID NO: 476225 - DNA, 25 bp, Mus musculus
gagattttcgctgtatgtaattaga

SEQ ID NO: 476226 - DNA, 25 bp, Mus musculus
gagattttctctatggagtaggaca

SEQ ID NO: 476227 - DNA, 25 bp, Mus musculus
gagattttctctttggagtaggaca

SEQ ID NO: 476228 - DNA, 25 bp, Mus musculus
gagattttctgacagccaggattac

SEQ ID NO: 476229 - DNA, 25 bp, Mus musculus
gagattttctgagagccaggattac

SEQ ID NO: 476230 - DNA, 25 bp, Mus musculus
gagattttctttaccgttgatgttt

SEQ ID NO: 476231 - DNA, 25 bp, Mus musculus
gagattttcttttccgttgatgttt

SEQ ID NO: 476232 - DNA, 25 bp, Mus musculus
gagattttgacgcacacttccacag

SEQ ID NO: 476233 - DNA, 25 bp, Mus musculus
gagattttgacggacacttccacag

SEQ ID NO: 476234 - DNA, 25 bp, Mus musculus
gagattttggagctcctttgtcaaa

SEQ ID NO: 476235 - DNA, 25 bp, Mus musculus
gagattttggaggtcctttgtcaaa

SEQ ID NO: 476236 - DNA, 25 bp, Mus musculus
gagattttgtccatagcaagcaact

SEQ ID NO: 476237 - DNA, 25 bp, Mus musculus
gagattttgtccttagcaagcaact

SEQ ID NO: 476238 - DNA, 25 bp, Mus musculus
gagattttgtgccattcctgttaaa

SEQ ID NO: 476239 - DNA, 25 bp, Mus musculus
gagattttgtgcgattcctgttaaa

SEQ ID NO: 476240 - DNA, 25 bp, Mus musculus
gagattttgttaatggcgatggcac

SEQ ID NO: 476241 - DNA, 25 bp, Mus musculus
gagattttgttattggcgatggcac

SEQ ID NO: 476242 - DNA, 25 bp, Mus musculus
gagatttttaaaactgcagccacat

SEQ ID NO: 476243 - DNA, 25 bp, Mus musculus
gagatttttaaatctgcagccacat

SEQ ID NO: 476244 - DNA, 25 bp, Mus musculus
gagatttttcaaagcctcatttctg

SEQ ID NO: 476245 - DNA, 25 bp, Mus musculus
gagatttttcaatgcctcatttctg

SEQ ID NO: 476246 - DNA, 25 bp, Mus musculus
gagatttttcgaattggctatgaac

SEQ ID NO: 476247 - DNA, 25 bp, Mus musculus
gagatttttcgatttggctatgaac

SEQ ID NO: 476248 - DNA, 25 bp, Mus musculus
gagatttttgccagagcctgttgaa

SEQ ID NO: 476249 - DNA, 25 bp, Mus musculus
gagatttttgcctgagcctgttgaa

SEQ ID NO: 476250 - DNA, 25 bp, Mus musculus
gagattttttaaaaccaggtgccag

SEQ ID NO: 476251 - DNA, 25 bp, Mus musculus
gagattttttaataccaggtgccag

SEQ ID NO: 476252 - DNA, 25 bp, Mus musculus
gagattttttcacctaatttgttat

SEQ ID NO: 476253 - DNA, 25 bp, Mus musculus
gagattttttcagctaatttgttat

SEQ ID NO: 476254 - DNA, 25 bp, Mus musculus
gagattttttctccgaatgacaaga

SEQ ID NO: 476255 - DNA, 25 bp, Mus musculus
gagattttttctgcgaatgacaaga

SEQ ID NO: 476256 - DNA, 25 bp, Mus musculus
gagcaaaaccaacaccaaccagaag

SEQ ID NO: 476257 - DNA, 25 bp, Mus musculus
gagcaaaaccaagaccaaccagaag

SEQ ID NO: 476258 - DNA, 25 bp, Mus musculus
gagcaaaacccaaagaagccgcaca

SEQ ID NO: 476259 - DNA, 25 bp, Mus musculus
gagcaaaacccaataaagtctttat

SEQ ID NO: 476260 - DNA, 25 bp, Mus musculus
gagcaaaacccatagaagccgcaca

SEQ ID NO: 476261 - DNA, 25 bp, Mus musculus
gagcaaaacccattaaagtctttat

SEQ ID NO: 476262 - DNA, 25 bp, Mus musculus
gagcaaaagattccctactagcagt

SEQ ID NO: 476263 - DNA, 25 bp, Mus musculus
gagcaaaagattgcctactagcagt

SEQ ID NO: 476264 - DNA, 25 bp, Mus musculus
gagcaaaagcagctgctgtccccag

SEQ ID NO: 476265 - DNA, 25 bp, Mus musculus
gagcaaaagcaggtgctgtccccag

SEQ ID NO: 476266 - DNA, 25 bp, Mus musculus
gagcaaaagctcacctcggctaata

SEQ ID NO: 476267 - DNA, 25 bp, Mus musculus
gagcaaaagctctcctcggctaata

SEQ ID NO: 476268 - DNA, 25 bp, Mus musculus
gagcaaaagctgaagatcgaccaga

SEQ ID NO: 476269 - DNA, 25 bp, Mus musculus
gagcaaaagctgtagatcgaccaga

SEQ ID NO: 476270 - DNA, 25 bp, Mus musculus
gagcaaaattcaataatcccacaag

SEQ ID NO: 476271 - DNA, 25 bp, Mus musculus
gagcaaaattcattaatcccacaag

SEQ ID NO: 476272 - DNA, 25 bp, Mus musculus
gagcaaaattgtactccattgttat

SEQ ID NO: 476273 - DNA, 25 bp, Mus musculus
gagcaaaattgttctccattgttat

SEQ ID NO: 476274 - DNA, 25 bp, Mus musculus
gagcaaaattttcacctatgaccct

SEQ ID NO: 476275 - DNA, 25 bp, Mus musculus
gagcaaaattttgacctatgaccct

SEQ ID NO: 476276 - DNA, 25 bp, Mus musculus
gagcaaacaatcacactgtagccgt

SEQ ID NO: 476277 - DNA, 25 bp, Mus musculus
gagcaaacaatctcactgtagccgt

SEQ ID NO: 476278 - DNA, 25 bp, Mus musculus
gagcaaaccagccatctaaaggccc

SEQ ID NO: 476279 - DNA, 25 bp, Mus musculus
gagcaaaccagcgatctaaaggccc

SEQ ID NO: 476280 - DNA, 25 bp, Mus musculus
gagcaaacccagagcccaggaaaat

SEQ ID NO: 476281 - DNA, 25 bp, Mus musculus
gagcaaacccagtgcccaggaaaat

SEQ ID NO: 476282 - DNA, 25 bp, Mus musculus
gagcaaaccctaagccatgcgttgg

SEQ ID NO: 476283 - DNA, 25 bp, Mus musculus
gagcaaaccctatgccatgcgttgg

SEQ ID NO: 476284 - DNA, 25 bp, Mus musculus
gagcaaaccgtgattacatgtctgt

SEQ ID NO: 476285 - DNA, 25 bp, Mus musculus
gagcaaaccgtgtttacatgtctgt

SEQ ID NO: 476286 - DNA, 25 bp, Mus musculus
gagcaaacctataaggccactcctg

SEQ ID NO: 476287 - DNA, 25 bp, Mus musculus
gagcaaacctattaggccactcctg

SEQ ID NO: 476288 - DNA, 25 bp, Mus musculus
gagcaaacctttactctggtggaat

SEQ ID NO: 476289 - DNA, 25 bp, Mus musculus
gagcaaaccttttctctggtggaat

SEQ ID NO: 476290 - DNA, 25 bp, Mus musculus
gagcaaacgccacgccgagctagca

SEQ ID NO: 476291 - DNA, 25 bp, Mus musculus
gagcaaacgccaggccgagctagca

SEQ ID NO: 476292 - DNA, 25 bp, Mus musculus
gagcaaacgggaaccccatggcaat

SEQ ID NO: 476293 - DNA, 25 bp, Mus musculus
gagcaaacgggatccccatggcaat

SEQ ID NO: 476294 - DNA, 25 bp, Mus musculus
gagcaaacggtgaagcgtgcttcct

SEQ ID NO: 476295 - DNA, 25 bp, Mus musculus
gagcaaacggtgtagcgtgcttcct

SEQ ID NO: 476296 - DNA, 25 bp, Mus musculus
gagcaaactcaaactgcgggcggat

SEQ ID NO: 476297 - DNA, 25 bp, Mus musculus
gagcaaactcaatctgcgggcggat

SEQ ID NO: 476298 - DNA, 25 bp, Mus musculus
gagcaaactcttaggccttggagca

SEQ ID NO: 476299 - DNA, 25 bp, Mus musculus
gagcaaactctttggccttggagca

SEQ ID NO: 476300 - DNA, 25 bp, Mus musculus
gagcaaactgctctcaaagcctgtt

SEQ ID NO: 476301 - DNA, 25 bp, Mus musculus
gagcaaactgctgtcaaagcctgtt

SEQ ID NO: 476302 - DNA, 25 bp, Mus musculus
gagcaaactggactaaactccctat

SEQ ID NO: 476303 - DNA, 25 bp, Mus musculus
gagcaaactggagtaaactccctat

SEQ ID NO: 476304 - DNA, 25 bp, Mus musculus
gagcaaacttttcactcagaacctt

SEQ ID NO: 476305 - DNA, 25 bp, Mus musculus
gagcaaacttttgactcagaacctt

SEQ ID NO: 476306 - DNA, 25 bp, Mus musculus
gagcaaagacccatcgaggaatggt

SEQ ID NO: 476307 - DNA, 25 bp, Mus musculus
gagcaaagacccttcgaggaatggt

SEQ ID NO: 476308 - DNA, 25 bp, Mus musculus
gagcaaagagatcctgccatggaac

SEQ ID NO: 476309 - DNA, 25 bp, Mus musculus
gagcaaagagatgctgccatggaac

SEQ ID NO: 476310 - DNA, 25 bp, Mus musculus
gagcaaagccggatttcttctggaa

SEQ ID NO: 476311 - DNA, 25 bp, Mus musculus
gagcaaagccggttttcttctggaa

SEQ ID NO: 476312 - DNA, 25 bp, Mus musculus
gagcaaagcctgacaagcatccaga

SEQ ID NO: 476313 - DNA, 25 bp, Mus musculus
gagcaaagcctgagactattcatta

SEQ ID NO: 476314 - DNA, 25 bp, Mus musculus
gagcaaagcctgagactgaacacat

SEQ ID NO: 476315 - DNA, 25 bp, Mus musculus
gagcaaagcctgtcaagcatccaga

SEQ ID NO: 476316 - DNA, 25 bp, Mus musculus
gagcaaagcctgtgactattcatta

SEQ ID NO: 476317 - DNA, 25 bp, Mus musculus
gagcaaagcctgtgactgaacacat

SEQ ID NO: 476318 - DNA, 25 bp, Mus musculus
gagcaaagcgggaggctctacccta

SEQ ID NO: 476319 - DNA, 25 bp, Mus musculus
gagcaaagcgggtggctctacccta

SEQ ID NO: 476320 - DNA, 25 bp, Mus musculus
gagcaaagctaaagccgctgccagg

SEQ ID NO: 476321 - DNA, 25 bp, Mus musculus
gagcaaagctaatgccgctgccagg

SEQ ID NO: 476322 - DNA, 25 bp, Mus musculus
gagcaaagctagcaaaattctgatt

SEQ ID NO: 476323 - DNA, 25 bp, Mus musculus
gagcaaagctaggaaaattctgatt

SEQ ID NO: 476324 - DNA, 25 bp, Mus musculus
gagcaaagctcaacgttctctctgg

SEQ ID NO: 476325 - DNA, 25 bp, Mus musculus
gagcaaagctcatcgttctctctgg

SEQ ID NO: 476326 - DNA, 25 bp, Mus musculus
gagcaaagctggagacttctctcca

SEQ ID NO: 476327 - DNA, 25 bp, Mus musculus
gagcaaagctggtgacttctctcca

SEQ ID NO: 476328 - DNA, 25 bp, Mus musculus
gagcaaaggctaccccatcctaaac

SEQ ID NO: 476329 - DNA, 25 bp, Mus musculus
gagcaaaggctagcccatcctaaac

SEQ ID NO: 476330 - DNA, 25 bp, Mus musculus
gagcaaaggcttcgatgcatattcc

SEQ ID NO: 476331 - DNA, 25 bp, Mus musculus
gagcaaaggcttggatgcatattcc

SEQ ID NO: 476332 - DNA, 25 bp, Mus musculus
gagcaaaggggtctgtttaaatcta

SEQ ID NO: 476333 - DNA, 25 bp, Mus musculus
gagcaaaggggtgtgtttaaatcta

SEQ ID NO: 476334 - DNA, 25 bp, Mus musculus
gagcaaaggtgcataagtagacagc

SEQ ID NO: 476335 - DNA, 25 bp, Mus musculus
gagcaaaggtgcttaagtagacagc

SEQ ID NO: 476336 - DNA, 25 bp, Mus musculus
gagcaaagtaccctttaggctgtaa

SEQ ID NO: 476337 - DNA, 25 bp, Mus musculus
gagcaaagtaccgtttaggctgtaa

SEQ ID NO: 476338 - DNA, 25 bp, Mus musculus
gagcaaagtctaccacaactcttat

SEQ ID NO: 476339 - DNA, 25 bp, Mus musculus
gagcaaagtctagcacaactcttat

SEQ ID NO: 476340 - DNA, 25 bp, Mus musculus
gagcaaagtgaccatcctctactaa

SEQ ID NO: 476341 - DNA, 25 bp, Mus musculus
gagcaaagtgacgatcctctactaa

SEQ ID NO: 476342 - DNA, 25 bp, Mus musculus
gagcaaagttcaccggttggattca

SEQ ID NO: 476343 - DNA, 25 bp, Mus musculus
gagcaaagttcagcggttggattca

SEQ ID NO: 476344 - DNA, 25 bp, Mus musculus
gagcaaataaagacactgtcaccaa

SEQ ID NO: 476345 - DNA, 25 bp, Mus musculus
gagcaaataaagtcactgtcaccaa

SEQ ID NO: 476346 - DNA, 25 bp, Mus musculus
gagcaaatacccattggatgtacaa

SEQ ID NO: 476347 - DNA, 25 bp, Mus musculus
gagcaaataccctttggatgtacaa

SEQ ID NO: 476348 - DNA, 25 bp, Mus musculus
gagcaaatccaacttcagtgtgtaa

SEQ ID NO: 476349 - DNA, 25 bp, Mus musculus
gagcaaatccaagttcagtgtgtaa

SEQ ID NO: 476350 - DNA, 25 bp, Mus musculus
gagcaaatcgccattccacagcatg

SEQ ID NO: 476351 - DNA, 25 bp, Mus musculus
gagcaaatcgcctttccacagcatg

SEQ ID NO: 476352 - DNA, 25 bp, Mus musculus
gagcaaatctcaactccattatgtt

SEQ ID NO: 476353 - DNA, 25 bp, Mus musculus
gagcaaatctcatctccattatgtt

SEQ ID NO: 476354 - DNA, 25 bp, Mus musculus
gagcaaatctctagcaagtgtcaac

SEQ ID NO: 476355 - DNA, 25 bp, Mus musculus
gagcaaatctcttgcaagtgtcaac

SEQ ID NO: 476356 - DNA, 25 bp, Mus musculus
gagcaaatgcagaactaagccccac

SEQ ID NO: 476357 - DNA, 25 bp, Mus musculus
gagcaaatgcagtactaagccccac

SEQ ID NO: 476358 - DNA, 25 bp, Mus musculus
gagcaaatgcctcgtgaacacacac

SEQ ID NO: 476359 - DNA, 25 bp, Mus musculus
gagcaaatgcctggtgaacacacac

SEQ ID NO: 476360 - DNA, 25 bp, Mus musculus
gagcaaatgctcactgtgtgcttaa

SEQ ID NO: 476361 - DNA, 25 bp, Mus musculus
gagcaaatgctctctgtgtgcttaa

SEQ ID NO: 476362 - DNA, 25 bp, Mus musculus
gagcaaatgcttactgttcgatgtt

SEQ ID NO: 476363 - DNA, 25 bp, Mus musculus
gagcaaatgctttctgttcgatgtt

SEQ ID NO: 476364 - DNA, 25 bp, Mus musculus
gagcaaatgttcaccagcatatagt

SEQ ID NO: 476365 - DNA, 25 bp, Mus musculus
gagcaaatgttctccagcatatagt

SEQ ID NO: 476366 - DNA, 25 bp, Mus musculus
gagcaaatgtttaattcttcatact

SEQ ID NO: 476367 - DNA, 25 bp, Mus musculus
gagcaaatgttttattcttcatact

SEQ ID NO: 476368 - DNA, 25 bp, Mus musculus
gagcaaattcaaccggaacagtgtt

SEQ ID NO: 476369 - DNA, 25 bp, Mus musculus
gagcaaattcaagcggaacagtgtt

SEQ ID NO: 476370 - DNA, 25 bp, Mus musculus
gagcaaattcgaatcacttgacttt

SEQ ID NO: 476371 - DNA, 25 bp, Mus musculus
gagcaaattcgattcacttgacttt

SEQ ID NO: 476372 - DNA, 25 bp, Mus musculus
gagcaaattgcacgctagactgggt

SEQ ID NO: 476373 - DNA, 25 bp, Mus musculus
gagcaaattgcaggctagactgggt

SEQ ID NO: 476374 - DNA, 25 bp, Mus musculus
gagcaaattgccatgtcggaccggt

SEQ ID NO: 476375 - DNA, 25 bp, Mus musculus
gagcaaattgccttgtcggaccggt

SEQ ID NO: 476376 - DNA, 25 bp, Mus musculus
gagcaaatttcacttatgaggtaga

SEQ ID NO: 476377 - DNA, 25 bp, Mus musculus
gagcaaatttcagttatgaggtaga

SEQ ID NO: 476378 - DNA, 25 bp, Mus musculus
gagcaaatttgtcctgaacctgaat

SEQ ID NO: 476379 - DNA, 25 bp, Mus musculus
gagcaaatttgtgctgaacctgaat

SEQ ID NO: 476380 - DNA, 25 bp, Mus musculus
gagcaacaaacaagtaagtactatg

SEQ ID NO: 476381 - DNA, 25 bp, Mus musculus
gagcaacaaacatgtaagtactatg

SEQ ID NO: 476382 - DNA, 25 bp, Mus musculus
gagcaacaaggtatcttgccaagaa

SEQ ID NO: 476383 - DNA, 25 bp, Mus musculus
gagcaacaaggtttcttgccaagaa

SEQ ID NO: 476384 - DNA, 25 bp, Mus musculus
gagcaacaattgatcctaactgctg

SEQ ID NO: 476385 - DNA, 25 bp, Mus musculus
gagcaacaattgttcctaactgctg

SEQ ID NO: 476386 - DNA, 25 bp, Mus musculus
gagcaacacatgcacaatgggcaca

SEQ ID NO: 476387 - DNA, 25 bp, Mus musculus
gagcaacacatggacaatgggcaca

SEQ ID NO: 476388 - DNA, 25 bp, Mus musculus
gagcaacacattatgtagcgagcaa

SEQ ID NO: 476389 - DNA, 25 bp, Mus musculus
gagcaacacattttgtagcgagcaa

SEQ ID NO: 476390 - DNA, 25 bp, Mus musculus
gagcaacaccctccatgtgggaata

SEQ ID NO: 476391 - DNA, 25 bp, Mus musculus
gagcaacaccctgcatgtgggaata

SEQ ID NO: 476392 - DNA, 25 bp, Mus musculus
gagcaacaccttagacacgtgactg

SEQ ID NO: 476393 - DNA, 25 bp, Mus musculus
gagcaacacctttgacacgtgactg

SEQ ID NO: 476394 - DNA, 25 bp, Mus musculus
gagcaacacggaccaaggattcttt

SEQ ID NO: 476395 - DNA, 25 bp, Mus musculus
gagcaacacggagcaaggattcttt

SEQ ID NO: 476396 - DNA, 25 bp, Mus musculus
gagcaacactgcacttctgatagaa

SEQ ID NO: 476397 - DNA, 25 bp, Mus musculus
gagcaacactgctcttctgatagaa

SEQ ID NO: 476398 - DNA, 25 bp, Mus musculus
gagcaacactgtacctgagttgtaa

SEQ ID NO: 476399 - DNA, 25 bp, Mus musculus
gagcaacactgttcctgagttgtaa

SEQ ID NO: 476400 - DNA, 25 bp, Mus musculus
gagcaacagcaaaggcggcccggca

SEQ ID NO: 476401 - DNA, 25 bp, Mus musculus
gagcaacagcaatggcggcccggca

SEQ ID NO: 476402 - DNA, 25 bp, Mus musculus
gagcaacagcgaaggagtctattac

SEQ ID NO: 476403 - DNA, 25 bp, Mus musculus
gagcaacagcgatggagtctattac

SEQ ID NO: 476404 - DNA, 25 bp, Mus musculus
gagcaacaggagagctttataaaac

SEQ ID NO: 476405 - DNA, 25 bp, Mus musculus
gagcaacaggagtgctttataaaac

SEQ ID NO: 476406 - DNA, 25 bp, Mus musculus
gagcaacatactacctgtagcaagc

SEQ ID NO: 476407 - DNA, 25 bp, Mus musculus
gagcaacatacttcctgtagcaagc

SEQ ID NO: 476408 - DNA, 25 bp, Mus musculus
gagcaacatagcaaacaccaggcta

SEQ ID NO: 476409 - DNA, 25 bp, Mus musculus
gagcaacatagctaacaccaggcta

SEQ ID NO: 476410 - DNA, 25 bp, Mus musculus
gagcaacatccacatgggacctaga

SEQ ID NO: 476411 - DNA, 25 bp, Mus musculus
gagcaacatccagatgggacctaga

SEQ ID NO: 476412 - DNA, 25 bp, Mus musculus
gagcaacatgtaaggccaggtcact

SEQ ID NO: 476413 - DNA, 25 bp, Mus musculus
gagcaacatgtatggccaggtcact

SEQ ID NO: 476414 - DNA, 25 bp, Mus musculus
gagcaacatttacacatgaccccag

SEQ ID NO: 476415 - DNA, 25 bp, Mus musculus
gagcaacatttagacatgaccccag

SEQ ID NO: 476416 - DNA, 25 bp, Mus musculus
gagcaaccaaaaaccatacttcctt

SEQ ID NO: 476417 - DNA, 25 bp, Mus musculus
gagcaaccaaaatccatacttcctt

SEQ ID NO: 476418 - DNA, 25 bp, Mus musculus
gagcaaccacagcaagggaagccat

SEQ ID NO: 476419 - DNA, 25 bp, Mus musculus
gagcaaccacaggaagggaagccat

SEQ ID NO: 476420 - DNA, 25 bp, Mus musculus
gagcaaccagagagctgttcagaaa

SEQ ID NO: 476421 - DNA, 25 bp, Mus musculus
gagcaaccagagtgctgttcagaaa

SEQ ID NO: 476422 - DNA, 25 bp, Mus musculus
gagcaaccagcgcttgtgactgata

SEQ ID NO: 476423 - DNA, 25 bp, Mus musculus
gagcaaccagcggttgtgactgata

SEQ ID NO: 476424 - DNA, 25 bp, Mus musculus
gagcaaccagctctgaagccctgtt

SEQ ID NO: 476425 - DNA, 25 bp, Mus musculus
gagcaaccagctgtgaagccctgtt

SEQ ID NO: 476426 - DNA, 25 bp, Mus musculus
gagcaacccatactatcctgatgtt

SEQ ID NO: 476427 - DNA, 25 bp, Mus musculus
gagcaacccatagtatcctgatgtt

SEQ ID NO: 476428 - DNA, 25 bp, Mus musculus
gagcaacccatgaaatctttgtgtt

SEQ ID NO: 476429 - DNA, 25 bp, Mus musculus
gagcaacccatgtaatctttgtgtt

SEQ ID NO: 476430 - DNA, 25 bp, Mus musculus
gagcaaccccgcagtaaacaacaga

SEQ ID NO: 476431 - DNA, 25 bp, Mus musculus
gagcaaccccgctgtaaacaacaga

SEQ ID NO: 476432 - DNA, 25 bp, Mus musculus
gagcaacccgatctggatactggaa

SEQ ID NO: 476433 - DNA, 25 bp, Mus musculus
gagcaacccgatgtggatactggaa

SEQ ID NO: 476434 - DNA, 25 bp, Mus musculus
gagcaaccgtttacctgtatttgta

SEQ ID NO: 476435 - DNA, 25 bp, Mus musculus
gagcaaccgttttcctgtatttgta

SEQ ID NO: 476436 - DNA, 25 bp, Mus musculus
gagcaacctcttccgaaggacctga

SEQ ID NO: 476437 - DNA, 25 bp, Mus musculus
gagcaacctcttgcgaaggacctga

SEQ ID NO: 476438 - DNA, 25 bp, Mus musculus
gagcaacctgagaacatcagtcatt

SEQ ID NO: 476439 - DNA, 25 bp, Mus musculus
gagcaacctgagtacatcagtcatt

SEQ ID NO: 476440 - DNA, 25 bp, Mus musculus
gagcaacctgcccagaggacggtca

SEQ ID NO: 476441 - DNA, 25 bp, Mus musculus
gagcaacctgccgagaggacggtca

SEQ ID NO: 476442 - DNA, 25 bp, Mus musculus
gagcaacctgctattggcactgggt

SEQ ID NO: 476443 - DNA, 25 bp, Mus musculus
gagcaacctgcttttggcactgggt

SEQ ID NO: 476444 - DNA, 25 bp, Mus musculus
gagcaacctggccaaggtccagaga

SEQ ID NO: 476445 - DNA, 25 bp, Mus musculus
gagcaacctggcgaaggtccagaga

SEQ ID NO: 476446 - DNA, 25 bp, Mus musculus
gagcaaccttacaggatttgggatt

SEQ ID NO: 476447 - DNA, 25 bp, Mus musculus
gagcaaccttactggatttgggatt

SEQ ID NO: 476448 - DNA, 25 bp, Mus musculus
gagcaaccttatcaaggcctgtcta

SEQ ID NO: 476449 - DNA, 25 bp, Mus musculus
gagcaaccttatctcaagatttcaa

SEQ ID NO: 476450 - DNA, 25 bp, Mus musculus
gagcaaccttatgaaggcctgtcta

SEQ ID NO: 476451 - DNA, 25 bp, Mus musculus
gagcaaccttatgtcaagatttcaa

SEQ ID NO: 476452 - DNA, 25 bp, Mus musculus
gagcaaccttgaattctgaggctag

SEQ ID NO: 476453 - DNA, 25 bp, Mus musculus
gagcaaccttgatttctgaggctag

SEQ ID NO: 476454 - DNA, 25 bp, Mus musculus
gagcaaccttggctacttgcagttt

SEQ ID NO: 476455 - DNA, 25 bp, Mus musculus
gagcaaccttgggtacttgcagttt

SEQ ID NO: 476456 - DNA, 25 bp, Mus musculus
gagcaacgccgaatatacgcaactt

SEQ ID NO: 476457 - DNA, 25 bp, Mus musculus
gagcaacgccgattatacgcaactt

SEQ ID NO: 476458 - DNA, 25 bp, Mus musculus
gagcaacgctggcataaaaagtatt

SEQ ID NO: 476459 - DNA, 25 bp, Mus musculus
gagcaacgctgggataaaaagtatt

SEQ ID NO: 476460 - DNA, 25 bp, Mus musculus
gagcaacgcttaagcccgggaagaa

SEQ ID NO: 476461 - DNA, 25 bp, Mus musculus
gagcaacgcttatgcccgggaagaa

SEQ ID NO: 476462 - DNA, 25 bp, Mus musculus
gagcaacgtgatctaaccacacctg

SEQ ID NO: 476463 - DNA, 25 bp, Mus musculus
gagcaacgtgatgtaaccacacctg

SEQ ID NO: 476464 - DNA, 25 bp, Mus musculus
gagcaacgtggactttgacctgacc

SEQ ID NO: 476465 - DNA, 25 bp, Mus musculus
gagcaacgtggagtttgacctgacc

SEQ ID NO: 476466 - DNA, 25 bp, Mus musculus
gagcaactaaaaagtgtatggcctg

SEQ ID NO: 476467 - DNA, 25 bp, Mus musculus
gagcaactaaaatgtgtatggcctg

SEQ ID NO: 476468 - DNA, 25 bp, Mus musculus
gagcaactaagaatactgtacccac

SEQ ID NO: 476469 - DNA, 25 bp, Mus musculus
gagcaactaagattactgtacccac

SEQ ID NO: 476470 - DNA, 25 bp, Mus musculus
gagcaactagtccttggccatgcat

SEQ ID NO: 476471 - DNA, 25 bp, Mus musculus
gagcaactagtcgttggccatgcat

SEQ ID NO: 476472 - DNA, 25 bp, Mus musculus
gagcaactatgacctttcaggctga

SEQ ID NO: 476473 - DNA, 25 bp, Mus musculus
gagcaactatgagctttcaggctga

SEQ ID NO: 476474 - DNA, 25 bp, Mus musculus
gagcaactcaatcaaactggaagta

SEQ ID NO: 476475 - DNA, 25 bp, Mus musculus
gagcaactcaatgaaactggaagta

SEQ ID NO: 476476 - DNA, 25 bp, Mus musculus
gagcaactcagaatttgtcattaaa

SEQ ID NO: 476477 - DNA, 25 bp, Mus musculus
gagcaactcagacccttcagacagc

SEQ ID NO: 476478 - DNA, 25 bp, Mus musculus
gagcaactcagagccttcagacagc

SEQ ID NO: 476479 - DNA, 25 bp, Mus musculus
gagcaactcagattttgtcattaaa

SEQ ID NO: 476480 - DNA, 25 bp, Mus musculus
gagcaactcctgatagtggttattt

SEQ ID NO: 476481 - DNA, 25 bp, Mus musculus
gagcaactcctgttagtggttattt

SEQ ID NO: 476482 - DNA, 25 bp, Mus musculus
gagcaactcttcaggcgggtctcac

SEQ ID NO: 476483 - DNA, 25 bp, Mus musculus
gagcaactcttctggcgggtctcac

SEQ ID NO: 476484 - DNA, 25 bp, Mus musculus
gagcaactgcctagtcaatgatgtt

SEQ ID NO: 476485 - DNA, 25 bp, Mus musculus
gagcaactgccttgtcaatgatgtt

SEQ ID NO: 476486 - DNA, 25 bp, Mus musculus
gagcaactgcttccaaaaatctgtg

SEQ ID NO: 476487 - DNA, 25 bp, Mus musculus
gagcaactgcttgcaaaaatctgtg

SEQ ID NO: 476488 - DNA, 25 bp, Mus musculus
gagcaactggacactcagataatgg

SEQ ID NO: 476489 - DNA, 25 bp, Mus musculus
gagcaactggactctcagataatgg

SEQ ID NO: 476490 - DNA, 25 bp, Mus musculus
gagcaactgggaaaggcacaggtgt

SEQ ID NO: 476491 - DNA, 25 bp, Mus musculus
gagcaactgggataggcacaggtgt

SEQ ID NO: 476492 - DNA, 25 bp, Mus musculus
gagcaactggtgctgggtcaaccat

SEQ ID NO: 476493 - DNA, 25 bp, Mus musculus
gagcaactggtggtgggtcaaccat

SEQ ID NO: 476494 - DNA, 25 bp, Mus musculus
gagcaactgtaccagcttggagaag

SEQ ID NO: 476495 - DNA, 25 bp, Mus musculus
gagcaactgtacgagcttggagaag

SEQ ID NO: 476496 - DNA, 25 bp, Mus musculus
gagcaactgttacgaacttctgtct

SEQ ID NO: 476497 - DNA, 25 bp, Mus musculus
gagcaactgttaggaacttctgtct

SEQ ID NO: 476498 - DNA, 25 bp, Mus musculus
gagcaactgttgctgcatcttagat

SEQ ID NO: 476499 - DNA, 25 bp, Mus musculus
gagcaactgttggtgcatcttagat

SEQ ID NO: 476500 - DNA, 25 bp, Mus musculus
gagcaacttaaaagccaccacagct

SEQ ID NO: 476501 - DNA, 25 bp, Mus musculus
gagcaacttaaatgccaccacagct

SEQ ID NO: 476502 - DNA, 25 bp, Mus musculus
gagcaacttactcgtaactccatgt

SEQ ID NO: 476503 - DNA, 25 bp, Mus musculus
gagcaacttactggtaactccatgt

SEQ ID NO: 476504 - DNA, 25 bp, Mus musculus
gagcaacttgcaatttttcagtctg

SEQ ID NO: 476505 - DNA, 25 bp, Mus musculus
gagcaacttgcattttttcagtctg

SEQ ID NO: 476506 - DNA, 25 bp, Mus musculus
gagcaacttgttcccgttttcagtt

SEQ ID NO: 476507 - DNA, 25 bp, Mus musculus
gagcaacttgttgccgttttcagtt

SEQ ID NO: 476508 - DNA, 25 bp, Mus musculus
gagcaactttgcctccggtgaactt

SEQ ID NO: 476509 - DNA, 25 bp, Mus musculus
gagcaactttgcgtccggtgaactt

SEQ ID NO: 476510 - DNA, 25 bp, Mus musculus
gagcaagaaactctggccctctatc

SEQ ID NO: 476511 - DNA, 25 bp, Mus musculus
gagcaagaaactgtggccctctatc

SEQ ID NO: 476512 - DNA, 25 bp, Mus musculus
gagcaagaaaggctgcaccccagaa

SEQ ID NO: 476513 - DNA, 25 bp, Mus musculus
gagcaagaaagggtgcaccccagaa

SEQ ID NO: 476514 - DNA, 25 bp, Mus musculus
gagcaagaacgcctgagcctcctag

SEQ ID NO: 476515 - DNA, 25 bp, Mus musculus
gagcaagaacgcgtgagcctcctag

SEQ ID NO: 476516 - DNA, 25 bp, Mus musculus
gagcaagaacttactgggtatcact

SEQ ID NO: 476517 - DNA, 25 bp, Mus musculus
gagcaagaacttcttctctgacctc

SEQ ID NO: 476518 - DNA, 25 bp, Mus musculus
gagcaagaacttgttctctgacctc

SEQ ID NO: 476519 - DNA, 25 bp, Mus musculus
gagcaagaactttctgggtatcact

SEQ ID NO: 476520 - DNA, 25 bp, Mus musculus
gagcaagaagacatagtaacccagg

SEQ ID NO: 476521 - DNA, 25 bp, Mus musculus
gagcaagaagacttagtaacccagg

SEQ ID NO: 476522 - DNA, 25 bp, Mus musculus
gagcaagacatcaaaactgcccctc

SEQ ID NO: 476523 - DNA, 25 bp, Mus musculus
gagcaagacatctaaactgcccctc

SEQ ID NO: 476524 - DNA, 25 bp, Mus musculus
gagcaagactgcagtcaggtccgag

SEQ ID NO: 476525 - DNA, 25 bp, Mus musculus
gagcaagactgctgtcaggtccgag

SEQ ID NO: 476526 - DNA, 25 bp, Mus musculus
gagcaagactggctgttcctgaagc

SEQ ID NO: 476527 - DNA, 25 bp, Mus musculus
gagcaagactgggtgttcctgaagc

SEQ ID NO: 476528 - DNA, 25 bp, Mus musculus
gagcaagagaaacttcaagcccttt

SEQ ID NO: 476529 - DNA, 25 bp, Mus musculus
gagcaagagaaagttcaagcccttt

SEQ ID NO: 476530 - DNA, 25 bp, Mus musculus
gagcaagagcaaccagtcagatgaa

SEQ ID NO: 476531 - DNA, 25 bp, Mus musculus
gagcaagagcaagcagtcagatgaa

SEQ ID NO: 476532 - DNA, 25 bp, Mus musculus
gagcaagagcatagcctccaaacaa

SEQ ID NO: 476533 - DNA, 25 bp, Mus musculus
gagcaagagcatctctatctaccct

SEQ ID NO: 476534 - DNA, 25 bp, Mus musculus
gagcaagagcatgtctatctaccct

SEQ ID NO: 476535 - DNA, 25 bp, Mus musculus
gagcaagagcattgcctccaaacaa

SEQ ID NO: 476536 - DNA, 25 bp, Mus musculus
gagcaagagcctatggtttaccacc

SEQ ID NO: 476537 - DNA, 25 bp, Mus musculus
gagcaagagcctcttccagctgagt

SEQ ID NO: 476538 - DNA, 25 bp, Mus musculus
gagcaagagcctgttccagctgagt

SEQ ID NO: 476539 - DNA, 25 bp, Mus musculus
gagcaagagcctttggtttaccacc

SEQ ID NO: 476540 - DNA, 25 bp, Mus musculus
gagcaagaggatcccattgtgtcag

SEQ ID NO: 476541 - DNA, 25 bp, Mus musculus
gagcaagaggatgccattgtgtcag

SEQ ID NO: 476542 - DNA, 25 bp, Mus musculus
gagcaagaggcaccagtaccacatt

SEQ ID NO: 476543 - DNA, 25 bp, Mus musculus
gagcaagaggcagcagtaccacatt

SEQ ID NO: 476544 - DNA, 25 bp, Mus musculus
gagcaagaggctccaaaggaagaga

SEQ ID NO: 476545 - DNA, 25 bp, Mus musculus
gagcaagaggctgcaaaggaagaga

SEQ ID NO: 476546 - DNA, 25 bp, Mus musculus
gagcaagagggaatcattcatgatt

SEQ ID NO: 476547 - DNA, 25 bp, Mus musculus
gagcaagagggattcattcatgatt

SEQ ID NO: 476548 - DNA, 25 bp, Mus musculus
gagcaagaggtaaactcccctgcct

SEQ ID NO: 476549 - DNA, 25 bp, Mus musculus
gagcaagaggtatactcccctgcct

SEQ ID NO: 476550 - DNA, 25 bp, Mus musculus
gagcaagaggtcaggcaatttctgc

SEQ ID NO: 476551 - DNA, 25 bp, Mus musculus
gagcaagaggtctggcaatttctgc

SEQ ID NO: 476552 - DNA, 25 bp, Mus musculus
gagcaagagttcaagtcaaacattg

SEQ ID NO: 476553 - DNA, 25 bp, Mus musculus
gagcaagagttctagtcaaacattg

SEQ ID NO: 476554 - DNA, 25 bp, Mus musculus
gagcaagagtttacagagcctacgt

SEQ ID NO: 476555 - DNA, 25 bp, Mus musculus
gagcaagagttttcagagcctacgt

SEQ ID NO: 476556 - DNA, 25 bp, Mus musculus
gagcaagatcgcctgtgtgactgca

SEQ ID NO: 476557 - DNA, 25 bp, Mus musculus
gagcaagatcgcgtgtgtgactgca

SEQ ID NO: 476558 - DNA, 25 bp, Mus musculus
gagcaagatctactgcgcttttgtt

SEQ ID NO: 476559 - DNA, 25 bp, Mus musculus
gagcaagatctagtgcgcttttgtt

SEQ ID NO: 476560 - DNA, 25 bp, Mus musculus
gagcaagatgatacagctgccatgc

SEQ ID NO: 476561 - DNA, 25 bp, Mus musculus
gagcaagatgattcagctgccatgc

SEQ ID NO: 476562 - DNA, 25 bp, Mus musculus
gagcaagatggtccagtctctctcc

SEQ ID NO: 476563 - DNA, 25 bp, Mus musculus
gagcaagatggtgcagtctctctcc

SEQ ID NO: 476564 - DNA, 25 bp, Mus musculus
gagcaagattgcacagcctgtcaga

SEQ ID NO: 476565 - DNA, 25 bp, Mus musculus
gagcaagattgcagaccagggccct

SEQ ID NO: 476566 - DNA, 25 bp, Mus musculus
gagcaagattgctcagcctgtcaga

SEQ ID NO: 476567 - DNA, 25 bp, Mus musculus
gagcaagattgctgaccagggccct

SEQ ID NO: 476568 - DNA, 25 bp, Mus musculus
gagcaagcaagcacgtaggcatcgc

SEQ ID NO: 476569 - DNA, 25 bp, Mus musculus
gagcaagcaagcactggtcttcaga

SEQ ID NO: 476570 - DNA, 25 bp, Mus musculus
gagcaagcaagctcgtaggcatcgc

SEQ ID NO: 476571 - DNA, 25 bp, Mus musculus
gagcaagcaagctctggtcttcaga

SEQ ID NO: 476572 - DNA, 25 bp, Mus musculus
gagcaagcacaactgtaacctagtt

SEQ ID NO: 476573 - DNA, 25 bp, Mus musculus
gagcaagcacaagtgtaacctagtt

SEQ ID NO: 476574 - DNA, 25 bp, Mus musculus
gagcaagcacagagggtcactggca

SEQ ID NO: 476575 - DNA, 25 bp, Mus musculus
gagcaagcacagtgggtcactggca

SEQ ID NO: 476576 - DNA, 25 bp, Mus musculus
gagcaagcacatccatttcattatt

SEQ ID NO: 476577 - DNA, 25 bp, Mus musculus
gagcaagcacatgcatttcattatt

SEQ ID NO: 476578 - DNA, 25 bp, Mus musculus
gagcaagcacccaaattgctttctt

SEQ ID NO: 476579 - DNA, 25 bp, Mus musculus
gagcaagcaccccaagtttgaggag

SEQ ID NO: 476580 - DNA, 25 bp, Mus musculus
gagcaagcacccgaagtttgaggag

SEQ ID NO: 476581 - DNA, 25 bp, Mus musculus
gagcaagcaccctaattgctttctt

SEQ ID NO: 476582 - DNA, 25 bp, Mus musculus
gagcaagcactaaattactgtcaga

SEQ ID NO: 476583 - DNA, 25 bp, Mus musculus
gagcaagcactatattactgtcaga

SEQ ID NO: 476584 - DNA, 25 bp, Mus musculus
gagcaagcactgctttctacttcat

SEQ ID NO: 476585 - DNA, 25 bp, Mus musculus
gagcaagcactggtttctacttcat

SEQ ID NO: 476586 - DNA, 25 bp, Mus musculus
gagcaagcagccaacaccaaacgtg

SEQ ID NO: 476587 - DNA, 25 bp, Mus musculus
gagcaagcagcctacaccaaacgtg

SEQ ID NO: 476588 - DNA, 25 bp, Mus musculus
gagcaagcagggacacctaatgcca

SEQ ID NO: 476589 - DNA, 25 bp, Mus musculus
gagcaagcagggtcacctaatgcca

SEQ ID NO: 476590 - DNA, 25 bp, Mus musculus
gagcaagcagtgatgtcctggtttt

SEQ ID NO: 476591 - DNA, 25 bp, Mus musculus
gagcaagcagtgttgtcctggtttt

SEQ ID NO: 476592 - DNA, 25 bp, Mus musculus
gagcaagcatgcaggccattccaaa

SEQ ID NO: 476593 - DNA, 25 bp, Mus musculus
gagcaagcatgccatttgatttttg

SEQ ID NO: 476594 - DNA, 25 bp, Mus musculus
gagcaagcatgcgatttgatttttg

SEQ ID NO: 476595 - DNA, 25 bp, Mus musculus
gagcaagcatgctggccattccaaa

SEQ ID NO: 476596 - DNA, 25 bp, Mus musculus
gagcaagcatggagcacccagatca

SEQ ID NO: 476597 - DNA, 25 bp, Mus musculus
gagcaagcatggtgcacccagatca

SEQ ID NO: 476598 - DNA, 25 bp, Mus musculus
gagcaagcattccaagcagttactt

SEQ ID NO: 476599 - DNA, 25 bp, Mus musculus
gagcaagcattcgaagcagttactt

SEQ ID NO: 476600 - DNA, 25 bp, Mus musculus
gagcaagcatttcagcgcctacaat

SEQ ID NO: 476601 - DNA, 25 bp, Mus musculus
gagcaagcatttgagcgcctacaat

SEQ ID NO: 476602 - DNA, 25 bp, Mus musculus
gagcaagccagtattcacattagag

SEQ ID NO: 476603 - DNA, 25 bp, Mus musculus
gagcaagccagttttcacattagag

SEQ ID NO: 476604 - DNA, 25 bp, Mus musculus
gagcaagcccagaacatgcacgtgg

SEQ ID NO: 476605 - DNA, 25 bp, Mus musculus
gagcaagcccagtacatgcacgtgg

SEQ ID NO: 476606 - DNA, 25 bp, Mus musculus
gagcaagccccaatcttggatgcta

SEQ ID NO: 476607 - DNA, 25 bp, Mus musculus
gagcaagccccattcttggatgcta

SEQ ID NO: 476608 - DNA, 25 bp, Mus musculus
gagcaagccctgcatggaccttctt

SEQ ID NO: 476609 - DNA, 25 bp, Mus musculus
gagcaagccctggatggaccttctt

SEQ ID NO: 476610 - DNA, 25 bp, Mus musculus
gagcaagcctggctggcctgacctc

SEQ ID NO: 476611 - DNA, 25 bp, Mus musculus
gagcaagcctgggtggcctgacctc

SEQ ID NO: 476612 - DNA, 25 bp, Mus musculus
gagcaagccttaaaaataccaatat

SEQ ID NO: 476613 - DNA, 25 bp, Mus musculus
gagcaagccttataaataccaatat

SEQ ID NO: 476614 - DNA, 25 bp, Mus musculus
gagcaagcggaactgactttcctga

SEQ ID NO: 476615 - DNA, 25 bp, Mus musculus
gagcaagcggaagtgactttcctga

SEQ ID NO: 476616 - DNA, 25 bp, Mus musculus
gagcaagcggagatgacctgagcaa

SEQ ID NO: 476617 - DNA, 25 bp, Mus musculus
gagcaagcggagttgacctgagcaa

SEQ ID NO: 476618 - DNA, 25 bp, Mus musculus
gagcaagcggcgctcctttccgcga

SEQ ID NO: 476619 - DNA, 25 bp, Mus musculus
gagcaagcggcggtcctttccgcga

SEQ ID NO: 476620 - DNA, 25 bp, Mus musculus
gagcaagcgtctcttccgagaagaa

SEQ ID NO: 476621 - DNA, 25 bp, Mus musculus
gagcaagcgtctgttccgagaagaa

SEQ ID NO: 476622 - DNA, 25 bp, Mus musculus
gagcaagcgtgacaattaagtcttc

SEQ ID NO: 476623 - DNA, 25 bp, Mus musculus
gagcaagcgtgagaattaagtcttc

SEQ ID NO: 476624 - DNA, 25 bp, Mus musculus
gagcaagctaagagcagtacccctc

SEQ ID NO: 476625 - DNA, 25 bp, Mus musculus
gagcaagctaagatcctctgtcgtc

SEQ ID NO: 476626 - DNA, 25 bp, Mus musculus
gagcaagctaagtgcagtacccctc

SEQ ID NO: 476627 - DNA, 25 bp, Mus musculus
gagcaagctaagttcctctgtcgtc

SEQ ID NO: 476628 - DNA, 25 bp, Mus musculus
gagcaagctcaaattccctgaaaga

SEQ ID NO: 476629 - DNA, 25 bp, Mus musculus
gagcaagctcaatttccctgaaaga

SEQ ID NO: 476630 - DNA, 25 bp, Mus musculus
gagcaagctcacaaagatgtttcca

SEQ ID NO: 476631 - DNA, 25 bp, Mus musculus
gagcaagctcactaagatgtttcca

SEQ ID NO: 476632 - DNA, 25 bp, Mus musculus
gagcaagctccaagcggacatcagg

SEQ ID NO: 476633 - DNA, 25 bp, Mus musculus
gagcaagctccatgcggacatcagg

SEQ ID NO: 476634 - DNA, 25 bp, Mus musculus
gagcaagctcccaacctgggaagga

SEQ ID NO: 476635 - DNA, 25 bp, Mus musculus
gagcaagctccctacctgggaagga

SEQ ID NO: 476636 - DNA, 25 bp, Mus musculus
gagcaagctgcccaaggctgctgaa

SEQ ID NO: 476637 - DNA, 25 bp, Mus musculus
gagcaagctgccgaaggctgctgaa

SEQ ID NO: 476638 - DNA, 25 bp, Mus musculus
gagcaagcttaacgaaatacagtga

SEQ ID NO: 476639 - DNA, 25 bp, Mus musculus
gagcaagcttaaggaaatacagtga

SEQ ID NO: 476640 - DNA, 25 bp, Mus musculus
gagcaagcttctagaattaatggac

SEQ ID NO: 476641 - DNA, 25 bp, Mus musculus
gagcaagcttcttgaattaatggac

SEQ ID NO: 476642 - DNA, 25 bp, Mus musculus
gagcaaggacacagggcttagcact

SEQ ID NO: 476643 - DNA, 25 bp, Mus musculus
gagcaaggacactgggcttagcact

SEQ ID NO: 476644 - DNA, 25 bp, Mus musculus
gagcaaggaccacatccaaggatgt

SEQ ID NO: 476645 - DNA, 25 bp, Mus musculus
gagcaaggaccagatccaaggatgt

SEQ ID NO: 476646 - DNA, 25 bp, Mus musculus
gagcaaggactgcacctccgtgcct

SEQ ID NO: 476647 - DNA, 25 bp, Mus musculus
gagcaaggactggacctccgtgcct

SEQ ID NO: 476648 - DNA, 25 bp, Mus musculus
gagcaaggagctccgtgcagctcaa

SEQ ID NO: 476649 - DNA, 25 bp, Mus musculus
gagcaaggagctgcgtgcagctcaa

SEQ ID NO: 476650 - DNA, 25 bp, Mus musculus
gagcaaggcaccacgacattgagaa

SEQ ID NO: 476651 - DNA, 25 bp, Mus musculus
gagcaaggcacctcgacattgagaa

SEQ ID NO: 476652 - DNA, 25 bp, Mus musculus
gagcaaggcagcaagcaggcctgac

SEQ ID NO: 476653 - DNA, 25 bp, Mus musculus
gagcaaggcagctagcaggcctgac

SEQ ID NO: 476654 - DNA, 25 bp, Mus musculus
gagcaaggcgtcattactggataaa

SEQ ID NO: 476655 - DNA, 25 bp, Mus musculus
gagcaaggcgtctttactggataaa

SEQ ID NO: 476656 - DNA, 25 bp, Mus musculus
gagcaaggctaaaggcggatgacat

SEQ ID NO: 476657 - DNA, 25 bp, Mus musculus
gagcaaggctaatggcggatgacat

SEQ ID NO: 476658 - DNA, 25 bp, Mus musculus
gagcaagggaggatcatgtccgtat

SEQ ID NO: 476659 - DNA, 25 bp, Mus musculus
gagcaagggaggttcatgtccgtat

SEQ ID NO: 476660 - DNA, 25 bp, Mus musculus
gagcaagggcacacaggtaccacaa

SEQ ID NO: 476661 - DNA, 25 bp, Mus musculus
gagcaagggcactcaggtaccacaa

SEQ ID NO: 476662 - DNA, 25 bp, Mus musculus
gagcaagggccaaaactcctgggca

SEQ ID NO: 476663 - DNA, 25 bp, Mus musculus
gagcaagggccataactcctgggca

SEQ ID NO: 476664 - DNA, 25 bp, Mus musculus
gagcaagggcgaatccccaaaggcc

SEQ ID NO: 476665 - DNA, 25 bp, Mus musculus
gagcaagggcgattccccaaaggcc

SEQ ID NO: 476666 - DNA, 25 bp, Mus musculus
gagcaaggtccacttgagcagcaca

SEQ ID NO: 476667 - DNA, 25 bp, Mus musculus
gagcaaggtccagttgagcagcaca

SEQ ID NO: 476668 - DNA, 25 bp, Mus musculus
gagcaaggtcctaccatagtgacgc

SEQ ID NO: 476669 - DNA, 25 bp, Mus musculus
gagcaaggtccttccatagtgacgc

SEQ ID NO: 476670 - DNA, 25 bp, Mus musculus
gagcaaggtcgcaccctgaggaaga

SEQ ID NO: 476671 - DNA, 25 bp, Mus musculus
gagcaaggtcgctccctgaggaaga

SEQ ID NO: 476672 - DNA, 25 bp, Mus musculus
gagcaaggtgacatcaacgtgcaga

SEQ ID NO: 476673 - DNA, 25 bp, Mus musculus
gagcaaggtgacttcaacgtgcaga

SEQ ID NO: 476674 - DNA, 25 bp, Mus musculus
gagcaaggtgatccctacattggca

SEQ ID NO: 476675 - DNA, 25 bp, Mus musculus
gagcaaggtgatgcctacattggca

SEQ ID NO: 476676 - DNA, 25 bp, Mus musculus
gagcaaggtgctatactcctagggc

SEQ ID NO: 476677 - DNA, 25 bp, Mus musculus
gagcaaggtgctttactcctagggc

SEQ ID NO: 476678 - DNA, 25 bp, Mus musculus
gagcaaggttacaactccaggagtg

SEQ ID NO: 476679 - DNA, 25 bp, Mus musculus
gagcaaggttactactccaggagtg

SEQ ID NO: 476680 - DNA, 25 bp, Mus musculus
gagcaaggttatatttccacactaa

SEQ ID NO: 476681 - DNA, 25 bp, Mus musculus
gagcaaggttatttttccacactaa

SEQ ID NO: 476682 - DNA, 25 bp, Mus musculus
gagcaaggttcaaccagcttcagcc

SEQ ID NO: 476683 - DNA, 25 bp, Mus musculus
gagcaaggttcatccagcttcagcc

SEQ ID NO: 476684 - DNA, 25 bp, Mus musculus
gagcaagtacccattcttagaacct

SEQ ID NO: 476685 - DNA, 25 bp, Mus musculus
gagcaagtaccctttcttagaacct

SEQ ID NO: 476686 - DNA, 25 bp, Mus musculus
gagcaagtacttcagcagtcctgct

SEQ ID NO: 476687 - DNA, 25 bp, Mus musculus
gagcaagtacttgagcagtcctgct

SEQ ID NO: 476688 - DNA, 25 bp, Mus musculus
gagcaagtagagaccgcatatttca

SEQ ID NO: 476689 - DNA, 25 bp, Mus musculus
gagcaagtagagtccgcatatttca

SEQ ID NO: 476690 - DNA, 25 bp, Mus musculus
gagcaagtagtcattcaggaacatt

SEQ ID NO: 476691 - DNA, 25 bp, Mus musculus
gagcaagtagtctttcaggaacatt

SEQ ID NO: 476692 - DNA, 25 bp, Mus musculus
gagcaagtatgtctgccgtcaggta

SEQ ID NO: 476693 - DNA, 25 bp, Mus musculus
gagcaagtatgtgtgccgtcaggta

SEQ ID NO: 476694 - DNA, 25 bp, Mus musculus
gagcaagtcattacacgatctactg

SEQ ID NO: 476695 - DNA, 25 bp, Mus musculus
gagcaagtcatttcacgatctactg

SEQ ID NO: 476696 - DNA, 25 bp, Mus musculus
gagcaagtctatcccacactgaaag

SEQ ID NO: 476697 - DNA, 25 bp, Mus musculus
gagcaagtctatgccacactgaaag

SEQ ID NO: 476698 - DNA, 25 bp, Mus musculus
gagcaagtctcaatttctttgtaag

SEQ ID NO: 476699 - DNA, 25 bp, Mus musculus
gagcaagtctcattttctttgtaag

SEQ ID NO: 476700 - DNA, 25 bp, Mus musculus
gagcaagtctgcaagcgctccgcgg

SEQ ID NO: 476701 - DNA, 25 bp, Mus musculus
gagcaagtctgcacaacagcaccaa

SEQ ID NO: 476702 - DNA, 25 bp, Mus musculus
gagcaagtctgccaccaacttaggt

SEQ ID NO: 476703 - DNA, 25 bp, Mus musculus
gagcaagtctgcgaccaacttaggt

SEQ ID NO: 476704 - DNA, 25 bp, Mus musculus
gagcaagtctgctagcgctccgcgg

SEQ ID NO: 476705 - DNA, 25 bp, Mus musculus
gagcaagtctgctcaacagcaccaa

SEQ ID NO: 476706 - DNA, 25 bp, Mus musculus
gagcaagtggccagggctctcaaat

SEQ ID NO: 476707 - DNA, 25 bp, Mus musculus
gagcaagtggcctgggctctcaaat

SEQ ID NO: 476708 - DNA, 25 bp, Mus musculus
gagcaagtggctaacgttgaccctt

SEQ ID NO: 476709 - DNA, 25 bp, Mus musculus
gagcaagtggcttacgttgaccctt

SEQ ID NO: 476710 - DNA, 25 bp, Mus musculus
gagcaagtgggacccgcaccccttt

SEQ ID NO: 476711 - DNA, 25 bp, Mus musculus
gagcaagtgggagccgcaccccttt

SEQ ID NO: 476712 - DNA, 25 bp, Mus musculus
gagcaagtggtaagagcagcctctt

SEQ ID NO: 476713 - DNA, 25 bp, Mus musculus
gagcaagtggtatgagcagcctctt

SEQ ID NO: 476714 - DNA, 25 bp, Mus musculus
gagcaagtgttaccaaagttctgtt

SEQ ID NO: 476715 - DNA, 25 bp, Mus musculus
gagcaagtgttagcaaagttctgtt

SEQ ID NO: 476716 - DNA, 25 bp, Mus musculus
gagcaagttaatactgatcccgata

SEQ ID NO: 476717 - DNA, 25 bp, Mus musculus
gagcaagttaattctgatcccgata

SEQ ID NO: 476718 - DNA, 25 bp, Mus musculus
gagcaagttcacatgtgtgtccaac

SEQ ID NO: 476719 - DNA, 25 bp, Mus musculus
gagcaagttcacttgtgtgtccaac

SEQ ID NO: 476720 - DNA, 25 bp, Mus musculus
gagcaagttccacggcttcatagag

SEQ ID NO: 476721 - DNA, 25 bp, Mus musculus
gagcaagttccagggcttcatagag

SEQ ID NO: 476722 - DNA, 25 bp, Mus musculus
gagcaagttccgcaagcctccgaag

SEQ ID NO: 476723 - DNA, 25 bp, Mus musculus
gagcaagttccggaagcctccgaag

SEQ ID NO: 476724 - DNA, 25 bp, Mus musculus
gagcaagttcttcgagcacttcatc

SEQ ID NO: 476725 - DNA, 25 bp, Mus musculus
gagcaagttcttggagcacttcatc

SEQ ID NO: 476726 - DNA, 25 bp, Mus musculus
gagcaagttggcattgacataggta

SEQ ID NO: 476727 - DNA, 25 bp, Mus musculus
gagcaagttggctttgacataggta

SEQ ID NO: 476728 - DNA, 25 bp, Mus musculus
gagcaagtttctatgtctacttaaa

SEQ ID NO: 476729 - DNA, 25 bp, Mus musculus
gagcaagtttctttgtctacttaaa

SEQ ID NO: 476730 - DNA, 25 bp, Mus musculus
gagcaagtttgaacttcagcagcag

SEQ ID NO: 476731 - DNA, 25 bp, Mus musculus
gagcaagtttgatcttcagcagcag

SEQ ID NO: 476732 - DNA, 25 bp, Mus musculus
gagcaagtttgtcaactaactccta

SEQ ID NO: 476733 - DNA, 25 bp, Mus musculus
gagcaagtttgtgaactaactccta

SEQ ID NO: 476734 - DNA, 25 bp, Mus musculus
gagcaagttttcaccaaatgacact

SEQ ID NO: 476735 - DNA, 25 bp, Mus musculus
gagcaagttttctccaaatgacact

SEQ ID NO: 476736 - DNA, 25 bp, Mus musculus
gagcaataacacagcctgccaggac

SEQ ID NO: 476737 - DNA, 25 bp, Mus musculus
gagcaataacactgcctgccaggac

SEQ ID NO: 476738 - DNA, 25 bp, Mus musculus
gagcaataatcactggtgcttttgt

SEQ ID NO: 476739 - DNA, 25 bp, Mus musculus
gagcaataatcagtggtgcttttgt

SEQ ID NO: 476740 - DNA, 25 bp, Mus musculus
gagcaatacgttccttattccacca

SEQ ID NO: 476741 - DNA, 25 bp, Mus musculus
gagcaatacgttgcttattccacca

SEQ ID NO: 476742 - DNA, 25 bp, Mus musculus
gagcaatagctacacctttttactt

SEQ ID NO: 476743 - DNA, 25 bp, Mus musculus
gagcaatagctagacctttttactt

SEQ ID NO: 476744 - DNA, 25 bp, Mus musculus
gagcaatatacccacaccgtggact

SEQ ID NO: 476745 - DNA, 25 bp, Mus musculus
gagcaatataccgacaccgtggact

SEQ ID NO: 476746 - DNA, 25 bp, Mus musculus
gagcaatatctactcattctaagaa

SEQ ID NO: 476747 - DNA, 25 bp, Mus musculus
gagcaatatctagtcattctaagaa

SEQ ID NO: 476748 - DNA, 25 bp, Mus musculus
gagcaatatggcctggtggtacaca

SEQ ID NO: 476749 - DNA, 25 bp, Mus musculus
gagcaatatggcgtggtggtacaca

SEQ ID NO: 476750 - DNA, 25 bp, Mus musculus
gagcaatattatcttcacttcctaa

SEQ ID NO: 476751 - DNA, 25 bp, Mus musculus
gagcaatattatgttcacttcctaa

SEQ ID NO: 476752 - DNA, 25 bp, Mus musculus
gagcaatcaaccaaaattgttcctt

SEQ ID NO: 476753 - DNA, 25 bp, Mus musculus
gagcaatcaacctaaattgttcctt

SEQ ID NO: 476754 - DNA, 25 bp, Mus musculus
gagcaatcaagtctatcagtccctg

SEQ ID NO: 476755 - DNA, 25 bp, Mus musculus
gagcaatcaagtgtatcagtccctg

SEQ ID NO: 476756 - DNA, 25 bp, Mus musculus
gagcaatcactgaggcccgaatcat

SEQ ID NO: 476757 - DNA, 25 bp, Mus musculus
gagcaatcactgtggcccgaatcat

SEQ ID NO: 476758 - DNA, 25 bp, Mus musculus
gagcaatcagtgatcctaaccacca

SEQ ID NO: 476759 - DNA, 25 bp, Mus musculus
gagcaatcagtgttcctaaccacca

SEQ ID NO: 476760 - DNA, 25 bp, Mus musculus
gagcaatccactctatgatactgtg

SEQ ID NO: 476761 - DNA, 25 bp, Mus musculus
gagcaatccactgtatgatactgtg

SEQ ID NO: 476762 - DNA, 25 bp, Mus musculus
gagcaatcctgaattttgccctgag

SEQ ID NO: 476763 - DNA, 25 bp, Mus musculus
gagcaatcctgatttttgccctgag

SEQ ID NO: 476764 - DNA, 25 bp, Mus musculus
gagcaatcgaatacactcaattact

SEQ ID NO: 476765 - DNA, 25 bp, Mus musculus
gagcaatcgaattcactcaattact

SEQ ID NO: 476766 - DNA, 25 bp, Mus musculus
gagcaatcgcatctgtgccgccagt

SEQ ID NO: 476767 - DNA, 25 bp, Mus musculus
gagcaatcgcatgtgtgccgccagt

SEQ ID NO: 476768 - DNA, 25 bp, Mus musculus
gagcaatcggcaccatcggattggt

SEQ ID NO: 476769 - DNA, 25 bp, Mus musculus
gagcaatcggcagcatcggattggt

SEQ ID NO: 476770 - DNA, 25 bp, Mus musculus
gagcaatcgtgaatccaaccttaga

SEQ ID NO: 476771 - DNA, 25 bp, Mus musculus
gagcaatcgtgattccaaccttaga

SEQ ID NO: 476772 - DNA, 25 bp, Mus musculus
gagcaatctcagcaacttgttagga

SEQ ID NO: 476773 - DNA, 25 bp, Mus musculus
gagcaatctcaggaacttgttagga

SEQ ID NO: 476774 - DNA, 25 bp, Mus musculus
gagcaatctctacaaagccagtgtg

SEQ ID NO: 476775 - DNA, 25 bp, Mus musculus
gagcaatctctagaaagccagtgtg

SEQ ID NO: 476776 - DNA, 25 bp, Mus musculus
gagcaatctggaaactgtgtgcgat

SEQ ID NO: 476777 - DNA, 25 bp, Mus musculus
gagcaatctggatactgtgtgcgat

SEQ ID NO: 476778 - DNA, 25 bp, Mus musculus
gagcaatcttgactttgcacagaaa

SEQ ID NO: 476779 - DNA, 25 bp, Mus musculus
gagcaatcttgagtttgcacagaaa

SEQ ID NO: 476780 - DNA, 25 bp, Mus musculus
gagcaatgaatcagactactgtagg

SEQ ID NO: 476781 - DNA, 25 bp, Mus musculus
gagcaatgaatctgactactgtagg

SEQ ID NO: 476782 - DNA, 25 bp, Mus musculus
gagcaatgactcatggatccactag

SEQ ID NO: 476783 - DNA, 25 bp, Mus musculus
gagcaatgactcttggatccactag

SEQ ID NO: 476784 - DNA, 25 bp, Mus musculus
gagcaatgacttcgctgcctcagag

SEQ ID NO: 476785 - DNA, 25 bp, Mus musculus
gagcaatgacttggctgcctcagag

SEQ ID NO: 476786 - DNA, 25 bp, Mus musculus
gagcaatgatgtccattactgcctg

SEQ ID NO: 476787 - DNA, 25 bp, Mus musculus
gagcaatgatgtgcattactgcctg

SEQ ID NO: 476788 - DNA, 25 bp, Mus musculus
gagcaatgcattactcttcaagtga

SEQ ID NO: 476789 - DNA, 25 bp, Mus musculus
gagcaatgcatttctcttcaagtga

SEQ ID NO: 476790 - DNA, 25 bp, Mus musculus
gagcaatgcctgaaatcatgtagtt

SEQ ID NO: 476791 - DNA, 25 bp, Mus musculus
gagcaatgcctgtaatcatgtagtt

SEQ ID NO: 476792 - DNA, 25 bp, Mus musculus
gagcaatgccttagtttcctggtgt

SEQ ID NO: 476793 - DNA, 25 bp, Mus musculus
gagcaatgcctttgtttcctggtgt

SEQ ID NO: 476794 - DNA, 25 bp, Mus musculus
gagcaatgctccagcaagattgata

SEQ ID NO: 476795 - DNA, 25 bp, Mus musculus
gagcaatgctcctgcaagattgata

SEQ ID NO: 476796 - DNA, 25 bp, Mus musculus
gagcaatggatgaatctcccgaaat

SEQ ID NO: 476797 - DNA, 25 bp, Mus musculus
gagcaatggatgtatctcccgaaat

SEQ ID NO: 476798 - DNA, 25 bp, Mus musculus
gagcaatggccactgcactcccggg

SEQ ID NO: 476799 - DNA, 25 bp, Mus musculus
gagcaatggccagtgcactcccggg

SEQ ID NO: 476800 - DNA, 25 bp, Mus musculus
gagcaatggttcatgggagtgacta

SEQ ID NO: 476801 - DNA, 25 bp, Mus musculus
gagcaatggttcttgggagtgacta

SEQ ID NO: 476802 - DNA, 25 bp, Mus musculus
gagcaatgttgacccttatcttcct

SEQ ID NO: 476803 - DNA, 25 bp, Mus musculus
gagcaatgttgagccttatcttcct

SEQ ID NO: 476804 - DNA, 25 bp, Mus musculus
gagcaattaaccatcctgtcatgtt

SEQ ID NO: 476805 - DNA, 25 bp, Mus musculus
gagcaattaaccttcctgtcatgtt

SEQ ID NO: 476806 - DNA, 25 bp, Mus musculus
gagcaattaccacacgttcagggca

SEQ ID NO: 476807 - DNA, 25 bp, Mus musculus
gagcaattaccagacgttcagggca

SEQ ID NO: 476808 - DNA, 25 bp, Mus musculus
gagcaattacttcgctttcctatgt

SEQ ID NO: 476809 - DNA, 25 bp, Mus musculus
gagcaattacttggctttcctatgt

SEQ ID NO: 476810 - DNA, 25 bp, Mus musculus
gagcaattagtaccaagcactgact

SEQ ID NO: 476811 - DNA, 25 bp, Mus musculus
gagcaattagtagcaagcactgact

SEQ ID NO: 476812 - DNA, 25 bp, Mus musculus
gagcaattatagctactgcctgagc

SEQ ID NO: 476813 - DNA, 25 bp, Mus musculus
gagcaattataggtactgcctgagc

SEQ ID NO: 476814 - DNA, 25 bp, Mus musculus
gagcaattccagagtatcacccgtg

SEQ ID NO: 476815 - DNA, 25 bp, Mus musculus
gagcaattccagtgtatcacccgtg

SEQ ID NO: 476816 - DNA, 25 bp, Mus musculus
gagcaattctatccatttatgagtt

SEQ ID NO: 476817 - DNA, 25 bp, Mus musculus
gagcaattctatgcatttatgagtt

SEQ ID NO: 476818 - DNA, 25 bp, Mus musculus
gagcaattcttgcttcagcggagag

SEQ ID NO: 476819 - DNA, 25 bp, Mus musculus
gagcaattcttggttcagcggagag

SEQ ID NO: 476820 - DNA, 25 bp, Mus musculus
gagcaattgaatacctcacaaaatt

SEQ ID NO: 476821 - DNA, 25 bp, Mus musculus
gagcaattgaattcctcacaaaatt

SEQ ID NO: 476822 - DNA, 25 bp, Mus musculus
gagcaattggagacccttcacgaag

SEQ ID NO: 476823 - DNA, 25 bp, Mus musculus
gagcaattggagtcccttcacgaag

SEQ ID NO: 476824 - DNA, 25 bp, Mus musculus
gagcaatttagtcctaccctgtctt

SEQ ID NO: 476825 - DNA, 25 bp, Mus musculus
gagcaatttagtgctaccctgtctt

SEQ ID NO: 476826 - DNA, 25 bp, Mus musculus
gagcaatttatacctctggatatat

SEQ ID NO: 476827 - DNA, 25 bp, Mus musculus
gagcaatttatagctctggatatat

SEQ ID NO: 476828 - DNA, 25 bp, Mus musculus
gagcaatttatgactcttgagggta

SEQ ID NO: 476829 - DNA, 25 bp, Mus musculus
gagcaatttatgtctcttgagggta

SEQ ID NO: 476830 - DNA, 25 bp, Mus musculus
gagcaatttcatacaaacacgtgac

SEQ ID NO: 476831 - DNA, 25 bp, Mus musculus
gagcaatttcattcaaacacgtgac

SEQ ID NO: 476832 - DNA, 25 bp, Mus musculus
gagcaatttctccaattctgaggtt

SEQ ID NO: 476833 - DNA, 25 bp, Mus musculus
gagcaatttctcgaattctgaggtt

SEQ ID NO: 476834 - DNA, 25 bp, Mus musculus
gagcaatttgcaagagtccaccaga

SEQ ID NO: 476835 - DNA, 25 bp, Mus musculus
gagcaatttgcatgagtccaccaga

SEQ ID NO: 476836 - DNA, 25 bp, Mus musculus
gagcaatttgccagctatggcagac

SEQ ID NO: 476837 - DNA, 25 bp, Mus musculus
gagcaatttgcctgctatggcagac

SEQ ID NO: 476838 - DNA, 25 bp, Mus musculus
gagcaattttcacctgtgacttttt

SEQ ID NO: 476839 - DNA, 25 bp, Mus musculus
gagcaattttcagctgtgacttttt

SEQ ID NO: 476840 - DNA, 25 bp, Mus musculus
gagcacaaaccaattggctttcctc

SEQ ID NO: 476841 - DNA, 25 bp, Mus musculus
gagcacaaaccatttggctttcctc

SEQ ID NO: 476842 - DNA, 25 bp, Mus musculus
gagcacaaacccagggcgaggtcta

SEQ ID NO: 476843 - DNA, 25 bp, Mus musculus
gagcacaaaccctgggcgaggtcta

SEQ ID NO: 476844 - DNA, 25 bp, Mus musculus
gagcacaaagccatagtgttagata

SEQ ID NO: 476845 - DNA, 25 bp, Mus musculus
gagcacaaagccttagtgttagata

SEQ ID NO: 476846 - DNA, 25 bp, Mus musculus
gagcacaaatctctctgtttgtact

SEQ ID NO: 476847 - DNA, 25 bp, Mus musculus
gagcacaaatctgtctgtttgtact

SEQ ID NO: 476848 - DNA, 25 bp, Mus musculus
gagcacaaattgaagcccagaaata

SEQ ID NO: 476849 - DNA, 25 bp, Mus musculus
gagcacaaattgtagcccagaaata

SEQ ID NO: 476850 - DNA, 25 bp, Mus musculus
gagcacaaccttccagagaaagcca

SEQ ID NO: 476851 - DNA, 25 bp, Mus musculus
gagcacaaccttgcagagaaagcca

SEQ ID NO: 476852 - DNA, 25 bp, Mus musculus
gagcacaacgctcacttagcaaaaa

SEQ ID NO: 476853 - DNA, 25 bp, Mus musculus
gagcacaacgctgacttagcaaaaa

SEQ ID NO: 476854 - DNA, 25 bp, Mus musculus
gagcacaacgttaaaggtcgtacaa

SEQ ID NO: 476855 - DNA, 25 bp, Mus musculus
gagcacaacgtttaaggtcgtacaa

SEQ ID NO: 476856 - DNA, 25 bp, Mus musculus
gagcacaagccacaaccaggaattt

SEQ ID NO: 476857 - DNA, 25 bp, Mus musculus
gagcacaagccagaaccaggaattt

SEQ ID NO: 476858 - DNA, 25 bp, Mus musculus
gagcacaagccgacagtcatcgtga

SEQ ID NO: 476859 - DNA, 25 bp, Mus musculus
gagcacaagccgtcagtcatcgtga

SEQ ID NO: 476860 - DNA, 25 bp, Mus musculus
gagcacaagctcacctctgaaaagg

SEQ ID NO: 476861 - DNA, 25 bp, Mus musculus
gagcacaagctctcctctgaaaagg

SEQ ID NO: 476862 - DNA, 25 bp, Mus musculus
gagcacaaggagacaggacccacag

SEQ ID NO: 476863 - DNA, 25 bp, Mus musculus
gagcacaaggagtcaggacccacag

SEQ ID NO: 476864 - DNA, 25 bp, Mus musculus
gagcacaaggcccaggttgcactca

SEQ ID NO: 476865 - DNA, 25 bp, Mus musculus
gagcacaaggccgaggttgcactca

SEQ ID NO: 476866 - DNA, 25 bp, Mus musculus
gagcacaaggctcaaaggtttgcaa

SEQ ID NO: 476867 - DNA, 25 bp, Mus musculus
gagcacaaggctgaaaggtttgcaa

SEQ ID NO: 476868 - DNA, 25 bp, Mus musculus
gagcacaagtgactgtaatagagac

SEQ ID NO: 476869 - DNA, 25 bp, Mus musculus
gagcacaagtgagtgtaatagagac

SEQ ID NO: 476870 - DNA, 25 bp, Mus musculus
gagcacaagtggagtcttcctactg

SEQ ID NO: 476871 - DNA, 25 bp, Mus musculus
gagcacaagtggtgtcttcctactg

SEQ ID NO: 476872 - DNA, 25 bp, Mus musculus
gagcacaatatgcacaaaacatttt

SEQ ID NO: 476873 - DNA, 25 bp, Mus musculus
gagcacaatatggacaaaacatttt

SEQ ID NO: 476874 - DNA, 25 bp, Mus musculus
gagcacaatcaacctacctgtaatt

SEQ ID NO: 476875 - DNA, 25 bp, Mus musculus
gagcacaatcaagctacctgtaatt

SEQ ID NO: 476876 - DNA, 25 bp, Mus musculus
gagcacaatgcaagttttccctcat

SEQ ID NO: 476877 - DNA, 25 bp, Mus musculus
gagcacaatgcatgttttccctcat

SEQ ID NO: 476878 - DNA, 25 bp, Mus musculus
gagcacaatggtcttaagtcactta

SEQ ID NO: 476879 - DNA, 25 bp, Mus musculus
gagcacaatggtgttaagtcactta

SEQ ID NO: 476880 - DNA, 25 bp, Mus musculus
gagcacaatgttactatgtaaagaa

SEQ ID NO: 476881 - DNA, 25 bp, Mus musculus
gagcacaatgtttctatgtaaagaa

SEQ ID NO: 476882 - DNA, 25 bp, Mus musculus
gagcacaattcccattaagagaagg

SEQ ID NO: 476883 - DNA, 25 bp, Mus musculus
gagcacaattccgattaagagaagg

SEQ ID NO: 476884 - DNA, 25 bp, Mus musculus
gagcacaattggaaccctacacctg

SEQ ID NO: 476885 - DNA, 25 bp, Mus musculus
gagcacaattggtaccctacacctg

SEQ ID NO: 476886 - DNA, 25 bp, Mus musculus
gagcacacaccacccttgcagggaa

SEQ ID NO: 476887 - DNA, 25 bp, Mus musculus
gagcacacaccagccttgcagggaa

SEQ ID NO: 476888 - DNA, 25 bp, Mus musculus
gagcacacataaccactgaggcccg

SEQ ID NO: 476889 - DNA, 25 bp, Mus musculus
gagcacacataagcactgaggcccg

SEQ ID NO: 476890 - DNA, 25 bp, Mus musculus
gagcacacatcccttataactgttc

SEQ ID NO: 476891 - DNA, 25 bp, Mus musculus
gagcacacatccgttataactgttc

SEQ ID NO: 476892 - DNA, 25 bp, Mus musculus
gagcacacatggattgtctctgctt

SEQ ID NO: 476893 - DNA, 25 bp, Mus musculus
gagcacacatggtttgtctctgctt

SEQ ID NO: 476894 - DNA, 25 bp, Mus musculus
gagcacacccggcatactgtggaag

SEQ ID NO: 476895 - DNA, 25 bp, Mus musculus
gagcacacccgggatactgtggaag

SEQ ID NO: 476896 - DNA, 25 bp, Mus musculus
gagcacacctcaaccaacatgaaag

SEQ ID NO: 476897 - DNA, 25 bp, Mus musculus
gagcacacctcatccaacatgaaag

SEQ ID NO: 476898 - DNA, 25 bp, Mus musculus
gagcacacctgtagacatcatcaaa

SEQ ID NO: 476899 - DNA, 25 bp, Mus musculus
gagcacacctgttgacatcatcaaa

SEQ ID NO: 476900 - DNA, 25 bp, Mus musculus
gagcacacgccacaaaccaattaga

SEQ ID NO: 476901 - DNA, 25 bp, Mus musculus
gagcacacgccagaaaccaattaga

SEQ ID NO: 476902 - DNA, 25 bp, Mus musculus
gagcacactaatccttgggaccgga

SEQ ID NO: 476903 - DNA, 25 bp, Mus musculus
gagcacactaatgcttgggaccgga

SEQ ID NO: 476904 - DNA, 25 bp, Mus musculus
gagcacactagactgcttagatgaa

SEQ ID NO: 476905 - DNA, 25 bp, Mus musculus
gagcacactagagtgcttagatgaa

SEQ ID NO: 476906 - DNA, 25 bp, Mus musculus
gagcacactgtgaaacctggatctg

SEQ ID NO: 476907 - DNA, 25 bp, Mus musculus
gagcacactgtgtaacctggatctg

SEQ ID NO: 476908 - DNA, 25 bp, Mus musculus
gagcacactgttccagaagcttcag

SEQ ID NO: 476909 - DNA, 25 bp, Mus musculus
gagcacactgttgcagaagcttcag

SEQ ID NO: 476910 - DNA, 25 bp, Mus musculus
gagcacagacaactctctgtacagt

SEQ ID NO: 476911 - DNA, 25 bp, Mus musculus
gagcacagacaagtctctgtacagt

SEQ ID NO: 476912 - DNA, 25 bp, Mus musculus
gagcacagagacactaatcgggcat

SEQ ID NO: 476913 - DNA, 25 bp, Mus musculus
gagcacagagactctaatcgggcat

SEQ ID NO: 476914 - DNA, 25 bp, Mus musculus
gagcacagagccagaacacggcttt

SEQ ID NO: 476915 - DNA, 25 bp, Mus musculus
gagcacagagcctgaacacggcttt

SEQ ID NO: 476916 - DNA, 25 bp, Mus musculus
gagcacagatccacgtggcggacac

SEQ ID NO: 476917 - DNA, 25 bp, Mus musculus
gagcacagatcctcgtggcggacac

SEQ ID NO: 476918 - DNA, 25 bp, Mus musculus
gagcacagcatgaactaccagtaca

SEQ ID NO: 476919 - DNA, 25 bp, Mus musculus
gagcacagcatgtactaccagtaca

SEQ ID NO: 476920 - DNA, 25 bp, Mus musculus
gagcacagcattctcattttctttg

SEQ ID NO: 476921 - DNA, 25 bp, Mus musculus
gagcacagcattgtcattttctttg

SEQ ID NO: 476922 - DNA, 25 bp, Mus musculus
gagcacagccacattattgttgaaa

SEQ ID NO: 476923 - DNA, 25 bp, Mus musculus
gagcacagccactttattgttgaaa

SEQ ID NO: 476924 - DNA, 25 bp, Mus musculus
gagcacagcctgattgaagatttga

SEQ ID NO: 476925 - DNA, 25 bp, Mus musculus
gagcacagcctgtttgaagatttga

SEQ ID NO: 476926 - DNA, 25 bp, Mus musculus
gagcacagcggcaaaggcccgaaga

SEQ ID NO: 476927 - DNA, 25 bp, Mus musculus
gagcacagcggctaaggcccgaaga

SEQ ID NO: 476928 - DNA, 25 bp, Mus musculus
gagcacagctaaactcccgagatgt

SEQ ID NO: 476929 - DNA, 25 bp, Mus musculus
gagcacagctaacatctctgttaga

SEQ ID NO: 476930 - DNA, 25 bp, Mus musculus
gagcacagctaagatctctgttaga

SEQ ID NO: 476931 - DNA, 25 bp, Mus musculus
gagcacagctaatctcccgagatgt

SEQ ID NO: 476932 - DNA, 25 bp, Mus musculus
gagcacagctgtcagggttttacca

SEQ ID NO: 476933 - DNA, 25 bp, Mus musculus
gagcacagctgtctcatcaacatcg

SEQ ID NO: 476934 - DNA, 25 bp, Mus musculus
gagcacagctgtgagggttttacca

SEQ ID NO: 476935 - DNA, 25 bp, Mus musculus
gagcacagctgtgtcatcaacatcg

SEQ ID NO: 476936 - DNA, 25 bp, Mus musculus
gagcacaggacaaggagctccgatt

SEQ ID NO: 476937 - DNA, 25 bp, Mus musculus
gagcacaggacacctaggacaacta

SEQ ID NO: 476938 - DNA, 25 bp, Mus musculus
gagcacaggacagctaggacaacta

SEQ ID NO: 476939 - DNA, 25 bp, Mus musculus
gagcacaggacatggagctccgatt

SEQ ID NO: 476940 - DNA, 25 bp, Mus musculus
gagcacaggattatcctctaactcc

SEQ ID NO: 476941 - DNA, 25 bp, Mus musculus
gagcacaggattttcctctaactcc

SEQ ID NO: 476942 - DNA, 25 bp, Mus musculus
gagcacaggcaactcaccgaagcta

SEQ ID NO: 476943 - DNA, 25 bp, Mus musculus
gagcacaggcaagtcaccgaagcta

SEQ ID NO: 476944 - DNA, 25 bp, Mus musculus
gagcacaggcacctgtttggaccct

SEQ ID NO: 476945 - DNA, 25 bp, Mus musculus
gagcacaggcacgtgtttggaccct

SEQ ID NO: 476946 - DNA, 25 bp, Mus musculus
gagcacaggcagcatcctgagcaaa

SEQ ID NO: 476947 - DNA, 25 bp, Mus musculus
gagcacaggcaggatcctgagcaaa

SEQ ID NO: 476948 - DNA, 25 bp, Mus musculus
gagcacaggcgtatcagcagttgat

SEQ ID NO: 476949 - DNA, 25 bp, Mus musculus
gagcacaggcgtctatttgatgaca

SEQ ID NO: 476950 - DNA, 25 bp, Mus musculus
gagcacaggcgtgtatttgatgaca

SEQ ID NO: 476951 - DNA, 25 bp, Mus musculus
gagcacaggcgtttcagcagttgat

SEQ ID NO: 476952 - DNA, 25 bp, Mus musculus
gagcacaggctaagggccacggcta

SEQ ID NO: 476953 - DNA, 25 bp, Mus musculus
gagcacaggctatgggccacggcta

SEQ ID NO: 476954 - DNA, 25 bp, Mus musculus
gagcacagggctagaagcctctttt

SEQ ID NO: 476955 - DNA, 25 bp, Mus musculus
gagcacagggcttgaagcctctttt

SEQ ID NO: 476956 - DNA, 25 bp, Mus musculus
gagcacagtatcacttatccattta

SEQ ID NO: 476957 - DNA, 25 bp, Mus musculus
gagcacagtatctcttatccattta

SEQ ID NO: 476958 - DNA, 25 bp, Mus musculus
gagcacagtcatccactgaccaatg

SEQ ID NO: 476959 - DNA, 25 bp, Mus musculus
gagcacagtcatgcactgaccaatg

SEQ ID NO: 476960 - DNA, 25 bp, Mus musculus
gagcacagtcctcatccagaggtaa

SEQ ID NO: 476961 - DNA, 25 bp, Mus musculus
gagcacagtcctgatccagaggtaa

SEQ ID NO: 476962 - DNA, 25 bp, Mus musculus
gagcacagtgatcatcattggaaac

SEQ ID NO: 476963 - DNA, 25 bp, Mus musculus
gagcacagtgatgatcattggaaac

SEQ ID NO: 476964 - DNA, 25 bp, Mus musculus
gagcacagtgcacgaaaacccacag

SEQ ID NO: 476965 - DNA, 25 bp, Mus musculus
gagcacagtgcaggaaaacccacag

SEQ ID NO: 476966 - DNA, 25 bp, Mus musculus
gagcacagtgcgcattttttgaatg

SEQ ID NO: 476967 - DNA, 25 bp, Mus musculus
gagcacagtgcggattttttgaatg

SEQ ID NO: 476968 - DNA, 25 bp, Mus musculus
gagcacagtgctactttcaaaatca

SEQ ID NO: 476969 - DNA, 25 bp, Mus musculus
gagcacagtgcttctttcaaaatca

SEQ ID NO: 476970 - DNA, 25 bp, Mus musculus
gagcacagtgtaatctagtgtaatc

SEQ ID NO: 476971 - DNA, 25 bp, Mus musculus
gagcacagtgtattctagtgtaatc

SEQ ID NO: 476972 - DNA, 25 bp, Mus musculus
gagcacagtgtgctgccagctctca

SEQ ID NO: 476973 - DNA, 25 bp, Mus musculus
gagcacagtgtggtgccagctctca

SEQ ID NO: 476974 - DNA, 25 bp, Mus musculus
gagcacagtgttatctttaagagtc

SEQ ID NO: 476975 - DNA, 25 bp, Mus musculus
gagcacagtgttttctttaagagtc

SEQ ID NO: 476976 - DNA, 25 bp, Mus musculus
gagcacagttttcctggatggttta

SEQ ID NO: 476977 - DNA, 25 bp, Mus musculus
gagcacagttttgctggatggttta

SEQ ID NO: 476978 - DNA, 25 bp, Mus musculus
gagcacataagacaactcctgcctc

SEQ ID NO: 476979 - DNA, 25 bp, Mus musculus
gagcacataagagaactcctgcctc

SEQ ID NO: 476980 - DNA, 25 bp, Mus musculus
gagcacataccaagccaaatgcttt

SEQ ID NO: 476981 - DNA, 25 bp, Mus musculus
gagcacataccaagcggattttata

SEQ ID NO: 476982 - DNA, 25 bp, Mus musculus
gagcacataccatgccaaatgcttt

SEQ ID NO: 476983 - DNA, 25 bp, Mus musculus
gagcacataccatgcggattttata

SEQ ID NO: 476984 - DNA, 25 bp, Mus musculus
gagcacatacgaactcatgacctgt

SEQ ID NO: 476985 - DNA, 25 bp, Mus musculus
gagcacatacgatctcatgacctgt

SEQ ID NO: 476986 - DNA, 25 bp, Mus musculus
gagcacatatgtacattctaaatcc

SEQ ID NO: 476987 - DNA, 25 bp, Mus musculus
gagcacatatgttcattctaaatcc

SEQ ID NO: 476988 - DNA, 25 bp, Mus musculus
gagcacatatttaagtttacatcat

SEQ ID NO: 476989 - DNA, 25 bp, Mus musculus
gagcacatattttagtttacatcat

SEQ ID NO: 476990 - DNA, 25 bp, Mus musculus
gagcacatcagaagcagtcgccttt

SEQ ID NO: 476991 - DNA, 25 bp, Mus musculus
gagcacatcagaatccagaaagtaa

SEQ ID NO: 476992 - DNA, 25 bp, Mus musculus
gagcacatcagatgcagtcgccttt

SEQ ID NO: 476993 - DNA, 25 bp, Mus musculus
gagcacatcagattccagaaagtaa

SEQ ID NO: 476994 - DNA, 25 bp, Mus musculus
gagcacatcaggacacccaacggcg

SEQ ID NO: 476995 - DNA, 25 bp, Mus musculus
gagcacatcaggtcacccaacggcg

SEQ ID NO: 476996 - DNA, 25 bp, Mus musculus
gagcacatcataatctagcaagcga

SEQ ID NO: 476997 - DNA, 25 bp, Mus musculus
gagcacatcatattctagcaagcga

SEQ ID NO: 476998 - DNA, 25 bp, Mus musculus
gagcacatccccactggtggtaaat

SEQ ID NO: 476999 - DNA, 25 bp, Mus musculus
gagcacatcccctctggtggtaaat

SEQ ID NO: 477000 - DNA, 25 bp, Mus musculus
gagcacatcctgcacccgtggtcta

SEQ ID NO: 477001 - DNA, 25 bp, Mus musculus
gagcacatcctggacccgtggtcta

SEQ ID NO: 477002 - DNA, 25 bp, Mus musculus
gagcacatctgtcataggcactgat

SEQ ID NO: 477003 - DNA, 25 bp, Mus musculus
gagcacatctgtgataggcactgat

SEQ ID NO: 477004 - DNA, 25 bp, Mus musculus
gagcacatgcacagagctatcttga

SEQ ID NO: 477005 - DNA, 25 bp, Mus musculus
gagcacatgcactgagctatcttga

SEQ ID NO: 477006 - DNA, 25 bp, Mus musculus
gagcacatgccaactcattcttaga

SEQ ID NO: 477007 - DNA, 25 bp, Mus musculus
gagcacatgccatctcattcttaga

SEQ ID NO: 477008 - DNA, 25 bp, Mus musculus
gagcacatggctcagcttccaaact

SEQ ID NO: 477009 - DNA, 25 bp, Mus musculus
gagcacatggctcctatacttgttc

SEQ ID NO: 477010 - DNA, 25 bp, Mus musculus
gagcacatggctgagcttccaaact

SEQ ID NO: 477011 - DNA, 25 bp, Mus musculus
gagcacatggctgctatacttgttc

SEQ ID NO: 477012 - DNA, 25 bp, Mus musculus
gagcacatgggtctgcagctcatga

SEQ ID NO: 477013 - DNA, 25 bp, Mus musculus
gagcacatgggtgtgcagctcatga

SEQ ID NO: 477014 - DNA, 25 bp, Mus musculus
gagcacatggttacaacactacaca

SEQ ID NO: 477015 - DNA, 25 bp, Mus musculus
gagcacatggtttcaacactacaca

SEQ ID NO: 477016 - DNA, 25 bp, Mus musculus
gagcacatgtctcactgtgttccca

SEQ ID NO: 477017 - DNA, 25 bp, Mus musculus
gagcacatgtctgactgtgttccca

SEQ ID NO: 477018 - DNA, 25 bp, Mus musculus
gagcacatgttcaatcccagatctc

SEQ ID NO: 477019 - DNA, 25 bp, Mus musculus
gagcacatgttctatcccagatctc

SEQ ID NO: 477020 - DNA, 25 bp, Mus musculus
gagcacattgagagccagccaacta

SEQ ID NO: 477021 - DNA, 25 bp, Mus musculus
gagcacattgagtgccagccaacta

SEQ ID NO: 477022 - DNA, 25 bp, Mus musculus
gagcacatttctacttgatcttatt

SEQ ID NO: 477023 - DNA, 25 bp, Mus musculus
gagcacatttcttcttgatcttatt

SEQ ID NO: 477024 - DNA, 25 bp, Mus musculus
gagcaccaaacgcttcatcaagtgg

SEQ ID NO: 477025 - DNA, 25 bp, Mus musculus
gagcaccaaacggttcatcaagtgg

SEQ ID NO: 477026 - DNA, 25 bp, Mus musculus
gagcaccaaactatccaaaagagca

SEQ ID NO: 477027 - DNA, 25 bp, Mus musculus
gagcaccaaactttccaaaagagca

SEQ ID NO: 477028 - DNA, 25 bp, Mus musculus
gagcaccaaagacttctgctgttct

SEQ ID NO: 477029 - DNA, 25 bp, Mus musculus
gagcaccaaagagttctgctgttct

SEQ ID NO: 477030 - DNA, 25 bp, Mus musculus
gagcaccaaccactgttgagtgaga

SEQ ID NO: 477031 - DNA, 25 bp, Mus musculus
gagcaccaaccagtgttgagtgaga

SEQ ID NO: 477032 - DNA, 25 bp, Mus musculus
gagcaccaagaaatacatcctgtaa

SEQ ID NO: 477033 - DNA, 25 bp, Mus musculus
gagcaccaagaattacatcctgtaa

SEQ ID NO: 477034 - DNA, 25 bp, Mus musculus
gagcaccaagacagacagccgggac

SEQ ID NO: 477035 - DNA, 25 bp, Mus musculus
gagcaccaagactgacagccgggac

SEQ ID NO: 477036 - DNA, 25 bp, Mus musculus
gagcaccacattaaaacttccacgc

SEQ ID NO: 477037 - DNA, 25 bp, Mus musculus
gagcaccacatttaaacttccacgc

SEQ ID NO: 477038 - DNA, 25 bp, Mus musculus
gagcaccacgcaagaagattcatcg

SEQ ID NO: 477039 - DNA, 25 bp, Mus musculus
gagcaccacgcatgaagattcatcg

SEQ ID NO: 477040 - DNA, 25 bp, Mus musculus
gagcaccacgccagcgaagtgtgtg

SEQ ID NO: 477041 - DNA, 25 bp, Mus musculus
gagcaccacgcctgcgaagtgtgtg

SEQ ID NO: 477042 - DNA, 25 bp, Mus musculus
gagcaccacgttaagcacaagatct

SEQ ID NO: 477043 - DNA, 25 bp, Mus musculus
gagcaccacgtttagcacaagatct

SEQ ID NO: 477044 - DNA, 25 bp, Mus musculus
gagcaccactagactgagggattaa

SEQ ID NO: 477045 - DNA, 25 bp, Mus musculus
gagcaccactagtctgagggattaa

SEQ ID NO: 477046 - DNA, 25 bp, Mus musculus
gagcaccacttcactgagagccagg

SEQ ID NO: 477047 - DNA, 25 bp, Mus musculus
gagcaccacttctctgagagccagg

SEQ ID NO: 477048 - DNA, 25 bp, Mus musculus
gagcaccagcagataattccacttg

SEQ ID NO: 477049 - DNA, 25 bp, Mus musculus
gagcaccagcagttaattccacttg

SEQ ID NO: 477050 - DNA, 25 bp, Mus musculus
gagcaccaggtaatgctaacatcat

SEQ ID NO: 477051 - DNA, 25 bp, Mus musculus
gagcaccaggtattgctaacatcat

SEQ ID NO: 477052 - DNA, 25 bp, Mus musculus
gagcaccaggtcagagctctgagtc

SEQ ID NO: 477053 - DNA, 25 bp, Mus musculus
gagcaccaggtctgagctctgagtc

SEQ ID NO: 477054 - DNA, 25 bp, Mus musculus
gagcaccaggtgcacatgcgagcaa

SEQ ID NO: 477055 - DNA, 25 bp, Mus musculus
gagcaccaggtggacatgcgagcaa

SEQ ID NO: 477056 - DNA, 25 bp, Mus musculus
gagcaccagtatcaacagcaactat

SEQ ID NO: 477057 - DNA, 25 bp, Mus musculus
gagcaccagtatgaacagcaactat

SEQ ID NO: 477058 - DNA, 25 bp, Mus musculus
gagcaccagtcgaatcctcaatggg

SEQ ID NO: 477059 - DNA, 25 bp, Mus musculus
gagcaccagtcgtatcctcaatggg

SEQ ID NO: 477060 - DNA, 25 bp, Mus musculus
gagcaccatgaccatagtttatgcg

SEQ ID NO: 477061 - DNA, 25 bp, Mus musculus
gagcaccatgacgatagtttatgcg

SEQ ID NO: 477062 - DNA, 25 bp, Mus musculus
gagcaccatgataaagtgaggccat

SEQ ID NO: 477063 - DNA, 25 bp, Mus musculus
gagcaccatgattaagtgaggccat

SEQ ID NO: 477064 - DNA, 25 bp, Mus musculus
gagcaccatggtcggaactccatat

SEQ ID NO: 477065 - DNA, 25 bp, Mus musculus
gagcaccatggtgggaactccatat

SEQ ID NO: 477066 - DNA, 25 bp, Mus musculus
gagcaccatgtgaagatccaagtaa

SEQ ID NO: 477067 - DNA, 25 bp, Mus musculus
gagcaccatgtgcacatactgacta

SEQ ID NO: 477068 - DNA, 25 bp, Mus musculus
gagcaccatgtggacatactgacta

SEQ ID NO: 477069 - DNA, 25 bp, Mus musculus
gagcaccatgtgtagatccaagtaa

SEQ ID NO: 477070 - DNA, 25 bp, Mus musculus
gagcacccaagaattcagtcgactt

SEQ ID NO: 477071 - DNA, 25 bp, Mus musculus
gagcacccaagatttcagtcgactt

SEQ ID NO: 477072 - DNA, 25 bp, Mus musculus
gagcacccaaggaatcaagaggcga

SEQ ID NO: 477073 - DNA, 25 bp, Mus musculus
gagcacccaaggtatcaagaggcga

SEQ ID NO: 477074 - DNA, 25 bp, Mus musculus
gagcacccacataagacggtttaca

SEQ ID NO: 477075 - DNA, 25 bp, Mus musculus
gagcacccacattagacggtttaca

SEQ ID NO: 477076 - DNA, 25 bp, Mus musculus
gagcacccagatcgagcctgtgtga

SEQ ID NO: 477077 - DNA, 25 bp, Mus musculus
gagcacccagatggagcctgtgtga

SEQ ID NO: 477078 - DNA, 25 bp, Mus musculus
gagcacccagcgaagcttaaagttt

SEQ ID NO: 477079 - DNA, 25 bp, Mus musculus
gagcacccagcgtagcttaaagttt

SEQ ID NO: 477080 - DNA, 25 bp, Mus musculus
gagcacccaggacctatcaggagca

SEQ ID NO: 477081 - DNA, 25 bp, Mus musculus
gagcacccaggagctatcaggagca

SEQ ID NO: 477082 - DNA, 25 bp, Mus musculus
gagcaccccacacaagacctggaaa

SEQ ID NO: 477083 - DNA, 25 bp, Mus musculus
gagcaccccacagaagacctggaaa

SEQ ID NO: 477084 - DNA, 25 bp, Mus musculus
gagcaccccagcaggtccacagatt

SEQ ID NO: 477085 - DNA, 25 bp, Mus musculus
gagcaccccagctggtccacagatt

SEQ ID NO: 477086 - DNA, 25 bp, Mus musculus
gagcacccctgacggtacgcgcttt

SEQ ID NO: 477087 - DNA, 25 bp, Mus musculus
gagcacccctgagggtacgcgcttt

SEQ ID NO: 477088 - DNA, 25 bp, Mus musculus
gagcacccggagaagtgtcccgagt

SEQ ID NO: 477089 - DNA, 25 bp, Mus musculus
gagcacccggagtagtgtcccgagt

SEQ ID NO: 477090 - DNA, 25 bp, Mus musculus
gagcaccctagtaggccggtgagaa

SEQ ID NO: 477091 - DNA, 25 bp, Mus musculus
gagcaccctagttggccggtgagaa

SEQ ID NO: 477092 - DNA, 25 bp, Mus musculus
gagcaccctcatacccaataggaat

SEQ ID NO: 477093 - DNA, 25 bp, Mus musculus
gagcaccctcattcccaataggaat

SEQ ID NO: 477094 - DNA, 25 bp, Mus musculus
gagcaccctgatacactagctgaga

SEQ ID NO: 477095 - DNA, 25 bp, Mus musculus
gagcaccctgattcactagctgaga

SEQ ID NO: 477096 - DNA, 25 bp, Mus musculus
gagcaccctggactacattgcagaa

SEQ ID NO: 477097 - DNA, 25 bp, Mus musculus
gagcaccctggagtacattgcagaa

SEQ ID NO: 477098 - DNA, 25 bp, Mus musculus
gagcaccctgtgcatgtaccaaagt

SEQ ID NO: 477099 - DNA, 25 bp, Mus musculus
gagcaccctgtggatgtaccaaagt

SEQ ID NO: 477100 - DNA, 25 bp, Mus musculus
gagcaccctttgatttctgaggaca

SEQ ID NO: 477101 - DNA, 25 bp, Mus musculus
gagcaccctttgttttctgaggaca

SEQ ID NO: 477102 - DNA, 25 bp, Mus musculus
gagcaccgagatacctgagagctat

SEQ ID NO: 477103 - DNA, 25 bp, Mus musculus
gagcaccgagattcctgagagctat

SEQ ID NO: 477104 - DNA, 25 bp, Mus musculus
gagcaccgcactatcttaggtaagg

SEQ ID NO: 477105 - DNA, 25 bp, Mus musculus
gagcaccgcactttcttaggtaagg

SEQ ID NO: 477106 - DNA, 25 bp, Mus musculus
gagcaccggaagatattttagccct

SEQ ID NO: 477107 - DNA, 25 bp, Mus musculus
gagcaccggaagttattttagccct

SEQ ID NO: 477108 - DNA, 25 bp, Mus musculus
gagcaccggaggctaggaccacctt

SEQ ID NO: 477109 - DNA, 25 bp, Mus musculus
gagcaccggagggtaggaccacctt

SEQ ID NO: 477110 - DNA, 25 bp, Mus musculus
gagcaccgggtgatgagaaatctgt

SEQ ID NO: 477111 - DNA, 25 bp, Mus musculus
gagcaccgggtgttgagaaatctgt

SEQ ID NO: 477112 - DNA, 25 bp, Mus musculus
gagcaccgtgaaaaatctctgtgag

SEQ ID NO: 477113 - DNA, 25 bp, Mus musculus
gagcaccgtgaataatctctgtgag

SEQ ID NO: 477114 - DNA, 25 bp, Mus musculus
gagcaccgtgctagggcttgtctgc

SEQ ID NO: 477115 - DNA, 25 bp, Mus musculus
gagcaccgtgcttgggcttgtctgc

SEQ ID NO: 477116 - DNA, 25 bp, Mus musculus
gagcaccgtgggaagcacagtccca

SEQ ID NO: 477117 - DNA, 25 bp, Mus musculus
gagcaccgtgggtagcacagtccca

SEQ ID NO: 477118 - DNA, 25 bp, Mus musculus
gagcaccgtgtaagaacatcgagga

SEQ ID NO: 477119 - DNA, 25 bp, Mus musculus
gagcaccgtgtatgaacatcgagga

SEQ ID NO: 477120 - DNA, 25 bp, Mus musculus
gagcaccgtgtcataagtggcagcc

SEQ ID NO: 477121 - DNA, 25 bp, Mus musculus
gagcaccgtgtcttaagtggcagcc

SEQ ID NO: 477122 - DNA, 25 bp, Mus musculus
gagcacctacatcagcttaaaaatt

SEQ ID NO: 477123 - DNA, 25 bp, Mus musculus
gagcacctacatgagcttaaaaatt

SEQ ID NO: 477124 - DNA, 25 bp, Mus musculus
gagcacctagagaatcaggcctttg

SEQ ID NO: 477125 - DNA, 25 bp, Mus musculus
gagcacctagagtatcaggcctttg

SEQ ID NO: 477126 - DNA, 25 bp, Mus musculus
gagcacctaggcaggatactttcca

SEQ ID NO: 477127 - DNA, 25 bp, Mus musculus
gagcacctaggctggatactttcca

SEQ ID NO: 477128 - DNA, 25 bp, Mus musculus
gagcacctcaaaagaattcatcagg

SEQ ID NO: 477129 - DNA, 25 bp, Mus musculus
gagcacctcaaatgaattcatcagg

SEQ ID NO: 477130 - DNA, 25 bp, Mus musculus
gagcacctcacacccagtttcaatt

SEQ ID NO: 477131 - DNA, 25 bp, Mus musculus
gagcacctcacagccagtttcaatt

SEQ ID NO: 477132 - DNA, 25 bp, Mus musculus
gagcacctcagccagctaatcaggt

SEQ ID NO: 477133 - DNA, 25 bp, Mus musculus
gagcacctcagcgagctaatcaggt

SEQ ID NO: 477134 - DNA, 25 bp, Mus musculus
gagcacctcgtactatcaggcttga

SEQ ID NO: 477135 - DNA, 25 bp, Mus musculus
gagcacctcgtagtatcaggcttga

SEQ ID NO: 477136 - DNA, 25 bp, Mus musculus
gagcacctctgacctaaaagacagt

SEQ ID NO: 477137 - DNA, 25 bp, Mus musculus
gagcacctctgagctaaaagacagt

SEQ ID NO: 477138 - DNA, 25 bp, Mus musculus
gagcacctcttactgacttccactg

SEQ ID NO: 477139 - DNA, 25 bp, Mus musculus
gagcacctcttagtgacttccactg

SEQ ID NO: 477140 - DNA, 25 bp, Mus musculus
gagcacctgaagactaatgttttac

SEQ ID NO: 477141 - DNA, 25 bp, Mus musculus
gagcacctgaagtctaatgttttac

SEQ ID NO: 477142 - DNA, 25 bp, Mus musculus
gagcacctgcatccaagagcatgcg

SEQ ID NO: 477143 - DNA, 25 bp, Mus musculus
gagcacctgcatgcaagagcatgcg

SEQ ID NO: 477144 - DNA, 25 bp, Mus musculus
gagcacctgcggcaggacaacctga

SEQ ID NO: 477145 - DNA, 25 bp, Mus musculus
gagcacctgcgggaggacaacctga

SEQ ID NO: 477146 - DNA, 25 bp, Mus musculus
gagcacctgcgtcgctggtaccaga

SEQ ID NO: 477147 - DNA, 25 bp, Mus musculus
gagcacctgcgtggctggtaccaga

SEQ ID NO: 477148 - DNA, 25 bp, Mus musculus
gagcacctgctgaatgctgagcact

SEQ ID NO: 477149 - DNA, 25 bp, Mus musculus
gagcacctgctgtatgctgagcact

SEQ ID NO: 477150 - DNA, 25 bp, Mus musculus
gagcacctgcttaggatttgagaaa

SEQ ID NO: 477151 - DNA, 25 bp, Mus musculus
gagcacctgctttggatttgagaaa

SEQ ID NO: 477152 - DNA, 25 bp, Mus musculus
gagcacctggacatgcaggtactag

SEQ ID NO: 477153 - DNA, 25 bp, Mus musculus
gagcacctggacttgcaggtactag

SEQ ID NO: 477154 - DNA, 25 bp, Mus musculus
gagcacctggctcagtacttggaag

SEQ ID NO: 477155 - DNA, 25 bp, Mus musculus
gagcacctggctccacgatggatat

SEQ ID NO: 477156 - DNA, 25 bp, Mus musculus
gagcacctggctgagtacttggaag

SEQ ID NO: 477157 - DNA, 25 bp, Mus musculus
gagcacctggctgcacgatggatat

SEQ ID NO: 477158 - DNA, 25 bp, Mus musculus
gagcacctgggactaacctagtcat

SEQ ID NO: 477159 - DNA, 25 bp, Mus musculus
gagcacctgggagtaacctagtcat

SEQ ID NO: 477160 - DNA, 25 bp, Mus musculus
gagcacctggtcaataatcacacaa

SEQ ID NO: 477161 - DNA, 25 bp, Mus musculus
gagcacctggtctataatcacacaa

SEQ ID NO: 477162 - DNA, 25 bp, Mus musculus
gagcacctgttgcaggactaggaaa

SEQ ID NO: 477163 - DNA, 25 bp, Mus musculus
gagcacctgttggaggactaggaaa

SEQ ID NO: 477164 - DNA, 25 bp, Mus musculus
gagcaccttacactgggctttgaag

SEQ ID NO: 477165 - DNA, 25 bp, Mus musculus
gagcaccttacagtgggctttgaag

SEQ ID NO: 477166 - DNA, 25 bp, Mus musculus
gagcaccttcacactgacattttca

SEQ ID NO: 477167 - DNA, 25 bp, Mus musculus
gagcaccttcactctgacattttca

SEQ ID NO: 477168 - DNA, 25 bp, Mus musculus
gagcaccttgtgagcaggaaaagtt

SEQ ID NO: 477169 - DNA, 25 bp, Mus musculus
gagcaccttgtgtgcaggaaaagtt

SEQ ID NO: 477170 - DNA, 25 bp, Mus musculus
gagcacctttctctagcatcagaat

SEQ ID NO: 477171 - DNA, 25 bp, Mus musculus
gagcacctttctgtagcatcagaat

SEQ ID NO: 477172 - DNA, 25 bp, Mus musculus
gagcacctttgacagtactcccttg

SEQ ID NO: 477173 - DNA, 25 bp, Mus musculus
gagcacctttgagagtactcccttg

SEQ ID NO: 477174 - DNA, 25 bp, Mus musculus
gagcacctttgtaggttacacttta

SEQ ID NO: 477175 - DNA, 25 bp, Mus musculus
gagcacctttgttggttacacttta

SEQ ID NO: 477176 - DNA, 25 bp, Mus musculus
gagcacgaaccacagctggcctcag

SEQ ID NO: 477177 - DNA, 25 bp, Mus musculus
gagcacgaaccagagctggcctcag

SEQ ID NO: 477178 - DNA, 25 bp, Mus musculus
gagcacgaagatcgcttcctacatg

SEQ ID NO: 477179 - DNA, 25 bp, Mus musculus
gagcacgaagatggcttcctacatg

SEQ ID NO: 477180 - DNA, 25 bp, Mus musculus
gagcacgaagcacatgtttctcatg

SEQ ID NO: 477181 - DNA, 25 bp, Mus musculus
gagcacgaagcagatgtttctcatg

SEQ ID NO: 477182 - DNA, 25 bp, Mus musculus
gagcacgaagtgatcctccagagga

SEQ ID NO: 477183 - DNA, 25 bp, Mus musculus
gagcacgaagtgttcctccagagga

SEQ ID NO: 477184 - DNA, 25 bp, Mus musculus
gagcacgaccagaggcgcagagact

SEQ ID NO: 477185 - DNA, 25 bp, Mus musculus
gagcacgaccagtggcgcagagact

SEQ ID NO: 477186 - DNA, 25 bp, Mus musculus
gagcacgacctacgtgtatctttct

SEQ ID NO: 477187 - DNA, 25 bp, Mus musculus
gagcacgacctaggtgtatctttct

SEQ ID NO: 477188 - DNA, 25 bp, Mus musculus
gagcacgagagacccccgttcgttg

SEQ ID NO: 477189 - DNA, 25 bp, Mus musculus
gagcacgagagagccccgttcgttg

SEQ ID NO: 477190 - DNA, 25 bp, Mus musculus
gagcacgaggaacccatgaacgccg

SEQ ID NO: 477191 - DNA, 25 bp, Mus musculus
gagcacgaggaagccatgaacgccg

SEQ ID NO: 477192 - DNA, 25 bp, Mus musculus
gagcacgaggccctgaccctgcaga

SEQ ID NO: 477193 - DNA, 25 bp, Mus musculus
gagcacgaggccgtgaccctgcaga

SEQ ID NO: 477194 - DNA, 25 bp, Mus musculus
gagcacgaggctcaaggagacccct

SEQ ID NO: 477195 - DNA, 25 bp, Mus musculus
gagcacgaggctgaaggagacccct

SEQ ID NO: 477196 - DNA, 25 bp, Mus musculus
gagcacgagggacgaacccacccta

SEQ ID NO: 477197 - DNA, 25 bp, Mus musculus
gagcacgagggaggaacccacccta

SEQ ID NO: 477198 - DNA, 25 bp, Mus musculus
gagcacgataatcccagaatccctt

SEQ ID NO: 477199 - DNA, 25 bp, Mus musculus
gagcacgataatgccagaatccctt

SEQ ID NO: 477200 - DNA, 25 bp, Mus musculus
gagcacgatctcaggaaccacaatt

SEQ ID NO: 477201 - DNA, 25 bp, Mus musculus
gagcacgatctctggaaccacaatt

SEQ ID NO: 477202 - DNA, 25 bp, Mus musculus
gagcacgattagatcttcagtcttg

SEQ ID NO: 477203 - DNA, 25 bp, Mus musculus
gagcacgattagttcttcagtcttg

SEQ ID NO: 477204 - DNA, 25 bp, Mus musculus
gagcacgccaagagggttgattcat

SEQ ID NO: 477205 - DNA, 25 bp, Mus musculus
gagcacgccaagtgggttgattcat

SEQ ID NO: 477206 - DNA, 25 bp, Mus musculus
gagcacgctattatccctgagtggt

SEQ ID NO: 477207 - DNA, 25 bp, Mus musculus
gagcacgctattttccctgagtggt

SEQ ID NO: 477208 - DNA, 25 bp, Mus musculus
gagcacgctggactcatatctgttc

SEQ ID NO: 477209 - DNA, 25 bp, Mus musculus
gagcacgctggagtcatatctgttc

SEQ ID NO: 477210 - DNA, 25 bp, Mus musculus
gagcacgctggcagtggcaagacat

SEQ ID NO: 477211 - DNA, 25 bp, Mus musculus
gagcacgctggctgtggcaagacat

SEQ ID NO: 477212 - DNA, 25 bp, Mus musculus
gagcacgcttctacagggctgcgtc

SEQ ID NO: 477213 - DNA, 25 bp, Mus musculus
gagcacgcttcttcagggctgcgtc

SEQ ID NO: 477214 - DNA, 25 bp, Mus musculus
gagcacggacagaaacagtgtattt

SEQ ID NO: 477215 - DNA, 25 bp, Mus musculus
gagcacggacagtaacagtgtattt

SEQ ID NO: 477216 - DNA, 25 bp, Mus musculus
gagcacggactgcagttccagacat

SEQ ID NO: 477217 - DNA, 25 bp, Mus musculus
gagcacggactggagttccagacat

SEQ ID NO: 477218 - DNA, 25 bp, Mus musculus
gagcacggacttactgagaccattc

SEQ ID NO: 477219 - DNA, 25 bp, Mus musculus
gagcacggactttctgagaccattc

SEQ ID NO: 477220 - DNA, 25 bp, Mus musculus
gagcacggcaagagagccctccaga

SEQ ID NO: 477221 - DNA, 25 bp, Mus musculus
gagcacggcaagtgagccctccaga

SEQ ID NO: 477222 - DNA, 25 bp, Mus musculus
gagcacgggcttcccattaacacgg

SEQ ID NO: 477223 - DNA, 25 bp, Mus musculus
gagcacgggcttgccattaacacgg

SEQ ID NO: 477224 - DNA, 25 bp, Mus musculus
gagcacgggtttacagactcacccc

SEQ ID NO: 477225 - DNA, 25 bp, Mus musculus
gagcacgggttttcagactcacccc

SEQ ID NO: 477226 - DNA, 25 bp, Mus musculus
gagcacggtctcctcctagggaccg

SEQ ID NO: 477227 - DNA, 25 bp, Mus musculus
gagcacggtctcgtcctagggaccg

SEQ ID NO: 477228 - DNA, 25 bp, Mus musculus
gagcacgtagctaacattcttccaa

SEQ ID NO: 477229 - DNA, 25 bp, Mus musculus
gagcacgtagcttacattcttccaa

SEQ ID NO: 477230 - DNA, 25 bp, Mus musculus
gagcacgtagtacttatattccttt

SEQ ID NO: 477231 - DNA, 25 bp, Mus musculus
gagcacgtagtagttatattccttt

SEQ ID NO: 477232 - DNA, 25 bp, Mus musculus
gagcacgtatttcaaggagaacatg

SEQ ID NO: 477233 - DNA, 25 bp, Mus musculus
gagcacgtatttgaaggagaacatg

SEQ ID NO: 477234 - DNA, 25 bp, Mus musculus
gagcacgtcaagatagccctagaga

SEQ ID NO: 477235 - DNA, 25 bp, Mus musculus
gagcacgtcaagttagccctagaga

SEQ ID NO: 477236 - DNA, 25 bp, Mus musculus
gagcacgtgggcactatgtgccaaa

SEQ ID NO: 477237 - DNA, 25 bp, Mus musculus
gagcacgtgggctctatgtgccaaa

SEQ ID NO: 477238 - DNA, 25 bp, Mus musculus
gagcacgtgttcatgagtgtgagct

SEQ ID NO: 477239 - DNA, 25 bp, Mus musculus
gagcacgtgttcttgagtgtgagct

SEQ ID NO: 477240 - DNA, 25 bp, Mus musculus
gagcacgttcagatggctagacaca

SEQ ID NO: 477241 - DNA, 25 bp, Mus musculus
gagcacgttcagttggctagacaca

SEQ ID NO: 477242 - DNA, 25 bp, Mus musculus
gagcacgttccacgtaatccggcga

SEQ ID NO: 477243 - DNA, 25 bp, Mus musculus
gagcacgttccaggtaatccggcga

SEQ ID NO: 477244 - DNA, 25 bp, Mus musculus
gagcacgttgctatagagcagcact

SEQ ID NO: 477245 - DNA, 25 bp, Mus musculus
gagcacgttgctttagagcagcact

SEQ ID NO: 477246 - DNA, 25 bp, Mus musculus
gagcactaaactcgcctgtgggcct

SEQ ID NO: 477247 - DNA, 25 bp, Mus musculus
gagcactaaactggcctgtgggcct

SEQ ID NO: 477248 - DNA, 25 bp, Mus musculus
gagcactaatagatcttcttcctgt

SEQ ID NO: 477249 - DNA, 25 bp, Mus musculus
gagcactaatagttcttcttcctgt

SEQ ID NO: 477250 - DNA, 25 bp, Mus musculus
gagcactaccctcggctctgtgaag

SEQ ID NO: 477251 - DNA, 25 bp, Mus musculus
gagcactaccctgggctctgtgaag

SEQ ID NO: 477252 - DNA, 25 bp, Mus musculus
gagcactacctaccaggctgtgtga

SEQ ID NO: 477253 - DNA, 25 bp, Mus musculus
gagcactacctagcaggctgtgtga

SEQ ID NO: 477254 - DNA, 25 bp, Mus musculus
gagcactacgagaaccggcatgtca

SEQ ID NO: 477255 - DNA, 25 bp, Mus musculus
gagcactacgagtaccggcatgtca

SEQ ID NO: 477256 - DNA, 25 bp, Mus musculus
gagcactacgtgacctggatccaga

SEQ ID NO: 477257 - DNA, 25 bp, Mus musculus
gagcactacgtgtcctggatccaga

SEQ ID NO: 477258 - DNA, 25 bp, Mus musculus
gagcactactatacgtggtctttcg

SEQ ID NO: 477259 - DNA, 25 bp, Mus musculus
gagcactactattcgtggtctttcg

SEQ ID NO: 477260 - DNA, 25 bp, Mus musculus
gagcactactgaaagggagccgcaa

SEQ ID NO: 477261 - DNA, 25 bp, Mus musculus
gagcactactgacagagatgtcgaa

SEQ ID NO: 477262 - DNA, 25 bp, Mus musculus
gagcactactgagagagatgtcgaa

SEQ ID NO: 477263 - DNA, 25 bp, Mus musculus
gagcactactgatagggagccgcaa

SEQ ID NO: 477264 - DNA, 25 bp, Mus musculus
gagcactagggaatttcctcctaag

SEQ ID NO: 477265 - DNA, 25 bp, Mus musculus
gagcactagggattttcctcctaag

SEQ ID NO: 477266 - DNA, 25 bp, Mus musculus
gagcactatgtaagtggatgtcctt

SEQ ID NO: 477267 - DNA, 25 bp, Mus musculus
gagcactatgtatgtggatgtcctt

SEQ ID NO: 477268 - DNA, 25 bp, Mus musculus
gagcactattgtatcagcattgaga

SEQ ID NO: 477269 - DNA, 25 bp, Mus musculus
gagcactattgtttcagcattgaga

SEQ ID NO: 477270 - DNA, 25 bp, Mus musculus
gagcactcagccagcagttctctat

SEQ ID NO: 477271 - DNA, 25 bp, Mus musculus
gagcactcagcctgcagttctctat

SEQ ID NO: 477272 - DNA, 25 bp, Mus musculus
gagcactcagctaattcccacctgg

SEQ ID NO: 477273 - DNA, 25 bp, Mus musculus
gagcactcagcttattcccacctgg

SEQ ID NO: 477274 - DNA, 25 bp, Mus musculus
gagcactcctgacataaccccaaag

SEQ ID NO: 477275 - DNA, 25 bp, Mus musculus
gagcactcctgagataaccccaaag

SEQ ID NO: 477276 - DNA, 25 bp, Mus musculus
gagcactcgaagatggttctttccc

SEQ ID NO: 477277 - DNA, 25 bp, Mus musculus
gagcactcgaagttggttctttccc

SEQ ID NO: 477278 - DNA, 25 bp, Mus musculus
gagcactcgctaagcacagagctaa

SEQ ID NO: 477279 - DNA, 25 bp, Mus musculus
gagcactcgctatgcacagagctaa

SEQ ID NO: 477280 - DNA, 25 bp, Mus musculus
gagcactcggtgaaattgttccagg

SEQ ID NO: 477281 - DNA, 25 bp, Mus musculus
gagcactcggtgtaattgttccagg

SEQ ID NO: 477282 - DNA, 25 bp, Mus musculus
gagcactctaccaagaagtgagtca

SEQ ID NO: 477283 - DNA, 25 bp, Mus musculus
gagcactctacctagaagtgagtca

SEQ ID NO: 477284 - DNA, 25 bp, Mus musculus
gagcactctctacatgaaggtcaca

SEQ ID NO: 477285 - DNA, 25 bp, Mus musculus
gagcactctctagatgaaggtcaca

SEQ ID NO: 477286 - DNA, 25 bp, Mus musculus
gagcactctctgaggtaagcactgt

SEQ ID NO: 477287 - DNA, 25 bp, Mus musculus
gagcactctctgtggtaagcactgt

SEQ ID NO: 477288 - DNA, 25 bp, Mus musculus
gagcactctgagaagtctagcaggc

SEQ ID NO: 477289 - DNA, 25 bp, Mus musculus
gagcactctgagtagtctagcaggc

SEQ ID NO: 477290 - DNA, 25 bp, Mus musculus
gagcactctgccagtaagctacagc

SEQ ID NO: 477291 - DNA, 25 bp, Mus musculus
gagcactctgcctgtaagctacagc

SEQ ID NO: 477292 - DNA, 25 bp, Mus musculus
gagcactctgctcgagaacctgtgg

SEQ ID NO: 477293 - DNA, 25 bp, Mus musculus
gagcactctgctggagaacctgtgg

SEQ ID NO: 477294 - DNA, 25 bp, Mus musculus
gagcactgactcctggaaattacta

SEQ ID NO: 477295 - DNA, 25 bp, Mus musculus
gagcactgactcgtggaaattacta

SEQ ID NO: 477296 - DNA, 25 bp, Mus musculus
gagcactgagaaaacaaggccagcc

SEQ ID NO: 477297 - DNA, 25 bp, Mus musculus
gagcactgagaaaaccaacactgct

SEQ ID NO: 477298 - DNA, 25 bp, Mus musculus
gagcactgagaatacaaggccagcc

SEQ ID NO: 477299 - DNA, 25 bp, Mus musculus
gagcactgagaataccaacactgct

SEQ ID NO: 477300 - DNA, 25 bp, Mus musculus
gagcactgagagaatgtgttctcat

SEQ ID NO: 477301 - DNA, 25 bp, Mus musculus
gagcactgagagtatgtgttctcat

SEQ ID NO: 477302 - DNA, 25 bp, Mus musculus
gagcactgagatccgccaagcacaa

SEQ ID NO: 477303 - DNA, 25 bp, Mus musculus
gagcactgagatgcgccaagcacaa

SEQ ID NO: 477304 - DNA, 25 bp, Mus musculus
gagcactgaggacaaccccagcgga

SEQ ID NO: 477305 - DNA, 25 bp, Mus musculus
gagcactgaggagaaccccagcgga

SEQ ID NO: 477306 - DNA, 25 bp, Mus musculus
gagcactgagtcattccaaagagct

SEQ ID NO: 477307 - DNA, 25 bp, Mus musculus
gagcactgagtctttccaaagagct

SEQ ID NO: 477308 - DNA, 25 bp, Mus musculus
gagcactgatacaccaccagggtag

SEQ ID NO: 477309 - DNA, 25 bp, Mus musculus
gagcactgatactccaccagggtag

SEQ ID NO: 477310 - DNA, 25 bp, Mus musculus
gagcactgatctagcttgctgcaca

SEQ ID NO: 477311 - DNA, 25 bp, Mus musculus
gagcactgatcttgcttgctgcaca

SEQ ID NO: 477312 - DNA, 25 bp, Mus musculus
gagcactgattacatggcaccagat

SEQ ID NO: 477313 - DNA, 25 bp, Mus musculus
gagcactgattagatggcaccagat

SEQ ID NO: 477314 - DNA, 25 bp, Mus musculus
gagcactgcagtaacctctagaaga

SEQ ID NO: 477315 - DNA, 25 bp, Mus musculus
gagcactgcagttacctctagaaga

SEQ ID NO: 477316 - DNA, 25 bp, Mus musculus
gagcactgcctgattgattactgtt

SEQ ID NO: 477317 - DNA, 25 bp, Mus musculus
gagcactgcctgtttgattactgtt

SEQ ID NO: 477318 - DNA, 25 bp, Mus musculus
gagcactgctctaacattgtaggaa

SEQ ID NO: 477319 - DNA, 25 bp, Mus musculus
gagcactgctcttacattgtaggaa

SEQ ID NO: 477320 - DNA, 25 bp, Mus musculus
gagcactggactctgatcttactac

SEQ ID NO: 477321 - DNA, 25 bp, Mus musculus
gagcactggactgtgatcttactac

SEQ ID NO: 477322 - DNA, 25 bp, Mus musculus
gagcactggatgctcagcctgccac

SEQ ID NO: 477323 - DNA, 25 bp, Mus musculus
gagcactggatggtcagcctgccac

SEQ ID NO: 477324 - DNA, 25 bp, Mus musculus
gagcactggcagatattacagaaga

SEQ ID NO: 477325 - DNA, 25 bp, Mus musculus
gagcactggcagttattacagaaga

SEQ ID NO: 477326 - DNA, 25 bp, Mus musculus
gagcactggcctaggatccagagct

SEQ ID NO: 477327 - DNA, 25 bp, Mus musculus
gagcactggccttggatccagagct

SEQ ID NO: 477328 - DNA, 25 bp, Mus musculus
gagcactggctcctggaaccaagtt

SEQ ID NO: 477329 - DNA, 25 bp, Mus musculus
gagcactggctcgtggaaccaagtt

SEQ ID NO: 477330 - DNA, 25 bp, Mus musculus
gagcactgggaactcaacttccaaa

SEQ ID NO: 477331 - DNA, 25 bp, Mus musculus
gagcactgggaagtcaacttccaaa

SEQ ID NO: 477332 - DNA, 25 bp, Mus musculus
gagcactgggccatcctgggagaca

SEQ ID NO: 477333 - DNA, 25 bp, Mus musculus
gagcactgggccttcctgggagaca

SEQ ID NO: 477334 - DNA, 25 bp, Mus musculus
gagcactgtactacatatacccatc

SEQ ID NO: 477335 - DNA, 25 bp, Mus musculus
gagcactgtacttcatatacccatc

SEQ ID NO: 477336 - DNA, 25 bp, Mus musculus
gagcactgtatacaatccttctcaa

SEQ ID NO: 477337 - DNA, 25 bp, Mus musculus
gagcactgtatagaatccttctcaa

SEQ ID NO: 477338 - DNA, 25 bp, Mus musculus
gagcactgtcagagggcacaggctc

SEQ ID NO: 477339 - DNA, 25 bp, Mus musculus
gagcactgtcagattccttataatg

SEQ ID NO: 477340 - DNA, 25 bp, Mus musculus
gagcactgtcagtgggcacaggctc

SEQ ID NO: 477341 - DNA, 25 bp, Mus musculus
gagcactgtcagtttccttataatg

SEQ ID NO: 477342 - DNA, 25 bp, Mus musculus
gagcactgtgccacctatatgggac

SEQ ID NO: 477343 - DNA, 25 bp, Mus musculus
gagcactgtgcctcctatatgggac

SEQ ID NO: 477344 - DNA, 25 bp, Mus musculus
gagcactgtgggaaataccttttta

SEQ ID NO: 477345 - DNA, 25 bp, Mus musculus
gagcactgtgggtaataccttttta

SEQ ID NO: 477346 - DNA, 25 bp, Mus musculus
gagcactgtgtaactaaaactggca

SEQ ID NO: 477347 - DNA, 25 bp, Mus musculus
gagcactgtgtatctaaaactggca

SEQ ID NO: 477348 - DNA, 25 bp, Mus musculus
gagcactgtgtgactcagtctttga

SEQ ID NO: 477349 - DNA, 25 bp, Mus musculus
gagcactgtgtgtctcagtctttga

SEQ ID NO: 477350 - DNA, 25 bp, Mus musculus
gagcacttaactctggagacatggg

SEQ ID NO: 477351 - DNA, 25 bp, Mus musculus
gagcacttaactgtggagacatggg

SEQ ID NO: 477352 - DNA, 25 bp, Mus musculus
gagcacttacagcactctcagaaga

SEQ ID NO: 477353 - DNA, 25 bp, Mus musculus
gagcacttacaggactctcagaaga

SEQ ID NO: 477354 - DNA, 25 bp, Mus musculus
gagcacttacgcaggcatttttaca

SEQ ID NO: 477355 - DNA, 25 bp, Mus musculus
gagcacttacgctggcatttttaca

SEQ ID NO: 477356 - DNA, 25 bp, Mus musculus
gagcacttactaagcttgcagaaga

SEQ ID NO: 477357 - DNA, 25 bp, Mus musculus
gagcacttactatgcttgcagaaga

SEQ ID NO: 477358 - DNA, 25 bp, Mus musculus
gagcacttaggaccacggttttgga

SEQ ID NO: 477359 - DNA, 25 bp, Mus musculus
gagcacttaggagcacggttttgga

SEQ ID NO: 477360 - DNA, 25 bp, Mus musculus
gagcacttaggcctcctgaactcca

SEQ ID NO: 477361 - DNA, 25 bp, Mus musculus
gagcacttaggcgtcctgaactcca

SEQ ID NO: 477362 - DNA, 25 bp, Mus musculus
gagcacttatcaaactccaattccc

SEQ ID NO: 477363 - DNA, 25 bp, Mus musculus
gagcacttatcatactccaattccc

SEQ ID NO: 477364 - DNA, 25 bp, Mus musculus
gagcacttatctatgatgcaccgcc

SEQ ID NO: 477365 - DNA, 25 bp, Mus musculus
gagcacttatctttgatgcaccgcc

SEQ ID NO: 477366 - DNA, 25 bp, Mus musculus
gagcacttcagacttttcatacttt

SEQ ID NO: 477367 - DNA, 25 bp, Mus musculus
gagcacttcagagttttcatacttt

SEQ ID NO: 477368 - DNA, 25 bp, Mus musculus
gagcacttccacctggactcaagtt

SEQ ID NO: 477369 - DNA, 25 bp, Mus musculus
gagcacttccacgtggactcaagtt

SEQ ID NO: 477370 - DNA, 25 bp, Mus musculus
gagcacttccctcgaatggcgagtt

SEQ ID NO: 477371 - DNA, 25 bp, Mus musculus
gagcacttccctggaatggcgagtt

SEQ ID NO: 477372 - DNA, 25 bp, Mus musculus
gagcacttcgcacaggtaccaggga

SEQ ID NO: 477373 - DNA, 25 bp, Mus musculus
gagcacttcgcagaggtaccaggga

SEQ ID NO: 477374 - DNA, 25 bp, Mus musculus
gagcacttcgttctgtgtaaccgat

SEQ ID NO: 477375 - DNA, 25 bp, Mus musculus
gagcacttcgttgtgtgtaaccgat

SEQ ID NO: 477376 - DNA, 25 bp, Mus musculus
gagcacttctctatacattgactgt

SEQ ID NO: 477377 - DNA, 25 bp, Mus musculus
gagcacttctctttacattgactgt

SEQ ID NO: 477378 - DNA, 25 bp, Mus musculus
gagcacttctggagtccaaggtgaa

SEQ ID NO: 477379 - DNA, 25 bp, Mus musculus
gagcacttctggtgtccaaggtgaa

SEQ ID NO: 477380 - DNA, 25 bp, Mus musculus
gagcacttgcagactctggagccag

SEQ ID NO: 477381 - DNA, 25 bp, Mus musculus
gagcacttgcagtctctggagccag

SEQ ID NO: 477382 - DNA, 25 bp, Mus musculus
gagcacttgccaagaccctgagttc

SEQ ID NO: 477383 - DNA, 25 bp, Mus musculus
gagcacttgccatgaccctgagttc

SEQ ID NO: 477384 - DNA, 25 bp, Mus musculus
gagcacttgctcaaagatgtgtgga

SEQ ID NO: 477385 - DNA, 25 bp, Mus musculus
gagcacttgctctaagatgtgtgga

SEQ ID NO: 477386 - DNA, 25 bp, Mus musculus
gagcacttggaaaaaggccttcaga

SEQ ID NO: 477387 - DNA, 25 bp, Mus musculus
gagcacttggaataaggccttcaga

SEQ ID NO: 477388 - DNA, 25 bp, Mus musculus
gagcacttggataatggatctgaat

SEQ ID NO: 477389 - DNA, 25 bp, Mus musculus
gagcacttggatcagctttccacaa

SEQ ID NO: 477390 - DNA, 25 bp, Mus musculus
gagcacttggatgagctttccacaa

SEQ ID NO: 477391 - DNA, 25 bp, Mus musculus
gagcacttggattatggatctgaat

SEQ ID NO: 477392 - DNA, 25 bp, Mus musculus
gagcacttggcccagttggcactga

SEQ ID NO: 477393 - DNA, 25 bp, Mus musculus
gagcacttggccgagttggcactga

SEQ ID NO: 477394 - DNA, 25 bp, Mus musculus
gagcacttggctatgaacccaggaa

SEQ ID NO: 477395 - DNA, 25 bp, Mus musculus
gagcacttggctttgaacccaggaa

SEQ ID NO: 477396 - DNA, 25 bp, Mus musculus
gagcacttggtcaggctaacacaac

SEQ ID NO: 477397 - DNA, 25 bp, Mus musculus
gagcacttggtctggctaacacaac

SEQ ID NO: 477398 - DNA, 25 bp, Mus musculus
gagcacttggtgagcgggcattttt

SEQ ID NO: 477399 - DNA, 25 bp, Mus musculus
gagcacttggtgtgcgggcattttt

SEQ ID NO: 477400 - DNA, 25 bp, Mus musculus
gagcacttggttagctgctgaccat

SEQ ID NO: 477401 - DNA, 25 bp, Mus musculus
gagcacttggtttgctgctgaccat

SEQ ID NO: 477402 - DNA, 25 bp, Mus musculus
gagcacttgtggagtttgcctttgc

SEQ ID NO: 477403 - DNA, 25 bp, Mus musculus
gagcacttgtggtgtttgcctttgc

SEQ ID NO: 477404 - DNA, 25 bp, Mus musculus
gagcacttgttactcttgaaacttt

SEQ ID NO: 477405 - DNA, 25 bp, Mus musculus
gagcacttgttagtcttgaaacttt

SEQ ID NO: 477406 - DNA, 25 bp, Mus musculus
gagcacttgttgcttctgtagaaga

SEQ ID NO: 477407 - DNA, 25 bp, Mus musculus
gagcacttgttggttctgtagaaga

SEQ ID NO: 477408 - DNA, 25 bp, Mus musculus
gagcactttaacactaaactctgaa

SEQ ID NO: 477409 - DNA, 25 bp, Mus musculus
gagcactttaactctaaactctgaa

SEQ ID NO: 477410 - DNA, 25 bp, Mus musculus
gagcactttactaacttggcagtca

SEQ ID NO: 477411 - DNA, 25 bp, Mus musculus
gagcactttacttacttggcagtca

SEQ ID NO: 477412 - DNA, 25 bp, Mus musculus
gagcactttagcaaactgagcattt

SEQ ID NO: 477413 - DNA, 25 bp, Mus musculus
gagcactttagctaactgagcattt

SEQ ID NO: 477414 - DNA, 25 bp, Mus musculus
gagcactttcttactgtagcatagc

SEQ ID NO: 477415 - DNA, 25 bp, Mus musculus
gagcactttctttctgtagcatagc

SEQ ID NO: 477416 - DNA, 25 bp, Mus musculus
gagcactttgaaccaaaaacctgta

SEQ ID NO: 477417 - DNA, 25 bp, Mus musculus
gagcactttgaagcaaaaacctgta

SEQ ID NO: 477418 - DNA, 25 bp, Mus musculus
gagcactttgcacttaatggctgtt

SEQ ID NO: 477419 - DNA, 25 bp, Mus musculus
gagcactttgcagttaatggctgtt

SEQ ID NO: 477420 - DNA, 25 bp, Mus musculus
gagcactttgttatcttacagcctg

SEQ ID NO: 477421 - DNA, 25 bp, Mus musculus
gagcactttgttttcttacagcctg

SEQ ID NO: 477422 - DNA, 25 bp, Mus musculus
gagcagaaagctcagaaacacccag

SEQ ID NO: 477423 - DNA, 25 bp, Mus musculus
gagcagaaagctgagaaacacccag

SEQ ID NO: 477424 - DNA, 25 bp, Mus musculus
gagcagaaccgacttgttacctgaa

SEQ ID NO: 477425 - DNA, 25 bp, Mus musculus
gagcagaaccgagttgttacctgaa

SEQ ID NO: 477426 - DNA, 25 bp, Mus musculus
gagcagaaccgcatcatattcgatt

SEQ ID NO: 477427 - DNA, 25 bp, Mus musculus
gagcagaaccgcttcatattcgatt

SEQ ID NO: 477428 - DNA, 25 bp, Mus musculus
gagcagaacctgcagatgttacaga

SEQ ID NO: 477429 - DNA, 25 bp, Mus musculus
gagcagaacctggagatgttacaga

SEQ ID NO: 477430 - DNA, 25 bp, Mus musculus
gagcagaacggaaacaacaatttac

SEQ ID NO: 477431 - DNA, 25 bp, Mus musculus
gagcagaacggatacaacaatttac

SEQ ID NO: 477432 - DNA, 25 bp, Mus musculus
gagcagaacgtgagcctcttagttg

SEQ ID NO: 477433 - DNA, 25 bp, Mus musculus
gagcagaacgtgtgcctcttagttg

SEQ ID NO: 477434 - DNA, 25 bp, Mus musculus
gagcagaagaaaacgggaatttgtt

SEQ ID NO: 477435 - DNA, 25 bp, Mus musculus
gagcagaagaaatcgggaatttgtt

SEQ ID NO: 477436 - DNA, 25 bp, Mus musculus
gagcagaagagacctttggaagccc

SEQ ID NO: 477437 - DNA, 25 bp, Mus musculus
gagcagaagagagctttggaagccc

SEQ ID NO: 477438 - DNA, 25 bp, Mus musculus
gagcagaagagtagaattaagttga

SEQ ID NO: 477439 - DNA, 25 bp, Mus musculus
gagcagaagagttgaattaagttga

SEQ ID NO: 477440 - DNA, 25 bp, Mus musculus
gagcagaagccgaagactgtccaga

SEQ ID NO: 477441 - DNA, 25 bp, Mus musculus
gagcagaagccgtagactgtccaga

SEQ ID NO: 477442 - DNA, 25 bp, Mus musculus
gagcagaagctaaggttcgccttca

SEQ ID NO: 477443 - DNA, 25 bp, Mus musculus
gagcagaagctatggttcgccttca

SEQ ID NO: 477444 - DNA, 25 bp, Mus musculus
gagcagaagcttctatagagtgtat

SEQ ID NO: 477445 - DNA, 25 bp, Mus musculus
gagcagaagcttgtatagagtgtat

SEQ ID NO: 477446 - DNA, 25 bp, Mus musculus
gagcagaaggcccagcaaccctgaa

SEQ ID NO: 477447 - DNA, 25 bp, Mus musculus
gagcagaaggccgagcaaccctgaa

SEQ ID NO: 477448 - DNA, 25 bp, Mus musculus
gagcagaagggacccagcccagcca

SEQ ID NO: 477449 - DNA, 25 bp, Mus musculus
gagcagaagggagccagcccagcca

SEQ ID NO: 477450 - DNA, 25 bp, Mus musculus
gagcagaagtacattcgtggcccca

SEQ ID NO: 477451 - DNA, 25 bp, Mus musculus
gagcagaagtactttcgtggcccca

SEQ ID NO: 477452 - DNA, 25 bp, Mus musculus
gagcagaagtcccatgaagtgatca

SEQ ID NO: 477453 - DNA, 25 bp, Mus musculus
gagcagaagtccgatgaagtgatca

SEQ ID NO: 477454 - DNA, 25 bp, Mus musculus
gagcagaagtgacaggctatttcaa

SEQ ID NO: 477455 - DNA, 25 bp, Mus musculus
gagcagaagtgagaggctatttcaa

SEQ ID NO: 477456 - DNA, 25 bp, Mus musculus
gagcagaatcttcaccttggaaatc

SEQ ID NO: 477457 - DNA, 25 bp, Mus musculus
gagcagaatcttgaccttggaaatc

SEQ ID NO: 477458 - DNA, 25 bp, Mus musculus
gagcagaatgcacccctggtaacca

SEQ ID NO: 477459 - DNA, 25 bp, Mus musculus
gagcagaatgcagccctggtaacca

SEQ ID NO: 477460 - DNA, 25 bp, Mus musculus
gagcagacaaaacttctgtacagtg

SEQ ID NO: 477461 - DNA, 25 bp, Mus musculus
gagcagacaaaagttctgtacagtg

SEQ ID NO: 477462 - DNA, 25 bp, Mus musculus
gagcagacaagaccgcagctgaaga

SEQ ID NO: 477463 - DNA, 25 bp, Mus musculus
gagcagacaagagcgcagctgaaga

SEQ ID NO: 477464 - DNA, 25 bp, Mus musculus
gagcagacaagcaaatgccaccaaa

SEQ ID NO: 477465 - DNA, 25 bp, Mus musculus
gagcagacaagctaatgccaccaaa

SEQ ID NO: 477466 - DNA, 25 bp, Mus musculus
gagcagacaattaatcccatccaga

SEQ ID NO: 477467 - DNA, 25 bp, Mus musculus
gagcagacaatttatcccatccaga

SEQ ID NO: 477468 - DNA, 25 bp, Mus musculus
gagcagacagccagaatctcaacct

SEQ ID NO: 477469 - DNA, 25 bp, Mus musculus
gagcagacagcctgaatctcaacct

SEQ ID NO: 477470 - DNA, 25 bp, Mus musculus
gagcagacatccacacaggcagaga

SEQ ID NO: 477471 - DNA, 25 bp, Mus musculus
gagcagacatccagtttagtgaaac

SEQ ID NO: 477472 - DNA, 25 bp, Mus musculus
gagcagacatcctcacaggcagaga

SEQ ID NO: 477473 - DNA, 25 bp, Mus musculus
gagcagacatcctgtttagtgaaac

SEQ ID NO: 477474 - DNA, 25 bp, Mus musculus
gagcagacatctacttaagccagat

SEQ ID NO: 477475 - DNA, 25 bp, Mus musculus
gagcagacatcttcttaagccagat

SEQ ID NO: 477476 - DNA, 25 bp, Mus musculus
gagcagacatgtacccagtccataa

SEQ ID NO: 477477 - DNA, 25 bp, Mus musculus
gagcagacatgttcccagtccataa

SEQ ID NO: 477478 - DNA, 25 bp, Mus musculus
gagcagacattcactccaaagaatt

SEQ ID NO: 477479 - DNA, 25 bp, Mus musculus
gagcagacattctctccaaagaatt

SEQ ID NO: 477480 - DNA, 25 bp, Mus musculus
gagcagaccaggatcagcaccaagt

SEQ ID NO: 477481 - DNA, 25 bp, Mus musculus
gagcagaccaggttcagcaccaagt

SEQ ID NO: 477482 - DNA, 25 bp, Mus musculus
gagcagaccatgagccctgtgtgct

SEQ ID NO: 477483 - DNA, 25 bp, Mus musculus
gagcagaccatgtgccctgtgtgct

SEQ ID NO: 477484 - DNA, 25 bp, Mus musculus
gagcagacccagacatagagccagg

SEQ ID NO: 477485 - DNA, 25 bp, Mus musculus
gagcagacccagtcatagagccagg

SEQ ID NO: 477486 - DNA, 25 bp, Mus musculus
gagcagacccttagtccattaaact

SEQ ID NO: 477487 - DNA, 25 bp, Mus musculus
gagcagaccctttgtccattaaact

SEQ ID NO: 477488 - DNA, 25 bp, Mus musculus
gagcagacctatcctctaagcaaga

SEQ ID NO: 477489 - DNA, 25 bp, Mus musculus
gagcagacctatgctctaagcaaga

SEQ ID NO: 477490 - DNA, 25 bp, Mus musculus
gagcagacctgacgttgcgccttga

SEQ ID NO: 477491 - DNA, 25 bp, Mus musculus
gagcagacctgaggttgcgccttga

SEQ ID NO: 477492 - DNA, 25 bp, Mus musculus
gagcagacgaggaagctggccattt

SEQ ID NO: 477493 - DNA, 25 bp, Mus musculus
gagcagacgaggtagctggccattt

SEQ ID NO: 477494 - DNA, 25 bp, Mus musculus
gagcagacggctatgccagctgtat

SEQ ID NO: 477495 - DNA, 25 bp, Mus musculus
gagcagacggctttgccagctgtat

SEQ ID NO: 477496 - DNA, 25 bp, Mus musculus
gagcagacgtgcagaaatggaaaag

SEQ ID NO: 477497 - DNA, 25 bp, Mus musculus
gagcagacgtgctgaaatggaaaag

SEQ ID NO: 477498 - DNA, 25 bp, Mus musculus
gagcagactaagaccttcctggctt

SEQ ID NO: 477499 - DNA, 25 bp, Mus musculus
gagcagactaagtccttcctggctt

SEQ ID NO: 477500 - DNA, 25 bp, Mus musculus
gagcagactctcatgatgctctctg

SEQ ID NO: 477501 - DNA, 25 bp, Mus musculus
gagcagactctcttgatgctctctg

SEQ ID NO: 477502 - DNA, 25 bp, Mus musculus
gagcagactctgctattcaggatac

SEQ ID NO: 477503 - DNA, 25 bp, Mus musculus
gagcagactctggtattcaggatac

SEQ ID NO: 477504 - DNA, 25 bp, Mus musculus
gagcagactgctcagcaccatgcat

SEQ ID NO: 477505 - DNA, 25 bp, Mus musculus
gagcagactgctgagcaccatgcat

SEQ ID NO: 477506 - DNA, 25 bp, Mus musculus
gagcagacttccactgaagaaccgc

SEQ ID NO: 477507 - DNA, 25 bp, Mus musculus
gagcagacttccagacacaaggctt

SEQ ID NO: 477508 - DNA, 25 bp, Mus musculus
gagcagacttcctctgaagaaccgc

SEQ ID NO: 477509 - DNA, 25 bp, Mus musculus
gagcagacttcctgacacaaggctt

SEQ ID NO: 477510 - DNA, 25 bp, Mus musculus
gagcagacttgcattttacagggaa

SEQ ID NO: 477511 - DNA, 25 bp, Mus musculus
gagcagacttgctttttacagggaa

SEQ ID NO: 477512 - DNA, 25 bp, Mus musculus
gagcagagaaaccagtgtccttgac

SEQ ID NO: 477513 - DNA, 25 bp, Mus musculus
gagcagagaaacgagtgtccttgac

SEQ ID NO: 477514 - DNA, 25 bp, Mus musculus
gagcagagaattaggcccctccagc

SEQ ID NO: 477515 - DNA, 25 bp, Mus musculus
gagcagagaatttggcccctccagc

SEQ ID NO: 477516 - DNA, 25 bp, Mus musculus
gagcagagacaccatgccattctag

SEQ ID NO: 477517 - DNA, 25 bp, Mus musculus
gagcagagacacgatgccattctag

SEQ ID NO: 477518 - DNA, 25 bp, Mus musculus
gagcagagacccctgtgtacttggc

SEQ ID NO: 477519 - DNA, 25 bp, Mus musculus
gagcagagacccgtgtgtacttggc

SEQ ID NO: 477520 - DNA, 25 bp, Mus musculus
gagcagagacgcagttcacacaacg

SEQ ID NO: 477521 - DNA, 25 bp, Mus musculus
gagcagagacgctgttcacacaacg

SEQ ID NO: 477522 - DNA, 25 bp, Mus musculus
gagcagagagataatcccaccgatt

SEQ ID NO: 477523 - DNA, 25 bp, Mus musculus
gagcagagagattatcccaccgatt

SEQ ID NO: 477524 - DNA, 25 bp, Mus musculus
gagcagagagccaaatctgacctag

SEQ ID NO: 477525 - DNA, 25 bp, Mus musculus
gagcagagagcctaatctgacctag

SEQ ID NO: 477526 - DNA, 25 bp, Mus musculus
gagcagagaggtagcccctttatgt

SEQ ID NO: 477527 - DNA, 25 bp, Mus musculus
gagcagagaggttgcccctttatgt

SEQ ID NO: 477528 - DNA, 25 bp, Mus musculus
gagcagagagtgacaggttccttat

SEQ ID NO: 477529 - DNA, 25 bp, Mus musculus
gagcagagagtgtcaggttccttat

SEQ ID NO: 477530 - DNA, 25 bp, Mus musculus
gagcagagatcaaagcagtctgcaa

SEQ ID NO: 477531 - DNA, 25 bp, Mus musculus
gagcagagatcatagcagtctgcaa

SEQ ID NO: 477532 - DNA, 25 bp, Mus musculus
gagcagagcaaaccagcgttgccag

SEQ ID NO: 477533 - DNA, 25 bp, Mus musculus
gagcagagcaaagcagcgttgccag

SEQ ID NO: 477534 - DNA, 25 bp, Mus musculus
gagcagagcaatcacccaagctggt

SEQ ID NO: 477535 - DNA, 25 bp, Mus musculus
gagcagagcaatgacccaagctggt

SEQ ID NO: 477536 - DNA, 25 bp, Mus musculus
gagcagagcacaacctcaaatgcta

SEQ ID NO: 477537 - DNA, 25 bp, Mus musculus
gagcagagcacatcctcaaatgcta

SEQ ID NO: 477538 - DNA, 25 bp, Mus musculus
gagcagagcatcaattccttcatag

SEQ ID NO: 477539 - DNA, 25 bp, Mus musculus
gagcagagcatctattccttcatag

SEQ ID NO: 477540 - DNA, 25 bp, Mus musculus
gagcagagccacaatctccagtgaa

SEQ ID NO: 477541 - DNA, 25 bp, Mus musculus
gagcagagccactatctccagtgaa

SEQ ID NO: 477542 - DNA, 25 bp, Mus musculus
gagcagagcccacaattacctggca

SEQ ID NO: 477543 - DNA, 25 bp, Mus musculus
gagcagagcccagaattacctggca

SEQ ID NO: 477544 - DNA, 25 bp, Mus musculus
gagcagagcccgaccctaaaaagaa

SEQ ID NO: 477545 - DNA, 25 bp, Mus musculus
gagcagagcccgtccctaaaaagaa

SEQ ID NO: 477546 - DNA, 25 bp, Mus musculus
gagcagagcgagcaactgtacgatg

SEQ ID NO: 477547 - DNA, 25 bp, Mus musculus
gagcagagcgaggaactgtacgatg

SEQ ID NO: 477548 - DNA, 25 bp, Mus musculus
gagcagagctaaagtcatctttaat

SEQ ID NO: 477549 - DNA, 25 bp, Mus musculus
gagcagagctaacagggttcagcaa

SEQ ID NO: 477550 - DNA, 25 bp, Mus musculus
gagcagagctaagagggttcagcaa

SEQ ID NO: 477551 - DNA, 25 bp, Mus musculus
gagcagagctaatgtcatctttaat

SEQ ID NO: 477552 - DNA, 25 bp, Mus musculus
gagcagagcttcaggagtccaggca

SEQ ID NO: 477553 - DNA, 25 bp, Mus musculus
gagcagagcttctggagtccaggca

SEQ ID NO: 477554 - DNA, 25 bp, Mus musculus
gagcagagctttcatttcctcacgg

SEQ ID NO: 477555 - DNA, 25 bp, Mus musculus
gagcagagctttgatttcctcacgg

SEQ ID NO: 477556 - DNA, 25 bp, Mus musculus
gagcagaggaccagccatagccctt

SEQ ID NO: 477557 - DNA, 25 bp, Mus musculus
gagcagaggacctgccatagccctt

SEQ ID NO: 477558 - DNA, 25 bp, Mus musculus
gagcagaggactataggacatcaat

SEQ ID NO: 477559 - DNA, 25 bp, Mus musculus
gagcagaggactttaggacatcaat

SEQ ID NO: 477560 - DNA, 25 bp, Mus musculus
gagcagaggccgagaaccttctgtc

SEQ ID NO: 477561 - DNA, 25 bp, Mus musculus
gagcagaggccgtgaaccttctgtc

SEQ ID NO: 477562 - DNA, 25 bp, Mus musculus
gagcagaggctcaccttatagagaa

SEQ ID NO: 477563 - DNA, 25 bp, Mus musculus
gagcagaggctcatcatccaaaagg

SEQ ID NO: 477564 - DNA, 25 bp, Mus musculus
gagcagaggctctccttatagagaa

SEQ ID NO: 477565 - DNA, 25 bp, Mus musculus
gagcagaggctcttcatccaaaagg

SEQ ID NO: 477566 - DNA, 25 bp, Mus musculus
gagcagaggtgaaaaccacactttt

SEQ ID NO: 477567 - DNA, 25 bp, Mus musculus
gagcagaggtgataaccacactttt

SEQ ID NO: 477568 - DNA, 25 bp, Mus musculus
gagcagaggtgccactcagtgccat

SEQ ID NO: 477569 - DNA, 25 bp, Mus musculus
gagcagaggtgcgactcagtgccat

SEQ ID NO: 477570 - DNA, 25 bp, Mus musculus
gagcagagtcacacttctcagtggc

SEQ ID NO: 477571 - DNA, 25 bp, Mus musculus
gagcagagtcactcttctcagtggc

SEQ ID NO: 477572 - DNA, 25 bp, Mus musculus
gagcagagtcagaacctgcagcgcc

SEQ ID NO: 477573 - DNA, 25 bp, Mus musculus
gagcagagtcagtacctgcagcgcc

SEQ ID NO: 477574 - DNA, 25 bp, Mus musculus
gagcagagtgaccagaagccaatga

SEQ ID NO: 477575 - DNA, 25 bp, Mus musculus
gagcagagtgacgagaagccaatga

SEQ ID NO: 477576 - DNA, 25 bp, Mus musculus
gagcagagttatcaagattctcaat

SEQ ID NO: 477577 - DNA, 25 bp, Mus musculus
gagcagagttatgaagattctcaat

SEQ ID NO: 477578 - DNA, 25 bp, Mus musculus
gagcagagttgcaaggagctcacca

SEQ ID NO: 477579 - DNA, 25 bp, Mus musculus
gagcagagttgctaggagctcacca

SEQ ID NO: 477580 - DNA, 25 bp, Mus musculus
gagcagagtttccatcctgcatggc

SEQ ID NO: 477581 - DNA, 25 bp, Mus musculus
gagcagagtttcgatcctgcatggc

SEQ ID NO: 477582 - DNA, 25 bp, Mus musculus
gagcagatagagcttgagatacaat

SEQ ID NO: 477583 - DNA, 25 bp, Mus musculus
gagcagatagaggttgagatacaat

SEQ ID NO: 477584 - DNA, 25 bp, Mus musculus
gagcagatatgcaggtagcccctag

SEQ ID NO: 477585 - DNA, 25 bp, Mus musculus
gagcagatatgctggtagcccctag

SEQ ID NO: 477586 - DNA, 25 bp, Mus musculus
gagcagatcaagcagtcgaagtcga

SEQ ID NO: 477587 - DNA, 25 bp, Mus musculus
gagcagatcaaggagtcgaagtcga

SEQ ID NO: 477588 - DNA, 25 bp, Mus musculus
gagcagatcagaaaggattacacca

SEQ ID NO: 477589 - DNA, 25 bp, Mus musculus
gagcagatcagataggattacacca

SEQ ID NO: 477590 - DNA, 25 bp, Mus musculus
gagcagatcatcagtttggtcaacc

SEQ ID NO: 477591 - DNA, 25 bp, Mus musculus
gagcagatcatctgtttggtcaacc

SEQ ID NO: 477592 - DNA, 25 bp, Mus musculus
gagcagatcatgcacttcacgccag

SEQ ID NO: 477593 - DNA, 25 bp, Mus musculus
gagcagatcatggacttcacgccag

SEQ ID NO: 477594 - DNA, 25 bp, Mus musculus
gagcagatcccgaatctccagcaag

SEQ ID NO: 477595 - DNA, 25 bp, Mus musculus
gagcagatcccgtatctccagcaag

SEQ ID NO: 477596 - DNA, 25 bp, Mus musculus
gagcagatccgcagcacccagaggt

SEQ ID NO: 477597 - DNA, 25 bp, Mus musculus
gagcagatccgctgcacccagaggt

SEQ ID NO: 477598 - DNA, 25 bp, Mus musculus
gagcagatccgtattttcagatgtt

SEQ ID NO: 477599 - DNA, 25 bp, Mus musculus
gagcagatccgttttttcagatgtt

SEQ ID NO: 477600 - DNA, 25 bp, Mus musculus
gagcagatcctcactgaacactgat

SEQ ID NO: 477601 - DNA, 25 bp, Mus musculus
gagcagatcctcagagggcagcaat

SEQ ID NO: 477602 - DNA, 25 bp, Mus musculus
gagcagatcctctctgaacactgat

SEQ ID NO: 477603 - DNA, 25 bp, Mus musculus
gagcagatcctctgagggcagcaat

SEQ ID NO: 477604 - DNA, 25 bp, Mus musculus
gagcagatcctgaagcccgagacca

SEQ ID NO: 477605 - DNA, 25 bp, Mus musculus
gagcagatcctgtagcccgagacca

SEQ ID NO: 477606 - DNA, 25 bp, Mus musculus
gagcagatcgccaggacgagaacag

SEQ ID NO: 477607 - DNA, 25 bp, Mus musculus
gagcagatcgcctggacgagaacag

SEQ ID NO: 477608 - DNA, 25 bp, Mus musculus
gagcagatcgtcagcattctggaca

SEQ ID NO: 477609 - DNA, 25 bp, Mus musculus
gagcagatcgtctgcattctggaca

SEQ ID NO: 477610 - DNA, 25 bp, Mus musculus
gagcagatctctagtcaggaggcca

SEQ ID NO: 477611 - DNA, 25 bp, Mus musculus
gagcagatctcttgtcaggaggcca

SEQ ID NO: 477612 - DNA, 25 bp, Mus musculus
gagcagatcttaccaggcttcactc

SEQ ID NO: 477613 - DNA, 25 bp, Mus musculus
gagcagatcttagcaggcttcactc

SEQ ID NO: 477614 - DNA, 25 bp, Mus musculus
gagcagatgatgattttatgagaga

SEQ ID NO: 477615 - DNA, 25 bp, Mus musculus
gagcagatgatgtttttatgagaga

SEQ ID NO: 477616 - DNA, 25 bp, Mus musculus
gagcagatgcagacagccattttgt

SEQ ID NO: 477617 - DNA, 25 bp, Mus musculus
gagcagatgcagtcagccattttgt

SEQ ID NO: 477618 - DNA, 25 bp, Mus musculus
gagcagatgcggatccgtgccccac

SEQ ID NO: 477619 - DNA, 25 bp, Mus musculus
gagcagatgcggttccgtgccccac

SEQ ID NO: 477620 - DNA, 25 bp, Mus musculus
gagcagatggctacatctgcagctg

SEQ ID NO: 477621 - DNA, 25 bp, Mus musculus
gagcagatggcttcatctgcagctg

SEQ ID NO: 477622 - DNA, 25 bp, Mus musculus
gagcagatgggcaagaccacctcac

SEQ ID NO: 477623 - DNA, 25 bp, Mus musculus
gagcagatgggctagaccacctcac

SEQ ID NO: 477624 - DNA, 25 bp, Mus musculus
gagcagatggtgcatgcagctccct

SEQ ID NO: 477625 - DNA, 25 bp, Mus musculus
gagcagatggtggatgcagctccct

SEQ ID NO: 477626 - DNA, 25 bp, Mus musculus
gagcagatgtctccttgacaactct

SEQ ID NO: 477627 - DNA, 25 bp, Mus musculus
gagcagatgtctgcttgacaactct

SEQ ID NO: 477628 - DNA, 25 bp, Mus musculus
gagcagatgtgtctccttagaggtt

SEQ ID NO: 477629 - DNA, 25 bp, Mus musculus
gagcagatgtgtgtccttagaggtt

SEQ ID NO: 477630 - DNA, 25 bp, Mus musculus
gagcagattattcaatgcctcatct

SEQ ID NO: 477631 - DNA, 25 bp, Mus musculus
gagcagattattgaatgcctcatct

SEQ ID NO: 477632 - DNA, 25 bp, Mus musculus
gagcagattcatatgttgtgataaa

SEQ ID NO: 477633 - DNA, 25 bp, Mus musculus
gagcagattcatttgttgtgataaa

SEQ ID NO: 477634 - DNA, 25 bp, Mus musculus
gagcagattccaaaggcgttccaat

SEQ ID NO: 477635 - DNA, 25 bp, Mus musculus
gagcagattccataggcgttccaat

SEQ ID NO: 477636 - DNA, 25 bp, Mus musculus
gagcagattctcaatggacacaagt

SEQ ID NO: 477637 - DNA, 25 bp, Mus musculus
gagcagattctctatggacacaagt

SEQ ID NO: 477638 - DNA, 25 bp, Mus musculus
gagcagattgcaattgagccaggac

SEQ ID NO: 477639 - DNA, 25 bp, Mus musculus
gagcagattgcatttgagccaggac

SEQ ID NO: 477640 - DNA, 25 bp, Mus musculus
gagcagatttccacttcgacttgag

SEQ ID NO: 477641 - DNA, 25 bp, Mus musculus
gagcagatttccatgctatcctcac

SEQ ID NO: 477642 - DNA, 25 bp, Mus musculus
gagcagatttcctcttcgacttgag

SEQ ID NO: 477643 - DNA, 25 bp, Mus musculus
gagcagatttccttgctatcctcac

SEQ ID NO: 477644 - DNA, 25 bp, Mus musculus
gagcagatttgacacaccatccaat

SEQ ID NO: 477645 - DNA, 25 bp, Mus musculus
gagcagatttgagacaccatccaat

SEQ ID NO: 477646 - DNA, 25 bp, Mus musculus
gagcagattttgaggtattcgtgga

SEQ ID NO: 477647 - DNA, 25 bp, Mus musculus
gagcagattttgtggtattcgtgga

SEQ ID NO: 477648 - DNA, 25 bp, Mus musculus
gagcagcaaaggacttggtcatcaa

SEQ ID NO: 477649 - DNA, 25 bp, Mus musculus
gagcagcaaaggtcttggtcatcaa

SEQ ID NO: 477650 - DNA, 25 bp, Mus musculus
gagcagcaagaccatctcttctgaa

SEQ ID NO: 477651 - DNA, 25 bp, Mus musculus
gagcagcaagacgatctcttctgaa

SEQ ID NO: 477652 - DNA, 25 bp, Mus musculus
gagcagcaagctatcagaagattat

SEQ ID NO: 477653 - DNA, 25 bp, Mus musculus
gagcagcaagctttcagaagattat

SEQ ID NO: 477654 - DNA, 25 bp, Mus musculus
gagcagcaagtgatcccaaccaccg

SEQ ID NO: 477655 - DNA, 25 bp, Mus musculus
gagcagcaagtgttcccaaccaccg

SEQ ID NO: 477656 - DNA, 25 bp, Mus musculus
gagcagcaattcattgttatgaaca

SEQ ID NO: 477657 - DNA, 25 bp, Mus musculus
gagcagcaattctttgttatgaaca

SEQ ID NO: 477658 - DNA, 25 bp, Mus musculus
gagcagcacaaaccatccttgagag

SEQ ID NO: 477659 - DNA, 25 bp, Mus musculus
gagcagcacaaagcatccttgagag

SEQ ID NO: 477660 - DNA, 25 bp, Mus musculus
gagcagcactgcacagggccctgtg

SEQ ID NO: 477661 - DNA, 25 bp, Mus musculus
gagcagcactgctcagggccctgtg

SEQ ID NO: 477662 - DNA, 25 bp, Mus musculus
gagcagcactgtatgtgatgcgctt

SEQ ID NO: 477663 - DNA, 25 bp, Mus musculus
gagcagcactgtttgtgatgcgctt

SEQ ID NO: 477664 - DNA, 25 bp, Mus musculus
gagcagcagattacatgtttatttc

SEQ ID NO: 477665 - DNA, 25 bp, Mus musculus
gagcagcagatttcatgtttatttc

SEQ ID NO: 477666 - DNA, 25 bp, Mus musculus
gagcagcagcacattggtaacctgt

SEQ ID NO: 477667 - DNA, 25 bp, Mus musculus
gagcagcagcactttggtaacctgt

SEQ ID NO: 477668 - DNA, 25 bp, Mus musculus
gagcagcagcagattgatgagttct

SEQ ID NO: 477669 - DNA, 25 bp, Mus musculus
gagcagcagcagtttgatgagttct

SEQ ID NO: 477670 - DNA, 25 bp, Mus musculus
gagcagcagccacatagttgtcgca

SEQ ID NO: 477671 - DNA, 25 bp, Mus musculus
gagcagcagccagatagttgtcgca

SEQ ID NO: 477672 - DNA, 25 bp, Mus musculus
gagcagcagcctcaagcaggacctg

SEQ ID NO: 477673 - DNA, 25 bp, Mus musculus
gagcagcagcctgaagcaggacctg

SEQ ID NO: 477674 - DNA, 25 bp, Mus musculus
gagcagcaggatagcagtcaccttc

SEQ ID NO: 477675 - DNA, 25 bp, Mus musculus
gagcagcaggattgcagtcaccttc

SEQ ID NO: 477676 - DNA, 25 bp, Mus musculus
gagcagcaggctatcagggcactgc

SEQ ID NO: 477677 - DNA, 25 bp, Mus musculus
gagcagcaggctttcagggcactgc

SEQ ID NO: 477678 - DNA, 25 bp, Mus musculus
gagcagcagggcagcattctcactg

SEQ ID NO: 477679 - DNA, 25 bp, Mus musculus
gagcagcagggctgcattctcactg

SEQ ID NO: 477680 - DNA, 25 bp, Mus musculus
gagcagcaggtaccccactgtcaaa

SEQ ID NO: 477681 - DNA, 25 bp, Mus musculus
gagcagcaggtagcccactgtcaaa

SEQ ID NO: 477682 - DNA, 25 bp, Mus musculus
gagcagcagtagatgcatcttacat

SEQ ID NO: 477683 - DNA, 25 bp, Mus musculus
gagcagcagtagttgcatcttacat

SEQ ID NO: 477684 - DNA, 25 bp, Mus musculus
gagcagcagtcaacaggtatctatt

SEQ ID NO: 477685 - DNA, 25 bp, Mus musculus
gagcagcagtcatcaggtatctatt

SEQ ID NO: 477686 - DNA, 25 bp, Mus musculus
gagcagcatactacatgtagggcat

SEQ ID NO: 477687 - DNA, 25 bp, Mus musculus
gagcagcatacttcatgtagggcat

SEQ ID NO: 477688 - DNA, 25 bp, Mus musculus
gagcagcatagacactaatgcccta

SEQ ID NO: 477689 - DNA, 25 bp, Mus musculus
gagcagcatagagactaatgcccta

SEQ ID NO: 477690 - DNA, 25 bp, Mus musculus
gagcagcatcagcagcgaaagcttc

SEQ ID NO: 477691 - DNA, 25 bp, Mus musculus
gagcagcatcaggagcgaaagcttc

SEQ ID NO: 477692 - DNA, 25 bp, Mus musculus
gagcagcatcctatgcaaatgagtc

SEQ ID NO: 477693 - DNA, 25 bp, Mus musculus
gagcagcatcctttgcaaatgagtc

SEQ ID NO: 477694 - DNA, 25 bp, Mus musculus
gagcagcatcgaccgaacatcggca

SEQ ID NO: 477695 - DNA, 25 bp, Mus musculus
gagcagcatcgagcgaacatcggca

SEQ ID NO: 477696 - DNA, 25 bp, Mus musculus
gagcagcatctcctctttatttatt

SEQ ID NO: 477697 - DNA, 25 bp, Mus musculus
gagcagcatctcgtctttatttatt

SEQ ID NO: 477698 - DNA, 25 bp, Mus musculus
gagcagcatgaacttacctagtaac

SEQ ID NO: 477699 - DNA, 25 bp, Mus musculus
gagcagcatgaagttacctagtaac

SEQ ID NO: 477700 - DNA, 25 bp, Mus musculus
gagcagcatgacagttgtgtcccag

SEQ ID NO: 477701 - DNA, 25 bp, Mus musculus
gagcagcatgactgttgtgtcccag

SEQ ID NO: 477702 - DNA, 25 bp, Mus musculus
gagcagcatgctaccaaagtcagat

SEQ ID NO: 477703 - DNA, 25 bp, Mus musculus
gagcagcatgcttccaaagtcagat

SEQ ID NO: 477704 - DNA, 25 bp, Mus musculus
gagcagcatggcctggcagtaccca

SEQ ID NO: 477705 - DNA, 25 bp, Mus musculus
gagcagcatggcgtggcagtaccca

SEQ ID NO: 477706 - DNA, 25 bp, Mus musculus
gagcagcattgaaactccaggacaa

SEQ ID NO: 477707 - DNA, 25 bp, Mus musculus
gagcagcattgatactccaggacaa

SEQ ID NO: 477708 - DNA, 25 bp, Mus musculus
gagcagcatttcaccaaaaccttgt

SEQ ID NO: 477709 - DNA, 25 bp, Mus musculus
gagcagcatttctccaaaaccttgt

SEQ ID NO: 477710 - DNA, 25 bp, Mus musculus
gagcagccaagaagcagcattgata

SEQ ID NO: 477711 - DNA, 25 bp, Mus musculus
gagcagccaagatgcagcattgata

SEQ ID NO: 477712 - DNA, 25 bp, Mus musculus
gagcagccacagagcagaagtccct

SEQ ID NO: 477713 - DNA, 25 bp, Mus musculus
gagcagccacagtgcagaagtccct

SEQ ID NO: 477714 - DNA, 25 bp, Mus musculus
gagcagccactgatcttcaaagatg

SEQ ID NO: 477715 - DNA, 25 bp, Mus musculus
gagcagccactgttcttcaaagatg

SEQ ID NO: 477716 - DNA, 25 bp, Mus musculus
gagcagccacttccaaagttgtgca

SEQ ID NO: 477717 - DNA, 25 bp, Mus musculus
gagcagccacttgcaaagttgtgca

SEQ ID NO: 477718 - DNA, 25 bp, Mus musculus
gagcagccagaccactaaatgattt

SEQ ID NO: 477719 - DNA, 25 bp, Mus musculus
gagcagccagacgactaaatgattt

SEQ ID NO: 477720 - DNA, 25 bp, Mus musculus
gagcagccaggaattccagtatgca

SEQ ID NO: 477721 - DNA, 25 bp, Mus musculus
gagcagccaggatttccagtatgca

SEQ ID NO: 477722 - DNA, 25 bp, Mus musculus
gagcagccagttatgacatccatag

SEQ ID NO: 477723 - DNA, 25 bp, Mus musculus
gagcagccagttttgacatccatag

SEQ ID NO: 477724 - DNA, 25 bp, Mus musculus
gagcagccatgaacatatttccttg

SEQ ID NO: 477725 - DNA, 25 bp, Mus musculus
gagcagccatgacactatacattca

SEQ ID NO: 477726 - DNA, 25 bp, Mus musculus
gagcagccatgagactatacattca

SEQ ID NO: 477727 - DNA, 25 bp, Mus musculus
gagcagccatgatcatatttccttg

SEQ ID NO: 477728 - DNA, 25 bp, Mus musculus
gagcagccattcagaggccaagtgg

SEQ ID NO: 477729 - DNA, 25 bp, Mus musculus
gagcagccattctgaggccaagtgg

SEQ ID NO: 477730 - DNA, 25 bp, Mus musculus
gagcagcccacgcaaggacctcttt

SEQ ID NO: 477731 - DNA, 25 bp, Mus musculus
gagcagcccacgcttttgtggaaat

SEQ ID NO: 477732 - DNA, 25 bp, Mus musculus
gagcagcccacggaaggacctcttt

SEQ ID NO: 477733 - DNA, 25 bp, Mus musculus
gagcagcccacggttttgtggaaat

SEQ ID NO: 477734 - DNA, 25 bp, Mus musculus
gagcagcccctgatctgtgttgaat

SEQ ID NO: 477735 - DNA, 25 bp, Mus musculus
gagcagcccctgttctgtgttgaat

SEQ ID NO: 477736 - DNA, 25 bp, Mus musculus
gagcagcccttcatctggaatataa

SEQ ID NO: 477737 - DNA, 25 bp, Mus musculus
gagcagcccttcttctggaatataa

SEQ ID NO: 477738 - DNA, 25 bp, Mus musculus
gagcagccggaccacttccctgatg

SEQ ID NO: 477739 - DNA, 25 bp, Mus musculus
gagcagccggacctaaagcagcgct

SEQ ID NO: 477740 - DNA, 25 bp, Mus musculus
gagcagccggacgacttccctgatg

SEQ ID NO: 477741 - DNA, 25 bp, Mus musculus
gagcagccggacgtaaagcagcgct

SEQ ID NO: 477742 - DNA, 25 bp, Mus musculus
gagcagccggagaacattgccacat

SEQ ID NO: 477743 - DNA, 25 bp, Mus musculus
gagcagccggagtacattgccacat

SEQ ID NO: 477744 - DNA, 25 bp, Mus musculus
gagcagcctactaaccggattgggt

SEQ ID NO: 477745 - DNA, 25 bp, Mus musculus
gagcagcctacttaccggattgggt

SEQ ID NO: 477746 - DNA, 25 bp, Mus musculus
gagcagcctcacattaggtaatggt

SEQ ID NO: 477747 - DNA, 25 bp, Mus musculus
gagcagcctcactttaggtaatggt

SEQ ID NO: 477748 - DNA, 25 bp, Mus musculus
gagcagcctgataagcaacaacgga

SEQ ID NO: 477749 - DNA, 25 bp, Mus musculus
gagcagcctgattagcaacaacgga

SEQ ID NO: 477750 - DNA, 25 bp, Mus musculus
gagcagcctggaagcaaaggccaga

SEQ ID NO: 477751 - DNA, 25 bp, Mus musculus
gagcagcctggacacgataccacgg

SEQ ID NO: 477752 - DNA, 25 bp, Mus musculus
gagcagcctggagacgataccacgg

SEQ ID NO: 477753 - DNA, 25 bp, Mus musculus
gagcagcctggatgcaaaggccaga

SEQ ID NO: 477754 - DNA, 25 bp, Mus musculus
gagcagcctggtagtagtaaattat

SEQ ID NO: 477755 - DNA, 25 bp, Mus musculus
gagcagcctggttgtagtaaattat

SEQ ID NO: 477756 - DNA, 25 bp, Mus musculus
gagcagccttccagcacgtgacgct

SEQ ID NO: 477757 - DNA, 25 bp, Mus musculus
gagcagccttcctgcacgtgacgct

SEQ ID NO: 477758 - DNA, 25 bp, Mus musculus
gagcagcctttccagaaacgttcat

SEQ ID NO: 477759 - DNA, 25 bp, Mus musculus
gagcagcctttccagagcctttgtt

SEQ ID NO: 477760 - DNA, 25 bp, Mus musculus
gagcagcctttccagggatgagaaa

SEQ ID NO: 477761 - DNA, 25 bp, Mus musculus
gagcagcctttcgagaaacgttcat

SEQ ID NO: 477762 - DNA, 25 bp, Mus musculus
gagcagcctttcgagagcctttgtt

SEQ ID NO: 477763 - DNA, 25 bp, Mus musculus
gagcagcctttcgagggatgagaaa

SEQ ID NO: 477764 - DNA, 25 bp, Mus musculus
gagcagcgaaacagcagccaggtat

SEQ ID NO: 477765 - DNA, 25 bp, Mus musculus
gagcagcgaaactgcagccaggtat

SEQ ID NO: 477766 - DNA, 25 bp, Mus musculus
gagcagcgacaactgtgcactttaa

SEQ ID NO: 477767 - DNA, 25 bp, Mus musculus
gagcagcgacaagtgtgcactttaa

SEQ ID NO: 477768 - DNA, 25 bp, Mus musculus
gagcagcgagctctgcatgcagatt

SEQ ID NO: 477769 - DNA, 25 bp, Mus musculus
gagcagcgagctgtgcatgcagatt

SEQ ID NO: 477770 - DNA, 25 bp, Mus musculus
gagcagcgaggacatggccactcta

SEQ ID NO: 477771 - DNA, 25 bp, Mus musculus
gagcagcgaggagatggccactcta

SEQ ID NO: 477772 - DNA, 25 bp, Mus musculus
gagcagcgatctctcaatatccaat

SEQ ID NO: 477773 - DNA, 25 bp, Mus musculus
gagcagcgatctgtcaatatccaat

SEQ ID NO: 477774 - DNA, 25 bp, Mus musculus
gagcagcgattgctgactcctggct

SEQ ID NO: 477775 - DNA, 25 bp, Mus musculus
gagcagcgattggtgactcctggct

SEQ ID NO: 477776 - DNA, 25 bp, Mus musculus
gagcagcgcaataggtagagtgcct

SEQ ID NO: 477777 - DNA, 25 bp, Mus musculus
gagcagcgcaattggtagagtgcct

SEQ ID NO: 477778 - DNA, 25 bp, Mus musculus
gagcagcgcctacaacacatcatga

SEQ ID NO: 477779 - DNA, 25 bp, Mus musculus
gagcagcgcctagaacacatcatga

SEQ ID NO: 477780 - DNA, 25 bp, Mus musculus
gagcagcgcgctctgggtaccaacc

SEQ ID NO: 477781 - DNA, 25 bp, Mus musculus
gagcagcgcgctgtgggtaccaacc

SEQ ID NO: 477782 - DNA, 25 bp, Mus musculus
gagcagcgctggcaacttgtataag

SEQ ID NO: 477783 - DNA, 25 bp, Mus musculus
gagcagcgctgggaacttgtataag

SEQ ID NO: 477784 - DNA, 25 bp, Mus musculus
gagcagcgctgtaccttgcaggctg

SEQ ID NO: 477785 - DNA, 25 bp, Mus musculus
gagcagcgctgttccttgcaggctg

SEQ ID NO: 477786 - DNA, 25 bp, Mus musculus
gagcagcgcttaaagaaatattcct

SEQ ID NO: 477787 - DNA, 25 bp, Mus musculus
gagcagcgcttatagaaatattcct

SEQ ID NO: 477788 - DNA, 25 bp, Mus musculus
gagcagcggattcagatatggatct

SEQ ID NO: 477789 - DNA, 25 bp, Mus musculus
gagcagcggattgagatatggatct

SEQ ID NO: 477790 - DNA, 25 bp, Mus musculus
gagcagcgggagaccttcctaggaa

SEQ ID NO: 477791 - DNA, 25 bp, Mus musculus
gagcagcgggagtccttcctaggaa

SEQ ID NO: 477792 - DNA, 25 bp, Mus musculus
gagcagcgtccacgcgatgcgaacc

SEQ ID NO: 477793 - DNA, 25 bp, Mus musculus
gagcagcgtccaggcgatgcgaacc

SEQ ID NO: 477794 - DNA, 25 bp, Mus musculus
gagcagcgtctactggacattccga

SEQ ID NO: 477795 - DNA, 25 bp, Mus musculus
gagcagcgtctagtggacattccga

SEQ ID NO: 477796 - DNA, 25 bp, Mus musculus
gagcagcgtctgagcggcagaactc

SEQ ID NO: 477797 - DNA, 25 bp, Mus musculus
gagcagcgtctgtgcggcagaactc

SEQ ID NO: 477798 - DNA, 25 bp, Mus musculus
gagcagcgtgcaccccgctggtttt

SEQ ID NO: 477799 - DNA, 25 bp, Mus musculus
gagcagcgtgcagcccgctggtttt

SEQ ID NO: 477800 - DNA, 25 bp, Mus musculus
gagcagctaaaacaaacattgagac

SEQ ID NO: 477801 - DNA, 25 bp, Mus musculus
gagcagctaaaagaaacattgagac

SEQ ID NO: 477802 - DNA, 25 bp, Mus musculus
gagcagctaactcgctcattgatga

SEQ ID NO: 477803 - DNA, 25 bp, Mus musculus
gagcagctaactggctcattgatga

SEQ ID NO: 477804 - DNA, 25 bp, Mus musculus
gagcagctaccaattctagcttggg

SEQ ID NO: 477805 - DNA, 25 bp, Mus musculus
gagcagctaccatttctagcttggg

SEQ ID NO: 477806 - DNA, 25 bp, Mus musculus
gagcagctagcgatctttggtctat

SEQ ID NO: 477807 - DNA, 25 bp, Mus musculus
gagcagctagcgttctttggtctat

SEQ ID NO: 477808 - DNA, 25 bp, Mus musculus
gagcagctagtgcaaccctggagtt

SEQ ID NO: 477809 - DNA, 25 bp, Mus musculus
gagcagctagtggaaccctggagtt

SEQ ID NO: 477810 - DNA, 25 bp, Mus musculus
gagcagctcaaaactcaaactagtt

SEQ ID NO: 477811 - DNA, 25 bp, Mus musculus
gagcagctcaaatctcaaactagtt

SEQ ID NO: 477812 - DNA, 25 bp, Mus musculus
gagcagctcaagacagggatcagat

SEQ ID NO: 477813 - DNA, 25 bp, Mus musculus
gagcagctcaagtcagggatcagat

SEQ ID NO: 477814 - DNA, 25 bp, Mus musculus
gagcagctcactcagggttcgagat

SEQ ID NO: 477815 - DNA, 25 bp, Mus musculus
gagcagctcactgagggttcgagat

SEQ ID NO: 477816 - DNA, 25 bp, Mus musculus
gagcagctccacagactcttggcta

SEQ ID NO: 477817 - DNA, 25 bp, Mus musculus
gagcagctccactgactcttggcta

SEQ ID NO: 477818 - DNA, 25 bp, Mus musculus
gagcagctccagaggacgtcagcag

SEQ ID NO: 477819 - DNA, 25 bp, Mus musculus
gagcagctccagtggacgtcagcag

SEQ ID NO: 477820 - DNA, 25 bp, Mus musculus
gagcagctccttattactgtggcat

SEQ ID NO: 477821 - DNA, 25 bp, Mus musculus
gagcagctcctttttactgtggcat

SEQ ID NO: 477822 - DNA, 25 bp, Mus musculus
gagcagctcgcactatttttgtgac

SEQ ID NO: 477823 - DNA, 25 bp, Mus musculus
gagcagctcgcagtatttttgtgac

SEQ ID NO: 477824 - DNA, 25 bp, Mus musculus
gagcagctctacatgtatatgccca

SEQ ID NO: 477825 - DNA, 25 bp, Mus musculus
gagcagctctacttgtatatgccca

SEQ ID NO: 477826 - DNA, 25 bp, Mus musculus
gagcagctctagctgttcagtacaa

SEQ ID NO: 477827 - DNA, 25 bp, Mus musculus
gagcagctctaggtgttcagtacaa

SEQ ID NO: 477828 - DNA, 25 bp, Mus musculus
gagcagctgaagacaccgtatttca

SEQ ID NO: 477829 - DNA, 25 bp, Mus musculus
gagcagctgaagtcaccgtatttca

SEQ ID NO: 477830 - DNA, 25 bp, Mus musculus
gagcagctgacaccccttgtcaggt

SEQ ID NO: 477831 - DNA, 25 bp, Mus musculus
gagcagctgacagcccttgtcaggt

SEQ ID NO: 477832 - DNA, 25 bp, Mus musculus
gagcagctgaccatcgcttgttgaa

SEQ ID NO: 477833 - DNA, 25 bp, Mus musculus
gagcagctgaccttcgcttgttgaa

SEQ ID NO: 477834 - DNA, 25 bp, Mus musculus
gagcagctgaggcaactctttgaac

SEQ ID NO: 477835 - DNA, 25 bp, Mus musculus
gagcagctgagggaactctttgaac

SEQ ID NO: 477836 - DNA, 25 bp, Mus musculus
gagcagctgagtacatccggagacg

SEQ ID NO: 477837 - DNA, 25 bp, Mus musculus
gagcagctgagttcatccggagacg

SEQ ID NO: 477838 - DNA, 25 bp, Mus musculus
gagcagctgatactgcacacagcct

SEQ ID NO: 477839 - DNA, 25 bp, Mus musculus
gagcagctgatagtgcacacagcct

SEQ ID NO: 477840 - DNA, 25 bp, Mus musculus
gagcagctgcaaacattcttgtctt

SEQ ID NO: 477841 - DNA, 25 bp, Mus musculus
gagcagctgcaatcattcttgtctt

SEQ ID NO: 477842 - DNA, 25 bp, Mus musculus
gagcagctgcacaccaaggcgaaga

SEQ ID NO: 477843 - DNA, 25 bp, Mus musculus
gagcagctgcactccaaggcgaaga

SEQ ID NO: 477844 - DNA, 25 bp, Mus musculus
gagcagctgcagaggctcagccacc

SEQ ID NO: 477845 - DNA, 25 bp, Mus musculus
gagcagctgcagtggctcagccacc

SEQ ID NO: 477846 - DNA, 25 bp, Mus musculus
gagcagctgccaaaagacctcacag

SEQ ID NO: 477847 - DNA, 25 bp, Mus musculus
gagcagctgccaattgagctcttga

SEQ ID NO: 477848 - DNA, 25 bp, Mus musculus
gagcagctgccataagacctcacag

SEQ ID NO: 477849 - DNA, 25 bp, Mus musculus
gagcagctgccatttgagctcttga

SEQ ID NO: 477850 - DNA, 25 bp, Mus musculus
gagcagctgcccacttgactcaagg

SEQ ID NO: 477851 - DNA, 25 bp, Mus musculus
gagcagctgccctcttgactcaagg

SEQ ID NO: 477852 - DNA, 25 bp, Mus musculus
gagcagctgcctagaggtctttgga

SEQ ID NO: 477853 - DNA, 25 bp, Mus musculus
gagcagctgccttgaggtctttgga

SEQ ID NO: 477854 - DNA, 25 bp, Mus musculus
gagcagctgctaatcttttgagttc

SEQ ID NO: 477855 - DNA, 25 bp, Mus musculus
gagcagctgctaatcttttgtttac

SEQ ID NO: 477856 - DNA, 25 bp, Mus musculus
gagcagctgctattcttttgagttc

SEQ ID NO: 477857 - DNA, 25 bp, Mus musculus
gagcagctgctattcttttgtttac

SEQ ID NO: 477858 - DNA, 25 bp, Mus musculus
gagcagctggcacgtgactttcgca

SEQ ID NO: 477859 - DNA, 25 bp, Mus musculus
gagcagctggcaggtgactttcgca

SEQ ID NO: 477860 - DNA, 25 bp, Mus musculus
gagcagctggcccaaatgcagcaaa

SEQ ID NO: 477861 - DNA, 25 bp, Mus musculus
gagcagctggccgaaatgcagcaaa

SEQ ID NO: 477862 - DNA, 25 bp, Mus musculus
gagcagctgggccaattccctggcc

SEQ ID NO: 477863 - DNA, 25 bp, Mus musculus
gagcagctgggcgaattccctggcc

SEQ ID NO: 477864 - DNA, 25 bp, Mus musculus
gagcagctgtagcagttcctacgat

SEQ ID NO: 477865 - DNA, 25 bp, Mus musculus
gagcagctgtaggagttcctacgat

SEQ ID NO: 477866 - DNA, 25 bp, Mus musculus
gagcagctgtccctatatcttcaac

SEQ ID NO: 477867 - DNA, 25 bp, Mus musculus
gagcagctgtccgtatatcttcaac

SEQ ID NO: 477868 - DNA, 25 bp, Mus musculus
gagcagctgtgcctcgtttgagttt

SEQ ID NO: 477869 - DNA, 25 bp, Mus musculus
gagcagctgtgcgtcgtttgagttt

SEQ ID NO: 477870 - DNA, 25 bp, Mus musculus
gagcagcttaatctgagatcaacat

SEQ ID NO: 477871 - DNA, 25 bp, Mus musculus
gagcagcttaatgtgagatcaacat

SEQ ID NO: 477872 - DNA, 25 bp, Mus musculus
gagcagcttaggagtcagaggacca

SEQ ID NO: 477873 - DNA, 25 bp, Mus musculus
gagcagcttaggtgtcagaggacca

SEQ ID NO: 477874 - DNA, 25 bp, Mus musculus
gagcagcttagtatactttagttca

SEQ ID NO: 477875 - DNA, 25 bp, Mus musculus
gagcagcttagtttactttagttca

SEQ ID NO: 477876 - DNA, 25 bp, Mus musculus
gagcagcttcagatggagcaggccc

SEQ ID NO: 477877 - DNA, 25 bp, Mus musculus
gagcagcttcagttggagcaggccc

SEQ ID NO: 477878 - DNA, 25 bp, Mus musculus
gagcagcttctgatgtgattctcaa

SEQ ID NO: 477879 - DNA, 25 bp, Mus musculus
gagcagcttctgttgtgattctcaa

SEQ ID NO: 477880 - DNA, 25 bp, Mus musculus
gagcagcttgtccataatcctacat

SEQ ID NO: 477881 - DNA, 25 bp, Mus musculus
gagcagcttgtcgataatcctacat

SEQ ID NO: 477882 - DNA, 25 bp, Mus musculus
gagcagctttccattgcaggtatct

SEQ ID NO: 477883 - DNA, 25 bp, Mus musculus
gagcagctttcctttgcaggtatct

SEQ ID NO: 477884 - DNA, 25 bp, Mus musculus
gagcagctttctaggcgctgaagaa

SEQ ID NO: 477885 - DNA, 25 bp, Mus musculus
gagcagctttcttggcgctgaagaa

SEQ ID NO: 477886 - DNA, 25 bp, Mus musculus
gagcagctttgacaacccaaacgaa

SEQ ID NO: 477887 - DNA, 25 bp, Mus musculus
gagcagctttgagaacccaaacgaa

SEQ ID NO: 477888 - DNA, 25 bp, Mus musculus
gagcagctttgcaaccaaattattc

SEQ ID NO: 477889 - DNA, 25 bp, Mus musculus
gagcagctttgctaccaaattattc

SEQ ID NO: 477890 - DNA, 25 bp, Mus musculus
gagcagcttttgcttgaaagaccaa

SEQ ID NO: 477891 - DNA, 25 bp, Mus musculus
gagcagcttttggttgaaagaccaa

SEQ ID NO: 477892 - DNA, 25 bp, Mus musculus
gagcaggaaaagcaatcaatcacag

SEQ ID NO: 477893 - DNA, 25 bp, Mus musculus
gagcaggaaaaggaatcaatcacag

SEQ ID NO: 477894 - DNA, 25 bp, Mus musculus
gagcaggaactaacctctcacttgg

SEQ ID NO: 477895 - DNA, 25 bp, Mus musculus
gagcaggaactatcctctcacttgg

SEQ ID NO: 477896 - DNA, 25 bp, Mus musculus
gagcaggaatataggcagaagattt

SEQ ID NO: 477897 - DNA, 25 bp, Mus musculus
gagcaggaatattggcagaagattt

SEQ ID NO: 477898 - DNA, 25 bp, Mus musculus
gagcaggacaagaatgttcattcat

SEQ ID NO: 477899 - DNA, 25 bp, Mus musculus
gagcaggacaagtatgttcattcat

SEQ ID NO: 477900 - DNA, 25 bp, Mus musculus
gagcaggacacacaaaatatcccag

SEQ ID NO: 477901 - DNA, 25 bp, Mus musculus
gagcaggacacacggcagatgcaca

SEQ ID NO: 477902 - DNA, 25 bp, Mus musculus
gagcaggacacagaaaatatcccag

SEQ ID NO: 477903 - DNA, 25 bp, Mus musculus
gagcaggacacagggcagatgcaca

SEQ ID NO: 477904 - DNA, 25 bp, Mus musculus
gagcaggaccccactgagatcacaa

SEQ ID NO: 477905 - DNA, 25 bp, Mus musculus
gagcaggacccctctgagatcacaa

SEQ ID NO: 477906 - DNA, 25 bp, Mus musculus
gagcaggactccacggatgaggcta

SEQ ID NO: 477907 - DNA, 25 bp, Mus musculus
gagcaggactcctcggatgaggcta

SEQ ID NO: 477908 - DNA, 25 bp, Mus musculus
gagcaggacttacgctcactcacgg

SEQ ID NO: 477909 - DNA, 25 bp, Mus musculus
gagcaggacttaggctcactcacgg

SEQ ID NO: 477910 - DNA, 25 bp, Mus musculus
gagcaggagcagagctcgccccagt

SEQ ID NO: 477911 - DNA, 25 bp, Mus musculus
gagcaggagcagtgctcgccccagt

SEQ ID NO: 477912 - DNA, 25 bp, Mus musculus
gagcaggagccaagcatgtccagtc

SEQ ID NO: 477913 - DNA, 25 bp, Mus musculus
gagcaggagccatgcatgtccagtc

SEQ ID NO: 477914 - DNA, 25 bp, Mus musculus
gagcaggagctgcaatcccaactct

SEQ ID NO: 477915 - DNA, 25 bp, Mus musculus
gagcaggagctggaatcccaactct

SEQ ID NO: 477916 - DNA, 25 bp, Mus musculus
gagcaggagttgatctgagcccaca

SEQ ID NO: 477917 - DNA, 25 bp, Mus musculus
gagcaggagttgttctgagcccaca

SEQ ID NO: 477918 - DNA, 25 bp, Mus musculus
gagcaggagtttcaggcccttttca

SEQ ID NO: 477919 - DNA, 25 bp, Mus musculus
gagcaggagtttgaggcccttttca

SEQ ID NO: 477920 - DNA, 25 bp, Mus musculus
gagcaggatcccagtgtgtggccca

SEQ ID NO: 477921 - DNA, 25 bp, Mus musculus
gagcaggatccctgtgtgtggccca

SEQ ID NO: 477922 - DNA, 25 bp, Mus musculus
gagcaggatctacctgactctaaga

SEQ ID NO: 477923 - DNA, 25 bp, Mus musculus
gagcaggatctagctgactctaaga

SEQ ID NO: 477924 - DNA, 25 bp, Mus musculus
gagcaggatcttaagaattcttacc

SEQ ID NO: 477925 - DNA, 25 bp, Mus musculus
gagcaggatctttagaattcttacc

SEQ ID NO: 477926 - DNA, 25 bp, Mus musculus
gagcaggatgataatgccccaaatt

SEQ ID NO: 477927 - DNA, 25 bp, Mus musculus
gagcaggatgatacagaccttgctg

SEQ ID NO: 477928 - DNA, 25 bp, Mus musculus
gagcaggatgattatgccccaaatt

SEQ ID NO: 477929 - DNA, 25 bp, Mus musculus
gagcaggatgattcagaccttgctg

SEQ ID NO: 477930 - DNA, 25 bp, Mus musculus
gagcaggatgcaattactgtgtaca

SEQ ID NO: 477931 - DNA, 25 bp, Mus musculus
gagcaggatgcatttactgtgtaca

SEQ ID NO: 477932 - DNA, 25 bp, Mus musculus
gagcaggcaagaagcaaatgcccat

SEQ ID NO: 477933 - DNA, 25 bp, Mus musculus
gagcaggcaagatgcaaatgcccat

SEQ ID NO: 477934 - DNA, 25 bp, Mus musculus
gagcaggcaagcagtcatctcagta

SEQ ID NO: 477935 - DNA, 25 bp, Mus musculus
gagcaggcaagctgtcatctcagta

SEQ ID NO: 477936 - DNA, 25 bp, Mus musculus
gagcaggcacagcaactccggaaaa

SEQ ID NO: 477937 - DNA, 25 bp, Mus musculus
gagcaggcacaggaactccggaaaa

SEQ ID NO: 477938 - DNA, 25 bp, Mus musculus
gagcaggcacgcactatacttccag

SEQ ID NO: 477939 - DNA, 25 bp, Mus musculus
gagcaggcacgctctatacttccag

SEQ ID NO: 477940 - DNA, 25 bp, Mus musculus
gagcaggcagttacttcagttcttc

SEQ ID NO: 477941 - DNA, 25 bp, Mus musculus
gagcaggcagtttcttcagttcttc

SEQ ID NO: 477942 - DNA, 25 bp, Mus musculus
gagcaggcatagattctgacaaccc

SEQ ID NO: 477943 - DNA, 25 bp, Mus musculus
gagcaggcatagtttctgacaaccc

SEQ ID NO: 477944 - DNA, 25 bp, Mus musculus
gagcaggcctttatgctggtagtaa

SEQ ID NO: 477945 - DNA, 25 bp, Mus musculus
gagcaggcctttttgctggtagtaa

SEQ ID NO: 477946 - DNA, 25 bp, Mus musculus
gagcaggcgctcaactgtgagcaaa

SEQ ID NO: 477947 - DNA, 25 bp, Mus musculus
gagcaggcgctctactgtgagcaaa

SEQ ID NO: 477948 - DNA, 25 bp, Mus musculus
gagcaggcgtctcccaacattcctg

SEQ ID NO: 477949 - DNA, 25 bp, Mus musculus
gagcaggcgtctgccaacattcctg

SEQ ID NO: 477950 - DNA, 25 bp, Mus musculus
gagcaggctaaaacacttatcaatt

SEQ ID NO: 477951 - DNA, 25 bp, Mus musculus
gagcaggctaaatcacttatcaatt

SEQ ID NO: 477952 - DNA, 25 bp, Mus musculus
gagcaggctaacaagtcatgggaaa

SEQ ID NO: 477953 - DNA, 25 bp, Mus musculus
gagcaggctaactagtcatgggaaa

SEQ ID NO: 477954 - DNA, 25 bp, Mus musculus
gagcaggctatactggagttgtcca

SEQ ID NO: 477955 - DNA, 25 bp, Mus musculus
gagcaggctatagtggagttgtcca

SEQ ID NO: 477956 - DNA, 25 bp, Mus musculus
gagcaggctatgcacatctacacaa

SEQ ID NO: 477957 - DNA, 25 bp, Mus musculus
gagcaggctatggacatctacacaa

SEQ ID NO: 477958 - DNA, 25 bp, Mus musculus
gagcaggctcagaatcctgggttat

SEQ ID NO: 477959 - DNA, 25 bp, Mus musculus
gagcaggctcagtatcctgggttat

SEQ ID NO: 477960 - DNA, 25 bp, Mus musculus
gagcaggctcccattgggtgacaga

SEQ ID NO: 477961 - DNA, 25 bp, Mus musculus
gagcaggctccctttgggtgacaga

SEQ ID NO: 477962 - DNA, 25 bp, Mus musculus
gagcaggctgacaaccacctataac

SEQ ID NO: 477963 - DNA, 25 bp, Mus musculus
gagcaggctgactaccacctataac

SEQ ID NO: 477964 - DNA, 25 bp, Mus musculus
gagcaggctgatataggaattcata

SEQ ID NO: 477965 - DNA, 25 bp, Mus musculus
gagcaggctgatatatatatctatg

SEQ ID NO: 477966 - DNA, 25 bp, Mus musculus
gagcaggctgatttaggaattcata

SEQ ID NO: 477967 - DNA, 25 bp, Mus musculus
gagcaggctgatttatatatctatg

SEQ ID NO: 477968 - DNA, 25 bp, Mus musculus
gagcaggctgtaaggtaactagtat

SEQ ID NO: 477969 - DNA, 25 bp, Mus musculus
gagcaggctgtacggcccttgccac

SEQ ID NO: 477970 - DNA, 25 bp, Mus musculus
gagcaggctgtagggcccttgccac

SEQ ID NO: 477971 - DNA, 25 bp, Mus musculus
gagcaggctgtatggtaactagtat

SEQ ID NO: 477972 - DNA, 25 bp, Mus musculus
gagcaggcttatattttgcagcagg

SEQ ID NO: 477973 - DNA, 25 bp, Mus musculus
gagcaggcttattttttgcagcagg

SEQ ID NO: 477974 - DNA, 25 bp, Mus musculus
gagcaggcttgactctggccaaacc

SEQ ID NO: 477975 - DNA, 25 bp, Mus musculus
gagcaggcttgagtctggccaaacc

SEQ ID NO: 477976 - DNA, 25 bp, Mus musculus
gagcaggctttccactaaatacata

SEQ ID NO: 477977 - DNA, 25 bp, Mus musculus
gagcaggctttcgactaaatacata

SEQ ID NO: 477978 - DNA, 25 bp, Mus musculus
gagcagggacaaagttttctgtatg

SEQ ID NO: 477979 - DNA, 25 bp, Mus musculus
gagcagggacaatgttttctgtatg

SEQ ID NO: 477980 - DNA, 25 bp, Mus musculus
gagcagggacagaacctagcagaaa

SEQ ID NO: 477981 - DNA, 25 bp, Mus musculus
gagcagggacagtacctagcagaaa

SEQ ID NO: 477982 - DNA, 25 bp, Mus musculus
gagcagggaccaaattctagcacct

SEQ ID NO: 477983 - DNA, 25 bp, Mus musculus
gagcagggaccatattctagcacct

SEQ ID NO: 477984 - DNA, 25 bp, Mus musculus
gagcagggacccaacttgaagccca

SEQ ID NO: 477985 - DNA, 25 bp, Mus musculus
gagcagggaccctacttgaagccca

SEQ ID NO: 477986 - DNA, 25 bp, Mus musculus
gagcagggacgaacacactcccagc

SEQ ID NO: 477987 - DNA, 25 bp, Mus musculus
gagcagggacgatcacactcccagc

SEQ ID NO: 477988 - DNA, 25 bp, Mus musculus
gagcagggactcattaccagggctt

SEQ ID NO: 477989 - DNA, 25 bp, Mus musculus
gagcagggactctttaccagggctt

SEQ ID NO: 477990 - DNA, 25 bp, Mus musculus
gagcagggagctcgaaaccctcttc

SEQ ID NO: 477991 - DNA, 25 bp, Mus musculus
gagcagggagctggaaaccctcttc

SEQ ID NO: 477992 - DNA, 25 bp, Mus musculus
gagcagggattcatggtaacatata

SEQ ID NO: 477993 - DNA, 25 bp, Mus musculus
gagcagggattcttggtaacatata

SEQ ID NO: 477994 - DNA, 25 bp, Mus musculus
gagcagggcaaaagagcctcttctt

SEQ ID NO: 477995 - DNA, 25 bp, Mus musculus
gagcagggcaaatgagcctcttctt

SEQ ID NO: 477996 - DNA, 25 bp, Mus musculus
gagcagggccctacctcttggcagc

SEQ ID NO: 477997 - DNA, 25 bp, Mus musculus
gagcagggcccttcctcttggcagc

SEQ ID NO: 477998 - DNA, 25 bp, Mus musculus
gagcagggccttcaatctagatttt

SEQ ID NO: 477999 - DNA, 25 bp, Mus musculus
gagcagggccttgaatctagatttt

SEQ ID NO: 478000 - DNA, 25 bp, Mus musculus
gagcagggctttagtttcaggtcgt

SEQ ID NO: 478001 - DNA, 25 bp, Mus musculus
gagcagggcttttgtttcaggtcgt

SEQ ID NO: 478002 - DNA, 25 bp, Mus musculus
gagcagggtaggacttatcccagaa

SEQ ID NO: 478003 - DNA, 25 bp, Mus musculus
gagcagggtaggtcttatcccagaa

SEQ ID NO: 478004 - DNA, 25 bp, Mus musculus
gagcagggtagtagttactgttgtt

SEQ ID NO: 478005 - DNA, 25 bp, Mus musculus
gagcagggtagttgttactgttgtt

SEQ ID NO: 478006 - DNA, 25 bp, Mus musculus
gagcagggtcctaacatggattgtt

SEQ ID NO: 478007 - DNA, 25 bp, Mus musculus
gagcagggtccttacatggattgtt

SEQ ID NO: 478008 - DNA, 25 bp, Mus musculus
gagcagggtgggacactctgatcct

SEQ ID NO: 478009 - DNA, 25 bp, Mus musculus
gagcagggtgggtcactctgatcct

SEQ ID NO: 478010 - DNA, 25 bp, Mus musculus
gagcagggttcaattgcccacaagt

SEQ ID NO: 478011 - DNA, 25 bp, Mus musculus
gagcagggttcatttgcccacaagt

SEQ ID NO: 478012 - DNA, 25 bp, Mus musculus
gagcaggtacacagccttctaaact

SEQ ID NO: 478013 - DNA, 25 bp, Mus musculus
gagcaggtacactgccttctaaact

SEQ ID NO: 478014 - DNA, 25 bp, Mus musculus
gagcaggtactcaggaccagcctgt

SEQ ID NO: 478015 - DNA, 25 bp, Mus musculus
gagcaggtactctggaccagcctgt

SEQ ID NO: 478016 - DNA, 25 bp, Mus musculus
gagcaggtatagagttggtttattt

SEQ ID NO: 478017 - DNA, 25 bp, Mus musculus
gagcaggtatagtgttggtttattt

SEQ ID NO: 478018 - DNA, 25 bp, Mus musculus
gagcaggtcacccttttattcaata

SEQ ID NO: 478019 - DNA, 25 bp, Mus musculus
gagcaggtcaccgttttattcaata

SEQ ID NO: 478020 - DNA, 25 bp, Mus musculus
gagcaggtccatccttacaaatgca

SEQ ID NO: 478021 - DNA, 25 bp, Mus musculus
gagcaggtccatgcttacaaatgca

SEQ ID NO: 478022 - DNA, 25 bp, Mus musculus
gagcaggtcccaatgatgtcatagc

SEQ ID NO: 478023 - DNA, 25 bp, Mus musculus
gagcaggtcccattgatgtcatagc

SEQ ID NO: 478024 - DNA, 25 bp, Mus musculus
gagcaggtcctacagaatctccagt

SEQ ID NO: 478025 - DNA, 25 bp, Mus musculus
gagcaggtcctagagaatctccagt

SEQ ID NO: 478026 - DNA, 25 bp, Mus musculus
gagcaggtcggaaagtgccacgatt

SEQ ID NO: 478027 - DNA, 25 bp, Mus musculus
gagcaggtcggatagtgccacgatt

SEQ ID NO: 478028 - DNA, 25 bp, Mus musculus
gagcaggtctatagtgaaacgttat

SEQ ID NO: 478029 - DNA, 25 bp, Mus musculus
gagcaggtctattgtgaaacgttat

SEQ ID NO: 478030 - DNA, 25 bp, Mus musculus
gagcaggtctgaagaactttccaga

SEQ ID NO: 478031 - DNA, 25 bp, Mus musculus
gagcaggtctgatgaactttccaga

SEQ ID NO: 478032 - DNA, 25 bp, Mus musculus
gagcaggtcttgcacgtagcctttg

SEQ ID NO: 478033 - DNA, 25 bp, Mus musculus
gagcaggtcttggacgtagcctttg

SEQ ID NO: 478034 - DNA, 25 bp, Mus musculus
gagcaggtctttctctaaagagcca

SEQ ID NO: 478035 - DNA, 25 bp, Mus musculus
gagcaggtctttgtctaaagagcca

SEQ ID NO: 478036 - DNA, 25 bp, Mus musculus
gagcaggtgatcaagcagcaagaac

SEQ ID NO: 478037 - DNA, 25 bp, Mus musculus
gagcaggtgatctagcagcaagaac

SEQ ID NO: 478038 - DNA, 25 bp, Mus musculus
gagcaggtgcgaaagcaagcccact

SEQ ID NO: 478039 - DNA, 25 bp, Mus musculus
gagcaggtgcgatagcaagcccact

SEQ ID NO: 478040 - DNA, 25 bp, Mus musculus
gagcaggtggtgatgatccccagcc

SEQ ID NO: 478041 - DNA, 25 bp, Mus musculus
gagcaggtggtgttgatccccagcc

SEQ ID NO: 478042 - DNA, 25 bp, Mus musculus
gagcaggtgtaacattcatacaagt

SEQ ID NO: 478043 - DNA, 25 bp, Mus musculus
gagcaggtgtaagattcatacaagt

SEQ ID NO: 478044 - DNA, 25 bp, Mus musculus
gagcaggtgtgccaaggatctccat

SEQ ID NO: 478045 - DNA, 25 bp, Mus musculus
gagcaggtgtgcgaaggatctccat

SEQ ID NO: 478046 - DNA, 25 bp, Mus musculus
gagcaggtgtgtagcgttagctaca

SEQ ID NO: 478047 - DNA, 25 bp, Mus musculus
gagcaggtgtgttgcgttagctaca

SEQ ID NO: 478048 - DNA, 25 bp, Mus musculus
gagcaggttctgaccaggcccgcag

SEQ ID NO: 478049 - DNA, 25 bp, Mus musculus
gagcaggttctgtccaggcccgcag

SEQ ID NO: 478050 - DNA, 25 bp, Mus musculus
gagcaggttgcaatgtgcccatgaa

SEQ ID NO: 478051 - DNA, 25 bp, Mus musculus
gagcaggttgcattgtgcccatgaa

SEQ ID NO: 478052 - DNA, 25 bp, Mus musculus
gagcaggttgccattgatgaaacca

SEQ ID NO: 478053 - DNA, 25 bp, Mus musculus
gagcaggttgcctttgatgaaacca

SEQ ID NO: 478054 - DNA, 25 bp, Mus musculus
gagcaggttgctattatggtccaca

SEQ ID NO: 478055 - DNA, 25 bp, Mus musculus
gagcaggttgcttttatggtccaca

SEQ ID NO: 478056 - DNA, 25 bp, Mus musculus
gagcaggtttctaaccctaagtgtt

SEQ ID NO: 478057 - DNA, 25 bp, Mus musculus
gagcaggtttcttaccctaagtgtt

SEQ ID NO: 478058 - DNA, 25 bp, Mus musculus
gagcagtaaaataaccatcccagga

SEQ ID NO: 478059 - DNA, 25 bp, Mus musculus
gagcagtaaaattaccatcccagga

SEQ ID NO: 478060 - DNA, 25 bp, Mus musculus
gagcagtaacagatgtccacagaac

SEQ ID NO: 478061 - DNA, 25 bp, Mus musculus
gagcagtaacagttgtccacagaac

SEQ ID NO: 478062 - DNA, 25 bp, Mus musculus
gagcagtaacatctcagcatcctag

SEQ ID NO: 478063 - DNA, 25 bp, Mus musculus
gagcagtaacatgtcagcatcctag

SEQ ID NO: 478064 - DNA, 25 bp, Mus musculus
gagcagtaactcagggtgcaggaca

SEQ ID NO: 478065 - DNA, 25 bp, Mus musculus
gagcagtaactctgggtgcaggaca

SEQ ID NO: 478066 - DNA, 25 bp, Mus musculus
gagcagtaagcaatccaaaccattg

SEQ ID NO: 478067 - DNA, 25 bp, Mus musculus
gagcagtaagcattccaaaccattg

SEQ ID NO: 478068 - DNA, 25 bp, Mus musculus
gagcagtaccaacagttccgaaagc

SEQ ID NO: 478069 - DNA, 25 bp, Mus musculus
gagcagtaccaagagttccgaaagc

SEQ ID NO: 478070 - DNA, 25 bp, Mus musculus
gagcagtacctcaaatcgtttgtgg

SEQ ID NO: 478071 - DNA, 25 bp, Mus musculus
gagcagtacctctaatcgtttgtgg

SEQ ID NO: 478072 - DNA, 25 bp, Mus musculus
gagcagtactcaagaggacgcctca

SEQ ID NO: 478073 - DNA, 25 bp, Mus musculus
gagcagtactcatgaggacgcctca

SEQ ID NO: 478074 - DNA, 25 bp, Mus musculus
gagcagtacttccttctgtaaaaat

SEQ ID NO: 478075 - DNA, 25 bp, Mus musculus
gagcagtacttcgttctgtaaaaat

SEQ ID NO: 478076 - DNA, 25 bp, Mus musculus
gagcagtagcccctggactttgacc

SEQ ID NO: 478077 - DNA, 25 bp, Mus musculus
gagcagtagcccgtggactttgacc

SEQ ID NO: 478078 - DNA, 25 bp, Mus musculus
gagcagtaggcaaccattaacaaat

SEQ ID NO: 478079 - DNA, 25 bp, Mus musculus
gagcagtaggcatccattaacaaat

SEQ ID NO: 478080 - DNA, 25 bp, Mus musculus
gagcagtaggggacatccagcccac

SEQ ID NO: 478081 - DNA, 25 bp, Mus musculus
gagcagtaggggtcatccagcccac

SEQ ID NO: 478082 - DNA, 25 bp, Mus musculus
gagcagtatataagtttcagattcc

SEQ ID NO: 478083 - DNA, 25 bp, Mus musculus
gagcagtatatatgtttcagattcc

SEQ ID NO: 478084 - DNA, 25 bp, Mus musculus
gagcagtatcaccagcagatcatgt

SEQ ID NO: 478085 - DNA, 25 bp, Mus musculus
gagcagtatcacgagcagatcatgt

SEQ ID NO: 478086 - DNA, 25 bp, Mus musculus
gagcagtatcatcatgcccacggtt

SEQ ID NO: 478087 - DNA, 25 bp, Mus musculus
gagcagtatcatgatgcccacggtt

SEQ ID NO: 478088 - DNA, 25 bp, Mus musculus
gagcagtatgaactgcgcttcaagc

SEQ ID NO: 478089 - DNA, 25 bp, Mus musculus
gagcagtatgaagtgcgcttcaagc

SEQ ID NO: 478090 - DNA, 25 bp, Mus musculus
gagcagtatgtcagcgcattctcca

SEQ ID NO: 478091 - DNA, 25 bp, Mus musculus
gagcagtatgtcatacaaagccaca

SEQ ID NO: 478092 - DNA, 25 bp, Mus musculus
gagcagtatgtctgcgcattctcca

SEQ ID NO: 478093 - DNA, 25 bp, Mus musculus
gagcagtatgtcttacaaagccaca

SEQ ID NO: 478094 - DNA, 25 bp, Mus musculus
gagcagtattccaatgtagcttaaa

SEQ ID NO: 478095 - DNA, 25 bp, Mus musculus
gagcagtattcctatgtagcttaaa

SEQ ID NO: 478096 - DNA, 25 bp, Mus musculus
gagcagtcaagcctaagcttccaaa

SEQ ID NO: 478097 - DNA, 25 bp, Mus musculus
gagcagtcaagcgtaagcttccaaa

SEQ ID NO: 478098 - DNA, 25 bp, Mus musculus
gagcagtcaatgaccggtgtgtgtc

SEQ ID NO: 478099 - DNA, 25 bp, Mus musculus
gagcagtcaatgtccggtgtgtgtc

SEQ ID NO: 478100 - DNA, 25 bp, Mus musculus
gagcagtcacatatctccttattgt

SEQ ID NO: 478101 - DNA, 25 bp, Mus musculus
gagcagtcacatttctccttattgt

SEQ ID NO: 478102 - DNA, 25 bp, Mus musculus
gagcagtcactgataaagcttaatt

SEQ ID NO: 478103 - DNA, 25 bp, Mus musculus
gagcagtcactgttaaagcttaatt

SEQ ID NO: 478104 - DNA, 25 bp, Mus musculus
gagcagtcatcaacgaagccaagga

SEQ ID NO: 478105 - DNA, 25 bp, Mus musculus
gagcagtcatcatcgaagccaagga

SEQ ID NO: 478106 - DNA, 25 bp, Mus musculus
gagcagtccaataatcagcaacatg

SEQ ID NO: 478107 - DNA, 25 bp, Mus musculus
gagcagtccaattatcagcaacatg

SEQ ID NO: 478108 - DNA, 25 bp, Mus musculus
gagcagtccataatctgaactacag

SEQ ID NO: 478109 - DNA, 25 bp, Mus musculus
gagcagtccatattctgaactacag

SEQ ID NO: 478110 - DNA, 25 bp, Mus musculus
gagcagtcctgcatagagggccacg

SEQ ID NO: 478111 - DNA, 25 bp, Mus musculus
gagcagtcctgcttagagggccacg

SEQ ID NO: 478112 - DNA, 25 bp, Mus musculus
gagcagtcgctgctcgtgcgcaaca

SEQ ID NO: 478113 - DNA, 25 bp, Mus musculus
gagcagtcgctggtcgtgcgcaaca

SEQ ID NO: 478114 - DNA, 25 bp, Mus musculus
gagcagtcggcaaatcgctagcaat

SEQ ID NO: 478115 - DNA, 25 bp, Mus musculus
gagcagtcggcatatcgctagcaat

SEQ ID NO: 478116 - DNA, 25 bp, Mus musculus
gagcagtcgtacatcaacacaaacc

SEQ ID NO: 478117 - DNA, 25 bp, Mus musculus
gagcagtcgtacttcaacacaaacc

SEQ ID NO: 478118 - DNA, 25 bp, Mus musculus
gagcagtcgttcaacacaaagcctt

SEQ ID NO: 478119 - DNA, 25 bp, Mus musculus
gagcagtcgttctacacaaagcctt

SEQ ID NO: 478120 - DNA, 25 bp, Mus musculus
gagcagtctaccatgtttatgacca

SEQ ID NO: 478121 - DNA, 25 bp, Mus musculus
gagcagtctaccttgtttatgacca

SEQ ID NO: 478122 - DNA, 25 bp, Mus musculus
gagcagtctctcaagtatgtgtcca

SEQ ID NO: 478123 - DNA, 25 bp, Mus musculus
gagcagtctctctagtatgtgtcca

SEQ ID NO: 478124 - DNA, 25 bp, Mus musculus
gagcagtctggcaggtggtttaaca

SEQ ID NO: 478125 - DNA, 25 bp, Mus musculus
gagcagtctggctggtggtttaaca

SEQ ID NO: 478126 - DNA, 25 bp, Mus musculus
gagcagtgacaacatgcacctccat

SEQ ID NO: 478127 - DNA, 25 bp, Mus musculus
gagcagtgacaagatgcacctccat

SEQ ID NO: 478128 - DNA, 25 bp, Mus musculus
gagcagtgacagagaaccgccgatc

SEQ ID NO: 478129 - DNA, 25 bp, Mus musculus
gagcagtgacagtgaaccgccgatc

SEQ ID NO: 478130 - DNA, 25 bp, Mus musculus
gagcagtgacgcacccttgcagcgc

SEQ ID NO: 478131 - DNA, 25 bp, Mus musculus
gagcagtgacgctcccttgcagcgc

SEQ ID NO: 478132 - DNA, 25 bp, Mus musculus
gagcagtgagtgaaacctctgagtt

SEQ ID NO: 478133 - DNA, 25 bp, Mus musculus
gagcagtgagtgtaacctctgagtt

SEQ ID NO: 478134 - DNA, 25 bp, Mus musculus
gagcagtgatgtagtcttaggtgac

SEQ ID NO: 478135 - DNA, 25 bp, Mus musculus
gagcagtgatgttgtcttaggtgac

SEQ ID NO: 478136 - DNA, 25 bp, Mus musculus
gagcagtgcacaagcgatccatgta

SEQ ID NO: 478137 - DNA, 25 bp, Mus musculus
gagcagtgcacatgcgatccatgta

SEQ ID NO: 478138 - DNA, 25 bp, Mus musculus
gagcagtgcaggcttgatgtacaca

SEQ ID NO: 478139 - DNA, 25 bp, Mus musculus
gagcagtgcagggttgatgtacaca

SEQ ID NO: 478140 - DNA, 25 bp, Mus musculus
gagcagtgcatcagagtgttctcct

SEQ ID NO: 478141 - DNA, 25 bp, Mus musculus
gagcagtgcatctgagtgttctcct

SEQ ID NO: 478142 - DNA, 25 bp, Mus musculus
gagcagtgcctgaataaacgtggct

SEQ ID NO: 478143 - DNA, 25 bp, Mus musculus
gagcagtgcctgcagattctttatg

SEQ ID NO: 478144 - DNA, 25 bp, Mus musculus
gagcagtgcctggagattctttatg

SEQ ID NO: 478145 - DNA, 25 bp, Mus musculus
gagcagtgcctgtataaacgtggct

SEQ ID NO: 478146 - DNA, 25 bp, Mus musculus
gagcagtgctagaacgtgaatcaga

SEQ ID NO: 478147 - DNA, 25 bp, Mus musculus
gagcagtgctagtacgtgaatcaga

SEQ ID NO: 478148 - DNA, 25 bp, Mus musculus
gagcagtggatccaggcgtccatca

SEQ ID NO: 478149 - DNA, 25 bp, Mus musculus
gagcagtggatcgaggcgtccatca

SEQ ID NO: 478150 - DNA, 25 bp, Mus musculus
gagcagtgggatacatctgacctcc

SEQ ID NO: 478151 - DNA, 25 bp, Mus musculus
gagcagtgggattcatctgacctcc

SEQ ID NO: 478152 - DNA, 25 bp, Mus musculus
gagcagtgggctcttctacagaata

SEQ ID NO: 478153 - DNA, 25 bp, Mus musculus
gagcagtgggctgttctacagaata

SEQ ID NO: 478154 - DNA, 25 bp, Mus musculus
gagcagtggttcagttgtccaatat

SEQ ID NO: 478155 - DNA, 25 bp, Mus musculus
gagcagtggttctgttgtccaatat

SEQ ID NO: 478156 - DNA, 25 bp, Mus musculus
gagcagtgtaaacctcacagggctt

SEQ ID NO: 478157 - DNA, 25 bp, Mus musculus
gagcagtgtaaagctcacagggctt

SEQ ID NO: 478158 - DNA, 25 bp, Mus musculus
gagcagtgtaccagaccaattcctg

SEQ ID NO: 478159 - DNA, 25 bp, Mus musculus
gagcagtgtacctgaccaattcctg

SEQ ID NO: 478160 - DNA, 25 bp, Mus musculus
gagcagtgtacgacagacaacattt

SEQ ID NO: 478161 - DNA, 25 bp, Mus musculus
gagcagtgtacgtcagacaacattt

SEQ ID NO: 478162 - DNA, 25 bp, Mus musculus
gagcagtgtattcacacctcggtgt

SEQ ID NO: 478163 - DNA, 25 bp, Mus musculus
gagcagtgtattgacacctcggtgt

SEQ ID NO: 478164 - DNA, 25 bp, Mus musculus
gagcagtgtcctactatgcagtgga

SEQ ID NO: 478165 - DNA, 25 bp, Mus musculus
gagcagtgtccttctatgcagtgga

SEQ ID NO: 478166 - DNA, 25 bp, Mus musculus
gagcagtgtgaactctttattcatt

SEQ ID NO: 478167 - DNA, 25 bp, Mus musculus
gagcagtgtgaagtctttattcatt

SEQ ID NO: 478168 - DNA, 25 bp, Mus musculus
gagcagtgtgctatgaactccatct

SEQ ID NO: 478169 - DNA, 25 bp, Mus musculus
gagcagtgtgctatgtgtgttattt

SEQ ID NO: 478170 - DNA, 25 bp, Mus musculus
gagcagtgtgctttgaactccatct

SEQ ID NO: 478171 - DNA, 25 bp, Mus musculus
gagcagtgtgctttgtgtgttattt

SEQ ID NO: 478172 - DNA, 25 bp, Mus musculus
gagcagtgtgggacccgtatcccag

SEQ ID NO: 478173 - DNA, 25 bp, Mus musculus
gagcagtgtgggtcccgtatcccag

SEQ ID NO: 478174 - DNA, 25 bp, Mus musculus
gagcagtgtgttaaccagcaggcca

SEQ ID NO: 478175 - DNA, 25 bp, Mus musculus
gagcagtgtgtttaccagcaggcca

SEQ ID NO: 478176 - DNA, 25 bp, Mus musculus
gagcagtgttctccagggactgtca

SEQ ID NO: 478177 - DNA, 25 bp, Mus musculus
gagcagtgttctgcagggactgtca

SEQ ID NO: 478178 - DNA, 25 bp, Mus musculus
gagcagtgtttgaaagctttccagt

SEQ ID NO: 478179 - DNA, 25 bp, Mus musculus
gagcagtgtttgaagcgttttctaa

SEQ ID NO: 478180 - DNA, 25 bp, Mus musculus
gagcagtgtttgtaagctttccagt

SEQ ID NO: 478181 - DNA, 25 bp, Mus musculus
gagcagtgtttgtagcgttttctaa

SEQ ID NO: 478182 - DNA, 25 bp, Mus musculus
gagcagttaaaccattcctgttttt

SEQ ID NO: 478183 - DNA, 25 bp, Mus musculus
gagcagttaaacgattcctgttttt

SEQ ID NO: 478184 - DNA, 25 bp, Mus musculus
gagcagttactcatctgaatttaag

SEQ ID NO: 478185 - DNA, 25 bp, Mus musculus
gagcagttactcttctgaatttaag

SEQ ID NO: 478186 - DNA, 25 bp, Mus musculus
gagcagttagctacctattacatat

SEQ ID NO: 478187 - DNA, 25 bp, Mus musculus
gagcagttagcttcctattacatat

SEQ ID NO: 478188 - DNA, 25 bp, Mus musculus
gagcagttatgcaagcacatcaaag

SEQ ID NO: 478189 - DNA, 25 bp, Mus musculus
gagcagttatgctagcacatcaaag

SEQ ID NO: 478190 - DNA, 25 bp, Mus musculus
gagcagttcaaccaccacatgagga

SEQ ID NO: 478191 - DNA, 25 bp, Mus musculus
gagcagttcaacgaccacatgagga

SEQ ID NO: 478192 - DNA, 25 bp, Mus musculus
gagcagttcagtaaaggcccatcat

SEQ ID NO: 478193 - DNA, 25 bp, Mus musculus
gagcagttcagttaaggcccatcat

SEQ ID NO: 478194 - DNA, 25 bp, Mus musculus
gagcagttcattcgtttaacttcag

SEQ ID NO: 478195 - DNA, 25 bp, Mus musculus
gagcagttcattggtttaacttcag

SEQ ID NO: 478196 - DNA, 25 bp, Mus musculus
gagcagttccaaaagtcatgtacga

SEQ ID NO: 478197 - DNA, 25 bp, Mus musculus
gagcagttccaatagtcatgtacga

SEQ ID NO: 478198 - DNA, 25 bp, Mus musculus
gagcagttcgtcacggcgacctgga

SEQ ID NO: 478199 - DNA, 25 bp, Mus musculus
gagcagttcgtctcggcgacctgga

SEQ ID NO: 478200 - DNA, 25 bp, Mus musculus
gagcagttctacaattaagactact

SEQ ID NO: 478201 - DNA, 25 bp, Mus musculus
gagcagttctactattaagactact

SEQ ID NO: 478202 - DNA, 25 bp, Mus musculus
gagcagttcttcaatatccctgtga

SEQ ID NO: 478203 - DNA, 25 bp, Mus musculus
gagcagttcttcaccacatttggag

SEQ ID NO: 478204 - DNA, 25 bp, Mus musculus
gagcagttcttcctcaggtgtagac

SEQ ID NO: 478205 - DNA, 25 bp, Mus musculus
gagcagttcttcgtcaggtgtagac

SEQ ID NO: 478206 - DNA, 25 bp, Mus musculus
gagcagttcttctatatccctgtga

SEQ ID NO: 478207 - DNA, 25 bp, Mus musculus
gagcagttcttctccacatttggag

SEQ ID NO: 478208 - DNA, 25 bp, Mus musculus
gagcagttgaacacaggaaggcaga

SEQ ID NO: 478209 - DNA, 25 bp, Mus musculus
gagcagttgaactcaggaaggcaga

SEQ ID NO: 478210 - DNA, 25 bp, Mus musculus
gagcagttgcatcggcccaacacga

SEQ ID NO: 478211 - DNA, 25 bp, Mus musculus
gagcagttgcatgggcccaacacga

SEQ ID NO: 478212 - DNA, 25 bp, Mus musculus
gagcagttgctcacagttggagtct

SEQ ID NO: 478213 - DNA, 25 bp, Mus musculus
gagcagttgctctcagttggagtct

SEQ ID NO: 478214 - DNA, 25 bp, Mus musculus
gagcagttgtcaaagctcctgctac

SEQ ID NO: 478215 - DNA, 25 bp, Mus musculus
gagcagttgtcatagctcctgctac

SEQ ID NO: 478216 - DNA, 25 bp, Mus musculus
gagcagttgttccatgttcagccgt

SEQ ID NO: 478217 - DNA, 25 bp, Mus musculus
gagcagttgttcgatgttcagccgt

SEQ ID NO: 478218 - DNA, 25 bp, Mus musculus
gagcagtttactacagagcatgtca

SEQ ID NO: 478219 - DNA, 25 bp, Mus musculus
gagcagtttactatatagcctagga

SEQ ID NO: 478220 - DNA, 25 bp, Mus musculus
gagcagtttacttcagagcatgtca

SEQ ID NO: 478221 - DNA, 25 bp, Mus musculus
gagcagtttactttatagcctagga

SEQ ID NO: 478222 - DNA, 25 bp, Mus musculus
gagcagtttccacgtatcgagccgt

SEQ ID NO: 478223 - DNA, 25 bp, Mus musculus
gagcagtttccaggtatcgagccgt

SEQ ID NO: 478224 - DNA, 25 bp, Mus musculus
gagcagtttctgcttttaacttttc

SEQ ID NO: 478225 - DNA, 25 bp, Mus musculus
gagcagtttctggttttaacttttc

SEQ ID NO: 478226 - DNA, 25 bp, Mus musculus
gagcagtttgtcctggtgactccga

SEQ ID NO: 478227 - DNA, 25 bp, Mus musculus
gagcagtttgtcgtggtgactccga

SEQ ID NO: 478228 - DNA, 25 bp, Mus musculus
gagcagttttctcccaaatggtgac

SEQ ID NO: 478229 - DNA, 25 bp, Mus musculus
gagcagttttctgccaaatggtgac

SEQ ID NO: 478230 - DNA, 25 bp, Mus musculus
gagcagtttttaatgccagccaggg

SEQ ID NO: 478231 - DNA, 25 bp, Mus musculus
gagcagtttttattgccagccaggg

SEQ ID NO: 478232 - DNA, 25 bp, Mus musculus
gagcagtttttcagagtctcaaact

SEQ ID NO: 478233 - DNA, 25 bp, Mus musculus
gagcagtttttctgagtctcaaact

SEQ ID NO: 478234 - DNA, 25 bp, Mus musculus
gagcataactagctgttcaatattt

SEQ ID NO: 478235 - DNA, 25 bp, Mus musculus
gagcataactaggtgttcaatattt

SEQ ID NO: 478236 - DNA, 25 bp, Mus musculus
gagcataagatcagcccatgtgtgg

SEQ ID NO: 478237 - DNA, 25 bp, Mus musculus
gagcataagatctgcccatgtgtgg

SEQ ID NO: 478238 - DNA, 25 bp, Mus musculus
gagcataaggatctgcacacctatg

SEQ ID NO: 478239 - DNA, 25 bp, Mus musculus
gagcataaggatgtgcacacctatg

SEQ ID NO: 478240 - DNA, 25 bp, Mus musculus
gagcataaggctagactaaccaact

SEQ ID NO: 478241 - DNA, 25 bp, Mus musculus
gagcataaggcttgactaaccaact

SEQ ID NO: 478242 - DNA, 25 bp, Mus musculus
gagcataagggcactacccctgcgg

SEQ ID NO: 478243 - DNA, 25 bp, Mus musculus
gagcataagggctctacccctgcgg

SEQ ID NO: 478244 - DNA, 25 bp, Mus musculus
gagcataataacaaaaccttccagg

SEQ ID NO: 478245 - DNA, 25 bp, Mus musculus
gagcataataactaaaccttccagg

SEQ ID NO: 478246 - DNA, 25 bp, Mus musculus
gagcataattttcaatagcagttac

SEQ ID NO: 478247 - DNA, 25 bp, Mus musculus
gagcataattttgaatagcagttac

SEQ ID NO: 478248 - DNA, 25 bp, Mus musculus
gagcatacaactacctcttcagtgt

SEQ ID NO: 478249 - DNA, 25 bp, Mus musculus
gagcatacaacttcctcttcagtgt

SEQ ID NO: 478250 - DNA, 25 bp, Mus musculus
gagcatacacagacttatgattctt

SEQ ID NO: 478251 - DNA, 25 bp, Mus musculus
gagcatacacagtcttatgattctt

SEQ ID NO: 478252 - DNA, 25 bp, Mus musculus
gagcatacagatagcccaagcacat

SEQ ID NO: 478253 - DNA, 25 bp, Mus musculus
gagcatacagattgcccaagcacat

SEQ ID NO: 478254 - DNA, 25 bp, Mus musculus
gagcatacagctataagtgtcgcac

SEQ ID NO: 478255 - DNA, 25 bp, Mus musculus
gagcatacagctctccgatgagtat

SEQ ID NO: 478256 - DNA, 25 bp, Mus musculus
gagcatacagctgtccgatgagtat

SEQ ID NO: 478257 - DNA, 25 bp, Mus musculus
gagcatacagctttaagtgtcgcac

SEQ ID NO: 478258 - DNA, 25 bp, Mus musculus
gagcatacccgtcgtggagtccaac

SEQ ID NO: 478259 - DNA, 25 bp, Mus musculus
gagcatacccgtggtggagtccaac

SEQ ID NO: 478260 - DNA, 25 bp, Mus musculus
gagcatacgctgagcaatcttgagt

SEQ ID NO: 478261 - DNA, 25 bp, Mus musculus
gagcatacgctgtgcaatcttgagt

SEQ ID NO: 478262 - DNA, 25 bp, Mus musculus
gagcatactactagatttcatgaga

SEQ ID NO: 478263 - DNA, 25 bp, Mus musculus
gagcatactacttgatttcatgaga

SEQ ID NO: 478264 - DNA, 25 bp, Mus musculus
gagcatactcacatgatcctgttca

SEQ ID NO: 478265 - DNA, 25 bp, Mus musculus
gagcatactcacttgatcctgttca

SEQ ID NO: 478266 - DNA, 25 bp, Mus musculus
gagcatactgagagctgctgagctg

SEQ ID NO: 478267 - DNA, 25 bp, Mus musculus
gagcatactgagtgctgctgagctg

SEQ ID NO: 478268 - DNA, 25 bp, Mus musculus
gagcatactttcatgttggagccca

SEQ ID NO: 478269 - DNA, 25 bp, Mus musculus
gagcatactttcttgttggagccca

SEQ ID NO: 478270 - DNA, 25 bp, Mus musculus
gagcatagatacacatgccatgtaa

SEQ ID NO: 478271 - DNA, 25 bp, Mus musculus
gagcatagatactcatgccatgtaa

SEQ ID NO: 478272 - DNA, 25 bp, Mus musculus
gagcatagatgtccttgtcaatttc

SEQ ID NO: 478273 - DNA, 25 bp, Mus musculus
gagcatagatgtgcttgtcaatttc

SEQ ID NO: 478274 - DNA, 25 bp, Mus musculus
gagcatagcaagctcaactcctaaa

SEQ ID NO: 478275 - DNA, 25 bp, Mus musculus
gagcatagcaaggtcaactcctaaa

SEQ ID NO: 478276 - DNA, 25 bp, Mus musculus
gagcatagcatgatttcctagagca

SEQ ID NO: 478277 - DNA, 25 bp, Mus musculus
gagcatagcatgttttcctagagca

SEQ ID NO: 478278 - DNA, 25 bp, Mus musculus
gagcatagcctccaaacaaaggata

SEQ ID NO: 478279 - DNA, 25 bp, Mus musculus
gagcatagcctcgaaacaaaggata

SEQ ID NO: 478280 - DNA, 25 bp, Mus musculus
gagcatagctcgcaggtgaatgaaa

SEQ ID NO: 478281 - DNA, 25 bp, Mus musculus
gagcatagctcggaggtgaatgaaa

SEQ ID NO: 478282 - DNA, 25 bp, Mus musculus
gagcataggaacatgtcagccaccc

SEQ ID NO: 478283 - DNA, 25 bp, Mus musculus
gagcataggaacttgtcagccaccc

SEQ ID NO: 478284 - DNA, 25 bp, Mus musculus
gagcataggctgcattcttattgag

SEQ ID NO: 478285 - DNA, 25 bp, Mus musculus
gagcataggctggattcttattgag

SEQ ID NO: 478286 - DNA, 25 bp, Mus musculus
gagcatagggctcgctctgtagccc

SEQ ID NO: 478287 - DNA, 25 bp, Mus musculus
gagcatagggctggctctgtagccc

SEQ ID NO: 478288 - DNA, 25 bp, Mus musculus
gagcatagtaggatctagcatacca

SEQ ID NO: 478289 - DNA, 25 bp, Mus musculus
gagcatagtaggttctagcatacca

SEQ ID NO: 478290 - DNA, 25 bp, Mus musculus
gagcatagtatgattagccatcgca

SEQ ID NO: 478291 - DNA, 25 bp, Mus musculus
gagcatagtatgtttagccatcgca

SEQ ID NO: 478292 - DNA, 25 bp, Mus musculus
gagcatagtcaaaccatcacactcc

SEQ ID NO: 478293 - DNA, 25 bp, Mus musculus
gagcatagtcaatccatcacactcc

SEQ ID NO: 478294 - DNA, 25 bp, Mus musculus
gagcatagtgtcagtgcctcaagaa

SEQ ID NO: 478295 - DNA, 25 bp, Mus musculus
gagcatagtgtctgtgcctcaagaa

SEQ ID NO: 478296 - DNA, 25 bp, Mus musculus
gagcatataattacccagaactctt

SEQ ID NO: 478297 - DNA, 25 bp, Mus musculus
gagcatataatttcccagaactctt

SEQ ID NO: 478298 - DNA, 25 bp, Mus musculus
gagcatatacaacccatcacgggaa

SEQ ID NO: 478299 - DNA, 25 bp, Mus musculus
gagcatatacaagccatcacgggaa

SEQ ID NO: 478300 - DNA, 25 bp, Mus musculus
gagcatatacggctggcgttccaat

SEQ ID NO: 478301 - DNA, 25 bp, Mus musculus
gagcatatacgggtggcgttccaat

SEQ ID NO: 478302 - DNA, 25 bp, Mus musculus
gagcatatactgactttcctgtaag

SEQ ID NO: 478303 - DNA, 25 bp, Mus musculus
gagcatatactgtctttcctgtaag

SEQ ID NO: 478304 - DNA, 25 bp, Mus musculus
gagcatatagctcaaccaaaccaaa

SEQ ID NO: 478305 - DNA, 25 bp, Mus musculus
gagcatatagctcctgttaaccctg

SEQ ID NO: 478306 - DNA, 25 bp, Mus musculus
gagcatatagctgaaccaaaccaaa

SEQ ID NO: 478307 - DNA, 25 bp, Mus musculus
gagcatatagctgctgttaaccctg

SEQ ID NO: 478308 - DNA, 25 bp, Mus musculus
gagcatatatctacataatctgatg

SEQ ID NO: 478309 - DNA, 25 bp, Mus musculus
gagcatatatcttcataatctgatg

SEQ ID NO: 478310 - DNA, 25 bp, Mus musculus
gagcatatcatcactgagggccgag

SEQ ID NO: 478311 - DNA, 25 bp, Mus musculus
gagcatatcatctctgagggccgag

SEQ ID NO: 478312 - DNA, 25 bp, Mus musculus
gagcatatccaacccatcgagctat

SEQ ID NO: 478313 - DNA, 25 bp, Mus musculus
gagcatatccaagccatcgagctat

SEQ ID NO: 478314 - DNA, 25 bp, Mus musculus
gagcatatcctgctaccacatgctt

SEQ ID NO: 478315 - DNA, 25 bp, Mus musculus
gagcatatcctggtaccacatgctt

SEQ ID NO: 478316 - DNA, 25 bp, Mus musculus
gagcatatcgccagggctgccgatg

SEQ ID NO: 478317 - DNA, 25 bp, Mus musculus
gagcatatcgcctgggctgccgatg

SEQ ID NO: 478318 - DNA, 25 bp, Mus musculus
gagcatatgagtactgcttcaacta

SEQ ID NO: 478319 - DNA, 25 bp, Mus musculus
gagcatatgagttctgcttcaacta

SEQ ID NO: 478320 - DNA, 25 bp, Mus musculus
gagcatatgggcaactgcattcagc

SEQ ID NO: 478321 - DNA, 25 bp, Mus musculus
gagcatatgggctactgcattcagc

SEQ ID NO: 478322 - DNA, 25 bp, Mus musculus
gagcatatgttgctcttctagagga

SEQ ID NO: 478323 - DNA, 25 bp, Mus musculus
gagcatatgttggtcttctagagga

SEQ ID NO: 478324 - DNA, 25 bp, Mus musculus
gagcatattattaacctaacctgaa

SEQ ID NO: 478325 - DNA, 25 bp, Mus musculus
gagcatattattctttccacctgta

SEQ ID NO: 478326 - DNA, 25 bp, Mus musculus
gagcatattattgtttccacctgta

SEQ ID NO: 478327 - DNA, 25 bp, Mus musculus
gagcatattatttacctaacctgaa

SEQ ID NO: 478328 - DNA, 25 bp, Mus musculus
gagcatatttatctgtctgccactc

SEQ ID NO: 478329 - DNA, 25 bp, Mus musculus
gagcatatttatgtgtctgccactc

SEQ ID NO: 478330 - DNA, 25 bp, Mus musculus
gagcatatttggctttctctcaaat

SEQ ID NO: 478331 - DNA, 25 bp, Mus musculus
gagcatatttgggtttctctcaaat

SEQ ID NO: 478332 - DNA, 25 bp, Mus musculus
gagcatatttgtctgtacctgtatg

SEQ ID NO: 478333 - DNA, 25 bp, Mus musculus
gagcatatttgtgtgtacctgtatg

SEQ ID NO: 478334 - DNA, 25 bp, Mus musculus
gagcatcaaacaacagcctttctat

SEQ ID NO: 478335 - DNA, 25 bp, Mus musculus
gagcatcaaacatcagcctttctat

SEQ ID NO: 478336 - DNA, 25 bp, Mus musculus
gagcatcaaagactgtgcccatctt

SEQ ID NO: 478337 - DNA, 25 bp, Mus musculus
gagcatcaaagagtgtgcccatctt

SEQ ID NO: 478338 - DNA, 25 bp, Mus musculus
gagcatcaaggacctcggaggccat

SEQ ID NO: 478339 - DNA, 25 bp, Mus musculus
gagcatcaaggagctcggaggccat

SEQ ID NO: 478340 - DNA, 25 bp, Mus musculus
gagcatcaatgccaatttcccatta

SEQ ID NO: 478341 - DNA, 25 bp, Mus musculus
gagcatcaatgcgaatttcccatta

SEQ ID NO: 478342 - DNA, 25 bp, Mus musculus
gagcatcacaaacaacttcgacgag

SEQ ID NO: 478343 - DNA, 25 bp, Mus musculus
gagcatcacaaagaacttcgacgag

SEQ ID NO: 478344 - DNA, 25 bp, Mus musculus
gagcatcacaccagcgattcagcca

SEQ ID NO: 478345 - DNA, 25 bp, Mus musculus
gagcatcacacctgcgattcagcca

SEQ ID NO: 478346 - DNA, 25 bp, Mus musculus
gagcatcaccataggctggagagtt

SEQ ID NO: 478347 - DNA, 25 bp, Mus musculus
gagcatcaccattggctggagagtt

SEQ ID NO: 478348 - DNA, 25 bp, Mus musculus
gagcatcacctaagcccaagatcat

SEQ ID NO: 478349 - DNA, 25 bp, Mus musculus
gagcatcacctatgcccaagatcat

SEQ ID NO: 478350 - DNA, 25 bp, Mus musculus
gagcatcacgctcgagggatgaatt

SEQ ID NO: 478351 - DNA, 25 bp, Mus musculus
gagcatcacgctggagggatgaatt

SEQ ID NO: 478352 - DNA, 25 bp, Mus musculus
gagcatcactgcatgttgcatagcc

SEQ ID NO: 478353 - DNA, 25 bp, Mus musculus
gagcatcactgcttgttgcatagcc

SEQ ID NO: 478354 - DNA, 25 bp, Mus musculus
gagcatcactggaacccgcactaaa

SEQ ID NO: 478355 - DNA, 25 bp, Mus musculus
gagcatcactggtacccgcactaaa

SEQ ID NO: 478356 - DNA, 25 bp, Mus musculus
gagcatcagacgagtgctgccgaaa

SEQ ID NO: 478357 - DNA, 25 bp, Mus musculus
gagcatcagacgtgtgctgccgaaa

SEQ ID NO: 478358 - DNA, 25 bp, Mus musculus
gagcatcagcaacatgtacaattag

SEQ ID NO: 478359 - DNA, 25 bp, Mus musculus
gagcatcagcaagatgtacaattag

SEQ ID NO: 478360 - DNA, 25 bp, Mus musculus
gagcatcagctgaggctacagatag

SEQ ID NO: 478361 - DNA, 25 bp, Mus musculus
gagcatcagctgtggctacagatag

SEQ ID NO: 478362 - DNA, 25 bp, Mus musculus
gagcatcaggcaccagacgtgcttg

SEQ ID NO: 478363 - DNA, 25 bp, Mus musculus
gagcatcaggcagcagacgtgcttg

SEQ ID NO: 478364 - DNA, 25 bp, Mus musculus
gagcatcagggcactgagggccaaa

SEQ ID NO: 478365 - DNA, 25 bp, Mus musculus
gagcatcagggctctgagggccaaa

SEQ ID NO: 478366 - DNA, 25 bp, Mus musculus
gagcatcaggtgctacttgtcacca

SEQ ID NO: 478367 - DNA, 25 bp, Mus musculus
gagcatcaggtggtacttgtcacca

SEQ ID NO: 478368 - DNA, 25 bp, Mus musculus
gagcatcagttcactcatctttgag

SEQ ID NO: 478369 - DNA, 25 bp, Mus musculus
gagcatcagttctctcatctttgag

SEQ ID NO: 478370 - DNA, 25 bp, Mus musculus
gagcatcatatcaatcatggcaaca

SEQ ID NO: 478371 - DNA, 25 bp, Mus musculus
gagcatcatatctatcatggcaaca

SEQ ID NO: 478372 - DNA, 25 bp, Mus musculus
gagcatcatcaacctggacactttt

SEQ ID NO: 478373 - DNA, 25 bp, Mus musculus
gagcatcatcaagctggacactttt

SEQ ID NO: 478374 - DNA, 25 bp, Mus musculus
gagcatcatcagaccaaaacggctg

SEQ ID NO: 478375 - DNA, 25 bp, Mus musculus
gagcatcatcagtccaaaacggctg

SEQ ID NO: 478376 - DNA, 25 bp, Mus musculus
gagcatcatcgacgcagaggtcttg

SEQ ID NO: 478377 - DNA, 25 bp, Mus musculus
gagcatcatcgaggcagaggtcttg

SEQ ID NO: 478378 - DNA, 25 bp, Mus musculus
gagcatcatcttcatgcaacacttg

SEQ ID NO: 478379 - DNA, 25 bp, Mus musculus
gagcatcatcttgatgcaacacttg

SEQ ID NO: 478380 - DNA, 25 bp, Mus musculus
gagcatcatgctattttggaaattt

SEQ ID NO: 478381 - DNA, 25 bp, Mus musculus
gagcatcatgctcacaagccaggat

SEQ ID NO: 478382 - DNA, 25 bp, Mus musculus
gagcatcatgctgacaagccaggat

SEQ ID NO: 478383 - DNA, 25 bp, Mus musculus
gagcatcatgcttttttggaaattt

SEQ ID NO: 478384 - DNA, 25 bp, Mus musculus
gagcatcattccatgcagaggcctg

SEQ ID NO: 478385 - DNA, 25 bp, Mus musculus
gagcatcattccttgcagaggcctg

SEQ ID NO: 478386 - DNA, 25 bp, Mus musculus
gagcatcattcgcaaagctttgact

SEQ ID NO: 478387 - DNA, 25 bp, Mus musculus
gagcatcattcggaaagctttgact

SEQ ID NO: 478388 - DNA, 25 bp, Mus musculus
gagcatcattttagcccatttaaca

SEQ ID NO: 478389 - DNA, 25 bp, Mus musculus
gagcatcatttttgcccatttaaca

SEQ ID NO: 478390 - DNA, 25 bp, Mus musculus
gagcatccacagctgttttcatgtg

SEQ ID NO: 478391 - DNA, 25 bp, Mus musculus
gagcatccacaggtgttttcatgtg

SEQ ID NO: 478392 - DNA, 25 bp, Mus musculus
gagcatccacatatctgcatttctg

SEQ ID NO: 478393 - DNA, 25 bp, Mus musculus
gagcatccacatttctgcatttctg

SEQ ID NO: 478394 - DNA, 25 bp, Mus musculus
gagcatccaccacatctgagactat

SEQ ID NO: 478395 - DNA, 25 bp, Mus musculus
gagcatccaccagatctgagactat

SEQ ID NO: 478396 - DNA, 25 bp, Mus musculus
gagcatccactacctggtggcaaaa

SEQ ID NO: 478397 - DNA, 25 bp, Mus musculus
gagcatccactagctggtggcaaaa

SEQ ID NO: 478398 - DNA, 25 bp, Mus musculus
gagcatccaggactcctctggaaag

SEQ ID NO: 478399 - DNA, 25 bp, Mus musculus
gagcatccaggagtcctctggaaag

SEQ ID NO: 478400 - DNA, 25 bp, Mus musculus
gagcatccatatagcctctttgtga

SEQ ID NO: 478401 - DNA, 25 bp, Mus musculus
gagcatccatattgcctctttgtga

SEQ ID NO: 478402 - DNA, 25 bp, Mus musculus
gagcatccattacatttttctctgg

SEQ ID NO: 478403 - DNA, 25 bp, Mus musculus
gagcatccattagatttttctctgg

SEQ ID NO: 478404 - DNA, 25 bp, Mus musculus
gagcatcccatactacagagacaca

SEQ ID NO: 478405 - DNA, 25 bp, Mus musculus
gagcatcccatagtacagagacaca

SEQ ID NO: 478406 - DNA, 25 bp, Mus musculus
gagcatccccaccaggcggctgcgc

SEQ ID NO: 478407 - DNA, 25 bp, Mus musculus
gagcatccccacgaggcggctgcgc

SEQ ID NO: 478408 - DNA, 25 bp, Mus musculus
gagcatccccatcaattgtttattg

SEQ ID NO: 478409 - DNA, 25 bp, Mus musculus
gagcatccccatcataaggttacat

SEQ ID NO: 478410 - DNA, 25 bp, Mus musculus
gagcatccccatgaattgtttattg

SEQ ID NO: 478411 - DNA, 25 bp, Mus musculus
gagcatccccatgataaggttacat

SEQ ID NO: 478412 - DNA, 25 bp, Mus musculus
gagcatccgaatatacgacgcgagc

SEQ ID NO: 478413 - DNA, 25 bp, Mus musculus
gagcatccgaatttacgacgcgagc

SEQ ID NO: 478414 - DNA, 25 bp, Mus musculus
gagcatccgattacttcactaaagg

SEQ ID NO: 478415 - DNA, 25 bp, Mus musculus
gagcatccgatttcttcactaaagg

SEQ ID NO: 478416 - DNA, 25 bp, Mus musculus
gagcatccggcaccgtttatttaga

SEQ ID NO: 478417 - DNA, 25 bp, Mus musculus
gagcatccggcagcgtttatttaga

SEQ ID NO: 478418 - DNA, 25 bp, Mus musculus
gagcatcctaagatgcatgacagcg

SEQ ID NO: 478419 - DNA, 25 bp, Mus musculus
gagcatcctaagttgcatgacagcg

SEQ ID NO: 478420 - DNA, 25 bp, Mus musculus
gagcatcctagaataccttcattac

SEQ ID NO: 478421 - DNA, 25 bp, Mus musculus
gagcatcctagattaccttcattac

SEQ ID NO: 478422 - DNA, 25 bp, Mus musculus
gagcatcctcagaaaactctgctgg

SEQ ID NO: 478423 - DNA, 25 bp, Mus musculus
gagcatcctcagtaaactctgctgg

SEQ ID NO: 478424 - DNA, 25 bp, Mus musculus
gagcatcctcatagcaagtagatcg

SEQ ID NO: 478425 - DNA, 25 bp, Mus musculus
gagcatcctcattgcaagtagatcg

SEQ ID NO: 478426 - DNA, 25 bp, Mus musculus
gagcatcctcctcttagaggcctaa

SEQ ID NO: 478427 - DNA, 25 bp, Mus musculus
gagcatcctcctgttagaggcctaa

SEQ ID NO: 478428 - DNA, 25 bp, Mus musculus
gagcatcctggcaagagtctcatga

SEQ ID NO: 478429 - DNA, 25 bp, Mus musculus
gagcatcctggcatatccattggtg

SEQ ID NO: 478430 - DNA, 25 bp, Mus musculus
gagcatcctggctagagtctcatga

SEQ ID NO: 478431 - DNA, 25 bp, Mus musculus
gagcatcctggcttatccattggtg

SEQ ID NO: 478432 - DNA, 25 bp, Mus musculus
gagcatcctgggaagaatcatcttg

SEQ ID NO: 478433 - DNA, 25 bp, Mus musculus
gagcatcctgggtagaatcatcttg

SEQ ID NO: 478434 - DNA, 25 bp, Mus musculus
gagcatccttaaaccaaaatccaat

SEQ ID NO: 478435 - DNA, 25 bp, Mus musculus
gagcatccttaaattaccttggttt

SEQ ID NO: 478436 - DNA, 25 bp, Mus musculus
gagcatccttaatccaaaatccaat

SEQ ID NO: 478437 - DNA, 25 bp, Mus musculus
gagcatccttaatttaccttggttt

SEQ ID NO: 478438 - DNA, 25 bp, Mus musculus
gagcatcctttactttacttatact

SEQ ID NO: 478439 - DNA, 25 bp, Mus musculus
gagcatcctttagtttacttatact

SEQ ID NO: 478440 - DNA, 25 bp, Mus musculus
gagcatcgaaccctggtgtccagat

SEQ ID NO: 478441 - DNA, 25 bp, Mus musculus
gagcatcgaaccgtggtgtccagat

SEQ ID NO: 478442 - DNA, 25 bp, Mus musculus
gagcatcgaattagacagagagttt

SEQ ID NO: 478443 - DNA, 25 bp, Mus musculus
gagcatcgaatttgacagagagttt

SEQ ID NO: 478444 - DNA, 25 bp, Mus musculus
gagcatcgaccgcaggaaaaagttg

SEQ ID NO: 478445 - DNA, 25 bp, Mus musculus
gagcatcgaccggaggaaaaagttg

SEQ ID NO: 478446 - DNA, 25 bp, Mus musculus
gagcatcgacgacccctagaagtag

SEQ ID NO: 478447 - DNA, 25 bp, Mus musculus
gagcatcgacgagccctagaagtag

SEQ ID NO: 478448 - DNA, 25 bp, Mus musculus
gagcatcgagaactacggccagagc

SEQ ID NO: 478449 - DNA, 25 bp, Mus musculus
gagcatcgagaagtacggccagagc

SEQ ID NO: 478450 - DNA, 25 bp, Mus musculus
gagcatcgatcacgcttcaaggcca

SEQ ID NO: 478451 - DNA, 25 bp, Mus musculus
gagcatcgatcaggcttcaaggcca

SEQ ID NO: 478452 - DNA, 25 bp, Mus musculus
gagcatcgcaagcttttgagcctgt

SEQ ID NO: 478453 - DNA, 25 bp, Mus musculus
gagcatcgcaaggttttgagcctgt

SEQ ID NO: 478454 - DNA, 25 bp, Mus musculus
gagcatcgcacactagcatttcagt

SEQ ID NO: 478455 - DNA, 25 bp, Mus musculus
gagcatcgcacagtagcatttcagt

SEQ ID NO: 478456 - DNA, 25 bp, Mus musculus
gagcatcgcaccacgaatgatgagt

SEQ ID NO: 478457 - DNA, 25 bp, Mus musculus
gagcatcgcacctcgaatgatgagt

SEQ ID NO: 478458 - DNA, 25 bp, Mus musculus
gagcatcgcagtcttggttctgaac

SEQ ID NO: 478459 - DNA, 25 bp, Mus musculus
gagcatcgcagtgttggttctgaac

SEQ ID NO: 478460 - DNA, 25 bp, Mus musculus
gagcatcgggccacaacacgagcag

SEQ ID NO: 478461 - DNA, 25 bp, Mus musculus
gagcatcgggcctcaacacgagcag

SEQ ID NO: 478462 - DNA, 25 bp, Mus musculus
gagcatcgtaaacttctattgtcca

SEQ ID NO: 478463 - DNA, 25 bp, Mus musculus
gagcatcgtaaagttctattgtcca

SEQ ID NO: 478464 - DNA, 25 bp, Mus musculus
gagcatcgtcatctgtgtattctga

SEQ ID NO: 478465 - DNA, 25 bp, Mus musculus
gagcatcgtcatgtgtgtattctga

SEQ ID NO: 478466 - DNA, 25 bp, Mus musculus
gagcatcgtgatctgtcactccgat

SEQ ID NO: 478467 - DNA, 25 bp, Mus musculus
gagcatcgtgatgtgtcactccgat

SEQ ID NO: 478468 - DNA, 25 bp, Mus musculus
gagcatctaagaacgagccgggact

SEQ ID NO: 478469 - DNA, 25 bp, Mus musculus
gagcatctaagatcgagccgggact

SEQ ID NO: 478470 - DNA, 25 bp, Mus musculus
gagcatctacctactattactaggg

SEQ ID NO: 478471 - DNA, 25 bp, Mus musculus
gagcatctaccttctattactaggg

SEQ ID NO: 478472 - DNA, 25 bp, Mus musculus
gagcatctactccataatctccaga

SEQ ID NO: 478473 - DNA, 25 bp, Mus musculus
gagcatctactcgataatctccaga

SEQ ID NO: 478474 - DNA, 25 bp, Mus musculus
gagcatctagaaaggcatctcccag

SEQ ID NO: 478475 - DNA, 25 bp, Mus musculus
gagcatctagaatggcatctcccag

SEQ ID NO: 478476 - DNA, 25 bp, Mus musculus
gagcatctagataccaccatgtgag

SEQ ID NO: 478477 - DNA, 25 bp, Mus musculus
gagcatctagattccaccatgtgag

SEQ ID NO: 478478 - DNA, 25 bp, Mus musculus
gagcatctagctagtacgcgtatct

SEQ ID NO: 478479 - DNA, 25 bp, Mus musculus
gagcatctagcttgtacgcgtatct

SEQ ID NO: 478480 - DNA, 25 bp, Mus musculus
gagcatctagttatctagtcactca

SEQ ID NO: 478481 - DNA, 25 bp, Mus musculus
gagcatctagttttctagtcactca

SEQ ID NO: 478482 - DNA, 25 bp, Mus musculus
gagcatctcaagctggctgggcata

SEQ ID NO: 478483 - DNA, 25 bp, Mus musculus
gagcatctcaaggtggctgggcata

SEQ ID NO: 478484 - DNA, 25 bp, Mus musculus
gagcatctcagcaggttacatgaaa

SEQ ID NO: 478485 - DNA, 25 bp, Mus musculus
gagcatctcagctggttacatgaaa

SEQ ID NO: 478486 - DNA, 25 bp, Mus musculus
gagcatctccatcttttacgttcag

SEQ ID NO: 478487 - DNA, 25 bp, Mus musculus
gagcatctccatgttttacgttcag

SEQ ID NO: 478488 - DNA, 25 bp, Mus musculus
gagcatctccgccaagctgaagcaa

SEQ ID NO: 478489 - DNA, 25 bp, Mus musculus
gagcatctccgcgaagctgaagcaa

SEQ ID NO: 478490 - DNA, 25 bp, Mus musculus
gagcatctcctgctgaagacagtat

SEQ ID NO: 478491 - DNA, 25 bp, Mus musculus
gagcatctcctggtgaagacagtat

SEQ ID NO: 478492 - DNA, 25 bp, Mus musculus
gagcatctctcactgactttagctg

SEQ ID NO: 478493 - DNA, 25 bp, Mus musculus
gagcatctctcagtgactttagctg

SEQ ID NO: 478494 - DNA, 25 bp, Mus musculus
gagcatctctctaatagccttagct

SEQ ID NO: 478495 - DNA, 25 bp, Mus musculus
gagcatctctcttatagccttagct

SEQ ID NO: 478496 - DNA, 25 bp, Mus musculus
gagcatctgaatccaggctctgctg

SEQ ID NO: 478497 - DNA, 25 bp, Mus musculus
gagcatctgaatgcaggctctgctg

SEQ ID NO: 478498 - DNA, 25 bp, Mus musculus
gagcatctgaccagagttcttattg

SEQ ID NO: 478499 - DNA, 25 bp, Mus musculus
gagcatctgacctgagttcttattg

SEQ ID NO: 478500 - DNA, 25 bp, Mus musculus
gagcatctgcaaagaaaagcaactc

SEQ ID NO: 478501 - DNA, 25 bp, Mus musculus
gagcatctgcaatgaaaagcaactc

SEQ ID NO: 478502 - DNA, 25 bp, Mus musculus
gagcatctgctcacttgggcataag

SEQ ID NO: 478503 - DNA, 25 bp, Mus musculus
gagcatctgctctcttgggcataag

SEQ ID NO: 478504 - DNA, 25 bp, Mus musculus
gagcatctggatatgcgtcccagga

SEQ ID NO: 478505 - DNA, 25 bp, Mus musculus
gagcatctggatttgcgtcccagga

SEQ ID NO: 478506 - DNA, 25 bp, Mus musculus
gagcatctggctcgttcctaactgt

SEQ ID NO: 478507 - DNA, 25 bp, Mus musculus
gagcatctggctggttcctaactgt

SEQ ID NO: 478508 - DNA, 25 bp, Mus musculus
gagcatctggtcatcattgcacaag

SEQ ID NO: 478509 - DNA, 25 bp, Mus musculus
gagcatctggtcttcattgcacaag

SEQ ID NO: 478510 - DNA, 25 bp, Mus musculus
gagcatctgtcacttgttggctaaa

SEQ ID NO: 478511 - DNA, 25 bp, Mus musculus
gagcatctgtcagttgttggctaaa

SEQ ID NO: 478512 - DNA, 25 bp, Mus musculus
gagcatctgttaactttgtcagtca

SEQ ID NO: 478513 - DNA, 25 bp, Mus musculus
gagcatctgttacccaagagaggca

SEQ ID NO: 478514 - DNA, 25 bp, Mus musculus
gagcatctgttagccaagagaggca

SEQ ID NO: 478515 - DNA, 25 bp, Mus musculus
gagcatctgttatctttgtcagtca

SEQ ID NO: 478516 - DNA, 25 bp, Mus musculus
gagcatctgttcatgcacggcaact

SEQ ID NO: 478517 - DNA, 25 bp, Mus musculus
gagcatctgttcctgcttatccgaa

SEQ ID NO: 478518 - DNA, 25 bp, Mus musculus
gagcatctgttcgtgcttatccgaa

SEQ ID NO: 478519 - DNA, 25 bp, Mus musculus
gagcatctgttcttgcacggcaact

SEQ ID NO: 478520 - DNA, 25 bp, Mus musculus
gagcatctgtttactgacatcacct

SEQ ID NO: 478521 - DNA, 25 bp, Mus musculus
gagcatctgttttctgacatcacct

SEQ ID NO: 478522 - DNA, 25 bp, Mus musculus
gagcatcttaacagccccagacctg

SEQ ID NO: 478523 - DNA, 25 bp, Mus musculus
gagcatcttaactgccccagacctg

SEQ ID NO: 478524 - DNA, 25 bp, Mus musculus
gagcatcttagaaactttgtacttt

SEQ ID NO: 478525 - DNA, 25 bp, Mus musculus
gagcatcttagactgagccacatca

SEQ ID NO: 478526 - DNA, 25 bp, Mus musculus
gagcatcttagagtgagccacatca

SEQ ID NO: 478527 - DNA, 25 bp, Mus musculus
gagcatcttagatactttgtacttt

SEQ ID NO: 478528 - DNA, 25 bp, Mus musculus
gagcatcttagccaagctgcaggaa

SEQ ID NO: 478529 - DNA, 25 bp, Mus musculus
gagcatcttagcgaagctgcaggaa

SEQ ID NO: 478530 - DNA, 25 bp, Mus musculus
gagcatcttcccagtgagaggatcc

SEQ ID NO: 478531 - DNA, 25 bp, Mus musculus
gagcatcttccctgtgagaggatcc

SEQ ID NO: 478532 - DNA, 25 bp, Mus musculus
gagcatcttcctctaatctattata

SEQ ID NO: 478533 - DNA, 25 bp, Mus musculus
gagcatcttcctctgaatttgtcag

SEQ ID NO: 478534 - DNA, 25 bp, Mus musculus
gagcatcttcctgtaatctattata

SEQ ID NO: 478535 - DNA, 25 bp, Mus musculus
gagcatcttcctgtgaatttgtcag

SEQ ID NO: 478536 - DNA, 25 bp, Mus musculus
gagcatcttctccagatcctatgag

SEQ ID NO: 478537 - DNA, 25 bp, Mus musculus
gagcatcttctcgagatcctatgag

SEQ ID NO: 478538 - DNA, 25 bp, Mus musculus
gagcatcttgctacatatttttatt

SEQ ID NO: 478539 - DNA, 25 bp, Mus musculus
gagcatcttgcttcatatttttatt

SEQ ID NO: 478540 - DNA, 25 bp, Mus musculus
gagcatcttggaacagaacttcctg

SEQ ID NO: 478541 - DNA, 25 bp, Mus musculus
gagcatcttggatcagaacttcctg

SEQ ID NO: 478542 - DNA, 25 bp, Mus musculus
gagcatcttgtactgtcactgtttt

SEQ ID NO: 478543 - DNA, 25 bp, Mus musculus
gagcatcttgtagtgtcactgtttt

SEQ ID NO: 478544 - DNA, 25 bp, Mus musculus
gagcatctttctaggaagtcagagc

SEQ ID NO: 478545 - DNA, 25 bp, Mus musculus
gagcatctttcttggaagtcagagc

SEQ ID NO: 478546 - DNA, 25 bp, Mus musculus
gagcatctttgactgagagttactt

SEQ ID NO: 478547 - DNA, 25 bp, Mus musculus
gagcatctttgagtgagagttactt

SEQ ID NO: 478548 - DNA, 25 bp, Mus musculus
gagcatctttttcaatcctgatttc

SEQ ID NO: 478549 - DNA, 25 bp, Mus musculus
gagcatctttttgaatcctgatttc

SEQ ID NO: 478550 - DNA, 25 bp, Mus musculus
gagcatgaaagaccacacgtacgta

SEQ ID NO: 478551 - DNA, 25 bp, Mus musculus
gagcatgaaagagcacacgtacgta

SEQ ID NO: 478552 - DNA, 25 bp, Mus musculus
gagcatgaacccaggaacagcctaa

SEQ ID NO: 478553 - DNA, 25 bp, Mus musculus
gagcatgaaccctggaacagcctaa

SEQ ID NO: 478554 - DNA, 25 bp, Mus musculus
gagcatgaacctagaccttcatttc

SEQ ID NO: 478555 - DNA, 25 bp, Mus musculus
gagcatgaaccttgaccttcatttc

SEQ ID NO: 478556 - DNA, 25 bp, Mus musculus
gagcatgaagccctgtagcctcctg

SEQ ID NO: 478557 - DNA, 25 bp, Mus musculus
gagcatgaagccgtgtagcctcctg

SEQ ID NO: 478558 - DNA, 25 bp, Mus musculus
gagcatgaaggcctttagtacttaa

SEQ ID NO: 478559 - DNA, 25 bp, Mus musculus
gagcatgaaggcgtttagtacttaa

SEQ ID NO: 478560 - DNA, 25 bp, Mus musculus
gagcatgaccagacgcacagtagca

SEQ ID NO: 478561 - DNA, 25 bp, Mus musculus
gagcatgaccagtcgcacagtagca

SEQ ID NO: 478562 - DNA, 25 bp, Mus musculus
gagcatgacctcatgggacaagctg

SEQ ID NO: 478563 - DNA, 25 bp, Mus musculus
gagcatgacctcttgggacaagctg

SEQ ID NO: 478564 - DNA, 25 bp, Mus musculus
gagcatgacggacgagttctactct

SEQ ID NO: 478565 - DNA, 25 bp, Mus musculus
gagcatgacggaggagttctactct

SEQ ID NO: 478566 - DNA, 25 bp, Mus musculus
gagcatgacgttctatgtgagcaac

SEQ ID NO: 478567 - DNA, 25 bp, Mus musculus
gagcatgacgttgtatgtgagcaac

SEQ ID NO: 478568 - DNA, 25 bp, Mus musculus
gagcatgagaggcatgccagccctt

SEQ ID NO: 478569 - DNA, 25 bp, Mus musculus
gagcatgagagggatgccagccctt

SEQ ID NO: 478570 - DNA, 25 bp, Mus musculus
gagcatgagatcattgcagccgagt

SEQ ID NO: 478571 - DNA, 25 bp, Mus musculus
gagcatgagatcctgagacaccctt

SEQ ID NO: 478572 - DNA, 25 bp, Mus musculus
gagcatgagatcgtgagacaccctt

SEQ ID NO: 478573 - DNA, 25 bp, Mus musculus
gagcatgagatctttgcagccgagt

SEQ ID NO: 478574 - DNA, 25 bp, Mus musculus
gagcatgagcacctaaaccactata

SEQ ID NO: 478575 - DNA, 25 bp, Mus musculus
gagcatgagcacgtaaaccactata

SEQ ID NO: 478576 - DNA, 25 bp, Mus musculus
gagcatgagctgctgactgtccttc

SEQ ID NO: 478577 - DNA, 25 bp, Mus musculus
gagcatgagctggtgactgtccttc

SEQ ID NO: 478578 - DNA, 25 bp, Mus musculus
gagcatgaggaacctgaaccctccg

SEQ ID NO: 478579 - DNA, 25 bp, Mus musculus
gagcatgaggaagctgaaccctccg

SEQ ID NO: 478580 - DNA, 25 bp, Mus musculus
gagcatgatatgacacgtttacaac

SEQ ID NO: 478581 - DNA, 25 bp, Mus musculus
gagcatgatatgtcacgtttacaac

SEQ ID NO: 478582 - DNA, 25 bp, Mus musculus
gagcatgattaccagaaccacattt

SEQ ID NO: 478583 - DNA, 25 bp, Mus musculus
gagcatgattacgagaaccacattt

SEQ ID NO: 478584 - DNA, 25 bp, Mus musculus
gagcatgcacaaccaggcacacagc

SEQ ID NO: 478585 - DNA, 25 bp, Mus musculus
gagcatgcacaagcaggcacacagc

SEQ ID NO: 478586 - DNA, 25 bp, Mus musculus
gagcatgcacagaggcgtgtcccca

SEQ ID NO: 478587 - DNA, 25 bp, Mus musculus
gagcatgcacagtggcgtgtcccca

SEQ ID NO: 478588 - DNA, 25 bp, Mus musculus
gagcatgcagccagcgggatcgtac

SEQ ID NO: 478589 - DNA, 25 bp, Mus musculus
gagcatgcagcctgcgggatcgtac

SEQ ID NO: 478590 - DNA, 25 bp, Mus musculus
gagcatgcagggatccggtagccta

SEQ ID NO: 478591 - DNA, 25 bp, Mus musculus
gagcatgcagggttccggtagccta

SEQ ID NO: 478592 - DNA, 25 bp, Mus musculus
gagcatgcaggtaaccgttctcaca

SEQ ID NO: 478593 - DNA, 25 bp, Mus musculus
gagcatgcaggttaccgttctcaca

SEQ ID NO: 478594 - DNA, 25 bp, Mus musculus
gagcatgcagtcaagtcaacgccgg

SEQ ID NO: 478595 - DNA, 25 bp, Mus musculus
gagcatgcagtctagtcaacgccgg

SEQ ID NO: 478596 - DNA, 25 bp, Mus musculus
gagcatgcattgatcttggaaagac

SEQ ID NO: 478597 - DNA, 25 bp, Mus musculus
gagcatgcattgttcttggaaagac

SEQ ID NO: 478598 - DNA, 25 bp, Mus musculus
gagcatgccagaaagcgaggatcca

SEQ ID NO: 478599 - DNA, 25 bp, Mus musculus
gagcatgccagatagcgaggatcca

SEQ ID NO: 478600 - DNA, 25 bp, Mus musculus
gagcatgccatacgccaagagttga

SEQ ID NO: 478601 - DNA, 25 bp, Mus musculus
gagcatgccataggccaagagttga

SEQ ID NO: 478602 - DNA, 25 bp, Mus musculus
gagcatgcccggacatacatccagt

SEQ ID NO: 478603 - DNA, 25 bp, Mus musculus
gagcatgcccggtcatacatccagt

SEQ ID NO: 478604 - DNA, 25 bp, Mus musculus
gagcatgccggcaggttgtccagca

SEQ ID NO: 478605 - DNA, 25 bp, Mus musculus
gagcatgccggctggttgtccagca

SEQ ID NO: 478606 - DNA, 25 bp, Mus musculus
gagcatgcctaacccaatcaggtag

SEQ ID NO: 478607 - DNA, 25 bp, Mus musculus
gagcatgcctaagccaatcaggtag

SEQ ID NO: 478608 - DNA, 25 bp, Mus musculus
gagcatgccttactgtcaatttaca

SEQ ID NO: 478609 - DNA, 25 bp, Mus musculus
gagcatgccttagtgtcaatttaca

SEQ ID NO: 478610 - DNA, 25 bp, Mus musculus
gagcatgcgcacattcctgattggg

SEQ ID NO: 478611 - DNA, 25 bp, Mus musculus
gagcatgcgcactttcctgattggg

SEQ ID NO: 478612 - DNA, 25 bp, Mus musculus
gagcatgcggcccacagtactgttg

SEQ ID NO: 478613 - DNA, 25 bp, Mus musculus
gagcatgcggccgacagtactgttg

SEQ ID NO: 478614 - DNA, 25 bp, Mus musculus
gagcatgcgtatcagcctctggaaa

SEQ ID NO: 478615 - DNA, 25 bp, Mus musculus
gagcatgcgtatgagcctctggaaa

SEQ ID NO: 478616 - DNA, 25 bp, Mus musculus
gagcatgcgtggaactcatcgcagc

SEQ ID NO: 478617 - DNA, 25 bp, Mus musculus
gagcatgcgtggtactcatcgcagc

SEQ ID NO: 478618 - DNA, 25 bp, Mus musculus
gagcatgctcaacgtgttcctcaag

SEQ ID NO: 478619 - DNA, 25 bp, Mus musculus
gagcatgctcaaggtgttcctcaag

SEQ ID NO: 478620 - DNA, 25 bp, Mus musculus
gagcatgctcctattattatataaa

SEQ ID NO: 478621 - DNA, 25 bp, Mus musculus
gagcatgctcctcgaaacctggaat

SEQ ID NO: 478622 - DNA, 25 bp, Mus musculus
gagcatgctcctggaaacctggaat

SEQ ID NO: 478623 - DNA, 25 bp, Mus musculus
gagcatgctccttttattatataaa

SEQ ID NO: 478624 - DNA, 25 bp, Mus musculus
gagcatgctgccatatgattttcat

SEQ ID NO: 478625 - DNA, 25 bp, Mus musculus
gagcatgctgccttatgattttcat

SEQ ID NO: 478626 - DNA, 25 bp, Mus musculus
gagcatgctggcacagtgcctcaca

SEQ ID NO: 478627 - DNA, 25 bp, Mus musculus
gagcatgctggctcagtgcctcaca

SEQ ID NO: 478628 - DNA, 25 bp, Mus musculus
gagcatgctggtaagttttgccctc

SEQ ID NO: 478629 - DNA, 25 bp, Mus musculus
gagcatgctggttagttttgccctc

SEQ ID NO: 478630 - DNA, 25 bp, Mus musculus
gagcatgcttggagaatcttgcaaa

SEQ ID NO: 478631 - DNA, 25 bp, Mus musculus
gagcatgcttggtgaatcttgcaaa

SEQ ID NO: 478632 - DNA, 25 bp, Mus musculus
gagcatgctttacctcacctagagc

SEQ ID NO: 478633 - DNA, 25 bp, Mus musculus
gagcatgctttagctcacctagagc

SEQ ID NO: 478634 - DNA, 25 bp, Mus musculus
gagcatgctttgctgtggtcttcac

SEQ ID NO: 478635 - DNA, 25 bp, Mus musculus
gagcatgctttggtgtggtcttcac

SEQ ID NO: 478636 - DNA, 25 bp, Mus musculus
gagcatggacccaaggatccttcag

SEQ ID NO: 478637 - DNA, 25 bp, Mus musculus
gagcatggaccctaggatccttcag

SEQ ID NO: 478638 - DNA, 25 bp, Mus musculus
gagcatggacctagtgccagatgaa

SEQ ID NO: 478639 - DNA, 25 bp, Mus musculus
gagcatggaccttgtgccagatgaa

SEQ ID NO: 478640 - DNA, 25 bp, Mus musculus
gagcatggagaaaatcacctgtatg

SEQ ID NO: 478641 - DNA, 25 bp, Mus musculus
gagcatggagaatatcacctgtatg

SEQ ID NO: 478642 - DNA, 25 bp, Mus musculus
gagcatggagtaactcaaagccttc

SEQ ID NO: 478643 - DNA, 25 bp, Mus musculus
gagcatggagtatctcaaagccttc

SEQ ID NO: 478644 - DNA, 25 bp, Mus musculus
gagcatggagtgacttgtgcaagta

SEQ ID NO: 478645 - DNA, 25 bp, Mus musculus
gagcatggagtgcaaacctctacag

SEQ ID NO: 478646 - DNA, 25 bp, Mus musculus
gagcatggagtggaaacctctacag

SEQ ID NO: 478647 - DNA, 25 bp, Mus musculus
gagcatggagtgtcttgtgcaagta

SEQ ID NO: 478648 - DNA, 25 bp, Mus musculus
gagcatggccagctaagtgacgcat

SEQ ID NO: 478649 - DNA, 25 bp, Mus musculus
gagcatggccaggtaagtgacgcat

SEQ ID NO: 478650 - DNA, 25 bp, Mus musculus
gagcatggcctgactttttaaaaga

SEQ ID NO: 478651 - DNA, 25 bp, Mus musculus
gagcatggcctgtctttttaaaaga

SEQ ID NO: 478652 - DNA, 25 bp, Mus musculus
gagcatggcgggactcttcagtgac

SEQ ID NO: 478653 - DNA, 25 bp, Mus musculus
gagcatggcgggtctcttcagtgac

SEQ ID NO: 478654 - DNA, 25 bp, Mus musculus
gagcatggctaaacctgtgttgttt

SEQ ID NO: 478655 - DNA, 25 bp, Mus musculus
gagcatggctaatcctgtgttgttt

SEQ ID NO: 478656 - DNA, 25 bp, Mus musculus
gagcatggctgactgtgttgtatct

SEQ ID NO: 478657 - DNA, 25 bp, Mus musculus
gagcatggctgagtgtgttgtatct

SEQ ID NO: 478658 - DNA, 25 bp, Mus musculus
gagcatggcttcagtttgcatcagt

SEQ ID NO: 478659 - DNA, 25 bp, Mus musculus
gagcatggcttctgtttgcatcagt

SEQ ID NO: 478660 - DNA, 25 bp, Mus musculus
gagcatgggacaccctggttccaaa

SEQ ID NO: 478661 - DNA, 25 bp, Mus musculus
gagcatgggacaccctggttgcaaa

SEQ ID NO: 478662 - DNA, 25 bp, Mus musculus
gagcatgggacagcctggttccaaa

SEQ ID NO: 478663 - DNA, 25 bp, Mus musculus
gagcatgggacagcctggttgcaaa

SEQ ID NO: 478664 - DNA, 25 bp, Mus musculus
gagcatgggcgcaggactcctgctt

SEQ ID NO: 478665 - DNA, 25 bp, Mus musculus
gagcatgggcgctggactcctgctt

SEQ ID NO: 478666 - DNA, 25 bp, Mus musculus
gagcatgggctcaagatgaaacctt

SEQ ID NO: 478667 - DNA, 25 bp, Mus musculus
gagcatgggctctagatgaaacctt

SEQ ID NO: 478668 - DNA, 25 bp, Mus musculus
gagcatggtacgagcttaccttttt

SEQ ID NO: 478669 - DNA, 25 bp, Mus musculus
gagcatggtacgtgcttaccttttt

SEQ ID NO: 478670 - DNA, 25 bp, Mus musculus
gagcatggtatgagcacaggcccag

SEQ ID NO: 478671 - DNA, 25 bp, Mus musculus
gagcatggtatgtgcacaggcccag

SEQ ID NO: 478672 - DNA, 25 bp, Mus musculus
gagcatgtactgcagcacccacagt

SEQ ID NO: 478673 - DNA, 25 bp, Mus musculus
gagcatgtactggagcacccacagt

SEQ ID NO: 478674 - DNA, 25 bp, Mus musculus
gagcatgtccacaatttcagtgact

SEQ ID NO: 478675 - DNA, 25 bp, Mus musculus
gagcatgtccactatttcagtgact

SEQ ID NO: 478676 - DNA, 25 bp, Mus musculus
gagcatgtctccaggaaagcgagca

SEQ ID NO: 478677 - DNA, 25 bp, Mus musculus
gagcatgtctcctggaaagcgagca

SEQ ID NO: 478678 - DNA, 25 bp, Mus musculus
gagcatgtctttaacatccttgttt

SEQ ID NO: 478679 - DNA, 25 bp, Mus musculus
gagcatgtctttatactcattttaa

SEQ ID NO: 478680 - DNA, 25 bp, Mus musculus
gagcatgtcttttacatccttgttt

SEQ ID NO: 478681 - DNA, 25 bp, Mus musculus
gagcatgtctttttactcattttaa

SEQ ID NO: 478682 - DNA, 25 bp, Mus musculus
gagcatgtgaccaggtatggccaat

SEQ ID NO: 478683 - DNA, 25 bp, Mus musculus
gagcatgtgacctggtatggccaat

SEQ ID NO: 478684 - DNA, 25 bp, Mus musculus
gagcatgtgatgacaagacaccttc

SEQ ID NO: 478685 - DNA, 25 bp, Mus musculus
gagcatgtgatgtcaagacaccttc

SEQ ID NO: 478686 - DNA, 25 bp, Mus musculus
gagcatgtgcagactggtctagcta

SEQ ID NO: 478687 - DNA, 25 bp, Mus musculus
gagcatgtgcagctgtttgacctga

SEQ ID NO: 478688 - DNA, 25 bp, Mus musculus
gagcatgtgcaggtgtttgacctga

SEQ ID NO: 478689 - DNA, 25 bp, Mus musculus
gagcatgtgcagtctggtctagcta

SEQ ID NO: 478690 - DNA, 25 bp, Mus musculus
gagcatgtgctcatgttcacaggac

SEQ ID NO: 478691 - DNA, 25 bp, Mus musculus
gagcatgtgctcttgttcacaggac

SEQ ID NO: 478692 - DNA, 25 bp, Mus musculus
gagcatgtgcttattgatgtgggaa

SEQ ID NO: 478693 - DNA, 25 bp, Mus musculus
gagcatgtgctttttgatgtgggaa

SEQ ID NO: 478694 - DNA, 25 bp, Mus musculus
gagcatgtggtaactatttttccta

SEQ ID NO: 478695 - DNA, 25 bp, Mus musculus
gagcatgtggtatctatttttccta

SEQ ID NO: 478696 - DNA, 25 bp, Mus musculus
gagcatgtgtacatctcattgtcac

SEQ ID NO: 478697 - DNA, 25 bp, Mus musculus
gagcatgtgtacttctcattgtcac

SEQ ID NO: 478698 - DNA, 25 bp, Mus musculus
gagcatgtgtggacctaagaagcaa

SEQ ID NO: 478699 - DNA, 25 bp, Mus musculus
gagcatgtgtggtcctaagaagcaa

SEQ ID NO: 478700 - DNA, 25 bp, Mus musculus
gagcatgttagtcatatctacccaa

SEQ ID NO: 478701 - DNA, 25 bp, Mus musculus
gagcatgttagtgatatctacccaa

SEQ ID NO: 478702 - DNA, 25 bp, Mus musculus
gagcatgttataatcttgtaaaaaa

SEQ ID NO: 478703 - DNA, 25 bp, Mus musculus
gagcatgttatattcttgtaaaaaa

SEQ ID NO: 478704 - DNA, 25 bp, Mus musculus
gagcatgttcaacctcttggagatg

SEQ ID NO: 478705 - DNA, 25 bp, Mus musculus
gagcatgttcaagctcttggagatg

SEQ ID NO: 478706 - DNA, 25 bp, Mus musculus
gagcatgttcacaggcacagccgag

SEQ ID NO: 478707 - DNA, 25 bp, Mus musculus
gagcatgttcactggcacagccgag

SEQ ID NO: 478708 - DNA, 25 bp, Mus musculus
gagcatgttcatcttttcttgtcac

SEQ ID NO: 478709 - DNA, 25 bp, Mus musculus
gagcatgttcatgttttcttgtcac

SEQ ID NO: 478710 - DNA, 25 bp, Mus musculus
gagcatgtttcccagtggccggaca

SEQ ID NO: 478711 - DNA, 25 bp, Mus musculus
gagcatgtttccgagtggccggaca

SEQ ID NO: 478712 - DNA, 25 bp, Mus musculus
gagcattaaactcgtctccacatcc

SEQ ID NO: 478713 - DNA, 25 bp, Mus musculus
gagcattaaactggtctccacatcc

SEQ ID NO: 478714 - DNA, 25 bp, Mus musculus
gagcattaactaccctacagaagcc

SEQ ID NO: 478715 - DNA, 25 bp, Mus musculus
gagcattaactagcctacagaagcc

SEQ ID NO: 478716 - DNA, 25 bp, Mus musculus
gagcattaagcccaagaacatcgtg

SEQ ID NO: 478717 - DNA, 25 bp, Mus musculus
gagcattaagccgaagaacatcgtg

SEQ ID NO: 478718 - DNA, 25 bp, Mus musculus
gagcattaatctatccctagggatg

SEQ ID NO: 478719 - DNA, 25 bp, Mus musculus
gagcattaatctttccctagggatg

SEQ ID NO: 478720 - DNA, 25 bp, Mus musculus
gagcattactagagttatgcaaata

SEQ ID NO: 478721 - DNA, 25 bp, Mus musculus
gagcattactagtgttatgcaaata

SEQ ID NO: 478722 - DNA, 25 bp, Mus musculus
gagcattactccaacaaggcactga

SEQ ID NO: 478723 - DNA, 25 bp, Mus musculus
gagcattactcctacaaggcactga

SEQ ID NO: 478724 - DNA, 25 bp, Mus musculus
gagcattagatacaagcccaggcaa

SEQ ID NO: 478725 - DNA, 25 bp, Mus musculus
gagcattagatagaagcccaggcaa

SEQ ID NO: 478726 - DNA, 25 bp, Mus musculus
gagcattagcacaaaaacccctctg

SEQ ID NO: 478727 - DNA, 25 bp, Mus musculus
gagcattagcactaaaacccctctg

SEQ ID NO: 478728 - DNA, 25 bp, Mus musculus
gagcattagccaccttcagattaac

SEQ ID NO: 478729 - DNA, 25 bp, Mus musculus
gagcattagccagcttcagattaac

SEQ ID NO: 478730 - DNA, 25 bp, Mus musculus
gagcattagctgaactgagcaggct

SEQ ID NO: 478731 - DNA, 25 bp, Mus musculus
gagcattagctgtactgagcaggct

SEQ ID NO: 478732 - DNA, 25 bp, Mus musculus
gagcattagtatacattggcacatc

SEQ ID NO: 478733 - DNA, 25 bp, Mus musculus
gagcattagtattcattggcacatc

SEQ ID NO: 478734 - DNA, 25 bp, Mus musculus
gagcattagtcaagcatgtaggaat

SEQ ID NO: 478735 - DNA, 25 bp, Mus musculus
gagcattagtcatgcatgtaggaat

SEQ ID NO: 478736 - DNA, 25 bp, Mus musculus
gagcattagtttactcatgtgccaa

SEQ ID NO: 478737 - DNA, 25 bp, Mus musculus
gagcattagttttctcatgtgccaa

SEQ ID NO: 478738 - DNA, 25 bp, Mus musculus
gagcattattgcagtagctgccacc

SEQ ID NO: 478739 - DNA, 25 bp, Mus musculus
gagcattattgctgtagctgccacc

SEQ ID NO: 478740 - DNA, 25 bp, Mus musculus
gagcattcacccatattagttggtg

SEQ ID NO: 478741 - DNA, 25 bp, Mus musculus
gagcattcacccttattagttggtg

SEQ ID NO: 478742 - DNA, 25 bp, Mus musculus
gagcattcagatcatcccaaattag

SEQ ID NO: 478743 - DNA, 25 bp, Mus musculus
gagcattcagatgatcccaaattag

SEQ ID NO: 478744 - DNA, 25 bp, Mus musculus
gagcattccctaagagttgtcacag

SEQ ID NO: 478745 - DNA, 25 bp, Mus musculus
gagcattccctatgagttgtcacag

SEQ ID NO: 478746 - DNA, 25 bp, Mus musculus
gagcattcctgcaaacacagagaga

SEQ ID NO: 478747 - DNA, 25 bp, Mus musculus
gagcattcctgctaacacagagaga

SEQ ID NO: 478748 - DNA, 25 bp, Mus musculus
gagcattcgggtcgctccgtaactt

SEQ ID NO: 478749 - DNA, 25 bp, Mus musculus
gagcattcgggtggctccgtaactt

SEQ ID NO: 478750 - DNA, 25 bp, Mus musculus
gagcattcgtacaccagggctcgct

SEQ ID NO: 478751 - DNA, 25 bp, Mus musculus
gagcattcgtactccagggctcgct

SEQ ID NO: 478752 - DNA, 25 bp, Mus musculus
gagcattcgtgtaacttctgagaca

SEQ ID NO: 478753 - DNA, 25 bp, Mus musculus
gagcattcgtgttacttctgagaca

SEQ ID NO: 478754 - DNA, 25 bp, Mus musculus
gagcattctaagctagctggaagac

SEQ ID NO: 478755 - DNA, 25 bp, Mus musculus
gagcattctaaggtagctggaagac

SEQ ID NO: 478756 - DNA, 25 bp, Mus musculus
gagcattctctcagatcattctttg

SEQ ID NO: 478757 - DNA, 25 bp, Mus musculus
gagcattctctctgatcattctttg

SEQ ID NO: 478758 - DNA, 25 bp, Mus musculus
gagcattctggcacctttagagaaa

SEQ ID NO: 478759 - DNA, 25 bp, Mus musculus
gagcattctggctcctttagagaaa

SEQ ID NO: 478760 - DNA, 25 bp, Mus musculus
gagcattcttctaggctgaattccc

SEQ ID NO: 478761 - DNA, 25 bp, Mus musculus
gagcattcttcttggctgaattccc

SEQ ID NO: 478762 - DNA, 25 bp, Mus musculus
gagcattgacttcgactcagtgtgt

SEQ ID NO: 478763 - DNA, 25 bp, Mus musculus
gagcattgacttggactcagtgtgt

SEQ ID NO: 478764 - DNA, 25 bp, Mus musculus
gagcattgatgcattccagagaccc

SEQ ID NO: 478765 - DNA, 25 bp, Mus musculus
gagcattgatgctttccagagaccc

SEQ ID NO: 478766 - DNA, 25 bp, Mus musculus
gagcattgcaagctaacaggccagg

SEQ ID NO: 478767 - DNA, 25 bp, Mus musculus
gagcattgcaaggtaacaggccagg

SEQ ID NO: 478768 - DNA, 25 bp, Mus musculus
gagcattgcagcagttcaacctgga

SEQ ID NO: 478769 - DNA, 25 bp, Mus musculus
gagcattgcagctgttcaacctgga

SEQ ID NO: 478770 - DNA, 25 bp, Mus musculus
gagcattgccgtataggttcctgtt

SEQ ID NO: 478771 - DNA, 25 bp, Mus musculus
gagcattgccgtttaggttcctgtt

SEQ ID NO: 478772 - DNA, 25 bp, Mus musculus
gagcattgcggtagctgctttgtac

SEQ ID NO: 478773 - DNA, 25 bp, Mus musculus
gagcattgcggttgctgctttgtac

SEQ ID NO: 478774 - DNA, 25 bp, Mus musculus
gagcattgctggaaatgttccctgt

SEQ ID NO: 478775 - DNA, 25 bp, Mus musculus
gagcattgctggtaatgttccctgt

SEQ ID NO: 478776 - DNA, 25 bp, Mus musculus
gagcattgctgtcctcattaatcat

SEQ ID NO: 478777 - DNA, 25 bp, Mus musculus
gagcattgctgtctttgtttgatta

SEQ ID NO: 478778 - DNA, 25 bp, Mus musculus
gagcattgctgtgctcattaatcat

SEQ ID NO: 478779 - DNA, 25 bp, Mus musculus
gagcattgctgtgtttgtttgatta

SEQ ID NO: 478780 - DNA, 25 bp, Mus musculus
gagcattggaaaatgggttctcctt

SEQ ID NO: 478781 - DNA, 25 bp, Mus musculus
gagcattggaaattgggttctcctt

SEQ ID NO: 478782 - DNA, 25 bp, Mus musculus
gagcattggctcatatgggtaaaat

SEQ ID NO: 478783 - DNA, 25 bp, Mus musculus
gagcattggctcttatgggtaaaat

SEQ ID NO: 478784 - DNA, 25 bp, Mus musculus
gagcattgggttcagatatttggat

SEQ ID NO: 478785 - DNA, 25 bp, Mus musculus
gagcattgggttgagatatttggat

SEQ ID NO: 478786 - DNA, 25 bp, Mus musculus
gagcattggtctctgagattttcat

SEQ ID NO: 478787 - DNA, 25 bp, Mus musculus
gagcattggtctgtgagattttcat

SEQ ID NO: 478788 - DNA, 25 bp, Mus musculus
gagcattgtgacagcatccagggac

SEQ ID NO: 478789 - DNA, 25 bp, Mus musculus
gagcattgtgactgcatccagggac

SEQ ID NO: 478790 - DNA, 25 bp, Mus musculus
gagcattgtgctcttgcgataccgt

SEQ ID NO: 478791 - DNA, 25 bp, Mus musculus
gagcattgtgctgttgcgataccgt

SEQ ID NO: 478792 - DNA, 25 bp, Mus musculus
gagcattgttatattgtgatttaaa

SEQ ID NO: 478793 - DNA, 25 bp, Mus musculus
gagcattgttattttgtgatttaaa

SEQ ID NO: 478794 - DNA, 25 bp, Mus musculus
gagcattgttgaaaaccactcttaa

SEQ ID NO: 478795 - DNA, 25 bp, Mus musculus
gagcattgttgataaccactcttaa

SEQ ID NO: 478796 - DNA, 25 bp, Mus musculus
gagcattgtttgatcttgtagagga

SEQ ID NO: 478797 - DNA, 25 bp, Mus musculus
gagcattgtttgttcttgtagagga

SEQ ID NO: 478798 - DNA, 25 bp, Mus musculus
gagcatttaaaccactgcggatgtc

SEQ ID NO: 478799 - DNA, 25 bp, Mus musculus
gagcatttaaacgactgcggatgtc

SEQ ID NO: 478800 - DNA, 25 bp, Mus musculus
gagcatttaagacctcaaagcccca

SEQ ID NO: 478801 - DNA, 25 bp, Mus musculus
gagcatttaagagctcaaagcccca

SEQ ID NO: 478802 - DNA, 25 bp, Mus musculus
gagcatttagcaaagggccggacaa

SEQ ID NO: 478803 - DNA, 25 bp, Mus musculus
gagcatttagcatagggccggacaa

SEQ ID NO: 478804 - DNA, 25 bp, Mus musculus
gagcatttatcccttacatttcttc

SEQ ID NO: 478805 - DNA, 25 bp, Mus musculus
gagcatttatccgttacatttcttc

SEQ ID NO: 478806 - DNA, 25 bp, Mus musculus
gagcatttcagcagggagatctccc

SEQ ID NO: 478807 - DNA, 25 bp, Mus musculus
gagcatttcagctgggagatctccc

SEQ ID NO: 478808 - DNA, 25 bp, Mus musculus
gagcatttcatgacagggagcctct

SEQ ID NO: 478809 - DNA, 25 bp, Mus musculus
gagcatttcatgtcagggagcctct

SEQ ID NO: 478810 - DNA, 25 bp, Mus musculus
gagcatttccgcatagacatcttcg

SEQ ID NO: 478811 - DNA, 25 bp, Mus musculus
gagcatttccgcttagacatcttcg

SEQ ID NO: 478812 - DNA, 25 bp, Mus musculus
gagcatttcctaatccactggattg

SEQ ID NO: 478813 - DNA, 25 bp, Mus musculus
gagcatttcctacaagcatcatcct

SEQ ID NO: 478814 - DNA, 25 bp, Mus musculus
gagcatttcctagaagcatcatcct

SEQ ID NO: 478815 - DNA, 25 bp, Mus musculus
gagcatttcctattccactggattg

SEQ ID NO: 478816 - DNA, 25 bp, Mus musculus
gagcatttcgtgagcgccttttgcc

SEQ ID NO: 478817 - DNA, 25 bp, Mus musculus
gagcatttcgtgtgcgccttttgcc

SEQ ID NO: 478818 - DNA, 25 bp, Mus musculus
gagcatttctcactatccctgagca

SEQ ID NO: 478819 - DNA, 25 bp, Mus musculus
gagcatttctcagtatccctgagca

SEQ ID NO: 478820 - DNA, 25 bp, Mus musculus
gagcatttctgactgtaggccatta

SEQ ID NO: 478821 - DNA, 25 bp, Mus musculus
gagcatttctgagtgtaggccatta

SEQ ID NO: 478822 - DNA, 25 bp, Mus musculus
gagcatttcttaatcctagttgttg

SEQ ID NO: 478823 - DNA, 25 bp, Mus musculus
gagcatttcttattcctagttgttg

SEQ ID NO: 478824 - DNA, 25 bp, Mus musculus
gagcatttgaggactaattctgaat

SEQ ID NO: 478825 - DNA, 25 bp, Mus musculus
gagcatttgaggtctaattctgaat

SEQ ID NO: 478826 - DNA, 25 bp, Mus musculus
gagcatttgcgcctgttcttcattt

SEQ ID NO: 478827 - DNA, 25 bp, Mus musculus
gagcatttgcgcgtgttcttcattt

SEQ ID NO: 478828 - DNA, 25 bp, Mus musculus
gagcatttgctgaaacgcgctctca

SEQ ID NO: 478829 - DNA, 25 bp, Mus musculus
gagcatttgctgtaacgcgctctca

SEQ ID NO: 478830 - DNA, 25 bp, Mus musculus
gagcatttgggcaccaggttcccag

SEQ ID NO: 478831 - DNA, 25 bp, Mus musculus
gagcatttgggctccaggttcccag

SEQ ID NO: 478832 - DNA, 25 bp, Mus musculus
gagcatttgttacacctcacatgtg

SEQ ID NO: 478833 - DNA, 25 bp, Mus musculus
gagcatttgttagacctcacatgtg

SEQ ID NO: 478834 - DNA, 25 bp, Mus musculus
gagcatttgttgatctggtagagga

SEQ ID NO: 478835 - DNA, 25 bp, Mus musculus
gagcatttgttgttctggtagagga

SEQ ID NO: 478836 - DNA, 25 bp, Mus musculus
gagcatttgtttccaccctatttat

SEQ ID NO: 478837 - DNA, 25 bp, Mus musculus
gagcatttgtttgcaccctatttat

SEQ ID NO: 478838 - DNA, 25 bp, Mus musculus
gagcattttaaaccaacctgggtca

SEQ ID NO: 478839 - DNA, 25 bp, Mus musculus
gagcattttaaacctttgcacacaa

SEQ ID NO: 478840 - DNA, 25 bp, Mus musculus
gagcattttaaagcaacctgggtca

SEQ ID NO: 478841 - DNA, 25 bp, Mus musculus
gagcattttaaagctttgcacacaa

SEQ ID NO: 478842 - DNA, 25 bp, Mus musculus
gagcattttcaaatttctctcgttt

SEQ ID NO: 478843 - DNA, 25 bp, Mus musculus
gagcattttcaattttctctcgttt

SEQ ID NO: 478844 - DNA, 25 bp, Mus musculus
gagcattttcttacattagcttaac

SEQ ID NO: 478845 - DNA, 25 bp, Mus musculus
gagcattttcttccgtgaggttgcc

SEQ ID NO: 478846 - DNA, 25 bp, Mus musculus
gagcattttcttgcgtgaggttgcc

SEQ ID NO: 478847 - DNA, 25 bp, Mus musculus
gagcattttctttcattagcttaac

SEQ ID NO: 478848 - DNA, 25 bp, Mus musculus
gagcattttgagacattcctcattt

SEQ ID NO: 478849 - DNA, 25 bp, Mus musculus
gagcattttgagtcattcctcattt

SEQ ID NO: 478850 - DNA, 25 bp, Mus musculus
gagcattttgtcatctcatacgaaa

SEQ ID NO: 478851 - DNA, 25 bp, Mus musculus
gagcattttgtcttctcatacgaaa

SEQ ID NO: 478852 - DNA, 25 bp, Mus musculus
gagcattttttacccaggtgtttgt

SEQ ID NO: 478853 - DNA, 25 bp, Mus musculus
gagcattttttagccaggtgtttgt

SEQ ID NO: 478854 - DNA, 25 bp, Mus musculus
gagccaaaaattacacagccttcag

SEQ ID NO: 478855 - DNA, 25 bp, Mus musculus
gagccaaaaatttcacagccttcag

SEQ ID NO: 478856 - DNA, 25 bp, Mus musculus
gagccaaaacagaggagccgatcaa

SEQ ID NO: 478857 - DNA, 25 bp, Mus musculus
gagccaaaacagtggagccgatcaa

SEQ ID NO: 478858 - DNA, 25 bp, Mus musculus
gagccaaaaccgaaggagcaccctg

SEQ ID NO: 478859 - DNA, 25 bp, Mus musculus
gagccaaaaccgtaggagcaccctg

SEQ ID NO: 478860 - DNA, 25 bp, Mus musculus
gagccaaaagcacatagtcatcaga

SEQ ID NO: 478861 - DNA, 25 bp, Mus musculus
gagccaaaagcagatagtcatcaga

SEQ ID NO: 478862 - DNA, 25 bp, Mus musculus
gagccaaaagctattccagaactta

SEQ ID NO: 478863 - DNA, 25 bp, Mus musculus
gagccaaaagcttttccagaactta

SEQ ID NO: 478864 - DNA, 25 bp, Mus musculus
gagccaaaccagcaagtctgataat

SEQ ID NO: 478865 - DNA, 25 bp, Mus musculus
gagccaaaccaggaagtctgataat

SEQ ID NO: 478866 - DNA, 25 bp, Mus musculus
gagccaaacccacattatagaggac

SEQ ID NO: 478867 - DNA, 25 bp, Mus musculus
gagccaaacccagattatagaggac

SEQ ID NO: 478868 - DNA, 25 bp, Mus musculus
gagccaaaccccagtaaggatgaga

SEQ ID NO: 478869 - DNA, 25 bp, Mus musculus
gagccaaacccctgtaaggatgaga

SEQ ID NO: 478870 - DNA, 25 bp, Mus musculus
gagccaaaccctcttgaacacaaat

SEQ ID NO: 478871 - DNA, 25 bp, Mus musculus
gagccaaaccctgttgaacacaaat

SEQ ID NO: 478872 - DNA, 25 bp, Mus musculus
gagccaaaccggctctctctttaag

SEQ ID NO: 478873 - DNA, 25 bp, Mus musculus
gagccaaaccgggtctctctttaag

SEQ ID NO: 478874 - DNA, 25 bp, Mus musculus
gagccaaacctacctagtgttctac

SEQ ID NO: 478875 - DNA, 25 bp, Mus musculus
gagccaaacctagctagtgttctac

SEQ ID NO: 478876 - DNA, 25 bp, Mus musculus
gagccaaaccttactagttgtcatg

SEQ ID NO: 478877 - DNA, 25 bp, Mus musculus
gagccaaacctttctagttgtcatg

SEQ ID NO: 478878 - DNA, 25 bp, Mus musculus
gagccaaacggtaggcaccactcta

SEQ ID NO: 478879 - DNA, 25 bp, Mus musculus
gagccaaacggttggcaccactcta

SEQ ID NO: 478880 - DNA, 25 bp, Mus musculus
gagccaaactaacgtctgtcagtca

SEQ ID NO: 478881 - DNA, 25 bp, Mus musculus
gagccaaactaaggtctgtcagtca

SEQ ID NO: 478882 - DNA, 25 bp, Mus musculus
gagccaaagaacagccgtgttgccc

SEQ ID NO: 478883 - DNA, 25 bp, Mus musculus
gagccaaagaactgccgtgttgccc

SEQ ID NO: 478884 - DNA, 25 bp, Mus musculus
gagccaaagactccgcttcggagca

SEQ ID NO: 478885 - DNA, 25 bp, Mus musculus
gagccaaagactgcgcttcggagca

SEQ ID NO: 478886 - DNA, 25 bp, Mus musculus
gagccaaagaggaacttgccagaac

SEQ ID NO: 478887 - DNA, 25 bp, Mus musculus
gagccaaagaggtacttgccagaac

SEQ ID NO: 478888 - DNA, 25 bp, Mus musculus
gagccaaagctacaaccagggataa

SEQ ID NO: 478889 - DNA, 25 bp, Mus musculus
gagccaaagctagaaccagggataa

SEQ ID NO: 478890 - DNA, 25 bp, Mus musculus
gagccaaagtagcaaaccatcctgt

SEQ ID NO: 478891 - DNA, 25 bp, Mus musculus
gagccaaagtaggaaaccatcctgt

SEQ ID NO: 478892 - DNA, 25 bp, Mus musculus
gagccaaagttacatcagtggttct

SEQ ID NO: 478893 - DNA, 25 bp, Mus musculus
gagccaaagttagatcagtggttct

SEQ ID NO: 478894 - DNA, 25 bp, Mus musculus
gagccaaatcaaaatttatcgtact

SEQ ID NO: 478895 - DNA, 25 bp, Mus musculus
gagccaaatcaatatttatcgtact

SEQ ID NO: 478896 - DNA, 25 bp, Mus musculus
gagccaaatctccagtaaacgcact

SEQ ID NO: 478897 - DNA, 25 bp, Mus musculus
gagccaaatctcgagtaaacgcact

SEQ ID NO: 478898 - DNA, 25 bp, Mus musculus
gagccaaatgttactcctctgtgac

SEQ ID NO: 478899 - DNA, 25 bp, Mus musculus
gagccaaatgtttctcctctgtgac

SEQ ID NO: 478900 - DNA, 25 bp, Mus musculus
gagccaacactcaggagcctcccca

SEQ ID NO: 478901 - DNA, 25 bp, Mus musculus
gagccaacactctggagcctcccca

SEQ ID NO: 478902 - DNA, 25 bp, Mus musculus
gagccaacagcgctggaccagtgac

SEQ ID NO: 478903 - DNA, 25 bp, Mus musculus
gagccaacagcggtggaccagtgac

SEQ ID NO: 478904 - DNA, 25 bp, Mus musculus
gagccaacagctactcattctaaag

SEQ ID NO: 478905 - DNA, 25 bp, Mus musculus
gagccaacagcttctcattctaaag

SEQ ID NO: 478906 - DNA, 25 bp, Mus musculus
gagccaacagtcaggttgtgctagt

SEQ ID NO: 478907 - DNA, 25 bp, Mus musculus
gagccaacagtctggttgtgctagt

SEQ ID NO: 478908 - DNA, 25 bp, Mus musculus
gagccaacatctatcacaggctttt

SEQ ID NO: 478909 - DNA, 25 bp, Mus musculus
gagccaacatctttcacaggctttt

SEQ ID NO: 478910 - DNA, 25 bp, Mus musculus
gagccaacatgtcaccgggacctgt

SEQ ID NO: 478911 - DNA, 25 bp, Mus musculus
gagccaacatgtgaccgggacctgt

SEQ ID NO: 478912 - DNA, 25 bp, Mus musculus
gagccaaccagccagttgttgactg

SEQ ID NO: 478913 - DNA, 25 bp, Mus musculus
gagccaaccagcgagttgttgactg

SEQ ID NO: 478914 - DNA, 25 bp, Mus musculus
gagccaaccgtgatgccctggtgaa

SEQ ID NO: 478915 - DNA, 25 bp, Mus musculus
gagccaaccgtgttgccctggtgaa

SEQ ID NO: 478916 - DNA, 25 bp, Mus musculus
gagccaacctcaattgtgctgggaa

SEQ ID NO: 478917 - DNA, 25 bp, Mus musculus
gagccaacctcatttgtgctgggaa

SEQ ID NO: 478918 - DNA, 25 bp, Mus musculus
gagccaacggccagttccttaatgg

SEQ ID NO: 478919 - DNA, 25 bp, Mus musculus
gagccaacggcctgttccttaatgg

SEQ ID NO: 478920 - DNA, 25 bp, Mus musculus
gagccaactcagaatgcattgccat

SEQ ID NO: 478921 - DNA, 25 bp, Mus musculus
gagccaactcagtatgcattgccat

SEQ ID NO: 478922 - DNA, 25 bp, Mus musculus
gagccaactcgtcgcatttgaggca

SEQ ID NO: 478923 - DNA, 25 bp, Mus musculus
gagccaactcgtggcatttgaggca

SEQ ID NO: 478924 - DNA, 25 bp, Mus musculus
gagccaactgacaaagcctggagta

SEQ ID NO: 478925 - DNA, 25 bp, Mus musculus
gagccaactgactaagcctggagta

SEQ ID NO: 478926 - DNA, 25 bp, Mus musculus
gagccaactttcacagggtgttaca

SEQ ID NO: 478927 - DNA, 25 bp, Mus musculus
gagccaactttctcagggtgttaca

SEQ ID NO: 478928 - DNA, 25 bp, Mus musculus
gagccaagaacccaattgtctgaag

SEQ ID NO: 478929 - DNA, 25 bp, Mus musculus
gagccaagaaccgaattgtctgaag

SEQ ID NO: 478930 - DNA, 25 bp, Mus musculus
gagccaagaagacagcttttccact

SEQ ID NO: 478931 - DNA, 25 bp, Mus musculus
gagccaagaagagagcttttccact

SEQ ID NO: 478932 - DNA, 25 bp, Mus musculus
gagccaagactcctcatcagtggta

SEQ ID NO: 478933 - DNA, 25 bp, Mus musculus
gagccaagactcgtcatcagtggta

SEQ ID NO: 478934 - DNA, 25 bp, Mus musculus
gagccaagactgctggatcctctgg

SEQ ID NO: 478935 - DNA, 25 bp, Mus musculus
gagccaagactggtggatcctctgg

SEQ ID NO: 478936 - DNA, 25 bp, Mus musculus
gagccaagagagcatgttaactact

SEQ ID NO: 478937 - DNA, 25 bp, Mus musculus
gagccaagagaggatgttaactact

SEQ ID NO: 478938 - DNA, 25 bp, Mus musculus
gagccaagagcccacgaagatctcg

SEQ ID NO: 478939 - DNA, 25 bp, Mus musculus
gagccaagagccgacgaagatctcg

SEQ ID NO: 478940 - DNA, 25 bp, Mus musculus
gagccaagagctctaacctcatgtg

SEQ ID NO: 478941 - DNA, 25 bp, Mus musculus
gagccaagagctgtaacctcatgtg

SEQ ID NO: 478942 - DNA, 25 bp, Mus musculus
gagccaagagtgatcttaggtgact

SEQ ID NO: 478943 - DNA, 25 bp, Mus musculus
gagccaagagtgttcttaggtgact

SEQ ID NO: 478944 - DNA, 25 bp, Mus musculus
gagccaagatggctgtcctctctaa

SEQ ID NO: 478945 - DNA, 25 bp, Mus musculus
gagccaagatgggtgtcctctctaa

SEQ ID NO: 478946 - DNA, 25 bp, Mus musculus
gagccaagcacaatctcacaacgat

SEQ ID NO: 478947 - DNA, 25 bp, Mus musculus
gagccaagcacattctcacaacgat

SEQ ID NO: 478948 - DNA, 25 bp, Mus musculus
gagccaagcacccatttctaaaaaa

SEQ ID NO: 478949 - DNA, 25 bp, Mus musculus
gagccaagcaccgatttctaaaaaa

SEQ ID NO: 478950 - DNA, 25 bp, Mus musculus
gagccaagcagtagcaatgtttgtt

SEQ ID NO: 478951 - DNA, 25 bp, Mus musculus
gagccaagcagttgcaatgtttgtt

SEQ ID NO: 478952 - DNA, 25 bp, Mus musculus
gagccaagcatgctgttagacttta

SEQ ID NO: 478953 - DNA, 25 bp, Mus musculus
gagccaagcatggtgttagacttta

SEQ ID NO: 478954 - DNA, 25 bp, Mus musculus
gagccaagccacaacatggaacaca

SEQ ID NO: 478955 - DNA, 25 bp, Mus musculus
gagccaagccactacatggaacaca

SEQ ID NO: 478956 - DNA, 25 bp, Mus musculus
gagccaagctatccaagcaccattg

SEQ ID NO: 478957 - DNA, 25 bp, Mus musculus
gagccaagctatgcaagcaccattg

SEQ ID NO: 478958 - DNA, 25 bp, Mus musculus
gagccaagctttagtggacctttgt

SEQ ID NO: 478959 - DNA, 25 bp, Mus musculus
gagccaagcttttgtggacctttgt

SEQ ID NO: 478960 - DNA, 25 bp, Mus musculus
gagccaaggacaaccgcatcttaga

SEQ ID NO: 478961 - DNA, 25 bp, Mus musculus
gagccaaggacatccgcatcttaga

SEQ ID NO: 478962 - DNA, 25 bp, Mus musculus
gagccaaggcacagaacattctagg

SEQ ID NO: 478963 - DNA, 25 bp, Mus musculus
gagccaaggcactgaacattctagg

SEQ ID NO: 478964 - DNA, 25 bp, Mus musculus
gagccaaggcgccaagtcgtatgta

SEQ ID NO: 478965 - DNA, 25 bp, Mus musculus
gagccaaggcgcgaagtcgtatgta

SEQ ID NO: 478966 - DNA, 25 bp, Mus musculus
gagccaaggctgacctatactataa

SEQ ID NO: 478967 - DNA, 25 bp, Mus musculus
gagccaaggctgtcctatactataa

SEQ ID NO: 478968 - DNA, 25 bp, Mus musculus
gagccaaggcttaatgactgctagg

SEQ ID NO: 478969 - DNA, 25 bp, Mus musculus
gagccaaggctttatgactgctagg

SEQ ID NO: 478970 - DNA, 25 bp, Mus musculus
gagccaagggataacaccccagggt

SEQ ID NO: 478971 - DNA, 25 bp, Mus musculus
gagccaagggattacaccccagggt

SEQ ID NO: 478972 - DNA, 25 bp, Mus musculus
gagccaagggtgctgatatcttcaa

SEQ ID NO: 478973 - DNA, 25 bp, Mus musculus
gagccaagggtggtgatatcttcaa

SEQ ID NO: 478974 - DNA, 25 bp, Mus musculus
gagccaagtatcagggtgcttaatt

SEQ ID NO: 478975 - DNA, 25 bp, Mus musculus
gagccaagtatctgggtgcttaatt

SEQ ID NO: 478976 - DNA, 25 bp, Mus musculus
gagccaagtcatcattattttgagc

SEQ ID NO: 478977 - DNA, 25 bp, Mus musculus
gagccaagtcatgattattttgagc

SEQ ID NO: 478978 - DNA, 25 bp, Mus musculus
gagccaagtctaagcagggatcttt

SEQ ID NO: 478979 - DNA, 25 bp, Mus musculus
gagccaagtctatgcagggatcttt

SEQ ID NO: 478980 - DNA, 25 bp, Mus musculus
gagccaagtgaacgccgtagctgcc

SEQ ID NO: 478981 - DNA, 25 bp, Mus musculus
gagccaagtgaaggccgtagctgcc

SEQ ID NO: 478982 - DNA, 25 bp, Mus musculus
gagccaagtgatctttccaagtcca

SEQ ID NO: 478983 - DNA, 25 bp, Mus musculus
gagccaagtgatgtttccaagtcca

SEQ ID NO: 478984 - DNA, 25 bp, Mus musculus
gagccaagtgcgctgccgcctttgc

SEQ ID NO: 478985 - DNA, 25 bp, Mus musculus
gagccaagtgcggtgccgcctttgc

SEQ ID NO: 478986 - DNA, 25 bp, Mus musculus
gagccaagtgttatagcactctgtt

SEQ ID NO: 478987 - DNA, 25 bp, Mus musculus
gagccaagtgttttagcactctgtt

SEQ ID NO: 478988 - DNA, 25 bp, Mus musculus
gagccaagttcccaattgcatgtcc

SEQ ID NO: 478989 - DNA, 25 bp, Mus musculus
gagccaagttccgaattgcatgtcc

SEQ ID NO: 478990 - DNA, 25 bp, Mus musculus
gagccaataaagaccctttcttgtt

SEQ ID NO: 478991 - DNA, 25 bp, Mus musculus
gagccaataaagtccctttcttgtt

SEQ ID NO: 478992 - DNA, 25 bp, Mus musculus
gagccaatacgtcaacaccgtgaat

SEQ ID NO: 478993 - DNA, 25 bp, Mus musculus
gagccaatacgtgaacaccgtgaat

SEQ ID NO: 478994 - DNA, 25 bp, Mus musculus
gagccaatacttacacttgtggatg

SEQ ID NO: 478995 - DNA, 25 bp, Mus musculus
gagccaatactttcacttgtggatg

SEQ ID NO: 478996 - DNA, 25 bp, Mus musculus
gagccaatcaccacacatcatgtag

SEQ ID NO: 478997 - DNA, 25 bp, Mus musculus
gagccaatcacctcacatcatgtag

SEQ ID NO: 478998 - DNA, 25 bp, Mus musculus
gagccaatcactacagccaatcatg

SEQ ID NO: 478999 - DNA, 25 bp, Mus musculus
gagccaatcacttcagccaatcatg

SEQ ID NO: 479000 - DNA, 25 bp, Mus musculus
gagccaatccccacttgaatggtaa

SEQ ID NO: 479001 - DNA, 25 bp, Mus musculus
gagccaatcccctcttgaatggtaa

SEQ ID NO: 479002 - DNA, 25 bp, Mus musculus
gagccaatccctcaagatggtcact

SEQ ID NO: 479003 - DNA, 25 bp, Mus musculus
gagccaatccctgaagatggtcact

SEQ ID NO: 479004 - DNA, 25 bp, Mus musculus
gagccaatccgtaagaggacccgtg

SEQ ID NO: 479005 - DNA, 25 bp, Mus musculus
gagccaatccgttagaggacccgtg

SEQ ID NO: 479006 - DNA, 25 bp, Mus musculus
gagccaatccttcaggctgactgga

SEQ ID NO: 479007 - DNA, 25 bp, Mus musculus
gagccaatccttgaggctgactgga

SEQ ID NO: 479008 - DNA, 25 bp, Mus musculus
gagccaatgacaatgacatcatggt

SEQ ID NO: 479009 - DNA, 25 bp, Mus musculus
gagccaatgacattgacatcatggt

SEQ ID NO: 479010 - DNA, 25 bp, Mus musculus
gagccaatgaccaccttctataagt

SEQ ID NO: 479011 - DNA, 25 bp, Mus musculus
gagccaatgacctccttctataagt

SEQ ID NO: 479012 - DNA, 25 bp, Mus musculus
gagccaatggcgacatgaccgatta

SEQ ID NO: 479013 - DNA, 25 bp, Mus musculus
gagccaatggcgtcatgaccgatta

SEQ ID NO: 479014 - DNA, 25 bp, Mus musculus
gagccaatggctactgcaagaacaa

SEQ ID NO: 479015 - DNA, 25 bp, Mus musculus
gagccaatggcttctgcaagaacaa

SEQ ID NO: 479016 - DNA, 25 bp, Mus musculus
gagccaatgggccagatcccagcca

SEQ ID NO: 479017 - DNA, 25 bp, Mus musculus
gagccaatgggcgagatcccagcca

SEQ ID NO: 479018 - DNA, 25 bp, Mus musculus
gagccaatgtccatactgacttgcc

SEQ ID NO: 479019 - DNA, 25 bp, Mus musculus
gagccaatgtccttactgacttgcc

SEQ ID NO: 479020 - DNA, 25 bp, Mus musculus
gagccaatgtttagactcatttgag

SEQ ID NO: 479021 - DNA, 25 bp, Mus musculus
gagccaatgttttgactcatttgag

SEQ ID NO: 479022 - DNA, 25 bp, Mus musculus
gagccaatttctataagcaccatga

SEQ ID NO: 479023 - DNA, 25 bp, Mus musculus
gagccaatttctttaagcaccatga

SEQ ID NO: 479024 - DNA, 25 bp, Mus musculus
gagccacaacatagctttgctgata

SEQ ID NO: 479025 - DNA, 25 bp, Mus musculus
gagccacaacattgctttgctgata

SEQ ID NO: 479026 - DNA, 25 bp, Mus musculus
gagccacaacgcattatgacgtctt

SEQ ID NO: 479027 - DNA, 25 bp, Mus musculus
gagccacaacgctttatgacgtctt

SEQ ID NO: 479028 - DNA, 25 bp, Mus musculus
gagccacaagccaccagtaggtact

SEQ ID NO: 479029 - DNA, 25 bp, Mus musculus
gagccacaagcctccagtaggtact

SEQ ID NO: 479030 - DNA, 25 bp, Mus musculus
gagccacaagctccactgtgaaacc

SEQ ID NO: 479031 - DNA, 25 bp, Mus musculus
gagccacaagctgcactgtgaaacc

SEQ ID NO: 479032 - DNA, 25 bp, Mus musculus
gagccacaatcccaggatgacctct

SEQ ID NO: 479033 - DNA, 25 bp, Mus musculus
gagccacaatccgaggatgacctct

SEQ ID NO: 479034 - DNA, 25 bp, Mus musculus
gagccacaattcacaagccttcttg

SEQ ID NO: 479035 - DNA, 25 bp, Mus musculus
gagccacaattctcaagccttcttg

SEQ ID NO: 479036 - DNA, 25 bp, Mus musculus
gagccacacaaacatcaggtcctat

SEQ ID NO: 479037 - DNA, 25 bp, Mus musculus
gagccacacaaagatcaggtcctat

SEQ ID NO: 479038 - DNA, 25 bp, Mus musculus
gagccacacaagcagactctctgtc

SEQ ID NO: 479039 - DNA, 25 bp, Mus musculus
gagccacacaaggagactctctgtc

SEQ ID NO: 479040 - DNA, 25 bp, Mus musculus
gagccacaccagaacaagaaacaga

SEQ ID NO: 479041 - DNA, 25 bp, Mus musculus
gagccacaccagacttattaatatt

SEQ ID NO: 479042 - DNA, 25 bp, Mus musculus
gagccacaccagtacaagaaacaga

SEQ ID NO: 479043 - DNA, 25 bp, Mus musculus
gagccacaccagtcttattaatatt

SEQ ID NO: 479044 - DNA, 25 bp, Mus musculus
gagccacaccatcgcctgtctgtaa

SEQ ID NO: 479045 - DNA, 25 bp, Mus musculus
gagccacaccatggcctgtctgtaa

SEQ ID NO: 479046 - DNA, 25 bp, Mus musculus
gagccacactcactgtaagtgctgt

SEQ ID NO: 479047 - DNA, 25 bp, Mus musculus
gagccacactcagtgtaagtgctgt

SEQ ID NO: 479048 - DNA, 25 bp, Mus musculus
gagccacagaagataggagttaacc

SEQ ID NO: 479049 - DNA, 25 bp, Mus musculus
gagccacagaagttaggagttaacc

SEQ ID NO: 479050 - DNA, 25 bp, Mus musculus
gagccacagattcacatggtactga

SEQ ID NO: 479051 - DNA, 25 bp, Mus musculus
gagccacagattctcgtgattgcca

SEQ ID NO: 479052 - DNA, 25 bp, Mus musculus
gagccacagattgacatggtactga

SEQ ID NO: 479053 - DNA, 25 bp, Mus musculus
gagccacagattgtcgtgattgcca

SEQ ID NO: 479054 - DNA, 25 bp, Mus musculus
gagccacagcgtctctttatatttg

SEQ ID NO: 479055 - DNA, 25 bp, Mus musculus
gagccacagcgtgtctttatatttg

SEQ ID NO: 479056 - DNA, 25 bp, Mus musculus
gagccacagctcaaatcctgcctgg

SEQ ID NO: 479057 - DNA, 25 bp, Mus musculus
gagccacagctctaatcctgcctgg

SEQ ID NO: 479058 - DNA, 25 bp, Mus musculus
gagccacagctgagagctctcggaa

SEQ ID NO: 479059 - DNA, 25 bp, Mus musculus
gagccacagctgtgagctctcggaa

SEQ ID NO: 479060 - DNA, 25 bp, Mus musculus
gagccacagtaaatctgccacagct

SEQ ID NO: 479061 - DNA, 25 bp, Mus musculus
gagccacagtaattctgccacagct

SEQ ID NO: 479062 - DNA, 25 bp, Mus musculus
gagccacagtgcctggtcctaagga

SEQ ID NO: 479063 - DNA, 25 bp, Mus musculus
gagccacagtgcgtggtcctaagga

SEQ ID NO: 479064 - DNA, 25 bp, Mus musculus
gagccacagttcatactctttaatt

SEQ ID NO: 479065 - DNA, 25 bp, Mus musculus
gagccacagttcttactctttaatt

SEQ ID NO: 479066 - DNA, 25 bp, Mus musculus
gagccacatcccaagatatacacaa

SEQ ID NO: 479067 - DNA, 25 bp, Mus musculus
gagccacatcccattctgatactta

SEQ ID NO: 479068 - DNA, 25 bp, Mus musculus
gagccacatccctagatatacacaa

SEQ ID NO: 479069 - DNA, 25 bp, Mus musculus
gagccacatccctttctgatactta

SEQ ID NO: 479070 - DNA, 25 bp, Mus musculus
gagccacatcttacgctttgtatgc

SEQ ID NO: 479071 - DNA, 25 bp, Mus musculus
gagccacatcttactgtgtcagagc

SEQ ID NO: 479072 - DNA, 25 bp, Mus musculus
gagccacatctttcgctttgtatgc

SEQ ID NO: 479073 - DNA, 25 bp, Mus musculus
gagccacatctttctgtgtcagagc

SEQ ID NO: 479074 - DNA, 25 bp, Mus musculus
gagccacatgcaatatctatttctg

SEQ ID NO: 479075 - DNA, 25 bp, Mus musculus
gagccacatgcattatctatttctg

SEQ ID NO: 479076 - DNA, 25 bp, Mus musculus
gagccacatgccagcgaggagagac

SEQ ID NO: 479077 - DNA, 25 bp, Mus musculus
gagccacatgcctgcgaggagagac

SEQ ID NO: 479078 - DNA, 25 bp, Mus musculus
gagccacattccaattttaacctgt

SEQ ID NO: 479079 - DNA, 25 bp, Mus musculus
gagccacattcctattttaacctgt

SEQ ID NO: 479080 - DNA, 25 bp, Mus musculus
gagccacatttaaaacaccgagtaa

SEQ ID NO: 479081 - DNA, 25 bp, Mus musculus
gagccacatttataacaccgagtaa

SEQ ID NO: 479082 - DNA, 25 bp, Mus musculus
gagccacatttcagcttaggaaaca

SEQ ID NO: 479083 - DNA, 25 bp, Mus musculus
gagccacatttccagagcatcatca

SEQ ID NO: 479084 - DNA, 25 bp, Mus musculus
gagccacatttcgagagcatcatca

SEQ ID NO: 479085 - DNA, 25 bp, Mus musculus
gagccacatttctgcttaggaaaca

SEQ ID NO: 479086 - DNA, 25 bp, Mus musculus
gagccaccaaccaaacagcattgtc

SEQ ID NO: 479087 - DNA, 25 bp, Mus musculus
gagccaccaacctaacagcattgtc

SEQ ID NO: 479088 - DNA, 25 bp, Mus musculus
gagccaccaagacttaagttacagg

SEQ ID NO: 479089 - DNA, 25 bp, Mus musculus
gagccaccaagagttaagttacagg

SEQ ID NO: 479090 - DNA, 25 bp, Mus musculus
gagccaccaccaaagcaagctgtag

SEQ ID NO: 479091 - DNA, 25 bp, Mus musculus
gagccaccaccatagcaagctgtag

SEQ ID NO: 479092 - DNA, 25 bp, Mus musculus
gagccaccacccaagttaactagag

SEQ ID NO: 479093 - DNA, 25 bp, Mus musculus
gagccaccaccctagttaactagag

SEQ ID NO: 479094 - DNA, 25 bp, Mus musculus
gagccaccagcaaagcgcaaaaagg

SEQ ID NO: 479095 - DNA, 25 bp, Mus musculus
gagccaccagcatagcgcaaaaagg

SEQ ID NO: 479096 - DNA, 25 bp, Mus musculus
gagccaccagtgaagcagagctgtg

SEQ ID NO: 479097 - DNA, 25 bp, Mus musculus
gagccaccagtgtagcagagctgtg

SEQ ID NO: 479098 - DNA, 25 bp, Mus musculus
gagccaccatacaagcagtgacctg

SEQ ID NO: 479099 - DNA, 25 bp, Mus musculus
gagccaccatactagcagtgacctg

SEQ ID NO: 479100 - DNA, 25 bp, Mus musculus
gagccaccatctcccagggtataga

SEQ ID NO: 479101 - DNA, 25 bp, Mus musculus
gagccaccatctgccagggtataga

SEQ ID NO: 479102 - DNA, 25 bp, Mus musculus
gagccaccatgaatggctttcagat

SEQ ID NO: 479103 - DNA, 25 bp, Mus musculus
gagccaccatgattggctttcagat

SEQ ID NO: 479104 - DNA, 25 bp, Mus musculus
gagccaccattgcagggaggttatt

SEQ ID NO: 479105 - DNA, 25 bp, Mus musculus
gagccaccattggagggaggttatt

SEQ ID NO: 479106 - DNA, 25 bp, Mus musculus
gagccacccacaatttctataaaag

SEQ ID NO: 479107 - DNA, 25 bp, Mus musculus
gagccacccacattttctataaaag

SEQ ID NO: 479108 - DNA, 25 bp, Mus musculus
gagccacccactaatgatgatgcct

SEQ ID NO: 479109 - DNA, 25 bp, Mus musculus
gagccacccacttatgatgatgcct

SEQ ID NO: 479110 - DNA, 25 bp, Mus musculus
gagccacccatgaagtgtgaccttg

SEQ ID NO: 479111 - DNA, 25 bp, Mus musculus
gagccacccatgtagtgtgaccttg

SEQ ID NO: 479112 - DNA, 25 bp, Mus musculus
gagccaccccagagtgggtacggtt

SEQ ID NO: 479113 - DNA, 25 bp, Mus musculus
gagccaccccagctagggttacaag

SEQ ID NO: 479114 - DNA, 25 bp, Mus musculus
gagccaccccaggtagggttacaag

SEQ ID NO: 479115 - DNA, 25 bp, Mus musculus
gagccaccccagtgtgggtacggtt

SEQ ID NO: 479116 - DNA, 25 bp, Mus musculus
gagccacccctaacagtcaggaatg

SEQ ID NO: 479117 - DNA, 25 bp, Mus musculus
gagccacccctatcagtcaggaatg

SEQ ID NO: 479118 - DNA, 25 bp, Mus musculus
gagccacccgtccagccagataata

SEQ ID NO: 479119 - DNA, 25 bp, Mus musculus
gagccacccgtcgagccagataata

SEQ ID NO: 479120 - DNA, 25 bp, Mus musculus
gagccaccctatagttttcaaatgt

SEQ ID NO: 479121 - DNA, 25 bp, Mus musculus
gagccaccctattgttttcaaatgt

SEQ ID NO: 479122 - DNA, 25 bp, Mus musculus
gagccaccgatcacgcgggtgccag

SEQ ID NO: 479123 - DNA, 25 bp, Mus musculus
gagccaccgatctcgcgggtgccag

SEQ ID NO: 479124 - DNA, 25 bp, Mus musculus
gagccaccggccatttaaacaacgt

SEQ ID NO: 479125 - DNA, 25 bp, Mus musculus
gagccaccggccttttaaacaacgt

SEQ ID NO: 479126 - DNA, 25 bp, Mus musculus
gagccaccggcgagcaacgtagcta

SEQ ID NO: 479127 - DNA, 25 bp, Mus musculus
gagccaccggcgtgcaacgtagcta

SEQ ID NO: 479128 - DNA, 25 bp, Mus musculus
gagccaccgtagagccttgcaaagg

SEQ ID NO: 479129 - DNA, 25 bp, Mus musculus
gagccaccgtagtgccttgcaaagg

SEQ ID NO: 479130 - DNA, 25 bp, Mus musculus
gagccacctgagagccaagtgtcta

SEQ ID NO: 479131 - DNA, 25 bp, Mus musculus
gagccacctgagtgccaagtgtcta

SEQ ID NO: 479132 - DNA, 25 bp, Mus musculus
gagccacctgatctgacagcaagtg

SEQ ID NO: 479133 - DNA, 25 bp, Mus musculus
gagccacctgatgtgacagcaagtg

SEQ ID NO: 479134 - DNA, 25 bp, Mus musculus
gagccacctggcactttggtgtcta

SEQ ID NO: 479135 - DNA, 25 bp, Mus musculus
gagccacctggctctttggtgtcta

SEQ ID NO: 479136 - DNA, 25 bp, Mus musculus
gagccacctggtcaatgactcacgg

SEQ ID NO: 479137 - DNA, 25 bp, Mus musculus
gagccacctggtcaggttcattata

SEQ ID NO: 479138 - DNA, 25 bp, Mus musculus
gagccacctggtgaatgactcacgg

SEQ ID NO: 479139 - DNA, 25 bp, Mus musculus
gagccacctggtgaggttcattata

SEQ ID NO: 479140 - DNA, 25 bp, Mus musculus
gagccacgacaaccaggctgctggt

SEQ ID NO: 479141 - DNA, 25 bp, Mus musculus
gagccacgacaagcaggctgctggt

SEQ ID NO: 479142 - DNA, 25 bp, Mus musculus
gagccacgaggcaacatttgaactc

SEQ ID NO: 479143 - DNA, 25 bp, Mus musculus
gagccacgaggctacatttgaactc

SEQ ID NO: 479144 - DNA, 25 bp, Mus musculus
gagccacgatttacattgcagacct

SEQ ID NO: 479145 - DNA, 25 bp, Mus musculus
gagccacgattttcattgcagacct

SEQ ID NO: 479146 - DNA, 25 bp, Mus musculus
gagccacggaaacatggtgccatct

SEQ ID NO: 479147 - DNA, 25 bp, Mus musculus
gagccacggaaagatggtgccatct

SEQ ID NO: 479148 - DNA, 25 bp, Mus musculus
gagccacggatgatttctgggctgt

SEQ ID NO: 479149 - DNA, 25 bp, Mus musculus
gagccacggatgttttctgggctgt

SEQ ID NO: 479150 - DNA, 25 bp, Mus musculus
gagccacggccccagtaagtaattt

SEQ ID NO: 479151 - DNA, 25 bp, Mus musculus
gagccacggcccgagtaagtaattt

SEQ ID NO: 479152 - DNA, 25 bp, Mus musculus
gagccacggctcatctaaaaactat

SEQ ID NO: 479153 - DNA, 25 bp, Mus musculus
gagccacggctcttctaaaaactat

SEQ ID NO: 479154 - DNA, 25 bp, Mus musculus
gagccacggtgtcctgcttaaacta

SEQ ID NO: 479155 - DNA, 25 bp, Mus musculus
gagccacggtgtgctgcttaaacta

SEQ ID NO: 479156 - DNA, 25 bp, Mus musculus
gagccacgtcgtcggaaggttttat

SEQ ID NO: 479157 - DNA, 25 bp, Mus musculus
gagccacgtcgtgggaaggttttat

SEQ ID NO: 479158 - DNA, 25 bp, Mus musculus
gagccacgtgcactgattgcccaaa

SEQ ID NO: 479159 - DNA, 25 bp, Mus musculus
gagccacgtgcagtgattgcccaaa

SEQ ID NO: 479160 - DNA, 25 bp, Mus musculus
gagccacgtggaatttcagtcttga

SEQ ID NO: 479161 - DNA, 25 bp, Mus musculus
gagccacgtggattttcagtcttga

SEQ ID NO: 479162 - DNA, 25 bp, Mus musculus
gagccactaagtctgcagttctttt

SEQ ID NO: 479163 - DNA, 25 bp, Mus musculus
gagccactaagtgtgcagttctttt

SEQ ID NO: 479164 - DNA, 25 bp, Mus musculus
gagccactaataaaaagttgccatt

SEQ ID NO: 479165 - DNA, 25 bp, Mus musculus
gagccactaatataaagttgccatt

SEQ ID NO: 479166 - DNA, 25 bp, Mus musculus
gagccactacctatgactaattctg

SEQ ID NO: 479167 - DNA, 25 bp, Mus musculus
gagccactacctttgactaattctg

SEQ ID NO: 479168 - DNA, 25 bp, Mus musculus
gagccactacgtatatttaccaagt

SEQ ID NO: 479169 - DNA, 25 bp, Mus musculus
gagccactacgtttatttaccaagt

SEQ ID NO: 479170 - DNA, 25 bp, Mus musculus
gagccactagcaactggttttagaa

SEQ ID NO: 479171 - DNA, 25 bp, Mus musculus
gagccactagcatctggttttagaa

SEQ ID NO: 479172 - DNA, 25 bp, Mus musculus
gagccactagtgaggactcagcagc

SEQ ID NO: 479173 - DNA, 25 bp, Mus musculus
gagccactagtgtggactcagcagc

SEQ ID NO: 479174 - DNA, 25 bp, Mus musculus
gagccactcaggaagccaccaacaa

SEQ ID NO: 479175 - DNA, 25 bp, Mus musculus
gagccactcaggtagccaccaacaa

SEQ ID NO: 479176 - DNA, 25 bp, Mus musculus
gagccactcataactctactttgaa

SEQ ID NO: 479177 - DNA, 25 bp, Mus musculus
gagccactcatatctctactttgaa

SEQ ID NO: 479178 - DNA, 25 bp, Mus musculus
gagccactctcaccagcagccactg

SEQ ID NO: 479179 - DNA, 25 bp, Mus musculus
gagccactctcagcagcagccactg

SEQ ID NO: 479180 - DNA, 25 bp, Mus musculus
gagccactgaccaattcttggtaaa

SEQ ID NO: 479181 - DNA, 25 bp, Mus musculus
gagccactgacccaacattttacaa

SEQ ID NO: 479182 - DNA, 25 bp, Mus musculus
gagccactgacccaggagcaagcaa

SEQ ID NO: 479183 - DNA, 25 bp, Mus musculus
gagccactgaccgaacattttacaa

SEQ ID NO: 479184 - DNA, 25 bp, Mus musculus
gagccactgaccgaggagcaagcaa

SEQ ID NO: 479185 - DNA, 25 bp, Mus musculus
gagccactgacctattcttggtaaa

SEQ ID NO: 479186 - DNA, 25 bp, Mus musculus
gagccactgagacactcctttgagg

SEQ ID NO: 479187 - DNA, 25 bp, Mus musculus
gagccactgagagactcctttgagg

SEQ ID NO: 479188 - DNA, 25 bp, Mus musculus
gagccactgaggaacgtaccttctt

SEQ ID NO: 479189 - DNA, 25 bp, Mus musculus
gagccactgaggtacgtaccttctt

SEQ ID NO: 479190 - DNA, 25 bp, Mus musculus
gagccactgcggctttgatttaaag

SEQ ID NO: 479191 - DNA, 25 bp, Mus musculus
gagccactgcgggtttgatttaaag

SEQ ID NO: 479192 - DNA, 25 bp, Mus musculus
gagccactgctgaatttgggaccta

SEQ ID NO: 479193 - DNA, 25 bp, Mus musculus
gagccactgctgtatttgggaccta

SEQ ID NO: 479194 - DNA, 25 bp, Mus musculus
gagccactgcttcgatggcaggcat

SEQ ID NO: 479195 - DNA, 25 bp, Mus musculus
gagccactgcttggatggcaggcat

SEQ ID NO: 479196 - DNA, 25 bp, Mus musculus
gagccactggagcatggtctttcat

SEQ ID NO: 479197 - DNA, 25 bp, Mus musculus
gagccactggaggatggtctttcat

SEQ ID NO: 479198 - DNA, 25 bp, Mus musculus
gagccactgggtcaagacaagaaga

SEQ ID NO: 479199 - DNA, 25 bp, Mus musculus
gagccactgggtgaagacaagaaga

SEQ ID NO: 479200 - DNA, 25 bp, Mus musculus
gagccactgtcacagtgtaccacag

SEQ ID NO: 479201 - DNA, 25 bp, Mus musculus
gagccactgtcagagtgtaccacag

SEQ ID NO: 479202 - DNA, 25 bp, Mus musculus
gagccactgtctcctagcagagctg

SEQ ID NO: 479203 - DNA, 25 bp, Mus musculus
gagccactgtctgctagcagagctg

SEQ ID NO: 479204 - DNA, 25 bp, Mus musculus
gagccactgtggaaatatttgtact

SEQ ID NO: 479205 - DNA, 25 bp, Mus musculus
gagccactgtggtaatatttgtact

SEQ ID NO: 479206 - DNA, 25 bp, Mus musculus
gagccacttaaaattctcgggtgca

SEQ ID NO: 479207 - DNA, 25 bp, Mus musculus
gagccacttaaatttctcgggtgca

SEQ ID NO: 479208 - DNA, 25 bp, Mus musculus
gagccacttcaacccttaggaactg

SEQ ID NO: 479209 - DNA, 25 bp, Mus musculus
gagccacttcaacgaccttctatga

SEQ ID NO: 479210 - DNA, 25 bp, Mus musculus
gagccacttcaagccttaggaactg

SEQ ID NO: 479211 - DNA, 25 bp, Mus musculus
gagccacttcaaggaccttctatga

SEQ ID NO: 479212 - DNA, 25 bp, Mus musculus
gagccacttggacacaatggccaga

SEQ ID NO: 479213 - DNA, 25 bp, Mus musculus
gagccacttggagacaatggccaga

SEQ ID NO: 479214 - DNA, 25 bp, Mus musculus
gagccacttggcatggaggctgaca

SEQ ID NO: 479215 - DNA, 25 bp, Mus musculus
gagccacttggcttggaggctgaca

SEQ ID NO: 479216 - DNA, 25 bp, Mus musculus
gagccactttgaactcagaatctgc

SEQ ID NO: 479217 - DNA, 25 bp, Mus musculus
gagccactttgatctcagaatctgc

SEQ ID NO: 479218 - DNA, 25 bp, Mus musculus
gagccactttgcaggaacacacctg

SEQ ID NO: 479219 - DNA, 25 bp, Mus musculus
gagccactttgctggaacacacctg

SEQ ID NO: 479220 - DNA, 25 bp, Mus musculus
gagccacttttaaggtgctgtcata

SEQ ID NO: 479221 - DNA, 25 bp, Mus musculus
gagccacttttatggtgctgtcata

SEQ ID NO: 479222 - DNA, 25 bp, Mus musculus
gagccagaaacaaatcaacagcatt

SEQ ID NO: 479223 - DNA, 25 bp, Mus musculus
gagccagaaacatatcaacagcatt

SEQ ID NO: 479224 - DNA, 25 bp, Mus musculus
gagccagaacaccagtctggtacca

SEQ ID NO: 479225 - DNA, 25 bp, Mus musculus
gagccagaacacgagtctggtacca

SEQ ID NO: 479226 - DNA, 25 bp, Mus musculus
gagccagaaccccaggctgagccaa

SEQ ID NO: 479227 - DNA, 25 bp, Mus musculus
gagccagaacccgaggctgagccaa

SEQ ID NO: 479228 - DNA, 25 bp, Mus musculus
gagccagaactgctacagaaggaga

SEQ ID NO: 479229 - DNA, 25 bp, Mus musculus
gagccagaactggtacagaaggaga

SEQ ID NO: 479230 - DNA, 25 bp, Mus musculus
gagccagaacttcgttacagagtct

SEQ ID NO: 479231 - DNA, 25 bp, Mus musculus
gagccagaacttggttacagagtct

SEQ ID NO: 479232 - DNA, 25 bp, Mus musculus
gagccagaatcacaagcttcagcgg

SEQ ID NO: 479233 - DNA, 25 bp, Mus musculus
gagccagaatcagaagcttcagcgg

SEQ ID NO: 479234 - DNA, 25 bp, Mus musculus
gagccagacaaaatgctaccctacc

SEQ ID NO: 479235 - DNA, 25 bp, Mus musculus
gagccagacaaattgctaccctacc

SEQ ID NO: 479236 - DNA, 25 bp, Mus musculus
gagccagacactcgaggccgcagat

SEQ ID NO: 479237 - DNA, 25 bp, Mus musculus
gagccagacactggaggccgcagat

SEQ ID NO: 479238 - DNA, 25 bp, Mus musculus
gagccagacagaaacgttttattta

SEQ ID NO: 479239 - DNA, 25 bp, Mus musculus
gagccagacagatacgttttattta

SEQ ID NO: 479240 - DNA, 25 bp, Mus musculus
gagccagacaggattctttgatttt

SEQ ID NO: 479241 - DNA, 25 bp, Mus musculus
gagccagacaggtttctttgatttt

SEQ ID NO: 479242 - DNA, 25 bp, Mus musculus
gagccagaccccagcaagttgtaaa

SEQ ID NO: 479243 - DNA, 25 bp, Mus musculus
gagccagacccctgcaagttgtaaa

SEQ ID NO: 479244 - DNA, 25 bp, Mus musculus
gagccagacctgcagtcaacagcaa

SEQ ID NO: 479245 - DNA, 25 bp, Mus musculus
gagccagacctggagtcaacagcaa

SEQ ID NO: 479246 - DNA, 25 bp, Mus musculus
gagccagacgctaacgtacgtacat

SEQ ID NO: 479247 - DNA, 25 bp, Mus musculus
gagccagacgcttacgtacgtacat

SEQ ID NO: 479248 - DNA, 25 bp, Mus musculus
gagccagagaacacccaggtcaggg

SEQ ID NO: 479249 - DNA, 25 bp, Mus musculus
gagccagagaactcccaggtcaggg

SEQ ID NO: 479250 - DNA, 25 bp, Mus musculus
gagccagagaatccctgggaattaa

SEQ ID NO: 479251 - DNA, 25 bp, Mus musculus
gagccagagaatgcctgggaattaa

SEQ ID NO: 479252 - DNA, 25 bp, Mus musculus
gagccagagactcttatctgcacca

SEQ ID NO: 479253 - DNA, 25 bp, Mus musculus
gagccagagactgttatctgcacca

SEQ ID NO: 479254 - DNA, 25 bp, Mus musculus
gagccagagagaagagccagcaagc

SEQ ID NO: 479255 - DNA, 25 bp, Mus musculus
gagccagagagactgtccagttacc

SEQ ID NO: 479256 - DNA, 25 bp, Mus musculus
gagccagagagagtgtccagttacc

SEQ ID NO: 479257 - DNA, 25 bp, Mus musculus
gagccagagagatgagccagcaagc

SEQ ID NO: 479258 - DNA, 25 bp, Mus musculus
gagccagagagccagcaacatagat

SEQ ID NO: 479259 - DNA, 25 bp, Mus musculus
gagccagagagcgagcaacatagat

SEQ ID NO: 479260 - DNA, 25 bp, Mus musculus
gagccagagcctcaactgacataag

SEQ ID NO: 479261 - DNA, 25 bp, Mus musculus
gagccagagcctctctatgcgaaaa

SEQ ID NO: 479262 - DNA, 25 bp, Mus musculus
gagccagagcctgaactgacataag

SEQ ID NO: 479263 - DNA, 25 bp, Mus musculus
gagccagagcctgtctatgcgaaaa

SEQ ID NO: 479264 - DNA, 25 bp, Mus musculus
gagccagagcgactgtagcacaggt

SEQ ID NO: 479265 - DNA, 25 bp, Mus musculus
gagccagagcgagtgtagcacaggt

SEQ ID NO: 479266 - DNA, 25 bp, Mus musculus
gagccagagctcatggaacctagag

SEQ ID NO: 479267 - DNA, 25 bp, Mus musculus
gagccagagctcttggaacctagag

SEQ ID NO: 479268 - DNA, 25 bp, Mus musculus
gagccagagcttagaaacttttcta

SEQ ID NO: 479269 - DNA, 25 bp, Mus musculus
gagccagagcttctaggcctagact

SEQ ID NO: 479270 - DNA, 25 bp, Mus musculus
gagccagagcttgtaggcctagact

SEQ ID NO: 479271 - DNA, 25 bp, Mus musculus
gagccagagctttgaaacttttcta

SEQ ID NO: 479272 - DNA, 25 bp, Mus musculus
gagccagaggaaccctcgctgacac

SEQ ID NO: 479273 - DNA, 25 bp, Mus musculus
gagccagaggaagcctcgctgacac

SEQ ID NO: 479274 - DNA, 25 bp, Mus musculus
gagccagaggcacacctgccagttt

SEQ ID NO: 479275 - DNA, 25 bp, Mus musculus
gagccagaggcagacctgccagttt

SEQ ID NO: 479276 - DNA, 25 bp, Mus musculus
gagccagaggccatgagcactgtcc

SEQ ID NO: 479277 - DNA, 25 bp, Mus musculus
gagccagaggccttgagcactgtcc

SEQ ID NO: 479278 - DNA, 25 bp, Mus musculus
gagccagagtacatccagcttttaa

SEQ ID NO: 479279 - DNA, 25 bp, Mus musculus
gagccagagtacttccagcttttaa

SEQ ID NO: 479280 - DNA, 25 bp, Mus musculus
gagccagagtatcacaagtcttgta

SEQ ID NO: 479281 - DNA, 25 bp, Mus musculus
gagccagagtatgacaagtcttgta

SEQ ID NO: 479282 - DNA, 25 bp, Mus musculus
gagccagagtgaccaagtttgacca

SEQ ID NO: 479283 - DNA, 25 bp, Mus musculus
gagccagagtgagcaagtttgacca

SEQ ID NO: 479284 - DNA, 25 bp, Mus musculus
gagccagagtgtatgcaggtccacc

SEQ ID NO: 479285 - DNA, 25 bp, Mus musculus
gagccagagtgtttgcaggtccacc

SEQ ID NO: 479286 - DNA, 25 bp, Mus musculus
gagccagagtttaattttcagtgtc

SEQ ID NO: 479287 - DNA, 25 bp, Mus musculus
gagccagagttttattttcagtgtc

SEQ ID NO: 479288 - DNA, 25 bp, Mus musculus
gagccagatcaacgacacagcatgt

SEQ ID NO: 479289 - DNA, 25 bp, Mus musculus
gagccagatcaaggacacagcatgt

SEQ ID NO: 479290 - DNA, 25 bp, Mus musculus
gagccagatcatctcagtttaagta

SEQ ID NO: 479291 - DNA, 25 bp, Mus musculus
gagccagatcatgtcagtttaagta

SEQ ID NO: 479292 - DNA, 25 bp, Mus musculus
gagccagatgaaaaccctgctacag

SEQ ID NO: 479293 - DNA, 25 bp, Mus musculus
gagccagatgaataccctgctacag

SEQ ID NO: 479294 - DNA, 25 bp, Mus musculus
gagccagatgacaaatggaccattt

SEQ ID NO: 479295 - DNA, 25 bp, Mus musculus
gagccagatgactaatggaccattt

SEQ ID NO: 479296 - DNA, 25 bp, Mus musculus
gagccagatgcaccgcagataacaa

SEQ ID NO: 479297 - DNA, 25 bp, Mus musculus
gagccagatgcagcgcagataacaa

SEQ ID NO: 479298 - DNA, 25 bp, Mus musculus
gagccagatgccattctcaagtgta

SEQ ID NO: 479299 - DNA, 25 bp, Mus musculus
gagccagatgcctttctcaagtgta

SEQ ID NO: 479300 - DNA, 25 bp, Mus musculus
gagccagatggaatttgaagcccaa

SEQ ID NO: 479301 - DNA, 25 bp, Mus musculus
gagccagatggattttgaagcccaa

SEQ ID NO: 479302 - DNA, 25 bp, Mus musculus
gagccagatggcacaggcctcacct

SEQ ID NO: 479303 - DNA, 25 bp, Mus musculus
gagccagatggctcaggcctcacct

SEQ ID NO: 479304 - DNA, 25 bp, Mus musculus
gagccagatggtaatttcatccttg

SEQ ID NO: 479305 - DNA, 25 bp, Mus musculus
gagccagatggttatttcatccttg

SEQ ID NO: 479306 - DNA, 25 bp, Mus musculus
gagccagcaactcatctgcagtctg

SEQ ID NO: 479307 - DNA, 25 bp, Mus musculus
gagccagcaactcgacctgctacag

SEQ ID NO: 479308 - DNA, 25 bp, Mus musculus
gagccagcaactgatctgcagtctg

SEQ ID NO: 479309 - DNA, 25 bp, Mus musculus
gagccagcaactggacctgctacag

SEQ ID NO: 479310 - DNA, 25 bp, Mus musculus
gagccagcagacacggtgctctgaa

SEQ ID NO: 479311 - DNA, 25 bp, Mus musculus
gagccagcagacatgggtttcccct

SEQ ID NO: 479312 - DNA, 25 bp, Mus musculus
gagccagcagactcggtgctctgaa

SEQ ID NO: 479313 - DNA, 25 bp, Mus musculus
gagccagcagacttgggtttcccct

SEQ ID NO: 479314 - DNA, 25 bp, Mus musculus
gagccagcagagcactcactgtgaa

SEQ ID NO: 479315 - DNA, 25 bp, Mus musculus
gagccagcagaggactcactgtgaa

SEQ ID NO: 479316 - DNA, 25 bp, Mus musculus
gagccagcaggacattctgagacaa

SEQ ID NO: 479317 - DNA, 25 bp, Mus musculus
gagccagcaggagattctgagacaa

SEQ ID NO: 479318 - DNA, 25 bp, Mus musculus
gagccagcaggtaccaggctggatt

SEQ ID NO: 479319 - DNA, 25 bp, Mus musculus
gagccagcaggttccaggctggatt

SEQ ID NO: 479320 - DNA, 25 bp, Mus musculus
gagccagcatagctgcaacaagcaa

SEQ ID NO: 479321 - DNA, 25 bp, Mus musculus
gagccagcataggtgcaacaagcaa

SEQ ID NO: 479322 - DNA, 25 bp, Mus musculus
gagccagcatcaaagttgtcacaga

SEQ ID NO: 479323 - DNA, 25 bp, Mus musculus
gagccagcatcatagttgtcacaga

SEQ ID NO: 479324 - DNA, 25 bp, Mus musculus
gagccagcattgctgtcatccttgt

SEQ ID NO: 479325 - DNA, 25 bp, Mus musculus
gagccagcattggtgtcatccttgt

SEQ ID NO: 479326 - DNA, 25 bp, Mus musculus
gagccagccagaaacagtgctgcgt

SEQ ID NO: 479327 - DNA, 25 bp, Mus musculus
gagccagccagatacagtgctgcgt

SEQ ID NO: 479328 - DNA, 25 bp, Mus musculus
gagccagccagcagttggcaattaa

SEQ ID NO: 479329 - DNA, 25 bp, Mus musculus
gagccagccagctgttggcaattaa

SEQ ID NO: 479330 - DNA, 25 bp, Mus musculus
gagccagccaggagatggtgaccac

SEQ ID NO: 479331 - DNA, 25 bp, Mus musculus
gagccagccaggtgatggtgaccac

SEQ ID NO: 479332 - DNA, 25 bp, Mus musculus
gagccagcccacaacttacaagcat

SEQ ID NO: 479333 - DNA, 25 bp, Mus musculus
gagccagcccactacttacaagcat

SEQ ID NO: 479334 - DNA, 25 bp, Mus musculus
gagccagccgagattgaagatccat

SEQ ID NO: 479335 - DNA, 25 bp, Mus musculus
gagccagccgagtttgaagatccat

SEQ ID NO: 479336 - DNA, 25 bp, Mus musculus
gagccagccgctcattcagtaagtt

SEQ ID NO: 479337 - DNA, 25 bp, Mus musculus
gagccagccgctgattcagtaagtt

SEQ ID NO: 479338 - DNA, 25 bp, Mus musculus
gagccagcctgcaagcatacagtag

SEQ ID NO: 479339 - DNA, 25 bp, Mus musculus
gagccagcctgctagcatacagtag

SEQ ID NO: 479340 - DNA, 25 bp, Mus musculus
gagccagcgatcctgagaggttcta

SEQ ID NO: 479341 - DNA, 25 bp, Mus musculus
gagccagcgatcgtgagaggttcta

SEQ ID NO: 479342 - DNA, 25 bp, Mus musculus
gagccagcgtagagcctgggcctca

SEQ ID NO: 479343 - DNA, 25 bp, Mus musculus
gagccagcgtagtgcctgggcctca

SEQ ID NO: 479344 - DNA, 25 bp, Mus musculus
gagccagctcatattcttattatat

SEQ ID NO: 479345 - DNA, 25 bp, Mus musculus
gagccagctcattttcttattatat

SEQ ID NO: 479346 - DNA, 25 bp, Mus musculus
gagccagctcccatcacttgagaag

SEQ ID NO: 479347 - DNA, 25 bp, Mus musculus
gagccagctcccttcacttgagaag

SEQ ID NO: 479348 - DNA, 25 bp, Mus musculus
gagccagctcttcaatgtgttatag

SEQ ID NO: 479349 - DNA, 25 bp, Mus musculus
gagccagctcttgaatgtgttatag

SEQ ID NO: 479350 - DNA, 25 bp, Mus musculus
gagccagctggaacccagaagacaa

SEQ ID NO: 479351 - DNA, 25 bp, Mus musculus
gagccagctggatcccagaagacaa

SEQ ID NO: 479352 - DNA, 25 bp, Mus musculus
gagccagctggtagtttctggtata

SEQ ID NO: 479353 - DNA, 25 bp, Mus musculus
gagccagctggtcgatactctgcag

SEQ ID NO: 479354 - DNA, 25 bp, Mus musculus
gagccagctggtggatactctgcag

SEQ ID NO: 479355 - DNA, 25 bp, Mus musculus
gagccagctggttgtttctggtata

SEQ ID NO: 479356 - DNA, 25 bp, Mus musculus
gagccagctgtcctaaagtggatac

SEQ ID NO: 479357 - DNA, 25 bp, Mus musculus
gagccagctgtcgtaaagtggatac

SEQ ID NO: 479358 - DNA, 25 bp, Mus musculus
gagccagcttggaagccttactgca

SEQ ID NO: 479359 - DNA, 25 bp, Mus musculus
gagccagcttggtagccttactgca

SEQ ID NO: 479360 - DNA, 25 bp, Mus musculus
gagccagcttgtcaattgcctcacg

SEQ ID NO: 479361 - DNA, 25 bp, Mus musculus
gagccagcttgtgaattgcctcacg

SEQ ID NO: 479362 - DNA, 25 bp, Mus musculus
gagccaggaacaagaggtcacccca

SEQ ID NO: 479363 - DNA, 25 bp, Mus musculus
gagccaggaacatgaggtcacccca

SEQ ID NO: 479364 - DNA, 25 bp, Mus musculus
gagccaggaagaccactgccagctg

SEQ ID NO: 479365 - DNA, 25 bp, Mus musculus
gagccaggaagagcactgccagctg

SEQ ID NO: 479366 - DNA, 25 bp, Mus musculus
gagccaggaagcctcttttgcagtg

SEQ ID NO: 479367 - DNA, 25 bp, Mus musculus
gagccaggaagcgtcttttgcagtg

SEQ ID NO: 479368 - DNA, 25 bp, Mus musculus
gagccaggaatgcacctcaagccta

SEQ ID NO: 479369 - DNA, 25 bp, Mus musculus
gagccaggaatggacctcaagccta

SEQ ID NO: 479370 - DNA, 25 bp, Mus musculus
gagccaggacaaaacagtgccccta

SEQ ID NO: 479371 - DNA, 25 bp, Mus musculus
gagccaggacaatacagtgccccta

SEQ ID NO: 479372 - DNA, 25 bp, Mus musculus
gagccaggacaccagatttgacttc

SEQ ID NO: 479373 - DNA, 25 bp, Mus musculus
gagccaggacacgagatttgacttc

SEQ ID NO: 479374 - DNA, 25 bp, Mus musculus
gagccaggacagctgcaggatttca

SEQ ID NO: 479375 - DNA, 25 bp, Mus musculus
gagccaggacaggtgcaggatttca

SEQ ID NO: 479376 - DNA, 25 bp, Mus musculus
gagccaggagataagcgacccacca

SEQ ID NO: 479377 - DNA, 25 bp, Mus musculus
gagccaggagatccaaaacttcaca

SEQ ID NO: 479378 - DNA, 25 bp, Mus musculus
gagccaggagatgcaaaacttcaca

SEQ ID NO: 479379 - DNA, 25 bp, Mus musculus
gagccaggagattagcgacccacca

SEQ ID NO: 479380 - DNA, 25 bp, Mus musculus
gagccaggaggactagcattcccaa

SEQ ID NO: 479381 - DNA, 25 bp, Mus musculus
gagccaggaggagtagcattcccaa

SEQ ID NO: 479382 - DNA, 25 bp, Mus musculus
gagccaggagtaagtactcagcgat

SEQ ID NO: 479383 - DNA, 25 bp, Mus musculus
gagccaggagtatgtactcagcgat

SEQ ID NO: 479384 - DNA, 25 bp, Mus musculus
gagccaggagtcagaagcccctgaa

SEQ ID NO: 479385 - DNA, 25 bp, Mus musculus
gagccaggagtctgaagcccctgaa

SEQ ID NO: 479386 - DNA, 25 bp, Mus musculus
gagccaggattcagcaggagcgcca

SEQ ID NO: 479387 - DNA, 25 bp, Mus musculus
gagccaggattctgcaggagcgcca

SEQ ID NO: 479388 - DNA, 25 bp, Mus musculus
gagccaggcaacagtgtcctttcag

SEQ ID NO: 479389 - DNA, 25 bp, Mus musculus
gagccaggcaactgtgtcctttcag

SEQ ID NO: 479390 - DNA, 25 bp, Mus musculus
gagccaggcccgagaaccctggaga

SEQ ID NO: 479391 - DNA, 25 bp, Mus musculus
gagccaggcccgtgaaccctggaga

SEQ ID NO: 479392 - DNA, 25 bp, Mus musculus
gagccaggcctacagtaatcggaga

SEQ ID NO: 479393 - DNA, 25 bp, Mus musculus
gagccaggcctagagtaatcggaga

SEQ ID NO: 479394 - DNA, 25 bp, Mus musculus
gagccaggcctgaggcttggacatt

SEQ ID NO: 479395 - DNA, 25 bp, Mus musculus
gagccaggcctgatcaattttacaa

SEQ ID NO: 479396 - DNA, 25 bp, Mus musculus
gagccaggcctgtggcttggacatt

SEQ ID NO: 479397 - DNA, 25 bp, Mus musculus
gagccaggcctgttcaattttacaa

SEQ ID NO: 479398 - DNA, 25 bp, Mus musculus
gagccaggctcacggcgagcaatca

SEQ ID NO: 479399 - DNA, 25 bp, Mus musculus
gagccaggctcagggcgagcaatca

SEQ ID NO: 479400 - DNA, 25 bp, Mus musculus
gagccaggctctctactgggcgtta

SEQ ID NO: 479401 - DNA, 25 bp, Mus musculus
gagccaggctctcttgcagatggtt

SEQ ID NO: 479402 - DNA, 25 bp, Mus musculus
gagccaggctctgtactgggcgtta

SEQ ID NO: 479403 - DNA, 25 bp, Mus musculus
gagccaggctctgttgcagatggtt

SEQ ID NO: 479404 - DNA, 25 bp, Mus musculus
gagccaggcttacatgcacttgtga

SEQ ID NO: 479405 - DNA, 25 bp, Mus musculus
gagccaggcttagatgcacttgtga

SEQ ID NO: 479406 - DNA, 25 bp, Mus musculus
gagccaggctttctgaagcttttgc

SEQ ID NO: 479407 - DNA, 25 bp, Mus musculus
gagccaggctttcttcatcgtgctt

SEQ ID NO: 479408 - DNA, 25 bp, Mus musculus
gagccaggctttgtgaagcttttgc

SEQ ID NO: 479409 - DNA, 25 bp, Mus musculus
gagccaggctttgttcatcgtgctt

SEQ ID NO: 479410 - DNA, 25 bp, Mus musculus
gagccagggaagcataaaactgtaa

SEQ ID NO: 479411 - DNA, 25 bp, Mus musculus
gagccagggaaggataaaactgtaa

SEQ ID NO: 479412 - DNA, 25 bp, Mus musculus
gagccagggacaagaggtgcttcct

SEQ ID NO: 479413 - DNA, 25 bp, Mus musculus
gagccagggacatgaggtgcttcct

SEQ ID NO: 479414 - DNA, 25 bp, Mus musculus
gagccagggactcctgtgcatgcct

SEQ ID NO: 479415 - DNA, 25 bp, Mus musculus
gagccagggactgctgtgcatgcct

SEQ ID NO: 479416 - DNA, 25 bp, Mus musculus
gagccagggatgcattctctccaaa

SEQ ID NO: 479417 - DNA, 25 bp, Mus musculus
gagccagggatggattctctccaaa

SEQ ID NO: 479418 - DNA, 25 bp, Mus musculus
gagccagggcacatagaacattgct

SEQ ID NO: 479419 - DNA, 25 bp, Mus musculus
gagccagggcacttagaacattgct

SEQ ID NO: 479420 - DNA, 25 bp, Mus musculus
gagccagggccaacagaggtcacac

SEQ ID NO: 479421 - DNA, 25 bp, Mus musculus
gagccagggccatcagaggtcacac

SEQ ID NO: 479422 - DNA, 25 bp, Mus musculus
gagccagggctcctcatgatatttg

SEQ ID NO: 479423 - DNA, 25 bp, Mus musculus
gagccagggctcgtcatgatatttg

SEQ ID NO: 479424 - DNA, 25 bp, Mus musculus
gagccaggtacgaacagacgctgaa

SEQ ID NO: 479425 - DNA, 25 bp, Mus musculus
gagccaggtacgtacagacgctgaa

SEQ ID NO: 479426 - DNA, 25 bp, Mus musculus
gagccaggtcagaacttgcctgtaa

SEQ ID NO: 479427 - DNA, 25 bp, Mus musculus
gagccaggtcagtacttgcctgtaa

SEQ ID NO: 479428 - DNA, 25 bp, Mus musculus
gagccaggtcctacgaaggccacat

SEQ ID NO: 479429 - DNA, 25 bp, Mus musculus
gagccaggtccttcgaaggccacat

SEQ ID NO: 479430 - DNA, 25 bp, Mus musculus
gagccaggtgatcggctctatttta

SEQ ID NO: 479431 - DNA, 25 bp, Mus musculus
gagccaggtgatgggctctatttta

SEQ ID NO: 479432 - DNA, 25 bp, Mus musculus
gagccaggttaacaactgacttatc

SEQ ID NO: 479433 - DNA, 25 bp, Mus musculus
gagccaggttaagaactgacttatc

SEQ ID NO: 479434 - DNA, 25 bp, Mus musculus
gagccaggttcaccatttcggaact

SEQ ID NO: 479435 - DNA, 25 bp, Mus musculus
gagccaggttcagcatttcggaact

SEQ ID NO: 479436 - DNA, 25 bp, Mus musculus
gagccaggttgtacggccacaggaa

SEQ ID NO: 479437 - DNA, 25 bp, Mus musculus
gagccaggttgttcggccacaggaa

SEQ ID NO: 479438 - DNA, 25 bp, Mus musculus
gagccaggtttcaacctagtgatct

SEQ ID NO: 479439 - DNA, 25 bp, Mus musculus
gagccaggtttctacctagtgatct

SEQ ID NO: 479440 - DNA, 25 bp, Mus musculus
gagccagtaaacagtctaaaccaga

SEQ ID NO: 479441 - DNA, 25 bp, Mus musculus
gagccagtaaactgtctaaaccaga

SEQ ID NO: 479442 - DNA, 25 bp, Mus musculus
gagccagtaagtagaatcaagcata

SEQ ID NO: 479443 - DNA, 25 bp, Mus musculus
gagccagtaagttgaatcaagcata

SEQ ID NO: 479444 - DNA, 25 bp, Mus musculus
gagccagtaataccccttttcaaag

SEQ ID NO: 479445 - DNA, 25 bp, Mus musculus
gagccagtaatagcccttttcaaag

SEQ ID NO: 479446 - DNA, 25 bp, Mus musculus
gagccagtacacaagggtccaggag

SEQ ID NO: 479447 - DNA, 25 bp, Mus musculus
gagccagtacactagggtccaggag

SEQ ID NO: 479448 - DNA, 25 bp, Mus musculus
gagccagtaccaatgagtgctgtca

SEQ ID NO: 479449 - DNA, 25 bp, Mus musculus
gagccagtaccattgagtgctgtca

SEQ ID NO: 479450 - DNA, 25 bp, Mus musculus
gagccagtactccaaaaacttgcca

SEQ ID NO: 479451 - DNA, 25 bp, Mus musculus
gagccagtactcgaaaaacttgcca

SEQ ID NO: 479452 - DNA, 25 bp, Mus musculus
gagccagtactgaagtcttagcttt

SEQ ID NO: 479453 - DNA, 25 bp, Mus musculus
gagccagtactgtagtcttagcttt

SEQ ID NO: 479454 - DNA, 25 bp, Mus musculus
gagccagtagcaacgtggacctgaa

SEQ ID NO: 479455 - DNA, 25 bp, Mus musculus
gagccagtagcatcgtggacctgaa

SEQ ID NO: 479456 - DNA, 25 bp, Mus musculus
gagccagtaggtctaatccccagga

SEQ ID NO: 479457 - DNA, 25 bp, Mus musculus
gagccagtaggtgtaatccccagga

SEQ ID NO: 479458 - DNA, 25 bp, Mus musculus
gagccagtatgtagcttcttgggaa

SEQ ID NO: 479459 - DNA, 25 bp, Mus musculus
gagccagtatgttgcttcttgggaa

SEQ ID NO: 479460 - DNA, 25 bp, Mus musculus
gagccagtccccagtattttacaaa

SEQ ID NO: 479461 - DNA, 25 bp, Mus musculus
gagccagtcccctgtattttacaaa

SEQ ID NO: 479462 - DNA, 25 bp, Mus musculus
gagccagtcctacccacattattga

SEQ ID NO: 479463 - DNA, 25 bp, Mus musculus
gagccagtcctagccacattattga

SEQ ID NO: 479464 - DNA, 25 bp, Mus musculus
gagccagtctccatcaaagtggcat

SEQ ID NO: 479465 - DNA, 25 bp, Mus musculus
gagccagtctccatggagtttctgg

SEQ ID NO: 479466 - DNA, 25 bp, Mus musculus
gagccagtctccttcaaagtggcat

SEQ ID NO: 479467 - DNA, 25 bp, Mus musculus
gagccagtctccttggagtttctgg

SEQ ID NO: 479468 - DNA, 25 bp, Mus musculus
gagccagtctctatgcaaaggacta

SEQ ID NO: 479469 - DNA, 25 bp, Mus musculus
gagccagtctctttgcaaaggacta

SEQ ID NO: 479470 - DNA, 25 bp, Mus musculus
gagccagtgctgacacgaagttatg

SEQ ID NO: 479471 - DNA, 25 bp, Mus musculus
gagccagtgctgcttggtgttatat

SEQ ID NO: 479472 - DNA, 25 bp, Mus musculus
gagccagtgctggttggtgttatat

SEQ ID NO: 479473 - DNA, 25 bp, Mus musculus
gagccagtgctgtcacgaagttatg

SEQ ID NO: 479474 - DNA, 25 bp, Mus musculus
gagccagtggacaaacatcctgttt

SEQ ID NO: 479475 - DNA, 25 bp, Mus musculus
gagccagtggactaacatcctgttt

SEQ ID NO: 479476 - DNA, 25 bp, Mus musculus
gagccagtggcacttgctaagaaca

SEQ ID NO: 479477 - DNA, 25 bp, Mus musculus
gagccagtggcagttgctaagaaca

SEQ ID NO: 479478 - DNA, 25 bp, Mus musculus
gagccagtgggtactaattctttca

SEQ ID NO: 479479 - DNA, 25 bp, Mus musculus
gagccagtgggtccttactgcttac

SEQ ID NO: 479480 - DNA, 25 bp, Mus musculus
gagccagtgggtgcttactgcttac

SEQ ID NO: 479481 - DNA, 25 bp, Mus musculus
gagccagtgggttctaattctttca

SEQ ID NO: 479482 - DNA, 25 bp, Mus musculus
gagccagtgtccatcaagctgtttt

SEQ ID NO: 479483 - DNA, 25 bp, Mus musculus
gagccagtgtccttcaagctgtttt

SEQ ID NO: 479484 - DNA, 25 bp, Mus musculus
gagccagtgtctaatttcttagcat

SEQ ID NO: 479485 - DNA, 25 bp, Mus musculus
gagccagtgtcttatttcttagcat

SEQ ID NO: 479486 - DNA, 25 bp, Mus musculus
gagccagtgtgtaagtgagcagcct

SEQ ID NO: 479487 - DNA, 25 bp, Mus musculus
gagccagtgtgttagtgagcagcct

SEQ ID NO: 479488 - DNA, 25 bp, Mus musculus
gagccagtgttcagcataatcagga

SEQ ID NO: 479489 - DNA, 25 bp, Mus musculus
gagccagtgttctgcataatcagga

SEQ ID NO: 479490 - DNA, 25 bp, Mus musculus
gagccagtgtttcacccaagaggtc

SEQ ID NO: 479491 - DNA, 25 bp, Mus musculus
gagccagtgtttgacccaagaggtc

SEQ ID NO: 479492 - DNA, 25 bp, Mus musculus
gagccagttaccattgctgtcattt

SEQ ID NO: 479493 - DNA, 25 bp, Mus musculus
gagccagttacctttgctgtcattt

SEQ ID NO: 479494 - DNA, 25 bp, Mus musculus
gagccagttactcttgttaccaagg

SEQ ID NO: 479495 - DNA, 25 bp, Mus musculus
gagccagttactgttgttaccaagg

SEQ ID NO: 479496 - DNA, 25 bp, Mus musculus
gagccagttatcagctgatgggtca

SEQ ID NO: 479497 - DNA, 25 bp, Mus musculus
gagccagttatctgctgatgggtca

SEQ ID NO: 479498 - DNA, 25 bp, Mus musculus
gagccagttccacgcgaatctaaca

SEQ ID NO: 479499 - DNA, 25 bp, Mus musculus
gagccagttccaggcgaatctaaca

SEQ ID NO: 479500 - DNA, 25 bp, Mus musculus
gagccagttctgagtcccaggtgac

SEQ ID NO: 479501 - DNA, 25 bp, Mus musculus
gagccagttctgtgtcccaggtgac

SEQ ID NO: 479502 - DNA, 25 bp, Mus musculus
gagccagttcttatccaatgaagta

SEQ ID NO: 479503 - DNA, 25 bp, Mus musculus
gagccagttcttttccaatgaagta

SEQ ID NO: 479504 - DNA, 25 bp, Mus musculus
gagccagttgagatgcatgtgtcta

SEQ ID NO: 479505 - DNA, 25 bp, Mus musculus
gagccagttgagttgcatgtgtcta

SEQ ID NO: 479506 - DNA, 25 bp, Mus musculus
gagccagttggtatctgttgtgcta

SEQ ID NO: 479507 - DNA, 25 bp, Mus musculus
gagccagttggtttctgttgtgcta

SEQ ID NO: 479508 - DNA, 25 bp, Mus musculus
gagccagttgttacagtgtcctctc

SEQ ID NO: 479509 - DNA, 25 bp, Mus musculus
gagccagttgtttcagtgtcctctc

SEQ ID NO: 479510 - DNA, 25 bp, Mus musculus
gagccagtttatcttacgactgccc

SEQ ID NO: 479511 - DNA, 25 bp, Mus musculus
gagccagtttatgttacgactgccc

SEQ ID NO: 479512 - DNA, 25 bp, Mus musculus
gagccagtttctcaaggtccacagc

SEQ ID NO: 479513 - DNA, 25 bp, Mus musculus
gagccagtttctgaaggtccacagc

SEQ ID NO: 479514 - DNA, 25 bp, Mus musculus
gagccagtttgcagatggttgccaa

SEQ ID NO: 479515 - DNA, 25 bp, Mus musculus
gagccagtttgctgatggttgccaa

SEQ ID NO: 479516 - DNA, 25 bp, Mus musculus
gagccataagatcgcgctagcctcc

SEQ ID NO: 479517 - DNA, 25 bp, Mus musculus
gagccataagatggcgctagcctcc

SEQ ID NO: 479518 - DNA, 25 bp, Mus musculus
gagccataagggattgtccaagaca

SEQ ID NO: 479519 - DNA, 25 bp, Mus musculus
gagccataagggtttgtccaagaca

SEQ ID NO: 479520 - DNA, 25 bp, Mus musculus
gagccataatatatcccttggccag

SEQ ID NO: 479521 - DNA, 25 bp, Mus musculus
gagccataatatttcccttggccag

SEQ ID NO: 479522 - DNA, 25 bp, Mus musculus
gagccataatgtacttgtgatgcca

SEQ ID NO: 479523 - DNA, 25 bp, Mus musculus
gagccataatgttcttgtgatgcca

SEQ ID NO: 479524 - DNA, 25 bp, Mus musculus
gagccatagagtaggtccaagcagt

SEQ ID NO: 479525 - DNA, 25 bp, Mus musculus
gagccatagagttggtccaagcagt

SEQ ID NO: 479526 - DNA, 25 bp, Mus musculus
gagccatagatgcataccccactat

SEQ ID NO: 479527 - DNA, 25 bp, Mus musculus
gagccatagatggataccccactat

SEQ ID NO: 479528 - DNA, 25 bp, Mus musculus
gagccatagcatcctgcatagggta

SEQ ID NO: 479529 - DNA, 25 bp, Mus musculus
gagccatagcatgctgcatagggta

SEQ ID NO: 479530 - DNA, 25 bp, Mus musculus
gagccatagccccttataataggtt

SEQ ID NO: 479531 - DNA, 25 bp, Mus musculus
gagccatagcccgttataataggtt

SEQ ID NO: 479532 - DNA, 25 bp, Mus musculus
gagccatagctcacagtgactcatg

SEQ ID NO: 479533 - DNA, 25 bp, Mus musculus
gagccatagctctcagtgactcatg

SEQ ID NO: 479534 - DNA, 25 bp, Mus musculus
gagccataggcaaggagttgccagt

SEQ ID NO: 479535 - DNA, 25 bp, Mus musculus
gagccataggcatggagttgccagt

SEQ ID NO: 479536 - DNA, 25 bp, Mus musculus
gagccatagtaaagccagtagatat

SEQ ID NO: 479537 - DNA, 25 bp, Mus musculus
gagccatagtaatgccagtagatat

SEQ ID NO: 479538 - DNA, 25 bp, Mus musculus
gagccatagtgaataagggctgttt

SEQ ID NO: 479539 - DNA, 25 bp, Mus musculus
gagccatagtgattaagggctgttt

SEQ ID NO: 479540 - DNA, 25 bp, Mus musculus
gagccatatatgagccctagctgtg

SEQ ID NO: 479541 - DNA, 25 bp, Mus musculus
gagccatatatgtgccctagctgtg

SEQ ID NO: 479542 - DNA, 25 bp, Mus musculus
gagccatatcaaacctgtactgttg

SEQ ID NO: 479543 - DNA, 25 bp, Mus musculus
gagccatatcaatcctgtactgttg

SEQ ID NO: 479544 - DNA, 25 bp, Mus musculus
gagccatattccaccactcactggg

SEQ ID NO: 479545 - DNA, 25 bp, Mus musculus
gagccatattcctccactcactggg

SEQ ID NO: 479546 - DNA, 25 bp, Mus musculus
gagccatcaaaccaactctgcggag

SEQ ID NO: 479547 - DNA, 25 bp, Mus musculus
gagccatcaaacgaactctgcggag

SEQ ID NO: 479548 - DNA, 25 bp, Mus musculus
gagccatcaactatgctacattttg

SEQ ID NO: 479549 - DNA, 25 bp, Mus musculus
gagccatcaactttgctacattttg

SEQ ID NO: 479550 - DNA, 25 bp, Mus musculus
gagccatcaagtctaactgaacagg

SEQ ID NO: 479551 - DNA, 25 bp, Mus musculus
gagccatcaagtgtaactgaacagg

SEQ ID NO: 479552 - DNA, 25 bp, Mus musculus
gagccatcacggatacacggtgact

SEQ ID NO: 479553 - DNA, 25 bp, Mus musculus
gagccatcacggttacacggtgact

SEQ ID NO: 479554 - DNA, 25 bp, Mus musculus
gagccatcactgagctgtgcttctg

SEQ ID NO: 479555 - DNA, 25 bp, Mus musculus
gagccatcactgtgctgtgcttctg

SEQ ID NO: 479556 - DNA, 25 bp, Mus musculus
gagccatcatcgcgccaaattttgc

SEQ ID NO: 479557 - DNA, 25 bp, Mus musculus
gagccatcatcgggccaaattttgc

SEQ ID NO: 479558 - DNA, 25 bp, Mus musculus
gagccatcatgtacctctgaatgcc

SEQ ID NO: 479559 - DNA, 25 bp, Mus musculus
gagccatcatgttcctctgaatgcc

SEQ ID NO: 479560 - DNA, 25 bp, Mus musculus
gagccatccatacacatatatccat

SEQ ID NO: 479561 - DNA, 25 bp, Mus musculus
gagccatccatagacatatatccat

SEQ ID NO: 479562 - DNA, 25 bp, Mus musculus
gagccatccatgaaccaagtgaact

SEQ ID NO: 479563 - DNA, 25 bp, Mus musculus
gagccatccatgaggctgtggagca

SEQ ID NO: 479564 - DNA, 25 bp, Mus musculus
gagccatccatgtaccaagtgaact

SEQ ID NO: 479565 - DNA, 25 bp, Mus musculus
gagccatccatgtggctgtggagca

SEQ ID NO: 479566 - DNA, 25 bp, Mus musculus
gagccatcccacatgagaacatttt

SEQ ID NO: 479567 - DNA, 25 bp, Mus musculus
gagccatcccacttgagaacatttt

SEQ ID NO: 479568 - DNA, 25 bp, Mus musculus
gagccatcccagcacatttttacag

SEQ ID NO: 479569 - DNA, 25 bp, Mus musculus
gagccatcccaggacatttttacag

SEQ ID NO: 479570 - DNA, 25 bp, Mus musculus
gagccatcccatatactttcatatt

SEQ ID NO: 479571 - DNA, 25 bp, Mus musculus
gagccatcccatttactttcatatt

SEQ ID NO: 479572 - DNA, 25 bp, Mus musculus
gagccatccccacaatctatacgaa

SEQ ID NO: 479573 - DNA, 25 bp, Mus musculus
gagccatccccagaatctatacgaa

SEQ ID NO: 479574 - DNA, 25 bp, Mus musculus
gagccatcctttcaatcatactcaa

SEQ ID NO: 479575 - DNA, 25 bp, Mus musculus
gagccatcctttgaatcatactcaa

SEQ ID NO: 479576 - DNA, 25 bp, Mus musculus
gagccatcggctaggactcaagaca

SEQ ID NO: 479577 - DNA, 25 bp, Mus musculus
gagccatcggcttggactcaagaca

SEQ ID NO: 479578 - DNA, 25 bp, Mus musculus
gagccatcgtcgcattttcacatta

SEQ ID NO: 479579 - DNA, 25 bp, Mus musculus
gagccatcgtcggattttcacatta

SEQ ID NO: 479580 - DNA, 25 bp, Mus musculus
gagccatctaaacactcactggaag

SEQ ID NO: 479581 - DNA, 25 bp, Mus musculus
gagccatctaaagactcactggaag

SEQ ID NO: 479582 - DNA, 25 bp, Mus musculus
gagccatctacaatggtcagataca

SEQ ID NO: 479583 - DNA, 25 bp, Mus musculus
gagccatctacattggtcagataca

SEQ ID NO: 479584 - DNA, 25 bp, Mus musculus
gagccatctactaaaaggccacagg

SEQ ID NO: 479585 - DNA, 25 bp, Mus musculus
gagccatctacttaaaggccacagg

SEQ ID NO: 479586 - DNA, 25 bp, Mus musculus
gagccatctatcacataacaaccag

SEQ ID NO: 479587 - DNA, 25 bp, Mus musculus
gagccatctatctcataacaaccag

SEQ ID NO: 479588 - DNA, 25 bp, Mus musculus
gagccatctcagctgttcataatag

SEQ ID NO: 479589 - DNA, 25 bp, Mus musculus
gagccatctcaggtgttcataatag

SEQ ID NO: 479590 - DNA, 25 bp, Mus musculus
gagccatctcctaggccagaagcat

SEQ ID NO: 479591 - DNA, 25 bp, Mus musculus
gagccatctccttggccagaagcat

SEQ ID NO: 479592 - DNA, 25 bp, Mus musculus
gagccatctggcagttctcctaatg

SEQ ID NO: 479593 - DNA, 25 bp, Mus musculus
gagccatctggctgttctcctaatg

SEQ ID NO: 479594 - DNA, 25 bp, Mus musculus
gagccatcttctaagccatagtagt

SEQ ID NO: 479595 - DNA, 25 bp, Mus musculus
gagccatcttcttagccatagtagt

SEQ ID NO: 479596 - DNA, 25 bp, Mus musculus
gagccatcttgaagctcctcacaca

SEQ ID NO: 479597 - DNA, 25 bp, Mus musculus
gagccatcttgatgctcctcacaca

SEQ ID NO: 479598 - DNA, 25 bp, Mus musculus
gagccatctttcacagagtatgcta

SEQ ID NO: 479599 - DNA, 25 bp, Mus musculus
gagccatctttctcagagtatgcta

SEQ ID NO: 479600 - DNA, 25 bp, Mus musculus
gagccatctttgaagcccttctgtg

SEQ ID NO: 479601 - DNA, 25 bp, Mus musculus
gagccatctttgtagcccttctgtg

SEQ ID NO: 479602 - DNA, 25 bp, Mus musculus
gagccatgaaacaaaaggagtccat

SEQ ID NO: 479603 - DNA, 25 bp, Mus musculus
gagccatgaaactaaaggagtccat

SEQ ID NO: 479604 - DNA, 25 bp, Mus musculus
gagccatgaaggagcacaagaccat

SEQ ID NO: 479605 - DNA, 25 bp, Mus musculus
gagccatgaaggtgcacaagaccat

SEQ ID NO: 479606 - DNA, 25 bp, Mus musculus
gagccatgatctagtgcttggtgtt

SEQ ID NO: 479607 - DNA, 25 bp, Mus musculus
gagccatgatcttgtgcttggtgtt

SEQ ID NO: 479608 - DNA, 25 bp, Mus musculus
gagccatgatttagagtctagcctg

SEQ ID NO: 479609 - DNA, 25 bp, Mus musculus
gagccatgattttgagtctagcctg

SEQ ID NO: 479610 - DNA, 25 bp, Mus musculus
gagccatgcattaggcactactgtc

SEQ ID NO: 479611 - DNA, 25 bp, Mus musculus
gagccatgcatttggcactactgtc

SEQ ID NO: 479612 - DNA, 25 bp, Mus musculus
gagccatgccatattatactttcac

SEQ ID NO: 479613 - DNA, 25 bp, Mus musculus
gagccatgccattttatactttcac

SEQ ID NO: 479614 - DNA, 25 bp, Mus musculus
gagccatgctgcaggtttatttaca

SEQ ID NO: 479615 - DNA, 25 bp, Mus musculus
gagccatgctgctggtttatttaca

SEQ ID NO: 479616 - DNA, 25 bp, Mus musculus
gagccatgctgtaaaaccctgtttt

SEQ ID NO: 479617 - DNA, 25 bp, Mus musculus
gagccatgctgttaaaccctgtttt

SEQ ID NO: 479618 - DNA, 25 bp, Mus musculus
gagccatgctttctagagtgcttta

SEQ ID NO: 479619 - DNA, 25 bp, Mus musculus
gagccatgctttgtagagtgcttta

SEQ ID NO: 479620 - DNA, 25 bp, Mus musculus
gagccatggaacaaactgggtccca

SEQ ID NO: 479621 - DNA, 25 bp, Mus musculus
gagccatggaactaactgggtccca

SEQ ID NO: 479622 - DNA, 25 bp, Mus musculus
gagccatggacaagactaccttgtg

SEQ ID NO: 479623 - DNA, 25 bp, Mus musculus
gagccatggacatgactaccttgtg

SEQ ID NO: 479624 - DNA, 25 bp, Mus musculus
gagccatggagcacttgccctggag

SEQ ID NO: 479625 - DNA, 25 bp, Mus musculus
gagccatggagctcttgccctggag

SEQ ID NO: 479626 - DNA, 25 bp, Mus musculus
gagccatggaggacatttcctcaaa

SEQ ID NO: 479627 - DNA, 25 bp, Mus musculus
gagccatggaggtcatttcctcaaa

SEQ ID NO: 479628 - DNA, 25 bp, Mus musculus
gagccatggattctgagtttcattt

SEQ ID NO: 479629 - DNA, 25 bp, Mus musculus
gagccatggattgtgagtttcattt

SEQ ID NO: 479630 - DNA, 25 bp, Mus musculus
gagccatggcaactgagattctaag

SEQ ID NO: 479631 - DNA, 25 bp, Mus musculus
gagccatggcaagtgagattctaag

SEQ ID NO: 479632 - DNA, 25 bp, Mus musculus
gagccatggcctaggtgaaactccc

SEQ ID NO: 479633 - DNA, 25 bp, Mus musculus
gagccatggccttggtgaaactccc

SEQ ID NO: 479634 - DNA, 25 bp, Mus musculus
gagccatgggaaaggaggatatcct

SEQ ID NO: 479635 - DNA, 25 bp, Mus musculus
gagccatgggaatggaggatatcct

SEQ ID NO: 479636 - DNA, 25 bp, Mus musculus
gagccatgggaccttacaatgtagc

SEQ ID NO: 479637 - DNA, 25 bp, Mus musculus
gagccatgggacgttacaatgtagc

SEQ ID NO: 479638 - DNA, 25 bp, Mus musculus
gagccatgggagctagacccttttt

SEQ ID NO: 479639 - DNA, 25 bp, Mus musculus
gagccatgggaggtagacccttttt

SEQ ID NO: 479640 - DNA, 25 bp, Mus musculus
gagccatggtaacgacacctcctta

SEQ ID NO: 479641 - DNA, 25 bp, Mus musculus
gagccatggtaaggacacctcctta

SEQ ID NO: 479642 - DNA, 25 bp, Mus musculus
gagccatggtttagctgtatactac

SEQ ID NO: 479643 - DNA, 25 bp, Mus musculus
gagccatggttttgctgtatactac

SEQ ID NO: 479644 - DNA, 25 bp, Mus musculus
gagccatgtcctacagtagctaatg

SEQ ID NO: 479645 - DNA, 25 bp, Mus musculus
gagccatgtccttcagtagctaatg

SEQ ID NO: 479646 - DNA, 25 bp, Mus musculus
gagccatgtctgctatattccactc

SEQ ID NO: 479647 - DNA, 25 bp, Mus musculus
gagccatgtctggtatattccactc

SEQ ID NO: 479648 - DNA, 25 bp, Mus musculus
gagccatgtgtgatgcgtactgtga

SEQ ID NO: 479649 - DNA, 25 bp, Mus musculus
gagccatgtgtgttgcgtactgtga

SEQ ID NO: 479650 - DNA, 25 bp, Mus musculus
gagccattaacaccagtgttcttct

SEQ ID NO: 479651 - DNA, 25 bp, Mus musculus
gagccattaacagcagtgttcttct

SEQ ID NO: 479652 - DNA, 25 bp, Mus musculus
gagccattaactcaagatgaagcaa

SEQ ID NO: 479653 - DNA, 25 bp, Mus musculus
gagccattaactgaagatgaagcaa

SEQ ID NO: 479654 - DNA, 25 bp, Mus musculus
gagccattacatcgttgggagaaca

SEQ ID NO: 479655 - DNA, 25 bp, Mus musculus
gagccattacatggttgggagaaca

SEQ ID NO: 479656 - DNA, 25 bp, Mus musculus
gagccattacctaccagattgctaa

SEQ ID NO: 479657 - DNA, 25 bp, Mus musculus
gagccattaccttccagattgctaa

SEQ ID NO: 479658 - DNA, 25 bp, Mus musculus
gagccattactccaactgtttccac

SEQ ID NO: 479659 - DNA, 25 bp, Mus musculus
gagccattactcgaactgtttccac

SEQ ID NO: 479660 - DNA, 25 bp, Mus musculus
gagccattatagcaagacctacctt

SEQ ID NO: 479661 - DNA, 25 bp, Mus musculus
gagccattataggaagacctacctt

SEQ ID NO: 479662 - DNA, 25 bp, Mus musculus
gagccattatctagtcttattgaat

SEQ ID NO: 479663 - DNA, 25 bp, Mus musculus
gagccattatcttgtcttattgaat

SEQ ID NO: 479664 - DNA, 25 bp, Mus musculus
gagccattcactcgtcagagacatt

SEQ ID NO: 479665 - DNA, 25 bp, Mus musculus
gagccattcactggtcagagacatt

SEQ ID NO: 479666 - DNA, 25 bp, Mus musculus
gagccattccatatagtgatcaaga

SEQ ID NO: 479667 - DNA, 25 bp, Mus musculus
gagccattccatccagtgcgttgaa

SEQ ID NO: 479668 - DNA, 25 bp, Mus musculus
gagccattccatcctgggtgcaaaa

SEQ ID NO: 479669 - DNA, 25 bp, Mus musculus
gagccattccatgcagtgcgttgaa

SEQ ID NO: 479670 - DNA, 25 bp, Mus musculus
gagccattccatgctgggtgcaaaa

SEQ ID NO: 479671 - DNA, 25 bp, Mus musculus
gagccattccatttagtgatcaaga

SEQ ID NO: 479672 - DNA, 25 bp, Mus musculus
gagccattgactccggtgcagcata

SEQ ID NO: 479673 - DNA, 25 bp, Mus musculus
gagccattgactgcggtgcagcata

SEQ ID NO: 479674 - DNA, 25 bp, Mus musculus
gagccattgagtcgacatcctttaa

SEQ ID NO: 479675 - DNA, 25 bp, Mus musculus
gagccattgagtggacatcctttaa

SEQ ID NO: 479676 - DNA, 25 bp, Mus musculus
gagccattgcacaaagttaaatctg

SEQ ID NO: 479677 - DNA, 25 bp, Mus musculus
gagccattgcacagtgtcttattta

SEQ ID NO: 479678 - DNA, 25 bp, Mus musculus
gagccattgcactaagttaaatctg

SEQ ID NO: 479679 - DNA, 25 bp, Mus musculus
gagccattgcactgtgtcttattta

SEQ ID NO: 479680 - DNA, 25 bp, Mus musculus
gagccattgcatatctagtgtgtga

SEQ ID NO: 479681 - DNA, 25 bp, Mus musculus
gagccattgcatttctagtgtgtga

SEQ ID NO: 479682 - DNA, 25 bp, Mus musculus
gagccattgtctctgcaaacagcaa

SEQ ID NO: 479683 - DNA, 25 bp, Mus musculus
gagccattgtctgtgcaaacagcaa

SEQ ID NO: 479684 - DNA, 25 bp, Mus musculus
gagccattgtgaatgtctccagcca

SEQ ID NO: 479685 - DNA, 25 bp, Mus musculus
gagccattgtgattgtctccagcca

SEQ ID NO: 479686 - DNA, 25 bp, Mus musculus
gagccattgttcaaggtccctgagg

SEQ ID NO: 479687 - DNA, 25 bp, Mus musculus
gagccattgttctaggtccctgagg

SEQ ID NO: 479688 - DNA, 25 bp, Mus musculus
gagccattgttgaatctgttccatt

SEQ ID NO: 479689 - DNA, 25 bp, Mus musculus
gagccattgttgtatctgttccatt

SEQ ID NO: 479690 - DNA, 25 bp, Mus musculus
gagccatttagaaggctgcccattc

SEQ ID NO: 479691 - DNA, 25 bp, Mus musculus
gagccatttagatggctgcccattc

SEQ ID NO: 479692 - DNA, 25 bp, Mus musculus
gagccatttctacacttatgtcagt

SEQ ID NO: 479693 - DNA, 25 bp, Mus musculus
gagccatttctagacttatgtcagt

SEQ ID NO: 479694 - DNA, 25 bp, Mus musculus
gagccatttgagaatgttgcatcct

SEQ ID NO: 479695 - DNA, 25 bp, Mus musculus
gagccatttgagtatgttgcatcct

SEQ ID NO: 479696 - DNA, 25 bp, Mus musculus
gagccatttgccagtctagcatgtt

SEQ ID NO: 479697 - DNA, 25 bp, Mus musculus
gagccatttgccatttctgtgcaga

SEQ ID NO: 479698 - DNA, 25 bp, Mus musculus
gagccatttgcctgtctagcatgtt

SEQ ID NO: 479699 - DNA, 25 bp, Mus musculus
gagccatttgccttttctgtgcaga

SEQ ID NO: 479700 - DNA, 25 bp, Mus musculus
gagccatttgctctatttgcctggt

SEQ ID NO: 479701 - DNA, 25 bp, Mus musculus
gagccatttgctgtatttgcctggt

SEQ ID NO: 479702 - DNA, 25 bp, Mus musculus
gagccatttgtacagtactttctgt

SEQ ID NO: 479703 - DNA, 25 bp, Mus musculus
gagccatttgtagagtactttctgt

SEQ ID NO: 479704 - DNA, 25 bp, Mus musculus
gagccattttagacttcatagttat

SEQ ID NO: 479705 - DNA, 25 bp, Mus musculus
gagccattttagtcttcatagttat

SEQ ID NO: 479706 - DNA, 25 bp, Mus musculus
gagccattttggagtatttttagtt

SEQ ID NO: 479707 - DNA, 25 bp, Mus musculus
gagccattttggatttcatgccagg

SEQ ID NO: 479708 - DNA, 25 bp, Mus musculus
gagccattttggtgtatttttagtt

SEQ ID NO: 479709 - DNA, 25 bp, Mus musculus
gagccattttggttttcatgccagg

SEQ ID NO: 479710 - DNA, 25 bp, Mus musculus
gagcccaaacaccagcacaggagat

SEQ ID NO: 479711 - DNA, 25 bp, Mus musculus
gagcccaaacacgagcacaggagat

SEQ ID NO: 479712 - DNA, 25 bp, Mus musculus
gagcccaaactcattaaggtaccct

SEQ ID NO: 479713 - DNA, 25 bp, Mus musculus
gagcccaaactctttaaggtaccct

SEQ ID NO: 479714 - DNA, 25 bp, Mus musculus
gagcccaaagagaatgagcctccat

SEQ ID NO: 479715 - DNA, 25 bp, Mus musculus
gagcccaaagagtatgagcctccat

SEQ ID NO: 479716 - DNA, 25 bp, Mus musculus
gagcccaaaggactgcttttgctat

SEQ ID NO: 479717 - DNA, 25 bp, Mus musculus
gagcccaaaggagtgcttttgctat

SEQ ID NO: 479718 - DNA, 25 bp, Mus musculus
gagcccaaagttcagaaatggcctc

SEQ ID NO: 479719 - DNA, 25 bp, Mus musculus
gagcccaaagttgagaaatggcctc

SEQ ID NO: 479720 - DNA, 25 bp, Mus musculus
gagcccaacagccttataagaagca

SEQ ID NO: 479721 - DNA, 25 bp, Mus musculus
gagcccaacagcgttataagaagca

SEQ ID NO: 479722 - DNA, 25 bp, Mus musculus
gagcccaacattagagttccactgt

SEQ ID NO: 479723 - DNA, 25 bp, Mus musculus
gagcccaacatttgagttccactgt

SEQ ID NO: 479724 - DNA, 25 bp, Mus musculus
gagcccaactcacattactaactag

SEQ ID NO: 479725 - DNA, 25 bp, Mus musculus
gagcccaactcagattactaactag

SEQ ID NO: 479726 - DNA, 25 bp, Mus musculus
gagcccaagctaacctcaaacttac

SEQ ID NO: 479727 - DNA, 25 bp, Mus musculus
gagcccaagctatcctcaaacttac

SEQ ID NO: 479728 - DNA, 25 bp, Mus musculus
gagcccaaggataccgatcagaagc

SEQ ID NO: 479729 - DNA, 25 bp, Mus musculus
gagcccaaggatcgcccctgtagct

SEQ ID NO: 479730 - DNA, 25 bp, Mus musculus
gagcccaaggatggcccctgtagct

SEQ ID NO: 479731 - DNA, 25 bp, Mus musculus
gagcccaaggattccgatcagaagc

SEQ ID NO: 479732 - DNA, 25 bp, Mus musculus
gagcccaaggttaccaatgaaggag

SEQ ID NO: 479733 - DNA, 25 bp, Mus musculus
gagcccaaggtttccaatgaaggag

SEQ ID NO: 479734 - DNA, 25 bp, Mus musculus
gagcccaagtagaggcttcctatga

SEQ ID NO: 479735 - DNA, 25 bp, Mus musculus
gagcccaagtagtggcttcctatga

SEQ ID NO: 479736 - DNA, 25 bp, Mus musculus
gagcccaagtatatttacattaaag

SEQ ID NO: 479737 - DNA, 25 bp, Mus musculus
gagcccaagtatttttacattaaag

SEQ ID NO: 479738 - DNA, 25 bp, Mus musculus
gagcccaagtcaccaaagttataat

SEQ ID NO: 479739 - DNA, 25 bp, Mus musculus
gagcccaagtcagcaaagttataat

SEQ ID NO: 479740 - DNA, 25 bp, Mus musculus
gagcccaagttccagtttgctgtca

SEQ ID NO: 479741 - DNA, 25 bp, Mus musculus
gagcccaagttcgagtttgctgtca

SEQ ID NO: 479742 - DNA, 25 bp, Mus musculus
gagcccaagtttcaatcccagtcac

SEQ ID NO: 479743 - DNA, 25 bp, Mus musculus
gagcccaagtttgaatcccagtcac

SEQ ID NO: 479744 - DNA, 25 bp, Mus musculus
gagcccaattcacattatttctgag

SEQ ID NO: 479745 - DNA, 25 bp, Mus musculus
gagcccaattcagattatttctgag

SEQ ID NO: 479746 - DNA, 25 bp, Mus musculus
gagcccacaaagaagctgaaagtcc

SEQ ID NO: 479747 - DNA, 25 bp, Mus musculus
gagcccacaaagtagctgaaagtcc

SEQ ID NO: 479748 - DNA, 25 bp, Mus musculus
gagcccacacagcaaggcaagctgt

SEQ ID NO: 479749 - DNA, 25 bp, Mus musculus
gagcccacacaggaaggcaagctgt

SEQ ID NO: 479750 - DNA, 25 bp, Mus musculus
gagcccacaggccatatcaagacca

SEQ ID NO: 479751 - DNA, 25 bp, Mus musculus
gagcccacaggcgatatcaagacca

SEQ ID NO: 479752 - DNA, 25 bp, Mus musculus
gagcccacaggtactaatcagacaa

SEQ ID NO: 479753 - DNA, 25 bp, Mus musculus
gagcccacaggtagattcctgccaa

SEQ ID NO: 479754 - DNA, 25 bp, Mus musculus
gagcccacaggtagggtccattgtg

SEQ ID NO: 479755 - DNA, 25 bp, Mus musculus
gagcccacaggttctaatcagacaa

SEQ ID NO: 479756 - DNA, 25 bp, Mus musculus
gagcccacaggttgattcctgccaa

SEQ ID NO: 479757 - DNA, 25 bp, Mus musculus
gagcccacaggttgggtccattgtg

SEQ ID NO: 479758 - DNA, 25 bp, Mus musculus
gagcccacagtgcacgtttctttgt

SEQ ID NO: 479759 - DNA, 25 bp, Mus musculus
gagcccacagtggacgtttctttgt

SEQ ID NO: 479760 - DNA, 25 bp, Mus musculus
gagcccaccattacagatgcaatca

SEQ ID NO: 479761 - DNA, 25 bp, Mus musculus
gagcccaccatttcagatgcaatca

SEQ ID NO: 479762 - DNA, 25 bp, Mus musculus
gagcccaccccaaacatttattgta

SEQ ID NO: 479763 - DNA, 25 bp, Mus musculus
gagcccaccccatacatttattgta

SEQ ID NO: 479764 - DNA, 25 bp, Mus musculus
gagcccaccggaagcaggaagagca

SEQ ID NO: 479765 - DNA, 25 bp, Mus musculus
gagcccaccggatgcaggaagagca

SEQ ID NO: 479766 - DNA, 25 bp, Mus musculus
gagcccacctctccaaggaggagga

SEQ ID NO: 479767 - DNA, 25 bp, Mus musculus
gagcccacctctgcaaggaggagga

SEQ ID NO: 479768 - DNA, 25 bp, Mus musculus
gagcccacgacgaagaagactcgaa

SEQ ID NO: 479769 - DNA, 25 bp, Mus musculus
gagcccacgacgtagaagactcgaa

SEQ ID NO: 479770 - DNA, 25 bp, Mus musculus
gagcccacgctgaaatctgagtctg

SEQ ID NO: 479771 - DNA, 25 bp, Mus musculus
gagcccacgctgtaatctgagtctg

SEQ ID NO: 479772 - DNA, 25 bp, Mus musculus
gagcccacgtgcatgtggagagcat

SEQ ID NO: 479773 - DNA, 25 bp, Mus musculus
gagcccacgtgcttgtggagagcat

SEQ ID NO: 479774 - DNA, 25 bp, Mus musculus
gagcccactgatcaatggttctgtt

SEQ ID NO: 479775 - DNA, 25 bp, Mus musculus
gagcccactgatgaatggttctgtt

SEQ ID NO: 479776 - DNA, 25 bp, Mus musculus
gagcccactgcgcatggttcaccaa

SEQ ID NO: 479777 - DNA, 25 bp, Mus musculus
gagcccactgcggatggttcaccaa

SEQ ID NO: 479778 - DNA, 25 bp, Mus musculus
gagcccacttgaatgtttctgtgaa

SEQ ID NO: 479779 - DNA, 25 bp, Mus musculus
gagcccacttgattgtttctgtgaa

SEQ ID NO: 479780 - DNA, 25 bp, Mus musculus
gagcccagaaaaaatctatctaccc

SEQ ID NO: 479781 - DNA, 25 bp, Mus musculus
gagcccagaaaatatctatctaccc

SEQ ID NO: 479782 - DNA, 25 bp, Mus musculus
gagcccagaatcaacatcctataca

SEQ ID NO: 479783 - DNA, 25 bp, Mus musculus
gagcccagaatctacatcctataca

SEQ ID NO: 479784 - DNA, 25 bp, Mus musculus
gagcccagacctagtccatgctagg

SEQ ID NO: 479785 - DNA, 25 bp, Mus musculus
gagcccagaccttgtccatgctagg

SEQ ID NO: 479786 - DNA, 25 bp, Mus musculus
gagcccagagtcatgggtcgtccca

SEQ ID NO: 479787 - DNA, 25 bp, Mus musculus
gagcccagagtcttgggtcgtccca

SEQ ID NO: 479788 - DNA, 25 bp, Mus musculus
gagcccagagtgaaacagtaccttg

SEQ ID NO: 479789 - DNA, 25 bp, Mus musculus
gagcccagagtgtaacagtaccttg

SEQ ID NO: 479790 - DNA, 25 bp, Mus musculus
gagcccagattgaattccgagatat

SEQ ID NO: 479791 - DNA, 25 bp, Mus musculus
gagcccagattgtattccgagatat

SEQ ID NO: 479792 - DNA, 25 bp, Mus musculus
gagcccagcacgcttctaacgaagc

SEQ ID NO: 479793 - DNA, 25 bp, Mus musculus
gagcccagcacggttctaacgaagc

SEQ ID NO: 479794 - DNA, 25 bp, Mus musculus
gagcccagcaggaacagatggagct

SEQ ID NO: 479795 - DNA, 25 bp, Mus musculus
gagcccagcaggcacacagttctgt

SEQ ID NO: 479796 - DNA, 25 bp, Mus musculus
gagcccagcagggacacagttctgt

SEQ ID NO: 479797 - DNA, 25 bp, Mus musculus
gagcccagcaggtacagatggagct

SEQ ID NO: 479798 - DNA, 25 bp, Mus musculus
gagcccagcatgcaagtgttcagct

SEQ ID NO: 479799 - DNA, 25 bp, Mus musculus
gagcccagcatggaagtgttcagct

SEQ ID NO: 479800 - DNA, 25 bp, Mus musculus
gagcccagccggcagtttgtaaagg

SEQ ID NO: 479801 - DNA, 25 bp, Mus musculus
gagcccagccgggagtttgtaaagg

SEQ ID NO: 479802 - DNA, 25 bp, Mus musculus
gagcccagcctgaaaaaccaattaa

SEQ ID NO: 479803 - DNA, 25 bp, Mus musculus
gagcccagcctgtaaaaccaattaa

SEQ ID NO: 479804 - DNA, 25 bp, Mus musculus
gagcccagctggaggactgtgtccc

SEQ ID NO: 479805 - DNA, 25 bp, Mus musculus
gagcccagctggcattatgttctct

SEQ ID NO: 479806 - DNA, 25 bp, Mus musculus
gagcccagctgggattatgttctct

SEQ ID NO: 479807 - DNA, 25 bp, Mus musculus
gagcccagctggtggactgtgtccc

SEQ ID NO: 479808 - DNA, 25 bp, Mus musculus
gagcccagcttaaggacgcattgaa

SEQ ID NO: 479809 - DNA, 25 bp, Mus musculus
gagcccagcttatggacgcattgaa

SEQ ID NO: 479810 - DNA, 25 bp, Mus musculus
gagcccagcttccagtggagaagcc

SEQ ID NO: 479811 - DNA, 25 bp, Mus musculus
gagcccagcttcgagtggagaagcc

SEQ ID NO: 479812 - DNA, 25 bp, Mus musculus
gagcccagctttcaggcctatgttt

SEQ ID NO: 479813 - DNA, 25 bp, Mus musculus
gagcccagctttgaggcctatgttt

SEQ ID NO: 479814 - DNA, 25 bp, Mus musculus
gagcccaggaacatccttgtcatat

SEQ ID NO: 479815 - DNA, 25 bp, Mus musculus
gagcccaggaacttccttgtcatat

SEQ ID NO: 479816 - DNA, 25 bp, Mus musculus
gagcccaggaagatttcaggatgaa

SEQ ID NO: 479817 - DNA, 25 bp, Mus musculus
gagcccaggaagttttcaggatgaa

SEQ ID NO: 479818 - DNA, 25 bp, Mus musculus
gagcccaggaatatcaaggccagtt

SEQ ID NO: 479819 - DNA, 25 bp, Mus musculus
gagcccaggaatttcaaggccagtt

SEQ ID NO: 479820 - DNA, 25 bp, Mus musculus
gagcccaggaccctgttcggatcct

SEQ ID NO: 479821 - DNA, 25 bp, Mus musculus
gagcccaggaccgtgttcggatcct

SEQ ID NO: 479822 - DNA, 25 bp, Mus musculus
gagcccaggatgattgcgcctttcc

SEQ ID NO: 479823 - DNA, 25 bp, Mus musculus
gagcccaggatgtttgcgcctttcc

SEQ ID NO: 479824 - DNA, 25 bp, Mus musculus
gagcccaggcctctgtataacctag

SEQ ID NO: 479825 - DNA, 25 bp, Mus musculus
gagcccaggcctgtgtataacctag

SEQ ID NO: 479826 - DNA, 25 bp, Mus musculus
gagcccaggctgatttgcatatcgg

SEQ ID NO: 479827 - DNA, 25 bp, Mus musculus
gagcccaggctgttttgcatatcgg

SEQ ID NO: 479828 - DNA, 25 bp, Mus musculus
gagcccaggtggacttcagccaaga

SEQ ID NO: 479829 - DNA, 25 bp, Mus musculus
gagcccaggtggtcttcagccaaga

SEQ ID NO: 479830 - DNA, 25 bp, Mus musculus
gagcccagtaagagaatcccgtcgt

SEQ ID NO: 479831 - DNA, 25 bp, Mus musculus
gagcccagtaagtgaatcccgtcgt

SEQ ID NO: 479832 - DNA, 25 bp, Mus musculus
gagcccagtagtcgcttccttggga

SEQ ID NO: 479833 - DNA, 25 bp, Mus musculus
gagcccagtagtggcttccttggga

SEQ ID NO: 479834 - DNA, 25 bp, Mus musculus
gagcccagtgaactctaagccatcc

SEQ ID NO: 479835 - DNA, 25 bp, Mus musculus
gagcccagtgaagtctaagccatcc

SEQ ID NO: 479836 - DNA, 25 bp, Mus musculus
gagcccagtggcatgctgaattcaa

SEQ ID NO: 479837 - DNA, 25 bp, Mus musculus
gagcccagtggcctgattaccctca

SEQ ID NO: 479838 - DNA, 25 bp, Mus musculus
gagcccagtggcgtgattaccctca

SEQ ID NO: 479839 - DNA, 25 bp, Mus musculus
gagcccagtggcttgctgaattcaa

SEQ ID NO: 479840 - DNA, 25 bp, Mus musculus
gagcccagtgttaccaccaagaagg

SEQ ID NO: 479841 - DNA, 25 bp, Mus musculus
gagcccagtgtttccaccaagaagg

SEQ ID NO: 479842 - DNA, 25 bp, Mus musculus
gagcccagtttgccctatatagtga

SEQ ID NO: 479843 - DNA, 25 bp, Mus musculus
gagcccagtttggcctatatagtga

SEQ ID NO: 479844 - DNA, 25 bp, Mus musculus
gagcccagttttagagccgagacca

SEQ ID NO: 479845 - DNA, 25 bp, Mus musculus
gagcccagtttttgagccgagacca

SEQ ID NO: 479846 - DNA, 25 bp, Mus musculus
gagcccatagacatagcatatggtt

SEQ ID NO: 479847 - DNA, 25 bp, Mus musculus
gagcccatagacttagcatatggtt

SEQ ID NO: 479848 - DNA, 25 bp, Mus musculus
gagcccatagatccatgcatggaga

SEQ ID NO: 479849 - DNA, 25 bp, Mus musculus
gagcccatagatgcatgcatggaga

SEQ ID NO: 479850 - DNA, 25 bp, Mus musculus
gagcccatagtacccaaagaccagc

SEQ ID NO: 479851 - DNA, 25 bp, Mus musculus
gagcccatagtagccaaagaccagc

SEQ ID NO: 479852 - DNA, 25 bp, Mus musculus
gagcccatatatcttactcgatgtg

SEQ ID NO: 479853 - DNA, 25 bp, Mus musculus
gagcccatatatgttactcgatgtg

SEQ ID NO: 479854 - DNA, 25 bp, Mus musculus
gagcccatcattagaagcagtccct

SEQ ID NO: 479855 - DNA, 25 bp, Mus musculus
gagcccatcatttgaagcagtccct

SEQ ID NO: 479856 - DNA, 25 bp, Mus musculus
gagcccatccatcttttgatttaat

SEQ ID NO: 479857 - DNA, 25 bp, Mus musculus
gagcccatccatgttttgatttaat

SEQ ID NO: 479858 - DNA, 25 bp, Mus musculus
gagcccatcccactgtatgaggcaa

SEQ ID NO: 479859 - DNA, 25 bp, Mus musculus
gagcccatcccagtgtatgaggcaa

SEQ ID NO: 479860 - DNA, 25 bp, Mus musculus
gagcccatcttgaggattgtgtcct

SEQ ID NO: 479861 - DNA, 25 bp, Mus musculus
gagcccatcttgtggattgtgtcct

SEQ ID NO: 479862 - DNA, 25 bp, Mus musculus
gagcccatgactacctatgttgtct

SEQ ID NO: 479863 - DNA, 25 bp, Mus musculus
gagcccatgacttcctatgttgtct

SEQ ID NO: 479864 - DNA, 25 bp, Mus musculus
gagcccatgagcctgtaaacaaact

SEQ ID NO: 479865 - DNA, 25 bp, Mus musculus
gagcccatgagcgtgtaaacaaact

SEQ ID NO: 479866 - DNA, 25 bp, Mus musculus
gagcccatggagctcttcctgtgta

SEQ ID NO: 479867 - DNA, 25 bp, Mus musculus
gagcccatggaggtcttcctgtgta

SEQ ID NO: 479868 - DNA, 25 bp, Mus musculus
gagcccatgggcactataactagac

SEQ ID NO: 479869 - DNA, 25 bp, Mus musculus
gagcccatgggctctataactagac

SEQ ID NO: 479870 - DNA, 25 bp, Mus musculus
gagcccatggtaatgcagcttcatt

SEQ ID NO: 479871 - DNA, 25 bp, Mus musculus
gagcccatggtattgcagcttcatt

SEQ ID NO: 479872 - DNA, 25 bp, Mus musculus
gagcccatgtaaaacttcctacagc

SEQ ID NO: 479873 - DNA, 25 bp, Mus musculus
gagcccatgtaatacttcctacagc

SEQ ID NO: 479874 - DNA, 25 bp, Mus musculus
gagcccatgtgtacagacagtgtct

SEQ ID NO: 479875 - DNA, 25 bp, Mus musculus
gagcccatgtgttcagacagtgtct

SEQ ID NO: 479876 - DNA, 25 bp, Mus musculus
gagcccattatgattatgccagtct

SEQ ID NO: 479877 - DNA, 25 bp, Mus musculus
gagcccattatgtttatgccagtct

SEQ ID NO: 479878 - DNA, 25 bp, Mus musculus
gagcccattattaggaagcacaaga

SEQ ID NO: 479879 - DNA, 25 bp, Mus musculus
gagcccattattcttcattgcagtg

SEQ ID NO: 479880 - DNA, 25 bp, Mus musculus
gagcccattattgttcattgcagtg

SEQ ID NO: 479881 - DNA, 25 bp, Mus musculus
gagcccattatttggaagcacaaga

SEQ ID NO: 479882 - DNA, 25 bp, Mus musculus
gagcccattgatccggagtaagccg

SEQ ID NO: 479883 - DNA, 25 bp, Mus musculus
gagcccattgatgcggagtaagccg

SEQ ID NO: 479884 - DNA, 25 bp, Mus musculus
gagcccattgctatttgtatataac

SEQ ID NO: 479885 - DNA, 25 bp, Mus musculus
gagcccattgctttttgtatataac

SEQ ID NO: 479886 - DNA, 25 bp, Mus musculus
gagcccatttttcttgatgtcccaa

SEQ ID NO: 479887 - DNA, 25 bp, Mus musculus
gagcccatttttgttgatgtcccaa

SEQ ID NO: 479888 - DNA, 25 bp, Mus musculus
gagccccaaattctggaccagctta

SEQ ID NO: 479889 - DNA, 25 bp, Mus musculus
gagccccaaattgtggaccagctta

SEQ ID NO: 479890 - DNA, 25 bp, Mus musculus
gagccccaaggcaaaattgtcgaag

SEQ ID NO: 479891 - DNA, 25 bp, Mus musculus
gagccccaaggctaaattgtcgaag

SEQ ID NO: 479892 - DNA, 25 bp, Mus musculus
gagccccaagttaatccgtatttct

SEQ ID NO: 479893 - DNA, 25 bp, Mus musculus
gagccccaagtttatccgtatttct

SEQ ID NO: 479894 - DNA, 25 bp, Mus musculus
gagccccacaaacgttcctgaagaa

SEQ ID NO: 479895 - DNA, 25 bp, Mus musculus
gagccccacaaaggttcctgaagaa

SEQ ID NO: 479896 - DNA, 25 bp, Mus musculus
gagccccacataaagcgtccaatga

SEQ ID NO: 479897 - DNA, 25 bp, Mus musculus
gagccccacatatagcgtccaatga

SEQ ID NO: 479898 - DNA, 25 bp, Mus musculus
gagccccaccaaactggtcggagga

SEQ ID NO: 479899 - DNA, 25 bp, Mus musculus
gagccccaccaatctggtcggagga

SEQ ID NO: 479900 - DNA, 25 bp, Mus musculus
gagccccacgaacctgtacaataat

SEQ ID NO: 479901 - DNA, 25 bp, Mus musculus
gagccccacgaagctgtacaataat

SEQ ID NO: 479902 - DNA, 25 bp, Mus musculus
gagccccacgagacggagaaaaagc

SEQ ID NO: 479903 - DNA, 25 bp, Mus musculus
gagccccacgagtcggagaaaaagc

SEQ ID NO: 479904 - DNA, 25 bp, Mus musculus
gagccccacggcacagtaatctgag

SEQ ID NO: 479905 - DNA, 25 bp, Mus musculus
gagccccacggctcagtaatctgag

SEQ ID NO: 479906 - DNA, 25 bp, Mus musculus
gagccccactcacgtagcagactgt

SEQ ID NO: 479907 - DNA, 25 bp, Mus musculus
gagccccactcaggtagcagactgt

SEQ ID NO: 479908 - DNA, 25 bp, Mus musculus
gagccccactggatccaaagactga

SEQ ID NO: 479909 - DNA, 25 bp, Mus musculus
gagccccactggttccaaagactga

SEQ ID NO: 479910 - DNA, 25 bp, Mus musculus
gagccccactgtaatgtgattttac

SEQ ID NO: 479911 - DNA, 25 bp, Mus musculus
gagccccactgttatgtgattttac

SEQ ID NO: 479912 - DNA, 25 bp, Mus musculus
gagccccagaaacccagagcatgtg

SEQ ID NO: 479913 - DNA, 25 bp, Mus musculus
gagccccagaaagccagagcatgtg

SEQ ID NO: 479914 - DNA, 25 bp, Mus musculus
gagccccagagaatctgccatgtga

SEQ ID NO: 479915 - DNA, 25 bp, Mus musculus
gagccccagagattctgccatgtga

SEQ ID NO: 479916 - DNA, 25 bp, Mus musculus
gagccccagagcagttctagtccag

SEQ ID NO: 479917 - DNA, 25 bp, Mus musculus
gagccccagagctgttctagtccag

SEQ ID NO: 479918 - DNA, 25 bp, Mus musculus
gagccccagagtcttagtctgagcc

SEQ ID NO: 479919 - DNA, 25 bp, Mus musculus
gagccccagagtgttagtctgagcc

SEQ ID NO: 479920 - DNA, 25 bp, Mus musculus
gagccccagcacaatagcagcctat

SEQ ID NO: 479921 - DNA, 25 bp, Mus musculus
gagccccagcactatagcagcctat

SEQ ID NO: 479922 - DNA, 25 bp, Mus musculus
gagccccagcatcctaaaattcata

SEQ ID NO: 479923 - DNA, 25 bp, Mus musculus
gagccccagcatgctaaaattcata

SEQ ID NO: 479924 - DNA, 25 bp, Mus musculus
gagccccagctactacaacataaat

SEQ ID NO: 479925 - DNA, 25 bp, Mus musculus
gagccccagctagtacaacataaat

SEQ ID NO: 479926 - DNA, 25 bp, Mus musculus
gagccccagcttcctaacctgtaaa

SEQ ID NO: 479927 - DNA, 25 bp, Mus musculus
gagccccagcttgctaacctgtaaa

SEQ ID NO: 479928 - DNA, 25 bp, Mus musculus
gagccccaggcaagtgtctaaacaa

SEQ ID NO: 479929 - DNA, 25 bp, Mus musculus
gagccccaggcatgtgtctaaacaa

SEQ ID NO: 479930 - DNA, 25 bp, Mus musculus
gagccccagggcactgagtgaaaga

SEQ ID NO: 479931 - DNA, 25 bp, Mus musculus
gagccccagggctctgagtgaaaga

SEQ ID NO: 479932 - DNA, 25 bp, Mus musculus
gagccccaggtgatagagaaggacc

SEQ ID NO: 479933 - DNA, 25 bp, Mus musculus
gagccccaggtgttagagaaggacc

SEQ ID NO: 479934 - DNA, 25 bp, Mus musculus
gagccccagtacaactattgagcag

SEQ ID NO: 479935 - DNA, 25 bp, Mus musculus
gagccccagtactactattgagcag

SEQ ID NO: 479936 - DNA, 25 bp, Mus musculus
gagccccagtttctcacagtaagat

SEQ ID NO: 479937 - DNA, 25 bp, Mus musculus
gagccccagtttgtcacagtaagat

SEQ ID NO: 479938 - DNA, 25 bp, Mus musculus
gagccccatcccagttatataacac

SEQ ID NO: 479939 - DNA, 25 bp, Mus musculus
gagccccatccctgttatataacac

SEQ ID NO: 479940 - DNA, 25 bp, Mus musculus
gagccccatctacaagttgatcgtg

SEQ ID NO: 479941 - DNA, 25 bp, Mus musculus
gagccccatctagaagttgatcgtg

SEQ ID NO: 479942 - DNA, 25 bp, Mus musculus
gagccccatgctcactgagctgcat

SEQ ID NO: 479943 - DNA, 25 bp, Mus musculus
gagccccatgctgactgagctgcat

SEQ ID NO: 479944 - DNA, 25 bp, Mus musculus
gagccccatggcattacccattgat

SEQ ID NO: 479945 - DNA, 25 bp, Mus musculus
gagccccatggctttacccattgat

SEQ ID NO: 479946 - DNA, 25 bp, Mus musculus
gagccccattatataggcccttcca

SEQ ID NO: 479947 - DNA, 25 bp, Mus musculus
gagccccattatttaggcccttcca

SEQ ID NO: 479948 - DNA, 25 bp, Mus musculus
gagccccgaggacgtccagaagaat

SEQ ID NO: 479949 - DNA, 25 bp, Mus musculus
gagccccgaggaggtccagaagaat

SEQ ID NO: 479950 - DNA, 25 bp, Mus musculus
gagccccgcaagagcagacaggaca

SEQ ID NO: 479951 - DNA, 25 bp, Mus musculus
gagccccgcaagtgcagacaggaca

SEQ ID NO: 479952 - DNA, 25 bp, Mus musculus
gagccccgcagtacacgatgctggg

SEQ ID NO: 479953 - DNA, 25 bp, Mus musculus
gagccccgcagttcacgatgctggg

SEQ ID NO: 479954 - DNA, 25 bp, Mus musculus
gagccccggacacgagccaaaagaa

SEQ ID NO: 479955 - DNA, 25 bp, Mus musculus
gagccccggacacgatatccataga

SEQ ID NO: 479956 - DNA, 25 bp, Mus musculus
gagccccggacaggagccaaaagaa

SEQ ID NO: 479957 - DNA, 25 bp, Mus musculus
gagccccggacaggatatccataga

SEQ ID NO: 479958 - DNA, 25 bp, Mus musculus
gagccccggccgacatgaaataaaa

SEQ ID NO: 479959 - DNA, 25 bp, Mus musculus
gagccccggccgtcatgaaataaaa

SEQ ID NO: 479960 - DNA, 25 bp, Mus musculus
gagccccgggatcctgactttggta

SEQ ID NO: 479961 - DNA, 25 bp, Mus musculus
gagccccgggatgctgactttggta

SEQ ID NO: 479962 - DNA, 25 bp, Mus musculus
gagccccgtcagcacaaagcggaag

SEQ ID NO: 479963 - DNA, 25 bp, Mus musculus
gagccccgtcaggacaaagcggaag

SEQ ID NO: 479964 - DNA, 25 bp, Mus musculus
gagcccctaaacagcaacagctgtt

SEQ ID NO: 479965 - DNA, 25 bp, Mus musculus
gagcccctaaactgcaacagctgtt

SEQ ID NO: 479966 - DNA, 25 bp, Mus musculus
gagcccctagaactggcttctgctc

SEQ ID NO: 479967 - DNA, 25 bp, Mus musculus
gagcccctagaagtggcttctgctc

SEQ ID NO: 479968 - DNA, 25 bp, Mus musculus
gagcccctcaacaaatgccaaattg

SEQ ID NO: 479969 - DNA, 25 bp, Mus musculus
gagcccctcaacacagttatcaatt

SEQ ID NO: 479970 - DNA, 25 bp, Mus musculus
gagcccctcaactaatgccaaattg

SEQ ID NO: 479971 - DNA, 25 bp, Mus musculus
gagcccctcaactcagttatcaatt

SEQ ID NO: 479972 - DNA, 25 bp, Mus musculus
gagcccctccgtaggcagaaggcta

SEQ ID NO: 479973 - DNA, 25 bp, Mus musculus
gagcccctccgttggcagaaggcta

SEQ ID NO: 479974 - DNA, 25 bp, Mus musculus
gagcccctcgctcagtggcagctat

SEQ ID NO: 479975 - DNA, 25 bp, Mus musculus
gagcccctcgctgagtggcagctat

SEQ ID NO: 479976 - DNA, 25 bp, Mus musculus
gagcccctgatcagctgatgtttgg

SEQ ID NO: 479977 - DNA, 25 bp, Mus musculus
gagcccctgatctgctgatgtttgg

SEQ ID NO: 479978 - DNA, 25 bp, Mus musculus
gagcccctgctgcaatttgagaact

SEQ ID NO: 479979 - DNA, 25 bp, Mus musculus
gagcccctgctggaatttgagaact

SEQ ID NO: 479980 - DNA, 25 bp, Mus musculus
gagcccctgtagctcagagacatta

SEQ ID NO: 479981 - DNA, 25 bp, Mus musculus
gagcccctgtaggtcagagacatta

SEQ ID NO: 479982 - DNA, 25 bp, Mus musculus
gagcccctgtccatggagattataa

SEQ ID NO: 479983 - DNA, 25 bp, Mus musculus
gagcccctgtccttggagattataa

SEQ ID NO: 479984 - DNA, 25 bp, Mus musculus
gagcccctgtgtaatcttttcagaa

SEQ ID NO: 479985 - DNA, 25 bp, Mus musculus
gagcccctgtgtaattttttcagaa

SEQ ID NO: 479986 - DNA, 25 bp, Mus musculus
gagcccctgtgttatcttttcagaa

SEQ ID NO: 479987 - DNA, 25 bp, Mus musculus
gagcccctgtgttattttttcagaa

SEQ ID NO: 479988 - DNA, 25 bp, Mus musculus
gagcccctgttgacatggttactgg

SEQ ID NO: 479989 - DNA, 25 bp, Mus musculus
gagcccctgttgtcatggttactgg

SEQ ID NO: 479990 - DNA, 25 bp, Mus musculus
gagccccttgaaatagaaatgtcct

SEQ ID NO: 479991 - DNA, 25 bp, Mus musculus
gagccccttgaattagaaatgtcct

SEQ ID NO: 479992 - DNA, 25 bp, Mus musculus
gagccccttgacatgtataaatcag

SEQ ID NO: 479993 - DNA, 25 bp, Mus musculus
gagccccttgacttgtataaatcag

SEQ ID NO: 479994 - DNA, 25 bp, Mus musculus
gagcccgaaaggatgctgaacttct

SEQ ID NO: 479995 - DNA, 25 bp, Mus musculus
gagcccgaaaggttgctgaacttct

SEQ ID NO: 479996 - DNA, 25 bp, Mus musculus
gagcccgaagtcattgtttcctatt

SEQ ID NO: 479997 - DNA, 25 bp, Mus musculus
gagcccgaagtctttgtttcctatt

SEQ ID NO: 479998 - DNA, 25 bp, Mus musculus
gagcccgacagaccctaagtgagac

SEQ ID NO: 479999 - DNA, 25 bp, Mus musculus
gagcccgacagagcctaagtgagac

SEQ ID NO: 480000 - DNA, 25 bp, Mus musculus
gagcccgaccgaccgttctatggac

SEQ ID NO: 480001 - DNA, 25 bp, Mus musculus
gagcccgaccgagcgttctatggac

SEQ ID NO: 480002 - DNA, 25 bp, Mus musculus
gagcccgactggagatctggcgcct

SEQ ID NO: 480003 - DNA, 25 bp, Mus musculus
gagcccgactggtgatctggcgcct

SEQ ID NO: 480004 - DNA, 25 bp, Mus musculus
gagcccgaggagaatacggactcaa

SEQ ID NO: 480005 - DNA, 25 bp, Mus musculus
gagcccgaggagtatacggactcaa

SEQ ID NO: 480006 - DNA, 25 bp, Mus musculus
gagcccgagtgccacgacggttttt

SEQ ID NO: 480007 - DNA, 25 bp, Mus musculus
gagcccgagtgcgacgacggttttt

SEQ ID NO: 480008 - DNA, 25 bp, Mus musculus
gagcccgatcctccatagatggcaa

SEQ ID NO: 480009 - DNA, 25 bp, Mus musculus
gagcccgatcctgcatagatggcaa

SEQ ID NO: 480010 - DNA, 25 bp, Mus musculus
gagcccgcacctccgcaggaagtag

SEQ ID NO: 480011 - DNA, 25 bp, Mus musculus
gagcccgcacctgcgcaggaagtag

SEQ ID NO: 480012 - DNA, 25 bp, Mus musculus
gagcccgcacttctttatcaacgca

SEQ ID NO: 480013 - DNA, 25 bp, Mus musculus
gagcccgcacttgtttatcaacgca

SEQ ID NO: 480014 - DNA, 25 bp, Mus musculus
gagcccgcagagagtgcagacccag

SEQ ID NO: 480015 - DNA, 25 bp, Mus musculus
gagcccgcagagtgtgcagacccag

SEQ ID NO: 480016 - DNA, 25 bp, Mus musculus
gagcccgctggaaaccttaagtgca

SEQ ID NO: 480017 - DNA, 25 bp, Mus musculus
gagcccgctggataccttaagtgca

SEQ ID NO: 480018 - DNA, 25 bp, Mus musculus
gagcccggacaaaggcttttgttca

SEQ ID NO: 480019 - DNA, 25 bp, Mus musculus
gagcccggacaatggcttttgttca

SEQ ID NO: 480020 - DNA, 25 bp, Mus musculus
gagcccggcacgaggtgtccagttc

SEQ ID NO: 480021 - DNA, 25 bp, Mus musculus
gagcccggcacgtggtgtccagttc

SEQ ID NO: 480022 - DNA, 25 bp, Mus musculus
gagcccggcgaaaagcacagactat

SEQ ID NO: 480023 - DNA, 25 bp, Mus musculus
gagcccggcgaatagcacagactat

SEQ ID NO: 480024 - DNA, 25 bp, Mus musculus
gagcccgggaatcgactagaaccaa

SEQ ID NO: 480025 - DNA, 25 bp, Mus musculus
gagcccgggaatggactagaaccaa

SEQ ID NO: 480026 - DNA, 25 bp, Mus musculus
gagcccgggatgaggaatcctctga

SEQ ID NO: 480027 - DNA, 25 bp, Mus musculus
gagcccgggatgtggaatcctctga

SEQ ID NO: 480028 - DNA, 25 bp, Mus musculus
gagcccgggttcagtcatctgcata

SEQ ID NO: 480029 - DNA, 25 bp, Mus musculus
gagcccgggttctgtcatctgcata

SEQ ID NO: 480030 - DNA, 25 bp, Mus musculus
gagcccggtataagctaactgtgct

SEQ ID NO: 480031 - DNA, 25 bp, Mus musculus
gagcccggtatatgctaactgtgct

SEQ ID NO: 480032 - DNA, 25 bp, Mus musculus
gagcccgtggctcttggtcatatac

SEQ ID NO: 480033 - DNA, 25 bp, Mus musculus
gagcccgtggctgttggtcatatac

SEQ ID NO: 480034 - DNA, 25 bp, Mus musculus
gagcccgtgggccaactactttggc

SEQ ID NO: 480035 - DNA, 25 bp, Mus musculus
gagcccgtgggcgaactactttggc

SEQ ID NO: 480036 - DNA, 25 bp, Mus musculus
gagcccgtggttcactatgatatct

SEQ ID NO: 480037 - DNA, 25 bp, Mus musculus
gagcccgtggttgactatgatatct

SEQ ID NO: 480038 - DNA, 25 bp, Mus musculus
gagcccgtgtttcaggtttcatcat

SEQ ID NO: 480039 - DNA, 25 bp, Mus musculus
gagcccgtgtttgaggtttcatcat

SEQ ID NO: 480040 - DNA, 25 bp, Mus musculus
gagcccgttctcagtcaaagctgaa

SEQ ID NO: 480041 - DNA, 25 bp, Mus musculus
gagcccgttctctgtcaaagctgaa

SEQ ID NO: 480042 - DNA, 25 bp, Mus musculus
gagccctaaaacagtcactgaccta

SEQ ID NO: 480043 - DNA, 25 bp, Mus musculus
gagccctaaaactgtcactgaccta

SEQ ID NO: 480044 - DNA, 25 bp, Mus musculus
gagccctaacatacgcatcaaagca

SEQ ID NO: 480045 - DNA, 25 bp, Mus musculus
gagccctaacattcgcatcaaagca

SEQ ID NO: 480046 - DNA, 25 bp, Mus musculus
gagccctaagaactgtgcctttttt

SEQ ID NO: 480047 - DNA, 25 bp, Mus musculus
gagccctaagaagtgtgcctttttt

SEQ ID NO: 480048 - DNA, 25 bp, Mus musculus
gagccctaaggaccacacagcagtg

SEQ ID NO: 480049 - DNA, 25 bp, Mus musculus
gagccctaaggagcacacagcagtg

SEQ ID NO: 480050 - DNA, 25 bp, Mus musculus
gagccctaatcccaatttggattta

SEQ ID NO: 480051 - DNA, 25 bp, Mus musculus
gagccctaatccgaatttggattta

SEQ ID NO: 480052 - DNA, 25 bp, Mus musculus
gagccctaatgcctactaagacttg

SEQ ID NO: 480053 - DNA, 25 bp, Mus musculus
gagccctaatgcgtactaagacttg

SEQ ID NO: 480054 - DNA, 25 bp, Mus musculus
gagccctacaggaagggtacactgg

SEQ ID NO: 480055 - DNA, 25 bp, Mus musculus
gagccctacaggtagggtacactgg

SEQ ID NO: 480056 - DNA, 25 bp, Mus musculus
gagccctaccagatccttctggatg

SEQ ID NO: 480057 - DNA, 25 bp, Mus musculus
gagccctaccagttccttctggatg

SEQ ID NO: 480058 - DNA, 25 bp, Mus musculus
gagccctactccaggacagagattg

SEQ ID NO: 480059 - DNA, 25 bp, Mus musculus
gagccctactcctggacagagattg

SEQ ID NO: 480060 - DNA, 25 bp, Mus musculus
gagccctacttacacataactgaag

SEQ ID NO: 480061 - DNA, 25 bp, Mus musculus
gagccctacttagacataactgaag

SEQ ID NO: 480062 - DNA, 25 bp, Mus musculus
gagccctagaatcctctagtgaagg

SEQ ID NO: 480063 - DNA, 25 bp, Mus musculus
gagccctagaatgctctagtgaagg

SEQ ID NO: 480064 - DNA, 25 bp, Mus musculus
gagccctagccacttgatgctgaag

SEQ ID NO: 480065 - DNA, 25 bp, Mus musculus
gagccctagccagttgatgctgaag

SEQ ID NO: 480066 - DNA, 25 bp, Mus musculus
gagccctaggccacaaggagctgga

SEQ ID NO: 480067 - DNA, 25 bp, Mus musculus
gagccctaggcctcaaggagctgga

SEQ ID NO: 480068 - DNA, 25 bp, Mus musculus
gagccctaggctaagtacagaagat

SEQ ID NO: 480069 - DNA, 25 bp, Mus musculus
gagccctaggcttagtacagaagat

SEQ ID NO: 480070 - DNA, 25 bp, Mus musculus
gagccctaggttattatagccttat

SEQ ID NO: 480071 - DNA, 25 bp, Mus musculus
gagccctaggtttttatagccttat

SEQ ID NO: 480072 - DNA, 25 bp, Mus musculus
gagccctagtaaatgcttgttagta

SEQ ID NO: 480073 - DNA, 25 bp, Mus musculus
gagccctagtaattgcttgttagta

SEQ ID NO: 480074 - DNA, 25 bp, Mus musculus
gagccctagtagatctttcagagga

SEQ ID NO: 480075 - DNA, 25 bp, Mus musculus
gagccctagtagttctttcagagga

SEQ ID NO: 480076 - DNA, 25 bp, Mus musculus
gagccctatactaagtcctgtttgt

SEQ ID NO: 480077 - DNA, 25 bp, Mus musculus
gagccctatacttagtcctgtttgt

SEQ ID NO: 480078 - DNA, 25 bp, Mus musculus
gagccctatgcaaaacactgtctga

SEQ ID NO: 480079 - DNA, 25 bp, Mus musculus
gagccctatgcataacactgtctga

SEQ ID NO: 480080 - DNA, 25 bp, Mus musculus
gagccctcaagcctgtgctctggga

SEQ ID NO: 480081 - DNA, 25 bp, Mus musculus
gagccctcaagcgtgtgctctggga

SEQ ID NO: 480082 - DNA, 25 bp, Mus musculus
gagccctcaaggacgattaagtgat

SEQ ID NO: 480083 - DNA, 25 bp, Mus musculus
gagccctcaaggtcgattaagtgat

SEQ ID NO: 480084 - DNA, 25 bp, Mus musculus
gagccctcactaattctgattttgc

SEQ ID NO: 480085 - DNA, 25 bp, Mus musculus
gagccctcactacgtcatcattagt

SEQ ID NO: 480086 - DNA, 25 bp, Mus musculus
gagccctcactaggtcatcattagt

SEQ ID NO: 480087 - DNA, 25 bp, Mus musculus
gagccctcactatttctgattttgc

SEQ ID NO: 480088 - DNA, 25 bp, Mus musculus
gagccctcagggacacctagcaggt

SEQ ID NO: 480089 - DNA, 25 bp, Mus musculus
gagccctcagggtcacctagcaggt

SEQ ID NO: 480090 - DNA, 25 bp, Mus musculus
gagccctcatagcagaagaagataa

SEQ ID NO: 480091 - DNA, 25 bp, Mus musculus
gagccctcataggagaagaagataa

SEQ ID NO: 480092 - DNA, 25 bp, Mus musculus
gagccctcatgaaaccacagagctt

SEQ ID NO: 480093 - DNA, 25 bp, Mus musculus
gagccctcatgactgtgcagggact

SEQ ID NO: 480094 - DNA, 25 bp, Mus musculus
gagccctcatgagtgtgcagggact

SEQ ID NO: 480095 - DNA, 25 bp, Mus musculus
gagccctcatgataccacagagctt

SEQ ID NO: 480096 - DNA, 25 bp, Mus musculus
gagccctccagtccacatgtcaaag

SEQ ID NO: 480097 - DNA, 25 bp, Mus musculus
gagccctccagtgcacatgtcaaag

SEQ ID NO: 480098 - DNA, 25 bp, Mus musculus
gagccctccattaacacaaccagga

SEQ ID NO: 480099 - DNA, 25 bp, Mus musculus
gagccctccattaggttttgctcat

SEQ ID NO: 480100 - DNA, 25 bp, Mus musculus
gagccctccatttacacaaccagga

SEQ ID NO: 480101 - DNA, 25 bp, Mus musculus
gagccctccatttggttttgctcat

SEQ ID NO: 480102 - DNA, 25 bp, Mus musculus
gagccctccttaatactataaccat

SEQ ID NO: 480103 - DNA, 25 bp, Mus musculus
gagccctccttattactataaccat

SEQ ID NO: 480104 - DNA, 25 bp, Mus musculus
gagccctcgggacatgactgagttc

SEQ ID NO: 480105 - DNA, 25 bp, Mus musculus
gagccctcgggagatgactgagttc

SEQ ID NO: 480106 - DNA, 25 bp, Mus musculus
gagccctctctgacacttaaatggt

SEQ ID NO: 480107 - DNA, 25 bp, Mus musculus
gagccctctctgagaagagaccaat

SEQ ID NO: 480108 - DNA, 25 bp, Mus musculus
gagccctctctgtcacttaaatggt

SEQ ID NO: 480109 - DNA, 25 bp, Mus musculus
gagccctctctgtgaagagaccaat

SEQ ID NO: 480110 - DNA, 25 bp, Mus musculus
gagccctctgcaaagacaaagggtt

SEQ ID NO: 480111 - DNA, 25 bp, Mus musculus
gagccctctgcatagacaaagggtt

SEQ ID NO: 480112 - DNA, 25 bp, Mus musculus
gagccctctgctcatttcattaaag

SEQ ID NO: 480113 - DNA, 25 bp, Mus musculus
gagccctctgctgatttcattaaag

SEQ ID NO: 480114 - DNA, 25 bp, Mus musculus
gagccctctggaacaagttttataa

SEQ ID NO: 480115 - DNA, 25 bp, Mus musculus
gagccctctggatcaagttttataa

SEQ ID NO: 480116 - DNA, 25 bp, Mus musculus
gagccctctggtcctacaggactct

SEQ ID NO: 480117 - DNA, 25 bp, Mus musculus
gagccctctggtgctacaggactct

SEQ ID NO: 480118 - DNA, 25 bp, Mus musculus
gagccctcttatcagtgaattccag

SEQ ID NO: 480119 - DNA, 25 bp, Mus musculus
gagccctcttatgagtgaattccag

SEQ ID NO: 480120 - DNA, 25 bp, Mus musculus
gagccctgaattacattctgtctat

SEQ ID NO: 480121 - DNA, 25 bp, Mus musculus
gagccctgaatttcattctgtctat

SEQ ID NO: 480122 - DNA, 25 bp, Mus musculus
gagccctgactaccggagatgagaa

SEQ ID NO: 480123 - DNA, 25 bp, Mus musculus
gagccctgactagcggagatgagaa

SEQ ID NO: 480124 - DNA, 25 bp, Mus musculus
gagccctgactcagtggcctttctt

SEQ ID NO: 480125 - DNA, 25 bp, Mus musculus
gagccctgactctgtggcctttctt

SEQ ID NO: 480126 - DNA, 25 bp, Mus musculus
gagccctgagctataattctgtagt

SEQ ID NO: 480127 - DNA, 25 bp, Mus musculus
gagccctgagctttaattctgtagt

SEQ ID NO: 480128 - DNA, 25 bp, Mus musculus
gagccctgaggcagctgcaaatgtt

SEQ ID NO: 480129 - DNA, 25 bp, Mus musculus
gagccctgaggctgctgcaaatgtt

SEQ ID NO: 480130 - DNA, 25 bp, Mus musculus
gagccctgagttactccaggcaaaa

SEQ ID NO: 480131 - DNA, 25 bp, Mus musculus
gagccctgagtttctccaggcaaaa

SEQ ID NO: 480132 - DNA, 25 bp, Mus musculus
gagccctgatggcttattcaatccc

SEQ ID NO: 480133 - DNA, 25 bp, Mus musculus
gagccctgatgggttattcaatccc

SEQ ID NO: 480134 - DNA, 25 bp, Mus musculus
gagccctgattgattaaatgcccac

SEQ ID NO: 480135 - DNA, 25 bp, Mus musculus
gagccctgattgtttaaatgcccac

SEQ ID NO: 480136 - DNA, 25 bp, Mus musculus
gagccctgcctgacgatggcggtca

SEQ ID NO: 480137 - DNA, 25 bp, Mus musculus
gagccctgcctgtcgatggcggtca

SEQ ID NO: 480138 - DNA, 25 bp, Mus musculus
gagccctgcgaccattcatcgggaa

SEQ ID NO: 480139 - DNA, 25 bp, Mus musculus
gagccctgcgacgattcatcgggaa

SEQ ID NO: 480140 - DNA, 25 bp, Mus musculus
gagccctgcgtcaccaggtgtatag

SEQ ID NO: 480141 - DNA, 25 bp, Mus musculus
gagccctgcgtctccaggtgtatag

SEQ ID NO: 480142 - DNA, 25 bp, Mus musculus
gagccctggataccaactattgctt

SEQ ID NO: 480143 - DNA, 25 bp, Mus musculus
gagccctggatagcaactattgctt

SEQ ID NO: 480144 - DNA, 25 bp, Mus musculus
gagccctggcaactggtgttataaa

SEQ ID NO: 480145 - DNA, 25 bp, Mus musculus
gagccctggcaagtggtgttataaa

SEQ ID NO: 480146 - DNA, 25 bp, Mus musculus
gagccctggctaatggcaggtgtca

SEQ ID NO: 480147 - DNA, 25 bp, Mus musculus
gagccctggctattggcaggtgtca

SEQ ID NO: 480148 - DNA, 25 bp, Mus musculus
gagccctgggagaatgcggcctgga

SEQ ID NO: 480149 - DNA, 25 bp, Mus musculus
gagccctgggagtatgcggcctgga

SEQ ID NO: 480150 - DNA, 25 bp, Mus musculus
gagccctgggatcgttcccaagcca

SEQ ID NO: 480151 - DNA, 25 bp, Mus musculus
gagccctgggatggttcccaagcca

SEQ ID NO: 480152 - DNA, 25 bp, Mus musculus
gagccctgggctacggttatcccaa

SEQ ID NO: 480153 - DNA, 25 bp, Mus musculus
gagccctgggcttcggttatcccaa

SEQ ID NO: 480154 - DNA, 25 bp, Mus musculus
gagccctgggtcactgagtacatga

SEQ ID NO: 480155 - DNA, 25 bp, Mus musculus
gagccctgggtctctgagtacatga

SEQ ID NO: 480156 - DNA, 25 bp, Mus musculus
gagccctgtccgcaatgagtaatca

SEQ ID NO: 480157 - DNA, 25 bp, Mus musculus
gagccctgtccggaatgagtaatca

SEQ ID NO: 480158 - DNA, 25 bp, Mus musculus
gagccctgtctcaagcttatgcaga

SEQ ID NO: 480159 - DNA, 25 bp, Mus musculus
gagccctgtctctagcttatgcaga

SEQ ID NO: 480160 - DNA, 25 bp, Mus musculus
gagccctgtgatctaaggagcaaca

SEQ ID NO: 480161 - DNA, 25 bp, Mus musculus
gagccctgtgatgtaaggagcaaca

SEQ ID NO: 480162 - DNA, 25 bp, Mus musculus
gagccctgtgggatatagcaactgg

SEQ ID NO: 480163 - DNA, 25 bp, Mus musculus
gagccctgtgggttatagcaactgg

SEQ ID NO: 480164 - DNA, 25 bp, Mus musculus
gagccctgtgtaaagatggccccat

SEQ ID NO: 480165 - DNA, 25 bp, Mus musculus
gagccctgtgtatagatggccccat

SEQ ID NO: 480166 - DNA, 25 bp, Mus musculus
gagccctgttagaagaatcatattg

SEQ ID NO: 480167 - DNA, 25 bp, Mus musculus
gagccctgttagtagaatcatattg

SEQ ID NO: 480168 - DNA, 25 bp, Mus musculus
gagccctgttccagttttaatgccc

SEQ ID NO: 480169 - DNA, 25 bp, Mus musculus
gagccctgttcctgttttaatgccc

SEQ ID NO: 480170 - DNA, 25 bp, Mus musculus
gagcccttaaagagttcttttgcca

SEQ ID NO: 480171 - DNA, 25 bp, Mus musculus
gagcccttaaagtgttcttttgcca

SEQ ID NO: 480172 - DNA, 25 bp, Mus musculus
gagcccttaatgagtatgtagtagc

SEQ ID NO: 480173 - DNA, 25 bp, Mus musculus
gagcccttaatgtgtatgtagtagc

SEQ ID NO: 480174 - DNA, 25 bp, Mus musculus
gagcccttactacttttcacaagaa

SEQ ID NO: 480175 - DNA, 25 bp, Mus musculus
gagcccttactagttttcacaagaa

SEQ ID NO: 480176 - DNA, 25 bp, Mus musculus
gagcccttaggaactctggttgaca

SEQ ID NO: 480177 - DNA, 25 bp, Mus musculus
gagcccttaggatctctggttgaca

SEQ ID NO: 480178 - DNA, 25 bp, Mus musculus
gagcccttcagcagagatccagtga

SEQ ID NO: 480179 - DNA, 25 bp, Mus musculus
gagcccttcagctgagatccagtga

SEQ ID NO: 480180 - DNA, 25 bp, Mus musculus
gagcccttcccaataactggaggat

SEQ ID NO: 480181 - DNA, 25 bp, Mus musculus
gagcccttcccattaactggaggat

SEQ ID NO: 480182 - DNA, 25 bp, Mus musculus
gagcccttccttatgctggactttt

SEQ ID NO: 480183 - DNA, 25 bp, Mus musculus
gagcccttccttccacataaggctg

SEQ ID NO: 480184 - DNA, 25 bp, Mus musculus
gagcccttccttgcacataaggctg

SEQ ID NO: 480185 - DNA, 25 bp, Mus musculus
gagcccttccttttgctggactttt

SEQ ID NO: 480186 - DNA, 25 bp, Mus musculus
gagcccttctctacagcaagttaag

SEQ ID NO: 480187 - DNA, 25 bp, Mus musculus
gagcccttctcttcagcaagttaag

SEQ ID NO: 480188 - DNA, 25 bp, Mus musculus
gagcccttcttgaactctggaagac

SEQ ID NO: 480189 - DNA, 25 bp, Mus musculus
gagcccttcttgcagccctggatgg

SEQ ID NO: 480190 - DNA, 25 bp, Mus musculus
gagcccttcttggagccctggatgg

SEQ ID NO: 480191 - DNA, 25 bp, Mus musculus
gagcccttcttgtactctggaagac

SEQ ID NO: 480192 - DNA, 25 bp, Mus musculus
gagcccttgagtatagccccaaata

SEQ ID NO: 480193 - DNA, 25 bp, Mus musculus
gagcccttgagtcgatctctagttt

SEQ ID NO: 480194 - DNA, 25 bp, Mus musculus
gagcccttgagtggatctctagttt

SEQ ID NO: 480195 - DNA, 25 bp, Mus musculus
gagcccttgagtttagccccaaata

SEQ ID NO: 480196 - DNA, 25 bp, Mus musculus
gagcccttgatgaatgagagcccaa

SEQ ID NO: 480197 - DNA, 25 bp, Mus musculus
gagcccttgatgtatgagagcccaa

SEQ ID NO: 480198 - DNA, 25 bp, Mus musculus
gagcccttgcaaaattggtttaaat

SEQ ID NO: 480199 - DNA, 25 bp, Mus musculus
gagcccttgcaatattggtttaaat

SEQ ID NO: 480200 - DNA, 25 bp, Mus musculus
gagcccttgcgcaaaagcttcatag

SEQ ID NO: 480201 - DNA, 25 bp, Mus musculus
gagcccttgcgctaaagcttcatag

SEQ ID NO: 480202 - DNA, 25 bp, Mus musculus
gagcccttggcacaagactttctgt

SEQ ID NO: 480203 - DNA, 25 bp, Mus musculus
gagcccttggcagaagactttctgt

SEQ ID NO: 480204 - DNA, 25 bp, Mus musculus
gagcccttggctatcacacaagtca

SEQ ID NO: 480205 - DNA, 25 bp, Mus musculus
gagcccttggctttcacacaagtca

SEQ ID NO: 480206 - DNA, 25 bp, Mus musculus
gagcccttggtaatgcttggaaagc

SEQ ID NO: 480207 - DNA, 25 bp, Mus musculus
gagcccttggtattgcttggaaagc

SEQ ID NO: 480208 - DNA, 25 bp, Mus musculus
gagcccttgtacatagacacagttt

SEQ ID NO: 480209 - DNA, 25 bp, Mus musculus
gagcccttgtacttagacacagttt

SEQ ID NO: 480210 - DNA, 25 bp, Mus musculus
gagcccttgtttatactctcaatca

SEQ ID NO: 480211 - DNA, 25 bp, Mus musculus
gagcccttgtttatcccagttgtta

SEQ ID NO: 480212 - DNA, 25 bp, Mus musculus
gagcccttgtttttactctcaatca

SEQ ID NO: 480213 - DNA, 25 bp, Mus musculus
gagcccttgtttttcccagttgtta

SEQ ID NO: 480214 - DNA, 25 bp, Mus musculus
gagccctttaaaatccccgaagatg

SEQ ID NO: 480215 - DNA, 25 bp, Mus musculus
gagccctttaaattccccgaagatg

SEQ ID NO: 480216 - DNA, 25 bp, Mus musculus
gagccctttactcttttatatttga

SEQ ID NO: 480217 - DNA, 25 bp, Mus musculus
gagccctttactgttttatatttga

SEQ ID NO: 480218 - DNA, 25 bp, Mus musculus
gagccctttaggagtggttcaaaat

SEQ ID NO: 480219 - DNA, 25 bp, Mus musculus
gagccctttaggtgtggttcaaaat

SEQ ID NO: 480220 - DNA, 25 bp, Mus musculus
gagccctttctcctcctggagggaa

SEQ ID NO: 480221 - DNA, 25 bp, Mus musculus
gagccctttctcgtcctggagggaa

SEQ ID NO: 480222 - DNA, 25 bp, Mus musculus
gagccctttgtcatttacattctga

SEQ ID NO: 480223 - DNA, 25 bp, Mus musculus
gagccctttgtcctagaccatggga

SEQ ID NO: 480224 - DNA, 25 bp, Mus musculus
gagccctttgtcgtagaccatggga

SEQ ID NO: 480225 - DNA, 25 bp, Mus musculus
gagccctttgtcttttacattctga

SEQ ID NO: 480226 - DNA, 25 bp, Mus musculus
gagcccttttacagtgacagaccac

SEQ ID NO: 480227 - DNA, 25 bp, Mus musculus
gagcccttttactgtgacagaccac

SEQ ID NO: 480228 - DNA, 25 bp, Mus musculus
gagcccttttgtcgagatgtctcgt

SEQ ID NO: 480229 - DNA, 25 bp, Mus musculus
gagcccttttgtggagatgtctcgt

SEQ ID NO: 480230 - DNA, 25 bp, Mus musculus
gagccctttttaaggaattgccctt

SEQ ID NO: 480231 - DNA, 25 bp, Mus musculus
gagccctttttatggaattgccctt

SEQ ID NO: 480232 - DNA, 25 bp, Mus musculus
gagccgaaacagacaggatccttcc

SEQ ID NO: 480233 - DNA, 25 bp, Mus musculus
gagccgaaacagtcaggatccttcc

SEQ ID NO: 480234 - DNA, 25 bp, Mus musculus
gagccgaaagctctcgatttgaatg

SEQ ID NO: 480235 - DNA, 25 bp, Mus musculus
gagccgaaagctgtcgatttgaatg

SEQ ID NO: 480236 - DNA, 25 bp, Mus musculus
gagccgaagttaacgcccaggatga

SEQ ID NO: 480237 - DNA, 25 bp, Mus musculus
gagccgaagttatcgcccaggatga

SEQ ID NO: 480238 - DNA, 25 bp, Mus musculus
gagccgaattagacagtgttttcta

SEQ ID NO: 480239 - DNA, 25 bp, Mus musculus
gagccgaattagtcagtgttttcta

SEQ ID NO: 480240 - DNA, 25 bp, Mus musculus
gagccgaccactcgatgctgtacga

SEQ ID NO: 480241 - DNA, 25 bp, Mus musculus
gagccgaccactggatgctgtacga

SEQ ID NO: 480242 - DNA, 25 bp, Mus musculus
gagccgacctttcatcctaacggag

SEQ ID NO: 480243 - DNA, 25 bp, Mus musculus
gagccgacctttgatcctaacggag

SEQ ID NO: 480244 - DNA, 25 bp, Mus musculus
gagccgagaactcaccaatgatgga

SEQ ID NO: 480245 - DNA, 25 bp, Mus musculus
gagccgagaactgaccaatgatgga

SEQ ID NO: 480246 - DNA, 25 bp, Mus musculus
gagccgagacttccagaggttacct

SEQ ID NO: 480247 - DNA, 25 bp, Mus musculus
gagccgagacttgcagaggttacct

SEQ ID NO: 480248 - DNA, 25 bp, Mus musculus
gagccgagatacatgatgactcata

SEQ ID NO: 480249 - DNA, 25 bp, Mus musculus
gagccgagatacttgatgactcata

SEQ ID NO: 480250 - DNA, 25 bp, Mus musculus
gagccgagccttagacctacaagga

SEQ ID NO: 480251 - DNA, 25 bp, Mus musculus
gagccgagcctttgacctacaagga

SEQ ID NO: 480252 - DNA, 25 bp, Mus musculus
gagccgagcgtacaagaggccctca

SEQ ID NO: 480253 - DNA, 25 bp, Mus musculus
gagccgagcgtagaagaggccctca

SEQ ID NO: 480254 - DNA, 25 bp, Mus musculus
gagccgaggaacaagacacgtctat

SEQ ID NO: 480255 - DNA, 25 bp, Mus musculus
gagccgaggaactagacacgtctat

SEQ ID NO: 480256 - DNA, 25 bp, Mus musculus
gagccgaggagactacaaggccttt

SEQ ID NO: 480257 - DNA, 25 bp, Mus musculus
gagccgaggagagtacaaggccttt

SEQ ID NO: 480258 - DNA, 25 bp, Mus musculus
gagccgaggagtctggcccatttaa

SEQ ID NO: 480259 - DNA, 25 bp, Mus musculus
gagccgaggagtgtggcccatttaa

SEQ ID NO: 480260 - DNA, 25 bp, Mus musculus
gagccgagggccaatagacttacct

SEQ ID NO: 480261 - DNA, 25 bp, Mus musculus
gagccgagggcctatagacttacct

SEQ ID NO: 480262 - DNA, 25 bp, Mus musculus
gagccgagtaatcagtcagccagat

SEQ ID NO: 480263 - DNA, 25 bp, Mus musculus
gagccgagtaatgagtcagccagat

SEQ ID NO: 480264 - DNA, 25 bp, Mus musculus
gagccgagtaccctctattgatgat

SEQ ID NO: 480265 - DNA, 25 bp, Mus musculus
gagccgagtaccgtctattgatgat

SEQ ID NO: 480266 - DNA, 25 bp, Mus musculus
gagccgagtagcaacactgtattgt

SEQ ID NO: 480267 - DNA, 25 bp, Mus musculus
gagccgagtagctacactgtattgt

SEQ ID NO: 480268 - DNA, 25 bp, Mus musculus
gagccgagttgtccttactacgcat

SEQ ID NO: 480269 - DNA, 25 bp, Mus musculus
gagccgagttgtgcttactacgcat

SEQ ID NO: 480270 - DNA, 25 bp, Mus musculus
gagccgatatcaactccatctgtca

SEQ ID NO: 480271 - DNA, 25 bp, Mus musculus
gagccgatatcatctccatctgtca

SEQ ID NO: 480272 - DNA, 25 bp, Mus musculus
gagccgatgctaaaataacacccaa

SEQ ID NO: 480273 - DNA, 25 bp, Mus musculus
gagccgatgctataataacacccaa

SEQ ID NO: 480274 - DNA, 25 bp, Mus musculus
gagccgatggcaccctggtgaccaa

SEQ ID NO: 480275 - DNA, 25 bp, Mus musculus
gagccgatggcacttgagttatgca

SEQ ID NO: 480276 - DNA, 25 bp, Mus musculus
gagccgatggcagcctggtgaccaa

SEQ ID NO: 480277 - DNA, 25 bp, Mus musculus
gagccgatggcagttgagttatgca

SEQ ID NO: 480278 - DNA, 25 bp, Mus musculus
gagccgatgtgaagcttacagacat

SEQ ID NO: 480279 - DNA, 25 bp, Mus musculus
gagccgatgtgatgcttacagacat

SEQ ID NO: 480280 - DNA, 25 bp, Mus musculus
gagccgattcgacgccatctggaag

SEQ ID NO: 480281 - DNA, 25 bp, Mus musculus
gagccgattcgaggccatctggaag

SEQ ID NO: 480282 - DNA, 25 bp, Mus musculus
gagccgattgtcctatctccagcgg

SEQ ID NO: 480283 - DNA, 25 bp, Mus musculus
gagccgattgtcgtatctccagcgg

SEQ ID NO: 480284 - DNA, 25 bp, Mus musculus
gagccgcactggcagtgagttcttt

SEQ ID NO: 480285 - DNA, 25 bp, Mus musculus
gagccgcactgggagtgagttcttt

SEQ ID NO: 480286 - DNA, 25 bp, Mus musculus
gagccgcagatcacttagcactgaa

SEQ ID NO: 480287 - DNA, 25 bp, Mus musculus
gagccgcagatctcttagcactgaa

SEQ ID NO: 480288 - DNA, 25 bp, Mus musculus
gagccgcagtgcagtttcaagcttt

SEQ ID NO: 480289 - DNA, 25 bp, Mus musculus
gagccgcagtgctgtttcaagcttt

SEQ ID NO: 480290 - DNA, 25 bp, Mus musculus
gagccgccagaaattgagatcgttg

SEQ ID NO: 480291 - DNA, 25 bp, Mus musculus
gagccgccagaatttgagatcgttg

SEQ ID NO: 480292 - DNA, 25 bp, Mus musculus
gagccgccagcaccgagcatgtgaa

SEQ ID NO: 480293 - DNA, 25 bp, Mus musculus
gagccgccagcagcgagcatgtgaa

SEQ ID NO: 480294 - DNA, 25 bp, Mus musculus
gagccgccattcaagggaacgcttt

SEQ ID NO: 480295 - DNA, 25 bp, Mus musculus
gagccgccattctagggaacgcttt

SEQ ID NO: 480296 - DNA, 25 bp, Mus musculus
gagccgccgcatagagcagccacag

SEQ ID NO: 480297 - DNA, 25 bp, Mus musculus
gagccgccgcattgagcagccacag

SEQ ID NO: 480298 - DNA, 25 bp, Mus musculus
gagccgccgcggacaagatgttcac

SEQ ID NO: 480299 - DNA, 25 bp, Mus musculus
gagccgccgcggtcaagatgttcac

SEQ ID NO: 480300 - DNA, 25 bp, Mus musculus
gagccgcgactccaagtatacgaga

SEQ ID NO: 480301 - DNA, 25 bp, Mus musculus
gagccgcgactcgaagtatacgaga

SEQ ID NO: 480302 - DNA, 25 bp, Mus musculus
gagccgcgtgacagtacgtgttgaa

SEQ ID NO: 480303 - DNA, 25 bp, Mus musculus
gagccgcgtgactgtacgtgttgaa

SEQ ID NO: 480304 - DNA, 25 bp, Mus musculus
gagccgctctggagacgtgtctgca

SEQ ID NO: 480305 - DNA, 25 bp, Mus musculus
gagccgctctggtgacgtgtctgca

SEQ ID NO: 480306 - DNA, 25 bp, Mus musculus
gagccgctgaatcagaaggttgtca

SEQ ID NO: 480307 - DNA, 25 bp, Mus musculus
gagccgctgaatgagaaggttgtca

SEQ ID NO: 480308 - DNA, 25 bp, Mus musculus
gagccgctgcagatatttccaagag

SEQ ID NO: 480309 - DNA, 25 bp, Mus musculus
gagccgctgcagttatttccaagag

SEQ ID NO: 480310 - DNA, 25 bp, Mus musculus
gagccgctgggtcagagaaaccact

SEQ ID NO: 480311 - DNA, 25 bp, Mus musculus
gagccgctgggtgagagaaaccact

SEQ ID NO: 480312 - DNA, 25 bp, Mus musculus
gagccggaaggaccgtttacacaac

SEQ ID NO: 480313 - DNA, 25 bp, Mus musculus
gagccggaaggagcgtttacacaac

SEQ ID NO: 480314 - DNA, 25 bp, Mus musculus
gagccggaattaattagaaagagga

SEQ ID NO: 480315 - DNA, 25 bp, Mus musculus
gagccggaattatttagaaagagga

SEQ ID NO: 480316 - DNA, 25 bp, Mus musculus
gagccggacaggcagcttttccaag

SEQ ID NO: 480317 - DNA, 25 bp, Mus musculus
gagccggacagggagcttttccaag

SEQ ID NO: 480318 - DNA, 25 bp, Mus musculus
gagccggaccatagcactgtgaaga

SEQ ID NO: 480319 - DNA, 25 bp, Mus musculus
gagccggaccattgcactgtgaaga

SEQ ID NO: 480320 - DNA, 25 bp, Mus musculus
gagccggagacacacatcttattct

SEQ ID NO: 480321 - DNA, 25 bp, Mus musculus
gagccggagacagacatcttattct

SEQ ID NO: 480322 - DNA, 25 bp, Mus musculus
gagccggatcctaaagagtcagaca

SEQ ID NO: 480323 - DNA, 25 bp, Mus musculus
gagccggatccttaagagtcagaca

SEQ ID NO: 480324 - DNA, 25 bp, Mus musculus
gagccggatctgatactgttagcaa

SEQ ID NO: 480325 - DNA, 25 bp, Mus musculus
gagccggatctgttactgttagcaa

SEQ ID NO: 480326 - DNA, 25 bp, Mus musculus
gagccggatgttactctagggtcca

SEQ ID NO: 480327 - DNA, 25 bp, Mus musculus
gagccggatgtttctctagggtcca

SEQ ID NO: 480328 - DNA, 25 bp, Mus musculus
gagccggattacaaatggtcagcct

SEQ ID NO: 480329 - DNA, 25 bp, Mus musculus
gagccggattactaatggtcagcct

SEQ ID NO: 480330 - DNA, 25 bp, Mus musculus
gagccggcagctagttgatttcagc

SEQ ID NO: 480331 - DNA, 25 bp, Mus musculus
gagccggcagcttgttgatttcagc

SEQ ID NO: 480332 - DNA, 25 bp, Mus musculus
gagccggcaggaagagatgaactct

SEQ ID NO: 480333 - DNA, 25 bp, Mus musculus
gagccggcaggatgagatgaactct

SEQ ID NO: 480334 - DNA, 25 bp, Mus musculus
gagccggcattgaggccagagtgca

SEQ ID NO: 480335 - DNA, 25 bp, Mus musculus
gagccggcattgtggccagagtgca

SEQ ID NO: 480336 - DNA, 25 bp, Mus musculus
gagccggccggcacttttgcatgag

SEQ ID NO: 480337 - DNA, 25 bp, Mus musculus
gagccggccggctcttttgcatgag

SEQ ID NO: 480338 - DNA, 25 bp, Mus musculus
gagccggccgtgattagaagcatat

SEQ ID NO: 480339 - DNA, 25 bp, Mus musculus
gagccggccgtgtttagaagcatat

SEQ ID NO: 480340 - DNA, 25 bp, Mus musculus
gagccggcggacagacttccacaga

SEQ ID NO: 480341 - DNA, 25 bp, Mus musculus
gagccggcggactgacttccacaga

SEQ ID NO: 480342 - DNA, 25 bp, Mus musculus
gagccggcggtgagacgtcaacact

SEQ ID NO: 480343 - DNA, 25 bp, Mus musculus
gagccggcggtgtgacgtcaacact

SEQ ID NO: 480344 - DNA, 25 bp, Mus musculus
gagccgggaaggagccacagattca

SEQ ID NO: 480345 - DNA, 25 bp, Mus musculus
gagccgggaaggtgccacagattca

SEQ ID NO: 480346 - DNA, 25 bp, Mus musculus
gagccgggacacatcttggatctgt

SEQ ID NO: 480347 - DNA, 25 bp, Mus musculus
gagccgggacacttcttggatctgt

SEQ ID NO: 480348 - DNA, 25 bp, Mus musculus
gagccgggactcagatttcatataa

SEQ ID NO: 480349 - DNA, 25 bp, Mus musculus
gagccgggactctgatttcatataa

SEQ ID NO: 480350 - DNA, 25 bp, Mus musculus
gagccgggaggacacgcttaaatcc

SEQ ID NO: 480351 - DNA, 25 bp, Mus musculus
gagccgggaggagacgcttaaatcc

SEQ ID NO: 480352 - DNA, 25 bp, Mus musculus
gagccgggccatataaaggccttat

SEQ ID NO: 480353 - DNA, 25 bp, Mus musculus
gagccgggccatttaaaggccttat

SEQ ID NO: 480354 - DNA, 25 bp, Mus musculus
gagccggtccacctggatagaattc

SEQ ID NO: 480355 - DNA, 25 bp, Mus musculus
gagccggtccacgtggatagaattc

SEQ ID NO: 480356 - DNA, 25 bp, Mus musculus
gagccggtcctacaacaaagctgat

SEQ ID NO: 480357 - DNA, 25 bp, Mus musculus
gagccggtcctagaacaaagctgat

SEQ ID NO: 480358 - DNA, 25 bp, Mus musculus
gagccggttagaagacagtccctta

SEQ ID NO: 480359 - DNA, 25 bp, Mus musculus
gagccggttagatgacagtccctta

SEQ ID NO: 480360 - DNA, 25 bp, Mus musculus
gagccggtttcccttgtgtcctcga

SEQ ID NO: 480361 - DNA, 25 bp, Mus musculus
gagccggtttccgttgtgtcctcga

SEQ ID NO: 480362 - DNA, 25 bp, Mus musculus
gagccgtacaaaccgaagttctgcc

SEQ ID NO: 480363 - DNA, 25 bp, Mus musculus
gagccgtacaaagcgaagttctgcc

SEQ ID NO: 480364 - DNA, 25 bp, Mus musculus
gagccgtacaccacagctatgggca

SEQ ID NO: 480365 - DNA, 25 bp, Mus musculus
gagccgtacacctcagctatgggca

SEQ ID NO: 480366 - DNA, 25 bp, Mus musculus
gagccgtaccagcaaagttgaagca

SEQ ID NO: 480367 - DNA, 25 bp, Mus musculus
gagccgtaccaggaaagttgaagca

SEQ ID NO: 480368 - DNA, 25 bp, Mus musculus
gagccgtataaactcagtcctctgt

SEQ ID NO: 480369 - DNA, 25 bp, Mus musculus
gagccgtataaagtcagtcctctgt

SEQ ID NO: 480370 - DNA, 25 bp, Mus musculus
gagccgtattaacctctagtcatag

SEQ ID NO: 480371 - DNA, 25 bp, Mus musculus
gagccgtattaactgcattgtttaa

SEQ ID NO: 480372 - DNA, 25 bp, Mus musculus
gagccgtattaagctctagtcatag

SEQ ID NO: 480373 - DNA, 25 bp, Mus musculus
gagccgtattaagtgcattgtttaa

SEQ ID NO: 480374 - DNA, 25 bp, Mus musculus
gagccgtattcactatcagtcacct

SEQ ID NO: 480375 - DNA, 25 bp, Mus musculus
gagccgtattcagtatcagtcacct

SEQ ID NO: 480376 - DNA, 25 bp, Mus musculus
gagccgtcacagcttcttcgttgga

SEQ ID NO: 480377 - DNA, 25 bp, Mus musculus
gagccgtcacaggttcttcgttgga

SEQ ID NO: 480378 - DNA, 25 bp, Mus musculus
gagccgtcagcccagagctgattta

SEQ ID NO: 480379 - DNA, 25 bp, Mus musculus
gagccgtcagccgagagctgattta

SEQ ID NO: 480380 - DNA, 25 bp, Mus musculus
gagccgtcatgaattccaggtgcga

SEQ ID NO: 480381 - DNA, 25 bp, Mus musculus
gagccgtcatgatttccaggtgcga

SEQ ID NO: 480382 - DNA, 25 bp, Mus musculus
gagccgtcattcaggagctactgaa

SEQ ID NO: 480383 - DNA, 25 bp, Mus musculus
gagccgtcattctggagctactgaa

SEQ ID NO: 480384 - DNA, 25 bp, Mus musculus
gagccgtccaaaacagaaccaactt

SEQ ID NO: 480385 - DNA, 25 bp, Mus musculus
gagccgtccaaatcagaaccaactt

SEQ ID NO: 480386 - DNA, 25 bp, Mus musculus
gagccgtccctgctcgactaggctg

SEQ ID NO: 480387 - DNA, 25 bp, Mus musculus
gagccgtccctggtcgactaggctg

SEQ ID NO: 480388 - DNA, 25 bp, Mus musculus
gagccgtcctgaaggacccaaacga

SEQ ID NO: 480389 - DNA, 25 bp, Mus musculus
gagccgtcctgatggacccaaacga

SEQ ID NO: 480390 - DNA, 25 bp, Mus musculus
gagccgtcctgcattttggagcata

SEQ ID NO: 480391 - DNA, 25 bp, Mus musculus
gagccgtcctgctttttggagcata

SEQ ID NO: 480392 - DNA, 25 bp, Mus musculus
gagccgtccttcaagcagtttcaag

SEQ ID NO: 480393 - DNA, 25 bp, Mus musculus
gagccgtccttctagcagtttcaag

SEQ ID NO: 480394 - DNA, 25 bp, Mus musculus
gagccgtcggtgagggcgatccctg

SEQ ID NO: 480395 - DNA, 25 bp, Mus musculus
gagccgtcggtgtgggcgatccctg

SEQ ID NO: 480396 - DNA, 25 bp, Mus musculus
gagccgtgaccaccaaaggagtcta

SEQ ID NO: 480397 - DNA, 25 bp, Mus musculus
gagccgtgaccagcaaaggagtcta

SEQ ID NO: 480398 - DNA, 25 bp, Mus musculus
gagccgtgaggtaatgcttatttca

SEQ ID NO: 480399 - DNA, 25 bp, Mus musculus
gagccgtgaggttatgcttatttca

SEQ ID NO: 480400 - DNA, 25 bp, Mus musculus
gagccgtgatgtatcagtaactgca

SEQ ID NO: 480401 - DNA, 25 bp, Mus musculus
gagccgtgatgtttcagtaactgca

SEQ ID NO: 480402 - DNA, 25 bp, Mus musculus
gagccgttaaccaattgaatttcat

SEQ ID NO: 480403 - DNA, 25 bp, Mus musculus
gagccgttaacctattgaatttcat

SEQ ID NO: 480404 - DNA, 25 bp, Mus musculus
gagccgttataccatgagaccacac

SEQ ID NO: 480405 - DNA, 25 bp, Mus musculus
gagccgttatacgatgagaccacac

SEQ ID NO: 480406 - DNA, 25 bp, Mus musculus
gagccgttcacacgtctagagtttt

SEQ ID NO: 480407 - DNA, 25 bp, Mus musculus
gagccgttcacaggtctagagtttt

SEQ ID NO: 480408 - DNA, 25 bp, Mus musculus
gagccgttcagactggcagatcttc

SEQ ID NO: 480409 - DNA, 25 bp, Mus musculus
gagccgttcagagtggcagatcttc

SEQ ID NO: 480410 - DNA, 25 bp, Mus musculus
gagccgttgggaagtccttccagta

SEQ ID NO: 480411 - DNA, 25 bp, Mus musculus
gagccgttgggatgtccttccagta

SEQ ID NO: 480412 - DNA, 25 bp, Mus musculus
gagccgtttccaaagcactgatctt

SEQ ID NO: 480413 - DNA, 25 bp, Mus musculus
gagccgtttccatagcactgatctt

SEQ ID NO: 480414 - DNA, 25 bp, Mus musculus
gagccgttttccatggacggagata

SEQ ID NO: 480415 - DNA, 25 bp, Mus musculus
gagccgttttccttggacggagata

SEQ ID NO: 480416 - DNA, 25 bp, Mus musculus
gagcctaaacaacccgatgtgcctg

SEQ ID NO: 480417 - DNA, 25 bp, Mus musculus
gagcctaaacaagccgatgtgcctg

SEQ ID NO: 480418 - DNA, 25 bp, Mus musculus
gagcctaaacacagactggcaagac

SEQ ID NO: 480419 - DNA, 25 bp, Mus musculus
gagcctaaacactgactggcaagac

SEQ ID NO: 480420 - DNA, 25 bp, Mus musculus
gagcctaaaccgcaacagcatacac

SEQ ID NO: 480421 - DNA, 25 bp, Mus musculus
gagcctaaaccggaacagcatacac

SEQ ID NO: 480422 - DNA, 25 bp, Mus musculus
gagcctaaacctacctgtggtgcaa

SEQ ID NO: 480423 - DNA, 25 bp, Mus musculus
gagcctaaaccttcctgtggtgcaa

SEQ ID NO: 480424 - DNA, 25 bp, Mus musculus
gagcctaaaggaagactgactccct

SEQ ID NO: 480425 - DNA, 25 bp, Mus musculus
gagcctaaaggatgactgactccct

SEQ ID NO: 480426 - DNA, 25 bp, Mus musculus
gagcctaaatgcattcttgtgaaaa

SEQ ID NO: 480427 - DNA, 25 bp, Mus musculus
gagcctaaatgctttcttgtgaaaa

SEQ ID NO: 480428 - DNA, 25 bp, Mus musculus
gagcctaacaatcatggcagccatg

SEQ ID NO: 480429 - DNA, 25 bp, Mus musculus
gagcctaacaatgatggcagccatg

SEQ ID NO: 480430 - DNA, 25 bp, Mus musculus
gagcctaacaggaagtgaactctat

SEQ ID NO: 480431 - DNA, 25 bp, Mus musculus
gagcctaacaggtagtgaactctat

SEQ ID NO: 480432 - DNA, 25 bp, Mus musculus
gagcctaaccggagcaacatttaaa

SEQ ID NO: 480433 - DNA, 25 bp, Mus musculus
gagcctaaccggtgcaacatttaaa

SEQ ID NO: 480434 - DNA, 25 bp, Mus musculus
gagcctaacggacaggtatttaact

SEQ ID NO: 480435 - DNA, 25 bp, Mus musculus
gagcctaacggagaggtatttaact

SEQ ID NO: 480436 - DNA, 25 bp, Mus musculus
gagcctaagaacaactactttccgg

SEQ ID NO: 480437 - DNA, 25 bp, Mus musculus
gagcctaagaactactactttccgg

SEQ ID NO: 480438 - DNA, 25 bp, Mus musculus
gagcctaagatgagcacgcctgaaa

SEQ ID NO: 480439 - DNA, 25 bp, Mus musculus
gagcctaagatgtgcacgcctgaaa

SEQ ID NO: 480440 - DNA, 25 bp, Mus musculus
gagcctaatcaaatattcctgccgc

SEQ ID NO: 480441 - DNA, 25 bp, Mus musculus
gagcctaatcaattattcctgccgc

SEQ ID NO: 480442 - DNA, 25 bp, Mus musculus
gagcctaatctgctctgtgcagcat

SEQ ID NO: 480443 - DNA, 25 bp, Mus musculus
gagcctaatctggtctgtgcagcat

SEQ ID NO: 480444 - DNA, 25 bp, Mus musculus
gagcctaatgaaagtaactaatccc

SEQ ID NO: 480445 - DNA, 25 bp, Mus musculus
gagcctaatgaatgtaactaatccc

SEQ ID NO: 480446 - DNA, 25 bp, Mus musculus
gagcctaattttactatccttgaaa

SEQ ID NO: 480447 - DNA, 25 bp, Mus musculus
gagcctaatttttctatccttgaaa

SEQ ID NO: 480448 - DNA, 25 bp, Mus musculus
gagcctacagcgaggaggacttcca

SEQ ID NO: 480449 - DNA, 25 bp, Mus musculus
gagcctacagcgtggaggacttcca

SEQ ID NO: 480450 - DNA, 25 bp, Mus musculus
gagcctacaggtcccctgagatctc

SEQ ID NO: 480451 - DNA, 25 bp, Mus musculus
gagcctacaggtgccctgagatctc

SEQ ID NO: 480452 - DNA, 25 bp, Mus musculus
gagcctacatcacggcagtgagcat

SEQ ID NO: 480453 - DNA, 25 bp, Mus musculus
gagcctacatcagggcagtgagcat

SEQ ID NO: 480454 - DNA, 25 bp, Mus musculus
gagcctaccagactcatttattgaa

SEQ ID NO: 480455 - DNA, 25 bp, Mus musculus
gagcctaccagagtcatttattgaa

SEQ ID NO: 480456 - DNA, 25 bp, Mus musculus
gagcctaccattattgaagtttaag

SEQ ID NO: 480457 - DNA, 25 bp, Mus musculus
gagcctaccatttttgaagtttaag

SEQ ID NO: 480458 - DNA, 25 bp, Mus musculus
gagcctaccctgaaaagtatgcaga

SEQ ID NO: 480459 - DNA, 25 bp, Mus musculus
gagcctaccctgtaaagtatgcaga

SEQ ID NO: 480460 - DNA, 25 bp, Mus musculus
gagcctacctaaccaacctgaattt

SEQ ID NO: 480461 - DNA, 25 bp, Mus musculus
gagcctacctaagcaacctgaattt

SEQ ID NO: 480462 - DNA, 25 bp, Mus musculus
gagcctactatgatatttcccactg

SEQ ID NO: 480463 - DNA, 25 bp, Mus musculus
gagcctactatgttatttcccactg

SEQ ID NO: 480464 - DNA, 25 bp, Mus musculus
gagcctactattcatattgccttat

SEQ ID NO: 480465 - DNA, 25 bp, Mus musculus
gagcctactattgatattgccttat

SEQ ID NO: 480466 - DNA, 25 bp, Mus musculus
gagcctactgatcaatgctttagca

SEQ ID NO: 480467 - DNA, 25 bp, Mus musculus
gagcctactgatgaatgctttagca

SEQ ID NO: 480468 - DNA, 25 bp, Mus musculus
gagcctacttgccttattgggtgca

SEQ ID NO: 480469 - DNA, 25 bp, Mus musculus
gagcctacttgcgttattgggtgca

SEQ ID NO: 480470 - DNA, 25 bp, Mus musculus
gagcctagaattactcagggcctgt

SEQ ID NO: 480471 - DNA, 25 bp, Mus musculus
gagcctagaatttctcagggcctgt

SEQ ID NO: 480472 - DNA, 25 bp, Mus musculus
gagcctagaccacacaccaaatcag

SEQ ID NO: 480473 - DNA, 25 bp, Mus musculus
gagcctagaccagacaccaaatcag

SEQ ID NO: 480474 - DNA, 25 bp, Mus musculus
gagcctagactcaagcgtactgtgg

SEQ ID NO: 480475 - DNA, 25 bp, Mus musculus
gagcctagactctagcgtactgtgg

SEQ ID NO: 480476 - DNA, 25 bp, Mus musculus
gagcctagagctcaatgattctgtt

SEQ ID NO: 480477 - DNA, 25 bp, Mus musculus
gagcctagagctgaatgattctgtt

SEQ ID NO: 480478 - DNA, 25 bp, Mus musculus
gagcctagagtgatggaacagccca

SEQ ID NO: 480479 - DNA, 25 bp, Mus musculus
gagcctagagtgttggaacagccca

SEQ ID NO: 480480 - DNA, 25 bp, Mus musculus
gagcctagcaacaaccatgttggag

SEQ ID NO: 480481 - DNA, 25 bp, Mus musculus
gagcctagcaactaccatgttggag

SEQ ID NO: 480482 - DNA, 25 bp, Mus musculus
gagcctagcctaaaaagtctgtctg

SEQ ID NO: 480483 - DNA, 25 bp, Mus musculus
gagcctagcctataaagtctgtctg

SEQ ID NO: 480484 - DNA, 25 bp, Mus musculus
gagcctaggaacattgcagtctggg

SEQ ID NO: 480485 - DNA, 25 bp, Mus musculus
gagcctaggaactttgcagtctggg

SEQ ID NO: 480486 - DNA, 25 bp, Mus musculus
gagcctaggacgagctgaatccctt

SEQ ID NO: 480487 - DNA, 25 bp, Mus musculus
gagcctaggacgtgctgaatccctt

SEQ ID NO: 480488 - DNA, 25 bp, Mus musculus
gagcctaggagcaaacatttcagac

SEQ ID NO: 480489 - DNA, 25 bp, Mus musculus
gagcctaggagctaacatttcagac

SEQ ID NO: 480490 - DNA, 25 bp, Mus musculus
gagcctaggatgatggtccgtacca

SEQ ID NO: 480491 - DNA, 25 bp, Mus musculus
gagcctaggatgttggtccgtacca

SEQ ID NO: 480492 - DNA, 25 bp, Mus musculus
gagcctaggcctcgacacaaatgca

SEQ ID NO: 480493 - DNA, 25 bp, Mus musculus
gagcctaggcctggacacaaatgca

SEQ ID NO: 480494 - DNA, 25 bp, Mus musculus
gagcctaggctcactttcatccctt

SEQ ID NO: 480495 - DNA, 25 bp, Mus musculus
gagcctaggctctctttcatccctt

SEQ ID NO: 480496 - DNA, 25 bp, Mus musculus
gagcctagggacactcacaggttag

SEQ ID NO: 480497 - DNA, 25 bp, Mus musculus
gagcctagggactctcacaggttag

SEQ ID NO: 480498 - DNA, 25 bp, Mus musculus
gagcctagtcttatagtaactggat

SEQ ID NO: 480499 - DNA, 25 bp, Mus musculus
gagcctagtcttttagtaactggat

SEQ ID NO: 480500 - DNA, 25 bp, Mus musculus
gagcctagtgaaacccagaaatgtc

SEQ ID NO: 480501 - DNA, 25 bp, Mus musculus
gagcctagtgaacctggctagaatg

SEQ ID NO: 480502 - DNA, 25 bp, Mus musculus
gagcctagtgaagctggctagaatg

SEQ ID NO: 480503 - DNA, 25 bp, Mus musculus
gagcctagtgaatcccagaaatgtc

SEQ ID NO: 480504 - DNA, 25 bp, Mus musculus
gagcctagtgctagaacacttgcct

SEQ ID NO: 480505 - DNA, 25 bp, Mus musculus
gagcctagtgcttgaacacttgcct

SEQ ID NO: 480506 - DNA, 25 bp, Mus musculus
gagcctagtttgcactgtgttctgt

SEQ ID NO: 480507 - DNA, 25 bp, Mus musculus
gagcctagtttggactgtgttctgt

SEQ ID NO: 480508 - DNA, 25 bp, Mus musculus
gagcctatactgatttatgatagac

SEQ ID NO: 480509 - DNA, 25 bp, Mus musculus
gagcctatactgttttatgatagac

SEQ ID NO: 480510 - DNA, 25 bp, Mus musculus
gagcctatagacagcgatgtgagca

SEQ ID NO: 480511 - DNA, 25 bp, Mus musculus
gagcctatagactgcgatgtgagca

SEQ ID NO: 480512 - DNA, 25 bp, Mus musculus
gagcctatagccagtgtccaccagt

SEQ ID NO: 480513 - DNA, 25 bp, Mus musculus
gagcctatagcctgtgtccaccagt

SEQ ID NO: 480514 - DNA, 25 bp, Mus musculus
gagcctatatcacagtggcgcccta

SEQ ID NO: 480515 - DNA, 25 bp, Mus musculus
gagcctatatcagagtggcgcccta

SEQ ID NO: 480516 - DNA, 25 bp, Mus musculus
gagcctatattactgttccctagag

SEQ ID NO: 480517 - DNA, 25 bp, Mus musculus
gagcctatattagtgttccctagag

SEQ ID NO: 480518 - DNA, 25 bp, Mus musculus
gagcctatatttaaacagaaacaga

SEQ ID NO: 480519 - DNA, 25 bp, Mus musculus
gagcctatattttaacagaaacaga

SEQ ID NO: 480520 - DNA, 25 bp, Mus musculus
gagcctatcaataggaatatgaccc

SEQ ID NO: 480521 - DNA, 25 bp, Mus musculus
gagcctatcaattggaatatgaccc

SEQ ID NO: 480522 - DNA, 25 bp, Mus musculus
gagcctatctaacgcaggtttggat

SEQ ID NO: 480523 - DNA, 25 bp, Mus musculus
gagcctatctaaggcaggtttggat

SEQ ID NO: 480524 - DNA, 25 bp, Mus musculus
gagcctatgaatatagcttcccaga

SEQ ID NO: 480525 - DNA, 25 bp, Mus musculus
gagcctatgaatttagcttcccaga

SEQ ID NO: 480526 - DNA, 25 bp, Mus musculus
gagcctatgatactctccatttact

SEQ ID NO: 480527 - DNA, 25 bp, Mus musculus
gagcctatgatagtctccatttact

SEQ ID NO: 480528 - DNA, 25 bp, Mus musculus
gagcctatgattacagcatgctttt

SEQ ID NO: 480529 - DNA, 25 bp, Mus musculus
gagcctatgatttcagcatgctttt

SEQ ID NO: 480530 - DNA, 25 bp, Mus musculus
gagcctatgctaagtttgggtcgat

SEQ ID NO: 480531 - DNA, 25 bp, Mus musculus
gagcctatgctatgtttgggtcgat

SEQ ID NO: 480532 - DNA, 25 bp, Mus musculus
gagcctatggctatgggcacagttc

SEQ ID NO: 480533 - DNA, 25 bp, Mus musculus
gagcctatggctttgggcacagttc

SEQ ID NO: 480534 - DNA, 25 bp, Mus musculus
gagcctatgggactcaaatgtgaag

SEQ ID NO: 480535 - DNA, 25 bp, Mus musculus
gagcctatgggagtcaaatgtgaag

SEQ ID NO: 480536 - DNA, 25 bp, Mus musculus
gagcctatgggcagcatgtcatcca

SEQ ID NO: 480537 - DNA, 25 bp, Mus musculus
gagcctatgggctgcatgtcatcca

SEQ ID NO: 480538 - DNA, 25 bp, Mus musculus
gagcctatggttaaggatcacatct

SEQ ID NO: 480539 - DNA, 25 bp, Mus musculus
gagcctatggtttaggatcacatct

SEQ ID NO: 480540 - DNA, 25 bp, Mus musculus
gagcctattagtctctagggtcact

SEQ ID NO: 480541 - DNA, 25 bp, Mus musculus
gagcctattagtgtctagggtcact

SEQ ID NO: 480542 - DNA, 25 bp, Mus musculus
gagcctattggactgcattcttggt

SEQ ID NO: 480543 - DNA, 25 bp, Mus musculus
gagcctattggagtgcattcttggt

SEQ ID NO: 480544 - DNA, 25 bp, Mus musculus
gagcctcaacacatctaatcttttt

SEQ ID NO: 480545 - DNA, 25 bp, Mus musculus
gagcctcaacacttctaatcttttt

SEQ ID NO: 480546 - DNA, 25 bp, Mus musculus
gagcctcaaccaaccctactatgaa

SEQ ID NO: 480547 - DNA, 25 bp, Mus musculus
gagcctcaaccatccctactatgaa

SEQ ID NO: 480548 - DNA, 25 bp, Mus musculus
gagcctcaactgcagaagccccatt

SEQ ID NO: 480549 - DNA, 25 bp, Mus musculus
gagcctcaactggagaagccccatt

SEQ ID NO: 480550 - DNA, 25 bp, Mus musculus
gagcctcaaggaacagagggcattt

SEQ ID NO: 480551 - DNA, 25 bp, Mus musculus
gagcctcaaggatcagagggcattt

SEQ ID NO: 480552 - DNA, 25 bp, Mus musculus
gagcctcaagtacaatggtgcccac

SEQ ID NO: 480553 - DNA, 25 bp, Mus musculus
gagcctcaagtagaatggtgcccac

SEQ ID NO: 480554 - DNA, 25 bp, Mus musculus
gagcctcaataaattccgtgcagtt

SEQ ID NO: 480555 - DNA, 25 bp, Mus musculus
gagcctcaataatttccgtgcagtt

SEQ ID NO: 480556 - DNA, 25 bp, Mus musculus
gagcctcaatttagggcagttttgg

SEQ ID NO: 480557 - DNA, 25 bp, Mus musculus
gagcctcaattttgggcagttttgg

SEQ ID NO: 480558 - DNA, 25 bp, Mus musculus
gagcctcacacaagcctggaagggt

SEQ ID NO: 480559 - DNA, 25 bp, Mus musculus
gagcctcacacatgcctggaagggt

SEQ ID NO: 480560 - DNA, 25 bp, Mus musculus
gagcctcacagacaatggccaagtg

SEQ ID NO: 480561 - DNA, 25 bp, Mus musculus
gagcctcacagagaatggccaagtg

SEQ ID NO: 480562 - DNA, 25 bp, Mus musculus
gagcctcacatccagggctgagaaa

SEQ ID NO: 480563 - DNA, 25 bp, Mus musculus
gagcctcacatcgagggctgagaaa

SEQ ID NO: 480564 - DNA, 25 bp, Mus musculus
gagcctcacgatcttgggtctcagg

SEQ ID NO: 480565 - DNA, 25 bp, Mus musculus
gagcctcacgatgttgggtctcagg

SEQ ID NO: 480566 - DNA, 25 bp, Mus musculus
gagcctcactttatacaacgatctg

SEQ ID NO: 480567 - DNA, 25 bp, Mus musculus
gagcctcactttttacaacgatctg

SEQ ID NO: 480568 - DNA, 25 bp, Mus musculus
gagcctcagactaatgctgctgttt

SEQ ID NO: 480569 - DNA, 25 bp, Mus musculus
gagcctcagacttatgctgctgttt

SEQ ID NO: 480570 - DNA, 25 bp, Mus musculus
gagcctcagagacaagtgacccggc

SEQ ID NO: 480571 - DNA, 25 bp, Mus musculus
gagcctcagagagaagtgacccggc

SEQ ID NO: 480572 - DNA, 25 bp, Mus musculus
gagcctcagctgcacgacagaactt

SEQ ID NO: 480573 - DNA, 25 bp, Mus musculus
gagcctcagctgcttaatcgttttg

SEQ ID NO: 480574 - DNA, 25 bp, Mus musculus
gagcctcagctggacgacagaactt

SEQ ID NO: 480575 - DNA, 25 bp, Mus musculus
gagcctcagctggttaatcgttttg

SEQ ID NO: 480576 - DNA, 25 bp, Mus musculus
gagcctcaggttacatagacgtgtt

SEQ ID NO: 480577 - DNA, 25 bp, Mus musculus
gagcctcaggtttcatagacgtgtt

SEQ ID NO: 480578 - DNA, 25 bp, Mus musculus
gagcctcagtggaacaagtcccttt

SEQ ID NO: 480579 - DNA, 25 bp, Mus musculus
gagcctcagtggtacaagtcccttt

SEQ ID NO: 480580 - DNA, 25 bp, Mus musculus
gagcctcagttaaatggtaatgcca

SEQ ID NO: 480581 - DNA, 25 bp, Mus musculus
gagcctcagttatatggtaatgcca

SEQ ID NO: 480582 - DNA, 25 bp, Mus musculus
gagcctcatcatacagatgccggag

SEQ ID NO: 480583 - DNA, 25 bp, Mus musculus
gagcctcatcattcagatgccggag

SEQ ID NO: 480584 - DNA, 25 bp, Mus musculus
gagcctcatccaacaagggacgttt

SEQ ID NO: 480585 - DNA, 25 bp, Mus musculus
gagcctcatccatcaagggacgttt

SEQ ID NO: 480586 - DNA, 25 bp, Mus musculus
gagcctcatgagcaagcacatccga

SEQ ID NO: 480587 - DNA, 25 bp, Mus musculus
gagcctcatgaggaagcacatccga

SEQ ID NO: 480588 - DNA, 25 bp, Mus musculus
gagcctcatggaagttcaaaccaga

SEQ ID NO: 480589 - DNA, 25 bp, Mus musculus
gagcctcatggatgttcaaaccaga

SEQ ID NO: 480590 - DNA, 25 bp, Mus musculus
gagcctcattacatcatgccaagtt

SEQ ID NO: 480591 - DNA, 25 bp, Mus musculus
gagcctcattacttcatgccaagtt

SEQ ID NO: 480592 - DNA, 25 bp, Mus musculus
gagcctcattcacaaattctaggcc

SEQ ID NO: 480593 - DNA, 25 bp, Mus musculus
gagcctcattcagaaattctaggcc

SEQ ID NO: 480594 - DNA, 25 bp, Mus musculus
gagcctcattccagggtaggattct

SEQ ID NO: 480595 - DNA, 25 bp, Mus musculus
gagcctcattcctgggtaggattct

SEQ ID NO: 480596 - DNA, 25 bp, Mus musculus
gagcctcattggagtctatcctgag

SEQ ID NO: 480597 - DNA, 25 bp, Mus musculus
gagcctcattggtgtctatcctgag

SEQ ID NO: 480598 - DNA, 25 bp, Mus musculus
gagcctcatttccacagattgggtt

SEQ ID NO: 480599 - DNA, 25 bp, Mus musculus
gagcctcatttcgacagattgggtt

SEQ ID NO: 480600 - DNA, 25 bp, Mus musculus
gagcctcattttatgctgctagtga

SEQ ID NO: 480601 - DNA, 25 bp, Mus musculus
gagcctcattttttgctgctagtga

SEQ ID NO: 480602 - DNA, 25 bp, Mus musculus
gagcctccaaagaatcaaagccctg

SEQ ID NO: 480603 - DNA, 25 bp, Mus musculus
gagcctccaaagtatcaaagccctg

SEQ ID NO: 480604 - DNA, 25 bp, Mus musculus
gagcctccaagcatcagctgaaaag

SEQ ID NO: 480605 - DNA, 25 bp, Mus musculus
gagcctccaagcttcagctgaaaag

SEQ ID NO: 480606 - DNA, 25 bp, Mus musculus
gagcctccaatcctgttgagagtgg

SEQ ID NO: 480607 - DNA, 25 bp, Mus musculus
gagcctccaatcgtgttgagagtgg

SEQ ID NO: 480608 - DNA, 25 bp, Mus musculus
gagcctccaccccaaattttgggat

SEQ ID NO: 480609 - DNA, 25 bp, Mus musculus
gagcctccacccgaaattttgggat

SEQ ID NO: 480610 - DNA, 25 bp, Mus musculus
gagcctccactcagaacattgtcag

SEQ ID NO: 480611 - DNA, 25 bp, Mus musculus
gagcctccactctgaacattgtcag

SEQ ID NO: 480612 - DNA, 25 bp, Mus musculus
gagcctccaggaagcaggaaactct

SEQ ID NO: 480613 - DNA, 25 bp, Mus musculus
gagcctccaggatgcaggaaactct

SEQ ID NO: 480614 - DNA, 25 bp, Mus musculus
gagcctccaggtcggcaatatccaa

SEQ ID NO: 480615 - DNA, 25 bp, Mus musculus
gagcctccaggtgggcaatatccaa

SEQ ID NO: 480616 - DNA, 25 bp, Mus musculus
gagcctccatatatctaagagccag

SEQ ID NO: 480617 - DNA, 25 bp, Mus musculus
gagcctccatatttctaagagccag

SEQ ID NO: 480618 - DNA, 25 bp, Mus musculus
gagcctccatccagctgagatgatc

SEQ ID NO: 480619 - DNA, 25 bp, Mus musculus
gagcctccatcctgctgagatgatc

SEQ ID NO: 480620 - DNA, 25 bp, Mus musculus
gagcctccatctacagcatcaaaaa

SEQ ID NO: 480621 - DNA, 25 bp, Mus musculus
gagcctccatcttcagcatcaaaaa

SEQ ID NO: 480622 - DNA, 25 bp, Mus musculus
gagcctccatttagcagtaacaaag

SEQ ID NO: 480623 - DNA, 25 bp, Mus musculus
gagcctccattttgcagtaacaaag

SEQ ID NO: 480624 - DNA, 25 bp, Mus musculus
gagcctccctgtagtgggtagtcag

SEQ ID NO: 480625 - DNA, 25 bp, Mus musculus
gagcctccctgttgtgggtagtcag

SEQ ID NO: 480626 - DNA, 25 bp, Mus musculus
gagcctccctttcgctgcttttgtt

SEQ ID NO: 480627 - DNA, 25 bp, Mus musculus
gagcctccctttggctgcttttgtt

SEQ ID NO: 480628 - DNA, 25 bp, Mus musculus
gagcctccgataacctaagtaggga

SEQ ID NO: 480629 - DNA, 25 bp, Mus musculus
gagcctccgatatcctaagtaggga

SEQ ID NO: 480630 - DNA, 25 bp, Mus musculus
gagcctccgggaactacgccacagt

SEQ ID NO: 480631 - DNA, 25 bp, Mus musculus
gagcctccgggatctacgccacagt

SEQ ID NO: 480632 - DNA, 25 bp, Mus musculus
gagcctccggttaagcctgatcacg

SEQ ID NO: 480633 - DNA, 25 bp, Mus musculus
gagcctccggtttagcctgatcacg

SEQ ID NO: 480634 - DNA, 25 bp, Mus musculus
gagcctcctaacatcaagtttcttg

SEQ ID NO: 480635 - DNA, 25 bp, Mus musculus
gagcctcctaacttcaagtttcttg

SEQ ID NO: 480636 - DNA, 25 bp, Mus musculus
gagcctcctcatcgtactgggaagc

SEQ ID NO: 480637 - DNA, 25 bp, Mus musculus
gagcctcctcatggtactgggaagc

SEQ ID NO: 480638 - DNA, 25 bp, Mus musculus
gagcctcctcctagataggatttag

SEQ ID NO: 480639 - DNA, 25 bp, Mus musculus
gagcctcctccttgataggatttag

SEQ ID NO: 480640 - DNA, 25 bp, Mus musculus
gagcctcctcggcataaccttaaga

SEQ ID NO: 480641 - DNA, 25 bp, Mus musculus
gagcctcctcgggataaccttaaga

SEQ ID NO: 480642 - DNA, 25 bp, Mus musculus
gagcctcctgaaaacggcccggaag

SEQ ID NO: 480643 - DNA, 25 bp, Mus musculus
gagcctcctgaatacggcccggaag

SEQ ID NO: 480644 - DNA, 25 bp, Mus musculus
gagcctcctgatccttcaaacaaca

SEQ ID NO: 480645 - DNA, 25 bp, Mus musculus
gagcctcctgatccttcaaacaata

SEQ ID NO: 480646 - DNA, 25 bp, Mus musculus
gagcctcctgatgcttcaaacaaca

SEQ ID NO: 480647 - DNA, 25 bp, Mus musculus
gagcctcctgatgcttcaaacaata

SEQ ID NO: 480648 - DNA, 25 bp, Mus musculus
gagcctcctggaaaagtaacctgga

SEQ ID NO: 480649 - DNA, 25 bp, Mus musculus
gagcctcctggataagtaacctgga

SEQ ID NO: 480650 - DNA, 25 bp, Mus musculus
gagcctccttgaacaaactctggta

SEQ ID NO: 480651 - DNA, 25 bp, Mus musculus
gagcctccttgatcaaactctggta

SEQ ID NO: 480652 - DNA, 25 bp, Mus musculus
gagcctcctttcataaaatcggtat

SEQ ID NO: 480653 - DNA, 25 bp, Mus musculus
gagcctcctttcttaaaatcggtat

SEQ ID NO: 480654 - DNA, 25 bp, Mus musculus
gagcctcgactcatagtgaacactc

SEQ ID NO: 480655 - DNA, 25 bp, Mus musculus
gagcctcgactcttagtgaacactc

SEQ ID NO: 480656 - DNA, 25 bp, Mus musculus
gagcctcgggccacgcagctgcaga

SEQ ID NO: 480657 - DNA, 25 bp, Mus musculus
gagcctcgggcctcgcagctgcaga

SEQ ID NO: 480658 - DNA, 25 bp, Mus musculus
gagcctcgtgttactcatctgtgta

SEQ ID NO: 480659 - DNA, 25 bp, Mus musculus
gagcctcgtgtttctcatctgtgta

SEQ ID NO: 480660 - DNA, 25 bp, Mus musculus
gagcctcgtttcaggagccctggga

SEQ ID NO: 480661 - DNA, 25 bp, Mus musculus
gagcctcgtttctggagccctggga

SEQ ID NO: 480662 - DNA, 25 bp, Mus musculus
gagcctctaccaaaactgagaccaa

SEQ ID NO: 480663 - DNA, 25 bp, Mus musculus
gagcctctaccataactgagaccaa

SEQ ID NO: 480664 - DNA, 25 bp, Mus musculus
gagcctctactaagaacagcaactt

SEQ ID NO: 480665 - DNA, 25 bp, Mus musculus
gagcctctactatgaacagcaactt

SEQ ID NO: 480666 - DNA, 25 bp, Mus musculus
gagcctctagaaatcatagcctctg

SEQ ID NO: 480667 - DNA, 25 bp, Mus musculus
gagcctctagaattcatagcctctg

SEQ ID NO: 480668 - DNA, 25 bp, Mus musculus
gagcctctagagatttcctgtatca

SEQ ID NO: 480669 - DNA, 25 bp, Mus musculus
gagcctctagagttttcctgtatca

SEQ ID NO: 480670 - DNA, 25 bp, Mus musculus
gagcctctatgcattgtagcttcgg

SEQ ID NO: 480671 - DNA, 25 bp, Mus musculus
gagcctctatgctttgtagcttcgg

SEQ ID NO: 480672 - DNA, 25 bp, Mus musculus
gagcctctatggatggacttttgga

SEQ ID NO: 480673 - DNA, 25 bp, Mus musculus
gagcctctatggttggacttttgga

SEQ ID NO: 480674 - DNA, 25 bp, Mus musculus
gagcctctatgtcccaaggttagtt

SEQ ID NO: 480675 - DNA, 25 bp, Mus musculus
gagcctctatgtgccaaggttagtt

SEQ ID NO: 480676 - DNA, 25 bp, Mus musculus
gagcctctcccaatctaggaaggat

SEQ ID NO: 480677 - DNA, 25 bp, Mus musculus
gagcctctcccattctaggaaggat

SEQ ID NO: 480678 - DNA, 25 bp, Mus musculus
gagcctctcctgatgctgagaagtg

SEQ ID NO: 480679 - DNA, 25 bp, Mus musculus
gagcctctcctgttgctgagaagtg

SEQ ID NO: 480680 - DNA, 25 bp, Mus musculus
gagcctctccttactatgtcattag

SEQ ID NO: 480681 - DNA, 25 bp, Mus musculus
gagcctctcctttctatgtcattag

SEQ ID NO: 480682 - DNA, 25 bp, Mus musculus
gagcctctctcacggaaagattcca

SEQ ID NO: 480683 - DNA, 25 bp, Mus musculus
gagcctctctcagggaaagattcca

SEQ ID NO: 480684 - DNA, 25 bp, Mus musculus
gagcctctgaagagagaattcccac

SEQ ID NO: 480685 - DNA, 25 bp, Mus musculus
gagcctctgaagtgagaattcccac

SEQ ID NO: 480686 - DNA, 25 bp, Mus musculus
gagcctctgacaagcttagcaagca

SEQ ID NO: 480687 - DNA, 25 bp, Mus musculus
gagcctctgacatgcttagcaagca

SEQ ID NO: 480688 - DNA, 25 bp, Mus musculus
gagcctctgatccaacttgtgcaag

SEQ ID NO: 480689 - DNA, 25 bp, Mus musculus
gagcctctgatcgaacttgtgcaag

SEQ ID NO: 480690 - DNA, 25 bp, Mus musculus
gagcctctgccaagatgaagccaat

SEQ ID NO: 480691 - DNA, 25 bp, Mus musculus
gagcctctgccaatagcttggatga

SEQ ID NO: 480692 - DNA, 25 bp, Mus musculus
gagcctctgccatgatgaagccaat

SEQ ID NO: 480693 - DNA, 25 bp, Mus musculus
gagcctctgccattagcttggatga

SEQ ID NO: 480694 - DNA, 25 bp, Mus musculus
gagcctctgggccaaatactgtcgc

SEQ ID NO: 480695 - DNA, 25 bp, Mus musculus
gagcctctgggcgaaatactgtcgc

SEQ ID NO: 480696 - DNA, 25 bp, Mus musculus
gagcctctgtgcaaggccttggagc

SEQ ID NO: 480697 - DNA, 25 bp, Mus musculus
gagcctctgtgctaggccttggagc

SEQ ID NO: 480698 - DNA, 25 bp, Mus musculus
gagcctctgtgtcgatgggtttcta

SEQ ID NO: 480699 - DNA, 25 bp, Mus musculus
gagcctctgtgtggatgggtttcta

SEQ ID NO: 480700 - DNA, 25 bp, Mus musculus
gagcctctgtttcaggccttagagg

SEQ ID NO: 480701 - DNA, 25 bp, Mus musculus
gagcctctgtttgaggccttagagg

SEQ ID NO: 480702 - DNA, 25 bp, Mus musculus
gagcctcttaatctgctgagtctta

SEQ ID NO: 480703 - DNA, 25 bp, Mus musculus
gagcctcttaatgtgctgagtctta

SEQ ID NO: 480704 - DNA, 25 bp, Mus musculus
gagcctcttaggacatcattttgaa

SEQ ID NO: 480705 - DNA, 25 bp, Mus musculus
gagcctcttaggtcatcattttgaa

SEQ ID NO: 480706 - DNA, 25 bp, Mus musculus
gagcctcttatgcttcaaacaacag

SEQ ID NO: 480707 - DNA, 25 bp, Mus musculus
gagcctcttatggttcaaacaacag

SEQ ID NO: 480708 - DNA, 25 bp, Mus musculus
gagcctcttccccaaattagaaccg

SEQ ID NO: 480709 - DNA, 25 bp, Mus musculus
gagcctcttcccgaaattagaaccg

SEQ ID NO: 480710 - DNA, 25 bp, Mus musculus
gagcctcttctgacttaacacacta

SEQ ID NO: 480711 - DNA, 25 bp, Mus musculus
gagcctcttctgtcttaacacacta

SEQ ID NO: 480712 - DNA, 25 bp, Mus musculus
gagcctcttgacaccttggcaggga

SEQ ID NO: 480713 - DNA, 25 bp, Mus musculus
gagcctcttgactccttggcaggga

SEQ ID NO: 480714 - DNA, 25 bp, Mus musculus
gagcctcttgagagctgtgatttca

SEQ ID NO: 480715 - DNA, 25 bp, Mus musculus
gagcctcttgagtgctgtgatttca

SEQ ID NO: 480716 - DNA, 25 bp, Mus musculus
gagcctctttacatacagactaatt

SEQ ID NO: 480717 - DNA, 25 bp, Mus musculus
gagcctctttacttacagactaatt

SEQ ID NO: 480718 - DNA, 25 bp, Mus musculus
gagcctctttccaatgaaatgcgtc

SEQ ID NO: 480719 - DNA, 25 bp, Mus musculus
gagcctctttcctatgaaatgcgtc

SEQ ID NO: 480720 - DNA, 25 bp, Mus musculus
gagcctctttgaagtacttgtggaa

SEQ ID NO: 480721 - DNA, 25 bp, Mus musculus
gagcctctttgatgtacttgtggaa

SEQ ID NO: 480722 - DNA, 25 bp, Mus musculus
gagcctcttttcatatgcatatttt

SEQ ID NO: 480723 - DNA, 25 bp, Mus musculus
gagcctcttttcttatgcatatttt

SEQ ID NO: 480724 - DNA, 25 bp, Mus musculus
gagcctctttttccaggtgtctctg

SEQ ID NO: 480725 - DNA, 25 bp, Mus musculus
gagcctctttttgcaggtgtctctg

SEQ ID NO: 480726 - DNA, 25 bp, Mus musculus
gagcctgaaaagctgaacccactgg

SEQ ID NO: 480727 - DNA, 25 bp, Mus musculus
gagcctgaaaaggtgaacccactgg

SEQ ID NO: 480728 - DNA, 25 bp, Mus musculus
gagcctgaagtccagatgtgctttc

SEQ ID NO: 480729 - DNA, 25 bp, Mus musculus
gagcctgaagtcgagatgtgctttc

SEQ ID NO: 480730 - DNA, 25 bp, Mus musculus
gagcctgaagtgaggtgctgcccat

SEQ ID NO: 480731 - DNA, 25 bp, Mus musculus
gagcctgaagtgtggtgctgcccat

SEQ ID NO: 480732 - DNA, 25 bp, Mus musculus
gagcctgaatagcaagggtttgcct

SEQ ID NO: 480733 - DNA, 25 bp, Mus musculus
gagcctgaataggaagggtttgcct

SEQ ID NO: 480734 - DNA, 25 bp, Mus musculus
gagcctgacaagcagctaaacccta

SEQ ID NO: 480735 - DNA, 25 bp, Mus musculus
gagcctgacaaggagctaaacccta

SEQ ID NO: 480736 - DNA, 25 bp, Mus musculus
gagcctgaccaacctagtcctcaag

SEQ ID NO: 480737 - DNA, 25 bp, Mus musculus
gagcctgaccaagctagtcctcaag

SEQ ID NO: 480738 - DNA, 25 bp, Mus musculus
gagcctgaccccaaagacttgtgaa

SEQ ID NO: 480739 - DNA, 25 bp, Mus musculus
gagcctgacccctaagacttgtgaa

SEQ ID NO: 480740 - DNA, 25 bp, Mus musculus
gagcctgacctgatggagtcgatca

SEQ ID NO: 480741 - DNA, 25 bp, Mus musculus
gagcctgacctgttggagtcgatca

SEQ ID NO: 480742 - DNA, 25 bp, Mus musculus
gagcctgacgggacgttgacaacgt

SEQ ID NO: 480743 - DNA, 25 bp, Mus musculus
gagcctgacgggtcgttgacaacgt

SEQ ID NO: 480744 - DNA, 25 bp, Mus musculus
gagcctgactaaatcaatccgtttt

SEQ ID NO: 480745 - DNA, 25 bp, Mus musculus
gagcctgactaattcaatccgtttt

SEQ ID NO: 480746 - DNA, 25 bp, Mus musculus
gagcctgactatcaagccatacaga

SEQ ID NO: 480747 - DNA, 25 bp, Mus musculus
gagcctgactatgaagccatacaga

SEQ ID NO: 480748 - DNA, 25 bp, Mus musculus
gagcctgactggacattccctcggg

SEQ ID NO: 480749 - DNA, 25 bp, Mus musculus
gagcctgactggtcattccctcggg

SEQ ID NO: 480750 - DNA, 25 bp, Mus musculus
gagcctgactgtccacaaaacacta

SEQ ID NO: 480751 - DNA, 25 bp, Mus musculus
gagcctgactgtgcacaaaacacta

SEQ ID NO: 480752 - DNA, 25 bp, Mus musculus
gagcctgactttactatggtgatgt

SEQ ID NO: 480753 - DNA, 25 bp, Mus musculus
gagcctgactttagaccggttttga

SEQ ID NO: 480754 - DNA, 25 bp, Mus musculus
gagcctgacttttctatggtgatgt

SEQ ID NO: 480755 - DNA, 25 bp, Mus musculus
gagcctgacttttgaccggttttga

SEQ ID NO: 480756 - DNA, 25 bp, Mus musculus
gagcctgagagacatggcatagtat

SEQ ID NO: 480757 - DNA, 25 bp, Mus musculus
gagcctgagagagatggcatagtat

SEQ ID NO: 480758 - DNA, 25 bp, Mus musculus
gagcctgagcacacaaatgtctgtt

SEQ ID NO: 480759 - DNA, 25 bp, Mus musculus
gagcctgagcactcaaatgtctgtt

SEQ ID NO: 480760 - DNA, 25 bp, Mus musculus
gagcctgagcagcttccatagcaga

SEQ ID NO: 480761 - DNA, 25 bp, Mus musculus
gagcctgagcaggttccatagcaga

SEQ ID NO: 480762 - DNA, 25 bp, Mus musculus
gagcctgagccgcgttcgaagttaa

SEQ ID NO: 480763 - DNA, 25 bp, Mus musculus
gagcctgagccgggttcgaagttaa

SEQ ID NO: 480764 - DNA, 25 bp, Mus musculus
gagcctgaggctcatgtcattctgt

SEQ ID NO: 480765 - DNA, 25 bp, Mus musculus
gagcctgaggctgatgtcattctgt

SEQ ID NO: 480766 - DNA, 25 bp, Mus musculus
gagcctgagttgcaaaggagtccct

SEQ ID NO: 480767 - DNA, 25 bp, Mus musculus
gagcctgagttggaaaggagtccct

SEQ ID NO: 480768 - DNA, 25 bp, Mus musculus
gagcctgatcatatctgatggttcc

SEQ ID NO: 480769 - DNA, 25 bp, Mus musculus
gagcctgatcatttctgatggttcc

SEQ ID NO: 480770 - DNA, 25 bp, Mus musculus
gagcctgatcgcaatttttgattta

SEQ ID NO: 480771 - DNA, 25 bp, Mus musculus
gagcctgatcgctatttttgattta

SEQ ID NO: 480772 - DNA, 25 bp, Mus musculus
gagcctgatgacactattactgttt

SEQ ID NO: 480773 - DNA, 25 bp, Mus musculus
gagcctgatgactctattactgttt

SEQ ID NO: 480774 - DNA, 25 bp, Mus musculus
gagcctgatggtaattctccgttct

SEQ ID NO: 480775 - DNA, 25 bp, Mus musculus
gagcctgatggttattctccgttct

SEQ ID NO: 480776 - DNA, 25 bp, Mus musculus
gagcctgatgtgaacggtctgttgt

SEQ ID NO: 480777 - DNA, 25 bp, Mus musculus
gagcctgatgtgtacggtctgttgt

SEQ ID NO: 480778 - DNA, 25 bp, Mus musculus
gagcctgatgttacttatctcctgt

SEQ ID NO: 480779 - DNA, 25 bp, Mus musculus
gagcctgatgtttcttatctcctgt

SEQ ID NO: 480780 - DNA, 25 bp, Mus musculus
gagcctgattggactcagtgtctta

SEQ ID NO: 480781 - DNA, 25 bp, Mus musculus
gagcctgattggtctcagtgtctta

SEQ ID NO: 480782 - DNA, 25 bp, Mus musculus
gagcctgattgtctgttgcgccttc

SEQ ID NO: 480783 - DNA, 25 bp, Mus musculus
gagcctgattgtgtgttgcgccttc

SEQ ID NO: 480784 - DNA, 25 bp, Mus musculus
gagcctgcacctatgtgctcatgtc

SEQ ID NO: 480785 - DNA, 25 bp, Mus musculus
gagcctgcacctttgtgctcatgtc

SEQ ID NO: 480786 - DNA, 25 bp, Mus musculus
gagcctgcactcagtcctgcaaaga

SEQ ID NO: 480787 - DNA, 25 bp, Mus musculus
gagcctgcactctgtcctgcaaaga

SEQ ID NO: 480788 - DNA, 25 bp, Mus musculus
gagcctgcacttacacagattgtca

SEQ ID NO: 480789 - DNA, 25 bp, Mus musculus
gagcctgcactttcacagattgtca

SEQ ID NO: 480790 - DNA, 25 bp, Mus musculus
gagcctgcagctcatagcttagatt

SEQ ID NO: 480791 - DNA, 25 bp, Mus musculus
gagcctgcagctgatagcttagatt

SEQ ID NO: 480792 - DNA, 25 bp, Mus musculus
gagcctgcagtacgtccatcaagag

SEQ ID NO: 480793 - DNA, 25 bp, Mus musculus
gagcctgcagtaggtccatcaagag

SEQ ID NO: 480794 - DNA, 25 bp, Mus musculus
gagcctgcatggcagatcactggtt

SEQ ID NO: 480795 - DNA, 25 bp, Mus musculus
gagcctgcatgggagatcactggtt

SEQ ID NO: 480796 - DNA, 25 bp, Mus musculus
gagcctgcattcatactatatggag

SEQ ID NO: 480797 - DNA, 25 bp, Mus musculus
gagcctgcattcttactatatggag

SEQ ID NO: 480798 - DNA, 25 bp, Mus musculus
gagcctgcccggaaaagtgaattaa

SEQ ID NO: 480799 - DNA, 25 bp, Mus musculus
gagcctgcccggcaatccaagctgg

SEQ ID NO: 480800 - DNA, 25 bp, Mus musculus
gagcctgcccgggaatccaagctgg

SEQ ID NO: 480801 - DNA, 25 bp, Mus musculus
gagcctgcccggtaaagtgaattaa

SEQ ID NO: 480802 - DNA, 25 bp, Mus musculus
gagcctgccgaaattggcccggaga

SEQ ID NO: 480803 - DNA, 25 bp, Mus musculus
gagcctgccgaatttggcccggaga

SEQ ID NO: 480804 - DNA, 25 bp, Mus musculus
gagcctgccgacaagtcatgagaga

SEQ ID NO: 480805 - DNA, 25 bp, Mus musculus
gagcctgccgaccaagattgacgca

SEQ ID NO: 480806 - DNA, 25 bp, Mus musculus
gagcctgccgacgaagattgacgca

SEQ ID NO: 480807 - DNA, 25 bp, Mus musculus
gagcctgccgactagtcatgagaga

SEQ ID NO: 480808 - DNA, 25 bp, Mus musculus
gagcctgccggtcatggactagaaa

SEQ ID NO: 480809 - DNA, 25 bp, Mus musculus
gagcctgccggtgatggactagaaa

SEQ ID NO: 480810 - DNA, 25 bp, Mus musculus
gagcctgccgtaagcgatattttgt

SEQ ID NO: 480811 - DNA, 25 bp, Mus musculus
gagcctgccgtatgcgatattttgt

SEQ ID NO: 480812 - DNA, 25 bp, Mus musculus
gagcctgcctccaaaaactcggcat

SEQ ID NO: 480813 - DNA, 25 bp, Mus musculus
gagcctgcctcctaaaactcggcat

SEQ ID NO: 480814 - DNA, 25 bp, Mus musculus
gagcctgccttacgaggatgcctta

SEQ ID NO: 480815 - DNA, 25 bp, Mus musculus
gagcctgccttaggaggatgcctta

SEQ ID NO: 480816 - DNA, 25 bp, Mus musculus
gagcctgccttcacaaagtcataat

SEQ ID NO: 480817 - DNA, 25 bp, Mus musculus
gagcctgccttctcaaagtcataat

SEQ ID NO: 480818 - DNA, 25 bp, Mus musculus
gagcctgccttgaggcattcctaat

SEQ ID NO: 480819 - DNA, 25 bp, Mus musculus
gagcctgccttgtggcattcctaat

SEQ ID NO: 480820 - DNA, 25 bp, Mus musculus
gagcctgcgaagctgtggtcctact

SEQ ID NO: 480821 - DNA, 25 bp, Mus musculus
gagcctgcgaaggtgtggtcctact

SEQ ID NO: 480822 - DNA, 25 bp, Mus musculus
gagcctgcgtgtatcctaagtgtgg

SEQ ID NO: 480823 - DNA, 25 bp, Mus musculus
gagcctgcgtgtttcctaagtgtgg

SEQ ID NO: 480824 - DNA, 25 bp, Mus musculus
gagcctgctaagcaacaatgccacc

SEQ ID NO: 480825 - DNA, 25 bp, Mus musculus
gagcctgctaaggaacaatgccacc

SEQ ID NO: 480826 - DNA, 25 bp, Mus musculus
gagcctgctcagaatcactttagtg

SEQ ID NO: 480827 - DNA, 25 bp, Mus musculus
gagcctgctcagtatcactttagtg

SEQ ID NO: 480828 - DNA, 25 bp, Mus musculus
gagcctgctcatagacacctgagaa

SEQ ID NO: 480829 - DNA, 25 bp, Mus musculus
gagcctgctcattgacacctgagaa

SEQ ID NO: 480830 - DNA, 25 bp, Mus musculus
gagcctgctgatctcagtgctgact

SEQ ID NO: 480831 - DNA, 25 bp, Mus musculus
gagcctgctgatgtcagtgctgact

SEQ ID NO: 480832 - DNA, 25 bp, Mus musculus
gagcctgctgctagccggtaggaaa

SEQ ID NO: 480833 - DNA, 25 bp, Mus musculus
gagcctgctgcttgccggtaggaaa

SEQ ID NO: 480834 - DNA, 25 bp, Mus musculus
gagcctgctgggaaagacccagtgt

SEQ ID NO: 480835 - DNA, 25 bp, Mus musculus
gagcctgctgggaaatattgccact

SEQ ID NO: 480836 - DNA, 25 bp, Mus musculus
gagcctgctgggtaagacccagtgt

SEQ ID NO: 480837 - DNA, 25 bp, Mus musculus
gagcctgctgggtaatattgccact

SEQ ID NO: 480838 - DNA, 25 bp, Mus musculus
gagcctgctggtcagagcttagcat

SEQ ID NO: 480839 - DNA, 25 bp, Mus musculus
gagcctgctggtgagagcttagcat

SEQ ID NO: 480840 - DNA, 25 bp, Mus musculus
gagcctgctgtaccttggacaacac

SEQ ID NO: 480841 - DNA, 25 bp, Mus musculus
gagcctgctgtagcttggacaacac

SEQ ID NO: 480842 - DNA, 25 bp, Mus musculus
gagcctgctgtgcttagggtccaat

SEQ ID NO: 480843 - DNA, 25 bp, Mus musculus
gagcctgctgtggttagggtccaat

SEQ ID NO: 480844 - DNA, 25 bp, Mus musculus
gagcctgcttagaaatgaaagtgac

SEQ ID NO: 480845 - DNA, 25 bp, Mus musculus
gagcctgcttagtaatgaaagtgac

SEQ ID NO: 480846 - DNA, 25 bp, Mus musculus
gagcctgcttcacaaagagcttcaa

SEQ ID NO: 480847 - DNA, 25 bp, Mus musculus
gagcctgcttcagaaagagcttcaa

SEQ ID NO: 480848 - DNA, 25 bp, Mus musculus
gagcctggaaatactccgttaaaca

SEQ ID NO: 480849 - DNA, 25 bp, Mus musculus
gagcctggaaattctccgttaaaca

SEQ ID NO: 480850 - DNA, 25 bp, Mus musculus
gagcctggaactagactcacacagt

SEQ ID NO: 480851 - DNA, 25 bp, Mus musculus
gagcctggaacttgactcacacagt

SEQ ID NO: 480852 - DNA, 25 bp, Mus musculus
gagcctggaagaaccgtattccatt

SEQ ID NO: 480853 - DNA, 25 bp, Mus musculus
gagcctggaagaagggtctcacacc

SEQ ID NO: 480854 - DNA, 25 bp, Mus musculus
gagcctggaagatccgtattccatt

SEQ ID NO: 480855 - DNA, 25 bp, Mus musculus
gagcctggaagatgggtctcacacc

SEQ ID NO: 480856 - DNA, 25 bp, Mus musculus
gagcctggaaggagtcttctgccag

SEQ ID NO: 480857 - DNA, 25 bp, Mus musculus
gagcctggaaggtgtcttctgccag

SEQ ID NO: 480858 - DNA, 25 bp, Mus musculus
gagcctggaccacggagccttgaca

SEQ ID NO: 480859 - DNA, 25 bp, Mus musculus
gagcctggaccagggagccttgaca

SEQ ID NO: 480860 - DNA, 25 bp, Mus musculus
gagcctggactaacagatgacgcaa

SEQ ID NO: 480861 - DNA, 25 bp, Mus musculus
gagcctggactatcagatgacgcaa

SEQ ID NO: 480862 - DNA, 25 bp, Mus musculus
gagcctggactgaaagtatccactt

SEQ ID NO: 480863 - DNA, 25 bp, Mus musculus
gagcctggactgtaagtatccactt

SEQ ID NO: 480864 - DNA, 25 bp, Mus musculus
gagcctggagcaacgctgaagagct

SEQ ID NO: 480865 - DNA, 25 bp, Mus musculus
gagcctggagcaatcctggatcaag

SEQ ID NO: 480866 - DNA, 25 bp, Mus musculus
gagcctggagcatcgctgaagagct

SEQ ID NO: 480867 - DNA, 25 bp, Mus musculus
gagcctggagcattcctggatcaag

SEQ ID NO: 480868 - DNA, 25 bp, Mus musculus
gagcctggaggaccaatgactctca

SEQ ID NO: 480869 - DNA, 25 bp, Mus musculus
gagcctggaggagcaatgactctca

SEQ ID NO: 480870 - DNA, 25 bp, Mus musculus
gagcctggaggcacgccaatcacat

SEQ ID NO: 480871 - DNA, 25 bp, Mus musculus
gagcctggaggctcgccaatcacat

SEQ ID NO: 480872 - DNA, 25 bp, Mus musculus
gagcctggagtcaggtattttaaag

SEQ ID NO: 480873 - DNA, 25 bp, Mus musculus
gagcctggagtctggtattttaaag

SEQ ID NO: 480874 - DNA, 25 bp, Mus musculus
gagcctggagtgagtgctacactaa

SEQ ID NO: 480875 - DNA, 25 bp, Mus musculus
gagcctggagtgtgtgctacactaa

SEQ ID NO: 480876 - DNA, 25 bp, Mus musculus
gagcctggagttactcagacacgtt

SEQ ID NO: 480877 - DNA, 25 bp, Mus musculus
gagcctggagtttctcagacacgtt

SEQ ID NO: 480878 - DNA, 25 bp, Mus musculus
gagcctggatgccaaacttctcctc

SEQ ID NO: 480879 - DNA, 25 bp, Mus musculus
gagcctggatgcgaaacttctcctc

SEQ ID NO: 480880 - DNA, 25 bp, Mus musculus
gagcctggattcattagtctggtaa

SEQ ID NO: 480881 - DNA, 25 bp, Mus musculus
gagcctggattctttagtctggtaa

SEQ ID NO: 480882 - DNA, 25 bp, Mus musculus
gagcctggcaacactaagtgttgat

SEQ ID NO: 480883 - DNA, 25 bp, Mus musculus
gagcctggcaactctaagtgttgat

SEQ ID NO: 480884 - DNA, 25 bp, Mus musculus
gagcctggcagaaccgatctaccta

SEQ ID NO: 480885 - DNA, 25 bp, Mus musculus
gagcctggcagatccgatctaccta

SEQ ID NO: 480886 - DNA, 25 bp, Mus musculus
gagcctggcatgatagtccatgact

SEQ ID NO: 480887 - DNA, 25 bp, Mus musculus
gagcctggcatgttagtccatgact

SEQ ID NO: 480888 - DNA, 25 bp, Mus musculus
gagcctggcattaacagtgtgaaca

SEQ ID NO: 480889 - DNA, 25 bp, Mus musculus
gagcctggcattacccgagctgcgg

SEQ ID NO: 480890 - DNA, 25 bp, Mus musculus
gagcctggcatttacagtgtgaaca

SEQ ID NO: 480891 - DNA, 25 bp, Mus musculus
gagcctggcatttcccgagctgcgg

SEQ ID NO: 480892 - DNA, 25 bp, Mus musculus
gagcctggcctaactgtggcttgac

SEQ ID NO: 480893 - DNA, 25 bp, Mus musculus
gagcctggcctatctgtggcttgac

SEQ ID NO: 480894 - DNA, 25 bp, Mus musculus
gagcctggctcacctgtaatgaaaa

SEQ ID NO: 480895 - DNA, 25 bp, Mus musculus
gagcctggctcagctgtaatgaaaa

SEQ ID NO: 480896 - DNA, 25 bp, Mus musculus
gagcctggctctctagagacagtgt

SEQ ID NO: 480897 - DNA, 25 bp, Mus musculus
gagcctggctctctctggtaggcct

SEQ ID NO: 480898 - DNA, 25 bp, Mus musculus
gagcctggctctgtagagacagtgt

SEQ ID NO: 480899 - DNA, 25 bp, Mus musculus
gagcctggctctgtctggtaggcct

SEQ ID NO: 480900 - DNA, 25 bp, Mus musculus
gagcctggcttgacaaactctgctg

SEQ ID NO: 480901 - DNA, 25 bp, Mus musculus
gagcctggcttgcaccttggcattc

SEQ ID NO: 480902 - DNA, 25 bp, Mus musculus
gagcctggcttggaccttggcattc

SEQ ID NO: 480903 - DNA, 25 bp, Mus musculus
gagcctggcttgtcaaactctgctg

SEQ ID NO: 480904 - DNA, 25 bp, Mus musculus
gagcctgggaggaagctaatgcttt

SEQ ID NO: 480905 - DNA, 25 bp, Mus musculus
gagcctgggaggagaaacccacatt

SEQ ID NO: 480906 - DNA, 25 bp, Mus musculus
gagcctgggaggtagctaatgcttt

SEQ ID NO: 480907 - DNA, 25 bp, Mus musculus
gagcctgggaggtgaaacccacatt

SEQ ID NO: 480908 - DNA, 25 bp, Mus musculus
gagcctgggcagcattgtcagcttt

SEQ ID NO: 480909 - DNA, 25 bp, Mus musculus
gagcctgggcaggattgtcagcttt

SEQ ID NO: 480910 - DNA, 25 bp, Mus musculus
gagcctgggctgatggtttgttacc

SEQ ID NO: 480911 - DNA, 25 bp, Mus musculus
gagcctgggctgttggtttgttacc

SEQ ID NO: 480912 - DNA, 25 bp, Mus musculus
gagcctggtactcatgacctgatct

SEQ ID NO: 480913 - DNA, 25 bp, Mus musculus
gagcctggtactgatgacctgatct

SEQ ID NO: 480914 - DNA, 25 bp, Mus musculus
gagcctggtatgactgagatgattc

SEQ ID NO: 480915 - DNA, 25 bp, Mus musculus
gagcctggtatgtctgagatgattc

SEQ ID NO: 480916 - DNA, 25 bp, Mus musculus
gagcctggtcaaaacagtgcctttt

SEQ ID NO: 480917 - DNA, 25 bp, Mus musculus
gagcctggtcaactggttatgtttg

SEQ ID NO: 480918 - DNA, 25 bp, Mus musculus
gagcctggtcaagtggttatgtttg

SEQ ID NO: 480919 - DNA, 25 bp, Mus musculus
gagcctggtcaatacagtgcctttt

SEQ ID NO: 480920 - DNA, 25 bp, Mus musculus
gagcctggtccaaatgcagagaggc

SEQ ID NO: 480921 - DNA, 25 bp, Mus musculus
gagcctggtccatatgcagagaggc

SEQ ID NO: 480922 - DNA, 25 bp, Mus musculus
gagcctggtctaaggactaagctga

SEQ ID NO: 480923 - DNA, 25 bp, Mus musculus
gagcctggtctatggactaagctga

SEQ ID NO: 480924 - DNA, 25 bp, Mus musculus
gagcctggtctcatacaacttaatg

SEQ ID NO: 480925 - DNA, 25 bp, Mus musculus
gagcctggtctcttacaacttaatg

SEQ ID NO: 480926 - DNA, 25 bp, Mus musculus
gagcctggtggcatagccaccatat

SEQ ID NO: 480927 - DNA, 25 bp, Mus musculus
gagcctggtggcttagccaccatat

SEQ ID NO: 480928 - DNA, 25 bp, Mus musculus
gagcctgtaagccagtgtgctacat

SEQ ID NO: 480929 - DNA, 25 bp, Mus musculus
gagcctgtaagcgagtgtgctacat

SEQ ID NO: 480930 - DNA, 25 bp, Mus musculus
gagcctgtaattatacaacccgcct

SEQ ID NO: 480931 - DNA, 25 bp, Mus musculus
gagcctgtaattttacaacccgcct

SEQ ID NO: 480932 - DNA, 25 bp, Mus musculus
gagcctgtacctacagtgatggtga

SEQ ID NO: 480933 - DNA, 25 bp, Mus musculus
gagcctgtaccttcagtgatggtga

SEQ ID NO: 480934 - DNA, 25 bp, Mus musculus
gagcctgtagaactctagcctggaa

SEQ ID NO: 480935 - DNA, 25 bp, Mus musculus
gagcctgtagaagtctagcctggaa

SEQ ID NO: 480936 - DNA, 25 bp, Mus musculus
gagcctgtagctacggatcaaaacc

SEQ ID NO: 480937 - DNA, 25 bp, Mus musculus
gagcctgtagcttcggatcaaaacc

SEQ ID NO: 480938 - DNA, 25 bp, Mus musculus
gagcctgtagtgcagaaattgtctg

SEQ ID NO: 480939 - DNA, 25 bp, Mus musculus
gagcctgtagtggagaaattgtctg

SEQ ID NO: 480940 - DNA, 25 bp, Mus musculus
gagcctgtatgcatctgagtgcaaa

SEQ ID NO: 480941 - DNA, 25 bp, Mus musculus
gagcctgtatgcttctgagtgcaaa

SEQ ID NO: 480942 - DNA, 25 bp, Mus musculus
gagcctgtattgaggaccctgggcc

SEQ ID NO: 480943 - DNA, 25 bp, Mus musculus
gagcctgtattgtggaccctgggcc

SEQ ID NO: 480944 - DNA, 25 bp, Mus musculus
gagcctgtcatgacctaattttgtc

SEQ ID NO: 480945 - DNA, 25 bp, Mus musculus
gagcctgtcatgtcctaattttgtc

SEQ ID NO: 480946 - DNA, 25 bp, Mus musculus
gagcctgtccaaccatctgatgaat

SEQ ID NO: 480947 - DNA, 25 bp, Mus musculus
gagcctgtccaagcatctgatgaat

SEQ ID NO: 480948 - DNA, 25 bp, Mus musculus
gagcctgtccaccagcgttcagctg

SEQ ID NO: 480949 - DNA, 25 bp, Mus musculus
gagcctgtccacgagcgttcagctg

SEQ ID NO: 480950 - DNA, 25 bp, Mus musculus
gagcctgtccttcggccgattcaca

SEQ ID NO: 480951 - DNA, 25 bp, Mus musculus
gagcctgtccttgggccgattcaca

SEQ ID NO: 480952 - DNA, 25 bp, Mus musculus
gagcctgtcgggagtgtgtttcccc

SEQ ID NO: 480953 - DNA, 25 bp, Mus musculus
gagcctgtcgggtgtgtgtttcccc

SEQ ID NO: 480954 - DNA, 25 bp, Mus musculus
gagcctgtctccaagtgttagattt

SEQ ID NO: 480955 - DNA, 25 bp, Mus musculus
gagcctgtctccaattatttaaatg

SEQ ID NO: 480956 - DNA, 25 bp, Mus musculus
gagcctgtctccagaaaggcatata

SEQ ID NO: 480957 - DNA, 25 bp, Mus musculus
gagcctgtctcctagtgttagattt

SEQ ID NO: 480958 - DNA, 25 bp, Mus musculus
gagcctgtctcctattatttaaatg

SEQ ID NO: 480959 - DNA, 25 bp, Mus musculus
gagcctgtctcctgaaaggcatata

SEQ ID NO: 480960 - DNA, 25 bp, Mus musculus
gagcctgtctgcaaacattgttgga

SEQ ID NO: 480961 - DNA, 25 bp, Mus musculus
gagcctgtctgctaacattgttgga

SEQ ID NO: 480962 - DNA, 25 bp, Mus musculus
gagcctgtgattaatagtgtacaac

SEQ ID NO: 480963 - DNA, 25 bp, Mus musculus
gagcctgtgatttatagtgtacaac

SEQ ID NO: 480964 - DNA, 25 bp, Mus musculus
gagcctgtgcatcaagaactcacgg

SEQ ID NO: 480965 - DNA, 25 bp, Mus musculus
gagcctgtgcatgaagaactcacgg

SEQ ID NO: 480966 - DNA, 25 bp, Mus musculus
gagcctgtgccaatgaaatctgaat

SEQ ID NO: 480967 - DNA, 25 bp, Mus musculus
gagcctgtgccattgaaatctgaat

SEQ ID NO: 480968 - DNA, 25 bp, Mus musculus
gagcctgtggatatccctcatattt

SEQ ID NO: 480969 - DNA, 25 bp, Mus musculus
gagcctgtggatttccctcatattt

SEQ ID NO: 480970 - DNA, 25 bp, Mus musculus
gagcctgtggtcacaccggaatttg

SEQ ID NO: 480971 - DNA, 25 bp, Mus musculus
gagcctgtggtctcaccggaatttg

SEQ ID NO: 480972 - DNA, 25 bp, Mus musculus
gagcctgtgtgacaacttactcgaa

SEQ ID NO: 480973 - DNA, 25 bp, Mus musculus
gagcctgtgtgagaacttactcgaa

SEQ ID NO: 480974 - DNA, 25 bp, Mus musculus
gagcctgtgttcacatttgtagatg

SEQ ID NO: 480975 - DNA, 25 bp, Mus musculus
gagcctgtgttctcatttgtagatg

SEQ ID NO: 480976 - DNA, 25 bp, Mus musculus
gagcctgttagcaagcttcggattc

SEQ ID NO: 480977 - DNA, 25 bp, Mus musculus
gagcctgttagcattgatggcagat

SEQ ID NO: 480978 - DNA, 25 bp, Mus musculus
gagcctgttagctagcttcggattc

SEQ ID NO: 480979 - DNA, 25 bp, Mus musculus
gagcctgttagctttgatggcagat

SEQ ID NO: 480980 - DNA, 25 bp, Mus musculus
gagcctgttcacaaaaattctttat

SEQ ID NO: 480981 - DNA, 25 bp, Mus musculus
gagcctgttcacagtgtttattgca

SEQ ID NO: 480982 - DNA, 25 bp, Mus musculus
gagcctgttcactaaaattctttat

SEQ ID NO: 480983 - DNA, 25 bp, Mus musculus
gagcctgttcactgtgtttattgca

SEQ ID NO: 480984 - DNA, 25 bp, Mus musculus
gagcctgttcatattccagcttata

SEQ ID NO: 480985 - DNA, 25 bp, Mus musculus
gagcctgttcattttccagcttata

SEQ ID NO: 480986 - DNA, 25 bp, Mus musculus
gagcctgttccacaattgctagaag

SEQ ID NO: 480987 - DNA, 25 bp, Mus musculus
gagcctgttccagaattgctagaag

SEQ ID NO: 480988 - DNA, 25 bp, Mus musculus
gagcctgttctcaatttccaaggaa

SEQ ID NO: 480989 - DNA, 25 bp, Mus musculus
gagcctgttctctatttccaaggaa

SEQ ID NO: 480990 - DNA, 25 bp, Mus musculus
gagcctgttctgctaacattgctta

SEQ ID NO: 480991 - DNA, 25 bp, Mus musculus
gagcctgttctggtaacattgctta

SEQ ID NO: 480992 - DNA, 25 bp, Mus musculus
gagcctgttcttatcaaccttgaag

SEQ ID NO: 480993 - DNA, 25 bp, Mus musculus
gagcctgttcttttcaaccttgaag

SEQ ID NO: 480994 - DNA, 25 bp, Mus musculus
gagcctgttggcagttttggcctca

SEQ ID NO: 480995 - DNA, 25 bp, Mus musculus
gagcctgttggctgttttggcctca

SEQ ID NO: 480996 - DNA, 25 bp, Mus musculus
gagcctgtttatattcagaggtcta

SEQ ID NO: 480997 - DNA, 25 bp, Mus musculus
gagcctgtttattttcagaggtcta

SEQ ID NO: 480998 - DNA, 25 bp, Mus musculus
gagcctgtttctacactgtccccag

SEQ ID NO: 480999 - DNA, 25 bp, Mus musculus
gagcctgtttctacagctggcaatg

SEQ ID NO: 481000 - DNA, 25 bp, Mus musculus
gagcctgtttcttcactgtccccag

SEQ ID NO: 481001 - DNA, 25 bp, Mus musculus
gagcctgtttcttcagctggcaatg

SEQ ID NO: 481002 - DNA, 25 bp, Mus musculus
gagcctgtttgaagggtttgccgat

SEQ ID NO: 481003 - DNA, 25 bp, Mus musculus
gagcctgtttgatgggtttgccgat

SEQ ID NO: 481004 - DNA, 25 bp, Mus musculus
gagcctgtttgtaggagtttactcc

SEQ ID NO: 481005 - DNA, 25 bp, Mus musculus
gagcctgtttgttggagtttactcc

SEQ ID NO: 481006 - DNA, 25 bp, Mus musculus
gagcctgttttgcaaatgcagtctt

SEQ ID NO: 481007 - DNA, 25 bp, Mus musculus
gagcctgttttggaaatgcagtctt

SEQ ID NO: 481008 - DNA, 25 bp, Mus musculus
gagccttaaaaaatggtcaccctgt

SEQ ID NO: 481009 - DNA, 25 bp, Mus musculus
gagccttaaaaattggtcaccctgt

SEQ ID NO: 481010 - DNA, 25 bp, Mus musculus
gagccttaaaacatctcagtttgat

SEQ ID NO: 481011 - DNA, 25 bp, Mus musculus
gagccttaaaacttctcagtttgat

SEQ ID NO: 481012 - DNA, 25 bp, Mus musculus
gagccttaacataacaatttctgtg

SEQ ID NO: 481013 - DNA, 25 bp, Mus musculus
gagccttaacattacaatttctgtg

SEQ ID NO: 481014 - DNA, 25 bp, Mus musculus
gagccttaaggacctttcttcagga

SEQ ID NO: 481015 - DNA, 25 bp, Mus musculus
gagccttaaggagctttcttcagga

SEQ ID NO: 481016 - DNA, 25 bp, Mus musculus
gagccttacaatacagagactgatg

SEQ ID NO: 481017 - DNA, 25 bp, Mus musculus
gagccttacaattcagagactgatg

SEQ ID NO: 481018 - DNA, 25 bp, Mus musculus
gagccttaccctaccaaatccaaag

SEQ ID NO: 481019 - DNA, 25 bp, Mus musculus
gagccttacccttccaaatccaaag

SEQ ID NO: 481020 - DNA, 25 bp, Mus musculus
gagccttacctgatcctagcagtgt

SEQ ID NO: 481021 - DNA, 25 bp, Mus musculus
gagccttacctgttcctagcagtgt

SEQ ID NO: 481022 - DNA, 25 bp, Mus musculus
gagccttagactatactgattctca

SEQ ID NO: 481023 - DNA, 25 bp, Mus musculus
gagccttagactcatgacctccaat

SEQ ID NO: 481024 - DNA, 25 bp, Mus musculus
gagccttagactgatgacctccaat

SEQ ID NO: 481025 - DNA, 25 bp, Mus musculus
gagccttagactttactgattctca

SEQ ID NO: 481026 - DNA, 25 bp, Mus musculus
gagccttagccaactgtttagtttc

SEQ ID NO: 481027 - DNA, 25 bp, Mus musculus
gagccttagccatctgtttagtttc

SEQ ID NO: 481028 - DNA, 25 bp, Mus musculus
gagccttaggaacatgtgcagcaat

SEQ ID NO: 481029 - DNA, 25 bp, Mus musculus
gagccttaggaagatgtgcagcaat

SEQ ID NO: 481030 - DNA, 25 bp, Mus musculus
gagccttaggacagaacacgacgtt

SEQ ID NO: 481031 - DNA, 25 bp, Mus musculus
gagccttaggactgaacacgacgtt

SEQ ID NO: 481032 - DNA, 25 bp, Mus musculus
gagccttaggcccaaccttgaggag

SEQ ID NO: 481033 - DNA, 25 bp, Mus musculus
gagccttaggccgaaccttgaggag

SEQ ID NO: 481034 - DNA, 25 bp, Mus musculus
gagccttataacatttgaaggtggg

SEQ ID NO: 481035 - DNA, 25 bp, Mus musculus
gagccttataacttttgaaggtggg

SEQ ID NO: 481036 - DNA, 25 bp, Mus musculus
gagccttataggacaggtctgtaat

SEQ ID NO: 481037 - DNA, 25 bp, Mus musculus
gagccttataggtcaggtctgtaat

SEQ ID NO: 481038 - DNA, 25 bp, Mus musculus
gagccttatggcagacgggaagatc

SEQ ID NO: 481039 - DNA, 25 bp, Mus musculus
gagccttatggcaggtcattgctga

SEQ ID NO: 481040 - DNA, 25 bp, Mus musculus
gagccttatggctgacgggaagatc

SEQ ID NO: 481041 - DNA, 25 bp, Mus musculus
gagccttatggctggtcattgctga

SEQ ID NO: 481042 - DNA, 25 bp, Mus musculus
gagccttattctcaccatggagttc

SEQ ID NO: 481043 - DNA, 25 bp, Mus musculus
gagccttattctgaccatggagttc

SEQ ID NO: 481044 - DNA, 25 bp, Mus musculus
gagccttcacatcgtcctggtgtat

SEQ ID NO: 481045 - DNA, 25 bp, Mus musculus
gagccttcacatggtcctggtgtat

SEQ ID NO: 481046 - DNA, 25 bp, Mus musculus
gagccttcacggaggtctgcaaaga

SEQ ID NO: 481047 - DNA, 25 bp, Mus musculus
gagccttcacggtggtctgcaaaga

SEQ ID NO: 481048 - DNA, 25 bp, Mus musculus
gagccttcagagatactgtcagcag

SEQ ID NO: 481049 - DNA, 25 bp, Mus musculus
gagccttcagagttactgtcagcag

SEQ ID NO: 481050 - DNA, 25 bp, Mus musculus
gagccttcaggaaaggagtcccagg

SEQ ID NO: 481051 - DNA, 25 bp, Mus musculus
gagccttcaggataggagtcccagg

SEQ ID NO: 481052 - DNA, 25 bp, Mus musculus
gagccttcagttcccacttttcaga

SEQ ID NO: 481053 - DNA, 25 bp, Mus musculus
gagccttcagttgccacttttcaga

SEQ ID NO: 481054 - DNA, 25 bp, Mus musculus
gagccttccaaactgggattcttca

SEQ ID NO: 481055 - DNA, 25 bp, Mus musculus
gagccttccaaagtgggattcttca

SEQ ID NO: 481056 - DNA, 25 bp, Mus musculus
gagccttccaagctgtccaattgcc

SEQ ID NO: 481057 - DNA, 25 bp, Mus musculus
gagccttccaaggtgtccaattgcc

SEQ ID NO: 481058 - DNA, 25 bp, Mus musculus
gagccttccctaaagggtcttcaga

SEQ ID NO: 481059 - DNA, 25 bp, Mus musculus
gagccttccctaactgcacagatgg

SEQ ID NO: 481060 - DNA, 25 bp, Mus musculus
gagccttccctatagggtcttcaga

SEQ ID NO: 481061 - DNA, 25 bp, Mus musculus
gagccttccctatctgcacagatgg

SEQ ID NO: 481062 - DNA, 25 bp, Mus musculus
gagccttcgatcagggcgcagacgc

SEQ ID NO: 481063 - DNA, 25 bp, Mus musculus
gagccttcgatctgggcgcagacgc

SEQ ID NO: 481064 - DNA, 25 bp, Mus musculus
gagccttctaccagggaggaacagc

SEQ ID NO: 481065 - DNA, 25 bp, Mus musculus
gagccttctacctgggaggaacagc

SEQ ID NO: 481066 - DNA, 25 bp, Mus musculus
gagccttctactactgaagtgaaac

SEQ ID NO: 481067 - DNA, 25 bp, Mus musculus
gagccttctacttctgaagtgaaac

SEQ ID NO: 481068 - DNA, 25 bp, Mus musculus
gagccttctagcctggatgatgttt

SEQ ID NO: 481069 - DNA, 25 bp, Mus musculus
gagccttctagcgtggatgatgttt

SEQ ID NO: 481070 - DNA, 25 bp, Mus musculus
gagccttctcagatagaggccttga

SEQ ID NO: 481071 - DNA, 25 bp, Mus musculus
gagccttctcagttagaggccttga

SEQ ID NO: 481072 - DNA, 25 bp, Mus musculus
gagccttctccgcacgctttaggga

SEQ ID NO: 481073 - DNA, 25 bp, Mus musculus
gagccttctccggacgctttaggga

SEQ ID NO: 481074 - DNA, 25 bp, Mus musculus
gagccttctgacaggattgattgtt

SEQ ID NO: 481075 - DNA, 25 bp, Mus musculus
gagccttctgactggattgattgtt

SEQ ID NO: 481076 - DNA, 25 bp, Mus musculus
gagccttctgtacgcagcaggttgc

SEQ ID NO: 481077 - DNA, 25 bp, Mus musculus
gagccttctgtaggcagcaggttgc

SEQ ID NO: 481078 - DNA, 25 bp, Mus musculus
gagccttctgtcaaagacctggccg

SEQ ID NO: 481079 - DNA, 25 bp, Mus musculus
gagccttctgtctaagacctggccg

SEQ ID NO: 481080 - DNA, 25 bp, Mus musculus
gagccttcttgaaacatcattccat

SEQ ID NO: 481081 - DNA, 25 bp, Mus musculus
gagccttcttgatacatcattccat

SEQ ID NO: 481082 - DNA, 25 bp, Mus musculus
gagccttctttgaaggtgcaaccag

SEQ ID NO: 481083 - DNA, 25 bp, Mus musculus
gagccttctttgtaggtgcaaccag

SEQ ID NO: 481084 - DNA, 25 bp, Mus musculus
gagccttgaaacacaaatgactctg

SEQ ID NO: 481085 - DNA, 25 bp, Mus musculus
gagccttgaaactcaaatgactctg

SEQ ID NO: 481086 - DNA, 25 bp, Mus musculus
gagccttgaacacatgggtacacgg

SEQ ID NO: 481087 - DNA, 25 bp, Mus musculus
gagccttgaacagatgggtacacgg

SEQ ID NO: 481088 - DNA, 25 bp, Mus musculus
gagccttgaaggaccactagacctg

SEQ ID NO: 481089 - DNA, 25 bp, Mus musculus
gagccttgaaggtccactagacctg

SEQ ID NO: 481090 - DNA, 25 bp, Mus musculus
gagccttgacagctaagagtcctaa

SEQ ID NO: 481091 - DNA, 25 bp, Mus musculus
gagccttgacaggtaagagtcctaa

SEQ ID NO: 481092 - DNA, 25 bp, Mus musculus
gagccttgactccattagatactta

SEQ ID NO: 481093 - DNA, 25 bp, Mus musculus
gagccttgactcgattagatactta

SEQ ID NO: 481094 - DNA, 25 bp, Mus musculus
gagccttgacttctatctttgccgc

SEQ ID NO: 481095 - DNA, 25 bp, Mus musculus
gagccttgacttgtatctttgccgc

SEQ ID NO: 481096 - DNA, 25 bp, Mus musculus
gagccttgccttcggtgagtgattc

SEQ ID NO: 481097 - DNA, 25 bp, Mus musculus
gagccttgccttgggtgagtgattc

SEQ ID NO: 481098 - DNA, 25 bp, Mus musculus
gagccttgctgtaggtggttagcta

SEQ ID NO: 481099 - DNA, 25 bp, Mus musculus
gagccttgctgttggtggttagcta

SEQ ID NO: 481100 - DNA, 25 bp, Mus musculus
gagccttgcttcacactggtaacgt

SEQ ID NO: 481101 - DNA, 25 bp, Mus musculus
gagccttgcttctcactggtaacgt

SEQ ID NO: 481102 - DNA, 25 bp, Mus musculus
gagccttgggcaaagagttgtacgt

SEQ ID NO: 481103 - DNA, 25 bp, Mus musculus
gagccttgggcaaagcacccagtaa

SEQ ID NO: 481104 - DNA, 25 bp, Mus musculus
gagccttgggcatagagttgtacgt

SEQ ID NO: 481105 - DNA, 25 bp, Mus musculus
gagccttgggcatagcacccagtaa

SEQ ID NO: 481106 - DNA, 25 bp, Mus musculus
gagccttggtaacgcaccattgcct

SEQ ID NO: 481107 - DNA, 25 bp, Mus musculus
gagccttggtaaggcaccattgcct

SEQ ID NO: 481108 - DNA, 25 bp, Mus musculus
gagccttggtgtacgggtgtggtga

SEQ ID NO: 481109 - DNA, 25 bp, Mus musculus
gagccttggtgttcgggtgtggtga

SEQ ID NO: 481110 - DNA, 25 bp, Mus musculus
gagccttgtggacacttgtgagata

SEQ ID NO: 481111 - DNA, 25 bp, Mus musculus
gagccttgtggagacttgtgagata

SEQ ID NO: 481112 - DNA, 25 bp, Mus musculus
gagccttgtttacaagcccttttgc

SEQ ID NO: 481113 - DNA, 25 bp, Mus musculus
gagccttgtttagaagcccttttgc

SEQ ID NO: 481114 - DNA, 25 bp, Mus musculus
gagcctttactaactgtgcctggtc

SEQ ID NO: 481115 - DNA, 25 bp, Mus musculus
gagcctttactatctgtgcctggtc

SEQ ID NO: 481116 - DNA, 25 bp, Mus musculus
gagcctttactgaggttttccctga

SEQ ID NO: 481117 - DNA, 25 bp, Mus musculus
gagcctttactgtggttttccctga

SEQ ID NO: 481118 - DNA, 25 bp, Mus musculus
gagcctttagctcaaataaccattt

SEQ ID NO: 481119 - DNA, 25 bp, Mus musculus
gagcctttagctgaaataaccattt

SEQ ID NO: 481120 - DNA, 25 bp, Mus musculus
gagcctttatcaaactcatacaccc

SEQ ID NO: 481121 - DNA, 25 bp, Mus musculus
gagcctttatcatactcatacaccc

SEQ ID NO: 481122 - DNA, 25 bp, Mus musculus
gagcctttatctaccattactgtgg

SEQ ID NO: 481123 - DNA, 25 bp, Mus musculus
gagcctttatcttccattactgtgg

SEQ ID NO: 481124 - DNA, 25 bp, Mus musculus
gagcctttatgaagaggacccctga

SEQ ID NO: 481125 - DNA, 25 bp, Mus musculus
gagcctttatgatgaggacccctga

SEQ ID NO: 481126 - DNA, 25 bp, Mus musculus
gagcctttatgcaggcaaggcctgc

SEQ ID NO: 481127 - DNA, 25 bp, Mus musculus
gagcctttatgctggcaaggcctgc

SEQ ID NO: 481128 - DNA, 25 bp, Mus musculus
gagcctttcactcggcctgaatgta

SEQ ID NO: 481129 - DNA, 25 bp, Mus musculus
gagcctttcactgggcctgaatgta

SEQ ID NO: 481130 - DNA, 25 bp, Mus musculus
gagcctttccccagtgcatgctttg

SEQ ID NO: 481131 - DNA, 25 bp, Mus musculus
gagcctttcccctgtgcatgctttg

SEQ ID NO: 481132 - DNA, 25 bp, Mus musculus
gagcctttcgagaatgacatctttg

SEQ ID NO: 481133 - DNA, 25 bp, Mus musculus
gagcctttcgagtatgacatctttg

SEQ ID NO: 481134 - DNA, 25 bp, Mus musculus
gagcctttctccagaaaatccactc

SEQ ID NO: 481135 - DNA, 25 bp, Mus musculus
gagcctttctccaggtgagctgtta

SEQ ID NO: 481136 - DNA, 25 bp, Mus musculus
gagcctttctcctgaaaatccactc

SEQ ID NO: 481137 - DNA, 25 bp, Mus musculus
gagcctttctcctggtgagctgtta

SEQ ID NO: 481138 - DNA, 25 bp, Mus musculus
gagcctttcttaaaccatctgtgga

SEQ ID NO: 481139 - DNA, 25 bp, Mus musculus
gagcctttcttataccatctgtgga

SEQ ID NO: 481140 - DNA, 25 bp, Mus musculus
gagcctttcttcaaacctctaggat

SEQ ID NO: 481141 - DNA, 25 bp, Mus musculus
gagcctttcttctaacctctaggat

SEQ ID NO: 481142 - DNA, 25 bp, Mus musculus
gagcctttcttgatcacttcgccat

SEQ ID NO: 481143 - DNA, 25 bp, Mus musculus
gagcctttcttgatcttcacaaggt

SEQ ID NO: 481144 - DNA, 25 bp, Mus musculus
gagcctttcttgttcacttcgccat

SEQ ID NO: 481145 - DNA, 25 bp, Mus musculus
gagcctttcttgttcttcacaaggt

SEQ ID NO: 481146 - DNA, 25 bp, Mus musculus
gagcctttgactactgtacatttca

SEQ ID NO: 481147 - DNA, 25 bp, Mus musculus
gagcctttgacttctgtacatttca

SEQ ID NO: 481148 - DNA, 25 bp, Mus musculus
gagcctttgagcatggtacgtgctt

SEQ ID NO: 481149 - DNA, 25 bp, Mus musculus
gagcctttgagcttggtacgtgctt

SEQ ID NO: 481150 - DNA, 25 bp, Mus musculus
gagcctttgccgcatcatggacaat

SEQ ID NO: 481151 - DNA, 25 bp, Mus musculus
gagcctttgccggatcatggacaat

SEQ ID NO: 481152 - DNA, 25 bp, Mus musculus
gagcctttgcctcaaaattcttctg

SEQ ID NO: 481153 - DNA, 25 bp, Mus musculus
gagcctttgcctgaaaattcttctg

SEQ ID NO: 481154 - DNA, 25 bp, Mus musculus
gagcctttgctgagataacttggac

SEQ ID NO: 481155 - DNA, 25 bp, Mus musculus
gagcctttgctgtgataacttggac

SEQ ID NO: 481156 - DNA, 25 bp, Mus musculus
gagcctttgtggatgctgtacacaa

SEQ ID NO: 481157 - DNA, 25 bp, Mus musculus
gagcctttgtggttgctgtacacaa

SEQ ID NO: 481158 - DNA, 25 bp, Mus musculus
gagcctttgttaactcatcttcaga

SEQ ID NO: 481159 - DNA, 25 bp, Mus musculus
gagcctttgttatctcatcttcaga

SEQ ID NO: 481160 - DNA, 25 bp, Mus musculus
gagccttttaccacaagtgaatttt

SEQ ID NO: 481161 - DNA, 25 bp, Mus musculus
gagccttttacctcaagtgaatttt

SEQ ID NO: 481162 - DNA, 25 bp, Mus musculus
gagccttttagaaactgctgccttt

SEQ ID NO: 481163 - DNA, 25 bp, Mus musculus
gagccttttagatactgctgccttt

SEQ ID NO: 481164 - DNA, 25 bp, Mus musculus
gagccttttcagagtgccagctcct

SEQ ID NO: 481165 - DNA, 25 bp, Mus musculus
gagccttttcagtgtgccagctcct

SEQ ID NO: 481166 - DNA, 25 bp, Mus musculus
gagccttttggactgttttatattc

SEQ ID NO: 481167 - DNA, 25 bp, Mus musculus
gagccttttggagtgttttatattc

SEQ ID NO: 481168 - DNA, 25 bp, Mus musculus
gagccttttggcatcaagtgggaag

SEQ ID NO: 481169 - DNA, 25 bp, Mus musculus
gagccttttggcttcaagtgggaag

SEQ ID NO: 481170 - DNA, 25 bp, Mus musculus
gagccttttgttctcgggactcgct

SEQ ID NO: 481171 - DNA, 25 bp, Mus musculus
gagccttttgttgtcgggactcgct

SEQ ID NO: 481172 - DNA, 25 bp, Mus musculus
gagcctttttacctttgagtctaga

SEQ ID NO: 481173 - DNA, 25 bp, Mus musculus
gagcctttttacgtttgagtctaga

SEQ ID NO: 481174 - DNA, 25 bp, Mus musculus
gagcctttttggcagtatcagtaaa

SEQ ID NO: 481175 - DNA, 25 bp, Mus musculus
gagcctttttgggagtatcagtaaa

SEQ ID NO: 481176 - DNA, 25 bp, Mus musculus
gagcctttttttcaggccttgtatt

SEQ ID NO: 481177 - DNA, 25 bp, Mus musculus
gagcctttttttgaggccttgtatt

SEQ ID NO: 481178 - DNA, 25 bp, Mus musculus
gagcgaaacaggacagaccaggatc

SEQ ID NO: 481179 - DNA, 25 bp, Mus musculus
gagcgaaacaggtcagaccaggatc

SEQ ID NO: 481180 - DNA, 25 bp, Mus musculus
gagcgaaccaggcacagtcagtgtt

SEQ ID NO: 481181 - DNA, 25 bp, Mus musculus
gagcgaaccagggacagtcagtgtt

SEQ ID NO: 481182 - DNA, 25 bp, Mus musculus
gagcgaaccctcaccttggaggaaa

SEQ ID NO: 481183 - DNA, 25 bp, Mus musculus
gagcgaaccctctccttggaggaaa

SEQ ID NO: 481184 - DNA, 25 bp, Mus musculus
gagcgaacggagaccatggtcagcc

SEQ ID NO: 481185 - DNA, 25 bp, Mus musculus
gagcgaacggagtccatggtcagcc

SEQ ID NO: 481186 - DNA, 25 bp, Mus musculus
gagcgaacggatcctgcgtccacga

SEQ ID NO: 481187 - DNA, 25 bp, Mus musculus
gagcgaacggatgctgcgtccacga

SEQ ID NO: 481188 - DNA, 25 bp, Mus musculus
gagcgaactctccatatgggtcagt

SEQ ID NO: 481189 - DNA, 25 bp, Mus musculus
gagcgaactctcgatatgggtcagt

SEQ ID NO: 481190 - DNA, 25 bp, Mus musculus
gagcgaaggcttcttcaagttctga

SEQ ID NO: 481191 - DNA, 25 bp, Mus musculus
gagcgaaggcttgttcaagttctga

SEQ ID NO: 481192 - DNA, 25 bp, Mus musculus
gagcgaaggttcaactgcgcctgca

SEQ ID NO: 481193 - DNA, 25 bp, Mus musculus
gagcgaaggttctactgcgcctgca

SEQ ID NO: 481194 - DNA, 25 bp, Mus musculus
gagcgaagtaaaactctacgtgtga

SEQ ID NO: 481195 - DNA, 25 bp, Mus musculus
gagcgaagtaaatctctacgtgtga

SEQ ID NO: 481196 - DNA, 25 bp, Mus musculus
gagcgaagtctcctgtttgataaaa

SEQ ID NO: 481197 - DNA, 25 bp, Mus musculus
gagcgaagtctcgtgtttgataaaa

SEQ ID NO: 481198 - DNA, 25 bp, Mus musculus
gagcgaagtggtcctttgctacctt

SEQ ID NO: 481199 - DNA, 25 bp, Mus musculus
gagcgaagtggtgctttgctacctt

SEQ ID NO: 481200 - DNA, 25 bp, Mus musculus
gagcgaagtgtgacgcccagaccca

SEQ ID NO: 481201 - DNA, 25 bp, Mus musculus
gagcgaagtgtgtcgcccagaccca

SEQ ID NO: 481202 - DNA, 25 bp, Mus musculus
gagcgaataaccaattacagccagt

SEQ ID NO: 481203 - DNA, 25 bp, Mus musculus
gagcgaataacctattacagccagt

SEQ ID NO: 481204 - DNA, 25 bp, Mus musculus
gagcgaatgaagacgtttccctcca

SEQ ID NO: 481205 - DNA, 25 bp, Mus musculus
gagcgaatgaagtcgtttccctcca

SEQ ID NO: 481206 - DNA, 25 bp, Mus musculus
gagcgaattcccaacttgggtttca

SEQ ID NO: 481207 - DNA, 25 bp, Mus musculus
gagcgaattccctacttgggtttca

SEQ ID NO: 481208 - DNA, 25 bp, Mus musculus
gagcgaatttatattcccctcagtt

SEQ ID NO: 481209 - DNA, 25 bp, Mus musculus
gagcgaatttattttcccctcagtt

SEQ ID NO: 481210 - DNA, 25 bp, Mus musculus
gagcgacaaaaaacagccggtaatg

SEQ ID NO: 481211 - DNA, 25 bp, Mus musculus
gagcgacaaaaatcagccggtaatg

SEQ ID NO: 481212 - DNA, 25 bp, Mus musculus
gagcgacaagccatatatgtgcaag

SEQ ID NO: 481213 - DNA, 25 bp, Mus musculus
gagcgacaagccttatatgtgcaag

SEQ ID NO: 481214 - DNA, 25 bp, Mus musculus
gagcgacacaagctgtctatcagtt

SEQ ID NO: 481215 - DNA, 25 bp, Mus musculus
gagcgacacaaggtgtctatcagtt

SEQ ID NO: 481216 - DNA, 25 bp, Mus musculus
gagcgacaccagagggactgatcct

SEQ ID NO: 481217 - DNA, 25 bp, Mus musculus
gagcgacaccagtgggactgatcct

SEQ ID NO: 481218 - DNA, 25 bp, Mus musculus
gagcgacagtgacttacagcagcca

SEQ ID NO: 481219 - DNA, 25 bp, Mus musculus
gagcgacagtgagttacagcagcca

SEQ ID NO: 481220 - DNA, 25 bp, Mus musculus
gagcgacagttccaggatgtatcca

SEQ ID NO: 481221 - DNA, 25 bp, Mus musculus
gagcgacagttcgaggatgtatcca

SEQ ID NO: 481222 - DNA, 25 bp, Mus musculus
gagcgacatcatcgtattcccctta

SEQ ID NO: 481223 - DNA, 25 bp, Mus musculus
gagcgacatcatggtattcccctta

SEQ ID NO: 481224 - DNA, 25 bp, Mus musculus
gagcgaccaggaactgaacgcccgt

SEQ ID NO: 481225 - DNA, 25 bp, Mus musculus
gagcgaccaggatctgaacgcccgt

SEQ ID NO: 481226 - DNA, 25 bp, Mus musculus
gagcgaccagggagcgacccaaagc

SEQ ID NO: 481227 - DNA, 25 bp, Mus musculus
gagcgaccagggtgcgacccaaagc

SEQ ID NO: 481228 - DNA, 25 bp, Mus musculus
gagcgaccatagacacagtccggac

SEQ ID NO: 481229 - DNA, 25 bp, Mus musculus
gagcgaccatagtcacagtccggac

SEQ ID NO: 481230 - DNA, 25 bp, Mus musculus
gagcgacccagaagacgatgatgtt

SEQ ID NO: 481231 - DNA, 25 bp, Mus musculus
gagcgacccagatgacgatgatgtt

SEQ ID NO: 481232 - DNA, 25 bp, Mus musculus
gagcgacctaacaataagcaatatt

SEQ ID NO: 481233 - DNA, 25 bp, Mus musculus
gagcgacctaactataagcaatatt

SEQ ID NO: 481234 - DNA, 25 bp, Mus musculus
gagcgacctactagagaaacacatt

SEQ ID NO: 481235 - DNA, 25 bp, Mus musculus
gagcgacctacttgagaaacacatt

SEQ ID NO: 481236 - DNA, 25 bp, Mus musculus
gagcgacctgcaagattcacaagag

SEQ ID NO: 481237 - DNA, 25 bp, Mus musculus
gagcgacctgcatgattcacaagag

SEQ ID NO: 481238 - DNA, 25 bp, Mus musculus
gagcgaccttataagtgtgatgact

SEQ ID NO: 481239 - DNA, 25 bp, Mus musculus
gagcgaccttattagtgtgatgact

SEQ ID NO: 481240 - DNA, 25 bp, Mus musculus
gagcgacggtacactccagagtgct

SEQ ID NO: 481241 - DNA, 25 bp, Mus musculus
gagcgacggtactctccagagtgct

SEQ ID NO: 481242 - DNA, 25 bp, Mus musculus
gagcgactatgacacggtggtccac

SEQ ID NO: 481243 - DNA, 25 bp, Mus musculus
gagcgactatgagacggtggtccac

SEQ ID NO: 481244 - DNA, 25 bp, Mus musculus
gagcgactatgtaactggcctggta

SEQ ID NO: 481245 - DNA, 25 bp, Mus musculus
gagcgactatgttactggcctggta

SEQ ID NO: 481246 - DNA, 25 bp, Mus musculus
gagcgactcagcagcaattactgaa

SEQ ID NO: 481247 - DNA, 25 bp, Mus musculus
gagcgactcagctgcaattactgaa

SEQ ID NO: 481248 - DNA, 25 bp, Mus musculus
gagcgactccagcaaactaatcact

SEQ ID NO: 481249 - DNA, 25 bp, Mus musculus
gagcgactccaggaaactaatcact

SEQ ID NO: 481250 - DNA, 25 bp, Mus musculus
gagcgactgagacactcgtgtgcta

SEQ ID NO: 481251 - DNA, 25 bp, Mus musculus
gagcgactgagagactcgtgtgcta

SEQ ID NO: 481252 - DNA, 25 bp, Mus musculus
gagcgactggacaaacccggagatc

SEQ ID NO: 481253 - DNA, 25 bp, Mus musculus
gagcgactggactaacccggagatc

SEQ ID NO: 481254 - DNA, 25 bp, Mus musculus
gagcgactggatagagacctccttc

SEQ ID NO: 481255 - DNA, 25 bp, Mus musculus
gagcgactggattgagacctccttc

SEQ ID NO: 481256 - DNA, 25 bp, Mus musculus
gagcgacttgctccatagtaacatg

SEQ ID NO: 481257 - DNA, 25 bp, Mus musculus
gagcgacttgctgcatagtaacatg

SEQ ID NO: 481258 - DNA, 25 bp, Mus musculus
gagcgagaacgtctctacctcagca

SEQ ID NO: 481259 - DNA, 25 bp, Mus musculus
gagcgagaacgtgtctacctcagca

SEQ ID NO: 481260 - DNA, 25 bp, Mus musculus
gagcgagacttcagtttgttccacc

SEQ ID NO: 481261 - DNA, 25 bp, Mus musculus
gagcgagacttctgtttgttccacc

SEQ ID NO: 481262 - DNA, 25 bp, Mus musculus
gagcgagagacccagacttttgaca

SEQ ID NO: 481263 - DNA, 25 bp, Mus musculus
gagcgagagaccgagacttttgaca

SEQ ID NO: 481264 - DNA, 25 bp, Mus musculus
gagcgagagattattctaatgtcct

SEQ ID NO: 481265 - DNA, 25 bp, Mus musculus
gagcgagagatttttctaatgtcct

SEQ ID NO: 481266 - DNA, 25 bp, Mus musculus
gagcgagattctagcttactctttg

SEQ ID NO: 481267 - DNA, 25 bp, Mus musculus
gagcgagattcttgcttactctttg

SEQ ID NO: 481268 - DNA, 25 bp, Mus musculus
gagcgagatttaacttcctgggcct

SEQ ID NO: 481269 - DNA, 25 bp, Mus musculus
gagcgagatttatcttcctgggcct

SEQ ID NO: 481270 - DNA, 25 bp, Mus musculus
gagcgagcaaccaacaaagaggcta

SEQ ID NO: 481271 - DNA, 25 bp, Mus musculus
gagcgagcaacctacaaagaggcta

SEQ ID NO: 481272 - DNA, 25 bp, Mus musculus
gagcgagcacacatgggttcctaca

SEQ ID NO: 481273 - DNA, 25 bp, Mus musculus
gagcgagcacacttgggttcctaca

SEQ ID NO: 481274 - DNA, 25 bp, Mus musculus
gagcgagcagcccattgtgcatcct

SEQ ID NO: 481275 - DNA, 25 bp, Mus musculus
gagcgagcagccgattgtgcatcct

SEQ ID NO: 481276 - DNA, 25 bp, Mus musculus
gagcgagcattcagctggcttgagc

SEQ ID NO: 481277 - DNA, 25 bp, Mus musculus
gagcgagcattctgctggcttgagc

SEQ ID NO: 481278 - DNA, 25 bp, Mus musculus
gagcgagcccagaatgtgagactag

SEQ ID NO: 481279 - DNA, 25 bp, Mus musculus
gagcgagcccagtatgtgagactag

SEQ ID NO: 481280 - DNA, 25 bp, Mus musculus
gagcgagccctacgactggacaaga

SEQ ID NO: 481281 - DNA, 25 bp, Mus musculus
gagcgagccctaggactggacaaga

SEQ ID NO: 481282 - DNA, 25 bp, Mus musculus
gagcgagcctcacacaagtcgaaga

SEQ ID NO: 481283 - DNA, 25 bp, Mus musculus
gagcgagcctcagacaagtcgaaga

SEQ ID NO: 481284 - DNA, 25 bp, Mus musculus
gagcgagcgccaagagctcccagct

SEQ ID NO: 481285 - DNA, 25 bp, Mus musculus
gagcgagcgccatgagctcccagct

SEQ ID NO: 481286 - DNA, 25 bp, Mus musculus
gagcgagcggctctctattaacctg

SEQ ID NO: 481287 - DNA, 25 bp, Mus musculus
gagcgagcggctgtctattaacctg

SEQ ID NO: 481288 - DNA, 25 bp, Mus musculus
gagcgagcggtgaccctgaaccaaa

SEQ ID NO: 481289 - DNA, 25 bp, Mus musculus
gagcgagcggtgtccctgaaccaaa

SEQ ID NO: 481290 - DNA, 25 bp, Mus musculus
gagcgagctcttacagggttatttc

SEQ ID NO: 481291 - DNA, 25 bp, Mus musculus
gagcgagctctttcagggttatttc

SEQ ID NO: 481292 - DNA, 25 bp, Mus musculus
gagcgagctgagaaccgaggacacc

SEQ ID NO: 481293 - DNA, 25 bp, Mus musculus
gagcgagctgagtaccgaggacacc

SEQ ID NO: 481294 - DNA, 25 bp, Mus musculus
gagcgagcttttcacagtttgtacc

SEQ ID NO: 481295 - DNA, 25 bp, Mus musculus
gagcgagcttttgacagtttgtacc

SEQ ID NO: 481296 - DNA, 25 bp, Mus musculus
gagcgaggatacagaattcatcttt

SEQ ID NO: 481297 - DNA, 25 bp, Mus musculus
gagcgaggatactgaattcatcttt

SEQ ID NO: 481298 - DNA, 25 bp, Mus musculus
gagcgaggccatatccagagatgaa

SEQ ID NO: 481299 - DNA, 25 bp, Mus musculus
gagcgaggccatttccagagatgaa

SEQ ID NO: 481300 - DNA, 25 bp, Mus musculus
gagcgaggcgttattcctggagaac

SEQ ID NO: 481301 - DNA, 25 bp, Mus musculus
gagcgaggcgtttttcctggagaac

SEQ ID NO: 481302 - DNA, 25 bp, Mus musculus
gagcgaggtgtgacgctaaacgccc

SEQ ID NO: 481303 - DNA, 25 bp, Mus musculus
gagcgaggtgtgtcgctaaacgccc

SEQ ID NO: 481304 - DNA, 25 bp, Mus musculus
gagcgagtacaacaagggcagcaac

SEQ ID NO: 481305 - DNA, 25 bp, Mus musculus
gagcgagtacaagaagggcagcaac

SEQ ID NO: 481306 - DNA, 25 bp, Mus musculus
gagcgagtcaggctcctctgtgaac

SEQ ID NO: 481307 - DNA, 25 bp, Mus musculus
gagcgagtcagggtcctctgtgaac

SEQ ID NO: 481308 - DNA, 25 bp, Mus musculus
gagcgagtgagtatgcctcatcctg

SEQ ID NO: 481309 - DNA, 25 bp, Mus musculus
gagcgagtgagtttgcctcatcctg

SEQ ID NO: 481310 - DNA, 25 bp, Mus musculus
gagcgagtgatcaccatcatgcaga

SEQ ID NO: 481311 - DNA, 25 bp, Mus musculus
gagcgagtgatctccatcatgcaga

SEQ ID NO: 481312 - DNA, 25 bp, Mus musculus
gagcgagtgatgctggccacacaac

SEQ ID NO: 481313 - DNA, 25 bp, Mus musculus
gagcgagtgatggtggccacacaac

SEQ ID NO: 481314 - DNA, 25 bp, Mus musculus
gagcgataagacctattcttctgaa

SEQ ID NO: 481315 - DNA, 25 bp, Mus musculus
gagcgataagacgtattcttctgaa

SEQ ID NO: 481316 - DNA, 25 bp, Mus musculus
gagcgatacaagacagggaagaaca

SEQ ID NO: 481317 - DNA, 25 bp, Mus musculus
gagcgatacaagtcagggaagaaca

SEQ ID NO: 481318 - DNA, 25 bp, Mus musculus
gagcgatagaaaacatgtcatcagc

SEQ ID NO: 481319 - DNA, 25 bp, Mus musculus
gagcgatagaaatcatgtcatcagc

SEQ ID NO: 481320 - DNA, 25 bp, Mus musculus
gagcgatatgaacccgttcgccgcg

SEQ ID NO: 481321 - DNA, 25 bp, Mus musculus
gagcgatatgaagccgttcgccgcg

SEQ ID NO: 481322 - DNA, 25 bp, Mus musculus
gagcgatcacatagtctttgtttct

SEQ ID NO: 481323 - DNA, 25 bp, Mus musculus
gagcgatcacattgtctttgtttct

SEQ ID NO: 481324 - DNA, 25 bp, Mus musculus
gagcgatcactacgatctccccagg

SEQ ID NO: 481325 - DNA, 25 bp, Mus musculus
gagcgatcactaggatctccccagg

SEQ ID NO: 481326 - DNA, 25 bp, Mus musculus
gagcgatcagcacctggactgcgcc

SEQ ID NO: 481327 - DNA, 25 bp, Mus musculus
gagcgatcagcagctggactgcgcc

SEQ ID NO: 481328 - DNA, 25 bp, Mus musculus
gagcgatcagttcttatctacttgt

SEQ ID NO: 481329 - DNA, 25 bp, Mus musculus
gagcgatcagttgttatctacttgt

SEQ ID NO: 481330 - DNA, 25 bp, Mus musculus
gagcgatcgggcagatgttcctgat

SEQ ID NO: 481331 - DNA, 25 bp, Mus musculus
gagcgatcgggctgatgttcctgat

SEQ ID NO: 481332 - DNA, 25 bp, Mus musculus
gagcgatctgtacctttcctgatga

SEQ ID NO: 481333 - DNA, 25 bp, Mus musculus
gagcgatctgtagctttcctgatga

SEQ ID NO: 481334 - DNA, 25 bp, Mus musculus
gagcgatgacagagatatcctaatt

SEQ ID NO: 481335 - DNA, 25 bp, Mus musculus
gagcgatgacagtgatatcctaatt

SEQ ID NO: 481336 - DNA, 25 bp, Mus musculus
gagcgatgacttacacctcagtgat

SEQ ID NO: 481337 - DNA, 25 bp, Mus musculus
gagcgatgactttcacctcagtgat

SEQ ID NO: 481338 - DNA, 25 bp, Mus musculus
gagcgatgagctcacaaggcactac

SEQ ID NO: 481339 - DNA, 25 bp, Mus musculus
gagcgatgagctgacaaggcactac

SEQ ID NO: 481340 - DNA, 25 bp, Mus musculus
gagcgatgagttagagggttccttc

SEQ ID NO: 481341 - DNA, 25 bp, Mus musculus
gagcgatgagtttgagggttccttc

SEQ ID NO: 481342 - DNA, 25 bp, Mus musculus
gagcgatgccgcatggcctggccaa

SEQ ID NO: 481343 - DNA, 25 bp, Mus musculus
gagcgatgccgcttggcctggccaa

SEQ ID NO: 481344 - DNA, 25 bp, Mus musculus
gagcgatgctggcagggaccccgtt

SEQ ID NO: 481345 - DNA, 25 bp, Mus musculus
gagcgatgctgggagggaccccgtt

SEQ ID NO: 481346 - DNA, 25 bp, Mus musculus
gagcgatggctccactgaagagaca

SEQ ID NO: 481347 - DNA, 25 bp, Mus musculus
gagcgatggctcgactgaagagaca

SEQ ID NO: 481348 - DNA, 25 bp, Mus musculus
gagcgatgggaaagtaccacgtact

SEQ ID NO: 481349 - DNA, 25 bp, Mus musculus
gagcgatgggaatgtaccacgtact

SEQ ID NO: 481350 - DNA, 25 bp, Mus musculus
gagcgatgtcgaagcacaacctgga

SEQ ID NO: 481351 - DNA, 25 bp, Mus musculus
gagcgatgtcgatgcacaacctgga

SEQ ID NO: 481352 - DNA, 25 bp, Mus musculus
gagcgatgttttcattgtcctcatg

SEQ ID NO: 481353 - DNA, 25 bp, Mus musculus
gagcgatgttttgattgtcctcatg

SEQ ID NO: 481354 - DNA, 25 bp, Mus musculus
gagcgattactcagtgtttaggttt

SEQ ID NO: 481355 - DNA, 25 bp, Mus musculus
gagcgattactctgtgtttaggttt

SEQ ID NO: 481356 - DNA, 25 bp, Mus musculus
gagcgattcagacaagtcctctcag

SEQ ID NO: 481357 - DNA, 25 bp, Mus musculus
gagcgattcagagaagtcctctcag

SEQ ID NO: 481358 - DNA, 25 bp, Mus musculus
gagcgatttctccaggacatcttgg

SEQ ID NO: 481359 - DNA, 25 bp, Mus musculus
gagcgatttctcgaggacatcttgg

SEQ ID NO: 481360 - DNA, 25 bp, Mus musculus
gagcgatttgctcgtgtggatattc

SEQ ID NO: 481361 - DNA, 25 bp, Mus musculus
gagcgatttgctggtgtggatattc

SEQ ID NO: 481362 - DNA, 25 bp, Mus musculus
gagcgatttgtcaggttaattccga

SEQ ID NO: 481363 - DNA, 25 bp, Mus musculus
gagcgatttgtctggttaattccga

SEQ ID NO: 481364 - DNA, 25 bp, Mus musculus
gagcgcaacaatctgcttcagtgtt

SEQ ID NO: 481365 - DNA, 25 bp, Mus musculus
gagcgcaacaatgtgcttcagtgtt

SEQ ID NO: 481366 - DNA, 25 bp, Mus musculus
gagcgcaacacgcagttttatcaca

SEQ ID NO: 481367 - DNA, 25 bp, Mus musculus
gagcgcaacacggagttttatcaca

SEQ ID NO: 481368 - DNA, 25 bp, Mus musculus
gagcgcaaggcaagcacggatccct

SEQ ID NO: 481369 - DNA, 25 bp, Mus musculus
gagcgcaaggcaatgagagtcctgc

SEQ ID NO: 481370 - DNA, 25 bp, Mus musculus
gagcgcaaggcatgcacggatccct

SEQ ID NO: 481371 - DNA, 25 bp, Mus musculus
gagcgcaaggcattgagagtcctgc

SEQ ID NO: 481372 - DNA, 25 bp, Mus musculus
gagcgcaagggccaactgcttcaag

SEQ ID NO: 481373 - DNA, 25 bp, Mus musculus
gagcgcaagggcgaactgcttcaag

SEQ ID NO: 481374 - DNA, 25 bp, Mus musculus
gagcgcaaggtcacagcttctctaa

SEQ ID NO: 481375 - DNA, 25 bp, Mus musculus
gagcgcaaggtctcagcttctctaa

SEQ ID NO: 481376 - DNA, 25 bp, Mus musculus
gagcgcaagtatcagcatcttgaca

SEQ ID NO: 481377 - DNA, 25 bp, Mus musculus
gagcgcaagtatgagcatcttgaca

SEQ ID NO: 481378 - DNA, 25 bp, Mus musculus
gagcgcaatcatatgtatctgttaa

SEQ ID NO: 481379 - DNA, 25 bp, Mus musculus
gagcgcaatcatttgtatctgttaa

SEQ ID NO: 481380 - DNA, 25 bp, Mus musculus
gagcgcacaaagactcgtgcagtta

SEQ ID NO: 481381 - DNA, 25 bp, Mus musculus
gagcgcacaaagtctcgtgcagtta

SEQ ID NO: 481382 - DNA, 25 bp, Mus musculus
gagcgcacacggaggttctgtgacc

SEQ ID NO: 481383 - DNA, 25 bp, Mus musculus
gagcgcacacggtggttctgtgacc

SEQ ID NO: 481384 - DNA, 25 bp, Mus musculus
gagcgcacagctccaaggacctgga

SEQ ID NO: 481385 - DNA, 25 bp, Mus musculus
gagcgcacagctgcaaggacctgga

SEQ ID NO: 481386 - DNA, 25 bp, Mus musculus
gagcgcacaggtcgcggtcaggtgg

SEQ ID NO: 481387 - DNA, 25 bp, Mus musculus
gagcgcacaggtggcggtcaggtgg

SEQ ID NO: 481388 - DNA, 25 bp, Mus musculus
gagcgcacttacaggtcttcaagat

SEQ ID NO: 481389 - DNA, 25 bp, Mus musculus
gagcgcacttactggtcttcaagat

SEQ ID NO: 481390 - DNA, 25 bp, Mus musculus
gagcgcacttcaattttactcagtt

SEQ ID NO: 481391 - DNA, 25 bp, Mus musculus
gagcgcacttcatttttactcagtt

SEQ ID NO: 481392 - DNA, 25 bp, Mus musculus
gagcgcagctcaccacaacacagtg

SEQ ID NO: 481393 - DNA, 25 bp, Mus musculus
gagcgcagctcagcacaacacagtg

SEQ ID NO: 481394 - DNA, 25 bp, Mus musculus
gagcgcagctgcaactggaaatgct

SEQ ID NO: 481395 - DNA, 25 bp, Mus musculus
gagcgcagctgctactggaaatgct

SEQ ID NO: 481396 - DNA, 25 bp, Mus musculus
gagcgcagtattaagtccattgttt

SEQ ID NO: 481397 - DNA, 25 bp, Mus musculus
gagcgcagtatttagtccattgttt

SEQ ID NO: 481398 - DNA, 25 bp, Mus musculus
gagcgcagtgctcggtcttcagata

SEQ ID NO: 481399 - DNA, 25 bp, Mus musculus
gagcgcagtgctgggtcttcagata

SEQ ID NO: 481400 - DNA, 25 bp, Mus musculus
gagcgcagttcaatcggccagccaa

SEQ ID NO: 481401 - DNA, 25 bp, Mus musculus
gagcgcagttcattcggccagccaa

SEQ ID NO: 481402 - DNA, 25 bp, Mus musculus
gagcgcatcagcagcagttaaagca

SEQ ID NO: 481403 - DNA, 25 bp, Mus musculus
gagcgcatcagctgcagttaaagca

SEQ ID NO: 481404 - DNA, 25 bp, Mus musculus
gagcgcatcctccatgggtaatgtc

SEQ ID NO: 481405 - DNA, 25 bp, Mus musculus
gagcgcatcctcgatgggtaatgtc

SEQ ID NO: 481406 - DNA, 25 bp, Mus musculus
gagcgcatccttaggcattttctta

SEQ ID NO: 481407 - DNA, 25 bp, Mus musculus
gagcgcatcctttggcattttctta

SEQ ID NO: 481408 - DNA, 25 bp, Mus musculus
gagcgcatctgtaactgaagccgaa

SEQ ID NO: 481409 - DNA, 25 bp, Mus musculus
gagcgcatctgttactgaagccgaa

SEQ ID NO: 481410 - DNA, 25 bp, Mus musculus
gagcgcatgctgctggaacctgcct

SEQ ID NO: 481411 - DNA, 25 bp, Mus musculus
gagcgcatgctggtggaacctgcct

SEQ ID NO: 481412 - DNA, 25 bp, Mus musculus
gagcgcatgcttcgatcctacagat

SEQ ID NO: 481413 - DNA, 25 bp, Mus musculus
gagcgcatgcttggatcctacagat

SEQ ID NO: 481414 - DNA, 25 bp, Mus musculus
gagcgcatgggacctctcaagtatg

SEQ ID NO: 481415 - DNA, 25 bp, Mus musculus
gagcgcatgggagctctcaagtatg

SEQ ID NO: 481416 - DNA, 25 bp, Mus musculus
gagcgcatgtgcacagtggtttact

SEQ ID NO: 481417 - DNA, 25 bp, Mus musculus
gagcgcatgtgctcagtggtttact

SEQ ID NO: 481418 - DNA, 25 bp, Mus musculus
gagcgcattcatcgcatcgtgctta

SEQ ID NO: 481419 - DNA, 25 bp, Mus musculus
gagcgcattcatggcatcgtgctta

SEQ ID NO: 481420 - DNA, 25 bp, Mus musculus
gagcgcattgctagcatagctactg

SEQ ID NO: 481421 - DNA, 25 bp, Mus musculus
gagcgcattgcttgcatagctactg

SEQ ID NO: 481422 - DNA, 25 bp, Mus musculus
gagcgccaagatcgtgaagcccaat

SEQ ID NO: 481423 - DNA, 25 bp, Mus musculus
gagcgccaagatggtgaagcccaat

SEQ ID NO: 481424 - DNA, 25 bp, Mus musculus
gagcgccaatgacgccatcacaact

SEQ ID NO: 481425 - DNA, 25 bp, Mus musculus
gagcgccaatgaggccatcacaact

SEQ ID NO: 481426 - DNA, 25 bp, Mus musculus
gagcgccacaacactctatgggaag

SEQ ID NO: 481427 - DNA, 25 bp, Mus musculus
gagcgccacaactctctatgggaag

SEQ ID NO: 481428 - DNA, 25 bp, Mus musculus
gagcgccactggcatttgggtttac

SEQ ID NO: 481429 - DNA, 25 bp, Mus musculus
gagcgccactgggatttgggtttac

SEQ ID NO: 481430 - DNA, 25 bp, Mus musculus
gagcgccagcctcgaacagcaagcg

SEQ ID NO: 481431 - DNA, 25 bp, Mus musculus
gagcgccagcctggaacagcaagcg

SEQ ID NO: 481432 - DNA, 25 bp, Mus musculus
gagcgccatgctctttgcggctgtc

SEQ ID NO: 481433 - DNA, 25 bp, Mus musculus
gagcgccatgctgtttgcggctgtc

SEQ ID NO: 481434 - DNA, 25 bp, Mus musculus
gagcgcccagaacctgaagccggtt

SEQ ID NO: 481435 - DNA, 25 bp, Mus musculus
gagcgcccagaagctgaagccggtt

SEQ ID NO: 481436 - DNA, 25 bp, Mus musculus
gagcgccccaacctagtgctctgga

SEQ ID NO: 481437 - DNA, 25 bp, Mus musculus
gagcgccccaacgtagtgctctgga

SEQ ID NO: 481438 - DNA, 25 bp, Mus musculus
gagcgcccgtgtacctggcggcggt

SEQ ID NO: 481439 - DNA, 25 bp, Mus musculus
gagcgcccgtgttcctggcggcggt

SEQ ID NO: 481440 - DNA, 25 bp, Mus musculus
gagcgcccgttcaagtgcagctact

SEQ ID NO: 481441 - DNA, 25 bp, Mus musculus
gagcgcccgttctagtgcagctact

SEQ ID NO: 481442 - DNA, 25 bp, Mus musculus
gagcgccgaactagctgccccagtt

SEQ ID NO: 481443 - DNA, 25 bp, Mus musculus
gagcgccgaacttgctgccccagtt

SEQ ID NO: 481444 - DNA, 25 bp, Mus musculus
gagcgccgacagagccaaactggac

SEQ ID NO: 481445 - DNA, 25 bp, Mus musculus
gagcgccgacagtgccaaactggac

SEQ ID NO: 481446 - DNA, 25 bp, Mus musculus
gagcgccgagaaccccaggacagca

SEQ ID NO: 481447 - DNA, 25 bp, Mus musculus
gagcgccgagaagcccaggacagca

SEQ ID NO: 481448 - DNA, 25 bp, Mus musculus
gagcgccgccaaaatgcactgtaca

SEQ ID NO: 481449 - DNA, 25 bp, Mus musculus
gagcgccgccaatatgcactgtaca

SEQ ID NO: 481450 - DNA, 25 bp, Mus musculus
gagcgcctagaaactctgtagctgc

SEQ ID NO: 481451 - DNA, 25 bp, Mus musculus
gagcgcctagaatctctgtagctgc

SEQ ID NO: 481452 - DNA, 25 bp, Mus musculus
gagcgcctatctcattcagaatatt

SEQ ID NO: 481453 - DNA, 25 bp, Mus musculus
gagcgcctatctgattcagaatatt

SEQ ID NO: 481454 - DNA, 25 bp, Mus musculus
gagcgcctcaccagacgaggagtag

SEQ ID NO: 481455 - DNA, 25 bp, Mus musculus
gagcgcctcacctgacgaggagtag

SEQ ID NO: 481456 - DNA, 25 bp, Mus musculus
gagcgcctcgtacatatcatttgtg

SEQ ID NO: 481457 - DNA, 25 bp, Mus musculus
gagcgcctcgtagatatcatttgtg

SEQ ID NO: 481458 - DNA, 25 bp, Mus musculus
gagcgcctcttcaacgtgggtgatg

SEQ ID NO: 481459 - DNA, 25 bp, Mus musculus
gagcgcctcttctacgtgggtgatg

SEQ ID NO: 481460 - DNA, 25 bp, Mus musculus
gagcgcctgaacaggatctactata

SEQ ID NO: 481461 - DNA, 25 bp, Mus musculus
gagcgcctgaactggatctactata

SEQ ID NO: 481462 - DNA, 25 bp, Mus musculus
gagcgcctgaagagaggcatcatcc

SEQ ID NO: 481463 - DNA, 25 bp, Mus musculus
gagcgcctgaagtgaggcatcatcc

SEQ ID NO: 481464 - DNA, 25 bp, Mus musculus
gagcgcctgattatcgcctgtggat

SEQ ID NO: 481465 - DNA, 25 bp, Mus musculus
gagcgcctgattttcgcctgtggat

SEQ ID NO: 481466 - DNA, 25 bp, Mus musculus
gagcgcctggccaagtacaaccaga

SEQ ID NO: 481467 - DNA, 25 bp, Mus musculus
gagcgcctggccaagtacaatcaga

SEQ ID NO: 481468 - DNA, 25 bp, Mus musculus
gagcgcctggcctagtacaaccaga

SEQ ID NO: 481469 - DNA, 25 bp, Mus musculus
gagcgcctggcctagtacaatcaga

SEQ ID NO: 481470 - DNA, 25 bp, Mus musculus
gagcgcctggctactgttgaagcag

SEQ ID NO: 481471 - DNA, 25 bp, Mus musculus
gagcgcctggcttctgttgaagcag

SEQ ID NO: 481472 - DNA, 25 bp, Mus musculus
gagcgccttgggaacttctctgtgg

SEQ ID NO: 481473 - DNA, 25 bp, Mus musculus
gagcgccttgggtacttctctgtgg

SEQ ID NO: 481474 - DNA, 25 bp, Mus musculus
gagcgcctttgaaatggatgactta

SEQ ID NO: 481475 - DNA, 25 bp, Mus musculus
gagcgcctttgatatggatgactta

SEQ ID NO: 481476 - DNA, 25 bp, Mus musculus
gagcgcgctcgtctaagcttgccgt

SEQ ID NO: 481477 - DNA, 25 bp, Mus musculus
gagcgcgctcgtgtaagcttgccgt

SEQ ID NO: 481478 - DNA, 25 bp, Mus musculus
gagcgcggaagcacgccggctttcc

SEQ ID NO: 481479 - DNA, 25 bp, Mus musculus
gagcgcggaagctcgccggctttcc

SEQ ID NO: 481480 - DNA, 25 bp, Mus musculus
gagcgcggccgaaattgtcctaaga

SEQ ID NO: 481481 - DNA, 25 bp, Mus musculus
gagcgcggccgatattgtcctaaga

SEQ ID NO: 481482 - DNA, 25 bp, Mus musculus
gagcgcggtgtgagtgccatccgtg

SEQ ID NO: 481483 - DNA, 25 bp, Mus musculus
gagcgcggtgtgtgtgccatccgtg

SEQ ID NO: 481484 - DNA, 25 bp, Mus musculus
gagcgcgtcctgacctgcagcttgg

SEQ ID NO: 481485 - DNA, 25 bp, Mus musculus
gagcgcgtcctgtcctgcagcttgg

SEQ ID NO: 481486 - DNA, 25 bp, Mus musculus
gagcgcgtgctgacttctaaaattc

SEQ ID NO: 481487 - DNA, 25 bp, Mus musculus
gagcgcgtgctgtcttctaaaattc

SEQ ID NO: 481488 - DNA, 25 bp, Mus musculus
gagcgcgttacacaagaccttcact

SEQ ID NO: 481489 - DNA, 25 bp, Mus musculus
gagcgcgttacagaagaccttcact

SEQ ID NO: 481490 - DNA, 25 bp, Mus musculus
gagcgctaacagacaagcctttgta

SEQ ID NO: 481491 - DNA, 25 bp, Mus musculus
gagcgctaacagtcaagcctttgta

SEQ ID NO: 481492 - DNA, 25 bp, Mus musculus
gagcgctaacggcttgatgccccag

SEQ ID NO: 481493 - DNA, 25 bp, Mus musculus
gagcgctaacgggttgatgccccag

SEQ ID NO: 481494 - DNA, 25 bp, Mus musculus
gagcgctacacaaacatgatccaca

SEQ ID NO: 481495 - DNA, 25 bp, Mus musculus
gagcgctacacatacatgatccaca

SEQ ID NO: 481496 - DNA, 25 bp, Mus musculus
gagcgctaccatcccagggaggacc

SEQ ID NO: 481497 - DNA, 25 bp, Mus musculus
gagcgctaccatgccagggaggacc

SEQ ID NO: 481498 - DNA, 25 bp, Mus musculus
gagcgctaccttagggcagtactgt

SEQ ID NO: 481499 - DNA, 25 bp, Mus musculus
gagcgctacctttgggcagtactgt

SEQ ID NO: 481500 - DNA, 25 bp, Mus musculus
gagcgctacgctagcgacaatgtaa

SEQ ID NO: 481501 - DNA, 25 bp, Mus musculus
gagcgctacgcttgcgacaatgtaa

SEQ ID NO: 481502 - DNA, 25 bp, Mus musculus
gagcgctcacgtctgtatgtgatga

SEQ ID NO: 481503 - DNA, 25 bp, Mus musculus
gagcgctcacgtgtgtatgtgatga

SEQ ID NO: 481504 - DNA, 25 bp, Mus musculus
gagcgctcagaacctgagaccagat

SEQ ID NO: 481505 - DNA, 25 bp, Mus musculus
gagcgctcagaagctgagaccagat

SEQ ID NO: 481506 - DNA, 25 bp, Mus musculus
gagcgctcgctactttactttgtct

SEQ ID NO: 481507 - DNA, 25 bp, Mus musculus
gagcgctcgctagtttactttgtct

SEQ ID NO: 481508 - DNA, 25 bp, Mus musculus
gagcgctctatcctggaaagtctaa

SEQ ID NO: 481509 - DNA, 25 bp, Mus musculus
gagcgctctatcgtggaaagtctaa

SEQ ID NO: 481510 - DNA, 25 bp, Mus musculus
gagcgctctcggcatagatgcactt

SEQ ID NO: 481511 - DNA, 25 bp, Mus musculus
gagcgctctcgggatagatgcactt

SEQ ID NO: 481512 - DNA, 25 bp, Mus musculus
gagcgctctggacaaatcccatgag

SEQ ID NO: 481513 - DNA, 25 bp, Mus musculus
gagcgctctggagaaatcccatgag

SEQ ID NO: 481514 - DNA, 25 bp, Mus musculus
gagcgctgacagaggctacatcatc

SEQ ID NO: 481515 - DNA, 25 bp, Mus musculus
gagcgctgacagtggctacatcatc

SEQ ID NO: 481516 - DNA, 25 bp, Mus musculus
gagcgctgactgaagttaactgtaa

SEQ ID NO: 481517 - DNA, 25 bp, Mus musculus
gagcgctgactgtagttaactgtaa

SEQ ID NO: 481518 - DNA, 25 bp, Mus musculus
gagcgctgattaatactgctgatga

SEQ ID NO: 481519 - DNA, 25 bp, Mus musculus
gagcgctgattattactgctgatga

SEQ ID NO: 481520 - DNA, 25 bp, Mus musculus
gagcgctgcaggcattgctacagat

SEQ ID NO: 481521 - DNA, 25 bp, Mus musculus
gagcgctgcagggattgctacagat

SEQ ID NO: 481522 - DNA, 25 bp, Mus musculus
gagcgctgccgaatttcttcacctg

SEQ ID NO: 481523 - DNA, 25 bp, Mus musculus
gagcgctgccgattttcttcacctg

SEQ ID NO: 481524 - DNA, 25 bp, Mus musculus
gagcgctgggacacctaagttatat

SEQ ID NO: 481525 - DNA, 25 bp, Mus musculus
gagcgctgggactcctaagttatat

SEQ ID NO: 481526 - DNA, 25 bp, Mus musculus
gagcgctgtctcctctacttatgat

SEQ ID NO: 481527 - DNA, 25 bp, Mus musculus
gagcgctgtctcgtctacttatgat

SEQ ID NO: 481528 - DNA, 25 bp, Mus musculus
gagcgctgtgaccagctgatcaaga

SEQ ID NO: 481529 - DNA, 25 bp, Mus musculus
gagcgctgtgacgagctgatcaaga

SEQ ID NO: 481530 - DNA, 25 bp, Mus musculus
gagcgcttacacctctatggtggat

SEQ ID NO: 481531 - DNA, 25 bp, Mus musculus
gagcgcttacacgtctatggtggat

SEQ ID NO: 481532 - DNA, 25 bp, Mus musculus
gagcgcttagaaatccatgttctgc

SEQ ID NO: 481533 - DNA, 25 bp, Mus musculus
gagcgcttagaattccatgttctgc

SEQ ID NO: 481534 - DNA, 25 bp, Mus musculus
gagcgcttccgcagctctgagatgc

SEQ ID NO: 481535 - DNA, 25 bp, Mus musculus
gagcgcttccgctgctctgagatgc

SEQ ID NO: 481536 - DNA, 25 bp, Mus musculus
gagcgcttcctgctacaccaggaga

SEQ ID NO: 481537 - DNA, 25 bp, Mus musculus
gagcgcttcctggtacaccaggaga

SEQ ID NO: 481538 - DNA, 25 bp, Mus musculus
gagcgcttcgatatgctattttctg

SEQ ID NO: 481539 - DNA, 25 bp, Mus musculus
gagcgcttcgatttgctattttctg

SEQ ID NO: 481540 - DNA, 25 bp, Mus musculus
gagcgcttgaaaaatcttacctgga

SEQ ID NO: 481541 - DNA, 25 bp, Mus musculus
gagcgcttgaaatatcttacctgga

SEQ ID NO: 481542 - DNA, 25 bp, Mus musculus
gagcgcttgctgcatatggaacaga

SEQ ID NO: 481543 - DNA, 25 bp, Mus musculus
gagcgcttgctggatatggaacaga

SEQ ID NO: 481544 - DNA, 25 bp, Mus musculus
gagcgcttgcttccctgcagttgtt

SEQ ID NO: 481545 - DNA, 25 bp, Mus musculus
gagcgcttgcttgcctgcagttgtt

SEQ ID NO: 481546 - DNA, 25 bp, Mus musculus
gagcgctttgagctgtttgtcatga

SEQ ID NO: 481547 - DNA, 25 bp, Mus musculus
gagcgctttgaggtgtttgtcatga

SEQ ID NO: 481548 - DNA, 25 bp, Mus musculus
gagcggaaatctcagtcgatgcaca

SEQ ID NO: 481549 - DNA, 25 bp, Mus musculus
gagcggaaatctgagtcgatgcaca

SEQ ID NO: 481550 - DNA, 25 bp, Mus musculus
gagcggaagaacctctcaaactgga

SEQ ID NO: 481551 - DNA, 25 bp, Mus musculus
gagcggaagaacgtctcaaactgga

SEQ ID NO: 481552 - DNA, 25 bp, Mus musculus
gagcggaagctgacactttcaacca

SEQ ID NO: 481553 - DNA, 25 bp, Mus musculus
gagcggaagctgtcactttcaacca

SEQ ID NO: 481554 - DNA, 25 bp, Mus musculus
gagcggaagtgtcagcccattgcca

SEQ ID NO: 481555 - DNA, 25 bp, Mus musculus
gagcggaagtgtgagcccattgcca

SEQ ID NO: 481556 - DNA, 25 bp, Mus musculus
gagcggacatgcagcgcagctacga

SEQ ID NO: 481557 - DNA, 25 bp, Mus musculus
gagcggacatgctgcgcagctacga

SEQ ID NO: 481558 - DNA, 25 bp, Mus musculus
gagcggaccctgacctctacaaaga

SEQ ID NO: 481559 - DNA, 25 bp, Mus musculus
gagcggaccctgtcctctacaaaga

SEQ ID NO: 481560 - DNA, 25 bp, Mus musculus
gagcggactagcagcggattaaaca

SEQ ID NO: 481561 - DNA, 25 bp, Mus musculus
gagcggactagctgcggattaaaca

SEQ ID NO: 481562 - DNA, 25 bp, Mus musculus
gagcggactcggagcctgctgcggg

SEQ ID NO: 481563 - DNA, 25 bp, Mus musculus
gagcggactcggtgcctgctgcggg

SEQ ID NO: 481564 - DNA, 25 bp, Mus musculus
gagcggagacagactgacccgggca

SEQ ID NO: 481565 - DNA, 25 bp, Mus musculus
gagcggagacagtctgacccgggca

SEQ ID NO: 481566 - DNA, 25 bp, Mus musculus
gagcggagacataaagtgcccctgc

SEQ ID NO: 481567 - DNA, 25 bp, Mus musculus
gagcggagacattaagtgcccctgc

SEQ ID NO: 481568 - DNA, 25 bp, Mus musculus
gagcggagacgaaggcggccatggc

SEQ ID NO: 481569 - DNA, 25 bp, Mus musculus
gagcggagacgatggcggccatggc

SEQ ID NO: 481570 - DNA, 25 bp, Mus musculus
gagcggagagaaacaaggcctttaa

SEQ ID NO: 481571 - DNA, 25 bp, Mus musculus
gagcggagagaatcaaggcctttaa

SEQ ID NO: 481572 - DNA, 25 bp, Mus musculus
gagcggagagcacccatctatgaca

SEQ ID NO: 481573 - DNA, 25 bp, Mus musculus
gagcggagagcagccatctatgaca

SEQ ID NO: 481574 - DNA, 25 bp, Mus musculus
gagcggaggttgcacaccacgacaa

SEQ ID NO: 481575 - DNA, 25 bp, Mus musculus
gagcggaggttggacaccacgacaa

SEQ ID NO: 481576 - DNA, 25 bp, Mus musculus
gagcggatagtgaccaggcaactgt

SEQ ID NO: 481577 - DNA, 25 bp, Mus musculus
gagcggatagtgtccaggcaactgt

SEQ ID NO: 481578 - DNA, 25 bp, Mus musculus
gagcggatctttaccattgtagagc

SEQ ID NO: 481579 - DNA, 25 bp, Mus musculus
gagcggatcttttccattgtagagc

SEQ ID NO: 481580 - DNA, 25 bp, Mus musculus
gagcggatgtcacgaaatctgttct

SEQ ID NO: 481581 - DNA, 25 bp, Mus musculus
gagcggatgtcaggaaatctgttct

SEQ ID NO: 481582 - DNA, 25 bp, Mus musculus
gagcggattatcatgactagggaca

SEQ ID NO: 481583 - DNA, 25 bp, Mus musculus
gagcggattatcttgactagggaca

SEQ ID NO: 481584 - DNA, 25 bp, Mus musculus
gagcggattcttagacaggattctt

SEQ ID NO: 481585 - DNA, 25 bp, Mus musculus
gagcggattctttgacaggattctt

SEQ ID NO: 481586 - DNA, 25 bp, Mus musculus
gagcggcaacgcaactttgagaagc

SEQ ID NO: 481587 - DNA, 25 bp, Mus musculus
gagcggcaacgctactttgagaagc

SEQ ID NO: 481588 - DNA, 25 bp, Mus musculus
gagcggcaaggccatgagattatta

SEQ ID NO: 481589 - DNA, 25 bp, Mus musculus
gagcggcaaggcgatgagattatta

SEQ ID NO: 481590 - DNA, 25 bp, Mus musculus
gagcggcacagacaacgacgtcaca

SEQ ID NO: 481591 - DNA, 25 bp, Mus musculus
gagcggcacagagaacgacgtcaca

SEQ ID NO: 481592 - DNA, 25 bp, Mus musculus
gagcggcaccagacaagaaaatatt

SEQ ID NO: 481593 - DNA, 25 bp, Mus musculus
gagcggcaccagtcaagaaaatatt

SEQ ID NO: 481594 - DNA, 25 bp, Mus musculus
gagcggcactatacaagggcctctt

SEQ ID NO: 481595 - DNA, 25 bp, Mus musculus
gagcggcactattcaagggcctctt

SEQ ID NO: 481596 - DNA, 25 bp, Mus musculus
gagcggcagctgatacgtggaacaa

SEQ ID NO: 481597 - DNA, 25 bp, Mus musculus
gagcggcagctgttacgtggaacaa

SEQ ID NO: 481598 - DNA, 25 bp, Mus musculus
gagcggcaggagacctactgttatc

SEQ ID NO: 481599 - DNA, 25 bp, Mus musculus
gagcggcaggagtcctactgttatc

SEQ ID NO: 481600 - DNA, 25 bp, Mus musculus
gagcggcaggccactgtacaagaaa

SEQ ID NO: 481601 - DNA, 25 bp, Mus musculus
gagcggcaggcctctgtacaagaaa

SEQ ID NO: 481602 - DNA, 25 bp, Mus musculus
gagcggcataatcgatatgacccca

SEQ ID NO: 481603 - DNA, 25 bp, Mus musculus
gagcggcataatggatatgacccca

SEQ ID NO: 481604 - DNA, 25 bp, Mus musculus
gagcggccaaccatgacctgacgga

SEQ ID NO: 481605 - DNA, 25 bp, Mus musculus
gagcggccaaccttgacctgacgga

SEQ ID NO: 481606 - DNA, 25 bp, Mus musculus
gagcggccaagcaatagtcctacag

SEQ ID NO: 481607 - DNA, 25 bp, Mus musculus
gagcggccaagctatagtcctacag

SEQ ID NO: 481608 - DNA, 25 bp, Mus musculus
gagcggccagccactgcaggacaga

SEQ ID NO: 481609 - DNA, 25 bp, Mus musculus
gagcggccagcctctgcaggacaga

SEQ ID NO: 481610 - DNA, 25 bp, Mus musculus
gagcggccgcctagctttcatctgg

SEQ ID NO: 481611 - DNA, 25 bp, Mus musculus
gagcggccgccttgctttcatctgg

SEQ ID NO: 481612 - DNA, 25 bp, Mus musculus
gagcggccggatcccgaggcggcga

SEQ ID NO: 481613 - DNA, 25 bp, Mus musculus
gagcggccggatgccgaggcggcga

SEQ ID NO: 481614 - DNA, 25 bp, Mus musculus
gagcggcctagaatactttgagaaa

SEQ ID NO: 481615 - DNA, 25 bp, Mus musculus
gagcggcctagattactttgagaaa

SEQ ID NO: 481616 - DNA, 25 bp, Mus musculus
gagcggcctgagaacaacctgcaag

SEQ ID NO: 481617 - DNA, 25 bp, Mus musculus
gagcggcctgagtacaacctgcaag

SEQ ID NO: 481618 - DNA, 25 bp, Mus musculus
gagcggcgacgcaagtaccactgaa

SEQ ID NO: 481619 - DNA, 25 bp, Mus musculus
gagcggcgacgctagtaccactgaa

SEQ ID NO: 481620 - DNA, 25 bp, Mus musculus
gagcggcgcaggactcagagcatca

SEQ ID NO: 481621 - DNA, 25 bp, Mus musculus
gagcggcgcaggtctcagagcatca

SEQ ID NO: 481622 - DNA, 25 bp, Mus musculus
gagcggcgcagtagtctactacttt

SEQ ID NO: 481623 - DNA, 25 bp, Mus musculus
gagcggcgcagttgtctactacttt

SEQ ID NO: 481624 - DNA, 25 bp, Mus musculus
gagcggcgcatcaaggagctcacct

SEQ ID NO: 481625 - DNA, 25 bp, Mus musculus
gagcggcgcatctaggagctcacct

SEQ ID NO: 481626 - DNA, 25 bp, Mus musculus
gagcggcgccataagtgcagcattt

SEQ ID NO: 481627 - DNA, 25 bp, Mus musculus
gagcggcgccattagtgcagcattt

SEQ ID NO: 481628 - DNA, 25 bp, Mus musculus
gagcggcggccaacagcccctagta

SEQ ID NO: 481629 - DNA, 25 bp, Mus musculus
gagcggcggccatcagcccctagta

SEQ ID NO: 481630 - DNA, 25 bp, Mus musculus
gagcggctagctattgccaacgtaa

SEQ ID NO: 481631 - DNA, 25 bp, Mus musculus
gagcggctagcttttgccaacgtaa

SEQ ID NO: 481632 - DNA, 25 bp, Mus musculus
gagcggctcaggatccagctacggt

SEQ ID NO: 481633 - DNA, 25 bp, Mus musculus
gagcggctcaggttccagctacggt

SEQ ID NO: 481634 - DNA, 25 bp, Mus musculus
gagcggctgactcggtcgtttctcc

SEQ ID NO: 481635 - DNA, 25 bp, Mus musculus
gagcggctgactgggtcgtttctcc

SEQ ID NO: 481636 - DNA, 25 bp, Mus musculus
gagcggctgcacaagaccctgatat

SEQ ID NO: 481637 - DNA, 25 bp, Mus musculus
gagcggctgcactagaccctgatat

SEQ ID NO: 481638 - DNA, 25 bp, Mus musculus
gagcggcttcagaaacgaatggttg

SEQ ID NO: 481639 - DNA, 25 bp, Mus musculus
gagcggcttcagtaacgaatggttg

SEQ ID NO: 481640 - DNA, 25 bp, Mus musculus
gagcggctttttcacctgtattaat

SEQ ID NO: 481641 - DNA, 25 bp, Mus musculus
gagcggctttttgacctgtattaat

SEQ ID NO: 481642 - DNA, 25 bp, Mus musculus
gagcgggacccccttgggctatatt

SEQ ID NO: 481643 - DNA, 25 bp, Mus musculus
gagcgggaccccgttgggctatatt

SEQ ID NO: 481644 - DNA, 25 bp, Mus musculus
gagcgggagtgaactcacctgccca

SEQ ID NO: 481645 - DNA, 25 bp, Mus musculus
gagcgggagtgatctcacctgccca

SEQ ID NO: 481646 - DNA, 25 bp, Mus musculus
gagcgggcagggactgatcccacct

SEQ ID NO: 481647 - DNA, 25 bp, Mus musculus
gagcgggcagggtctgatcccacct

SEQ ID NO: 481648 - DNA, 25 bp, Mus musculus
gagcgggcattaatgctccatattg

SEQ ID NO: 481649 - DNA, 25 bp, Mus musculus
gagcgggcattattgctccatattg

SEQ ID NO: 481650 - DNA, 25 bp, Mus musculus
gagcgggcatttcacaaggcagacc

SEQ ID NO: 481651 - DNA, 25 bp, Mus musculus
gagcgggcatttgacaaggcagacc

SEQ ID NO: 481652 - DNA, 25 bp, Mus musculus
gagcgggcgaagaatgttccccact

SEQ ID NO: 481653 - DNA, 25 bp, Mus musculus
gagcgggcgaagtatgttccccact

SEQ ID NO: 481654 - DNA, 25 bp, Mus musculus
gagcgggcgatgagttctagcacct

SEQ ID NO: 481655 - DNA, 25 bp, Mus musculus
gagcgggcgatgtgttctagcacct

SEQ ID NO: 481656 - DNA, 25 bp, Mus musculus
gagcgggctgtaccggaactcaata

SEQ ID NO: 481657 - DNA, 25 bp, Mus musculus
gagcgggctgtagcggaactcaata

SEQ ID NO: 481658 - DNA, 25 bp, Mus musculus
gagcgggcttgtagtagaagaccaa

SEQ ID NO: 481659 - DNA, 25 bp, Mus musculus
gagcgggcttgttgtagaagaccaa

SEQ ID NO: 481660 - DNA, 25 bp, Mus musculus
gagcggtacactaggattgtgctgt

SEQ ID NO: 481661 - DNA, 25 bp, Mus musculus
gagcggtacacttggattgtgctgt

SEQ ID NO: 481662 - DNA, 25 bp, Mus musculus
gagcggtccaagcttctcagaagac

SEQ ID NO: 481663 - DNA, 25 bp, Mus musculus
gagcggtccaaggttctcagaagac

SEQ ID NO: 481664 - DNA, 25 bp, Mus musculus
gagcggtctcgcagcccaagaagac

SEQ ID NO: 481665 - DNA, 25 bp, Mus musculus
gagcggtctcgctgcccaagaagac

SEQ ID NO: 481666 - DNA, 25 bp, Mus musculus
gagcggtctttgcagaacgtgccat

SEQ ID NO: 481667 - DNA, 25 bp, Mus musculus
gagcggtctttgctagctagagctt

SEQ ID NO: 481668 - DNA, 25 bp, Mus musculus
gagcggtctttggagaacgtgccat

SEQ ID NO: 481669 - DNA, 25 bp, Mus musculus
gagcggtctttggtagctagagctt

SEQ ID NO: 481670 - DNA, 25 bp, Mus musculus
gagcggtgcaggatccatataacct

SEQ ID NO: 481671 - DNA, 25 bp, Mus musculus
gagcggtgcaggttccatataacct

SEQ ID NO: 481672 - DNA, 25 bp, Mus musculus
gagcggtgtgctcagattctttccc

SEQ ID NO: 481673 - DNA, 25 bp, Mus musculus
gagcggtgtgctgagattctttccc

SEQ ID NO: 481674 - DNA, 25 bp, Mus musculus
gagcggtgtgttacaatagtttact

SEQ ID NO: 481675 - DNA, 25 bp, Mus musculus
gagcggtgtgtttcaatagtttact

SEQ ID NO: 481676 - DNA, 25 bp, Mus musculus
gagcggttgatgcaagttgaacagg

SEQ ID NO: 481677 - DNA, 25 bp, Mus musculus
gagcggttgatggaagttgaacagg

SEQ ID NO: 481678 - DNA, 25 bp, Mus musculus
gagcggtttcgaattcatggcccta

SEQ ID NO: 481679 - DNA, 25 bp, Mus musculus
gagcggtttcgatttcatggcccta

SEQ ID NO: 481680 - DNA, 25 bp, Mus musculus
gagcgtacacataaactgagctgtt

SEQ ID NO: 481681 - DNA, 25 bp, Mus musculus
gagcgtacacattaactgagctgtt

SEQ ID NO: 481682 - DNA, 25 bp, Mus musculus
gagcgtacgtaaccaaactgactta

SEQ ID NO: 481683 - DNA, 25 bp, Mus musculus
gagcgtacgtaagcaaactgactta

SEQ ID NO: 481684 - DNA, 25 bp, Mus musculus
gagcgtacgtttaattcctgattgt

SEQ ID NO: 481685 - DNA, 25 bp, Mus musculus
gagcgtacgttttattcctgattgt

SEQ ID NO: 481686 - DNA, 25 bp, Mus musculus
gagcgtacttatcccattgttctac

SEQ ID NO: 481687 - DNA, 25 bp, Mus musculus
gagcgtacttatgccattgttctac

SEQ ID NO: 481688 - DNA, 25 bp, Mus musculus
gagcgtactttcctgcactccagct

SEQ ID NO: 481689 - DNA, 25 bp, Mus musculus
gagcgtactttcgtgcactccagct

SEQ ID NO: 481690 - DNA, 25 bp, Mus musculus
gagcgtagctatcacttagtgcgta

SEQ ID NO: 481691 - DNA, 25 bp, Mus musculus
gagcgtagctatgacttagtgcgta

SEQ ID NO: 481692 - DNA, 25 bp, Mus musculus
gagcgtagtatcacgtgactccatt

SEQ ID NO: 481693 - DNA, 25 bp, Mus musculus
gagcgtagtatctcgtgactccatt

SEQ ID NO: 481694 - DNA, 25 bp, Mus musculus
gagcgtatgaaacatatgtgacatc

SEQ ID NO: 481695 - DNA, 25 bp, Mus musculus
gagcgtatgaaagatatgtgacatc

SEQ ID NO: 481696 - DNA, 25 bp, Mus musculus
gagcgtatggagagcacacttcaca

SEQ ID NO: 481697 - DNA, 25 bp, Mus musculus
gagcgtatggagtgcacacttcaca

SEQ ID NO: 481698 - DNA, 25 bp, Mus musculus
gagcgtattacacggcatggcaaga

SEQ ID NO: 481699 - DNA, 25 bp, Mus musculus
gagcgtattacagggcatggcaaga

SEQ ID NO: 481700 - DNA, 25 bp, Mus musculus
gagcgtattggaaaatccctgtgat

SEQ ID NO: 481701 - DNA, 25 bp, Mus musculus
gagcgtattggataatccctgtgat

SEQ ID NO: 481702 - DNA, 25 bp, Mus musculus
gagcgtatttgcagtcagaacctca

SEQ ID NO: 481703 - DNA, 25 bp, Mus musculus
gagcgtatttgctgtcagaacctca

SEQ ID NO: 481704 - DNA, 25 bp, Mus musculus
gagcgtcaagcaatcttttcctggt

SEQ ID NO: 481705 - DNA, 25 bp, Mus musculus
gagcgtcaagcattcttttcctggt

SEQ ID NO: 481706 - DNA, 25 bp, Mus musculus
gagcgtcaatatcatgtcatagcat

SEQ ID NO: 481707 - DNA, 25 bp, Mus musculus
gagcgtcaatatgatgtcatagcat

SEQ ID NO: 481708 - DNA, 25 bp, Mus musculus
gagcgtcactatccccagtatgatg

SEQ ID NO: 481709 - DNA, 25 bp, Mus musculus
gagcgtcactatgcccagtatgatg

SEQ ID NO: 481710 - DNA, 25 bp, Mus musculus
gagcgtcactggctgtcccagaaag

SEQ ID NO: 481711 - DNA, 25 bp, Mus musculus
gagcgtcactgggtgtcccagaaag

SEQ ID NO: 481712 - DNA, 25 bp, Mus musculus
gagcgtcagtaaaggctgctcgctt

SEQ ID NO: 481713 - DNA, 25 bp, Mus musculus
gagcgtcagtaatggctgctcgctt

SEQ ID NO: 481714 - DNA, 25 bp, Mus musculus
gagcgtcataaaataggttacctaa

SEQ ID NO: 481715 - DNA, 25 bp, Mus musculus
gagcgtcataaattaggttacctaa

SEQ ID NO: 481716 - DNA, 25 bp, Mus musculus
gagcgtcatgccatgatgcctataa

SEQ ID NO: 481717 - DNA, 25 bp, Mus musculus
gagcgtcatgccttgatgcctataa

SEQ ID NO: 481718 - DNA, 25 bp, Mus musculus
gagcgtccagttatatttatgccac

SEQ ID NO: 481719 - DNA, 25 bp, Mus musculus
gagcgtccagttttatttatgccac

SEQ ID NO: 481720 - DNA, 25 bp, Mus musculus
gagcgtccatttcgtcactctgcat

SEQ ID NO: 481721 - DNA, 25 bp, Mus musculus
gagcgtccatttggtcactctgcat

SEQ ID NO: 481722 - DNA, 25 bp, Mus musculus
gagcgtcccattaatttgcctcttt

SEQ ID NO: 481723 - DNA, 25 bp, Mus musculus
gagcgtcccatttatttgcctcttt

SEQ ID NO: 481724 - DNA, 25 bp, Mus musculus
gagcgtccccaaaacctgggatgca

SEQ ID NO: 481725 - DNA, 25 bp, Mus musculus
gagcgtccccaatacctgggatgca

SEQ ID NO: 481726 - DNA, 25 bp, Mus musculus
gagcgtccctggcattcgagagaca

SEQ ID NO: 481727 - DNA, 25 bp, Mus musculus
gagcgtccctgggattcgagagaca

SEQ ID NO: 481728 - DNA, 25 bp, Mus musculus
gagcgtcctcagaagtttaatctct

SEQ ID NO: 481729 - DNA, 25 bp, Mus musculus
gagcgtcctcagtagtttaatctct

SEQ ID NO: 481730 - DNA, 25 bp, Mus musculus
gagcgtcctgaaaagtaggaaacgg

SEQ ID NO: 481731 - DNA, 25 bp, Mus musculus
gagcgtcctgaatagtaggaaacgg

SEQ ID NO: 481732 - DNA, 25 bp, Mus musculus
gagcgtcctgcacaccgaggaaatg

SEQ ID NO: 481733 - DNA, 25 bp, Mus musculus
gagcgtcctgcagaccgaggaaatg

SEQ ID NO: 481734 - DNA, 25 bp, Mus musculus
gagcgtccttacacatagttcagtg

SEQ ID NO: 481735 - DNA, 25 bp, Mus musculus
gagcgtccttactcatagttcagtg

SEQ ID NO: 481736 - DNA, 25 bp, Mus musculus
gagcgtccttagatcggaagcccac

SEQ ID NO: 481737 - DNA, 25 bp, Mus musculus
gagcgtccttagttcggaagcccac

SEQ ID NO: 481738 - DNA, 25 bp, Mus musculus
gagcgtccttgcaaaggattccaag

SEQ ID NO: 481739 - DNA, 25 bp, Mus musculus
gagcgtccttgctaaggattccaag

SEQ ID NO: 481740 - DNA, 25 bp, Mus musculus
gagcgtcgatccaacagtgcagtaa

SEQ ID NO: 481741 - DNA, 25 bp, Mus musculus
gagcgtcgatcctacagtgcagtaa

SEQ ID NO: 481742 - DNA, 25 bp, Mus musculus
gagcgtcggtggactttcctggaaa

SEQ ID NO: 481743 - DNA, 25 bp, Mus musculus
gagcgtcggtggtctttcctggaaa

SEQ ID NO: 481744 - DNA, 25 bp, Mus musculus
gagcgtctcatacagttggtggacc

SEQ ID NO: 481745 - DNA, 25 bp, Mus musculus
gagcgtctcatagagttggtggacc

SEQ ID NO: 481746 - DNA, 25 bp, Mus musculus
gagcgtctccagaggttgtttcaaa

SEQ ID NO: 481747 - DNA, 25 bp, Mus musculus
gagcgtctccagatgatgatggctg

SEQ ID NO: 481748 - DNA, 25 bp, Mus musculus
gagcgtctccagtggttgtttcaaa

SEQ ID NO: 481749 - DNA, 25 bp, Mus musculus
gagcgtctccagttgatgatggctg

SEQ ID NO: 481750 - DNA, 25 bp, Mus musculus
gagcgtctcgaaagttccttggtgg

SEQ ID NO: 481751 - DNA, 25 bp, Mus musculus
gagcgtctcgaatgttccttggtgg

SEQ ID NO: 481752 - DNA, 25 bp, Mus musculus
gagcgtctctcaaaggttgggatcc

SEQ ID NO: 481753 - DNA, 25 bp, Mus musculus
gagcgtctctcataggttgggatcc

SEQ ID NO: 481754 - DNA, 25 bp, Mus musculus
gagcgtctgtctccaggaacctggt

SEQ ID NO: 481755 - DNA, 25 bp, Mus musculus
gagcgtctgtctgcaggaacctggt

SEQ ID NO: 481756 - DNA, 25 bp, Mus musculus
gagcgtgaaactcctacattagaat

SEQ ID NO: 481757 - DNA, 25 bp, Mus musculus
gagcgtgaaactgctacattagaat

SEQ ID NO: 481758 - DNA, 25 bp, Mus musculus
gagcgtgaagtgatctcctagtcag

SEQ ID NO: 481759 - DNA, 25 bp, Mus musculus
gagcgtgaagtgttctcctagtcag

SEQ ID NO: 481760 - DNA, 25 bp, Mus musculus
gagcgtgaccttcccatgttcaaca

SEQ ID NO: 481761 - DNA, 25 bp, Mus musculus
gagcgtgaccttgccatgttcaaca

SEQ ID NO: 481762 - DNA, 25 bp, Mus musculus
gagcgtgactttaacggagtgtttc

SEQ ID NO: 481763 - DNA, 25 bp, Mus musculus
gagcgtgacttttacggagtgtttc

SEQ ID NO: 481764 - DNA, 25 bp, Mus musculus
gagcgtgagactctgccacacacat

SEQ ID NO: 481765 - DNA, 25 bp, Mus musculus
gagcgtgagactgtgccacacacat

SEQ ID NO: 481766 - DNA, 25 bp, Mus musculus
gagcgtgagcatcacaacttcctgt

SEQ ID NO: 481767 - DNA, 25 bp, Mus musculus
gagcgtgagcatgacaacttcctgt

SEQ ID NO: 481768 - DNA, 25 bp, Mus musculus
gagcgtgagctgacagtaccatgtc

SEQ ID NO: 481769 - DNA, 25 bp, Mus musculus
gagcgtgagctgtcagtaccatgtc

SEQ ID NO: 481770 - DNA, 25 bp, Mus musculus
gagcgtgagcttcataacttgaaaa

SEQ ID NO: 481771 - DNA, 25 bp, Mus musculus
gagcgtgagcttgataacttgaaaa

SEQ ID NO: 481772 - DNA, 25 bp, Mus musculus
gagcgtgaggtgagtcatttctttc

SEQ ID NO: 481773 - DNA, 25 bp, Mus musculus
gagcgtgaggtgtgtcatttctttc

SEQ ID NO: 481774 - DNA, 25 bp, Mus musculus
gagcgtgatcatagttatccaatgg

SEQ ID NO: 481775 - DNA, 25 bp, Mus musculus
gagcgtgatcattgttatccaatgg

SEQ ID NO: 481776 - DNA, 25 bp, Mus musculus
gagcgtgcactcacgatgaaccaag

SEQ ID NO: 481777 - DNA, 25 bp, Mus musculus
gagcgtgcactctcgatgaaccaag

SEQ ID NO: 481778 - DNA, 25 bp, Mus musculus
gagcgtgccagcaccaagaagctgt

SEQ ID NO: 481779 - DNA, 25 bp, Mus musculus
gagcgtgccagctccaagaagctgt

SEQ ID NO: 481780 - DNA, 25 bp, Mus musculus
gagcgtgcctacattcccgagggac

SEQ ID NO: 481781 - DNA, 25 bp, Mus musculus
gagcgtgcctactttcccgagggac

SEQ ID NO: 481782 - DNA, 25 bp, Mus musculus
gagcgtgccttaaaagcgatcagtc

SEQ ID NO: 481783 - DNA, 25 bp, Mus musculus
gagcgtgccttataagcgatcagtc

SEQ ID NO: 481784 - DNA, 25 bp, Mus musculus
gagcgtgccttcagtagttttgtcc

SEQ ID NO: 481785 - DNA, 25 bp, Mus musculus
gagcgtgccttctgtagttttgtcc

SEQ ID NO: 481786 - DNA, 25 bp, Mus musculus
gagcgtgctgccaatcatgtgcaaa

SEQ ID NO: 481787 - DNA, 25 bp, Mus musculus
gagcgtgctgcctatcatgtgcaaa

SEQ ID NO: 481788 - DNA, 25 bp, Mus musculus
gagcgtgctgttccagaatacccat

SEQ ID NO: 481789 - DNA, 25 bp, Mus musculus
gagcgtgctgttgcagaatacccat

SEQ ID NO: 481790 - DNA, 25 bp, Mus musculus
gagcgtgcttagagacagggccaca

SEQ ID NO: 481791 - DNA, 25 bp, Mus musculus
gagcgtgcttagtgacagggccaca

SEQ ID NO: 481792 - DNA, 25 bp, Mus musculus
gagcgtggcctgcattttctccaag

SEQ ID NO: 481793 - DNA, 25 bp, Mus musculus
gagcgtggcctggattttctccaag

SEQ ID NO: 481794 - DNA, 25 bp, Mus musculus
gagcgtggctctaagtaagcaaggt

SEQ ID NO: 481795 - DNA, 25 bp, Mus musculus
gagcgtggctcttagtaagcaaggt

SEQ ID NO: 481796 - DNA, 25 bp, Mus musculus
gagcgtggctgtagctcccgcagaa

SEQ ID NO: 481797 - DNA, 25 bp, Mus musculus
gagcgtggctgttgctcccgcagaa

SEQ ID NO: 481798 - DNA, 25 bp, Mus musculus
gagcgtggcttcagcagcctggaca

SEQ ID NO: 481799 - DNA, 25 bp, Mus musculus
gagcgtggcttctgcagcctggaca

SEQ ID NO: 481800 - DNA, 25 bp, Mus musculus
gagcgtgggctaaagacttctgtgt

SEQ ID NO: 481801 - DNA, 25 bp, Mus musculus
gagcgtgggctatagacttctgtgt

SEQ ID NO: 481802 - DNA, 25 bp, Mus musculus
gagcgtggtagcaaacaggcagaca

SEQ ID NO: 481803 - DNA, 25 bp, Mus musculus
gagcgtggtagctaacaggcagaca

SEQ ID NO: 481804 - DNA, 25 bp, Mus musculus
gagcgtggtttgcttcagaactcca

SEQ ID NO: 481805 - DNA, 25 bp, Mus musculus
gagcgtggtttggttcagaactcca

SEQ ID NO: 481806 - DNA, 25 bp, Mus musculus
gagcgtgtatgtatctatcttgtct

SEQ ID NO: 481807 - DNA, 25 bp, Mus musculus
gagcgtgtatgtttctatcttgtct

SEQ ID NO: 481808 - DNA, 25 bp, Mus musculus
gagcgtgtatttcaattttcctgga

SEQ ID NO: 481809 - DNA, 25 bp, Mus musculus
gagcgtgtatttgaattttcctgga

SEQ ID NO: 481810 - DNA, 25 bp, Mus musculus
gagcgtgtctgactgcggatccact

SEQ ID NO: 481811 - DNA, 25 bp, Mus musculus
gagcgtgtctgagtgcggatccact

SEQ ID NO: 481812 - DNA, 25 bp, Mus musculus
gagcgtgtgaacattgctttcaact

SEQ ID NO: 481813 - DNA, 25 bp, Mus musculus
gagcgtgtgaactttgctttcaact

SEQ ID NO: 481814 - DNA, 25 bp, Mus musculus
gagcgtgtggcaccccagtgaacct

SEQ ID NO: 481815 - DNA, 25 bp, Mus musculus
gagcgtgtggcagcccagtgaacct

SEQ ID NO: 481816 - DNA, 25 bp, Mus musculus
gagcgtgtggttaagtttccagata

SEQ ID NO: 481817 - DNA, 25 bp, Mus musculus
gagcgtgtggtttagtttccagata

SEQ ID NO: 481818 - DNA, 25 bp, Mus musculus
gagcgtgtgtggaatacaatccaaa

SEQ ID NO: 481819 - DNA, 25 bp, Mus musculus
gagcgtgtgtggtatacaatccaaa

SEQ ID NO: 481820 - DNA, 25 bp, Mus musculus
gagcgtgttgtcaggcatagcctaa

SEQ ID NO: 481821 - DNA, 25 bp, Mus musculus
gagcgtgttgtctggcatagcctaa

SEQ ID NO: 481822 - DNA, 25 bp, Mus musculus
gagcgtgtttgtagaatgtcatcct

SEQ ID NO: 481823 - DNA, 25 bp, Mus musculus
gagcgtgtttgtatgctatcctgtc

SEQ ID NO: 481824 - DNA, 25 bp, Mus musculus
gagcgtgtttgttgaatgtcatcct

SEQ ID NO: 481825 - DNA, 25 bp, Mus musculus
gagcgtgtttgtttgctatcctgtc

SEQ ID NO: 481826 - DNA, 25 bp, Mus musculus
gagcgttaacataccttgaaacctt

SEQ ID NO: 481827 - DNA, 25 bp, Mus musculus
gagcgttaacattccttgaaacctt

SEQ ID NO: 481828 - DNA, 25 bp, Mus musculus
gagcgttaaccacaccttactaata

SEQ ID NO: 481829 - DNA, 25 bp, Mus musculus
gagcgttaaccagaccttactaata

SEQ ID NO: 481830 - DNA, 25 bp, Mus musculus
gagcgttaaggccttccaagtccga

SEQ ID NO: 481831 - DNA, 25 bp, Mus musculus
gagcgttaaggcgttccaagtccga

SEQ ID NO: 481832 - DNA, 25 bp, Mus musculus
gagcgttcacccacacttgcatcat

SEQ ID NO: 481833 - DNA, 25 bp, Mus musculus
gagcgttcaccctcacttgcatcat

SEQ ID NO: 481834 - DNA, 25 bp, Mus musculus
gagcgttcagtactatcaggtcttg

SEQ ID NO: 481835 - DNA, 25 bp, Mus musculus
gagcgttcagtagtatcaggtcttg

SEQ ID NO: 481836 - DNA, 25 bp, Mus musculus
gagcgttcctttccttgcagaggga

SEQ ID NO: 481837 - DNA, 25 bp, Mus musculus
gagcgttcctttgcttgcagaggga

SEQ ID NO: 481838 - DNA, 25 bp, Mus musculus
gagcgttctcatacatttatgcagc

SEQ ID NO: 481839 - DNA, 25 bp, Mus musculus
gagcgttctcattcatttatgcagc

SEQ ID NO: 481840 - DNA, 25 bp, Mus musculus
gagcgttctcctagcaagagggtgt

SEQ ID NO: 481841 - DNA, 25 bp, Mus musculus
gagcgttctccttgcaagagggtgt

SEQ ID NO: 481842 - DNA, 25 bp, Mus musculus
gagcgttcttggagaaggcccactg

SEQ ID NO: 481843 - DNA, 25 bp, Mus musculus
gagcgttcttggtgaaggcccactg

SEQ ID NO: 481844 - DNA, 25 bp, Mus musculus
gagcgttcttgtcaagctgacattt

SEQ ID NO: 481845 - DNA, 25 bp, Mus musculus
gagcgttcttgtgaagctgacattt

SEQ ID NO: 481846 - DNA, 25 bp, Mus musculus
gagcgttgtcctatctatcatagca

SEQ ID NO: 481847 - DNA, 25 bp, Mus musculus
gagcgttgtcctttctatcatagca

SEQ ID NO: 481848 - DNA, 25 bp, Mus musculus
gagcgtttaaggctctagtcacact

SEQ ID NO: 481849 - DNA, 25 bp, Mus musculus
gagcgtttaagggtctagtcacact

SEQ ID NO: 481850 - DNA, 25 bp, Mus musculus
gagcgtttcagaacaacacctttaa

SEQ ID NO: 481851 - DNA, 25 bp, Mus musculus
gagcgtttcagactttcatacggaa

SEQ ID NO: 481852 - DNA, 25 bp, Mus musculus
gagcgtttcagagtttcatacggaa

SEQ ID NO: 481853 - DNA, 25 bp, Mus musculus
gagcgtttcagatcaacacctttaa

SEQ ID NO: 481854 - DNA, 25 bp, Mus musculus
gagcgtttctgtccagctactaccg

SEQ ID NO: 481855 - DNA, 25 bp, Mus musculus
gagcgtttctgtgcagctactaccg

SEQ ID NO: 481856 - DNA, 25 bp, Mus musculus
gagcgtttgaatccttattgctatc

SEQ ID NO: 481857 - DNA, 25 bp, Mus musculus
gagcgtttgaatgcttattgctatc

SEQ ID NO: 481858 - DNA, 25 bp, Mus musculus
gagcgtttgtcaccattcatcattg

SEQ ID NO: 481859 - DNA, 25 bp, Mus musculus
gagcgtttgtcagcattcatcattg

SEQ ID NO: 481860 - DNA, 25 bp, Mus musculus
gagcgttttttcacagatctgcatt

SEQ ID NO: 481861 - DNA, 25 bp, Mus musculus
gagcgttttttctcagatctgcatt

SEQ ID NO: 481862 - DNA, 25 bp, Mus musculus
gagctaaaacagcagggcaccacaa

SEQ ID NO: 481863 - DNA, 25 bp, Mus musculus
gagctaaaacaggagggcaccacaa

SEQ ID NO: 481864 - DNA, 25 bp, Mus musculus
gagctaaaacgaccgcggatccgag

SEQ ID NO: 481865 - DNA, 25 bp, Mus musculus
gagctaaaacgagcgcggatccgag

SEQ ID NO: 481866 - DNA, 25 bp, Mus musculus
gagctaaaacttctacatcttcatt

SEQ ID NO: 481867 - DNA, 25 bp, Mus musculus
gagctaaaacttgtacatcttcatt

SEQ ID NO: 481868 - DNA, 25 bp, Mus musculus
gagctaaaagccaaggccgccggga

SEQ ID NO: 481869 - DNA, 25 bp, Mus musculus
gagctaaaagcctaggccgccggga

SEQ ID NO: 481870 - DNA, 25 bp, Mus musculus
gagctaaaaggaacgctttcctgcg

SEQ ID NO: 481871 - DNA, 25 bp, Mus musculus
gagctaaaaggatcgctttcctgcg

SEQ ID NO: 481872 - DNA, 25 bp, Mus musculus
gagctaaaagtcatgttcgagtttt

SEQ ID NO: 481873 - DNA, 25 bp, Mus musculus
gagctaaaagtcttgttcgagtttt

SEQ ID NO: 481874 - DNA, 25 bp, Mus musculus
gagctaaaatccacctgtacagaaa

SEQ ID NO: 481875 - DNA, 25 bp, Mus musculus
gagctaaaatcctcctgtacagaaa

SEQ ID NO: 481876 - DNA, 25 bp, Mus musculus
gagctaaacacacccagtttgagga

SEQ ID NO: 481877 - DNA, 25 bp, Mus musculus
gagctaaacacagccagtttgagga

SEQ ID NO: 481878 - DNA, 25 bp, Mus musculus
gagctaaacagacggtcattcggat

SEQ ID NO: 481879 - DNA, 25 bp, Mus musculus
gagctaaacagagggtcattcggat

SEQ ID NO: 481880 - DNA, 25 bp, Mus musculus
gagctaaacgctcacgttgtaaaga

SEQ ID NO: 481881 - DNA, 25 bp, Mus musculus
gagctaaacgctgacgttgtaaaga

SEQ ID NO: 481882 - DNA, 25 bp, Mus musculus
gagctaaactacaagaacactgaac

SEQ ID NO: 481883 - DNA, 25 bp, Mus musculus
gagctaaactactagaacactgaac

SEQ ID NO: 481884 - DNA, 25 bp, Mus musculus
gagctaaagccccaaccccaagatt

SEQ ID NO: 481885 - DNA, 25 bp, Mus musculus
gagctaaagcccgaaccccaagatt

SEQ ID NO: 481886 - DNA, 25 bp, Mus musculus
gagctaaagtatagcccatcttcct

SEQ ID NO: 481887 - DNA, 25 bp, Mus musculus
gagctaaagtattgcccatcttcct

SEQ ID NO: 481888 - DNA, 25 bp, Mus musculus
gagctaaagtgaagcttgtggatct

SEQ ID NO: 481889 - DNA, 25 bp, Mus musculus
gagctaaagtgatgcttgtggatct

SEQ ID NO: 481890 - DNA, 25 bp, Mus musculus
gagctaaatgagatgttcaaacctg

SEQ ID NO: 481891 - DNA, 25 bp, Mus musculus
gagctaaatgagttgttcaaacctg

SEQ ID NO: 481892 - DNA, 25 bp, Mus musculus
gagctaaatgtcaagccccagttat

SEQ ID NO: 481893 - DNA, 25 bp, Mus musculus
gagctaaatgtctagccccagttat

SEQ ID NO: 481894 - DNA, 25 bp, Mus musculus
gagctaacatcacgactgctggatt

SEQ ID NO: 481895 - DNA, 25 bp, Mus musculus
gagctaacatcaggactgctggatt

SEQ ID NO: 481896 - DNA, 25 bp, Mus musculus
gagctaacatctcatggactctcct

SEQ ID NO: 481897 - DNA, 25 bp, Mus musculus
gagctaacatctgatggactctcct

SEQ ID NO: 481898 - DNA, 25 bp, Mus musculus
gagctaacatgtctccctaaacttt

SEQ ID NO: 481899 - DNA, 25 bp, Mus musculus
gagctaacatgtgtccctaaacttt

SEQ ID NO: 481900 - DNA, 25 bp, Mus musculus
gagctaacctggacacttcagacct

SEQ ID NO: 481901 - DNA, 25 bp, Mus musculus
gagctaacctggcaaaggtttgtgt

SEQ ID NO: 481902 - DNA, 25 bp, Mus musculus
gagctaacctgggaaaggtttgtgt

SEQ ID NO: 481903 - DNA, 25 bp, Mus musculus
gagctaacctggtcacttcagacct

SEQ ID NO: 481904 - DNA, 25 bp, Mus musculus
gagctaacgaggatgactgcctcct

SEQ ID NO: 481905 - DNA, 25 bp, Mus musculus
gagctaacgaggttgactgcctcct

SEQ ID NO: 481906 - DNA, 25 bp, Mus musculus
gagctaactaacatccagggttaca

SEQ ID NO: 481907 - DNA, 25 bp, Mus musculus
gagctaactaacttccagggttaca

SEQ ID NO: 481908 - DNA, 25 bp, Mus musculus
gagctaactaggcacacagccagta

SEQ ID NO: 481909 - DNA, 25 bp, Mus musculus
gagctaactagggacacagccagta

SEQ ID NO: 481910 - DNA, 25 bp, Mus musculus
gagctaactcagaagcgcctcgagg

SEQ ID NO: 481911 - DNA, 25 bp, Mus musculus
gagctaactcagtagcgcctcgagg

SEQ ID NO: 481912 - DNA, 25 bp, Mus musculus
gagctaactcgcagcaagctaccaa

SEQ ID NO: 481913 - DNA, 25 bp, Mus musculus
gagctaactcgctgcaagctaccaa

SEQ ID NO: 481914 - DNA, 25 bp, Mus musculus
gagctaactttcagtgaggcccttg

SEQ ID NO: 481915 - DNA, 25 bp, Mus musculus
gagctaactttctgtgaggcccttg

SEQ ID NO: 481916 - DNA, 25 bp, Mus musculus
gagctaagaatgctctctatgtttc

SEQ ID NO: 481917 - DNA, 25 bp, Mus musculus
gagctaagaatggtctctatgtttc

SEQ ID NO: 481918 - DNA, 25 bp, Mus musculus
gagctaagacatactttccctggaa

SEQ ID NO: 481919 - DNA, 25 bp, Mus musculus
gagctaagacatatccagtggcacc

SEQ ID NO: 481920 - DNA, 25 bp, Mus musculus
gagctaagacattctttccctggaa

SEQ ID NO: 481921 - DNA, 25 bp, Mus musculus
gagctaagacatttccagtggcacc

SEQ ID NO: 481922 - DNA, 25 bp, Mus musculus
gagctaagaccaacagagtttttct

SEQ ID NO: 481923 - DNA, 25 bp, Mus musculus
gagctaagaccatcagagtttttct

SEQ ID NO: 481924 - DNA, 25 bp, Mus musculus
gagctaagactgacgtacctcctca

SEQ ID NO: 481925 - DNA, 25 bp, Mus musculus
gagctaagactgtcgtacctcctca

SEQ ID NO: 481926 - DNA, 25 bp, Mus musculus
gagctaagatctctcagtgagccca

SEQ ID NO: 481927 - DNA, 25 bp, Mus musculus
gagctaagatctgtcagtgagccca

SEQ ID NO: 481928 - DNA, 25 bp, Mus musculus
gagctaagcataattttcctttgtg

SEQ ID NO: 481929 - DNA, 25 bp, Mus musculus
gagctaagcatatttttcctttgtg

SEQ ID NO: 481930 - DNA, 25 bp, Mus musculus
gagctaagcctgaagttgttctgca

SEQ ID NO: 481931 - DNA, 25 bp, Mus musculus
gagctaagcctgtagttgttctgca

SEQ ID NO: 481932 - DNA, 25 bp, Mus musculus
gagctaagcgttaggaagaaattcc

SEQ ID NO: 481933 - DNA, 25 bp, Mus musculus
gagctaagcgtttggaagaaattcc

SEQ ID NO: 481934 - DNA, 25 bp, Mus musculus
gagctaaggaccaagtgcgttccaa

SEQ ID NO: 481935 - DNA, 25 bp, Mus musculus
gagctaaggacctagtgcgttccaa

SEQ ID NO: 481936 - DNA, 25 bp, Mus musculus
gagctaagtgacactttaaagaagc

SEQ ID NO: 481937 - DNA, 25 bp, Mus musculus
gagctaagtgactctttaaagaagc

SEQ ID NO: 481938 - DNA, 25 bp, Mus musculus
gagctaagtgggatcagcaccacgt

SEQ ID NO: 481939 - DNA, 25 bp, Mus musculus
gagctaagtgggttcagcaccacgt

SEQ ID NO: 481940 - DNA, 25 bp, Mus musculus
gagctaagttttatacttcagtcac

SEQ ID NO: 481941 - DNA, 25 bp, Mus musculus
gagctaagttttttacttcagtcac

SEQ ID NO: 481942 - DNA, 25 bp, Mus musculus
gagctaatacccagttgcttaagtt

SEQ ID NO: 481943 - DNA, 25 bp, Mus musculus
gagctaataccctgttgcttaagtt

SEQ ID NO: 481944 - DNA, 25 bp, Mus musculus
gagctaatactgcattctccgtctt

SEQ ID NO: 481945 - DNA, 25 bp, Mus musculus
gagctaatactggattctccgtctt

SEQ ID NO: 481946 - DNA, 25 bp, Mus musculus
gagctaataggaatttgtacccaga

SEQ ID NO: 481947 - DNA, 25 bp, Mus musculus
gagctaataggattttgtacccaga

SEQ ID NO: 481948 - DNA, 25 bp, Mus musculus
gagctaatatttacccaagactttt

SEQ ID NO: 481949 - DNA, 25 bp, Mus musculus
gagctaatattttcccaagactttt

SEQ ID NO: 481950 - DNA, 25 bp, Mus musculus
gagctaatcacaccctgtctttgga

SEQ ID NO: 481951 - DNA, 25 bp, Mus musculus
gagctaatcacagcctgtctttgga

SEQ ID NO: 481952 - DNA, 25 bp, Mus musculus
gagctaatctctcctgtgttggcac

SEQ ID NO: 481953 - DNA, 25 bp, Mus musculus
gagctaatctctgctgtgttggcac

SEQ ID NO: 481954 - DNA, 25 bp, Mus musculus
gagctaatggcaaaccctgtactgg

SEQ ID NO: 481955 - DNA, 25 bp, Mus musculus
gagctaatggcataccctgtactgg

SEQ ID NO: 481956 - DNA, 25 bp, Mus musculus
gagctaatgttacttcaaatcttct

SEQ ID NO: 481957 - DNA, 25 bp, Mus musculus
gagctaatgttagttcaaatcttct

SEQ ID NO: 481958 - DNA, 25 bp, Mus musculus
gagctaattattacgggtgttctaa

SEQ ID NO: 481959 - DNA, 25 bp, Mus musculus
gagctaattatttcgggtgttctaa

SEQ ID NO: 481960 - DNA, 25 bp, Mus musculus
gagctaattcgaagactgcactgat

SEQ ID NO: 481961 - DNA, 25 bp, Mus musculus
gagctaattcgatgactgcactgat

SEQ ID NO: 481962 - DNA, 25 bp, Mus musculus
gagctacaagcaatccattgcagcc

SEQ ID NO: 481963 - DNA, 25 bp, Mus musculus
gagctacaagcattccattgcagcc

SEQ ID NO: 481964 - DNA, 25 bp, Mus musculus
gagctacaagcccagtcacaaggaa

SEQ ID NO: 481965 - DNA, 25 bp, Mus musculus
gagctacaagccgagtcacaaggaa

SEQ ID NO: 481966 - DNA, 25 bp, Mus musculus
gagctacaatggctcactctttccc

SEQ ID NO: 481967 - DNA, 25 bp, Mus musculus
gagctacaatgggtcactctttccc

SEQ ID NO: 481968 - DNA, 25 bp, Mus musculus
gagctacacaagagctatgtgcatc

SEQ ID NO: 481969 - DNA, 25 bp, Mus musculus
gagctacacaagtgctatgtgcatc

SEQ ID NO: 481970 - DNA, 25 bp, Mus musculus
gagctacacactcgtttggtctaca

SEQ ID NO: 481971 - DNA, 25 bp, Mus musculus
gagctacacactggtttggtctaca

SEQ ID NO: 481972 - DNA, 25 bp, Mus musculus
gagctacacattaacatccgagaga

SEQ ID NO: 481973 - DNA, 25 bp, Mus musculus
gagctacacattatgaccctgtttt

SEQ ID NO: 481974 - DNA, 25 bp, Mus musculus
gagctacacatttacatccgagaga

SEQ ID NO: 481975 - DNA, 25 bp, Mus musculus
gagctacacattttgaccctgtttt

SEQ ID NO: 481976 - DNA, 25 bp, Mus musculus
gagctacaccagcagttactgggta

SEQ ID NO: 481977 - DNA, 25 bp, Mus musculus
gagctacaccaggagttactgggta

SEQ ID NO: 481978 - DNA, 25 bp, Mus musculus
gagctacaccttcactttgttttga

SEQ ID NO: 481979 - DNA, 25 bp, Mus musculus
gagctacaccttgactttgttttga

SEQ ID NO: 481980 - DNA, 25 bp, Mus musculus
gagctacacgaacgactccagcatg

SEQ ID NO: 481981 - DNA, 25 bp, Mus musculus
gagctacacgaaggactccagcatg

SEQ ID NO: 481982 - DNA, 25 bp, Mus musculus
gagctacagcccagaatagttacgc

SEQ ID NO: 481983 - DNA, 25 bp, Mus musculus
gagctacagccctgaatagttacgc

SEQ ID NO: 481984 - DNA, 25 bp, Mus musculus
gagctacagcgaaccaaccctatct

SEQ ID NO: 481985 - DNA, 25 bp, Mus musculus
gagctacagcgatccaaccctatct

SEQ ID NO: 481986 - DNA, 25 bp, Mus musculus
gagctacagcgtctctttgaaacag

SEQ ID NO: 481987 - DNA, 25 bp, Mus musculus
gagctacagcgtgtctttgaaacag

SEQ ID NO: 481988 - DNA, 25 bp, Mus musculus
gagctacaggatccagctgtgagca

SEQ ID NO: 481989 - DNA, 25 bp, Mus musculus
gagctacaggatgcagctgtgagca

SEQ ID NO: 481990 - DNA, 25 bp, Mus musculus
gagctacaggcactgaattctgtca

SEQ ID NO: 481991 - DNA, 25 bp, Mus musculus
gagctacaggcagtgaattctgtca

SEQ ID NO: 481992 - DNA, 25 bp, Mus musculus
gagctacaggtgagctttgctgaca

SEQ ID NO: 481993 - DNA, 25 bp, Mus musculus
gagctacaggtgtgctttgctgaca

SEQ ID NO: 481994 - DNA, 25 bp, Mus musculus
gagctacagtgcagaagtatgccag

SEQ ID NO: 481995 - DNA, 25 bp, Mus musculus
gagctacagtgctgaagtatgccag

SEQ ID NO: 481996 - DNA, 25 bp, Mus musculus
gagctacataacaaaaccctattca

SEQ ID NO: 481997 - DNA, 25 bp, Mus musculus
gagctacataactaaaccctattca

SEQ ID NO: 481998 - DNA, 25 bp, Mus musculus
gagctacatggaacactactgcaat

SEQ ID NO: 481999 - DNA, 25 bp, Mus musculus
gagctacatggatcactactgcaat

SEQ ID NO: 482000 - DNA, 25 bp, Mus musculus
gagctacatggcaggtccccaagtg

SEQ ID NO: 482001 - DNA, 25 bp, Mus musculus
gagctacatggctggtccccaagtg

SEQ ID NO: 482002 - DNA, 25 bp, Mus musculus
gagctaccacatataaaccttacct

SEQ ID NO: 482003 - DNA, 25 bp, Mus musculus
gagctaccacatttaaaccttacct

SEQ ID NO: 482004 - DNA, 25 bp, Mus musculus
gagctaccagtaagacatgtgtcta

SEQ ID NO: 482005 - DNA, 25 bp, Mus musculus
gagctaccagtatgacatgtgtcta

SEQ ID NO: 482006 - DNA, 25 bp, Mus musculus
gagctaccagtgagctacgtgtcca

SEQ ID NO: 482007 - DNA, 25 bp, Mus musculus
gagctaccagtgcacaagaaggtct

SEQ ID NO: 482008 - DNA, 25 bp, Mus musculus
gagctaccagtggacaagaaggtct

SEQ ID NO: 482009 - DNA, 25 bp, Mus musculus
gagctaccagtgtgctacgtgtcca

SEQ ID NO: 482010 - DNA, 25 bp, Mus musculus
gagctaccatacaattttttgacat

SEQ ID NO: 482011 - DNA, 25 bp, Mus musculus
gagctaccatactattttttgacat

SEQ ID NO: 482012 - DNA, 25 bp, Mus musculus
gagctaccatgtactgatgagtccc

SEQ ID NO: 482013 - DNA, 25 bp, Mus musculus
gagctaccatgttctgatgagtccc

SEQ ID NO: 482014 - DNA, 25 bp, Mus musculus
gagctacccagaaaactttcttcat

SEQ ID NO: 482015 - DNA, 25 bp, Mus musculus
gagctacccagataactttcttcat

SEQ ID NO: 482016 - DNA, 25 bp, Mus musculus
gagctacccctgcatgatgaagtca

SEQ ID NO: 482017 - DNA, 25 bp, Mus musculus
gagctacccctggatgatgaagtca

SEQ ID NO: 482018 - DNA, 25 bp, Mus musculus
gagctacccgagacccttggcttag

SEQ ID NO: 482019 - DNA, 25 bp, Mus musculus
gagctacccgagtcccttggcttag

SEQ ID NO: 482020 - DNA, 25 bp, Mus musculus
gagctaccgaaaatgaattggctaa

SEQ ID NO: 482021 - DNA, 25 bp, Mus musculus
gagctaccgaaattgaattggctaa

SEQ ID NO: 482022 - DNA, 25 bp, Mus musculus
gagctaccggtaagccacattacaa

SEQ ID NO: 482023 - DNA, 25 bp, Mus musculus
gagctaccggtatgccacattacaa

SEQ ID NO: 482024 - DNA, 25 bp, Mus musculus
gagctacctatgcagctgaccatga

SEQ ID NO: 482025 - DNA, 25 bp, Mus musculus
gagctacctatggagctgaccatga

SEQ ID NO: 482026 - DNA, 25 bp, Mus musculus
gagctacctgaacaagatcctcggg

SEQ ID NO: 482027 - DNA, 25 bp, Mus musculus
gagctacctgaagaagatcctcggg

SEQ ID NO: 482028 - DNA, 25 bp, Mus musculus
gagctacctggacactttggcagat

SEQ ID NO: 482029 - DNA, 25 bp, Mus musculus
gagctacctggactctttattagaa

SEQ ID NO: 482030 - DNA, 25 bp, Mus musculus
gagctacctggagactttggcagat

SEQ ID NO: 482031 - DNA, 25 bp, Mus musculus
gagctacctggagtctttattagaa

SEQ ID NO: 482032 - DNA, 25 bp, Mus musculus
gagctacctggcaagattttgaccg

SEQ ID NO: 482033 - DNA, 25 bp, Mus musculus
gagctacctggctagattttgaccg

SEQ ID NO: 482034 - DNA, 25 bp, Mus musculus
gagctacctgtacaaaccatgccca

SEQ ID NO: 482035 - DNA, 25 bp, Mus musculus
gagctacctgtacccaggcatgaca

SEQ ID NO: 482036 - DNA, 25 bp, Mus musculus
gagctacctgtagaaaccatgccca

SEQ ID NO: 482037 - DNA, 25 bp, Mus musculus
gagctacctgtagccaggcatgaca

SEQ ID NO: 482038 - DNA, 25 bp, Mus musculus
gagctacctgtgcaagtgaacccgt

SEQ ID NO: 482039 - DNA, 25 bp, Mus musculus
gagctacctgtggaagtgaacccgt

SEQ ID NO: 482040 - DNA, 25 bp, Mus musculus
gagctaccttcccagtcctatgaaa

SEQ ID NO: 482041 - DNA, 25 bp, Mus musculus
gagctaccttccgagtcctatgaaa

SEQ ID NO: 482042 - DNA, 25 bp, Mus musculus
gagctaccttgaatcctatggcgat

SEQ ID NO: 482043 - DNA, 25 bp, Mus musculus
gagctaccttgattcctatggcgat

SEQ ID NO: 482044 - DNA, 25 bp, Mus musculus
gagctacggataccatcaaattaat

SEQ ID NO: 482045 - DNA, 25 bp, Mus musculus
gagctacggatagcatcaaattaat

SEQ ID NO: 482046 - DNA, 25 bp, Mus musculus
gagctacgggtcatagcttaggaca

SEQ ID NO: 482047 - DNA, 25 bp, Mus musculus
gagctacgggtcttagcttaggaca

SEQ ID NO: 482048 - DNA, 25 bp, Mus musculus
gagctacggtatctgagcagcccaa

SEQ ID NO: 482049 - DNA, 25 bp, Mus musculus
gagctacggtatgtgagcagcccaa

SEQ ID NO: 482050 - DNA, 25 bp, Mus musculus
gagctacgtcatctggatcatcatc

SEQ ID NO: 482051 - DNA, 25 bp, Mus musculus
gagctacgtcatgtggatcatcatc

SEQ ID NO: 482052 - DNA, 25 bp, Mus musculus
gagctactaatcacgtacacggttg

SEQ ID NO: 482053 - DNA, 25 bp, Mus musculus
gagctactaatctcgtacacggttg

SEQ ID NO: 482054 - DNA, 25 bp, Mus musculus
gagctactatagaggagctgcaggt

SEQ ID NO: 482055 - DNA, 25 bp, Mus musculus
gagctactatagtggagctgcaggt

SEQ ID NO: 482056 - DNA, 25 bp, Mus musculus
gagctactcgtgagcaattatgtgt

SEQ ID NO: 482057 - DNA, 25 bp, Mus musculus
gagctactcgtgtgcaattatgtgt

SEQ ID NO: 482058 - DNA, 25 bp, Mus musculus
gagctactcgttctgagaactcaag

SEQ ID NO: 482059 - DNA, 25 bp, Mus musculus
gagctactcgttgtgagaactcaag

SEQ ID NO: 482060 - DNA, 25 bp, Mus musculus
gagctactgaagatctcttctctgt

SEQ ID NO: 482061 - DNA, 25 bp, Mus musculus
gagctactgaagcaagaatccccag

SEQ ID NO: 482062 - DNA, 25 bp, Mus musculus
gagctactgaagctttacacactca

SEQ ID NO: 482063 - DNA, 25 bp, Mus musculus
gagctactgaaggaagaatccccag

SEQ ID NO: 482064 - DNA, 25 bp, Mus musculus
gagctactgaaggtttacacactca

SEQ ID NO: 482065 - DNA, 25 bp, Mus musculus
gagctactgaagttctcttctctgt

SEQ ID NO: 482066 - DNA, 25 bp, Mus musculus
gagctactgaatcaagactctccac

SEQ ID NO: 482067 - DNA, 25 bp, Mus musculus
gagctactgaatgaagactctccac

SEQ ID NO: 482068 - DNA, 25 bp, Mus musculus
gagctactgatcatggcccaagaac

SEQ ID NO: 482069 - DNA, 25 bp, Mus musculus
gagctactgatcttggcccaagaac

SEQ ID NO: 482070 - DNA, 25 bp, Mus musculus
gagctactgctcatctgggcataca

SEQ ID NO: 482071 - DNA, 25 bp, Mus musculus
gagctactgctcttctgggcataca

SEQ ID NO: 482072 - DNA, 25 bp, Mus musculus
gagctactggaacccagatcctggt

SEQ ID NO: 482073 - DNA, 25 bp, Mus musculus
gagctactggaagccagatcctggt

SEQ ID NO: 482074 - DNA, 25 bp, Mus musculus
gagctactggagactgcctgtgaga

SEQ ID NO: 482075 - DNA, 25 bp, Mus musculus
gagctactggagtctgcctgtgaga

SEQ ID NO: 482076 - DNA, 25 bp, Mus musculus
gagctacttaggcagggtcagactt

SEQ ID NO: 482077 - DNA, 25 bp, Mus musculus
gagctacttagggagggtcagactt

SEQ ID NO: 482078 - DNA, 25 bp, Mus musculus
gagctactttagaccctgccttgaa

SEQ ID NO: 482079 - DNA, 25 bp, Mus musculus
gagctactttagtccctgccttgaa

SEQ ID NO: 482080 - DNA, 25 bp, Mus musculus
gagctactttggcattcatctttca

SEQ ID NO: 482081 - DNA, 25 bp, Mus musculus
gagctactttgggattcatctttca

SEQ ID NO: 482082 - DNA, 25 bp, Mus musculus
gagctactttgtactatataatatt

SEQ ID NO: 482083 - DNA, 25 bp, Mus musculus
gagctactttgttctatataatatt

SEQ ID NO: 482084 - DNA, 25 bp, Mus musculus
gagctagaaataattggatccttca

SEQ ID NO: 482085 - DNA, 25 bp, Mus musculus
gagctagaaatatttggatccttca

SEQ ID NO: 482086 - DNA, 25 bp, Mus musculus
gagctagaacagacgcgcctggcca

SEQ ID NO: 482087 - DNA, 25 bp, Mus musculus
gagctagaacagtcgcgcctggcca

SEQ ID NO: 482088 - DNA, 25 bp, Mus musculus
gagctagaacatagtagatcatcac

SEQ ID NO: 482089 - DNA, 25 bp, Mus musculus
gagctagaacattgtagatcatcac

SEQ ID NO: 482090 - DNA, 25 bp, Mus musculus
gagctagaagatatcaccgtcaccg

SEQ ID NO: 482091 - DNA, 25 bp, Mus musculus
gagctagaagatttcaccgtcaccg

SEQ ID NO: 482092 - DNA, 25 bp, Mus musculus
gagctagacaagcacttcttgctgt

SEQ ID NO: 482093 - DNA, 25 bp, Mus musculus
gagctagacaaggacttcttgctgt

SEQ ID NO: 482094 - DNA, 25 bp, Mus musculus
gagctagacacccaaccagaaatga

SEQ ID NO: 482095 - DNA, 25 bp, Mus musculus
gagctagacaccgaaccagaaatga

SEQ ID NO: 482096 - DNA, 25 bp, Mus musculus
gagctagacattacattccatagat

SEQ ID NO: 482097 - DNA, 25 bp, Mus musculus
gagctagacatttcattccatagat

SEQ ID NO: 482098 - DNA, 25 bp, Mus musculus
gagctagacgagaccctgtcggaga

SEQ ID NO: 482099 - DNA, 25 bp, Mus musculus
gagctagacgagtccctgtcggaga

SEQ ID NO: 482100 - DNA, 25 bp, Mus musculus
gagctagagagccagaaatccagag

SEQ ID NO: 482101 - DNA, 25 bp, Mus musculus
gagctagagagcgagaaatccagag

SEQ ID NO: 482102 - DNA, 25 bp, Mus musculus
gagctagagaggagtctcagtgtta

SEQ ID NO: 482103 - DNA, 25 bp, Mus musculus
gagctagagaggtgtctcagtgtta

SEQ ID NO: 482104 - DNA, 25 bp, Mus musculus
gagctagagccaaattctcagtgta

SEQ ID NO: 482105 - DNA, 25 bp, Mus musculus
gagctagagccatattctcagtgta

SEQ ID NO: 482106 - DNA, 25 bp, Mus musculus
gagctagagtcgcagaatgccccag

SEQ ID NO: 482107 - DNA, 25 bp, Mus musculus
gagctagagtcggagaatgccccag

SEQ ID NO: 482108 - DNA, 25 bp, Mus musculus
gagctagagtttacactattgggtg

SEQ ID NO: 482109 - DNA, 25 bp, Mus musculus
gagctagagttttcactattgggtg

SEQ ID NO: 482110 - DNA, 25 bp, Mus musculus
gagctagcaaagcattgcccaccat

SEQ ID NO: 482111 - DNA, 25 bp, Mus musculus
gagctagcaaaggattgcccaccat

SEQ ID NO: 482112 - DNA, 25 bp, Mus musculus
gagctagcaaccagcaatgagggca

SEQ ID NO: 482113 - DNA, 25 bp, Mus musculus
gagctagcaacctgcaatgagggca

SEQ ID NO: 482114 - DNA, 25 bp, Mus musculus
gagctagcaagcaagattcattcaa

SEQ ID NO: 482115 - DNA, 25 bp, Mus musculus
gagctagcaagctagattcattcaa

SEQ ID NO: 482116 - DNA, 25 bp, Mus musculus
gagctagcactaaacacactttgga

SEQ ID NO: 482117 - DNA, 25 bp, Mus musculus
gagctagcactatacacactttgga

SEQ ID NO: 482118 - DNA, 25 bp, Mus musculus
gagctagcactgaacaggtttgaac

SEQ ID NO: 482119 - DNA, 25 bp, Mus musculus
gagctagcactgtacaggtttgaac

SEQ ID NO: 482120 - DNA, 25 bp, Mus musculus
gagctagcagctaccttatttgaaa

SEQ ID NO: 482121 - DNA, 25 bp, Mus musculus
gagctagcagcttccttatttgaaa

SEQ ID NO: 482122 - DNA, 25 bp, Mus musculus
gagctagcatggactgttcactttt

SEQ ID NO: 482123 - DNA, 25 bp, Mus musculus
gagctagcatggtctgttcactttt

SEQ ID NO: 482124 - DNA, 25 bp, Mus musculus
gagctagcatgtatctacaagtgta

SEQ ID NO: 482125 - DNA, 25 bp, Mus musculus
gagctagcatgtttctacaagtgta

SEQ ID NO: 482126 - DNA, 25 bp, Mus musculus
gagctagcctcaattgactccttct

SEQ ID NO: 482127 - DNA, 25 bp, Mus musculus
gagctagcctcatttgactccttct

SEQ ID NO: 482128 - DNA, 25 bp, Mus musculus
gagctagccttcatgctgtggcccg

SEQ ID NO: 482129 - DNA, 25 bp, Mus musculus
gagctagccttcttgctgtggcccg

SEQ ID NO: 482130 - DNA, 25 bp, Mus musculus
gagctagccttgcagagacttaaag

SEQ ID NO: 482131 - DNA, 25 bp, Mus musculus
gagctagccttggagagacttaaag

SEQ ID NO: 482132 - DNA, 25 bp, Mus musculus
gagctagcgattagtaaacagcctg

SEQ ID NO: 482133 - DNA, 25 bp, Mus musculus
gagctagcgatttgtaaacagcctg

SEQ ID NO: 482134 - DNA, 25 bp, Mus musculus
gagctagcgttgacttcatgttcac

SEQ ID NO: 482135 - DNA, 25 bp, Mus musculus
gagctagcgttgtcttcatgttcac

SEQ ID NO: 482136 - DNA, 25 bp, Mus musculus
gagctagctaccaacacaagagtct

SEQ ID NO: 482137 - DNA, 25 bp, Mus musculus
gagctagctaccactacaggactgg

SEQ ID NO: 482138 - DNA, 25 bp, Mus musculus
gagctagctacctacacaagagtct

SEQ ID NO: 482139 - DNA, 25 bp, Mus musculus
gagctagctacctctacaggactgg

SEQ ID NO: 482140 - DNA, 25 bp, Mus musculus
gagctagctatcagaggaaatcctt

SEQ ID NO: 482141 - DNA, 25 bp, Mus musculus
gagctagctatctgaggaaatcctt

SEQ ID NO: 482142 - DNA, 25 bp, Mus musculus
gagctagctctcactacaatttttc

SEQ ID NO: 482143 - DNA, 25 bp, Mus musculus
gagctagctctctctacaatttttc

SEQ ID NO: 482144 - DNA, 25 bp, Mus musculus
gagctagctgagattttccgggctt

SEQ ID NO: 482145 - DNA, 25 bp, Mus musculus
gagctagctgagtttttccgggctt

SEQ ID NO: 482146 - DNA, 25 bp, Mus musculus
gagctagctggccataacacatgcc

SEQ ID NO: 482147 - DNA, 25 bp, Mus musculus
gagctagctggcgataacacatgcc

SEQ ID NO: 482148 - DNA, 25 bp, Mus musculus
gagctagcttccacaaggtggtctc

SEQ ID NO: 482149 - DNA, 25 bp, Mus musculus
gagctagcttcctcaaggtggtctc

SEQ ID NO: 482150 - DNA, 25 bp, Mus musculus
gagctaggaaccaatcgatcagtct

SEQ ID NO: 482151 - DNA, 25 bp, Mus musculus
gagctaggaacctatcgatcagtct

SEQ ID NO: 482152 - DNA, 25 bp, Mus musculus
gagctaggacctcccacaagaacta

SEQ ID NO: 482153 - DNA, 25 bp, Mus musculus
gagctaggacctgccacaagaacta

SEQ ID NO: 482154 - DNA, 25 bp, Mus musculus
gagctaggacttcgcatcatgctat

SEQ ID NO: 482155 - DNA, 25 bp, Mus musculus
gagctaggacttggcatcatgctat

SEQ ID NO: 482156 - DNA, 25 bp, Mus musculus
gagctaggagagatatgtggtacac

SEQ ID NO: 482157 - DNA, 25 bp, Mus musculus
gagctaggagagttatgtggtacac

SEQ ID NO: 482158 - DNA, 25 bp, Mus musculus
gagctaggatcaaaggcctgcatca

SEQ ID NO: 482159 - DNA, 25 bp, Mus musculus
gagctaggatcataggcctgcatca

SEQ ID NO: 482160 - DNA, 25 bp, Mus musculus
gagctaggccacagcactcagcagt

SEQ ID NO: 482161 - DNA, 25 bp, Mus musculus
gagctaggccactgcactcagcagt

SEQ ID NO: 482162 - DNA, 25 bp, Mus musculus
gagctaggccagagtatcgagtgaa

SEQ ID NO: 482163 - DNA, 25 bp, Mus musculus
gagctaggccagtgtatcgagtgaa

SEQ ID NO: 482164 - DNA, 25 bp, Mus musculus
gagctaggccgtatgcttgctttat

SEQ ID NO: 482165 - DNA, 25 bp, Mus musculus
gagctaggccgtttgcttgctttat

SEQ ID NO: 482166 - DNA, 25 bp, Mus musculus
gagctaggctaaaaatcatccctga

SEQ ID NO: 482167 - DNA, 25 bp, Mus musculus
gagctaggctaataatcatccctga

SEQ ID NO: 482168 - DNA, 25 bp, Mus musculus
gagctaggctgactcatactcccag

SEQ ID NO: 482169 - DNA, 25 bp, Mus musculus
gagctaggctgagtcatactcccag

SEQ ID NO: 482170 - DNA, 25 bp, Mus musculus
gagctagggaacaacctcagagtac

SEQ ID NO: 482171 - DNA, 25 bp, Mus musculus
gagctagggaactacctcagagtac

SEQ ID NO: 482172 - DNA, 25 bp, Mus musculus
gagctagggaatctccagccactca

SEQ ID NO: 482173 - DNA, 25 bp, Mus musculus
gagctagggaatgtccagccactca

SEQ ID NO: 482174 - DNA, 25 bp, Mus musculus
gagctagggcttcattcatagatgc

SEQ ID NO: 482175 - DNA, 25 bp, Mus musculus
gagctagggcttgattcatagatgc

SEQ ID NO: 482176 - DNA, 25 bp, Mus musculus
gagctaggtacccacctgttaattt

SEQ ID NO: 482177 - DNA, 25 bp, Mus musculus
gagctaggtaccgacctgttaattt

SEQ ID NO: 482178 - DNA, 25 bp, Mus musculus
gagctaggtactcaactcggctttt

SEQ ID NO: 482179 - DNA, 25 bp, Mus musculus
gagctaggtactgaactcggctttt

SEQ ID NO: 482180 - DNA, 25 bp, Mus musculus
gagctaggtccaagtttctgtcata

SEQ ID NO: 482181 - DNA, 25 bp, Mus musculus
gagctaggtccatgtttctgtcata

SEQ ID NO: 482182 - DNA, 25 bp, Mus musculus
gagctaggtgatacgctgtgagttt

SEQ ID NO: 482183 - DNA, 25 bp, Mus musculus
gagctaggtgattcgctgtgagttt

SEQ ID NO: 482184 - DNA, 25 bp, Mus musculus
gagctaggttatacctttgtgtaat

SEQ ID NO: 482185 - DNA, 25 bp, Mus musculus
gagctaggttattcctttgtgtaat

SEQ ID NO: 482186 - DNA, 25 bp, Mus musculus
gagctagtaacgacactaagggaca

SEQ ID NO: 482187 - DNA, 25 bp, Mus musculus
gagctagtaacgtcactaagggaca

SEQ ID NO: 482188 - DNA, 25 bp, Mus musculus
gagctagtaagcagagttccatcat

SEQ ID NO: 482189 - DNA, 25 bp, Mus musculus
gagctagtaagctgagttccatcat

SEQ ID NO: 482190 - DNA, 25 bp, Mus musculus
gagctagtaatcaggattcctccat

SEQ ID NO: 482191 - DNA, 25 bp, Mus musculus
gagctagtaatctggattcctccat

SEQ ID NO: 482192 - DNA, 25 bp, Mus musculus
gagctagtaggcatgacaaagactt

SEQ ID NO: 482193 - DNA, 25 bp, Mus musculus
gagctagtaggcttgacaaagactt

SEQ ID NO: 482194 - DNA, 25 bp, Mus musculus
gagctagtccctcgagctaggctcc

SEQ ID NO: 482195 - DNA, 25 bp, Mus musculus
gagctagtccctggagctaggctcc

SEQ ID NO: 482196 - DNA, 25 bp, Mus musculus
gagctagtccggactcgttggccag

SEQ ID NO: 482197 - DNA, 25 bp, Mus musculus
gagctagtccggtctcgttggccag

SEQ ID NO: 482198 - DNA, 25 bp, Mus musculus
gagctagtcctgagtaagttcaacc

SEQ ID NO: 482199 - DNA, 25 bp, Mus musculus
gagctagtcctgtgtaagttcaacc

SEQ ID NO: 482200 - DNA, 25 bp, Mus musculus
gagctagtgagacgctcctaggtcc

SEQ ID NO: 482201 - DNA, 25 bp, Mus musculus
gagctagtgagaggctcctaggtcc

SEQ ID NO: 482202 - DNA, 25 bp, Mus musculus
gagctagtgctccatggtgctgtct

SEQ ID NO: 482203 - DNA, 25 bp, Mus musculus
gagctagtgctcgatggtgctgtct

SEQ ID NO: 482204 - DNA, 25 bp, Mus musculus
gagctagtggatacctttttgcagc

SEQ ID NO: 482205 - DNA, 25 bp, Mus musculus
gagctagtggattcctttttgcagc

SEQ ID NO: 482206 - DNA, 25 bp, Mus musculus
gagctagtgggcagaccaactcagc

SEQ ID NO: 482207 - DNA, 25 bp, Mus musculus
gagctagtgggctgaccaactcagc

SEQ ID NO: 482208 - DNA, 25 bp, Mus musculus
gagctagtggtcaggctgttacatc

SEQ ID NO: 482209 - DNA, 25 bp, Mus musculus
gagctagtggtctggctgttacatc

SEQ ID NO: 482210 - DNA, 25 bp, Mus musculus
gagctagtgtctacacggaggtcct

SEQ ID NO: 482211 - DNA, 25 bp, Mus musculus
gagctagtgtcttcacggaggtcct

SEQ ID NO: 482212 - DNA, 25 bp, Mus musculus
gagctagttaatactcttctacatt

SEQ ID NO: 482213 - DNA, 25 bp, Mus musculus
gagctagttaattctcttctacatt

SEQ ID NO: 482214 - DNA, 25 bp, Mus musculus
gagctagttccacgccctcggtata

SEQ ID NO: 482215 - DNA, 25 bp, Mus musculus
gagctagttccaggccctcggtata

SEQ ID NO: 482216 - DNA, 25 bp, Mus musculus
gagctagttgccagtatgtcactgc

SEQ ID NO: 482217 - DNA, 25 bp, Mus musculus
gagctagttgcctgtatgtcactgc

SEQ ID NO: 482218 - DNA, 25 bp, Mus musculus
gagctagtttggcagttccgtatat

SEQ ID NO: 482219 - DNA, 25 bp, Mus musculus
gagctagtttgggagttccgtatat

SEQ ID NO: 482220 - DNA, 25 bp, Mus musculus
gagctagtttgtagtgactcactgc

SEQ ID NO: 482221 - DNA, 25 bp, Mus musculus
gagctagtttgttgtgactcactgc

SEQ ID NO: 482222 - DNA, 25 bp, Mus musculus
gagctataacatacctgttccagga

SEQ ID NO: 482223 - DNA, 25 bp, Mus musculus
gagctataacattcctgttccagga

SEQ ID NO: 482224 - DNA, 25 bp, Mus musculus
gagctataagatatgctgacagcca

SEQ ID NO: 482225 - DNA, 25 bp, Mus musculus
gagctataagatttgctgacagcca

SEQ ID NO: 482226 - DNA, 25 bp, Mus musculus
gagctataagctaccatctttagtg

SEQ ID NO: 482227 - DNA, 25 bp, Mus musculus
gagctataagcttccatctttagtg

SEQ ID NO: 482228 - DNA, 25 bp, Mus musculus
gagctataaggacttgcccacttga

SEQ ID NO: 482229 - DNA, 25 bp, Mus musculus
gagctataaggagttgcccacttga

SEQ ID NO: 482230 - DNA, 25 bp, Mus musculus
gagctataattacccaatctgtttg

SEQ ID NO: 482231 - DNA, 25 bp, Mus musculus
gagctataattagccaatctgtttg

SEQ ID NO: 482232 - DNA, 25 bp, Mus musculus
gagctatacagtcagggtccactac

SEQ ID NO: 482233 - DNA, 25 bp, Mus musculus
gagctatacagtgagggtccactac

SEQ ID NO: 482234 - DNA, 25 bp, Mus musculus
gagctatacatccagtccataaagt

SEQ ID NO: 482235 - DNA, 25 bp, Mus musculus
gagctatacatcgagtccataaagt

SEQ ID NO: 482236 - DNA, 25 bp, Mus musculus
gagctataccgtagccttgtgcaga

SEQ ID NO: 482237 - DNA, 25 bp, Mus musculus
gagctataccgttgccttgtgcaga

SEQ ID NO: 482238 - DNA, 25 bp, Mus musculus
gagctatactcaagccccattttgt

SEQ ID NO: 482239 - DNA, 25 bp, Mus musculus
gagctatactcatgccccattttgt

SEQ ID NO: 482240 - DNA, 25 bp, Mus musculus
gagctatactccagttcagaatata

SEQ ID NO: 482241 - DNA, 25 bp, Mus musculus
gagctatactcctgttcagaatata

SEQ ID NO: 482242 - DNA, 25 bp, Mus musculus
gagctatactctcacccaggatgtt

SEQ ID NO: 482243 - DNA, 25 bp, Mus musculus
gagctatactctgacccaggatgtt

SEQ ID NO: 482244 - DNA, 25 bp, Mus musculus
gagctatagctaatcgtctagagac

SEQ ID NO: 482245 - DNA, 25 bp, Mus musculus
gagctatagctattcgtctagagac

SEQ ID NO: 482246 - DNA, 25 bp, Mus musculus
gagctataggctagcatttagtatc

SEQ ID NO: 482247 - DNA, 25 bp, Mus musculus
gagctataggcttgcatttagtatc

SEQ ID NO: 482248 - DNA, 25 bp, Mus musculus
gagctatagtgtaagtccaggcaat

SEQ ID NO: 482249 - DNA, 25 bp, Mus musculus
gagctatagtgttagtccaggcaat

SEQ ID NO: 482250 - DNA, 25 bp, Mus musculus
gagctatatattataattccttgaa

SEQ ID NO: 482251 - DNA, 25 bp, Mus musculus
gagctatatattttaattccttgaa

SEQ ID NO: 482252 - DNA, 25 bp, Mus musculus
gagctatatttgaactttgggcatt

SEQ ID NO: 482253 - DNA, 25 bp, Mus musculus
gagctatatttgtactttgggcatt

SEQ ID NO: 482254 - DNA, 25 bp, Mus musculus
gagctatcaaaaagtctatgtaatt

SEQ ID NO: 482255 - DNA, 25 bp, Mus musculus
gagctatcaaaatgtctatgtaatt

SEQ ID NO: 482256 - DNA, 25 bp, Mus musculus
gagctatcacacagggccagcgggt

SEQ ID NO: 482257 - DNA, 25 bp, Mus musculus
gagctatcacactgggccagcgggt

SEQ ID NO: 482258 - DNA, 25 bp, Mus musculus
gagctatcagcacctgttaccacaa

SEQ ID NO: 482259 - DNA, 25 bp, Mus musculus
gagctatcagcagctgttaccacaa

SEQ ID NO: 482260 - DNA, 25 bp, Mus musculus
gagctatcagccaaaaaggaccgtt

SEQ ID NO: 482261 - DNA, 25 bp, Mus musculus
gagctatcagcctaaaaggaccgtt

SEQ ID NO: 482262 - DNA, 25 bp, Mus musculus
gagctatcagctactgcatccagtt

SEQ ID NO: 482263 - DNA, 25 bp, Mus musculus
gagctatcagcttctgcatccagtt

SEQ ID NO: 482264 - DNA, 25 bp, Mus musculus
gagctatcatgtaactctgtgaaac

SEQ ID NO: 482265 - DNA, 25 bp, Mus musculus
gagctatcatgtctagcttccctag

SEQ ID NO: 482266 - DNA, 25 bp, Mus musculus
gagctatcatgtgtagcttccctag

SEQ ID NO: 482267 - DNA, 25 bp, Mus musculus
gagctatcatgttactctgtgaaac

SEQ ID NO: 482268 - DNA, 25 bp, Mus musculus
gagctatcatttatgggctgtaaat

SEQ ID NO: 482269 - DNA, 25 bp, Mus musculus
gagctatcatttttgggctgtaaat

SEQ ID NO: 482270 - DNA, 25 bp, Mus musculus
gagctatccaatccatgaacacagt

SEQ ID NO: 482271 - DNA, 25 bp, Mus musculus
gagctatccaatgcatgaacacagt

SEQ ID NO: 482272 - DNA, 25 bp, Mus musculus
gagctatccatcatggagctgctga

SEQ ID NO: 482273 - DNA, 25 bp, Mus musculus
gagctatccatcttggagctgctga

SEQ ID NO: 482274 - DNA, 25 bp, Mus musculus
gagctatccattcatgtcagtgccc

SEQ ID NO: 482275 - DNA, 25 bp, Mus musculus
gagctatccattgatgtcagtgccc

SEQ ID NO: 482276 - DNA, 25 bp, Mus musculus
gagctatcggtcagttataccaaat

SEQ ID NO: 482277 - DNA, 25 bp, Mus musculus
gagctatcggtctgttataccaaat

SEQ ID NO: 482278 - DNA, 25 bp, Mus musculus
gagctatctcatataaaacacttaa

SEQ ID NO: 482279 - DNA, 25 bp, Mus musculus
gagctatctcatttaaaacacttaa

SEQ ID NO: 482280 - DNA, 25 bp, Mus musculus
gagctatctggaacttgagaagtct

SEQ ID NO: 482281 - DNA, 25 bp, Mus musculus
gagctatctggatcttgagaagtct

SEQ ID NO: 482282 - DNA, 25 bp, Mus musculus
gagctatctggtcatggtagactta

SEQ ID NO: 482283 - DNA, 25 bp, Mus musculus
gagctatctggtgatggtagactta

SEQ ID NO: 482284 - DNA, 25 bp, Mus musculus
gagctatctgtccagaccacatttg

SEQ ID NO: 482285 - DNA, 25 bp, Mus musculus
gagctatctgtcgagaccacatttg

SEQ ID NO: 482286 - DNA, 25 bp, Mus musculus
gagctatctgtgctgcggttctgca

SEQ ID NO: 482287 - DNA, 25 bp, Mus musculus
gagctatctgtggtgcggttctgca

SEQ ID NO: 482288 - DNA, 25 bp, Mus musculus
gagctatcttctcaactcaactgtt

SEQ ID NO: 482289 - DNA, 25 bp, Mus musculus
gagctatcttctgaactcaactgtt

SEQ ID NO: 482290 - DNA, 25 bp, Mus musculus
gagctatctttaagcctttgatgaa

SEQ ID NO: 482291 - DNA, 25 bp, Mus musculus
gagctatctttatgcctttgatgaa

SEQ ID NO: 482292 - DNA, 25 bp, Mus musculus
gagctatgactcctctagttgttat

SEQ ID NO: 482293 - DNA, 25 bp, Mus musculus
gagctatgactcgtctagttgttat

SEQ ID NO: 482294 - DNA, 25 bp, Mus musculus
gagctatgagatctatcccggccct

SEQ ID NO: 482295 - DNA, 25 bp, Mus musculus
gagctatgagatgtatcccggccct

SEQ ID NO: 482296 - DNA, 25 bp, Mus musculus
gagctatgaggaagacccctacctg

SEQ ID NO: 482297 - DNA, 25 bp, Mus musculus
gagctatgaggatgacccctacctg

SEQ ID NO: 482298 - DNA, 25 bp, Mus musculus
gagctatgattcctccgaatgttgt

SEQ ID NO: 482299 - DNA, 25 bp, Mus musculus
gagctatgattcgtccgaatgttgt

SEQ ID NO: 482300 - DNA, 25 bp, Mus musculus
gagctatgatttccagaaaggcttt

SEQ ID NO: 482301 - DNA, 25 bp, Mus musculus
gagctatgatttgcagaaaggcttt

SEQ ID NO: 482302 - DNA, 25 bp, Mus musculus
gagctatgcctaattagggcaccat

SEQ ID NO: 482303 - DNA, 25 bp, Mus musculus
gagctatgcctatttagggcaccat

SEQ ID NO: 482304 - DNA, 25 bp, Mus musculus
gagctatgctcacatgtctggattt

SEQ ID NO: 482305 - DNA, 25 bp, Mus musculus
gagctatgctcactatacagaactg

SEQ ID NO: 482306 - DNA, 25 bp, Mus musculus
gagctatgctcagatgtctggattt

SEQ ID NO: 482307 - DNA, 25 bp, Mus musculus
gagctatgctcagtatacagaactg

SEQ ID NO: 482308 - DNA, 25 bp, Mus musculus
gagctatgctgtataacttccaatt

SEQ ID NO: 482309 - DNA, 25 bp, Mus musculus
gagctatgctgtattatgtgaccaa

SEQ ID NO: 482310 - DNA, 25 bp, Mus musculus
gagctatgctgtttaacttccaatt

SEQ ID NO: 482311 - DNA, 25 bp, Mus musculus
gagctatgctgttttatgtgaccaa

SEQ ID NO: 482312 - DNA, 25 bp, Mus musculus
gagctatggcaaatggcatcctcac

SEQ ID NO: 482313 - DNA, 25 bp, Mus musculus
gagctatggcaattggcatcctcac

SEQ ID NO: 482314 - DNA, 25 bp, Mus musculus
gagctatggctccttttttgataga

SEQ ID NO: 482315 - DNA, 25 bp, Mus musculus
gagctatggctcgttttttgataga

SEQ ID NO: 482316 - DNA, 25 bp, Mus musculus
gagctatgggacagtagttccctca

SEQ ID NO: 482317 - DNA, 25 bp, Mus musculus
gagctatgggactgtagttccctca

SEQ ID NO: 482318 - DNA, 25 bp, Mus musculus
gagctatggtcacactcactctcgt

SEQ ID NO: 482319 - DNA, 25 bp, Mus musculus
gagctatggtcagactcactctcgt

SEQ ID NO: 482320 - DNA, 25 bp, Mus musculus
gagctatgtacactcattcgcaacg

SEQ ID NO: 482321 - DNA, 25 bp, Mus musculus
gagctatgtacagtcattcgcaacg

SEQ ID NO: 482322 - DNA, 25 bp, Mus musculus
gagctatgtctgcactaacatgccc

SEQ ID NO: 482323 - DNA, 25 bp, Mus musculus
gagctatgtctggactaacatgccc

SEQ ID NO: 482324 - DNA, 25 bp, Mus musculus
gagctatgtggaaatgccgttttgt

SEQ ID NO: 482325 - DNA, 25 bp, Mus musculus
gagctatgtggatatgccgttttgt

SEQ ID NO: 482326 - DNA, 25 bp, Mus musculus
gagctatgttctaggatgattcaac

SEQ ID NO: 482327 - DNA, 25 bp, Mus musculus
gagctatgttcttggatgattcaac

SEQ ID NO: 482328 - DNA, 25 bp, Mus musculus
gagctattagctccacggctttgaa

SEQ ID NO: 482329 - DNA, 25 bp, Mus musculus
gagctattagctgcacggctttgaa

SEQ ID NO: 482330 - DNA, 25 bp, Mus musculus
gagctattctttcctgggtaaaaat

SEQ ID NO: 482331 - DNA, 25 bp, Mus musculus
gagctattctttgctgggtaaaaat

SEQ ID NO: 482332 - DNA, 25 bp, Mus musculus
gagctattgagtaggtattctgtaa

SEQ ID NO: 482333 - DNA, 25 bp, Mus musculus
gagctattgagttggtattctgtaa

SEQ ID NO: 482334 - DNA, 25 bp, Mus musculus
gagctattgatcattccactttccg

SEQ ID NO: 482335 - DNA, 25 bp, Mus musculus
gagctattgatctttccactttccg

SEQ ID NO: 482336 - DNA, 25 bp, Mus musculus
gagctattgcagatggcctgccctt

SEQ ID NO: 482337 - DNA, 25 bp, Mus musculus
gagctattgcagttggcctgccctt

SEQ ID NO: 482338 - DNA, 25 bp, Mus musculus
gagctattgctactcttgaagagga

SEQ ID NO: 482339 - DNA, 25 bp, Mus musculus
gagctattgctagtcttgaagagga

SEQ ID NO: 482340 - DNA, 25 bp, Mus musculus
gagctattgctcacagtaccagtca

SEQ ID NO: 482341 - DNA, 25 bp, Mus musculus
gagctattgctctcagtaccagtca

SEQ ID NO: 482342 - DNA, 25 bp, Mus musculus
gagctattgtaacatctctaattgt

SEQ ID NO: 482343 - DNA, 25 bp, Mus musculus
gagctattgtaagatctctaattgt

SEQ ID NO: 482344 - DNA, 25 bp, Mus musculus
gagctattgtgcatggaattgtctc

SEQ ID NO: 482345 - DNA, 25 bp, Mus musculus
gagctattgtgcttggaattgtctc

SEQ ID NO: 482346 - DNA, 25 bp, Mus musculus
gagctatttcctaattctggcagtg

SEQ ID NO: 482347 - DNA, 25 bp, Mus musculus
gagctatttccttattctggcagtg

SEQ ID NO: 482348 - DNA, 25 bp, Mus musculus
gagctatttgacactgaccatatca

SEQ ID NO: 482349 - DNA, 25 bp, Mus musculus
gagctatttgactctgaccatatca

SEQ ID NO: 482350 - DNA, 25 bp, Mus musculus
gagctatttgatactcccaacgttc

SEQ ID NO: 482351 - DNA, 25 bp, Mus musculus
gagctatttgattctcccaacgttc

SEQ ID NO: 482352 - DNA, 25 bp, Mus musculus
gagctatttgctcagtcaccattat

SEQ ID NO: 482353 - DNA, 25 bp, Mus musculus
gagctatttgctgagtcaccattat

SEQ ID NO: 482354 - DNA, 25 bp, Mus musculus
gagctatttgtaaacaggtctactt

SEQ ID NO: 482355 - DNA, 25 bp, Mus musculus
gagctatttgtatacaggtctactt

SEQ ID NO: 482356 - DNA, 25 bp, Mus musculus
gagctattttacaggttctgaaagc

SEQ ID NO: 482357 - DNA, 25 bp, Mus musculus
gagctattttactggttctgaaagc

SEQ ID NO: 482358 - DNA, 25 bp, Mus musculus
gagctattttgaattatccaggcat

SEQ ID NO: 482359 - DNA, 25 bp, Mus musculus
gagctattttgatttatccaggcat

SEQ ID NO: 482360 - DNA, 25 bp, Mus musculus
gagctcaaaccaataactgttcact

SEQ ID NO: 482361 - DNA, 25 bp, Mus musculus
gagctcaaaccaatttacattcctg

SEQ ID NO: 482362 - DNA, 25 bp, Mus musculus
gagctcaaaccattaactgttcact

SEQ ID NO: 482363 - DNA, 25 bp, Mus musculus
gagctcaaaccattttacattcctg

SEQ ID NO: 482364 - DNA, 25 bp, Mus musculus
gagctcaaacgtagactttcttaca

SEQ ID NO: 482365 - DNA, 25 bp, Mus musculus
gagctcaaacgttgactttcttaca

SEQ ID NO: 482366 - DNA, 25 bp, Mus musculus
gagctcaaagaccttggatcccaga

SEQ ID NO: 482367 - DNA, 25 bp, Mus musculus
gagctcaaagacgttggatcccaga

SEQ ID NO: 482368 - DNA, 25 bp, Mus musculus
gagctcaaaggccatttccttaatg

SEQ ID NO: 482369 - DNA, 25 bp, Mus musculus
gagctcaaaggcgatttccttaatg

SEQ ID NO: 482370 - DNA, 25 bp, Mus musculus
gagctcaaatttccattgtcagtca

SEQ ID NO: 482371 - DNA, 25 bp, Mus musculus
gagctcaaatttgcattgtcagtca

SEQ ID NO: 482372 - DNA, 25 bp, Mus musculus
gagctcaaccacatcggatatcatt

SEQ ID NO: 482373 - DNA, 25 bp, Mus musculus
gagctcaaccacttcggatatcatt

SEQ ID NO: 482374 - DNA, 25 bp, Mus musculus
gagctcaacctgagagacaccagat

SEQ ID NO: 482375 - DNA, 25 bp, Mus musculus
gagctcaacctgtgagacaccagat

SEQ ID NO: 482376 - DNA, 25 bp, Mus musculus
gagctcaactacaacttcctatgac

SEQ ID NO: 482377 - DNA, 25 bp, Mus musculus
gagctcaactactacttcctatgac

SEQ ID NO: 482378 - DNA, 25 bp, Mus musculus
gagctcaactgcacactctgtgtgg

SEQ ID NO: 482379 - DNA, 25 bp, Mus musculus
gagctcaactgctcactctgtgtgg

SEQ ID NO: 482380 - DNA, 25 bp, Mus musculus
gagctcaagaccaactaagcaactt

SEQ ID NO: 482381 - DNA, 25 bp, Mus musculus
gagctcaagaccaccaggtttcatc

SEQ ID NO: 482382 - DNA, 25 bp, Mus musculus
gagctcaagacctactaagcaactt

SEQ ID NO: 482383 - DNA, 25 bp, Mus musculus
gagctcaagacctccaggtttcatc

SEQ ID NO: 482384 - DNA, 25 bp, Mus musculus
gagctcaaggacagaagcagccaca

SEQ ID NO: 482385 - DNA, 25 bp, Mus musculus
gagctcaaggactgaagcagccaca

SEQ ID NO: 482386 - DNA, 25 bp, Mus musculus
gagctcaaggagagtctagcccaca

SEQ ID NO: 482387 - DNA, 25 bp, Mus musculus
gagctcaaggagtgtctagcccaca

SEQ ID NO: 482388 - DNA, 25 bp, Mus musculus
gagctcaaggctactctagtcttat

SEQ ID NO: 482389 - DNA, 25 bp, Mus musculus
gagctcaaggcttctctagtcttat

SEQ ID NO: 482390 - DNA, 25 bp, Mus musculus
gagctcaagggcagtctgggataca

SEQ ID NO: 482391 - DNA, 25 bp, Mus musculus
gagctcaagggctgtctgggataca

SEQ ID NO: 482392 - DNA, 25 bp, Mus musculus
gagctcaaggtcacctgaacccagg

SEQ ID NO: 482393 - DNA, 25 bp, Mus musculus
gagctcaaggtctcctgaacccagg

SEQ ID NO: 482394 - DNA, 25 bp, Mus musculus
gagctcaagtctccaaaaaacactg

SEQ ID NO: 482395 - DNA, 25 bp, Mus musculus
gagctcaagtctgcaaaaaacactg

SEQ ID NO: 482396 - DNA, 25 bp, Mus musculus
gagctcaagtggagttccacggaca

SEQ ID NO: 482397 - DNA, 25 bp, Mus musculus
gagctcaagtggtgttccacggaca

SEQ ID NO: 482398 - DNA, 25 bp, Mus musculus
gagctcaataaacccgccatgatct

SEQ ID NO: 482399 - DNA, 25 bp, Mus musculus
gagctcaataaagccgccatgatct

SEQ ID NO: 482400 - DNA, 25 bp, Mus musculus
gagctcaatgcacccatccgaagaa

SEQ ID NO: 482401 - DNA, 25 bp, Mus musculus
gagctcaatgcagccatccgaagaa

SEQ ID NO: 482402 - DNA, 25 bp, Mus musculus
gagctcaatggaaccctatgtctaa

SEQ ID NO: 482403 - DNA, 25 bp, Mus musculus
gagctcaatggatccctatgtctaa

SEQ ID NO: 482404 - DNA, 25 bp, Mus musculus
gagctcacaaacatcgatgctacta

SEQ ID NO: 482405 - DNA, 25 bp, Mus musculus
gagctcacaaacttcgatgctacta

SEQ ID NO: 482406 - DNA, 25 bp, Mus musculus
gagctcacactactgtttactctaa

SEQ ID NO: 482407 - DNA, 25 bp, Mus musculus
gagctcacactagtgtttactctaa

SEQ ID NO: 482408 - DNA, 25 bp, Mus musculus
gagctcacacttagtatctaataca

SEQ ID NO: 482409 - DNA, 25 bp, Mus musculus
gagctcacactttgtatctaataca

SEQ ID NO: 482410 - DNA, 25 bp, Mus musculus
gagctcacagaaacccagtagcaca

SEQ ID NO: 482411 - DNA, 25 bp, Mus musculus
gagctcacagaatcccagtagcaca

SEQ ID NO: 482412 - DNA, 25 bp, Mus musculus
gagctcacagacaagataaatttgg

SEQ ID NO: 482413 - DNA, 25 bp, Mus musculus
gagctcacagactagataaatttgg

SEQ ID NO: 482414 - DNA, 25 bp, Mus musculus
gagctcacaggtacatcatggcacc

SEQ ID NO: 482415 - DNA, 25 bp, Mus musculus
gagctcacaggttcatcatggcacc

SEQ ID NO: 482416 - DNA, 25 bp, Mus musculus
gagctcacagtcagctgttcctgta

SEQ ID NO: 482417 - DNA, 25 bp, Mus musculus
gagctcacagtctgctgttcctgta

SEQ ID NO: 482418 - DNA, 25 bp, Mus musculus
gagctcacattaacagcccgatgag

SEQ ID NO: 482419 - DNA, 25 bp, Mus musculus
gagctcacattatcagcccgatgag

SEQ ID NO: 482420 - DNA, 25 bp, Mus musculus
gagctcacatttctaataccaacat

SEQ ID NO: 482421 - DNA, 25 bp, Mus musculus
gagctcacatttgtaataccaacat

SEQ ID NO: 482422 - DNA, 25 bp, Mus musculus
gagctcacccaaaggacagctttat

SEQ ID NO: 482423 - DNA, 25 bp, Mus musculus
gagctcacccaatggacagctttat

SEQ ID NO: 482424 - DNA, 25 bp, Mus musculus
gagctcaccttaactcagtgttgaa

SEQ ID NO: 482425 - DNA, 25 bp, Mus musculus
gagctcaccttatctcagtgttgaa

SEQ ID NO: 482426 - DNA, 25 bp, Mus musculus
gagctcacggcacaggctggctaca

SEQ ID NO: 482427 - DNA, 25 bp, Mus musculus
gagctcacggcagaggctggctaca

SEQ ID NO: 482428 - DNA, 25 bp, Mus musculus
gagctcacggtcacttgtaagtacc

SEQ ID NO: 482429 - DNA, 25 bp, Mus musculus
gagctcacggtctcttgtaagtacc

SEQ ID NO: 482430 - DNA, 25 bp, Mus musculus
gagctcacgtcgcacaaatcatttg

SEQ ID NO: 482431 - DNA, 25 bp, Mus musculus
gagctcacgtcggacaaatcatttg

SEQ ID NO: 482432 - DNA, 25 bp, Mus musculus
gagctcactaatatatttccaagaa

SEQ ID NO: 482433 - DNA, 25 bp, Mus musculus
gagctcactaatttatttccaagaa

SEQ ID NO: 482434 - DNA, 25 bp, Mus musculus
gagctcactacacaagtgtggtcaa

SEQ ID NO: 482435 - DNA, 25 bp, Mus musculus
gagctcactacagaagtgtggtcaa

SEQ ID NO: 482436 - DNA, 25 bp, Mus musculus
gagctcactgatcaactttcttacc

SEQ ID NO: 482437 - DNA, 25 bp, Mus musculus
gagctcactgatgaactttcttacc

SEQ ID NO: 482438 - DNA, 25 bp, Mus musculus
gagctcactgctcctgatgtggtaa

SEQ ID NO: 482439 - DNA, 25 bp, Mus musculus
gagctcactgctgctgatgtggtaa

SEQ ID NO: 482440 - DNA, 25 bp, Mus musculus
gagctcactggaagcttggttgaac

SEQ ID NO: 482441 - DNA, 25 bp, Mus musculus
gagctcactggatgcttggttgaac

SEQ ID NO: 482442 - DNA, 25 bp, Mus musculus
gagctcactgtcagggttcagacct

SEQ ID NO: 482443 - DNA, 25 bp, Mus musculus
gagctcactgtctgggttcagacct

SEQ ID NO: 482444 - DNA, 25 bp, Mus musculus
gagctcactgttaaggctagtccca

SEQ ID NO: 482445 - DNA, 25 bp, Mus musculus
gagctcactgtttaggctagtccca

SEQ ID NO: 482446 - DNA, 25 bp, Mus musculus
gagctcacttgtaaaatatcattat

SEQ ID NO: 482447 - DNA, 25 bp, Mus musculus
gagctcacttgtctattcatcatgt

SEQ ID NO: 482448 - DNA, 25 bp, Mus musculus
gagctcacttgtgtattcatcatgt

SEQ ID NO: 482449 - DNA, 25 bp, Mus musculus
gagctcacttgttaaatatcattat

SEQ ID NO: 482450 - DNA, 25 bp, Mus musculus
gagctcactttcagggttggaaccc

SEQ ID NO: 482451 - DNA, 25 bp, Mus musculus
gagctcactttctgggttggaaccc

SEQ ID NO: 482452 - DNA, 25 bp, Mus musculus
gagctcagaccactgcaaaccagaa

SEQ ID NO: 482453 - DNA, 25 bp, Mus musculus
gagctcagaccagtgcaaaccagaa

SEQ ID NO: 482454 - DNA, 25 bp, Mus musculus
gagctcagacccaaaagtaactcga

SEQ ID NO: 482455 - DNA, 25 bp, Mus musculus
gagctcagaccctaaagtaactcga

SEQ ID NO: 482456 - DNA, 25 bp, Mus musculus
gagctcagagatagttcatacacat

SEQ ID NO: 482457 - DNA, 25 bp, Mus musculus
gagctcagagattgttcatacacat

SEQ ID NO: 482458 - DNA, 25 bp, Mus musculus
gagctcagagcgagtcgttttgtgt

SEQ ID NO: 482459 - DNA, 25 bp, Mus musculus
gagctcagagcgtgtcgttttgtgt

SEQ ID NO: 482460 - DNA, 25 bp, Mus musculus
gagctcagagttcacatgttttcac

SEQ ID NO: 482461 - DNA, 25 bp, Mus musculus
gagctcagagttgacatgttttcac

SEQ ID NO: 482462 - DNA, 25 bp, Mus musculus
gagctcagatcaaataggaaaatac

SEQ ID NO: 482463 - DNA, 25 bp, Mus musculus
gagctcagatcatataggaaaatac

SEQ ID NO: 482464 - DNA, 25 bp, Mus musculus
gagctcagatccctagcaagcatgt

SEQ ID NO: 482465 - DNA, 25 bp, Mus musculus
gagctcagatccgtagcaagcatgt

SEQ ID NO: 482466 - DNA, 25 bp, Mus musculus
gagctcagatctcctctgttcagaa

SEQ ID NO: 482467 - DNA, 25 bp, Mus musculus
gagctcagatctgctctgttcagaa

SEQ ID NO: 482468 - DNA, 25 bp, Mus musculus
gagctcagatgccagagaaccctgt

SEQ ID NO: 482469 - DNA, 25 bp, Mus musculus
gagctcagatgcgagagaaccctgt

SEQ ID NO: 482470 - DNA, 25 bp, Mus musculus
gagctcagcaagcagacaagcacag

SEQ ID NO: 482471 - DNA, 25 bp, Mus musculus
gagctcagcaaggagacaagcacag

SEQ ID NO: 482472 - DNA, 25 bp, Mus musculus
gagctcagccacatattcacatggt

SEQ ID NO: 482473 - DNA, 25 bp, Mus musculus
gagctcagccacttattcacatggt

SEQ ID NO: 482474 - DNA, 25 bp, Mus musculus
gagctcagccgcatgcaggacagtg

SEQ ID NO: 482475 - DNA, 25 bp, Mus musculus
gagctcagccgccatctggtcaaaa

SEQ ID NO: 482476 - DNA, 25 bp, Mus musculus
gagctcagccgcgatctggtcaaaa

SEQ ID NO: 482477 - DNA, 25 bp, Mus musculus
gagctcagccgcttgcaggacagtg

SEQ ID NO: 482478 - DNA, 25 bp, Mus musculus
gagctcagcgacacggcagcagtat

SEQ ID NO: 482479 - DNA, 25 bp, Mus musculus
gagctcagcgactcggcagcagtat

SEQ ID NO: 482480 - DNA, 25 bp, Mus musculus
gagctcagctgacttatcacgcttg

SEQ ID NO: 482481 - DNA, 25 bp, Mus musculus
gagctcagctgagttatcacgcttg

SEQ ID NO: 482482 - DNA, 25 bp, Mus musculus
gagctcagctttagggagcctttgt

SEQ ID NO: 482483 - DNA, 25 bp, Mus musculus
gagctcagctttctggctaggtctt

SEQ ID NO: 482484 - DNA, 25 bp, Mus musculus
gagctcagctttgtggctaggtctt

SEQ ID NO: 482485 - DNA, 25 bp, Mus musculus
gagctcagcttttgggagcctttgt

SEQ ID NO: 482486 - DNA, 25 bp, Mus musculus
gagctcaggagaaggcattcccaga

SEQ ID NO: 482487 - DNA, 25 bp, Mus musculus
gagctcaggagatggcattcccaga

SEQ ID NO: 482488 - DNA, 25 bp, Mus musculus
gagctcaggatgctcaccttccttc

SEQ ID NO: 482489 - DNA, 25 bp, Mus musculus
gagctcaggatggtcaccttccttc

SEQ ID NO: 482490 - DNA, 25 bp, Mus musculus
gagctcagggctaattactataggt

SEQ ID NO: 482491 - DNA, 25 bp, Mus musculus
gagctcagggctcactgtacattta

SEQ ID NO: 482492 - DNA, 25 bp, Mus musculus
gagctcagggctgactgtacattta

SEQ ID NO: 482493 - DNA, 25 bp, Mus musculus
gagctcagggcttattactataggt

SEQ ID NO: 482494 - DNA, 25 bp, Mus musculus
gagctcagtatcaggaacccacgga

SEQ ID NO: 482495 - DNA, 25 bp, Mus musculus
gagctcagtatctggaacccacgga

SEQ ID NO: 482496 - DNA, 25 bp, Mus musculus
gagctcagtcaaatgcaactgcaag

SEQ ID NO: 482497 - DNA, 25 bp, Mus musculus
gagctcagtcaattgcaactgcaag

SEQ ID NO: 482498 - DNA, 25 bp, Mus musculus
gagctcagtgcaaggacagaataaa

SEQ ID NO: 482499 - DNA, 25 bp, Mus musculus
gagctcagtgcatggacagaataaa

SEQ ID NO: 482500 - DNA, 25 bp, Mus musculus
gagctcagtgtcctggagcccaaat

SEQ ID NO: 482501 - DNA, 25 bp, Mus musculus
gagctcagtgtcgtggagcccaaat

SEQ ID NO: 482502 - DNA, 25 bp, Mus musculus
gagctcagttgtctgctttcagggc

SEQ ID NO: 482503 - DNA, 25 bp, Mus musculus
gagctcagttgtgtgctttcagggc

SEQ ID NO: 482504 - DNA, 25 bp, Mus musculus
gagctcataaagctccatctgcctc

SEQ ID NO: 482505 - DNA, 25 bp, Mus musculus
gagctcataaaggtccatctgcctc

SEQ ID NO: 482506 - DNA, 25 bp, Mus musculus
gagctcataagaagctttcacccca

SEQ ID NO: 482507 - DNA, 25 bp, Mus musculus
gagctcataagatgctttcacccca

SEQ ID NO: 482508 - DNA, 25 bp, Mus musculus
gagctcatacagactcaacagatca

SEQ ID NO: 482509 - DNA, 25 bp, Mus musculus
gagctcatacagtctcaacagatca

SEQ ID NO: 482510 - DNA, 25 bp, Mus musculus
gagctcatcacacactttggttcgg

SEQ ID NO: 482511 - DNA, 25 bp, Mus musculus
gagctcatcacagactttggttcgg

SEQ ID NO: 482512 - DNA, 25 bp, Mus musculus
gagctcatcactccccgaaagtgaa

SEQ ID NO: 482513 - DNA, 25 bp, Mus musculus
gagctcatcactgcccgaaagtgaa

SEQ ID NO: 482514 - DNA, 25 bp, Mus musculus
gagctcatcaggctagccggatcta

SEQ ID NO: 482515 - DNA, 25 bp, Mus musculus
gagctcatcagggtagccggatcta

SEQ ID NO: 482516 - DNA, 25 bp, Mus musculus
gagctcatccaacgcctgttcttat

SEQ ID NO: 482517 - DNA, 25 bp, Mus musculus
gagctcatccaaggcctgttcttat

SEQ ID NO: 482518 - DNA, 25 bp, Mus musculus
gagctcatccagctggtcaacaagg

SEQ ID NO: 482519 - DNA, 25 bp, Mus musculus
gagctcatccaggtggtcaacaagg

SEQ ID NO: 482520 - DNA, 25 bp, Mus musculus
gagctcatccttcccctattcagtg

SEQ ID NO: 482521 - DNA, 25 bp, Mus musculus
gagctcatccttgccctattcagtg

SEQ ID NO: 482522 - DNA, 25 bp, Mus musculus
gagctcatcgaacgaggacttgcct

SEQ ID NO: 482523 - DNA, 25 bp, Mus musculus
gagctcatcgaaggaggacttgcct

SEQ ID NO: 482524 - DNA, 25 bp, Mus musculus
gagctcatctctaacaattttccaa

SEQ ID NO: 482525 - DNA, 25 bp, Mus musculus
gagctcatctcttacaattttccaa

SEQ ID NO: 482526 - DNA, 25 bp, Mus musculus
gagctcatgactcagacattctaga

SEQ ID NO: 482527 - DNA, 25 bp, Mus musculus
gagctcatgactgagacattctaga

SEQ ID NO: 482528 - DNA, 25 bp, Mus musculus
gagctcatgagcactacctggacag

SEQ ID NO: 482529 - DNA, 25 bp, Mus musculus
gagctcatgagctctacctggacag

SEQ ID NO: 482530 - DNA, 25 bp, Mus musculus
gagctcatgatcagcttaggcagca

SEQ ID NO: 482531 - DNA, 25 bp, Mus musculus
gagctcatgatctgcttaggcagca

SEQ ID NO: 482532 - DNA, 25 bp, Mus musculus
gagctcatgtaaatgcctatggatt

SEQ ID NO: 482533 - DNA, 25 bp, Mus musculus
gagctcatgtaattgcctatggatt

SEQ ID NO: 482534 - DNA, 25 bp, Mus musculus
gagctcatgttacgactttgccact

SEQ ID NO: 482535 - DNA, 25 bp, Mus musculus
gagctcatgttaggactttgccact

SEQ ID NO: 482536 - DNA, 25 bp, Mus musculus
gagctcatgtttctctacaatctta

SEQ ID NO: 482537 - DNA, 25 bp, Mus musculus
gagctcatgtttgtctacaatctta

SEQ ID NO: 482538 - DNA, 25 bp, Mus musculus
gagctcattaaacctattgtccctt

SEQ ID NO: 482539 - DNA, 25 bp, Mus musculus
gagctcattaaagctattgtccctt

SEQ ID NO: 482540 - DNA, 25 bp, Mus musculus
gagctcattagtctggtagccgcat

SEQ ID NO: 482541 - DNA, 25 bp, Mus musculus
gagctcattagtgtggtagccgcat

SEQ ID NO: 482542 - DNA, 25 bp, Mus musculus
gagctcattcataagctgccaggca

SEQ ID NO: 482543 - DNA, 25 bp, Mus musculus
gagctcattcatacaagtctgcctt

SEQ ID NO: 482544 - DNA, 25 bp, Mus musculus
gagctcattcatactctacaaacct

SEQ ID NO: 482545 - DNA, 25 bp, Mus musculus
gagctcattcattagctgccaggca

SEQ ID NO: 482546 - DNA, 25 bp, Mus musculus
gagctcattcattcaagtctgcctt

SEQ ID NO: 482547 - DNA, 25 bp, Mus musculus
gagctcattcattctctacaaacct

SEQ ID NO: 482548 - DNA, 25 bp, Mus musculus
gagctcattccaccaagtctgctga

SEQ ID NO: 482549 - DNA, 25 bp, Mus musculus
gagctcattccacgagacactctga

SEQ ID NO: 482550 - DNA, 25 bp, Mus musculus
gagctcattccagcaagtctgctga

SEQ ID NO: 482551 - DNA, 25 bp, Mus musculus
gagctcattccaggagacactctga

SEQ ID NO: 482552 - DNA, 25 bp, Mus musculus
gagctcattgacaggtgaatctgat

SEQ ID NO: 482553 - DNA, 25 bp, Mus musculus
gagctcattgactggtgaatctgat

SEQ ID NO: 482554 - DNA, 25 bp, Mus musculus
gagctcattgagatatcacaacaga

SEQ ID NO: 482555 - DNA, 25 bp, Mus musculus
gagctcattgagttatcacaacaga

SEQ ID NO: 482556 - DNA, 25 bp, Mus musculus
gagctcattgcacagatcagcccat

SEQ ID NO: 482557 - DNA, 25 bp, Mus musculus
gagctcattgcagagatcagcccat

SEQ ID NO: 482558 - DNA, 25 bp, Mus musculus
gagctcattgccaagatgacagcgg

SEQ ID NO: 482559 - DNA, 25 bp, Mus musculus
gagctcattgcctagatgacagcgg

SEQ ID NO: 482560 - DNA, 25 bp, Mus musculus
gagctcatttgtcgctaataatctt

SEQ ID NO: 482561 - DNA, 25 bp, Mus musculus
gagctcatttgtggctaataatctt

SEQ ID NO: 482562 - DNA, 25 bp, Mus musculus
gagctcattttgctagttcctgtca

SEQ ID NO: 482563 - DNA, 25 bp, Mus musculus
gagctcattttggtagttcctgtca

SEQ ID NO: 482564 - DNA, 25 bp, Mus musculus
gagctccaacacacttgcactaggg

SEQ ID NO: 482565 - DNA, 25 bp, Mus musculus
gagctccaacactcttgcactaggg

SEQ ID NO: 482566 - DNA, 25 bp, Mus musculus
gagctccaagaaagtggccagtgat

SEQ ID NO: 482567 - DNA, 25 bp, Mus musculus
gagctccaagaatgtggccagtgat

SEQ ID NO: 482568 - DNA, 25 bp, Mus musculus
gagctccaagccagcaggaagccaa

SEQ ID NO: 482569 - DNA, 25 bp, Mus musculus
gagctccaagcctgcaggaagccaa

SEQ ID NO: 482570 - DNA, 25 bp, Mus musculus
gagctccaaggcaacagtgttagca

SEQ ID NO: 482571 - DNA, 25 bp, Mus musculus
gagctccaaggctacagtgttagca

SEQ ID NO: 482572 - DNA, 25 bp, Mus musculus
gagctccacgtgagactagcttcag

SEQ ID NO: 482573 - DNA, 25 bp, Mus musculus
gagctccacgtgtgactagcttcag

SEQ ID NO: 482574 - DNA, 25 bp, Mus musculus
gagctccactccagaagacgttcag

SEQ ID NO: 482575 - DNA, 25 bp, Mus musculus
gagctccactcctgaagacgttcag

SEQ ID NO: 482576 - DNA, 25 bp, Mus musculus
gagctccacttcacacgtgaaaatg

SEQ ID NO: 482577 - DNA, 25 bp, Mus musculus
gagctccacttctcacgtgaaaatg

SEQ ID NO: 482578 - DNA, 25 bp, Mus musculus
gagctccagaatctgcacgggacac

SEQ ID NO: 482579 - DNA, 25 bp, Mus musculus
gagctccagaatgtgcacgggacac

SEQ ID NO: 482580 - DNA, 25 bp, Mus musculus
gagctccagactccaactgaactag

SEQ ID NO: 482581 - DNA, 25 bp, Mus musculus
gagctccagactgcaactgaactag

SEQ ID NO: 482582 - DNA, 25 bp, Mus musculus
gagctccaggagaccgaaacttgct

SEQ ID NO: 482583 - DNA, 25 bp, Mus musculus
gagctccaggagtccgaaacttgct

SEQ ID NO: 482584 - DNA, 25 bp, Mus musculus
gagctccaggccaacgtgcgggacc

SEQ ID NO: 482585 - DNA, 25 bp, Mus musculus
gagctccaggcctacgtgcgggacc

SEQ ID NO: 482586 - DNA, 25 bp, Mus musculus
gagctccagtcacgcagaacttgta

SEQ ID NO: 482587 - DNA, 25 bp, Mus musculus
gagctccagtcaggcagaacttgta

SEQ ID NO: 482588 - DNA, 25 bp, Mus musculus
gagctccagtttatattagcttgct

SEQ ID NO: 482589 - DNA, 25 bp, Mus musculus
gagctccagtttttattagcttgct

SEQ ID NO: 482590 - DNA, 25 bp, Mus musculus
gagctccatcaacgctgacatcgtt

SEQ ID NO: 482591 - DNA, 25 bp, Mus musculus
gagctccatcaaggctgacatcgtt

SEQ ID NO: 482592 - DNA, 25 bp, Mus musculus
gagctccatctcagaagcagatcat

SEQ ID NO: 482593 - DNA, 25 bp, Mus musculus
gagctccatctctgaagcagatcat

SEQ ID NO: 482594 - DNA, 25 bp, Mus musculus
gagctccatgagaagcgagggcctt

SEQ ID NO: 482595 - DNA, 25 bp, Mus musculus
gagctccatgagatctttacgtttc

SEQ ID NO: 482596 - DNA, 25 bp, Mus musculus
gagctccatgagcactctcagagga

SEQ ID NO: 482597 - DNA, 25 bp, Mus musculus
gagctccatgaggactctcagagga

SEQ ID NO: 482598 - DNA, 25 bp, Mus musculus
gagctccatgagtagcgagggcctt

SEQ ID NO: 482599 - DNA, 25 bp, Mus musculus
gagctccatgagttctttacgtttc

SEQ ID NO: 482600 - DNA, 25 bp, Mus musculus
gagctccatgatcttccatagcagt

SEQ ID NO: 482601 - DNA, 25 bp, Mus musculus
gagctccatgatgttccatagcagt

SEQ ID NO: 482602 - DNA, 25 bp, Mus musculus
gagctccatgccattcatgctggaa

SEQ ID NO: 482603 - DNA, 25 bp, Mus musculus
gagctccatgcctttcatgctggaa

SEQ ID NO: 482604 - DNA, 25 bp, Mus musculus
gagctccatgctagtccattagaac

SEQ ID NO: 482605 - DNA, 25 bp, Mus musculus
gagctccatgcttgtccattagaac

SEQ ID NO: 482606 - DNA, 25 bp, Mus musculus
gagctccattcaaattagtacttgt

SEQ ID NO: 482607 - DNA, 25 bp, Mus musculus
gagctccattcatattagtacttgt

SEQ ID NO: 482608 - DNA, 25 bp, Mus musculus
gagctccattccacacattgaggag

SEQ ID NO: 482609 - DNA, 25 bp, Mus musculus
gagctccattcctcacattgaggag

SEQ ID NO: 482610 - DNA, 25 bp, Mus musculus
gagctccatttacttgttgggactc

SEQ ID NO: 482611 - DNA, 25 bp, Mus musculus
gagctccatttagttgttgggactc

SEQ ID NO: 482612 - DNA, 25 bp, Mus musculus
gagctcccagcgcttgcctataatt

SEQ ID NO: 482613 - DNA, 25 bp, Mus musculus
gagctcccagcggttgcctataatt

SEQ ID NO: 482614 - DNA, 25 bp, Mus musculus
gagctcccaggaagtaccaataccc

SEQ ID NO: 482615 - DNA, 25 bp, Mus musculus
gagctcccaggatgtaccaataccc

SEQ ID NO: 482616 - DNA, 25 bp, Mus musculus
gagctccccagaattaatttctata

SEQ ID NO: 482617 - DNA, 25 bp, Mus musculus
gagctccccagatttaatttctata

SEQ ID NO: 482618 - DNA, 25 bp, Mus musculus
gagctccccagcagaattgaatcaa

SEQ ID NO: 482619 - DNA, 25 bp, Mus musculus
gagctccccagctgaattgaatcaa

SEQ ID NO: 482620 - DNA, 25 bp, Mus musculus
gagctcccgtgtatccgaaaattct

SEQ ID NO: 482621 - DNA, 25 bp, Mus musculus
gagctcccgtgtttccgaaaattct

SEQ ID NO: 482622 - DNA, 25 bp, Mus musculus
gagctccctcggcttatacaggaac

SEQ ID NO: 482623 - DNA, 25 bp, Mus musculus
gagctccctcgggttatacaggaac

SEQ ID NO: 482624 - DNA, 25 bp, Mus musculus
gagctccctgataccaaaattcaag

SEQ ID NO: 482625 - DNA, 25 bp, Mus musculus
gagctccctgattccaaaattcaag

SEQ ID NO: 482626 - DNA, 25 bp, Mus musculus
gagctcccttctattgaaaacaggt

SEQ ID NO: 482627 - DNA, 25 bp, Mus musculus
gagctcccttctccaggactaagca

SEQ ID NO: 482628 - DNA, 25 bp, Mus musculus
gagctcccttctgcaggactaagca

SEQ ID NO: 482629 - DNA, 25 bp, Mus musculus
gagctcccttcttttgaaaacaggt

SEQ ID NO: 482630 - DNA, 25 bp, Mus musculus
gagctccctttgcagtctgaaggca

SEQ ID NO: 482631 - DNA, 25 bp, Mus musculus
gagctccctttggagtctgaaggca

SEQ ID NO: 482632 - DNA, 25 bp, Mus musculus
gagctccgaacccaggcctgcttgg

SEQ ID NO: 482633 - DNA, 25 bp, Mus musculus
gagctccgaaccgaggcctgcttgg

SEQ ID NO: 482634 - DNA, 25 bp, Mus musculus
gagctccgatttaaccggcagtatg

SEQ ID NO: 482635 - DNA, 25 bp, Mus musculus
gagctccgattttaccggcagtatg

SEQ ID NO: 482636 - DNA, 25 bp, Mus musculus
gagctccgcctgaggtggcgccata

SEQ ID NO: 482637 - DNA, 25 bp, Mus musculus
gagctccgcctgtggtggcgccata

SEQ ID NO: 482638 - DNA, 25 bp, Mus musculus
gagctccggcaaagaccatggtaac

SEQ ID NO: 482639 - DNA, 25 bp, Mus musculus
gagctccggcaatgaccatggtaac

SEQ ID NO: 482640 - DNA, 25 bp, Mus musculus
gagctccgggaaatgaggtcctgct

SEQ ID NO: 482641 - DNA, 25 bp, Mus musculus
gagctccgggaattgaggtcctgct

SEQ ID NO: 482642 - DNA, 25 bp, Mus musculus
gagctccgtcttcagttgtatcttt

SEQ ID NO: 482643 - DNA, 25 bp, Mus musculus
gagctccgtcttgagttgtatcttt

SEQ ID NO: 482644 - DNA, 25 bp, Mus musculus
gagctcctactcaaagtggtggcaa

SEQ ID NO: 482645 - DNA, 25 bp, Mus musculus
gagctcctactctaagtggtggcaa

SEQ ID NO: 482646 - DNA, 25 bp, Mus musculus
gagctcctaggcagcaatgtgatct

SEQ ID NO: 482647 - DNA, 25 bp, Mus musculus
gagctcctaggctgcaatgtgatct

SEQ ID NO: 482648 - DNA, 25 bp, Mus musculus
gagctcctcagcctgggttcaggaa

SEQ ID NO: 482649 - DNA, 25 bp, Mus musculus
gagctcctcagcgtgggttcaggaa

SEQ ID NO: 482650 - DNA, 25 bp, Mus musculus
gagctcctcaggaagaacaggttcc

SEQ ID NO: 482651 - DNA, 25 bp, Mus musculus
gagctcctcaggtagaacaggttcc

SEQ ID NO: 482652 - DNA, 25 bp, Mus musculus
gagctcctctaacgcctttgctaga

SEQ ID NO: 482653 - DNA, 25 bp, Mus musculus
gagctcctctaaggcctttgctaga

SEQ ID NO: 482654 - DNA, 25 bp, Mus musculus
gagctcctcttgagtatggctgaaa

SEQ ID NO: 482655 - DNA, 25 bp, Mus musculus
gagctcctcttgtgtatggctgaaa

SEQ ID NO: 482656 - DNA, 25 bp, Mus musculus
gagctcctgagccaccatggtgtga

SEQ ID NO: 482657 - DNA, 25 bp, Mus musculus
gagctcctgagcgaccatggtgtga

SEQ ID NO: 482658 - DNA, 25 bp, Mus musculus
gagctcctggataagtacgcagctt

SEQ ID NO: 482659 - DNA, 25 bp, Mus musculus
gagctcctggattagtacgcagctt

SEQ ID NO: 482660 - DNA, 25 bp, Mus musculus
gagctcctgggtagattttcttaca

SEQ ID NO: 482661 - DNA, 25 bp, Mus musculus
gagctcctgggttgattttcttaca

SEQ ID NO: 482662 - DNA, 25 bp, Mus musculus
gagctcctgtttatccggaacactt

SEQ ID NO: 482663 - DNA, 25 bp, Mus musculus
gagctcctgtttttccggaacactt

SEQ ID NO: 482664 - DNA, 25 bp, Mus musculus
gagctccttaacactgctgtggtaa

SEQ ID NO: 482665 - DNA, 25 bp, Mus musculus
gagctccttaactctgctgtggtaa

SEQ ID NO: 482666 - DNA, 25 bp, Mus musculus
gagctccttagtagggtccttacca

SEQ ID NO: 482667 - DNA, 25 bp, Mus musculus
gagctccttagttgggtccttacca

SEQ ID NO: 482668 - DNA, 25 bp, Mus musculus
gagctccttatgatattcagcaagc

SEQ ID NO: 482669 - DNA, 25 bp, Mus musculus
gagctccttatgttattcagcaagc

SEQ ID NO: 482670 - DNA, 25 bp, Mus musculus
gagctccttcaaccctatgggattt

SEQ ID NO: 482671 - DNA, 25 bp, Mus musculus
gagctccttcaagcctatgggattt

SEQ ID NO: 482672 - DNA, 25 bp, Mus musculus
gagctccttcagaaacagtgttggg

SEQ ID NO: 482673 - DNA, 25 bp, Mus musculus
gagctccttcagtaacagtgttggg

SEQ ID NO: 482674 - DNA, 25 bp, Mus musculus
gagctccttccccaaagctgacagt

SEQ ID NO: 482675 - DNA, 25 bp, Mus musculus
gagctccttcccgaaagctgacagt

SEQ ID NO: 482676 - DNA, 25 bp, Mus musculus
gagctccttgagagtgtcctttcag

SEQ ID NO: 482677 - DNA, 25 bp, Mus musculus
gagctccttgagtgtgtcctttcag

SEQ ID NO: 482678 - DNA, 25 bp, Mus musculus
gagctccttggaatctagtacctta

SEQ ID NO: 482679 - DNA, 25 bp, Mus musculus
gagctccttggaatgttaccacgta

SEQ ID NO: 482680 - DNA, 25 bp, Mus musculus
gagctccttggattctagtacctta

SEQ ID NO: 482681 - DNA, 25 bp, Mus musculus
gagctccttggattgttaccacgta

SEQ ID NO: 482682 - DNA, 25 bp, Mus musculus
gagctccttgggatgagaccacggc

SEQ ID NO: 482683 - DNA, 25 bp, Mus musculus
gagctccttgggttgagaccacggc

SEQ ID NO: 482684 - DNA, 25 bp, Mus musculus
gagctcgaaaacagaacctccgaaa

SEQ ID NO: 482685 - DNA, 25 bp, Mus musculus
gagctcgaaaactgaacctccgaaa

SEQ ID NO: 482686 - DNA, 25 bp, Mus musculus
gagctcgaactaatatctatccaaa

SEQ ID NO: 482687 - DNA, 25 bp, Mus musculus
gagctcgaactattatctatccaaa

SEQ ID NO: 482688 - DNA, 25 bp, Mus musculus
gagctcgaatgtacttctgtgcaac

SEQ ID NO: 482689 - DNA, 25 bp, Mus musculus
gagctcgaatgttcttctgtgcaac

SEQ ID NO: 482690 - DNA, 25 bp, Mus musculus
gagctcgacaaaatttactcacatt

SEQ ID NO: 482691 - DNA, 25 bp, Mus musculus
gagctcgacaaattttactcacatt

SEQ ID NO: 482692 - DNA, 25 bp, Mus musculus
gagctcgacctccaaaaacagcgga

SEQ ID NO: 482693 - DNA, 25 bp, Mus musculus
gagctcgacctcgaaaaacagcgga

SEQ ID NO: 482694 - DNA, 25 bp, Mus musculus
gagctcgactacctaaccatcaggg

SEQ ID NO: 482695 - DNA, 25 bp, Mus musculus
gagctcgactacgtaaccatcaggg

SEQ ID NO: 482696 - DNA, 25 bp, Mus musculus
gagctcgagactaacaaggccacac

SEQ ID NO: 482697 - DNA, 25 bp, Mus musculus
gagctcgagacttacaaggccacac

SEQ ID NO: 482698 - DNA, 25 bp, Mus musculus
gagctcgagatactccaggctcctt

SEQ ID NO: 482699 - DNA, 25 bp, Mus musculus
gagctcgagatagtccaggctcctt

SEQ ID NO: 482700 - DNA, 25 bp, Mus musculus
gagctcgagttccagcgacgtcagc

SEQ ID NO: 482701 - DNA, 25 bp, Mus musculus
gagctcgagttcgagcgacgtcagc

SEQ ID NO: 482702 - DNA, 25 bp, Mus musculus
gagctcgcacttcaaagcacacaga

SEQ ID NO: 482703 - DNA, 25 bp, Mus musculus
gagctcgcacttgaaagcacacaga

SEQ ID NO: 482704 - DNA, 25 bp, Mus musculus
gagctcgcagaaagcagtagcaatt

SEQ ID NO: 482705 - DNA, 25 bp, Mus musculus
gagctcgcagaatgcagtagcaatt

SEQ ID NO: 482706 - DNA, 25 bp, Mus musculus
gagctcgcctgcagaactcagtgtg

SEQ ID NO: 482707 - DNA, 25 bp, Mus musculus
gagctcgcctgctgaactcagtgtg

SEQ ID NO: 482708 - DNA, 25 bp, Mus musculus
gagctcgcctttaaactgcagagtt

SEQ ID NO: 482709 - DNA, 25 bp, Mus musculus
gagctcgccttttaactgcagagtt

SEQ ID NO: 482710 - DNA, 25 bp, Mus musculus
gagctcgctctaccgcttgtcgcgg

SEQ ID NO: 482711 - DNA, 25 bp, Mus musculus
gagctcgctctagcgcttgtcgcgg

SEQ ID NO: 482712 - DNA, 25 bp, Mus musculus
gagctcgcttgcagataaactccac

SEQ ID NO: 482713 - DNA, 25 bp, Mus musculus
gagctcgcttgctgataaactccac

SEQ ID NO: 482714 - DNA, 25 bp, Mus musculus
gagctcggaaccagttggactctca

SEQ ID NO: 482715 - DNA, 25 bp, Mus musculus
gagctcggaacctgttggactctca

SEQ ID NO: 482716 - DNA, 25 bp, Mus musculus
gagctcggaactctaccctggtagg

SEQ ID NO: 482717 - DNA, 25 bp, Mus musculus
gagctcggaactgtaccctggtagg

SEQ ID NO: 482718 - DNA, 25 bp, Mus musculus
gagctcggaggactcagccttcttt

SEQ ID NO: 482719 - DNA, 25 bp, Mus musculus
gagctcggaggagtcagccttcttt

SEQ ID NO: 482720 - DNA, 25 bp, Mus musculus
gagctcgggaacacgtatgggcaaa

SEQ ID NO: 482721 - DNA, 25 bp, Mus musculus
gagctcgggaactcgtatgggcaaa

SEQ ID NO: 482722 - DNA, 25 bp, Mus musculus
gagctcgggctaatgtgaatcacct

SEQ ID NO: 482723 - DNA, 25 bp, Mus musculus
gagctcgggctattgtgaatcacct

SEQ ID NO: 482724 - DNA, 25 bp, Mus musculus
gagctcgggctcaatgacatgaaga

SEQ ID NO: 482725 - DNA, 25 bp, Mus musculus
gagctcgggctctatgacatgaaga

SEQ ID NO: 482726 - DNA, 25 bp, Mus musculus
gagctcgtgaataaggcccgcttgg

SEQ ID NO: 482727 - DNA, 25 bp, Mus musculus
gagctcgtgaattaggcccgcttgg

SEQ ID NO: 482728 - DNA, 25 bp, Mus musculus
gagctcgtgagtctccagatttgta

SEQ ID NO: 482729 - DNA, 25 bp, Mus musculus
gagctcgtgagtgtccagatttgta

SEQ ID NO: 482730 - DNA, 25 bp, Mus musculus
gagctcgtgtttactaagcaagctt

SEQ ID NO: 482731 - DNA, 25 bp, Mus musculus
gagctcgtgttttctaagcaagctt

SEQ ID NO: 482732 - DNA, 25 bp, Mus musculus
gagctcgttctgcagtacgaagaga

SEQ ID NO: 482733 - DNA, 25 bp, Mus musculus
gagctcgttctggagtacgaagaga

SEQ ID NO: 482734 - DNA, 25 bp, Mus musculus
gagctctaaaccaatgtctaccata

SEQ ID NO: 482735 - DNA, 25 bp, Mus musculus
gagctctaaacctatgtctaccata

SEQ ID NO: 482736 - DNA, 25 bp, Mus musculus
gagctctaatgtctaacacttcctc

SEQ ID NO: 482737 - DNA, 25 bp, Mus musculus
gagctctaatgtgtaacacttcctc

SEQ ID NO: 482738 - DNA, 25 bp, Mus musculus
gagctctacagaatcctgtcagtgg

SEQ ID NO: 482739 - DNA, 25 bp, Mus musculus
gagctctacagattcctgtcagtgg

SEQ ID NO: 482740 - DNA, 25 bp, Mus musculus
gagctctacgagaagctgcctcaag

SEQ ID NO: 482741 - DNA, 25 bp, Mus musculus
gagctctacgagtagctgcctcaag

SEQ ID NO: 482742 - DNA, 25 bp, Mus musculus
gagctctacttcaatgtcaccaagt

SEQ ID NO: 482743 - DNA, 25 bp, Mus musculus
gagctctacttctatgtcaccaagt

SEQ ID NO: 482744 - DNA, 25 bp, Mus musculus
gagctctactttaatccctgaggga

SEQ ID NO: 482745 - DNA, 25 bp, Mus musculus
gagctctactttatcgtgtgtcatt

SEQ ID NO: 482746 - DNA, 25 bp, Mus musculus
gagctctacttttatccctgaggga

SEQ ID NO: 482747 - DNA, 25 bp, Mus musculus
gagctctactttttcgtgtgtcatt

SEQ ID NO: 482748 - DNA, 25 bp, Mus musculus
gagctctagaaccagaactctcagt

SEQ ID NO: 482749 - DNA, 25 bp, Mus musculus
gagctctagaacgagaactctcagt

SEQ ID NO: 482750 - DNA, 25 bp, Mus musculus
gagctctagcccaaggattcccagg

SEQ ID NO: 482751 - DNA, 25 bp, Mus musculus
gagctctagccctaggattcccagg

SEQ ID NO: 482752 - DNA, 25 bp, Mus musculus
gagctctagccgctagttctcagaa

SEQ ID NO: 482753 - DNA, 25 bp, Mus musculus
gagctctagccggtagttctcagaa

SEQ ID NO: 482754 - DNA, 25 bp, Mus musculus
gagctctaggcccaaaacgacctta

SEQ ID NO: 482755 - DNA, 25 bp, Mus musculus
gagctctaggccgaaaacgacctta

SEQ ID NO: 482756 - DNA, 25 bp, Mus musculus
gagctctatcatcctgatgaccacg

SEQ ID NO: 482757 - DNA, 25 bp, Mus musculus
gagctctatcatgctgatgaccacg

SEQ ID NO: 482758 - DNA, 25 bp, Mus musculus
gagctctatggtcttcctgaagaca

SEQ ID NO: 482759 - DNA, 25 bp, Mus musculus
gagctctatggtgttcctgaagaca

SEQ ID NO: 482760 - DNA, 25 bp, Mus musculus
gagctctcagggacctgtgggctca

SEQ ID NO: 482761 - DNA, 25 bp, Mus musculus
gagctctcagggtcctgtgggctca

SEQ ID NO: 482762 - DNA, 25 bp, Mus musculus
gagctctcatacctgtgtggttgga

SEQ ID NO: 482763 - DNA, 25 bp, Mus musculus
gagctctcatacgtgtgtggttgga

SEQ ID NO: 482764 - DNA, 25 bp, Mus musculus
gagctctcatggcattgtcaccgtt

SEQ ID NO: 482765 - DNA, 25 bp, Mus musculus
gagctctcatgggattgtcaccgtt

SEQ ID NO: 482766 - DNA, 25 bp, Mus musculus
gagctctccaagctggtgatcgtag

SEQ ID NO: 482767 - DNA, 25 bp, Mus musculus
gagctctccaaggtggtgatcgtag

SEQ ID NO: 482768 - DNA, 25 bp, Mus musculus
gagctctcccgtaacggaacagcaa

SEQ ID NO: 482769 - DNA, 25 bp, Mus musculus
gagctctcccgttacggaacagcaa

SEQ ID NO: 482770 - DNA, 25 bp, Mus musculus
gagctctcctttaacctattcatcg

SEQ ID NO: 482771 - DNA, 25 bp, Mus musculus
gagctctccttttacctattcatcg

SEQ ID NO: 482772 - DNA, 25 bp, Mus musculus
gagctctcggttaccttcagacatg

SEQ ID NO: 482773 - DNA, 25 bp, Mus musculus
gagctctcggtttccttcagacatg

SEQ ID NO: 482774 - DNA, 25 bp, Mus musculus
gagctctctaccagcgtgcccgagg

SEQ ID NO: 482775 - DNA, 25 bp, Mus musculus
gagctctctacctgcgtgcccgagg

SEQ ID NO: 482776 - DNA, 25 bp, Mus musculus
gagctctctattaagttatccaata

SEQ ID NO: 482777 - DNA, 25 bp, Mus musculus
gagctctctatttagttatccaata

SEQ ID NO: 482778 - DNA, 25 bp, Mus musculus
gagctctctcagacacattctgcaa

SEQ ID NO: 482779 - DNA, 25 bp, Mus musculus
gagctctctcagtcacattctgcaa

SEQ ID NO: 482780 - DNA, 25 bp, Mus musculus
gagctctctcttctagcttacatac

SEQ ID NO: 482781 - DNA, 25 bp, Mus musculus
gagctctctcttgtagcttacatac

SEQ ID NO: 482782 - DNA, 25 bp, Mus musculus
gagctctctgacattaaggctggtc

SEQ ID NO: 482783 - DNA, 25 bp, Mus musculus
gagctctctgactttaaggctggtc

SEQ ID NO: 482784 - DNA, 25 bp, Mus musculus
gagctctctgagacactagcaactt

SEQ ID NO: 482785 - DNA, 25 bp, Mus musculus
gagctctctgagtcactagcaactt

SEQ ID NO: 482786 - DNA, 25 bp, Mus musculus
gagctctctgcacataggcacagtc

SEQ ID NO: 482787 - DNA, 25 bp, Mus musculus
gagctctctgcagataggcacagtc

SEQ ID NO: 482788 - DNA, 25 bp, Mus musculus
gagctctctgctcgaaatgttgttg

SEQ ID NO: 482789 - DNA, 25 bp, Mus musculus
gagctctctgctggaaatgttgttg

SEQ ID NO: 482790 - DNA, 25 bp, Mus musculus
gagctctcttgccataaatacctta

SEQ ID NO: 482791 - DNA, 25 bp, Mus musculus
gagctctcttgcgataaatacctta

SEQ ID NO: 482792 - DNA, 25 bp, Mus musculus
gagctctcttttatgttttcaacca

SEQ ID NO: 482793 - DNA, 25 bp, Mus musculus
gagctctcttttttgttttcaacca

SEQ ID NO: 482794 - DNA, 25 bp, Mus musculus
gagctctgacacaggtctgagaaca

SEQ ID NO: 482795 - DNA, 25 bp, Mus musculus
gagctctgacactggtctgagaaca

SEQ ID NO: 482796 - DNA, 25 bp, Mus musculus
gagctctgaccacgatagtcatttg

SEQ ID NO: 482797 - DNA, 25 bp, Mus musculus
gagctctgaccaggatagtcatttg

SEQ ID NO: 482798 - DNA, 25 bp, Mus musculus
gagctctgaccccagtgatagtgcc

SEQ ID NO: 482799 - DNA, 25 bp, Mus musculus
gagctctgacccgagtgatagtgcc

SEQ ID NO: 482800 - DNA, 25 bp, Mus musculus
gagctctgagaaccagcggtcacag

SEQ ID NO: 482801 - DNA, 25 bp, Mus musculus
gagctctgagaagcagcggtcacag

SEQ ID NO: 482802 - DNA, 25 bp, Mus musculus
gagctctgagccaggaatcgatgga

SEQ ID NO: 482803 - DNA, 25 bp, Mus musculus
gagctctgagcccacttagaaagta

SEQ ID NO: 482804 - DNA, 25 bp, Mus musculus
gagctctgagccgacttagaaagta

SEQ ID NO: 482805 - DNA, 25 bp, Mus musculus
gagctctgagcctggaatcgatgga

SEQ ID NO: 482806 - DNA, 25 bp, Mus musculus
gagctctgaggtacttgtcgccgga

SEQ ID NO: 482807 - DNA, 25 bp, Mus musculus
gagctctgaggttcttgtcgccgga

SEQ ID NO: 482808 - DNA, 25 bp, Mus musculus
gagctctgagtcagggtctgaattc

SEQ ID NO: 482809 - DNA, 25 bp, Mus musculus
gagctctgagtctgggtctgaattc

SEQ ID NO: 482810 - DNA, 25 bp, Mus musculus
gagctctgattcattactattcccc

SEQ ID NO: 482811 - DNA, 25 bp, Mus musculus
gagctctgattctttactattcccc

SEQ ID NO: 482812 - DNA, 25 bp, Mus musculus
gagctctgcaccagtgtctgagtat

SEQ ID NO: 482813 - DNA, 25 bp, Mus musculus
gagctctgcacctgtgtctgagtat

SEQ ID NO: 482814 - DNA, 25 bp, Mus musculus
gagctctgcagaattcttgtgttta

SEQ ID NO: 482815 - DNA, 25 bp, Mus musculus
gagctctgcagatttcttgtgttta

SEQ ID NO: 482816 - DNA, 25 bp, Mus musculus
gagctctgccccagggtaggtgaca

SEQ ID NO: 482817 - DNA, 25 bp, Mus musculus
gagctctgcccctgggtaggtgaca

SEQ ID NO: 482818 - DNA, 25 bp, Mus musculus
gagctctgctacactgggtattgca

SEQ ID NO: 482819 - DNA, 25 bp, Mus musculus
gagctctgctactctgggtattgca

SEQ ID NO: 482820 - DNA, 25 bp, Mus musculus
gagctctgctcacagacagctagaa

SEQ ID NO: 482821 - DNA, 25 bp, Mus musculus
gagctctgctcagagacagctagaa

SEQ ID NO: 482822 - DNA, 25 bp, Mus musculus
gagctctggaacactagaccaggtt

SEQ ID NO: 482823 - DNA, 25 bp, Mus musculus
gagctctggaactctagaccaggtt

SEQ ID NO: 482824 - DNA, 25 bp, Mus musculus
gagctctggagaagccccagcttct

SEQ ID NO: 482825 - DNA, 25 bp, Mus musculus
gagctctggagatgccccagcttct

SEQ ID NO: 482826 - DNA, 25 bp, Mus musculus
gagctctggagccttccttcacgtt

SEQ ID NO: 482827 - DNA, 25 bp, Mus musculus
gagctctggagcgttccttcacgtt

SEQ ID NO: 482828 - DNA, 25 bp, Mus musculus
gagctctgggatagcctgtgttcac

SEQ ID NO: 482829 - DNA, 25 bp, Mus musculus
gagctctgggattgcctgtgttcac

SEQ ID NO: 482830 - DNA, 25 bp, Mus musculus
gagctctggtggcatccattctgga

SEQ ID NO: 482831 - DNA, 25 bp, Mus musculus
gagctctggtgggatccattctgga

SEQ ID NO: 482832 - DNA, 25 bp, Mus musculus
gagctctggtgtccaccaagtgctg

SEQ ID NO: 482833 - DNA, 25 bp, Mus musculus
gagctctggtgtgcaccaagtgctg

SEQ ID NO: 482834 - DNA, 25 bp, Mus musculus
gagctctggttcacatgtattagga

SEQ ID NO: 482835 - DNA, 25 bp, Mus musculus
gagctctggttctcatgtattagga

SEQ ID NO: 482836 - DNA, 25 bp, Mus musculus
gagctctgtaaaccttcatgtgtca

SEQ ID NO: 482837 - DNA, 25 bp, Mus musculus
gagctctgtaaagcttcatgtgtca

SEQ ID NO: 482838 - DNA, 25 bp, Mus musculus
gagctctgtcacataacctgaactt

SEQ ID NO: 482839 - DNA, 25 bp, Mus musculus
gagctctgtcacttaacctgaactt

SEQ ID NO: 482840 - DNA, 25 bp, Mus musculus
gagctctgtctgatgagttgtcctt

SEQ ID NO: 482841 - DNA, 25 bp, Mus musculus
gagctctgtctgttgagttgtcctt

SEQ ID NO: 482842 - DNA, 25 bp, Mus musculus
gagctctgtgacaggtcctgctgag

SEQ ID NO: 482843 - DNA, 25 bp, Mus musculus
gagctctgtgactggtcctgctgag

SEQ ID NO: 482844 - DNA, 25 bp, Mus musculus
gagctctgtgcccaggacagagata

SEQ ID NO: 482845 - DNA, 25 bp, Mus musculus
gagctctgtgccgaggacagagata

SEQ ID NO: 482846 - DNA, 25 bp, Mus musculus
gagctctgttggatccgaatgtgta

SEQ ID NO: 482847 - DNA, 25 bp, Mus musculus
gagctctgttggttccgaatgtgta

SEQ ID NO: 482848 - DNA, 25 bp, Mus musculus
gagctctgtttcaaactctaggtga

SEQ ID NO: 482849 - DNA, 25 bp, Mus musculus
gagctctgtttcattccagtctgaa

SEQ ID NO: 482850 - DNA, 25 bp, Mus musculus
gagctctgtttctaactctaggtga

SEQ ID NO: 482851 - DNA, 25 bp, Mus musculus
gagctctgtttctttccagtctgaa

SEQ ID NO: 482852 - DNA, 25 bp, Mus musculus
gagctcttagctcgttaggtatgga

SEQ ID NO: 482853 - DNA, 25 bp, Mus musculus
gagctcttagctggttaggtatgga

SEQ ID NO: 482854 - DNA, 25 bp, Mus musculus
gagctcttataactaatgtgtgtat

SEQ ID NO: 482855 - DNA, 25 bp, Mus musculus
gagctcttataagtaatgtgtgtat

SEQ ID NO: 482856 - DNA, 25 bp, Mus musculus
gagctcttatctatacaatcatcca

SEQ ID NO: 482857 - DNA, 25 bp, Mus musculus
gagctcttatctttacaatcatcca

SEQ ID NO: 482858 - DNA, 25 bp, Mus musculus
gagctcttcagaaacctccaggctg

SEQ ID NO: 482859 - DNA, 25 bp, Mus musculus
gagctcttcagatacctccaggctg

SEQ ID NO: 482860 - DNA, 25 bp, Mus musculus
gagctcttcagcatggcaggacgtg

SEQ ID NO: 482861 - DNA, 25 bp, Mus musculus
gagctcttcagcttggcaggacgtg

SEQ ID NO: 482862 - DNA, 25 bp, Mus musculus
gagctcttctctcatgtgaagcgca

SEQ ID NO: 482863 - DNA, 25 bp, Mus musculus
gagctcttctctctgaatttttgca

SEQ ID NO: 482864 - DNA, 25 bp, Mus musculus
gagctcttctctgatgtgaagcgca

SEQ ID NO: 482865 - DNA, 25 bp, Mus musculus
gagctcttctctgtgaatttttgca

SEQ ID NO: 482866 - DNA, 25 bp, Mus musculus
gagctcttctgacatttgcccagta

SEQ ID NO: 482867 - DNA, 25 bp, Mus musculus
gagctcttctgagatttgcccagta

SEQ ID NO: 482868 - DNA, 25 bp, Mus musculus
gagctcttgaatacgtgtgtgggac

SEQ ID NO: 482869 - DNA, 25 bp, Mus musculus
gagctcttgaattcgtgtgtgggac

SEQ ID NO: 482870 - DNA, 25 bp, Mus musculus
gagctcttgcctcagtactcaaaag

SEQ ID NO: 482871 - DNA, 25 bp, Mus musculus
gagctcttgcctcttttcatgagaa

SEQ ID NO: 482872 - DNA, 25 bp, Mus musculus
gagctcttgcctgagtactcaaaag

SEQ ID NO: 482873 - DNA, 25 bp, Mus musculus
gagctcttgcctgttttcatgagaa

SEQ ID NO: 482874 - DNA, 25 bp, Mus musculus
gagctcttgcttcatgttgggcatt

SEQ ID NO: 482875 - DNA, 25 bp, Mus musculus
gagctcttgcttgatgttgggcatt

SEQ ID NO: 482876 - DNA, 25 bp, Mus musculus
gagctcttggctctattctgtgtgc

SEQ ID NO: 482877 - DNA, 25 bp, Mus musculus
gagctcttggctgtattctgtgtgc

SEQ ID NO: 482878 - DNA, 25 bp, Mus musculus
gagctcttgggcacccacagagggt

SEQ ID NO: 482879 - DNA, 25 bp, Mus musculus
gagctcttgggctcccacagagggt

SEQ ID NO: 482880 - DNA, 25 bp, Mus musculus
gagctcttggtgattagcattgtct

SEQ ID NO: 482881 - DNA, 25 bp, Mus musculus
gagctcttggtgtttagcattgtct

SEQ ID NO: 482882 - DNA, 25 bp, Mus musculus
gagctcttggttaatgattacccta

SEQ ID NO: 482883 - DNA, 25 bp, Mus musculus
gagctcttggtttatgattacccta

SEQ ID NO: 482884 - DNA, 25 bp, Mus musculus
gagctctttaagacaaggatctgct

SEQ ID NO: 482885 - DNA, 25 bp, Mus musculus
gagctctttaagattcgttctttcc

SEQ ID NO: 482886 - DNA, 25 bp, Mus musculus
gagctctttaagtcaaggatctgct

SEQ ID NO: 482887 - DNA, 25 bp, Mus musculus
gagctctttaagtttcgttctttcc

SEQ ID NO: 482888 - DNA, 25 bp, Mus musculus
gagctctttaatcctgactgtgctg

SEQ ID NO: 482889 - DNA, 25 bp, Mus musculus
gagctctttaatgctgactgtgctg

SEQ ID NO: 482890 - DNA, 25 bp, Mus musculus
gagctctttaggatgatgactgatt

SEQ ID NO: 482891 - DNA, 25 bp, Mus musculus
gagctctttaggttgatgactgatt

SEQ ID NO: 482892 - DNA, 25 bp, Mus musculus
gagctctttatcagggaggccctgt

SEQ ID NO: 482893 - DNA, 25 bp, Mus musculus
gagctctttatctgggaggccctgt

SEQ ID NO: 482894 - DNA, 25 bp, Mus musculus
gagctctttctgagtagacttacta

SEQ ID NO: 482895 - DNA, 25 bp, Mus musculus
gagctctttctgtgtagacttacta

SEQ ID NO: 482896 - DNA, 25 bp, Mus musculus
gagctcttttcacgcctcaaagtga

SEQ ID NO: 482897 - DNA, 25 bp, Mus musculus
gagctcttttcaggcctcaaagtga

SEQ ID NO: 482898 - DNA, 25 bp, Mus musculus
gagctgaaaaatcaacctgacgaca

SEQ ID NO: 482899 - DNA, 25 bp, Mus musculus
gagctgaaaaatgaacctgacgaca

SEQ ID NO: 482900 - DNA, 25 bp, Mus musculus
gagctgaaactcacaaagccctgag

SEQ ID NO: 482901 - DNA, 25 bp, Mus musculus
gagctgaaactctcaaagccctgag

SEQ ID NO: 482902 - DNA, 25 bp, Mus musculus
gagctgaaagatcagggcccactcc

SEQ ID NO: 482903 - DNA, 25 bp, Mus musculus
gagctgaaagatgagggcccactcc

SEQ ID NO: 482904 - DNA, 25 bp, Mus musculus
gagctgaaaggaacttggcaggcat

SEQ ID NO: 482905 - DNA, 25 bp, Mus musculus
gagctgaaaggatcttggcaggcat

SEQ ID NO: 482906 - DNA, 25 bp, Mus musculus
gagctgaaatccattgttctgccat

SEQ ID NO: 482907 - DNA, 25 bp, Mus musculus
gagctgaaatcctttgttctgccat

SEQ ID NO: 482908 - DNA, 25 bp, Mus musculus
gagctgaaatctaagctatctcttt

SEQ ID NO: 482909 - DNA, 25 bp, Mus musculus
gagctgaaatctcatgcccttttaa

SEQ ID NO: 482910 - DNA, 25 bp, Mus musculus
gagctgaaatctgatgcccttttaa

SEQ ID NO: 482911 - DNA, 25 bp, Mus musculus
gagctgaaatcttagctatctcttt

SEQ ID NO: 482912 - DNA, 25 bp, Mus musculus
gagctgaaatgtccactctcatgat

SEQ ID NO: 482913 - DNA, 25 bp, Mus musculus
gagctgaaatgtgcactctcatgat

SEQ ID NO: 482914 - DNA, 25 bp, Mus musculus
gagctgaacagcctcattggaattg

SEQ ID NO: 482915 - DNA, 25 bp, Mus musculus
gagctgaacagcgtcattggaattg

SEQ ID NO: 482916 - DNA, 25 bp, Mus musculus
gagctgaacaggctttccaactgga

SEQ ID NO: 482917 - DNA, 25 bp, Mus musculus
gagctgaacagggtttccaactgga

SEQ ID NO: 482918 - DNA, 25 bp, Mus musculus
gagctgaacagtatctaacgcgcaa

SEQ ID NO: 482919 - DNA, 25 bp, Mus musculus
gagctgaacagtttctaacgcgcaa

SEQ ID NO: 482920 - DNA, 25 bp, Mus musculus
gagctgaaccacactgtccatatta

SEQ ID NO: 482921 - DNA, 25 bp, Mus musculus
gagctgaaccactctgtccatatta

SEQ ID NO: 482922 - DNA, 25 bp, Mus musculus
gagctgaaccctaaagatgctactt

SEQ ID NO: 482923 - DNA, 25 bp, Mus musculus
gagctgaacccttaagatgctactt

SEQ ID NO: 482924 - DNA, 25 bp, Mus musculus
gagctgaactgaaggcttctctcct

SEQ ID NO: 482925 - DNA, 25 bp, Mus musculus
gagctgaactgatggcttctctcct

SEQ ID NO: 482926 - DNA, 25 bp, Mus musculus
gagctgaactggattttaactccat

SEQ ID NO: 482927 - DNA, 25 bp, Mus musculus
gagctgaactggtttttaactccat

SEQ ID NO: 482928 - DNA, 25 bp, Mus musculus
gagctgaactgtatgcaagagccta

SEQ ID NO: 482929 - DNA, 25 bp, Mus musculus
gagctgaactgtttgcaagagccta

SEQ ID NO: 482930 - DNA, 25 bp, Mus musculus
gagctgaagaagattatggacaaga

SEQ ID NO: 482931 - DNA, 25 bp, Mus musculus
gagctgaagaagtttatggacaaga

SEQ ID NO: 482932 - DNA, 25 bp, Mus musculus
gagctgaaggaaagccctctagttt

SEQ ID NO: 482933 - DNA, 25 bp, Mus musculus
gagctgaaggaatgccctctagttt

SEQ ID NO: 482934 - DNA, 25 bp, Mus musculus
gagctgaaggccatggacgtttaaa

SEQ ID NO: 482935 - DNA, 25 bp, Mus musculus
gagctgaaggcccattttcgtaagg

SEQ ID NO: 482936 - DNA, 25 bp, Mus musculus
gagctgaaggccgattttcgtaagg

SEQ ID NO: 482937 - DNA, 25 bp, Mus musculus
gagctgaaggccttggacgtttaaa

SEQ ID NO: 482938 - DNA, 25 bp, Mus musculus
gagctgaaggctcttctccagagtt

SEQ ID NO: 482939 - DNA, 25 bp, Mus musculus
gagctgaaggctgttctccagagtt

SEQ ID NO: 482940 - DNA, 25 bp, Mus musculus
gagctgaagggcagactccccgaag

SEQ ID NO: 482941 - DNA, 25 bp, Mus musculus
gagctgaagggcagttctgatatca

SEQ ID NO: 482942 - DNA, 25 bp, Mus musculus
gagctgaagggctgactccccgaag

SEQ ID NO: 482943 - DNA, 25 bp, Mus musculus
gagctgaagggctgttctgatatca

SEQ ID NO: 482944 - DNA, 25 bp, Mus musculus
gagctgaagggtatgttcctgccaa

SEQ ID NO: 482945 - DNA, 25 bp, Mus musculus
gagctgaagggtttgttcctgccaa

SEQ ID NO: 482946 - DNA, 25 bp, Mus musculus
gagctgaagtacctcatgatcggag

SEQ ID NO: 482947 - DNA, 25 bp, Mus musculus
gagctgaagtacgtcatgatcggag

SEQ ID NO: 482948 - DNA, 25 bp, Mus musculus
gagctgaataaccataccctcatgg

SEQ ID NO: 482949 - DNA, 25 bp, Mus musculus
gagctgaataacgataccctcatgg

SEQ ID NO: 482950 - DNA, 25 bp, Mus musculus
gagctgaatatccgggtcattgcca

SEQ ID NO: 482951 - DNA, 25 bp, Mus musculus
gagctgaatatcggggtcattgcca

SEQ ID NO: 482952 - DNA, 25 bp, Mus musculus
gagctgaatctactccttgggtttt

SEQ ID NO: 482953 - DNA, 25 bp, Mus musculus
gagctgaatctagtccttgggtttt

SEQ ID NO: 482954 - DNA, 25 bp, Mus musculus
gagctgaatgacaagcccttaccaa

SEQ ID NO: 482955 - DNA, 25 bp, Mus musculus
gagctgaatgactagcccttaccaa

SEQ ID NO: 482956 - DNA, 25 bp, Mus musculus
gagctgaatggtactccatgtgtta

SEQ ID NO: 482957 - DNA, 25 bp, Mus musculus
gagctgaatggttctccatgtgtta

SEQ ID NO: 482958 - DNA, 25 bp, Mus musculus
gagctgaattcacaccgtgtgggaa

SEQ ID NO: 482959 - DNA, 25 bp, Mus musculus
gagctgaattcagaccgtgtgggaa

SEQ ID NO: 482960 - DNA, 25 bp, Mus musculus
gagctgaattctatgtgatttcctc

SEQ ID NO: 482961 - DNA, 25 bp, Mus musculus
gagctgaattctttgtgatttcctc

SEQ ID NO: 482962 - DNA, 25 bp, Mus musculus
gagctgaattgtacagtctctctat

SEQ ID NO: 482963 - DNA, 25 bp, Mus musculus
gagctgaattgttcagtctctctat

SEQ ID NO: 482964 - DNA, 25 bp, Mus musculus
gagctgacaagccttccatcagagg

SEQ ID NO: 482965 - DNA, 25 bp, Mus musculus
gagctgacaagcgttccatcagagg

SEQ ID NO: 482966 - DNA, 25 bp, Mus musculus
gagctgacacgtcccagggtgactc

SEQ ID NO: 482967 - DNA, 25 bp, Mus musculus
gagctgacacgtgccagggtgactc

SEQ ID NO: 482968 - DNA, 25 bp, Mus musculus
gagctgacagaacagcagtatgtga

SEQ ID NO: 482969 - DNA, 25 bp, Mus musculus
gagctgacagaagagcagtatgtga

SEQ ID NO: 482970 - DNA, 25 bp, Mus musculus
gagctgacagccaccttggaatact

SEQ ID NO: 482971 - DNA, 25 bp, Mus musculus
gagctgacagcctccttggaatact

SEQ ID NO: 482972 - DNA, 25 bp, Mus musculus
gagctgacatgaatctgtgttcacg

SEQ ID NO: 482973 - DNA, 25 bp, Mus musculus
gagctgacatgattctgtgttcacg

SEQ ID NO: 482974 - DNA, 25 bp, Mus musculus
gagctgacatgtcctattgagtcac

SEQ ID NO: 482975 - DNA, 25 bp, Mus musculus
gagctgacatgtgctattgagtcac

SEQ ID NO: 482976 - DNA, 25 bp, Mus musculus
gagctgacattcaatgatccttccc

SEQ ID NO: 482977 - DNA, 25 bp, Mus musculus
gagctgacattctatgatccttccc

SEQ ID NO: 482978 - DNA, 25 bp, Mus musculus
gagctgacatttcacacatatttgg

SEQ ID NO: 482979 - DNA, 25 bp, Mus musculus
gagctgacatttgacacatatttgg

SEQ ID NO: 482980 - DNA, 25 bp, Mus musculus
gagctgaccacgagaacatgaccat

SEQ ID NO: 482981 - DNA, 25 bp, Mus musculus
gagctgaccacgtgaacatgaccat

SEQ ID NO: 482982 - DNA, 25 bp, Mus musculus
gagctgaccagtcgaacgttaacta

SEQ ID NO: 482983 - DNA, 25 bp, Mus musculus
gagctgaccagtggaacgttaacta

SEQ ID NO: 482984 - DNA, 25 bp, Mus musculus
gagctgaccatgagacaaaacccct

SEQ ID NO: 482985 - DNA, 25 bp, Mus musculus
gagctgaccatgtgacaaaacccct

SEQ ID NO: 482986 - DNA, 25 bp, Mus musculus
gagctgaccgagcacgaatgaccgt

SEQ ID NO: 482987 - DNA, 25 bp, Mus musculus
gagctgaccgaggacgaatgaccgt

SEQ ID NO: 482988 - DNA, 25 bp, Mus musculus
gagctgacctagaggctgcctgaga

SEQ ID NO: 482989 - DNA, 25 bp, Mus musculus
gagctgacctagtggctgcctgaga

SEQ ID NO: 482990 - DNA, 25 bp, Mus musculus
gagctgacctccatggtactcggaa

SEQ ID NO: 482991 - DNA, 25 bp, Mus musculus
gagctgacctccttggtactcggaa

SEQ ID NO: 482992 - DNA, 25 bp, Mus musculus
gagctgacggttcatatatgcaaaa

SEQ ID NO: 482993 - DNA, 25 bp, Mus musculus
gagctgacggttgatatatgcaaaa

SEQ ID NO: 482994 - DNA, 25 bp, Mus musculus
gagctgacgtaaagtgtgggccaca

SEQ ID NO: 482995 - DNA, 25 bp, Mus musculus
gagctgacgtaatgtgtgggccaca

SEQ ID NO: 482996 - DNA, 25 bp, Mus musculus
gagctgactcttagccagtgtgatg

SEQ ID NO: 482997 - DNA, 25 bp, Mus musculus
gagctgactctttgccagtgtgatg

SEQ ID NO: 482998 - DNA, 25 bp, Mus musculus
gagctgactgacaaaaaccaaacct

SEQ ID NO: 482999 - DNA, 25 bp, Mus musculus
gagctgactgactaaaaccaaacct

SEQ ID NO: 483000 - DNA, 25 bp, Mus musculus
gagctgactttgaaagccactgaca

SEQ ID NO: 483001 - DNA, 25 bp, Mus musculus
gagctgactttgtaagccactgaca

SEQ ID NO: 483002 - DNA, 25 bp, Mus musculus
gagctgagaacaactcatttcctga

SEQ ID NO: 483003 - DNA, 25 bp, Mus musculus
gagctgagaacatctcatttcctga

SEQ ID NO: 483004 - DNA, 25 bp, Mus musculus
gagctgagaatgcttgttacttttc

SEQ ID NO: 483005 - DNA, 25 bp, Mus musculus
gagctgagaatggttgttacttttc

SEQ ID NO: 483006 - DNA, 25 bp, Mus musculus
gagctgagacatccagagggtccaa

SEQ ID NO: 483007 - DNA, 25 bp, Mus musculus
gagctgagacatgcagagggtccaa

SEQ ID NO: 483008 - DNA, 25 bp, Mus musculus
gagctgagaccgcttatcctgcatt

SEQ ID NO: 483009 - DNA, 25 bp, Mus musculus
gagctgagaccggttatcctgcatt

SEQ ID NO: 483010 - DNA, 25 bp, Mus musculus
gagctgagagaaagtcccaccaaga

SEQ ID NO: 483011 - DNA, 25 bp, Mus musculus
gagctgagagaatgtcccaccaaga

SEQ ID NO: 483012 - DNA, 25 bp, Mus musculus
gagctgagagctactgccttgtccg

SEQ ID NO: 483013 - DNA, 25 bp, Mus musculus
gagctgagagcttctgccttgtccg

SEQ ID NO: 483014 - DNA, 25 bp, Mus musculus
gagctgagagtccagaagaccctaa

SEQ ID NO: 483015 - DNA, 25 bp, Mus musculus
gagctgagagtcgagaagaccctaa

SEQ ID NO: 483016 - DNA, 25 bp, Mus musculus
gagctgagattcatggctcttcctt

SEQ ID NO: 483017 - DNA, 25 bp, Mus musculus
gagctgagattcttggctcttcctt

SEQ ID NO: 483018 - DNA, 25 bp, Mus musculus
gagctgagcaacagtgttcaccggc

SEQ ID NO: 483019 - DNA, 25 bp, Mus musculus
gagctgagcaactgtgttcaccggc

SEQ ID NO: 483020 - DNA, 25 bp, Mus musculus
gagctgagcaagacgaacactgcat

SEQ ID NO: 483021 - DNA, 25 bp, Mus musculus
gagctgagcaagctgcccgctgatc

SEQ ID NO: 483022 - DNA, 25 bp, Mus musculus
gagctgagcaaggtgcccgctgatc

SEQ ID NO: 483023 - DNA, 25 bp, Mus musculus
gagctgagcaagtcgaacactgcat

SEQ ID NO: 483024 - DNA, 25 bp, Mus musculus
gagctgagcatcatggtgacgtcaa

SEQ ID NO: 483025 - DNA, 25 bp, Mus musculus
gagctgagcatcttggtgacgtcaa

SEQ ID NO: 483026 - DNA, 25 bp, Mus musculus
gagctgagcatgacaacttcaggtt

SEQ ID NO: 483027 - DNA, 25 bp, Mus musculus
gagctgagcatgtcaacttcaggtt

SEQ ID NO: 483028 - DNA, 25 bp, Mus musculus
gagctgagccagattcttcggattt

SEQ ID NO: 483029 - DNA, 25 bp, Mus musculus
gagctgagccagtttcttcggattt

SEQ ID NO: 483030 - DNA, 25 bp, Mus musculus
gagctgagctacatgccagtcagaa

SEQ ID NO: 483031 - DNA, 25 bp, Mus musculus
gagctgagctacttgccagtcagaa

SEQ ID NO: 483032 - DNA, 25 bp, Mus musculus
gagctgagctatcggtctgttatac

SEQ ID NO: 483033 - DNA, 25 bp, Mus musculus
gagctgagctatgggtctgttatac

SEQ ID NO: 483034 - DNA, 25 bp, Mus musculus
gagctgagctcgcttctagaacaat

SEQ ID NO: 483035 - DNA, 25 bp, Mus musculus
gagctgagctcggttctagaacaat

SEQ ID NO: 483036 - DNA, 25 bp, Mus musculus
gagctgaggactcctgctgtagcca

SEQ ID NO: 483037 - DNA, 25 bp, Mus musculus
gagctgaggactgctgctgtagcca

SEQ ID NO: 483038 - DNA, 25 bp, Mus musculus
gagctgaggatgatctctggccaat

SEQ ID NO: 483039 - DNA, 25 bp, Mus musculus
gagctgaggatgttctctggccaat

SEQ ID NO: 483040 - DNA, 25 bp, Mus musculus
gagctgaggcttctaggatctaccc

SEQ ID NO: 483041 - DNA, 25 bp, Mus musculus
gagctgaggcttgtaggatctaccc

SEQ ID NO: 483042 - DNA, 25 bp, Mus musculus
gagctgagggacagtttccgagccc

SEQ ID NO: 483043 - DNA, 25 bp, Mus musculus
gagctgagggactgtttccgagccc

SEQ ID NO: 483044 - DNA, 25 bp, Mus musculus
gagctgagggctatactggtaagtc

SEQ ID NO: 483045 - DNA, 25 bp, Mus musculus
gagctgagggctttactggtaagtc

SEQ ID NO: 483046 - DNA, 25 bp, Mus musculus
gagctgagtattactattctctagt

SEQ ID NO: 483047 - DNA, 25 bp, Mus musculus
gagctgagtatttctattctctagt

SEQ ID NO: 483048 - DNA, 25 bp, Mus musculus
gagctgagttggcttctcctcaatc

SEQ ID NO: 483049 - DNA, 25 bp, Mus musculus
gagctgagttgggttctcctcaatc

SEQ ID NO: 483050 - DNA, 25 bp, Mus musculus
gagctgataagcagagccacctctt

SEQ ID NO: 483051 - DNA, 25 bp, Mus musculus
gagctgataagctgagccacctctt

SEQ ID NO: 483052 - DNA, 25 bp, Mus musculus
gagctgataccaccttcctcacagg

SEQ ID NO: 483053 - DNA, 25 bp, Mus musculus
gagctgataccagcttcctcacagg

SEQ ID NO: 483054 - DNA, 25 bp, Mus musculus
gagctgatatacagtctgcttgcag

SEQ ID NO: 483055 - DNA, 25 bp, Mus musculus
gagctgatatactgtctgcttgcag

SEQ ID NO: 483056 - DNA, 25 bp, Mus musculus
gagctgatcaaccaattggctgggc

SEQ ID NO: 483057 - DNA, 25 bp, Mus musculus
gagctgatcaacgaattggctgggc

SEQ ID NO: 483058 - DNA, 25 bp, Mus musculus
gagctgatcataagccacacttcaa

SEQ ID NO: 483059 - DNA, 25 bp, Mus musculus
gagctgatcatatgccacacttcaa

SEQ ID NO: 483060 - DNA, 25 bp, Mus musculus
gagctgatcccgattgtgaagcctg

SEQ ID NO: 483061 - DNA, 25 bp, Mus musculus
gagctgatcccgtttgtgaagcctg

SEQ ID NO: 483062 - DNA, 25 bp, Mus musculus
gagctgatccgtcagcggctaaaag

SEQ ID NO: 483063 - DNA, 25 bp, Mus musculus
gagctgatccgtgagcggctaaaag

SEQ ID NO: 483064 - DNA, 25 bp, Mus musculus
gagctgatcctgagcaatgccatgt

SEQ ID NO: 483065 - DNA, 25 bp, Mus musculus
gagctgatcctgtgcaatgccatgt

SEQ ID NO: 483066 - DNA, 25 bp, Mus musculus
gagctgatcttactggtgtgtgttt

SEQ ID NO: 483067 - DNA, 25 bp, Mus musculus
gagctgatcttagtggtgtgtgttt

SEQ ID NO: 483068 - DNA, 25 bp, Mus musculus
gagctgatgatcaccttctgattca

SEQ ID NO: 483069 - DNA, 25 bp, Mus musculus
gagctgatgatcatctagtccctat

SEQ ID NO: 483070 - DNA, 25 bp, Mus musculus
gagctgatgatctccttctgattca

SEQ ID NO: 483071 - DNA, 25 bp, Mus musculus
gagctgatgatcttctagtccctat

SEQ ID NO: 483072 - DNA, 25 bp, Mus musculus
gagctgatgcggcaaccctgcatta

SEQ ID NO: 483073 - DNA, 25 bp, Mus musculus
gagctgatgcgggaaccctgcatta

SEQ ID NO: 483074 - DNA, 25 bp, Mus musculus
gagctgatgctcacatttgaaactt

SEQ ID NO: 483075 - DNA, 25 bp, Mus musculus
gagctgatgctcatgccaaagtatt

SEQ ID NO: 483076 - DNA, 25 bp, Mus musculus
gagctgatgctctcatttgaaactt

SEQ ID NO: 483077 - DNA, 25 bp, Mus musculus
gagctgatgctcttgccaaagtatt

SEQ ID NO: 483078 - DNA, 25 bp, Mus musculus
gagctgatggacacctttcggcctg

SEQ ID NO: 483079 - DNA, 25 bp, Mus musculus
gagctgatggaccaactggagcaat

SEQ ID NO: 483080 - DNA, 25 bp, Mus musculus
gagctgatggacgaactggagcaat

SEQ ID NO: 483081 - DNA, 25 bp, Mus musculus
gagctgatggactcctttcggcctg

SEQ ID NO: 483082 - DNA, 25 bp, Mus musculus
gagctgatggcacatcccggatacc

SEQ ID NO: 483083 - DNA, 25 bp, Mus musculus
gagctgatggcagatcccggatacc

SEQ ID NO: 483084 - DNA, 25 bp, Mus musculus
gagctgatggtgatactcagactca

SEQ ID NO: 483085 - DNA, 25 bp, Mus musculus
gagctgatggtgctattgcttctct

SEQ ID NO: 483086 - DNA, 25 bp, Mus musculus
gagctgatggtggtattgcttctct

SEQ ID NO: 483087 - DNA, 25 bp, Mus musculus
gagctgatggtgttactcagactca

SEQ ID NO: 483088 - DNA, 25 bp, Mus musculus
gagctgatgtaaatcttgtacccat

SEQ ID NO: 483089 - DNA, 25 bp, Mus musculus
gagctgatgtaattcttgtacccat

SEQ ID NO: 483090 - DNA, 25 bp, Mus musculus
gagctgatgtcaatcgcactgcctc

SEQ ID NO: 483091 - DNA, 25 bp, Mus musculus
gagctgatgtcattcgcactgcctc

SEQ ID NO: 483092 - DNA, 25 bp, Mus musculus
gagctgattcacactcaaatttttc

SEQ ID NO: 483093 - DNA, 25 bp, Mus musculus
gagctgattcactctcaaatttttc

SEQ ID NO: 483094 - DNA, 25 bp, Mus musculus
gagctgattgcaattcttgaccatt

SEQ ID NO: 483095 - DNA, 25 bp, Mus musculus
gagctgattgcatttcttgaccatt

SEQ ID NO: 483096 - DNA, 25 bp, Mus musculus
gagctgcaacctcatgcatcgacat

SEQ ID NO: 483097 - DNA, 25 bp, Mus musculus
gagctgcaacctgatgcatcgacat

SEQ ID NO: 483098 - DNA, 25 bp, Mus musculus
gagctgcacaaaagacctcaggagt

SEQ ID NO: 483099 - DNA, 25 bp, Mus musculus
gagctgcacaaatgacctcaggagt

SEQ ID NO: 483100 - DNA, 25 bp, Mus musculus
gagctgcacagccaactgtaaccag

SEQ ID NO: 483101 - DNA, 25 bp, Mus musculus
gagctgcacagcgaactgtaaccag

SEQ ID NO: 483102 - DNA, 25 bp, Mus musculus
gagctgcacgagctcttgtctcaat

SEQ ID NO: 483103 - DNA, 25 bp, Mus musculus
gagctgcacgaggtcttgtctcaat

SEQ ID NO: 483104 - DNA, 25 bp, Mus musculus
gagctgcacgctcgaactgagtcta

SEQ ID NO: 483105 - DNA, 25 bp, Mus musculus
gagctgcacgctggaactgagtcta

SEQ ID NO: 483106 - DNA, 25 bp, Mus musculus
gagctgcagaggactgccaactcga

SEQ ID NO: 483107 - DNA, 25 bp, Mus musculus
gagctgcagaggtctgccaactcga

SEQ ID NO: 483108 - DNA, 25 bp, Mus musculus
gagctgcagatacagatcctgaacc

SEQ ID NO: 483109 - DNA, 25 bp, Mus musculus
gagctgcagatagagatcctgaacc

SEQ ID NO: 483110 - DNA, 25 bp, Mus musculus
gagctgcagcacaacagtttatatt

SEQ ID NO: 483111 - DNA, 25 bp, Mus musculus
gagctgcagcactacagtttatatt

SEQ ID NO: 483112 - DNA, 25 bp, Mus musculus
gagctgcagcgaattcttactgttt

SEQ ID NO: 483113 - DNA, 25 bp, Mus musculus
gagctgcagcgatttcttactgttt

SEQ ID NO: 483114 - DNA, 25 bp, Mus musculus
gagctgcagctcaatcacctgcaaa

SEQ ID NO: 483115 - DNA, 25 bp, Mus musculus
gagctgcagctctatcacctgcaaa

SEQ ID NO: 483116 - DNA, 25 bp, Mus musculus
gagctgcaggagcacaacacagatt

SEQ ID NO: 483117 - DNA, 25 bp, Mus musculus
gagctgcaggaggacaacacagatt

SEQ ID NO: 483118 - DNA, 25 bp, Mus musculus
gagctgcaggccagttctgaacaag

SEQ ID NO: 483119 - DNA, 25 bp, Mus musculus
gagctgcaggccctgtacctgatgt

SEQ ID NO: 483120 - DNA, 25 bp, Mus musculus
gagctgcaggccgtgtacctgatgt

SEQ ID NO: 483121 - DNA, 25 bp, Mus musculus
gagctgcaggcctgttctgaacaag

SEQ ID NO: 483122 - DNA, 25 bp, Mus musculus
gagctgcaggtgaaagacacgtttc

SEQ ID NO: 483123 - DNA, 25 bp, Mus musculus
gagctgcaggtgtaagacacgtttc

SEQ ID NO: 483124 - DNA, 25 bp, Mus musculus
gagctgcagtgaaccgcttgtgctt

SEQ ID NO: 483125 - DNA, 25 bp, Mus musculus
gagctgcagtgaagacgctacacac

SEQ ID NO: 483126 - DNA, 25 bp, Mus musculus
gagctgcagtgatccgcttgtgctt

SEQ ID NO: 483127 - DNA, 25 bp, Mus musculus
gagctgcagtgatgacgctacacac

SEQ ID NO: 483128 - DNA, 25 bp, Mus musculus
gagctgcagtgtctatataccacct

SEQ ID NO: 483129 - DNA, 25 bp, Mus musculus
gagctgcagtgtgtatataccacct

SEQ ID NO: 483130 - DNA, 25 bp, Mus musculus
gagctgcagttcaaaagtcttcccc

SEQ ID NO: 483131 - DNA, 25 bp, Mus musculus
gagctgcagttctaaagtcttcccc

SEQ ID NO: 483132 - DNA, 25 bp, Mus musculus
gagctgcagttgacgttgagtttgt

SEQ ID NO: 483133 - DNA, 25 bp, Mus musculus
gagctgcagttgtcgttgagtttgt

SEQ ID NO: 483134 - DNA, 25 bp, Mus musculus
gagctgcataaaccatgcctcagta

SEQ ID NO: 483135 - DNA, 25 bp, Mus musculus
gagctgcataaagcatgcctcagta

SEQ ID NO: 483136 - DNA, 25 bp, Mus musculus
gagctgcataggacctgcatgctca

SEQ ID NO: 483137 - DNA, 25 bp, Mus musculus
gagctgcataggtcctgcatgctca

SEQ ID NO: 483138 - DNA, 25 bp, Mus musculus
gagctgcatatcacttatgtttggg

SEQ ID NO: 483139 - DNA, 25 bp, Mus musculus
gagctgcatatctcttatgtttggg

SEQ ID NO: 483140 - DNA, 25 bp, Mus musculus
gagctgcatcacattacttgtatgt

SEQ ID NO: 483141 - DNA, 25 bp, Mus musculus
gagctgcatcactttacttgtatgt

SEQ ID NO: 483142 - DNA, 25 bp, Mus musculus
gagctgcatctgagaaaagcacagt

SEQ ID NO: 483143 - DNA, 25 bp, Mus musculus
gagctgcatctgtgaaaagcacagt

SEQ ID NO: 483144 - DNA, 25 bp, Mus musculus
gagctgcatgaaccatcagatggag

SEQ ID NO: 483145 - DNA, 25 bp, Mus musculus
gagctgcatgaagcatcagatggag

SEQ ID NO: 483146 - DNA, 25 bp, Mus musculus
gagctgcatgatccccacatagagg

SEQ ID NO: 483147 - DNA, 25 bp, Mus musculus
gagctgcatgatgcccacatagagg

SEQ ID NO: 483148 - DNA, 25 bp, Mus musculus
gagctgcatgccaacatcctgcgtg

SEQ ID NO: 483149 - DNA, 25 bp, Mus musculus
gagctgcatgcctacatcctgcgtg

SEQ ID NO: 483150 - DNA, 25 bp, Mus musculus
gagctgcatggccacttcatgctgc

SEQ ID NO: 483151 - DNA, 25 bp, Mus musculus
gagctgcatggcgacttcatgctgc

SEQ ID NO: 483152 - DNA, 25 bp, Mus musculus
gagctgcattggctttttatttaga

SEQ ID NO: 483153 - DNA, 25 bp, Mus musculus
gagctgcattgggtttttatttaga

SEQ ID NO: 483154 - DNA, 25 bp, Mus musculus
gagctgccaagtatcgtcgaggtaa

SEQ ID NO: 483155 - DNA, 25 bp, Mus musculus
gagctgccaagtttcgtcgaggtaa

SEQ ID NO: 483156 - DNA, 25 bp, Mus musculus
gagctgccacagctgtgacgtgact

SEQ ID NO: 483157 - DNA, 25 bp, Mus musculus
gagctgccacaggtgtgacgtgact

SEQ ID NO: 483158 - DNA, 25 bp, Mus musculus
gagctgccacctcgcatttagttta

SEQ ID NO: 483159 - DNA, 25 bp, Mus musculus
gagctgccacctggcatttagttta

SEQ ID NO: 483160 - DNA, 25 bp, Mus musculus
gagctgccacttacctaaatagaaa

SEQ ID NO: 483161 - DNA, 25 bp, Mus musculus
gagctgccactttcctaaatagaaa

SEQ ID NO: 483162 - DNA, 25 bp, Mus musculus
gagctgccagagattgagttccttg

SEQ ID NO: 483163 - DNA, 25 bp, Mus musculus
gagctgccagagtttgagttccttg

SEQ ID NO: 483164 - DNA, 25 bp, Mus musculus
gagctgccagcacagttcaaactct

SEQ ID NO: 483165 - DNA, 25 bp, Mus musculus
gagctgccagcagagttcaaactct

SEQ ID NO: 483166 - DNA, 25 bp, Mus musculus
gagctgccaggcaagtttaaatatg

SEQ ID NO: 483167 - DNA, 25 bp, Mus musculus
gagctgccaggcagagcacgataat

SEQ ID NO: 483168 - DNA, 25 bp, Mus musculus
gagctgccaggctagtttaaatatg

SEQ ID NO: 483169 - DNA, 25 bp, Mus musculus
gagctgccaggctgagcacgataat

SEQ ID NO: 483170 - DNA, 25 bp, Mus musculus
gagctgccattgatgacatgacact

SEQ ID NO: 483171 - DNA, 25 bp, Mus musculus
gagctgccattgttgacatgacact

SEQ ID NO: 483172 - DNA, 25 bp, Mus musculus
gagctgcccaatcttgggtcctctg

SEQ ID NO: 483173 - DNA, 25 bp, Mus musculus
gagctgcccaatgttgggtcctctg

SEQ ID NO: 483174 - DNA, 25 bp, Mus musculus
gagctgcccacaaggctgggtctaa

SEQ ID NO: 483175 - DNA, 25 bp, Mus musculus
gagctgcccacatggctgggtctaa

SEQ ID NO: 483176 - DNA, 25 bp, Mus musculus
gagctgccccacaaatctgagtaag

SEQ ID NO: 483177 - DNA, 25 bp, Mus musculus
gagctgccccactaatctgagtaag

SEQ ID NO: 483178 - DNA, 25 bp, Mus musculus
gagctgcccttcagattaggaggtg

SEQ ID NO: 483179 - DNA, 25 bp, Mus musculus
gagctgcccttctgattaggaggtg

SEQ ID NO: 483180 - DNA, 25 bp, Mus musculus
gagctgccgacactgagtctgttcc

SEQ ID NO: 483181 - DNA, 25 bp, Mus musculus
gagctgccgacagtgagtctgttcc

SEQ ID NO: 483182 - DNA, 25 bp, Mus musculus
gagctgccgagcaggataatgatgc

SEQ ID NO: 483183 - DNA, 25 bp, Mus musculus
gagctgccgagcctgatgaccaaag

SEQ ID NO: 483184 - DNA, 25 bp, Mus musculus
gagctgccgagcgtgatgaccaaag

SEQ ID NO: 483185 - DNA, 25 bp, Mus musculus
gagctgccgagctggataatgatgc

SEQ ID NO: 483186 - DNA, 25 bp, Mus musculus
gagctgccgagtctgttgatcctcc

SEQ ID NO: 483187 - DNA, 25 bp, Mus musculus
gagctgccgagtgtgttgatcctcc

SEQ ID NO: 483188 - DNA, 25 bp, Mus musculus
gagctgccgattcctgtgagctgta

SEQ ID NO: 483189 - DNA, 25 bp, Mus musculus
gagctgccgattgctgtgagctgta

SEQ ID NO: 483190 - DNA, 25 bp, Mus musculus
gagctgccggtcacggtgggctgaa

SEQ ID NO: 483191 - DNA, 25 bp, Mus musculus
gagctgccggtctcggtgggctgaa

SEQ ID NO: 483192 - DNA, 25 bp, Mus musculus
gagctgccgtgacttcagggatcca

SEQ ID NO: 483193 - DNA, 25 bp, Mus musculus
gagctgccgtgagttcagggatcca

SEQ ID NO: 483194 - DNA, 25 bp, Mus musculus
gagctgcctacgataacacacaact

SEQ ID NO: 483195 - DNA, 25 bp, Mus musculus
gagctgcctacgttaacacacaact

SEQ ID NO: 483196 - DNA, 25 bp, Mus musculus
gagctgcctcacatgctgcggttag

SEQ ID NO: 483197 - DNA, 25 bp, Mus musculus
gagctgcctcacttgctgcggttag

SEQ ID NO: 483198 - DNA, 25 bp, Mus musculus
gagctgcctcagagcaacttggaag

SEQ ID NO: 483199 - DNA, 25 bp, Mus musculus
gagctgcctcagtgcaacttggaag

SEQ ID NO: 483200 - DNA, 25 bp, Mus musculus
gagctgcctgtgatcttcagtccta

SEQ ID NO: 483201 - DNA, 25 bp, Mus musculus
gagctgcctgtgttcttcagtccta

SEQ ID NO: 483202 - DNA, 25 bp, Mus musculus
gagctgcctgttatagcgtttgtaa

SEQ ID NO: 483203 - DNA, 25 bp, Mus musculus
gagctgcctgttttagcgtttgtaa

SEQ ID NO: 483204 - DNA, 25 bp, Mus musculus
gagctgcctttgactgttcattctt

SEQ ID NO: 483205 - DNA, 25 bp, Mus musculus
gagctgcctttgtctgttcattctt

SEQ ID NO: 483206 - DNA, 25 bp, Mus musculus
gagctgccttttctccttggaagag

SEQ ID NO: 483207 - DNA, 25 bp, Mus musculus
gagctgccttttgtccttggaagag

SEQ ID NO: 483208 - DNA, 25 bp, Mus musculus
gagctgcgaaagatcagacgctgta

SEQ ID NO: 483209 - DNA, 25 bp, Mus musculus
gagctgcgaaagttcagacgctgta

SEQ ID NO: 483210 - DNA, 25 bp, Mus musculus
gagctgcgaattacttatcatgtta

SEQ ID NO: 483211 - DNA, 25 bp, Mus musculus
gagctgcgaatttcttatcatgtta

SEQ ID NO: 483212 - DNA, 25 bp, Mus musculus
gagctgcgagcgactagagatcctg

SEQ ID NO: 483213 - DNA, 25 bp, Mus musculus
gagctgcgagcgtctagagatcctg

SEQ ID NO: 483214 - DNA, 25 bp, Mus musculus
gagctgcgcagaccagaaagagcca

SEQ ID NO: 483215 - DNA, 25 bp, Mus musculus
gagctgcgcagagcagaaagagcca

SEQ ID NO: 483216 - DNA, 25 bp, Mus musculus
gagctgcgcagtcagagccagtcta

SEQ ID NO: 483217 - DNA, 25 bp, Mus musculus
gagctgcgcagtgagagccagtcta

SEQ ID NO: 483218 - DNA, 25 bp, Mus musculus
gagctgcgctacctgaacgcggcca

SEQ ID NO: 483219 - DNA, 25 bp, Mus musculus
gagctgcgctacgtgaacgcggcca

SEQ ID NO: 483220 - DNA, 25 bp, Mus musculus
gagctgcggctcagatagatctctt

SEQ ID NO: 483221 - DNA, 25 bp, Mus musculus
gagctgcggctctgatagatctctt

SEQ ID NO: 483222 - DNA, 25 bp, Mus musculus
gagctgcgttacatccagattaacc

SEQ ID NO: 483223 - DNA, 25 bp, Mus musculus
gagctgcgttacttccagattaacc

SEQ ID NO: 483224 - DNA, 25 bp, Mus musculus
gagctgctaataacctctcagcctg

SEQ ID NO: 483225 - DNA, 25 bp, Mus musculus
gagctgctaatatcctctcagcctg

SEQ ID NO: 483226 - DNA, 25 bp, Mus musculus
gagctgctacagaaatttcctggac

SEQ ID NO: 483227 - DNA, 25 bp, Mus musculus
gagctgctacagtaatttcctggac

SEQ ID NO: 483228 - DNA, 25 bp, Mus musculus
gagctgctacatcagagtactttga

SEQ ID NO: 483229 - DNA, 25 bp, Mus musculus
gagctgctacatgagagtactttga

SEQ ID NO: 483230 - DNA, 25 bp, Mus musculus
gagctgctagttcgcacaggtttgt

SEQ ID NO: 483231 - DNA, 25 bp, Mus musculus
gagctgctagttggcacaggtttgt

SEQ ID NO: 483232 - DNA, 25 bp, Mus musculus
gagctgctatagcaaggtttcgcaa

SEQ ID NO: 483233 - DNA, 25 bp, Mus musculus
gagctgctataggaaggtttcgcaa

SEQ ID NO: 483234 - DNA, 25 bp, Mus musculus
gagctgctattcaatggccttttta

SEQ ID NO: 483235 - DNA, 25 bp, Mus musculus
gagctgctattctatggccttttta

SEQ ID NO: 483236 - DNA, 25 bp, Mus musculus
gagctgctcaaacagttgtacccct

SEQ ID NO: 483237 - DNA, 25 bp, Mus musculus
gagctgctcaaagagttgtacccct

SEQ ID NO: 483238 - DNA, 25 bp, Mus musculus
gagctgctcacgctggtgaacagaa

SEQ ID NO: 483239 - DNA, 25 bp, Mus musculus
gagctgctcacggtggtgaacagaa

SEQ ID NO: 483240 - DNA, 25 bp, Mus musculus
gagctgctcaggctcaaataacttg

SEQ ID NO: 483241 - DNA, 25 bp, Mus musculus
gagctgctcagggtcaaataacttg

SEQ ID NO: 483242 - DNA, 25 bp, Mus musculus
gagctgctccagagaatgacggaca

SEQ ID NO: 483243 - DNA, 25 bp, Mus musculus
gagctgctccagtgaatgacggaca

SEQ ID NO: 483244 - DNA, 25 bp, Mus musculus
gagctgctccggaatctctatgaga

SEQ ID NO: 483245 - DNA, 25 bp, Mus musculus
gagctgctccggtatctctatgaga

SEQ ID NO: 483246 - DNA, 25 bp, Mus musculus
gagctgctcgtcatttatctcagag

SEQ ID NO: 483247 - DNA, 25 bp, Mus musculus
gagctgctcgtcttttatctcagag

SEQ ID NO: 483248 - DNA, 25 bp, Mus musculus
gagctgctctaacaagggaacaccc

SEQ ID NO: 483249 - DNA, 25 bp, Mus musculus
gagctgctctaagaagggaacaccc

SEQ ID NO: 483250 - DNA, 25 bp, Mus musculus
gagctgctctgacaagtcttcgttt

SEQ ID NO: 483251 - DNA, 25 bp, Mus musculus
gagctgctctgagaagtcttcgttt

SEQ ID NO: 483252 - DNA, 25 bp, Mus musculus
gagctgctcttcaacacggtcgaag

SEQ ID NO: 483253 - DNA, 25 bp, Mus musculus
gagctgctcttctacacggtcgaag

SEQ ID NO: 483254 - DNA, 25 bp, Mus musculus
gagctgctgaacactctgttgagga

SEQ ID NO: 483255 - DNA, 25 bp, Mus musculus
gagctgctgaactctctgttgagga

SEQ ID NO: 483256 - DNA, 25 bp, Mus musculus
gagctgctgacaccaacagctggtg

SEQ ID NO: 483257 - DNA, 25 bp, Mus musculus
gagctgctgacagcaacagctggtg

SEQ ID NO: 483258 - DNA, 25 bp, Mus musculus
gagctgctgagaagtctcggcagac

SEQ ID NO: 483259 - DNA, 25 bp, Mus musculus
gagctgctgagatgtctcggcagac

SEQ ID NO: 483260 - DNA, 25 bp, Mus musculus
gagctgctgagccaatacgtgaaca

SEQ ID NO: 483261 - DNA, 25 bp, Mus musculus
gagctgctgagcgaatacgtgaaca

SEQ ID NO: 483262 - DNA, 25 bp, Mus musculus
gagctgctgatactcctagaggact

SEQ ID NO: 483263 - DNA, 25 bp, Mus musculus
gagctgctgatagtcctagaggact

SEQ ID NO: 483264 - DNA, 25 bp, Mus musculus
gagctgctgattcttatgaatcaca

SEQ ID NO: 483265 - DNA, 25 bp, Mus musculus
gagctgctgattgttatgaatcaca

SEQ ID NO: 483266 - DNA, 25 bp, Mus musculus
gagctgctgcagaatgagtcttcac

SEQ ID NO: 483267 - DNA, 25 bp, Mus musculus
gagctgctgcagcaactgctggtat

SEQ ID NO: 483268 - DNA, 25 bp, Mus musculus
gagctgctgcaggaactgctggtat

SEQ ID NO: 483269 - DNA, 25 bp, Mus musculus
gagctgctgcagtatgagtcttcac

SEQ ID NO: 483270 - DNA, 25 bp, Mus musculus
gagctgctgcgcctagggcaactcc

SEQ ID NO: 483271 - DNA, 25 bp, Mus musculus
gagctgctgcgcgtagggcaactcc

SEQ ID NO: 483272 - DNA, 25 bp, Mus musculus
gagctgctgcggactttgaataccc

SEQ ID NO: 483273 - DNA, 25 bp, Mus musculus
gagctgctgcggtctttgaataccc

SEQ ID NO: 483274 - DNA, 25 bp, Mus musculus
gagctgctggcactataacaaataa

SEQ ID NO: 483275 - DNA, 25 bp, Mus musculus
gagctgctggcagtataacaaataa

SEQ ID NO: 483276 - DNA, 25 bp, Mus musculus
gagctgctggccagcacttaagagc

SEQ ID NO: 483277 - DNA, 25 bp, Mus musculus
gagctgctggcctgcacttaagagc

SEQ ID NO: 483278 - DNA, 25 bp, Mus musculus
gagctgctgggacaccacagttcta

SEQ ID NO: 483279 - DNA, 25 bp, Mus musculus
gagctgctgggagaccacagttcta

SEQ ID NO: 483280 - DNA, 25 bp, Mus musculus
gagctgctgggcaggactccagctt

SEQ ID NO: 483281 - DNA, 25 bp, Mus musculus
gagctgctgggctggactccagctt

SEQ ID NO: 483282 - DNA, 25 bp, Mus musculus
gagctgctgtaacgaaacctccaga

SEQ ID NO: 483283 - DNA, 25 bp, Mus musculus
gagctgctgtaaggaaacctccaga

SEQ ID NO: 483284 - DNA, 25 bp, Mus musculus
gagctgctgttaacaccatatttta

SEQ ID NO: 483285 - DNA, 25 bp, Mus musculus
gagctgctgttaaggctatggatga

SEQ ID NO: 483286 - DNA, 25 bp, Mus musculus
gagctgctgttatcaccatatttta

SEQ ID NO: 483287 - DNA, 25 bp, Mus musculus
gagctgctgttatggctatggatga

SEQ ID NO: 483288 - DNA, 25 bp, Mus musculus
gagctgctgttgatttgtgttatta

SEQ ID NO: 483289 - DNA, 25 bp, Mus musculus
gagctgctgttgttttgtgttatta

SEQ ID NO: 483290 - DNA, 25 bp, Mus musculus
gagctgcttaccatccagagtttcc

SEQ ID NO: 483291 - DNA, 25 bp, Mus musculus
gagctgcttaccttccagagtttcc

SEQ ID NO: 483292 - DNA, 25 bp, Mus musculus
gagctgcttcagcaattctctgatc

SEQ ID NO: 483293 - DNA, 25 bp, Mus musculus
gagctgcttcaggaattctctgatc

SEQ ID NO: 483294 - DNA, 25 bp, Mus musculus
gagctgcttccgactttagatcaag
